United States Patent 7,250,496 (BIOINFORMATICALLY DETECTABLE GROUP OF NOVEL REGULATORY GENES AND USES THEREOF) - sequence listing, part 18

SEQ ID NO: 742780 - RNA, 24 nt, Human
aggcggagguugcaguaagccaag

SEQ ID NO: 742781 - RNA, 24 nt, Human
aggcggagguugcagugagccaag

SEQ ID NO: 742782 - RNA, 20 nt, Human
agggagccaggguccccuag

SEQ ID NO: 742783 - RNA, 24 nt, Human
agggaggcggagguugcagugagc

SEQ ID NO: 742784 - RNA, 24 nt, Human
agggcccugacccagcagcccugc

SEQ ID NO: 742785 - RNA, 22 nt, Human
agguggguggaucaccugaggu

SEQ ID NO: 742786 - RNA, 24 nt, Human
aguggcucaccccuguaaucccag

SEQ ID NO: 742787 - RNA, 18 nt, Human
agugugagggucagggag

SEQ ID NO: 742788 - RNA, 19 nt, Human
aucacaaacuccaagaaaa

SEQ ID NO: 742789 - RNA, 24 nt, Human
aucacgccauugcacuccagccug

SEQ ID NO: 742790 - RNA, 18 nt, Human
auccaccucaccaccucc

SEQ ID NO: 742791 - RNA, 19 nt, Human
augacuccucccuccccca

SEQ ID NO: 742792 - RNA, 24 nt, Human
auggcacaggcaggagaccccugc

SEQ ID NO: 742793 - RNA, 24 nt, Human
auugcaccacugcgcuccagccug

SEQ ID NO: 742794 - RNA, 21 nt, Human
auugcacuccagccuggguga

SEQ ID NO: 742795 - RNA, 24 nt, Human
auugcacuccagccugggugacag

SEQ ID NO: 742796 - RNA, 18 nt, Human
caaaaguaccugaacuga

SEQ ID NO: 742797 - RNA, 20 nt, Human
caacaacccucaaaaguacc

SEQ ID NO: 742798 - RNA, 24 nt, Human
caacacggcgaaaccccgucucua

SEQ ID NO: 742799 - RNA, 18 nt, Human
caacuuccugggccccac

SEQ ID NO: 742800 - RNA, 23 nt, Human
caacuuccugggccccacccucu

SEQ ID NO: 742801 - RNA, 20 nt, Human
cacacgcacaucauaccaca

SEQ ID NO: 742802 - RNA, 23 nt, Human
cacacgggagcauccuuccugaa

SEQ ID NO: 742803 - RNA, 23 nt, Human
cacacucacgcacacgcacauca

SEQ ID NO: 742804 - RNA, 19 nt, Human
cacagaccaugcaaucugg

SEQ ID NO: 742805 - RNA, 18 nt, Human
caccaguacccgggugcc

SEQ ID NO: 742806 - RNA, 23 nt, Human
caccaguacccgggugccuuaug

SEQ ID NO: 742807 - RNA, 22 nt, Human
caccauuggcaaauaaugaaau

SEQ ID NO: 742808 - RNA, 24 nt, Human
caccccuguaaucccagcacuuug

SEQ ID NO: 742809 - RNA, 22 nt, Human
caccuccagagggcaguuucug

SEQ ID NO: 742810 - RNA, 18 nt, Human
cacuccagccugggugac

SEQ ID NO: 742811 - RNA, 20 nt, Human
cacuccagccugggugacag

SEQ ID NO: 742812 - RNA, 19 nt, Human
cacugcgcuccagccuggg

SEQ ID NO: 742813 - RNA, 20 nt, Human
cacugcgcuccagccugggc

SEQ ID NO: 742814 - RNA, 20 nt, Human
cacugcgcuccagccugggc

SEQ ID NO: 742815 - RNA, 21 nt, Human
cacugcgcuccagccugggcg

SEQ ID NO: 742816 - RNA, 22 nt, Human
cacugcgcuccagccugggcga

SEQ ID NO: 742817 - RNA, 24 nt, Human
cacugcgcuccagccugggcgaca

SEQ ID NO: 742818 - RNA, 18 nt, Human
cagaacaaagccucucca

SEQ ID NO: 742819 - RNA, 21 nt, Human
cagaagcagcgcagggcagag

SEQ ID NO: 742820 - RNA, 19 nt, Human
cagaaggcccacagggccc

SEQ ID NO: 742821 - RNA, 22 nt, Human
cagagcucaggacagaucucag

SEQ ID NO: 742822 - RNA, 23 nt, Human
cagcacaacaacccucaaaagua

SEQ ID NO: 742823 - RNA, 22 nt, Human
cagcacuuugggaggccgaggu

SEQ ID NO: 742824 - RNA, 24 nt, Human
cagcacuuugggaggccgaggugg

SEQ ID NO: 742825 - RNA, 19 nt, Human
cagcagaaagaaaaagccc

SEQ ID NO: 742826 - RNA, 25 nt, Human
cagcagaaagaaaaagcccgcccuc

SEQ ID NO: 742827 - RNA, 19 nt, Human
cagcccccuucucguugcc

SEQ ID NO: 742828 - RNA, 24 nt, Human
cagcgcagggcagagauagccccu

SEQ ID NO: 742829 - RNA, 19 nt, Human
cagcuggguccuguccucc

SEQ ID NO: 742830 - RNA, 18 nt, Human
caggcagcucuaccaccc

SEQ ID NO: 742831 - RNA, 21 nt, Human
caggcucuccuccugcuccuc

SEQ ID NO: 742832 - RNA, 20 nt, Human
cagggucagcacaacaaccc

SEQ ID NO: 742833 - RNA, 21 nt, Human
caugacuccucccucccccag

SEQ ID NO: 742834 - RNA, 19 nt, Human
cauugcacuccagccuggg

SEQ ID NO: 742835 - RNA, 21 nt, Human
cauugcacuccagccugggug

SEQ ID NO: 742836 - RNA, 22 nt, Human
cauugcacuccagccuggguga

SEQ ID NO: 742837 - RNA, 24 nt, Human
cauugcacuccagccugggugaca

SEQ ID NO: 742838 - RNA, 24 nt, Human
cauugcacuccagccugggugaca

SEQ ID NO: 742839 - RNA, 25 nt, Human
cauuugaucaacuugaaggccuacu

SEQ ID NO: 742840 - RNA, 19 nt, Human
ccacacacucacgcacacg

SEQ ID NO: 742841 - RNA, 23 nt, Human
ccacagggucagcacaacaaccc

SEQ ID NO: 742842 - RNA, 20 nt, Human
ccacugcgcuccagccuggg

SEQ ID NO: 742843 - RNA, 20 nt, Human
ccacugcgcuccagccuggg

SEQ ID NO: 742844 - RNA, 21 nt, Human
ccacugcgcuccagccugggc

SEQ ID NO: 742845 - RNA, 21 nt, Human
ccacugcgcuccagccugggc

SEQ ID NO: 742846 - RNA, 23 nt, Human
ccacugcgcuccagccugggcga

SEQ ID NO: 742847 - RNA, 24 nt, Human
ccacugcgcuccagccugggcgac

SEQ ID NO: 742848 - RNA, 21 nt, Human
ccaggccccuccccacagagc

SEQ ID NO: 742849 - RNA, 24 nt, Human
ccaggcccugaagccucuacccca

SEQ ID NO: 742850 - RNA, 20 nt, Human
ccauugcacuccagccuggg

SEQ ID NO: 742851 - RNA, 21 nt, Human
ccauugcacuccagccugggu

SEQ ID NO: 742852 - RNA, 21 nt, Human
ccauugcacuccagccugggu

SEQ ID NO: 742853 - RNA, 22 nt, Human
ccauugcacuccagccugggug

SEQ ID NO: 742854 - RNA, 24 nt, Human
ccauugcacuccagccugggugac

SEQ ID NO: 742855 - RNA, 21 nt, Human
cccaaccuggccuccaccaac

SEQ ID NO: 742856 - RNA, 28 nt, Human
cccacagagcucaggacagaucucagca

SEQ ID NO: 742857 - RNA, 26 nt, Human
cccacagagcucaggacagcggaccg

SEQ ID NO: 742858 - RNA, 25 nt, Human
cccacagggcccugacccagcagcc

SEQ ID NO: 742859 - RNA, 22 nt, Human
cccaccucccccaccaguaccc

SEQ ID NO: 742860 - RNA, 22 nt, Human
cccagccucaacugacucuggc

SEQ ID NO: 742861 - RNA, 18 nt, Human
cccagcgaccugggaggc

SEQ ID NO: 742862 - RNA, 24 nt, Human
cccaggcccugaagccucuaccuc

SEQ ID NO: 742863 - RNA, 24 nt, Human
cccaugaauaaccuucccuacccc

SEQ ID NO: 742864 - RNA, 23 nt, Human
ccccacccucugaagagccccag

SEQ ID NO: 742865 - RNA, 24 nt, Human
ccccaccucccccaccaguacccg

SEQ ID NO: 742866 - RNA, 21 nt, Human
ccccuacccuagacaggacag

SEQ ID NO: 742867 - RNA, 19 nt, Human
ccccuguaaucccagcacu

SEQ ID NO: 742868 - RNA, 19 nt, Human
cccuagacaggacagcagg

SEQ ID NO: 742869 - RNA, 21 nt, Human
cccugcacacgggagcauccu

SEQ ID NO: 742870 - RNA, 23 nt, Human
cccugcacacgggagcauccuuc

SEQ ID NO: 742871 - RNA, 21 nt, Human
ccgauagugccagcaguggag

SEQ ID NO: 742872 - RNA, 19 nt, Human
ccgcccucacauccuccug

SEQ ID NO: 742873 - RNA, 19 nt, Human
ccgguuccugggcuucauc

SEQ ID NO: 742874 - RNA, 23 nt, Human
ccuaccccagccaagccuaggaa

SEQ ID NO: 742875 - RNA, 23 nt, Human
ccuacccuagacaggacagcagg

SEQ ID NO: 742876 - RNA, 18 nt, Human
ccucccccaccaguaccc

SEQ ID NO: 742877 - RNA, 19 nt, Human
ccucccuuuuucuuggucc

SEQ ID NO: 742878 - RNA, 19 nt, Human
ccuccucugagccuggggg

SEQ ID NO: 742879 - RNA, 22 nt, Human
ccuccugccccaccucccccac

SEQ ID NO: 742880 - RNA, 18 nt, Human
ccuccuucccucucuccu

SEQ ID NO: 742881 - RNA, 23 nt, Human
ccuccuucccucucuccuucccc

SEQ ID NO: 742882 - RNA, 22 nt, Human
ccugaagccucuaccucccagg

SEQ ID NO: 742883 - RNA, 22 nt, Human
ccugaggucagaaguucgagac

SEQ ID NO: 742884 - RNA, 19 nt, Human
ccuggccuccaccaacacc

SEQ ID NO: 742885 - RNA, 25 nt, Human
ccuggccuccaccaacaccccuaac

SEQ ID NO: 742886 - RNA, 19 nt, Human
ccugggaggcggagguugc

SEQ ID NO: 742887 - RNA, 22 nt, Human
ccugggcgacagagcaagacuc

SEQ ID NO: 742888 - RNA, 22 nt, Human
ccugggugacagaauaagacuc

SEQ ID NO: 742889 - RNA, 23 nt, Human
ccuggucaacacggcgaaacccc

SEQ ID NO: 742890 - RNA, 24 nt, Human
ccuggucaacacggcgaaaccccg

SEQ ID NO: 742891 - RNA, 22 nt, Human
ccuguaaucccagcacuuuggg

SEQ ID NO: 742892 - RNA, 19 nt, Human
cgagaccagccuggucaac

SEQ ID NO: 742893 - RNA, 24 nt, Human
cgagguggguggaucaccugaggu

SEQ ID NO: 742894 - RNA, 22 nt, Human
cgccaggcucuccuccugcucc

SEQ ID NO: 742895 - RNA, 26 nt, Human
cgccauugcacuccagccugggugac

SEQ ID NO: 742896 - RNA, 25 nt, Human
cguggaaggcucagccucuccuccg

SEQ ID NO: 742897 - RNA, 24 nt, Human
cuacccuagacaggacagcaggcu

SEQ ID NO: 742898 - RNA, 24 nt, Human
cucaccccuguaaucccagcacuu

SEQ ID NO: 742899 - RNA, 24 nt, Human
cucccccaccaguacccgggugcc

SEQ ID NO: 742900 - RNA, 22 nt, Human
cuccgccaccgccaggcucucc

SEQ ID NO: 742901 - RNA, 22 nt, Human
cuccucugagccugggggcucc

SEQ ID NO: 742902 - RNA, 20 nt, Human
cucuaccacccaggcccuga

SEQ ID NO: 742903 - RNA, 21 nt, Human
cucuaccucccaggccccagc

SEQ ID NO: 742904 - RNA, 19 nt, Human
cucuccuuauucuacucua

SEQ ID NO: 742905 - RNA, 19 nt, Human
cucugucucaaaaaaaaaa

SEQ ID NO: 742906 - RNA, 22 nt, Human
cugaagccucuaccucccaggc

SEQ ID NO: 742907 - RNA, 20 nt, Human
cuggcccuggggccagcugg

SEQ ID NO: 742908 - RNA, 24 nt, Human
cugggaggcugagacaacgagaau

SEQ ID NO: 742909 - RNA, 18 nt, Human
cuggggcuggcccugggg

SEQ ID NO: 742910 - RNA, 19 nt, Human
cuugaaccugggaggcgga

SEQ ID NO: 742911 - RNA, 21 nt, Human
cuugaaggccuacuguagggc

SEQ ID NO: 742912 - RNA, 22 nt, Human
gacaacgagaauugcuugaacc

SEQ ID NO: 742913 - RNA, 24 nt, Human
gacaacgagaauugcuugaaccug

SEQ ID NO: 742914 - RNA, 23 nt, Human
gacagaauaagacucugucucaa

SEQ ID NO: 742915 - RNA, 19 nt, Human
gacagaucucagcacucac

SEQ ID NO: 742916 - RNA, 20 nt, Human
gagcucaggacagaucucag

SEQ ID NO: 742917 - RNA, 20 nt, Human
gaggaagcuccuucugggca

SEQ ID NO: 742918 - RNA, 22 nt, Human
gaggccugagcagagcuuccuc

SEQ ID NO: 742919 - RNA, 23 nt, Human
gagguggguggaucaccugaggu

SEQ ID NO: 742920 - RNA, 25 nt, Human
gagguggguggaucaccugagguca

SEQ ID NO: 742921 - RNA, 18 nt, Human
gagguugcaguaagccaa

SEQ ID NO: 742922 - RNA, 22 nt, Human
gagguugcaguaagccaagauc

SEQ ID NO: 742923 - RNA, 18 nt, Human
gagguugcagugagccaa

SEQ ID NO: 742924 - RNA, 23 nt, Human
gagguugcagugagccaagauug

SEQ ID NO: 742925 - RNA, 24 nt, Human
gaucaccugaggucagaaguucga

SEQ ID NO: 742926 - RNA, 20 nt, Human
gcaccguuacagaacaaagc

SEQ ID NO: 742927 - RNA, 22 nt, Human
gcagaaucaucagaaucucuaa

SEQ ID NO: 742928 - RNA, 19 nt, Human
gccauugcacuccagccug

SEQ ID NO: 742929 - RNA, 24 nt, Human
gccauugcacuccagccuggguga

SEQ ID NO: 742930 - RNA, 18 nt, Human
gccccaccucccccacca

SEQ ID NO: 742931 - RNA, 18 nt, Human
gcccuggggccagcuggg

SEQ ID NO: 742932 - RNA, 20 nt, Human
gcccuggggccagcuggguc

SEQ ID NO: 742933 - RNA, 24 nt, Human
gcgcuccagccugggcgacagagc

SEQ ID NO: 742934 - RNA, 19 nt, Human
gcggccagcagggagcugg

SEQ ID NO: 742935 - RNA, 21 nt, Human
gcggcggcugcagaggaaugc

SEQ ID NO: 742936 - RNA, 26 nt, Human
gcuucccuccccaaccuggccuccac

SEQ ID NO: 742937 - RNA, 20 nt, Human
ggagguugcaguaagccaag

SEQ ID NO: 742938 - RNA, 24 nt, Human
ggagguugcaguaagccaagauca

SEQ ID NO: 742939 - RNA, 22 nt, Human
ggagguugcagugagccaagau

SEQ ID NO: 742940 - RNA, 24 nt, Human
ggagguugcagugagccaagauug

SEQ ID NO: 742941 - RNA, 20 nt, Human
ggcccuggggccagcugggu

SEQ ID NO: 742942 - RNA, 21 nt, Human
ggcucaugccuguagucccag

SEQ ID NO: 742943 - RNA, 18 nt, Human
ggcuguggccauggccag

SEQ ID NO: 742944 - RNA, 22 nt, Human
gggcuccuccaucuggcugugg

SEQ ID NO: 742945 - RNA, 19 nt, Human
ggggcaggaauccagagga

SEQ ID NO: 742946 - RNA, 20 nt, Human
gggucccucugaucuucccu

SEQ ID NO: 742947 - RNA, 24 nt, Human
gguggcucaugccuguagucccag

SEQ ID NO: 742948 - RNA, 22 nt, Human
ggugugguggcucaugccugua

SEQ ID NO: 742949 - RNA, 19 nt, Human
gucagggaggcggagguug

SEQ ID NO: 742950 - RNA, 20 nt, Human
guccuccuucccucucuccu

SEQ ID NO: 742951 - RNA, 20 nt, Human
guggcuuggacaaacaagcu

SEQ ID NO: 742952 - RNA, 18 nt, Human
guuaacuacaacuuccug

SEQ ID NO: 742953 - RNA, 21 nt, Human
uaagacaucccuggcccauga

SEQ ID NO: 742954 - RNA, 22 nt, Human
uaagacaucccuggcccaugaa

SEQ ID NO: 742955 - RNA, 25 nt, Human
uacaacuuccugggccccacccucu

SEQ ID NO: 742956 - RNA, 23 nt, Human
uaccuagauggccguguaaggac

SEQ ID NO: 742957 - RNA, 18 nt, Human
uaccugaacugaauccac

SEQ ID NO: 742958 - RNA, 18 nt, Human
uagaggaagcuccuucug

SEQ ID NO: 742959 - RNA, 24 nt, Human
uagcugggugugguggcucaugcc

SEQ ID NO: 742960 - RNA, 23 nt, Human
uaggcagcagaaagaaaaagccc

SEQ ID NO: 742961 - RNA, 22 nt, Human
uagucuccgaguuuagaauccu

SEQ ID NO: 742962 - RNA, 22 nt, Human
ucaaaaaaaaaaaaaaaaaaaa

SEQ ID NO: 742963 - RNA, 22 nt, Human
ucaagugggggauaaaaaagaa

SEQ ID NO: 742964 - RNA, 23 nt, Human
ucacgccauugcacuccagccug

SEQ ID NO: 742965 - RNA, 21 nt, Human
ucagccucuccuccgcauccc

SEQ ID NO: 742966 - RNA, 22 nt, Human
ucagccucuccuccgcaucccu

SEQ ID NO: 742967 - RNA, 21 nt, Human
ucagggaggcggagguugcag

SEQ ID NO: 742968 - RNA, 23 nt, Human
uccaccaacaccccuaacaggag

SEQ ID NO: 742969 - RNA, 24 nt, Human
uccaccaacaccccuaacaggagg

SEQ ID NO: 742970 - RNA, 24 nt, Human
uccagccugggcgacagagcaaga

SEQ ID NO: 742971 - RNA, 18 nt, Human
uccagccugggugacaga

SEQ ID NO: 742972 - RNA, 21 nt, Human
ucccagccucaacugacucug

SEQ ID NO: 742973 - RNA, 23 nt, Human
uccccaaccuccaacaugacucc

SEQ ID NO: 742974 - RNA, 19 nt, Human
ucccccaccaguacccggg

SEQ ID NO: 742975 - RNA, 21 nt, Human
ucccuaagacaucccuggccc

SEQ ID NO: 742976 - RNA, 20 nt, Human
ucccuaccccagccaagccu

SEQ ID NO: 742977 - RNA, 18 nt, Human
ucccuuugaacugagccu

SEQ ID NO: 742978 - RNA, 23 nt, Human
uccuccaucuggcuguggccaug

SEQ ID NO: 742979 - RNA, 19 nt, Human
uccucccucccccaggagu

SEQ ID NO: 742980 - RNA, 20 nt, Human
uccuccgcaucccuccuccu

SEQ ID NO: 742981 - RNA, 18 nt, Human
uccugccccaccuccccc

SEQ ID NO: 742982 - RNA, 28 nt, Human
uccugggccccacccucugaagagcccc

SEQ ID NO: 742983 - RNA, 26 nt, Human
ucucaaaaaaaaaaaaaaaaaaaauc

SEQ ID NO: 742984 - RNA, 22 nt, Human
ucuccaggccacugccugaguc

SEQ ID NO: 742985 - RNA, 20 nt, Human
ucucccuuugaacugagccu

SEQ ID NO: 742986 - RNA, 19 nt, Human
ucuccuggggaugggcucc

SEQ ID NO: 742987 - RNA, 22 nt, Human
ucucuacuaaaaauacaaaaaa

SEQ ID NO: 742988 - RNA, 23 nt, Human
ucucucugggaagaagugagcuu

SEQ ID NO: 742989 - RNA, 19 nt, Human
ucuggcccuuggggaaaag

SEQ ID NO: 742990 - RNA, 22 nt, Human
ucuggcugugggagguguggag

SEQ ID NO: 742991 - RNA, 23 nt, Human
ucugucucaaaaaaaaaaaaaaa

SEQ ID NO: 742992 - RNA, 24 nt, Human
ugaaccugggaggcggagguugca

SEQ ID NO: 742993 - RNA, 19 nt, Human
ugaagccucuaccucccag

SEQ ID NO: 742994 - RNA, 18 nt, Human
ugacaggaggggaauaaa

SEQ ID NO: 742995 - RNA, 23 nt, Human
ugacccugaauccucuuccuccc

SEQ ID NO: 742996 - RNA, 24 nt, Human
ugacuccucccucccccaggaguc

SEQ ID NO: 742997 - RNA, 25 nt, Human
ugagacaacgagaauugcuugaacc

SEQ ID NO: 742998 - RNA, 26 nt, Human
ugagacaacgagaauugcuugaaccu

SEQ ID NO: 742999 - RNA, 21 nt, Human
ugagcagaagcagcgcagggc

SEQ ID NO: 743000 - RNA, 22 nt, Human
ugcacuccagccugggugacag

SEQ ID NO: 743001 - RNA, 19 nt, Human
ugcaguggcucaccccugu

SEQ ID NO: 743002 - RNA, 21 nt, Human
ugccagcaguggagggcggcc

SEQ ID NO: 743003 - RNA, 18 nt, Human
ugcccugucagguccucc

SEQ ID NO: 743004 - RNA, 24 nt, Human
ugccuguagucccagcgaccuggg

SEQ ID NO: 743005 - RNA, 23 nt, Human
ugccuucaugcccugucaggucc

SEQ ID NO: 743006 - RNA, 19 nt, Human
ugcucaaccgugcuuccac

SEQ ID NO: 743007 - RNA, 24 nt, Human
uggaucaccugaggucagaaguuc

SEQ ID NO: 743008 - RNA, 27 nt, Human
uggaucaccugaggucagaaguucgag

SEQ ID NO: 743009 - RNA, 20 nt, Human
uggcccgauagugccagcag

SEQ ID NO: 743010 - RNA, 19 nt, Human
uggccuccaccaacacccc

SEQ ID NO: 743011 - RNA, 20 nt, Human
uggccuccaccaacaccccu

SEQ ID NO: 743012 - RNA, 21 nt, Human
uggcucaccccuguaauccca

SEQ ID NO: 743013 - RNA, 22 nt, Human
uggcucaccccuguaaucccag

SEQ ID NO: 743014 - RNA, 24 nt, Human
uggcucaccccuguaaucccagca

SEQ ID NO: 743015 - RNA, 23 nt, Human
ugggaggccgagguggguggauc

SEQ ID NO: 743016 - RNA, 24 nt, Human
ugggaggccgagguggguggauca

SEQ ID NO: 743017 - RNA, 20 nt, Human
ugggaggcggagguugcagu

SEQ ID NO: 743018 - RNA, 29 nt, Human
ugggaggcggagguugcaguaacaacggu

SEQ ID NO: 743019 - RNA, 19 nt, Human
ugggaggcugagacaacga

SEQ ID NO: 743020 - RNA, 20 nt, Human
ugggaggggggcaggaaucc

SEQ ID NO: 743021 - RNA, 20 nt, Human
uggggcuggcccuggggcca

SEQ ID NO: 743022 - RNA, 20 nt, Human
ugggucccucugaucuuccc

SEQ ID NO: 743023 - RNA, 24 nt, Human
uggguggaucaccugaggucagaa

SEQ ID NO: 743024 - RNA, 18 nt, Human
ugggugugguggcucaug

SEQ ID NO: 743025 - RNA, 22 nt, Human
ugguccaacucuggcccuuggg

SEQ ID NO: 743026 - RNA, 18 nt, Human
uggucuggcagcugcccu

SEQ ID NO: 743027 - RNA, 24 nt, Human
ugguggcucaugccuguaguccca

SEQ ID NO: 743028 - RNA, 20 nt, Human
ugucccagccucaacugagg

SEQ ID NO: 743029 - RNA, 20 nt, Human
uguggaaggaacaaccucca

SEQ ID NO: 743030 - RNA, 22 nt, Human
uuacaagggaagcagccacacc

SEQ ID NO: 743031 - RNA, 18 nt, Human
uuagcugggugugguggc

SEQ ID NO: 743032 - RNA, 22 nt, Human
uuagcugggugugguggcucau

SEQ ID NO: 743033 - RNA, 23 nt, Human
uuagcugggugugguggcucaug

SEQ ID NO: 743034 - RNA, 24 nt, Human
uuagcugggugugguggcucaugc

SEQ ID NO: 743035 - RNA, 19 nt, Human
uucaugcauuugaucaacu

SEQ ID NO: 743036 - RNA, 22 nt, Human
uucaugcauuugaucaacuuga

SEQ ID NO: 743037 - RNA, 19 nt, Human
uucaugggaggggggcagg

SEQ ID NO: 743038 - RNA, 22 nt, Human
uuccccuuugucccagccucaa

SEQ ID NO: 743039 - RNA, 18 nt, Human
uuccugggccccacccuc

SEQ ID NO: 743040 - RNA, 20 nt, Human
uuccugggccccacccucug

SEQ ID NO: 743041 - RNA, 24 nt, Human
uuccugggcuucaucacaaacucc

SEQ ID NO: 743042 - RNA, 24 nt, Human
uugaaccugggaggcggagguugc

SEQ ID NO: 743043 - RNA, 23 nt, Human
uugcaccacugcgcuccagccug

SEQ ID NO: 743044 - RNA, 22 nt, Human
uugcagugagccaagauugcac

SEQ ID NO: 743045 - RNA, 24 nt, Human
uugcuugaaccugggaggcggagg

SEQ ID NO: 743046 - RNA, 25 nt, Human
uugggaggccgagguggguggauca

SEQ ID NO: 743047 - RNA, 19 nt, Human
uuucuugguccaacucugg

SEQ ID NO: 743048 - RNA, 19 nt, Human
aaaaaaaaacaaaaacccc

SEQ ID NO: 743049 - RNA, 19 nt, Human
aaaaaaaacaaaaacccca

SEQ ID NO: 743050 - RNA, 27 nt, Human
aaaaaaacaaaaaccccacacaccaag

SEQ ID NO: 743051 - RNA, 18 nt, Human
aaacaaaaaccccacaca

SEQ ID NO: 743052 - RNA, 18 nt, Human
aaacaaaaaccccacaca

SEQ ID NO: 743053 - RNA, 24 nt, Human
acccgaucaaaacacaacaccacc

SEQ ID NO: 743054 - RNA, 23 nt, Human
acgccaacgagacaccacaguuu

SEQ ID NO: 743055 - RNA, 19 nt, Human
aggcaucggccaacaauca

SEQ ID NO: 743056 - RNA, 27 nt, Human
caaaaaccccacacaccaagggacuaa

SEQ ID NO: 743057 - RNA, 24 nt, Human
caaaauauaaaaaaaaaacaaaaa

SEQ ID NO: 743058 - RNA, 20 nt, Human
caacaccaccuuguuaaggu

SEQ ID NO: 743059 - RNA, 23 nt, Human
caacauaggaauaagagccccga

SEQ ID NO: 743060 - RNA, 18 nt, Human
caccugguguggccuggc

SEQ ID NO: 743061 - RNA, 19 nt, Human
cacgccaacgagacaccac

SEQ ID NO: 743062 - RNA, 21 nt, Human
cagaugauccugcagcaacau

SEQ ID NO: 743063 - RNA, 18 nt, Human
cagcacacccaggggaag

SEQ ID NO: 743064 - RNA, 22 nt, Human
cagcacgccaacgagacaccac

SEQ ID NO: 743065 - RNA, 22 nt, Human
cagcccacucagcagagcacca

SEQ ID NO: 743066 - RNA, 19 nt, Human
caggaacaccugguguggc

SEQ ID NO: 743067 - RNA, 21 nt, Human
caggagcccagaugccaggaa

SEQ ID NO: 743068 - RNA, 20 nt, Human
cagucguacugccaacaugc

SEQ ID NO: 743069 - RNA, 24 nt, Human
ccagaacacccgaucaaaacacaa

SEQ ID NO: 743070 - RNA, 23 nt, Human
cccacacaccaagggacuaagau

SEQ ID NO: 743071 - RNA, 19 nt, Human
ccccaaaaacuggucugca

SEQ ID NO: 743072 - RNA, 20 nt, Human
cccgaacaaauugacacuug

SEQ ID NO: 743073 - RNA, 23 nt, Human
cccgaucaaaacacaacaccacc

SEQ ID NO: 743074 - RNA, 20 nt, Human
ccgaaaagccuugccucgcc

SEQ ID NO: 743075 - RNA, 23 nt, Human
ccgcaaagaagagucguggaauc

SEQ ID NO: 743076 - RNA, 25 nt, Human
cgaacaaauugacacuuggauccca

SEQ ID NO: 743077 - RNA, 23 nt, Human
cgaagaacacaauuccaaacuaa

SEQ ID NO: 743078 - RNA, 21 nt, Human
cgccgacggccguaggggccg

SEQ ID NO: 743079 - RNA, 25 nt, Human
cuagaagagccuuccuuacauggca

SEQ ID NO: 743080 - RNA, 26 nt, Human
cucaaaauauaaaaaaaaaacaaaaa

SEQ ID NO: 743081 - RNA, 30 nt, Human
cucaaaauauaaaaaaaaaacaaaaacccc

SEQ ID NO: 743082 - RNA, 22 nt, Human
cugcugcuucagcacacccagg

SEQ ID NO: 743083 - RNA, 24 nt, Human
cugcugcuucagcacacccagggg

SEQ ID NO: 743084 - RNA, 19 nt, Human
gagcucaccccugcuggca

SEQ ID NO: 743085 - RNA, 20 nt, Human
gaucccagaacacccgauca

SEQ ID NO: 743086 - RNA, 18 nt, Human
gcaaagaagagucgugga

SEQ ID NO: 743087 - RNA, 23 nt, Human
gcaggaacaccugguguggccuu

SEQ ID NO: 743088 - RNA, 24 nt, Human
gcgaggcagcguauacauggcccc

SEQ ID NO: 743089 - RNA, 19 nt, Human
gguguggccuggcgaggca

SEQ ID NO: 743090 - RNA, 25 nt, Human
gucugcaauucuucccgcuucucgc

SEQ ID NO: 743091 - RNA, 23 nt, Human
uaaaaaaaaaacaaaaaccccac

SEQ ID NO: 743092 - RNA, 31 nt, Human
uaaaaaaaaaacaaaaaccccacacaccaag

SEQ ID NO: 743093 - RNA, 18 nt, Human
ucaaaggaggcaagcucc

SEQ ID NO: 743094 - RNA, 19 nt, Human
uccagaagaggaagagcuc

SEQ ID NO: 743095 - RNA, 19 nt, Human
ucccugugcucuaggucau

SEQ ID NO: 743096 - RNA, 20 nt, Human
ucggcuguggggcaccugga

SEQ ID NO: 743097 - RNA, 26 nt, Human
ucucccgcaaagaagagucguggaau

SEQ ID NO: 743098 - RNA, 21 nt, Human
ucuccugccacuagugccaac

SEQ ID NO: 743099 - RNA, 20 nt, Human
ugagaauggccaggcaucgg

SEQ ID NO: 743100 - RNA, 20 nt, Human
ugcacugcuaccaaaaaucc

SEQ ID NO: 743101 - RNA, 24 nt, Human
ugcaucugucucacaugcuugggg

SEQ ID NO: 743102 - RNA, 25 nt, Human
ugcuaccaaaaaucccuuugagaag

SEQ ID NO: 743103 - RNA, 22 nt, Human
ugcuagaagagccuuccuuaca

SEQ ID NO: 743104 - RNA, 19 nt, Human
uggacugcagauguuuucc

SEQ ID NO: 743105 - RNA, 19 nt, Human
uuccaugauaccagcagcu

SEQ ID NO: 743106 - RNA, 25 nt, Human
uuuuccaugauaccagcagcuucuc

SEQ ID NO: 743107 - RNA, 18 nt, Human
aaaaaacucacaggagca

SEQ ID NO: 743108 - RNA, 18 nt, Human
aaaaccagucuacauaug

SEQ ID NO: 743109 - RNA, 18 nt, Human
aacacugguaccacuuuc

SEQ ID NO: 743110 - RNA, 22 nt, Human
aacuccgcgcuucagcagcccu

SEQ ID NO: 743111 - RNA, 18 nt, Human
aagcagaaagcuaaucua

SEQ ID NO: 743112 - RNA, 23 nt, Human
aagcaggcagggagaaaugaccc

SEQ ID NO: 743113 - RNA, 19 nt, Human
aauuagcaacauucuccuu

SEQ ID NO: 743114 - RNA, 21 nt, Human
acaaagcaggcagggagaaau

SEQ ID NO: 743115 - RNA, 23 nt, Human
acauagcaacaacaaaaaccagu

SEQ ID NO: 743116 - RNA, 22 nt, Human
accgcgccccccacucccgcgc

SEQ ID NO: 743117 - RNA, 26 nt, Human
agaaaaaaauacauucauuuuuuuca

SEQ ID NO: 743118 - RNA, 18 nt, Human
agaaaugacccuaccuuc

SEQ ID NO: 743119 - RNA, 20 nt, Human
agauaauccaucugugaaaa

SEQ ID NO: 743120 - RNA, 19 nt, Human
agcagaaagcuaaucuaga

SEQ ID NO: 743121 - RNA, 22 nt, Human
agugaaacaugcuguucuuugg

SEQ ID NO: 743122 - RNA, 22 nt, Human
auaaagacaaaaagauuucaca

SEQ ID NO: 743123 - RNA, 22 nt, Human
auacacacuggguaacagugcg

SEQ ID NO: 743124 - RNA, 20 nt, Human
auagcaacaacaaaaaccag

SEQ ID NO: 743125 - RNA, 22 nt, Human
auucugucaauuggucaaaaga

SEQ ID NO: 743126 - RNA, 19 nt, Human
caaaaagcagugaggauaa

SEQ ID NO: 743127 - RNA, 18 nt, Human
caaaaaugcugcaucaac

SEQ ID NO: 743128 - RNA, 23 nt, Human
caaagcuuucugaaaccccuaga

SEQ ID NO: 743129 - RNA, 18 nt, Human
caaauaaaaaaagcagaa

SEQ ID NO: 743130 - RNA, 20 nt, Human
caacaacaaaaaccagucua

SEQ ID NO: 743131 - RNA, 21 nt, Human
caacaacaaaaaccagucuac

SEQ ID NO: 743132 - RNA, 19 nt, Human
cagccacaauguccuacug

SEQ ID NO: 743133 - RNA, 23 nt, Human
caucuguucaucaaagcuuucug

SEQ ID NO: 743134 - RNA, 21 nt, Human
caugcuaguuggcacaaagca

SEQ ID NO: 743135 - RNA, 19 nt, Human
ccagcgacaugcaggcucu

SEQ ID NO: 743136 - RNA, 24 nt, Human
ccccagauaauccaucugugaaaa

SEQ ID NO: 743137 - RNA, 20 nt, Human
ccgaaacugugccaacugcc

SEQ ID NO: 743138 - RNA, 21 nt, Human
ccgaacuccgcgcuucagcag

SEQ ID NO: 743139 - RNA, 24 nt, Human
ccgcgccccccacucccgcgcaga

SEQ ID NO: 743140 - RNA, 19 nt, Human
ccgcgcuucagcagcccug

SEQ ID NO: 743141 - RNA, 21 nt, Human
ccuauacccagcaugcgugaa

SEQ ID NO: 743142 - RNA, 21 nt, Human
cgcgcuucagcagcccugccc

SEQ ID NO: 743143 - RNA, 24 nt, Human
cggaggggguuucagauguuuguc

SEQ ID NO: 743144 - RNA, 21 nt, Human
cggcgcgaccccgaacuccgc

SEQ ID NO: 743145 - RNA, 23 nt, Human
cggcucggaggcuccggcggcgg

SEQ ID NO: 743146 - RNA, 19 nt, Human
cuagagcuuuacuauucua

SEQ ID NO: 743147 - RNA, 19 nt, Human
cucaaaacuuuucacauaa

SEQ ID NO: 743148 - RNA, 21 nt, Human
cucgccucaccagggcaccgc

SEQ ID NO: 743149 - RNA, 23 nt, Human
cugaaaaagagaacugcaaaugu

SEQ ID NO: 743150 - RNA, 19 nt, Human
cuggucuaguuugcuaaaa

SEQ ID NO: 743151 - RNA, 19 nt, Human
cuuucugaaaccccuagag

SEQ ID NO: 743152 - RNA, 21 nt, Human
gaaaaagagaacugcaaaugu

SEQ ID NO: 743153 - RNA, 22 nt, Human
gaacuccgcgcuucagcagccc

SEQ ID NO: 743154 - RNA, 26 nt, Human
gaccccgaacuccgcgcuucagcagc

SEQ ID NO: 743155 - RNA, 18 nt, Human
gaggguccccgcggccgc

SEQ ID NO: 743156 - RNA, 21 nt, Human
gccgcaccgggcucccgcgcc

SEQ ID NO: 743157 - RNA, 19 nt, Human
gccgggcgcaccgcgcccc

SEQ ID NO: 743158 - RNA, 19 nt, Human
gcucuggcuuuguuucacu

SEQ ID NO: 743159 - RNA, 18 nt, Human
ggaggcuccggcggcggg

SEQ ID NO: 743160 - RNA, 18 nt, Human
ggcucccgcgccugccug

SEQ ID NO: 743161 - RNA, 18 nt, Human
gggcauccuccuccucgg

SEQ ID NO: 743162 - RNA, 27 nt, Human
guucauuuuauauauauauuuauaugu

SEQ ID NO: 743163 - RNA, 18 nt, Human
uaaaaaaagcagaaagcu

SEQ ID NO: 743164 - RNA, 21 nt, Human
uaaaguaaugccuaaccagac

SEQ ID NO: 743165 - RNA, 25 nt, Human
uaaccagacucauaaugcauguaga

SEQ ID NO: 743166 - RNA, 21 nt, Human
uacacauaaaguuacauaaau

SEQ ID NO: 743167 - RNA, 20 nt, Human
uaccuucccaaaaaacucaa

SEQ ID NO: 743168 - RNA, 20 nt, Human
uagaugcaacaugcuaguug

SEQ ID NO: 743169 - RNA, 19 nt, Human
uagcaacaacaaaaaccag

SEQ ID NO: 743170 - RNA, 19 nt, Human
uaguuggcacaaagcaggc

SEQ ID NO: 743171 - RNA, 21 nt, Human
uauaacaagucauuauauaca

SEQ ID NO: 743172 - RNA, 22 nt, Human
uauaacaagucauuauauacac

SEQ ID NO: 743173 - RNA, 22 nt, Human
uaucauagaaucaucucugaaa

SEQ ID NO: 743174 - RNA, 21 nt, Human
uauugcaauauacaaagaugc

SEQ ID NO: 743175 - RNA, 19 nt, Human
ucagauguuugucaucuga

SEQ ID NO: 743176 - RNA, 20 nt, Human
ucagcaccaguauuaggugg

SEQ ID NO: 743177 - RNA, 21 nt, Human
ucgggcaggaccuccccuucc

SEQ ID NO: 743178 - RNA, 22 nt, Human
ucugaaaaagagaacugcaaau

SEQ ID NO: 743179 - RNA, 22 nt, Human
ucugaaaccccuagagcuuuac

SEQ ID NO: 743180 - RNA, 23 nt, Human
ugaaaaagagaacugcaaaugua

SEQ ID NO: 743181 - RNA, 21 nt, Human
ugaccaguaaucauuuuccuc

SEQ ID NO: 743182 - RNA, 22 nt, Human
ugaccaguaaucauuuuccuca

SEQ ID NO: 743183 - RNA, 25 nt, Human
ugacuaaaaaaauuaaucuaaauau

SEQ ID NO: 743184 - RNA, 21 nt, Human
ugagcuggguagacucagcca

SEQ ID NO: 743185 - RNA, 19 nt, Human
ugcaaaaagcagugaggau

SEQ ID NO: 743186 - RNA, 20 nt, Human
ugccccaugcagcacuucca

SEQ ID NO: 743187 - RNA, 18 nt, Human
uggcaccaaauaaagagg

SEQ ID NO: 743188 - RNA, 18 nt, Human
uggguaacagugcggagg

SEQ ID NO: 743189 - RNA, 23 nt, Human
ugguaacacugguaccacuuucu

SEQ ID NO: 743190 - RNA, 19 nt, Human
uguagaugcaacaugcuag

SEQ ID NO: 743191 - RNA, 21 nt, Human
ugugaaaauacaaguacugca

SEQ ID NO: 743192 - RNA, 20 nt, Human
uuacauaaauguuuccaccu

SEQ ID NO: 743193 - RNA, 21 nt, Human
uuccaucagcuucagggucca

SEQ ID NO: 743194 - RNA, 25 nt, Human
uucuaaggagcacuuucugcugagg

SEQ ID NO: 743195 - RNA, 25 nt, Human
uuguaggcugaggaagugaagaguu

SEQ ID NO: 743196 - RNA, 18 nt, Human
aagaugccuccucccucc

SEQ ID NO: 743197 - RNA, 21 nt, Human
aagaugccuccucccuccuuc

SEQ ID NO: 743198 - RNA, 21 nt, Human
aagcaguagggggugccgccg

SEQ ID NO: 743199 - RNA, 23 nt, Human
aaggagguuuccccaccccccac

SEQ ID NO: 743200 - RNA, 21 nt, Human
acaaugacaccuagugccccc

SEQ ID NO: 743201 - RNA, 22 nt, Human
acccgcccagcacugccccucc

SEQ ID NO: 743202 - RNA, 28 nt, Human
acccgcccagcacugccccuccuccccc

SEQ ID NO: 743203 - RNA, 18 nt, Human
acccuggagccucccucc

SEQ ID NO: 743204 - RNA, 18 nt, Human
acccuggagccucccucc

SEQ ID NO: 743205 - RNA, 26 nt, Human
agacucugggucccuucaagcaagcu

SEQ ID NO: 743206 - RNA, 20 nt, Human
agccagaaagcugggguguu

SEQ ID NO: 743207 - RNA, 23 nt, Human
aggcaaaauaaauaaccccccaa

SEQ ID NO: 743208 - RNA, 22 nt, Human
aggcugggggcccagauuccuu

SEQ ID NO: 743209 - RNA, 20 nt, Human
agggcacaugggcugaggca

SEQ ID NO: 743210 - RNA, 24 nt, Human
caaaauaaauaaccccccaacccc

SEQ ID NO: 743211 - RNA, 28 nt, Human
caaccacguugauuuccaagccgauccc

SEQ ID NO: 743212 - RNA, 22 nt, Human
caacccccaucgucacucugcu

SEQ ID NO: 743213 - RNA, 19 nt, Human
caagccgaucccugccccc

SEQ ID NO: 743214 - RNA, 21 nt, Human
caccaggccugucugccccag

SEQ ID NO: 743215 - RNA, 27 nt, Human
cacccccacccccgcaccgcucuugac

SEQ ID NO: 743216 - RNA, 21 nt, Human
cacgacacaaagguuuaaaga

SEQ ID NO: 743217 - RNA, 20 nt, Human
cacgcccuggccggcagggc

SEQ ID NO: 743218 - RNA, 22 nt, Human
caggcaaaauaaauaacccccc

SEQ ID NO: 743219 - RNA, 23 nt, Human
caggcugcugcagcuccaccccc

SEQ ID NO: 743220 - RNA, 18 nt, Human
cagguggaaggagguuuc

SEQ ID NO: 743221 - RNA, 21 nt, Human
cauuuauugaguguccacaug

SEQ ID NO: 743222 - RNA, 22 nt, Human
ccacagccgaggggagcccacg

SEQ ID NO: 743223 - RNA, 21 nt, Human
ccaccaggccugucugcccca

SEQ ID NO: 743224 - RNA, 18 nt, Human
ccagaaagcugggguguu

SEQ ID NO: 743225 - RNA, 18 nt, Human
ccaggcugcugcagcucc

SEQ ID NO: 743226 - RNA, 20 nt, Human
cccaccccccaccaggccug

SEQ ID NO: 743227 - RNA, 18 nt, Human
cccacuccuggcuccagg

SEQ ID NO: 743228 - RNA, 22 nt, Human
cccccaucgucacucugcugca

SEQ ID NO: 743229 - RNA, 23 nt, Human
ccccccaacccccaucgucacuc

SEQ ID NO: 743230 - RNA, 24 nt, Human
ccccccaccaggccugucugcccc

SEQ ID NO: 743231 - RNA, 19 nt, Human
ccccuccucccccuugguc

SEQ ID NO: 743232 - RNA, 20 nt, Human
ccccuccucccccuuggucu

SEQ ID NO: 743233 - RNA, 21 nt, Human
ccccugggucuguccccggug

SEQ ID NO: 743234 - RNA, 23 nt, Human
ccccuggguuuauaagaaaggua

SEQ ID NO: 743235 - RNA, 19 nt, Human
ccgccccugggucuguccc

SEQ ID NO: 743236 - RNA, 18 nt, Human
ccgcggcugcuucacucc

SEQ ID NO: 743237 - RNA, 19 nt, Human
ccuccuucccucucugccc

SEQ ID NO: 743238 - RNA, 21 nt, Human
ccuggcuccagccaggccaga

SEQ ID NO: 743239 - RNA, 20 nt, Human
cgaaggaggcaaggugcaga

SEQ ID NO: 743240 - RNA, 20 nt, Human
cgacagggcggcgaugagaa

SEQ ID NO: 743241 - RNA, 22 nt, Human
cucacgccgcguugcccacucc

SEQ ID NO: 743242 - RNA, 21 nt, Human
cugcggccccgagcggcgaag

SEQ ID NO: 743243 - RNA, 18 nt, Human
cugcuccugccagcccug

SEQ ID NO: 743244 - RNA, 21 nt, Human
cuggggcucgagcgaaggagg

SEQ ID NO: 743245 - RNA, 24 nt, Human
cugggucccuucaagcaagcucag

SEQ ID NO: 743246 - RNA, 24 nt, Human
gaauccgcggcugcuucacuccgg

SEQ ID NO: 743247 - RNA, 22 nt, Human
gaccuggggggccagaggaggc

SEQ ID NO: 743248 - RNA, 23 nt, Human
gaggcaguucagacccuggguca

SEQ ID NO: 743249 - RNA, 19 nt, Human
gaucccugcccccaugggg

SEQ ID NO: 743250 - RNA, 26 nt, Human
gcaaaauaaauaaccccccaaccccc

SEQ ID NO: 743251 - RNA, 20 nt, Human
gcagcuccacccccaccccc

SEQ ID NO: 743252 - RNA, 22 nt, Human
gccgcguugcccacuccuggcu

SEQ ID NO: 743253 - RNA, 19 nt, Human
gcggccccgagcggcgaag

SEQ ID NO: 743254 - RNA, 23 nt, Human
ggaggaagucuggggaggggggg

SEQ ID NO: 743255 - RNA, 20 nt, Human
gggagccucgggccgcugcu

SEQ ID NO: 743256 - RNA, 22 nt, Human
gggaggggggggccagauuggg

SEQ ID NO: 743257 - RNA, 19 nt, Human
gggauaaggacaggcaaaa

SEQ ID NO: 743258 - RNA, 22 nt, Human
gggcuggggcucgagcgaagga

SEQ ID NO: 743259 - RNA, 24 nt, Human
ggggaggaagucuggggagggggg

SEQ ID NO: 743260 - RNA, 19 nt, Human
gggggagggaagcaaggga

SEQ ID NO: 743261 - RNA, 18 nt, Human
gggggccagaggaggcac

SEQ ID NO: 743262 - RNA, 21 nt, Human
guguccaagcagggauaagga

SEQ ID NO: 743263 - RNA, 20 nt, Human
gugugugugugugugugugu

SEQ ID NO: 743264 - RNA, 21 nt, Human
gugugugugugugugugugug

SEQ ID NO: 743265 - RNA, 21 nt, Human
gugugugugugugugugugug

SEQ ID NO: 743266 - RNA, 21 nt, Human
gugugugugugugugugugug

SEQ ID NO: 743267 - RNA, 21 nt, Human
gugugugugugugugugugug

SEQ ID NO: 743268 - RNA, 22 nt, Human
guuuuggggaggaagucugggg

SEQ ID NO: 743269 - RNA, 20 nt, Human
uaaagaucugggcccaaaga

SEQ ID NO: 743270 - RNA, 18 nt, Human
uaaauaaccccccaaccc

SEQ ID NO: 743271 - RNA, 20 nt, Human
uaagccugcugucugcccaa

SEQ ID NO: 743272 - RNA, 19 nt, Human
uaaucacuggggaaacaug

SEQ ID NO: 743273 - RNA, 18 nt, Human
ucaagagugugugugugu

SEQ ID NO: 743274 - RNA, 27 nt, Human
ucaagagugugugugugugugugugug

SEQ ID NO: 743275 - RNA, 19 nt, Human
ucacuggggaaacaugcgg

SEQ ID NO: 743276 - RNA, 21 nt, Human
ucccuucaagcaagcucaggu

SEQ ID NO: 743277 - RNA, 21 nt, Human
uccugccagcccugucuuacc

SEQ ID NO: 743278 - RNA, 20 nt, Human
uccuggcuccaggcugcugc

SEQ ID NO: 743279 - RNA, 20 nt, Human
uccuuacacuugaggggugg

SEQ ID NO: 743280 - RNA, 19 nt, Human
ucucgcggccggcauugcc

SEQ ID NO: 743281 - RNA, 26 nt, Human
ucugggucccuucaagcaagcucagg

SEQ ID NO: 743282 - RNA, 18 nt, Human
ucuguccccgguggacac

SEQ ID NO: 743283 - RNA, 20 nt, Human
ugagaucacacaggcugcgg

SEQ ID NO: 743284 - RNA, 18 nt, Human
ugcacagcuuugaacuug

SEQ ID NO: 743285 - RNA, 20 nt, Human
ugcccuaggauggaggcagu

SEQ ID NO: 743286 - RNA, 22 nt, Human
ugcccuugcccucagaaaagcc

SEQ ID NO: 743287 - RNA, 21 nt, Human
ugcuccaaccuuccccggccu

SEQ ID NO: 743288 - RNA, 19 nt, Human
uggaaggagguuuccccac

SEQ ID NO: 743289 - RNA, 25 nt, Human
uggaggcaguucagacccuggguca

SEQ ID NO: 743290 - RNA, 22 nt, Human
uggaguguaaucacuggggaaa

SEQ ID NO: 743291 - RNA, 19 nt, Human
uggcaccagggggacagga

SEQ ID NO: 743292 - RNA, 24 nt, Human
uggggaggaagucuggggaggggg

SEQ ID NO: 743293 - RNA, 18 nt, Human
uggggaggggggggccag

SEQ ID NO: 743294 - RNA, 24 nt, Human
uggggaggggggggccagauuggg

SEQ ID NO: 743295 - RNA, 20 nt, Human
uguguguguguguggucccc

SEQ ID NO: 743296 - RNA, 18 nt, Human
ugugugugugugugugug

SEQ ID NO: 743297 - RNA, 18 nt, Human
ugugugugugugugugug

SEQ ID NO: 743298 - RNA, 18 nt, Human
ugugugugugugugugug

SEQ ID NO: 743299 - RNA, 18 nt, Human
ugugugugugugugugug

SEQ ID NO: 743300 - RNA, 18 nt, Human
ugugugugugugugugug

SEQ ID NO: 743301 - RNA, 18 nt, Human
ugugugugugugugugug

SEQ ID NO: 743302 - RNA, 18 nt, Human
ugugugugugugugugug

SEQ ID NO: 743303 - RNA, 18 nt, Human
ugugugugugugugugug

SEQ ID NO: 743304 - RNA, 18 nt, Human
ugugugugugugugugug

SEQ ID NO: 743305 - RNA, 18 nt, Human
ugugugugugugugugug

SEQ ID NO: 743306 - RNA, 18 nt, Human
ugugugugugugugugug

SEQ ID NO: 743307 - RNA, 18 nt, Human
ugugugugugugugugug

SEQ ID NO: 743308 - RNA, 18 nt, Human
ugugugugugugugugug

SEQ ID NO: 743309 - RNA, 18 nt, Human
ugugugugugugugugug

SEQ ID NO: 743310 - RNA, 18 nt, Human
ugugugugugugugugug

SEQ ID NO: 743311 - RNA, 18 nt, Human
ugugugugugugugugug

SEQ ID NO: 743312 - RNA, 21 nt, Human
ugugugugugugugugugugu

SEQ ID NO: 743313 - RNA, 21 nt, Human
ugugugugugugugugugugu

SEQ ID NO: 743314 - RNA, 21 nt, Human
ugugugugugugugugugugu

SEQ ID NO: 743315 - RNA, 21 nt, Human
ugugugugugugugugugugu

SEQ ID NO: 743316 - RNA, 21 nt, Human
ugugugugugugugugugugu

SEQ ID NO: 743317 - RNA, 21 nt, Human
ugugugugugugugugugugu

SEQ ID NO: 743318 - RNA, 21 nt, Human
ugugugugugugugugugugu

SEQ ID NO: 743319 - RNA, 21 nt, Human
ugugugugugugugugugugu

SEQ ID NO: 743320 - RNA, 21 nt, Human
ugugugugugugugugugugu

SEQ ID NO: 743321 - RNA, 21 nt, Human
ugugugugugugugugugugu

SEQ ID NO: 743322 - RNA, 21 nt, Human
ugugugugugugugugugugu

SEQ ID NO: 743323 - RNA, 21 nt, Human
ugugugugugugugugugugu

SEQ ID NO: 743324 - RNA, 21 nt, Human
ugugugugugugugugugugu

SEQ ID NO: 743325 - RNA, 21 nt, Human
ugugugugugugugugugugu

SEQ ID NO: 743326 - RNA, 21 nt, Human
ugugugugugugugugugugu

SEQ ID NO: 743327 - RNA, 21 nt, Human
ugugugugugugugugugugu

SEQ ID NO: 743328 - RNA, 21 nt, Human
ugugugugugugugugugugu

SEQ ID NO: 743329 - RNA, 21 nt, Human
ugugugugugugugugugugu

SEQ ID NO: 743330 - RNA, 21 nt, Human
ugugugugugugugugugugu

SEQ ID NO: 743331 - RNA, 21 nt, Human
ugugugugugugugugugugu

SEQ ID NO: 743332 - RNA, 21 nt, Human
ugugugugugugugugugugu

SEQ ID NO: 743333 - RNA, 21 nt, Human
ugugugugugugugugugugu

SEQ ID NO: 743334 - RNA, 21 nt, Human
ugugugugugugugugugugu

SEQ ID NO: 743335 - RNA, 21 nt, Human
ugugugugugugugugugugu

SEQ ID NO: 743336 - RNA, 21 nt, Human
ugugugugugugugugugugu

SEQ ID NO: 743337 - RNA, 21 nt, Human
ugugugugugugugugugugu

SEQ ID NO: 743338 - RNA, 21 nt, Human
ugugugugugugugugugugu

SEQ ID NO: 743339 - RNA, 21 nt, Human
ugugugugugugugugugugu

SEQ ID NO: 743340 - RNA, 21 nt, Human
ugugugugugugugugugugu

SEQ ID NO: 743341 - RNA, 21 nt, Human
ugugugugugugugugugugu

SEQ ID NO: 743342 - RNA, 22 nt, Human
ugugugugugugugugugugug

SEQ ID NO: 743343 - RNA, 22 nt, Human
ugugugugugugugugugugug

SEQ ID NO: 743344 - RNA, 22 nt, Human
ugugugugugugugugugugug

SEQ ID NO: 743345 - RNA, 22 nt, Human
ugugugugugugugugugugug

SEQ ID NO: 743346 - RNA, 22 nt, Human
ugugugugugugugugugugug

SEQ ID NO: 743347 - RNA, 22 nt, Human
ugugugugugugugugugugug

SEQ ID NO: 743348 - RNA, 22 nt, Human
ugugugugugugugugugugug

SEQ ID NO: 743349 - RNA, 22 nt, Human
ugugugugugugugugugugug

SEQ ID NO: 743350 - RNA, 22 nt, Human
ugugugugugugugugugugug

SEQ ID NO: 743351 - RNA, 22 nt, Human
ugugugugugugugugugugug

SEQ ID NO: 743352 - RNA, 22 nt, Human
ugugugugugugugugugugug

SEQ ID NO: 743353 - RNA, 23 nt, Human
uguuuuggggaggaagucugggg

SEQ ID NO: 743354 - RNA, 22 nt, Human
uuccuggcuccagccaggccag

SEQ ID NO: 743355 - RNA, 24 nt, Human
aaaaaaccuuuauccaaaaaccag

SEQ ID NO: 743356 - RNA, 26 nt, Human
aaacaaauggacaccauacuauggaa

SEQ ID NO: 743357 - RNA, 19 nt, Human
aaagcacuuuccuucuacc

SEQ ID NO: 743358 - RNA, 26 nt, Human
aacaucuaaacaaacaauaaacaauc

SEQ ID NO: 743359 - RNA, 19 nt, Human
aagacaaaaaauuucccuu

SEQ ID NO: 743360 - RNA, 20 nt, Human
aaugacaucuucagugacuu

SEQ ID NO: 743361 - RNA, 22 nt, Human
aauuuguuagacuagaaccaga

SEQ ID NO: 743362 - RNA, 27 nt, Human
acugaagugcaaagcacuuuccuucua

SEQ ID NO: 743363 - RNA, 22 nt, Human
agacaaaaaauuucccuuaaaa

SEQ ID NO: 743364 - RNA, 22 nt, Human
agccuccagaauaucuuugugg

SEQ ID NO: 743365 - RNA, 20 nt, Human
aguacuuuggagguuaacag

SEQ ID NO: 743366 - RNA, 24 nt, Human
auucuuauuuccacugauuaggaa

SEQ ID NO: 743367 - RNA, 23 nt, Human
caaagucaagucuucaauccacu

SEQ ID NO: 743368 - RNA, 25 nt, Human
cagaauggcuaaaauucucugagug

SEQ ID NO: 743369 - RNA, 20 nt, Human
cccuuaaaaaacaaauggac

SEQ ID NO: 743370 - RNA, 24 nt, Human
cucaaagucaagucuucaauccac

SEQ ID NO: 743371 - RNA, 27 nt, Human
cucaccacuuaaacuuuuuccuuugaa

SEQ ID NO: 743372 - RNA, 22 nt, Human
cuccaacauuuucuuccacgcc

SEQ ID NO: 743373 - RNA, 18 nt, Human
gacaucuucagugacuua

SEQ ID NO: 743374 - RNA, 19 nt, Human
guaaaaauuugaaguaucu

SEQ ID NO: 743375 - RNA, 23 nt, Human
uaaaugacaucuucagugacuua

SEQ ID NO: 743376 - RNA, 22 nt, Human
uaaggaagacaaaaaauuuccc

SEQ ID NO: 743377 - RNA, 20 nt, Human
uaaguuacuuauuucauuua

SEQ ID NO: 743378 - RNA, 21 nt, Human
uacauaggaaacaaaaaaccu

SEQ ID NO: 743379 - RNA, 26 nt, Human
uagcaugcuguuuaagaacucucagg

SEQ ID NO: 743380 - RNA, 21 nt, Human
uagguaucuccaacauuuuuu

SEQ ID NO: 743381 - RNA, 21 nt, Human
uaguacuuuggagguuaacag

SEQ ID NO: 743382 - RNA, 21 nt, Human
uauccaaaaaccacuuuuucu

SEQ ID NO: 743383 - RNA, 23 nt, Human
ucaaagcuauuuuaaaaauuuau

SEQ ID NO: 743384 - RNA, 24 nt, Human
ucaccacuuaaacuuuuuccuuug

SEQ ID NO: 743385 - RNA, 19 nt, Human
ucagcaguuuuccaccucu

SEQ ID NO: 743386 - RNA, 18 nt, Human
ucccaccaacauuuccag

SEQ ID NO: 743387 - RNA, 19 nt, Human
uccuacucuagccuccaga

SEQ ID NO: 743388 - RNA, 21 nt, Human
uccuagguaacucgaauuugc

SEQ ID NO: 743389 - RNA, 22 nt, Human
ucuguacuauaguacuuuggag

SEQ ID NO: 743390 - RNA, 21 nt, Human
ugaaaaaugacucuaccuaca

SEQ ID NO: 743391 - RNA, 23 nt, Human
ugaaugaagauaaaugacaucuu

SEQ ID NO: 743392 - RNA, 22 nt, Human
ugacaucuucagugacuuaaau

SEQ ID NO: 743393 - RNA, 19 nt, Human
ugagaaacaucauauaugu

SEQ ID NO: 743394 - RNA, 22 nt, Human
ugagaaacaucauauauguuuu

SEQ ID NO: 743395 - RNA, 18 nt, Human
uggaaaaacaucuaaaca

SEQ ID NO: 743396 - RNA, 21 nt, Human
uguaaaaucagcaguuuucca

SEQ ID NO: 743397 - RNA, 19 nt, Human
uguaacuaaaaaauaugaa

SEQ ID NO: 743398 - RNA, 25 nt, Human
uguggaauauaaacucaccacuuaa

SEQ ID NO: 743399 - RNA, 23 nt, Human
uuaacaauccuacucuagccucc

SEQ ID NO: 743400 - RNA, 21 nt, Human
uucuuauuuccacugauuagg

SEQ ID NO: 743401 - RNA, 23 nt, Human
uuuagguaucuccaacauuuucu

SEQ ID NO: 743402 - RNA, 24 nt, Human
uuuauugcauuuuguuuacuccaa

SEQ ID NO: 743403 - RNA, 23 nt, Human
uuucccuuaaaaaacaaauggaa

SEQ ID NO: 743404 - RNA, 21 nt, Human
uuugaaguaucuucaaagcua

SEQ ID NO: 743405 - RNA, 23 nt, Human
uuuuagguaucuccaacauuuuc

SEQ ID NO: 743406 - RNA, 24 nt, Human
acagcccuggcggaccaugcgcgc

SEQ ID NO: 743407 - RNA, 18 nt, Human
accuccuccuccuccucc

SEQ ID NO: 743408 - RNA, 20 nt, Human
acucgcccgugccaccgcgc

SEQ ID NO: 743409 - RNA, 19 nt, Human
caccgcgcaagcgccggcu

SEQ ID NO: 743410 - RNA, 19 nt, Human
caccuccucgcccccccac

SEQ ID NO: 743411 - RNA, 18 nt, Human
cacgccgggagcugacac

SEQ ID NO: 743412 - RNA, 22 nt, Human
cagcccugggcgggcggguggg

SEQ ID NO: 743413 - RNA, 18 nt, Human
caggccccggggcugggg

SEQ ID NO: 743414 - RNA, 22 nt, Human
ccaccuccucgcccccccacuc

SEQ ID NO: 743415 - RNA, 19 nt, Human
ccacggcccacagcccugg

SEQ ID NO: 743416 - RNA, 25 nt, Human
ccaugcgcgccccuccccugagccu

SEQ ID NO: 743417 - RNA, 22 nt, Human
cccagcccagcccugggcgggc

SEQ ID NO: 743418 - RNA, 18 nt, Human
ccccugagccugcccgcc

SEQ ID NO: 743419 - RNA, 23 nt, Human
cccggggcugggggcgagggagc

SEQ ID NO: 743420 - RNA, 23 nt, Human
cccgugccaccgcgcaagcgccg

SEQ ID NO: 743421 - RNA, 22 nt, Human
cccuccccugagccugcccgcc

SEQ ID NO: 743422 - RNA, 18 nt, Human
cccuggggcggcgugggg

SEQ ID NO: 743423 - RNA, 22 nt, Human
ccgggggcgggcuggcgggggg

SEQ ID NO: 743424 - RNA, 24 nt, Human
ccgggggcgggcuggcggggggcg

SEQ ID NO: 743425 - RNA, 21 nt, Human
ccuccgaucccagcccagccc

SEQ ID NO: 743426 - RNA, 26 nt, Human
ccuccgaucccagcccagcccugggc

SEQ ID NO: 743427 - RNA, 20 nt, Human
ccuccuccuccuccaccucc

SEQ ID NO: 743428 - RNA, 25 nt, Human
ccuccuccuccuccuccuccuccaa

SEQ ID NO: 743429 - RNA, 18 nt, Human
cgccccuccccugagccu

SEQ ID NO: 743430 - RNA, 22 nt, Human
cggccuccgaucccagcccagc

SEQ ID NO: 743431 - RNA, 18 nt, Human
cgggcggguggguggacg

SEQ ID NO: 743432 - RNA, 22 nt, Human
cucccuggggcggcguggggcu

SEQ ID NO: 743433 - RNA, 20 nt, Human
cuccuccaccuccucgcccc

SEQ ID NO: 743434 - RNA, 20 nt, Human
cuccuccuccaccuccucgc

SEQ ID NO: 743435 - RNA, 21 nt, Human
cuccuccuccuccaccuccuc

SEQ ID NO: 743436 - RNA, 20 nt, Human
cuccuccuccuccuccuccu

SEQ ID NO: 743437 - RNA, 20 nt, Human
cuccuccuccuccuccuccu

SEQ ID NO: 743438 - RNA, 20 nt, Human
cucgccgccaccuccuccuc

SEQ ID NO: 743439 - RNA, 23 nt, Human
cucuaccugaccacgggcugggg

SEQ ID NO: 743440 - RNA, 18 nt, Human
cuggcgccuccucccugg

SEQ ID NO: 743441 - RNA, 18 nt, Human
cuucucgccgccaccucc

SEQ ID NO: 743442 - RNA, 21 nt, Human
cuucucgccgccaccuccucc

SEQ ID NO: 743443 - RNA, 23 nt, Human
gaaaaugcgccacggcccacagc

SEQ ID NO: 743444 - RNA, 23 nt, Human
gagcugacacuucccgcaucuua

SEQ ID NO: 743445 - RNA, 19 nt, Human
gagguggacaaccgggggc

SEQ ID NO: 743446 - RNA, 23 nt, Human
gccacggcccacagcccuggcgg

SEQ ID NO: 743447 - RNA, 20 nt, Human
gccccggggcugggggcgag

SEQ ID NO: 743448 - RNA, 22 nt, Human
gccucgcgauugggcuucgcgg

SEQ ID NO: 743449 - RNA, 18 nt, Human
gcggaccaugcgcgcccc

SEQ ID NO: 743450 - RNA, 18 nt, Human
ggcccggcucgcggccuc

SEQ ID NO: 743451 - RNA, 20 nt, Human
ggccuccgaucccagcccag

SEQ ID NO: 743452 - RNA, 19 nt, Human
ggccucgcgauugggcuuc

SEQ ID NO: 743453 - RNA, 18 nt, Human
ggcggaugggcuggggga

SEQ ID NO: 743454 - RNA, 18 nt, Human
ggcuucgcgggaggugga

SEQ ID NO: 743455 - RNA, 23 nt, Human
gggaggcucacggccuccgaucc

SEQ ID NO: 743456 - RNA, 19 nt, Human
gggcgggcgggugggugga

SEQ ID NO: 743457 - RNA, 24 nt, Human
gggcggguggguggacggcccggc

SEQ ID NO: 743458 - RNA, 22 nt, Human
gggcugggggcgagggagccag

SEQ ID NO: 743459 - RNA, 20 nt, Human
ggggcgggcuggcggggggc

SEQ ID NO: 743460 - RNA, 21 nt, Human
ggggggcgcuuggcggcauug

SEQ ID NO: 743461 - RNA, 23 nt, Human
gugcagggagggucugcaggggc

SEQ ID NO: 743462 - RNA, 21 nt, Human
uccaccuccucgcccccccac

SEQ ID NO: 743463 - RNA, 21 nt, Human
ucccuggggcggcguggggcu

SEQ ID NO: 743464 - RNA, 24 nt, Human
uccuccaccuccucgcccccccac

SEQ ID NO: 743465 - RNA, 20 nt, Human
ucucgccgccaccuccuccu

SEQ ID NO: 743466 - RNA, 20 nt, Human
ucugcaggggcgggaggcuc

SEQ ID NO: 743467 - RNA, 23 nt, Human
uggcggaugggcugggggaccgg

SEQ ID NO: 743468 - RNA, 21 nt, Human
ugggcgggcggguggguggac

SEQ ID NO: 743469 - RNA, 18 nt, Human
aaaagaagaaggacuugg

SEQ ID NO: 743470 - RNA, 22 nt, Human
aaaagaagaaggacuugggcaa

SEQ ID NO: 743471 - RNA, 24 nt, Human
aaaaugcugggauuacaggcauga

SEQ ID NO: 743472 - RNA, 22 nt, Human
aaauccacagccacaucuuuga

SEQ ID NO: 743473 - RNA, 26 nt, Human
aaaugcugggauuacaggcaugaacc

SEQ ID NO: 743474 - RNA, 22 nt, Human
aacaguggcuggucucugcccc

SEQ ID NO: 743475 - RNA, 27 nt, Human
aacccauucccucaacugcggaucccg

SEQ ID NO: 743476 - RNA, 22 nt, Human
aagauccucuuccuucugcccu

SEQ ID NO: 743477 - RNA, 22 nt, Human
aagcgaggauuucaggagcgag

SEQ ID NO: 743478 - RNA, 19 nt, Human
aaggacuugggcaaguugc

SEQ ID NO: 743479 - RNA, 24 nt, Human
aauuuuguauuuuuaguagagacg

SEQ ID NO: 743480 - RNA, 24 nt, Human
acaacccauucccucaacugcgga

SEQ ID NO: 743481 - RNA, 18 nt, Human
acaagauguugccaccuc

SEQ ID NO: 743482 - RNA, 24 nt, Human
acacagacacaguaacagucugau

SEQ ID NO: 743483 - RNA, 22 nt, Human
acagcuccucucccugcuccaa

SEQ ID NO: 743484 - RNA, 22 nt, Human
accucauaagccagggaaacua

SEQ ID NO: 743485 - RNA, 19 nt, Human
accugaagaggcgcaggaa

SEQ ID NO: 743486 - RNA, 19 nt, Human
acgcuuagcgguggcuucu

SEQ ID NO: 743487 - RNA, 24 nt, Human
acgggauuucuccauguuggccag

SEQ ID NO: 743488 - RNA, 19 nt, Human
acucagagguccacagcag

SEQ ID NO: 743489 - RNA, 21 nt, Human
acugccuccgggcuuccccca

SEQ ID NO: 743490 - RNA, 19 nt, Human
agaagcagccucugccccu

SEQ ID NO: 743491 - RNA, 18 nt, Human
agacgggauuucuccaug

SEQ ID NO: 743492 - RNA, 22 nt, Human
agagaaagaagagagcaaaaag

SEQ ID NO: 743493 - RNA, 21 nt, Human
agagagcaaaaagcugcagcc

SEQ ID NO: 743494 - RNA, 22 nt, Human
agagaugccaguggggcuugag

SEQ ID NO: 743495 - RNA, 18 nt, Human
agaugccaguggggcuug

SEQ ID NO: 743496 - RNA, 21 nt, Human
agcccuagauccuuuaaaccu

SEQ ID NO: 743497 - RNA, 21 nt, Human
agcucucacuuccccacuccu

SEQ ID NO: 743498 - RNA, 21 nt, Human
aggaggaggaggacauggggu

SEQ ID NO: 743499 - RNA, 23 nt, Human
aggauugcaggcaugcagcacca

SEQ ID NO: 743500 - RNA, 19 nt, Human
aggcaauaaagaccaguca

SEQ ID NO: 743501 - RNA, 19 nt, Human
aggcaugaaccaccgcgcc

SEQ ID NO: 743502 - RNA, 19 nt, Human
aggcucccaugucauggau

SEQ ID NO: 743503 - RNA, 22 nt, Human
agggcuggacuauguugacaug

SEQ ID NO: 743504 - RNA, 22 nt, Human
agguaugccgagcagacagcug

SEQ ID NO: 743505 - RNA, 24 nt, Human
aggugaucugcccaccuuggccuc

SEQ ID NO: 743506 - RNA, 24 nt, Human
aucagcaccagaacgcacacccag

SEQ ID NO: 743507 - RNA, 18 nt, Human
augcugcuggacccccgc

SEQ ID NO: 743508 - RNA, 19 nt, Human
augcugcuggacccccgcc

SEQ ID NO: 743509 - RNA, 24 nt, Human
caaaaugcugggauuacaggcaug

SEQ ID NO: 743510 - RNA, 23 nt, Human
caaauuaacagcaucucagccaa

SEQ ID NO: 743511 - RNA, 19 nt, Human
caacaggaauagcuaacau

SEQ ID NO: 743512 - RNA, 21 nt, Human
caacaguggcuggucucugcc

SEQ ID NO: 743513 - RNA, 24 nt, Human
cacagugcuacgugcaccagcgug

SEQ ID NO: 743514 - RNA, 19 nt, Human
caccagaacgcacacccag

SEQ ID NO: 743515 - RNA, 24 nt, Human
caccccaggcaauaaagaccaguc

SEQ ID NO: 743516 - RNA, 22 nt, Human
caccccugcucugcccucugcc

SEQ ID NO: 743517 - RNA, 20 nt, Human
cacgcugcuggccugggcug

SEQ ID NO: 743518 - RNA, 23 nt, Human
cacuguaccgggccggacaccuc

SEQ ID NO: 743519 - RNA, 18 nt, Human
cacuuccccacuccucac

SEQ ID NO: 743520 - RNA, 21 nt, Human
cagaucuccgaaguacaagau

SEQ ID NO: 743521 - RNA, 20 nt, Human
cagcaacaguggcuggucuc

SEQ ID NO: 743522 - RNA, 20 nt, Human
cagcaccagaacgcacaccc

SEQ ID NO: 743523 - RNA, 18 nt, Human
cagcaccaugccuggcua

SEQ ID NO: 743524 - RNA, 22 nt, Human
cagccacaucuuugaaugacac

SEQ ID NO: 743525 - RNA, 24 nt, Human
cagccugugaagcuguguaaccga

SEQ ID NO: 743526 - RNA, 24 nt, Human
cagcucaccccugcucugcccucu

SEQ ID NO: 743527 - RNA, 18 nt, Human
cagcuccucucccugcuc

SEQ ID NO: 743528 - RNA, 19 nt, Human
cagcuccucucccugcucc

SEQ ID NO: 743529 - RNA, 24 nt, Human
caggauugcaggcaugcagcacca

SEQ ID NO: 743530 - RNA, 20 nt, Human
caggcaugcagcaccaugcc

SEQ ID NO: 743531 - RNA, 27 nt, Human
cagggacaccuagcccggugcgucugc

SEQ ID NO: 743532 - RNA, 18 nt, Human
caugacuaacuccucauc

SEQ ID NO: 743533 - RNA, 20 nt, Human
caugugcucccucugccagg

SEQ ID NO: 743534 - RNA, 24 nt, Human
cauguuggccaggcuggucucaaa

SEQ ID NO: 743535 - RNA, 18 nt, Human
cauugugcugucccuccu

SEQ ID NO: 743536 - RNA, 21 nt, Human
cauugugcugucccuccugcu

SEQ ID NO: 743537 - RNA, 23 nt, Human
ccaaaaugcugggauuacaggca

SEQ ID NO: 743538 - RNA, 24 nt, Human
ccaaaaugcugggauuacaggcau

SEQ ID NO: 743539 - RNA, 20 nt, Human
ccagacagaucugcaugaac

SEQ ID NO: 743540 - RNA, 20 nt, Human
ccagauccgccucccugggg

SEQ ID NO: 743541 - RNA, 18 nt, Human
ccagccccgcagacucgg

SEQ ID NO: 743542 - RNA, 19 nt, Human
ccagggaaacuagauggcu

SEQ ID NO: 743543 - RNA, 22 nt, Human
ccaugcaugcucagcucacccc

SEQ ID NO: 743544 - RNA, 19 nt, Human
ccauguuggccaggcuggu

SEQ ID NO: 743545 - RNA, 22 nt, Human
ccauguuggccaggcuggucuc

SEQ ID NO: 743546 - RNA, 24 nt, Human
cccaaaaugcugggauuacaggca

SEQ ID NO: 743547 - RNA, 20 nt, Human
cccacaaucccugagggguc

SEQ ID NO: 743548 - RNA, 18 nt, Human
ccccaccgaggccugagc

SEQ ID NO: 743549 - RNA, 21 nt, Human
ccccacuccucaccccccugu

SEQ ID NO: 743550 - RNA, 22 nt, Human
ccccacuccucaccccccugua

SEQ ID NO: 743551 - RNA, 20 nt, Human
cccccaagaccacgcuuagg

SEQ ID NO: 743552 - RNA, 19 nt, Human
ccccuccuggggcucugca

SEQ ID NO: 743553 - RNA, 19 nt, Human
ccccucuggccccagcgcc

SEQ ID NO: 743554 - RNA, 19 nt, Human
ccccuucgccuccgccacc

SEQ ID NO: 743555 - RNA, 20 nt, Human
cccgcgcgaacccugggccg

SEQ ID NO: 743556 - RNA, 22 nt, Human
cccgcgcgaacccugggccgca

SEQ ID NO: 743557 - RNA, 20 nt, Human
cccggccccaccgaggccug

SEQ ID NO: 743558 - RNA, 18 nt, Human
cccuccugcuuccucucc

SEQ ID NO: 743559 - RNA, 21 nt, Human
cccucuggccccagcgccgcu

SEQ ID NO: 743560 - RNA, 18 nt, Human
cccugggccgcacagcuc

SEQ ID NO: 743561 - RNA, 21 nt, Human
cccugggccgcacagcucccg

SEQ ID NO: 743562 - RNA, 20 nt, Human
ccgccaccaccucccgcccg

SEQ ID NO: 743563 - RNA, 19 nt, Human
ccgccgaggacacacacgg

SEQ ID NO: 743564 - RNA, 20 nt, Human
ccgccgaggacacacacggg

SEQ ID NO: 743565 - RNA, 18 nt, Human
ccggcgccaggccgccga

SEQ ID NO: 743566 - RNA, 20 nt, Human
ccguacagcgacggccggcg

SEQ ID NO: 743567 - RNA, 24 nt, Human
ccuccgccaccaccucccgcccgg

SEQ ID NO: 743568 - RNA, 20 nt, Human
ccuccuguccaccucaccaa

SEQ ID NO: 743569 - RNA, 19 nt, Human
ccucugccccacggcuccc

SEQ ID NO: 743570 - RNA, 25 nt, Human
ccucuggccccagcgccgcuggcuc

SEQ ID NO: 743571 - RNA, 24 nt, Human
ccugaccucaggugaucugcccac

SEQ ID NO: 743572 - RNA, 25 nt, Human
ccugcucugcccucugcccuaggaa

SEQ ID NO: 743573 - RNA, 21 nt, Human
ccuggagcaaaaguucuccuc

SEQ ID NO: 743574 - RNA, 20 nt, Human
ccugggccgcacagcucccg

SEQ ID NO: 743575 - RNA, 24 nt, Human
ccuggggcucugcagccucugccc

SEQ ID NO: 743576 - RNA, 24 nt, Human
cgaacccugggccgcacagcuccc

SEQ ID NO: 743577 - RNA, 23 nt, Human
cgcccgccuaggugcuggcccgg

SEQ ID NO: 743578 - RNA, 21 nt, Human
cgccuaggugcuggcccgggc

SEQ ID NO: 743579 - RNA, 23 nt, Human
cgccuccgccaccaccucccgcc

SEQ ID NO: 743580 - RNA, 23 nt, Human
cggcucccgagaggccggggcgg

SEQ ID NO: 743581 - RNA, 24 nt, Human
cgggauuucuccauguuggccagg

SEQ ID NO: 743582 - RNA, 23 nt, Human
cggggcaaauccaggcggguguc

SEQ ID NO: 743583 - RNA, 18 nt, Human
cuaaguccuuucuuggcu

SEQ ID NO: 743584 - RNA, 19 nt, Human
cuaaguccuuucuuggcuc

SEQ ID NO: 743585 - RNA, 20 nt, Human
cucacaggccaaagcaucag

SEQ ID NO: 743586 - RNA, 24 nt, Human
cucaggugaucugcccaccuuggc

SEQ ID NO: 743587 - RNA, 18 nt, Human
cuccagguccaucugcca

SEQ ID NO: 743588 - RNA, 19 nt, Human
cuccaugcaugcucagcuc

SEQ ID NO: 743589 - RNA, 24 nt, Human
cuccauguuggccaggcuggucuc

SEQ ID NO: 743590 - RNA, 21 nt, Human
cucccgagaggccggggcggg

SEQ ID NO: 743591 - RNA, 19 nt, Human
cuccugcugugagcuggcu

SEQ ID NO: 743592 - RNA, 23 nt, Human
cucggggcccagauccgccuccc

SEQ ID NO: 743593 - RNA, 20 nt, Human
cucucacuuccccacuccuc

SEQ ID NO: 743594 - RNA, 22 nt, Human
cucugccccacggcucccgaga

SEQ ID NO: 743595 - RNA, 21 nt, Human
cucugccccgugccuccucca

SEQ ID NO: 743596 - RNA, 22 nt, Human
cucuucugaagaaccaagggug

SEQ ID NO: 743597 - RNA, 18 nt, Human
cugaagaaccaaggguga

SEQ ID NO: 743598 - RNA, 20 nt, Human
cugcagccucugccccacgg

SEQ ID NO: 743599 - RNA, 19 nt, Human
cugcaugcccuggcagggu

SEQ ID NO: 743600 - RNA, 30 nt, Human
cugccaggccagcugucucccagccaugcu

SEQ ID NO: 743601 - RNA, 19 nt, Human
cugccuccgggcuuccccc

SEQ ID NO: 743602 - RNA, 19 nt, Human
cugcuggacccccgccagg

SEQ ID NO: 743603 - RNA, 24 nt, Human
cugcuggacccccgccaggcuccc

SEQ ID NO: 743604 - RNA, 21 nt, Human
cuggagcaaaaguucuccucu

SEQ ID NO: 743605 - RNA, 24 nt, Human
cuuccuggcggucucccccuuaga

SEQ ID NO: 743606 - RNA, 21 nt, Human
cuucugaagaaccaaggguga

SEQ ID NO: 743607 - RNA, 22 nt, Human
cuugcacaccgccuugcacaua

SEQ ID NO: 743608 - RNA, 18 nt, Human
cuuugaaugacacuggcc

SEQ ID NO: 743609 - RNA, 20 nt, Human
gaaguccccuccuguccacc

SEQ ID NO: 743610 - RNA, 23 nt, Human
gaccucaggugaucugcccaccu

SEQ ID NO: 743611 - RNA, 18 nt, Human
gagaaugaagacauggua

SEQ ID NO: 743612 - RNA, 24 nt, Human
gagacgggauuucuccauguuggc

SEQ ID NO: 743613 - RNA, 24 nt, Human
gagcacugccuccgggcuuccccc

SEQ ID NO: 743614 - RNA, 18 nt, Human
gaggagcccggggcaggg

SEQ ID NO: 743615 - RNA, 18 nt, Human
gaggaggaggacaugggg

SEQ ID NO: 743616 - RNA, 19 nt, Human
gaggggcccgggccgggcc

SEQ ID NO: 743617 - RNA, 20 nt, Human
gaggggcccgggccgggccu

SEQ ID NO: 743618 - RNA, 23 nt, Human
gagugggggcaugcuugggaggc

SEQ ID NO: 743619 - RNA, 22 nt, Human
gauuacaggcaugaaccaccgc

SEQ ID NO: 743620 - RNA, 24 nt, Human
gauugcaggcaugcagcaccaugc

SEQ ID NO: 743621 - RNA, 19 nt, Human
gcacaccgccuugcacaua

SEQ ID NO: 743622 - RNA, 18 nt, Human
gcacagcucccgcccgcc

SEQ ID NO: 743623 - RNA, 20 nt, Human
gcacaucuaacaucuacauu

SEQ ID NO: 743624 - RNA, 19 nt, Human
gcagcgagcccugugccac

SEQ ID NO: 743625 - RNA, 21 nt, Human
gccacgcugcuggccugggcu

SEQ ID NO: 743626 - RNA, 22 nt, Human
gcccggccccucuggccccagc

SEQ ID NO: 743627 - RNA, 21 nt, Human
gcccuagauccuuuaaaccuu

SEQ ID NO: 743628 - RNA, 19 nt, Human
gcccugccugcccggcccc

SEQ ID NO: 743629 - RNA, 23 nt, Human
gcccugccugcccggccccaccg

SEQ ID NO: 743630 - RNA, 20 nt, Human
gccgccgaggacacacacgg

SEQ ID NO: 743631 - RNA, 19 nt, Human
gccuggggucucuguuuac

SEQ ID NO: 743632 - RNA, 23 nt, Human
gcuggucucaaacuccugaccuc

SEQ ID NO: 743633 - RNA, 18 nt, Human
gcuuaacucuuuccugcu

SEQ ID NO: 743634 - RNA, 18 nt, Human
gcuuccucuccaggucca

SEQ ID NO: 743635 - RNA, 20 nt, Human
ggaggaggaggaggacaugg

SEQ ID NO: 743636 - RNA, 21 nt, Human
ggaggaggaggaggacauggg

SEQ ID NO: 743637 - RNA, 23 nt, Human
ggaggaggaggaggacauggggu

SEQ ID NO: 743638 - RNA, 22 nt, Human
ggauuacaggcaugaaccaccg

SEQ ID NO: 743639 - RNA, 19 nt, Human
ggcaagaggaauagaaaag

SEQ ID NO: 743640 - RNA, 21 nt, Human
ggccaaagcaucagcaccaga

SEQ ID NO: 743641 - RNA, 18 nt, Human
ggccccuguguucugccu

SEQ ID NO: 743642 - RNA, 21 nt, Human
ggcguggcugagggacucaga

SEQ ID NO: 743643 - RNA, 20 nt, Human
ggcucaccguacagcgacgg

SEQ ID NO: 743644 - RNA, 24 nt, Human
ggcuggucucaaacuccugaccuc

SEQ ID NO: 743645 - RNA, 25 nt, Human
gggaagcauuuucuccuggaccccu

SEQ ID NO: 743646 - RNA, 23 nt, Human
gggauuucuccauguuggccagg

SEQ ID NO: 743647 - RNA, 20 nt, Human
gggcagagaccccaggccag

SEQ ID NO: 743648 - RNA, 18 nt, Human
gggccgggccuacggggc

SEQ ID NO: 743649 - RNA, 24 nt, Human
gggcgccuucagguacagggcgug

SEQ ID NO: 743650 - RNA, 24 nt, Human
gggcuggacuauguugacauggaa

SEQ ID NO: 743651 - RNA, 19 nt, Human
ggggauggggugaacugcu

SEQ ID NO: 743652 - RNA, 21 nt, Human
gggguucacgcucgggggucc

SEQ ID NO: 743653 - RNA, 24 nt, Human
gggguucacgcucgggggucccgg

SEQ ID NO: 743654 - RNA, 20 nt, Human
ggguuccagcagcgagcccu

SEQ ID NO: 743655 - RNA, 18 nt, Human
gguuccagcagcgagccc

SEQ ID NO: 743656 - RNA, 19 nt, Human
guccaguugccaccacucc

SEQ ID NO: 743657 - RNA, 21 nt, Human
gugccagcaacaguggcuggu

SEQ ID NO: 743658 - RNA, 19 nt, Human
gugggaaguacccccagac

SEQ ID NO: 743659 - RNA, 21 nt, Human
guugucugugucagcugugac

SEQ ID NO: 743660 - RNA, 23 nt, Human
uaacagcaucucagccaaccaau

SEQ ID NO: 743661 - RNA, 20 nt, Human
uaacagucugaucucucuuu

SEQ ID NO: 743662 - RNA, 28 nt, Human
uaaccgagacacgcuuuuccuuagguau

SEQ ID NO: 743663 - RNA, 19 nt, Human
uaacucuuuccugcugcac

SEQ ID NO: 743664 - RNA, 20 nt, Human
uaagucuggcuugacaaccc

SEQ ID NO: 743665 - RNA, 20 nt, Human
uacaagaugcgcugcagcag

SEQ ID NO: 743666 - RNA, 23 nt, Human
uacaggcaugaaccaccgcgccc

SEQ ID NO: 743667 - RNA, 20 nt, Human
uaccauguugcuuggacacc

SEQ ID NO: 743668 - RNA, 21 nt, Human
uagcucagccucacaggccaa

SEQ ID NO: 743669 - RNA, 24 nt, Human
uaguagagacgggauuucuccaug

SEQ ID NO: 743670 - RNA, 18 nt, Human
uauguuaucuucucauca

SEQ ID NO: 743671 - RNA, 19 nt, Human
uauguuaucuucucaucag

SEQ ID NO: 743672 - RNA, 21 nt, Human
ucacgcucgggggucccggcu

SEQ ID NO: 743673 - RNA, 18 nt, Human
ucagaucuccgaaguaca

SEQ ID NO: 743674 - RNA, 22 nt, Human
ucagcucaccccugcucugccc

SEQ ID NO: 743675 - RNA, 21 nt, Human
ucaggguccaguugccaccac

SEQ ID NO: 743676 - RNA, 22 nt, Human
ucaggguccaguugccaccacu

SEQ ID NO: 743677 - RNA, 20 nt, Human
ucagguacagggcgugcgcc

SEQ ID NO: 743678 - RNA, 22 nt, Human
ucagguacagggcgugcgccag

SEQ ID NO: 743679 - RNA, 23 nt, Human
uccaugcaugcucagcucacccc

SEQ ID NO: 743680 - RNA, 21 nt, Human
uccauggccacgcugcuggcc

SEQ ID NO: 743681 - RNA, 21 nt, Human
uccauggccacgcugcuggcc

SEQ ID NO: 743682 - RNA, 19 nt, Human
uccaugugcucccucugcc

SEQ ID NO: 743683 - RNA, 24 nt, Human
ucccaaaaugcugggauuacaggc

SEQ ID NO: 743684 - RNA, 26 nt, Human
ucccagccaugcugcuggacccccgc

SEQ ID NO: 743685 - RNA, 20 nt, Human
ucccgaggggcccgggccgg

SEQ ID NO: 743686 - RNA, 24 nt, Human
ucccgcccggccccucuggccccc

SEQ ID NO: 743687 - RNA, 23 nt, Human
ucccgggugccgagcacugccuc

SEQ ID NO: 743688 - RNA, 18 nt, Human
ucccuacaggauugcagg

SEQ ID NO: 743689 - RNA, 18 nt, Human
ucccugaggggucaguca

SEQ ID NO: 743690 - RNA, 23 nt, Human
ucccuuucuacacagacacagua

SEQ ID NO: 743691 - RNA, 19 nt, Human
uccgccaccaccucccgcc

SEQ ID NO: 743692 - RNA, 18 nt, Human
ucgccccuucgccuccgc

SEQ ID NO: 743693 - RNA, 19 nt, Human
ucguggagggggggauggg

SEQ ID NO: 743694 - RNA, 22 nt, Human
ucuacuccaugugcucccucug

SEQ ID NO: 743695 - RNA, 21 nt, Human
ucucauccacuagaggccaaa

SEQ ID NO: 743696 - RNA, 21 nt, Human
ucuccagguccaucugccaca

SEQ ID NO: 743697 - RNA, 21 nt, Human
ucucucuuucuuuucccuaca

SEQ ID NO: 743698 - RNA, 21 nt, Human
ucugaacugagacaugugacu

SEQ ID NO: 743699 - RNA, 19 nt, Human
ucugcagccucugccccac

SEQ ID NO: 743700 - RNA, 25 nt, Human
ucugccacagugcuacgugcaccag

SEQ ID NO: 743701 - RNA, 20 nt, Human
ucugccccucucccuuuccc

SEQ ID NO: 743702 - RNA, 20 nt, Human
ucugguugucugugucagcu

SEQ ID NO: 743703 - RNA, 22 nt, Human
ugaacgggucgagaugccgacg

SEQ ID NO: 743704 - RNA, 21 nt, Human
ugaaugacacuggcccccucc

SEQ ID NO: 743705 - RNA, 19 nt, Human
ugacauggaaauucaccuc

SEQ ID NO: 743706 - RNA, 21 nt, Human
ugacauggaaauucaccuccc

SEQ ID NO: 743707 - RNA, 18 nt, Human
ugaccucaggugaucugc

SEQ ID NO: 743708 - RNA, 20 nt, Human
ugaccucaggugaucugccc

SEQ ID NO: 743709 - RNA, 21 nt, Human
ugaccucaggugaucugccca

SEQ ID NO: 743710 - RNA, 24 nt, Human
ugaccucaggugaucugcccaccu

SEQ ID NO: 743711 - RNA, 18 nt, Human
ugaggaggacuuccuggc

SEQ ID NO: 743712 - RNA, 24 nt, Human
ugaucugcccaccuuggccuccca

SEQ ID NO: 743713 - RNA, 21 nt, Human
ugcagccggugcuugcacacc

SEQ ID NO: 743714 - RNA, 19 nt, Human
ugcaugaacacccacugua

SEQ ID NO: 743715 - RNA, 21 nt, Human
ugcaugggucggagagugggc

SEQ ID NO: 743716 - RNA, 22 nt, Human
ugcccaccuuggccucccaaaa

SEQ ID NO: 743717 - RNA, 22 nt, Human
ugccccacggcucccgagaggc

SEQ ID NO: 743718 - RNA, 20 nt, Human
ugccccgugccuccuccacu

SEQ ID NO: 743719 - RNA, 22 nt, Human
ugcccggccccaccgaggccug

SEQ ID NO: 743720 - RNA, 23 nt, Human
ugcccuggcaggguuccagcagc

SEQ ID NO: 743721 - RNA, 18 nt, Human
ugcucagcucaccccugc

SEQ ID NO: 743722 - RNA, 18 nt, Human
ugcucgcgaaguccccuc

SEQ ID NO: 743723 - RNA, 23 nt, Human
ugcugggauuacaggcaugaacc

SEQ ID NO: 743724 - RNA, 21 nt, Human
ugcuucaacaggaauagcuaa

SEQ ID NO: 743725 - RNA, 24 nt, Human
ugcuugcacaccgccuugcacaua

SEQ ID NO: 743726 - RNA, 18 nt, Human
uggaauagcagagaacgg

SEQ ID NO: 743727 - RNA, 18 nt, Human
uggcagggagaaauucag

SEQ ID NO: 743728 - RNA, 24 nt, Human
uggccaggcuggucucaaacuccu

SEQ ID NO: 743729 - RNA, 24 nt, Human
uggcuugacaacccauucccucaa

SEQ ID NO: 743730 - RNA, 20 nt, Human
ugggaaguacccccagacag

SEQ ID NO: 743731 - RNA, 25 nt, Human
ugggacccuggagcaaaaguucucc

SEQ ID NO: 743732 - RNA, 21 nt, Human
ugggauuacaggcaugaacca

SEQ ID NO: 743733 - RNA, 23 nt, Human
ugggauuacaggcaugaaccacc

SEQ ID NO: 743734 - RNA, 24 nt, Human
ugggauuacaggcaugaaccaccg

SEQ ID NO: 743735 - RNA, 24 nt, Human
ugggauuacaggcaugaaccaccg

SEQ ID NO: 743736 - RNA, 22 nt, Human
ugggguuugauuuugugccuuu

SEQ ID NO: 743737 - RNA, 21 nt, Human
uggguaaugaaggcugaaagg

SEQ ID NO: 743738 - RNA, 20 nt, Human
uggucucugccccgugccuc

SEQ ID NO: 743739 - RNA, 25 nt, Human
uguccaccucaccaaggcuguucug

SEQ ID NO: 743740 - RNA, 18 nt, Human
ugugcucccucugccagg

SEQ ID NO: 743741 - RNA, 23 nt, Human
uguugcuuggacaccagggugga

SEQ ID NO: 743742 - RNA, 21 nt, Human
uuacagagaugccaguggggc

SEQ ID NO: 743743 - RNA, 18 nt, Human
uuaguagagacgggauuu

SEQ ID NO: 743744 - RNA, 24 nt, Human
uuaguagagacgggauuucuccau

SEQ ID NO: 743745 - RNA, 25 nt, Human
uucaggaaaugaugaaugaaugguu

SEQ ID NO: 743746 - RNA, 22 nt, Human
uucccucaacugcggaucccgg

SEQ ID NO: 743747 - RNA, 19 nt, Human
uucccuggcagccucgaug

SEQ ID NO: 743748 - RNA, 23 nt, Human
uucuccaagguuaugcuucaaca

SEQ ID NO: 743749 - RNA, 21 nt, Human
uugauuccauacaacacaugu

SEQ ID NO: 743750 - RNA, 22 nt, Human
uugcccaggcucccacugcugg

SEQ ID NO: 743751 - RNA, 23 nt, Human
uugcccaggcucccacugcuggu

SEQ ID NO: 743752 - RNA, 19 nt, Human
uugccuuugaccuggaugc

SEQ ID NO: 743753 - RNA, 18 nt, Human
uuggccucccaaaaugcu

SEQ ID NO: 743754 - RNA, 21 nt, Human
uuggggcaaagucacaaauua

SEQ ID NO: 743755 - RNA, 20 nt, Human
uuggggcagagaccccaggc

SEQ ID NO: 743756 - RNA, 24 nt, Human
uuuaaaccuugauuccauacaaca

SEQ ID NO: 743757 - RNA, 21 nt, Human
uuucuccauguuggccaggcu

SEQ ID NO: 743758 - RNA, 21 nt, Human
uuucuccuggaccccuugaug

SEQ ID NO: 743759 - RNA, 23 nt, Human
uuucuuaugucuucccuuucuac

SEQ ID NO: 743760 - RNA, 19 nt, Human
uuuuguauuuuuaguagag

SEQ ID NO: 743761 - RNA, 20 nt, Human
uuuuguauuuuuaguagaga

SEQ ID NO: 743762 - RNA, 19 nt, Human
uuuuuaguagagacgggau

SEQ ID NO: 743763 - RNA, 19 nt, Human
aacaaaaaucugacacuac

SEQ ID NO: 743764 - RNA, 20 nt, Human
aagcaacaaaaaucugacac

SEQ ID NO: 743765 - RNA, 23 nt, Human
aagcaacaaaaaucugacacuac

SEQ ID NO: 743766 - RNA, 31 nt, Human
aagcaacaaaaaucugacacuacuugaaacu

SEQ ID NO: 743767 - RNA, 19 nt, Human
acagccgcccaagcaacaa

SEQ ID NO: 743768 - RNA, 24 nt, Human
acguuguggagcaagugggugggc

SEQ ID NO: 743769 - RNA, 19 nt, Human
agaaaccaaucaaagguca

SEQ ID NO: 743770 - RNA, 20 nt, Human
agcacucguagauguugucc

SEQ ID NO: 743771 - RNA, 20 nt, Human
agcuauucacaguuggugca

SEQ ID NO: 743772 - RNA, 24 nt, Human
aggcagcaccaaauggaaauacuu

SEQ ID NO: 743773 - RNA, 18 nt, Human
aggcaggcgucgaugugg

SEQ ID NO: 743774 - RNA, 21 nt, Human
aggcgcggccgggagccggga

SEQ ID NO: 743775 - RNA, 22 nt, Human
aggcgucgaugaaggccugcgc

SEQ ID NO: 743776 - RNA, 22 nt, Human
aggggucaaggcgggggcgccc

SEQ ID NO: 743777 - RNA, 20 nt, Human
aggugcccaggggucaaggc

SEQ ID NO: 743778 - RNA, 22 nt, Human
aggugcccaggggucaaggcgg

SEQ ID NO: 743779 - RNA, 20 nt, Human
auccucuacgggugaggggg

SEQ ID NO: 743780 - RNA, 18 nt, Human
augacugaaaggcaggcg

SEQ ID NO: 743781 - RNA, 19 nt, Human
augaucugcggccgauacc

SEQ ID NO: 743782 - RNA, 19 nt, Human
auggcgcgggcacugccca

SEQ ID NO: 743783 - RNA, 24 nt, Human
caaagccaccaccugcucaaacuu

SEQ ID NO: 743784 - RNA, 20 nt, Human
caagucuuucacucggccca

SEQ ID NO: 743785 - RNA, 27 nt, Human
caaguugaggcccagugggcguccauu

SEQ ID NO: 743786 - RNA, 20 nt, Human
cacuguagcacucguagaug

SEQ ID NO: 743787 - RNA, 18 nt, Human
cagagagcagccccuccu

SEQ ID NO: 743788 - RNA, 26 nt, Human
cagagagcagccccuccuccugcccc

SEQ ID NO: 743789 - RNA, 20 nt, Human
cagagucccagcugcccccc

SEQ ID NO: 743790 - RNA, 19 nt, Human
cagaugggcauucaucucu

SEQ ID NO: 743791 - RNA, 20 nt, Human
cagccccuccuccugccccc

SEQ ID NO: 743792 - RNA, 24 nt, Human
cagccuccgggcuggcggccuccu

SEQ ID NO: 743793 - RNA, 18 nt, Human
cagccugcuccuccagga

SEQ ID NO: 743794 - RNA, 25 nt, Human
cagcuccugugccccccaucccucc

SEQ ID NO: 743795 - RNA, 22 nt, Human
cagcugccccccuccagccccc

SEQ ID NO: 743796 - RNA, 20 nt, Human
caggggucaaggcgggggcg

SEQ ID NO: 743797 - RNA, 25 nt, Human
cauccagaaacuucugcaacgugcc

SEQ ID NO: 743798 - RNA, 24 nt, Human
ccaacagccgcccaagcaacaaaa

SEQ ID NO: 743799 - RNA, 26 nt, Human
ccaccaccugcucaaacuugugcugc

SEQ ID NO: 743800 - RNA, 19 nt, Human
ccagagucccagcugcccc

SEQ ID NO: 743801 - RNA, 21 nt, Human
ccagagucccagcugcccccc

SEQ ID NO: 743802 - RNA, 19 nt, Human
ccagcccccaugggcucug

SEQ ID NO: 743803 - RNA, 23 nt, Human
ccagcugccccccuccagccccc

SEQ ID NO: 743804 - RNA, 19 nt, Human
cccacucuaccaacagccg

SEQ ID NO: 743805 - RNA, 21 nt, Human
cccagaaccggagaggaaggc

SEQ ID NO: 743806 - RNA, 26 nt, Human
cccagcuccugugccccccaucccuc

SEQ ID NO: 743807 - RNA, 24 nt, Human
cccagcugcaggucagagauggag

SEQ ID NO: 743808 - RNA, 24 nt, Human
ccccaucccuccccuccacccucc

SEQ ID NO: 743809 - RNA, 21 nt, Human
ccccauggcgcgggcacugcc

SEQ ID NO: 743810 - RNA, 22 nt, Human
ccccauggcgcgggcacugccc

SEQ ID NO: 743811 - RNA, 20 nt, Human
cccccaucccuccccuccac

SEQ ID NO: 743812 - RNA, 20 nt, Human
ccccccaucccuccccucca

SEQ ID NO: 743813 - RNA, 18 nt, Human
ccccuccacccucccugc

SEQ ID NO: 743814 - RNA, 21 nt, Human
ccuccagcgcggccaugaucu

SEQ ID NO: 743815 - RNA, 20 nt, Human
ccuccccuccacccucccug

SEQ ID NO: 743816 - RNA, 21 nt, Human
ccucuucucagccugcuccuc

SEQ ID NO: 743817 - RNA, 20 nt, Human
ccugcucaaacuugugcugc

SEQ ID NO: 743818 - RNA, 26 nt, Human
cgcggccaugaucugcggccgauacc

SEQ ID NO: 743819 - RNA, 25 nt, Human
cuccagcccccaugggcucugagcc

SEQ ID NO: 743820 - RNA, 23 nt, Human
cuccccuccacccucccugcucc

SEQ ID NO: 743821 - RNA, 18 nt, Human
cuccgggccgugggguug

SEQ ID NO: 743822 - RNA, 23 nt, Human
cuccugcccccgccccagccguc

SEQ ID NO: 743823 - RNA, 19 nt, Human
cuccuuggcguagaggagc

SEQ ID NO: 743824 - RNA, 24 nt, Human
cucuccaugugucucaggccucac

SEQ ID NO: 743825 - RNA, 18 nt, Human
cugcaggucagagaugga

SEQ ID NO: 743826 - RNA, 21 nt, Human
cugccauggccacauuggugu

SEQ ID NO: 743827 - RNA, 19 nt, Human
gagacugaucuggggacag

SEQ ID NO: 743828 - RNA, 19 nt, Human
gagcaagugggugggcaca

SEQ ID NO: 743829 - RNA, 19 nt, Human
gagccagucccaacacugg

SEQ ID NO: 743830 - RNA, 23 nt, Human
gagccagucccaacacuggcuga

SEQ ID NO: 743831 - RNA, 21 nt, Human
gaggaaggcuguuggucuucc

SEQ ID NO: 743832 - RNA, 19 nt, Human
gauggcucugccggugaga

SEQ ID NO: 743833 - RNA, 19 nt, Human
gcagcaccaaauggaaaua

SEQ ID NO: 743834 - RNA, 25 nt, Human
gcagccccuccuccugcccccgccc

SEQ ID NO: 743835 - RNA, 22 nt, Human
gcagccuccgggcuggcggccu

SEQ ID NO: 743836 - RNA, 18 nt, Human
gccauggccacauuggug

SEQ ID NO: 743837 - RNA, 22 nt, Human
gcccaagcaacaaaaaucugac

SEQ ID NO: 743838 - RNA, 18 nt, Human
gcccaggggucaaggcgg

SEQ ID NO: 743839 - RNA, 18 nt, Human
gcgaggcgcggccgggag

SEQ ID NO: 743840 - RNA, 19 nt, Human
gcgcggccgggagccggga

SEQ ID NO: 743841 - RNA, 21 nt, Human
gcgcggccgggagccgggagc

SEQ ID NO: 743842 - RNA, 19 nt, Human
gcggcgggaggcggggggg

SEQ ID NO: 743843 - RNA, 20 nt, Human
gcucccagcuccugugcccc

SEQ ID NO: 743844 - RNA, 24 nt, Human
gcucccagcuccugugccccccau

SEQ ID NO: 743845 - RNA, 22 nt, Human
ggaaguggagauaacauuuugg

SEQ ID NO: 743846 - RNA, 21 nt, Human
ggagacggggcucccagcucc

SEQ ID NO: 743847 - RNA, 19 nt, Human
gggcugcagccuccgggcu

SEQ ID NO: 743848 - RNA, 22 nt, Human
ggggauggaggugcccagggga

SEQ ID NO: 743849 - RNA, 21 nt, Human
gggggcgccccugucucagag

SEQ ID NO: 743850 - RNA, 21 nt, Human
uaaaucucugccauggccaca

SEQ ID NO: 743851 - RNA, 18 nt, Human
uagaagaucaaguugagg

SEQ ID NO: 743852 - RNA, 21 nt, Human
uagaggagcuuguugguuggc

SEQ ID NO: 743853 - RNA, 19 nt, Human
ucaaacuugugcugcaguu

SEQ ID NO: 743854 - RNA, 19 nt, Human
ucacggauacucagaaugg

SEQ ID NO: 743855 - RNA, 21 nt, Human
ucauccagaaacuucugcaac

SEQ ID NO: 743856 - RNA, 23 nt, Human
uccaagucuuucacucggcccag

SEQ ID NO: 743857 - RNA, 22 nt, Human
uccagaaacuucugcaacgugc

SEQ ID NO: 743858 - RNA, 19 nt, Human
uccagagucccagcugccc

SEQ ID NO: 743859 - RNA, 23 nt, Human
uccagcccccaugggcucugagc

SEQ ID NO: 743860 - RNA, 24 nt, Human
ucccagcugccccccuccagcccc

SEQ ID NO: 743861 - RNA, 18 nt, Human
uccuggagaagcccacag

SEQ ID NO: 743862 - RNA, 21 nt, Human
ucggagauuccccucuucuca

SEQ ID NO: 743863 - RNA, 27 nt, Human
ucucagagagcagccccuccuccugcc

SEQ ID NO: 743864 - RNA, 23 nt, Human
ucucuggccuccaucccagagac

SEQ ID NO: 743865 - RNA, 24 nt, Human
ucugccaggucugcccgcucucug

SEQ ID NO: 743866 - RNA, 24 nt, Human
ucuggcaggaacggaguggguggu

SEQ ID NO: 743867 - RNA, 19 nt, Human
ugaguuggcugcgaggggg

SEQ ID NO: 743868 - RNA, 20 nt, Human
ugaucugcggccgauaccuc

SEQ ID NO: 743869 - RNA, 21 nt, Human
ugccaggucugcccgcucucu

SEQ ID NO: 743870 - RNA, 24 nt, Human
ugcccacucuaccaacagccgccc

SEQ ID NO: 743871 - RNA, 18 nt, Human
ugcccaggggucaaggcg

SEQ ID NO: 743872 - RNA, 19 nt, Human
ugcccaggggucaaggcgg

SEQ ID NO: 743873 - RNA, 19 nt, Human
ugcccccgccccagccguc

SEQ ID NO: 743874 - RNA, 21 nt, Human
ugcccccgccccagccgucuc

SEQ ID NO: 743875 - RNA, 20 nt, Human
ugcucaaacuugugcugcag

SEQ ID NO: 743876 - RNA, 21 nt, Human
ugcucaguauuucccagucug

SEQ ID NO: 743877 - RNA, 23 nt, Human
ugcugggcagaugggggagccug

SEQ ID NO: 743878 - RNA, 22 nt, Human
uggcaggaacggaguggguggu

SEQ ID NO: 743879 - RNA, 24 nt, Human
uggcaggaacggagugggugguag

SEQ ID NO: 743880 - RNA, 23 nt, Human
uggcggccuccucucccccaguu

SEQ ID NO: 743881 - RNA, 18 nt, Human
ugggaggggauggaggug

SEQ ID NO: 743882 - RNA, 19 nt, Human
ugggcucugagccaguccc

SEQ ID NO: 743883 - RNA, 23 nt, Human
ugguaguugaagcagaaaccaau

SEQ ID NO: 743884 - RNA, 19 nt, Human
ugguggagagcaggcgggu

SEQ ID NO: 743885 - RNA, 22 nt, Human
uguccaagucuuucacucggcc

SEQ ID NO: 743886 - RNA, 21 nt, Human
uguccuccaucaaagccacca

SEQ ID NO: 743887 - RNA, 19 nt, Human
ugucuugucgaugucaaag

SEQ ID NO: 743888 - RNA, 24 nt, Human
ugugccccccaucccuccccucca

SEQ ID NO: 743889 - RNA, 27 nt, Human
uguggaugagguagaguuucugggcug

SEQ ID NO: 743890 - RNA, 21 nt, Human
uucaucucuugcucgcugagc

SEQ ID NO: 743891 - RNA, 24 nt, Human
uuccagagucccagcugccccccu

SEQ ID NO: 743892 - RNA, 18 nt, Human
uuuccucgacuccucggc

SEQ ID NO: 743893 - RNA, 19 nt, Human
aaauacugaagaugaccag

SEQ ID NO: 743894 - RNA, 18 nt, Human
aacaccaaaucguuuucc

SEQ ID NO: 743895 - RNA, 20 nt, Human
aacauaaccagaaugauauu

SEQ ID NO: 743896 - RNA, 22 nt, Human
aagaugaccagaggcucaggug

SEQ ID NO: 743897 - RNA, 22 nt, Human
aauacugaagaugaccagaggc

SEQ ID NO: 743898 - RNA, 22 nt, Human
acaaaaaacaagcuuaucuaga

SEQ ID NO: 743899 - RNA, 21 nt, Human
acugauagaaauucucucuau

SEQ ID NO: 743900 - RNA, 22 nt, Human
acuucaaggacauuauuacgga

SEQ ID NO: 743901 - RNA, 23 nt, Human
agaaaauacugaagaugaccagu

SEQ ID NO: 743902 - RNA, 25 nt, Human
caaaugacagaaaauacugaagaug

SEQ ID NO: 743903 - RNA, 21 nt, Human
cauuuauucucucaggagcua

SEQ ID NO: 743904 - RNA, 20 nt, Human
cccacgagcuggucaucuuc

SEQ ID NO: 743905 - RNA, 23 nt, Human
cucucaggagcuaaaaacaccaa

SEQ ID NO: 743906 - RNA, 23 nt, Human
cuggcccaugucacugggcuuuc

SEQ ID NO: 743907 - RNA, 24 nt, Human
gcugcuggcccaugucacugggcu

SEQ ID NO: 743908 - RNA, 21 nt, Human
uaaccagaaugauauucgugg

SEQ ID NO: 743909 - RNA, 24 nt, Human
uacacaaugcccucugaaagcuuu

SEQ ID NO: 743910 - RNA, 20 nt, Human
uacggauacacaaugcccuc

SEQ ID NO: 743911 - RNA, 20 nt, Human
ucccacgagcuggucaucuu

SEQ ID NO: 743912 - RNA, 24 nt, Human
ucccacgagcuggucaucuucagu

SEQ ID NO: 743913 - RNA, 25 nt, Human
ucuuucuucucuucauuuauucucu

SEQ ID NO: 743914 - RNA, 19 nt, Human
ugaaagcuuuugcaaauga

SEQ ID NO: 743915 - RNA, 20 nt, Human
ugaacauaaccagaaugaua

SEQ ID NO: 743916 - RNA, 21 nt, Human
ugaagaugaccagaggcucag

SEQ ID NO: 743917 - RNA, 19 nt, Human
ugacagaaaauacugaaga

SEQ ID NO: 743918 - RNA, 25 nt, Human
ugacagaaaauacugaagaugacca

SEQ ID NO: 743919 - RNA, 19 nt, Human
ugaccagaggcucaggugu

SEQ ID NO: 743920 - RNA, 24 nt, Human
ugcaaaugacagaaaauacugaag

SEQ ID NO: 743921 - RNA, 19 nt, Human
ugcuauacaaauauacauu

SEQ ID NO: 743922 - RNA, 21 nt, Human
ugcuggcccaugucacugggc

SEQ ID NO: 743923 - RNA, 23 nt, Human
uguuuuccaacagcacacaaacu

SEQ ID NO: 743924 - RNA, 24 nt, Human
uuccauguuuuccaacagcacaca

SEQ ID NO: 743925 - RNA, 23 nt, Human
uuucaacuuuuacaacauucacu

SEQ ID NO: 743926 - RNA, 24 nt, Human
uuugcaaaugacagaaaauacuga

SEQ ID NO: 743927 - RNA, 23 nt, Human
aaacgucucuuaaagcaaagucc

SEQ ID NO: 743928 - RNA, 26 nt, Human
aacaucacgggugcuggcuccaaagc

SEQ ID NO: 743929 - RNA, 23 nt, Human
aacccacguacgugcguuugcua

SEQ ID NO: 743930 - RNA, 18 nt, Human
aagaagccuuuaaaaaga

SEQ ID NO: 743931 - RNA, 18 nt, Human
aagcaaaguccacagaug

SEQ ID NO: 743932 - RNA, 19 nt, Human
aaggauauauauucucucc

SEQ ID NO: 743933 - RNA, 20 nt, Human
aaguggcaaugaggacuaaa

SEQ ID NO: 743934 - RNA, 18 nt, Human
aaucucccucuacaucuc

SEQ ID NO: 743935 - RNA, 24 nt, Human
aaugcaaucacgagcaaaccaccu

SEQ ID NO: 743936 - RNA, 22 nt, Human
acagcaggucaugggacaaacc

SEQ ID NO: 743937 - RNA, 23 nt, Human
acgggugcuggcuccaaagcucc

SEQ ID NO: 743938 - RNA, 18 nt, Human
acucccuuaaaaauugaa

SEQ ID NO: 743939 - RNA, 22 nt, Human
agaaaaacaagacaagaugaga

SEQ ID NO: 743940 - RNA, 22 nt, Human
agacagguaaacacauuuuuga

SEQ ID NO: 743941 - RNA, 18 nt, Human
agagaucagccucugaaa

SEQ ID NO: 743942 - RNA, 25 nt, Human
agcuucucaggccuucccgggcgac

SEQ ID NO: 743943 - RNA, 21 nt, Human
aguuucguuuaacagcagcuu

SEQ ID NO: 743944 - RNA, 19 nt, Human
auaccaaagucucugaggu

SEQ ID NO: 743945 - RNA, 26 nt, Human
auuugcaugagaagaacuaacaucac

SEQ ID NO: 743946 - RNA, 24 nt, Human
caaaaaaagcuaucuauggaaaua

SEQ ID NO: 743947 - RNA, 19 nt, Human
caaagucucugagguacgu

SEQ ID NO: 743948 - RNA, 24 nt, Human
caagaagccuuuaaaaagacuucu

SEQ ID NO: 743949 - RNA, 20 nt, Human
caagcucucuuuccuccaca

SEQ ID NO: 743950 - RNA, 24 nt, Human
cacuccuaccuaagggaugagagu

SEQ ID NO: 743951 - RNA, 22 nt, Human
cagagaucagccucugaaacuc

SEQ ID NO: 743952 - RNA, 19 nt, Human
cagcgggccguucccuggu

SEQ ID NO: 743953 - RNA, 21 nt, Human
cagcuugggcuccugucuccu

SEQ ID NO: 743954 - RNA, 23 nt, Human
cauuguggaggaccuaauuguuc

SEQ ID NO: 743955 - RNA, 24 nt, Human
cccuggugacuuucugaguggugg

SEQ ID NO: 743956 - RNA, 25 nt, Human
ccucugaaacucauuaucacauaga

SEQ ID NO: 743957 - RNA, 23 nt, Human
cgaaagcuucucaggccuucccg

SEQ ID NO: 743958 - RNA, 24 nt, Human
cgaaucuucuaucagacaacacac

SEQ ID NO: 743959 - RNA, 25 nt, Human
cuaaaauuauuaaguaccuacagaa

SEQ ID NO: 743960 - RNA, 23 nt, Human
cuagcgauagcucagcccucccc

SEQ ID NO: 743961 - RNA, 22 nt, Human
cuccugccuuagaaaaacaaga

SEQ ID NO: 743962 - RNA, 23 nt, Human
cugagaagaaacugcaaaaaacc

SEQ ID NO: 743963 - RNA, 22 nt, Human
cugaguggugggguuccaggaa

SEQ ID NO: 743964 - RNA, 19 nt, Human
cugauguuucucgcacccu

SEQ ID NO: 743965 - RNA, 22 nt, Human
cugcgucacuggucacagcuug

SEQ ID NO: 743966 - RNA, 24 nt, Human
cuucugugucaaugagggaaaaaa

SEQ ID NO: 743967 - RNA, 23 nt, Human
gaaaagcaaaauuaaaacugaga

SEQ ID NO: 743968 - RNA, 22 nt, Human
gagaagaaacugcaaaaaaccc

SEQ ID NO: 743969 - RNA, 20 nt, Human
gcaaugcagggggcacugga

SEQ ID NO: 743970 - RNA, 22 nt, Human
ggaaaagcaaaauuaaaacuga

SEQ ID NO: 743971 - RNA, 21 nt, Human
ggacaaaaguggcaaugagga

SEQ ID NO: 743972 - RNA, 20 nt, Human
ggccuggggaaugaaaaaaa

SEQ ID NO: 743973 - RNA, 21 nt, Human
guagauaucagcccugguacu

SEQ ID NO: 743974 - RNA, 20 nt, Human
uaaagcaaaguccacagauu

SEQ ID NO: 743975 - RNA, 23 nt, Human
uaacaucacgggugcuggcucca

SEQ ID NO: 743976 - RNA, 18 nt, Human
uacagugguguacucuuu

SEQ ID NO: 743977 - RNA, 24 nt, Human
uacaucuguauuacaaggagcagc

SEQ ID NO: 743978 - RNA, 20 nt, Human
uaccugucuucauuguggag

SEQ ID NO: 743979 - RNA, 21 nt, Human
uacuuuuuaaaaggaaaagca

SEQ ID NO: 743980 - RNA, 19 nt, Human
uagggaaacauaaggacaa

SEQ ID NO: 743981 - RNA, 18 nt, Human
uaguggcuucuucuccuc

SEQ ID NO: 743982 - RNA, 21 nt, Human
uauaaaggaaaagcaaaauua

SEQ ID NO: 743983 - RNA, 25 nt, Human
uauaaaggaaaagcaaaauuaaaac

SEQ ID NO: 743984 - RNA, 27 nt, Human
ucacagcaggucaugggacaaaccugu

SEQ ID NO: 743985 - RNA, 24 nt, Human
ucaccaauuaagguauuuggcaga

SEQ ID NO: 743986 - RNA, 20 nt, Human
ucacucaaucagacagguaa

SEQ ID NO: 743987 - RNA, 21 nt, Human
uccaagaagccuuuaaaaaga

SEQ ID NO: 743988 - RNA, 21 nt, Human
uccacagauggaagagucugg

SEQ ID NO: 743989 - RNA, 23 nt, Human
uccacagauggaagagucuggaa

SEQ ID NO: 743990 - RNA, 25 nt, Human
uccacagauggaagagucuggaaaa

SEQ ID NO: 743991 - RNA, 19 nt, Human
uccagucccauucacugca

SEQ ID NO: 743992 - RNA, 21 nt, Human
ucccuagcgauagcucagccc

SEQ ID NO: 743993 - RNA, 27 nt, Human
uccgaaagcuucucaggccuucccggg

SEQ ID NO: 743994 - RNA, 20 nt, Human
uccuggguccauagaguugg

SEQ ID NO: 743995 - RNA, 23 nt, Human
ucgcacccuucucuacuggggaa

SEQ ID NO: 743996 - RNA, 19 nt, Human
ucucaguuucguuuaacag

SEQ ID NO: 743997 - RNA, 24 nt, Human
ucucuuaaagcaaaguccacagau

SEQ ID NO: 743998 - RNA, 23 nt, Human
ucugguaucaauucugcacccug

SEQ ID NO: 743999 - RNA, 24 nt, Human
ucugguaucaauucugcacccuga

SEQ ID NO: 744000 - RNA, 24 nt, Human
ucuuacagugguguacucuuugcc

SEQ ID NO: 744001 - RNA, 23 nt, Human
ugaaaaaaaaauaacaagccucg

SEQ ID NO: 744002 - RNA, 21 nt, Human
ugacuuguagauaucagcccu

SEQ ID NO: 744003 - RNA, 19 nt, Human
ugagaagaaacugcaaaaa

SEQ ID NO: 744004 - RNA, 24 nt, Human
ugagaagaaacugcaaaaaaccca

SEQ ID NO: 744005 - RNA, 25 nt, Human
ugagaagaaacugcaaaaaacccac

SEQ ID NO: 744006 - RNA, 24 nt, Human
ugagaagaacuaacaucacgggug

SEQ ID NO: 744007 - RNA, 22 nt, Human
ugccuuagaaaaacaagacaag

SEQ ID NO: 744008 - RNA, 20 nt, Human
ugcuuccgaaagcuucucag

SEQ ID NO: 744009 - RNA, 22 nt, Human
uggaaaaaaacccagcgggccg

SEQ ID NO: 744010 - RNA, 25 nt, Human
uggaaaaaaacccagcgggccgguu

SEQ ID NO: 744011 - RNA, 24 nt, Human
uggaaaaaaacccagcgggccguu

SEQ ID NO: 744012 - RNA, 21 nt, Human
uggaaacaaacaaaaaaagcu

SEQ ID NO: 744013 - RNA, 23 nt, Human
uggaaauaggccuggggaauggu

SEQ ID NO: 744014 - RNA, 18 nt, Human
uggaacaugacaaaugua

SEQ ID NO: 744015 - RNA, 27 nt, Human
uggcaaugaggacuaaaccagaaagaa

SEQ ID NO: 744016 - RNA, 22 nt, Human
uggcuccaaagcuccuguuuau

SEQ ID NO: 744017 - RNA, 26 nt, Human
uggguccauagaguuggucggaugac

SEQ ID NO: 744018 - RNA, 18 nt, Human
uggugggguuccaggaau

SEQ ID NO: 744019 - RNA, 24 nt, Human
uguuccuuaaccucuucucuccca

SEQ ID NO: 744020 - RNA, 24 nt, Human
uuaaccuuuuacaaucucccucua

SEQ ID NO: 744021 - RNA, 20 nt, Human
uuagaaaaacaagacaagau

SEQ ID NO: 744022 - RNA, 24 nt, Human
uuauuccagccaucuccaugaaag

SEQ ID NO: 744023 - RNA, 20 nt, Human
uuccuuaaccucuucucuuc

SEQ ID NO: 744024 - RNA, 21 nt, Human
uucugcacccugauguuucuc

SEQ ID NO: 744025 - RNA, 22 nt, Human
uuggaacaugacaaauguaaug

SEQ ID NO: 744026 - RNA, 26 nt, Human
uugguacuugagcaagaaccaugaca

SEQ ID NO: 744027 - RNA, 23 nt, Human
uuugcaugagaagaacuaacauc

SEQ ID NO: 744028 - RNA, 20 nt, Human
aaaaaaaaaaaaugggaaaa

SEQ ID NO: 744029 - RNA, 21 nt, Human
aaaaaaaacagccaacagcug

SEQ ID NO: 744030 - RNA, 22 nt, Human
aaaaaauauucaaaagacacca

SEQ ID NO: 744031 - RNA, 18 nt, Human
aaaagcagccccauccau

SEQ ID NO: 744032 - RNA, 23 nt, Human
aaaaugaacaggcaaaccaaaca

SEQ ID NO: 744033 - RNA, 26 nt, Human
aaacaaaugauggcuuauccacacaa

SEQ ID NO: 744034 - RNA, 22 nt, Human
aaacaggcaaaaggcacgaaca

SEQ ID NO: 744035 - RNA, 24 nt, Human
aaagaacuugagucaacaauaagc

SEQ ID NO: 744036 - RNA, 24 nt, Human
aaaggcacgaacagacacaucaca

SEQ ID NO: 744037 - RNA, 21 nt, Human
aaagugcugggauuauacagg

SEQ ID NO: 744038 - RNA, 26 nt, Human
aaagugcugggauuauacaggcauga

SEQ ID NO: 744039 - RNA, 20 nt, Human
aaaguuguuuuuugagacag

SEQ ID NO: 744040 - RNA, 19 nt, Human
aaauuuuaagagacugaca

SEQ ID NO: 744041 - RNA, 22 nt, Human
aacaaaaaaaaacagccaacag

SEQ ID NO: 744042 - RNA, 22 nt, Human
aacaaaacggaagcccuuccaa

SEQ ID NO: 744043 - RNA, 21 nt, Human
aacaaacaacaaaaaaaaaca

SEQ ID NO: 744044 - RNA, 22 nt, Human
aaccacaugaauccuaauucca

SEQ ID NO: 744045 - RNA, 20 nt, Human
aaccuccaccucccaggcuc

SEQ ID NO: 744046 - RNA, 21 nt, Human
aacuacugaaacacaaaacag

SEQ ID NO: 744047 - RNA, 19 nt, Human
aacuucuaaguaggagcag

SEQ ID NO: 744048 - RNA, 22 nt, Human
aagcagaugaaaucauagacau

SEQ ID NO: 744049 - RNA, 18 nt, Human
aagcaucccaacuuaaaa

SEQ ID NO: 744050 - RNA, 22 nt, Human
aagcaucccaacuuaaaaacag

SEQ ID NO: 744051 - RNA, 24 nt, Human
aagcgauccgcccgccucggccuc

SEQ ID NO: 744052 - RNA, 25 nt, Human
aaguaaauauaguaauagcaguaau

SEQ ID NO: 744053 - RNA, 21 nt, Human
aagugcugggauuauacaggc

SEQ ID NO: 744054 - RNA, 21 nt, Human
acaaaagacgacacggaaaag

SEQ ID NO: 744055 - RNA, 18 nt, Human
acaaagcaagagagaugc

SEQ ID NO: 744056 - RNA, 18 nt, Human
acaccauuaagaaaauga

SEQ ID NO: 744057 - RNA, 19 nt, Human
acagacacaucacaaaaga

SEQ ID NO: 744058 - RNA, 22 nt, Human
acagaugacaugauuaucuaca

SEQ ID NO: 744059 - RNA, 20 nt, Human
acagcaggcacccccucacc

SEQ ID NO: 744060 - RNA, 26 nt, Human
acaggcaaaaggcacgaacagacaca

SEQ ID NO: 744061 - RNA, 19 nt, Human
acaggcgccugccaccacg

SEQ ID NO: 744062 - RNA, 20 nt, Human
acccuauuuucuucuucagc

SEQ ID NO: 744063 - RNA, 20 nt, Human
acgaaaaugcaaaggaucua

SEQ ID NO: 744064 - RNA, 20 nt, Human
acgaacagacacaucacaaa

SEQ ID NO: 744065 - RNA, 19 nt, Human
acugaaacacaaaacagcu

SEQ ID NO: 744066 - RNA, 18 nt, Human
acuguuccagcugagcca

SEQ ID NO: 744067 - RNA, 25 nt, Human
agaaaaaaauuauaucguuacaaaa

SEQ ID NO: 744068 - RNA, 22 nt, Human
agaaauuaacagaucuaaauaa

SEQ ID NO: 744069 - RNA, 20 nt, Human
agaacucaaaauauggccuc

SEQ ID NO: 744070 - RNA, 25 nt, Human
agagacccuucaacaagaacaaagg

SEQ ID NO: 744071 - RNA, 23 nt, Human
agcugaggagaagggcugagccc

SEQ ID NO: 744072 - RNA, 20 nt, Human
aggcaaaaggcacgaacaga

SEQ ID NO: 744073 - RNA, 21 nt, Human
aggccuggaguuccuccucag

SEQ ID NO: 744074 - RNA, 18 nt, Human
agggaagaugaagcaguc

SEQ ID NO: 744075 - RNA, 21 nt, Human
aggugguggugguuacacagg

SEQ ID NO: 744076 - RNA, 21 nt, Human
agugcugggauuauacaggcc

SEQ ID NO: 744077 - RNA, 24 nt, Human
auagugacagagauagucuaucac

SEQ ID NO: 744078 - RNA, 19 nt, Human
aucaaucagauaugaucac

SEQ ID NO: 744079 - RNA, 22 nt, Human
augagucuaaaaacaugccaaa

SEQ ID NO: 744080 - RNA, 18 nt, Human
auggaaagaacuugaguc

SEQ ID NO: 744081 - RNA, 24 nt, Human
augggguuucaccaccccggccag

SEQ ID NO: 744082 - RNA, 21 nt, Human
auucuccugccucagccuccc

SEQ ID NO: 744083 - RNA, 23 nt, Human
caaaacggaagcccuuccaauac

SEQ ID NO: 744084 - RNA, 26 nt, Human
caaaaugaacaaacaacaaaaaaaaa

SEQ ID NO: 744085 - RNA, 21 nt, Human
caaaggaucuagaagucaaaa

SEQ ID NO: 744086 - RNA, 19 nt, Human
caacaagaacaaaggcgag

SEQ ID NO: 744087 - RNA, 23 nt, Human
caacauugaggacuauuccuuau

SEQ ID NO: 744088 - RNA, 20 nt, Human
caacuuaaaaacaggcaaaa

SEQ ID NO: 744089 - RNA, 25 nt, Human
caacuuaaaaacaggcaaaaggcac

SEQ ID NO: 744090 - RNA, 25 nt, Human
caagagcucaguucaaccucagaac

SEQ ID NO: 744091 - RNA, 22 nt, Human
caagcaauucuccugccucagc

SEQ ID NO: 744092 - RNA, 19 nt, Human
cacaauggaauacuauuca

SEQ ID NO: 744093 - RNA, 21 nt, Human
caccaccccggccaggcuggu

SEQ ID NO: 744094 - RNA, 24 nt, Human
caccaccccggccaggcuggucuu

SEQ ID NO: 744095 - RNA, 20 nt, Human
caccccggccaggcuggucu

SEQ ID NO: 744096 - RNA, 19 nt, Human
cacgaacagacacaucaca

SEQ ID NO: 744097 - RNA, 22 nt, Human
cacgaacagacacaucacaaaa

SEQ ID NO: 744098 - RNA, 18 nt, Human
cagaauauggaaagaacu

SEQ ID NO: 744099 - RNA, 24 nt, Human
cagacaaguaaguaaagaccuucu

SEQ ID NO: 744100 - RNA, 20 nt, Human
cagcaaggagaacuacugaa

SEQ ID NO: 744101 - RNA, 23 nt, Human
caggcgccugccaccacgccugg

SEQ ID NO: 744102 - RNA, 26 nt, Human
ccaaagugcugggauuauacaggcau

SEQ ID NO: 744103 - RNA, 21 nt, Human
ccaaauguugacacccucauc

SEQ ID NO: 744104 - RNA, 19 nt, Human
ccaauaccugaguucaacu

SEQ ID NO: 744105 - RNA, 22 nt, Human
ccacagcaggcacccccucacc

SEQ ID NO: 744106 - RNA, 19 nt, Human
ccacgggccuggccugaag

SEQ ID NO: 744107 - RNA, 19 nt, Human
cccgagcagcugggauucu

SEQ ID NO: 744108 - RNA, 21 nt, Human
ccuacuguuccagcucagagu

SEQ ID NO: 744109 - RNA, 19 nt, Human
ccuagguacuuacccaaga

SEQ ID NO: 744110 - RNA, 24 nt, Human
ccucccaggcucaagcaauucucc

SEQ ID NO: 744111 - RNA, 20 nt, Human
ccuccuguccccacuguucc

SEQ ID NO: 744112 - RNA, 18 nt, Human
ccugaccucaagcgaucc

SEQ ID NO: 744113 - RNA, 22 nt, Human
ccugaccucaagcgauccgccc

SEQ ID NO: 744114 - RNA, 22 nt, Human
ccugagggcacauacuuaacuc

SEQ ID NO: 744115 - RNA, 24 nt, Human
ccugccucagccucccgagcagcu

SEQ ID NO: 744116 - RNA, 21 nt, Human
ccuuaccacuugcaauagcau

SEQ ID NO: 744117 - RNA, 22 nt, Human
cgaacagacacaucacaaaaga

SEQ ID NO: 744118 - RNA, 24 nt, Human
cgccucggccucccaaagugcugg

SEQ ID NO: 744119 - RNA, 24 nt, Human
cggccaggcuggucuugaacuccu

SEQ ID NO: 744120 - RNA, 24 nt, Human
cucaagcaauucuccugccucagc

SEQ ID NO: 744121 - RNA, 27 nt, Human
cucacaaaauucugacauguccaaauc

SEQ ID NO: 744122 - RNA, 22 nt, Human
cucacugaaaccuccaccuccc

SEQ ID NO: 744123 - RNA, 23 nt, Human
cucacugaaaccuccaccuccca

SEQ ID NO: 744124 - RNA, 24 nt, Human
cucacugaaaccuccaccucccag

SEQ ID NO: 744125 - RNA, 25 nt, Human
cucccaggcucaagcaauucuccug

SEQ ID NO: 744126 - RNA, 26 nt, Human
cuccugaccucaagcgauccgcccgc

SEQ ID NO: 744127 - RNA, 28 nt, Human
cucugugccacagcaggcacccccuccu

SEQ ID NO: 744128 - RNA, 24 nt, Human
cucuugguugcccaggcuagagug

SEQ ID NO: 744129 - RNA, 20 nt, Human
cuguaaggccuucccagcuc

SEQ ID NO: 744130 - RNA, 22 nt, Human
cugugcuccuucacaccugagg

SEQ ID NO: 744131 - RNA, 22 nt, Human
cuucaacuuaacacaucaaaau

SEQ ID NO: 744132 - RNA, 21 nt, Human
cuugaaccaugauucagaguu

SEQ ID NO: 744133 - RNA, 23 nt, Human
cuugagucaacaauaagcauccc

SEQ ID NO: 744134 - RNA, 20 nt, Human
gaaaggacaaagcaagagag

SEQ ID NO: 744135 - RNA, 21 nt, Human
gaacaaacaacaaaaaaaaac

SEQ ID NO: 744136 - RNA, 20 nt, Human
gaagggcugagccgaguagg

SEQ ID NO: 744137 - RNA, 19 nt, Human
gacaguagcagggcugaga

SEQ ID NO: 744138 - RNA, 23 nt, Human
gacccaacaugcugcuacccaca

SEQ ID NO: 744139 - RNA, 24 nt, Human
gaccucaagcgauccgcccgccuc

SEQ ID NO: 744140 - RNA, 20 nt, Human
gagaugccaauuacacauag

SEQ ID NO: 744141 - RNA, 24 nt, Human
gagaugggguuucaccaccccggc

SEQ ID NO: 744142 - RNA, 22 nt, Human
gauagaaagugguuaucugggg

SEQ ID NO: 744143 - RNA, 23 nt, Human
gaucuccgucuuccccacuacac

SEQ ID NO: 744144 - RNA, 19 nt, Human
gcaaaccaaacaugaaaau

SEQ ID NO: 744145 - RNA, 23 nt, Human
gcaggcacccccucaccugugcu

SEQ ID NO: 744146 - RNA, 24 nt, Human
gcgauccgcccgccucggccuccc

SEQ ID NO: 744147 - RNA, 19 nt, Human
gcugaggagaagggcugag

SEQ ID NO: 744148 - RNA, 20 nt, Human
gcugauuuuccagaaaaugu

SEQ ID NO: 744149 - RNA, 23 nt, Human
gcuggucuugaacuccugaccuc

SEQ ID NO: 744150 - RNA, 20 nt, Human
ggcacauacuuaacucaccc

SEQ ID NO: 744151 - RNA, 24 nt, Human
ggcacgaacagacacaucacaaaa

SEQ ID NO: 744152 - RNA, 18 nt, Human
ggccuggaguuccuccuc

SEQ ID NO: 744153 - RNA, 24 nt, Human
ggcuggucuugaacuccugaccuc

SEQ ID NO: 744154 - RNA, 23 nt, Human
gggacagaaucacaaggggagag

SEQ ID NO: 744155 - RNA, 22 nt, Human
gggcugagccgaguagggcugc

SEQ ID NO: 744156 - RNA, 22 nt, Human
gggguuucaccaccccggccag

SEQ ID NO: 744157 - RNA, 18 nt, Human
gggucuuggggaggggac

SEQ ID NO: 744158 - RNA, 19 nt, Human
ggucuugaacuccugaccu

SEQ ID NO: 744159 - RNA, 22 nt, Human
guagcgcauugagacugugccu

SEQ ID NO: 744160 - RNA, 22 nt, Human
guggcacacaggagggcgugga

SEQ ID NO: 744161 - RNA, 21 nt, Human
guugcccaggcuagagugcaa

SEQ ID NO: 744162 - RNA, 20 nt, Human
uaaauugaucuauaaauccc

SEQ ID NO: 744163 - RNA, 19 nt, Human
uaacuagaaaacagcuuuu

SEQ ID NO: 744164 - RNA, 21 nt, Human
uaagagacugacaaugccaag

SEQ ID NO: 744165 - RNA, 19 nt, Human
uaaguuaacugaucuaagu

SEQ ID NO: 744166 - RNA, 23 nt, Human
uaauagcaguaaucacugagcca

SEQ ID NO: 744167 - RNA, 23 nt, Human
uacaaaaugaacaaacaacaaaa

SEQ ID NO: 744168 - RNA, 24 nt, Human
uacaaaaugaacaaacaacaaaaa

SEQ ID NO: 744169 - RNA, 22 nt, Human
uacaacacagcaauuaaagucc

SEQ ID NO: 744170 - RNA, 21 nt, Human
uacaggcaugagccacgggcc

SEQ ID NO: 744171 - RNA, 22 nt, Human
uacaggcgccugccaccacgcc

SEQ ID NO: 744172 - RNA, 21 nt, Human
uacccaagagaaauaaaaaca

SEQ ID NO: 744173 - RNA, 24 nt, Human
uacccaagagaaauaaaaacacau

SEQ ID NO: 744174 - RNA, 22 nt, Human
uaccucgccugcuuucgaacag

SEQ ID NO: 744175 - RNA, 23 nt, Human
uagcgcauugagacugugccuuu

SEQ ID NO: 744176 - RNA, 32 nt, Human
uagggcacacgaugggaggccuggaguucccc

SEQ ID NO: 744177 - RNA, 19 nt, Human
uaguagagaugggguuuca

SEQ ID NO: 744178 - RNA, 23 nt, Human
uaguagagaugggguuucaccac

SEQ ID NO: 744179 - RNA, 24 nt, Human
uaugaucacuguccucaggaaccc

SEQ ID NO: 744180 - RNA, 21 nt, Human
uauuacauguauguuuuucau

SEQ ID NO: 744181 - RNA, 21 nt, Human
ucacagcugaggagaagggcu

SEQ ID NO: 744182 - RNA, 21 nt, Human
ucacucuugguugcccaggcu

SEQ ID NO: 744183 - RNA, 24 nt, Human
ucacucuugguugcccaggcuaga

SEQ ID NO: 744184 - RNA, 24 nt, Human
ucacugaaaccuccaccucccagg

SEQ ID NO: 744185 - RNA, 18 nt, Human
ucagcaaggagaacuacu

SEQ ID NO: 744186 - RNA, 22 nt, Human
uccaagagguggaaaguguuuc

SEQ ID NO: 744187 - RNA, 18 nt, Human
ucccaaagugcugggauu

SEQ ID NO: 744188 - RNA, 26 nt, Human
ucccaaagugcugggauuauacaggc

SEQ ID NO: 744189 - RNA, 23 nt, Human
ucccagcucacugaaaccuccac

SEQ ID NO: 744190 - RNA, 21 nt, Human
ucccaggcucaagcaauucuc

SEQ ID NO: 744191 - RNA, 24 nt, Human
ucccaggcucaagcaauucuccug

SEQ ID NO: 744192 - RNA, 24 nt, Human
uccccacuguuccagcugagccag

SEQ ID NO: 744193 - RNA, 19 nt, Human
uccuagguacuuacccaag

SEQ ID NO: 744194 - RNA, 18 nt, Human
ucggccucccaaagugcu

SEQ ID NO: 744195 - RNA, 27 nt, Human
ucuacaggcgccugccaccacgccugg

SEQ ID NO: 744196 - RNA, 22 nt, Human
ucuacuuaaaaggaagcaggcc

SEQ ID NO: 744197 - RNA, 19 nt, Human
ucuccuggacccuauuuuc

SEQ ID NO: 744198 - RNA, 19 nt, Human
ucugcagauuccucuccug

SEQ ID NO: 744199 - RNA, 18 nt, Human
ucugccccucauccugac

SEQ ID NO: 744200 - RNA, 18 nt, Human
ucuggggcuggagugggc

SEQ ID NO: 744201 - RNA, 24 nt, Human
ucuuccgcauuuuuaguagagaug

SEQ ID NO: 744202 - RNA, 21 nt, Human
ucuucuguaaggccuucccag

SEQ ID NO: 744203 - RNA, 21 nt, Human
ucuugaacuccugaccucaag

SEQ ID NO: 744204 - RNA, 19 nt, Human
ugaaaccuccaccucccag

SEQ ID NO: 744205 - RNA, 23 nt, Human
ugaaaugacacaaugagccagag

SEQ ID NO: 744206 - RNA, 24 nt, Human
ugaaauucagagguaaagacuaac

SEQ ID NO: 744207 - RNA, 22 nt, Human
ugaacaaacaacaaaaaaaaac

SEQ ID NO: 744208 - RNA, 22 nt, Human
ugaacaggcaaaccaaacauga

SEQ ID NO: 744209 - RNA, 26 nt, Human
ugaauaaacaaaugauggcuuaucca

SEQ ID NO: 744210 - RNA, 24 nt, Human
ugacaauuucuuaggaaguuagaa

SEQ ID NO: 744211 - RNA, 18 nt, Human
ugaccucaagcgauccgc

SEQ ID NO: 744212 - RNA, 22 nt, Human
ugagacagaaagauacagacaa

SEQ ID NO: 744213 - RNA, 18 nt, Human
ugaggagaagggcugagc

SEQ ID NO: 744214 - RNA, 19 nt, Human
ugagggaaacacccauuga

SEQ ID NO: 744215 - RNA, 21 nt, Human
ugagggcacauacuuaacuca

SEQ ID NO: 744216 - RNA, 25 nt, Human
ugagucaacaauaagcaucccaacu

SEQ ID NO: 744217 - RNA, 24 nt, Human
ugauacaaaaugaacaaacaacaa

SEQ ID NO: 744218 - RNA, 20 nt, Human
ugauaugagguggggucuug

SEQ ID NO: 744219 - RNA, 22 nt, Human
ugaucacuguccucaggaaccc

SEQ ID NO: 744220 - RNA, 23 nt, Human
ugccacagcaggcacccccucac

SEQ ID NO: 744221 - RNA, 22 nt, Human
ugcccaggcuagagugcaaugc

SEQ ID NO: 744222 - RNA, 24 nt, Human
ugccucagccucccgagcagcugg

SEQ ID NO: 744223 - RNA, 24 nt, Human
uggaaaacucagaauuguuaaaau

SEQ ID NO: 744224 - RNA, 19 nt, Human
uggaaaguguuuccucugc

SEQ ID NO: 744225 - RNA, 22 nt, Human
uggacucugcuuaacuggggau

SEQ ID NO: 744226 - RNA, 21 nt, Human
uggaugaauaaacaaaugaug

SEQ ID NO: 744227 - RNA, 18 nt, Human
uggcuaacucuuccgcau

SEQ ID NO: 744228 - RNA, 22 nt, Human
uggcuuaauaaaaaauauucaa

SEQ ID NO: 744229 - RNA, 22 nt, Human
ugggaggccuggaguuccuccu

SEQ ID NO: 744230 - RNA, 24 nt, Human
ugggauuauacaggcaugagccac

SEQ ID NO: 744231 - RNA, 18 nt, Human
uggggaggggacagaauc

SEQ ID NO: 744232 - RNA, 24 nt, Human
ugggguuucaccaccccggccagg

SEQ ID NO: 744233 - RNA, 18 nt, Human
ugguuacacagguggugg

SEQ ID NO: 744234 - RNA, 20 nt, Human
uguaaggccuucccagcucu

SEQ ID NO: 744235 - RNA, 24 nt, Human
uguaaggccuucccagcucugugc

SEQ ID NO: 744236 - RNA, 21 nt, Human
ugucaccucuucuguaaggcc

SEQ ID NO: 744237 - RNA, 22 nt, Human
uguccacuguccauuuaccucg

SEQ ID NO: 744238 - RNA, 21 nt, Human
ugugagagcugcaaacugaga

SEQ ID NO: 744239 - RNA, 24 nt, Human
uuaaaaacaggcaaaaggcacgaa

SEQ ID NO: 744240 - RNA, 19 nt, Human
uuagauacacaguugugcu

SEQ ID NO: 744241 - RNA, 18 nt, Human
uuaguagagaugggguuu

SEQ ID NO: 744242 - RNA, 22 nt, Human
uuaguagagaugggguuucacc

SEQ ID NO: 744243 - RNA, 23 nt, Human
uuaguagagaugggguuucacca

SEQ ID NO: 744244 - RNA, 18 nt, Human
uucagagguaaagacuaa

SEQ ID NO: 744245 - RNA, 18 nt, Human
uuccacgcauuuccaaac

SEQ ID NO: 744246 - RNA, 23 nt, Human
uucuuuguggcuccacuuuuaac

SEQ ID NO: 744247 - RNA, 20 nt, Human
uuuccaaacaucacucacug

SEQ ID NO: 744248 - RNA, 24 nt, Human
uuuuuaguagagaugggguuucac

SEQ ID NO: 744249 - RNA, 21 nt, Human
aaaaacaacaaaucuuguccc

SEQ ID NO: 744250 - RNA, 21 nt, Human
aaaaagaaaccucaaaagccu

SEQ ID NO: 744251 - RNA, 19 nt, Human
aaacaccaccauuacaaaa

SEQ ID NO: 744252 - RNA, 24 nt, Human
aaacauagcucaguaauucucaga

SEQ ID NO: 744253 - RNA, 19 nt, Human
aaacuagaccuguguucca

SEQ ID NO: 744254 - RNA, 18 nt, Human
aaacuccucaccagacac

SEQ ID NO: 744255 - RNA, 22 nt, Human
aaagaaaacacaacauguuccu

SEQ ID NO: 744256 - RNA, 23 nt, Human
aacaagcaaauauuuuacuagga

SEQ ID NO: 744257 - RNA, 24 nt, Human
aacccuccgcuugcagaucuccau

SEQ ID NO: 744258 - RNA, 20 nt, Human
aacugcuuggcuaucuugac

SEQ ID NO: 744259 - RNA, 21 nt, Human
aagaaaacacaacauguuccu

SEQ ID NO: 744260 - RNA, 21 nt, Human
aagaaaccucaaaagccucaa

SEQ ID NO: 744261 - RNA, 21 nt, Human
aagaaacuccaaauacuuuga

SEQ ID NO: 744262 - RNA, 18 nt, Human
aagcaagguagcaacgca

SEQ ID NO: 744263 - RNA, 21 nt, Human
aagcagaaauacuaacauuac

SEQ ID NO: 744264 - RNA, 20 nt, Human
aagcaggcucagaauggcca

SEQ ID NO: 744265 - RNA, 21 nt, Human
aaggugagucauugucacaaa

SEQ ID NO: 744266 - RNA, 19 nt, Human
aaugcagucaacacugaga

SEQ ID NO: 744267 - RNA, 22 nt, Human
acacaccugugcaaaacaauuc

SEQ ID NO: 744268 - RNA, 24 nt, Human
acaucugaauuagccagagaaaga

SEQ ID NO: 744269 - RNA, 25 nt, Human
accaccaccaccauguaauaauaac

SEQ ID NO: 744270 - RNA, 19 nt, Human
acugcagaagaugggcauc

SEQ ID NO: 744271 - RNA, 19 nt, Human
agaaauuucaagaggguaa

SEQ ID NO: 744272 - RNA, 21 nt, Human
agaacuggaagcuagaacacu

SEQ ID NO: 744273 - RNA, 18 nt, Human
agaacuguuugaaaugga

SEQ ID NO: 744274 - RNA, 20 nt, Human
agagaaagaguagcagcugc

SEQ ID NO: 744275 - RNA, 23 nt, Human
agaggacuuaaagccuuaagcug

SEQ ID NO: 744276 - RNA, 25 nt, Human
agaggacuuaaagccuuaagcuggu

SEQ ID NO: 744277 - RNA, 24 nt, Human
agccuuguguuugugaaauauaac

SEQ ID NO: 744278 - RNA, 22 nt, Human
agcugccuuuuaaacacuacuu

SEQ ID NO: 744279 - RNA, 21 nt, Human
aggaagaaagggaaggaagag

SEQ ID NO: 744280 - RNA, 23 nt, Human
aggaagaaguuggaaaugccaag

SEQ ID NO: 744281 - RNA, 18 nt, Human
aggaagcaggcucgggcc

SEQ ID NO: 744282 - RNA, 19 nt, Human
aggaauuccauugcaauau

SEQ ID NO: 744283 - RNA, 21 nt, Human
aggaggaucucuccauagccc

SEQ ID NO: 744284 - RNA, 26 nt, Human
agggagaaagcaaaaaaaggggaccc

SEQ ID NO: 744285 - RNA, 22 nt, Human
auaacacuggaggaucacauac

SEQ ID NO: 744286 - RNA, 21 nt, Human
auauucuucaccagcuaagaa

SEQ ID NO: 744287 - RNA, 24 nt, Human
augggaaaaggaaaaaaaaauuca

SEQ ID NO: 744288 - RNA, 24 nt, Human
augugcaggaaggacugccacaug

SEQ ID NO: 744289 - RNA, 21 nt, Human
caaaaaaagggagaaagcaaa

SEQ ID NO: 744290 - RNA, 22 nt, Human
caaaaacaacaaaucuuguccc

SEQ ID NO: 744291 - RNA, 25 nt, Human
caaaacuucuaaaauauuuuuaaau

SEQ ID NO: 744292 - RNA, 18 nt, Human
caaaagccucaaugacuc

SEQ ID NO: 744293 - RNA, 23 nt, Human
caaaagccucaaugacucaacag

SEQ ID NO: 744294 - RNA, 24 nt, Human
caaaaugguaacccaagaauaauu

SEQ ID NO: 744295 - RNA, 21 nt, Human
caaaauuacugucacaaaaau

SEQ ID NO: 744296 - RNA, 20 nt, Human
caaacaaaucacauaaaaca

SEQ ID NO: 744297 - RNA, 23 nt, Human
caaacaaaucacauaaaacagaa

SEQ ID NO: 744298 - RNA, 21 nt, Human
caacaaugcagucaacacuga

SEQ ID NO: 744299 - RNA, 18 nt, Human
caagcugaauugaaacca

SEQ ID NO: 744300 - RNA, 22 nt, Human
cacaagaaauguucuuaucugg

SEQ ID NO: 744301 - RNA, 19 nt, Human
cacacugaaaaacuccuca

SEQ ID NO: 744302 - RNA, 27 nt, Human
cacacugaaaaacuccucaccagacac

SEQ ID NO: 744303 - RNA, 18 nt, Human
cacagcuugaagggcccc

SEQ ID NO: 744304 - RNA, 24 nt, Human
cacauaaaacagaagggagagaug

SEQ ID NO: 744305 - RNA, 18 nt, Human
caccacaaaacuucuccu

SEQ ID NO: 744306 - RNA, 24 nt, Human
caccagacacaccugugcaaaaca

SEQ ID NO: 744307 - RNA, 18 nt, Human
caccagcggcaccacaaa

SEQ ID NO: 744308 - RNA, 23 nt, Human
caccaggauaaagaggccauccc

SEQ ID NO: 744309 - RNA, 25 nt, Human
cacugaaaaacuccucaccagacac

SEQ ID NO: 744310 - RNA, 21 nt, Human
cagaaccaguccuaaaauuau

SEQ ID NO: 744311 - RNA, 19 nt, Human
cagaacuguuugaaaugga

SEQ ID NO: 744312 - RNA, 25 nt, Human
cagcagaugauggguacaaagcuga

SEQ ID NO: 744313 - RNA, 21 nt, Human
cagcccagugaccacauauca

SEQ ID NO: 744314 - RNA, 21 nt, Human
cagcuccucgguguucaaccu

SEQ ID NO: 744315 - RNA, 22 nt, Human
caggaauguccccauccccagu

SEQ ID NO: 744316 - RNA, 22 nt, Human
caggcugcaaggaaacacccug

SEQ ID NO: 744317 - RNA, 23 nt, Human
caucucaacuagugaauuuuugc

SEQ ID NO: 744318 - RNA, 23 nt, Human
caucuccauccugcaccuccuug

SEQ ID NO: 744319 - RNA, 19 nt, Human
caugauuccuccucccuca

SEQ ID NO: 744320 - RNA, 23 nt, Human
cauuaaaacaaaacugaaacucu

SEQ ID NO: 744321 - RNA, 21 nt, Human
ccaguaccuucuacuugaccc

SEQ ID NO: 744322 - RNA, 27 nt, Human
cccaaacaaaucacauaaaaggaguuc

SEQ ID NO: 744323 - RNA, 21 nt, Human
cccaauauuaagaacgcaggg

SEQ ID NO: 744324 - RNA, 19 nt, Human
cccccagagaaaaaccuuc

SEQ ID NO: 744325 - RNA, 21 nt, Human
cccuccgcuugcagaucucca

SEQ ID NO: 744326 - RNA, 23 nt, Human
ccggcacugagaagauauucagc

SEQ ID NO: 744327 - RNA, 18 nt, Human
ccucgguguucaaccugg

SEQ ID NO: 744328 - RNA, 24 nt, Human
ccugaccagcaaucacaauaacac

SEQ ID NO: 744329 - RNA, 26 nt, Human
ccuucuaucagcauuuuuccugaccc

SEQ ID NO: 744330 - RNA, 21 nt, Human
cuacacagaaccaguccuaaa

SEQ ID NO: 744331 - RNA, 22 nt, Human
cuaggaaugucaacuaugugca

SEQ ID NO: 744332 - RNA, 22 nt, Human
cuccaaauacuuugacagcucc

SEQ ID NO: 744333 - RNA, 19 nt, Human
cuccaggaacuggugcagc

SEQ ID NO: 744334 - RNA, 24 nt, Human
cucuccauagcccaauauuaagaa

SEQ ID NO: 744335 - RNA, 19 nt, Human
cucuucggucugccuucuc

SEQ ID NO: 744336 - RNA, 27 nt, Human
cugcugggcaacuccaggaacuggugc

SEQ ID NO: 744337 - RNA, 19 nt, Human
cuugacccagauccaugca

SEQ ID NO: 744338 - RNA, 20 nt, Human
gaaaaggaaaaaaaaauuca

SEQ ID NO: 744339 - RNA, 25 nt, Human
gaaaauaauagguaacacuaauagc

SEQ ID NO: 744340 - RNA, 23 nt, Human
gaaaauacugaaaauacaagcua

SEQ ID NO: 744341 - RNA, 18 nt, Human
gaaaggaagaaguuggaa

SEQ ID NO: 744342 - RNA, 22 nt, Human
gaggaagaaagggaaggaagag

SEQ ID NO: 744343 - RNA, 19 nt, Human
gcaccaggauaaagaggcc

SEQ ID NO: 744344 - RNA, 25 nt, Human
gcagcagaugauggguacaaagcug

SEQ ID NO: 744345 - RNA, 21 nt, Human
gcagcugcugcaguagaacug

SEQ ID NO: 744346 - RNA, 24 nt, Human
gcugagaguacaaggacaauuuca

SEQ ID NO: 744347 - RNA, 24 nt, Human
ggcaauaaguggguucaaaaagaa

SEQ ID NO: 744348 - RNA, 18 nt, Human
ggccaggagaagguagcc

SEQ ID NO: 744349 - RNA, 23 nt, Human
ggguaauucucuuaucugcauca

SEQ ID NO: 744350 - RNA, 20 nt, Human
guauuucagcugagcacuga

SEQ ID NO: 744351 - RNA, 23 nt, Human
gugcaaaacaauuccaagggucu

SEQ ID NO: 744352 - RNA, 24 nt, Human
guuaaaaaaaaaaaaaaucaaaau

SEQ ID NO: 744353 - RNA, 23 nt, Human
uaaaaaauaaagaaaacacaaca

SEQ ID NO: 744354 - RNA, 18 nt, Human
uaaaacaaaacugaaacu

SEQ ID NO: 744355 - RNA, 19 nt, Human
uaaaacaaaacugaaacuc

SEQ ID NO: 744356 - RNA, 23 nt, Human
uaaaagaaagcgcacaaccaaaa

SEQ ID NO: 744357 - RNA, 23 nt, Human
uaaacucuauuaaccacuacauu

SEQ ID NO: 744358 - RNA, 22 nt, Human
uaaaggagaaaagcugcuguuu

SEQ ID NO: 744359 - RNA, 24 nt, Human
uaacaaacacaggagcaauugaga

SEQ ID NO: 744360 - RNA, 19 nt, Human
uaacaugauugcuaugugg

SEQ ID NO: 744361 - RNA, 25 nt, Human
uaaggcaagcucacuguaaacuccu

SEQ ID NO: 744362 - RNA, 23 nt, Human
uaagggaaggaggaagaaaggga

SEQ ID NO: 744363 - RNA, 21 nt, Human
uacaaagcugacugguaguuu

SEQ ID NO: 744364 - RNA, 24 nt, Human
uacacauuugauuacaaauaacau

SEQ ID NO: 744365 - RNA, 21 nt, Human
uaccaaaauuacugucacaaa

SEQ ID NO: 744366 - RNA, 21 nt, Human
uaccugccccaucuuggaagc

SEQ ID NO: 744367 - RNA, 22 nt, Human
uagaaacuagaccuguguucca

SEQ ID NO: 744368 - RNA, 19 nt, Human
uagcuucacaaaaugguaa

SEQ ID NO: 744369 - RNA, 23 nt, Human
uaucacacagcccagugaccaca

SEQ ID NO: 744370 - RNA, 24 nt, Human
uaucaguuaaaaaaaaaaaaaauc

SEQ ID NO: 744371 - RNA, 22 nt, Human
uauugagcugauugcugaagcu

SEQ ID NO: 744372 - RNA, 21 nt, Human
uauuuuacauacucccuaagu

SEQ ID NO: 744373 - RNA, 22 nt, Human
ucaaacuaugacuaauuaggca

SEQ ID NO: 744374 - RNA, 18 nt, Human
ucacaaaagcaggcucag

SEQ ID NO: 744375 - RNA, 24 nt, Human
ucacaauaacacaaaaugaaauaa

SEQ ID NO: 744376 - RNA, 24 nt, Human
ucagaacaaucucucuuccuuggu

SEQ ID NO: 744377 - RNA, 20 nt, Human
ucagcuggcaagccuugugu

SEQ ID NO: 744378 - RNA, 18 nt, Human
ucagugggccccugcaga

SEQ ID NO: 744379 - RNA, 22 nt, Human
ucaguuaaaaaaaaaaaaaauc

SEQ ID NO: 744380 - RNA, 24 nt, Human
uccaaaauggaaagggguagaggu

SEQ ID NO: 744381 - RNA, 18 nt, Human
uccacgggggcuugcugg

SEQ ID NO: 744382 - RNA, 24 nt, Human
uccccaguaccuucuacuugaccc

SEQ ID NO: 744383 - RNA, 18 nt, Human
ucccccagagaaaaaccu

SEQ ID NO: 744384 - RNA, 21 nt, Human
ucccccagagaaaaaccuucu

SEQ ID NO: 744385 - RNA, 18 nt, Human
uccuuuagaaacuagacc

SEQ ID NO: 744386 - RNA, 23 nt, Human
ucuccgcuucuucucucagggcc

SEQ ID NO: 744387 - RNA, 25 nt, Human
ucucucacauuaaguuaccagcaaa

SEQ ID NO: 744388 - RNA, 25 nt, Human
ucugccaacaugucuguucccucca

SEQ ID NO: 744389 - RNA, 18 nt, Human
ucugccuucucugccaac

SEQ ID NO: 744390 - RNA, 20 nt, Human
ugaagcaccaggauaaagag

SEQ ID NO: 744391 - RNA, 22 nt, Human
ugacaccaucucuaucuacaca

SEQ ID NO: 744392 - RNA, 22 nt, Human
ugacagaaauuauacaaacugc

SEQ ID NO: 744393 - RNA, 21 nt, Human
ugaccacauaucaauagcuuc

SEQ ID NO: 744394 - RNA, 19 nt, Human
ugaccaggcuccaugaaau

SEQ ID NO: 744395 - RNA, 18 nt, Human
ugacccagauccaugcag

SEQ ID NO: 744396 - RNA, 18 nt, Human
ugacccaggccagcugcu

SEQ ID NO: 744397 - RNA, 20 nt, Human
ugacuaagguaacaauacaa

SEQ ID NO: 744398 - RNA, 22 nt, Human
ugagacagguucccccagagaa

SEQ ID NO: 744399 - RNA, 20 nt, Human
ugagcugccuuuuaaacacu

SEQ ID NO: 744400 - RNA, 22 nt, Human
ugaggucaggucacugugaccc

SEQ ID NO: 744401 - RNA, 22 nt, Human
ugcaggcaaugccccugcucau

SEQ ID NO: 744402 - RNA, 21 nt, Human
ugccaguaucucauaauagac

SEQ ID NO: 744403 - RNA, 20 nt, Human
ugcugaaaacacaacucaau

SEQ ID NO: 744404 - RNA, 19 nt, Human
ugcuucagugggccccugc

SEQ ID NO: 744405 - RNA, 19 nt, Human
uggaaagggguagaggugg

SEQ ID NO: 744406 - RNA, 23 nt, Human
uggaauggaucugucugagugca

SEQ ID NO: 744407 - RNA, 24 nt, Human
uggaggacaauggaugagcaauca

SEQ ID NO: 744408 - RNA, 21 nt, Human
uggaguucuuauuccuggggu

SEQ ID NO: 744409 - RNA, 19 nt, Human
uggcaaaaaggagacacaa

SEQ ID NO: 744410 - RNA, 20 nt, Human
uggcaaaaaggagacacaaa

SEQ ID NO: 744411 - RNA, 21 nt, Human
uggcuaagaaauuucaagagg

SEQ ID NO: 744412 - RNA, 19 nt, Human
uggcuaagggcagucaagc

SEQ ID NO: 744413 - RNA, 18 nt, Human
ugggaaaaggaaaaaaaa

SEQ ID NO: 744414 - RNA, 20 nt, Human
ugguaagcaauacaacaggc

SEQ ID NO: 744415 - RNA, 22 nt, Human
ugguaagcaauacaacaggcuc

SEQ ID NO: 744416 - RNA, 22 nt, Human
uguaaaaccaaagacaaacauu

SEQ ID NO: 744417 - RNA, 22 nt, Human
ugucugagugcaaaucugggug

SEQ ID NO: 744418 - RNA, 21 nt, Human
ugugaaauauaacgaaucuga

SEQ ID NO: 744419 - RNA, 22 nt, Human
ugugcaaaacaauuccaagggu

SEQ ID NO: 744420 - RNA, 20 nt, Human
uguggaaaauccaaaaggug

SEQ ID NO: 744421 - RNA, 19 nt, Human
uuaaguuaccagcaaaugg

SEQ ID NO: 744422 - RNA, 23 nt, Human
uuagcaacaaacaaccauguaga

SEQ ID NO: 744423 - RNA, 19 nt, Human
uucagcugagcacugaaaa

SEQ ID NO: 744424 - RNA, 22 nt, Human
uuuagagggguaauucucuuau

SEQ ID NO: 744425 - RNA, 18 nt, Human
uuucaacuccuucuauca

SEQ ID NO: 744426 - RNA, 18 nt, Human
uuugcaaaaauaacaauu

SEQ ID NO: 744427 - RNA, 25 nt, Human
uuugguuuaaauacaauggagacau

SEQ ID NO: 744428 - RNA, 24 nt, Human
acugcaagaaguaccaguacgggg

SEQ ID NO: 744429 - RNA, 18 nt, Human
agguccuucgugggaggg

SEQ ID NO: 744430 - RNA, 19 nt, Human
caccagcucacuuguccug

SEQ ID NO: 744431 - RNA, 21 nt, Human
cacuguccuccuccguugcag

SEQ ID NO: 744432 - RNA, 19 nt, Human
cacuuggaccugcugggag

SEQ ID NO: 744433 - RNA, 21 nt, Human
cagcccccuugugguguguga

SEQ ID NO: 744434 - RNA, 20 nt, Human
cagcucacuuguccuggggc

SEQ ID NO: 744435 - RNA, 24 nt, Human
cagggaccagaugccccagccccc

SEQ ID NO: 744436 - RNA, 19 nt, Human
caucgucucacuguccucc

SEQ ID NO: 744437 - RNA, 21 nt, Human
ccacccccuuccugggagcag

SEQ ID NO: 744438 - RNA, 18 nt, Human
cccccaaucagcaccgug

SEQ ID NO: 744439 - RNA, 18 nt, Human
ccugugacacgcugcggc

SEQ ID NO: 744440 - RNA, 19 nt, Human
ccugugacacgcugcggcu

SEQ ID NO: 744441 - RNA, 20 nt, Human
ccugugacacgcugcggcug

SEQ ID NO: 744442 - RNA, 21 nt, Human
ccugugacacgcugcggcugu

SEQ ID NO: 744443 - RNA, 19 nt, Human
cgucucuucuuucagagca

SEQ ID NO: 744444 - RNA, 24 nt, Human
cgugaaggugacacgcaaaggugg

SEQ ID NO: 744445 - RNA, 22 nt, Human
cuggaagucccgugaaggugac

SEQ ID NO: 744446 - RNA, 21 nt, Human
cuggcucuucccccaggcagg

SEQ ID NO: 744447 - RNA, 21 nt, Human
cuggugcgcuccacccuggac

SEQ ID NO: 744448 - RNA, 19 nt, Human
cuugaucagguguuugcac

SEQ ID NO: 744449 - RNA, 22 nt, Human
gacauacagauguaaccucggu

SEQ ID NO: 744450 - RNA, 19 nt, Human
gagcagcgagcagugcccc

SEQ ID NO: 744451 - RNA, 21 nt, Human
gagcagcgagcagugccccag

SEQ ID NO: 744452 - RNA, 24 nt, Human
gcaugguggcagguccuucguggg

SEQ ID NO: 744453 - RNA, 18 nt, Human
gcucuggcugaggcuggu

SEQ ID NO: 744454 - RNA, 20 nt, Human
gcugcucuggcugaggcugg

SEQ ID NO: 744455 - RNA, 25 nt, Human
ggccuaguguguguccucaccaaca

SEQ ID NO: 744456 - RNA, 18 nt, Human
ggcugcucuggcugaggc

SEQ ID NO: 744457 - RNA, 22 nt, Human
ggcuguuccucagggccuggcu

SEQ ID NO: 744458 - RNA, 20 nt, Human
gggaggguugccacauaugu

SEQ ID NO: 744459 - RNA, 24 nt, Human
gggcuucaaccagcuucccuuccu

SEQ ID NO: 744460 - RNA, 24 nt, Human
gucguggcugcucuggcugaggcu

SEQ ID NO: 744461 - RNA, 25 nt, Human
uaaaaauaaaaucuuuaaaucucuc

SEQ ID NO: 744462 - RNA, 21 nt, Human
uaaaaucuuuaaaucucucga

SEQ ID NO: 744463 - RNA, 21 nt, Human
uagacauacagauguaaccuc

SEQ ID NO: 744464 - RNA, 22 nt, Human
ucaaggaaggguuucugaggug

SEQ ID NO: 744465 - RNA, 19 nt, Human
ucagagcaucggccuaugg

SEQ ID NO: 744466 - RNA, 18 nt, Human
ucagguagccaacccgcc

SEQ ID NO: 744467 - RNA, 20 nt, Human
ucagguagccaacccgcccg

SEQ ID NO: 744468 - RNA, 26 nt, Human
uccuccuucagcaucugccucucaaa

SEQ ID NO: 744469 - RNA, 18 nt, Human
uccuucagcaucugccuc

SEQ ID NO: 744470 - RNA, 19 nt, Human
ucgcagguuccugccuguc

SEQ ID NO: 744471 - RNA, 23 nt, Human
ucucacuguccuccuccguugca

SEQ ID NO: 744472 - RNA, 20 nt, Human
ucuccggccucgccauaauu

SEQ ID NO: 744473 - RNA, 22 nt, Human
ucucgagccccacgucucuucu

SEQ ID NO: 744474 - RNA, 24 nt, Human
ucucucgagccccacgucucuucu

SEQ ID NO: 744475 - RNA, 21 nt, Human
ugacaccagcucacuuguccu

SEQ ID NO: 744476 - RNA, 22 nt, Human
ugccccagcccccuuguggugu

SEQ ID NO: 744477 - RNA, 18 nt, Human
uggcuggagcugcacuug

SEQ ID NO: 744478 - RNA, 22 nt, Human
uguagagguugaaggccuucuu

SEQ ID NO: 744479 - RNA, 24 nt, Human
ugucaaggaaggguuucugaggug

SEQ ID NO: 744480 - RNA, 24 nt, Human
uguccuggggcucccacagagcac

SEQ ID NO: 744481 - RNA, 19 nt, Human
ugucguggcugcucuggcu

SEQ ID NO: 744482 - RNA, 20 nt, Human
ugucguggcugcucuggcug

SEQ ID NO: 744483 - RNA, 20 nt, Human
uguguccucaccaacaccuu

SEQ ID NO: 744484 - RNA, 19 nt, Human
uguuccagcugugcuccca

SEQ ID NO: 744485 - RNA, 24 nt, Human
uucagcaucugccucucaaacagg

SEQ ID NO: 744486 - RNA, 21 nt, Human
uugaaggccuucuucagguag

SEQ ID NO: 744487 - RNA, 21 nt, Human
uuugcucaucucuccguuccc

SEQ ID NO: 744488 - RNA, 24 nt, Human
uuuuuuuuuuuuuuucuugauugg

SEQ ID NO: 744489 - RNA, 26 nt, Human
uuuuuuuuuuuuuuuuuuucuugggg

SEQ ID NO: 744490 - RNA, 21 nt, Human
aaaagaucuuaaaucaguaag

SEQ ID NO: 744491 - RNA, 21 nt, Human
aaacacacagcaucauggagc

SEQ ID NO: 744492 - RNA, 23 nt, Human
aaagguccaaaaucagucuaagg

SEQ ID NO: 744493 - RNA, 23 nt, Human
aaccugccaacaagaaucguuua

SEQ ID NO: 744494 - RNA, 18 nt, Human
aagaaucguuuauuagca

SEQ ID NO: 744495 - RNA, 21 nt, Human
acacagcaucuucuccuuucc

SEQ ID NO: 744496 - RNA, 21 nt, Human
acagcggcggagcgcggcgga

SEQ ID NO: 744497 - RNA, 22 nt, Human
accgccgccaccgcugccgccc

SEQ ID NO: 744498 - RNA, 23 nt, Human
accgccgccaccgcugccgcccu

SEQ ID NO: 744499 - RNA, 22 nt, Human
acgauaucauacaaagggagcc

SEQ ID NO: 744500 - RNA, 18 nt, Human
acgcgggcggugcuccgg

SEQ ID NO: 744501 - RNA, 22 nt, Human
agacaagaaaguaacaccaaaa

SEQ ID NO: 744502 - RNA, 23 nt, Human
agacaagaaaguaacaccaaaac

SEQ ID NO: 744503 - RNA, 20 nt, Human
aggaacacaccgaaaaucaa

SEQ ID NO: 744504 - RNA, 19 nt, Human
aggcaccgugggggaggcc

SEQ ID NO: 744505 - RNA, 27 nt, Human
aucacauucagauuguuccaucugauu

SEQ ID NO: 744506 - RNA, 25 nt, Human
cacaucuugauuucuauuacuuuuu

SEQ ID NO: 744507 - RNA, 23 nt, Human
cacccgccacccuugcaggacuc

SEQ ID NO: 744508 - RNA, 19 nt, Human
caccuuugaaaagccuccc

SEQ ID NO: 744509 - RNA, 27 nt, Human
cagccacccgccacccuugcaggacuc

SEQ ID NO: 744510 - RNA, 24 nt, Human
caggauuccagaaggcucccagug

SEQ ID NO: 744511 - RNA, 21 nt, Human
cauuaaagugaccucaccaua

SEQ ID NO: 744512 - RNA, 20 nt, Human
ccagaaggcucccagugaag

SEQ ID NO: 744513 - RNA, 22 nt, Human
ccagugguggugugaccucagc

SEQ ID NO: 744514 - RNA, 18 nt, Human
cccauaaauauaauuaag

SEQ ID NO: 744515 - RNA, 21 nt, Human
cccauaaauauaauuaagugu

SEQ ID NO: 744516 - RNA, 18 nt, Human
ccgccgccaccgcugccg

SEQ ID NO: 744517 - RNA, 22 nt, Human
ccgccgccaccgcugccgcccu

SEQ ID NO: 744518 - RNA, 21 nt, Human
ccggcggaggacagcggcgga

SEQ ID NO: 744519 - RNA, 18 nt, Human
ccucagccacccgccacc

SEQ ID NO: 744520 - RNA, 19 nt, Human
cgagucaggcgcuggcuac

SEQ ID NO: 744521 - RNA, 22 nt, Human
cgcgucaaggcugaaccaaaau

SEQ ID NO: 744522 - RNA, 22 nt, Human
cggcggagcgcggcggacggaa

SEQ ID NO: 744523 - RNA, 19 nt, Human
cuaccgccgccaccgcugc

SEQ ID NO: 744524 - RNA, 20 nt, Human
cuaccgccgccaccgcugcc

SEQ ID NO: 744525 - RNA, 24 nt, Human
cuaccgccgccaccgcugccgccc

SEQ ID NO: 744526 - RNA, 23 nt, Human
cucagauacacauuuuauuucau

SEQ ID NO: 744527 - RNA, 23 nt, Human
gcugacccaucguccucccacgc

SEQ ID NO: 744528 - RNA, 22 nt, Human
gcugugaugaagagcaauuggc

SEQ ID NO: 744529 - RNA, 20 nt, Human
ggaauggcuguccauguggg

SEQ ID NO: 744530 - RNA, 22 nt, Human
ggcugguagcucgugccucacc

SEQ ID NO: 744531 - RNA, 21 nt, Human
gggaauggcuguccauguggg

SEQ ID NO: 744532 - RNA, 24 nt, Human
gggcauccaacaucccugcuccuu

SEQ ID NO: 744533 - RNA, 23 nt, Human
guggugugaccucagccacccgc

SEQ ID NO: 744534 - RNA, 18 nt, Human
uaaaagacagauagcugu

SEQ ID NO: 744535 - RNA, 23 nt, Human
uaacaaagccaccuuugaaaagc

SEQ ID NO: 744536 - RNA, 21 nt, Human
uacuuguuuucucacucagau

SEQ ID NO: 744537 - RNA, 23 nt, Human
uaugugguaaaagucucaaaggu

SEQ ID NO: 744538 - RNA, 22 nt, Human
ucaaaagaucuuaaaucaguaa

SEQ ID NO: 744539 - RNA, 20 nt, Human
ucaguaaguaguuucaucca

SEQ ID NO: 744540 - RNA, 26 nt, Human
ucauggacugugacccucugugaagu

SEQ ID NO: 744541 - RNA, 19 nt, Human
uccaaaaucagucuaaggc

SEQ ID NO: 744542 - RNA, 21 nt, Human
ucccauuaaccugccaacaag

SEQ ID NO: 744543 - RNA, 19 nt, Human
ucugaacucuugacaggug

SEQ ID NO: 744544 - RNA, 23 nt, Human
ucugcaauucucuggccucuguu

SEQ ID NO: 744545 - RNA, 20 nt, Human
ugaaacauuaaagugaccuc

SEQ ID NO: 744546 - RNA, 24 nt, Human
ugaacucuugacaggugggcaucc

SEQ ID NO: 744547 - RNA, 23 nt, Human
ugccucaccaagaguuuagcaac

SEQ ID NO: 744548 - RNA, 22 nt, Human
ugggcuccagcauuuauagucc

SEQ ID NO: 744549 - RNA, 20 nt, Human
ugggggaggccuaugucacu

SEQ ID NO: 744550 - RNA, 22 nt, Human
uggucagaucauggacugugac

SEQ ID NO: 744551 - RNA, 21 nt, Human
uguuggacaaacgcgucaagg

SEQ ID NO: 744552 - RNA, 18 nt, Human
uucaucaacacaucuuga

SEQ ID NO: 744553 - RNA, 22 nt, Human
uuccuggcuaugcagacuccuu

SEQ ID NO: 744554 - RNA, 22 nt, Human
uuccuggcuaugcagacuccuu

SEQ ID NO: 744555 - RNA, 19 nt, Human
aaacaaaaaaauagguaug

SEQ ID NO: 744556 - RNA, 25 nt, Human
aaacauaggcaugacaacuaaaaac

SEQ ID NO: 744557 - RNA, 24 nt, Human
aaagugcugggauuacaggcguga

SEQ ID NO: 744558 - RNA, 19 nt, Human
aaccacauguggcuacuga

SEQ ID NO: 744559 - RNA, 25 nt, Human
aaccagcccacauccuaauacacac

SEQ ID NO: 744560 - RNA, 21 nt, Human
aagaagaaaaaguuaagcaug

SEQ ID NO: 744561 - RNA, 20 nt, Human
aagauuaaaacuacagcuau

SEQ ID NO: 744562 - RNA, 19 nt, Human
aagcaugacagcauagcau

SEQ ID NO: 744563 - RNA, 23 nt, Human
aagucaaccuaaauuggaguugu

SEQ ID NO: 744564 - RNA, 19 nt, Human
aagugcugggauuacaggc

SEQ ID NO: 744565 - RNA, 19 nt, Human
aagugcugggauuacaggc

SEQ ID NO: 744566 - RNA, 26 nt, Human
aagugcugggauuacaggcgugagcc

SEQ ID NO: 744567 - RNA, 19 nt, Human
aaguggcugggauuacagg

SEQ ID NO: 744568 - RNA, 23 nt, Human
acacacacacacacacacacaca

SEQ ID NO: 744569 - RNA, 23 nt, Human
acacacacacacacacacacaca

SEQ ID NO: 744570 - RNA, 23 nt, Human
acacacacacacacacacacaca

SEQ ID NO: 744571 - RNA, 22 nt, Human
acagaguguuacucugucaccc

SEQ ID NO: 744572 - RNA, 21 nt, Human
accacaagaggaaacaaaaua

SEQ ID NO: 744573 - RNA, 24 nt, Human
acccaggcuggagugcaauggcau

SEQ ID NO: 744574 - RNA, 33 nt, Human
acccccagguauacacacacacacacacacagu

SEQ ID NO: 744575 - RNA, 25 nt, Human
acucgccucggccucccaaagugcu

SEQ ID NO: 744576 - RNA, 18 nt, Human
acucugucacccaggcug

SEQ ID NO: 744577 - RNA, 20 nt, Human
acucugucacccaggcugga

SEQ ID NO: 744578 - RNA, 27 nt, Human
acucugucacccaggcuggagugcaau

SEQ ID NO: 744579 - RNA, 21 nt, Human
acugagcaucugaaauguggc

SEQ ID NO: 744580 - RNA, 22 nt, Human
aggaaauccacucgccucggcc

SEQ ID NO: 744581 - RNA, 24 nt, Human
aggaaauccacucgccucggccuc

SEQ ID NO: 744582 - RNA, 18 nt, Human
aggugcccgccaccaagc

SEQ ID NO: 744583 - RNA, 19 nt, Human
aggugguagaaaagcaaac

SEQ ID NO: 744584 - RNA, 24 nt, Human
agugcaauggcaugaucuuggcuc

SEQ ID NO: 744585 - RNA, 18 nt, Human
agugcugggauuacaggc

SEQ ID NO: 744586 - RNA, 24 nt, Human
auauuucauuacuguucuguucuu

SEQ ID NO: 744587 - RNA, 22 nt, Human
aucaagcugcuacuagaaaaau

SEQ ID NO: 744588 - RNA, 19 nt, Human
auguucaugauuuucagca

SEQ ID NO: 744589 - RNA, 22 nt, Human
auuacaggugcccgccaccaag

SEQ ID NO: 744590 - RNA, 21 nt, Human
auucuccugccucagccuccc

SEQ ID NO: 744591 - RNA, 26 nt, Human
auuuuucuuuuuuuuuuuucugaaau

SEQ ID NO: 744592 - RNA, 24 nt, Human
auuuuuguauuuuuaguagagaug

SEQ ID NO: 744593 - RNA, 28 nt, Human
caaaauuucuaaaguuccugugucacac

SEQ ID NO: 744594 - RNA, 24 nt, Human
caaagugcugggauuacaggcgug

SEQ ID NO: 744595 - RNA, 22 nt, Human
caagcaauucuccugccucagc

SEQ ID NO: 744596 - RNA, 27 nt, Human
caagcaauucuccugccucagccuccc

SEQ ID NO: 744597 - RNA, 25 nt, Human
caauacagaguucuauacaacaaga

SEQ ID NO: 744598 - RNA, 20 nt, Human
cacacacacacacacacaca

SEQ ID NO: 744599 - RNA, 20 nt, Human
cacacacacacacacacaca

SEQ ID NO: 744600 - RNA, 20 nt, Human
cacacacacacacacacaca

SEQ ID NO: 744601 - RNA, 20 nt, Human
cacacacacacacacacaca

SEQ ID NO: 744602 - RNA, 20 nt, Human
cacacacacacacacacaca

SEQ ID NO: 744603 - RNA, 20 nt, Human
cacacacacacacacacaca

SEQ ID NO: 744604 - RNA, 20 nt, Human
cacacacacacacacacaca

SEQ ID NO: 744605 - RNA, 22 nt, Human
cacacacacacacacacacaca

SEQ ID NO: 744606 - RNA, 22 nt, Human
cacacacacacacacacacaca

SEQ ID NO: 744607 - RNA, 22 nt, Human
cacacacacacacacacacaca

SEQ ID NO: 744608 - RNA, 22 nt, Human
cacacacacacacacacacaca

SEQ ID NO: 744609 - RNA, 22 nt, Human
cacacacacacacacacacaca

SEQ ID NO: 744610 - RNA, 26 nt, Human
cacacacacacacacacacacacaca

SEQ ID NO: 744611 - RNA, 26 nt, Human
cacacacacacacacacacacacaca

SEQ ID NO: 744612 - RNA, 29 nt, Human
cacacacacacacacacacacacacuuca

SEQ ID NO: 744613 - RNA, 25 nt, Human
cacaggauuucaaagauaauacaaa

SEQ ID NO: 744614 - RNA, 18 nt, Human
cacauguggcuacugagc

SEQ ID NO: 744615 - RNA, 21 nt, Human
cacauugcucaggcuggucuc

SEQ ID NO: 744616 - RNA, 24 nt, Human
cacauugcucaggcuggucucaaa

SEQ ID NO: 744617 - RNA, 24 nt, Human
caccaagcccagauaauuuuugua

SEQ ID NO: 744618 - RNA, 27 nt, Human
caccacauugcucaggcuggucucaaa

SEQ ID NO: 744619 - RNA, 31 nt, Human
cacccccagguauacacacacacacacagug

SEQ ID NO: 744620 - RNA, 23 nt, Human
cagccuccaccucccggguucaa

SEQ ID NO: 744621 - RNA, 19 nt, Human
caggugcccgccaccaagc

SEQ ID NO: 744622 - RNA, 18 nt, Human
cauucacuuuccuauguu

SEQ ID NO: 744623 - RNA, 22 nt, Human
ccaaagugcugggauuacaggc

SEQ ID NO: 744624 - RNA, 22 nt, Human
ccaaagugcugggauuacaggc

SEQ ID NO: 744625 - RNA, 24 nt, Human
ccaaagugcugggauuacaggcgu

SEQ ID NO: 744626 - RNA, 20 nt, Human
ccaaauaauacuucaaaaaa

SEQ ID NO: 744627 - RNA, 21 nt, Human
ccaaguggcugggauuacagg

SEQ ID NO: 744628 - RNA, 27 nt, Human
ccaccucccggguucaagcaauucuuu

SEQ ID NO: 744629 - RNA, 19 nt, Human
ccagcccacauccuaauac

SEQ ID NO: 744630 - RNA, 23 nt, Human
cccaaguggcugggauuacaggu

SEQ ID NO: 744631 - RNA, 24 nt, Human
cccaaguggcugggauuacaggug

SEQ ID NO: 744632 - RNA, 18 nt, Human
cccacauccuaauacaca

SEQ ID NO: 744633 - RNA, 19 nt, Human
cccacccccagguauacac

SEQ ID NO: 744634 - RNA, 24 nt, Human
cccacccccagguauacacacaca

SEQ ID NO: 744635 - RNA, 30 nt, Human
cccagguauacacacacacacacacacaca

SEQ ID NO: 744636 - RNA, 23 nt, Human
cccggguucaagcaauucuccug

SEQ ID NO: 744637 - RNA, 18 nt, Human
ccgcagccuccaccuccc

SEQ ID NO: 744638 - RNA, 23 nt, Human
ccgcagccuccaccucccggguu

SEQ ID NO: 744639 - RNA, 24 nt, Human
ccgcagccuccaccucccggguuc

SEQ ID NO: 744640 - RNA, 24 nt, Human
ccucccggguucaagcaauucucc

SEQ ID NO: 744641 - RNA, 23 nt, Human
ccugccucagccucccaaguggc

SEQ ID NO: 744642 - RNA, 24 nt, Human
cgccucggccucccaaagugcugg

SEQ ID NO: 744643 - RNA, 19 nt, Human
cguaaguagauaaaagcua

SEQ ID NO: 744644 - RNA, 24 nt, Human
cuacugagcaucugaaauguggcu

SEQ ID NO: 744645 - RNA, 20 nt, Human
cuaugggacagcacuccucu

SEQ ID NO: 744646 - RNA, 24 nt, Human
cucaccgcagccuccaccucccgg

SEQ ID NO: 744647 - RNA, 24 nt, Human
cucagccucccaaguggcugggau

SEQ ID NO: 744648 - RNA, 23 nt, Human
cucuccugcucuuucagccuuag

SEQ ID NO: 744649 - RNA, 22 nt, Human
cugaaauguggcuaguguaaau

SEQ ID NO: 744650 - RNA, 23 nt, Human
cugccucagccucccaaguggcu

SEQ ID NO: 744651 - RNA, 24 nt, Human
cuggagugcaauggcaugaucuug

SEQ ID NO: 744652 - RNA, 19 nt, Human
cuugacaacagacaguaga

SEQ ID NO: 744653 - RNA, 18 nt, Human
gaaaagcaaaccagccca

SEQ ID NO: 744654 - RNA, 20 nt, Human
gaaaagcaaaccagcccaca

SEQ ID NO: 744655 - RNA, 23 nt, Human
gacagcacuccucuagagcuacu

SEQ ID NO: 744656 - RNA, 20 nt, Human
gagaugggguuucaccacau

SEQ ID NO: 744657 - RNA, 23 nt, Human
gagaugggguuucaccacauugc

SEQ ID NO: 744658 - RNA, 20 nt, Human
gaucauucacuuuccuaugu

SEQ ID NO: 744659 - RNA, 18 nt, Human
gauuacaggcgugagcca

SEQ ID NO: 744660 - RNA, 22 nt, Human
gauuacaggcgugagccacugc

SEQ ID NO: 744661 - RNA, 23 nt, Human
gauuacaggcgugagccacugca

SEQ ID NO: 744662 - RNA, 18 nt, Human
gauuacaggugcccgcca

SEQ ID NO: 744663 - RNA, 18 nt, Human
gcauuuuggggaacuggu

SEQ ID NO: 744664 - RNA, 24 nt, Human
gccucagccucccaaguggcuggg

SEQ ID NO: 744665 - RNA, 23 nt, Human
gcucaggcuggucucaaacuccu

SEQ ID NO: 744666 - RNA, 19 nt, Human
gcuggagugcaauggcaug

SEQ ID NO: 744667 - RNA, 24 nt, Human
ggaaauccacucgccucggccucc

SEQ ID NO: 744668 - RNA, 23 nt, Human
ggcuggucucaaacuccugaccu

SEQ ID NO: 744669 - RNA, 22 nt, Human
ggugcccgccaccaagcccaga

SEQ ID NO: 744670 - RNA, 22 nt, Human
uaaaaagggcauaauucagaua

SEQ ID NO: 744671 - RNA, 19 nt, Human
uaaaagcuagguauuuaau

SEQ ID NO: 744672 - RNA, 21 nt, Human
uaaacauaggcaugacaacua

SEQ ID NO: 744673 - RNA, 24 nt, Human
uaauauuuuggacauacuggggua

SEQ ID NO: 744674 - RNA, 24 nt, Human
uaauuuuuguauuuuuaguagaga

SEQ ID NO: 744675 - RNA, 24 nt, Human
uacaaacaaaaaaauagguaugua

SEQ ID NO: 744676 - RNA, 20 nt, Human
uacacacacacacacacaca

SEQ ID NO: 744677 - RNA, 25 nt, Human
uacacacacacacacacacacacac

SEQ ID NO: 744678 - RNA, 20 nt, Human
uacacacuaaaaagggcaua

SEQ ID NO: 744679 - RNA, 19 nt, Human
uacaggcgugagccacugc

SEQ ID NO: 744680 - RNA, 23 nt, Human
uacaggcgugagccacugcaccc

SEQ ID NO: 744681 - RNA, 18 nt, Human
uacgcuucuccaggucuu

SEQ ID NO: 744682 - RNA, 24 nt, Human
uacucugucacccaggcuggagug

SEQ ID NO: 744683 - RNA, 25 nt, Human
uacuucaaaaaacuauauuuuaaaa

SEQ ID NO: 744684 - RNA, 21 nt, Human
uagaaaaagagcacugcccac

SEQ ID NO: 744685 - RNA, 20 nt, Human
uagaaaagcaaaccagccca

SEQ ID NO: 744686 - RNA, 19 nt, Human
uagaagaaaaagaguggua

SEQ ID NO: 744687 - RNA, 18 nt, Human
uagagcuacuguugauau

SEQ ID NO: 744688 - RNA, 19 nt, Human
uaguagagaugggguuuca

SEQ ID NO: 744689 - RNA, 23 nt, Human
uaguagagaugggguuucaccac

SEQ ID NO: 744690 - RNA, 25 nt, Human
uaguagagaugggguuucaccacau

SEQ ID NO: 744691 - RNA, 22 nt, Human
uauacaaaacucugcauauagc

SEQ ID NO: 744692 - RNA, 25 nt, Human
uauacacacacacacacacacacac

SEQ ID NO: 744693 - RNA, 21 nt, Human
uauuauaagaagacuagaccu

SEQ ID NO: 744694 - RNA, 21 nt, Human
ucaccacauugcucaggcugg

SEQ ID NO: 744695 - RNA, 18 nt, Human
ucacccaggcuggagugc

SEQ ID NO: 744696 - RNA, 24 nt, Human
ucaccgcagccuccaccucccggg

SEQ ID NO: 744697 - RNA, 24 nt, Human
ucccaaagugcugggauuacaggc

SEQ ID NO: 744698 - RNA, 23 nt, Human
ucccaaguggcugggauuacagg

SEQ ID NO: 744699 - RNA, 24 nt, Human
ucccaaguggcugggauuacaggu

SEQ ID NO: 744700 - RNA, 21 nt, Human
ucccggguucaagcaauucuc

SEQ ID NO: 744701 - RNA, 24 nt, Human
ucccggguucaagcaauucuccug

SEQ ID NO: 744702 - RNA, 20 nt, Human
uccuaaacacugacuuucca

SEQ ID NO: 744703 - RNA, 20 nt, Human
uccucuagagcuacuguuga

SEQ ID NO: 744704 - RNA, 24 nt, Human
ucgccucggccucccaaagugcug

SEQ ID NO: 744705 - RNA, 22 nt, Human
ucuaaaguuccugugucacacu

SEQ ID NO: 744706 - RNA, 23 nt, Human
ucuagcaaccacauguggcuacu

SEQ ID NO: 744707 - RNA, 26 nt, Human
ucuccugccucagccucccaaguggc

SEQ ID NO: 744708 - RNA, 24 nt, Human
ucucguauacgcuucuccaggucu

SEQ ID NO: 744709 - RNA, 24 nt, Human
ucugucacccaggcuggagugcaa

SEQ ID NO: 744710 - RNA, 20 nt, Human
ugaaaguacauauccauuga

SEQ ID NO: 744711 - RNA, 22 nt, Human
ugacagagguagaauuuguguc

SEQ ID NO: 744712 - RNA, 18 nt, Human
ugacagcauagcaucaaa

SEQ ID NO: 744713 - RNA, 21 nt, Human
ugacuuuccaaauaauacuuc

SEQ ID NO: 744714 - RNA, 22 nt, Human
ugcccacccccagguauacaca

SEQ ID NO: 744715 - RNA, 24 nt, Human
ugccucagccucccaaguggcugg

SEQ ID NO: 744716 - RNA, 21 nt, Human
ugcugaagaaagucaaccuaa

SEQ ID NO: 744717 - RNA, 24 nt, Human
ugcugggauuacaggcgugagcca

SEQ ID NO: 744718 - RNA, 19 nt, Human
uggagugcaauggcaugau

SEQ ID NO: 744719 - RNA, 24 nt, Human
uggagugcaauggcaugaucuugg

SEQ ID NO: 744720 - RNA, 20 nt, Human
uggcugggauuacaggugcc

SEQ ID NO: 744721 - RNA, 18 nt, Human
ugggauuacaggcgugag

SEQ ID NO: 744722 - RNA, 19 nt, Human
ugggauuacaggcgugagc

SEQ ID NO: 744723 - RNA, 21 nt, Human
ugggauuacaggcgugagcca

SEQ ID NO: 744724 - RNA, 22 nt, Human
ugggauuacaggcgugagccac

SEQ ID NO: 744725 - RNA, 22 nt, Human
ugggauuacaggcgugagccac

SEQ ID NO: 744726 - RNA, 24 nt, Human
ugggauuacaggcgugagccacug

SEQ ID NO: 744727 - RNA, 26 nt, Human
ugggauuacaggcgugagccacugca

SEQ ID NO: 744728 - RNA, 21 nt, Human
ugggauuacaggugcccgcca

SEQ ID NO: 744729 - RNA, 22 nt, Human
ugggauuacaggugcccgccac

SEQ ID NO: 744730 - RNA, 24 nt, Human
ugggauuacaggugcccgccacca

SEQ ID NO: 744731 - RNA, 18 nt, Human
uggggaacugguaaauua

SEQ ID NO: 744732 - RNA, 24 nt, Human
ugggguuucaccacauugcucagg

SEQ ID NO: 744733 - RNA, 19 nt, Human
ugguauugcaaacaguccc

SEQ ID NO: 744734 - RNA, 19 nt, Human
uguagcccaggcaacucug

SEQ ID NO: 744735 - RNA, 21 nt, Human
uguauuuuuaguagagauggg

SEQ ID NO: 744736 - RNA, 19 nt, Human
ugucacacugcauggaacu

SEQ ID NO: 744737 - RNA, 20 nt, Human
ugucacccaggcuggagugc

SEQ ID NO: 744738 - RNA, 22 nt, Human
ugucacccaggcuggagugcaa

SEQ ID NO: 744739 - RNA, 19 nt, Human
ugugcaguguaaugaaagu

SEQ ID NO: 744740 - RNA, 22 nt, Human
uguguuacauagaguccauaug

SEQ ID NO: 744741 - RNA, 24 nt, Human
uguuacucugucacccaggcugga

SEQ ID NO: 744742 - RNA, 23 nt, Human
uuacauauauggcucauaucaua

SEQ ID NO: 744743 - RNA, 22 nt, Human
uuacucugucacccaggcugga

SEQ ID NO: 744744 - RNA, 24 nt, Human
uuacucugucacccaggcuggagu

SEQ ID NO: 744745 - RNA, 18 nt, Human
uuaguagagaugggguuu

SEQ ID NO: 744746 - RNA, 22 nt, Human
uuaguagagaugggguuucacc

SEQ ID NO: 744747 - RNA, 24 nt, Human
uuaguagagaugggguuucaccac

SEQ ID NO: 744748 - RNA, 25 nt, Human
uuaguagagaugggguuucaccaca

SEQ ID NO: 744749 - RNA, 23 nt, Human
uuauuuuuuuaaaucaagcugcu

SEQ ID NO: 744750 - RNA, 21 nt, Human
uucaagcaauucuccugccuc

SEQ ID NO: 744751 - RNA, 24 nt, Human
uucaagcaauucuccugccucagc

SEQ ID NO: 744752 - RNA, 20 nt, Human
uucaugauuuucagcaacaa

SEQ ID NO: 744753 - RNA, 18 nt, Human
uucuuuuuuuuuuuucug

SEQ ID NO: 744754 - RNA, 19 nt, Human
uuggaguuguaauuuauga

SEQ ID NO: 744755 - RNA, 23 nt, Human
uuguauuuuuaguagagaugggg

SEQ ID NO: 744756 - RNA, 23 nt, Human
uuuaacauauucacugauuuaaa

SEQ ID NO: 744757 - RNA, 23 nt, Human
uuuuggacauacugggguaaaua

SEQ ID NO: 744758 - RNA, 24 nt, Human
uuuuuaguagagaugggguuucac

SEQ ID NO: 744759 - RNA, 20 nt, Human
uuuuuguauuuuuaguagag

SEQ ID NO: 744760 - RNA, 20 nt, Human
uuuuuuuuucugagacagag

SEQ ID NO: 744761 - RNA, 24 nt, Human
aaaaaaaucuaaacacuaaggcua

SEQ ID NO: 744762 - RNA, 22 nt, Human
aaaaagccuacagaauaaaaug

SEQ ID NO: 744763 - RNA, 22 nt, Human
aaacaaauuacuaacccaaaac

SEQ ID NO: 744764 - RNA, 21 nt, Human
aaacacucaugguguagacaa

SEQ ID NO: 744765 - RNA, 22 nt, Human
aaacagcugggguaucucugag

SEQ ID NO: 744766 - RNA, 19 nt, Human
aagcaaugcuucacuaaaa

SEQ ID NO: 744767 - RNA, 20 nt, Human
aagccaucucuucuaaaaaa

SEQ ID NO: 744768 - RNA, 21 nt, Human
acaaaacaacuuuucuaaaag

SEQ ID NO: 744769 - RNA, 18 nt, Human
acaaagggaucacauuuc

SEQ ID NO: 744770 - RNA, 18 nt, Human
acaggcugcuaacgcugg

SEQ ID NO: 744771 - RNA, 18 nt, Human
accccgcgaaacuuggcc

SEQ ID NO: 744772 - RNA, 21 nt, Human
acgucucugucguaguaaaca

SEQ ID NO: 744773 - RNA, 24 nt, Human
acguggagacacuguggugagcug

SEQ ID NO: 744774 - RNA, 18 nt, Human
acuaaaauacaguaccug

SEQ ID NO: 744775 - RNA, 18 nt, Human
acuggaauauaacaagcu

SEQ ID NO: 744776 - RNA, 22 nt, Human
agaauauuuaauuggcuuaaaa

SEQ ID NO: 744777 - RNA, 22 nt, Human
agaccugguacaggcugcuaac

SEQ ID NO: 744778 - RNA, 18 nt, Human
agagacgugcuucugguc

SEQ ID NO: 744779 - RNA, 19 nt, Human
agagacgugcuucuggucc

SEQ ID NO: 744780 - RNA, 18 nt, Human
agcagggaccaccugcca

SEQ ID NO: 744781 - RNA, 25 nt, Human
agugaugagcacaguuacaaaggga

SEQ ID NO: 744782 - RNA, 20 nt, Human
augcuucacuaaaauacagu

SEQ ID NO: 744783 - RNA, 24 nt, Human
caacaaaacaacuuuucuaaaagg

SEQ ID NO: 744784 - RNA, 21 nt, Human
caagaguccugcuacuaaaca

SEQ ID NO: 744785 - RNA, 20 nt, Human
cacuuuagaaccugcgguua

SEQ ID NO: 744786 - RNA, 19 nt, Human
cagagacgugcuucugguc

SEQ ID NO: 744787 - RNA, 21 nt, Human
cauacacgugacccuugugca

SEQ ID NO: 744788 - RNA, 22 nt, Human
ccaaaacuuuaaaaaacuuuac

SEQ ID NO: 744789 - RNA, 21 nt, Human
ccaagugcucauuugugcccc

SEQ ID NO: 744790 - RNA, 18 nt, Human
cccagugauggccgcauc

SEQ ID NO: 744791 - RNA, 27 nt, Human
ccgcaucuucccuaucauaaaaaaauc

SEQ ID NO: 744792 - RNA, 19 nt, Human
ccggccucuggggcggcuc

SEQ ID NO: 744793 - RNA, 23 nt, Human
cguacacagccgugggcagagcg

SEQ ID NO: 744794 - RNA, 21 nt, Human
cugccugaucaucuugagagc

SEQ ID NO: 744795 - RNA, 20 nt, Human
cuucugguccugaggacagg

SEQ ID NO: 744796 - RNA, 18 nt, Human
gaaugcagaaaccugaaa

SEQ ID NO: 744797 - RNA, 20 nt, Human
gacaacugacacuucacucu

SEQ ID NO: 744798 - RNA, 18 nt, Human
gaccugguacaggcugcu

SEQ ID NO: 744799 - RNA, 23 nt, Human
gagcacaguuacaaagggaucac

SEQ ID NO: 744800 - RNA, 18 nt, Human
gagcggcccugagagugc

SEQ ID NO: 744801 - RNA, 18 nt, Human
gcggcgcgggcggacgcu

SEQ ID NO: 744802 - RNA, 19 nt, Human
ggccucuggggcggcuccc

SEQ ID NO: 744803 - RNA, 23 nt, Human
ggguuucagcagggaccaccugc

SEQ ID NO: 744804 - RNA, 20 nt, Human
uaaaacaccccgcgaaacuu

SEQ ID NO: 744805 - RNA, 23 nt, Human
uaaaacaccccgcgaaacuuggc

SEQ ID NO: 744806 - RNA, 20 nt, Human
uaaaacauagucaaugcaaa

SEQ ID NO: 744807 - RNA, 19 nt, Human
uaaaaucuagucaccauau

SEQ ID NO: 744808 - RNA, 21 nt, Human
uaaagccugaaugcagaaacu

SEQ ID NO: 744809 - RNA, 22 nt, Human
uaacccaaaacuuuaaaaaacu

SEQ ID NO: 744810 - RNA, 21 nt, Human
uacaggcugcuaacgcugggg

SEQ ID NO: 744811 - RNA, 24 nt, Human
uagacaacaaugugugcagcagag

SEQ ID NO: 744812 - RNA, 24 nt, Human
uagaucacugcuuuccaagagucc

SEQ ID NO: 744813 - RNA, 24 nt, Human
uauguacaguauuucaacaaaaca

SEQ ID NO: 744814 - RNA, 24 nt, Human
ucacucugauguccuugggauuug

SEQ ID NO: 744815 - RNA, 24 nt, Human
ucagaauauuuaauuggcuuaaaa

SEQ ID NO: 744816 - RNA, 22 nt, Human
ucaucuugagagcauacacgug

SEQ ID NO: 744817 - RNA, 19 nt, Human
uccaaaugccacgucucug

SEQ ID NO: 744818 - RNA, 24 nt, Human
uccaagaguccugcuacuaaacac

SEQ ID NO: 744819 - RNA, 19 nt, Human
uccggcuguaucuuagguu

SEQ ID NO: 744820 - RNA, 21 nt, Human
ucuaaguuucguuuccaaaug

SEQ ID NO: 744821 - RNA, 18 nt, Human
ucucugaagacauaacuu

SEQ ID NO: 744822 - RNA, 22 nt, Human
ucucugaguuaacugaccaugu

SEQ ID NO: 744823 - RNA, 23 nt, Human
ucucugaguuaacugaccaugua

SEQ ID NO: 744824 - RNA, 18 nt, Human
ucugcccccgcgccccuc

SEQ ID NO: 744825 - RNA, 21 nt, Human
ucugcccccgcgccccucccg

SEQ ID NO: 744826 - RNA, 21 nt, Human
ucuuacagcauagaucacugc

SEQ ID NO: 744827 - RNA, 23 nt, Human
ucuuacagcauagaucacugcuu

SEQ ID NO: 744828 - RNA, 20 nt, Human
ugaaaaaaagaaucugugac

SEQ ID NO: 744829 - RNA, 21 nt, Human
ugaaugcagaaaccugaaaug

SEQ ID NO: 744830 - RNA, 21 nt, Human
ugagagcauacacgugacccu

SEQ ID NO: 744831 - RNA, 21 nt, Human
ugagcuggagagcggcccuga

SEQ ID NO: 744832 - RNA, 18 nt, Human
ugaugauaaacagcuggg

SEQ ID NO: 744833 - RNA, 19 nt, Human
ugcucauuugugcccccga

SEQ ID NO: 744834 - RNA, 23 nt, Human
uggccuaguggugccgucgugag

SEQ ID NO: 744835 - RNA, 24 nt, Human
uggcuugcccuccaccuccuauuu

SEQ ID NO: 744836 - RNA, 22 nt, Human
ugggaaaguucucaaaauaagc

SEQ ID NO: 744837 - RNA, 19 nt, Human
ugggguaucucugaguuaa

SEQ ID NO: 744838 - RNA, 24 nt, Human
ugugugcagcagagacgugcuucu

SEQ ID NO: 744839 - RNA, 22 nt, Human
uuaauaaaacaccccgcgaaac

SEQ ID NO: 744840 - RNA, 21 nt, Human
uuacagcauagaucacugcuu

SEQ ID NO: 744841 - RNA, 22 nt, Human
uucacucugauguccuugggau

SEQ ID NO: 744842 - RNA, 19 nt, Human
uucauaguugacaggacaa

SEQ ID NO: 744843 - RNA, 19 nt, Human
uugugcauuaccucggccc

SEQ ID NO: 744844 - RNA, 22 nt, Human
uuuacagauuucauuugauagc

SEQ ID NO: 744845 - RNA, 18 nt, Human
uuuacaucuucuuuguca

SEQ ID NO: 744846 - RNA, 20 nt, Human
aaaaagguauucagucccuu

SEQ ID NO: 744847 - RNA, 21 nt, Human
aaaacccccagccugggccca

SEQ ID NO: 744848 - RNA, 21 nt, Human
aaacccccagccugggcccag

SEQ ID NO: 744849 - RNA, 20 nt, Human
aaagagaaaacaggcugggg

SEQ ID NO: 744850 - RNA, 21 nt, Human
aaccauggcaaugaagcaguc

SEQ ID NO: 744851 - RNA, 20 nt, Human
aagagaaaacaggcugggga

SEQ ID NO: 744852 - RNA, 21 nt, Human
aaggggucugaggcaggaggg

SEQ ID NO: 744853 - RNA, 19 nt, Human
agauggcccacagcugaag

SEQ ID NO: 744854 - RNA, 22 nt, Human
agcauuggaggaauccucuuuc

SEQ ID NO: 744855 - RNA, 21 nt, Human
agcuggaggccugguccucca

SEQ ID NO: 744856 - RNA, 18 nt, Human
aggaaaaagguauucagu

SEQ ID NO: 744857 - RNA, 19 nt, Human
aggaauccucuuucccugu

SEQ ID NO: 744858 - RNA, 19 nt, Human
aggcaggaggggaucuuug

SEQ ID NO: 744859 - RNA, 22 nt, Human
aggcagggggaaggaaaaaggu

SEQ ID NO: 744860 - RNA, 23 nt, Human
aggcuccagagcuccuagaggug

SEQ ID NO: 744861 - RNA, 18 nt, Human
agggaaaggagaacaaug

SEQ ID NO: 744862 - RNA, 21 nt, Human
agggagagggcuggacugggg

SEQ ID NO: 744863 - RNA, 22 nt, Human
agggcgaggccagacagcugga

SEQ ID NO: 744864 - RNA, 20 nt, Human
aguucugggcucccaggagg

SEQ ID NO: 744865 - RNA, 20 nt, Human
caaagccaccucuacuuuuc

SEQ ID NO: 744866 - RNA, 21 nt, Human
caaauacugaaaacccccagc

SEQ ID NO: 744867 - RNA, 24 nt, Human
caacacuguacagaacuccaacca

SEQ ID NO: 744868 - RNA, 23 nt, Human
cacaggaccaagcuccuuacaga

SEQ ID NO: 744869 - RNA, 25 nt, Human
cagcccccaaagccccuggcaaagg

SEQ ID NO: 744870 - RNA, 21 nt, Human
caguggaagggagagggcugg

SEQ ID NO: 744871 - RNA, 22 nt, Human
cauuuccaucacccuucggagg

SEQ ID NO: 744872 - RNA, 23 nt, Human
ccaccucuacuuuucuucuucug

SEQ ID NO: 744873 - RNA, 21 nt, Human
ccauggcaaugaagcagucac

SEQ ID NO: 744874 - RNA, 21 nt, Human
cccacagcugaagcagugggc

SEQ ID NO: 744875 - RNA, 21 nt, Human
cccagaaacucacaggaccaa

SEQ ID NO: 744876 - RNA, 20 nt, Human
cccccaaagccccuggcaaa

SEQ ID NO: 744877 - RNA, 19 nt, Human
cccuggcugggccuggggc

SEQ ID NO: 744878 - RNA, 19 nt, Human
ccuagaggugggggggggg

SEQ ID NO: 744879 - RNA, 22 nt, Human
ccugggcccaggcaaccaaggg

SEQ ID NO: 744880 - RNA, 18 nt, Human
ccuggggcaggacccuaa

SEQ ID NO: 744881 - RNA, 20 nt, Human
ccugugcaucagggcugaag

SEQ ID NO: 744882 - RNA, 21 nt, Human
cggaggcugaaggaagggcgg

SEQ ID NO: 744883 - RNA, 19 nt, Human
cuagagguggggggggggc

SEQ ID NO: 744884 - RNA, 22 nt, Human
cucagcccccaaagccccuggc

SEQ ID NO: 744885 - RNA, 22 nt, Human
cucucccaacugcaucgcuccu

SEQ ID NO: 744886 - RNA, 25 nt, Human
cucuggauguggcucugcucagccc

SEQ ID NO: 744887 - RNA, 20 nt, Human
cugaggcaggaggggaucuu

SEQ ID NO: 744888 - RNA, 19 nt, Human
cuggcugggccuggggcag

SEQ ID NO: 744889 - RNA, 24 nt, Human
cugugacagcuccucagcccuggc

SEQ ID NO: 744890 - RNA, 22 nt, Human
cuuacaaauacugaaaaccccc

SEQ ID NO: 744891 - RNA, 21 nt, Human
cuuaugguaccauaauuuguc

SEQ ID NO: 744892 - RNA, 23 nt, Human
cuuccccucugcugcaucaucuc

SEQ ID NO: 744893 - RNA, 23 nt, Human
cuucuagcuuccucucccaacug

SEQ ID NO: 744894 - RNA, 27 nt, Human
cuucuggcucuaagcaaggcaccuuac

SEQ ID NO: 744895 - RNA, 23 nt, Human
cuuuucuucuucuggcugguucu

SEQ ID NO: 744896 - RNA, 25 nt, Human
cuuuucuucuucuggcugguucuuc

SEQ ID NO: 744897 - RNA, 21 nt, Human
gaaaacccccagccugggccc

SEQ ID NO: 744898 - RNA, 24 nt, Human
gaaaggagaacaauggggcagagc

SEQ ID NO: 744899 - RNA, 19 nt, Human
gaagacacaggcaggggga

SEQ ID NO: 744900 - RNA, 21 nt, Human
gagaacaauggggcagagccg

SEQ ID NO: 744901 - RNA, 24 nt, Human
gagaugcccaggggccugggcugg

SEQ ID NO: 744902 - RNA, 19 nt, Human
gcaaguucugggcucccag

SEQ ID NO: 744903 - RNA, 20 nt, Human
gcccaggcaaccaagggcuc

SEQ ID NO: 744904 - RNA, 21 nt, Human
gccccuggcaaaggggucuga

SEQ ID NO: 744905 - RNA, 23 nt, Human
gcuccagagcuccuagagguggg

SEQ ID NO: 744906 - RNA, 19 nt, Human
ggacuggggggcuggcagc

SEQ ID NO: 744907 - RNA, 23 nt, Human
ggacuggggggcuggcagccugu

SEQ ID NO: 744908 - RNA, 26 nt, Human
ggagagcaggugucagguccccaagg

SEQ ID NO: 744909 - RNA, 18 nt, Human
ggaggggaucuuuggcag

SEQ ID NO: 744910 - RNA, 18 nt, Human
ggcucggcucggucgcgg

SEQ ID NO: 744911 - RNA, 19 nt, Human
ggcugguucuucaggaggc

SEQ ID NO: 744912 - RNA, 24 nt, Human
gggccuggggcaggacccuaaagg

SEQ ID NO: 744913 - RNA, 18 nt, Human
gggcugggccacagagcg

SEQ ID NO: 744914 - RNA, 19 nt, Human
ggggcagagcgggguuuga

SEQ ID NO: 744915 - RNA, 20 nt, Human
ggucugaggcaggaggggau

SEQ ID NO: 744916 - RNA, 23 nt, Human
ggucugaggcaggaggggaucuu

SEQ ID NO: 744917 - RNA, 21 nt, Human
gugcaucagggcugaagacac

SEQ ID NO: 744918 - RNA, 22 nt, Human
gugggcugggccacagagcugc

SEQ ID NO: 744919 - RNA, 22 nt, Human
uaagggaaaggagaacaauggg

SEQ ID NO: 744920 - RNA, 19 nt, Human
uagagguggggggggggca

SEQ ID NO: 744921 - RNA, 21 nt, Human
ucccuuagccuggcucggcuc

SEQ ID NO: 744922 - RNA, 24 nt, Human
ucucccaacugcaucgcuccuccu

SEQ ID NO: 744923 - RNA, 23 nt, Human
ucucugugacagcuccucagccc

SEQ ID NO: 744924 - RNA, 27 nt, Human
ucugcaacuaggggauggagcugggac

SEQ ID NO: 744925 - RNA, 23 nt, Human
ugcaucgcuccuccucuguucca

SEQ ID NO: 744926 - RNA, 18 nt, Human
ugcugcaucaucuccugc

SEQ ID NO: 744927 - RNA, 18 nt, Human
ugcugggaaggagagcag

SEQ ID NO: 744928 - RNA, 21 nt, Human
uggacuggggggcuggcagcc

SEQ ID NO: 744929 - RNA, 22 nt, Human
uggagcugggaccucaagguug

SEQ ID NO: 744930 - RNA, 21 nt, Human
uggauguggcucugcucagcc

SEQ ID NO: 744931 - RNA, 18 nt, Human
uggcaaaggggucugagg

SEQ ID NO: 744932 - RNA, 22 nt, Human
uggcagccugugcaucagggcu

SEQ ID NO: 744933 - RNA, 19 nt, Human
uggcucggcucggucgcgg

SEQ ID NO: 744934 - RNA, 19 nt, Human
uggcucggcucggucgcgg

SEQ ID NO: 744935 - RNA, 19 nt, Human
uggcugguucuucaggagg

SEQ ID NO: 744936 - RNA, 18 nt, Human
uggggggggggcagggag

SEQ ID NO: 744937 - RNA, 22 nt, Human
uuacaaauacugaaaaccccca

SEQ ID NO: 744938 - RNA, 24 nt, Human
uuaguauguaaccauggcaaugaa

SEQ ID NO: 744939 - RNA, 22 nt, Human
uuccguaguccaaaggcuuuau

SEQ ID NO: 744940 - RNA, 19 nt, Human
uucuuauacaaaagcccca

SEQ ID NO: 744941 - RNA, 24 nt, Human
aaaagaagaagaaaaaagaaaaaa

SEQ ID NO: 744942 - RNA, 23 nt, Human
aaacaaaacagggguuaccuucc

SEQ ID NO: 744943 - RNA, 22 nt, Human
aaacaugaagguggcuguaauc

SEQ ID NO: 744944 - RNA, 24 nt, Human
aaaccaacuccacuucuaauuuca

SEQ ID NO: 744945 - RNA, 28 nt, Human
aaaccaacuccacuucuaauuucacaac

SEQ ID NO: 744946 - RNA, 24 nt, Human
aaacuccugggcucaagugauccu

SEQ ID NO: 744947 - RNA, 21 nt, Human
aaagaaaaaaaccaacuccac

SEQ ID NO: 744948 - RNA, 22 nt, Human
aacagccagauguuccccuacg

SEQ ID NO: 744949 - RNA, 24 nt, Human
aagaagaaaaaagaaaaaaaccaa

SEQ ID NO: 744950 - RNA, 19 nt, Human
aagaagaagaaaaaagaaa

SEQ ID NO: 744951 - RNA, 20 nt, Human
aagcuccuuuagagaaaccc

SEQ ID NO: 744952 - RNA, 25 nt, Human
aagugauccucccaccuuggccucc

SEQ ID NO: 744953 - RNA, 24 nt, Human
aaucucuugaaccugggaggcaga

SEQ ID NO: 744954 - RNA, 22 nt, Human
aaugcaaacauaggaggcuaaa

SEQ ID NO: 744955 - RNA, 22 nt, Human
aauggaggauuccucaucugga

SEQ ID NO: 744956 - RNA, 22 nt, Human
acaaagcuccuuuagagaaacc

SEQ ID NO: 744957 - RNA, 22 nt, Human
acacuuagguagcgagcugcag

SEQ ID NO: 744958 - RNA, 22 nt, Human
acccaagggcgcuugccaccac

SEQ ID NO: 744959 - RNA, 20 nt, Human
accuuggccuccugaguagc

SEQ ID NO: 744960 - RNA, 18 nt, Human
acucugucacccaggcug

SEQ ID NO: 744961 - RNA, 25 nt, Human
acucugucacccaggcuggagugca

SEQ ID NO: 744962 - RNA, 19 nt, Human
acugccagaggaaugucag

SEQ ID NO: 744963 - RNA, 20 nt, Human
agaaaaaagaaaaaaaccaa

SEQ ID NO: 744964 - RNA, 22 nt, Human
agaagaagaaaaaagaaaaaaa

SEQ ID NO: 744965 - RNA, 19 nt, Human
agccuccugaauagcugag

SEQ ID NO: 744966 - RNA, 19 nt, Human
aggauuccucaucuggagc

SEQ ID NO: 744967 - RNA, 22 nt, Human
aggcagaagaaucucuugaacc

SEQ ID NO: 744968 - RNA, 24 nt, Human
aggcagaagaaucucuugaaccug

SEQ ID NO: 744969 - RNA, 24 nt, Human
aggcugaggcagaagaaucucuug

SEQ ID NO: 744970 - RNA, 19 nt, Human
aggcuggagugcaguggca

SEQ ID NO: 744971 - RNA, 20 nt, Human
aguaacaaaagcagccaaga

SEQ ID NO: 744972 - RNA, 24 nt, Human
agugauucuccugccucagccucc

SEQ ID NO: 744973 - RNA, 20 nt, Human
agugcaguggcaugaucacg

SEQ ID NO: 744974 - RNA, 23 nt, Human
agugcaguggcaugaucacggcu

SEQ ID NO: 744975 - RNA, 24 nt, Human
agugcaguggcaugaucacggcuc

SEQ ID NO: 744976 - RNA, 18 nt, Human
auucuccugccucagccu

SEQ ID NO: 744977 - RNA, 22 nt, Human
caacuuccuggucucaagugau

SEQ ID NO: 744978 - RNA, 27 nt, Human
caagugauccucccaccuuggccuccu

SEQ ID NO: 744979 - RNA, 20 nt, Human
caagugauucuccugccuca

SEQ ID NO: 744980 - RNA, 22 nt, Human
caagugauucuccugccucagc

SEQ ID NO: 744981 - RNA, 22 nt, Human
cacaggcaugccccuccacacc

SEQ ID NO: 744982 - RNA, 23 nt, Human
cacucugucacccaggcuggagu

SEQ ID NO: 744983 - RNA, 24 nt, Human
cacucugucacccaggcuggagug

SEQ ID NO: 744984 - RNA, 20 nt, Human
cacuuaguuguccaggcuag

SEQ ID NO: 744985 - RNA, 28 nt, Human
cacuuuagacaaaacaaagcuccuuuag

SEQ ID NO: 744986 - RNA, 19 nt, Human
cagccaagacuuguguggc

SEQ ID NO: 744987 - RNA, 19 nt, Human
cagccaagacuuguguggc

SEQ ID NO: 744988 - RNA, 24 nt, Human
cagccucaacuuccuggucucaag

SEQ ID NO: 744989 - RNA, 24 nt, Human
cagcuacuuaggaggcugaggcag

SEQ ID NO: 744990 - RNA, 23 nt, Human
caggcaugccccuccacaccugg

SEQ ID NO: 744991 - RNA, 19 nt, Human
cauugcagccucaacuucc

SEQ ID NO: 744992 - RNA, 18 nt, Human
ccaagggcgcuugccacc

SEQ ID NO: 744993 - RNA, 22 nt, Human
ccaagggcgcuugccaccacuc

SEQ ID NO: 744994 - RNA, 24 nt, Human
ccaagggcgcuugccaccacuccc

SEQ ID NO: 744995 - RNA, 24 nt, Human
ccacaggcaugccccuccacaccu

SEQ ID NO: 744996 - RNA, 23 nt, Human
ccaccuuggccuccugaguagcu

SEQ ID NO: 744997 - RNA, 19 nt, Human
cccaagggcgcuugccacc

SEQ ID NO: 744998 - RNA, 23 nt, Human
cccaggcuggagugcaguggcau

SEQ ID NO: 744999 - RNA, 22 nt, Human
ccccuacgauuccaaacaugag

SEQ ID NO: 745000 - RNA, 24 nt, Human
ccucccaccuuggccuccugagua

SEQ ID NO: 745001 - RNA, 22 nt, Human
ccugggcucaagugauccuccc

SEQ ID NO: 745002 - RNA, 21 nt, Human
ccuggucucaagugauucucc

SEQ ID NO: 745003 - RNA, 21 nt, Human
ccuggucucaagugauucucc

SEQ ID NO: 745004 - RNA, 23 nt, Human
ccuggucucaagugauucuccug

SEQ ID NO: 745005 - RNA, 21 nt, Human
ccuguaaucccagcuacuuag

SEQ ID NO: 745006 - RNA, 22 nt, Human
ccuguaaucccagcuacuuagg

SEQ ID NO: 745007 - RNA, 24 nt, Human
cucaagugauccucccaccuuggc

SEQ ID NO: 745008 - RNA, 20 nt, Human
cucaagugauucuccugccu

SEQ ID NO: 745009 - RNA, 21 nt, Human
cucaagugauucuccugccuc

SEQ ID NO: 745010 - RNA, 23 nt, Human
cucaagugauucuccugccucag

SEQ ID NO: 745011 - RNA, 24 nt, Human
cucaagugauucuccugccucagc

SEQ ID NO: 745012 - RNA, 24 nt, Human
cucacucugucacccaggcuggag

SEQ ID NO: 745013 - RNA, 24 nt, Human
cuccugaauagcugagaccacagg

SEQ ID NO: 745014 - RNA, 23 nt, Human
cuccugggcucaagugauccucc

SEQ ID NO: 745015 - RNA, 25 nt, Human
cuccugggcucaagugauccuccca

SEQ ID NO: 745016 - RNA, 23 nt, Human
cugccucagccuccugaauagcu

SEQ ID NO: 745017 - RNA, 21 nt, Human
cuuccuggucucaagugauuc

SEQ ID NO: 745018 - RNA, 24 nt, Human
cuuccuggucucaagugauucucc

SEQ ID NO: 745019 - RNA, 30 nt, Human
cuuuucauauuaaaaaaaaagaagaagaaa

SEQ ID NO: 745020 - RNA, 20 nt, Human
gaacacaugcauuccucaag

SEQ ID NO: 745021 - RNA, 20 nt, Human
gaaccugggaggcagaggcg

SEQ ID NO: 745022 - RNA, 22 nt, Human
gaagaaaaaagaaaaaaaccaa

SEQ ID NO: 745023 - RNA, 21 nt, Human
gaagaagaaaaaagaaaaaaa

SEQ ID NO: 745024 - RNA, 24 nt, Human
gaauagcugagaccacaggcaugc

SEQ ID NO: 745025 - RNA, 18 nt, Human
gagugcaguggcaugauc

SEQ ID NO: 745026 - RNA, 19 nt, Human
gaguuucugagagggcagc

SEQ ID NO: 745027 - RNA, 21 nt, Human
gaguuuuugucccguggaugu

SEQ ID NO: 745028 - RNA, 20 nt, Human
gcaugaucacggcucauugc

SEQ ID NO: 745029 - RNA, 18 nt, Human
gccuccugaguagcugga

SEQ ID NO: 745030 - RNA, 20 nt, Human
gcgcuugccaccacucccag

SEQ ID NO: 745031 - RNA, 19 nt, Human
gcuagucuaaaacuccugg

SEQ ID NO: 745032 - RNA, 23 nt, Human
gcuagucuaaaacuccugggcuc

SEQ ID NO: 745033 - RNA, 18 nt, Human
gcucaagugauccuccca

SEQ ID NO: 745034 - RNA, 22 nt, Human
gcuccuuuagagaaacccuggc

SEQ ID NO: 745035 - RNA, 18 nt, Human
gcucuuauuucuucuuga

SEQ ID NO: 745036 - RNA, 19 nt, Human
gcuggagugcaguggcaug

SEQ ID NO: 745037 - RNA, 22 nt, Human
gggcucaagugauccucccacc

SEQ ID NO: 745038 - RNA, 23 nt, Human
gugauucuccugccucagccucc

SEQ ID NO: 745039 - RNA, 21 nt, Human
uaaaaaaaaagaagaagaaaa

SEQ ID NO: 745040 - RNA, 18 nt, Human
uaaaauacauuuaaugcu

SEQ ID NO: 745041 - RNA, 25 nt, Human
uaaaucagaaacaugaaucuguacc

SEQ ID NO: 745042 - RNA, 21 nt, Human
uagcgagcugcaggaaaccug

SEQ ID NO: 745043 - RNA, 19 nt, Human
uagcuggacccaagggcgc

SEQ ID NO: 745044 - RNA, 26 nt, Human
uaggaggcugaggcagaagaaucucu

SEQ ID NO: 745045 - RNA, 22 nt, Human
uaguuguccaggcuagucuaaa

SEQ ID NO: 745046 - RNA, 24 nt, Human
ucaagugauccucccaccuuggcc

SEQ ID NO: 745047 - RNA, 19 nt, Human
ucaauccuguguuguuguu

SEQ ID NO: 745048 - RNA, 22 nt, Human
ucacccaggcuggagugcagug

SEQ ID NO: 745049 - RNA, 24 nt, Human
ucacucugucacccaggcuggagu

SEQ ID NO: 745050 - RNA, 21 nt, Human
ucagaaacaugaaucuguacc

SEQ ID NO: 745051 - RNA, 22 nt, Human
ucagugaucaugaguccagcca

SEQ ID NO: 745052 - RNA, 24 nt, Human
ucauauuaaaaaaaaagaagaaga

SEQ ID NO: 745053 - RNA, 21 nt, Human
ucauggaaugcaaacauagga

SEQ ID NO: 745054 - RNA, 23 nt, Human
ucauugcagccucaacuuccugg

SEQ ID NO: 745055 - RNA, 21 nt, Human
uccugggcucaagugauccuc

SEQ ID NO: 745056 - RNA, 24 nt, Human
uccuggucucaagugauucuccug

SEQ ID NO: 745057 - RNA, 22 nt, Human
ucucacucugucacccaggcug

SEQ ID NO: 745058 - RNA, 23 nt, Human
ucucacucugucacccaggcugg

SEQ ID NO: 745059 - RNA, 24 nt, Human
ucucacucugucacccaggcugga

SEQ ID NO: 745060 - RNA, 26 nt, Human
ucucacucugucacccaggcuggagu

SEQ ID NO: 745061 - RNA, 27 nt, Human
ucucacucugucacccaggcuggagug

SEQ ID NO: 745062 - RNA, 22 nt, Human
ucucacuuaguuguccaggcua

SEQ ID NO: 745063 - RNA, 24 nt, Human
ucuccugccucagccuccugaaua

SEQ ID NO: 745064 - RNA, 24 nt, Human
ucugucacccaggcuggagugcag

SEQ ID NO: 745065 - RNA, 24 nt, Human
ugagaccacaggcaugccccucca

SEQ ID NO: 745066 - RNA, 20 nt, Human
ugaggcagaagaaucucuug

SEQ ID NO: 745067 - RNA, 24 nt, Human
ugaggcagaagaaucucuugaacc

SEQ ID NO: 745068 - RNA, 24 nt, Human
ugaggcagaagaaucucuugaacc

SEQ ID NO: 745069 - RNA, 24 nt, Human
ugcaaacauaggaggcuaaagcag

SEQ ID NO: 745070 - RNA, 27 nt, Human
ugccucagccuccugaauagcugagac

SEQ ID NO: 745071 - RNA, 19 nt, Human
uggagugcaguggcaugau

SEQ ID NO: 745072 - RNA, 24 nt, Human
uggagugcaguggcaugaucacgg

SEQ ID NO: 745073 - RNA, 21 nt, Human
uggaugugaaucacuaagaac

SEQ ID NO: 745074 - RNA, 19 nt, Human
uggccuccugaguagcugg

SEQ ID NO: 745075 - RNA, 19 nt, Human
ugggaggcagaggcgcagc

SEQ ID NO: 745076 - RNA, 23 nt, Human
ugggagucuggaguuucugagag

SEQ ID NO: 745077 - RNA, 24 nt, Human
ugggcucaagugauccucccaccu

SEQ ID NO: 745078 - RNA, 23 nt, Human
uggucucaagugauucuccugcc

SEQ ID NO: 745079 - RNA, 24 nt, Human
uggucucaagugauucuccugccu

SEQ ID NO: 745080 - RNA, 19 nt, Human
ugucauugccaugggaguc

SEQ ID NO: 745081 - RNA, 22 nt, Human
ugucauugccaugggagucugg

SEQ ID NO: 745082 - RNA, 20 nt, Human
uuaaaaaaaaagaagaagaa

SEQ ID NO: 745083 - RNA, 20 nt, Human
uuaaauuuuuuguagagaug

SEQ ID NO: 745084 - RNA, 25 nt, Human
uuccagccccaacucugcuggaguc

SEQ ID NO: 745085 - RNA, 25 nt, Human
uuccucaaguuuuagaagauaaaua

SEQ ID NO: 745086 - RNA, 24 nt, Human
uuccuguaaucccagcuacuuagg

SEQ ID NO: 745087 - RNA, 23 nt, Human
uucuucuugaguuuuugucccgu

SEQ ID NO: 745088 - RNA, 23 nt, Human
uuguagagauggagucucacuua

SEQ ID NO: 745089 - RNA, 21 nt, Human
uugugcacuaugucuugccac

SEQ ID NO: 745090 - RNA, 21 nt, Human
uuuaccuacaagucugagggu

SEQ ID NO: 745091 - RNA, 24 nt, Human
uuuagaagauaaauaagguggaaa

SEQ ID NO: 745092 - RNA, 24 nt, Human
uuuuuuguagagauggagucucac

SEQ ID NO: 745093 - RNA, 21 nt, Human
aaaaagccacaggagcaaccc

SEQ ID NO: 745094 - RNA, 24 nt, Human
aaaaagccaggagcacaaaaggug

SEQ ID NO: 745095 - RNA, 23 nt, Human
aaaagaaauagcuaggagaugca

SEQ ID NO: 745096 - RNA, 19 nt, Human
aaaauggcccaguccaacu

SEQ ID NO: 745097 - RNA, 20 nt, Human
aaacaaaaagcaugcaccca

SEQ ID NO: 745098 - RNA, 22 nt, Human
aaacauaaaaggagugaacugg

SEQ ID NO: 745099 - RNA, 22 nt, Human
aaacauaagaaguaaugcauca

SEQ ID NO: 745100 - RNA, 19 nt, Human
aaacuaagaaugacagucu

SEQ ID NO: 745101 - RNA, 21 nt, Human
aaagcagcuguaguuuuaagu

SEQ ID NO: 745102 - RNA, 24 nt, Human
aaaggaacauaauaaaauggccca

SEQ ID NO: 745103 - RNA, 24 nt, Human
aacaaaacuucucuguuugacacu

SEQ ID NO: 745104 - RNA, 20 nt, Human
aacacagauccaggcauuag

SEQ ID NO: 745105 - RNA, 21 nt, Human
aacacagauccaggcauuagg

SEQ ID NO: 745106 - RNA, 18 nt, Human
aaccacugugaccauaac

SEQ ID NO: 745107 - RNA, 20 nt, Human
aagacacucaguuggggagg

SEQ ID NO: 745108 - RNA, 21 nt, Human
aagccuccaagcgaagccucc

SEQ ID NO: 745109 - RNA, 19 nt, Human
aauaaaggauccuaccccu

SEQ ID NO: 745110 - RNA, 23 nt, Human
acaagcacccccuuucuaccccc

SEQ ID NO: 745111 - RNA, 22 nt, Human
acacagauccaggcauuaggca

SEQ ID NO: 745112 - RNA, 21 nt, Human
acacugagcaaacaaaaagca

SEQ ID NO: 745113 - RNA, 19 nt, Human
accaguaugcucucaaucu

SEQ ID NO: 745114 - RNA, 22 nt, Human
acccucaggggcuuaaggcccu

SEQ ID NO: 745115 - RNA, 19 nt, Human
accuguuuacaucccccuu

SEQ ID NO: 745116 - RNA, 19 nt, Human
acucuggcucugaccaccu

SEQ ID NO: 745117 - RNA, 21 nt, Human
acugccaauaaauccauaacc

SEQ ID NO: 745118 - RNA, 22 nt, Human
agcaaacaaaaagcaugcaccc

SEQ ID NO: 745119 - RNA, 20 nt, Human
agccaacauaaacgaguucc

SEQ ID NO: 745120 - RNA, 26 nt, Human
agccacaggagcaacccugacagaga

SEQ ID NO: 745121 - RNA, 19 nt, Human
aggagcacaaaaggugcca

SEQ ID NO: 745122 - RNA, 19 nt, Human
aggagcacaaaaggugcca

SEQ ID NO: 745123 - RNA, 24 nt, Human
agggcacagucaaccaugucacug

SEQ ID NO: 745124 - RNA, 18 nt, Human
auuucuggccauguuggg

SEQ ID NO: 745125 - RNA, 26 nt, Human
caaacaaaaagcaugcacccaaauau

SEQ ID NO: 745126 - RNA, 23 nt, Human
caaagccuccaagcgaagccucc

SEQ ID NO: 745127 - RNA, 23 nt, Human
caaguaccauccauuuacuucuc

SEQ ID NO: 745128 - RNA, 22 nt, Human
cacaaaacggcacuuccccuga

SEQ ID NO: 745129 - RNA, 18 nt, Human
cacagauccaggcauuag

SEQ ID NO: 745130 - RNA, 23 nt, Human
caccaaaccaguggagucccugg

SEQ ID NO: 745131 - RNA, 23 nt, Human
caccaggacccucaggggcuuaa

SEQ ID NO: 745132 - RNA, 22 nt, Human
caccauccauuuguccccuacu

SEQ ID NO: 745133 - RNA, 21 nt, Human
cacccccuuucuacccccaaa

SEQ ID NO: 745134 - RNA, 22 nt, Human
cacccccuuucuacccccaaag

SEQ ID NO: 745135 - RNA, 24 nt, Human
cagccccuccuccguccuuugucc

SEQ ID NO: 745136 - RNA, 27 nt, Human
caucccaccauccauuuguccccuacu

SEQ ID NO: 745137 - RNA, 18 nt, Human
caugcagccuucuccuga

SEQ ID NO: 745138 - RNA, 22 nt, Human
caugggucaaucuaggccaaac

SEQ ID NO: 745139 - RNA, 25 nt, Human
ccaguccaacuaaaacaguccuuga

SEQ ID NO: 745140 - RNA, 21 nt, Human
ccagugggucaucagcuacau

SEQ ID NO: 745141 - RNA, 19 nt, Human
cccagugaaacuaaaguag

SEQ ID NO: 745142 - RNA, 20 nt, Human
cccccaaagccuggcuucug

SEQ ID NO: 745143 - RNA, 19 nt, Human
ccccugaggugggcuggug

SEQ ID NO: 745144 - RNA, 20 nt, Human
ccccugaggugggcuggugg

SEQ ID NO: 745145 - RNA, 21 nt, Human
cccucuacuauuucauauaaa

SEQ ID NO: 745146 - RNA, 19 nt, Human
ccggaggccggcccggguc

SEQ ID NO: 745147 - RNA, 30 nt, Human
ccuccgaccucagcaucccaccauccauuu

SEQ ID NO: 745148 - RNA, 21 nt, Human
ccuccguccuuuguccggagg

SEQ ID NO: 745149 - RNA, 19 nt, Human
cuaaaguagaacacagauc

SEQ ID NO: 745150 - RNA, 20 nt, Human
cuaaaguagaacacagaucc

SEQ ID NO: 745151 - RNA, 19 nt, Human
cuccuuagggccaaugaga

SEQ ID NO: 745152 - RNA, 20 nt, Human
gaagucuugcaugcagccuu

SEQ ID NO: 745153 - RNA, 20 nt, Human
gacagucuauuuccuguggu

SEQ ID NO: 745154 - RNA, 23 nt, Human
gagcaaacaaaaagcaugcaccc

SEQ ID NO: 745155 - RNA, 26 nt, Human
gagcaaacaaaaagcaugcacccaaa

SEQ ID NO: 745156 - RNA, 18 nt, Human
gauucccugagucaccag

SEQ ID NO: 745157 - RNA, 24 nt, Human
gcaaacaaaaagcaugcacccaaa

SEQ ID NO: 745158 - RNA, 18 nt, Human
gcacuuccccugaggugg

SEQ ID NO: 745159 - RNA, 24 nt, Human
ggccaagucaggcggcgcggggcg

SEQ ID NO: 745160 - RNA, 21 nt, Human
ggcccgggucucugcaggcgg

SEQ ID NO: 745161 - RNA, 18 nt, Human
uaaaaaagccacaggagc

SEQ ID NO: 745162 - RNA, 26 nt, Human
uaaaauaagcccuggcagcaaacuaa

SEQ ID NO: 745163 - RNA, 22 nt, Human
uaaaauggcccaguccaacuaa

SEQ ID NO: 745164 - RNA, 23 nt, Human
uaaacacacugucacagaugugg

SEQ ID NO: 745165 - RNA, 18 nt, Human
uaaaguagaacacagauc

SEQ ID NO: 745166 - RNA, 28 nt, Human
uaaaguagaacacagauccaggcauuuu

SEQ ID NO: 745167 - RNA, 24 nt, Human
uaaauagaaacaaaacuucucugu

SEQ ID NO: 745168 - RNA, 21 nt, Human
uacaaaagccauucgcauagc

SEQ ID NO: 745169 - RNA, 20 nt, Human
uacuucauaaauagcaggga

SEQ ID NO: 745170 - RNA, 22 nt, Human
uaggccaaacauaaaaggagug

SEQ ID NO: 745171 - RNA, 19 nt, Human
uagugacugcauuuuuaga

SEQ ID NO: 745172 - RNA, 20 nt, Human
uaguuggaaacaacugaaca

SEQ ID NO: 745173 - RNA, 23 nt, Human
ucaccaaaccaguggagucccug

SEQ ID NO: 745174 - RNA, 20 nt, Human
ucauauaaagacacuaaugu

SEQ ID NO: 745175 - RNA, 22 nt, Human
uccagccccuccuccguccuuu

SEQ ID NO: 745176 - RNA, 25 nt, Human
ucccgcccugcgugcagcggccgga

SEQ ID NO: 745177 - RNA, 20 nt, Human
ucccugagucaccaggaccc

SEQ ID NO: 745178 - RNA, 21 nt, Human
ucccugguugaaaauaagagc

SEQ ID NO: 745179 - RNA, 23 nt, Human
uccgaccucagcaucccaccauc

SEQ ID NO: 745180 - RNA, 18 nt, Human
uccggaggccggcccggg

SEQ ID NO: 745181 - RNA, 22 nt, Human
uccuugagucuauuggucaguu

SEQ ID NO: 745182 - RNA, 24 nt, Human
ucgcagcgccguccagccccuccu

SEQ ID NO: 745183 - RNA, 21 nt, Human
ucucaaucuaaaauaagcccu

SEQ ID NO: 745184 - RNA, 22 nt, Human
ucugcagaccccggguacuacu

SEQ ID NO: 745185 - RNA, 24 nt, Human
ucugcaggcgggcuucgcccgggg

SEQ ID NO: 745186 - RNA, 21 nt, Human
ucugcauugcagugcuacaaa

SEQ ID NO: 745187 - RNA, 23 nt, Human
ucugcauugcagugcuacaaaag

SEQ ID NO: 745188 - RNA, 19 nt, Human
ugaaaagguggguggugag

SEQ ID NO: 745189 - RNA, 21 nt, Human
ugaaaagguggguggugagga

SEQ ID NO: 745190 - RNA, 19 nt, Human
ugacacugagcaaacaaaa

SEQ ID NO: 745191 - RNA, 21 nt, Human
ugagaagagggcaggcauggg

SEQ ID NO: 745192 - RNA, 18 nt, Human
ugagcaaacaaaaagcau

SEQ ID NO: 745193 - RNA, 19 nt, Human
ugagucuauuggucaguuc

SEQ ID NO: 745194 - RNA, 18 nt, Human
ugcaauagugcuaugauu

SEQ ID NO: 745195 - RNA, 21 nt, Human
ugcacccaaauauuucuggcc

SEQ ID NO: 745196 - RNA, 23 nt, Human
ugcacccaaauauuucuggccau

SEQ ID NO: 745197 - RNA, 21 nt, Human
uggagucccuggccaagccuc

SEQ ID NO: 745198 - RNA, 22 nt, Human
uggcaagugcacaaaacggcac

SEQ ID NO: 745199 - RNA, 22 nt, Human
uggggugaaagacccggggcug

SEQ ID NO: 745200 - RNA, 24 nt, Human
ugggucaucagcuacauauacauc

SEQ ID NO: 745201 - RNA, 19 nt, Human
ugguuuuaguagaacagau

SEQ ID NO: 745202 - RNA, 25 nt, Human
uguaguuuuaaguggucuggacauu

SEQ ID NO: 745203 - RNA, 25 nt, Human
ugucacugauaaaaacauaagaagu

SEQ ID NO: 745204 - RNA, 26 nt, Human
uuaaaacaaaaacauuuaaaagaaau

SEQ ID NO: 745205 - RNA, 23 nt, Human
uuaguagaacagauacccacugg

SEQ ID NO: 745206 - RNA, 18 nt, Human
uugcaugcagccuucucc

SEQ ID NO: 745207 - RNA, 18 nt, Human
uugcaugcagccuucucc

SEQ ID NO: 745208 - RNA, 18 nt, Human
uugggaauugggggaugg

SEQ ID NO: 745209 - RNA, 20 nt, Human
uuuucagugauguucuaugg

SEQ ID NO: 745210 - RNA, 21 nt, Human
aaaacaaacaaacaaacaaac

SEQ ID NO: 745211 - RNA, 20 nt, Human
aaacaaaaaacaauggcccc

SEQ ID NO: 745212 - RNA, 21 nt, Human
aaacaaaaaacaauggccccc

SEQ ID NO: 745213 - RNA, 26 nt, Human
aaacaaacaaaaaacaauggccccca

SEQ ID NO: 745214 - RNA, 23 nt, Human
aaacaauggcccccacucacuga

SEQ ID NO: 745215 - RNA, 21 nt, Human
aacaaaaaacaauggccccca

SEQ ID NO: 745216 - RNA, 23 nt, Human
aacaaacaaacaaacaaaaaaca

SEQ ID NO: 745217 - RNA, 23 nt, Human
aacaaacaaacaaacaaacaaac

SEQ ID NO: 745218 - RNA, 23 nt, Human
aacaaacaaacaaacaaacaaac

SEQ ID NO: 745219 - RNA, 18 nt, Human
acaaacaaacaaacaaac

SEQ ID NO: 745220 - RNA, 18 nt, Human
acaaacaaacaaacaaac

SEQ ID NO: 745221 - RNA, 24 nt, Human
acaaacaaacaaacaaacaaaaaa

SEQ ID NO: 745222 - RNA, 23 nt, Human
acacuggagcccucccacggaca

SEQ ID NO: 745223 - RNA, 22 nt, Human
agugguggcagcagcagcagcu

SEQ ID NO: 745224 - RNA, 21 nt, Human
caaaaaacaauggcccccacu

SEQ ID NO: 745225 - RNA, 27 nt, Human
caaacaaaaaacaauggcccccacuca

SEQ ID NO: 745226 - RNA, 25 nt, Human
caaacaaacaaacaaacaaaaaaca

SEQ ID NO: 745227 - RNA, 23 nt, Human
cagcaaacggacaccugacuccu

SEQ ID NO: 745228 - RNA, 22 nt, Human
cagcagcagcagcugcuuccaa

SEQ ID NO: 745229 - RNA, 19 nt, Human
caguggcucacccaccuuc

SEQ ID NO: 745230 - RNA, 21 nt, Human
caguggcucacccaccuuccc

SEQ ID NO: 745231 - RNA, 21 nt, Human
ccaaaaacaaacaaacaaaca

SEQ ID NO: 745232 - RNA, 18 nt, Human
ccccuaauaucccauaga

SEQ ID NO: 745233 - RNA, 21 nt, Human
ccgccugcccucuucccagac

SEQ ID NO: 745234 - RNA, 21 nt, Human
cucccaccugcucugagcacu

SEQ ID NO: 745235 - RNA, 23 nt, Human
cucccaccugcucugagcacuug

SEQ ID NO: 745236 - RNA, 23 nt, Human
cuggaauccuccgccccggguuu

SEQ ID NO: 745237 - RNA, 21 nt, Human
cuggagcccucccacggacaa

SEQ ID NO: 745238 - RNA, 24 nt, Human
gacaggagugguggcagcagcagc

SEQ ID NO: 745239 - RNA, 18 nt, Human
gagugguggcagcagcag

SEQ ID NO: 745240 - RNA, 21 nt, Human
gccaaaaacaaacaaacaaac

SEQ ID NO: 745241 - RNA, 24 nt, Human
gccaaaaacaaacaaacaaacaaa

SEQ ID NO: 745242 - RNA, 22 nt, Human
gccugccuggaauccuccgccc

SEQ ID NO: 745243 - RNA, 22 nt, Human
gggccaaaaacaaacaaacaaa

SEQ ID NO: 745244 - RNA, 18 nt, Human
ggugaaggaaaaggaugc

SEQ ID NO: 745245 - RNA, 19 nt, Human
guggcagcagcagcagcug

SEQ ID NO: 745246 - RNA, 18 nt, Human
ucccagacacuggagccc

SEQ ID NO: 745247 - RNA, 19 nt, Human
ucccagacacuggagcccu

SEQ ID NO: 745248 - RNA, 24 nt, Human
ucugccccuaauaucccauagaug

SEQ ID NO: 745249 - RNA, 19 nt, Human
ugacuccuagagccugccu

SEQ ID NO: 745250 - RNA, 20 nt, Human
ugauagcagcaaacggacac

SEQ ID NO: 745251 - RNA, 20 nt, Human
ugauagcagcaaacggacac

SEQ ID NO: 745252 - RNA, 18 nt, Human
ugcacacuccugggcaag

SEQ ID NO: 745253 - RNA, 19 nt, Human
ugcccucuucccagacacu

SEQ ID NO: 745254 - RNA, 25 nt, Human
uggcagcagcagcagcugcuuccaa

SEQ ID NO: 745255 - RNA, 23 nt, Human
uggcucacccaccuucccccagc

SEQ ID NO: 745256 - RNA, 24 nt, Human
uggcucacccaccuucccccagca

SEQ ID NO: 745257 - RNA, 21 nt, Human
uggggcagagaagucaucuug

SEQ ID NO: 745258 - RNA, 23 nt, Human
uguuuuucccuuuagcuguucca

SEQ ID NO: 745259 - RNA, 23 nt, Human
aaaaaaauuuaaaaauucagccc

SEQ ID NO: 745260 - RNA, 20 nt, Human
aaaaaauuaauucaguagac

SEQ ID NO: 745261 - RNA, 21 nt, Human
aaaaucagaaagcaacauuua

SEQ ID NO: 745262 - RNA, 23 nt, Human
aaacaaagaaauauuuaaucuga

SEQ ID NO: 745263 - RNA, 21 nt, Human
aaacaagucccuccccaucag

SEQ ID NO: 745264 - RNA, 22 nt, Human
aaagcaaaacacuuauuuccaa

SEQ ID NO: 745265 - RNA, 18 nt, Human
aaaguaggcaggcagaaa

SEQ ID NO: 745266 - RNA, 22 nt, Human
aacacaccuacugauugcuuga

SEQ ID NO: 745267 - RNA, 21 nt, Human
aacagaaucauccaccuuuga

SEQ ID NO: 745268 - RNA, 23 nt, Human
aagaagcuucaaacuagacacaa

SEQ ID NO: 745269 - RNA, 20 nt, Human
aagcugccaaaguccaacua

SEQ ID NO: 745270 - RNA, 21 nt, Human
acacuacagccuaucaagacg

SEQ ID NO: 745271 - RNA, 24 nt, Human
acuacagccuaucaagacgaaguu

SEQ ID NO: 745272 - RNA, 19 nt, Human
agaagcauuuauuuuaugc

SEQ ID NO: 745273 - RNA, 24 nt, Human
agaauuauacauaaaaguuuccaa

SEQ ID NO: 745274 - RNA, 26 nt, Human
agacaaaagcaaaacacuuauuucca

SEQ ID NO: 745275 - RNA, 19 nt, Human
agacacuugcaucauguua

SEQ ID NO: 745276 - RNA, 24 nt, Human
agaccaucagacaaaagcaaaaca

SEQ ID NO: 745277 - RNA, 20 nt, Human
agcacauucugcuagggcuu

SEQ ID NO: 745278 - RNA, 23 nt, Human
agcccagaccaucagacaaaagc

SEQ ID NO: 745279 - RNA, 18 nt, Human
aggauuuuacacuuguca

SEQ ID NO: 745280 - RNA, 19 nt, Human
aggcagagaguguguguuc

SEQ ID NO: 745281 - RNA, 19 nt, Human
aggcaggaacuggaaccaa

SEQ ID NO: 745282 - RNA, 20 nt, Human
aggcaggaacuggaaccaag

SEQ ID NO: 745283 - RNA, 19 nt, Human
agggcuuugcggaugaccc

SEQ ID NO: 745284 - RNA, 20 nt, Human
auaaaaaucagaaagcaaca

SEQ ID NO: 745285 - RNA, 22 nt, Human
augcugcauuucuugguuuuau

SEQ ID NO: 745286 - RNA, 21 nt, Human
caaauagcacaaugcugaaaa

SEQ ID NO: 745287 - RNA, 20 nt, Human
caagaauaugcaaaacuacu

SEQ ID NO: 745288 - RNA, 25 nt, Human
caagaguuucugcuguacauuucca

SEQ ID NO: 745289 - RNA, 24 nt, Human
caauccuaaaacaccuccaacuuu

SEQ ID NO: 745290 - RNA, 23 nt, Human
caccuccaacuuuccuuaaaagc

SEQ ID NO: 745291 - RNA, 22 nt, Human
cacucuaacagaaucauccacc

SEQ ID NO: 745292 - RNA, 26 nt, Human
cagaccaucagacaaaagcaaaacac

SEQ ID NO: 745293 - RNA, 23 nt, Human
caggcagaaagaauuauacauaa

SEQ ID NO: 745294 - RNA, 22 nt, Human
caucuuucagucaauacacagc

SEQ ID NO: 745295 - RNA, 22 nt, Human
caugaaaaaauucacaagaaag

SEQ ID NO: 745296 - RNA, 19 nt, Human
caugacaucuagaagcauu

SEQ ID NO: 745297 - RNA, 23 nt, Human
caugugcagcacaagaauaugca

SEQ ID NO: 745298 - RNA, 21 nt, Human
cauuuucuguucagggacauu

SEQ ID NO: 745299 - RNA, 18 nt, Human
ccaugacaucuagaagca

SEQ ID NO: 745300 - RNA, 19 nt, Human
ccauuguucccuaagcauc

SEQ ID NO: 745301 - RNA, 25 nt, Human
cccagaccaucagacaaaagcaaaa

SEQ ID NO: 745302 - RNA, 20 nt, Human
cccauguacacuacagccua

SEQ ID NO: 745303 - RNA, 21 nt, Human
cccguaaacaagucccucccc

SEQ ID NO: 745304 - RNA, 20 nt, Human
cccuacucuugcuucccuua

SEQ ID NO: 745305 - RNA, 23 nt, Human
ccuaagcaucuucugauaccuuu

SEQ ID NO: 745306 - RNA, 21 nt, Human
ccuaugcugaacaaugccaag

SEQ ID NO: 745307 - RNA, 23 nt, Human
ccuaugcugaacaaugccaagaa

SEQ ID NO: 745308 - RNA, 24 nt, Human
cguaaacaagucccuccccaucag

SEQ ID NO: 745309 - RNA, 20 nt, Human
cucaaauauaagucugcacu

SEQ ID NO: 745310 - RNA, 20 nt, Human
cucucaaacuucacucuaac

SEQ ID NO: 745311 - RNA, 18 nt, Human
cugccaaaguccaacuau

SEQ ID NO: 745312 - RNA, 20 nt, Human
cugcuucuguuuggccuuca

SEQ ID NO: 745313 - RNA, 20 nt, Human
cuggaaccaaguguuaagca

SEQ ID NO: 745314 - RNA, 19 nt, Human
cuguaaucauguuaugacu

SEQ ID NO: 745315 - RNA, 20 nt, Human
cuuaaaagcugccaaagucc

SEQ ID NO: 745316 - RNA, 22 nt, Human
cuuacaucauacaaggagcaaa

SEQ ID NO: 745317 - RNA, 24 nt, Human
cuucauuuucuguucagggacauu

SEQ ID NO: 745318 - RNA, 21 nt, Human
cuuuccuuaaaagcugccaaa

SEQ ID NO: 745319 - RNA, 22 nt, Human
gaaaagucuaggggaaggggga

SEQ ID NO: 745320 - RNA, 24 nt, Human
gacaaauuucauguuccuccagaa

SEQ ID NO: 745321 - RNA, 22 nt, Human
gacagucuuuacuccuuuaaaa

SEQ ID NO: 745322 - RNA, 21 nt, Human
gacagugggggcaggauagaa

SEQ ID NO: 745323 - RNA, 25 nt, Human
gcaggcagaaagaauuauacauaaa

SEQ ID NO: 745324 - RNA, 18 nt, Human
ggaagggggagaacagag

SEQ ID NO: 745325 - RNA, 21 nt, Human
ggcaauaaggaagagugggga

SEQ ID NO: 745326 - RNA, 25 nt, Human
gggaagggggagaacagaguugcuu

SEQ ID NO: 745327 - RNA, 18 nt, Human
gggauuuuaauguuuucc

SEQ ID NO: 745328 - RNA, 18 nt, Human
gucugcacuuuuguguug

SEQ ID NO: 745329 - RNA, 22 nt, Human
gucuuacaugccuucguuauuu

SEQ ID NO: 745330 - RNA, 24 nt, Human
gugagcuucauuuucuguucaggg

SEQ ID NO: 745331 - RNA, 19 nt, Human
uaaaacaccuccaacuuuc

SEQ ID NO: 745332 - RNA, 24 nt, Human
uaaaaguuuccaaaaggaaaaaca

SEQ ID NO: 745333 - RNA, 22 nt, Human
uaaaauggaugaauuuucagug

SEQ ID NO: 745334 - RNA, 20 nt, Human
uaaaauugcuaccacaucac

SEQ ID NO: 745335 - RNA, 23 nt, Human
uaacaugggaauuccuggcucua

SEQ ID NO: 745336 - RNA, 23 nt, Human
uaagaaaagucuaggggaagggg

SEQ ID NO: 745337 - RNA, 18 nt, Human
uaaggaaauggagugagc

SEQ ID NO: 745338 - RNA, 24 nt, Human
uacaagguucugcuucaaguuuuu

SEQ ID NO: 745339 - RNA, 24 nt, Human
uacucucaaacuucacucuaacag

SEQ ID NO: 745340 - RNA, 23 nt, Human
uacuuuacauuauacacacuuuu

SEQ ID NO: 745341 - RNA, 23 nt, Human
uaucacaaaauuaaaaaccugag

SEQ ID NO: 745342 - RNA, 22 nt, Human
uaugcugaacaaugccaagaaa

SEQ ID NO: 745343 - RNA, 20 nt, Human
uauguguacacauaaagugc

SEQ ID NO: 745344 - RNA, 24 nt, Human
uauuuuauauagauaauggagagu

SEQ ID NO: 745345 - RNA, 24 nt, Human
uccaaaaggaaaaacaaagaaaua

SEQ ID NO: 745346 - RNA, 19 nt, Human
ucccguaaacaagucccuc

SEQ ID NO: 745347 - RNA, 22 nt, Human
ucuggacaugagaaaagacaaa

SEQ ID NO: 745348 - RNA, 23 nt, Human
ugacauuuacucucaaacuucac

SEQ ID NO: 745349 - RNA, 22 nt, Human
ugccuucguuauuuuguuauca

SEQ ID NO: 745350 - RNA, 19 nt, Human
uggacagugggggcaggau

SEQ ID NO: 745351 - RNA, 18 nt, Human
uuagcauuuuaugguagg

SEQ ID NO: 745352 - RNA, 21 nt, Human
uuauaaaaccaaaugcuggac

SEQ ID NO: 745353 - RNA, 22 nt, Human
uuauaaaaccaaaugcuggaca

SEQ ID NO: 745354 - RNA, 21 nt, Human
uucaaacuagacacaaagggu

SEQ ID NO: 745355 - RNA, 18 nt, Human
uuccaaauauuccaacau

SEQ ID NO: 745356 - RNA, 19 nt, Human
uucccguaaacaagucccu

SEQ ID NO: 745357 - RNA, 20 nt, Human
uuccuuaaaagcugccaaag

SEQ ID NO: 745358 - RNA, 18 nt, Human
uuuaacuucucuccugca

SEQ ID NO: 745359 - RNA, 19 nt, Human
uuuccaaaaggaaaaacaa

SEQ ID NO: 745360 - RNA, 24 nt, Human
uuuggccuucauuuucucccuuug

SEQ ID NO: 745361 - RNA, 22 nt, Human
uuuuugcagaagcuggagccug

SEQ ID NO: 745362 - RNA, 21 nt, Human
aacacagaaaacugcaguuag

SEQ ID NO: 745363 - RNA, 19 nt, Human
aacccaggacgcgaaccca

SEQ ID NO: 745364 - RNA, 23 nt, Human
aagcaucagagccucugugaacc

SEQ ID NO: 745365 - RNA, 19 nt, Human
acccaggcccagggcuggg

SEQ ID NO: 745366 - RNA, 21 nt, Human
acccuacaaaauugaacaaca

SEQ ID NO: 745367 - RNA, 18 nt, Human
acugcagccaccgccggc

SEQ ID NO: 745368 - RNA, 19 nt, Human
acugcagccaccgccggcc

SEQ ID NO: 745369 - RNA, 18 nt, Human
aggcggcgggccgggggc

SEQ ID NO: 745370 - RNA, 23 nt, Human
caacccaggacgcgaacccacag

SEQ ID NO: 745371 - RNA, 24 nt, Human
caccagcaaucaaccaaaaagcau

SEQ ID NO: 745372 - RNA, 23 nt, Human
cacccaggcccagggcugggcug

SEQ ID NO: 745373 - RNA, 18 nt, Human
cacggcccagagaucagg

SEQ ID NO: 745374 - RNA, 18 nt, Human
cacggcccagagaucagg

SEQ ID NO: 745375 - RNA, 20 nt, Human
cacugcagccaccgccggcc

SEQ ID NO: 745376 - RNA, 18 nt, Human
cagaacacagaaaacugc

SEQ ID NO: 745377 - RNA, 19 nt, Human
cagagccucugugaaccug

SEQ ID NO: 745378 - RNA, 22 nt, Human
cagccaccgccggccauucuca

SEQ ID NO: 745379 - RNA, 22 nt, Human
cagcuuaaaaaggaugacuaga

SEQ ID NO: 745380 - RNA, 21 nt, Human
cagggccagcgcgcuccgccc

SEQ ID NO: 745381 - RNA, 21 nt, Human
caguuuucagaugugcucugg

SEQ ID NO: 745382 - RNA, 25 nt, Human
caucacacacacgcacggcuacgcc

SEQ ID NO: 745383 - RNA, 22 nt, Human
cauguugguguacauauauaca

SEQ ID NO: 745384 - RNA, 21 nt, Human
ccaccgccggccauucucacc

SEQ ID NO: 745385 - RNA, 20 nt, Human
ccaggacgcgaacccacagc

SEQ ID NO: 745386 - RNA, 18 nt, Human
ccaggcccagggcugggc

SEQ ID NO: 745387 - RNA, 21 nt, Human
ccaucacacacacgcacggcu

SEQ ID NO: 745388 - RNA, 18 nt, Human
cccagagaucagguccuc

SEQ ID NO: 745389 - RNA, 19 nt, Human
ccccccgccuccccgccuc

SEQ ID NO: 745390 - RNA, 22 nt, Human
ccccccgccuccccgccucccc

SEQ ID NO: 745391 - RNA, 20 nt, Human
cccccgccuccccgccuccc

SEQ ID NO: 745392 - RNA, 31 nt, Human
ccccgccgcccgccgcgcggaccccgccugg

SEQ ID NO: 745393 - RNA, 23 nt, Human
ccccgccuccccgcgcgccgccg

SEQ ID NO: 745394 - RNA, 19 nt, Human
cccgccgcgcggaccccgc

SEQ ID NO: 745395 - RNA, 20 nt, Human
cccgccgcgcggaccccgcc

SEQ ID NO: 745396 - RNA, 20 nt, Human
cccgcgcgccgccgcugccg

SEQ ID NO: 745397 - RNA, 23 nt, Human
cccgcgcgccgccgcugccgccg

SEQ ID NO: 745398 - RNA, 18 nt, Human
cccgcgucccacgucccg

SEQ ID NO: 745399 - RNA, 23 nt, Human
cccgcgucccacgucccggggga

SEQ ID NO: 745400 - RNA, 19 nt, Human
ccgcccgucccccgccgcc

SEQ ID NO: 745401 - RNA, 20 nt, Human
ccgcccgucccccgccgccc

SEQ ID NO: 745402 - RNA, 26 nt, Human
ccgccgcccgccgcgcggaccccgcc

SEQ ID NO: 745403 - RNA, 20 nt, Human
ccgccuccccgccuccccgc

SEQ ID NO: 745404 - RNA, 18 nt, Human
ccgcgcgccgccgcugcc

SEQ ID NO: 745405 - RNA, 25 nt, Human
ccgcgcgccgccgcugccgccgccc

SEQ ID NO: 745406 - RNA, 22 nt, Human
ccgcgcggaccccgccugcgcc

SEQ ID NO: 745407 - RNA, 18 nt, Human
ccgcugccgccgccccgc

SEQ ID NO: 745408 - RNA, 19 nt, Human
ccucaucacuccacuuaca

SEQ ID NO: 745409 - RNA, 19 nt, Human
ccuuccuugcagccacgga

SEQ ID NO: 745410 - RNA, 24 nt, Human
cgccgccccgcgcccgggccgcgc

SEQ ID NO: 745411 - RNA, 22 nt, Human
cgccgccgcugccgccgccccg

SEQ ID NO: 745412 - RNA, 22 nt, Human
cgccgcugccgccgccccgcgc

SEQ ID NO: 745413 - RNA, 23 nt, Human
cgucuguuaaauaaaaguuucau

SEQ ID NO: 745414 - RNA, 21 nt, Human
cuccccgcgcgccgccgcugc

SEQ ID NO: 745415 - RNA, 22 nt, Human
cugcgcccgcgucccacguccc

SEQ ID NO: 745416 - RNA, 21 nt, Human
cuguccugggagcuucccaac

SEQ ID NO: 745417 - RNA, 21 nt, Human
gaaaacugcaguuaggaacac

SEQ ID NO: 745418 - RNA, 26 nt, Human
gaacacagaaaacugcaguuaggaac

SEQ ID NO: 745419 - RNA, 18 nt, Human
gacaacgucugcaaaugc

SEQ ID NO: 745420 - RNA, 19 nt, Human
ggacgcgaacccacagcuc

SEQ ID NO: 745421 - RNA, 19 nt, Human
ggcaagcgguacccaugag

SEQ ID NO: 745422 - RNA, 20 nt, Human
ggccgggccccccgccuccc

SEQ ID NO: 745423 - RNA, 21 nt, Human
ggccgggggcgggccggaggc

SEQ ID NO: 745424 - RNA, 24 nt, Human
ggccgggggcgggccggaggcugc

SEQ ID NO: 745425 - RNA, 20 nt, Human
ggcugugaugguaagaaccc

SEQ ID NO: 745426 - RNA, 18 nt, Human
gggcagcuuggccuuccu

SEQ ID NO: 745427 - RNA, 21 nt, Human
gggccccccgccuccccgccu

SEQ ID NO: 745428 - RNA, 20 nt, Human
gggccgaggcgguguccucu

SEQ ID NO: 745429 - RNA, 19 nt, Human
gggccgggggcgggccgga

SEQ ID NO: 745430 - RNA, 25 nt, Human
gggcgcggggagggggcgcaggggc

SEQ ID NO: 745431 - RNA, 24 nt, Human
gggcugggcugccgagcagcugcc

SEQ ID NO: 745432 - RNA, 18 nt, Human
ggggaggggcgcgcagag

SEQ ID NO: 745433 - RNA, 20 nt, Human
gugauucccagggagggcag

SEQ ID NO: 745434 - RNA, 21 nt, Human
uaaaaguuucauguuggugua

SEQ ID NO: 745435 - RNA, 22 nt, Human
uaagaaccaaauguuuccuaag

SEQ ID NO: 745436 - RNA, 18 nt, Human
uagcagacggggaggggc

SEQ ID NO: 745437 - RNA, 22 nt, Human
uauaauagacuguuucccuucc

SEQ ID NO: 745438 - RNA, 19 nt, Human
uauacagggcuauguauaa

SEQ ID NO: 745439 - RNA, 22 nt, Human
ucagagccucugugaaccuggc

SEQ ID NO: 745440 - RNA, 21 nt, Human
ucagguccucaucacuccacu

SEQ ID NO: 745441 - RNA, 24 nt, Human
ucccccgccgcccgccgcgcggac

SEQ ID NO: 745442 - RNA, 19 nt, Human
uccccgcgcgccgccgcug

SEQ ID NO: 745443 - RNA, 22 nt, Human
uccccgcgcgccgccgcugccg

SEQ ID NO: 745444 - RNA, 25 nt, Human
uccccgcgcgccgccgcugccgccg

SEQ ID NO: 745445 - RNA, 23 nt, Human
uccucaggcuaccacugcagcca

SEQ ID NO: 745446 - RNA, 19 nt, Human
ugaacccacccaggcccag

SEQ ID NO: 745447 - RNA, 19 nt, Human
ugauugcaguuuucagaug

SEQ ID NO: 745448 - RNA, 21 nt, Human
ugcagccaccgccggccauuc

SEQ ID NO: 745449 - RNA, 21 nt, Human
ugcagggccagcgcgcuccgc

SEQ ID NO: 745450 - RNA, 24 nt, Human
ugcuuuauuucucuaccggcuuca

SEQ ID NO: 745451 - RNA, 18 nt, Human
uugacccaaccgacaagc

SEQ ID NO: 745452 - RNA, 21 nt, Human
aaaaaaccaaaauccaaaaca

SEQ ID NO: 745453 - RNA, 23 nt, Human
aaaaaccccacaaaaaaccaaaa

SEQ ID NO: 745454 - RNA, 19 nt, Human
aaaaacuccuuacuguaau

SEQ ID NO: 745455 - RNA, 20 nt, Human
aaaaccccacaaaaaaccaa

SEQ ID NO: 745456 - RNA, 20 nt, Human
aaaaggcuuggagagaguuu

SEQ ID NO: 745457 - RNA, 21 nt, Human
aaaccccacaaaaaaccaaaa

SEQ ID NO: 745458 - RNA, 18 nt, Human
aaagucaaacaaacaaua

SEQ ID NO: 745459 - RNA, 22 nt, Human
aaauaaauucacgcaaaaguaa

SEQ ID NO: 745460 - RNA, 23 nt, Human
aaauuucagauuauauaacacau

SEQ ID NO: 745461 - RNA, 24 nt, Human
aaccucccuuacacaaaagacaaa

SEQ ID NO: 745462 - RNA, 23 nt, Human
aaggcaggaagacugcuugaacc

SEQ ID NO: 745463 - RNA, 19 nt, Human
acaaaguuaauuuuuacag

SEQ ID NO: 745464 - RNA, 20 nt, Human
acacacacacacacacagga

SEQ ID NO: 745465 - RNA, 23 nt, Human
acccucuuggucuucugaaacag

SEQ ID NO: 745466 - RNA, 18 nt, Human
agauaaauccaacuguga

SEQ ID NO: 745467 - RNA, 20 nt, Human
agccaaucuuccccacagcu

SEQ ID NO: 745468 - RNA, 19 nt, Human
agccugggcaauguaguga

SEQ ID NO: 745469 - RNA, 20 nt, Human
agccugggcaauguagugag

SEQ ID NO: 745470 - RNA, 23 nt, Human
agccugggcaauguagugaggcc

SEQ ID NO: 745471 - RNA, 18 nt, Human
aggaguucaagacuagcc

SEQ ID NO: 745472 - RNA, 24 nt, Human
aggcaggaagacugcuugaaccca

SEQ ID NO: 745473 - RNA, 24 nt, Human
aguaggcuauuauuuuccuuugga

SEQ ID NO: 745474 - RNA, 23 nt, Human
auaaaugccaugugccaguuuua

SEQ ID NO: 745475 - RNA, 19 nt, Human
auauauauauauauauaua

SEQ ID NO: 745476 - RNA, 25 nt, Human
auccugaauucugcauugaguuucc

SEQ ID NO: 745477 - RNA, 22 nt, Human
aucguuuuuuaacaagauaacu

SEQ ID NO: 745478 - RNA, 20 nt, Human
caaaacacuucaggucccaa

SEQ ID NO: 745479 - RNA, 24 nt, Human
caaaacacuucaggucccaaccag

SEQ ID NO: 745480 - RNA, 21 nt, Human
caaaacaucuuuguuaaauaa

SEQ ID NO: 745481 - RNA, 23 nt, Human
caaaauaauaauuuaaaaacccc

SEQ ID NO: 745482 - RNA, 25 nt, Human
caaccuguaguaccaugggagccaa

SEQ ID NO: 745483 - RNA, 26 nt, Human
caacugugaaaauauagaaaaacucc

SEQ ID NO: 745484 - RNA, 24 nt, Human
caacuuucuaccagaaaguacacu

SEQ ID NO: 745485 - RNA, 25 nt, Human
caagaaauguuccaaaauucaaaaa

SEQ ID NO: 745486 - RNA, 25 nt, Human
cacgcaaaaguaauaaaaagguuuu

SEQ ID NO: 745487 - RNA, 22 nt, Human
cagaaaguacacuaaugugaga

SEQ ID NO: 745488 - RNA, 20 nt, Human
caucuuuguuaaauaaauuc

SEQ ID NO: 745489 - RNA, 24 nt, Human
caugcccagguacuuguauugucc

SEQ ID NO: 745490 - RNA, 27 nt, Human
cauuucaaauguuuuugcagcaacuuu

SEQ ID NO: 745491 - RNA, 19 nt, Human
ccaaaacacuucagguccc

SEQ ID NO: 745492 - RNA, 26 nt, Human
ccacaaaaaaccaaaauccaaaacac

SEQ ID NO: 745493 - RNA, 21 nt, Human
ccacaaaaauggagauucaua

SEQ ID NO: 745494 - RNA, 21 nt, Human
cccagguacuuguauuguccc

SEQ ID NO: 745495 - RNA, 19 nt, Human
cccuuacacaaaagacaaa

SEQ ID NO: 745496 - RNA, 19 nt, Human
ccuguaaucccugcuacuu

SEQ ID NO: 745497 - RNA, 22 nt, Human
ccuguaaucccugcuacuuagg

SEQ ID NO: 745498 - RNA, 22 nt, Human
cgcaaaaguaauaaaaagguuu

SEQ ID NO: 745499 - RNA, 18 nt, Human
cuagauaauauccauaga

SEQ ID NO: 745500 - RNA, 22 nt, Human
cuagccucuagaaccucccuua

SEQ ID NO: 745501 - RNA, 19 nt, Human
cucauugaagcauuuccaa

SEQ ID NO: 745502 - RNA, 23 nt, Human
cugucacaaguucacucauugau

SEQ ID NO: 745503 - RNA, 22 nt, Human
cuuacacaaagacauauauaug

SEQ ID NO: 745504 - RNA, 20 nt, Human
cuugaacccaggaguucaag

SEQ ID NO: 745505 - RNA, 23 nt, Human
cuugaacccaggaguucaagacu

SEQ ID NO: 745506 - RNA, 24 nt, Human
gaaaaggauuccuuaauaugcuga

SEQ ID NO: 745507 - RNA, 18 nt, Human
gaaaauauagaaaaacuc

SEQ ID NO: 745508 - RNA, 21 nt, Human
gaaacaagaaauguuccaaaa

SEQ ID NO: 745509 - RNA, 18 nt, Human
gaaacagagaugcagaaa

SEQ ID NO: 745510 - RNA, 19 nt, Human
gaacaaaaguguacagaua

SEQ ID NO: 745511 - RNA, 18 nt, Human
gacacauaagggaaaugc

SEQ ID NO: 745512 - RNA, 22 nt, Human
gcaggaagacugcuugaaccca

SEQ ID NO: 745513 - RNA, 20 nt, Human
gccuguaaucccugcuacuu

SEQ ID NO: 745514 - RNA, 22 nt, Human
gcuugaacccaggaguucaaga

SEQ ID NO: 745515 - RNA, 22 nt, Human
ggaagaagaaaccagaaaaaaa

SEQ ID NO: 745516 - RNA, 18 nt, Human
gucuucugaaacagagau

SEQ ID NO: 745517 - RNA, 22 nt, Human
uaaaaaccccacaaaaaaccaa

SEQ ID NO: 745518 - RNA, 19 nt, Human
uaaaacuuggugcugcuga

SEQ ID NO: 745519 - RNA, 23 nt, Human
uaaaaugaacaaaaguguacaga

SEQ ID NO: 745520 - RNA, 18 nt, Human
uacacaaaagacaaaaca

SEQ ID NO: 745521 - RNA, 20 nt, Human
uacacacacacacacacaca

SEQ ID NO: 745522 - RNA, 21 nt, Human
uacucagucugguaagucacc

SEQ ID NO: 745523 - RNA, 24 nt, Human
uagaaaaacuccacaaaaauggag

SEQ ID NO: 745524 - RNA, 18 nt, Human
uagccucuagaaccuccc

SEQ ID NO: 745525 - RNA, 20 nt, Human
uagccugggcaauguaguga

SEQ ID NO: 745526 - RNA, 19 nt, Human
uauaacacauaacacagga

SEQ ID NO: 745527 - RNA, 25 nt, Human
uauauacacacacacacacacacag

SEQ ID NO: 745528 - RNA, 26 nt, Human
uauauacacacacacacacacacagg

SEQ ID NO: 745529 - RNA, 18 nt, Human
uauauauauauauauaca

SEQ ID NO: 745530 - RNA, 18 nt, Human
uauauauauauauauaua

SEQ ID NO: 745531 - RNA, 19 nt, Human
uauauauauauauauauau

SEQ ID NO: 745532 - RNA, 21 nt, Human
uauauauauauauauauauac

SEQ ID NO: 745533 - RNA, 20 nt, Human
uauauauuuauauauauaua

SEQ ID NO: 745534 - RNA, 22 nt, Human
uauauuuauauauauauauaua

SEQ ID NO: 745535 - RNA, 24 nt, Human
uccaaaauaauaauuuaaaaaccc

SEQ ID NO: 745536 - RNA, 19 nt, Human
uccaaauauugguacgggg

SEQ ID NO: 745537 - RNA, 21 nt, Human
uccacaaaaauggagauucau

SEQ ID NO: 745538 - RNA, 20 nt, Human
uccccagaaauacucagucu

SEQ ID NO: 745539 - RNA, 19 nt, Human
ucuaccagaaaguacacua

SEQ ID NO: 745540 - RNA, 22 nt, Human
ugaacaaaaguguacagauaug

SEQ ID NO: 745541 - RNA, 23 nt, Human
ugaacccaggaguucaagacuag

SEQ ID NO: 745542 - RNA, 21 nt, Human
ugacacauaagggaaaugcuc

SEQ ID NO: 745543 - RNA, 23 nt, Human
ugagaccaauggccucuucucuc

SEQ ID NO: 745544 - RNA, 23 nt, Human
ugaguaucccuaaucuaaaaguc

SEQ ID NO: 745545 - RNA, 24 nt, Human
ugccuguaaucccugcuacuuagg

SEQ ID NO: 745546 - RNA, 19 nt, Human
ugccuuggauuuaaaacau

SEQ ID NO: 745547 - RNA, 20 nt, Human
uggaagaagaaaccagaaaa

SEQ ID NO: 745548 - RNA, 19 nt, Human
uggagauucauacuuaaaa

SEQ ID NO: 745549 - RNA, 19 nt, Human
uggcuguagcauuaauuuu

SEQ ID NO: 745550 - RNA, 18 nt, Human
uguaaucccugcuacuua

SEQ ID NO: 745551 - RNA, 24 nt, Human
uguaauuaccauuuuguuucuucu

SEQ ID NO: 745552 - RNA, 18 nt, Human
ugucuggaauaauuccag

SEQ ID NO: 745553 - RNA, 21 nt, Human
ugugaaaauauagaaaaacuc

SEQ ID NO: 745554 - RNA, 21 nt, Human
uucaggucccaaccauuuuga

SEQ ID NO: 745555 - RNA, 18 nt, Human
uuccugauuguaacauug

SEQ ID NO: 745556 - RNA, 18 nt, Human
uugaaugguuguuuccag

SEQ ID NO: 745557 - RNA, 19 nt, Human
uugaaugguuguuuccagu

SEQ ID NO: 745558 - RNA, 23 nt, Human
uugcagcaacuuucuaccagaaa

SEQ ID NO: 745559 - RNA, 23 nt, Human
uuggagagaguuuuauuucaguu

SEQ ID NO: 745560 - RNA, 19 nt, Human
uugguacaacaugaaccuc

SEQ ID NO: 745561 - RNA, 23 nt, Human
uuuaaaauuuuuauccugaauuc

SEQ ID NO: 745562 - RNA, 24 nt, Human
uuuaagcaauaaaaauuggcaugu

SEQ ID NO: 745563 - RNA, 19 nt, Human
uuuauauauauauauauau

SEQ ID NO: 745564 - RNA, 20 nt, Human
uuuauauauauauauauauu

SEQ ID NO: 745565 - RNA, 23 nt, Human
uuuaugaagcuuccaauuuuaaa

SEQ ID NO: 745566 - RNA, 23 nt, Human
uuugaaaugcuaccacugucaca

SEQ ID NO: 745567 - RNA, 21 nt, Human
uuugcucaaauguagaaaagg

SEQ ID NO: 745568 - RNA, 22 nt, Human
uuuuacagucacugccacauua

SEQ ID NO: 745569 - RNA, 25 nt, Human
uuuuaugaagcuuccaauuuuaaaa

SEQ ID NO: 745570 - RNA, 21 nt, Human
aaagauugcugccucagacaa

SEQ ID NO: 745571 - RNA, 18 nt, Human
aagagagagaagaagagg

SEQ ID NO: 745572 - RNA, 21 nt, Human
aagcagcagcccggauucuca

SEQ ID NO: 745573 - RNA, 20 nt, Human
aagcagcugagaaccaccug

SEQ ID NO: 745574 - RNA, 19 nt, Human
aagcaggaggaaaagcucc

SEQ ID NO: 745575 - RNA, 27 nt, Human
aaggggacaaugaagagagcuaaggga

SEQ ID NO: 745576 - RNA, 19 nt, Human
aagugaaaaacaacucacc

SEQ ID NO: 745577 - RNA, 21 nt, Human
acaaugaagagagcuaaggga

SEQ ID NO: 745578 - RNA, 23 nt, Human
accauguucuauaaccaaggagc

SEQ ID NO: 745579 - RNA, 21 nt, Human
acuccuuccuucuuccuccug

SEQ ID NO: 745580 - RNA, 19 nt, Human
acugucuccuuccucuuuc

SEQ ID NO: 745581 - RNA, 21 nt, Human
agaaauacaggcauagaggca

SEQ ID NO: 745582 - RNA, 23 nt, Human
agaaauacaggcauagaggcaag

SEQ ID NO: 745583 - RNA, 20 nt, Human
agaagaagaggagaagaaga

SEQ ID NO: 745584 - RNA, 19 nt, Human
agaagccaauccagcuggu

SEQ ID NO: 745585 - RNA, 18 nt, Human
agagaagaagaggagaag

SEQ ID NO: 745586 - RNA, 18 nt, Human
agagagcaguagcugaaa

SEQ ID NO: 745587 - RNA, 18 nt, Human
agagcccuccgccuucuc

SEQ ID NO: 745588 - RNA, 20 nt, Human
agaggcaagagagagaagaa

SEQ ID NO: 745589 - RNA, 22 nt, Human
agaggcaagagagagaagaaga

SEQ ID NO: 745590 - RNA, 22 nt, Human
agaugguagcuaggcccaagca

SEQ ID NO: 745591 - RNA, 23 nt, Human
agcggucacucccgccuuaagcc

SEQ ID NO: 745592 - RNA, 21 nt, Human
aggaaucugcgaagcugcggc

SEQ ID NO: 745593 - RNA, 25 nt, Human
aggagaagaagauagcaggaaguaa

SEQ ID NO: 745594 - RNA, 21 nt, Human
aggaggaauggaguagaccua

SEQ ID NO: 745595 - RNA, 19 nt, Human
aggagucagucuagggcuc

SEQ ID NO: 745596 - RNA, 19 nt, Human
aggcaagagagagaagaag

SEQ ID NO: 745597 - RNA, 27 nt, Human
aggcaagagagagaagaagagggaccc

SEQ ID NO: 745598 - RNA, 23 nt, Human
aggcacuugacuuauucaaguaa

SEQ ID NO: 745599 - RNA, 18 nt, Human
aggcaggaggccggcagc

SEQ ID NO: 745600 - RNA, 22 nt, Human
aggcaggaggccggcagcagga

SEQ ID NO: 745601 - RNA, 23 nt, Human
aggcagggaaggggccagcugca

SEQ ID NO: 745602 - RNA, 24 nt, Human
aggccugucauauugccagaaaua

SEQ ID NO: 745603 - RNA, 22 nt, Human
agggacuucuggguccccaugg

SEQ ID NO: 745604 - RNA, 24 nt, Human
agggggugcugcugggacucaagg

SEQ ID NO: 745605 - RNA, 22 nt, Human
aguaaaggggacaaugaagaga

SEQ ID NO: 745606 - RNA, 24 nt, Human
agucuccaggagguccaagaguag

SEQ ID NO: 745607 - RNA, 21 nt, Human
augccaaagauugcugccuca

SEQ ID NO: 745608 - RNA, 22 nt, Human
auggagcccuggugaaaggcug

SEQ ID NO: 745609 - RNA, 25 nt, Human
auggagcccuggugaaaggcugcug

SEQ ID NO: 745610 - RNA, 18 nt, Human
caaacaguggauggugac

SEQ ID NO: 745611 - RNA, 24 nt, Human
caagcaggaggaaaagcuccacag

SEQ ID NO: 745612 - RNA, 26 nt, Human
caagugaaaaacaacucaccucaaac

SEQ ID NO: 745613 - RNA, 23 nt, Human
cacaaaaagggggugcugcuggg

SEQ ID NO: 745614 - RNA, 23 nt, Human
cacacacaacauccccuaaccac

SEQ ID NO: 745615 - RNA, 21 nt, Human
caccaggaauacgcaacuauc

SEQ ID NO: 745616 - RNA, 20 nt, Human
caccuggcucagagcaggau

SEQ ID NO: 745617 - RNA, 27 nt, Human
cacugggaggugacuuugcccccggga

SEQ ID NO: 745618 - RNA, 22 nt, Human
cacugucuccuuccucuuucug

SEQ ID NO: 745619 - RNA, 24 nt, Human
cagaaauacaggcauagaggcaag

SEQ ID NO: 745620 - RNA, 19 nt, Human
cagaauggagucagucacu

SEQ ID NO: 745621 - RNA, 20 nt, Human
cagauggagcccuggugaaa

SEQ ID NO: 745622 - RNA, 23 nt, Human
cagcaacggggggacaagaggaa

SEQ ID NO: 745623 - RNA, 22 nt, Human
cagcagcacgcagagcucuggu

SEQ ID NO: 745624 - RNA, 18 nt, Human
cagcagccggucgcuucc

SEQ ID NO: 745625 - RNA, 20 nt, Human
cagcccggauucucaauaac

SEQ ID NO: 745626 - RNA, 18 nt, Human
caggacagccccagggaa

SEQ ID NO: 745627 - RNA, 21 nt, Human
caggcccaggcaggaggccgg

SEQ ID NO: 745628 - RNA, 20 nt, Human
caguguagagaaccugggau

SEQ ID NO: 745629 - RNA, 22 nt, Human
cauggcaggucugaggggcaag

SEQ ID NO: 745630 - RNA, 18 nt, Human
ccaaagauugcugccuca

SEQ ID NO: 745631 - RNA, 24 nt, Human
ccaagcaggaggaaaagcuccaca

SEQ ID NO: 745632 - RNA, 21 nt, Human
ccagaaauacaggcauagagg

SEQ ID NO: 745633 - RNA, 24 nt, Human
ccaggaauacgcaacuauccaagg

SEQ ID NO: 745634 - RNA, 19 nt, Human
cccaagcucagcucaaagu

SEQ ID NO: 745635 - RNA, 23 nt, Human
ccccagggcaguguagagaaccc

SEQ ID NO: 745636 - RNA, 22 nt, Human
cccggauucucaauaaccuccg

SEQ ID NO: 745637 - RNA, 22 nt, Human
ccguacacgucgccgauagaca

SEQ ID NO: 745638 - RNA, 21 nt, Human
ccugagcacaggcagccacca

SEQ ID NO: 745639 - RNA, 22 nt, Human
ccuguagaugccaaagauugcu

SEQ ID NO: 745640 - RNA, 23 nt, Human
ccuucccccuucucaaagcuggg

SEQ ID NO: 745641 - RNA, 22 nt, Human
ccuucuuccuccuggcacuguc

SEQ ID NO: 745642 - RNA, 22 nt, Human
ccuuggaaagagagcaguagcu

SEQ ID NO: 745643 - RNA, 19 nt, Human
cgauagacaccuaaggcuu

SEQ ID NO: 745644 - RNA, 19 nt, Human
cggccagcccucuucuugg

SEQ ID NO: 745645 - RNA, 19 nt, Human
cuauaaccaaggagcagca

SEQ ID NO: 745646 - RNA, 18 nt, Human
cucccgccuuaagcccag

SEQ ID NO: 745647 - RNA, 18 nt, Human
cuccuuccuucuuccucc

SEQ ID NO: 745648 - RNA, 18 nt, Human
cugaugcaugggaggcug

SEQ ID NO: 745649 - RNA, 18 nt, Human
cugcagaaacugugggag

SEQ ID NO: 745650 - RNA, 19 nt, Human
cuuccugggcugccagaau

SEQ ID NO: 745651 - RNA, 24 nt, Human
cuucuuccuccuggcacugucucc

SEQ ID NO: 745652 - RNA, 18 nt, Human
cuucuuggaucucgcugu

SEQ ID NO: 745653 - RNA, 22 nt, Human
gaaaagcuccacaggacagccc

SEQ ID NO: 745654 - RNA, 22 nt, Human
gaaaggacagaucauagguggg

SEQ ID NO: 745655 - RNA, 21 nt, Human
gaagaggagaagaagauagca

SEQ ID NO: 745656 - RNA, 21 nt, Human
gaauggagucagucacucugc

SEQ ID NO: 745657 - RNA, 22 nt, Human
gacaaugaagagagcuaaggga

SEQ ID NO: 745658 - RNA, 20 nt, Human
gagaaccugggauuagaggg

SEQ ID NO: 745659 - RNA, 22 nt, Human
gagcacaggcagccaccagggc

SEQ ID NO: 745660 - RNA, 20 nt, Human
gagcagcaacggggggacaa

SEQ ID NO: 745661 - RNA, 19 nt, Human
gagcucugguccccgccag

SEQ ID NO: 745662 - RNA, 20 nt, Human
gcaggaggccggcagcagga

SEQ ID NO: 745663 - RNA, 21 nt, Human
gcagggaaggggccagcugca

SEQ ID NO: 745664 - RNA, 22 nt, Human
gcccaagcaggaggaaaagcuc

SEQ ID NO: 745665 - RNA, 19 nt, Human
gccccagacguuuugcucc

SEQ ID NO: 745666 - RNA, 23 nt, Human
gcccuggggccacaaaaaggggg

SEQ ID NO: 745667 - RNA, 19 nt, Human
ggacacacacaacaucccc

SEQ ID NO: 745668 - RNA, 20 nt, Human
ggagacaaacagcugguccc

SEQ ID NO: 745669 - RNA, 20 nt, Human
ggaggaggaggagggacucu

SEQ ID NO: 745670 - RNA, 21 nt, Human
ggaggaggaggagggacucug

SEQ ID NO: 745671 - RNA, 19 nt, Human
ggaggagggacucugacac

SEQ ID NO: 745672 - RNA, 19 nt, Human
ggaggcugcuuaugcccug

SEQ ID NO: 745673 - RNA, 21 nt, Human
ggauaaaccugagccuggggg

SEQ ID NO: 745674 - RNA, 22 nt, Human
ggcaagggcuggccuuaacagu

SEQ ID NO: 745675 - RNA, 21 nt, Human
ggccccagacguuuugcuccu

SEQ ID NO: 745676 - RNA, 20 nt, Human
ggccgggaccugggaccgac

SEQ ID NO: 745677 - RNA, 18 nt, Human
ggccuuggaaagagagca

SEQ ID NO: 745678 - RNA, 20 nt, Human
gggagcagcugaugcauggg

SEQ ID NO: 745679 - RNA, 24 nt, Human
gguuccgggcucucauuacggagg

SEQ ID NO: 745680 - RNA, 21 nt, Human
guccuggcucgcaggccccag

SEQ ID NO: 745681 - RNA, 21 nt, Human
gugaaaaacaacucaccucaa

SEQ ID NO: 745682 - RNA, 19 nt, Human
guuggagagguuggaggag

SEQ ID NO: 745683 - RNA, 23 nt, Human
uaaaccccagggcaguguagaga

SEQ ID NO: 745684 - RNA, 23 nt, Human
uaacaguugcuuuacuucuccca

SEQ ID NO: 745685 - RNA, 26 nt, Human
uagaggcaagagagagaagaagagga

SEQ ID NO: 745686 - RNA, 21 nt, Human
uagcacccaggacuuccuggg

SEQ ID NO: 745687 - RNA, 22 nt, Human
uagcucgguauuuccaaacaag

SEQ ID NO: 745688 - RNA, 21 nt, Human
uauccaagguaaagccuuuag

SEQ ID NO: 745689 - RNA, 21 nt, Human
ucaaacaguggauggugacag

SEQ ID NO: 745690 - RNA, 18 nt, Human
uccagcugguaaacccca

SEQ ID NO: 745691 - RNA, 23 nt, Human
uccagcugguaaaccccagggca

SEQ ID NO: 745692 - RNA, 20 nt, Human
ucccccuucucaaagcuggg

SEQ ID NO: 745693 - RNA, 19 nt, Human
ucccucacugguuaagcgg

SEQ ID NO: 745694 - RNA, 21 nt, Human
uccuggcugaggguuccgcgc

SEQ ID NO: 745695 - RNA, 23 nt, Human
uccugggcugccagaauggaguc

SEQ ID NO: 745696 - RNA, 26 nt, Human
uccuugaccaggacuaccagcgaggc

SEQ ID NO: 745697 - RNA, 24 nt, Human
ucgcaggccccagacguuuugcuc

SEQ ID NO: 745698 - RNA, 19 nt, Human
ucuauaaccaaggagcagc

SEQ ID NO: 745699 - RNA, 23 nt, Human
ucuccaacugggcacugggcuug

SEQ ID NO: 745700 - RNA, 18 nt, Human
ucucgcugucuguauggu

SEQ ID NO: 745701 - RNA, 19 nt, Human
ucugcagaaacugugggag

SEQ ID NO: 745702 - RNA, 21 nt, Human
ucugcagaaacugugggagau

SEQ ID NO: 745703 - RNA, 22 nt, Human
ucugcgaagcugcggcacaaag

SEQ ID NO: 745704 - RNA, 22 nt, Human
ucugggccaaagucaggagggc

SEQ ID NO: 745705 - RNA, 19 nt, Human
ugaaaaacaacucaccuca

SEQ ID NO: 745706 - RNA, 21 nt, Human
ugaaaaacaacucaccucaaa

SEQ ID NO: 745707 - RNA, 22 nt, Human
ugaaaaacaacucaccucaaac

SEQ ID NO: 745708 - RNA, 23 nt, Human
ugaaaaacaacucaccucaaaca

SEQ ID NO: 745709 - RNA, 21 nt, Human
ugaaaggcugcugccaccugg

SEQ ID NO: 745710 - RNA, 23 nt, Human
ugacaaaauccuagagauucagg

SEQ ID NO: 745711 - RNA, 25 nt, Human
ugacacccuugggaagcaguuggug

SEQ ID NO: 745712 - RNA, 21 nt, Human
ugacagcaggcagggaagggg

SEQ ID NO: 745713 - RNA, 23 nt, Human
ugacuuugcccccggccagcccu

SEQ ID NO: 745714 - RNA, 22 nt, Human
ugccagaaauacaggcauagag

SEQ ID NO: 745715 - RNA, 22 nt, Human
ugcuccacugaagcacagcugc

SEQ ID NO: 745716 - RNA, 21 nt, Human
ugcugcugggacucaaggaua

SEQ ID NO: 745717 - RNA, 22 nt, Human
ugcugcugggacucaaggauac

SEQ ID NO: 745718 - RNA, 24 nt, Human
uggagcugaggaccugagcacagg

SEQ ID NO: 745719 - RNA, 18 nt, Human
uggaggaggaggagggac

SEQ ID NO: 745720 - RNA, 23 nt, Human
uggaggaggaggagggacucuga

SEQ ID NO: 745721 - RNA, 19 nt, Human
uggcucgcaggccccagac

SEQ ID NO: 745722 - RNA, 22 nt, Human
uggcugagacucuucacagaug

SEQ ID NO: 745723 - RNA, 22 nt, Human
ugggaaaggacagaucauaggu

SEQ ID NO: 745724 - RNA, 18 nt, Human
ugggaagcaguuggugau

SEQ ID NO: 745725 - RNA, 19 nt, Human
ugggaagcaguuggugaug

SEQ ID NO: 745726 - RNA, 21 nt, Human
ugggagcagcugaugcauggg

SEQ ID NO: 745727 - RNA, 18 nt, Human
ugggaggcugcuuaugcc

SEQ ID NO: 745728 - RNA, 24 nt, Human
ugggaggcugcuuaugcccugggg

SEQ ID NO: 745729 - RNA, 22 nt, Human
ugggaggugacuuugcccccgg

SEQ ID NO: 745730 - RNA, 21 nt, Human
ugggauuagagggagauggua

SEQ ID NO: 745731 - RNA, 20 nt, Human
ugggcagggcacacagaugg

SEQ ID NO: 745732 - RNA, 18 nt, Human
uggugaugggcagggcac

SEQ ID NO: 745733 - RNA, 24 nt, Human
ugguggcagcagcagcacgcagag

SEQ ID NO: 745734 - RNA, 21 nt, Human
ugucccgggggugcugcagga

SEQ ID NO: 745735 - RNA, 22 nt, Human
ugucuccuuccucuuucugccu

SEQ ID NO: 745736 - RNA, 23 nt, Human
ugugacuccaagugacaaaaucc

SEQ ID NO: 745737 - RNA, 22 nt, Human
uguucuauaaccaaggagcagc

SEQ ID NO: 745738 - RNA, 24 nt, Human
uuaacaguugcuuuacuucuccca

SEQ ID NO: 745739 - RNA, 21 nt, Human
uucagugcuucccucacuggu

SEQ ID NO: 745740 - RNA, 19 nt, Human
uuccucuauaaaauaucug

SEQ ID NO: 745741 - RNA, 20 nt, Human
uuccucuuucugccuccaca

SEQ ID NO: 745742 - RNA, 26 nt, Human
uuccuucuuccuccuggcacugucuc

SEQ ID NO: 745743 - RNA, 22 nt, Human
uucuugguggcagcagcagcac

SEQ ID NO: 745744 - RNA, 19 nt, Human
uuggaguucugaucuuggg

SEQ ID NO: 745745 - RNA, 22 nt, Human
uuugcccccggccagcccucuu

SEQ ID NO: 745746 - RNA, 18 nt, Human
aaaugcccacaggggccg

SEQ ID NO: 745747 - RNA, 20 nt, Human
agaggcaaaaagcaauggca

SEQ ID NO: 745748 - RNA, 25 nt, Human
agaggcaaaaagcaauggcagggag

SEQ ID NO: 745749 - RNA, 18 nt, Human
agcggcgaacgguggggg

SEQ ID NO: 745750 - RNA, 21 nt, Human
aggcaaaaagcaauggcaggg

SEQ ID NO: 745751 - RNA, 23 nt, Human
auggcagggaggugggacagagg

SEQ ID NO: 745752 - RNA, 28 nt, Human
gggagaggcaaaaagcaauggcagggag

SEQ ID NO: 745753 - RNA, 18 nt, Human
gggcaggggggggugcgg

SEQ ID NO: 745754 - RNA, 20 nt, Human
ggugggggggcagggggggg

SEQ ID NO: 745755 - RNA, 20 nt, Human
uuagcggcugaagcagucug

SEQ ID NO: 745756 - RNA, 27 nt, Human
aaaaaaacauugacaauaaaacaacug

SEQ ID NO: 745757 - RNA, 20 nt, Human
aaaaaaauccuuaagccccc

SEQ ID NO: 745758 - RNA, 18 nt, Human
aaaaauacaguaaagaca

SEQ ID NO: 745759 - RNA, 26 nt, Human
aaaaauuaacaagaaugcaaacacga

SEQ ID NO: 745760 - RNA, 27 nt, Human
aaaaugcccucaucauuucacaaacua

SEQ ID NO: 745761 - RNA, 19 nt, Human
aaacagaaauacaagaaaa

SEQ ID NO: 745762 - RNA, 22 nt, Human
aaacuccaaaguaauuuucugg

SEQ ID NO: 745763 - RNA, 21 nt, Human
aaaugaucaaaaaggcugugu

SEQ ID NO: 745764 - RNA, 23 nt, Human
aacuaugaaaaucugugucccca

SEQ ID NO: 745765 - RNA, 23 nt, Human
aagacuuucccucaaacauggaa

SEQ ID NO: 745766 - RNA, 21 nt, Human
aagauuuuuuuuuuacucaaa

SEQ ID NO: 745767 - RNA, 20 nt, Human
aagccccccaaaaauggaaa

SEQ ID NO: 745768 - RNA, 18 nt, Human
acaaagauagaauggaga

SEQ ID NO: 745769 - RNA, 19 nt, Human
acaaugucaaaugcuagag

SEQ ID NO: 745770 - RNA, 28 nt, Human
acacagcuuaaagaaaggagggaacgcc

SEQ ID NO: 745771 - RNA, 19 nt, Human
acacaggacucccucccuc

SEQ ID NO: 745772 - RNA, 19 nt, Human
acacuuaaacaaaaugugc

SEQ ID NO: 745773 - RNA, 20 nt, Human
accaucaaaaaauaaaacaa

SEQ ID NO: 745774 - RNA, 19 nt, Human
acugcaauuuuuauacauu

SEQ ID NO: 745775 - RNA, 24 nt, Human
acuguacaaaauuaccagcaagac

SEQ ID NO: 745776 - RNA, 19 nt, Human
acuugugguuuacuggaac

SEQ ID NO: 745777 - RNA, 24 nt, Human
agaacaaaaauacaguaaagacaa

SEQ ID NO: 745778 - RNA, 25 nt, Human
agacaauaauccagcagcuacaaac

SEQ ID NO: 745779 - RNA, 19 nt, Human
agaggacaaaauguuaaaa

SEQ ID NO: 745780 - RNA, 21 nt, Human
agcaagcagauaaaaugcccu

SEQ ID NO: 745781 - RNA, 20 nt, Human
agccaagaugguaaagccaa

SEQ ID NO: 745782 - RNA, 21 nt, Human
aggacucccucccucccacag

SEQ ID NO: 745783 - RNA, 28 nt, Human
aggcagaaacaguaacacuuaaacaaaa

SEQ ID NO: 745784 - RNA, 21 nt, Human
agucuuguuaagguuuaugug

SEQ ID NO: 745785 - RNA, 19 nt, Human
augacaguucccugccccc

SEQ ID NO: 745786 - RNA, 24 nt, Human
augauguauuaauagaaggcacca

SEQ ID NO: 745787 - RNA, 19 nt, Human
auggaaacuaugaaaaucu

SEQ ID NO: 745788 - RNA, 27 nt, Human
auugcacuauuuguguucccagcauua

SEQ ID NO: 745789 - RNA, 28 nt, Human
caaaaaaaaaauuaacaagaaugcaaac

SEQ ID NO: 745790 - RNA, 24 nt, Human
caaaaaauaaaacaaaaucagcaa

SEQ ID NO: 745791 - RNA, 24 nt, Human
caaaaucagcaaauaacaguaaug

SEQ ID NO: 745792 - RNA, 22 nt, Human
caaaaugaaugacaguucccug

SEQ ID NO: 745793 - RNA, 25 nt, Human
caaacacacaggacucccucccucc

SEQ ID NO: 745794 - RNA, 22 nt, Human
caaagccaaaaaaaaaauuaac

SEQ ID NO: 745795 - RNA, 26 nt, Human
caaauaacugacuuccuccuucccuc

SEQ ID NO: 745796 - RNA, 21 nt, Human
caagaacaaugucucugccgc

SEQ ID NO: 745797 - RNA, 19 nt, Human
caagaaugcaaacacgaug

SEQ ID NO: 745798 - RNA, 23 nt, Human
caagauaaauaauaugcuagucc

SEQ ID NO: 745799 - RNA, 22 nt, Human
caauaaagaugguaauccauug

SEQ ID NO: 745800 - RNA, 22 nt, Human
cacaaacacacaggacucccuc

SEQ ID NO: 745801 - RNA, 24 nt, Human
caccucaauuuaacugauaaccaa

SEQ ID NO: 745802 - RNA, 19 nt, Human
caccuccggcucccgggcu

SEQ ID NO: 745803 - RNA, 25 nt, Human
cagaaacaguaacacuuaaacaaaa

SEQ ID NO: 745804 - RNA, 27 nt, Human
caggagccacucgggugccgaccuggu

SEQ ID NO: 745805 - RNA, 21 nt, Human
caguaaagacaauuuucacug

SEQ ID NO: 745806 - RNA, 19 nt, Human
cauauugcccaguacauga

SEQ ID NO: 745807 - RNA, 26 nt, Human
caucaaaaaauaaaacaaaaucagca

SEQ ID NO: 745808 - RNA, 23 nt, Human
ccaaagccaaaaaaaaaauuaac

SEQ ID NO: 745809 - RNA, 24 nt, Human
ccagcaagacuggaaugauguauu

SEQ ID NO: 745810 - RNA, 20 nt, Human
cccaguacaugaaaaacaaa

SEQ ID NO: 745811 - RNA, 20 nt, Human
cccccaaauagaaaaugcaa

SEQ ID NO: 745812 - RNA, 20 nt, Human
ccgaaaauugcaguauccuc

SEQ ID NO: 745813 - RNA, 20 nt, Human
ccucaucauuucacaaacua

SEQ ID NO: 745814 - RNA, 20 nt, Human
ccugccccccaaauagaaaa

SEQ ID NO: 745815 - RNA, 18 nt, Human
cguagauaguuuaagaua

SEQ ID NO: 745816 - RNA, 21 nt, Human
cuacuuuucuauuauuacacu

SEQ ID NO: 745817 - RNA, 20 nt, Human
cucaaagaauacuuuccacc

SEQ ID NO: 745818 - RNA, 20 nt, Human
cugaaaagaggacaaaaugu

SEQ ID NO: 745819 - RNA, 18 nt, Human
cugaagcugaauggcucu

SEQ ID NO: 745820 - RNA, 26 nt, Human
cuuaaagagcugcuguucuuuucucc

SEQ ID NO: 745821 - RNA, 21 nt, Human
cuuccuccuucccucucccca

SEQ ID NO: 745822 - RNA, 21 nt, Human
gaaacaauuaaacuagauucu

SEQ ID NO: 745823 - RNA, 20 nt, Human
gaaaggaaaaaaggggagga

SEQ ID NO: 745824 - RNA, 20 nt, Human
gaacaagauaaauaauaugc

SEQ ID NO: 745825 - RNA, 19 nt, Human
gaauccuguugugaaauug

SEQ ID NO: 745826 - RNA, 20 nt, Human
gaugaauaauguaccacugc

SEQ ID NO: 745827 - RNA, 22 nt, Human
gcauguccuuuuaaguucacuu

SEQ ID NO: 745828 - RNA, 24 nt, Human
ggaaacagaaauacaagaaaauau

SEQ ID NO: 745829 - RNA, 19 nt, Human
guaguauuaauaaaggcuu

SEQ ID NO: 745830 - RNA, 23 nt, Human
uaaaaauaaaagaugucguccca

SEQ ID NO: 745831 - RNA, 24 nt, Human
uaaaacuguuucaaacagaaaaaa

SEQ ID NO: 745832 - RNA, 20 nt, Human
uaaaaugcccucaucauuuc

SEQ ID NO: 745833 - RNA, 21 nt, Human
uaaagccaauuugguugcaau

SEQ ID NO: 745834 - RNA, 26 nt, Human
uaaccaaagaugcuuuucacaucaaa

SEQ ID NO: 745835 - RNA, 23 nt, Human
uaacugaagaacaagauaaauaa

SEQ ID NO: 745836 - RNA, 26 nt, Human
uaagccccccaaaaauggaaacuaug

SEQ ID NO: 745837 - RNA, 24 nt, Human
uaauaaaggcuucaaaacuccaaa

SEQ ID NO: 745838 - RNA, 19 nt, Human
uaauagucaagaccaucgc

SEQ ID NO: 745839 - RNA, 19 nt, Human
uaccagagaacaaaaauac

SEQ ID NO: 745840 - RNA, 21 nt, Human
uacugcaggugaacaaucacc

SEQ ID NO: 745841 - RNA, 21 nt, Human
uacuggaacuugcuauaaaga

SEQ ID NO: 745842 - RNA, 24 nt, Human
uacuguacaaaauuaccagcaaga

SEQ ID NO: 745843 - RNA, 20 nt, Human
uagaaaaugcaaacacuuaa

SEQ ID NO: 745844 - RNA, 18 nt, Human
uauauauauauauauaua

SEQ ID NO: 745845 - RNA, 19 nt, Human
uauauauauauauauauau

SEQ ID NO: 745846 - RNA, 24 nt, Human
ucaaaggaccugaauucagugggc

SEQ ID NO: 745847 - RNA, 23 nt, Human
ucaaaugcuagaggaaagacugg

SEQ ID NO: 745848 - RNA, 18 nt, Human
ucagaaaguauaaaacug

SEQ ID NO: 745849 - RNA, 19 nt, Human
ucagaaaguauaaaacugu

SEQ ID NO: 745850 - RNA, 21 nt, Human
ucagaaccaauuugcuacuau

SEQ ID NO: 745851 - RNA, 23 nt, Human
ucauacacuauacuguacaaaau

SEQ ID NO: 745852 - RNA, 18 nt, Human
ucccucaaacauggaaga

SEQ ID NO: 745853 - RNA, 22 nt, Human
ugaaaaacaaaauacaugcaag

SEQ ID NO: 745854 - RNA, 20 nt, Human
ugaaacaucagaaacugggg

SEQ ID NO: 745855 - RNA, 19 nt, Human
ugacaguucccugcccccc

SEQ ID NO: 745856 - RNA, 20 nt, Human
ugagauuuuuucccuguugc

SEQ ID NO: 745857 - RNA, 22 nt, Human
ugcaguauccucacuucaggcu

SEQ ID NO: 745858 - RNA, 20 nt, Human
ugcccaguacaugaaaaaca

SEQ ID NO: 745859 - RNA, 21 nt, Human
ugcccaguacaugaaaaacaa

SEQ ID NO: 745860 - RNA, 18 nt, Human
ugccugaaacaucagaaa

SEQ ID NO: 745861 - RNA, 24 nt, Human
ugcuauaaagacagacaauaaucc

SEQ ID NO: 745862 - RNA, 21 nt, Human
uggaaacuaugaaaaucugug

SEQ ID NO: 745863 - RNA, 26 nt, Human
uggaaacuaugaaaaucugugucccc

SEQ ID NO: 745864 - RNA, 23 nt, Human
uggggggagccaagaaaaaaggc

SEQ ID NO: 745865 - RNA, 22 nt, Human
ugguauguacugacugcuccaa

SEQ ID NO: 745866 - RNA, 21 nt, Human
uguacugacugcuccaagcau

SEQ ID NO: 745867 - RNA, 20 nt, Human
ugucucugccgcuacaccuc

SEQ ID NO: 745868 - RNA, 19 nt, Human
ugugcaaaaugaaugacag

SEQ ID NO: 745869 - RNA, 20 nt, Human
ugugcaaaaugaaugacagu

SEQ ID NO: 745870 - RNA, 19 nt, Human
ugugguuuacuggaacuug

SEQ ID NO: 745871 - RNA, 19 nt, Human
uguguacacacgcugguca

SEQ ID NO: 745872 - RNA, 20 nt, Human
uuacaaagauagaauggaga

SEQ ID NO: 745873 - RNA, 24 nt, Human
uuacuaaauagcaaacaguugcau

SEQ ID NO: 745874 - RNA, 18 nt, Human
uuauauauauauauauau

SEQ ID NO: 745875 - RNA, 21 nt, Human
uucaaacagaaaaaaaaaaaa

SEQ ID NO: 745876 - RNA, 25 nt, Human
uuccaaagccaaaaaaaaaauuaac

SEQ ID NO: 745877 - RNA, 24 nt, Human
uugcccaguacaugaaaaacaaaa

SEQ ID NO: 745878 - RNA, 22 nt, Human
uuggugccagaacaguuuucau

SEQ ID NO: 745879 - RNA, 24 nt, Human
uuggugccagaacaguuuucaugg

SEQ ID NO: 745880 - RNA, 19 nt, Human
uuguuaacugaagaacaag

SEQ ID NO: 745881 - RNA, 23 nt, Human
uuucccuguugccuccuguugca

SEQ ID NO: 745882 - RNA, 24 nt, Human
uuuugcagcuguuuggcuuugcag

SEQ ID NO: 745883 - RNA, 24 nt, Human
aaaaaagaaguuauuuaaaaagcu

SEQ ID NO: 745884 - RNA, 27 nt, Human
aaagaaaaaaauaauaauaauaaaagg

SEQ ID NO: 745885 - RNA, 20 nt, Human
aaagagagagagagaacagc

SEQ ID NO: 745886 - RNA, 23 nt, Human
aaauacaucuaaaauuaaaauac

SEQ ID NO: 745887 - RNA, 20 nt, Human
aaauauaaaaagcuacaaac

SEQ ID NO: 745888 - RNA, 25 nt, Human
aacacccaccauccugcugccaccu

SEQ ID NO: 745889 - RNA, 19 nt, Human
aacuugagaaaagacgucc

SEQ ID NO: 745890 - RNA, 27 nt, Human
aagaaaaaaauaauaauaauaaaagga

SEQ ID NO: 745891 - RNA, 20 nt, Human
aagauacuuuuacucuuaua

SEQ ID NO: 745892 - RNA, 21 nt, Human
aaggagaaggaaaaagcauca

SEQ ID NO: 745893 - RNA, 19 nt, Human
aagggacagacgcuuguug

SEQ ID NO: 745894 - RNA, 20 nt, Human
aaguggaauaagcgguccuc

SEQ ID NO: 745895 - RNA, 24 nt, Human
aauaauaaaaggaaaggagaagga

SEQ ID NO: 745896 - RNA, 24 nt, Human
acaggacaagugggaguggauaag

SEQ ID NO: 745897 - RNA, 19 nt, Human
acccaccauccugcugcca

SEQ ID NO: 745898 - RNA, 23 nt, Human
acccagucucgggcccuagggac

SEQ ID NO: 745899 - RNA, 24 nt, Human
accccaagauguggcugagcccuu

SEQ ID NO: 745900 - RNA, 18 nt, Human
agaaagaaauuccuaaag

SEQ ID NO: 745901 - RNA, 21 nt, Human
agaaggauccuggcuuuccaa

SEQ ID NO: 745902 - RNA, 18 nt, Human
agacucccccucucccac

SEQ ID NO: 745903 - RNA, 18 nt, Human
agagagaacagcuugaug

SEQ ID NO: 745904 - RNA, 22 nt, Human
agccuggggccccgugagacuc

SEQ ID NO: 745905 - RNA, 19 nt, Human
agcucugacucuggggcug

SEQ ID NO: 745906 - RNA, 27 nt, Human
aggaaacuuuaaaaacaccaguucuga

SEQ ID NO: 745907 - RNA, 19 nt, Human
aggcaaggcccucccuggu

SEQ ID NO: 745908 - RNA, 23 nt, Human
aggcaaggcccucccuggugagg

SEQ ID NO: 745909 - RNA, 24 nt, Human
aggcagcucggcacccuccuggga

SEQ ID NO: 745910 - RNA, 20 nt, Human
agggcaagacggucccugcc

SEQ ID NO: 745911 - RNA, 22 nt, Human
auuaaaauacaggauugccugg

SEQ ID NO: 745912 - RNA, 20 nt, Human
caaaaccugaaauauuuuua

SEQ ID NO: 745913 - RNA, 23 nt, Human
caacaagggcaggguaaaggaaa

SEQ ID NO: 745914 - RNA, 23 nt, Human
caaucacacccacgcucaggggg

SEQ ID NO: 745915 - RNA, 19 nt, Human
cacagacaucacuuguuuu

SEQ ID NO: 745916 - RNA, 18 nt, Human
caccaacccagcugccag

SEQ ID NO: 745917 - RNA, 21 nt, Human
cacccaccauccugcugccac

SEQ ID NO: 745918 - RNA, 21 nt, Human
cacgcugacacgggagaacag

SEQ ID NO: 745919 - RNA, 18 nt, Human
cacugucccugccccugc

SEQ ID NO: 745920 - RNA, 21 nt, Human
cacuugcuccuccucuuucug

SEQ ID NO: 745921 - RNA, 22 nt, Human
cagaccccaagauguggcugag

SEQ ID NO: 745922 - RNA, 18 nt, Human
cagaggcccugcaaucac

SEQ ID NO: 745923 - RNA, 20 nt, Human
cagaguguggccagcagggc

SEQ ID NO: 745924 - RNA, 24 nt, Human
cagcaucacaaaacacggaaacac

SEQ ID NO: 745925 - RNA, 23 nt, Human
caggcgacaccacacgcugacac

SEQ ID NO: 745926 - RNA, 19 nt, Human
caggguaaaggaaacuuua

SEQ ID NO: 745927 - RNA, 19 nt, Human
cagguuagauuauauaaau

SEQ ID NO: 745928 - RNA, 24 nt, Human
caucacaaaacacggaaacacuuc

SEQ ID NO: 745929 - RNA, 21 nt, Human
ccaccauccugcugccaccug

SEQ ID NO: 745930 - RNA, 22 nt, Human
ccacgauaaacuuuguuagaaa

SEQ ID NO: 745931 - RNA, 24 nt, Human
ccagccuguggccagcucugacuc

SEQ ID NO: 745932 - RNA, 24 nt, Human
ccauccugcugccaccugccaacc

SEQ ID NO: 745933 - RNA, 21 nt, Human
ccauggguuuucucacaguuu

SEQ ID NO: 745934 - RNA, 22 nt, Human
cccaccauccugcugccaccug

SEQ ID NO: 745935 - RNA, 18 nt, Human
cccccaauccccucauca

SEQ ID NO: 745936 - RNA, 23 nt, Human
cccccagaaaugcuccugggcau

SEQ ID NO: 745937 - RNA, 21 nt, Human
cccccucucccacccagucuc

SEQ ID NO: 745938 - RNA, 21 nt, Human
cccuagggacugcgucccucc

SEQ ID NO: 745939 - RNA, 20 nt, Human
ccuccaccaagcugccucuc

SEQ ID NO: 745940 - RNA, 23 nt, Human
ccuccaccaagcugccucuccca

SEQ ID NO: 745941 - RNA, 18 nt, Human
ccugagcggagcagaagg

SEQ ID NO: 745942 - RNA, 25 nt, Human
cggggcagacccuuccucacccgcc

SEQ ID NO: 745943 - RNA, 19 nt, Human
cucacaguuugggcagugg

SEQ ID NO: 745944 - RNA, 20 nt, Human
cuccaccaagcugccucucc

SEQ ID NO: 745945 - RNA, 19 nt, Human
cucccccucucccacccag

SEQ ID NO: 745946 - RNA, 18 nt, Human
cuccggggguccugagcg

SEQ ID NO: 745947 - RNA, 21 nt, Human
cugaacacccaccauccugcu

SEQ ID NO: 745948 - RNA, 21 nt, Human
cugacucuggggcuggugagc

SEQ ID NO: 745949 - RNA, 25 nt, Human
cugacucuggggcuggugagcauug

SEQ ID NO: 745950 - RNA, 18 nt, Human
cugccccugccccugccc

SEQ ID NO: 745951 - RNA, 18 nt, Human
cugccccugccccugccc

SEQ ID NO: 745952 - RNA, 22 nt, Human
cugcccgcuaacacaccaaccc

SEQ ID NO: 745953 - RNA, 24 nt, Human
cugcugccaccugccaaccagaaa

SEQ ID NO: 745954 - RNA, 20 nt, Human
cugucccugccccugccccu

SEQ ID NO: 745955 - RNA, 21 nt, Human
cuuagccugggccucccagac

SEQ ID NO: 745956 - RNA, 20 nt, Human
cuugcuccuccucuuucugu

SEQ ID NO: 745957 - RNA, 18 nt, Human
gacccaugcaggcgacac

SEQ ID NO: 745958 - RNA, 20 nt, Human
gagaacagagaagugccgac

SEQ ID NO: 745959 - RNA, 25 nt, Human
gagcauuggcucacucugucuuccu

SEQ ID NO: 745960 - RNA, 25 nt, Human
gccccgugagacucccccucuccca

SEQ ID NO: 745961 - RNA, 22 nt, Human
gcgacaccacacgcugacacgg

SEQ ID NO: 745962 - RNA, 24 nt, Human
gcgcuugccccgggccguguuugu

SEQ ID NO: 745963 - RNA, 27 nt, Human
gcugccaccugccaaccagaaagcucg

SEQ ID NO: 745964 - RNA, 18 nt, Human
gcuguccuuaaaguggaa

SEQ ID NO: 745965 - RNA, 21 nt, Human
gcuucuguaaagacagagugu

SEQ ID NO: 745966 - RNA, 26 nt, Human
ggaggcagauguuuucgcggggcucc

SEQ ID NO: 745967 - RNA, 21 nt, Human
ggcgacaccacacgcugacac

SEQ ID NO: 745968 - RNA, 18 nt, Human
ggcugaagggacagacgc

SEQ ID NO: 745969 - RNA, 19 nt, Human
gggagauggcagccgggaa

SEQ ID NO: 745970 - RNA, 24 nt, Human
ggguaaaggaaacuuuaaaaacac

SEQ ID NO: 745971 - RNA, 21 nt, Human
guaaaggaaacuuuaaaaaca

SEQ ID NO: 745972 - RNA, 22 nt, Human
uaaaaaaaagagagagagagaa

SEQ ID NO: 745973 - RNA, 19 nt, Human
uaaaacuuugaucuaaguu

SEQ ID NO: 745974 - RNA, 21 nt, Human
uaaacaucccacuugcuccuc

SEQ ID NO: 745975 - RNA, 21 nt, Human
uaacuguaucccccaaucccc

SEQ ID NO: 745976 - RNA, 23 nt, Human
uaagaaauguacaaauauaaaaa

SEQ ID NO: 745977 - RNA, 21 nt, Human
uaagcgguccucaaacuugca

SEQ ID NO: 745978 - RNA, 20 nt, Human
uaauagccacgauaaacuuu

SEQ ID NO: 745979 - RNA, 21 nt, Human
uacaaauauaaaaagcuacaa

SEQ ID NO: 745980 - RNA, 21 nt, Human
uacagcaucacaaaacacgga

SEQ ID NO: 745981 - RNA, 21 nt, Human
uacgacccaugcaggcgacac

SEQ ID NO: 745982 - RNA, 24 nt, Human
ucagaacccaacuguccaucugac

SEQ ID NO: 745983 - RNA, 19 nt, Human
ucagcagagcugcagaggc

SEQ ID NO: 745984 - RNA, 21 nt, Human
ucauggacucgauacaagagu

SEQ ID NO: 745985 - RNA, 27 nt, Human
ucccagaccccaagauguggcugagcc

SEQ ID NO: 745986 - RNA, 18 nt, Human
ucccagggcaggggugcc

SEQ ID NO: 745987 - RNA, 19 nt, Human
ucccagggcaggggugccu

SEQ ID NO: 745988 - RNA, 22 nt, Human
ucccagggcaggggugccuugg

SEQ ID NO: 745989 - RNA, 20 nt, Human
uccuggggaccccacaaugg

SEQ ID NO: 745990 - RNA, 18 nt, Human
ucucacaguuugggcagu

SEQ ID NO: 745991 - RNA, 21 nt, Human
ugaauugggaaauaaaacacu

SEQ ID NO: 745992 - RNA, 21 nt, Human
ugacucagcaaaaaacucgua

SEQ ID NO: 745993 - RNA, 19 nt, Human
ugagaaacaaauccagccc

SEQ ID NO: 745994 - RNA, 24 nt, Human
ugaggcagcucggcacccuccugg

SEQ ID NO: 745995 - RNA, 18 nt, Human
ugccccugccccugcccu

SEQ ID NO: 745996 - RNA, 26 nt, Human
ugccccugccccugcccugccagucc

SEQ ID NO: 745997 - RNA, 21 nt, Human
ugccccugcccugccaguccc

SEQ ID NO: 745998 - RNA, 21 nt, Human
ugcccgcuaacacaccaaccc

SEQ ID NO: 745999 - RNA, 22 nt, Human
ugccugagaaacaaauccagcc

SEQ ID NO: 746000 - RNA, 22 nt, Human
ugccuuagaccucauggacucu

SEQ ID NO: 746001 - RNA, 21 nt, Human
uggacucgauacaagaguaau

SEQ ID NO: 746002 - RNA, 20 nt, Human
uggccagcucugacucuggg

SEQ ID NO: 746003 - RNA, 19 nt, Human
uggcucacucugucuuccu

SEQ ID NO: 746004 - RNA, 18 nt, Human
ugggccucccagacccca

SEQ ID NO: 746005 - RNA, 20 nt, Human
uggggcuggugagcauuggc

SEQ ID NO: 746006 - RNA, 24 nt, Human
uguaaagacagaguguaaggcugg

SEQ ID NO: 746007 - RNA, 21 nt, Human
ugucccugccccugccccugc

SEQ ID NO: 746008 - RNA, 19 nt, Human
ugucuggacuuggcugaga

SEQ ID NO: 746009 - RNA, 21 nt, Human
uguggccagcucugacucugg

SEQ ID NO: 746010 - RNA, 25 nt, Human
uguugccaaaauaauaauaauaaaa

SEQ ID NO: 746011 - RNA, 24 nt, Human
uuaagccccuggaggcugccagcc

SEQ ID NO: 746012 - RNA, 23 nt, Human
uuccuaaagauacuuuuacucuu

SEQ ID NO: 746013 - RNA, 21 nt, Human
uucgcggggcuccgggggucc

SEQ ID NO: 746014 - RNA, 23 nt, Human
uuguuagaaauguacauguugcc

SEQ ID NO: 746015 - RNA, 23 nt, Human
uuuaaaacuuugaucuaaguugg

SEQ ID NO: 746016 - RNA, 20 nt, Human
uuuuuaaaacuuugaucuaa

SEQ ID NO: 746017 - RNA, 22 nt, Human
uuuuuaagccccuggaggcugc

SEQ ID NO: 746018 - RNA, 28 nt, Human
aaaaaagaauuccucuaaucaugucacc

SEQ ID NO: 746019 - RNA, 24 nt, Human
aaaaaagccaaaacugacaaacac

SEQ ID NO: 746020 - RNA, 25 nt, Human
aaaaagacauacaauuuaacacaga

SEQ ID NO: 746021 - RNA, 24 nt, Human
aaaaauuaaccaaauuuugucccu

SEQ ID NO: 746022 - RNA, 21 nt, Human
aaacaagccacugcuuccuca

SEQ ID NO: 746023 - RNA, 21 nt, Human
aaacaauggcaucaaauggac

SEQ ID NO: 746024 - RNA, 20 nt, Human
aaagaauacaacaaagaaga

SEQ ID NO: 746025 - RNA, 24 nt, Human
aaauauuggcagcuugaauaagcu

SEQ ID NO: 746026 - RNA, 21 nt, Human
aacaaagaagaaaaaagccaa

SEQ ID NO: 746027 - RNA, 22 nt, Human
aacaaagaagaaaaaagccaaa

SEQ ID NO: 746028 - RNA, 21 nt, Human
aacacgaaacauugacuaaua

SEQ ID NO: 746029 - RNA, 23 nt, Human
aacagagcagcagaagcaucaag

SEQ ID NO: 746030 - RNA, 22 nt, Human
aacucaauucagaaaugaagaa

SEQ ID NO: 746031 - RNA, 25 nt, Human
aagaaaagaaaacucaauucagaaa

SEQ ID NO: 746032 - RNA, 21 nt, Human
aagaauuccucuaaucauguc

SEQ ID NO: 746033 - RNA, 24 nt, Human
aauaaagaauauauacaaaaggga

SEQ ID NO: 746034 - RNA, 26 nt, Human
aauucagagguauacuucugauuugg

SEQ ID NO: 746035 - RNA, 22 nt, Human
acaaagaagaaaaaagccaaaa

SEQ ID NO: 746036 - RNA, 18 nt, Human
acaacaaagaagaaaaaa

SEQ ID NO: 746037 - RNA, 20 nt, Human
acaacaaagaagaaaaaagc

SEQ ID NO: 746038 - RNA, 25 nt, Human
acaucaagaaaagaaaacucaauuc

SEQ ID NO: 746039 - RNA, 21 nt, Human
acccccagagcaucucaauau

SEQ ID NO: 746040 - RNA, 19 nt, Human
acugcuuccucaaagcaag

SEQ ID NO: 746041 - RNA, 27 nt, Human
agaaaacucaauucagaaaugaagaaa

SEQ ID NO: 746042 - RNA, 24 nt, Human
agaaaauccauggugaaaccugaa

SEQ ID NO: 746043 - RNA, 20 nt, Human
agaaaugaagaaaacuggca

SEQ ID NO: 746044 - RNA, 25 nt, Human
agaauacaacaaagaagaaaaaagc

SEQ ID NO: 746045 - RNA, 19 nt, Human
agaggugugucuauacaua

SEQ ID NO: 746046 - RNA, 18 nt, Human
agcaaggaggcaaguacu

SEQ ID NO: 746047 - RNA, 27 nt, Human
agcaaggaggcaaguacugaagaagaa

SEQ ID NO: 746048 - RNA, 25 nt, Human
agcagaagcaucaagaucaggucca

SEQ ID NO: 746049 - RNA, 21 nt, Human
agcaguuccuuaggagccaac

SEQ ID NO: 746050 - RNA, 19 nt, Human
agcucauuuuuucccucag

SEQ ID NO: 746051 - RNA, 21 nt, Human
agggacaauuuucauacuaaa

SEQ ID NO: 746052 - RNA, 24 nt, Human
agguagggaaacuucuugaacccg

SEQ ID NO: 746053 - RNA, 24 nt, Human
agucucuuuuuuguggagagaagg

SEQ ID NO: 746054 - RNA, 22 nt, Human
auaaagaauacaacaaagaaga

SEQ ID NO: 746055 - RNA, 19 nt, Human
auaaugcggaacacgaaac

SEQ ID NO: 746056 - RNA, 18 nt, Human
auacaauuuaacacagac

SEQ ID NO: 746057 - RNA, 28 nt, Human
auacacccccagagcaucucccguaccg

SEQ ID NO: 746058 - RNA, 20 nt, Human
aucaaaauggguaaguccuu

SEQ ID NO: 746059 - RNA, 20 nt, Human
auccagggaaucccagaaau

SEQ ID NO: 746060 - RNA, 22 nt, Human
caaagcaaggaccaggcuccaa

SEQ ID NO: 746061 - RNA, 19 nt, Human
caacaucaagaaaagaaaa

SEQ ID NO: 746062 - RNA, 21 nt, Human
caagaucagguccaaagaguu

SEQ ID NO: 746063 - RNA, 19 nt, Human
cacccuuucacuugaucuc

SEQ ID NO: 746064 - RNA, 23 nt, Human
cagagcaucucaauaucccuggc

SEQ ID NO: 746065 - RNA, 21 nt, Human
cagcaguuccuuaggagccaa

SEQ ID NO: 746066 - RNA, 22 nt, Human
caucaagaaaagaaaacucaau

SEQ ID NO: 746067 - RNA, 22 nt, Human
caucaagacaauacauaaagaa

SEQ ID NO: 746068 - RNA, 19 nt, Human
caucccaaucuucccaaga

SEQ ID NO: 746069 - RNA, 22 nt, Human
ccagagcaucucaauaucccug

SEQ ID NO: 746070 - RNA, 20 nt, Human
cccucaggugguuaaaggcc

SEQ ID NO: 746071 - RNA, 21 nt, Human
ccuguagucccagcuacucag

SEQ ID NO: 746072 - RNA, 22 nt, Human
ccuguagucccagcuacucagg

SEQ ID NO: 746073 - RNA, 19 nt, Human
ccuuccuuccucuuccucc

SEQ ID NO: 746074 - RNA, 19 nt, Human
ccuuccuuccucuuccucc

SEQ ID NO: 746075 - RNA, 23 nt, Human
ccuuucacuugaucucccucuca

SEQ ID NO: 746076 - RNA, 19 nt, Human
cucaaaagaugauaaacaa

SEQ ID NO: 746077 - RNA, 20 nt, Human
cucaaaagaugauaaacaau

SEQ ID NO: 746078 - RNA, 21 nt, Human
cucaaaagaugauaaacaaug

SEQ ID NO: 746079 - RNA, 21 nt, Human
cucaauucagaaaugaagaaa

SEQ ID NO: 746080 - RNA, 19 nt, Human
cucauauaaugaauccagg

SEQ ID NO: 746081 - RNA, 22 nt, Human
cuggccaccuacagcaaaauau

SEQ ID NO: 746082 - RNA, 23 nt, Human
cuuccucaaagcaaggaccaggc

SEQ ID NO: 746083 - RNA, 20 nt, Human
cuucuugaaacaagccacug

SEQ ID NO: 746084 - RNA, 21 nt, Human
cuugaacccgggaggcggagg

SEQ ID NO: 746085 - RNA, 22 nt, Human
gaaggaaaccaacaucaagaaa

SEQ ID NO: 746086 - RNA, 19 nt, Human
gcgauuuuuuuuuuaaagu

SEQ ID NO: 746087 - RNA, 22 nt, Human
ggagaagggcuaucauacaaca

SEQ ID NO: 746088 - RNA, 23 nt, Human
ggauugguagaggugugucuaua

SEQ ID NO: 746089 - RNA, 22 nt, Human
ggcagguauacaauacaccccc

SEQ ID NO: 746090 - RNA, 21 nt, Human
gggcaacagggguuuguuggg

SEQ ID NO: 746091 - RNA, 24 nt, Human
ggggcaaauucuagacuaaagaaa

SEQ ID NO: 746092 - RNA, 20 nt, Human
ggguuuguugggagaguuag

SEQ ID NO: 746093 - RNA, 19 nt, Human
gguuuguugggagaguuag

SEQ ID NO: 746094 - RNA, 24 nt, Human
gucaccaucucauauaaugaaucc

SEQ ID NO: 746095 - RNA, 24 nt, Human
gucucuuuuuuguggagagaaggg

SEQ ID NO: 746096 - RNA, 25 nt, Human
uaaaaaagcaaaagaauaaagaaua

SEQ ID NO: 746097 - RNA, 22 nt, Human
uaaaaaucugaccccaaggaau

SEQ ID NO: 746098 - RNA, 20 nt, Human
uaaaguaacuuuaaaaaucu

SEQ ID NO: 746099 - RNA, 22 nt, Human
uaaaguguccucacuaccaccu

SEQ ID NO: 746100 - RNA, 24 nt, Human
uaacagagcagcagaagcaucaag

SEQ ID NO: 746101 - RNA, 25 nt, Human
uaacagagcagcagaagcaucaaga

SEQ ID NO: 746102 - RNA, 18 nt, Human
uaagggcaaaugguucaa

SEQ ID NO: 746103 - RNA, 23 nt, Human
uaccucugcuuuggagaagggcu

SEQ ID NO: 746104 - RNA, 19 nt, Human
uagaaaauuaguuucaggg

SEQ ID NO: 746105 - RNA, 18 nt, Human
uauacaauacacccccag

SEQ ID NO: 746106 - RNA, 18 nt, Human
uaugaaggaaaccaacau

SEQ ID NO: 746107 - RNA, 23 nt, Human
uaugagaaacaaaacuggccacc

SEQ ID NO: 746108 - RNA, 21 nt, Human
ucaauucagaaaugaagaaaa

SEQ ID NO: 746109 - RNA, 19 nt, Human
ucagaaaugaagaaaacug

SEQ ID NO: 746110 - RNA, 22 nt, Human
ucagaaguggcuucuugaaaca

SEQ ID NO: 746111 - RNA, 21 nt, Human
ucagagguauacuucugauuu

SEQ ID NO: 746112 - RNA, 24 nt, Human
ucauacaacauucagucagcugaa

SEQ ID NO: 746113 - RNA, 23 nt, Human
uccauauucccaacaaggcuacg

SEQ ID NO: 746114 - RNA, 18 nt, Human
uccauggugaaaccugaa

SEQ ID NO: 746115 - RNA, 19 nt, Human
ucccucucagucucuuuuu

SEQ ID NO: 746116 - RNA, 18 nt, Human
uccugagcugcucagccc

SEQ ID NO: 746117 - RNA, 25 nt, Human
uccuuaggagccaacaugacaggug

SEQ ID NO: 746118 - RNA, 20 nt, Human
uccuuccuuccucuuccucc

SEQ ID NO: 746119 - RNA, 20 nt, Human
ucuagacuaaagaaaugauc

SEQ ID NO: 746120 - RNA, 24 nt, Human
ucuuccaaaugacaacuugaucac

SEQ ID NO: 746121 - RNA, 25 nt, Human
ugaaacaagccacugcuuccucaaa

SEQ ID NO: 746122 - RNA, 18 nt, Human
ugaagaagaaaagggaca

SEQ ID NO: 746123 - RNA, 21 nt, Human
ugacaggugggucagauuucc

SEQ ID NO: 746124 - RNA, 23 nt, Human
ugaccccaaggaauccaggacac

SEQ ID NO: 746125 - RNA, 23 nt, Human
ugagccgcuuacaacagcaguuc

SEQ ID NO: 746126 - RNA, 19 nt, Human
ugaucucccucucagucuc

SEQ ID NO: 746127 - RNA, 23 nt, Human
ugggcaacagggguuuguuggga

SEQ ID NO: 746128 - RNA, 22 nt, Human
uggguagauucuuagaucagaa

SEQ ID NO: 746129 - RNA, 28 nt, Human
uguaauccuguagucccagcuacucagg

SEQ ID NO: 746130 - RNA, 19 nt, Human
uuaacacagacugaguggg

SEQ ID NO: 746131 - RNA, 23 nt, Human
uuauaaaguaacuuuaaaaaucu

SEQ ID NO: 746132 - RNA, 24 nt, Human
uucagaggcuaacagagcagcaga

SEQ ID NO: 746133 - RNA, 23 nt, Human
uucuugaacccgggaggcggagg

SEQ ID NO: 746134 - RNA, 24 nt, Human
uugaacccgggaggcggagguugc

SEQ ID NO: 746135 - RNA, 21 nt, Human
uuuaaaguguccucacuacca

SEQ ID NO: 746136 - RNA, 21 nt, Human
aagcaacaccugccccccagc

SEQ ID NO: 746137 - RNA, 24 nt, Human
aagcagcagccaucaugucgacca

SEQ ID NO: 746138 - RNA, 23 nt, Human
aaucccgucugcgcgucacccac

SEQ ID NO: 746139 - RNA, 21 nt, Human
acacgccauucacgugucucc

SEQ ID NO: 746140 - RNA, 22 nt, Human
accuguaacucccgggauccgu

SEQ ID NO: 746141 - RNA, 19 nt, Human
agacaggcugggcccgggg

SEQ ID NO: 746142 - RNA, 21 nt, Human
agcccuccagccccgccacag

SEQ ID NO: 746143 - RNA, 22 nt, Human
agcuccggcuccccaccccucc

SEQ ID NO: 746144 - RNA, 22 nt, Human
aggcagacgcccgucuccuccg

SEQ ID NO: 746145 - RNA, 21 nt, Human
aggccccaaggcugcgcccag

SEQ ID NO: 746146 - RNA, 21 nt, Human
cacaacggcggcucccguccc

SEQ ID NO: 746147 - RNA, 20 nt, Human
caccagggcucugacagcag

SEQ ID NO: 746148 - RNA, 21 nt, Human
cacgccauucacgugucucca

SEQ ID NO: 746149 - RNA, 24 nt, Human
cagcaagccaaccccgaccccucc

SEQ ID NO: 746150 - RNA, 20 nt, Human
cagcacgggcaggguggagc

SEQ ID NO: 746151 - RNA, 24 nt, Human
cagcagccagaccacgccagucac

SEQ ID NO: 746152 - RNA, 18 nt, Human
cagcgguggggaugcucu

SEQ ID NO: 746153 - RNA, 19 nt, Human
caggcagacgcccgucucc

SEQ ID NO: 746154 - RNA, 22 nt, Human
caggguggccacauccuccccc

SEQ ID NO: 746155 - RNA, 19 nt, Human
cauucacgugucuccaaug

SEQ ID NO: 746156 - RNA, 23 nt, Human
ccacagagcuccggcuccccacc

SEQ ID NO: 746157 - RNA, 21 nt, Human
ccacucaggagucacccacuc

SEQ ID NO: 746158 - RNA, 20 nt, Human
ccacugggcucugagggccc

SEQ ID NO: 746159 - RNA, 22 nt, Human
ccagccccgccacagagcuccg

SEQ ID NO: 746160 - RNA, 23 nt, Human
cccaaacuaaagugcaccccagc

SEQ ID NO: 746161 - RNA, 19 nt, Human
cccagcaagccaaccccga

SEQ ID NO: 746162 - RNA, 22 nt, Human
cccagccucgcccccggcccac

SEQ ID NO: 746163 - RNA, 18 nt, Human
cccaggaggacacggggg

SEQ ID NO: 746164 - RNA, 23 nt, Human
ccccagagcuagucucagaccag

SEQ ID NO: 746165 - RNA, 22 nt, Human
cccccagccucgcccccggccc

SEQ ID NO: 746166 - RNA, 22 nt, Human
cccccgccacccccagagcuag

SEQ ID NO: 746167 - RNA, 24 nt, Human
ccccuugaaacaaggugucuggac

SEQ ID NO: 746168 - RNA, 22 nt, Human
cccgucccgccccaaacuaaag

SEQ ID NO: 746169 - RNA, 19 nt, Human
ccgcaaacccaggcagacg

SEQ ID NO: 746170 - RNA, 18 nt, Human
ccugccccccagccggga

SEQ ID NO: 746171 - RNA, 18 nt, Human
ccugccccccagccggga

SEQ ID NO: 746172 - RNA, 20 nt, Human
ccuucuuccgcuucccgcug

SEQ ID NO: 746173 - RNA, 21 nt, Human
cgagucagagccacccacugg

SEQ ID NO: 746174 - RNA, 21 nt, Human
cgcaaacccaggcagacgccc

SEQ ID NO: 746175 - RNA, 28 nt, Human
cgcaaacccaggcagacgcccgucuccu

SEQ ID NO: 746176 - RNA, 18 nt, Human
cgcacacgccauucacgu

SEQ ID NO: 746177 - RNA, 18 nt, Human
cggggcaggcaggccagg

SEQ ID NO: 746178 - RNA, 21 nt, Human
cgggggugguggcagccaaag

SEQ ID NO: 746179 - RNA, 21 nt, Human
cucacgcccaucccccuugaa

SEQ ID NO: 746180 - RNA, 21 nt, Human
cuccagccccgccacagagcu

SEQ ID NO: 746181 - RNA, 19 nt, Human
cuccccaccccuccccacc

SEQ ID NO: 746182 - RNA, 18 nt, Human
cucccgucccgccccaaa

SEQ ID NO: 746183 - RNA, 19 nt, Human
cuccggcuccccaccccuc

SEQ ID NO: 746184 - RNA, 20 nt, Human
cucgcccccuucucccgcag

SEQ ID NO: 746185 - RNA, 22 nt, Human
gaccacacccauaagcggcucu

SEQ ID NO: 746186 - RNA, 19 nt, Human
gagcagcagcacgggcagg

SEQ ID NO: 746187 - RNA, 24 nt, Human
gagcagcagcacgggcagggugga

SEQ ID NO: 746188 - RNA, 31 nt, Human
gagcuagucucagaccaggaagggagcuggg

SEQ ID NO: 746189 - RNA, 21 nt, Human
gagcuccggcuccccaccccu

SEQ ID NO: 746190 - RNA, 19 nt, Human
gcaaacccaggcagacgcc

SEQ ID NO: 746191 - RNA, 19 nt, Human
gcacagagcagcagcacgg

SEQ ID NO: 746192 - RNA, 21 nt, Human
gcaggcaggccaggcucccag

SEQ ID NO: 746193 - RNA, 22 nt, Human
gccccaaacuaaagugcacccc

SEQ ID NO: 746194 - RNA, 19 nt, Human
gcucacgcccaucccccuu

SEQ ID NO: 746195 - RNA, 24 nt, Human
gcucacgcccaucccccuugaaac

SEQ ID NO: 746196 - RNA, 18 nt, Human
gcuccccaccccucccca

SEQ ID NO: 746197 - RNA, 20 nt, Human
gcuggcuguccgucuggcuc

SEQ ID NO: 746198 - RNA, 20 nt, Human
ggcagcucagguuaaaacug

SEQ ID NO: 746199 - RNA, 21 nt, Human
ggccccgcuucccccagccuc

SEQ ID NO: 746200 - RNA, 19 nt, Human
ggccggacggcgggggccg

SEQ ID NO: 746201 - RNA, 19 nt, Human
gggcgcacucgcacacgcc

SEQ ID NO: 746202 - RNA, 20 nt, Human
gggcgcacucgcacacgccg

SEQ ID NO: 746203 - RNA, 21 nt, Human
gggggccgaagcaacaccugc

SEQ ID NO: 746204 - RNA, 18 nt, Human
ggggugggguggggugag

SEQ ID NO: 746205 - RNA, 19 nt, Human
gggucucaggguggccaca

SEQ ID NO: 746206 - RNA, 24 nt, Human
gugacggggccgcuggcuggcugu

SEQ ID NO: 746207 - RNA, 21 nt, Human
guggagcgggagcagcgugug

SEQ ID NO: 746208 - RNA, 23 nt, Human
uaaacccugaacuuucagacagg

SEQ ID NO: 746209 - RNA, 22 nt, Human
uaagcggcucuccgcaaaccca

SEQ ID NO: 746210 - RNA, 21 nt, Human
ucagguuaaaacugaggggag

SEQ ID NO: 746211 - RNA, 18 nt, Human
uccccaccggguuuuucg

SEQ ID NO: 746212 - RNA, 22 nt, Human
ucccgucccgccccaaacuaaa

SEQ ID NO: 746213 - RNA, 19 nt, Human
uccgcaaacccaggcagac

SEQ ID NO: 746214 - RNA, 22 nt, Human
uccgcaaacccaggcagacgcc

SEQ ID NO: 746215 - RNA, 19 nt, Human
ucucaggguggccacaucc

SEQ ID NO: 746216 - RNA, 24 nt, Human
ucugcaucaucuauucauugaacc

SEQ ID NO: 746217 - RNA, 19 nt, Human
ugaccugagaaaucccguc

SEQ ID NO: 746218 - RNA, 18 nt, Human
ugagacguggaggaagag

SEQ ID NO: 746219 - RNA, 18 nt, Human
ugccccccagccgggaac

SEQ ID NO: 746220 - RNA, 23 nt, Human
ugcggggcaggcaggccaggcuc

SEQ ID NO: 746221 - RNA, 18 nt, Human
ugcucugcuugcccgcuc

SEQ ID NO: 746222 - RNA, 23 nt, Human
ugggguggggugagacguggagg

SEQ ID NO: 746223 - RNA, 26 nt, Human
ugucuggacggaccacacccauaagg

SEQ ID NO: 746224 - RNA, 24 nt, Human
uucccccagccucgcccccggccc

SEQ ID NO: 746225 - RNA, 18 nt, Human
uugggccccgcuuccccc

SEQ ID NO: 746226 - RNA, 19 nt, Human
uuuaaaaacaagaaaaagu

SEQ ID NO: 746227 - RNA, 20 nt, Human
uuuuucggccuaaacccuga

SEQ ID NO: 746228 - RNA, 25 nt, Human
aaacaaacccuggcugccucgggau

SEQ ID NO: 746229 - RNA, 22 nt, Human
aacaaaccagaagggcgacuac

SEQ ID NO: 746230 - RNA, 22 nt, Human
aacaagaaacugaguaucaccc

SEQ ID NO: 746231 - RNA, 20 nt, Human
aacguccccacaagagccca

SEQ ID NO: 746232 - RNA, 22 nt, Human
aagaccagucagguccuaccuc

SEQ ID NO: 746233 - RNA, 21 nt, Human
aagcacccuccucccagaggg

SEQ ID NO: 746234 - RNA, 23 nt, Human
aaggaagaagggagcugcuggag

SEQ ID NO: 746235 - RNA, 21 nt, Human
aauggccccaaagacaggucu

SEQ ID NO: 746236 - RNA, 18 nt, Human
acaagaagccccauggcc

SEQ ID NO: 746237 - RNA, 21 nt, Human
acaaugcggccggcggaggcc

SEQ ID NO: 746238 - RNA, 22 nt, Human
acacacucccaggaugggaagc

SEQ ID NO: 746239 - RNA, 20 nt, Human
acagagggaaggaagaaggg

SEQ ID NO: 746240 - RNA, 19 nt, Human
acagggagcagggugggcc

SEQ ID NO: 746241 - RNA, 18 nt, Human
acaguggggccugcuggc

SEQ ID NO: 746242 - RNA, 22 nt, Human
acccugggagaauguggaaagc

SEQ ID NO: 746243 - RNA, 28 nt, Human
acgcgggacaaggcgggcgggcggacca

SEQ ID NO: 746244 - RNA, 19 nt, Human
acggggcuaggaaucaagc

SEQ ID NO: 746245 - RNA, 24 nt, Human
agaaaaacagaccuugaaaaauau

SEQ ID NO: 746246 - RNA, 21 nt, Human
agagggaaggaagaagggagc

SEQ ID NO: 746247 - RNA, 24 nt, Human
agagggaaggaagaagggagcugc

SEQ ID NO: 746248 - RNA, 20 nt, Human
augauaugcuacauauauac

SEQ ID NO: 746249 - RNA, 22 nt, Human
augcuccccacucuucuugcua

SEQ ID NO: 746250 - RNA, 21 nt, Human
caagagcccaagggggcagcc

SEQ ID NO: 746251 - RNA, 21 nt, Human
caagcucaggggcacuggcag

SEQ ID NO: 746252 - RNA, 18 nt, Human
cacaagagcccaggaguu

SEQ ID NO: 746253 - RNA, 18 nt, Human
cacagccggaaccagugc

SEQ ID NO: 746254 - RNA, 22 nt, Human
cacagccggaaccagugcccca

SEQ ID NO: 746255 - RNA, 22 nt, Human
caccagacacagccggaaccag

SEQ ID NO: 746256 - RNA, 19 nt, Human
caccagccccugaccccag

SEQ ID NO: 746257 - RNA, 19 nt, Human
cacuggcaggcccuagcag

SEQ ID NO: 746258 - RNA, 24 nt, Human
cagaccuugaaaaauauauacaua

SEQ ID NO: 746259 - RNA, 19 nt, Human
cagagcgccgagcaagcgu

SEQ ID NO: 746260 - RNA, 21 nt, Human
cagauggcuggcagcaggcac

SEQ ID NO: 746261 - RNA, 21 nt, Human
cagccucuucccccagccccc

SEQ ID NO: 746262 - RNA, 22 nt, Human
cagcucccaggcaccagccccu

SEQ ID NO: 746263 - RNA, 18 nt, Human
caggcccuagcaggaaca

SEQ ID NO: 746264 - RNA, 21 nt, Human
cagggugggccccaaccuagc

SEQ ID NO: 746265 - RNA, 23 nt, Human
cagguccuaccucucccaacuuc

SEQ ID NO: 746266 - RNA, 22 nt, Human
cagucagguccuaccucuccca

SEQ ID NO: 746267 - RNA, 22 nt, Human
cauggcccacugcuacccuccc

SEQ ID NO: 746268 - RNA, 23 nt, Human
ccaacugccccacagagaacaaa

SEQ ID NO: 746269 - RNA, 23 nt, Human
ccaacugccccacagagaacaaa

SEQ ID NO: 746270 - RNA, 23 nt, Human
ccacagcccuggcaccugcuuca

SEQ ID NO: 746271 - RNA, 21 nt, Human
ccacaggcuccucucuugugc

SEQ ID NO: 746272 - RNA, 18 nt, Human
ccaccaacugccccacag

SEQ ID NO: 746273 - RNA, 22 nt, Human
ccagccccugaccccagccaag

SEQ ID NO: 746274 - RNA, 22 nt, Human
ccaggcaccagccccugacccc

SEQ ID NO: 746275 - RNA, 26 nt, Human
ccagugccccacagaacggggcuagg

SEQ ID NO: 746276 - RNA, 21 nt, Human
ccaugcuccccacucuucuug

SEQ ID NO: 746277 - RNA, 22 nt, Human
cccacagagaacaaaccagaag

SEQ ID NO: 746278 - RNA, 25 nt, Human
cccacagagaacaaaccagaagggc

SEQ ID NO: 746279 - RNA, 21 nt, Human
cccacagcccuggcaccugcu

SEQ ID NO: 746280 - RNA, 18 nt, Human
cccaccaacugccccaca

SEQ ID NO: 746281 - RNA, 23 nt, Human
cccaccaacugccccacagagaa

SEQ ID NO: 746282 - RNA, 18 nt, Human
cccacugcuacccucccc

SEQ ID NO: 746283 - RNA, 19 nt, Human
cccauggcccacugcuacc

SEQ ID NO: 746284 - RNA, 20 nt, Human
ccccacagaacggggcuagg

SEQ ID NO: 746285 - RNA, 21 nt, Human
ccccauggcccacugcuaccc

SEQ ID NO: 746286 - RNA, 24 nt, Human
ccccauggcccacugcuacccucc

SEQ ID NO: 746287 - RNA, 20 nt, Human
ccccgcagccagaccaccag

SEQ ID NO: 746288 - RNA, 18 nt, Human
ccccuccucccccuuccc

SEQ ID NO: 746289 - RNA, 21 nt, Human
cccgcagccagaccaccagac

SEQ ID NO: 746290 - RNA, 23 nt, Human
cccgggacaaauacacacuuuug

SEQ ID NO: 746291 - RNA, 19 nt, Human
cccuagcaggaacagggag

SEQ ID NO: 746292 - RNA, 21 nt, Human
cccuagguggagggcacuaac

SEQ ID NO: 746293 - RNA, 22 nt, Human
cccucccacagcccuggcaccu

SEQ ID NO: 746294 - RNA, 21 nt, Human
ccgauacccugaacgucccca

SEQ ID NO: 746295 - RNA, 19 nt, Human
ccgcagccagaccaccaga

SEQ ID NO: 746296 - RNA, 19 nt, Human
ccgccggggcgcgcccccu

SEQ ID NO: 746297 - RNA, 21 nt, Human
ccgcucagggcgacacagcgg

SEQ ID NO: 746298 - RNA, 22 nt, Human
ccguagcuugccccucccacag

SEQ ID NO: 746299 - RNA, 23 nt, Human
ccguccccagcagaggggaagcc

SEQ ID NO: 746300 - RNA, 19 nt, Human
ccucaccaccacugcaucc

SEQ ID NO: 746301 - RNA, 19 nt, Human
ccucgagccaccugcugcu

SEQ ID NO: 746302 - RNA, 23 nt, Human
ccucgcaccccgauacccugaac

SEQ ID NO: 746303 - RNA, 21 nt, Human
ccucgcuuccuugcccagggg

SEQ ID NO: 746304 - RNA, 19 nt, Human
cgacacagcggccgggccc

SEQ ID NO: 746305 - RNA, 22 nt, Human
cgacgcgggacaaggcgggcgg

SEQ ID NO: 746306 - RNA, 21 nt, Human
cgcgcccccuuuccgcguggg

SEQ ID NO: 746307 - RNA, 26 nt, Human
cggaaccagugccccaggccccucuc

SEQ ID NO: 746308 - RNA, 18 nt, Human
cgggcggacaaugcggcc

SEQ ID NO: 746309 - RNA, 24 nt, Human
cggugcagacagaccucgcacccc

SEQ ID NO: 746310 - RNA, 21 nt, Human
cguagcuugccccucccacag

SEQ ID NO: 746311 - RNA, 22 nt, Human
cguagcuugccccucccacagc

SEQ ID NO: 746312 - RNA, 24 nt, Human
cucaccaccacugcauccagccuc

SEQ ID NO: 746313 - RNA, 20 nt, Human
cucccaggcaccagccccug

SEQ ID NO: 746314 - RNA, 27 nt, Human
cucccaggcaccagccccugaccccag

SEQ ID NO: 746315 - RNA, 18 nt, Human
cuccucccagagggccuc

SEQ ID NO: 746316 - RNA, 22 nt, Human
cucuccacggccaggaacaaga

SEQ ID NO: 746317 - RNA, 24 nt, Human
cugcccguccuuuucaucugcaug

SEQ ID NO: 746318 - RNA, 24 nt, Human
cugcuaaccgccucgagccaccug

SEQ ID NO: 746319 - RNA, 21 nt, Human
cuggagcuaagcacccuccuc

SEQ ID NO: 746320 - RNA, 18 nt, Human
cuuccuugcccaggggca

SEQ ID NO: 746321 - RNA, 23 nt, Human
cuugccccucccacagcccuggc

SEQ ID NO: 746322 - RNA, 18 nt, Human
gaaagcaagcucaggggc

SEQ ID NO: 746323 - RNA, 25 nt, Human
gaaggaagaagggagcugcuggagc

SEQ ID NO: 746324 - RNA, 21 nt, Human
gaccucgcaccccgauacccc

SEQ ID NO: 746325 - RNA, 22 nt, Human
gaccuugaaaaauauauacaua

SEQ ID NO: 746326 - RNA, 19 nt, Human
gagccugcuaaccgccucg

SEQ ID NO: 746327 - RNA, 28 nt, Human
gagcgcaaaacaaacccuggcugccucu

SEQ ID NO: 746328 - RNA, 21 nt, Human
gccagaccaccagacacagcc

SEQ ID NO: 746329 - RNA, 22 nt, Human
gccagccucuucccccagcccc

SEQ ID NO: 746330 - RNA, 23 nt, Human
gccaggaacaagaaacugaguau

SEQ ID NO: 746331 - RNA, 23 nt, Human
gccccaggccccucuccacggcc

SEQ ID NO: 746332 - RNA, 19 nt, Human
gccgagcaagcgugugggg

SEQ ID NO: 746333 - RNA, 19 nt, Human
gccucgcuuccuugcccag

SEQ ID NO: 746334 - RNA, 18 nt, Human
gccugguuagaugugggg

SEQ ID NO: 746335 - RNA, 18 nt, Human
gcggcuucuagcccggcc

SEQ ID NO: 746336 - RNA, 19 nt, Human
gcucagggcgacacagcgg

SEQ ID NO: 746337 - RNA, 24 nt, Human
gcucuaaaaguccccuccuccccc

SEQ ID NO: 746338 - RNA, 22 nt, Human
ggacaaugcggccggcggaggc

SEQ ID NO: 746339 - RNA, 21 nt, Human
ggaguuccaugcuccccacuc

SEQ ID NO: 746340 - RNA, 18 nt, Human
ggccaggaacaagaaacu

SEQ ID NO: 746341 - RNA, 22 nt, Human
ggcccggggcgcgcgggcacgc

SEQ ID NO: 746342 - RNA, 21 nt, Human
ggcucagugcugcagugaagg

SEQ ID NO: 746343 - RNA, 18 nt, Human
gggacaaauacacacuuu

SEQ ID NO: 746344 - RNA, 22 nt, Human
gggcagaggcagcucaccuagc

SEQ ID NO: 746345 - RNA, 21 nt, Human
gggcgacuaccugaacaagag

SEQ ID NO: 746346 - RNA, 19 nt, Human
ggggaagcggcggggugcu

SEQ ID NO: 746347 - RNA, 21 nt, Human
ggugcagacagaccucgcacc

SEQ ID NO: 746348 - RNA, 19 nt, Human
ggugggccccaaccuagca

SEQ ID NO: 746349 - RNA, 20 nt, Human
guggagggcacuaaccuugu

SEQ ID NO: 746350 - RNA, 22 nt, Human
guggagggcacuaaccuuguaa

SEQ ID NO: 746351 - RNA, 24 nt, Human
uaaaaaacuuaagaaccaauagug

SEQ ID NO: 746352 - RNA, 18 nt, Human
uacaguggggccugcugg

SEQ ID NO: 746353 - RNA, 20 nt, Human
uacccugaacguccccacaa

SEQ ID NO: 746354 - RNA, 24 nt, Human
uaccugaacaagagcugcaagagc

SEQ ID NO: 746355 - RNA, 18 nt, Human
uagcaggaacagggagca

SEQ ID NO: 746356 - RNA, 18 nt, Human
ucaccaccacugcaucca

SEQ ID NO: 746357 - RNA, 19 nt, Human
ucagggccugguuagaugu

SEQ ID NO: 746358 - RNA, 18 nt, Human
ucagguccuaccucuccc

SEQ ID NO: 746359 - RNA, 21 nt, Human
ucaguuagaaaaacagacccu

SEQ ID NO: 746360 - RNA, 22 nt, Human
ucccacagcccuggcaccugcu

SEQ ID NO: 746361 - RNA, 25 nt, Human
ucccagagggccucgcuuccuugcc

SEQ ID NO: 746362 - RNA, 22 nt, Human
ucccagauggcuggcagcaggc

SEQ ID NO: 746363 - RNA, 20 nt, Human
ucccagucccccaugauaug

SEQ ID NO: 746364 - RNA, 18 nt, Human
uccccacaagagcccagg

SEQ ID NO: 746365 - RNA, 21 nt, Human
uccccacaagagcccaggagu

SEQ ID NO: 746366 - RNA, 22 nt, Human
uccccagcagaggggaagccua

SEQ ID NO: 746367 - RNA, 20 nt, Human
ucccccuucccuauccaggg

SEQ ID NO: 746368 - RNA, 24 nt, Human
ucccuagguggagggcacuaaccu

SEQ ID NO: 746369 - RNA, 19 nt, Human
uccuagaagucagagcgcc

SEQ ID NO: 746370 - RNA, 21 nt, Human
uccuugcccaggggcagaggc

SEQ ID NO: 746371 - RNA, 24 nt, Human
ucgcaccccgauacccugaacguc

SEQ ID NO: 746372 - RNA, 23 nt, Human
ucuaaaaguccccuccucccccu

SEQ ID NO: 746373 - RNA, 24 nt, Human
ucuaaaaguccccuccucccccuu

SEQ ID NO: 746374 - RNA, 24 nt, Human
ucuccaucaagugcuuccugccug

SEQ ID NO: 746375 - RNA, 24 nt, Human
ucugccagccucuucccccagccc

SEQ ID NO: 746376 - RNA, 23 nt, Human
ugaacaagagcugcaagagccca

SEQ ID NO: 746377 - RNA, 19 nt, Human
ugaaggccugcccgccuuc

SEQ ID NO: 746378 - RNA, 19 nt, Human
ugacaggagagcgcaaaac

SEQ ID NO: 746379 - RNA, 25 nt, Human
ugacaggagagcgcaaaacaaaccc

SEQ ID NO: 746380 - RNA, 22 nt, Human
ugccagccucuucccccagccc

SEQ ID NO: 746381 - RNA, 22 nt, Human
ugccccaggccccucuccacgg

SEQ ID NO: 746382 - RNA, 25 nt, Human
ugcuacccuccccgggacaaauaca

SEQ ID NO: 746383 - RNA, 24 nt, Human
ugcuauaaccccagaugcuaaugg

SEQ ID NO: 746384 - RNA, 25 nt, Human
ugcuauaaccccagaugcuaauggc

SEQ ID NO: 746385 - RNA, 18 nt, Human
ugcugcagugaaggccug

SEQ ID NO: 746386 - RNA, 22 nt, Human
ugcuggagccugcuaaccgccu

SEQ ID NO: 746387 - RNA, 22 nt, Human
ugcuggagccugcuaaccgccu

SEQ ID NO: 746388 - RNA, 21 nt, Human
ugggccccaaccuagcaucag

SEQ ID NO: 746389 - RNA, 20 nt, Human
ugggggaagcggcggggugc

SEQ ID NO: 746390 - RNA, 25 nt, Human
uguggacucuuccccugaagagaau

SEQ ID NO: 746391 - RNA, 22 nt, Human
uguucacccacucccagauggc

SEQ ID NO: 746392 - RNA, 18 nt, Human
uucacccacucccagaug

SEQ ID NO: 746393 - RNA, 18 nt, Human
uucaguuagaaaaacaga

SEQ ID NO: 746394 - RNA, 22 nt, Human
uucaguuagaaaaacagaccuu

SEQ ID NO: 746395 - RNA, 18 nt, Human
uucaucugcauggggcca

SEQ ID NO: 746396 - RNA, 22 nt, Human
uucccagucccccaugauaugc

SEQ ID NO: 746397 - RNA, 18 nt, Human
uucuugcuauaaccccag

SEQ ID NO: 746398 - RNA, 20 nt, Human
uugcccaggggcagaggcag

SEQ ID NO: 746399 - RNA, 25 nt, Human
aaaaaaaaaaaaaacaacaaaaaag

SEQ ID NO: 746400 - RNA, 22 nt, Human
aaaaaaaaaaaacaacaaaaaa

SEQ ID NO: 746401 - RNA, 21 nt, Human
aaaaaaaaaaaagacaaaaaa

SEQ ID NO: 746402 - RNA, 21 nt, Human
aaaaaacaacaaaaaaaaaac

SEQ ID NO: 746403 - RNA, 21 nt, Human
aaaaaagacaaaaaaaaaaaa

SEQ ID NO: 746404 - RNA, 26 nt, Human
aaaaggccaaacacacaaccaaagca

SEQ ID NO: 746405 - RNA, 23 nt, Human
aaacaaaugaacaaaguuuucuu

SEQ ID NO: 746406 - RNA, 20 nt, Human
aaacaacaaaaaaaaaacca

SEQ ID NO: 746407 - RNA, 21 nt, Human
aaauaaaacacaaauaaauga

SEQ ID NO: 746408 - RNA, 18 nt, Human
aaccccgaagaaacugaa

SEQ ID NO: 746409 - RNA, 22 nt, Human
aaccccgaagaaacugaaauuc

SEQ ID NO: 746410 - RNA, 20 nt, Human
aaggccaaacacacaaccaa

SEQ ID NO: 746411 - RNA, 25 nt, Human
acaaaaaaaaaaaaaacaacaaaaa

SEQ ID NO: 746412 - RNA, 23 nt, Human
acaaaaaaaaaaccaaacuccau

SEQ ID NO: 746413 - RNA, 26 nt, Human
acaaaaaaaaaaccaaacuccauuac

SEQ ID NO: 746414 - RNA, 21 nt, Human
accaaacuaccuguucguucu

SEQ ID NO: 746415 - RNA, 18 nt, Human
acgggaccggaggcgccc

SEQ ID NO: 746416 - RNA, 19 nt, Human
agaaacugaaauucaaacu

SEQ ID NO: 746417 - RNA, 21 nt, Human
agaaaguagaaacaaaugaac

SEQ ID NO: 746418 - RNA, 23 nt, Human
agcagcccuguaauaaauaaaac

SEQ ID NO: 746419 - RNA, 20 nt, Human
agcccuguaauaaauaaaac

SEQ ID NO: 746420 - RNA, 19 nt, Human
agcggcgaguccggagucg

SEQ ID NO: 746421 - RNA, 23 nt, Human
agcucagcuccaccaaacuaccu

SEQ ID NO: 746422 - RNA, 23 nt, Human
agcuggcugaagguccgcgggcg

SEQ ID NO: 746423 - RNA, 18 nt, Human
aggaaacaugggagagcc

SEQ ID NO: 746424 - RNA, 24 nt, Human
aggaggaggaggcgguggcggcgg

SEQ ID NO: 746425 - RNA, 23 nt, Human
aggccaaacacacaaccaaagca

SEQ ID NO: 746426 - RNA, 27 nt, Human
aggcgguggcggcggcgugaggggcgg

SEQ ID NO: 746427 - RNA, 19 nt, Human
auagauugcuuucaguuuu

SEQ ID NO: 746428 - RNA, 26 nt, Human
aucaugcuagacaguaaagaaaauug

SEQ ID NO: 746429 - RNA, 21 nt, Human
auuacaauaagagugcuggau

SEQ ID NO: 746430 - RNA, 22 nt, Human
auuacaauaagagugcuggaua

SEQ ID NO: 746431 - RNA, 21 nt, Human
caacaaaaaaaaaaccaaacu

SEQ ID NO: 746432 - RNA, 19 nt, Human
caacagcgcugcaugacau

SEQ ID NO: 746433 - RNA, 24 nt, Human
caauaacuggugacuaccuguacc

SEQ ID NO: 746434 - RNA, 19 nt, Human
caccccugcgggcgggcgg

SEQ ID NO: 746435 - RNA, 19 nt, Human
cagcaggccuuggcugggg

SEQ ID NO: 746436 - RNA, 24 nt, Human
caggccuuggcugggggugggagu

SEQ ID NO: 746437 - RNA, 22 nt, Human
caggggcgggccggcugcuucc

SEQ ID NO: 746438 - RNA, 19 nt, Human
cccccaaagacaaaguccg

SEQ ID NO: 746439 - RNA, 20 nt, Human
cccccaaagacaaaguccga

SEQ ID NO: 746440 - RNA, 19 nt, Human
cccgcggcggcuccuccuu

SEQ ID NO: 746441 - RNA, 23 nt, Human
ccuaaaccccgaagaaacugaaa

SEQ ID NO: 746442 - RNA, 24 nt, Human
cgaagaggaggaggaggaggcggu

SEQ ID NO: 746443 - RNA, 23 nt, Human
cggugguggcuucuccggcuccu

SEQ ID NO: 746444 - RNA, 20 nt, Human
cuccaccaaacuaccuguuc

SEQ ID NO: 746445 - RNA, 22 nt, Human
cucggccuccccucgcggcuuc

SEQ ID NO: 746446 - RNA, 21 nt, Human
cucucgucuccgggcagccgu

SEQ ID NO: 746447 - RNA, 19 nt, Human
cugcgcuggggucugaggc

SEQ ID NO: 746448 - RNA, 19 nt, Human
cugggggugggagugggag

SEQ ID NO: 746449 - RNA, 22 nt, Human
cugggggugggagugggagggc

SEQ ID NO: 746450 - RNA, 18 nt, Human
cuguggcgcgggcaggcg

SEQ ID NO: 746451 - RNA, 21 nt, Human
cuuccuuuuuagcucucgcag

SEQ ID NO: 746452 - RNA, 23 nt, Human
cuuugcuucuuugguuacaaagu

SEQ ID NO: 746453 - RNA, 19 nt, Human
gacaguaaagaaaauugug

SEQ ID NO: 746454 - RNA, 21 nt, Human
gacugccucaggcggaaaccc

SEQ ID NO: 746455 - RNA, 19 nt, Human
gagccgcgggccggagcug

SEQ ID NO: 746456 - RNA, 18 nt, Human
gaggaggaggaggcggug

SEQ ID NO: 746457 - RNA, 23 nt, Human
gaggaggaggaggcgguggcggc

SEQ ID NO: 746458 - RNA, 21 nt, Human
gaggcgccccggcugugugag

SEQ ID NO: 746459 - RNA, 22 nt, Human
gcagaccgcuggcacgggaccg

SEQ ID NO: 746460 - RNA, 23 nt, Human
gcagagaggcacgccggcuccuc

SEQ ID NO: 746461 - RNA, 21 nt, Human
gcggcgacggcggucucggcc

SEQ ID NO: 746462 - RNA, 29 nt, Human
gcgguggcggcggcgugaggggcggugac

SEQ ID NO: 746463 - RNA, 20 nt, Human
gcgguggggcuguggcgcgg

SEQ ID NO: 746464 - RNA, 22 nt, Human
gcucugggggaggggaaagccg

SEQ ID NO: 746465 - RNA, 25 nt, Human
ggaaacaugggagagccaccaaaac

SEQ ID NO: 746466 - RNA, 21 nt, Human
ggaaaccggggagggcagagc

SEQ ID NO: 746467 - RNA, 24 nt, Human
ggaccggaggcgccccggcuguga

SEQ ID NO: 746468 - RNA, 18 nt, Human
ggaggcgguggcggcggc

SEQ ID NO: 746469 - RNA, 23 nt, Human
ggagggcagagaggcacgccggc

SEQ ID NO: 746470 - RNA, 21 nt, Human
ggagggcagagcacgggcccc

SEQ ID NO: 746471 - RNA, 18 nt, Human
ggcagagaggcacgccgg

SEQ ID NO: 746472 - RNA, 19 nt, Human
ggcgaagaggaggaggagg

SEQ ID NO: 746473 - RNA, 22 nt, Human
ggcggcggcgugaggggcggug

SEQ ID NO: 746474 - RNA, 19 nt, Human
ggcggugcugccccgcucg

SEQ ID NO: 746475 - RNA, 26 nt, Human
gggcaggcggcccucccuccccggcu

SEQ ID NO: 746476 - RNA, 23 nt, Human
gggccggagcuggcugaaggucc

SEQ ID NO: 746477 - RNA, 24 nt, Human
gggcgggcgguggggcuguggcgc

SEQ ID NO: 746478 - RNA, 23 nt, Human
gggcuguggcgcgggcaggcggc

SEQ ID NO: 746479 - RNA, 21 nt, Human
gggggaggggaaagccggcuc

SEQ ID NO: 746480 - RNA, 18 nt, Human
ggggugggagugggaggg

SEQ ID NO: 746481 - RNA, 21 nt, Human
guacacuagcucagcuccacc

SEQ ID NO: 746482 - RNA, 21 nt, Human
gugggagggcgaagaggagga

SEQ ID NO: 746483 - RNA, 18 nt, Human
uaaaccccgaagaaacug

SEQ ID NO: 746484 - RNA, 21 nt, Human
uaaaccccgaagaaacugaaa

SEQ ID NO: 746485 - RNA, 25 nt, Human
uaaaccccgaagaaacugaaauuca

SEQ ID NO: 746486 - RNA, 24 nt, Human
uaauacugaaaaggccaaacacac

SEQ ID NO: 746487 - RNA, 25 nt, Human
uagaaugauugucuaauacugaaaa

SEQ ID NO: 746488 - RNA, 19 nt, Human
uagccggagcucagcccca

SEQ ID NO: 746489 - RNA, 24 nt, Human
uagccggagcucagccccagggac

SEQ ID NO: 746490 - RNA, 22 nt, Human
uagcggugguggcuucuccccc

SEQ ID NO: 746491 - RNA, 24 nt, Human
uagcggugguggcuucuccggcuc

SEQ ID NO: 746492 - RNA, 23 nt, Human
uaggaaacaugggagagccacca

SEQ ID NO: 746493 - RNA, 24 nt, Human
uaggaaacaugggagagccaccaa

SEQ ID NO: 746494 - RNA, 28 nt, Human
uauaaaguggaaagaacaccaguggcac

SEQ ID NO: 746495 - RNA, 21 nt, Human
ucagcaggccuuggcuggggg

SEQ ID NO: 746496 - RNA, 19 nt, Human
ucaggguaaauccaugggu

SEQ ID NO: 746497 - RNA, 21 nt, Human
ucccucagaggcggcgagagc

SEQ ID NO: 746498 - RNA, 18 nt, Human
uccgagucugcgcugggg

SEQ ID NO: 746499 - RNA, 21 nt, Human
uccgcgggcgggcgguggggc

SEQ ID NO: 746500 - RNA, 24 nt, Human
uccuaaaccccgaagaaacugaaa

SEQ ID NO: 746501 - RNA, 18 nt, Human
uccugucuuucacuuccu

SEQ ID NO: 746502 - RNA, 19 nt, Human
uccuuuuuagcucucgcag

SEQ ID NO: 746503 - RNA, 19 nt, Human
ucggcgcucggcgcgguca

SEQ ID NO: 746504 - RNA, 23 nt, Human
ucuccggcuccuccucgggggcc

SEQ ID NO: 746505 - RNA, 26 nt, Human
ucuccgggcagccguggucaguccag

SEQ ID NO: 746506 - RNA, 22 nt, Human
ucuccuuguguacugaugacau

SEQ ID NO: 746507 - RNA, 21 nt, Human
ucucugacugagggaaggagc

SEQ ID NO: 746508 - RNA, 21 nt, Human
ucugcgcuggggucugaggcc

SEQ ID NO: 746509 - RNA, 22 nt, Human
ucuuuuguucaauuauugccua

SEQ ID NO: 746510 - RNA, 25 nt, Human
ugaaaagcagaggaaucguggcaaa

SEQ ID NO: 746511 - RNA, 19 nt, Human
ugaaaaggccaaacacaca

SEQ ID NO: 746512 - RNA, 25 nt, Human
ugaaaaggccaaacacacaaccaaa

SEQ ID NO: 746513 - RNA, 18 nt, Human
ugaaauggccgcgccagg

SEQ ID NO: 746514 - RNA, 23 nt, Human
ugaaauggccgcgccagggaugc

SEQ ID NO: 746515 - RNA, 22 nt, Human
ugaacaauuucacagcuuuuua

SEQ ID NO: 746516 - RNA, 19 nt, Human
uggaaagaacaccaguggc

SEQ ID NO: 746517 - RNA, 20 nt, Human
uggaaagaacaccaguggca

SEQ ID NO: 746518 - RNA, 27 nt, Human
uggaaagaacaccaguggcacacaagg

SEQ ID NO: 746519 - RNA, 18 nt, Human
uggcugaagguccgcggg

SEQ ID NO: 746520 - RNA, 23 nt, Human
uggcugggggugggagugggagg

SEQ ID NO: 746521 - RNA, 18 nt, Human
ugggggugggagugggag

SEQ ID NO: 746522 - RNA, 23 nt, Human
uggguccugucggaaaccgggga

SEQ ID NO: 746523 - RNA, 22 nt, Human
ugugugagguagcggugguggc

SEQ ID NO: 746524 - RNA, 23 nt, Human
uuacacuauacaaaauuuacauu

SEQ ID NO: 746525 - RNA, 21 nt, Human
uugugacugagaaaacacuaa

SEQ ID NO: 746526 - RNA, 22 nt, Human
aaaaccugcaccaccagcauca

SEQ ID NO: 746527 - RNA, 22 nt, Human
aaaaggcaaaggucaaacaaaa

SEQ ID NO: 746528 - RNA, 23 nt, Human
aaagauaacaacuuucaaccccc

SEQ ID NO: 746529 - RNA, 25 nt, Human
aacaaaaggccgaagucaccacccg

SEQ ID NO: 746530 - RNA, 18 nt, Human
aacccccacccuuacccc

SEQ ID NO: 746531 - RNA, 21 nt, Human
aagaagagacaggcuccagga

SEQ ID NO: 746532 - RNA, 18 nt, Human
aagcugcaacaucaaaac

SEQ ID NO: 746533 - RNA, 24 nt, Human
acaaagucaaaaggcaaaggucaa

SEQ ID NO: 746534 - RNA, 19 nt, Human
acagacuagugaacugggu

SEQ ID NO: 746535 - RNA, 21 nt, Human
accagcaucaccacacggacu

SEQ ID NO: 746536 - RNA, 21 nt, Human
acccccacccuuaccccagac

SEQ ID NO: 746537 - RNA, 18 nt, Human
acccgaaaggaacaaaca

SEQ ID NO: 746538 - RNA, 22 nt, Human
acugcggagccuccgggcgccg

SEQ ID NO: 746539 - RNA, 23 nt, Human
acuuucaggcuuguuuguuuugu

SEQ ID NO: 746540 - RNA, 22 nt, Human
agaaagaagagacaggcuccag

SEQ ID NO: 746541 - RNA, 24 nt, Human
agaaagaagagacaggcuccagga

SEQ ID NO: 746542 - RNA, 23 nt, Human
agcccggagcccgccgcaggguu

SEQ ID NO: 746543 - RNA, 19 nt, Human
aggaaagagccagcagaga

SEQ ID NO: 746544 - RNA, 26 nt, Human
aggcugaaaguggaucaaaagggacc

SEQ ID NO: 746545 - RNA, 18 nt, Human
aggcuuguuuguuuuguu

SEQ ID NO: 746546 - RNA, 21 nt, Human
agggaggccaccuuuggcucc

SEQ ID NO: 746547 - RNA, 23 nt, Human
agguagcuggcaaaggucagugc

SEQ ID NO: 746548 - RNA, 19 nt, Human
aguggaaaaaggaaaacug

SEQ ID NO: 746549 - RNA, 25 nt, Human
auagccaauauauuuggggacaggg

SEQ ID NO: 746550 - RNA, 22 nt, Human
caaaagaggcacaaagucaaaa

SEQ ID NO: 746551 - RNA, 26 nt, Human
caaaagaggcacaaagucaaaaggca

SEQ ID NO: 746552 - RNA, 22 nt, Human
caaagcaggccacaccgcaggc

SEQ ID NO: 746553 - RNA, 20 nt, Human
caacccccacccuuacccca

SEQ ID NO: 746554 - RNA, 19 nt, Human
cacacggacuggagaucac

SEQ ID NO: 746555 - RNA, 22 nt, Human
cacacggacuggagaucacaau

SEQ ID NO: 746556 - RNA, 23 nt, Human
cagcaucaccacacggacuggag

SEQ ID NO: 746557 - RNA, 20 nt, Human
cagcccggagcccgccgcag

SEQ ID NO: 746558 - RNA, 27 nt, Human
caggaaagagccagcagagaacacuug

SEQ ID NO: 746559 - RNA, 18 nt, Human
caggaccccacagacuag

SEQ ID NO: 746560 - RNA, 20 nt, Human
caucccccucacgcgcgccc

SEQ ID NO: 746561 - RNA, 26 nt, Human
ccaaaucuuuucucacuccccuaauc

SEQ ID NO: 746562 - RNA, 22 nt, Human
ccacagacuagugaacugggug

SEQ ID NO: 746563 - RNA, 18 nt, Human
ccaccagcaucaccacac

SEQ ID NO: 746564 - RNA, 19 nt, Human
ccacccgaaaggaacaaac

SEQ ID NO: 746565 - RNA, 22 nt, Human
ccagaaagaagagacaggcucc

SEQ ID NO: 746566 - RNA, 23 nt, Human
cccacccuuaccccagacuccca

SEQ ID NO: 746567 - RNA, 20 nt, Human
ccccaggacugcuagaaucc

SEQ ID NO: 746568 - RNA, 20 nt, Human
cccgaaaggaacaaacaaaa

SEQ ID NO: 746569 - RNA, 22 nt, Human
cccgccgcgccgccuccugccg

SEQ ID NO: 746570 - RNA, 24 nt, Human
cccgccgcgccgccuccugccgca

SEQ ID NO: 746571 - RNA, 19 nt, Human
ccgaagucaccacccgaaa

SEQ ID NO: 746572 - RNA, 19 nt, Human
ccgccgcgccgccuccugc

SEQ ID NO: 746573 - RNA, 20 nt, Human
ccucccggcccucgucccca

SEQ ID NO: 746574 - RNA, 21 nt, Human
ccuccgggcgccgucuggccc

SEQ ID NO: 746575 - RNA, 26 nt, Human
ccuccgggcgccgucuggcccgcgcg

SEQ ID NO: 746576 - RNA, 20 nt, Human
ccuccugccgcaucccccuc

SEQ ID NO: 746577 - RNA, 22 nt, Human
ccugcaagaccugacaugagcc

SEQ ID NO: 746578 - RNA, 19 nt, Human
ccugcuuccuuucuguggc

SEQ ID NO: 746579 - RNA, 22 nt, Human
cgcggagccucccgggcgacgg

SEQ ID NO: 746580 - RNA, 18 nt, Human
cucacuccccuaaucccc

SEQ ID NO: 746581 - RNA, 23 nt, Human
cucccgccgcgccgccuccugcc

SEQ ID NO: 746582 - RNA, 22 nt, Human
cuccgcccgggcugccugcucc

SEQ ID NO: 746583 - RNA, 19 nt, Human
cuccuccagacacuuucag

SEQ ID NO: 746584 - RNA, 22 nt, Human
cucguccccaugaccagauggg

SEQ ID NO: 746585 - RNA, 23 nt, Human
cugauccugcaagaccugacaug

SEQ ID NO: 746586 - RNA, 23 nt, Human
cuuucaacccccacccuuacccc

SEQ ID NO: 746587 - RNA, 20 nt, Human
gaaaaaggaaaacuguuagg

SEQ ID NO: 746588 - RNA, 22 nt, Human
gaaaaggcuacccggugcccuc

SEQ ID NO: 746589 - RNA, 18 nt, Human
gaaaggaacaaacaaaac

SEQ ID NO: 746590 - RNA, 22 nt, Human
gaacaaacaaaaccugcaccac

SEQ ID NO: 746591 - RNA, 22 nt, Human
gaagagacaggcuccaggaccc

SEQ ID NO: 746592 - RNA, 21 nt, Human
gaaggacggagcagcccggag

SEQ ID NO: 746593 - RNA, 21 nt, Human
gaagugaaacauuuuuguuuu

SEQ ID NO: 746594 - RNA, 22 nt, Human
gaccagaugggacuucaugaga

SEQ ID NO: 746595 - RNA, 18 nt, Human
gaccugguccaguugugg

SEQ ID NO: 746596 - RNA, 19 nt, Human
gcaggaaagagccagcaga

SEQ ID NO: 746597 - RNA, 18 nt, Human
gcauggaggcugaaagug

SEQ ID NO: 746598 - RNA, 20 nt, Human
gcauggaggcugaaagugga

SEQ ID NO: 746599 - RNA, 20 nt, Human
gccgccgccuacuccucccg

SEQ ID NO: 746600 - RNA, 23 nt, Human
gccgucuggcccgcgcgcagcuc

SEQ ID NO: 746601 - RNA, 24 nt, Human
gccuacuccucccgccgcgccgcc

SEQ ID NO: 746602 - RNA, 21 nt, Human
gcggccugaaagguuuuccag

SEQ ID NO: 746603 - RNA, 19 nt, Human
ggaacaaacaaaaccugca

SEQ ID NO: 746604 - RNA, 22 nt, Human
ggaaggacggagcagcccggag

SEQ ID NO: 746605 - RNA, 18 nt, Human
ggaccccacagacuagug

SEQ ID NO: 746606 - RNA, 21 nt, Human
ggcccugcuguccugcuuccu

SEQ ID NO: 746607 - RNA, 19 nt, Human
ggggacagggaggccaccu

SEQ ID NO: 746608 - RNA, 21 nt, Human
uacacuguguugggaaaaaua

SEQ ID NO: 746609 - RNA, 22 nt, Human
uacccggugcccucccggcccu

SEQ ID NO: 746610 - RNA, 22 nt, Human
ucagucacacaguggaaaaagg

SEQ ID NO: 746611 - RNA, 20 nt, Human
uccccaagugugaaaaggcu

SEQ ID NO: 746612 - RNA, 23 nt, Human
ucccccagguagcuggcaaaggu

SEQ ID NO: 746613 - RNA, 19 nt, Human
uccugaccagccuuggaug

SEQ ID NO: 746614 - RNA, 18 nt, Human
uccugccgcaucccccuc

SEQ ID NO: 746615 - RNA, 21 nt, Human
ucucacuccccuaauccccaa

SEQ ID NO: 746616 - RNA, 21 nt, Human
ucuccguggcugguuucacuu

SEQ ID NO: 746617 - RNA, 19 nt, Human
ugaacugggugccuuuagg

SEQ ID NO: 746618 - RNA, 19 nt, Human
ugagaaggaaaugagcggc

SEQ ID NO: 746619 - RNA, 24 nt, Human
ugagaggggcccugcuguccugcu

SEQ ID NO: 746620 - RNA, 18 nt, Human
ugcaccaccagcaucacc

SEQ ID NO: 746621 - RNA, 23 nt, Human
uggagagguggguguuuucuggc

SEQ ID NO: 746622 - RNA, 19 nt, Human
uggaggcugaaaguggauc

SEQ ID NO: 746623 - RNA, 19 nt, Human
uggcaggaaagagccagca

SEQ ID NO: 746624 - RNA, 22 nt, Human
uggcauggaggcugaaagugga

SEQ ID NO: 746625 - RNA, 22 nt, Human
uggcucccgcgcggagccuccc

SEQ ID NO: 746626 - RNA, 23 nt, Human
ugggucuaaccaggcaaagugag

SEQ ID NO: 746627 - RNA, 22 nt, Human
uguccugcuuccuuucuguggc

SEQ ID NO: 746628 - RNA, 27 nt, Human
uuguuuuguuuuauagauucagaaaua

SEQ ID NO: 746629 - RNA, 19 nt, Human
uuuaaacuuugacuuugca

SEQ ID NO: 746630 - RNA, 20 nt, Human
uuuucuggcauggaggcuga

SEQ ID NO: 746631 - RNA, 20 nt, Human
aaaaaacagauauaauacca

SEQ ID NO: 746632 - RNA, 27 nt, Human
aaaacagauauaauaccagcauaaaau

SEQ ID NO: 746633 - RNA, 21 nt, Human
aaacagauauaauaccagcau

SEQ ID NO: 746634 - RNA, 19 nt, Human
acugaagugaaaggcugca

SEQ ID NO: 746635 - RNA, 21 nt, Human
agauaggagaguccggcuggu

SEQ ID NO: 746636 - RNA, 18 nt, Human
agcaccagagccagaccc

SEQ ID NO: 746637 - RNA, 24 nt, Human
agccaggugggcacugaagugaaa

SEQ ID NO: 746638 - RNA, 19 nt, Human
agccugcagggcaggaggg

SEQ ID NO: 746639 - RNA, 21 nt, Human
aggcggggaggacagccugca

SEQ ID NO: 746640 - RNA, 23 nt, Human
aggcggggaggacagccugcagg

SEQ ID NO: 746641 - RNA, 23 nt, Human
auccaguaagaaaaacauaauuu

SEQ ID NO: 746642 - RNA, 23 nt, Human
caacagcgauaacgaggguccca

SEQ ID NO: 746643 - RNA, 25 nt, Human
caccacggaguucgcgcucacggaa

SEQ ID NO: 746644 - RNA, 20 nt, Human
cagagccagacccaccacca

SEQ ID NO: 746645 - RNA, 21 nt, Human
cagagccagacccaccaccac

SEQ ID NO: 746646 - RNA, 20 nt, Human
cagcagcagcuaagcuggau

SEQ ID NO: 746647 - RNA, 22 nt, Human
cagcagcagcuaagcuggaugc

SEQ ID NO: 746648 - RNA, 18 nt, Human
cagcagcuaagcuggaug

SEQ ID NO: 746649 - RNA, 20 nt, Human
cagcagcuaagcuggaugca

SEQ ID NO: 746650 - RNA, 19 nt, Human
caggccccagcugggugcc

SEQ ID NO: 746651 - RNA, 23 nt, Human
caggucagccaggugggcacuga

SEQ ID NO: 746652 - RNA, 27 nt, Human
ccuuuuguccugggaagcagagauugg

SEQ ID NO: 746653 - RNA, 18 nt, Human
cuggagaagcgggugcag

SEQ ID NO: 746654 - RNA, 18 nt, Human
gagaagcgggugcaggag

SEQ ID NO: 746655 - RNA, 19 nt, Human
gagggcucugggggugcca

SEQ ID NO: 746656 - RNA, 22 nt, Human
gcagcaccagagccagacccac

SEQ ID NO: 746657 - RNA, 22 nt, Human
gcucacggaacccaggccugcu

SEQ ID NO: 746658 - RNA, 20 nt, Human
ggagggcucugggggugcca

SEQ ID NO: 746659 - RNA, 19 nt, Human
gggcacugaagugaaaggc

SEQ ID NO: 746660 - RNA, 21 nt, Human
gggcacugaagugaaaggcug

SEQ ID NO: 746661 - RNA, 23 nt, Human
gggcaggaggggcacagacaggc

SEQ ID NO: 746662 - RNA, 24 nt, Human
gggugcaggagggcucugggggug

SEQ ID NO: 746663 - RNA, 21 nt, Human
gugcaggagggcucugggggu

SEQ ID NO: 746664 - RNA, 22 nt, Human
gugccaugguacagccgcaacc

SEQ ID NO: 746665 - RNA, 20 nt, Human
uaaaaaacagauauaauacc

SEQ ID NO: 746666 - RNA, 24 nt, Human
uaagaaaaacauaauuuucucauu

SEQ ID NO: 746667 - RNA, 22 nt, Human
uaauagauuauguuuguacaaa

SEQ ID NO: 746668 - RNA, 28 nt, Human
uagcaaauaauagauuauguuuguacaa

SEQ ID NO: 746669 - RNA, 19 nt, Human
ucugcuuccucagccaagu

SEQ ID NO: 746670 - RNA, 18 nt, Human
ugaagugaaaggcugcag

SEQ ID NO: 746671 - RNA, 19 nt, Human
ugaagugaaaggcugcaga

SEQ ID NO: 746672 - RNA, 23 nt, Human
ugcagagaggcggggaggacagc

SEQ ID NO: 746673 - RNA, 22 nt, Human
ugcagggcaggaggggcacaga

SEQ ID NO: 746674 - RNA, 24 nt, Human
ugcguagauggcagcaccagagga

SEQ ID NO: 746675 - RNA, 23 nt, Human
uguuuguacaaaauccaguaaga

SEQ ID NO: 746676 - RNA, 23 nt, Human
uuaguauuuuguucaacaauuua

SEQ ID NO: 746677 - RNA, 30 nt, Human
uugagcaacagcgauaacgagggucccuuu

SEQ ID NO: 746678 - RNA, 20 nt, Human
uugcucugcgggguccugga

SEQ ID NO: 746679 - RNA, 18 nt, Human
uuugcucugcgggguccu

SEQ ID NO: 746680 - RNA, 21 nt, Human
uuuugcucugcgggguccugg

SEQ ID NO: 746681 - RNA, 22 nt, Human
uuuugcucugcgggguccugga

SEQ ID NO: 746682 - RNA, 25 nt, Human
aaagaagaagauacaugucccagga

SEQ ID NO: 746683 - RNA, 19 nt, Human
aaccuggcccagcacauga

SEQ ID NO: 746684 - RNA, 24 nt, Human
aagaagaagauacaugucccagga

SEQ ID NO: 746685 - RNA, 25 nt, Human
aagcaaucgcuuuccuccuuuuuuc

SEQ ID NO: 746686 - RNA, 18 nt, Human
aaucgcgggaacuaacac

SEQ ID NO: 746687 - RNA, 21 nt, Human
aaugaagagauuaaaaagucu

SEQ ID NO: 746688 - RNA, 19 nt, Human
acaauaagcaaucgcuuuc

SEQ ID NO: 746689 - RNA, 26 nt, Human
acccugugguucgccuagacccaggg

SEQ ID NO: 746690 - RNA, 20 nt, Human
acugcacugggauuuagaug

SEQ ID NO: 746691 - RNA, 23 nt, Human
acuuccaaagaaucuccaacuuc

SEQ ID NO: 746692 - RNA, 18 nt, Human
agauuaaaaagucuggca

SEQ ID NO: 746693 - RNA, 20 nt, Human
agcugcagaaucgcgggaac

SEQ ID NO: 746694 - RNA, 24 nt, Human
aggaucagcagagagguugucagc

SEQ ID NO: 746695 - RNA, 27 nt, Human
aggcaaagaagaagauacaugucccag

SEQ ID NO: 746696 - RNA, 23 nt, Human
aggcuguuuuggggcuguguacu

SEQ ID NO: 746697 - RNA, 22 nt, Human
aggucuuguugccggggcacag

SEQ ID NO: 746698 - RNA, 23 nt, Human
agucgaaaaccuggcccagcaca

SEQ ID NO: 746699 - RNA, 27 nt, Human
auaagcaaucgcuuuccuccuuuuuuc

SEQ ID NO: 746700 - RNA, 21 nt, Human
aucaugcuuagggaaggguug

SEQ ID NO: 746701 - RNA, 25 nt, Human
augcccagcauuccauccucccagc

SEQ ID NO: 746702 - RNA, 24 nt, Human
caacagcacaggcuggagggacaa

SEQ ID NO: 746703 - RNA, 23 nt, Human
caccugcuuauugaacuccacag

SEQ ID NO: 746704 - RNA, 24 nt, Human
caccuugaccucacccugugguuc

SEQ ID NO: 746705 - RNA, 18 nt, Human
cacugugaccaucagagc

SEQ ID NO: 746706 - RNA, 24 nt, Human
cagaagguggccaacccacccucu

SEQ ID NO: 746707 - RNA, 21 nt, Human
cagaaugcucaccuugaccuc

SEQ ID NO: 746708 - RNA, 19 nt, Human
cagcagcugccugauccag

SEQ ID NO: 746709 - RNA, 18 nt, Human
caggaucagcagagaggu

SEQ ID NO: 746710 - RNA, 19 nt, Human
ccaacccacccucugagcc

SEQ ID NO: 746711 - RNA, 24 nt, Human
ccacuuccaaagaaucuccaacuu

SEQ ID NO: 746712 - RNA, 21 nt, Human
ccaggcuguugacugcacugg

SEQ ID NO: 746713 - RNA, 22 nt, Human
ccaguccuucuuccaacuugcu

SEQ ID NO: 746714 - RNA, 22 nt, Human
ccauuagcucaaaguucacaug

SEQ ID NO: 746715 - RNA, 23 nt, Human
cccucugagcccaaauauuguuc

SEQ ID NO: 746716 - RNA, 26 nt, Human
ccuaaccuccaccucgaaccgguucc

SEQ ID NO: 746717 - RNA, 26 nt, Human
cuaacacugugaccaucagagccaga

SEQ ID NO: 746718 - RNA, 19 nt, Human
cugaaagagccagccggua

SEQ ID NO: 746719 - RNA, 21 nt, Human
cugugugguuccccagaacug

SEQ ID NO: 746720 - RNA, 23 nt, Human
cuuagggaaggguugcagagaaa

SEQ ID NO: 746721 - RNA, 21 nt, Human
gaagagauuaaaaagucuggc

SEQ ID NO: 746722 - RNA, 19 nt, Human
gaaggaugggcagcauggg

SEQ ID NO: 746723 - RNA, 22 nt, Human
gaaggaugggcagcaugggcug

SEQ ID NO: 746724 - RNA, 22 nt, Human
gcccuugaugacuuuuccugau

SEQ ID NO: 746725 - RNA, 20 nt, Human
gccuaaccuccaccucgaac

SEQ ID NO: 746726 - RNA, 18 nt, Human
gcucaugguggcuggugc

SEQ ID NO: 746727 - RNA, 18 nt, Human
ggcuguugacugcacugg

SEQ ID NO: 746728 - RNA, 23 nt, Human
gugacacaacaggaucagcagag

SEQ ID NO: 746729 - RNA, 20 nt, Human
guguugccugauuuccuguu

SEQ ID NO: 746730 - RNA, 19 nt, Human
uaaccuccaccucgaacac

SEQ ID NO: 746731 - RNA, 21 nt, Human
uaaccuccaccucgaacacca

SEQ ID NO: 746732 - RNA, 20 nt, Human
uauuaccccuucugagccaa

SEQ ID NO: 746733 - RNA, 18 nt, Human
ucaaaguucacaugaauc

SEQ ID NO: 746734 - RNA, 25 nt, Human
ucacccgccuaaccuccaccucgaa

SEQ ID NO: 746735 - RNA, 18 nt, Human
ucaccggguugcggggag

SEQ ID NO: 746736 - RNA, 24 nt, Human
ucacugagggaguuagauuuggua

SEQ ID NO: 746737 - RNA, 20 nt, Human
ucagcagagagguugucagc

SEQ ID NO: 746738 - RNA, 20 nt, Human
uccaguccaaaaagugaggc

SEQ ID NO: 746739 - RNA, 23 nt, Human
ucccagaaugcucaccuugaccu

SEQ ID NO: 746740 - RNA, 20 nt, Human
ucccagagucccagggccug

SEQ ID NO: 746741 - RNA, 20 nt, Human
ucccagagucccagggccug

SEQ ID NO: 746742 - RNA, 18 nt, Human
ucccaggacuauaggcca

SEQ ID NO: 746743 - RNA, 20 nt, Human
ucccuuaguucuaccaggga

SEQ ID NO: 746744 - RNA, 20 nt, Human
ucuuuguuagcaguggaguc

SEQ ID NO: 746745 - RNA, 21 nt, Human
ugaauccuagcaaccguaacu

SEQ ID NO: 746746 - RNA, 22 nt, Human
ugacacaacaggaucagcagag

SEQ ID NO: 746747 - RNA, 23 nt, Human
ugacugcaucgggacuuguauuu

SEQ ID NO: 746748 - RNA, 24 nt, Human
ugauggaccaguucugucucuggu

SEQ ID NO: 746749 - RNA, 22 nt, Human
ugcagagaaaccuuugcaccag

SEQ ID NO: 746750 - RNA, 22 nt, Human
ugcuuagggaaggguugcagag

SEQ ID NO: 746751 - RNA, 25 nt, Human
uggaaggaugggcagcaugggcugg

SEQ ID NO: 746752 - RNA, 22 nt, Human
uggcuuucaccggguugcgggg

SEQ ID NO: 746753 - RNA, 18 nt, Human
uggggcucagaagguggc

SEQ ID NO: 746754 - RNA, 23 nt, Human
uggugacacaacaggaucagcag

SEQ ID NO: 746755 - RNA, 22 nt, Human
ugguguugccugauuuccuguu

SEQ ID NO: 746756 - RNA, 20 nt, Human
ugugggagugcucauggugg

SEQ ID NO: 746757 - RNA, 18 nt, Human
uuaaugaagagauuaaaa

SEQ ID NO: 746758 - RNA, 24 nt, Human
uucagguagaggagggcucccagg

SEQ ID NO: 746759 - RNA, 19 nt, Human
uucccuggccuuucuuagg

SEQ ID NO: 746760 - RNA, 20 nt, Human
uuccuccuuuuuucaugccc

SEQ ID NO: 746761 - RNA, 21 nt, Human
uuccugauccuaacuucaagc

SEQ ID NO: 746762 - RNA, 18 nt, Human
uugcugccguucccuggc

SEQ ID NO: 746763 - RNA, 24 nt, Human
aaacaagcagcucauaauaaaaga

SEQ ID NO: 746764 - RNA, 19 nt, Human
aacugacuuuaaauacugc

SEQ ID NO: 746765 - RNA, 22 nt, Human
aagcagcucauaauaaaagaaa

SEQ ID NO: 746766 - RNA, 25 nt, Human
acaagcagcucauaauaaaagaaaa

SEQ ID NO: 746767 - RNA, 22 nt, Human
caacugacuuuaaauacugccc

SEQ ID NO: 746768 - RNA, 21 nt, Human
caagaaaaaaaccuacuaaga

SEQ ID NO: 746769 - RNA, 22 nt, Human
caagaaaaaacauccuaagaaa

SEQ ID NO: 746770 - RNA, 21 nt, Human
cacugcuugccaacugacuuu

SEQ ID NO: 746771 - RNA, 22 nt, Human
cucauaauaaaagaaaacugag

SEQ ID NO: 746772 - RNA, 24 nt, Human
cucauaauaaaagaaaacugagcu

SEQ ID NO: 746773 - RNA, 22 nt, Human
gaaaaaaaccuacuaagagcau

SEQ ID NO: 746774 - RNA, 18 nt, Human
gacaagaaaaaacauccu

SEQ ID NO: 746775 - RNA, 22 nt, Human
gagaaagaaucaucaaucucau

SEQ ID NO: 746776 - RNA, 20 nt, Human
gcccuuuaaugcugagauga

SEQ ID NO: 746777 - RNA, 19 nt, Human
ggagaguaaaggaugagug

SEQ ID NO: 746778 - RNA, 20 nt, Human
gugugcugcacccauuccua

SEQ ID NO: 746779 - RNA, 24 nt, Human
uaaaaagacaagaaaaaacauccu

SEQ ID NO: 746780 - RNA, 25 nt, Human
uacaagaaaaaaaccuacuaagagc

SEQ ID NO: 746781 - RNA, 23 nt, Human
uacaccacucaaacaagcagcuc

SEQ ID NO: 746782 - RNA, 21 nt, Human
uaguuacauguguauucaugu

SEQ ID NO: 746783 - RNA, 21 nt, Human
uauaguguaacuauuaaaauu

SEQ ID NO: 746784 - RNA, 19 nt, Human
ucugcuucaagcucuuuca

SEQ ID NO: 746785 - RNA, 18 nt, Human
ugaggggagaguaaagga

SEQ ID NO: 746786 - RNA, 19 nt, Human
ugccaugcuggugugcugc

SEQ ID NO: 746787 - RNA, 22 nt, Human
ugcuucaagcucuuucaguuca

SEQ ID NO: 746788 - RNA, 26 nt, Human
ugugaugaaagguuuuccaggagaaa

SEQ ID NO: 746789 - RNA, 20 nt, Human
uuuacaaaaaucuuauucca

SEQ ID NO: 746790 - RNA, 19 nt, Human
uuucacaaguccugaagau

SEQ ID NO: 746791 - RNA, 20 nt, Human
aacaagcacaugccccccaa

SEQ ID NO: 746792 - RNA, 21 nt, Human
aagcaagagcagccccaugug

SEQ ID NO: 746793 - RNA, 20 nt, Human
aaggugccuaauucauaaac

SEQ ID NO: 746794 - RNA, 20 nt, Human
aauggagaaaccaaugucca

SEQ ID NO: 746795 - RNA, 22 nt, Human
acagccacgccugugcgcagcg

SEQ ID NO: 746796 - RNA, 21 nt, Human
accagcagguucugcgucucc

SEQ ID NO: 746797 - RNA, 23 nt, Human
acuuccuucaccaggacccacaa

SEQ ID NO: 746798 - RNA, 26 nt, Human
agaacacagccagggccccauacuug

SEQ ID NO: 746799 - RNA, 21 nt, Human
agaugcaggcccagggaaucu

SEQ ID NO: 746800 - RNA, 19 nt, Human
agcuggugcgaggcgggcu

SEQ ID NO: 746801 - RNA, 22 nt, Human
aggcaagcaagggcagaucuga

SEQ ID NO: 746802 - RNA, 22 nt, Human
aggcaggaggagaugaggccag

SEQ ID NO: 746803 - RNA, 23 nt, Human
aggcauugagcacaguguaauuu

SEQ ID NO: 746804 - RNA, 22 nt, Human
agucaggagguucaggcucccg

SEQ ID NO: 746805 - RNA, 21 nt, Human
auggagaaaccaauguccaca

SEQ ID NO: 746806 - RNA, 26 nt, Human
caagagcagccccaugugggggcuaa

SEQ ID NO: 746807 - RNA, 22 nt, Human
caagaggcaggaaugaccccca

SEQ ID NO: 746808 - RNA, 22 nt, Human
caagcacaugccccccaaccug

SEQ ID NO: 746809 - RNA, 27 nt, Human
cacaacucacugcuccugggagagcag

SEQ ID NO: 746810 - RNA, 21 nt, Human
caccaggacccacaaccccug

SEQ ID NO: 746811 - RNA, 18 nt, Human
caccugaggguuccauca

SEQ ID NO: 746812 - RNA, 25 nt, Human
caccuuuggcuccacagucugguuc

SEQ ID NO: 746813 - RNA, 20 nt, Human
cacggauggagggacucagc

SEQ ID NO: 746814 - RNA, 21 nt, Human
cagccagggccccauacuugg

SEQ ID NO: 746815 - RNA, 19 nt, Human
cagccccaugugggggcua

SEQ ID NO: 746816 - RNA, 21 nt, Human
caggacccacaaccccugccc

SEQ ID NO: 746817 - RNA, 26 nt, Human
caggugcagcuggugcgaggcgggcu

SEQ ID NO: 746818 - RNA, 22 nt, Human
ccaacaagcacaugccccccaa

SEQ ID NO: 746819 - RNA, 19 nt, Human
ccacagccucuuccugggc

SEQ ID NO: 746820 - RNA, 18 nt, Human
ccaggagaugcaggccca

SEQ ID NO: 746821 - RNA, 20 nt, Human
ccagggccccauacuuggcc

SEQ ID NO: 746822 - RNA, 18 nt, Human
ccaguacuggcuagccag

SEQ ID NO: 746823 - RNA, 23 nt, Human
cccauaccacauagcugcaggaa

SEQ ID NO: 746824 - RNA, 22 nt, Human
ccccaaccuggugccaagaggc

SEQ ID NO: 746825 - RNA, 18 nt, Human
ccccacugaugacaccuu

SEQ ID NO: 746826 - RNA, 21 nt, Human
cccccaguacuggcuagccag

SEQ ID NO: 746827 - RNA, 26 nt, Human
ccuggccgcaguguggagcacagagg

SEQ ID NO: 746828 - RNA, 20 nt, Human
ccugggagagcaggaggggc

SEQ ID NO: 746829 - RNA, 22 nt, Human
ccuuguggcuccagcccugggg

SEQ ID NO: 746830 - RNA, 18 nt, Human
cggcgccaggagaugcag

SEQ ID NO: 746831 - RNA, 22 nt, Human
cguguacagccacgccugugcg

SEQ ID NO: 746832 - RNA, 27 nt, Human
cuagccaggugcuuggccuuaaacacc

SEQ ID NO: 746833 - RNA, 26 nt, Human
cugcaccagccuucuuuccacucaca

SEQ ID NO: 746834 - RNA, 23 nt, Human
cugggcccagaagcagccggcgc

SEQ ID NO: 746835 - RNA, 26 nt, Human
cugggcccagaagcagccggcgccag

SEQ ID NO: 746836 - RNA, 21 nt, Human
cuuuccacucacaacucacug

SEQ ID NO: 746837 - RNA, 23 nt, Human
gaaagcauccacggauggaggga

SEQ ID NO: 746838 - RNA, 22 nt, Human
gaacacagccagggccccauac

SEQ ID NO: 746839 - RNA, 20 nt, Human
gaagcaagagcagccccaug

SEQ ID NO: 746840 - RNA, 22 nt, Human
gaccuugcacucuuccacccac

SEQ ID NO: 746841 - RNA, 22 nt, Human
gagaaaccaauguccacaggua

SEQ ID NO: 746842 - RNA, 19 nt, Human
gauaagggaggaaaggcag

SEQ ID NO: 746843 - RNA, 20 nt, Human
gcagcuggugcgaggcgggc

SEQ ID NO: 746844 - RNA, 20 nt, Human
gccaggccucacagcugcag

SEQ ID NO: 746845 - RNA, 23 nt, Human
gcccuggggcccccugcggucac

SEQ ID NO: 746846 - RNA, 19 nt, Human
gccuggccgcaguguggag

SEQ ID NO: 746847 - RNA, 22 nt, Human
gccuucuuuccacucacaacuc

SEQ ID NO: 746848 - RNA, 26 nt, Human
gcugcacccccaguacuggcuagcca

SEQ ID NO: 746849 - RNA, 24 nt, Human
ggaaaaaacaguauguauaagguu

SEQ ID NO: 746850 - RNA, 21 nt, Human
ggaaauauaucaggaccugag

SEQ ID NO: 746851 - RNA, 20 nt, Human
ggagaaaccaauguccacag

SEQ ID NO: 746852 - RNA, 21 nt, Human
ggagaugaggccagccccacu

SEQ ID NO: 746853 - RNA, 19 nt, Human
ggauaaggggguaacugcu

SEQ ID NO: 746854 - RNA, 21 nt, Human
ggcauccccugaugcagguug

SEQ ID NO: 746855 - RNA, 19 nt, Human
ggcccagaagcagccggcg

SEQ ID NO: 746856 - RNA, 22 nt, Human
ggcccagaagcagccggcgcca

SEQ ID NO: 746857 - RNA, 20 nt, Human
guaaagguccuccagcucuu

SEQ ID NO: 746858 - RNA, 20 nt, Human
guggauaaggggguaacugc

SEQ ID NO: 746859 - RNA, 23 nt, Human
guguacagccacgccugugcgca

SEQ ID NO: 746860 - RNA, 18 nt, Human
uaaagagaaacugauaag

SEQ ID NO: 746861 - RNA, 26 nt, Human
uaagguuuguuauuaucugugguuuu

SEQ ID NO: 746862 - RNA, 19 nt, Human
uaccacauagcugcaggaa

SEQ ID NO: 746863 - RNA, 20 nt, Human
uagauauccacuguaucccc

SEQ ID NO: 746864 - RNA, 23 nt, Human
uagcugcaggaaagcauccacgg

SEQ ID NO: 746865 - RNA, 23 nt, Human
uccacagguauagcucggaccac

SEQ ID NO: 746866 - RNA, 18 nt, Human
uccaggaugggcgugggg

SEQ ID NO: 746867 - RNA, 20 nt, Human
uccccuguggauaagggggu

SEQ ID NO: 746868 - RNA, 20 nt, Human
uccucaugcaaagugagggu

SEQ ID NO: 746869 - RNA, 20 nt, Human
uccuccagcucuucaaugga

SEQ ID NO: 746870 - RNA, 20 nt, Human
uccugggcccagaagcagcc

SEQ ID NO: 746871 - RNA, 24 nt, Human
ucuagccaagugaaaugaauccaa

SEQ ID NO: 746872 - RNA, 24 nt, Human
ucugcaccagccuucuuuccacuc

SEQ ID NO: 746873 - RNA, 21 nt, Human
ucuuuuaguagaagcaagagc

SEQ ID NO: 746874 - RNA, 20 nt, Human
ugagagcacguguacagccc

SEQ ID NO: 746875 - RNA, 18 nt, Human
uggagaaaccaauguccc

SEQ ID NO: 746876 - RNA, 18 nt, Human
ugggaggccuaagcagug

SEQ ID NO: 746877 - RNA, 22 nt, Human
ugggaggccuaagcagugguug

SEQ ID NO: 746878 - RNA, 23 nt, Human
uggggcccccugcggucaccuuu

SEQ ID NO: 746879 - RNA, 22 nt, Human
ugguuuuagacauccacugggg

SEQ ID NO: 746880 - RNA, 24 nt, Human
uguggagcacagagguaugaggca

SEQ ID NO: 746881 - RNA, 25 nt, Human
ugugguuuuagacauccacuggggg

SEQ ID NO: 746882 - RNA, 24 nt, Human
uguucugcccauguuccucaguca

SEQ ID NO: 746883 - RNA, 22 nt, Human
uuggccuuaaacaccauguaaa

SEQ ID NO: 746884 - RNA, 24 nt, Human
uugggccaggccucacagcugcag

SEQ ID NO: 746885 - RNA, 18 nt, Human
uuuuuuaaaguuacugga

SEQ ID NO: 746886 - RNA, 24 nt, Human
uuuuuuuuuuuuuuuuuuuuacag

SEQ ID NO: 746887 - RNA, 21 nt, Human
acaaauucuugaggagcaaaa

SEQ ID NO: 746888 - RNA, 20 nt, Human
acacacacauauaaauacaa

SEQ ID NO: 746889 - RNA, 19 nt, Human
acacccaucuccagccaac

SEQ ID NO: 746890 - RNA, 22 nt, Human
acaggaaucuacagcccaaagc

SEQ ID NO: 746891 - RNA, 24 nt, Human
acauacacgcacgcacgcacgcag

SEQ ID NO: 746892 - RNA, 18 nt, Human
accccccaccccaaaauc

SEQ ID NO: 746893 - RNA, 23 nt, Human
acgcacacacacacacacauaua

SEQ ID NO: 746894 - RNA, 22 nt, Human
acugcugccacgugcccagaaa

SEQ ID NO: 746895 - RNA, 19 nt, Human
agaaucacccaccaggcuc

SEQ ID NO: 746896 - RNA, 24 nt, Human
agacaggaaucuacagcccaaagc

SEQ ID NO: 746897 - RNA, 24 nt, Human
agccacagcauuccagugcucagc

SEQ ID NO: 746898 - RNA, 21 nt, Human
aggaacaaggcagccagucca

SEQ ID NO: 746899 - RNA, 22 nt, Human
aggaagaaaguaaaggccaggg

SEQ ID NO: 746900 - RNA, 20 nt, Human
aggaaucuacagcccaaagc

SEQ ID NO: 746901 - RNA, 23 nt, Human
aggaaucuacagcccaaagcccc

SEQ ID NO: 746902 - RNA, 20 nt, Human
aggcaaacaaauucuugagg

SEQ ID NO: 746903 - RNA, 24 nt, Human
aggcaaacaaauucuugaggagca

SEQ ID NO: 746904 - RNA, 22 nt, Human
agggcuuaggcucagcuccugc

SEQ ID NO: 746905 - RNA, 25 nt, Human
aggggcuggcagaagcugguccaga

SEQ ID NO: 746906 - RNA, 18 nt, Human
caaaaucagcucccuccc

SEQ ID NO: 746907 - RNA, 23 nt, Human
caaggcagccaguccagccagca

SEQ ID NO: 746908 - RNA, 19 nt, Human
cacacacacacacacauau

SEQ ID NO: 746909 - RNA, 18 nt, Human
cacacacccauguuaucc

SEQ ID NO: 746910 - RNA, 19 nt, Human
cacacccauguuaucccca

SEQ ID NO: 746911 - RNA, 19 nt, Human
cacccacacccuguaauac

SEQ ID NO: 746912 - RNA, 21 nt, Human
cacccaccaggcucugccugc

SEQ ID NO: 746913 - RNA, 24 nt, Human
caccccaaaaucagcucccuccca

SEQ ID NO: 746914 - RNA, 20 nt, Human
caccccccaccccaaaauca

SEQ ID NO: 746915 - RNA, 24 nt, Human
caccccccaccccaaaaucagcuc

SEQ ID NO: 746916 - RNA, 21 nt, Human
cacugucuugagacgguucca

SEQ ID NO: 746917 - RNA, 22 nt, Human
cagaagcugguccagaccaaac

SEQ ID NO: 746918 - RNA, 19 nt, Human
cagcccaaagccccgccag

SEQ ID NO: 746919 - RNA, 20 nt, Human
cagugcagccacagcauucc

SEQ ID NO: 746920 - RNA, 19 nt, Human
cagugggccuccaauggcc

SEQ ID NO: 746921 - RNA, 20 nt, Human
ccaccuacagugggccucca

SEQ ID NO: 746922 - RNA, 22 nt, Human
ccacuggccgauccuacugcuu

SEQ ID NO: 746923 - RNA, 22 nt, Human
ccagaccaaacauacacgcacg

SEQ ID NO: 746924 - RNA, 20 nt, Human
ccagccaacccccaggagcc

SEQ ID NO: 746925 - RNA, 21 nt, Human
ccagccaacccccaggagccc

SEQ ID NO: 746926 - RNA, 21 nt, Human
ccagccaacccccaggagccc

SEQ ID NO: 746927 - RNA, 20 nt, Human
ccagggcuuaggcucagcuc

SEQ ID NO: 746928 - RNA, 20 nt, Human
cccaaagccccgccagggcu

SEQ ID NO: 746929 - RNA, 21 nt, Human
cccaccuacagugggccucca

SEQ ID NO: 746930 - RNA, 23 nt, Human
cccaggcaaacaaauucuugagg

SEQ ID NO: 746931 - RNA, 18 nt, Human
cccauguucuccuuuagg

SEQ ID NO: 746932 - RNA, 24 nt, Human
ccccaaaaucagcucccucccacc

SEQ ID NO: 746933 - RNA, 25 nt, Human
ccccaaaaucagcucccucccaccu

SEQ ID NO: 746934 - RNA, 18 nt, Human
ccccaggagcccuuacuc

SEQ ID NO: 746935 - RNA, 24 nt, Human
cccccaggagcccuuacucagcuc

SEQ ID NO: 746936 - RNA, 23 nt, Human
ccucccaccuacagugggccucc

SEQ ID NO: 746937 - RNA, 23 nt, Human
ccucuagucccaccccccacccc

SEQ ID NO: 746938 - RNA, 19 nt, Human
ccuguuuaaccccuucagu

SEQ ID NO: 746939 - RNA, 20 nt, Human
cgcacacacacacacacaua

SEQ ID NO: 746940 - RNA, 25 nt, Human
cgcacgcacacacacacacacauau

SEQ ID NO: 746941 - RNA, 26 nt, Human
cgcacgcacgcacacacacacacaca

SEQ ID NO: 746942 - RNA, 26 nt, Human
cgcacgcacgcacgcacacacacaca

SEQ ID NO: 746943 - RNA, 26 nt, Human
cgcacgcacgcacgcacgcacacaca

SEQ ID NO: 746944 - RNA, 20 nt, Human
cuaaguccuaggccaggaac

SEQ ID NO: 746945 - RNA, 23 nt, Human
cuacagugggccuccaauggccc

SEQ ID NO: 746946 - RNA, 24 nt, Human
cuccugcugucgccacuggccgau

SEQ ID NO: 746947 - RNA, 19 nt, Human
cuggauggcugagaauccc

SEQ ID NO: 746948 - RNA, 19 nt, Human
gaaaguaaaggccaggggc

SEQ ID NO: 746949 - RNA, 18 nt, Human
gaagacaaagagguggca

SEQ ID NO: 746950 - RNA, 23 nt, Human
gagggugggugagaagaugaugg

SEQ ID NO: 746951 - RNA, 24 nt, Human
gcacacacacacacacauauaaau

SEQ ID NO: 746952 - RNA, 25 nt, Human
gcacacacacacacacauauaaaua

SEQ ID NO: 746953 - RNA, 24 nt, Human
gccacagcauuccagugcucagcc

SEQ ID NO: 746954 - RNA, 21 nt, Human
gccagggcuuaggcucagcuc

SEQ ID NO: 746955 - RNA, 20 nt, Human
ggacagaugccacacccauc

SEQ ID NO: 746956 - RNA, 21 nt, Human
ggccaggggcuggcagaagcu

SEQ ID NO: 746957 - RNA, 24 nt, Human
gggcacacacccauguuaucccca

SEQ ID NO: 746958 - RNA, 18 nt, Human
gugcagccacagcauucc

SEQ ID NO: 746959 - RNA, 27 nt, Human
uacaaaaguagggguuggggcaaguac

SEQ ID NO: 746960 - RNA, 26 nt, Human
uacacgcacgcacgcacgcacgcaca

SEQ ID NO: 746961 - RNA, 25 nt, Human
uacacgcacgcacgcacgcacgcag

SEQ ID NO: 746962 - RNA, 19 nt, Human
uacagcccaaagccccgcc

SEQ ID NO: 746963 - RNA, 20 nt, Human
uaccagcaccucagccuagu

SEQ ID NO: 746964 - RNA, 23 nt, Human
uacuuugccacaggggcucugca

SEQ ID NO: 746965 - RNA, 23 nt, Human
uagucccaccccccaccccaaaa

SEQ ID NO: 746966 - RNA, 24 nt, Human
ucagccccucagcugggagaucag

SEQ ID NO: 746967 - RNA, 21 nt, Human
ucccuuuagucagacaggaau

SEQ ID NO: 746968 - RNA, 19 nt, Human
uccuaacccucccagcccc

SEQ ID NO: 746969 - RNA, 26 nt, Human
ucuacagcccaaagccccgccagggc

SEQ ID NO: 746970 - RNA, 18 nt, Human
ucucaauacugcagcuuu

SEQ ID NO: 746971 - RNA, 22 nt, Human
ugacagaaucacccaccaggcu

SEQ ID NO: 746972 - RNA, 18 nt, Human
ugaggagcaaaaaccugu

SEQ ID NO: 746973 - RNA, 18 nt, Human
ugagggcagaauuucaca

SEQ ID NO: 746974 - RNA, 21 nt, Human
ugagggugggugagaagauga

SEQ ID NO: 746975 - RNA, 24 nt, Human
ugagggugggugagaagaugaugg

SEQ ID NO: 746976 - RNA, 22 nt, Human
ugcaggugauaguuaugaagcu

SEQ ID NO: 746977 - RNA, 19 nt, Human
ugccacacccaucuccagc

SEQ ID NO: 746978 - RNA, 23 nt, Human
ugccacgugcccagaaauggcuc

SEQ ID NO: 746979 - RNA, 24 nt, Human
ugccagcacugucuugagacgguc

SEQ ID NO: 746980 - RNA, 23 nt, Human
uggcugagaaucccuuggacccu

SEQ ID NO: 746981 - RNA, 28 nt, Human
uguuuaaccccuucaguauugcccucua

SEQ ID NO: 746982 - RNA, 19 nt, Human
uuaggcucagcuccugcug

SEQ ID NO: 746983 - RNA, 23 nt, Human
uucacauuuuguuugcccugcau

SEQ ID NO: 746984 - RNA, 23 nt, Human
uucacuacagcggaaugcaauga

SEQ ID NO: 746985 - RNA, 21 nt, Human
uucccuccuuuuugagguccc

SEQ ID NO: 746986 - RNA, 21 nt, Human
uuccuuuucuuuuuacaacuu

SEQ ID NO: 746987 - RNA, 20 nt, Human
uugagacgguuccaggccug

SEQ ID NO: 746988 - RNA, 23 nt, Human
uuggugugaagcccuccaauccu

SEQ ID NO: 746989 - RNA, 24 nt, Human
uuucuguugacagaaucacccacc

SEQ ID NO: 746990 - RNA, 21 nt, Human
uuuucauccuaacccucccaa

SEQ ID NO: 746991 - RNA, 25 nt, Human
aaaaaaaaaauuacaaaaacuagga

SEQ ID NO: 746992 - RNA, 20 nt, Human
agaagguuaaugauugagga

SEQ ID NO: 746993 - RNA, 22 nt, Human
aucacugacuuuuuuuccuaag

SEQ ID NO: 746994 - RNA, 18 nt, Human
auuacacucaucuuuuac

SEQ ID NO: 746995 - RNA, 24 nt, Human
cacaagcuccuuuucauucaauuu

SEQ ID NO: 746996 - RNA, 24 nt, Human
ccacuggcuaagagacaccacuua

SEQ ID NO: 746997 - RNA, 21 nt, Human
cuuggcacuggccuuucagcc

SEQ ID NO: 746998 - RNA, 23 nt, Human
gaggaugccagugaagggugcag

SEQ ID NO: 746999 - RNA, 20 nt, Human
ggaggauggccacgcagacu

SEQ ID NO: 747000 - RNA, 18 nt, Human
gugcuuacauacaccaag

SEQ ID NO: 747001 - RNA, 21 nt, Human
uaaaggaacaaaugugcuuac

SEQ ID NO: 747002 - RNA, 19 nt, Human
uacaauuaggaucacugac

SEQ ID NO: 747003 - RNA, 21 nt, Human
uagcaaggucaguuucauuca

SEQ ID NO: 747004 - RNA, 19 nt, Human
uagcucaacccuacaguca

SEQ ID NO: 747005 - RNA, 27 nt, Human
uauguacacauaugaaugaucuguaua

SEQ ID NO: 747006 - RNA, 20 nt, Human
ucaauauaaggguagcaagg

SEQ ID NO: 747007 - RNA, 20 nt, Human
ucagaagguuaaugauugag

SEQ ID NO: 747008 - RNA, 19 nt, Human
ucagcuggaggaaugugga

SEQ ID NO: 747009 - RNA, 18 nt, Human
uggacuuggcacuggccu

SEQ ID NO: 747010 - RNA, 18 nt, Human
uggaugguggggggagga

SEQ ID NO: 747011 - RNA, 26 nt, Human
uggaugguggggggaggauggccacg

SEQ ID NO: 747012 - RNA, 18 nt, Human
uuacaaaaacuaggaaga

SEQ ID NO: 747013 - RNA, 19 nt, Human
uuacauacaccaagaaaaa

SEQ ID NO: 747014 - RNA, 23 nt, Human
uucacaguuuuguaaacagauau

SEQ ID NO: 747015 - RNA, 21 nt, Human
uucagcguuuauugucucucg

SEQ ID NO: 747016 - RNA, 19 nt, Human
uugaugcaggagagggaaa

SEQ ID NO: 747017 - RNA, 22 nt, Human
uuugucuuuuugauucacaguu

SEQ ID NO: 747018 - RNA, 20 nt, Human
uuuuaaaauuuuauguacac

SEQ ID NO: 747019 - RNA, 22 nt, Human
aaaaccucagccagagacagac

SEQ ID NO: 747020 - RNA, 19 nt, Human
aacacacacauucaaaucc

SEQ ID NO: 747021 - RNA, 21 nt, Human
aacauacuuugagugauaaaa

SEQ ID NO: 747022 - RNA, 20 nt, Human
aagaaaaagaugcaugaaaa

SEQ ID NO: 747023 - RNA, 18 nt, Human
aagcacuugugaagaaca

SEQ ID NO: 747024 - RNA, 20 nt, Human
aagugguucuuuaaaauacc

SEQ ID NO: 747025 - RNA, 22 nt, Human
aauuuuuauggcuggauugaaa

SEQ ID NO: 747026 - RNA, 21 nt, Human
acaaagcacuugugaagaaca

SEQ ID NO: 747027 - RNA, 23 nt, Human
accuauuauacaagaaaugcaau

SEQ ID NO: 747028 - RNA, 23 nt, Human
agcaacacaauaauagagaguuu

SEQ ID NO: 747029 - RNA, 24 nt, Human
caacauaauggugaaacaagagua

SEQ ID NO: 747030 - RNA, 18 nt, Human
caagaggugcaguaaugc

SEQ ID NO: 747031 - RNA, 19 nt, Human
cacaaguuaaacggaaaca

SEQ ID NO: 747032 - RNA, 23 nt, Human
cacacaggugaggagcacuuccc

SEQ ID NO: 747033 - RNA, 20 nt, Human
cagccagagacagacaccug

SEQ ID NO: 747034 - RNA, 20 nt, Human
caguaaauacuguacuguau

SEQ ID NO: 747035 - RNA, 23 nt, Human
cccccaaagaugaucagucucug

SEQ ID NO: 747036 - RNA, 24 nt, Human
ccuaaaucccuuaauaaguucuca

SEQ ID NO: 747037 - RNA, 23 nt, Human
cuaggugaaguaugguugcuuug

SEQ ID NO: 747038 - RNA, 22 nt, Human
cucacacacaacuuagugggaa

SEQ ID NO: 747039 - RNA, 20 nt, Human
cugcauccuuccuuuugcuu

SEQ ID NO: 747040 - RNA, 24 nt, Human
cuuuaaaauaccaaugaauggcag

SEQ ID NO: 747041 - RNA, 23 nt, Human
cuuugaggaauccacaucaggag

SEQ ID NO: 747042 - RNA, 20 nt, Human
gaacuuuccauguucuguua

SEQ ID NO: 747043 - RNA, 22 nt, Human
gacaaaaccucagccagagaca

SEQ ID NO: 747044 - RNA, 19 nt, Human
gagcagaagucauagugug

SEQ ID NO: 747045 - RNA, 23 nt, Human
gcagcacauuuguaucuugcuuu

SEQ ID NO: 747046 - RNA, 18 nt, Human
gcagggcuucccccaaag

SEQ ID NO: 747047 - RNA, 18 nt, Human
ggcaauaaaaaauugcau

SEQ ID NO: 747048 - RNA, 24 nt, Human
ggcacaaagcacuugugaagaaca

SEQ ID NO: 747049 - RNA, 23 nt, Human
ggugaaacaagaguauucuccga

SEQ ID NO: 747050 - RNA, 24 nt, Human
guauuugggagcagaagucauagu

SEQ ID NO: 747051 - RNA, 20 nt, Human
guguccuuuuuuuuuuuuuu

SEQ ID NO: 747052 - RNA, 23 nt, Human
uaaaauagacaaaaccucagcca

SEQ ID NO: 747053 - RNA, 22 nt, Human
uaaacggaaacacacacauuca

SEQ ID NO: 747054 - RNA, 19 nt, Human
uaacuaguccuuauuccca

SEQ ID NO: 747055 - RNA, 19 nt, Human
uaaggaaaagcaugacuuu

SEQ ID NO: 747056 - RNA, 19 nt, Human
uagacaaaaccucagccag

SEQ ID NO: 747057 - RNA, 24 nt, Human
uagcaacacaauaauagagaguuu

SEQ ID NO: 747058 - RNA, 25 nt, Human
uagcaacacaauaauagagaguuuc

SEQ ID NO: 747059 - RNA, 19 nt, Human
uccaacuuuaaaaaaaugc

SEQ ID NO: 747060 - RNA, 19 nt, Human
ucuauuugggucuuguuuu

SEQ ID NO: 747061 - RNA, 20 nt, Human
ucucaagacacuaaaauaau

SEQ ID NO: 747062 - RNA, 19 nt, Human
ucucuaggugaaguauggu

SEQ ID NO: 747063 - RNA, 24 nt, Human
ucucuguuuccaaauagucucacu

SEQ ID NO: 747064 - RNA, 24 nt, Human
ucugcagauucuuaaaauacaaga

SEQ ID NO: 747065 - RNA, 21 nt, Human
ucuuucugauuuccaacuccc

SEQ ID NO: 747066 - RNA, 20 nt, Human
ugaaauagaaaaugacaguc

SEQ ID NO: 747067 - RNA, 24 nt, Human
ugaaaugacaacagacucuaggug

SEQ ID NO: 747068 - RNA, 26 nt, Human
ugaagcuugcuacaguuuucuagggu

SEQ ID NO: 747069 - RNA, 22 nt, Human
ugaauggcaggaucuacauuua

SEQ ID NO: 747070 - RNA, 21 nt, Human
ugacaguaaauacuguacugu

SEQ ID NO: 747071 - RNA, 19 nt, Human
ugacuuuauucccaguccu

SEQ ID NO: 747072 - RNA, 20 nt, Human
ugaucuguguccuuuuuuuu

SEQ ID NO: 747073 - RNA, 19 nt, Human
ugaugaagaauauccacgg

SEQ ID NO: 747074 - RNA, 21 nt, Human
ugauuuccaacucccaccccu

SEQ ID NO: 747075 - RNA, 24 nt, Human
ugcccagcaauuuuaaucuauauu

SEQ ID NO: 747076 - RNA, 25 nt, Human
uggcacaacauaaaauaaugguacu

SEQ ID NO: 747077 - RNA, 22 nt, Human
uguaucuauggaugccaucugc

SEQ ID NO: 747078 - RNA, 19 nt, Human
uguuggagccaucugggcc

SEQ ID NO: 747079 - RNA, 20 nt, Human
uuaaaaaugucaagugugca

SEQ ID NO: 747080 - RNA, 24 nt, Human
uuagugggaacuuuccauguucug

SEQ ID NO: 747081 - RNA, 20 nt, Human
uucaaguuuuuauuacaggu

SEQ ID NO: 747082 - RNA, 20 nt, Human
uucacccgcauuauaaaauu

SEQ ID NO: 747083 - RNA, 24 nt, Human
uucacccgcauuauaaaauuuggc

SEQ ID NO: 747084 - RNA, 21 nt, Human
uuccaacucccaccccuuuuc

SEQ ID NO: 747085 - RNA, 20 nt, Human
uuccuaauucuaacaugguc

SEQ ID NO: 747086 - RNA, 20 nt, Human
uuucugaagcuugcuacagu

SEQ ID NO: 747087 - RNA, 19 nt, Human
aaaagacaaaaaagaccaa

SEQ ID NO: 747088 - RNA, 19 nt, Human
aaaagacaaaaaagaccaa

SEQ ID NO: 747089 - RNA, 20 nt, Human
aaaagaccaaggcggcaggu

SEQ ID NO: 747090 - RNA, 23 nt, Human
aaacaggcagaccuccgggccug

SEQ ID NO: 747091 - RNA, 22 nt, Human
aaagacaaaaaagaccaaggcg

SEQ ID NO: 747092 - RNA, 20 nt, Human
aacacgggcgccugagagaa

SEQ ID NO: 747093 - RNA, 22 nt, Human
aacgcgucacuggugaaaccca

SEQ ID NO: 747094 - RNA, 18 nt, Human
aagaccaaggcggcagga

SEQ ID NO: 747095 - RNA, 22 nt, Human
aagcagccugaugccagagagc

SEQ ID NO: 747096 - RNA, 22 nt, Human
aagcucaguggaagagaagugg

SEQ ID NO: 747097 - RNA, 21 nt, Human
aagguguaccaaaggguuaaa

SEQ ID NO: 747098 - RNA, 23 nt, Human
aagucccaagccgugaacagucc

SEQ ID NO: 747099 - RNA, 22 nt, Human
acacuuugggaggccgagguag

SEQ ID NO: 747100 - RNA, 19 nt, Human
acauggugaaacccagucu

SEQ ID NO: 747101 - RNA, 20 nt, Human
acauggugaaacccagucuc

SEQ ID NO: 747102 - RNA, 22 nt, Human
acauggugaaacccagucucua

SEQ ID NO: 747103 - RNA, 18 nt, Human
acauggugaaaccccguc

SEQ ID NO: 747104 - RNA, 19 nt, Human
acauggugaaaccccgucu

SEQ ID NO: 747105 - RNA, 20 nt, Human
acauuuugcaagguguacca

SEQ ID NO: 747106 - RNA, 21 nt, Human
accccgucuaccaaaaauaca

SEQ ID NO: 747107 - RNA, 18 nt, Human
acgccacugcacuccagc

SEQ ID NO: 747108 - RNA, 20 nt, Human
acgcugcggagcacagacgg

SEQ ID NO: 747109 - RNA, 21 nt, Human
acgggguuucauguccaagca

SEQ ID NO: 747110 - RNA, 22 nt, Human
acgggguuucauguccaagcag

SEQ ID NO: 747111 - RNA, 24 nt, Human
acuugagguugggaguucaagacc

SEQ ID NO: 747112 - RNA, 23 nt, Human
agaaaaacagaggcucagccagg

SEQ ID NO: 747113 - RNA, 20 nt, Human
agacggcccugcacaaaaga

SEQ ID NO: 747114 - RNA, 24 nt, Human
agcacuuugggagaacaagguggg

SEQ ID NO: 747115 - RNA, 23 nt, Human
agccacacacccucucggugcca

SEQ ID NO: 747116 - RNA, 24 nt, Human
agccuggcccacauggugaaaccc

SEQ ID NO: 747117 - RNA, 24 nt, Human
agccuggucuacauggugaaaccc

SEQ ID NO: 747118 - RNA, 18 nt, Human
aggaaaaggagaggagga

SEQ ID NO: 747119 - RNA, 23 nt, Human
aggaauucgagaccagccugguc

SEQ ID NO: 747120 - RNA, 22 nt, Human
aggaugucauuagucugagguc

SEQ ID NO: 747121 - RNA, 21 nt, Human
aggccgagguagguggaucac

SEQ ID NO: 747122 - RNA, 24 nt, Human
aggcgggacaaucgcuugaaccag

SEQ ID NO: 747123 - RNA, 24 nt, Human
aggcgugguggcucacacccguaa

SEQ ID NO: 747124 - RNA, 20 nt, Human
aggcugaggcgggacaaucg

SEQ ID NO: 747125 - RNA, 24 nt, Human
aggcugaggcgggacaaucgcuug

SEQ ID NO: 747126 - RNA, 19 nt, Human
agggagcuuggcaucuggg

SEQ ID NO: 747127 - RNA, 20 nt, Human
agggagcuuggcaucugggc

SEQ ID NO: 747128 - RNA, 26 nt, Human
agguagguggaucacuugaggucagg

SEQ ID NO: 747129 - RNA, 22 nt, Human
agguggaucacuugaggucagg

SEQ ID NO: 747130 - RNA, 23 nt, Human
agguggguggaucacuugagguu

SEQ ID NO: 747131 - RNA, 20 nt, Human
auagcaugcugugcucagug

SEQ ID NO: 747132 - RNA, 23 nt, Human
aucacgccacugcacuccagccc

SEQ ID NO: 747133 - RNA, 21 nt, Human
auguccaagcagccugaugcc

SEQ ID NO: 747134 - RNA, 24 nt, Human
auuagccaggcgugguggcucaca

SEQ ID NO: 747135 - RNA, 20 nt, Human
caaaaaagaccaaggcggca

SEQ ID NO: 747136 - RNA, 27 nt, Human
caaaaaagaccaaggcggcaggaaaag

SEQ ID NO: 747137 - RNA, 18 nt, Human
caaaagacaaaaaagacc

SEQ ID NO: 747138 - RNA, 19 nt, Human
caacuuccugagaagugau

SEQ ID NO: 747139 - RNA, 20 nt, Human
caagaccagccuggcccaca

SEQ ID NO: 747140 - RNA, 20 nt, Human
caaggcggcaggaaaaggag

SEQ ID NO: 747141 - RNA, 21 nt, Human
caagguggguggaucacuuga

SEQ ID NO: 747142 - RNA, 24 nt, Human
caagguggguggaucacuugaggu

SEQ ID NO: 747143 - RNA, 20 nt, Human
cacaaaagacaaaaaagacc

SEQ ID NO: 747144 - RNA, 24 nt, Human
cacacccguaauccccacacuuug

SEQ ID NO: 747145 - RNA, 24 nt, Human
cacaccuguaaucucagcacuuug

SEQ ID NO: 747146 - RNA, 24 nt, Human
cacacuuugggaggccgagguagg

SEQ ID NO: 747147 - RNA, 20 nt, Human
cacaggaugggaggauggga

SEQ ID NO: 747148 - RNA, 19 nt, Human
cacauggugaaaccccguc

SEQ ID NO: 747149 - RNA, 19 nt, Human
caccccaggaucaccccau

SEQ ID NO: 747150 - RNA, 23 nt, Human
cacccguaauccccacacuuugg

SEQ ID NO: 747151 - RNA, 24 nt, Human
cacccguaauccccacacuuuggg

SEQ ID NO: 747152 - RNA, 23 nt, Human
caccuguaaucucagcacuuugg

SEQ ID NO: 747153 - RNA, 24 nt, Human
caccuguaaucucagcacuuuggg

SEQ ID NO: 747154 - RNA, 22 nt, Human
cacugcacuccagcccucucgg

SEQ ID NO: 747155 - RNA, 20 nt, Human
cacuugagaccccccaguug

SEQ ID NO: 747156 - RNA, 20 nt, Human
cacuugaggucaggaauucg

SEQ ID NO: 747157 - RNA, 23 nt, Human
cacuugagguugggaguucaaga

SEQ ID NO: 747158 - RNA, 19 nt, Human
cacuuugggagaacaaggu

SEQ ID NO: 747159 - RNA, 24 nt, Human
cagcacuuugggagaacaaggugg

SEQ ID NO: 747160 - RNA, 20 nt, Human
cagcccuggagggagagcag

SEQ ID NO: 747161 - RNA, 22 nt, Human
cagccugaugccagagagcugg

SEQ ID NO: 747162 - RNA, 20 nt, Human
cagccuugggaggcugaggc

SEQ ID NO: 747163 - RNA, 22 nt, Human
cagcggaggaugccagcucaag

SEQ ID NO: 747164 - RNA, 21 nt, Human
caggacagagaccaaguccca

SEQ ID NO: 747165 - RNA, 23 nt, Human
caggcugggcaugguggcucaca

SEQ ID NO: 747166 - RNA, 20 nt, Human
caggggccccggagucuggu

SEQ ID NO: 747167 - RNA, 21 nt, Human
cagugagaugcagugcaguuc

SEQ ID NO: 747168 - RNA, 22 nt, Human
cauaccuguaaucccagccuug

SEQ ID NO: 747169 - RNA, 19 nt, Human
ccaagcagccugaugccag

SEQ ID NO: 747170 - RNA, 24 nt, Human
ccacacuuugggaggccgagguag

SEQ ID NO: 747171 - RNA, 23 nt, Human
ccacugcacuccagcccucucgg

SEQ ID NO: 747172 - RNA, 23 nt, Human
ccacugcacuccagcccucucgg

SEQ ID NO: 747173 - RNA, 23 nt, Human
ccacugcacuccagcccucucgg

SEQ ID NO: 747174 - RNA, 24 nt, Human
ccacugcacuccagcccucucggu

SEQ ID NO: 747175 - RNA, 25 nt, Human
ccacugcacuccagcccucucgguc

SEQ ID NO: 747176 - RNA, 24 nt, Human
ccagaucacgccacugcacuccag

SEQ ID NO: 747177 - RNA, 21 nt, Human
ccagugcaaaccagcggagga

SEQ ID NO: 747178 - RNA, 18 nt, Human
ccagugcaggguggggcc

SEQ ID NO: 747179 - RNA, 18 nt, Human
ccaugcccggcacucuuc

SEQ ID NO: 747180 - RNA, 20 nt, Human
ccaugcccggcacucuucau

SEQ ID NO: 747181 - RNA, 24 nt, Human
cccagccuugggaggcugaggcgg

SEQ ID NO: 747182 - RNA, 25 nt, Human
cccagcuugagcuuggaagggguac

SEQ ID NO: 747183 - RNA, 24 nt, Human
cccagggccccggagccacacacc

SEQ ID NO: 747184 - RNA, 24 nt, Human
cccaguggcaccccaggaucaccc

SEQ ID NO: 747185 - RNA, 24 nt, Human
cccccauuuccuagagagaaaaac

SEQ ID NO: 747186 - RNA, 22 nt, Human
ccccgccccgccccccagccca

SEQ ID NO: 747187 - RNA, 25 nt, Human
ccccuuacucuccugggguggggac

SEQ ID NO: 747188 - RNA, 20 nt, Human
cccgccccgccccccagccc

SEQ ID NO: 747189 - RNA, 18 nt, Human
cccgugcccagugcaaac

SEQ ID NO: 747190 - RNA, 21 nt, Human
cccugggugacugaaccaggg

SEQ ID NO: 747191 - RNA, 18 nt, Human
ccgcugggcaguggccuu

SEQ ID NO: 747192 - RNA, 19 nt, Human
ccucguccccuuacucucc

SEQ ID NO: 747193 - RNA, 19 nt, Human
ccugccgcuccccgccccg

SEQ ID NO: 747194 - RNA, 23 nt, Human
ccuggcccacauggugaaacccc

SEQ ID NO: 747195 - RNA, 24 nt, Human
ccuggcccacauggugaaaccccg

SEQ ID NO: 747196 - RNA, 23 nt, Human
ccugggugacugaaccagggcuc

SEQ ID NO: 747197 - RNA, 22 nt, Human
ccuggucuacauggugaaaccc

SEQ ID NO: 747198 - RNA, 23 nt, Human
ccuggucuacauggugaaaccca

SEQ ID NO: 747199 - RNA, 23 nt, Human
ccuguuccuccccucugcagagu

SEQ ID NO: 747200 - RNA, 24 nt, Human
cgagaccagccuggucuacauggu

SEQ ID NO: 747201 - RNA, 24 nt, Human
cgagguagguggaucacuugaggu

SEQ ID NO: 747202 - RNA, 26 nt, Human
cgagguagguggaucacuugagguca

SEQ ID NO: 747203 - RNA, 22 nt, Human
cgcagucagugucugcuagaac

SEQ ID NO: 747204 - RNA, 20 nt, Human
cgccacugcacuccagcccu

SEQ ID NO: 747205 - RNA, 18 nt, Human
cgccugagagaagccugg

SEQ ID NO: 747206 - RNA, 22 nt, Human
cggcugaaaaaaaugauuacau

SEQ ID NO: 747207 - RNA, 19 nt, Human
cgggcagaggccgcuggaa

SEQ ID NO: 747208 - RNA, 18 nt, Human
cguccacgcagcagggaa

SEQ ID NO: 747209 - RNA, 21 nt, Human
cgucuuccaccaaguuucacg

SEQ ID NO: 747210 - RNA, 22 nt, Human
cucacaccuguaaucucagcac

SEQ ID NO: 747211 - RNA, 24 nt, Human
cucacaccuguaaucucagcacuu

SEQ ID NO: 747212 - RNA, 22 nt, Human
cucaggcuggagaaaaugugaa

SEQ ID NO: 747213 - RNA, 24 nt, Human
cucucuaaaaccuuaugaaguaag

SEQ ID NO: 747214 - RNA, 23 nt, Human
cugcacaaaagacaaaaaagacc

SEQ ID NO: 747215 - RNA, 20 nt, Human
cugcucccuuggacucuucc

SEQ ID NO: 747216 - RNA, 19 nt, Human
cuggccagcggagaggacc

SEQ ID NO: 747217 - RNA, 24 nt, Human
cuuccaccugaugcauggggcuua

SEQ ID NO: 747218 - RNA, 19 nt, Human
gaaaaacaagcgggcagag

SEQ ID NO: 747219 - RNA, 26 nt, Human
gaaaagcucuaacccgagaggccccu

SEQ ID NO: 747220 - RNA, 20 nt, Human
gaaccagggcucgugguccc

SEQ ID NO: 747221 - RNA, 22 nt, Human
gaagagaaguggguggaaaagc

SEQ ID NO: 747222 - RNA, 18 nt, Human
gacccaggggccccggag

SEQ ID NO: 747223 - RNA, 23 nt, Human
gacggcccugcacaaaagacaaa

SEQ ID NO: 747224 - RNA, 23 nt, Human
gagaaucuucucugggcuuuacu

SEQ ID NO: 747225 - RNA, 23 nt, Human
gagcuuggcaucugggcuuggag

SEQ ID NO: 747226 - RNA, 23 nt, Human
gagguagguggaucacuugaggu

SEQ ID NO: 747227 - RNA, 18 nt, Human
gaucacuugaggucagga

SEQ ID NO: 747228 - RNA, 24 nt, Human
gaucacuugaggucaggaauucga

SEQ ID NO: 747229 - RNA, 23 nt, Human
gaucacuugagguugggaguuca

SEQ ID NO: 747230 - RNA, 24 nt, Human
gaucacuugagguugggaguucaa

SEQ ID NO: 747231 - RNA, 21 nt, Human
gcacucuucaugcauuacugc

SEQ ID NO: 747232 - RNA, 20 nt, Human
gcaggguccccgcuguuuug

SEQ ID NO: 747233 - RNA, 20 nt, Human
gcaggguccccgcuguuuug

SEQ ID NO: 747234 - RNA, 21 nt, Human
gcagucagugucugcuagaac

SEQ ID NO: 747235 - RNA, 26 nt, Human
gccauggaguccucacccacuugaga

SEQ ID NO: 747236 - RNA, 22 nt, Human
gcccacauggugaaaccccguc

SEQ ID NO: 747237 - RNA, 20 nt, Human
gcccagaucacgccacugca

SEQ ID NO: 747238 - RNA, 19 nt, Human
gcccuggagggagagcagg

SEQ ID NO: 747239 - RNA, 18 nt, Human
gccguggccauggagucc

SEQ ID NO: 747240 - RNA, 18 nt, Human
gcgcaggguccccgcugu

SEQ ID NO: 747241 - RNA, 18 nt, Human
gcgcaggguccccgcugu

SEQ ID NO: 747242 - RNA, 19 nt, Human
ggaaaaacaagcgggcaga

SEQ ID NO: 747243 - RNA, 23 nt, Human
ggaccagugcaggguggggccgc

SEQ ID NO: 747244 - RNA, 24 nt, Human
ggagccacacacccucucggugcc

SEQ ID NO: 747245 - RNA, 26 nt, Human
ggagccacacacccucucggugccag

SEQ ID NO: 747246 - RNA, 22 nt, Human
ggaggcuucccugggugacuga

SEQ ID NO: 747247 - RNA, 23 nt, Human
ggcaugguggcucacaccuguaa

SEQ ID NO: 747248 - RNA, 21 nt, Human
ggccagcggagaggaccuuga

SEQ ID NO: 747249 - RNA, 20 nt, Human
ggccuggcuugggaucccag

SEQ ID NO: 747250 - RNA, 22 nt, Human
ggccugguggcucuccaguccc

SEQ ID NO: 747251 - RNA, 21 nt, Human
ggcucacaccuguaaucucag

SEQ ID NO: 747252 - RNA, 19 nt, Human
gggacagggggagcagggg

SEQ ID NO: 747253 - RNA, 19 nt, Human
gggcacccagcacaguguc

SEQ ID NO: 747254 - RNA, 24 nt, Human
gggcgugguggugcauaccuguaa

SEQ ID NO: 747255 - RNA, 23 nt, Human
gguggcucacacccguaaucccc

SEQ ID NO: 747256 - RNA, 24 nt, Human
gguggcucacaccuguaaucucag

SEQ ID NO: 747257 - RNA, 24 nt, Human
gguggugcauaccuguaaucccag

SEQ ID NO: 747258 - RNA, 19 nt, Human
ggugucugauggaugaaug

SEQ ID NO: 747259 - RNA, 19 nt, Human
guccaagcagccugaugcc

SEQ ID NO: 747260 - RNA, 23 nt, Human
guccccgcuguuuugauuccaac

SEQ ID NO: 747261 - RNA, 19 nt, Human
gucuuccaccaaguuucac

SEQ ID NO: 747262 - RNA, 21 nt, Human
uaacguggcugcucccuugga

SEQ ID NO: 747263 - RNA, 21 nt, Human
uacauggugaaacccagucuc

SEQ ID NO: 747264 - RNA, 23 nt, Human
uacauggugaaacccagucucua

SEQ ID NO: 747265 - RNA, 22 nt, Human
uaccaaaaauacaaaaaauuag

SEQ ID NO: 747266 - RNA, 25 nt, Human
uaccaaaaauacaaaaaauuagcca

SEQ ID NO: 747267 - RNA, 19 nt, Human
uaccuguaaucccagccuu

SEQ ID NO: 747268 - RNA, 21 nt, Human
uaccuguaaucccagccuugg

SEQ ID NO: 747269 - RNA, 24 nt, Human
uagccaggcgugguggcucacacc

SEQ ID NO: 747270 - RNA, 22 nt, Human
uaggaacaggcugggcauggug

SEQ ID NO: 747271 - RNA, 19 nt, Human
uaggcacaauuaucacccc

SEQ ID NO: 747272 - RNA, 24 nt, Human
uagguggaucacuugaggucagga

SEQ ID NO: 747273 - RNA, 21 nt, Human
ucaagaccagccuggcccaca

SEQ ID NO: 747274 - RNA, 23 nt, Human
ucacuugagguugggaguucaag

SEQ ID NO: 747275 - RNA, 25 nt, Human
ucagaagagacaguucugcugccgu

SEQ ID NO: 747276 - RNA, 25 nt, Human
ucagcccgugccucuagccugugcc

SEQ ID NO: 747277 - RNA, 21 nt, Human
ucaguggccugguggcucucc

SEQ ID NO: 747278 - RNA, 18 nt, Human
uccaggcgggaggcugcg

SEQ ID NO: 747279 - RNA, 22 nt, Human
uccccgccccgccccccagccc

SEQ ID NO: 747280 - RNA, 22 nt, Human
uccccgcuguuuugauuccaac

SEQ ID NO: 747281 - RNA, 23 nt, Human
uccccgugcccagugcaaaccag

SEQ ID NO: 747282 - RNA, 19 nt, Human
ucccugggugacugaacca

SEQ ID NO: 747283 - RNA, 26 nt, Human
ucccuuggaaagacauaggugggaau

SEQ ID NO: 747284 - RNA, 20 nt, Human
ucuaccaaaaauacaaaaaa

SEQ ID NO: 747285 - RNA, 20 nt, Human
ucucaggcuggagaaaaugu

SEQ ID NO: 747286 - RNA, 21 nt, Human
ucucugggcuuuacuuggcuu

SEQ ID NO: 747287 - RNA, 22 nt, Human
ucuguucaccaaagccugcaug

SEQ ID NO: 747288 - RNA, 21 nt, Human
ucuugcucugcccucuccguc

SEQ ID NO: 747289 - RNA, 23 nt, Human
ugaaaaauacaaaauuagccggg

SEQ ID NO: 747290 - RNA, 24 nt, Human
ugaaacccagucucuaugaaaaau

SEQ ID NO: 747291 - RNA, 21 nt, Human
ugaaugaaugagggagaggac

SEQ ID NO: 747292 - RNA, 21 nt, Human
ugacucacuuaauucuggcac

SEQ ID NO: 747293 - RNA, 19 nt, Human
ugagagaagccuggggaug

SEQ ID NO: 747294 - RNA, 19 nt, Human
ugagguaggcacaauuauc

SEQ ID NO: 747295 - RNA, 25 nt, Human
ugagguaggcacaauuaucaccccc

SEQ ID NO: 747296 - RNA, 21 nt, Human
ugagugacaucauucagcuca

SEQ ID NO: 747297 - RNA, 19 nt, Human
ugaugagaaucuucucugg

SEQ ID NO: 747298 - RNA, 20 nt, Human
ugcacaaaagacaaaaaaga

SEQ ID NO: 747299 - RNA, 22 nt, Human
ugcacaaaagacaaaaaagacc

SEQ ID NO: 747300 - RNA, 22 nt, Human
ugcaggguggggccgccugccc

SEQ ID NO: 747301 - RNA, 20 nt, Human
ugccagagagcuggcccucg

SEQ ID NO: 747302 - RNA, 22 nt, Human
ugccucuagccugugccuguuc

SEQ ID NO: 747303 - RNA, 24 nt, Human
ugccucuagccugugccuguuccu

SEQ ID NO: 747304 - RNA, 18 nt, Human
ugccugggccgcugggca

SEQ ID NO: 747305 - RNA, 19 nt, Human
ugccugggccgcugggcag

SEQ ID NO: 747306 - RNA, 19 nt, Human
ugccuguuccuccccucug

SEQ ID NO: 747307 - RNA, 24 nt, Human
ugcguuuauuucucucuaaaaccu

SEQ ID NO: 747308 - RNA, 20 nt, Human
ugcucaguggccugguggcu

SEQ ID NO: 747309 - RNA, 26 nt, Human
uggaagagaaguggguggaaaagcuc

SEQ ID NO: 747310 - RNA, 24 nt, Human
uggaucacuugaggucaggaauuc

SEQ ID NO: 747311 - RNA, 27 nt, Human
uggaucacuugaggucaggaauucgag

SEQ ID NO: 747312 - RNA, 24 nt, Human
uggaucacuugagguugggaguuc

SEQ ID NO: 747313 - RNA, 20 nt, Human
uggcaccccaggaucacccc

SEQ ID NO: 747314 - RNA, 21 nt, Human
uggccugguggcucuccaguc

SEQ ID NO: 747315 - RNA, 21 nt, Human
uggcucacaccuguaaucuca

SEQ ID NO: 747316 - RNA, 24 nt, Human
uggcucacaccuguaaucucagca

SEQ ID NO: 747317 - RNA, 21 nt, Human
ugggagaacaaggugggugga

SEQ ID NO: 747318 - RNA, 24 nt, Human
ugggaggauggguuacauuuugca

SEQ ID NO: 747319 - RNA, 19 nt, Human
ugggaggccgagguaggug

SEQ ID NO: 747320 - RNA, 24 nt, Human
ugggaggccgagguagguggauca

SEQ ID NO: 747321 - RNA, 23 nt, Human
ugggaggcugaggcgggacaauc

SEQ ID NO: 747322 - RNA, 24 nt, Human
ugggaggcugaggcgggacaaucg

SEQ ID NO: 747323 - RNA, 19 nt, Human
ugggcaguggccugaggcc

SEQ ID NO: 747324 - RNA, 21 nt, Human
ugggccgcugggcaguggccu

SEQ ID NO: 747325 - RNA, 21 nt, Human
uggggcaggacagagaccaag

SEQ ID NO: 747326 - RNA, 28 nt, Human
ugggguggggacagggggagcagggguu

SEQ ID NO: 747327 - RNA, 23 nt, Human
ugggguggggacagggggagcca

SEQ ID NO: 747328 - RNA, 22 nt, Human
uggugcauaccuguaaucccag

SEQ ID NO: 747329 - RNA, 24 nt, Human
ugguggcucacaccuguaaucuca

SEQ ID NO: 747330 - RNA, 24 nt, Human
ugguggugcauaccuguaauccca

SEQ ID NO: 747331 - RNA, 20 nt, Human
ugucuagauucagacugcag

SEQ ID NO: 747332 - RNA, 23 nt, Human
ugucuaucugagguaggcacaau

SEQ ID NO: 747333 - RNA, 19 nt, Human
uuagccgggcgugguggug

SEQ ID NO: 747334 - RNA, 20 nt, Human
uuagccgggcgugguggugc

SEQ ID NO: 747335 - RNA, 21 nt, Human
uuagccgggcgugguggugca

SEQ ID NO: 747336 - RNA, 21 nt, Human
uucaagaccagccuggcccac

SEQ ID NO: 747337 - RNA, 24 nt, Human
uucaugcauuacugcguuuauuuc

SEQ ID NO: 747338 - RNA, 18 nt, Human
uuccgugucugcuacaga

SEQ ID NO: 747339 - RNA, 21 nt, Human
uucgagaccagccuggucuac

SEQ ID NO: 747340 - RNA, 19 nt, Human
uucucugggcuuuacuugg

SEQ ID NO: 747341 - RNA, 21 nt, Human
uugaauuagauguugaaacca

SEQ ID NO: 747342 - RNA, 25 nt, Human
uugggaggccgagguagguggauca

SEQ ID NO: 747343 - RNA, 24 nt, Human
uugggaggcugaggcgggacaauc

SEQ ID NO: 747344 - RNA, 18 nt, Human
uugugucuggggcaccca

SEQ ID NO: 747345 - RNA, 22 nt, Human
acacccugccugggcugugagc

SEQ ID NO: 747346 - RNA, 19 nt, Human
accguccuccccuccugcc

SEQ ID NO: 747347 - RNA, 20 nt, Human
acgaaacgcgaucgcggccc

SEQ ID NO: 747348 - RNA, 23 nt, Human
acgagcccauccaggagccacac

SEQ ID NO: 747349 - RNA, 20 nt, Human
agccuugggggcucugagca

SEQ ID NO: 747350 - RNA, 21 nt, Human
agccuugggggcucugagcag

SEQ ID NO: 747351 - RNA, 21 nt, Human
cacagccccagccccacgucc

SEQ ID NO: 747352 - RNA, 18 nt, Human
cagaggagagccuugggg

SEQ ID NO: 747353 - RNA, 23 nt, Human
cagcagguacaccguccuccccu

SEQ ID NO: 747354 - RNA, 22 nt, Human
cagcagguacaccguccucccu

SEQ ID NO: 747355 - RNA, 24 nt, Human
cagccccagccccacguccaggcu

SEQ ID NO: 747356 - RNA, 22 nt, Human
cagcccgagggaccugggacaa

SEQ ID NO: 747357 - RNA, 18 nt, Human
cagccgccugccuugcug

SEQ ID NO: 747358 - RNA, 21 nt, Human
cagguacaccguccuccccuc

SEQ ID NO: 747359 - RNA, 25 nt, Human
cagugcccaggcccaguguauuuuu

SEQ ID NO: 747360 - RNA, 22 nt, Human
ccagcagcgcccacagccccag

SEQ ID NO: 747361 - RNA, 18 nt, Human
cccacguccaggcugcca

SEQ ID NO: 747362 - RNA, 24 nt, Human
cccacguccaggcugccauguccc

SEQ ID NO: 747363 - RNA, 26 nt, Human
cccaucccgccccacgagcccaucca

SEQ ID NO: 747364 - RNA, 31 nt, Human
cccaucccgccccacgagcccauccaggagg

SEQ ID NO: 747365 - RNA, 21 nt, Human
cccgccagcagcgcccacagc

SEQ ID NO: 747366 - RNA, 21 nt, Human
ccugggcugugagcacuauuc

SEQ ID NO: 747367 - RNA, 18 nt, Human
ccuggggaggccuccagg

SEQ ID NO: 747368 - RNA, 25 nt, Human
cgcccacagccccagccccacgucc

SEQ ID NO: 747369 - RNA, 25 nt, Human
cgccccacgagcccauccaggagcc

SEQ ID NO: 747370 - RNA, 25 nt, Human
cgcucagcccgagggaccugggaca

SEQ ID NO: 747371 - RNA, 22 nt, Human
cggcaggccgggccuuccuucu

SEQ ID NO: 747372 - RNA, 18 nt, Human
cguccuccccuccugcca

SEQ ID NO: 747373 - RNA, 19 nt, Human
cuccugccagccugguucu

SEQ ID NO: 747374 - RNA, 21 nt, Human
cuuccugcaucugcacucucc

SEQ ID NO: 747375 - RNA, 22 nt, Human
gaagaccuggccucgcuacaaa

SEQ ID NO: 747376 - RNA, 20 nt, Human
gagggaccugggacaagagc

SEQ ID NO: 747377 - RNA, 22 nt, Human
gcccauccaggagccacacacc

SEQ ID NO: 747378 - RNA, 20 nt, Human
gccgcggccccggacgaaac

SEQ ID NO: 747379 - RNA, 20 nt, Human
gcgagggugguccuggggag

SEQ ID NO: 747380 - RNA, 18 nt, Human
gcuccaggccgcugcuca

SEQ ID NO: 747381 - RNA, 21 nt, Human
gcugcacuauaaauagcggca

SEQ ID NO: 747382 - RNA, 20 nt, Human
ggacaagagcugcucugucc

SEQ ID NO: 747383 - RNA, 21 nt, Human
gggcgaggcucccgcggguuu

SEQ ID NO: 747384 - RNA, 18 nt, Human
gggggcucugagcagcag

SEQ ID NO: 747385 - RNA, 19 nt, Human
ggguccgggcgaggcuccc

SEQ ID NO: 747386 - RNA, 24 nt, Human
ggugguccuggggaggccuccagg

SEQ ID NO: 747387 - RNA, 22 nt, Human
gguuuucuugagccucuggggc

SEQ ID NO: 747388 - RNA, 21 nt, Human
uagcggcaggccgggccuucc

SEQ ID NO: 747389 - RNA, 24 nt, Human
uccccacggccgccgcggccccgg

SEQ ID NO: 747390 - RNA, 25 nt, Human
ucccgcggguuuucuugagccucug

SEQ ID NO: 747391 - RNA, 23 nt, Human
ucccggcgggcagugcccaggcc

SEQ ID NO: 747392 - RNA, 19 nt, Human
uccguaccggaugcggccg

SEQ ID NO: 747393 - RNA, 22 nt, Human
uccguaccggaugcggccgaag

SEQ ID NO: 747394 - RNA, 21 nt, Human
uccuggguccgggcgaggcuc

SEQ ID NO: 747395 - RNA, 19 nt, Human
ucgcugcagccgauucccc

SEQ ID NO: 747396 - RNA, 21 nt, Human
ucgcugcagccgauuccccac

SEQ ID NO: 747397 - RNA, 23 nt, Human
ugccagccugguucugcccucac

SEQ ID NO: 747398 - RNA, 21 nt, Human
ugcccugucccaucccgcccc

SEQ ID NO: 747399 - RNA, 22 nt, Human
ugcccugucccaucccgcccca

SEQ ID NO: 747400 - RNA, 18 nt, Human
ugcggccgaagaccuggc

SEQ ID NO: 747401 - RNA, 19 nt, Human
ugcggccgaagaccuggcc

SEQ ID NO: 747402 - RNA, 25 nt, Human
ugcucuguccugcuugguggcucuc

SEQ ID NO: 747403 - RNA, 23 nt, Human
uggccccgagcacgaguuccuuc

SEQ ID NO: 747404 - RNA, 21 nt, Human
ugggacaagagcugcucuguc

SEQ ID NO: 747405 - RNA, 19 nt, Human
ugggggcucugagcagcag

SEQ ID NO: 747406 - RNA, 19 nt, Human
ugggggcucugagcagcag

SEQ ID NO: 747407 - RNA, 20 nt, Human
ugggggcucugagcagcagg

SEQ ID NO: 747408 - RNA, 22 nt, Human
uuccuggguccgggcgaggcuc

SEQ ID NO: 747409 - RNA, 19 nt, Human
aaaaaaaacuguaaaaaca

SEQ ID NO: 747410 - RNA, 22 nt, Human
aaaaacuguaaaaacagccucc

SEQ ID NO: 747411 - RNA, 24 nt, Human
aaacaaaacaacaacaaaaaaaaa

SEQ ID NO: 747412 - RNA, 19 nt, Human
aacaaaacaacaacaaaaa

SEQ ID NO: 747413 - RNA, 24 nt, Human
acaaaaaaaaacuguaaaaacagc

SEQ ID NO: 747414 - RNA, 24 nt, Human
accgguagugcuagaaaccagucu

SEQ ID NO: 747415 - RNA, 27 nt, Human
accuuauugcugugcucugggcuuggg

SEQ ID NO: 747416 - RNA, 19 nt, Human
agcggaggccagggcgcug

SEQ ID NO: 747417 - RNA, 22 nt, Human
aggcaaaacagaaaaacauuug

SEQ ID NO: 747418 - RNA, 19 nt, Human
aggguccugccccccccac

SEQ ID NO: 747419 - RNA, 20 nt, Human
aggguccugccccccccacc

SEQ ID NO: 747420 - RNA, 22 nt, Human
aggguccugccccccccacccc

SEQ ID NO: 747421 - RNA, 28 nt, Human
caaaaaaaaacuguaaaaacagccucca

SEQ ID NO: 747422 - RNA, 28 nt, Human
caacaaaaaaaaacuguaaaaacagccc

SEQ ID NO: 747423 - RNA, 27 nt, Human
caacguaaaauaaucuucuggacccuu

SEQ ID NO: 747424 - RNA, 21 nt, Human
cacaugggcccggccgagggc

SEQ ID NO: 747425 - RNA, 21 nt, Human
cagccuccauguccacgcccu

SEQ ID NO: 747426 - RNA, 20 nt, Human
cagccugaccagggugggcc

SEQ ID NO: 747427 - RNA, 19 nt, Human
cagggcgcugguggaggca

SEQ ID NO: 747428 - RNA, 22 nt, Human
cagguuuuuccaacccaggccc

SEQ ID NO: 747429 - RNA, 21 nt, Human
caucccugccaggccuagagg

SEQ ID NO: 747430 - RNA, 25 nt, Human
ccaacccaggcccuugacucugccc

SEQ ID NO: 747431 - RNA, 24 nt, Human
cccacccccaccccggcuccugca

SEQ ID NO: 747432 - RNA, 26 nt, Human
ccccagugccacaccaugucccccca

SEQ ID NO: 747433 - RNA, 23 nt, Human
cccccacccccaccccggcuccc

SEQ ID NO: 747434 - RNA, 19 nt, Human
ccccccacccccaccccgg

SEQ ID NO: 747435 - RNA, 22 nt, Human
ccccccacccccaccccggcuc

SEQ ID NO: 747436 - RNA, 24 nt, Human
cccccccacccccaccccggcucc

SEQ ID NO: 747437 - RNA, 18 nt, Human
ccccccccacccccaccc

SEQ ID NO: 747438 - RNA, 21 nt, Human
ccgacucggggccgcgggcgg

SEQ ID NO: 747439 - RNA, 23 nt, Human
ccgcacacacaugggcccggccg

SEQ ID NO: 747440 - RNA, 20 nt, Human
cggcggcucgagaccgacuc

SEQ ID NO: 747441 - RNA, 22 nt, Human
cggggccgcgggcggcacuccg

SEQ ID NO: 747442 - RNA, 24 nt, Human
cguguggaggcccgagcggaggcc

SEQ ID NO: 747443 - RNA, 20 nt, Human
cucugggcuugggggcggcu

SEQ ID NO: 747444 - RNA, 25 nt, Human
cugcaggccgaccuuauugcugugc

SEQ ID NO: 747445 - RNA, 23 nt, Human
cugggcacagggacaucccugcc

SEQ ID NO: 747446 - RNA, 23 nt, Human
cugugcucugggcuugggggcgg

SEQ ID NO: 747447 - RNA, 21 nt, Human
gaccuuauugcugugcucugg

SEQ ID NO: 747448 - RNA, 22 nt, Human
gccagcuccaagggcuauuggg

SEQ ID NO: 747449 - RNA, 24 nt, Human
gcgcugguggaggcaaagcccggg

SEQ ID NO: 747450 - RNA, 18 nt, Human
gcgggccgcacacacaug

SEQ ID NO: 747451 - RNA, 22 nt, Human
gcugggcacagggacaucccug

SEQ ID NO: 747452 - RNA, 24 nt, Human
ggcccuugacucugcccugagcuu

SEQ ID NO: 747453 - RNA, 21 nt, Human
ggcgcugguggaggcaaagcc

SEQ ID NO: 747454 - RNA, 18 nt, Human
ggcucgagaccgacucgg

SEQ ID NO: 747455 - RNA, 20 nt, Human
gggccguggccgggcggcag

SEQ ID NO: 747456 - RNA, 22 nt, Human
gggcgcugguggaggcaaagcc

SEQ ID NO: 747457 - RNA, 20 nt, Human
ggguccugccccccccaccc

SEQ ID NO: 747458 - RNA, 21 nt, Human
ggguuuggggugcccugucag

SEQ ID NO: 747459 - RNA, 21 nt, Human
gguggcaucucaggguccugc

SEQ ID NO: 747460 - RNA, 21 nt, Human
uaaaaacaaaacaacaacaaa

SEQ ID NO: 747461 - RNA, 25 nt, Human
uaaaaacaaaacaacaacaaaaaaa

SEQ ID NO: 747462 - RNA, 26 nt, Human
uagugcuagaaaccagucuucgagcc

SEQ ID NO: 747463 - RNA, 21 nt, Human
ucaggcagaagagacgcaagc

SEQ ID NO: 747464 - RNA, 22 nt, Human
ucagguccugguggcaucucag

SEQ ID NO: 747465 - RNA, 18 nt, Human
uccaacccaggcccuuga

SEQ ID NO: 747466 - RNA, 22 nt, Human
uccauguccacgcccuuccugg

SEQ ID NO: 747467 - RNA, 21 nt, Human
uccugccccccccacccccac

SEQ ID NO: 747468 - RNA, 24 nt, Human
uccugccccccccacccccacccc

SEQ ID NO: 747469 - RNA, 21 nt, Human
ucgauuaaggaggcagccuga

SEQ ID NO: 747470 - RNA, 22 nt, Human
ucucaggguccugcccccccca

SEQ ID NO: 747471 - RNA, 18 nt, Human
ucucccccugccaggcac

SEQ ID NO: 747472 - RNA, 21 nt, Human
ucuuuaaaaacaaaacaacaa

SEQ ID NO: 747473 - RNA, 19 nt, Human
ugccacaccaugucccccc

SEQ ID NO: 747474 - RNA, 20 nt, Human
uggcaucucaggguccugcc

SEQ ID NO: 747475 - RNA, 25 nt, Human
uuaugcauuccugugagucagguuu

SEQ ID NO: 747476 - RNA, 18 nt, Human
uucaggcaaaacagaaaa

SEQ ID NO: 747477 - RNA, 21 nt, Human
uucauucaguggaagauuuau

SEQ ID NO: 747478 - RNA, 23 nt, Human
uuuauaaucucuuuaccugcccu

SEQ ID NO: 747479 - RNA, 23 nt, Human
uuuccaacccaggcccuugacuc

SEQ ID NO: 747480 - RNA, 20 nt, Human
uuuucauucaguggaagauu

SEQ ID NO: 747481 - RNA, 23 nt, Human
aaaaaaaaaaggaaaacagaaag

SEQ ID NO: 747482 - RNA, 22 nt, Human
aaaaaggaaaacagaaagaaag

SEQ ID NO: 747483 - RNA, 23 nt, Human
aaaaaggaaaacagaaagaaaga

SEQ ID NO: 747484 - RNA, 21 nt, Human
aaacagaaagaaagaaaaaga

SEQ ID NO: 747485 - RNA, 23 nt, Human
aaacagaaagaaagaaaagggac

SEQ ID NO: 747486 - RNA, 21 nt, Human
aagaaagaaaaagaacaaaaa

SEQ ID NO: 747487 - RNA, 23 nt, Human
aagugaacagacgcacucccucc

SEQ ID NO: 747488 - RNA, 23 nt, Human
aauaaaauuugagacuacagcca

SEQ ID NO: 747489 - RNA, 21 nt, Human
acgcacucccuccucccccca

SEQ ID NO: 747490 - RNA, 23 nt, Human
agaaagaaagaaaaagaacaaaa

SEQ ID NO: 747491 - RNA, 20 nt, Human
agcaguuuucacgaaguuuu

SEQ ID NO: 747492 - RNA, 23 nt, Human
auacaaccaaaaaucuuaaaacu

SEQ ID NO: 747493 - RNA, 18 nt, Human
cacucccuccucccccca

SEQ ID NO: 747494 - RNA, 24 nt, Human
ccccccacccucaauuaaaaaaaa

SEQ ID NO: 747495 - RNA, 18 nt, Human
ccuaauccaagugugggg

SEQ ID NO: 747496 - RNA, 23 nt, Human
ccuccccccacccucaauuaaaa

SEQ ID NO: 747497 - RNA, 21 nt, Human
gaagucagcuuuuugcaccca

SEQ ID NO: 747498 - RNA, 26 nt, Human
gcacucccuccuccccccacccucaa

SEQ ID NO: 747499 - RNA, 21 nt, Human
uaaagugaacagacgcacucc

SEQ ID NO: 747500 - RNA, 24 nt, Human
uacagccaaauauuuucuaaaacc

SEQ ID NO: 747501 - RNA, 18 nt, Human
uaggaggagggaaacccu

SEQ ID NO: 747502 - RNA, 22 nt, Human
ucaauuaaaaaaaaaaggaaaa

SEQ ID NO: 747503 - RNA, 20 nt, Human
uccaugcuacagaauaaaaa

SEQ ID NO: 747504 - RNA, 25 nt, Human
uccaugcuacagaauaaaauuugag

SEQ ID NO: 747505 - RNA, 18 nt, Human
ucccuccuccccccaccc

SEQ ID NO: 747506 - RNA, 25 nt, Human
ucccuccuccccccacccucaauua

SEQ ID NO: 747507 - RNA, 23 nt, Human
ugaacagacgcacucccuccucc

SEQ ID NO: 747508 - RNA, 21 nt, Human
ugcuucaauauugcugcuuau

SEQ ID NO: 747509 - RNA, 29 nt, Human
uuuuuuuuuuuuuuuuuuuauacuuuugg

SEQ ID NO: 747510 - RNA, 21 nt, Human
acagggcagcccaggggcccu

SEQ ID NO: 747511 - RNA, 18 nt, Human
accuacucagaggcacug

SEQ ID NO: 747512 - RNA, 23 nt, Human
agaggcacugaggccacauuccc

SEQ ID NO: 747513 - RNA, 20 nt, Human
aggcaggaugccacguggcu

SEQ ID NO: 747514 - RNA, 20 nt, Human
aggcaggaugccacguggcu

SEQ ID NO: 747515 - RNA, 23 nt, Human
cacaguaaaucucacccagacca

SEQ ID NO: 747516 - RNA, 21 nt, Human
cagaccacaggcaggaugcca

SEQ ID NO: 747517 - RNA, 20 nt, Human
cauccugaguccaggcucug

SEQ ID NO: 747518 - RNA, 21 nt, Human
cauccugaguccaggcucugc

SEQ ID NO: 747519 - RNA, 25 nt, Human
cauucccaucuccaggcaccaggga

SEQ ID NO: 747520 - RNA, 24 nt, Human
ccaagcccuaguuccaagucaucc

SEQ ID NO: 747521 - RNA, 18 nt, Human
ccugaguccaggcucugc

SEQ ID NO: 747522 - RNA, 18 nt, Human
ccugggggcugaaagggc

SEQ ID NO: 747523 - RNA, 19 nt, Human
cgcucagaacccacgugcc

SEQ ID NO: 747524 - RNA, 23 nt, Human
cucagaacccacgugccucgugc

SEQ ID NO: 747525 - RNA, 18 nt, Human
gagcaccuggagcuggug

SEQ ID NO: 747526 - RNA, 22 nt, Human
gccagaaucuugagcaccugga

SEQ ID NO: 747527 - RNA, 18 nt, Human
gccucagacuggaccaca

SEQ ID NO: 747528 - RNA, 18 nt, Human
gcucugccagaaucuuga

SEQ ID NO: 747529 - RNA, 22 nt, Human
gcugaaagggccucagacugga

SEQ ID NO: 747530 - RNA, 21 nt, Human
gcugguggcaaggcagccugg

SEQ ID NO: 747531 - RNA, 21 nt, Human
ggccacucugggcagaaagca

SEQ ID NO: 747532 - RNA, 22 nt, Human
gggcagcccaggggcccugggc

SEQ ID NO: 747533 - RNA, 23 nt, Human
guuccaagucauccugaguccag

SEQ ID NO: 747534 - RNA, 18 nt, Human
uccagggacguagaaaca

SEQ ID NO: 747535 - RNA, 24 nt, Human
ucuacaucuggucacaguaaaucu

SEQ ID NO: 747536 - RNA, 22 nt, Human
ucuccaggcaccagggaugucu

SEQ ID NO: 747537 - RNA, 23 nt, Human
ucuccaggcaccagggaugucuc

SEQ ID NO: 747538 - RNA, 20 nt, Human
ugauuccauuuggaguuucc

SEQ ID NO: 747539 - RNA, 21 nt, Human
uggagcugguggcaaggcagc

SEQ ID NO: 747540 - RNA, 21 nt, Human
uggaguuuccaaaauccagga

SEQ ID NO: 747541 - RNA, 24 nt, Human
uggccacucugggcagaaagcaaa

SEQ ID NO: 747542 - RNA, 27 nt, Human
uuccaagucauccugaguccaggcucu

SEQ ID NO: 747543 - RNA, 22 nt, Human
uuuuuuuuuuuuuugcaggaug

SEQ ID NO: 747544 - RNA, 18 nt, Human
uuuuuuuuuuuuuuuuug

SEQ ID NO: 747545 - RNA, 21 nt, Human
uuuuuuuuuuuuuuuuugcag

SEQ ID NO: 747546 - RNA, 22 nt, Human
uuuuuuuuuuuuuuuuugcagg

SEQ ID NO: 747547 - RNA, 23 nt, Human
uuuuuuuuuuuuuuuuugcagga

SEQ ID NO: 747548 - RNA, 19 nt, Human
aaagauguaaagagauuga

SEQ ID NO: 747549 - RNA, 22 nt, Human
aaaguauugggauuauaggcau

SEQ ID NO: 747550 - RNA, 23 nt, Human
aaaguauugggauuauaggcaug

SEQ ID NO: 747551 - RNA, 24 nt, Human
aaagugcugggauuacaggcguga

SEQ ID NO: 747552 - RNA, 19 nt, Human
aacaaacagcugcauaaga

SEQ ID NO: 747553 - RNA, 20 nt, Human
aagaaacuuguuccaaguca

SEQ ID NO: 747554 - RNA, 21 nt, Human
aaguauugggauuauaggcau

SEQ ID NO: 747555 - RNA, 19 nt, Human
aagugcugggauuacaggc

SEQ ID NO: 747556 - RNA, 19 nt, Human
aagugcugggauuacaggc

SEQ ID NO: 747557 - RNA, 26 nt, Human
aagugcugggauuacaggcgugagcu

SEQ ID NO: 747558 - RNA, 20 nt, Human
acaguaaguaguggccugau

SEQ ID NO: 747559 - RNA, 24 nt, Human
accauguuggccaagcuggucucg

SEQ ID NO: 747560 - RNA, 20 nt, Human
acccccacucuucccacccc

SEQ ID NO: 747561 - RNA, 21 nt, Human
acccccacucuucccaccccc

SEQ ID NO: 747562 - RNA, 19 nt, Human
acccgccguucaggaagcg

SEQ ID NO: 747563 - RNA, 19 nt, Human
acuacagguguaugcuacc

SEQ ID NO: 747564 - RNA, 24 nt, Human
acuauguugcccaggcuggucuag

SEQ ID NO: 747565 - RNA, 23 nt, Human
acucccaucucagccuccugagu

SEQ ID NO: 747566 - RNA, 24 nt, Human
acucccaucucagccuccugagua

SEQ ID NO: 747567 - RNA, 25 nt, Human
acucuguugcccaggcuggagugca

SEQ ID NO: 747568 - RNA, 21 nt, Human
acucuucccacccccuucccu

SEQ ID NO: 747569 - RNA, 20 nt, Human
acuuucuuucagaggcaacu

SEQ ID NO: 747570 - RNA, 21 nt, Human
agagacagggucucacucugu

SEQ ID NO: 747571 - RNA, 18 nt, Human
agccuccugaguagcuag

SEQ ID NO: 747572 - RNA, 21 nt, Human
agcuaccaugcccggcuggua

SEQ ID NO: 747573 - RNA, 23 nt, Human
agcuaggacuacagguguaugcu

SEQ ID NO: 747574 - RNA, 24 nt, Human
agcuggucucgaacuccugaccuc

SEQ ID NO: 747575 - RNA, 21 nt, Human
agugcaguggugcuaucauag

SEQ ID NO: 747576 - RNA, 23 nt, Human
agugcaguggugcuaucauaguu

SEQ ID NO: 747577 - RNA, 24 nt, Human
agugcaguggugcuaucauaguuc

SEQ ID NO: 747578 - RNA, 18 nt, Human
agugcugggauuacaggc

SEQ ID NO: 747579 - RNA, 22 nt, Human
auagcuggggacccagagacau

SEQ ID NO: 747580 - RNA, 18 nt, Human
aucagugaauuauaauua

SEQ ID NO: 747581 - RNA, 22 nt, Human
auccaagugaaugaugugucca

SEQ ID NO: 747582 - RNA, 22 nt, Human
aucuugccucuacuugccccag

SEQ ID NO: 747583 - RNA, 20 nt, Human
augaccauauuaggauuuuc

SEQ ID NO: 747584 - RNA, 20 nt, Human
augcaugcaggguacaugug

SEQ ID NO: 747585 - RNA, 19 nt, Human
auugaugauuaaacaguuc

SEQ ID NO: 747586 - RNA, 24 nt, Human
auuuuuguauuuuuaguagagaca

SEQ ID NO: 747587 - RNA, 24 nt, Human
caaagugcugggauuacaggcgug

SEQ ID NO: 747588 - RNA, 24 nt, Human
caccacaccuggcuaauuuuugua

SEQ ID NO: 747589 - RNA, 19 nt, Human
caccaugccuggccagagu

SEQ ID NO: 747590 - RNA, 21 nt, Human
caccauguuggccaagcuggu

SEQ ID NO: 747591 - RNA, 24 nt, Human
caccauguuggccaagcuggucuc

SEQ ID NO: 747592 - RNA, 27 nt, Human
caccauguuggccaagcuggucucgaa

SEQ ID NO: 747593 - RNA, 19 nt, Human
cacccccacucuucccacc

SEQ ID NO: 747594 - RNA, 26 nt, Human
cacccccacucuucccacccccuucc

SEQ ID NO: 747595 - RNA, 19 nt, Human
cacuauguugcccaggcug

SEQ ID NO: 747596 - RNA, 22 nt, Human
cacuauguugcccaggcugguc

SEQ ID NO: 747597 - RNA, 24 nt, Human
cacucuguugcccaggcuggagug

SEQ ID NO: 747598 - RNA, 19 nt, Human
cagccuccugaguagcuag

SEQ ID NO: 747599 - RNA, 24 nt, Human
cagggucucacucuguugcccagg

SEQ ID NO: 747600 - RNA, 22 nt, Human
cauaacacagguauugucagcu

SEQ ID NO: 747601 - RNA, 24 nt, Human
caucucagccuccugaguagcuag

SEQ ID NO: 747602 - RNA, 25 nt, Human
caucuccaacuuuaaauaacaaccu

SEQ ID NO: 747603 - RNA, 24 nt, Human
cauguuggccaagcuggucucgaa

SEQ ID NO: 747604 - RNA, 22 nt, Human
ccaaagugcugggauuacaggc

SEQ ID NO: 747605 - RNA, 22 nt, Human
ccaaagugcugggauuacaggc

SEQ ID NO: 747606 - RNA, 24 nt, Human
ccaaagugcugggauuacaggcgu

SEQ ID NO: 747607 - RNA, 20 nt, Human
ccaaccuucucuauccaccc

SEQ ID NO: 747608 - RNA, 26 nt, Human
ccacccccuucccuccucugaagcuu

SEQ ID NO: 747609 - RNA, 23 nt, Human
ccaucucagccuccugaguagcu

SEQ ID NO: 747610 - RNA, 22 nt, Human
cccaggccuggacucucccucc

SEQ ID NO: 747611 - RNA, 19 nt, Human
ccccaccaugccuggccag

SEQ ID NO: 747612 - RNA, 18 nt, Human
ccccaccaugccuggccg

SEQ ID NO: 747613 - RNA, 24 nt, Human
ccccacucuucccacccccuuccc

SEQ ID NO: 747614 - RNA, 19 nt, Human
cccccucuuccucgcucaa

SEQ ID NO: 747615 - RNA, 18 nt, Human
ccccgcgccaaccuucuc

SEQ ID NO: 747616 - RNA, 18 nt, Human
cccgccguucaggaagcg

SEQ ID NO: 747617 - RNA, 19 nt, Human
ccuccaggagaccuuggcc

SEQ ID NO: 747618 - RNA, 21 nt, Human
ccucccgccggucuuccccgc

SEQ ID NO: 747619 - RNA, 21 nt, Human
ccugaccucgggauccgccug

SEQ ID NO: 747620 - RNA, 24 nt, Human
ccugaguagcuaggacuacaggug

SEQ ID NO: 747621 - RNA, 22 nt, Human
ccugucuuggccucccaaagug

SEQ ID NO: 747622 - RNA, 23 nt, Human
cgcauaaaugaaaacaaacagcu

SEQ ID NO: 747623 - RNA, 19 nt, Human
cgccaaaugcuugugcacu

SEQ ID NO: 747624 - RNA, 21 nt, Human
cgccggucacgccaaucgcgc

SEQ ID NO: 747625 - RNA, 24 nt, Human
cuaaaguauugggauuauaggcau

SEQ ID NO: 747626 - RNA, 23 nt, Human
cuaauuuuuguauuuuuaguaga

SEQ ID NO: 747627 - RNA, 24 nt, Human
cucacucuguugcccaggcuggag

SEQ ID NO: 747628 - RNA, 24 nt, Human
cuccugaccucgggauccgccugu

SEQ ID NO: 747629 - RNA, 24 nt, Human
cuccugaguagcuaggacuacagg

SEQ ID NO: 747630 - RNA, 20 nt, Human
cuccuuccuacaccuacuca

SEQ ID NO: 747631 - RNA, 20 nt, Human
cucuacgcauaaaugaaaac

SEQ ID NO: 747632 - RNA, 22 nt, Human
cucuauuauaaacuguauugcu

SEQ ID NO: 747633 - RNA, 24 nt, Human
cucucaggacugacauaaugucaa

SEQ ID NO: 747634 - RNA, 24 nt, Human
cucuuccucgcucaacucgcaaga

SEQ ID NO: 747635 - RNA, 20 nt, Human
cugcaaaucuaaauaccauc

SEQ ID NO: 747636 - RNA, 22 nt, Human
cugcaugaaucuaucuugauuu

SEQ ID NO: 747637 - RNA, 21 nt, Human
cugggcuaaacaguaucaaaa

SEQ ID NO: 747638 - RNA, 23 nt, Human
cugucuuggccucccaaagugcu

SEQ ID NO: 747639 - RNA, 21 nt, Human
cuuaagaaauucuuacacuaa

SEQ ID NO: 747640 - RNA, 21 nt, Human
cuucaccauguuggccaagcu

SEQ ID NO: 747641 - RNA, 23 nt, Human
cuuccagcuucugggcucaucuc

SEQ ID NO: 747642 - RNA, 19 nt, Human
cuugcacccccacucuucc

SEQ ID NO: 747643 - RNA, 21 nt, Human
cuugcacccccacucuuccca

SEQ ID NO: 747644 - RNA, 18 nt, Human
cuugugcacuugagauug

SEQ ID NO: 747645 - RNA, 19 nt, Human
cuugugcacuugagauugc

SEQ ID NO: 747646 - RNA, 18 nt, Human
gaagacuuuccaaacucu

SEQ ID NO: 747647 - RNA, 19 nt, Human
gagaaauaaaaacaaauuc

SEQ ID NO: 747648 - RNA, 26 nt, Human
gaguagcuaggacuacagguguaugc

SEQ ID NO: 747649 - RNA, 21 nt, Human
gauuacaggcgugagcuacca

SEQ ID NO: 747650 - RNA, 24 nt, Human
gauuacaggcgugagcuaccaugc

SEQ ID NO: 747651 - RNA, 19 nt, Human
gcauccaagugaaugaugu

SEQ ID NO: 747652 - RNA, 19 nt, Human
gcccaggcuggagugcagu

SEQ ID NO: 747653 - RNA, 20 nt, Human
gcccaggcuggagugcagug

SEQ ID NO: 747654 - RNA, 21 nt, Human
gcuggagugcaguggugcuag

SEQ ID NO: 747655 - RNA, 22 nt, Human
ggacuacagguguaugcuacca

SEQ ID NO: 747656 - RNA, 23 nt, Human
ggcuggucuagaauuccugaccu

SEQ ID NO: 747657 - RNA, 22 nt, Human
gggauccgccugucuuggccuc

SEQ ID NO: 747658 - RNA, 19 nt, Human
ggucucgaacuccugaccu

SEQ ID NO: 747659 - RNA, 19 nt, Human
guauugggauuauaggcau

SEQ ID NO: 747660 - RNA, 20 nt, Human
gucagcuucaauuuauagcu

SEQ ID NO: 747661 - RNA, 18 nt, Human
gucugguucuaaaaugcc

SEQ ID NO: 747662 - RNA, 19 nt, Human
gucuuaaagcuuaugagaa

SEQ ID NO: 747663 - RNA, 23 nt, Human
uaaaaauggcauaauuaacaggu

SEQ ID NO: 747664 - RNA, 24 nt, Human
uaaaaauggcauaauuaacagguu

SEQ ID NO: 747665 - RNA, 23 nt, Human
uaaaaccucagagcaauguuggu

SEQ ID NO: 747666 - RNA, 21 nt, Human
uaacagguucucucuuccuuc

SEQ ID NO: 747667 - RNA, 25 nt, Human
uaaguaguggccugaucugcaacgu

SEQ ID NO: 747668 - RNA, 24 nt, Human
uaauuuuuguauuuuuaguagaga

SEQ ID NO: 747669 - RNA, 21 nt, Human
uacauugaugaccuuuuagcc

SEQ ID NO: 747670 - RNA, 21 nt, Human
uaccaucuuuuucaugcagaa

SEQ ID NO: 747671 - RNA, 19 nt, Human
uacuauucaugaucuauuu

SEQ ID NO: 747672 - RNA, 21 nt, Human
uacugcugcccaaacuuccac

SEQ ID NO: 747673 - RNA, 26 nt, Human
uacuugaugggcugucucccguuacg

SEQ ID NO: 747674 - RNA, 25 nt, Human
uagacucccaggccuggacucuccc

SEQ ID NO: 747675 - RNA, 22 nt, Human
uagagauugggucucacuaugu

SEQ ID NO: 747676 - RNA, 21 nt, Human
uagcuggggacccagagacau

SEQ ID NO: 747677 - RNA, 24 nt, Human
uaggacuacagguguaugcuacca

SEQ ID NO: 747678 - RNA, 24 nt, Human
uaguagagacagagcuucaccaug

SEQ ID NO: 747679 - RNA, 26 nt, Human
uaguagagacagagcuucaccauguu

SEQ ID NO: 747680 - RNA, 21 nt, Human
uauagcuggggacccagagac

SEQ ID NO: 747681 - RNA, 22 nt, Human
uaugacgcugccuuagggcaaa

SEQ ID NO: 747682 - RNA, 20 nt, Human
uauguugcccaggcuggucu

SEQ ID NO: 747683 - RNA, 22 nt, Human
uauguugcccaggcuggucuag

SEQ ID NO: 747684 - RNA, 23 nt, Human
uauguugcccaggcuggucuaga

SEQ ID NO: 747685 - RNA, 24 nt, Human
uauguugcccaggcuggucuagaa

SEQ ID NO: 747686 - RNA, 24 nt, Human
ucacucuguugcccaggcuggagu

SEQ ID NO: 747687 - RNA, 20 nt, Human
uccacagaacucagacuuuc

SEQ ID NO: 747688 - RNA, 21 nt, Human
uccacauuucuccuuccuaca

SEQ ID NO: 747689 - RNA, 23 nt, Human
uccaucuauguccacagaacuca

SEQ ID NO: 747690 - RNA, 24 nt, Human
ucccaaagugcugggauuacaggc

SEQ ID NO: 747691 - RNA, 18 nt, Human
ucccacccccuucccucc

SEQ ID NO: 747692 - RNA, 22 nt, Human
uccccgcgccaaccuucucuau

SEQ ID NO: 747693 - RNA, 24 nt, Human
uccuaaaguauugggauuauaggc

SEQ ID NO: 747694 - RNA, 23 nt, Human
uccuacaccuacucaucuccaac

SEQ ID NO: 747695 - RNA, 24 nt, Human
uccugaguagcuaggacuacaggu

SEQ ID NO: 747696 - RNA, 19 nt, Human
ucucacuauguugcccagg

SEQ ID NO: 747697 - RNA, 23 nt, Human
ucucacuauguugcccaggcugg

SEQ ID NO: 747698 - RNA, 24 nt, Human
ucucacuauguugcccaggcuggu

SEQ ID NO: 747699 - RNA, 26 nt, Human
ucucacuauguugcccaggcuggucu

SEQ ID NO: 747700 - RNA, 22 nt, Human
ucucacucuguugcccaggcug

SEQ ID NO: 747701 - RNA, 23 nt, Human
ucucacucuguugcccaggcugg

SEQ ID NO: 747702 - RNA, 24 nt, Human
ucucacucuguugcccaggcugga

SEQ ID NO: 747703 - RNA, 26 nt, Human
ucucacucuguugcccaggcuggagu

SEQ ID NO: 747704 - RNA, 24 nt, Human
ucucuugcacccccacucuuccca

SEQ ID NO: 747705 - RNA, 21 nt, Human
ucugaagcuucucgaagacuu

SEQ ID NO: 747706 - RNA, 18 nt, Human
ucuguugcccaggcugga

SEQ ID NO: 747707 - RNA, 24 nt, Human
ucuguugcccaggcuggagugcag

SEQ ID NO: 747708 - RNA, 18 nt, Human
ucuuccccgcgccaaccu

SEQ ID NO: 747709 - RNA, 26 nt, Human
ucuugcacccccacucuucccacccc

SEQ ID NO: 747710 - RNA, 20 nt, Human
ucuuggccucccaaagugcu

SEQ ID NO: 747711 - RNA, 25 nt, Human
ugaagcuucucgaagacuuuccaaa

SEQ ID NO: 747712 - RNA, 18 nt, Human
ugaccucgggauccgccu

SEQ ID NO: 747713 - RNA, 18 nt, Human
ugcacccccacucuuccc

SEQ ID NO: 747714 - RNA, 19 nt, Human
ugcccaaacuuccacauuu

SEQ ID NO: 747715 - RNA, 18 nt, Human
ugcccaggcuggagugca

SEQ ID NO: 747716 - RNA, 21 nt, Human
ugcccaggcuggagugcagug

SEQ ID NO: 747717 - RNA, 24 nt, Human
ugcccaggcuggagugcaguggug

SEQ ID NO: 747718 - RNA, 24 nt, Human
ugcccaggcuggucuagaauuccu

SEQ ID NO: 747719 - RNA, 18 nt, Human
ugcugggauuacaggcgu

SEQ ID NO: 747720 - RNA, 28 nt, Human
uggagugcaguggugcuauccuagcacg

SEQ ID NO: 747721 - RNA, 28 nt, Human
uggagugcaguggugcuauggcucuagc

SEQ ID NO: 747722 - RNA, 24 nt, Human
uggccaagcuggucucgaacuccu

SEQ ID NO: 747723 - RNA, 18 nt, Human
uggccucccaaagugcug

SEQ ID NO: 747724 - RNA, 18 nt, Human
ugggauuacaggcgugag

SEQ ID NO: 747725 - RNA, 22 nt, Human
ugggauuacaggcgugagcuac

SEQ ID NO: 747726 - RNA, 23 nt, Human
ugggauuacaggcgugagcuacc

SEQ ID NO: 747727 - RNA, 24 nt, Human
ugggauuacaggcgugagcuacca

SEQ ID NO: 747728 - RNA, 25 nt, Human
ugggauuacaggcgugagcuaccau

SEQ ID NO: 747729 - RNA, 21 nt, Human
ugggauuauaggcaugcccca

SEQ ID NO: 747730 - RNA, 24 nt, Human
ugggauuauaggcaugccccacca

SEQ ID NO: 747731 - RNA, 25 nt, Human
ugggauuauaggcaugccccaccau

SEQ ID NO: 747732 - RNA, 24 nt, Human
uguaaagagauugaugaggacaau

SEQ ID NO: 747733 - RNA, 22 nt, Human
uuaaauaacaaccucaaaauua

SEQ ID NO: 747734 - RNA, 23 nt, Human
uuaggauuuucuagguguagaca

SEQ ID NO: 747735 - RNA, 24 nt, Human
uuaguagagacagagcuucaccau

SEQ ID NO: 747736 - RNA, 25 nt, Human
uucaaaugaauacuugaugggcugu

SEQ ID NO: 747737 - RNA, 22 nt, Human
uucacaacagacaucuugccuc

SEQ ID NO: 747738 - RNA, 25 nt, Human
uucccacccccuucccuccucugaa

SEQ ID NO: 747739 - RNA, 23 nt, Human
uuccuauagaaagagauagaaaa

SEQ ID NO: 747740 - RNA, 24 nt, Human
uugggucucacuauguugcccagg

SEQ ID NO: 747741 - RNA, 18 nt, Human
uugugcacuugagauugc

SEQ ID NO: 747742 - RNA, 21 nt, Human
uuuagagauugggucucacua

SEQ ID NO: 747743 - RNA, 20 nt, Human
uuuuuguauuuuuaguagag

SEQ ID NO: 747744 - RNA, 20 nt, Human
aacuucuagaaacacaucuc

SEQ ID NO: 747745 - RNA, 18 nt, Human
aaggacaagccccagaac

SEQ ID NO: 747746 - RNA, 21 nt, Human
aagugacugagggccugaaca

SEQ ID NO: 747747 - RNA, 22 nt, Human
acaaccacuaaaagcgaaagga

SEQ ID NO: 747748 - RNA, 20 nt, Human
acaggagaccgggagccacg

SEQ ID NO: 747749 - RNA, 24 nt, Human
acuggugugcaggggccagggcca

SEQ ID NO: 747750 - RNA, 25 nt, Human
agaaaaccaggauguguacaaagug

SEQ ID NO: 747751 - RNA, 23 nt, Human
agaaaacggccccgacacgacca

SEQ ID NO: 747752 - RNA, 22 nt, Human
agaaauaacaaccacuaaaagc

SEQ ID NO: 747753 - RNA, 23 nt, Human
agaacagaaauuccucaagaacg

SEQ ID NO: 747754 - RNA, 18 nt, Human
agcacguccacccgcccc

SEQ ID NO: 747755 - RNA, 20 nt, Human
agccaggcagagcugaugcc

SEQ ID NO: 747756 - RNA, 19 nt, Human
agcccaggaggacggguca

SEQ ID NO: 747757 - RNA, 19 nt, Human
agcgggcgccgcucagccc

SEQ ID NO: 747758 - RNA, 25 nt, Human
aggaaaacuacauucaaaacagcug

SEQ ID NO: 747759 - RNA, 25 nt, Human
aggaaggacaagccccagaacagaa

SEQ ID NO: 747760 - RNA, 23 nt, Human
aggacuuggcugcuacagaaaua

SEQ ID NO: 747761 - RNA, 19 nt, Human
aggcccacaggagaccggg

SEQ ID NO: 747762 - RNA, 20 nt, Human
agggcggcucucggaguucc

SEQ ID NO: 747763 - RNA, 22 nt, Human
aggggcucggcggggucuccgg

SEQ ID NO: 747764 - RNA, 18 nt, Human
agugguccccagccccag

SEQ ID NO: 747765 - RNA, 20 nt, Human
caaaacagcugcaaaggaag

SEQ ID NO: 747766 - RNA, 23 nt, Human
caaaacagcugcaaaggaaggac

SEQ ID NO: 747767 - RNA, 30 nt, Human
caagccccagaacagaaauuccucaagaag

SEQ ID NO: 747768 - RNA, 24 nt, Human
cacagaaagccuuggaugccucca

SEQ ID NO: 747769 - RNA, 24 nt, Human
caccagccaggcagagcugaugcc

SEQ ID NO: 747770 - RNA, 19 nt, Human
cacccggggcccagguggc

SEQ ID NO: 747771 - RNA, 21 nt, Human
cacccggggcccagguggcuc

SEQ ID NO: 747772 - RNA, 22 nt, Human
cacgggggcggcguccugcccu

SEQ ID NO: 747773 - RNA, 18 nt, Human
cagcagaggggcugggag

SEQ ID NO: 747774 - RNA, 20 nt, Human
cagcccccggcccgcggggc

SEQ ID NO: 747775 - RNA, 22 nt, Human
cagccccucacaaaaggacaac

SEQ ID NO: 747776 - RNA, 19 nt, Human
cagcugcuggaguuggggu

SEQ ID NO: 747777 - RNA, 20 nt, Human
cagcuucucguggccugcgg

SEQ ID NO: 747778 - RNA, 21 nt, Human
caggauggcaaggguggcggu

SEQ ID NO: 747779 - RNA, 26 nt, Human
caggcccacaggagaccgggagccac

SEQ ID NO: 747780 - RNA, 21 nt, Human
caucaggagccuccagguucc

SEQ ID NO: 747781 - RNA, 27 nt, Human
caucaggagccuccagguuccacagga

SEQ ID NO: 747782 - RNA, 18 nt, Human
ccagccaggcagagcuga

SEQ ID NO: 747783 - RNA, 18 nt, Human
ccagggcucgggugcagg

SEQ ID NO: 747784 - RNA, 23 nt, Human
cccagaacagaaauuccucaaga

SEQ ID NO: 747785 - RNA, 21 nt, Human
cccagggcucaacuccuuccu

SEQ ID NO: 747786 - RNA, 28 nt, Human
ccccagggcucgggugcagguagcucag

SEQ ID NO: 747787 - RNA, 19 nt, Human
cccgccccugugguggggc

SEQ ID NO: 747788 - RNA, 23 nt, Human
cccggggcccagguggcucugcc

SEQ ID NO: 747789 - RNA, 23 nt, Human
ccgcugccaccgccagcgugcgc

SEQ ID NO: 747790 - RNA, 21 nt, Human
ccgcugccaccgcugccaccg

SEQ ID NO: 747791 - RNA, 19 nt, Human
ccguuguagguggcagggu

SEQ ID NO: 747792 - RNA, 19 nt, Human
ccuccaugggacagucgcc

SEQ ID NO: 747793 - RNA, 26 nt, Human
ccugugguggggcugagccccagggc

SEQ ID NO: 747794 - RNA, 21 nt, Human
cgaaaggaauaaauaucugug

SEQ ID NO: 747795 - RNA, 24 nt, Human
cgacacgaccaaggccgagggcac

SEQ ID NO: 747796 - RNA, 23 nt, Human
cgacugggcccgccgccccacag

SEQ ID NO: 747797 - RNA, 22 nt, Human
cgcccagccuggagucaaaggc

SEQ ID NO: 747798 - RNA, 20 nt, Human
cgccuagggugcccacugca

SEQ ID NO: 747799 - RNA, 26 nt, Human
cgccugcccggugcccaugagggcgg

SEQ ID NO: 747800 - RNA, 22 nt, Human
cggcaagaauauggggcaggag

SEQ ID NO: 747801 - RNA, 23 nt, Human
cggcagcagaggggcugggagau

SEQ ID NO: 747802 - RNA, 21 nt, Human
cggccagcacguccacccgcc

SEQ ID NO: 747803 - RNA, 18 nt, Human
cggggagagaggccugga

SEQ ID NO: 747804 - RNA, 20 nt, Human
cggggcccagguggcucugc

SEQ ID NO: 747805 - RNA, 25 nt, Human
cguguauacacauacgccuagggug

SEQ ID NO: 747806 - RNA, 20 nt, Human
cucaagaacggaaaagaggc

SEQ ID NO: 747807 - RNA, 24 nt, Human
cucagaugauguuucuggcagcuc

SEQ ID NO: 747808 - RNA, 21 nt, Human
cugcggagcccgagcgacccc

SEQ ID NO: 747809 - RNA, 26 nt, Human
cugcuggaguugggguugggugucuu

SEQ ID NO: 747810 - RNA, 23 nt, Human
cuggugugcaggggccagggcca

SEQ ID NO: 747811 - RNA, 19 nt, Human
cuuuuccaagacacggcaa

SEQ ID NO: 747812 - RNA, 23 nt, Human
gaaaacggccccgacacgaccaa

SEQ ID NO: 747813 - RNA, 20 nt, Human
gaacggaaaagaggcgcucc

SEQ ID NO: 747814 - RNA, 21 nt, Human
gagaccgggagccacgggggc

SEQ ID NO: 747815 - RNA, 21 nt, Human
gagcccgagcgaccccagcgg

SEQ ID NO: 747816 - RNA, 18 nt, Human
gagcggggguggggagcc

SEQ ID NO: 747817 - RNA, 23 nt, Human
gcaaaggaaggacaagccccaga

SEQ ID NO: 747818 - RNA, 19 nt, Human
gcaggagccaucugccugc

SEQ ID NO: 747819 - RNA, 26 nt, Human
gccgcucagcccccggcccgcggggc

SEQ ID NO: 747820 - RNA, 27 nt, Human
gcgccugcccggugcccaugagggcgg

SEQ ID NO: 747821 - RNA, 23 nt, Human
gcucuggacuucaaaaugggauc

SEQ ID NO: 747822 - RNA, 18 nt, Human
gcugcaaaggaaggacaa

SEQ ID NO: 747823 - RNA, 18 nt, Human
ggaaaagaggcgcucccu

SEQ ID NO: 747824 - RNA, 20 nt, Human
ggaagccguuguagguggca

SEQ ID NO: 747825 - RNA, 23 nt, Human
ggaaggacaagccccagaacaga

SEQ ID NO: 747826 - RNA, 20 nt, Human
ggacaagccccagaacagaa

SEQ ID NO: 747827 - RNA, 18 nt, Human
ggagcccaggaggacggg

SEQ ID NO: 747828 - RNA, 21 nt, Human
ggagcggggguggggagccca

SEQ ID NO: 747829 - RNA, 22 nt, Human
ggauucuuggcacagaaagccu

SEQ ID NO: 747830 - RNA, 18 nt, Human
ggcuccuuggguggcggc

SEQ ID NO: 747831 - RNA, 20 nt, Human
ggcugggagaugccucucac

SEQ ID NO: 747832 - RNA, 26 nt, Human
gggaauacugggaggaggggcucggc

SEQ ID NO: 747833 - RNA, 18 nt, Human
gggagcggggguggggag

SEQ ID NO: 747834 - RNA, 20 nt, Human
gggaugggaauacugggagg

SEQ ID NO: 747835 - RNA, 21 nt, Human
gggaugggaauacugggagga

SEQ ID NO: 747836 - RNA, 22 nt, Human
gggccagggccaggggcucuca

SEQ ID NO: 747837 - RNA, 19 nt, Human
ggggaugggaauacuggga

SEQ ID NO: 747838 - RNA, 20 nt, Human
ggggcccagguggcucugcc

SEQ ID NO: 747839 - RNA, 21 nt, Human
gggguugggugucuuauccag

SEQ ID NO: 747840 - RNA, 19 nt, Human
gguggcgguuauucugggc

SEQ ID NO: 747841 - RNA, 20 nt, Human
gguggggcugagccccaggg

SEQ ID NO: 747842 - RNA, 18 nt, Human
uagcucagguuuggcaca

SEQ ID NO: 747843 - RNA, 23 nt, Human
ucacuugggauucuuggcacaga

SEQ ID NO: 747844 - RNA, 22 nt, Human
ucagggcggcucucggaguucc

SEQ ID NO: 747845 - RNA, 18 nt, Human
uccagcuguugcaggaug

SEQ ID NO: 747846 - RNA, 23 nt, Human
uccagguuccacaggaaacuucu

SEQ ID NO: 747847 - RNA, 25 nt, Human
uccccagccccagucacuugggauu

SEQ ID NO: 747848 - RNA, 22 nt, Human
ucgccucagccccucacaaaag

SEQ ID NO: 747849 - RNA, 22 nt, Human
ucucauggucggggagagaggc

SEQ ID NO: 747850 - RNA, 21 nt, Human
ucuccggcugcacccggggcc

SEQ ID NO: 747851 - RNA, 18 nt, Human
ucucuuggacauggaccc

SEQ ID NO: 747852 - RNA, 24 nt, Human
ucugagggaauacuggcugggguc

SEQ ID NO: 747853 - RNA, 19 nt, Human
ugcaaaggaaggacaagcc

SEQ ID NO: 747854 - RNA, 22 nt, Human
ugcaggauggcaaggguggcgg

SEQ ID NO: 747855 - RNA, 20 nt, Human
ugcccaaacccucagaugau

SEQ ID NO: 747856 - RNA, 18 nt, Human
ugcccuggagugcgcugu

SEQ ID NO: 747857 - RNA, 23 nt, Human
uggacauggacccccuccaaagu

SEQ ID NO: 747858 - RNA, 24 nt, Human
uggagucaaaggcaucaggagccu

SEQ ID NO: 747859 - RNA, 20 nt, Human
uggcacacagcaggcccaca

SEQ ID NO: 747860 - RNA, 18 nt, Human
uggccgcgugggucccag

SEQ ID NO: 747861 - RNA, 23 nt, Human
ugggaauacugggaggaggggcu

SEQ ID NO: 747862 - RNA, 24 nt, Human
ugggaauacugggaggaggggcuc

SEQ ID NO: 747863 - RNA, 21 nt, Human
ugggaggaggggcucggcggg

SEQ ID NO: 747864 - RNA, 20 nt, Human
ugggauucuuggcacagaaa

SEQ ID NO: 747865 - RNA, 20 nt, Human
uggggagcggggguggggag

SEQ ID NO: 747866 - RNA, 19 nt, Human
uggggcaggagccaucugc

SEQ ID NO: 747867 - RNA, 22 nt, Human
uggggcuccuuggguggcggcu

SEQ ID NO: 747868 - RNA, 18 nt, Human
ugguacaggaaucuugau

SEQ ID NO: 747869 - RNA, 23 nt, Human
ugguggggcugagccccagggcu

SEQ ID NO: 747870 - RNA, 24 nt, Human
uguauacacauacgccuagggugc

SEQ ID NO: 747871 - RNA, 18 nt, Human
ugugggccucaggagggc

SEQ ID NO: 747872 - RNA, 23 nt, Human
ugugguggggcugagccccaggg

SEQ ID NO: 747873 - RNA, 21 nt, Human
uguguacaaagugccugugug

SEQ ID NO: 747874 - RNA, 20 nt, Human
uguugcaggauggcaagggu

SEQ ID NO: 747875 - RNA, 21 nt, Human
uucugggccuacuggugugca

SEQ ID NO: 747876 - RNA, 24 nt, Human
uugugggcccagaguccagcugcu

SEQ ID NO: 747877 - RNA, 22 nt, Human
aaaacacaaaacaaccaaaaga

SEQ ID NO: 747878 - RNA, 21 nt, Human
aaaagaggguuaagccccaaa

SEQ ID NO: 747879 - RNA, 21 nt, Human
aaaauguaagccucuuuucau

SEQ ID NO: 747880 - RNA, 22 nt, Human
aaaauuaggaaaugacaucuuc

SEQ ID NO: 747881 - RNA, 23 nt, Human
aauucagcaaucugugugaacac

SEQ ID NO: 747882 - RNA, 23 nt, Human
agccgccgccgagaacccggagc

SEQ ID NO: 747883 - RNA, 21 nt, Human
auuucaguuuugacugccacu

SEQ ID NO: 747884 - RNA, 21 nt, Human
caaaacacaaaacaaccaaaa

SEQ ID NO: 747885 - RNA, 22 nt, Human
caaggccccggccaaggccaca

SEQ ID NO: 747886 - RNA, 21 nt, Human
cagccgccgccgagaacccgg

SEQ ID NO: 747887 - RNA, 18 nt, Human
ccaaaacacaaaacaacc

SEQ ID NO: 747888 - RNA, 19 nt, Human
ccaaaacacaaaacaacca

SEQ ID NO: 747889 - RNA, 22 nt, Human
ccccaaaacacaaaacaaccaa

SEQ ID NO: 747890 - RNA, 20 nt, Human
cccggccaaggccacagccg

SEQ ID NO: 747891 - RNA, 23 nt, Human
ccggagcaucacgcucaggccgc

SEQ ID NO: 747892 - RNA, 21 nt, Human
cgaccgggagagacccaaggc

SEQ ID NO: 747893 - RNA, 20 nt, Human
cgcucaggccgccacggccg

SEQ ID NO: 747894 - RNA, 18 nt, Human
cgggagagacccaaggcc

SEQ ID NO: 747895 - RNA, 23 nt, Human
gcucacugccuccucucuucgug

SEQ ID NO: 747896 - RNA, 18 nt, Human
gcucaggccgccacggcc

SEQ ID NO: 747897 - RNA, 21 nt, Human
uaagccccaaaacacaaaaca

SEQ ID NO: 747898 - RNA, 26 nt, Human
uaagccccaaaacacaaaacaaccaa

SEQ ID NO: 747899 - RNA, 30 nt, Human
uaagccccaaaacacaaaacaaccaaaagg

SEQ ID NO: 747900 - RNA, 20 nt, Human
uagucauaaaagcauuugaa

SEQ ID NO: 747901 - RNA, 21 nt, Human
uauuaacaaauauggagaaau

SEQ ID NO: 747902 - RNA, 18 nt, Human
ucacugccuccucucuuc

SEQ ID NO: 747903 - RNA, 23 nt, Human
uccauuuuguuuuauugucuuuu

SEQ ID NO: 747904 - RNA, 18 nt, Human
uccccuaacugguaacau

SEQ ID NO: 747905 - RNA, 20 nt, Human
ucccuagaucacaacagcuu

SEQ ID NO: 747906 - RNA, 20 nt, Human
ucucguccuguugcucacug

SEQ ID NO: 747907 - RNA, 23 nt, Human
ucucguccuguugcucacugccu

SEQ ID NO: 747908 - RNA, 24 nt, Human
ugaaaauaaaagucuuccccuaac

SEQ ID NO: 747909 - RNA, 25 nt, Human
uuaaaaaaugccgaaaaugagauau

SEQ ID NO: 747910 - RNA, 24 nt, Human
uuacauuuuaaaaaaugccgaaaa

SEQ ID NO: 747911 - RNA, 22 nt, Human
uucccuagaucacaacagcuua

SEQ ID NO: 747912 - RNA, 23 nt, Human
uuuaaaaaaugccgaaaaugaga

SEQ ID NO: 747913 - RNA, 22 nt, Human
uuucaguuuugacugccacucc

SEQ ID NO: 747914 - RNA, 26 nt, Human
aaaaaaaaaaaaaaaggucuugggag

SEQ ID NO: 747915 - RNA, 26 nt, Human
aacagugugguguuucuguacaggcc

SEQ ID NO: 747916 - RNA, 22 nt, Human
aagcaaaaaggaggaaacaacc

SEQ ID NO: 747917 - RNA, 23 nt, Human
aagcaaaaaggaggaaacaaccc

SEQ ID NO: 747918 - RNA, 19 nt, Human
acuuccagaaaugcagaaa

SEQ ID NO: 747919 - RNA, 20 nt, Human
aggaggaaacaacccaccaa

SEQ ID NO: 747920 - RNA, 23 nt, Human
caaaagcaaaaaggaggaaacaa

SEQ ID NO: 747921 - RNA, 22 nt, Human
caagagauguuuguacaaccau

SEQ ID NO: 747922 - RNA, 24 nt, Human
cacuguucacaaaagcaaaaagga

SEQ ID NO: 747923 - RNA, 18 nt, Human
cagucacaaccagaucga

SEQ ID NO: 747924 - RNA, 20 nt, Human
ccagauccagcaauuccacu

SEQ ID NO: 747925 - RNA, 23 nt, Human
cccuggagcccacgagguuccuu

SEQ ID NO: 747926 - RNA, 21 nt, Human
ccucaaaaaauuaaaaaggga

SEQ ID NO: 747927 - RNA, 19 nt, Human
ccugagaacgaaagaaaau

SEQ ID NO: 747928 - RNA, 24 nt, Human
ccugagaacgaaagaaaaugcuga

SEQ ID NO: 747929 - RNA, 19 nt, Human
cgaaagaaaaugcugacac

SEQ ID NO: 747930 - RNA, 23 nt, Human
cugcggccuccuaaaagucuccc

SEQ ID NO: 747931 - RNA, 18 nt, Human
cuuaaaaaaaaaaaaaaa

SEQ ID NO: 747932 - RNA, 18 nt, Human
cuuaaaaaaaaaaaaaaa

SEQ ID NO: 747933 - RNA, 24 nt, Human
gagcuaccagauccagcaauucca

SEQ ID NO: 747934 - RNA, 21 nt, Human
gaggaaaaacugauccgguga

SEQ ID NO: 747935 - RNA, 19 nt, Human
gcaaaaaggaggaaacaac

SEQ ID NO: 747936 - RNA, 19 nt, Human
gccugggucccuggagccc

SEQ ID NO: 747937 - RNA, 23 nt, Human
gucacaaccagaucgagaugauu

SEQ ID NO: 747938 - RNA, 19 nt, Human
uaaaaagggagcuaccaga

SEQ ID NO: 747939 - RNA, 24 nt, Human
uaagugaaauaaaccagucacaaa

SEQ ID NO: 747940 - RNA, 22 nt, Human
uacaacauggauacaccuuuaa

SEQ ID NO: 747941 - RNA, 21 nt, Human
uccagaaaugcagaaacacau

SEQ ID NO: 747942 - RNA, 24 nt, Human
ucccuggagcccacgagguuccug

SEQ ID NO: 747943 - RNA, 24 nt, Human
ugaaugaaugcaugaaacauggug

SEQ ID NO: 747944 - RNA, 18 nt, Human
ugacgaggagacacggca

SEQ ID NO: 747945 - RNA, 24 nt, Human
ugcagaaacacaucuuuucuucuu

SEQ ID NO: 747946 - RNA, 24 nt, Human
ugcagaaacacaucuuuucuucuu

SEQ ID NO: 747947 - RNA, 22 nt, Human
ugcuacaacauggauacaccuu

SEQ ID NO: 747948 - RNA, 18 nt, Human
uggaaggcugcggccucc

SEQ ID NO: 747949 - RNA, 21 nt, Human
ugggccugggucccuggagcc

SEQ ID NO: 747950 - RNA, 20 nt, Human
uuaaaaaaaaaaaaaaaaaa

SEQ ID NO: 747951 - RNA, 20 nt, Human
uuaaaaaaaaaaaaaaaaaa

SEQ ID NO: 747952 - RNA, 22 nt, Human
uuguacaaccauguucguagca

SEQ ID NO: 747953 - RNA, 18 nt, Human
aacugccugcgccggggc

SEQ ID NO: 747954 - RNA, 24 nt, Human
aagcccccacaagggaaccggggg

SEQ ID NO: 747955 - RNA, 22 nt, Human
acggaaccuaagaagaacugcc

SEQ ID NO: 747956 - RNA, 20 nt, Human
agcaagggggcccaggggga

SEQ ID NO: 747957 - RNA, 18 nt, Human
agcugccaaagcccccac

SEQ ID NO: 747958 - RNA, 23 nt, Human
aggaauggggaggaugagaggga

SEQ ID NO: 747959 - RNA, 18 nt, Human
aggagcaagggggcccag

SEQ ID NO: 747960 - RNA, 21 nt, Human
aggauggaggagcaagggggc

SEQ ID NO: 747961 - RNA, 19 nt, Human
auggggaggaugagaggga

SEQ ID NO: 747962 - RNA, 19 nt, Human
caaagcccccacaagggaa

SEQ ID NO: 747963 - RNA, 23 nt, Human
caaagcccccacaagggaaccgg

SEQ ID NO: 747964 - RNA, 18 nt, Human
cacguccaugcucccagg

SEQ ID NO: 747965 - RNA, 22 nt, Human
ccacguccaugcucccaggccu

SEQ ID NO: 747966 - RNA, 20 nt, Human
ccagggggaagaacagcaga

SEQ ID NO: 747967 - RNA, 19 nt, Human
cgcccaagcacaccggaca

SEQ ID NO: 747968 - RNA, 19 nt, Human
cuaaagcuacacugcacug

SEQ ID NO: 747969 - RNA, 20 nt, Human
cuuaaacuaaagcuacacug

SEQ ID NO: 747970 - RNA, 20 nt, Human
gaacugccugcgccggggcc

SEQ ID NO: 747971 - RNA, 19 nt, Human
gagacggaaccuaagaaga

SEQ ID NO: 747972 - RNA, 22 nt, Human
gaggagcaagggggcccagggg

SEQ ID NO: 747973 - RNA, 18 nt, Human
gaggauggaggagcaagg

SEQ ID NO: 747974 - RNA, 26 nt, Human
gaggauggaggagcaagggggcccag

SEQ ID NO: 747975 - RNA, 23 nt, Human
gcccccacaagggaaccgggggc

SEQ ID NO: 747976 - RNA, 23 nt, Human
gccucaguuccugggcuccuugg

SEQ ID NO: 747977 - RNA, 19 nt, Human
gcugccaaagcccccacaa

SEQ ID NO: 747978 - RNA, 21 nt, Human
ggaggagcaagggggcccagg

SEQ ID NO: 747979 - RNA, 22 nt, Human
ggaggagcaagggggcccaggg

SEQ ID NO: 747980 - RNA, 23 nt, Human
ggcagagguaggagagcuuggau

SEQ ID NO: 747981 - RNA, 23 nt, Human
gggcccagggggaagaacagcag

SEQ ID NO: 747982 - RNA, 18 nt, Human
uaagaagaacugccugcg

SEQ ID NO: 747983 - RNA, 26 nt, Human
uagcugccaaagcccccacaagggaa

SEQ ID NO: 747984 - RNA, 22 nt, Human
uauuuugguucuuccauagcug

SEQ ID NO: 747985 - RNA, 23 nt, Human
uccauagcugccaaagcccccac

SEQ ID NO: 747986 - RNA, 22 nt, Human
ucgccucaguuccugggcuccu

SEQ ID NO: 747987 - RNA, 26 nt, Human
ugagacggaaccuaagaagaacugcc

SEQ ID NO: 747988 - RNA, 18 nt, Human
ugagagaaugaggaugga

SEQ ID NO: 747989 - RNA, 20 nt, Human
ugagagaaugaggauggagg

SEQ ID NO: 747990 - RNA, 19 nt, Human
ugagagggacggcugggca

SEQ ID NO: 747991 - RNA, 22 nt, Human
ugagguugugcugucccuugaa

SEQ ID NO: 747992 - RNA, 22 nt, Human
ugcgaugccgcccaagcacacc

SEQ ID NO: 747993 - RNA, 19 nt, Human
ugcgccggggcgggcgggu

SEQ ID NO: 747994 - RNA, 20 nt, Human
ugggcagagguaggagagcu

SEQ ID NO: 747995 - RNA, 20 nt, Human
cagcaaacaggaagcacuac

SEQ ID NO: 747996 - RNA, 22 nt, Human
cagccccgugacucuggggcug

SEQ ID NO: 747997 - RNA, 22 nt, Human
cagcucccgcccccucagcccc

SEQ ID NO: 747998 - RNA, 22 nt, Human
ccccucagccccgugacucugg

SEQ ID NO: 747999 - RNA, 23 nt, Human
ccgcccccucagccccgugacuc

SEQ ID NO: 748000 - RNA, 23 nt, Human
ccuaugacaggggcagcucccgc

SEQ ID NO: 748001 - RNA, 18 nt, Human
ccucccuaugacaggggc

SEQ ID NO: 748002 - RNA, 22 nt, Human
cucccaccgcccggcucagccc

SEQ ID NO: 748003 - RNA, 19 nt, Human
cucccgcccccucagcccc

SEQ ID NO: 748004 - RNA, 21 nt, Human
cucccgcccccucagccccgu

SEQ ID NO: 748005 - RNA, 18 nt, Human
cugggaaucccccucccu

SEQ ID NO: 748006 - RNA, 18 nt, Human
cugggaaucccccucccu

SEQ ID NO: 748007 - RNA, 19 nt, Human
gcaaacaggaagcacuaca

SEQ ID NO: 748008 - RNA, 18 nt, Human
uagguguuuccugcaucu

SEQ ID NO: 748009 - RNA, 19 nt, Human
ucagccccgugacucuggg

SEQ ID NO: 748010 - RNA, 23 nt, Human
ucagccccgugacucuggggcug

SEQ ID NO: 748011 - RNA, 18 nt, Human
ucccgcccccucagcccc

SEQ ID NO: 748012 - RNA, 21 nt, Human
ucccuaugacaggggcagcuc

SEQ ID NO: 748013 - RNA, 19 nt, Human
ugacaggggcagcucccgc

SEQ ID NO: 748014 - RNA, 20 nt, Human
ugacaggggcagcucccgcc

SEQ ID NO: 748015 - RNA, 24 nt, Human
ugacaggggcagcucccgcccccu

SEQ ID NO: 748016 - RNA, 22 nt, Human
aagccggcagccaagcuuuguc

SEQ ID NO: 748017 - RNA, 26 nt, Human
acaaauuuuuaaaaaauggaacaaaa

SEQ ID NO: 748018 - RNA, 23 nt, Human
accacuguuuugcaaagaaugaa

SEQ ID NO: 748019 - RNA, 23 nt, Human
acccaaccuucagcaagacagca

SEQ ID NO: 748020 - RNA, 20 nt, Human
accugugucacacccucccu

SEQ ID NO: 748021 - RNA, 18 nt, Human
agaaaguaccaagcaagg

SEQ ID NO: 748022 - RNA, 18 nt, Human
agaauggacauccuggcc

SEQ ID NO: 748023 - RNA, 19 nt, Human
aggacuucaaucccuagcc

SEQ ID NO: 748024 - RNA, 20 nt, Human
agggggagcgcaagcgcugu

SEQ ID NO: 748025 - RNA, 21 nt, Human
auagcaccaucugugacccua

SEQ ID NO: 748026 - RNA, 21 nt, Human
caacuuaggaagccaucuccc

SEQ ID NO: 748027 - RNA, 20 nt, Human
cagcaccgaugggccuagaa

SEQ ID NO: 748028 - RNA, 19 nt, Human
cagguccagaaaguaccaa

SEQ ID NO: 748029 - RNA, 24 nt, Human
caguccaucuuucugcccuucuca

SEQ ID NO: 748030 - RNA, 21 nt, Human
ccacagucccuuuagaugccu

SEQ ID NO: 748031 - RNA, 19 nt, Human
ccaggauccaaaggcccuu

SEQ ID NO: 748032 - RNA, 19 nt, Human
cccuagacccugagcacgu

SEQ ID NO: 748033 - RNA, 22 nt, Human
cccucaggcucaggcaccuucc

SEQ ID NO: 748034 - RNA, 18 nt, Human
ccugacccaaccuucagc

SEQ ID NO: 748035 - RNA, 21 nt, Human
ccuuaccacagucccuuuaga

SEQ ID NO: 748036 - RNA, 19 nt, Human
ccuucucauaaagacccuu

SEQ ID NO: 748037 - RNA, 23 nt, Human
ccuuuagaugccugacccaaccu

SEQ ID NO: 748038 - RNA, 20 nt, Human
cguccaguacuggaagugga

SEQ ID NO: 748039 - RNA, 23 nt, Human
cuagccagcuaggaacuuacagu

SEQ ID NO: 748040 - RNA, 19 nt, Human
cuccagauacuuucgguac

SEQ ID NO: 748041 - RNA, 23 nt, Human
cucuacuugcuggccccuccagg

SEQ ID NO: 748042 - RNA, 18 nt, Human
cuguaccacuguuuugca

SEQ ID NO: 748043 - RNA, 21 nt, Human
cuuacaccugugucacacccu

SEQ ID NO: 748044 - RNA, 18 nt, Human
cuuccaguccaucuuucu

SEQ ID NO: 748045 - RNA, 20 nt, Human
cuuguggaaagacucaggcu

SEQ ID NO: 748046 - RNA, 22 nt, Human
cuuguuuggcccucaggcucag

SEQ ID NO: 748047 - RNA, 19 nt, Human
cuuuuggcaaugguauugg

SEQ ID NO: 748048 - RNA, 21 nt, Human
gaacagguagacagugucaag

SEQ ID NO: 748049 - RNA, 21 nt, Human
gagcaccuuguggaaagacuc

SEQ ID NO: 748050 - RNA, 21 nt, Human
ggagagggccgugguucuuug

SEQ ID NO: 748051 - RNA, 21 nt, Human
ggauggaagacagaugcuucu

SEQ ID NO: 748052 - RNA, 26 nt, Human
ggcuccuagaaccuuugcaacaauuc

SEQ ID NO: 748053 - RNA, 18 nt, Human
gggaaggguagucagagc

SEQ ID NO: 748054 - RNA, 27 nt, Human
gggcauccucaauacugucauggguuu

SEQ ID NO: 748055 - RNA, 22 nt, Human
guauagccaacuuaggaagcca

SEQ ID NO: 748056 - RNA, 22 nt, Human
guccuugggcaccuggcaagga

SEQ ID NO: 748057 - RNA, 23 nt, Human
uaagaauaccaauuacuuuccau

SEQ ID NO: 748058 - RNA, 18 nt, Human
uacuugcuggccccucca

SEQ ID NO: 748059 - RNA, 19 nt, Human
uagaacgaguagggggagc

SEQ ID NO: 748060 - RNA, 24 nt, Human
uagaugccugacccaaccuucagc

SEQ ID NO: 748061 - RNA, 18 nt, Human
uagcaccaucugugaccc

SEQ ID NO: 748062 - RNA, 19 nt, Human
uaucccugaagcaguuggu

SEQ ID NO: 748063 - RNA, 22 nt, Human
ucauggguuuccccuugaaucu

SEQ ID NO: 748064 - RNA, 20 nt, Human
uccaggagcuucucugccug

SEQ ID NO: 748065 - RNA, 22 nt, Human
uccauggcggauauuuuggagc

SEQ ID NO: 748066 - RNA, 21 nt, Human
uccuugggcaccuggcaagga

SEQ ID NO: 748067 - RNA, 23 nt, Human
uccuugggcaccuggcaaggaua

SEQ ID NO: 748068 - RNA, 26 nt, Human
ucuacuugcuggccccuccaggucgg

SEQ ID NO: 748069 - RNA, 19 nt, Human
ucucccaguucuggggcuu

SEQ ID NO: 748070 - RNA, 23 nt, Human
ucuguaccacuguuuugcaaaga

SEQ ID NO: 748071 - RNA, 19 nt, Human
ucuuugggaaggguaguca

SEQ ID NO: 748072 - RNA, 23 nt, Human
ugaagaaggaaugaaucuggcuc

SEQ ID NO: 748073 - RNA, 18 nt, Human
ugacccaaccuucagcaa

SEQ ID NO: 748074 - RNA, 21 nt, Human
uggaacagguagacaguguca

SEQ ID NO: 748075 - RNA, 21 nt, Human
ugucauggguuuccccuugaa

SEQ ID NO: 748076 - RNA, 26 nt, Human
uguggaaagacucaggcucagugcca

SEQ ID NO: 748077 - RNA, 19 nt, Human
uuagaugccugacccaacc

SEQ ID NO: 748078 - RNA, 19 nt, Human
uugggaaggguagucagag

SEQ ID NO: 748079 - RNA, 23 nt, Human
uugggacuuguuuggcccucagg

SEQ ID NO: 748080 - RNA, 22 nt, Human
uuugcuugggccaccaacacuc

SEQ ID NO: 748081 - RNA, 18 nt, Human
aaaaacacugcucauggc

SEQ ID NO: 748082 - RNA, 18 nt, Human
aaaaagcaaaaacacugc

SEQ ID NO: 748083 - RNA, 19 nt, Human
aaaagacaccacugccuuu

SEQ ID NO: 748084 - RNA, 22 nt, Human
aaaaggcaggacagugugaaug

SEQ ID NO: 748085 - RNA, 23 nt, Human
aaacccuagcggcuccacacccc

SEQ ID NO: 748086 - RNA, 21 nt, Human
aaagcaaagcgaaagcggccc

SEQ ID NO: 748087 - RNA, 20 nt, Human
aaauaauauuaaaguaggca

SEQ ID NO: 748088 - RNA, 21 nt, Human
aaccacagacucuuuaaaaag

SEQ ID NO: 748089 - RNA, 22 nt, Human
aaccuauuuuucaauuacccac

SEQ ID NO: 748090 - RNA, 22 nt, Human
aagcaaaaggaaagcaaagcga

SEQ ID NO: 748091 - RNA, 23 nt, Human
aaugauuuuccccgcuuuuuagg

SEQ ID NO: 748092 - RNA, 19 nt, Human
acacugguccugugugcug

SEQ ID NO: 748093 - RNA, 22 nt, Human
accaggugucucucucugcagc

SEQ ID NO: 748094 - RNA, 19 nt, Human
accugggccccgcaaaccc

SEQ ID NO: 748095 - RNA, 18 nt, Human
acgcagacuuagaacacc

SEQ ID NO: 748096 - RNA, 19 nt, Human
acuccgggguuuccagccu

SEQ ID NO: 748097 - RNA, 20 nt, Human
acugagaccucucauaacca

SEQ ID NO: 748098 - RNA, 24 nt, Human
acuggauuaacaaacaaauaauau

SEQ ID NO: 748099 - RNA, 22 nt, Human
acuugagggucccaggcuccug

SEQ ID NO: 748100 - RNA, 20 nt, Human
agacucagaaaccaaauccc

SEQ ID NO: 748101 - RNA, 19 nt, Human
agaguccccuuaugggcuc

SEQ ID NO: 748102 - RNA, 19 nt, Human
agcacaugguacgaaauuu

SEQ ID NO: 748103 - RNA, 23 nt, Human
agccaugggaaccgcacaggacu

SEQ ID NO: 748104 - RNA, 22 nt, Human
agccuuacuccgggguuuccag

SEQ ID NO: 748105 - RNA, 23 nt, Human
aggaagcugugcuacaucuagug

SEQ ID NO: 748106 - RNA, 26 nt, Human
aggcaugugaguuugaguagcaaugg

SEQ ID NO: 748107 - RNA, 19 nt, Human
aguucaugaguaaccaugg

SEQ ID NO: 748108 - RNA, 19 nt, Human
aucacuauucagaacugug

SEQ ID NO: 748109 - RNA, 19 nt, Human
augaaacgcuggaaagcca

SEQ ID NO: 748110 - RNA, 24 nt, Human
augggcucuccuucucuguggcuc

SEQ ID NO: 748111 - RNA, 20 nt, Human
augguguggggaaggaaaua

SEQ ID NO: 748112 - RNA, 22 nt, Human
caaaaagcaaaaacacugcuca

SEQ ID NO: 748113 - RNA, 24 nt, Human
caaaagacaaaagaacguugaaaa

SEQ ID NO: 748114 - RNA, 21 nt, Human
caaaaugaaagccacaccuug

SEQ ID NO: 748115 - RNA, 21 nt, Human
caaacauacgaggcucugcac

SEQ ID NO: 748116 - RNA, 20 nt, Human
caaagcgaaagcggcccuga

SEQ ID NO: 748117 - RNA, 26 nt, Human
caaccaaagcgagcacaugguacgag

SEQ ID NO: 748118 - RNA, 22 nt, Human
caagcagacacguccccagaac

SEQ ID NO: 748119 - RNA, 20 nt, Human
caauagguuggccggacauc

SEQ ID NO: 748120 - RNA, 22 nt, Human
caauccaaauccauccacuugg

SEQ ID NO: 748121 - RNA, 21 nt, Human
cacagaucacaacagcugccc

SEQ ID NO: 748122 - RNA, 24 nt, Human
cacagaucacaacagcugcccuga

SEQ ID NO: 748123 - RNA, 23 nt, Human
cacagugucugugccgggugccc

SEQ ID NO: 748124 - RNA, 23 nt, Human
caccccagggacuggcccccaaa

SEQ ID NO: 748125 - RNA, 22 nt, Human
caccuggggcuuugcugccggg

SEQ ID NO: 748126 - RNA, 23 nt, Human
cacgauccacauugaaaacauca

SEQ ID NO: 748127 - RNA, 20 nt, Human
cacguccccagaacauaccg

SEQ ID NO: 748128 - RNA, 20 nt, Human
cagaacacagaaagcugaga

SEQ ID NO: 748129 - RNA, 21 nt, Human
cagaacauaccguaacccaga

SEQ ID NO: 748130 - RNA, 21 nt, Human
cagaagcaaagacaagcaaaa

SEQ ID NO: 748131 - RNA, 20 nt, Human
cagcaaugccucugcccucc

SEQ ID NO: 748132 - RNA, 22 nt, Human
caggugucucucucugcagccu

SEQ ID NO: 748133 - RNA, 20 nt, Human
cagugauaacagcauaugag

SEQ ID NO: 748134 - RNA, 25 nt, Human
caucaaggcaauagccucaucuaac

SEQ ID NO: 748135 - RNA, 22 nt, Human
caucagaacuacacgauccaca

SEQ ID NO: 748136 - RNA, 22 nt, Human
caucucaaaugaaccuugauug

SEQ ID NO: 748137 - RNA, 23 nt, Human
caugggcaagcagacacgucccc

SEQ ID NO: 748138 - RNA, 25 nt, Human
cauuuggaaaggccccugcguaugg

SEQ ID NO: 748139 - RNA, 23 nt, Human
ccaaagggaccugggccccgcaa

SEQ ID NO: 748140 - RNA, 18 nt, Human
ccaacauccagcaaugac

SEQ ID NO: 748141 - RNA, 21 nt, Human
ccaacuucagagccuugauuu

SEQ ID NO: 748142 - RNA, 19 nt, Human
ccagaaauuagcagaaaca

SEQ ID NO: 748143 - RNA, 21 nt, Human
ccagaacacagaaagcugaga

SEQ ID NO: 748144 - RNA, 21 nt, Human
ccagaucauaaauuccagccc

SEQ ID NO: 748145 - RNA, 19 nt, Human
ccagcacagugucugugcc

SEQ ID NO: 748146 - RNA, 22 nt, Human
ccauccaacauccaccacuucu

SEQ ID NO: 748147 - RNA, 25 nt, Human
cccaaaaagcaaaaacacugcucau

SEQ ID NO: 748148 - RNA, 18 nt, Human
cccaaaagacaccacugc

SEQ ID NO: 748149 - RNA, 19 nt, Human
ccccaaaaagcaaaaacac

SEQ ID NO: 748150 - RNA, 20 nt, Human
ccccaaaaagcaaaaacacu

SEQ ID NO: 748151 - RNA, 21 nt, Human
ccccaaaagacaccacugccu

SEQ ID NO: 748152 - RNA, 19 nt, Human
ccccacuguacccugaggc

SEQ ID NO: 748153 - RNA, 20 nt, Human
cccccgccucgccuuugccc

SEQ ID NO: 748154 - RNA, 19 nt, Human
ccccgccucgccuuugccc

SEQ ID NO: 748155 - RNA, 21 nt, Human
cccgacuccccaccacguccu

SEQ ID NO: 748156 - RNA, 22 nt, Human
cccgcaaaccccugccgaggga

SEQ ID NO: 748157 - RNA, 21 nt, Human
cccucgcucucaggaguccgu

SEQ ID NO: 748158 - RNA, 18 nt, Human
ccgaaguuccaaauccag

SEQ ID NO: 748159 - RNA, 23 nt, Human
ccgcacaggacugugcaaccacc

SEQ ID NO: 748160 - RNA, 19 nt, Human
ccuauaaaaggccaaucaa

SEQ ID NO: 748161 - RNA, 21 nt, Human
ccuauuuccaaaucguuuaca

SEQ ID NO: 748162 - RNA, 18 nt, Human
ccucaggaacccccacug

SEQ ID NO: 748163 - RNA, 24 nt, Human
ccucaggaacccccacuguacccu

SEQ ID NO: 748164 - RNA, 19 nt, Human
ccucggggcuccuucgaag

SEQ ID NO: 748165 - RNA, 23 nt, Human
ccugcagcagucccaaaaugaaa

SEQ ID NO: 748166 - RNA, 21 nt, Human
ccugcaggucuggccaagguc

SEQ ID NO: 748167 - RNA, 24 nt, Human
ccugggccccgcaaaccccugccg

SEQ ID NO: 748168 - RNA, 19 nt, Human
ccuuugcccucuccucucc

SEQ ID NO: 748169 - RNA, 22 nt, Human
ccuuuugcuguaaauacuguuu

SEQ ID NO: 748170 - RNA, 24 nt, Human
cgaaguguccaaaccaccagcgug

SEQ ID NO: 748171 - RNA, 20 nt, Human
cgagggagacgcccgccgac

SEQ ID NO: 748172 - RNA, 23 nt, Human
cgagucagacauuuggaaaugcc

SEQ ID NO: 748173 - RNA, 21 nt, Human
cgccaggaccgcgucagccaa

SEQ ID NO: 748174 - RNA, 22 nt, Human
cgcgcccccgguuccgcagccu

SEQ ID NO: 748175 - RNA, 24 nt, Human
cgcgucagccaacauccagcaaug

SEQ ID NO: 748176 - RNA, 24 nt, Human
cggccacacuuagaauacugauug

SEQ ID NO: 748177 - RNA, 21 nt, Human
cgggcccaaagggaccugggc

SEQ ID NO: 748178 - RNA, 23 nt, Human
cguaacccagaucauaaauucca

SEQ ID NO: 748179 - RNA, 20 nt, Human
cucaaggcauccacccccaa

SEQ ID NO: 748180 - RNA, 25 nt, Human
cucaaggcauccacccccagaagca

SEQ ID NO: 748181 - RNA, 21 nt, Human
cucacggggcaggacccuucc

SEQ ID NO: 748182 - RNA, 24 nt, Human
cucgccuuugcccucuccucucca

SEQ ID NO: 748183 - RNA, 22 nt, Human
cucggcaugaacugacaaacau

SEQ ID NO: 748184 - RNA, 20 nt, Human
cucggccacacuuagaauac

SEQ ID NO: 748185 - RNA, 19 nt, Human
cucuccucuccagcgagga

SEQ ID NO: 748186 - RNA, 27 nt, Human
cugaaccccagccacuuuaaaucugcc

SEQ ID NO: 748187 - RNA, 21 nt, Human
cugcagcuuccuuugcuggga

SEQ ID NO: 748188 - RNA, 22 nt, Human
cugccagcacagugucugugcc

SEQ ID NO: 748189 - RNA, 18 nt, Human
cugcccucccugcagcag

SEQ ID NO: 748190 - RNA, 22 nt, Human
cugcccucccugcagcaguccc

SEQ ID NO: 748191 - RNA, 22 nt, Human
cugccgggccccacaggaagcu

SEQ ID NO: 748192 - RNA, 23 nt, Human
cugcgcccgcgcgcccccgguuc

SEQ ID NO: 748193 - RNA, 19 nt, Human
cuucugaaccccagccacu

SEQ ID NO: 748194 - RNA, 24 nt, Human
cuugcugaacuucugaaccccagc

SEQ ID NO: 748195 - RNA, 21 nt, Human
cuuugcugccgggccccacag

SEQ ID NO: 748196 - RNA, 25 nt, Human
cuuuuuggaguugagccaaccaaag

SEQ ID NO: 748197 - RNA, 20 nt, Human
gaacacagaaagcugagacc

SEQ ID NO: 748198 - RNA, 19 nt, Human
gaacuucugaaccccagcc

SEQ ID NO: 748199 - RNA, 18 nt, Human
gaauacaaaaaugcacuu

SEQ ID NO: 748200 - RNA, 24 nt, Human
gacaccacugccuuuucagacauu

SEQ ID NO: 748201 - RNA, 23 nt, Human
gacaccagaaauuagcagaaaca

SEQ ID NO: 748202 - RNA, 18 nt, Human
gacugugcaaccaccccc

SEQ ID NO: 748203 - RNA, 18 nt, Human
gagacgcccgccgacccc

SEQ ID NO: 748204 - RNA, 25 nt, Human
gcaaaagacaaaagaacguugaaaa

SEQ ID NO: 748205 - RNA, 24 nt, Human
gcaaugccucugcccucccugcag

SEQ ID NO: 748206 - RNA, 25 nt, Human
gccccgacuccccaccacguccucc

SEQ ID NO: 748207 - RNA, 26 nt, Human
gcgcccccagaacacaggauacaaua

SEQ ID NO: 748208 - RNA, 21 nt, Human
gcugucauaucaccgcgcccc

SEQ ID NO: 748209 - RNA, 22 nt, Human
ggaaggcucaagcucauuccuc

SEQ ID NO: 748210 - RNA, 22 nt, Human
ggaggacacugguccccuuaaa

SEQ ID NO: 748211 - RNA, 18 nt, Human
ggcaagcagacacguccc

SEQ ID NO: 748212 - RNA, 23 nt, Human
ggcuacacaacugcaaggucacg

SEQ ID NO: 748213 - RNA, 18 nt, Human
gggacaccccggggccgg

SEQ ID NO: 748214 - RNA, 23 nt, Human
gggagacgcccgccgaccccgcc

SEQ ID NO: 748215 - RNA, 19 nt, Human
gggcaagcagacacguccc

SEQ ID NO: 748216 - RNA, 21 nt, Human
gggccccgcaaaccccugccg

SEQ ID NO: 748217 - RNA, 26 nt, Human
gggggauguuaggagaagccgcugug

SEQ ID NO: 748218 - RNA, 21 nt, Human
ggguuuccagccucacagcuu

SEQ ID NO: 748219 - RNA, 23 nt, Human
uaaaaugaacauuauuuguuucc

SEQ ID NO: 748220 - RNA, 23 nt, Human
uaaaucagaaagagcuuuacuua

SEQ ID NO: 748221 - RNA, 20 nt, Human
uaacagcauaugaguuugau

SEQ ID NO: 748222 - RNA, 20 nt, Human
uaacauugcagaaggggaaa

SEQ ID NO: 748223 - RNA, 21 nt, Human
uaacauugcagaaggggaaau

SEQ ID NO: 748224 - RNA, 25 nt, Human
uaacauuuuccccaaaagacaccac

SEQ ID NO: 748225 - RNA, 23 nt, Human
uacaaccauuucuccaguauacu

SEQ ID NO: 748226 - RNA, 22 nt, Human
uacacagaucacaacagcugcc

SEQ ID NO: 748227 - RNA, 19 nt, Human
uacagaguggacuaucaaa

SEQ ID NO: 748228 - RNA, 23 nt, Human
uacuccgggguuuccagccucac

SEQ ID NO: 748229 - RNA, 19 nt, Human
uacucuuuuuggaguugag

SEQ ID NO: 748230 - RNA, 18 nt, Human
uagcagaaacagagcaga

SEQ ID NO: 748231 - RNA, 19 nt, Human
uagccaaagaauuuccaca

SEQ ID NO: 748232 - RNA, 19 nt, Human
uagccaaagaauuuccaca

SEQ ID NO: 748233 - RNA, 19 nt, Human
uagcggcuccacaccccag

SEQ ID NO: 748234 - RNA, 23 nt, Human
uaggagaagccgcugugcuccug

SEQ ID NO: 748235 - RNA, 24 nt, Human
uaucagaaaguugauugauuuuua

SEQ ID NO: 748236 - RNA, 20 nt, Human
uauccuuuuccggggacagu

SEQ ID NO: 748237 - RNA, 21 nt, Human
ucacacgcugcucccccgccu

SEQ ID NO: 748238 - RNA, 18 nt, Human
ucagacauuuggaaaggc

SEQ ID NO: 748239 - RNA, 22 nt, Human
ucauaucaccgcgcccccagaa

SEQ ID NO: 748240 - RNA, 19 nt, Human
ucauccguaauucacugcc

SEQ ID NO: 748241 - RNA, 22 nt, Human
uccaaaccaccagcguggccag

SEQ ID NO: 748242 - RNA, 21 nt, Human
uccaaaucguuuacaggaagu

SEQ ID NO: 748243 - RNA, 18 nt, Human
uccagcuggcgccaggac

SEQ ID NO: 748244 - RNA, 21 nt, Human
ucccaagaugauuaaccaagu

SEQ ID NO: 748245 - RNA, 19 nt, Human
ucccacuuguggcuacaca

SEQ ID NO: 748246 - RNA, 22 nt, Human
ucccucuuugcaacgcuggcug

SEQ ID NO: 748247 - RNA, 20 nt, Human
ucccugcagcagucccaaaa

SEQ ID NO: 748248 - RNA, 26 nt, Human
uccgcgggcccaaagggaccugggcc

SEQ ID NO: 748249 - RNA, 23 nt, Human
uccggggacaguguuacucugga

SEQ ID NO: 748250 - RNA, 19 nt, Human
uccgggguuuccagccucc

SEQ ID NO: 748251 - RNA, 21 nt, Human
uccucgccgcggcuccucuuc

SEQ ID NO: 748252 - RNA, 24 nt, Human
uccuggcacgcgaucagauuucac

SEQ ID NO: 748253 - RNA, 20 nt, Human
uccugggucucaaggcaucc

SEQ ID NO: 748254 - RNA, 24 nt, Human
uccuucucuguggcucccacuugu

SEQ ID NO: 748255 - RNA, 18 nt, Human
ucgccgcggcuccucuuc

SEQ ID NO: 748256 - RNA, 24 nt, Human
ucgccgcggcuccucuucagccgc

SEQ ID NO: 748257 - RNA, 22 nt, Human
ucuaacuauuuuaaugggugga

SEQ ID NO: 748258 - RNA, 18 nt, Human
ucugaagcuccugccagc

SEQ ID NO: 748259 - RNA, 18 nt, Human
ucugaagcuccugccagc

SEQ ID NO: 748260 - RNA, 22 nt, Human
ucugcacuauuuaugcccagga

SEQ ID NO: 748261 - RNA, 20 nt, Human
ucugugccgggugcccgaag

SEQ ID NO: 748262 - RNA, 24 nt, Human
ucuucagccgccgggcccgggacg

SEQ ID NO: 748263 - RNA, 24 nt, Human
ugaaaaguaaaauguuaaaugaga

SEQ ID NO: 748264 - RNA, 21 nt, Human
ugaaacgcuggaaagccaugg

SEQ ID NO: 748265 - RNA, 18 nt, Human
ugaaagcccccucggucc

SEQ ID NO: 748266 - RNA, 27 nt, Human
ugaauggaucuccagcuggcgccagga

SEQ ID NO: 748267 - RNA, 20 nt, Human
ugacagggagcaccuggggc

SEQ ID NO: 748268 - RNA, 25 nt, Human
ugaccccucucugcgugcuuccccc

SEQ ID NO: 748269 - RNA, 25 nt, Human
ugacuggagcugcaguugacugcgg

SEQ ID NO: 748270 - RNA, 25 nt, Human
ugaggugacagggagcaccuggggc

SEQ ID NO: 748271 - RNA, 19 nt, Human
ugcaggaagcagugcggag

SEQ ID NO: 748272 - RNA, 18 nt, Human
ugcccagaaagucuuggu

SEQ ID NO: 748273 - RNA, 20 nt, Human
ugcccagaaagucuugguga

SEQ ID NO: 748274 - RNA, 20 nt, Human
ugccucaggaacccccacug

SEQ ID NO: 748275 - RNA, 23 nt, Human
ugcucacccacucacuucacaug

SEQ ID NO: 748276 - RNA, 18 nt, Human
ugcugggauaucaggugu

SEQ ID NO: 748277 - RNA, 24 nt, Human
uggagcugcaguugacugcgguug

SEQ ID NO: 748278 - RNA, 20 nt, Human
uggaggagcuuugaucucac

SEQ ID NO: 748279 - RNA, 26 nt, Human
uggaggguguggcuuuucuguuucau

SEQ ID NO: 748280 - RNA, 24 nt, Human
uggaucccacagccuucucugugu

SEQ ID NO: 748281 - RNA, 26 nt, Human
uggccccaacuucagagccuugauuu

SEQ ID NO: 748282 - RNA, 20 nt, Human
ugggaaccgcacaggacugu

SEQ ID NO: 748283 - RNA, 20 nt, Human
uggugaauggaucuccagcu

SEQ ID NO: 748284 - RNA, 22 nt, Human
uggugaauggaucuccagcugg

SEQ ID NO: 748285 - RNA, 23 nt, Human
uggugauaagcacgucacuuccu

SEQ ID NO: 748286 - RNA, 28 nt, Human
uguggaaaacguggaaaugauguggcca

SEQ ID NO: 748287 - RNA, 19 nt, Human
uguggacagcugucaucaa

SEQ ID NO: 748288 - RNA, 22 nt, Human
uguggccccaacuucagagccu

SEQ ID NO: 748289 - RNA, 26 nt, Human
uguguccacgcuuuguugugugugug

SEQ ID NO: 748290 - RNA, 21 nt, Human
uguguccugucugucaaggga

SEQ ID NO: 748291 - RNA, 19 nt, Human
ugugugugaaggggggaau

SEQ ID NO: 748292 - RNA, 28 nt, Human
uucaauuacccacugauuucuacagaga

SEQ ID NO: 748293 - RNA, 18 nt, Human
uucacaaguaaaaucaca

SEQ ID NO: 748294 - RNA, 18 nt, Human
uucacugccagggggaug

SEQ ID NO: 748295 - RNA, 20 nt, Human
uuccaguaacuuuuccucuu

SEQ ID NO: 748296 - RNA, 24 nt, Human
uuccccaaaagacaccacugccuu

SEQ ID NO: 748297 - RNA, 20 nt, Human
uuccucuuacaguaagaaaa

SEQ ID NO: 748298 - RNA, 24 nt, Human
uucucuguggcucccacuuguggg

SEQ ID NO: 748299 - RNA, 25 nt, Human
uugccaagcuauccccucaguucau

SEQ ID NO: 748300 - RNA, 21 nt, Human
uuucauuuucaaacacuaaac

SEQ ID NO: 748301 - RNA, 21 nt, Human
uuuccagccucacagcuuuuc

SEQ ID NO: 748302 - RNA, 25 nt, Human
uuucugcagccugggugaccaggug

SEQ ID NO: 748303 - RNA, 21 nt, Human
aaccaaacacccucucuuuca

SEQ ID NO: 748304 - RNA, 21 nt, Human
aaccucaccaccacagguuaa

SEQ ID NO: 748305 - RNA, 22 nt, Human
aagaacugcggcacuucaaaac

SEQ ID NO: 748306 - RNA, 22 nt, Human
aagaacuuuacuuucuuccacc

SEQ ID NO: 748307 - RNA, 18 nt, Human
aagauuccccgcugcuuc

SEQ ID NO: 748308 - RNA, 24 nt, Human
aagauuccccgcugcuucagcuuc

SEQ ID NO: 748309 - RNA, 20 nt, Human
aagcaggaacacaacaggga

SEQ ID NO: 748310 - RNA, 24 nt, Human
aagcaggaacacaacagggaaugc

SEQ ID NO: 748311 - RNA, 20 nt, Human
aagcuagcccuagauggcaa

SEQ ID NO: 748312 - RNA, 20 nt, Human
aaggagaagcaggaacacaa

SEQ ID NO: 748313 - RNA, 22 nt, Human
aaggagaagcaggaacacaaca

SEQ ID NO: 748314 - RNA, 24 nt, Human
aagucuauagauggaagagggggu

SEQ ID NO: 748315 - RNA, 21 nt, Human
aauccaacugguuccaaccuc

SEQ ID NO: 748316 - RNA, 21 nt, Human
acagaauggauguccugaaca

SEQ ID NO: 748317 - RNA, 20 nt, Human
acccacagaauggauguccu

SEQ ID NO: 748318 - RNA, 21 nt, Human
acgaugccauaucucucaaug

SEQ ID NO: 748319 - RNA, 22 nt, Human
acggggcuuuaccauccuucag

SEQ ID NO: 748320 - RNA, 19 nt, Human
acugccggguuccagcugu

SEQ ID NO: 748321 - RNA, 24 nt, Human
acuucaaguuaggucccacaucac

SEQ ID NO: 748322 - RNA, 20 nt, Human
agacaaaaaugacaaagucc

SEQ ID NO: 748323 - RNA, 21 nt, Human
agacaaaaaugacaaagucua

SEQ ID NO: 748324 - RNA, 24 nt, Human
agauuccccgcugcuucagcuucu

SEQ ID NO: 748325 - RNA, 19 nt, Human
agcuacugaaggagaagca

SEQ ID NO: 748326 - RNA, 24 nt, Human
agcugguagguaagcagaggguuu

SEQ ID NO: 748327 - RNA, 23 nt, Human
aucgaugugaacugcucucaauu

SEQ ID NO: 748328 - RNA, 21 nt, Human
aucuguugcugcugaaacugc

SEQ ID NO: 748329 - RNA, 21 nt, Human
caaauacuaagaagaaaggac

SEQ ID NO: 748330 - RNA, 19 nt, Human
caaguguguccugagacag

SEQ ID NO: 748331 - RNA, 22 nt, Human
caccagaaaggcgauagauucc

SEQ ID NO: 748332 - RNA, 25 nt, Human
caccuaaagaaguuuccuuaaguac

SEQ ID NO: 748333 - RNA, 21 nt, Human
cagcagcaguuuucuuggccc

SEQ ID NO: 748334 - RNA, 25 nt, Human
cagcagcaguuuucuuggcccuguu

SEQ ID NO: 748335 - RNA, 24 nt, Human
caucacugccggguuccagcuguu

SEQ ID NO: 748336 - RNA, 23 nt, Human
caucaggauacaacagcucugcc

SEQ ID NO: 748337 - RNA, 19 nt, Human
cccaggucacaaccaaaca

SEQ ID NO: 748338 - RNA, 19 nt, Human
ccccgcugcuucagcuucu

SEQ ID NO: 748339 - RNA, 22 nt, Human
cccugcagcagcaguuuucuug

SEQ ID NO: 748340 - RNA, 25 nt, Human
cuaccaggaaaucgaugugaacugc

SEQ ID NO: 748341 - RNA, 19 nt, Human
cugcgcaaguugugcagcu

SEQ ID NO: 748342 - RNA, 18 nt, Human
cugguguuuuaugaugac

SEQ ID NO: 748343 - RNA, 21 nt, Human
cuuuucuaaagacaaaaauga

SEQ ID NO: 748344 - RNA, 18 nt, Human
gagaaugaagugacaaca

SEQ ID NO: 748345 - RNA, 21 nt, Human
gaguucccggaaguacagcuu

SEQ ID NO: 748346 - RNA, 23 nt, Human
gauauuggaggcaacaccagaaa

SEQ ID NO: 748347 - RNA, 24 nt, Human
gaucuuuucuaaagacaaaaauga

SEQ ID NO: 748348 - RNA, 22 nt, Human
gauucaucaggauacaacagcu

SEQ ID NO: 748349 - RNA, 23 nt, Human
ggaacacaacagggaaugcagac

SEQ ID NO: 748350 - RNA, 22 nt, Human
ggacccccugcagcagcaguuu

SEQ ID NO: 748351 - RNA, 18 nt, Human
gggagcugcuggaugaca

SEQ ID NO: 748352 - RNA, 22 nt, Human
gguaaugaagcagggaagggga

SEQ ID NO: 748353 - RNA, 22 nt, Human
uagaacaguccacuguccagca

SEQ ID NO: 748354 - RNA, 18 nt, Human
uagaauuacaauucacca

SEQ ID NO: 748355 - RNA, 23 nt, Human
uccacuguccagcagaggcugcu

SEQ ID NO: 748356 - RNA, 22 nt, Human
ucccacaucacugccggguucc

SEQ ID NO: 748357 - RNA, 23 nt, Human
ucccccaggucacaaccaaacac

SEQ ID NO: 748358 - RNA, 26 nt, Human
ucccccaggucacaaccaaacacccu

SEQ ID NO: 748359 - RNA, 19 nt, Human
uccguacaagaguguagaa

SEQ ID NO: 748360 - RNA, 20 nt, Human
ucuguugcugcugaaacugc

SEQ ID NO: 748361 - RNA, 18 nt, Human
ugaaagaaaguugauaau

SEQ ID NO: 748362 - RNA, 22 nt, Human
ugagucuaaguggucugguguu

SEQ ID NO: 748363 - RNA, 21 nt, Human
ugcuucaacucuauugcucgc

SEQ ID NO: 748364 - RNA, 22 nt, Human
uggggggagcugcuggaugaca

SEQ ID NO: 748365 - RNA, 24 nt, Human
ugggguaagaagaaaaccugaagg

SEQ ID NO: 748366 - RNA, 23 nt, Human
ugguagguaagcagaggguuugg

SEQ ID NO: 748367 - RNA, 23 nt, Human
ugguuccaaccucaccaccacag

SEQ ID NO: 748368 - RNA, 19 nt, Human
uguagaaaauaaaucauaa

SEQ ID NO: 748369 - RNA, 18 nt, Human
ugugguggggggagcugc

SEQ ID NO: 748370 - RNA, 22 nt, Human
uguuuucaggacccccugcagc

SEQ ID NO: 748371 - RNA, 20 nt, Human
uucaagauuccccgcugcuu

SEQ ID NO: 748372 - RNA, 24 nt, Human
uucaagauuccccgcugcuucagg

SEQ ID NO: 748373 - RNA, 23 nt, Human
uuccaaccucaccaccacagguu

SEQ ID NO: 748374 - RNA, 25 nt, Human
uuuaagaucaauacuuaaaauuauu

SEQ ID NO: 748375 - RNA, 23 nt, Human
uuucaggacccccugcagcagca

SEQ ID NO: 748376 - RNA, 21 nt, Human
aaaaaaguggucacugccuuc

SEQ ID NO: 748377 - RNA, 21 nt, Human
aaaagcacauauguacaaaua

SEQ ID NO: 748378 - RNA, 24 nt, Human
aaacaaacaugguuaaacuaaaau

SEQ ID NO: 748379 - RNA, 23 nt, Human
aaacagucaguaaaagaaaaaac

SEQ ID NO: 748380 - RNA, 22 nt, Human
aacaaacaugguuaaacuaaaa

SEQ ID NO: 748381 - RNA, 22 nt, Human
aacauaaaaagguacaaaagga

SEQ ID NO: 748382 - RNA, 22 nt, Human
aagaaaaaacaaagauauaaaa

SEQ ID NO: 748383 - RNA, 26 nt, Human
aagcaaaagcuaguucaaaagggacc

SEQ ID NO: 748384 - RNA, 21 nt, Human
aagcaacagaaauauggagcu

SEQ ID NO: 748385 - RNA, 18 nt, Human
aagcuuugcaaccccuua

SEQ ID NO: 748386 - RNA, 25 nt, Human
aaguauucaguaaaaacgauacaac

SEQ ID NO: 748387 - RNA, 26 nt, Human
acaaagcuaaaaugcauauguuccuu

SEQ ID NO: 748388 - RNA, 18 nt, Human
acagcagucaaacagcaa

SEQ ID NO: 748389 - RNA, 28 nt, Human
accaacaaaacaaacaugguuaaacuaa

SEQ ID NO: 748390 - RNA, 21 nt, Human
agcaaaagcaaccuuaaagaa

SEQ ID NO: 748391 - RNA, 25 nt, Human
agcaaaagcaaccuuaaagaaguau

SEQ ID NO: 748392 - RNA, 19 nt, Human
agcuaccaacaaaacaaac

SEQ ID NO: 748393 - RNA, 23 nt, Human
agcuucccaacaaaagagggaaa

SEQ ID NO: 748394 - RNA, 20 nt, Human
aggaaaaggaaaucaaggaa

SEQ ID NO: 748395 - RNA, 20 nt, Human
aguaaaagaaaaaacaaaga

SEQ ID NO: 748396 - RNA, 23 nt, Human
aguaaaagaaaaaacaaagauau

SEQ ID NO: 748397 - RNA, 19 nt, Human
aguggagagucgugaggaa

SEQ ID NO: 748398 - RNA, 21 nt, Human
auacaaacacaugcauauaau

SEQ ID NO: 748399 - RNA, 24 nt, Human
auacaagcaucucacagcucaaag

SEQ ID NO: 748400 - RNA, 19 nt, Human
caaaagcaaaagcuaguuc

SEQ ID NO: 748401 - RNA, 21 nt, Human
caaaagcaaaagcuaguucaa

SEQ ID NO: 748402 - RNA, 20 nt, Human
caaacagcaaaagcaaccuu

SEQ ID NO: 748403 - RNA, 24 nt, Human
caaacaugguuaaacuaaaaugag

SEQ ID NO: 748404 - RNA, 20 nt, Human
caaauugcaccuugaaaaga

SEQ ID NO: 748405 - RNA, 32 nt, Human
caagagaaagacgacaggucagcuaagacaaa

SEQ ID NO: 748406 - RNA, 18 nt, Human
cacaugcauauaaucaua

SEQ ID NO: 748407 - RNA, 20 nt, Human
cagcuaagacaaacuccacu

SEQ ID NO: 748408 - RNA, 23 nt, Human
cagucccaagcuuugcaaccccu

SEQ ID NO: 748409 - RNA, 23 nt, Human
cauaaaauacaaacacaugcaua

SEQ ID NO: 748410 - RNA, 27 nt, Human
cauaaaauacaaacacaugcauauagu

SEQ ID NO: 748411 - RNA, 18 nt, Human
cauauauauguauauaua

SEQ ID NO: 748412 - RNA, 19 nt, Human
ccaagcacuagucaacaaa

SEQ ID NO: 748413 - RNA, 22 nt, Human
ccaagcacuagucaacaaaucu

SEQ ID NO: 748414 - RNA, 19 nt, Human
ccauacuucauuuaacauc

SEQ ID NO: 748415 - RNA, 22 nt, Human
ccuaucuagaccuaagaugcua

SEQ ID NO: 748416 - RNA, 24 nt, Human
cucacugccaaaauuuuuuuuaaa

SEQ ID NO: 748417 - RNA, 20 nt, Human
gaauucuaauccaggaagca

SEQ ID NO: 748418 - RNA, 23 nt, Human
gacaggucagcuaagacaaacuu

SEQ ID NO: 748419 - RNA, 22 nt, Human
ggcauaauuauaacaaucauac

SEQ ID NO: 748420 - RNA, 20 nt, Human
gggaccaaauaguggaauuc

SEQ ID NO: 748421 - RNA, 24 nt, Human
gucaaacagcaaaagcaaccuuaa

SEQ ID NO: 748422 - RNA, 19 nt, Human
gugguuacaaacacgaagu

SEQ ID NO: 748423 - RNA, 21 nt, Human
guuacaaacacgaaguguuau

SEQ ID NO: 748424 - RNA, 22 nt, Human
guuuuuuuuuuucuucacuuaa

SEQ ID NO: 748425 - RNA, 23 nt, Human
uaaaagaaaaaacaaagauauaa

SEQ ID NO: 748426 - RNA, 18 nt, Human
uaaaauaaggaccacugu

SEQ ID NO: 748427 - RNA, 23 nt, Human
uaaaauacaaacacaugcauaua

SEQ ID NO: 748428 - RNA, 23 nt, Human
uaaaugucuucucaucauacuuc

SEQ ID NO: 748429 - RNA, 23 nt, Human
uaaguuuuuuuuuuucuucacuu

SEQ ID NO: 748430 - RNA, 22 nt, Human
uaccauucagcagcaaccaaca

SEQ ID NO: 748431 - RNA, 18 nt, Human
uagaaaaccucuauaacc

SEQ ID NO: 748432 - RNA, 22 nt, Human
uaggaugugcacugacuuaaua

SEQ ID NO: 748433 - RNA, 24 nt, Human
uagggaccaaauaguggaauucua

SEQ ID NO: 748434 - RNA, 19 nt, Human
uauacaagcaucucacagc

SEQ ID NO: 748435 - RNA, 21 nt, Human
uauagaaaaccucuauaacca

SEQ ID NO: 748436 - RNA, 18 nt, Human
uauauauguauauauaua

SEQ ID NO: 748437 - RNA, 19 nt, Human
uauauauguauauauauau

SEQ ID NO: 748438 - RNA, 26 nt, Human
uauauguauauauauaugaauguggu

SEQ ID NO: 748439 - RNA, 25 nt, Human
uaucaagaaaggaagcgcaaaauuc

SEQ ID NO: 748440 - RNA, 22 nt, Human
uauggagcuucacauauauaug

SEQ ID NO: 748441 - RNA, 21 nt, Human
uauguauauauauaugaaugu

SEQ ID NO: 748442 - RNA, 21 nt, Human
uauguauauauauaugaaugu

SEQ ID NO: 748443 - RNA, 24 nt, Human
uauguuccuuuucucaauuaugaa

SEQ ID NO: 748444 - RNA, 19 nt, Human
uauugugcaacaugauauu

SEQ ID NO: 748445 - RNA, 21 nt, Human
ucaaagacauuuuuuccuagg

SEQ ID NO: 748446 - RNA, 23 nt, Human
ucuuuaucacuauuuaccacuuc

SEQ ID NO: 748447 - RNA, 21 nt, Human
ugacaauaucguauugguuuu

SEQ ID NO: 748448 - RNA, 22 nt, Human
ugacugcaaaacuugcaagaua

SEQ ID NO: 748449 - RNA, 21 nt, Human
ugagcuucccaacaaaagagg

SEQ ID NO: 748450 - RNA, 20 nt, Human
ugccuacacuaaaugucuuc

SEQ ID NO: 748451 - RNA, 19 nt, Human
ugccucauuaauacuucag

SEQ ID NO: 748452 - RNA, 22 nt, Human
ugccucauuaauacuucagcau

SEQ ID NO: 748453 - RNA, 24 nt, Human
ugcucgccugcuugaacuuuaauu

SEQ ID NO: 748454 - RNA, 23 nt, Human
uggaacucugaagcaaauugcac

SEQ ID NO: 748455 - RNA, 22 nt, Human
uggcuccaagagcaaauaacac

SEQ ID NO: 748456 - RNA, 20 nt, Human
uguaaacgggcaaagaaugc

SEQ ID NO: 748457 - RNA, 19 nt, Human
uguauauauauaugaaugu

SEQ ID NO: 748458 - RNA, 25 nt, Human
ugucaggguaguaagggauuuagcu

SEQ ID NO: 748459 - RNA, 24 nt, Human
uguuaggaugugcacugacuuaau

SEQ ID NO: 748460 - RNA, 22 nt, Human
uuaaagcaacagaaauauggag

SEQ ID NO: 748461 - RNA, 26 nt, Human
uucaagagaaagacgacaggucagcu

SEQ ID NO: 748462 - RNA, 22 nt, Human
uucaagauaaauucaacugcuc

SEQ ID NO: 748463 - RNA, 23 nt, Human
uucacauauauauguauauauau

SEQ ID NO: 748464 - RNA, 30 nt, Human
uucacuaaacauaaauauuuaacauauauu

SEQ ID NO: 748465 - RNA, 18 nt, Human
uucugacugcaaaacuug

SEQ ID NO: 748466 - RNA, 18 nt, Human
uugcaagauacaaagcua

SEQ ID NO: 748467 - RNA, 23 nt, Human
uuuacgaauguagacagcaguca

SEQ ID NO: 748468 - RNA, 22 nt, Human
uuuccagucccaagcuuugcaa

SEQ ID NO: 748469 - RNA, 20 nt, Human
uuuuuuuuuucuucacuuaa

SEQ ID NO: 748470 - RNA, 21 nt, Human
aaguaggaugggcagccuagg

SEQ ID NO: 748471 - RNA, 24 nt, Human
aaucguuugaacccgggaggcaga

SEQ ID NO: 748472 - RNA, 18 nt, Human
aauggcacucuugggggc

SEQ ID NO: 748473 - RNA, 19 nt, Human
aauggcacucuugggggcc

SEQ ID NO: 748474 - RNA, 22 nt, Human
aauggcacucuugggggccucc

SEQ ID NO: 748475 - RNA, 24 nt, Human
acagagugagacucuguauuaaaa

SEQ ID NO: 748476 - RNA, 18 nt, Human
acauaccuaggaacagga

SEQ ID NO: 748477 - RNA, 24 nt, Human
accaauauggugaaaugccgucuc

SEQ ID NO: 748478 - RNA, 24 nt, Human
accaggugcccccucugcucggcc

SEQ ID NO: 748479 - RNA, 20 nt, Human
accccgacucucgccccaac

SEQ ID NO: 748480 - RNA, 23 nt, Human
accuaggugacagagugagacuc

SEQ ID NO: 748481 - RNA, 19 nt, Human
accugagcucauuaggcgg

SEQ ID NO: 748482 - RNA, 21 nt, Human
acgggagccgcgggacgggcu

SEQ ID NO: 748483 - RNA, 24 nt, Human
acugcacuccaaccuaggugacag

SEQ ID NO: 748484 - RNA, 20 nt, Human
acuuaaaauacaaaaacuag

SEQ ID NO: 748485 - RNA, 24 nt, Human
acuuggggucaggaguucgagacc

SEQ ID NO: 748486 - RNA, 22 nt, Human
agaaucguuugaacccgggagg

SEQ ID NO: 748487 - RNA, 20 nt, Human
agacucgagcugagcuggua

SEQ ID NO: 748488 - RNA, 18 nt, Human
agagguugcagugagccg

SEQ ID NO: 748489 - RNA, 24 nt, Human
agagguugcagugagccgacauca

SEQ ID NO: 748490 - RNA, 18 nt, Human
agcacaggaacacaagga

SEQ ID NO: 748491 - RNA, 24 nt, Human
agccgcgggacgggcucagucgac

SEQ ID NO: 748492 - RNA, 26 nt, Human
aggaacacaaggaggccgcccugaac

SEQ ID NO: 748493 - RNA, 20 nt, Human
aggagcccagcccugaagac

SEQ ID NO: 748494 - RNA, 21 nt, Human
aggcagaggcgggcggaacac

SEQ ID NO: 748495 - RNA, 21 nt, Human
aggcagagguugcagugagcc

SEQ ID NO: 748496 - RNA, 22 nt, Human
aggcagagguugcagugagccg

SEQ ID NO: 748497 - RNA, 22 nt, Human
aggcaggcugucugcugucucu

SEQ ID NO: 748498 - RNA, 21 nt, Human
aggcagggauccugcccagca

SEQ ID NO: 748499 - RNA, 21 nt, Human
aggcgggcggaacacuugggg

SEQ ID NO: 748500 - RNA, 23 nt, Human
aggcgggcggaacacuugggguc

SEQ ID NO: 748501 - RNA, 23 nt, Human
aggcucuaaggcucgggccgaga

SEQ ID NO: 748502 - RNA, 24 nt, Human
agguagagccagggcaagugacuu

SEQ ID NO: 748503 - RNA, 24 nt, Human
aguagcucaggccuguaauucuag

SEQ ID NO: 748504 - RNA, 23 nt, Human
aguccgaccaggugcccccucug

SEQ ID NO: 748505 - RNA, 19 nt, Human
aucacaccacugcacucca

SEQ ID NO: 748506 - RNA, 20 nt, Human
auggugaaaugccgucucua

SEQ ID NO: 748507 - RNA, 18 nt, Human
auuaaaaaaaaaaaaaaa

SEQ ID NO: 748508 - RNA, 20 nt, Human
auuaaaaaaaaaaaaaaagu

SEQ ID NO: 748509 - RNA, 18 nt, Human
caaaaacuagcccggcgu

SEQ ID NO: 748510 - RNA, 20 nt, Human
caaagcaaaggacucuuccc

SEQ ID NO: 748511 - RNA, 24 nt, Human
caauauggugaaaugccgucucua

SEQ ID NO: 748512 - RNA, 21 nt, Human
cacaaggaggccgcccugaac

SEQ ID NO: 748513 - RNA, 19 nt, Human
cacaccugcaguuccagcu

SEQ ID NO: 748514 - RNA, 18 nt, Human
cacagaacccagcccaag

SEQ ID NO: 748515 - RNA, 20 nt, Human
cacagaacccagcccaagcc

SEQ ID NO: 748516 - RNA, 26 nt, Human
caccacugcacuccaaccuaggugac

SEQ ID NO: 748517 - RNA, 18 nt, Human
caccccacaccccauuac

SEQ ID NO: 748518 - RNA, 19 nt, Human
caccccauuacuucccagu

SEQ ID NO: 748519 - RNA, 22 nt, Human
caccugcaguuccagcuacuag

SEQ ID NO: 748520 - RNA, 23 nt, Human
caccugcaguuccagcuacuaga

SEQ ID NO: 748521 - RNA, 23 nt, Human
cacuccaaccuaggugacagagu

SEQ ID NO: 748522 - RNA, 19 nt, Human
cacuuggggucaggaguuc

SEQ ID NO: 748523 - RNA, 23 nt, Human
cacuuggggucaggaguucgaga

SEQ ID NO: 748524 - RNA, 23 nt, Human
cagaacccagcccaagccagggg

SEQ ID NO: 748525 - RNA, 19 nt, Human
cagccauggaggagguugg

SEQ ID NO: 748526 - RNA, 19 nt, Human
cagccauggaggagguugg

SEQ ID NO: 748527 - RNA, 26 nt, Human
cagccuaggagcccagcccugaagac

SEQ ID NO: 748528 - RNA, 24 nt, Human
caggccuguaauucuagcacuaug

SEQ ID NO: 748529 - RNA, 19 nt, Human
cauggaggacccaccuucc

SEQ ID NO: 748530 - RNA, 23 nt, Human
cauuacuucccagugcuucccau

SEQ ID NO: 748531 - RNA, 19 nt, Human
ccaccccgacucucgcccc

SEQ ID NO: 748532 - RNA, 20 nt, Human
ccacugcacuccaaccuagg

SEQ ID NO: 748533 - RNA, 24 nt, Human
ccacugcacuccaaccuaggugac

SEQ ID NO: 748534 - RNA, 25 nt, Human
ccacugcacuccaaccuaggugaca

SEQ ID NO: 748535 - RNA, 20 nt, Human
ccagggguggccugugggac

SEQ ID NO: 748536 - RNA, 19 nt, Human
cccacaccccauuacuucc

SEQ ID NO: 748537 - RNA, 21 nt, Human
cccaccuucccaagagggcug

SEQ ID NO: 748538 - RNA, 24 nt, Human
ccccacaccccauuacuucccagu

SEQ ID NO: 748539 - RNA, 24 nt, Human
ccccaccccgacucucgccccaac

SEQ ID NO: 748540 - RNA, 23 nt, Human
ccccauggaggacccaccuuccc

SEQ ID NO: 748541 - RNA, 19 nt, Human
cccccauggaggacccacc

SEQ ID NO: 748542 - RNA, 18 nt, Human
ccccgagucacugggccc

SEQ ID NO: 748543 - RNA, 19 nt, Human
ccccggggggcaccugggg

SEQ ID NO: 748544 - RNA, 21 nt, Human
cccgccccgcgccgucgagaa

SEQ ID NO: 748545 - RNA, 19 nt, Human
cccugaauccccggggggc

SEQ ID NO: 748546 - RNA, 18 nt, Human
ccgcaaggggccaagcgc

SEQ ID NO: 748547 - RNA, 19 nt, Human
ccgcgcccgcagggcccgc

SEQ ID NO: 748548 - RNA, 23 nt, Human
ccugaccaauauggugaaaugcc

SEQ ID NO: 748549 - RNA, 24 nt, Human
ccugaccaauauggugaaaugccg

SEQ ID NO: 748550 - RNA, 25 nt, Human
ccugcaguuccagcuacuagagugg

SEQ ID NO: 748551 - RNA, 21 nt, Human
cgacaucacaccacugcacuc

SEQ ID NO: 748552 - RNA, 20 nt, Human
cgagaagggcccgccuggcg

SEQ ID NO: 748553 - RNA, 18 nt, Human
cgagaccagccugaccaa

SEQ ID NO: 748554 - RNA, 21 nt, Human
cgcaaggggccaagcgcagua

SEQ ID NO: 748555 - RNA, 24 nt, Human
cggaacacuuggggucaggaguuc

SEQ ID NO: 748556 - RNA, 20 nt, Human
cggccuccgcguccccagcc

SEQ ID NO: 748557 - RNA, 19 nt, Human
cggcggugcagcugcuggc

SEQ ID NO: 748558 - RNA, 21 nt, Human
cggcuccgugcucucugcccg

SEQ ID NO: 748559 - RNA, 24 nt, Human
cgggaggcagagguugcagugagc

SEQ ID NO: 748560 - RNA, 19 nt, Human
cuacuagaguggcuggggc

SEQ ID NO: 748561 - RNA, 21 nt, Human
cuagaccugagcucauuaggc

SEQ ID NO: 748562 - RNA, 23 nt, Human
cucaggccuguaauucuagcacu

SEQ ID NO: 748563 - RNA, 21 nt, Human
cucggccuccgcguccccagc

SEQ ID NO: 748564 - RNA, 22 nt, Human
cucgggccgagacugccaaagc

SEQ ID NO: 748565 - RNA, 22 nt, Human
cucucgccccaacccugagaac

SEQ ID NO: 748566 - RNA, 24 nt, Human
cucuguauuaaaaaaaaaaaaaaa

SEQ ID NO: 748567 - RNA, 19 nt, Human
cugcuggcagucggcgugg

SEQ ID NO: 748568 - RNA, 24 nt, Human
cuguauuaaaaaaaaaaaaaaagu

SEQ ID NO: 748569 - RNA, 22 nt, Human
cuuaaaauacaaaaacuagccc

SEQ ID NO: 748570 - RNA, 23 nt, Human
cuugggggccucccucugcucag

SEQ ID NO: 748571 - RNA, 18 nt, Human
gaacacuuggggucagga

SEQ ID NO: 748572 - RNA, 24 nt, Human
gaacacuuggggucaggaguucga

SEQ ID NO: 748573 - RNA, 21 nt, Human
gaacaggaccagggucuccuc

SEQ ID NO: 748574 - RNA, 23 nt, Human
gaaccacuucaagguagagccag

SEQ ID NO: 748575 - RNA, 20 nt, Human
gaacugggcagauucagccc

SEQ ID NO: 748576 - RNA, 18 nt, Human
gaagggacccccauggag

SEQ ID NO: 748577 - RNA, 20 nt, Human
gaagguggggaagucugggg

SEQ ID NO: 748578 - RNA, 18 nt, Human
gaggggcugccugggcag

SEQ ID NO: 748579 - RNA, 22 nt, Human
gcaaaggacucuucccagugga

SEQ ID NO: 748580 - RNA, 21 nt, Human
gcagcggacaggccaaguaga

SEQ ID NO: 748581 - RNA, 19 nt, Human
gcaggugccggcacgcccc

SEQ ID NO: 748582 - RNA, 18 nt, Human
gcagucggcguggugaca

SEQ ID NO: 748583 - RNA, 19 nt, Human
gccccgagucacugggccc

SEQ ID NO: 748584 - RNA, 18 nt, Human
gcgcccaggggcuucccg

SEQ ID NO: 748585 - RNA, 22 nt, Human
gcucucugcccgucgugguucc

SEQ ID NO: 748586 - RNA, 23 nt, Human
ggaacacuuggggucaggaguuc

SEQ ID NO: 748587 - RNA, 19 nt, Human
ggacugggaaggugggggc

SEQ ID NO: 748588 - RNA, 22 nt, Human
ggaggccagugaggguagaagu

SEQ ID NO: 748589 - RNA, 21 nt, Human
ggaguaggugacgaggggcug

SEQ ID NO: 748590 - RNA, 22 nt, Human
ggaguaggugacgaggggcugc

SEQ ID NO: 748591 - RNA, 23 nt, Human
ggagugaaucccacuggaggcca

SEQ ID NO: 748592 - RNA, 22 nt, Human
ggcaaagcgcaaaucgggcccg

SEQ ID NO: 748593 - RNA, 21 nt, Human
ggcaaguggaggagcacagga

SEQ ID NO: 748594 - RNA, 23 nt, Human
ggcaggagaaucguuugaacccg

SEQ ID NO: 748595 - RNA, 18 nt, Human
ggcccgccccgcgccguc

SEQ ID NO: 748596 - RNA, 24 nt, Human
ggccuguaauucuagcacuauggg

SEQ ID NO: 748597 - RNA, 24 nt, Human
ggcgggcggggggaggcggggccg

SEQ ID NO: 748598 - RNA, 18 nt, Human
ggcggugcagcugcuggc

SEQ ID NO: 748599 - RNA, 20 nt, Human
ggcuccgugcucucugcccg

SEQ ID NO: 748600 - RNA, 21 nt, Human
gggaaggugggggcagggcag

SEQ ID NO: 748601 - RNA, 20 nt, Human
gggcagccuaggagcccagc

SEQ ID NO: 748602 - RNA, 19 nt, Human
gggcggggggaggcggggc

SEQ ID NO: 748603 - RNA, 19 nt, Human
ggggacgggagccgcggga

SEQ ID NO: 748604 - RNA, 20 nt, Human
ggggagaggcucugauggug

SEQ ID NO: 748605 - RNA, 22 nt, Human
gguagagccagggcaagugacu

SEQ ID NO: 748606 - RNA, 24 nt, Human
ggugacauaccuaggaacaggacc

SEQ ID NO: 748607 - RNA, 19 nt, Human
gguggcugaagguggggaa

SEQ ID NO: 748608 - RNA, 21 nt, Human
gguggcugaagguggggaagu

SEQ ID NO: 748609 - RNA, 18 nt, Human
ggugguacuguggccugg

SEQ ID NO: 748610 - RNA, 24 nt, Human
gguggugcacaccugcaguuccag

SEQ ID NO: 748611 - RNA, 19 nt, Human
uaacuucacagaacccagc

SEQ ID NO: 748612 - RNA, 21 nt, Human
uaaggcucuaaggcucgggcc

SEQ ID NO: 748613 - RNA, 20 nt, Human
uacaaaaacuagcccggcgu

SEQ ID NO: 748614 - RNA, 21 nt, Human
uaccuaggaacaggaccaggg

SEQ ID NO: 748615 - RNA, 19 nt, Human
uacuagaguggcuggggca

SEQ ID NO: 748616 - RNA, 22 nt, Human
uagcacuaugggaggcagaggc

SEQ ID NO: 748617 - RNA, 24 nt, Human
uagcacuaugggaggcagaggcgg

SEQ ID NO: 748618 - RNA, 22 nt, Human
uagcccuccgacgggcgcccag

SEQ ID NO: 748619 - RNA, 24 nt, Human
uagcucaggccuguaauucuagca

SEQ ID NO: 748620 - RNA, 23 nt, Human
uaggaugggcagccuaggagccc

SEQ ID NO: 748621 - RNA, 20 nt, Human
uaggcagggauccugcccag

SEQ ID NO: 748622 - RNA, 21 nt, Human
uaggugacagagugagacucu

SEQ ID NO: 748623 - RNA, 25 nt, Human
ucaauggcacucuugggggccuccc

SEQ ID NO: 748624 - RNA, 27 nt, Human
ucacugggccccaaagcaaaggacucc

SEQ ID NO: 748625 - RNA, 24 nt, Human
uccaaccuaggugacagagugaga

SEQ ID NO: 748626 - RNA, 28 nt, Human
uccacuccauccaguccggcaaagcgca

SEQ ID NO: 748627 - RNA, 22 nt, Human
uccccaccccgacucucgcccc

SEQ ID NO: 748628 - RNA, 22 nt, Human
uccgaccaggugcccccucugc

SEQ ID NO: 748629 - RNA, 23 nt, Human
uccguggcaaguggaggagcaca

SEQ ID NO: 748630 - RNA, 18 nt, Human
uccuccacuccauccagu

SEQ ID NO: 748631 - RNA, 18 nt, Human
ucguuugaacccgggagg

SEQ ID NO: 748632 - RNA, 21 nt, Human
ucucugcccgucgugguuccg

SEQ ID NO: 748633 - RNA, 20 nt, Human
ucugaugguggcugaaggug

SEQ ID NO: 748634 - RNA, 21 nt, Human
ucugaugguggcugaaggugg

SEQ ID NO: 748635 - RNA, 23 nt, Human
ucuguauuaaaaaaaaaaaaaaa

SEQ ID NO: 748636 - RNA, 23 nt, Human
ugaaaugccgucucuacuuaaaa

SEQ ID NO: 748637 - RNA, 22 nt, Human
ugacgaggggcugccugggcag

SEQ ID NO: 748638 - RNA, 19 nt, Human
ugacuucucucucggccuc

SEQ ID NO: 748639 - RNA, 18 nt, Human
ugccaaagccucaugggg

SEQ ID NO: 748640 - RNA, 18 nt, Human
ugcccccucugcucggcc

SEQ ID NO: 748641 - RNA, 20 nt, Human
ugccugggcagguggggugg

SEQ ID NO: 748642 - RNA, 23 nt, Human
uggaggacccaccuucccaagag

SEQ ID NO: 748643 - RNA, 18 nt, Human
uggaggagcacaggaaca

SEQ ID NO: 748644 - RNA, 23 nt, Human
uggcaagcuccauccguggccca

SEQ ID NO: 748645 - RNA, 24 nt, Human
uggcaagcuccauccguggcccau

SEQ ID NO: 748646 - RNA, 21 nt, Human
uggccugagugugggaacugg

SEQ ID NO: 748647 - RNA, 24 nt, Human
uggccugugggacugggaaggugg

SEQ ID NO: 748648 - RNA, 24 nt, Human
uggcuggggcaggagaaucguuug

SEQ ID NO: 748649 - RNA, 21 nt, Human
ugggacugggaaggugggggc

SEQ ID NO: 748650 - RNA, 18 nt, Human
ugggaggcagaggcgggc

SEQ ID NO: 748651 - RNA, 19 nt, Human
ugggaggcagaggcgggcg

SEQ ID NO: 748652 - RNA, 21 nt, Human
ugggccuccuccacuccaucc

SEQ ID NO: 748653 - RNA, 24 nt, Human
uggggcaggagaaucguuugaacc

SEQ ID NO: 748654 - RNA, 18 nt, Human
uggggcgcgcggggagag

SEQ ID NO: 748655 - RNA, 19 nt, Human
ugggggccucccucugcuc

SEQ ID NO: 748656 - RNA, 20 nt, Human
uggucaauggcacucuuggg

SEQ ID NO: 748657 - RNA, 19 nt, Human
uggugcacaccugcaguuc

SEQ ID NO: 748658 - RNA, 19 nt, Human
ugucacaggccucgcagag

SEQ ID NO: 748659 - RNA, 22 nt, Human
aaaaacagugacauaaggagca

SEQ ID NO: 748660 - RNA, 21 nt, Human
aaaaccaaaggggaaaagggu

SEQ ID NO: 748661 - RNA, 24 nt, Human
aaacaaaaagccugcuuugccagu

SEQ ID NO: 748662 - RNA, 23 nt, Human
aaaccaaugugauaacauagaac

SEQ ID NO: 748663 - RNA, 18 nt, Human
aaacccacgccacagcag

SEQ ID NO: 748664 - RNA, 24 nt, Human
aaagaaaggcaguaugguacacua

SEQ ID NO: 748665 - RNA, 21 nt, Human
aaagguacaggaaaaccaaug

SEQ ID NO: 748666 - RNA, 19 nt, Human
aaauacgguagugacacuu

SEQ ID NO: 748667 - RNA, 24 nt, Human
aaaucugccuaauuuaacacugcc

SEQ ID NO: 748668 - RNA, 18 nt, Human
aaccagaaggugagagug

SEQ ID NO: 748669 - RNA, 21 nt, Human
aaccagaaggugagagugagu

SEQ ID NO: 748670 - RNA, 18 nt, Human
aagagaaagcagauggaa

SEQ ID NO: 748671 - RNA, 18 nt, Human
aagagaaagcagauggaa

SEQ ID NO: 748672 - RNA, 18 nt, Human
aagcaaaaagcaggccug

SEQ ID NO: 748673 - RNA, 22 nt, Human
aagcaguccaaggcccaaaaaa

SEQ ID NO: 748674 - RNA, 23 nt, Human
aagcccaggaaggcagcugggau

SEQ ID NO: 748675 - RNA, 23 nt, Human
aaggaaaaucuuccuccaagcau

SEQ ID NO: 748676 - RNA, 20 nt, Human
aaggaggcuggagaucuucc

SEQ ID NO: 748677 - RNA, 22 nt, Human
aaggcccagaggaagaauggca

SEQ ID NO: 748678 - RNA, 18 nt, Human
aagguacaggaaaaccaa

SEQ ID NO: 748679 - RNA, 23 nt, Human
aagucagacuagugggagaggga

SEQ ID NO: 748680 - RNA, 20 nt, Human
aauaucaaguaagacaacag

SEQ ID NO: 748681 - RNA, 24 nt, Human
aauuuugucauaggcugaaacaga

SEQ ID NO: 748682 - RNA, 20 nt, Human
acacagaugcugcacauccc

SEQ ID NO: 748683 - RNA, 21 nt, Human
acacagaugcugcacaucccc

SEQ ID NO: 748684 - RNA, 19 nt, Human
acagaugcugcacaucccc

SEQ ID NO: 748685 - RNA, 25 nt, Human
acagccagcauaaaguaugaagccc

SEQ ID NO: 748686 - RNA, 22 nt, Human
accuacaaaaugcuacccuaga

SEQ ID NO: 748687 - RNA, 25 nt, Human
acuaagcuggaagggacugcguucc

SEQ ID NO: 748688 - RNA, 18 nt, Human
acugcguuccagccuugc

SEQ ID NO: 748689 - RNA, 18 nt, Human
acugcguuccagccuugc

SEQ ID NO: 748690 - RNA, 23 nt, Human
acugcguuccagccuugcuuugg

SEQ ID NO: 748691 - RNA, 20 nt, Human
acuuuugucauguucagagu

SEQ ID NO: 748692 - RNA, 21 nt, Human
agaaaagcaugaaggcccaga

SEQ ID NO: 748693 - RNA, 23 nt, Human
agaaagcagauggaagacugcau

SEQ ID NO: 748694 - RNA, 23 nt, Human
agaaagcagauggaagagggacc

SEQ ID NO: 748695 - RNA, 22 nt, Human
agaaaggcaguaugguacacua

SEQ ID NO: 748696 - RNA, 21 nt, Human
agacaaaaguacuaaaugauc

SEQ ID NO: 748697 - RNA, 24 nt, Human
agaccuccuaaacccucagguagc

SEQ ID NO: 748698 - RNA, 18 nt, Human
agaggggaggaggaggga

SEQ ID NO: 748699 - RNA, 18 nt, Human
agaggggaggaggaggga

SEQ ID NO: 748700 - RNA, 18 nt, Human
agagugggugcaggcggg

SEQ ID NO: 748701 - RNA, 21 nt, Human
agcaaaaagcaggccuguaaa

SEQ ID NO: 748702 - RNA, 19 nt, Human
agcaggcucauuccugcuc

SEQ ID NO: 748703 - RNA, 22 nt, Human
aggaaaugcagaagcugagaaa

SEQ ID NO: 748704 - RNA, 21 nt, Human
aggagaagagugaccuacaaa

SEQ ID NO: 748705 - RNA, 21 nt, Human
aggagucagaaagacuaagcu

SEQ ID NO: 748706 - RNA, 24 nt, Human
aggcagacaaugguggccuaagca

SEQ ID NO: 748707 - RNA, 20 nt, Human
aggcagcugggauccaguug

SEQ ID NO: 748708 - RNA, 22 nt, Human
aggcucauuccugcucuggacu

SEQ ID NO: 748709 - RNA, 18 nt, Human
agggagaggggaggagga

SEQ ID NO: 748710 - RNA, 22 nt, Human
agggaugggagggagaggggga

SEQ ID NO: 748711 - RNA, 21 nt, Human
aggggccuccccucccacccc

SEQ ID NO: 748712 - RNA, 21 nt, Human
agggggagggagaggggagga

SEQ ID NO: 748713 - RNA, 20 nt, Human
augcacuugaaacauguuaa

SEQ ID NO: 748714 - RNA, 21 nt, Human
caaaaagcaggccuguaaaca

SEQ ID NO: 748715 - RNA, 20 nt, Human
caaaaugcuacccuagaagc

SEQ ID NO: 748716 - RNA, 21 nt, Human
caagaaauacgguagugacac

SEQ ID NO: 748717 - RNA, 20 nt, Human
caagcccaggaaggcagcug

SEQ ID NO: 748718 - RNA, 22 nt, Human
caagcccaggaaggcagcuggg

SEQ ID NO: 748719 - RNA, 23 nt, Human
caaggcccaaaaaagaauuucca

SEQ ID NO: 748720 - RNA, 20 nt, Human
cacaagcccaggaaggcagc

SEQ ID NO: 748721 - RNA, 21 nt, Human
cacaaugcagaaaagcaugaa

SEQ ID NO: 748722 - RNA, 21 nt, Human
cacacagaugcugcacauccc

SEQ ID NO: 748723 - RNA, 21 nt, Human
cacugcuuaggaacauaaaug

SEQ ID NO: 748724 - RNA, 25 nt, Human
cagaaacaaaauaguacaaaggaga

SEQ ID NO: 748725 - RNA, 18 nt, Human
cagauggaagacugcaug

SEQ ID NO: 748726 - RNA, 23 nt, Human
cagguucuuuccugugagccuuu

SEQ ID NO: 748727 - RNA, 22 nt, Human
ccaaacccacgccacagcaggc

SEQ ID NO: 748728 - RNA, 21 nt, Human
ccaacucuggcaacuuuuguc

SEQ ID NO: 748729 - RNA, 22 nt, Human
ccacacagaugcugcacauccc

SEQ ID NO: 748730 - RNA, 24 nt, Human
ccacacagaugcugcacauccccu

SEQ ID NO: 748731 - RNA, 26 nt, Human
ccacuguguguguucagaccuccuuc

SEQ ID NO: 748732 - RNA, 18 nt, Human
ccccucccaccccugauc

SEQ ID NO: 748733 - RNA, 19 nt, Human
ccccucccaccccugaucc

SEQ ID NO: 748734 - RNA, 24 nt, Human
ccccucccaccccugauccugcag

SEQ ID NO: 748735 - RNA, 23 nt, Human
cccugggagcuacgucuacagau

SEQ ID NO: 748736 - RNA, 23 nt, Human
ccuagaagcaguccaaggcccaa

SEQ ID NO: 748737 - RNA, 18 nt, Human
ccucaaugccccaacucu

SEQ ID NO: 748738 - RNA, 18 nt, Human
ccucaggggccuccccuc

SEQ ID NO: 748739 - RNA, 24 nt, Human
ccucagucacgccuagcagucacc

SEQ ID NO: 748740 - RNA, 21 nt, Human
ccuggagagcaccucaggggc

SEQ ID NO: 748741 - RNA, 22 nt, Human
ccugugagccuuuccaaaccca

SEQ ID NO: 748742 - RNA, 19 nt, Human
cuaaagaaguugcucacau

SEQ ID NO: 748743 - RNA, 19 nt, Human
cuagauuaaccucuccacu

SEQ ID NO: 748744 - RNA, 21 nt, Human
cucaccagcagcuggucauga

SEQ ID NO: 748745 - RNA, 21 nt, Human
cucuggacuuuuacucaguuu

SEQ ID NO: 748746 - RNA, 18 nt, Human
cugaauucuucauacugc

SEQ ID NO: 748747 - RNA, 22 nt, Human
cuguguguguucagaccuccuu

SEQ ID NO: 748748 - RNA, 21 nt, Human
cuucaaaaccaaaggggaaaa

SEQ ID NO: 748749 - RNA, 21 nt, Human
cuucauacucaccagcagcug

SEQ ID NO: 748750 - RNA, 18 nt, Human
cuucccuggagagcaccu

SEQ ID NO: 748751 - RNA, 19 nt, Human
cuugcagugguaauaccca

SEQ ID NO: 748752 - RNA, 21 nt, Human
gaagcaguccaaggcccaaaa

SEQ ID NO: 748753 - RNA, 19 nt, Human
gaaggccaugcacuugaaa

SEQ ID NO: 748754 - RNA, 19 nt, Human
gaccuacaaaaugcuaccc

SEQ ID NO: 748755 - RNA, 18 nt, Human
gagcagggaaggaaaugc

SEQ ID NO: 748756 - RNA, 21 nt, Human
gaggaauaagggcaauaagag

SEQ ID NO: 748757 - RNA, 20 nt, Human
gaguaaccaaagguacagga

SEQ ID NO: 748758 - RNA, 21 nt, Human
gagugaaagggaagaaaaggg

SEQ ID NO: 748759 - RNA, 23 nt, Human
gagugaccuacaaaaugcuaccc

SEQ ID NO: 748760 - RNA, 22 nt, Human
gcaaaaagcaggccuguaaaca

SEQ ID NO: 748761 - RNA, 22 nt, Human
gccuccccucccaccccugauc

SEQ ID NO: 748762 - RNA, 20 nt, Human
ggaagggacugcguuccagc

SEQ ID NO: 748763 - RNA, 24 nt, Human
ggacugcguuccagccuugcuuug

SEQ ID NO: 748764 - RNA, 18 nt, Human
ggagaagagugaccuaca

SEQ ID NO: 748765 - RNA, 19 nt, Human
ggagagggggagggagagg

SEQ ID NO: 748766 - RNA, 22 nt, Human
ggagggagaggggaggaggagg

SEQ ID NO: 748767 - RNA, 23 nt, Human
ggagggagaggggaggaggaggg

SEQ ID NO: 748768 - RNA, 22 nt, Human
gggagaagagcauggucacaga

SEQ ID NO: 748769 - RNA, 20 nt, Human
gggccuccccucccaccccu

SEQ ID NO: 748770 - RNA, 18 nt, Human
gggggagggagaggggag

SEQ ID NO: 748771 - RNA, 22 nt, Human
gggugcaggcggggaaaagagg

SEQ ID NO: 748772 - RNA, 22 nt, Human
guacacuauaucuauaguauca

SEQ ID NO: 748773 - RNA, 23 nt, Human
gugaaaauccacacagaugcugc

SEQ ID NO: 748774 - RNA, 22 nt, Human
guguugcugugagcucccuggg

SEQ ID NO: 748775 - RNA, 23 nt, Human
uaaaaacucaagaaauacacagg

SEQ ID NO: 748776 - RNA, 21 nt, Human
uaaacaaaaagccugcuuugc

SEQ ID NO: 748777 - RNA, 21 nt, Human
uaagaauagagccauauauga

SEQ ID NO: 748778 - RNA, 26 nt, Human
uaagcaaaaagcaggccuguaaacau

SEQ ID NO: 748779 - RNA, 23 nt, Human
uaagcuggaagggacugcguucc

SEQ ID NO: 748780 - RNA, 24 nt, Human
uacaaaggagaagagugaccuaca

SEQ ID NO: 748781 - RNA, 22 nt, Human
uagaagcaguccaaggcccaaa

SEQ ID NO: 748782 - RNA, 18 nt, Human
uagauuaaccucuccacu

SEQ ID NO: 748783 - RNA, 21 nt, Human
uaggagcagggaaggaaaugc

SEQ ID NO: 748784 - RNA, 24 nt, Human
uaggauggagacccaagggacauc

SEQ ID NO: 748785 - RNA, 24 nt, Human
uagggcaagaaauaucaaguaaga

SEQ ID NO: 748786 - RNA, 20 nt, Human
uagguccaagaggagguggu

SEQ ID NO: 748787 - RNA, 23 nt, Human
uauuuaaaccccagccccucuuc

SEQ ID NO: 748788 - RNA, 24 nt, Human
ucaaaaacagugacauaaggagca

SEQ ID NO: 748789 - RNA, 24 nt, Human
ucaggggccuccccucccaccccu

SEQ ID NO: 748790 - RNA, 21 nt, Human
ucaugacguagaguaaccaaa

SEQ ID NO: 748791 - RNA, 18 nt, Human
ucauguucagagugggug

SEQ ID NO: 748792 - RNA, 19 nt, Human
uccuaaacccucagguagc

SEQ ID NO: 748793 - RNA, 22 nt, Human
ugaaaauccacacagaugcugc

SEQ ID NO: 748794 - RNA, 23 nt, Human
ugaacacaaucagggaaagagca

SEQ ID NO: 748795 - RNA, 24 nt, Human
ugaacacaaucagggaaagagcaa

SEQ ID NO: 748796 - RNA, 18 nt, Human
ugaagagaaagcagaugg

SEQ ID NO: 748797 - RNA, 19 nt, Human
ugagagaaaacaucgacuu

SEQ ID NO: 748798 - RNA, 23 nt, Human
ugagccuuuccaaacccacgcca

SEQ ID NO: 748799 - RNA, 18 nt, Human
ugaggcagacaauggugg

SEQ ID NO: 748800 - RNA, 21 nt, Human
ugaggcagacaaugguggccc

SEQ ID NO: 748801 - RNA, 23 nt, Human
ugaggcagacaaugguggccucc

SEQ ID NO: 748802 - RNA, 18 nt, Human
ugagggccaagaaagcca

SEQ ID NO: 748803 - RNA, 22 nt, Human
ugccuaaagaaguugcucacau

SEQ ID NO: 748804 - RNA, 21 nt, Human
ugcuuugccaguuuuguuuuc

SEQ ID NO: 748805 - RNA, 22 nt, Human
uggaagaagucagacuaguggg

SEQ ID NO: 748806 - RNA, 21 nt, Human
uggaagggacugcguuccagc

SEQ ID NO: 748807 - RNA, 21 nt, Human
uggagacccaagggacaucag

SEQ ID NO: 748808 - RNA, 22 nt, Human
uggauggcacaagcccaggaag

SEQ ID NO: 748809 - RNA, 22 nt, Human
ugggagaagacaaaaguacuaa

SEQ ID NO: 748810 - RNA, 20 nt, Human
ugggagaagagcauggucac

SEQ ID NO: 748811 - RNA, 18 nt, Human
ugggguggaggaauaagg

SEQ ID NO: 748812 - RNA, 22 nt, Human
ugguagaauggaugggguaaaa

SEQ ID NO: 748813 - RNA, 25 nt, Human
uguaaacaucaauuuugucauaggc

SEQ ID NO: 748814 - RNA, 23 nt, Human
ugucaaaaucugccuaauuuaac

SEQ ID NO: 748815 - RNA, 20 nt, Human
ugucauaggcugaaacagag

SEQ ID NO: 748816 - RNA, 24 nt, Human
ugugaaaauguaucaagauucuuu

SEQ ID NO: 748817 - RNA, 20 nt, Human
ugugguacagaaccacuuaa

SEQ ID NO: 748818 - RNA, 21 nt, Human
uucaagcacaugggagaagac

SEQ ID NO: 748819 - RNA, 24 nt, Human
uucaagcacaugggagaagacaaa

SEQ ID NO: 748820 - RNA, 24 nt, Human
uucuuuccugugagccuuuccaaa

SEQ ID NO: 748821 - RNA, 23 nt, Human
uugcucacauuaaggaugguuug

SEQ ID NO: 748822 - RNA, 19 nt, Human
uugcuuugggcucugucac

SEQ ID NO: 748823 - RNA, 19 nt, Human
uugguauuuuugcacaugu

SEQ ID NO: 748824 - RNA, 18 nt, Human
uuugaaacuuucagaccu

SEQ ID NO: 748825 - RNA, 19 nt, Human
uuugagguuauuuucacaa

SEQ ID NO: 748826 - RNA, 22 nt, Human
aaaaacaaauaagcaaaacuua

SEQ ID NO: 748827 - RNA, 22 nt, Human
aaagcaccauuuauauacugcc

SEQ ID NO: 748828 - RNA, 20 nt, Human
aagcacaaaaacaaauaagc

SEQ ID NO: 748829 - RNA, 21 nt, Human
accaagaauuaagccuauaaa

SEQ ID NO: 748830 - RNA, 20 nt, Human
agcacuggacaaacugaagc

SEQ ID NO: 748831 - RNA, 25 nt, Human
caaaaacaaauaagcaaaacuuaua

SEQ ID NO: 748832 - RNA, 21 nt, Human
caccauaucauacacaguaaa

SEQ ID NO: 748833 - RNA, 20 nt, Human
cagcauggggguugggggug

SEQ ID NO: 748834 - RNA, 21 nt, Human
caucuggaguucugccugacc

SEQ ID NO: 748835 - RNA, 26 nt, Human
ccacuaaagugaacucuuaauuacau

SEQ ID NO: 748836 - RNA, 20 nt, Human
ccuauaaaucuaucuugcca

SEQ ID NO: 748837 - RNA, 19 nt, Human
gcaaguuuuuuucaucugg

SEQ ID NO: 748838 - RNA, 18 nt, Human
ggggugagggacuuaaaa

SEQ ID NO: 748839 - RNA, 18 nt, Human
uacagggcuaggcaaccc

SEQ ID NO: 748840 - RNA, 18 nt, Human
uauacaaacagcaugggg

SEQ ID NO: 748841 - RNA, 22 nt, Human
uauacugccaggccacagcuaa

SEQ ID NO: 748842 - RNA, 23 nt, Human
uauacugccaggccacagcuaaa

SEQ ID NO: 748843 - RNA, 24 nt, Human
ugaagcacaaaaacaaauaagcaa

SEQ ID NO: 748844 - RNA, 19 nt, Human
ugaccaagaauuaagccua

SEQ ID NO: 748845 - RNA, 20 nt, Human
ugccugaccaagaauuaagc

SEQ ID NO: 748846 - RNA, 21 nt, Human
ugccugaccaagaauuaagcc

SEQ ID NO: 748847 - RNA, 24 nt, Human
uucuucccagacagccauauuaaa

SEQ ID NO: 748848 - RNA, 19 nt, Human
aaaccccaguuuuagaucc

SEQ ID NO: 748849 - RNA, 22 nt, Human
aagacgcccccaccccgagccc

SEQ ID NO: 748850 - RNA, 24 nt, Human
aagacgcccccaccccgagcccgg

SEQ ID NO: 748851 - RNA, 21 nt, Human
aagagucauggagagaggagg

SEQ ID NO: 748852 - RNA, 20 nt, Human
acaaaccccagaugaucaaa

SEQ ID NO: 748853 - RNA, 22 nt, Human
acaaaccccagaugaucaaggg

SEQ ID NO: 748854 - RNA, 23 nt, Human
accccgagcccggcaggcuucua

SEQ ID NO: 748855 - RNA, 26 nt, Human
accccuuuccccccucaagccccagg

SEQ ID NO: 748856 - RNA, 24 nt, Human
accuucccccaaaccccaguuuua

SEQ ID NO: 748857 - RNA, 23 nt, Human
accuugcugccuuugcgcuguuu

SEQ ID NO: 748858 - RNA, 21 nt, Human
agaagaagcuaggaugucaag

SEQ ID NO: 748859 - RNA, 19 nt, Human
agccccagggcuaaggagc

SEQ ID NO: 748860 - RNA, 18 nt, Human
aggagggggaaggggaug

SEQ ID NO: 748861 - RNA, 19 nt, Human
aggagguuaggggugggga

SEQ ID NO: 748862 - RNA, 20 nt, Human
aggggaguggggagaggcug

SEQ ID NO: 748863 - RNA, 23 nt, Human
aggggaguggggagaggcugaaa

SEQ ID NO: 748864 - RNA, 26 nt, Human
aucuccccccuuucccuccccccuua

SEQ ID NO: 748865 - RNA, 18 nt, Human
caagccccagggcuaagg

SEQ ID NO: 748866 - RNA, 23 nt, Human
caccaaccuugcugccuuugcgc

SEQ ID NO: 748867 - RNA, 23 nt, Human
cacccuaccccuuuccccccuca

SEQ ID NO: 748868 - RNA, 20 nt, Human
caccuuggcuggagcagagu

SEQ ID NO: 748869 - RNA, 22 nt, Human
cagagcgcccgcgacgccuucc

SEQ ID NO: 748870 - RNA, 20 nt, Human
cagcacaaaggccuguccua

SEQ ID NO: 748871 - RNA, 21 nt, Human
cagcagggagaaaauauggug

SEQ ID NO: 748872 - RNA, 18 nt, Human
caucuccaaagucaccaa

SEQ ID NO: 748873 - RNA, 22 nt, Human
ccccaaaccccaguuuuagauc

SEQ ID NO: 748874 - RNA, 25 nt, Human
ccccaccccgagcccggcaggcuuc

SEQ ID NO: 748875 - RNA, 21 nt, Human
cccccaaaccccaguuuuaga

SEQ ID NO: 748876 - RNA, 22 nt, Human
cccccauggacucuuacccacc

SEQ ID NO: 748877 - RNA, 24 nt, Human
ccccccucaagccccagggcuaag

SEQ ID NO: 748878 - RNA, 18 nt, Human
cccccgcccguuccucgc

SEQ ID NO: 748879 - RNA, 19 nt, Human
ccccuuucccuccccccuu

SEQ ID NO: 748880 - RNA, 23 nt, Human
cccgcagggccuucuugugggcu

SEQ ID NO: 748881 - RNA, 19 nt, Human
cccuccccccuuagaagaa

SEQ ID NO: 748882 - RNA, 22 nt, Human
ccgccguaaauccgaggcccac

SEQ ID NO: 748883 - RNA, 19 nt, Human
ccggcggcaaugcguucuu

SEQ ID NO: 748884 - RNA, 20 nt, Human
ccuaccccuuuccccccuca

SEQ ID NO: 748885 - RNA, 19 nt, Human
ccucaagccccagggcuaa

SEQ ID NO: 748886 - RNA, 25 nt, Human
ccuccggggcgcugggccccagucc

SEQ ID NO: 748887 - RNA, 19 nt, Human
cguaaauccgaggcccacu

SEQ ID NO: 748888 - RNA, 24 nt, Human
cguucacgguggucaggaccggcg

SEQ ID NO: 748889 - RNA, 21 nt, Human
cuaccccuuuccccccucaag

SEQ ID NO: 748890 - RNA, 24 nt, Human
cuaggcgugcguccccccccgccc

SEQ ID NO: 748891 - RNA, 24 nt, Human
cuaguaacuccaggccugucccuu

SEQ ID NO: 748892 - RNA, 24 nt, Human
cuccuggggcccagagguaccacc

SEQ ID NO: 748893 - RNA, 22 nt, Human
cugaaaccuucccccaaacccc

SEQ ID NO: 748894 - RNA, 19 nt, Human
cugggcuggggaguaaagg

SEQ ID NO: 748895 - RNA, 19 nt, Human
cuucauuguccccuuuccu

SEQ ID NO: 748896 - RNA, 19 nt, Human
cuugugggcuaucucucca

SEQ ID NO: 748897 - RNA, 20 nt, Human
gaggaaggccccccacucug

SEQ ID NO: 748898 - RNA, 23 nt, Human
gagggggaaggggauguagaggc

SEQ ID NO: 748899 - RNA, 23 nt, Human
gcgcccgcgacgccuuccuccgg

SEQ ID NO: 748900 - RNA, 21 nt, Human
ggaguaaaggguguggggcaa

SEQ ID NO: 748901 - RNA, 20 nt, Human
ggcauggugggaacagcagg

SEQ ID NO: 748902 - RNA, 19 nt, Human
ggcccagagguaccaccag

SEQ ID NO: 748903 - RNA, 25 nt, Human
gggaguggggagaggcugaaaccuu

SEQ ID NO: 748904 - RNA, 20 nt, Human
gggcggggggggaggaaggc

SEQ ID NO: 748905 - RNA, 19 nt, Human
gggcugaugcuccuggggc

SEQ ID NO: 748906 - RNA, 23 nt, Human
gucccuucauuguccccuuuccu

SEQ ID NO: 748907 - RNA, 21 nt, Human
guguauacauugcuacucagc

SEQ ID NO: 748908 - RNA, 19 nt, Human
uaauccagaugaacuauca

SEQ ID NO: 748909 - RNA, 27 nt, Human
uauaaaaaucuccccccuuucccuccc

SEQ ID NO: 748910 - RNA, 27 nt, Human
uauauauauaaaaaucuccccccuuuc

SEQ ID NO: 748911 - RNA, 18 nt, Human
uauauauauauguauaua

SEQ ID NO: 748912 - RNA, 18 nt, Human
uauauauauguauauaua

SEQ ID NO: 748913 - RNA, 18 nt, Human
uauauauguauauauaua

SEQ ID NO: 748914 - RNA, 19 nt, Human
uauauauguauauauauau

SEQ ID NO: 748915 - RNA, 18 nt, Human
uauauguauauauauaua

SEQ ID NO: 748916 - RNA, 23 nt, Human
uauauguauauauauauaaaaau

SEQ ID NO: 748917 - RNA, 18 nt, Human
ucaauagucuuuccuggu

SEQ ID NO: 748918 - RNA, 23 nt, Human
uccccccucaagccccagggcua

SEQ ID NO: 748919 - RNA, 23 nt, Human
uccugggacugggcacccccaug

SEQ ID NO: 748920 - RNA, 24 nt, Human
ucugcaguccaggccuccuaggcg

SEQ ID NO: 748921 - RNA, 27 nt, Human
ucuuuuuuccccauuuuuucaaggauc

SEQ ID NO: 748922 - RNA, 19 nt, Human
ugcagccgccguaaauccg

SEQ ID NO: 748923 - RNA, 20 nt, Human
ugcugggcaaugggggggcc

SEQ ID NO: 748924 - RNA, 24 nt, Human
uggagagaggagggggaaggggau

SEQ ID NO: 748925 - RNA, 21 nt, Human
uggagcagaguguucuggggg

SEQ ID NO: 748926 - RNA, 23 nt, Human
uggcuugagggggagcaggaggu

SEQ ID NO: 748927 - RNA, 19 nt, Human
ugggcuggggaguaaaggg

SEQ ID NO: 748928 - RNA, 21 nt, Human
uggggcccagagguaccacca

SEQ ID NO: 748929 - RNA, 19 nt, Human
ugggggggcccgcagggcc

SEQ ID NO: 748930 - RNA, 18 nt, Human
uucaaggauggaaagguc

SEQ ID NO: 748931 - RNA, 19 nt, Human
uucaaggauggaaagguca

SEQ ID NO: 748932 - RNA, 20 nt, Human
uucaaggauggaaaggucag

SEQ ID NO: 748933 - RNA, 22 nt, Human
uuccuccggggcgcugggcccc

SEQ ID NO: 748934 - RNA, 19 nt, Human
uugcaucuccaaagucacc

SEQ ID NO: 748935 - RNA, 25 nt, Human
uuuagauccuuugguuuccuucucc

SEQ ID NO: 748936 - RNA, 19 nt, Human
uuucaaggauggaaagguc

SEQ ID NO: 748937 - RNA, 29 nt, Human
aaaaaaaaaaaacaaaaaacacagaaaag

SEQ ID NO: 748938 - RNA, 24 nt, Human
aaaaaaaaaacaaaaaacacagaa

SEQ ID NO: 748939 - RNA, 25 nt, Human
aaaaaaacaaaaaacacagaaaaca

SEQ ID NO: 748940 - RNA, 18 nt, Human
aaaaaaacaggaaugcag

SEQ ID NO: 748941 - RNA, 24 nt, Human
aaaaaacacagaaaacaggaaugc

SEQ ID NO: 748942 - RNA, 26 nt, Human
aaaaacacagaaaacaggaaugcagu

SEQ ID NO: 748943 - RNA, 19 nt, Human
aaaacaaaaaacacagaaa

SEQ ID NO: 748944 - RNA, 22 nt, Human
aaacaaaaaacacagaaaacag

SEQ ID NO: 748945 - RNA, 24 nt, Human
aaaggggugaaacaugaacagcca

SEQ ID NO: 748946 - RNA, 19 nt, Human
aacauagugagaccccauc

SEQ ID NO: 748947 - RNA, 20 nt, Human
aacauagugagaccccaucu

SEQ ID NO: 748948 - RNA, 21 nt, Human
aacauagugagaccccaucuc

SEQ ID NO: 748949 - RNA, 20 nt, Human
aacauggugaaacccugucu

SEQ ID NO: 748950 - RNA, 21 nt, Human
aacauggugaaacccugucuc

SEQ ID NO: 748951 - RNA, 18 nt, Human
aacccaaggaucuuccuc

SEQ ID NO: 748952 - RNA, 23 nt, Human
aaccccaccaccaccccaccauc

SEQ ID NO: 748953 - RNA, 26 nt, Human
aacccugucucuacuaaaaauaccac

SEQ ID NO: 748954 - RNA, 23 nt, Human
aaggcgggcggaucaugagguca

SEQ ID NO: 748955 - RNA, 24 nt, Human
aaucgcuugaacccgggaggcaga

SEQ ID NO: 748956 - RNA, 21 nt, Human
aauuuauagaagcacuuccuu

SEQ ID NO: 748957 - RNA, 24 nt, Human
acagagcgagacucugucucaaaa

SEQ ID NO: 748958 - RNA, 19 nt, Human
accacugcacuccagccug

SEQ ID NO: 748959 - RNA, 24 nt, Human
accacugcacuccagccuggguga

SEQ ID NO: 748960 - RNA, 26 nt, Human
accccaucucuacugcuacccuccaa

SEQ ID NO: 748961 - RNA, 18 nt, Human
acccugucucuacuaaaa

SEQ ID NO: 748962 - RNA, 24 nt, Human
acugcacuccagccugggugacag

SEQ ID NO: 748963 - RNA, 26 nt, Human
acugcacuccagccugggugacagag

SEQ ID NO: 748964 - RNA, 21 nt, Human
acugcucccuaggguuucuac

SEQ ID NO: 748965 - RNA, 20 nt, Human
acuuugguggaaccucuuaa

SEQ ID NO: 748966 - RNA, 23 nt, Human
agaaauaauauauauaaagagaa

SEQ ID NO: 748967 - RNA, 23 nt, Human
agaccccaucucuacugcuaccc

SEQ ID NO: 748968 - RNA, 22 nt, Human
agacugggcaacauagugagac

SEQ ID NO: 748969 - RNA, 24 nt, Human
agagguuucagugagcugaggucg

SEQ ID NO: 748970 - RNA, 22 nt, Human
agauaaggaugguaacugcaga

SEQ ID NO: 748971 - RNA, 24 nt, Human
agauaaggaugguaacugcagaaa

SEQ ID NO: 748972 - RNA, 18 nt, Human
agcacuuugggaagccga

SEQ ID NO: 748973 - RNA, 20 nt, Human
agcacuuugggaagccgagg

SEQ ID NO: 748974 - RNA, 20 nt, Human
agcacuuugggaggucaagg

SEQ ID NO: 748975 - RNA, 19 nt, Human
agccauggcucuguaagcu

SEQ ID NO: 748976 - RNA, 22 nt, Human
agccuggccaacauggugaaac

SEQ ID NO: 748977 - RNA, 24 nt, Human
agccuggccaacauggugaaaccc

SEQ ID NO: 748978 - RNA, 24 nt, Human
agccugggugacagagcgagacuc

SEQ ID NO: 748979 - RNA, 24 nt, Human
aggcacaguggcucacaccuguaa

SEQ ID NO: 748980 - RNA, 20 nt, Human
aggcagagguuucagugagc

SEQ ID NO: 748981 - RNA, 24 nt, Human
aggcagagguuucagugagcugag

SEQ ID NO: 748982 - RNA, 24 nt, Human
aggcgggcggaucaugaggucagg

SEQ ID NO: 748983 - RNA, 24 nt, Human
aggcugaugcaggagaaucgcuug

SEQ ID NO: 748984 - RNA, 20 nt, Human
aggucaaggcgggcggauca

SEQ ID NO: 748985 - RNA, 19 nt, Human
aguaaaaagcaucuccaga

SEQ ID NO: 748986 - RNA, 24 nt, Human
aguggcgggcgccuguaauccuag

SEQ ID NO: 748987 - RNA, 19 nt, Human
aucaugaggucaggaguuc

SEQ ID NO: 748988 - RNA, 20 nt, Human
aucaugaggucaggaguucc

SEQ ID NO: 748989 - RNA, 22 nt, Human
aucucuacugcuacccuccaaa

SEQ ID NO: 748990 - RNA, 18 nt, Human
augcaggagaaucgcuug

SEQ ID NO: 748991 - RNA, 19 nt, Human
augccuguaaucccagcac

SEQ ID NO: 748992 - RNA, 22 nt, Human
auuuguauuguaguugggauuc

SEQ ID NO: 748993 - RNA, 19 nt, Human
caaaaacaggcucuuggac

SEQ ID NO: 748994 - RNA, 18 nt, Human
caaaagcacugcucccua

SEQ ID NO: 748995 - RNA, 24 nt, Human
caacauggugaaacccugucucua

SEQ ID NO: 748996 - RNA, 21 nt, Human
caacccaaggaucuuccucag

SEQ ID NO: 748997 - RNA, 21 nt, Human
caaccccaccaccaccccacc

SEQ ID NO: 748998 - RNA, 25 nt, Human
caagugaauacaacuuuagacuuuu

SEQ ID NO: 748999 - RNA, 24 nt, Human
cacaccuguaauccgagcacuuug

SEQ ID NO: 749000 - RNA, 23 nt, Human
cacaugcugcuagcauuuugcuu

SEQ ID NO: 749001 - RNA, 20 nt, Human
caccaccaccccaccaucuc

SEQ ID NO: 749002 - RNA, 26 nt, Human
caccacugcacuccagccugggugac

SEQ ID NO: 749003 - RNA, 20 nt, Human
caccccuuaacagagcuuaa

SEQ ID NO: 749004 - RNA, 23 nt, Human
caccuguaauccgagcacuuugg

SEQ ID NO: 749005 - RNA, 24 nt, Human
caccuguaauccgagcacuuuggg

SEQ ID NO: 749006 - RNA, 27 nt, Human
caccuguaauccgagcacuuugggaag

SEQ ID NO: 749007 - RNA, 21 nt, Human
cacgguucaagcaaagguacc

SEQ ID NO: 749008 - RNA, 22 nt, Human
cacuccagccugggugacagag

SEQ ID NO: 749009 - RNA, 23 nt, Human
cacuccagccugggugacagagc

SEQ ID NO: 749010 - RNA, 24 nt, Human
cacuccagccugggugacagagcg

SEQ ID NO: 749011 - RNA, 19 nt, Human
cacugcacuccagccuggg

SEQ ID NO: 749012 - RNA, 19 nt, Human
cacugcacuccagccuggg

SEQ ID NO: 749013 - RNA, 22 nt, Human
cacugcacuccagccuggguga

SEQ ID NO: 749014 - RNA, 23 nt, Human
cacugcacuccagccugggugac

SEQ ID NO: 749015 - RNA, 24 nt, Human
cacugcacuccagccugggugaca

SEQ ID NO: 749016 - RNA, 25 nt, Human
cacugcacuccagccugggugacag

SEQ ID NO: 749017 - RNA, 18 nt, Human
cacuguuucaggaucacc

SEQ ID NO: 749018 - RNA, 22 nt, Human
cagagguuucagugagcugagg

SEQ ID NO: 749019 - RNA, 24 nt, Human
cagcacuuugggaggucaaggcgg

SEQ ID NO: 749020 - RNA, 19 nt, Human
caggaguucaagacuagaa

SEQ ID NO: 749021 - RNA, 19 nt, Human
caggaguucaagacuagac

SEQ ID NO: 749022 - RNA, 20 nt, Human
caggcucuuggacacuuucc

SEQ ID NO: 749023 - RNA, 23 nt, Human
cagguggcuucucuagucuguuu

SEQ ID NO: 749024 - RNA, 19 nt, Human
cagugagcugaggucgcac

SEQ ID NO: 749025 - RNA, 19 nt, Human
cauaggauaaaacuaugua

SEQ ID NO: 749026 - RNA, 24 nt, Human
cauagugagaccccaucucuacug

SEQ ID NO: 749027 - RNA, 19 nt, Human
caucauggguugugaugag

SEQ ID NO: 749028 - RNA, 23 nt, Human
caugaacugugauaacucagaua

SEQ ID NO: 749029 - RNA, 20 nt, Human
caugccuguaaucccagcac

SEQ ID NO: 749030 - RNA, 20 nt, Human
ccacugcacuccagccuggg

SEQ ID NO: 749031 - RNA, 20 nt, Human
ccacugcacuccagccuggg

SEQ ID NO: 749032 - RNA, 20 nt, Human
ccacugcacuccagccuggg

SEQ ID NO: 749033 - RNA, 21 nt, Human
ccacugcacuccagccugggu

SEQ ID NO: 749034 - RNA, 24 nt, Human
ccacugcacuccagccugggugac

SEQ ID NO: 749035 - RNA, 21 nt, Human
ccaucucuaugcuuugcuugc

SEQ ID NO: 749036 - RNA, 24 nt, Human
ccauguagcccaguaugcccaugu

SEQ ID NO: 749037 - RNA, 18 nt, Human
cccaaggaucuuccucag

SEQ ID NO: 749038 - RNA, 26 nt, Human
cccaucucuacugcuacccuccaaaa

SEQ ID NO: 749039 - RNA, 26 nt, Human
ccccaucucuacugcuacccuccaaa

SEQ ID NO: 749040 - RNA, 19 nt, Human
cccccuggugguuacgaag

SEQ ID NO: 749041 - RNA, 23 nt, Human
ccccuggugguuacgaaguuauc

SEQ ID NO: 749042 - RNA, 24 nt, Human
cccuaggguuucuacucucuucac

SEQ ID NO: 749043 - RNA, 21 nt, Human
ccuaagaauuuauagaagcac

SEQ ID NO: 749044 - RNA, 18 nt, Human
ccuaggguuucuacucuc

SEQ ID NO: 749045 - RNA, 22 nt, Human
ccuggccaacauggugaaaccc

SEQ ID NO: 749046 - RNA, 24 nt, Human
ccuggccaacauggugaaacccug

SEQ ID NO: 749047 - RNA, 22 nt, Human
ccugggugacagagcgagacuc

SEQ ID NO: 749048 - RNA, 20 nt, Human
ccuguaaucccagcacuuug

SEQ ID NO: 749049 - RNA, 24 nt, Human
ccuguaauccgagcacuuugggaa

SEQ ID NO: 749050 - RNA, 19 nt, Human
ccuguaauccuagcuacuc

SEQ ID NO: 749051 - RNA, 24 nt, Human
cgagaccagccuggccaacauggu

SEQ ID NO: 749052 - RNA, 21 nt, Human
cgcaccacugcacuccagccu

SEQ ID NO: 749053 - RNA, 24 nt, Human
cgccuguaauccuagcuacucggg

SEQ ID NO: 749054 - RNA, 22 nt, Human
cggaucaugaggucaggaguuc

SEQ ID NO: 749055 - RNA, 23 nt, Human
cuaccagaagcccagcuuguguu

SEQ ID NO: 749056 - RNA, 19 nt, Human
cuacuagacccagaugugg

SEQ ID NO: 749057 - RNA, 24 nt, Human
cucacaccuguaauccgagcacuu

SEQ ID NO: 749058 - RNA, 24 nt, Human
cucaugccuguaaucccagcacuu

SEQ ID NO: 749059 - RNA, 19 nt, Human
cucugucucaaaaaaaaaa

SEQ ID NO: 749060 - RNA, 22 nt, Human
cugaaguccauucuggcucugc

SEQ ID NO: 749061 - RNA, 24 nt, Human
cuggccaacauggugaaacccugu

SEQ ID NO: 749062 - RNA, 18 nt, Human
cuggcucugcuacuuaac

SEQ ID NO: 749063 - RNA, 19 nt, Human
cugggugaugucauuuucc

SEQ ID NO: 749064 - RNA, 23 nt, Human
cuguagcccaggaguucaagacu

SEQ ID NO: 749065 - RNA, 20 nt, Human
cugucuacaaacaguaaaag

SEQ ID NO: 749066 - RNA, 24 nt, Human
cugucucaaaaaaaaaaaacaaaa

SEQ ID NO: 749067 - RNA, 22 nt, Human
cuuaaaacacaugcugcuagca

SEQ ID NO: 749068 - RNA, 21 nt, Human
cuucacacaaccgcucccacc

SEQ ID NO: 749069 - RNA, 20 nt, Human
cuugcccagacucccuucac

SEQ ID NO: 749070 - RNA, 19 nt, Human
gaaacccugucucuacuaa

SEQ ID NO: 749071 - RNA, 24 nt, Human
gacagagcgagacucugucucaaa

SEQ ID NO: 749072 - RNA, 23 nt, Human
gagaaucgcuugaacccgggagg

SEQ ID NO: 749073 - RNA, 23 nt, Human
gaggucgcaccacugcacuccag

SEQ ID NO: 749074 - RNA, 22 nt, Human
gaucaugaggucaggaguucga

SEQ ID NO: 749075 - RNA, 24 nt, Human
gaucaugaggucaggaguucgaga

SEQ ID NO: 749076 - RNA, 20 nt, Human
gcaccacugcacuccagccu

SEQ ID NO: 749077 - RNA, 24 nt, Human
gcacuccagccugggugacagagc

SEQ ID NO: 749078 - RNA, 23 nt, Human
gcagauaacucuucacuggcuug

SEQ ID NO: 749079 - RNA, 22 nt, Human
gcaggagaaucgcuugaacccg

SEQ ID NO: 749080 - RNA, 24 nt, Human
gccaacauggugaaacccugucuc

SEQ ID NO: 749081 - RNA, 20 nt, Human
gcgguggcucaugccuguaa

SEQ ID NO: 749082 - RNA, 20 nt, Human
gcuaggcacaguggcucaca

SEQ ID NO: 749083 - RNA, 22 nt, Human
ggaaugcaggcugggugcggug

SEQ ID NO: 749084 - RNA, 27 nt, Human
ggaaugcaggcugggugcgguggcuca

SEQ ID NO: 749085 - RNA, 21 nt, Human
ggaucaugaggucaggaguuc

SEQ ID NO: 749086 - RNA, 21 nt, Human
ggaugguaacugcagaaauaa

SEQ ID NO: 749087 - RNA, 23 nt, Human
ggcggaucaugaggucaggaguu

SEQ ID NO: 749088 - RNA, 23 nt, Human
ggcgggcggaucaugaggucagg

SEQ ID NO: 749089 - RNA, 18 nt, Human
ggcguaguggcgggcgcc

SEQ ID NO: 749090 - RNA, 23 nt, Human
ggcguaguggcgggcgccuguaa

SEQ ID NO: 749091 - RNA, 19 nt, Human
ggcucaaagcugaguacac

SEQ ID NO: 749092 - RNA, 21 nt, Human
ggcucaugccuguaaucccag

SEQ ID NO: 749093 - RNA, 23 nt, Human
ggcugggugcgguggcucaugcc

SEQ ID NO: 749094 - RNA, 23 nt, Human
gguggcucaugccuguaauccca

SEQ ID NO: 749095 - RNA, 24 nt, Human
gguggcucaugccuguaaucccag

SEQ ID NO: 749096 - RNA, 23 nt, Human
guaaaaagcaucuccagauuaca

SEQ ID NO: 749097 - RNA, 18 nt, Human
gugaauacaacuuuagac

SEQ ID NO: 749098 - RNA, 24 nt, Human
gugacagagcgagacucugucuca

SEQ ID NO: 749099 - RNA, 24 nt, Human
guuacaaccagguggcuucucuag

SEQ ID NO: 749100 - RNA, 21 nt, Human
uaaagagaaaucacuccuggg

SEQ ID NO: 749101 - RNA, 20 nt, Human
uaacuguagcccaggaguuc

SEQ ID NO: 749102 - RNA, 19 nt, Human
uaagaauccauagccaugg

SEQ ID NO: 749103 - RNA, 20 nt, Human
uacguagcugguugaggagg

SEQ ID NO: 749104 - RNA, 24 nt, Human
uacuagacccagaugugguugcac

SEQ ID NO: 749105 - RNA, 18 nt, Human
uagcugggcguaguggcg

SEQ ID NO: 749106 - RNA, 23 nt, Human
uaggcuaggcacaguggcucaca

SEQ ID NO: 749107 - RNA, 22 nt, Human
uaguggcgggcgccuguaaucc

SEQ ID NO: 749108 - RNA, 21 nt, Human
ucaaacacaagugaauacaac

SEQ ID NO: 749109 - RNA, 19 nt, Human
ucaaagcaguguacugaug

SEQ ID NO: 749110 - RNA, 21 nt, Human
ucaacagguucuaggacccaa

SEQ ID NO: 749111 - RNA, 18 nt, Human
ucaagcaaagguacccag

SEQ ID NO: 749112 - RNA, 24 nt, Human
ucaugaggucaggaguucgagacc

SEQ ID NO: 749113 - RNA, 22 nt, Human
ucaugccuguaaucccagcacu

SEQ ID NO: 749114 - RNA, 19 nt, Human
uccaaagaauacucccugg

SEQ ID NO: 749115 - RNA, 23 nt, Human
uccagccugggugacagagcgag

SEQ ID NO: 749116 - RNA, 24 nt, Human
uccagccugggugacagagcgaga

SEQ ID NO: 749117 - RNA, 23 nt, Human
uccauagccauggcucuguaagc

SEQ ID NO: 749118 - RNA, 18 nt, Human
uccauucuggcucugcua

SEQ ID NO: 749119 - RNA, 21 nt, Human
uccugggugaugucauuuucc

SEQ ID NO: 749120 - RNA, 23 nt, Human
ucgcaccacugcacuccagccug

SEQ ID NO: 749121 - RNA, 18 nt, Human
ucgcuugaacccgggagg

SEQ ID NO: 749122 - RNA, 24 nt, Human
ucgggaggcugaugcaggagaauc

SEQ ID NO: 749123 - RNA, 25 nt, Human
ucuaaaccuaagaauuuauagaagc

SEQ ID NO: 749124 - RNA, 24 nt, Human
ucucaaaaaaaaaaaacaaaaaac

SEQ ID NO: 749125 - RNA, 21 nt, Human
ucucuacuaaaaauaccacaa

SEQ ID NO: 749126 - RNA, 22 nt, Human
ucucuacuaaaaauaccacaaa

SEQ ID NO: 749127 - RNA, 21 nt, Human
ucucuacugcuacccuccaaa

SEQ ID NO: 749128 - RNA, 20 nt, Human
ucugucucaaaaaaaaaaaa

SEQ ID NO: 749129 - RNA, 22 nt, Human
ucuucaaccccaccaccacccc

SEQ ID NO: 749130 - RNA, 25 nt, Human
ucuucaaccccaccaccaccccacc

SEQ ID NO: 749131 - RNA, 21 nt, Human
ucuucacuggcuuggagaaca

SEQ ID NO: 749132 - RNA, 23 nt, Human
ugacaauuauaccaacaaguuuc

SEQ ID NO: 749133 - RNA, 22 nt, Human
ugagcugaggucgcaccacugc

SEQ ID NO: 749134 - RNA, 24 nt, Human
ugaugcaggagaaucgcuugaacc

SEQ ID NO: 749135 - RNA, 25 nt, Human
ugcaggcugggugcgguggcucaug

SEQ ID NO: 749136 - RNA, 23 nt, Human
ugccuguaaucccagcacuuugg

SEQ ID NO: 749137 - RNA, 23 nt, Human
ugccuguaaucccagcacuuugg

SEQ ID NO: 749138 - RNA, 24 nt, Human
ugccuguaaucccagcacuuuggg

SEQ ID NO: 749139 - RNA, 26 nt, Human
ugcuuugcuugcccagacucccuuca

SEQ ID NO: 749140 - RNA, 24 nt, Human
uggccaacauggugaaacccuguc

SEQ ID NO: 749141 - RNA, 19 nt, Human
uggcucacaccuguaaucc

SEQ ID NO: 749142 - RNA, 19 nt, Human
uggcucacaccuguaaucc

SEQ ID NO: 749143 - RNA, 20 nt, Human
uggcucacaccuguaauccg

SEQ ID NO: 749144 - RNA, 22 nt, Human
uggcucaugccuguaaucccag

SEQ ID NO: 749145 - RNA, 24 nt, Human
uggcucaugccuguaaucccagca

SEQ ID NO: 749146 - RNA, 22 nt, Human
ugggcaacauagugagacccca

SEQ ID NO: 749147 - RNA, 21 nt, Human
uguagaguuccgccucuuaga

SEQ ID NO: 749148 - RNA, 24 nt, Human
ugugauguauugaaucugcccccu

SEQ ID NO: 749149 - RNA, 19 nt, Human
uguuuucaaagcaguguac

SEQ ID NO: 749150 - RNA, 18 nt, Human
uuaaaacacaugcugcua

SEQ ID NO: 749151 - RNA, 18 nt, Human
uuagcugggcguaguggc

SEQ ID NO: 749152 - RNA, 24 nt, Human
uuagcugggcguaguggcgggcgc

SEQ ID NO: 749153 - RNA, 21 nt, Human
uucaaccccaccaccacccca

SEQ ID NO: 749154 - RNA, 26 nt, Human
uucaaccccaccaccaccccaccauc

SEQ ID NO: 749155 - RNA, 21 nt, Human
uuccauguagcccaguaugcc

SEQ ID NO: 749156 - RNA, 20 nt, Human
uuuaacaauauuaaacccuc

SEQ ID NO: 749157 - RNA, 21 nt, Human
uuuaacaccagaaucuaugcc

SEQ ID NO: 749158 - RNA, 28 nt, Human
aacaacaacagcaacaauaacaagaaaa

SEQ ID NO: 749159 - RNA, 22 nt, Human
aacagcaacaauaacaagaaaa

SEQ ID NO: 749160 - RNA, 22 nt, Human
aagagacagggucucacucugu

SEQ ID NO: 749161 - RNA, 25 nt, Human
aagugaucuucccacuucagccucc

SEQ ID NO: 749162 - RNA, 23 nt, Human
acaaacaacaacagcaacaaaac

SEQ ID NO: 749163 - RNA, 22 nt, Human
acaacaacagcaacaauaacaa

SEQ ID NO: 749164 - RNA, 25 nt, Human
acaacaacagcaacaauaacaagaa

SEQ ID NO: 749165 - RNA, 20 nt, Human
acagcaacaauaacaagaaa

SEQ ID NO: 749166 - RNA, 25 nt, Human
acucugucccccaggcuggagugca

SEQ ID NO: 749167 - RNA, 23 nt, Human
acuucagccucccaaguagcuag

SEQ ID NO: 749168 - RNA, 25 nt, Human
agaguugggggagaguaggagaggg

SEQ ID NO: 749169 - RNA, 19 nt, Human
aggcuggagugcaguggca

SEQ ID NO: 749170 - RNA, 23 nt, Human
aguagcuaggaccacaggcacau

SEQ ID NO: 749171 - RNA, 23 nt, Human
agugcaguggcaccaucauggcu

SEQ ID NO: 749172 - RNA, 20 nt, Human
aucaugcuucauccacuuuc

SEQ ID NO: 749173 - RNA, 22 nt, Human
aucccuucaguuuucuuugcug

SEQ ID NO: 749174 - RNA, 26 nt, Human
auuaaaauuaaguuauucuuuccaca

SEQ ID NO: 749175 - RNA, 19 nt, Human
caaggccccuaauucuacc

SEQ ID NO: 749176 - RNA, 27 nt, Human
caagugaucuucccacuucagccuccc

SEQ ID NO: 749177 - RNA, 18 nt, Human
cacaggcacaugccacca

SEQ ID NO: 749178 - RNA, 22 nt, Human
caccaacucuuaucucucugca

SEQ ID NO: 749179 - RNA, 18 nt, Human
caccaugcuuggcuaauu

SEQ ID NO: 749180 - RNA, 22 nt, Human
cacucugucccccaggcuggag

SEQ ID NO: 749181 - RNA, 21 nt, Human
caguggcaccaucauggcuca

SEQ ID NO: 749182 - RNA, 20 nt, Human
cauggcucacugaagccuug

SEQ ID NO: 749183 - RNA, 23 nt, Human
cauucccauuuaagaaucaacau

SEQ ID NO: 749184 - RNA, 19 nt, Human
ccacuuucuaucuuccaga

SEQ ID NO: 749185 - RNA, 21 nt, Human
ccaucuugccuaggcuggucu

SEQ ID NO: 749186 - RNA, 21 nt, Human
ccgcuguucccugcagcgcgg

SEQ ID NO: 749187 - RNA, 19 nt, Human
ccggggcccaggccucggu

SEQ ID NO: 749188 - RNA, 21 nt, Human
ccugcagcgcggguucggggc

SEQ ID NO: 749189 - RNA, 22 nt, Human
ccugggcucaagugaucuuccc

SEQ ID NO: 749190 - RNA, 22 nt, Human
ccuugaacuccugggcucaagu

SEQ ID NO: 749191 - RNA, 23 nt, Human
ccuugaacuccugggcucaagug

SEQ ID NO: 749192 - RNA, 24 nt, Human
cgggauguugccaucuugccuagg

SEQ ID NO: 749193 - RNA, 24 nt, Human
cucaagugaucuucccacuucagc

SEQ ID NO: 749194 - RNA, 24 nt, Human
cucacucugucccccaggcuggag

SEQ ID NO: 749195 - RNA, 24 nt, Human
cucccaaguagcuaggaccacagg

SEQ ID NO: 749196 - RNA, 23 nt, Human
cuccugggcucaagugaucuucc

SEQ ID NO: 749197 - RNA, 19 nt, Human
cugaagccuugaacuccug

SEQ ID NO: 749198 - RNA, 23 nt, Human
cuucccacuucagccucccaagu

SEQ ID NO: 749199 - RNA, 20 nt, Human
cuuugggguuauguuguuca

SEQ ID NO: 749200 - RNA, 21 nt, Human
cuuuguaguauccuguuuuuc

SEQ ID NO: 749201 - RNA, 22 nt, Human
cuuuuugcucuuuaucuggaga

SEQ ID NO: 749202 - RNA, 22 nt, Human
gcacaugccaccaugcuuggcu

SEQ ID NO: 749203 - RNA, 18 nt, Human
gcacuugaguaggagguc

SEQ ID NO: 749204 - RNA, 23 nt, Human
gccuaggcuggucuugaacuccu

SEQ ID NO: 749205 - RNA, 20 nt, Human
gcuggagugcaguggcacca

SEQ ID NO: 749206 - RNA, 19 nt, Human
ggaccacaggcacaugcca

SEQ ID NO: 749207 - RNA, 22 nt, Human
ggaccacaggcacaugccacca

SEQ ID NO: 749208 - RNA, 22 nt, Human
ggauguugccaucuugccuagg

SEQ ID NO: 749209 - RNA, 20 nt, Human
ggcuggucuugaacuccuga

SEQ ID NO: 749210 - RNA, 21 nt, Human
gggcucaagugaucuucccac

SEQ ID NO: 749211 - RNA, 21 nt, Human
gggcucaagugaucuucccac

SEQ ID NO: 749212 - RNA, 18 nt, Human
gggggagaguaggagagg

SEQ ID NO: 749213 - RNA, 21 nt, Human
guagagacgggauguugccau

SEQ ID NO: 749214 - RNA, 23 nt, Human
guaggaggucucagcugucagua

SEQ ID NO: 749215 - RNA, 24 nt, Human
gugaucuucccacuucagccuccc

SEQ ID NO: 749216 - RNA, 24 nt, Human
gugcaguggcaccaucauggcuca

SEQ ID NO: 749217 - RNA, 21 nt, Human
uaaaaauuauuuuguagagac

SEQ ID NO: 749218 - RNA, 21 nt, Human
uaacaagaaauuuuuaacugg

SEQ ID NO: 749219 - RNA, 22 nt, Human
uaaccaaaucccuucaguuuuc

SEQ ID NO: 749220 - RNA, 21 nt, Human
uaccaaauacuuuuagcaguc

SEQ ID NO: 749221 - RNA, 24 nt, Human
uaccaaauacuuuuagcagucuua

SEQ ID NO: 749222 - RNA, 24 nt, Human
uaggaccacaggcacaugccacca

SEQ ID NO: 749223 - RNA, 24 nt, Human
uauaccaaauacuuuuagcagucu

SEQ ID NO: 749224 - RNA, 25 nt, Human
uauccuguuuuucaucuuaaauaca

SEQ ID NO: 749225 - RNA, 22 nt, Human
ucacugaagccuugaacuccug

SEQ ID NO: 749226 - RNA, 24 nt, Human
ucacugaagccuugaacuccuggg

SEQ ID NO: 749227 - RNA, 18 nt, Human
ucagccucccaaguagcu

SEQ ID NO: 749228 - RNA, 20 nt, Human
ucagccucccaaguagcuag

SEQ ID NO: 749229 - RNA, 23 nt, Human
ucaguagacaagcuuuucaggug

SEQ ID NO: 749230 - RNA, 24 nt, Human
ucccccaggcuggagugcaguggc

SEQ ID NO: 749231 - RNA, 26 nt, Human
ucccuccccaucgcccaugucuggga

SEQ ID NO: 749232 - RNA, 20 nt, Human
ucccugcagcgcggguucgg

SEQ ID NO: 749233 - RNA, 19 nt, Human
uccucuucccuccccaucg

SEQ ID NO: 749234 - RNA, 20 nt, Human
uccugggcucaagugaucuu

SEQ ID NO: 749235 - RNA, 24 nt, Human
uccugggcucaagugaucuuccca

SEQ ID NO: 749236 - RNA, 26 nt, Human
uccuuuauacaaacaacaacagcaac

SEQ ID NO: 749237 - RNA, 22 nt, Human
ucggucaccgcgggccucuccu

SEQ ID NO: 749238 - RNA, 19 nt, Human
ucuacgcugaaccccacuc

SEQ ID NO: 749239 - RNA, 21 nt, Human
ucucacucugucccccaggcu

SEQ ID NO: 749240 - RNA, 23 nt, Human
ucucacucugucccccaggcugg

SEQ ID NO: 749241 - RNA, 24 nt, Human
ucucacucugucccccaggcugga

SEQ ID NO: 749242 - RNA, 23 nt, Human
ucugcaagcagccuguucaauuc

SEQ ID NO: 749243 - RNA, 19 nt, Human
ucugucccccaggcuggag

SEQ ID NO: 749244 - RNA, 24 nt, Human
ucugucccccaggcuggagugcag

SEQ ID NO: 749245 - RNA, 22 nt, Human
ucugugcauaagaguuggggga

SEQ ID NO: 749246 - RNA, 22 nt, Human
ucuugccuaggcuggucuugaa

SEQ ID NO: 749247 - RNA, 25 nt, Human
ugagauccucuccacuuuccacagg

SEQ ID NO: 749248 - RNA, 24 nt, Human
ugccaucuugccuaggcuggucuu

SEQ ID NO: 749249 - RNA, 25 nt, Human
ugcuucauccacuuucuaucuucca

SEQ ID NO: 749250 - RNA, 21 nt, Human
uggagugcaguggcaccauca

SEQ ID NO: 749251 - RNA, 24 nt, Human
uggagugcaguggcaccaucaugg

SEQ ID NO: 749252 - RNA, 19 nt, Human
uggcauggguuuccucugc

SEQ ID NO: 749253 - RNA, 20 nt, Human
uggcauggguuuccucugcu

SEQ ID NO: 749254 - RNA, 21 nt, Human
uggcauggguuuccucugcug

SEQ ID NO: 749255 - RNA, 22 nt, Human
ugggcucaagugaucuucccac

SEQ ID NO: 749256 - RNA, 23 nt, Human
ugggcucaagugaucuucccacu

SEQ ID NO: 749257 - RNA, 20 nt, Human
uggguuuccucugcuguugu

SEQ ID NO: 749258 - RNA, 26 nt, Human
uuaaauacaccucaaaucucucugga

SEQ ID NO: 749259 - RNA, 23 nt, Human
uuccagaaauaugcugagauccu

SEQ ID NO: 749260 - RNA, 24 nt, Human
uuccagacuguauaccaaauacuu

SEQ ID NO: 749261 - RNA, 27 nt, Human
uucucuuucuuuucuugcuuuuuaaga

SEQ ID NO: 749262 - RNA, 21 nt, Human
uugucuuuguuucccucagag

SEQ ID NO: 749263 - RNA, 20 nt, Human
uuucaaggccccuaauucua

SEQ ID NO: 749264 - RNA, 24 nt, Human
uuuguagagacgggauguugccau

SEQ ID NO: 749265 - RNA, 20 nt, Human
aaagaguaguuuggacccac

SEQ ID NO: 749266 - RNA, 25 nt, Human
aagcacagguaccaaaauauuaucc

SEQ ID NO: 749267 - RNA, 23 nt, Human
acacacacacacacacacacaca

SEQ ID NO: 749268 - RNA, 23 nt, Human
acacacacacacacacacacaca

SEQ ID NO: 749269 - RNA, 25 nt, Human
acacacacacacacacacacacagu

SEQ ID NO: 749270 - RNA, 29 nt, Human
acacacacacacacacacacauaucccug

SEQ ID NO: 749271 - RNA, 25 nt, Human
acacacacacacacacacauauccc

SEQ ID NO: 749272 - RNA, 22 nt, Human
acgcaggcaugagggguaggga

SEQ ID NO: 749273 - RNA, 24 nt, Human
acuaggacccuagaaaaauucaag

SEQ ID NO: 749274 - RNA, 19 nt, Human
acuucagaaacguugcgaa

SEQ ID NO: 749275 - RNA, 24 nt, Human
agcauguaguauacagacauucug

SEQ ID NO: 749276 - RNA, 20 nt, Human
agggaugaagcacgcacugu

SEQ ID NO: 749277 - RNA, 18 nt, Human
aucuggagagaacuggag

SEQ ID NO: 749278 - RNA, 20 nt, Human
cacacacacacacacacaca

SEQ ID NO: 749279 - RNA, 20 nt, Human
cacacacacacacacacaca

SEQ ID NO: 749280 - RNA, 20 nt, Human
cacacacacacacacacaca

SEQ ID NO: 749281 - RNA, 20 nt, Human
cacacacacacacacacaca

SEQ ID NO: 749282 - RNA, 22 nt, Human
cacacacacacacacacacaca

SEQ ID NO: 749283 - RNA, 26 nt, Human
cacacacacacacacacacacacaua

SEQ ID NO: 749284 - RNA, 22 nt, Human
cacacacacacacacacacaua

SEQ ID NO: 749285 - RNA, 20 nt, Human
cacacacacacacacacaua

SEQ ID NO: 749286 - RNA, 22 nt, Human
caggagcagcgcgcaggcagag

SEQ ID NO: 749287 - RNA, 22 nt, Human
ccaauugcaaaauuugcaucca

SEQ ID NO: 749288 - RNA, 26 nt, Human
ccuggccccagcuucccaauaccagc

SEQ ID NO: 749289 - RNA, 19 nt, Human
cggaagcacuaggacccua

SEQ ID NO: 749290 - RNA, 31 nt, Human
cucuaacacacacacacacacacacacacag

SEQ ID NO: 749291 - RNA, 19 nt, Human
cuucugaacucagaugaaa

SEQ ID NO: 749292 - RNA, 20 nt, Human
cuuugaggaacagggcugug

SEQ ID NO: 749293 - RNA, 21 nt, Human
gagcagcgcgcaggcagagcg

SEQ ID NO: 749294 - RNA, 23 nt, Human
gcaaagaguaguuuggacccaca

SEQ ID NO: 749295 - RNA, 23 nt, Human
gcucugcucagcuuuggguauca

SEQ ID NO: 749296 - RNA, 22 nt, Human
ggccccagcuucccaauaccag

SEQ ID NO: 749297 - RNA, 20 nt, Human
guagggcaugcuaugacucc

SEQ ID NO: 749298 - RNA, 27 nt, Human
uaauuugacuuuaaaaaaaaugacacc

SEQ ID NO: 749299 - RNA, 20 nt, Human
uaccuuagcagcauguagua

SEQ ID NO: 749300 - RNA, 21 nt, Human
uagaacaaaagucugugaugg

SEQ ID NO: 749301 - RNA, 19 nt, Human
uaggucuuggaagucaaag

SEQ ID NO: 749302 - RNA, 28 nt, Human
uauuccguugcugccagucuauucuaac

SEQ ID NO: 749303 - RNA, 18 nt, Human
ucacgcaggcaugagggg

SEQ ID NO: 749304 - RNA, 23 nt, Human
ucacgcaggcaugagggguaggg

SEQ ID NO: 749305 - RNA, 23 nt, Human
uccaggcacaaacaauuuauuuc

SEQ ID NO: 749306 - RNA, 31 nt, Human
uccucucuaacacacacacacacacacacag

SEQ ID NO: 749307 - RNA, 18 nt, Human
ucucucucaucuggagag

SEQ ID NO: 749308 - RNA, 22 nt, Human
ucugaacucagaugaaacaacu

SEQ ID NO: 749309 - RNA, 19 nt, Human
ucugcucuuccucuuccuc

SEQ ID NO: 749310 - RNA, 24 nt, Human
ugaaaagauucucucucaucugga

SEQ ID NO: 749311 - RNA, 24 nt, Human
ugaaacuauaagcuagaggcuuac

SEQ ID NO: 749312 - RNA, 23 nt, Human
ugacaccaauugcaaaauuugca

SEQ ID NO: 749313 - RNA, 23 nt, Human
ugauuuauucacuaccuuagcag

SEQ ID NO: 749314 - RNA, 24 nt, Human
ugcauuuccaggcacaaacaauuu

SEQ ID NO: 749315 - RNA, 23 nt, Human
ugcgaacguuuccuucaaagaca

SEQ ID NO: 749316 - RNA, 22 nt, Human
ugcuuccaaauugacaacacaa

SEQ ID NO: 749317 - RNA, 19 nt, Human
uggcaagcacagguaccaa

SEQ ID NO: 749318 - RNA, 21 nt, Human
uguauaagaauccagaucugg

SEQ ID NO: 749319 - RNA, 20 nt, Human
uuaaguacuaagaaucuucu

SEQ ID NO: 749320 - RNA, 24 nt, Human
uucaaagacaguaaaauaaauaaa

SEQ ID NO: 749321 - RNA, 20 nt, Human
uucucauucuuccaccuuuu

SEQ ID NO: 749322 - RNA, 18 nt, Human
uucugcucuuccucuucc

SEQ ID NO: 749323 - RNA, 26 nt, Human
uuggacccacaauauugcauuacuga

SEQ ID NO: 749324 - RNA, 20 nt, Human
aaaaaaagauccuuccaaaa

SEQ ID NO: 749325 - RNA, 18 nt, Human
aacagccagcucaggucc

SEQ ID NO: 749326 - RNA, 20 nt, Human
aacagccagcucaggucccc

SEQ ID NO: 749327 - RNA, 18 nt, Human
aacuggacaugggggccu

SEQ ID NO: 749328 - RNA, 21 nt, Human
aagauccuuccaaagcuguau

SEQ ID NO: 749329 - RNA, 23 nt, Human
aagcuaauaccacugcuagugcu

SEQ ID NO: 749330 - RNA, 22 nt, Human
aaggauaaaggccgugcaguaa

SEQ ID NO: 749331 - RNA, 18 nt, Human
aaguccuccaaagcccuc

SEQ ID NO: 749332 - RNA, 20 nt, Human
acaggguugaggacaguggg

SEQ ID NO: 749333 - RNA, 18 nt, Human
agaaggcccugaggaguu

SEQ ID NO: 749334 - RNA, 24 nt, Human
aggaaacagccagcucaggucccc

SEQ ID NO: 749335 - RNA, 19 nt, Human
aggaguugggaggaaggga

SEQ ID NO: 749336 - RNA, 19 nt, Human
aggaguugggaggaaggga

SEQ ID NO: 749337 - RNA, 26 nt, Human
aggcacagauacagaaggcccugagg

SEQ ID NO: 749338 - RNA, 23 nt, Human
agggaagaaggugaccaucuagu

SEQ ID NO: 749339 - RNA, 18 nt, Human
agggcacaggcucugccc

SEQ ID NO: 749340 - RNA, 20 nt, Human
auggagcgagacgaaggcag

SEQ ID NO: 749341 - RNA, 24 nt, Human
auuggcccugcugucccaaguccu

SEQ ID NO: 749342 - RNA, 22 nt, Human
caaagcccucuccguaucacca

SEQ ID NO: 749343 - RNA, 25 nt, Human
caaagcccucuccguaucaccagcu

SEQ ID NO: 749344 - RNA, 20 nt, Human
cagagcagucaggcugggac

SEQ ID NO: 749345 - RNA, 19 nt, Human
cagauacagaaggcccuga

SEQ ID NO: 749346 - RNA, 20 nt, Human
cagcucagguccccgcccca

SEQ ID NO: 749347 - RNA, 20 nt, Human
caggcaaaggcccgaauaug

SEQ ID NO: 749348 - RNA, 25 nt, Human
ccaucuaguuaaagaaaaaaagauc

SEQ ID NO: 749349 - RNA, 18 nt, Human
ccccaggggcccagaagg

SEQ ID NO: 749350 - RNA, 18 nt, Human
cccgacccagggacuggc

SEQ ID NO: 749351 - RNA, 19 nt, Human
cccgccccaggggcccaga

SEQ ID NO: 749352 - RNA, 21 nt, Human
cccgccccaggggcccagaag

SEQ ID NO: 749353 - RNA, 24 nt, Human
ccucugggaggauccgcccgaccc

SEQ ID NO: 749354 - RNA, 20 nt, Human
ccuguccaccuucccaccca

SEQ ID NO: 749355 - RNA, 23 nt, Human
cgugcaguaaagggaacauacgg

SEQ ID NO: 749356 - RNA, 21 nt, Human
cucugcccuuggacccuagcc

SEQ ID NO: 749357 - RNA, 21 nt, Human
gacaugggggccugagcugcu

SEQ ID NO: 749358 - RNA, 18 nt, Human
gaggaagggagaacaaug

SEQ ID NO: 749359 - RNA, 21 nt, Human
gaggaguugggaggaagggag

SEQ ID NO: 749360 - RNA, 21 nt, Human
gaggauccgcccgacccaggg

SEQ ID NO: 749361 - RNA, 19 nt, Human
gccgugcaguaaagggaac

SEQ ID NO: 749362 - RNA, 18 nt, Human
ggagcuccaagacugaua

SEQ ID NO: 749363 - RNA, 26 nt, Human
ggcucugcccuuggacccuagcuuua

SEQ ID NO: 749364 - RNA, 21 nt, Human
gucccaaguccuccaaagccc

SEQ ID NO: 749365 - RNA, 18 nt, Human
gugaguuagcagccuagg

SEQ ID NO: 749366 - RNA, 22 nt, Human
uagcagccuaggcacuugggca

SEQ ID NO: 749367 - RNA, 20 nt, Human
ucccaaguccuccaaagccc

SEQ ID NO: 749368 - RNA, 21 nt, Human
ucucuuuggucaggcaaaggc

SEQ ID NO: 749369 - RNA, 18 nt, Human
ugaaagggcugaagggca

SEQ ID NO: 749370 - RNA, 21 nt, Human
ugaagggcacaggcucugccc

SEQ ID NO: 749371 - RNA, 19 nt, Human
ugaggacaguggggacaga

SEQ ID NO: 749372 - RNA, 22 nt, Human
ugaggaguugggaggaagggag

SEQ ID NO: 749373 - RNA, 21 nt, Human
ugcaggcaaagcaggaaacag

SEQ ID NO: 749374 - RNA, 19 nt, Human
ugcaguaaagggaacauac

SEQ ID NO: 749375 - RNA, 26 nt, Human
ugcccuuggacccuagcuuuaggcuc

SEQ ID NO: 749376 - RNA, 18 nt, Human
uguaagauccaguggcuu

SEQ ID NO: 749377 - RNA, 20 nt, Human
ugugguagggaagaagguga

SEQ ID NO: 749378 - RNA, 19 nt, Human
uuggugcaaaacuguaaag

SEQ ID NO: 749379 - RNA, 21 nt, Human
uuuuuuuuuuuuuuuuuuugg

SEQ ID NO: 749380 - RNA, 20 nt, Human
aaaaaacuuguccccuaaac

SEQ ID NO: 749381 - RNA, 19 nt, Human
aaaaauuuuuccacccuag

SEQ ID NO: 749382 - RNA, 21 nt, Human
aaaagaaaaagaaaaagaaag

SEQ ID NO: 749383 - RNA, 19 nt, Human
aaaagaaaaagaaagacaa

SEQ ID NO: 749384 - RNA, 23 nt, Human
aaaagaaaaagaaagacaaucuu

SEQ ID NO: 749385 - RNA, 21 nt, Human
aaagggagauagggguggggc

SEQ ID NO: 749386 - RNA, 24 nt, Human
aaagggagauagggguggggcugu

SEQ ID NO: 749387 - RNA, 23 nt, Human
aaauaggacuccaguguugugga

SEQ ID NO: 749388 - RNA, 22 nt, Human
aacugugagccaauuaaaccuc

SEQ ID NO: 749389 - RNA, 25 nt, Human
aacuuguccccuaaacuugauccug

SEQ ID NO: 749390 - RNA, 22 nt, Human
aagccaauucugucagaccaca

SEQ ID NO: 749391 - RNA, 29 nt, Human
aagcuuuucuuuaagauaugagaggaaga

SEQ ID NO: 749392 - RNA, 18 nt, Human
aagucaucuucaaagcug

SEQ ID NO: 749393 - RNA, 23 nt, Human
aaguugauuucuucaaaggaggu

SEQ ID NO: 749394 - RNA, 20 nt, Human
aaugucaaagcuugggagaa

SEQ ID NO: 749395 - RNA, 21 nt, Human
accuccccuuuccuuuguucc

SEQ ID NO: 749396 - RNA, 21 nt, Human
acuguccugcuuccucagaaa

SEQ ID NO: 749397 - RNA, 22 nt, Human
agaaagaaacuggauuuaagga

SEQ ID NO: 749398 - RNA, 22 nt, Human
agacaaucuuguuuuugugcuu

SEQ ID NO: 749399 - RNA, 19 nt, Human
agagaaaccaguguacaga

SEQ ID NO: 749400 - RNA, 22 nt, Human
agcaccaucuccccuugguacu

SEQ ID NO: 749401 - RNA, 18 nt, Human
agccagaaagugaggugu

SEQ ID NO: 749402 - RNA, 22 nt, Human
aggaauuucacaaaguaauguc

SEQ ID NO: 749403 - RNA, 24 nt, Human
aggcaggggugggggucacaaggu

SEQ ID NO: 749404 - RNA, 25 nt, Human
aggcaggggugggggucacaaggug

SEQ ID NO: 749405 - RNA, 19 nt, Human
agggagauagggguggggc

SEQ ID NO: 749406 - RNA, 23 nt, Human
aguguggccuccgcucccagggu

SEQ ID NO: 749407 - RNA, 25 nt, Human
auaaagcuuuucuuuaagauaugag

SEQ ID NO: 749408 - RNA, 20 nt, Human
auccuacuuaucucuuuuuc

SEQ ID NO: 749409 - RNA, 28 nt, Human
augaaucuuuuuuucuacauaaagcuuu

SEQ ID NO: 749410 - RNA, 20 nt, Human
augcugccuuucuccugcag

SEQ ID NO: 749411 - RNA, 22 nt, Human
caaagcaaacuacagcuguuag

SEQ ID NO: 749412 - RNA, 18 nt, Human
caaaguaaugucaucugu

SEQ ID NO: 749413 - RNA, 24 nt, Human
caagucccucucuuccuguuuuuu

SEQ ID NO: 749414 - RNA, 25 nt, Human
caauggcuaggagaagagacucuga

SEQ ID NO: 749415 - RNA, 24 nt, Human
cacuagaucacugugagaacugaa

SEQ ID NO: 749416 - RNA, 19 nt, Human
cacugcaugugcucaagcu

SEQ ID NO: 749417 - RNA, 25 nt, Human
cagaaaauccuucuucagaguaucc

SEQ ID NO: 749418 - RNA, 22 nt, Human
cagaacaaaaucaacuucuguu

SEQ ID NO: 749419 - RNA, 18 nt, Human
caggggugggggucacaa

SEQ ID NO: 749420 - RNA, 24 nt, Human
caugcaggucacaggggauaugau

SEQ ID NO: 749421 - RNA, 24 nt, Human
ccaaacuacagccaagaucaagua

SEQ ID NO: 749422 - RNA, 19 nt, Human
ccagaagaaggaauuucac

SEQ ID NO: 749423 - RNA, 23 nt, Human
ccagccucuucccaguuuuacaa

SEQ ID NO: 749424 - RNA, 20 nt, Human
ccaugcugccuuucuccugc

SEQ ID NO: 749425 - RNA, 18 nt, Human
ccaugcuuuuagagccag

SEQ ID NO: 749426 - RNA, 23 nt, Human
ccauuguuggagguggggccugg

SEQ ID NO: 749427 - RNA, 19 nt, Human
cccacaauggcuaggagaa

SEQ ID NO: 749428 - RNA, 19 nt, Human
cccauuguuggaggugggg

SEQ ID NO: 749429 - RNA, 25 nt, Human
ccccagaaacugauguugccaugcu

SEQ ID NO: 749430 - RNA, 19 nt, Human
ccuaaugcuggcaauagca

SEQ ID NO: 749431 - RNA, 20 nt, Human
ccuccccuuuccuuuguucc

SEQ ID NO: 749432 - RNA, 19 nt, Human
ccuuuugucucugccucac

SEQ ID NO: 749433 - RNA, 19 nt, Human
cgaaaucagaccuccuccc

SEQ ID NO: 749434 - RNA, 24 nt, Human
cgaaaucagaccuccucccugcaa

SEQ ID NO: 749435 - RNA, 28 nt, Human
cgucaugaaucuuuuuuucuacauaaag

SEQ ID NO: 749436 - RNA, 23 nt, Human
cuaggagaagagacucugaaucc

SEQ ID NO: 749437 - RNA, 22 nt, Human
cucaagucccucucuuccuguu

SEQ ID NO: 749438 - RNA, 21 nt, Human
cucacaauuuauuaggcagcc

SEQ ID NO: 749439 - RNA, 24 nt, Human
cucauuuaaaaagaaaaagaaaaa

SEQ ID NO: 749440 - RNA, 24 nt, Human
cuccugguuucugugggugggaag

SEQ ID NO: 749441 - RNA, 21 nt, Human
cugcuggaagccaaacuacag

SEQ ID NO: 749442 - RNA, 19 nt, Human
cuucaggcccuugaccucc

SEQ ID NO: 749443 - RNA, 22 nt, Human
gaaaauccuucuucagaguauc

SEQ ID NO: 749444 - RNA, 24 nt, Human
gaaagugagguguccuuccucucu

SEQ ID NO: 749445 - RNA, 23 nt, Human
gacuucaggcccuugaccucccu

SEQ ID NO: 749446 - RNA, 22 nt, Human
gaucuguguccucacccaaauc

SEQ ID NO: 749447 - RNA, 25 nt, Human
gauuauucucuggcaggcaggggug

SEQ ID NO: 749448 - RNA, 18 nt, Human
gauucuccacuugcuuca

SEQ ID NO: 749449 - RNA, 19 nt, Human
gcccacugcugucuuuuga

SEQ ID NO: 749450 - RNA, 18 nt, Human
gcgucaugaaucuuuuuu

SEQ ID NO: 749451 - RNA, 22 nt, Human
ggaaggguaggaaacuuggagu

SEQ ID NO: 749452 - RNA, 19 nt, Human
ggagauagggguggggcug

SEQ ID NO: 749453 - RNA, 20 nt, Human
ggcaggcagggguggggguc

SEQ ID NO: 749454 - RNA, 24 nt, Human
ggcuaggagaagagacucugaauc

SEQ ID NO: 749455 - RNA, 19 nt, Human
ggcucagaggccugacagu

SEQ ID NO: 749456 - RNA, 24 nt, Human
ggcugaguccaaaaagagagucag

SEQ ID NO: 749457 - RNA, 23 nt, Human
gggaaggguaggaaacuuggagu

SEQ ID NO: 749458 - RNA, 22 nt, Human
gggagauagggguggggcuguu

SEQ ID NO: 749459 - RNA, 19 nt, Human
gggcucagaggccugacag

SEQ ID NO: 749460 - RNA, 21 nt, Human
gggcuuuuuccaaauugugaa

SEQ ID NO: 749461 - RNA, 18 nt, Human
gggucacaaggugcucag

SEQ ID NO: 749462 - RNA, 21 nt, Human
ggucuuccuccccauguacca

SEQ ID NO: 749463 - RNA, 23 nt, Human
gguggggcuguuuuauaggauuu

SEQ ID NO: 749464 - RNA, 24 nt, Human
gucaaaggggauuauucucuggcc

SEQ ID NO: 749465 - RNA, 24 nt, Human
guccuuccucucuucacuugggcc

SEQ ID NO: 749466 - RNA, 22 nt, Human
guuaggaauacagggaugaaca

SEQ ID NO: 749467 - RNA, 23 nt, Human
uaaaaagaaaaagaaaaagaaag

SEQ ID NO: 749468 - RNA, 26 nt, Human
uaaaaauaguagauauuucuucucuc

SEQ ID NO: 749469 - RNA, 21 nt, Human
uaaagcucccugaggccuccc

SEQ ID NO: 749470 - RNA, 25 nt, Human
uaaagcucccugaggccuccccaga

SEQ ID NO: 749471 - RNA, 25 nt, Human
uaagaugccugcucccacuuugcuu

SEQ ID NO: 749472 - RNA, 24 nt, Human
uaaugucaucuguuaaggcagcaa

SEQ ID NO: 749473 - RNA, 27 nt, Human
uacacacauaguagagaaaccagugua

SEQ ID NO: 749474 - RNA, 23 nt, Human
uacagccaagaucaaguagcugg

SEQ ID NO: 749475 - RNA, 22 nt, Human
uacaugcaggucacaggggaua

SEQ ID NO: 749476 - RNA, 24 nt, Human
uaccaugcugccuuucuccugcag

SEQ ID NO: 749477 - RNA, 22 nt, Human
uacuggguagaguuuucauuaa

SEQ ID NO: 749478 - RNA, 19 nt, Human
uagcaccuccccuuuccuu

SEQ ID NO: 749479 - RNA, 22 nt, Human
uagcagugugagaauggacuaa

SEQ ID NO: 749480 - RNA, 22 nt, Human
uaggaaacuuggaguggggggc

SEQ ID NO: 749481 - RNA, 19 nt, Human
uaggaauacagggaugaac

SEQ ID NO: 749482 - RNA, 20 nt, Human
uaguagauauuucuucucuc

SEQ ID NO: 749483 - RNA, 26 nt, Human
uaguuccccugucuccugguuucugu

SEQ ID NO: 749484 - RNA, 23 nt, Human
uaucaugucugguguaauuuuuu

SEQ ID NO: 749485 - RNA, 22 nt, Human
ucaaagcuggucccauggcugc

SEQ ID NO: 749486 - RNA, 20 nt, Human
ucagaccacaugcuguugug

SEQ ID NO: 749487 - RNA, 22 nt, Human
ucagaccacaugcuguuguggu

SEQ ID NO: 749488 - RNA, 20 nt, Human
ucagcaaagggagauagggg

SEQ ID NO: 749489 - RNA, 26 nt, Human
ucauuuaaaaagaaaaagaaaaagaa

SEQ ID NO: 749490 - RNA, 18 nt, Human
uccaagaugcucugaaac

SEQ ID NO: 749491 - RNA, 21 nt, Human
uccaagaugcucugaaaccac

SEQ ID NO: 749492 - RNA, 21 nt, Human
ucccagggucaagucaucuuc

SEQ ID NO: 749493 - RNA, 18 nt, Human
ucccauggcugcagaagc

SEQ ID NO: 749494 - RNA, 19 nt, Human
ucccauggcugcagaagcc

SEQ ID NO: 749495 - RNA, 19 nt, Human
uccccagaaacugauguug

SEQ ID NO: 749496 - RNA, 21 nt, Human
uccccauguaccaugcugccu

SEQ ID NO: 749497 - RNA, 23 nt, Human
uccuagugugagauguaccaugc

SEQ ID NO: 749498 - RNA, 25 nt, Human
uccuagugugagauguaccaugcuu

SEQ ID NO: 749499 - RNA, 23 nt, Human
uccuggagaagaguuugccauug

SEQ ID NO: 749500 - RNA, 20 nt, Human
ucgcucagucuggucuuccu

SEQ ID NO: 749501 - RNA, 24 nt, Human
ucucaagaagaaaaauaggacucc

SEQ ID NO: 749502 - RNA, 26 nt, Human
ucucaggggagaaaugugacguaaac

SEQ ID NO: 749503 - RNA, 24 nt, Human
ucucauuuaaaaagaaaaagaaaa

SEQ ID NO: 749504 - RNA, 22 nt, Human
ucucuaggaccugagaaccacc

SEQ ID NO: 749505 - RNA, 24 nt, Human
ucucuggcaggcaggggugggggu

SEQ ID NO: 749506 - RNA, 24 nt, Human
ucugccaacagaaauagcauuuuu

SEQ ID NO: 749507 - RNA, 21 nt, Human
ucugcuucuuuucucccuucc

SEQ ID NO: 749508 - RNA, 19 nt, Human
ucugucagaccacaugcug

SEQ ID NO: 749509 - RNA, 21 nt, Human
ugagaacugaacgaaaucaga

SEQ ID NO: 749510 - RNA, 20 nt, Human
ugaguuaaagcucccugagg

SEQ ID NO: 749511 - RNA, 27 nt, Human
ugauggcuuagcuugggcucagaggcc

SEQ ID NO: 749512 - RNA, 25 nt, Human
ugauuggauuacuggguagaguucc

SEQ ID NO: 749513 - RNA, 22 nt, Human
ugcaacuaauuccauuccacaa

SEQ ID NO: 749514 - RNA, 27 nt, Human
ugcuucuuuucucccuuccucccaaga

SEQ ID NO: 749515 - RNA, 26 nt, Human
uggauuacuggguagaguuuucauua

SEQ ID NO: 749516 - RNA, 24 nt, Human
uggcugcagaagccauuguagaua

SEQ ID NO: 749517 - RNA, 21 nt, Human
ugggaaggguaggaaacuugg

SEQ ID NO: 749518 - RNA, 21 nt, Human
uggggaauuaguaaacacaga

SEQ ID NO: 749519 - RNA, 24 nt, Human
uggguggugauuggauuacugggu

SEQ ID NO: 749520 - RNA, 23 nt, Human
ugguggguggugauuggauuacu

SEQ ID NO: 749521 - RNA, 21 nt, Human
uguacagagaaaugaagagau

SEQ ID NO: 749522 - RNA, 19 nt, Human
uguauacaugcaggucaca

SEQ ID NO: 749523 - RNA, 24 nt, Human
ugucucgaggaaacuccuggagaa

SEQ ID NO: 749524 - RNA, 18 nt, Human
uguggugguggagaaagc

SEQ ID NO: 749525 - RNA, 24 nt, Human
uguuagcaccuccccuuuccuuug

SEQ ID NO: 749526 - RNA, 20 nt, Human
uguuguggugguggagaaag

SEQ ID NO: 749527 - RNA, 27 nt, Human
uguuuuacucuuaugacuguggucuca

SEQ ID NO: 749528 - RNA, 19 nt, Human
uuaaucaccugggugcagg

SEQ ID NO: 749529 - RNA, 21 nt, Human
uuccuuucccacaagggugga

SEQ ID NO: 749530 - RNA, 20 nt, Human
uucugccaacagaaauagca

SEQ ID NO: 749531 - RNA, 20 nt, Human
uugaagccaauucugucaga

SEQ ID NO: 749532 - RNA, 21 nt, Human
uugauccugaagucuccuaac

SEQ ID NO: 749533 - RNA, 25 nt, Human
uugcuuccuaccaaauaagcauuua

SEQ ID NO: 749534 - RNA, 23 nt, Human
uuggggguuuggaggaccaagga

SEQ ID NO: 749535 - RNA, 20 nt, Human
uugucucugccucacuacgu

SEQ ID NO: 749536 - RNA, 18 nt, Human
uuguuggagguggggccu

SEQ ID NO: 749537 - RNA, 24 nt, Human
uuuaaaaagaaaaagaaaaagaaa

SEQ ID NO: 749538 - RNA, 30 nt, Human
uuuaaaaauuuuuccacccuagcccuuuuu

SEQ ID NO: 749539 - RNA, 19 nt, Human
uuuucuuuaagauaugaga

SEQ ID NO: 749540 - RNA, 18 nt, Human
uuuuuuuuuuuucuuuug

SEQ ID NO: 749541 - RNA, 23 nt, Human
accaaaggucacagacaugcguu

SEQ ID NO: 749542 - RNA, 22 nt, Human
aggaggcugagaggggaggagg

SEQ ID NO: 749543 - RNA, 22 nt, Human
agucgugugcggcaguggugcg

SEQ ID NO: 749544 - RNA, 25 nt, Human
caggcaucacagugguuaaagucuu

SEQ ID NO: 749545 - RNA, 22 nt, Human
caucacagugguuaaagucuuc

SEQ ID NO: 749546 - RNA, 24 nt, Human
cucggcccuggccgcgggcgcagc

SEQ ID NO: 749547 - RNA, 18 nt, Human
gcaaaauacaggguuccg

SEQ ID NO: 749548 - RNA, 21 nt, Human
gccucggcccuggccgcgggc

SEQ ID NO: 749549 - RNA, 21 nt, Human
ggaggcuagcuaaagaggagg

SEQ ID NO: 749550 - RNA, 20 nt, Human
gggaggcuagcuaaagagga

SEQ ID NO: 749551 - RNA, 19 nt, Human
ggguugccauguuccgaaa

SEQ ID NO: 749552 - RNA, 25 nt, Human
uacagcaucaaauaccauaaauaaa

SEQ ID NO: 749553 - RNA, 21 nt, Human
uaccaaaggucacagacaugc

SEQ ID NO: 749554 - RNA, 23 nt, Human
ucacagugguuaaagucuucucu

SEQ ID NO: 749555 - RNA, 22 nt, Human
ucaggagucgugugcggcagug

SEQ ID NO: 749556 - RNA, 21 nt, Human
ucuucucuuucugggaugaga

SEQ ID NO: 749557 - RNA, 22 nt, Human
ugagaggggaggagggcacucu

SEQ ID NO: 749558 - RNA, 27 nt, Human
ugagaggggaggagggcacucuuuggu

SEQ ID NO: 749559 - RNA, 22 nt, Human
ugaugagauggggaggcuagcu

SEQ ID NO: 749560 - RNA, 21 nt, Human
uggcacuguaaaugauuacca

SEQ ID NO: 749561 - RNA, 19 nt, Human
ugggaugagacacacacgg

SEQ ID NO: 749562 - RNA, 25 nt, Human
uguaaaugauuaccaaaggucacag

SEQ ID NO: 749563 - RNA, 23 nt, Human
uugccauguuccgaaagucgcgc

SEQ ID NO: 749564 - RNA, 20 nt, Human
aaggugcugggauuacaggc

SEQ ID NO: 749565 - RNA, 24 nt, Human
aaggugcugggauuacaggcguga

SEQ ID NO: 749566 - RNA, 22 nt, Human
accucaaccucuaccaccucgg

SEQ ID NO: 749567 - RNA, 23 nt, Human
acggaguuucgcucguugcccag

SEQ ID NO: 749568 - RNA, 24 nt, Human
agaaagcucaaaccagaguggccc

SEQ ID NO: 749569 - RNA, 22 nt, Human
aggcgugagccacugugcccgg

SEQ ID NO: 749570 - RNA, 26 nt, Human
aggugcugggauuacaggcgugagcc

SEQ ID NO: 749571 - RNA, 23 nt, Human
aguagcugggauugcaggcaugu

SEQ ID NO: 749572 - RNA, 24 nt, Human
agugcaauggcacaaccuuggcuc

SEQ ID NO: 749573 - RNA, 24 nt, Human
auggcaguuaaaaugaaaggcaag

SEQ ID NO: 749574 - RNA, 19 nt, Human
caaaauucccaaaucucau

SEQ ID NO: 749575 - RNA, 21 nt, Human
caaggugcugggauuacaggc

SEQ ID NO: 749576 - RNA, 24 nt, Human
caaggugcugggauuacaggcgug

SEQ ID NO: 749577 - RNA, 19 nt, Human
caagugauucuccugccuu

SEQ ID NO: 749578 - RNA, 22 nt, Human
caagugauucuccugccuuggc

SEQ ID NO: 749579 - RNA, 22 nt, Human
cacaaccuuggcucaccucaac

SEQ ID NO: 749580 - RNA, 22 nt, Human
caggcaugugacaccacaccca

SEQ ID NO: 749581 - RNA, 19 nt, Human
cccaggcuggagugcaaug

SEQ ID NO: 749582 - RNA, 20 nt, Human
ccucgguucaagugauucuc

SEQ ID NO: 749583 - RNA, 23 nt, Human
ccucgguucaagugauucuccuc

SEQ ID NO: 749584 - RNA, 23 nt, Human
ccucgguucaagugauucuccug

SEQ ID NO: 749585 - RNA, 23 nt, Human
ccugaguagcugggauugcaggc

SEQ ID NO: 749586 - RNA, 24 nt, Human
ccugaguagcugggauugcaggca

SEQ ID NO: 749587 - RNA, 23 nt, Human
ccugccuuggccuccugaguagc

SEQ ID NO: 749588 - RNA, 21 nt, Human
cgcucguugcccaggcuggag

SEQ ID NO: 749589 - RNA, 23 nt, Human
cggaguuucgcucguugcccagg

SEQ ID NO: 749590 - RNA, 20 nt, Human
cguugcccaggcuggagugc

SEQ ID NO: 749591 - RNA, 24 nt, Human
cucaaugucagucaggcuggucuc

SEQ ID NO: 749592 - RNA, 26 nt, Human
cuccugaccucugcugauccgcccgu

SEQ ID NO: 749593 - RNA, 24 nt, Human
cucguugcccaggcuggagugcaa

SEQ ID NO: 749594 - RNA, 24 nt, Human
cugaguagcugggauugcaggcau

SEQ ID NO: 749595 - RNA, 23 nt, Human
cugccuuggccuccugaguagcu

SEQ ID NO: 749596 - RNA, 19 nt, Human
cugugcccggugugacucu

SEQ ID NO: 749597 - RNA, 24 nt, Human
cuuggccuccugaguagcugggau

SEQ ID NO: 749598 - RNA, 20 nt, Human
gaggcaacaacuauaagcac

SEQ ID NO: 749599 - RNA, 22 nt, Human
gaguagcugggauugcaggcau

SEQ ID NO: 749600 - RNA, 18 nt, Human
gauuacaggcgugagcca

SEQ ID NO: 749601 - RNA, 19 nt, Human
gauuacaggcgugagccac

SEQ ID NO: 749602 - RNA, 21 nt, Human
gauuacaggcgugagccacug

SEQ ID NO: 749603 - RNA, 19 nt, Human
gcccaggcuggagugcaau

SEQ ID NO: 749604 - RNA, 19 nt, Human
gcuggagugcaauggcaca

SEQ ID NO: 749605 - RNA, 23 nt, Human
gcuggucucaaacuccugaccuc

SEQ ID NO: 749606 - RNA, 22 nt, Human
ggaguuucgcucguugcccagg

SEQ ID NO: 749607 - RNA, 21 nt, Human
ggcaacaacuauaagcacauc

SEQ ID NO: 749608 - RNA, 24 nt, Human
ggcuggucucaaacuccugaccuc

SEQ ID NO: 749609 - RNA, 18 nt, Human
ggugcugggauuacaggc

SEQ ID NO: 749610 - RNA, 21 nt, Human
gguucaagugauucuccugcc

SEQ ID NO: 749611 - RNA, 20 nt, Human
guagcugggauugcaggcau

SEQ ID NO: 749612 - RNA, 21 nt, Human
gugcugggauuacaggcguga

SEQ ID NO: 749613 - RNA, 21 nt, Human
gugggguuucucaaugucagu

SEQ ID NO: 749614 - RNA, 24 nt, Human
guuucgcucguugcccaggcugga

SEQ ID NO: 749615 - RNA, 23 nt, Human
uaaaaugaaaggcaagaccuaua

SEQ ID NO: 749616 - RNA, 22 nt, Human
uaauuuuguauuuuuaggagcg

SEQ ID NO: 749617 - RNA, 23 nt, Human
uacaggcgugagccacugugccc

SEQ ID NO: 749618 - RNA, 23 nt, Human
uacaggcgugagccacugugccc

SEQ ID NO: 749619 - RNA, 23 nt, Human
uaguaguuuuuaaaccaaaauuc

SEQ ID NO: 749620 - RNA, 22 nt, Human
ucaaggugcugggauuacaggc

SEQ ID NO: 749621 - RNA, 24 nt, Human
ucaaggugcugggauuacaggcgu

SEQ ID NO: 749622 - RNA, 19 nt, Human
ucaagugauucuccugccu

SEQ ID NO: 749623 - RNA, 24 nt, Human
ucccaaaucucauuucuggcagaa

SEQ ID NO: 749624 - RNA, 24 nt, Human
uccugaguagcugggauugcaggc

SEQ ID NO: 749625 - RNA, 19 nt, Human
ucgcucguugcccaggcug

SEQ ID NO: 749626 - RNA, 20 nt, Human
ucgcucguugcccaggcugg

SEQ ID NO: 749627 - RNA, 21 nt, Human
ucgcucguugcccaggcugga

SEQ ID NO: 749628 - RNA, 24 nt, Human
ucgguucaagugauucuccugccu

SEQ ID NO: 749629 - RNA, 21 nt, Human
ucucaaacuccugaccucugc

SEQ ID NO: 749630 - RNA, 24 nt, Human
ucucaaggugcugggauuacaggc

SEQ ID NO: 749631 - RNA, 23 nt, Human
ucugagacaacuaagcugcauuu

SEQ ID NO: 749632 - RNA, 20 nt, Human
ugaacgcccaggacaucuuc

SEQ ID NO: 749633 - RNA, 22 nt, Human
ugaagcuuccugcaccaggucc

SEQ ID NO: 749634 - RNA, 23 nt, Human
ugaagcuuccugcaccagguccu

SEQ ID NO: 749635 - RNA, 20 nt, Human
ugauucuccugccuuggccu

SEQ ID NO: 749636 - RNA, 20 nt, Human
ugcaauggcacaaccuuggc

SEQ ID NO: 749637 - RNA, 24 nt, Human
ugccaacguucaguugccagaaug

SEQ ID NO: 749638 - RNA, 18 nt, Human
ugcccaggcuggagugca

SEQ ID NO: 749639 - RNA, 21 nt, Human
ugcccaggcuggagugcaaug

SEQ ID NO: 749640 - RNA, 24 nt, Human
ugcccaggcuggagugcaauggca

SEQ ID NO: 749641 - RNA, 20 nt, Human
ugccuuggccuccugaguaa

SEQ ID NO: 749642 - RNA, 24 nt, Human
ugcugggauuacaggcgugagcca

SEQ ID NO: 749643 - RNA, 23 nt, Human
uggagugcaauggcacaaccuug

SEQ ID NO: 749644 - RNA, 24 nt, Human
uggagugcaauggcacaaccuugg

SEQ ID NO: 749645 - RNA, 24 nt, Human
uggcacaaccuuggcucaccucaa

SEQ ID NO: 749646 - RNA, 19 nt, Human
uggcagaaagcucaaacca

SEQ ID NO: 749647 - RNA, 20 nt, Human
uggccuccugaguagcuggg

SEQ ID NO: 749648 - RNA, 19 nt, Human
uggcucaccucaaccucua

SEQ ID NO: 749649 - RNA, 18 nt, Human
ugggauuacaggcgugag

SEQ ID NO: 749650 - RNA, 21 nt, Human
ugggauuacaggcgugagcca

SEQ ID NO: 749651 - RNA, 22 nt, Human
ugggauuacaggcgugagccac

SEQ ID NO: 749652 - RNA, 22 nt, Human
ugggauuacaggcgugagccac

SEQ ID NO: 749653 - RNA, 22 nt, Human
ugggauuacaggcgugagccac

SEQ ID NO: 749654 - RNA, 24 nt, Human
ugggauuacaggcgugagccacug

SEQ ID NO: 749655 - RNA, 26 nt, Human
ugggauuacaggcgugagccacugug

SEQ ID NO: 749656 - RNA, 18 nt, Human
ugggauugcaggcaugug

SEQ ID NO: 749657 - RNA, 24 nt, Human
ugggauugcaggcaugugacacca

SEQ ID NO: 749658 - RNA, 22 nt, Human
uuaaaaugaaaggcaagaccua

SEQ ID NO: 749659 - RNA, 21 nt, Human
uuaggagcggugggguuucuc

SEQ ID NO: 749660 - RNA, 20 nt, Human
uucaagugauucuccugccu

SEQ ID NO: 749661 - RNA, 24 nt, Human
uucaagugauucuccugccuuggc

SEQ ID NO: 749662 - RNA, 20 nt, Human
uucaguugccagaauggcag

SEQ ID NO: 749663 - RNA, 24 nt, Human
uucgcucguugcccaggcuggagu

SEQ ID NO: 749664 - RNA, 18 nt, Human
uugcccaggcuggagugc

SEQ ID NO: 749665 - RNA, 21 nt, Human
uuucgcucguugcccaggcug

SEQ ID NO: 749666 - RNA, 22 nt, Human
uuucgcucguugcccaggcugg

SEQ ID NO: 749667 - RNA, 23 nt, Human
uuucgcucguugcccaggcugga

SEQ ID NO: 749668 - RNA, 18 nt, Human
aaaaaugugaaaaucacc

SEQ ID NO: 749669 - RNA, 27 nt, Human
aaaagaaaaugcaaagugaggaugacc

SEQ ID NO: 749670 - RNA, 20 nt, Human
aaacacaggcuuuucucuug

SEQ ID NO: 749671 - RNA, 22 nt, Human
aaauggccucgccucagagagc

SEQ ID NO: 749672 - RNA, 22 nt, Human
aauaggaaaaguacacauucug

SEQ ID NO: 749673 - RNA, 23 nt, Human
aaucaaguuguguugccugggca

SEQ ID NO: 749674 - RNA, 21 nt, Human
acuccccagguuaaacacccu

SEQ ID NO: 749675 - RNA, 20 nt, Human
agagacacuucugaccucau

SEQ ID NO: 749676 - RNA, 19 nt, Human
agauguuggaggaccaggc

SEQ ID NO: 749677 - RNA, 21 nt, Human
agguaguacagaacaauagug

SEQ ID NO: 749678 - RNA, 20 nt, Human
aguuguguugccugggcacu

SEQ ID NO: 749679 - RNA, 22 nt, Human
auacauuuccagaaccauugcc

SEQ ID NO: 749680 - RNA, 20 nt, Human
auacguaucgauuaucuuuc

SEQ ID NO: 749681 - RNA, 24 nt, Human
augaaaaucaauuuugcacaaaua

SEQ ID NO: 749682 - RNA, 22 nt, Human
caacacacagcaauaaaauaug

SEQ ID NO: 749683 - RNA, 19 nt, Human
caauaggaaaaguacacau

SEQ ID NO: 749684 - RNA, 18 nt, Human
cacccuguaauuuaccuu

SEQ ID NO: 749685 - RNA, 18 nt, Human
cacugacagccagggggc

SEQ ID NO: 749686 - RNA, 21 nt, Human
cacuucugaccucaucggaga

SEQ ID NO: 749687 - RNA, 19 nt, Human
cagcacaguacaaacugcc

SEQ ID NO: 749688 - RNA, 24 nt, Human
cagcacaguacaaacugccacaca

SEQ ID NO: 749689 - RNA, 25 nt, Human
caggaaaacauuaacauuaaaugaa

SEQ ID NO: 749690 - RNA, 18 nt, Human
cauuccguuucuuuuucu

SEQ ID NO: 749691 - RNA, 28 nt, Human
cauuuucaucaccaaacugagccagagg

SEQ ID NO: 749692 - RNA, 18 nt, Human
ccaaagaugcaaaacagg

SEQ ID NO: 749693 - RNA, 20 nt, Human
ccagaggaaugaacauggua

SEQ ID NO: 749694 - RNA, 22 nt, Human
ccauccaucuguucccuacucc

SEQ ID NO: 749695 - RNA, 22 nt, Human
ccuaaaaccauuccuggccuag

SEQ ID NO: 749696 - RNA, 23 nt, Human
ccugaaauucuuguacuucagag

SEQ ID NO: 749697 - RNA, 18 nt, Human
cgccaaagaugcaaaaca

SEQ ID NO: 749698 - RNA, 20 nt, Human
cuaaaaaugugaaaaucacc

SEQ ID NO: 749699 - RNA, 20 nt, Human
cuacucccacuuggguuccu

SEQ ID NO: 749700 - RNA, 24 nt, Human
cuacucccacuuggguuccuuugu

SEQ ID NO: 749701 - RNA, 18 nt, Human
cuccagugugacacaagg

SEQ ID NO: 749702 - RNA, 20 nt, Human
cuggacagguuauaaagagu

SEQ ID NO: 749703 - RNA, 19 nt, Human
cuuggguuccuuuguggua

SEQ ID NO: 749704 - RNA, 26 nt, Human
cuugucauccggcaacagucuucccu

SEQ ID NO: 749705 - RNA, 19 nt, Human
gcagcagaggagagguuug

SEQ ID NO: 749706 - RNA, 19 nt, Human
gcaucauacauuuccagaa

SEQ ID NO: 749707 - RNA, 23 nt, Human
gggccagagguccugacaggaaa

SEQ ID NO: 749708 - RNA, 18 nt, Human
gucaacacacagcaauaa

SEQ ID NO: 749709 - RNA, 20 nt, Human
uaaaaccauuccuggccuag

SEQ ID NO: 749710 - RNA, 25 nt, Human
uaaaucaccugaaauucuuguacuu

SEQ ID NO: 749711 - RNA, 23 nt, Human
uaacuccccagguuaaacacccu

SEQ ID NO: 749712 - RNA, 22 nt, Human
uaagcaggaaaacauuaacauu

SEQ ID NO: 749713 - RNA, 23 nt, Human
uacaaacugccacacaaauuacu

SEQ ID NO: 749714 - RNA, 23 nt, Human
uacagaacaauagugacagccuu

SEQ ID NO: 749715 - RNA, 24 nt, Human
uaggaaaaguacacauucugaaaa

SEQ ID NO: 749716 - RNA, 20 nt, Human
uagggugaggcgcggcuacu

SEQ ID NO: 749717 - RNA, 21 nt, Human
ucaaaacauuuucaucaccaa

SEQ ID NO: 749718 - RNA, 21 nt, Human
ucaccaaacugagccagagga

SEQ ID NO: 749719 - RNA, 18 nt, Human
uccccggcacugccuucc

SEQ ID NO: 749720 - RNA, 22 nt, Human
ucccuacucccacuuggguucc

SEQ ID NO: 749721 - RNA, 24 nt, Human
uccuuugugguaugaaauagagac

SEQ ID NO: 749722 - RNA, 22 nt, Human
ucucuggggagacacagagguc

SEQ ID NO: 749723 - RNA, 18 nt, Human
ucuucgcgccauccaucu

SEQ ID NO: 749724 - RNA, 25 nt, Human
ucuuucaaaacauuuucaucaccaa

SEQ ID NO: 749725 - RNA, 20 nt, Human
ugacagccagggggcuccug

SEQ ID NO: 749726 - RNA, 18 nt, Human
ugacaggaaaucgccaaa

SEQ ID NO: 749727 - RNA, 25 nt, Human
ugaggaacuaaaaaugugaaaauca

SEQ ID NO: 749728 - RNA, 25 nt, Human
ugaggaugaaaauuuccugugggcc

SEQ ID NO: 749729 - RNA, 19 nt, Human
ugggcagcaccuucugggc

SEQ ID NO: 749730 - RNA, 18 nt, Human
ugggccaaaacaaagggu

SEQ ID NO: 749731 - RNA, 19 nt, Human
uguaagauguuggaggacc

SEQ ID NO: 749732 - RNA, 24 nt, Human
ugugaucaagcagcuuaaaucacc

SEQ ID NO: 749733 - RNA, 26 nt, Human
uucccugggggcgucucaggcauucu

SEQ ID NO: 749734 - RNA, 19 nt, Human
uugccauaaucaaguugug

SEQ ID NO: 749735 - RNA, 24 nt, Human
uugccauaaucaaguuguguugcc

SEQ ID NO: 749736 - RNA, 23 nt, Human
aaaaaacaaaacaacaaaacaaa

SEQ ID NO: 749737 - RNA, 18 nt, Human
aaaaagaaccaacugaac

SEQ ID NO: 749738 - RNA, 21 nt, Human
aaaacaaaacaaaacaaaacc

SEQ ID NO: 749739 - RNA, 26 nt, Human
aaaacaaaacaaaacaaaaccccaaa

SEQ ID NO: 749740 - RNA, 25 nt, Human
aaaacaaaacaaaaccccaaaaaag

SEQ ID NO: 749741 - RNA, 21 nt, Human
aaaacaaaacaacaaaacaaa

SEQ ID NO: 749742 - RNA, 21 nt, Human
aaaacaacaaaacaaaacaaa

SEQ ID NO: 749743 - RNA, 22 nt, Human
aaaacaacaaaacaaaacaaaa

SEQ ID NO: 749744 - RNA, 25 nt, Human
aaaacaacaaaacaaaacaaaacaa

SEQ ID NO: 749745 - RNA, 22 nt, Human
aaaaccccaaaaaaagaaccaa

SEQ ID NO: 749746 - RNA, 21 nt, Human
aaaauaucuauugacaguaca

SEQ ID NO: 749747 - RNA, 24 nt, Human
aaacaaaacaaaacaaaaccccaa

SEQ ID NO: 749748 - RNA, 25 nt, Human
aaacaaaacaaaacaaaaccccaaa

SEQ ID NO: 749749 - RNA, 26 nt, Human
aaacaaaacaaaacaaaaccccaaaa

SEQ ID NO: 749750 - RNA, 19 nt, Human
aaacaacaaaacaaaacaa

SEQ ID NO: 749751 - RNA, 19 nt, Human
aaacaacaaaacaaaacaa

SEQ ID NO: 749752 - RNA, 20 nt, Human
aaagcagccauugguugaga

SEQ ID NO: 749753 - RNA, 25 nt, Human
aacaaaacaacaaaacaaaacaaaa

SEQ ID NO: 749754 - RNA, 22 nt, Human
aacucuccucuccccucgggcc

SEQ ID NO: 749755 - RNA, 22 nt, Human
aagaacaucagcaaauucacag

SEQ ID NO: 749756 - RNA, 21 nt, Human
aagcagccauugguugagaua

SEQ ID NO: 749757 - RNA, 18 nt, Human
aagcauggacauguugcc

SEQ ID NO: 749758 - RNA, 26 nt, Human
aagcugaaggggccuucaggcuugga

SEQ ID NO: 749759 - RNA, 28 nt, Human
aaggaaaaaacaaaacaacaaaacaaaa

SEQ ID NO: 749760 - RNA, 20 nt, Human
aaucacagcaaccucaucca

SEQ ID NO: 749761 - RNA, 21 nt, Human
acaaaacaaaacaaaacaaaa

SEQ ID NO: 749762 - RNA, 25 nt, Human
acaaaacaaaacaaaacaaaacccc

SEQ ID NO: 749763 - RNA, 19 nt, Human
acaaaacaaaacaaaaccc

SEQ ID NO: 749764 - RNA, 25 nt, Human
acaaaacaaaacaaaaccccaaaaa

SEQ ID NO: 749765 - RNA, 18 nt, Human
acaaaacaacaaaacaaa

SEQ ID NO: 749766 - RNA, 19 nt, Human
acaaaacaacaaaacaaaa

SEQ ID NO: 749767 - RNA, 21 nt, Human
acaaaaccccaaaaaaagaac

SEQ ID NO: 749768 - RNA, 18 nt, Human
accccaaaaaaagaacca

SEQ ID NO: 749769 - RNA, 24 nt, Human
acucgguucaccuuugacaccugg

SEQ ID NO: 749770 - RNA, 18 nt, Human
agaagcugaaggggccuu

SEQ ID NO: 749771 - RNA, 22 nt, Human
agaagcugaaggggccuucagg

SEQ ID NO: 749772 - RNA, 19 nt, Human
agacacacagaccucgaca

SEQ ID NO: 749773 - RNA, 18 nt, Human
agagauuagcaaaaugaa

SEQ ID NO: 749774 - RNA, 28 nt, Human
agagguggggaagccaggggguggggag

SEQ ID NO: 749775 - RNA, 20 nt, Human
agcaucugaggagccgucuc

SEQ ID NO: 749776 - RNA, 22 nt, Human
agccaggggguggggaguccag

SEQ ID NO: 749777 - RNA, 18 nt, Human
agcgagaggcgcggcugc

SEQ ID NO: 749778 - RNA, 20 nt, Human
aggauugagauggaggggca

SEQ ID NO: 749779 - RNA, 23 nt, Human
aggccucuagcucgccgcuccag

SEQ ID NO: 749780 - RNA, 19 nt, Human
aggggguggggaguccagc

SEQ ID NO: 749781 - RNA, 21 nt, Human
agucgcuaagugaacucccac

SEQ ID NO: 749782 - RNA, 19 nt, Human
auauauauauauauauaua

SEQ ID NO: 749783 - RNA, 19 nt, Human
auauauauauauauauaua

SEQ ID NO: 749784 - RNA, 19 nt, Human
auauauauauauauauaua

SEQ ID NO: 749785 - RNA, 19 nt, Human
auauauauauauauauaua

SEQ ID NO: 749786 - RNA, 19 nt, Human
auauauauauauauauaua

SEQ ID NO: 749787 - RNA, 19 nt, Human
auauauauauauauauaua

SEQ ID NO: 749788 - RNA, 19 nt, Human
auauauauauauauauaua

SEQ ID NO: 749789 - RNA, 19 nt, Human
auauauauauauauauaua

SEQ ID NO: 749790 - RNA, 19 nt, Human
auauauauauauauauaua

SEQ ID NO: 749791 - RNA, 19 nt, Human
auauauauauauauauaua

SEQ ID NO: 749792 - RNA, 19 nt, Human
auauauauauauauauaua

SEQ ID NO: 749793 - RNA, 19 nt, Human
auauauauauauauauaua

SEQ ID NO: 749794 - RNA, 19 nt, Human
auauauauauauauauaua

SEQ ID NO: 749795 - RNA, 19 nt, Human
auauauauauauauauaua

SEQ ID NO: 749796 - RNA, 19 nt, Human
auauauauauauauauaua

SEQ ID NO: 749797 - RNA, 19 nt, Human
auauauauauauauauaua

SEQ ID NO: 749798 - RNA, 19 nt, Human
auauauauauauauauaua

SEQ ID NO: 749799 - RNA, 19 nt, Human
auauauauauauauauaua

SEQ ID NO: 749800 - RNA, 19 nt, Human
auauauauauauauauaua

SEQ ID NO: 749801 - RNA, 19 nt, Human
auauauauauauauauaua

SEQ ID NO: 749802 - RNA, 19 nt, Human
auauauauauauauauaua

SEQ ID NO: 749803 - RNA, 19 nt, Human
auauauauauauauauaua

SEQ ID NO: 749804 - RNA, 19 nt, Human
auauauauauauauauaua

SEQ ID NO: 749805 - RNA, 19 nt, Human
auauauauauauauauaua

SEQ ID NO: 749806 - RNA, 20 nt, Human
aucacagcaaccucauccag

SEQ ID NO: 749807 - RNA, 22 nt, Human
aucugagucgcuaagugaacuc

SEQ ID NO: 749808 - RNA, 18 nt, Human
augcccugcuaggcuggu

SEQ ID NO: 749809 - RNA, 20 nt, Human
augcccugcuaggcuggucu

SEQ ID NO: 749810 - RNA, 21 nt, Human
caaaaaaagaaccaacugaac

SEQ ID NO: 749811 - RNA, 23 nt, Human
caaaacaaaacaaaacaaaaccc

SEQ ID NO: 749812 - RNA, 23 nt, Human
caaaacaaaacaaaaccccaaaa

SEQ ID NO: 749813 - RNA, 25 nt, Human
caaaacaaaaccccaaaaaaagaac

SEQ ID NO: 749814 - RNA, 26 nt, Human
caaaaccccaaaaaaagaagggaguc

SEQ ID NO: 749815 - RNA, 20 nt, Human
caaacucuugccccacuccu

SEQ ID NO: 749816 - RNA, 27 nt, Human
caacaaaacaaaacaaaacaaaacccc

SEQ ID NO: 749817 - RNA, 26 nt, Human
caaucacagcaaccucauccaguaag

SEQ ID NO: 749818 - RNA, 21 nt, Human
cacccgcgcucacccccuaag

SEQ ID NO: 749819 - RNA, 18 nt, Human
cacuggacuuucccuccu

SEQ ID NO: 749820 - RNA, 21 nt, Human
cagacacacagaccucgacac

SEQ ID NO: 749821 - RNA, 21 nt, Human
caguggccucaggauucagcc

SEQ ID NO: 749822 - RNA, 22 nt, Human
caucacaaacaguuauggcuaa

SEQ ID NO: 749823 - RNA, 21 nt, Human
caucacuaaaagcauggacau

SEQ ID NO: 749824 - RNA, 22 nt, Human
caugagaagcugaaggggccuu

SEQ ID NO: 749825 - RNA, 18 nt, Human
cauugguugagauaucug

SEQ ID NO: 749826 - RNA, 19 nt, Human
ccaaaugauuuuccuucug

SEQ ID NO: 749827 - RNA, 21 nt, Human
ccaagggaugagccuuuggga

SEQ ID NO: 749828 - RNA, 19 nt, Human
ccagcccacgaucucugcc

SEQ ID NO: 749829 - RNA, 23 nt, Human
cccaaaaaaagaaccaacugaac

SEQ ID NO: 749830 - RNA, 26 nt, Human
cccaaacucuccucuccccucgggcc

SEQ ID NO: 749831 - RNA, 24 nt, Human
cccacuccugcucuuguaccccca

SEQ ID NO: 749832 - RNA, 20 nt, Human
ccccaaaaaaagaaccaacu

SEQ ID NO: 749833 - RNA, 25 nt, Human
ccccaaaaaaagaaccaacugaaca

SEQ ID NO: 749834 - RNA, 18 nt, Human
ccccaaacucuccucucc

SEQ ID NO: 749835 - RNA, 19 nt, Human
ccccguguggcaggagggc

SEQ ID NO: 749836 - RNA, 20 nt, Human
cccugccccaaacucuccuc

SEQ ID NO: 749837 - RNA, 24 nt, Human
cccugccccaaacucuccucuccc

SEQ ID NO: 749838 - RNA, 24 nt, Human
cgacacccgcgcucacccccuaag

SEQ ID NO: 749839 - RNA, 22 nt, Human
cuccaccagcucaagaaaagga

SEQ ID NO: 749840 - RNA, 20 nt, Human
cucccugccccaaacucucc

SEQ ID NO: 749841 - RNA, 21 nt, Human
cucgacacccgcgcucacccc

SEQ ID NO: 749842 - RNA, 23 nt, Human
cugcagacacacagaccucgaca

SEQ ID NO: 749843 - RNA, 26 nt, Human
cuggaccagcggagugcuccugaaau

SEQ ID NO: 749844 - RNA, 18 nt, Human
cuguuccucccugcccca

SEQ ID NO: 749845 - RNA, 22 nt, Human
cuuaucuccuccauggcuucug

SEQ ID NO: 749846 - RNA, 19 nt, Human
cuuucucccagaaaagccc

SEQ ID NO: 749847 - RNA, 21 nt, Human
gaauaacuuucucccagaaaa

SEQ ID NO: 749848 - RNA, 20 nt, Human
gaaucugaacggaagugcca

SEQ ID NO: 749849 - RNA, 26 nt, Human
gacaacaaagcagccauugguugaga

SEQ ID NO: 749850 - RNA, 18 nt, Human
gacucgguucaccuuuga

SEQ ID NO: 749851 - RNA, 23 nt, Human
gagagguggggaagccagggggu

SEQ ID NO: 749852 - RNA, 21 nt, Human
gaucucugccaccuacauggu

SEQ ID NO: 749853 - RNA, 21 nt, Human
gauuagcaaaaugaaucugaa

SEQ ID NO: 749854 - RNA, 19 nt, Human
gcaucugaggagccgucuc

SEQ ID NO: 749855 - RNA, 22 nt, Human
gccccguguggcaggagggcuc

SEQ ID NO: 749856 - RNA, 18 nt, Human
gcgcggcugccgccggag

SEQ ID NO: 749857 - RNA, 21 nt, Human
gcugccgccggagccgggccc

SEQ ID NO: 749858 - RNA, 18 nt, Human
ggaaaaaacaaaacaaca

SEQ ID NO: 749859 - RNA, 26 nt, Human
ggaaaaaacaaaacaacaaaacaaaa

SEQ ID NO: 749860 - RNA, 26 nt, Human
ggaaaaccuuaaaaucacucaacuga

SEQ ID NO: 749861 - RNA, 19 nt, Human
ggagcaaaguucacgaagg

SEQ ID NO: 749862 - RNA, 22 nt, Human
ggaguccagcuggggauccuug

SEQ ID NO: 749863 - RNA, 21 nt, Human
ggcgcaaucuggaaauggaaa

SEQ ID NO: 749864 - RNA, 21 nt, Human
gggcaugugcaaacaacagaa

SEQ ID NO: 749865 - RNA, 19 nt, Human
gguagguguauagauaguu

SEQ ID NO: 749866 - RNA, 21 nt, Human
gguggggaguccagcugggga

SEQ ID NO: 749867 - RNA, 23 nt, Human
gugcaaacaacagaaagggggaa

SEQ ID NO: 749868 - RNA, 25 nt, Human
guuggcuuugcaaugggagggguag

SEQ ID NO: 749869 - RNA, 22 nt, Human
uaacuuucucccagaaaagccc

SEQ ID NO: 749870 - RNA, 25 nt, Human
uaagaugcacaccugggagcagggc

SEQ ID NO: 749871 - RNA, 19 nt, Human
uaagugaacucccacgugg

SEQ ID NO: 749872 - RNA, 23 nt, Human
uacgaaaugacauucagcuaaua

SEQ ID NO: 749873 - RNA, 18 nt, Human
uagcagucugcagacaca

SEQ ID NO: 749874 - RNA, 24 nt, Human
uagcagucugcagacacacagacc

SEQ ID NO: 749875 - RNA, 21 nt, Human
uagcauguauuuaacuaucuc

SEQ ID NO: 749876 - RNA, 19 nt, Human
uauauauauauauauauau

SEQ ID NO: 749877 - RNA, 19 nt, Human
uauauauauauauauauau

SEQ ID NO: 749878 - RNA, 19 nt, Human
uauauauauauauauauau

SEQ ID NO: 749879 - RNA, 19 nt, Human
uauauauauauauauauau

SEQ ID NO: 749880 - RNA, 19 nt, Human
uauauauauauauauauau

SEQ ID NO: 749881 - RNA, 19 nt, Human
uauauauauauauauauau

SEQ ID NO: 749882 - RNA, 19 nt, Human
uauauauauauauauauau

SEQ ID NO: 749883 - RNA, 19 nt, Human
uauauauauauauauauau

SEQ ID NO: 749884 - RNA, 19 nt, Human
uauauauauauauauauau

SEQ ID NO: 749885 - RNA, 19 nt, Human
uauauauauauauauauau

SEQ ID NO: 749886 - RNA, 19 nt, Human
uauauauauauauauauau

SEQ ID NO: 749887 - RNA, 19 nt, Human
uauauauauauauauauau

SEQ ID NO: 749888 - RNA, 19 nt, Human
uauauauauauauauauau

SEQ ID NO: 749889 - RNA, 19 nt, Human
uauauauauauauauauau

SEQ ID NO: 749890 - RNA, 19 nt, Human
uauauuaaaaagagagcca

SEQ ID NO: 749891 - RNA, 18 nt, Human
uaucugagucgcuaagug

SEQ ID NO: 749892 - RNA, 18 nt, Human
ucacaugagaagcugaag

SEQ ID NO: 749893 - RNA, 24 nt, Human
ucagccagacuuaaacuugcucaa

SEQ ID NO: 749894 - RNA, 19 nt, Human
ucccacguggacacagcca

SEQ ID NO: 749895 - RNA, 20 nt, Human
ucccagaaaagcccacugca

SEQ ID NO: 749896 - RNA, 18 nt, Human
ucccagagacagaaaucc

SEQ ID NO: 749897 - RNA, 20 nt, Human
ucccuugucagacaacaaag

SEQ ID NO: 749898 - RNA, 18 nt, Human
ucgacacccgcgcucacc

SEQ ID NO: 749899 - RNA, 19 nt, Human
ucgcuaagugaacucccac

SEQ ID NO: 749900 - RNA, 21 nt, Human
ucgcuaagugaacucccacgu

SEQ ID NO: 749901 - RNA, 24 nt, Human
ucguauuccagucugugaccacag

SEQ ID NO: 749902 - RNA, 18 nt, Human
ucugcagacacacagacc

SEQ ID NO: 749903 - RNA, 19 nt, Human
ucugcagacacacagaccu

SEQ ID NO: 749904 - RNA, 21 nt, Human
ugaagggcccuucccagucca

SEQ ID NO: 749905 - RNA, 18 nt, Human
ugaagugcaagguuccug

SEQ ID NO: 749906 - RNA, 21 nt, Human
ugaauaacuuucucccagaaa

SEQ ID NO: 749907 - RNA, 22 nt, Human
ugacagguacacuggacuuucc

SEQ ID NO: 749908 - RNA, 19 nt, Human
ugcccugcuaggcuggucu

SEQ ID NO: 749909 - RNA, 24 nt, Human
ugcccugcuaggcuggucuuagua

SEQ ID NO: 749910 - RNA, 18 nt, Human
uggaaaacuagaaaacua

SEQ ID NO: 749911 - RNA, 19 nt, Human
uggaagacuaaagaaccca

SEQ ID NO: 749912 - RNA, 23 nt, Human
ugguagaaaucaaauguaaaaca

SEQ ID NO: 749913 - RNA, 18 nt, Human
uguacaucuacaugugau

SEQ ID NO: 749914 - RNA, 23 nt, Human
ugugcaaacaacagaaaggggga

SEQ ID NO: 749915 - RNA, 23 nt, Human
uguguacaucacaaacaguuaug

SEQ ID NO: 749916 - RNA, 19 nt, Human
uguguuggagcaaaguuca

SEQ ID NO: 749917 - RNA, 19 nt, Human
uguugccgccuggaccagc

SEQ ID NO: 749918 - RNA, 21 nt, Human
uucaaacucuugccccacucc

SEQ ID NO: 749919 - RNA, 22 nt, Human
uucagccagacuuaaacuugcu

SEQ ID NO: 749920 - RNA, 18 nt, Human
uucucccagaaaagccca

SEQ ID NO: 749921 - RNA, 19 nt, Human
uugaauauuuauuuaaaaa

SEQ ID NO: 749922 - RNA, 21 nt, Human
uuggagcaaaguucacgaagg

SEQ ID NO: 749923 - RNA, 24 nt, Human
uuggagcaaaguucacgaaggcca

SEQ ID NO: 749924 - RNA, 21 nt, Human
uugucauagguuagcagucug

SEQ ID NO: 749925 - RNA, 21 nt, Human
uuuaaccacguugaaacacac

SEQ ID NO: 749926 - RNA, 25 nt, Human
aaacagaaacaagaaagcaaggaaa

SEQ ID NO: 749927 - RNA, 25 nt, Human
aaagcaaauaaccaaugaaaucaag

SEQ ID NO: 749928 - RNA, 23 nt, Human
aaauaaccaaugaaaucaagaac

SEQ ID NO: 749929 - RNA, 19 nt, Human
aacaauuuaaaaccccauu

SEQ ID NO: 749930 - RNA, 21 nt, Human
aacaauuuaaaaccccauuuc

SEQ ID NO: 749931 - RNA, 25 nt, Human
aaccaaugaaaucaagaacucccau

SEQ ID NO: 749932 - RNA, 19 nt, Human
aaccaugaaugcagcagca

SEQ ID NO: 749933 - RNA, 18 nt, Human
aacuccuacccuugcccc

SEQ ID NO: 749934 - RNA, 25 nt, Human
aagcaaauaaccaaugaaaucaaga

SEQ ID NO: 749935 - RNA, 22 nt, Human
aagcaaggaaaagauaaucuau

SEQ ID NO: 749936 - RNA, 20 nt, Human
aagccaggguacccuucugu

SEQ ID NO: 749937 - RNA, 21 nt, Human
aaggaaauggaagggaagcgg

SEQ ID NO: 749938 - RNA, 21 nt, Human
aauaagccaggguacccuucu

SEQ ID NO: 749939 - RNA, 26 nt, Human
aauggugggguguagacagaccuggg

SEQ ID NO: 749940 - RNA, 20 nt, Human
acagaggcuaaaaggagaga

SEQ ID NO: 749941 - RNA, 19 nt, Human
accccaagaggacacauac

SEQ ID NO: 749942 - RNA, 24 nt, Human
acgaggagggggaagggaggggau

SEQ ID NO: 749943 - RNA, 22 nt, Human
acgcagccaggccuggagaaag

SEQ ID NO: 749944 - RNA, 18 nt, Human
acgccgggccugcccugg

SEQ ID NO: 749945 - RNA, 20 nt, Human
acuccaggaugugggcccca

SEQ ID NO: 749946 - RNA, 21 nt, Human
acucuuucuccuccuaauccu

SEQ ID NO: 749947 - RNA, 24 nt, Human
agaaacaagaaagcaaggaaaaga

SEQ ID NO: 749948 - RNA, 22 nt, Human
agaaccuuaaccccuggcuuac

SEQ ID NO: 749949 - RNA, 20 nt, Human
agacagaaugaauggugggg

SEQ ID NO: 749950 - RNA, 22 nt, Human
agagauggggccaugcccugcu

SEQ ID NO: 749951 - RNA, 19 nt, Human
agagggcugggcccagaag

SEQ ID NO: 749952 - RNA, 21 nt, Human
aggaaauggaagggaagcggg

SEQ ID NO: 749953 - RNA, 23 nt, Human
aggagggggaagggaggggaugu

SEQ ID NO: 749954 - RNA, 22 nt, Human
aggcaagagcaagucaaaucua

SEQ ID NO: 749955 - RNA, 19 nt, Human
aggcagagaacgcagccag

SEQ ID NO: 749956 - RNA, 24 nt, Human
aggcagagaacgcagccaggccug

SEQ ID NO: 749957 - RNA, 18 nt, Human
aggcagggaaaaggucag

SEQ ID NO: 749958 - RNA, 20 nt, Human
aggcagggaaaaggucaggu

SEQ ID NO: 749959 - RNA, 22 nt, Human
aggcauggcugugcagaagucu

SEQ ID NO: 749960 - RNA, 19 nt, Human
aggcugggguggggcaagg

SEQ ID NO: 749961 - RNA, 22 nt, Human
agggaagccuggggaaagggau

SEQ ID NO: 749962 - RNA, 21 nt, Human
agggaggggauguaaguuucu

SEQ ID NO: 749963 - RNA, 24 nt, Human
agggaggggauguaaguuucuugg

SEQ ID NO: 749964 - RNA, 23 nt, Human
agggcacugucuugagacccuuu

SEQ ID NO: 749965 - RNA, 18 nt, Human
agguacaucaagaaacgg

SEQ ID NO: 749966 - RNA, 21 nt, Human
aguggagaggaaagagaauca

SEQ ID NO: 749967 - RNA, 23 nt, Human
auaaccaaugaaaucaagaacuc

SEQ ID NO: 749968 - RNA, 25 nt, Human
auagcagaaaguaaaaaguggugga

SEQ ID NO: 749969 - RNA, 20 nt, Human
caaaacagaaacaagaaagc

SEQ ID NO: 749970 - RNA, 26 nt, Human
caaauaaccaaugaaaucaagaacuc

SEQ ID NO: 749971 - RNA, 26 nt, Human
caaauucuuggaccaguuuuguccaa

SEQ ID NO: 749972 - RNA, 18 nt, Human
caacaagcagcugaggcc

SEQ ID NO: 749973 - RNA, 19 nt, Human
caacaagcagcugaggccu

SEQ ID NO: 749974 - RNA, 19 nt, Human
cacagggccagcugggaca

SEQ ID NO: 749975 - RNA, 22 nt, Human
cagaaacaagaaagcaaggaaa

SEQ ID NO: 749976 - RNA, 20 nt, Human
cagaaugaaugguggggugu

SEQ ID NO: 749977 - RNA, 20 nt, Human
cagagcccagacgccgggcc

SEQ ID NO: 749978 - RNA, 21 nt, Human
cagcaaugaaagauuaaggca

SEQ ID NO: 749979 - RNA, 23 nt, Human
cagcacaaugcaaacugggucuu

SEQ ID NO: 749980 - RNA, 24 nt, Human
cagcacaaugcaaacugggucuuu

SEQ ID NO: 749981 - RNA, 22 nt, Human
cagcagaagagaacagugaugg

SEQ ID NO: 749982 - RNA, 21 nt, Human
cagccaggccuggagaaaguc

SEQ ID NO: 749983 - RNA, 26 nt, Human
cagcugggacagguagcgcauccccc

SEQ ID NO: 749984 - RNA, 20 nt, Human
caggauuaggaagaggcugg

SEQ ID NO: 749985 - RNA, 21 nt, Human
caggauuaggaagaggcuggg

SEQ ID NO: 749986 - RNA, 21 nt, Human
caggcacaugcccaguaccca

SEQ ID NO: 749987 - RNA, 20 nt, Human
cagugaugggcccuaguccu

SEQ ID NO: 749988 - RNA, 18 nt, Human
cauuucacuuucaaaaca

SEQ ID NO: 749989 - RNA, 19 nt, Human
ccaauccgcaaguacugcc

SEQ ID NO: 749990 - RNA, 21 nt, Human
ccaccuuucugcugaggcagu

SEQ ID NO: 749991 - RNA, 21 nt, Human
ccacugaguguguggcacagg

SEQ ID NO: 749992 - RNA, 22 nt, Human
ccaguuuuguccaaggccaccu

SEQ ID NO: 749993 - RNA, 19 nt, Human
cccaacaugaaaaguggac

SEQ ID NO: 749994 - RNA, 19 nt, Human
cccaaugaaccccacauaa

SEQ ID NO: 749995 - RNA, 19 nt, Human
cccaggccuacagccccaa

SEQ ID NO: 749996 - RNA, 19 nt, Human
ccccccuucugccucuccc

SEQ ID NO: 749997 - RNA, 22 nt, Human
cccgcgcccgccuccgcuccuc

SEQ ID NO: 749998 - RNA, 18 nt, Human
cccuagcccaaugaaccc

SEQ ID NO: 749999 - RNA, 19 nt, Human
cccuagcccaaugaacccc

SEQ ID NO: 750000 - RNA, 21 nt, Human
cccuucuguuaggggagggaa

SEQ ID NO: 750001 - RNA, 19 nt, Human
ccgcgcccgccuccgcucc

SEQ ID NO: 750002 - RNA, 21 nt, Human
ccucauaccacuacccuagcc

SEQ ID NO: 750003 - RNA, 22 nt, Human
ccucccucagggaagccuggga

SEQ ID NO: 750004 - RNA, 19 nt, Human
ccugaaggcagggaaaagg

SEQ ID NO: 750005 - RNA, 22 nt, Human
ccugaauaagccaggguacccu

SEQ ID NO: 750006 - RNA, 23 nt, Human
ccuugccccaguucugcaggcug

SEQ ID NO: 750007 - RNA, 22 nt, Human
cggccgcccgcgcccgccuccg

SEQ ID NO: 750008 - RNA, 19 nt, Human
cucauaccacuacccuagc

SEQ ID NO: 750009 - RNA, 20 nt, Human
cugaagacucuuucuccucc

SEQ ID NO: 750010 - RNA, 22 nt, Human
cugaagacucuuucuccuccua

SEQ ID NO: 750011 - RNA, 18 nt, Human
cugggcccagaaguccug

SEQ ID NO: 750012 - RNA, 18 nt, Human
gaaauuacaccaggucug

SEQ ID NO: 750013 - RNA, 25 nt, Human
gaagggggagccccccuucugccuc

SEQ ID NO: 750014 - RNA, 21 nt, Human
gacacaguguggacuaaggag

SEQ ID NO: 750015 - RNA, 19 nt, Human
gagcucuggguuggaggca

SEQ ID NO: 750016 - RNA, 24 nt, Human
gcaaauaaccaaugaaaucaagaa

SEQ ID NO: 750017 - RNA, 23 nt, Human
gcagccagcagguccucccucag

SEQ ID NO: 750018 - RNA, 18 nt, Human
gcagccaggccuggagaa

SEQ ID NO: 750019 - RNA, 18 nt, Human
gcccagaaguccugaagg

SEQ ID NO: 750020 - RNA, 24 nt, Human
gcccaggaucucccaaggccacac

SEQ ID NO: 750021 - RNA, 19 nt, Human
ggaacgaggagggggaagg

SEQ ID NO: 750022 - RNA, 26 nt, Human
ggaagggaggggauguaaguuucuug

SEQ ID NO: 750023 - RNA, 19 nt, Human
ggacagagccaauccgcaa

SEQ ID NO: 750024 - RNA, 18 nt, Human
ggagaugggagauagcag

SEQ ID NO: 750025 - RNA, 19 nt, Human
ggaggcacagggccagcug

SEQ ID NO: 750026 - RNA, 23 nt, Human
ggauuaggaagaggcuggggugg

SEQ ID NO: 750027 - RNA, 18 nt, Human
ggcaagagggcugggccc

SEQ ID NO: 750028 - RNA, 24 nt, Human
ggccugaaagcaaauaaccaaugg

SEQ ID NO: 750029 - RNA, 24 nt, Human
gggaacagacagacagaaugaaug

SEQ ID NO: 750030 - RNA, 22 nt, Human
gggaacgaggagggggaaggga

SEQ ID NO: 750031 - RNA, 23 nt, Human
gggcaaggaccacaggcagagaa

SEQ ID NO: 750032 - RNA, 20 nt, Human
ggggagcucuggguuggagg

SEQ ID NO: 750033 - RNA, 20 nt, Human
ggguagacucugaaccugcc

SEQ ID NO: 750034 - RNA, 22 nt, Human
guagacagaccuggggcucaga

SEQ ID NO: 750035 - RNA, 18 nt, Human
guagcgcaucccccaaaa

SEQ ID NO: 750036 - RNA, 21 nt, Human
uaaaaggagagauggggccau

SEQ ID NO: 750037 - RNA, 21 nt, Human
uaaaccucauaccacuacccu

SEQ ID NO: 750038 - RNA, 21 nt, Human
uaaccccuggcuuacuguccc

SEQ ID NO: 750039 - RNA, 23 nt, Human
uacagccccaacaugaaaagugg

SEQ ID NO: 750040 - RNA, 25 nt, Human
uacaucaagaaacggccugaaagca

SEQ ID NO: 750041 - RNA, 18 nt, Human
uaccugcuccuuccccua

SEQ ID NO: 750042 - RNA, 21 nt, Human
uagaaaggaaauggaagggaa

SEQ ID NO: 750043 - RNA, 23 nt, Human
uagcagaaaguaaaaaguggugg

SEQ ID NO: 750044 - RNA, 24 nt, Human
uagcagaaaguaaaaaguggugga

SEQ ID NO: 750045 - RNA, 25 nt, Human
uagcagaaaguaaaaagugguggaa

SEQ ID NO: 750046 - RNA, 21 nt, Human
uaggcaguguccagggaacag

SEQ ID NO: 750047 - RNA, 22 nt, Human
uaggcauggaaagcuucuaacc

SEQ ID NO: 750048 - RNA, 22 nt, Human
ucaaaacagaaacaagaaagca

SEQ ID NO: 750049 - RNA, 23 nt, Human
ucaagaacucccauaacccuggu

SEQ ID NO: 750050 - RNA, 19 nt, Human
ucaagcaucugcccucugc

SEQ ID NO: 750051 - RNA, 19 nt, Human
uccacagucucugauccag

SEQ ID NO: 750052 - RNA, 20 nt, Human
uccacagucucugauccagu

SEQ ID NO: 750053 - RNA, 19 nt, Human
ucccagagcccagacgccg

SEQ ID NO: 750054 - RNA, 21 nt, Human
ucccagagcccagacgccggg

SEQ ID NO: 750055 - RNA, 18 nt, Human
ucccagggccacugagug

SEQ ID NO: 750056 - RNA, 22 nt, Human
uccgccucccucagggaagccu

SEQ ID NO: 750057 - RNA, 20 nt, Human
uccgcuccucacugcagcca

SEQ ID NO: 750058 - RNA, 23 nt, Human
ucuaaccaugaaugcagcagcac

SEQ ID NO: 750059 - RNA, 22 nt, Human
ucuucagucccagcugaggcag

SEQ ID NO: 750060 - RNA, 21 nt, Human
ugaaugccuaaugaaacacag

SEQ ID NO: 750061 - RNA, 22 nt, Human
ugaaugccuaaugaaacacaga

SEQ ID NO: 750062 - RNA, 26 nt, Human
ugaggcaagagcaagucaaaucuacc

SEQ ID NO: 750063 - RNA, 18 nt, Human
ugauaugcauaucucaca

SEQ ID NO: 750064 - RNA, 23 nt, Human
ugauaugcauaucucacauaugc

SEQ ID NO: 750065 - RNA, 26 nt, Human
ugauaugcauaucucacauaugcaug

SEQ ID NO: 750066 - RNA, 20 nt, Human
ugcccaguacccaggaaaca

SEQ ID NO: 750067 - RNA, 20 nt, Human
ugccccaguucugcaggcug

SEQ ID NO: 750068 - RNA, 21 nt, Human
uggaaagcuucuaaccaugaa

SEQ ID NO: 750069 - RNA, 18 nt, Human
uggaagggaagcgggaga

SEQ ID NO: 750070 - RNA, 23 nt, Human
uggaagggaagcgggagauggga

SEQ ID NO: 750071 - RNA, 20 nt, Human
uggagaggaaagagaaucag

SEQ ID NO: 750072 - RNA, 18 nt, Human
ugggacagguagcgcauc

SEQ ID NO: 750073 - RNA, 26 nt, Human
uggugggguguagacagaccuggggc

SEQ ID NO: 750074 - RNA, 20 nt, Human
uucaaaaaaaggaaagaacc

SEQ ID NO: 750075 - RNA, 24 nt, Human
uucaaaacagaaacaagaaagcaa

SEQ ID NO: 750076 - RNA, 18 nt, Human
uuccccuacuggaacucc

SEQ ID NO: 750077 - RNA, 24 nt, Human
uucuaaccaugaaugcagcagcac

SEQ ID NO: 750078 - RNA, 21 nt, Human
uuucaaaaaaaggaaagaacc

SEQ ID NO: 750079 - RNA, 22 nt, Human
uuuuccacagucucugauccag

SEQ ID NO: 750080 - RNA, 25 nt, Human
aaacggccugaaucuuuucuggaac

SEQ ID NO: 750081 - RNA, 23 nt, Human
aagacacacggggacaccagcuc

SEQ ID NO: 750082 - RNA, 18 nt, Human
acagcccagccuggaccc

SEQ ID NO: 750083 - RNA, 20 nt, Human
acaggugggaucucuaaagg

SEQ ID NO: 750084 - RNA, 22 nt, Human
acgcgaggcccugcugcccagc

SEQ ID NO: 750085 - RNA, 20 nt, Human
acugcuacccuucagaaaga

SEQ ID NO: 750086 - RNA, 19 nt, Human
agcugacgccagaugacau

SEQ ID NO: 750087 - RNA, 21 nt, Human
agcuuuugcuuucccaaacaa

SEQ ID NO: 750088 - RNA, 19 nt, Human
aggaccccgaagcuguggc

SEQ ID NO: 750089 - RNA, 19 nt, Human
aggcagacauccuggggcc

SEQ ID NO: 750090 - RNA, 23 nt, Human
aggcagacauccuggggcccucg

SEQ ID NO: 750091 - RNA, 19 nt, Human
agggugggagggaugugag

SEQ ID NO: 750092 - RNA, 20 nt, Human
aggugacacacagccagagg

SEQ ID NO: 750093 - RNA, 18 nt, Human
augaaagacacacgggga

SEQ ID NO: 750094 - RNA, 23 nt, Human
cacaggugggcggguuaaaguca

SEQ ID NO: 750095 - RNA, 22 nt, Human
cacauuuuuaaaaaggcuaaac

SEQ ID NO: 750096 - RNA, 23 nt, Human
caccaaagaaaugccacgccaau

SEQ ID NO: 750097 - RNA, 18 nt, Human
cagaaugaaaccucacua

SEQ ID NO: 750098 - RNA, 22 nt, Human
cagagcgcagccucacagcuga

SEQ ID NO: 750099 - RNA, 21 nt, Human
cagcaugacuccagccucugg

SEQ ID NO: 750100 - RNA, 19 nt, Human
cauuacugcuacccuucag

SEQ ID NO: 750101 - RNA, 23 nt, Human
ccaaacaagaugugggcagcaug

SEQ ID NO: 750102 - RNA, 25 nt, Human
ccagccagccaaggugacacacagc

SEQ ID NO: 750103 - RNA, 24 nt, Human
ccagccagccagccaaggugacac

SEQ ID NO: 750104 - RNA, 20 nt, Human
ccagccuggacccaaucaca

SEQ ID NO: 750105 - RNA, 21 nt, Human
ccaugaaagacacacggggac

SEQ ID NO: 750106 - RNA, 22 nt, Human
cccagcacagcuccaggacaca

SEQ ID NO: 750107 - RNA, 23 nt, Human
cccaugcuguuucuuucugagca

SEQ ID NO: 750108 - RNA, 19 nt, Human
ccccgggaagggcucagug

SEQ ID NO: 750109 - RNA, 23 nt, Human
cccucagcgucuccugcuccugu

SEQ ID NO: 750110 - RNA, 27 nt, Human
cccuggccagccagccagccaagguga

SEQ ID NO: 750111 - RNA, 19 nt, Human
ccgaggacagugccacagg

SEQ ID NO: 750112 - RNA, 18 nt, Human
ccuccugccuccccuccc

SEQ ID NO: 750113 - RNA, 23 nt, Human
ccuccugccuccccucccagggg

SEQ ID NO: 750114 - RNA, 22 nt, Human
ccucuccuccugccguccggcc

SEQ ID NO: 750115 - RNA, 23 nt, Human
ccucuggaacccaacaauguauc

SEQ ID NO: 750116 - RNA, 22 nt, Human
ccugcuugcgcaggauggaggu

SEQ ID NO: 750117 - RNA, 23 nt, Human
ccuuacgcgaggcccugcugccc

SEQ ID NO: 750118 - RNA, 21 nt, Human
cggggacaccagcucacuggg

SEQ ID NO: 750119 - RNA, 24 nt, Human
cgugagcgcuugauggccuccucc

SEQ ID NO: 750120 - RNA, 23 nt, Human
cuccccucccaggggaugugaug

SEQ ID NO: 750121 - RNA, 22 nt, Human
cuccugccuccccucccagggg

SEQ ID NO: 750122 - RNA, 21 nt, Human
cucuccucccagcacagaaga

SEQ ID NO: 750123 - RNA, 21 nt, Human
cugugccaaacggccugaauc

SEQ ID NO: 750124 - RNA, 21 nt, Human
cuucccugacagcccagccug

SEQ ID NO: 750125 - RNA, 20 nt, Human
cuugcaaauaaacagaauga

SEQ ID NO: 750126 - RNA, 18 nt, Human
gaaagacacacggggaca

SEQ ID NO: 750127 - RNA, 18 nt, Human
gaaaugccacgccaaugg

SEQ ID NO: 750128 - RNA, 19 nt, Human
gaacgcggccccgcggccc

SEQ ID NO: 750129 - RNA, 18 nt, Human
gacagucccaugaaagac

SEQ ID NO: 750130 - RNA, 23 nt, Human
gagaauugaugagucggagacac

SEQ ID NO: 750131 - RNA, 20 nt, Human
gagacaccagggcgcuuccc

SEQ ID NO: 750132 - RNA, 21 nt, Human
gagugcuuuggggagccuggc

SEQ ID NO: 750133 - RNA, 22 nt, Human
gagugcuuuggggagccuggcu

SEQ ID NO: 750134 - RNA, 25 nt, Human
gaguuuccugaaagccccuccuggg

SEQ ID NO: 750135 - RNA, 25 nt, Human
gaugugggcagcaugacuccagccu

SEQ ID NO: 750136 - RNA, 20 nt, Human
gcacaacacgcagagcgcag

SEQ ID NO: 750137 - RNA, 25 nt, Human
gcacagcuccaggacacaccgagga

SEQ ID NO: 750138 - RNA, 22 nt, Human
gccagaugacaugcagcaguuu

SEQ ID NO: 750139 - RNA, 25 nt, Human
ggaacgcggccccgcggcccgcaga

SEQ ID NO: 750140 - RNA, 20 nt, Human
ggcuccccucuccuccugcc

SEQ ID NO: 750141 - RNA, 18 nt, Human
ggguuuucugucuguucc

SEQ ID NO: 750142 - RNA, 18 nt, Human
uaagugcggcgggaaacc

SEQ ID NO: 750143 - RNA, 21 nt, Human
ucacagcugacgccagaugac

SEQ ID NO: 750144 - RNA, 20 nt, Human
ucagccugcuugcgcaggau

SEQ ID NO: 750145 - RNA, 22 nt, Human
ucauugguaaacuuaaaaaaau

SEQ ID NO: 750146 - RNA, 24 nt, Human
uccacaaacuuuugauaagcuugc

SEQ ID NO: 750147 - RNA, 19 nt, Human
uccaggucggaacaaccuc

SEQ ID NO: 750148 - RNA, 21 nt, Human
ucccaugaaagacacacgggg

SEQ ID NO: 750149 - RNA, 20 nt, Human
uccuccugccuccccuccca

SEQ ID NO: 750150 - RNA, 22 nt, Human
uccuggggcccucggccuccuc

SEQ ID NO: 750151 - RNA, 20 nt, Human
ucggccuccuccugccuccc

SEQ ID NO: 750152 - RNA, 24 nt, Human
ucuuucugagcagacaccaaagaa

SEQ ID NO: 750153 - RNA, 23 nt, Human
ugaaaccucacuagccugaagga

SEQ ID NO: 750154 - RNA, 22 nt, Human
ugaaagacacacggggacacca

SEQ ID NO: 750155 - RNA, 21 nt, Human
ugaaggaacacacuaagugcg

SEQ ID NO: 750156 - RNA, 21 nt, Human
ugagaaaagcugacauacuca

SEQ ID NO: 750157 - RNA, 22 nt, Human
ugagcagacaccaaagaaaugc

SEQ ID NO: 750158 - RNA, 22 nt, Human
ugauaugaccgagggugggagg

SEQ ID NO: 750159 - RNA, 19 nt, Human
ugauggccuccuccucagc

SEQ ID NO: 750160 - RNA, 24 nt, Human
ugcgagacaaagagugcuuugggg

SEQ ID NO: 750161 - RNA, 18 nt, Human
ugcuuuggggagccuggc

SEQ ID NO: 750162 - RNA, 18 nt, Human
uggcagcccgaggcugug

SEQ ID NO: 750163 - RNA, 21 nt, Human
uggccuccuccucagccugcu

SEQ ID NO: 750164 - RNA, 19 nt, Human
ugggaggacacaggugggc

SEQ ID NO: 750165 - RNA, 21 nt, Human
ugggaggacacaggugggcgg

SEQ ID NO: 750166 - RNA, 24 nt, Human
ugggaucucuaaaggggacagucc

SEQ ID NO: 750167 - RNA, 20 nt, Human
ugggcagcaugacuccagcc

SEQ ID NO: 750168 - RNA, 22 nt, Human
uggggcccucggccuccuccug

SEQ ID NO: 750169 - RNA, 18 nt, Human
ugucacauugccagcugu

SEQ ID NO: 750170 - RNA, 23 nt, Human
ugucacauugccagcuguuuccc

SEQ ID NO: 750171 - RNA, 22 nt, Human
ugugggcagcaugacuccagcc

SEQ ID NO: 750172 - RNA, 20 nt, Human
uuacaguuagacucuccucc

SEQ ID NO: 750173 - RNA, 23 nt, Human
uuuacagucacgccaauacauuu

SEQ ID NO: 750174 - RNA, 20 nt, Human
uuuccugaaagccccuccug

SEQ ID NO: 750175 - RNA, 22 nt, Human
uuugcagauuugcugguacggu

SEQ ID NO: 750176 - RNA, 21 nt, Human
uuuucuggaacaaccuaaagg

SEQ ID NO: 750177 - RNA, 21 nt, Human
aaaaaaaggcaacugucagaa

SEQ ID NO: 750178 - RNA, 22 nt, Human
aaaaaagugccccuacacauuu

SEQ ID NO: 750179 - RNA, 19 nt, Human
aaaauccaaggaaaacccc

SEQ ID NO: 750180 - RNA, 23 nt, Human
aaacuaauuuuauuaacaccuua

SEQ ID NO: 750181 - RNA, 20 nt, Human
aaauacagaauuacugcaau

SEQ ID NO: 750182 - RNA, 24 nt, Human
aaccaaaaaagugccccuacacau

SEQ ID NO: 750183 - RNA, 24 nt, Human
aaugacagguuacugccucuaguu

SEQ ID NO: 750184 - RNA, 20 nt, Human
acaguaaaaaaaaaaaaaaa

SEQ ID NO: 750185 - RNA, 18 nt, Human
accuaaauucuuagucau

SEQ ID NO: 750186 - RNA, 24 nt, Human
acuauaucauaaaagacaaugacu

SEQ ID NO: 750187 - RNA, 24 nt, Human
agaacaccuaaaaaacagacugca

SEQ ID NO: 750188 - RNA, 22 nt, Human
agaagcgccaagcaccuccucc

SEQ ID NO: 750189 - RNA, 22 nt, Human
agagcagggccaacguuagaaa

SEQ ID NO: 750190 - RNA, 20 nt, Human
aggccacaagagcagggcca

SEQ ID NO: 750191 - RNA, 22 nt, Human
aggucuuccagucuuucucuca

SEQ ID NO: 750192 - RNA, 19 nt, Human
aggugggugauggggaggg

SEQ ID NO: 750193 - RNA, 20 nt, Human
aggugggugauggggaggga

SEQ ID NO: 750194 - RNA, 21 nt, Human
aguauuaccuucgaacucaga

SEQ ID NO: 750195 - RNA, 25 nt, Human
auaaaauagcccccaguuauuaaaa

SEQ ID NO: 750196 - RNA, 20 nt, Human
auaagacaaaaaagcuaaaa

SEQ ID NO: 750197 - RNA, 31 nt, Human
aucuuuuuuccucaucguuuuugauagggcc

SEQ ID NO: 750198 - RNA, 20 nt, Human
augacaaccaaaaaagugcc

SEQ ID NO: 750199 - RNA, 19 nt, Human
caaaagcacauuuaaggag

SEQ ID NO: 750200 - RNA, 24 nt, Human
cacugcaggggugagugucuuuag

SEQ ID NO: 750201 - RNA, 24 nt, Human
cagaaauguuuaaaaaaaagucuc

SEQ ID NO: 750202 - RNA, 18 nt, Human
cagaacaccuaaaaaaca

SEQ ID NO: 750203 - RNA, 20 nt, Human
cagaacaccuaaaaaacaga

SEQ ID NO: 750204 - RNA, 19 nt, Human
cagcaauacccacgcagau

SEQ ID NO: 750205 - RNA, 23 nt, Human
caggacagagcccuuaaaucuga

SEQ ID NO: 750206 - RNA, 27 nt, Human
ccacgcagauaagacaaaaaagcuaaa

SEQ ID NO: 750207 - RNA, 22 nt, Human
ccagaucaccucagcagaggca

SEQ ID NO: 750208 - RNA, 22 nt, Human
ccauuaaaauaagagcugaaau

SEQ ID NO: 750209 - RNA, 28 nt, Human
cccacgcagauaagacaaaaggaguuuc

SEQ ID NO: 750210 - RNA, 18 nt, Human
cgcaaggggagaggagga

SEQ ID NO: 750211 - RNA, 25 nt, Human
cuaaaaaacagacugcaaauucaac

SEQ ID NO: 750212 - RNA, 18 nt, Human
cuaauccuggagugcaau

SEQ ID NO: 750213 - RNA, 21 nt, Human
cuucugcaaauugguucaaaa

SEQ ID NO: 750214 - RNA, 18 nt, Human
gacaaccaaaaaagugcc

SEQ ID NO: 750215 - RNA, 22 nt, Human
gacugcuuuuaaauauuucuac

SEQ ID NO: 750216 - RNA, 23 nt, Human
gaggccacaagagcagggccaac

SEQ ID NO: 750217 - RNA, 22 nt, Human
gaucaguuuggacggcugguac

SEQ ID NO: 750218 - RNA, 21 nt, Human
gauugccuuuucauggugaac

SEQ ID NO: 750219 - RNA, 23 nt, Human
gcaagcugauaaaauagccccca

SEQ ID NO: 750220 - RNA, 19 nt, Human
gcaaucuuuuuuccucauc

SEQ ID NO: 750221 - RNA, 23 nt, Human
gccaaauuuagaagguuggaauu

SEQ ID NO: 750222 - RNA, 21 nt, Human
gccaagcaccuccuccgcucu

SEQ ID NO: 750223 - RNA, 21 nt, Human
gccugagaagcgccaagcacc

SEQ ID NO: 750224 - RNA, 23 nt, Human
gcuucugcaaauugguucaaaag

SEQ ID NO: 750225 - RNA, 18 nt, Human
ggaagaaaucugucagua

SEQ ID NO: 750226 - RNA, 20 nt, Human
ggugauggggagggaagagg

SEQ ID NO: 750227 - RNA, 22 nt, Human
ggugauggggagggaagaggga

SEQ ID NO: 750228 - RNA, 24 nt, Human
guaaaaaaaaaaaaaaagaauuac

SEQ ID NO: 750229 - RNA, 19 nt, Human
guauaacaggacagagccc

SEQ ID NO: 750230 - RNA, 27 nt, Human
uaaaaaacagacugcaaauucaacuca

SEQ ID NO: 750231 - RNA, 20 nt, Human
uaaaauaaagcagcaauacc

SEQ ID NO: 750232 - RNA, 22 nt, Human
uaaaauagcccccaguuauuaa

SEQ ID NO: 750233 - RNA, 26 nt, Human
uaagacaaaaaagcuaaaauaucuca

SEQ ID NO: 750234 - RNA, 22 nt, Human
uaagacaggacuuuggaacaag

SEQ ID NO: 750235 - RNA, 21 nt, Human
uaagagcugaaauuuuuggca

SEQ ID NO: 750236 - RNA, 22 nt, Human
uacgacaguuccaaauuuuaga

SEQ ID NO: 750237 - RNA, 19 nt, Human
uacuagccaaauuuagaag

SEQ ID NO: 750238 - RNA, 21 nt, Human
uauaacaggacagagcccuua

SEQ ID NO: 750239 - RNA, 20 nt, Human
uauagcaaauucucuauagc

SEQ ID NO: 750240 - RNA, 23 nt, Human
uauaucugaaacuuaaaaaugau

SEQ ID NO: 750241 - RNA, 24 nt, Human
uauaucugaaacuuaaaaaugauu

SEQ ID NO: 750242 - RNA, 22 nt, Human
uaucugaaacuuaaaaaugauu

SEQ ID NO: 750243 - RNA, 27 nt, Human
ucaauaguuaagacaggacuuuggaac

SEQ ID NO: 750244 - RNA, 23 nt, Human
ucacugaggugggugauggggag

SEQ ID NO: 750245 - RNA, 19 nt, Human
ucagaauuuuaauugugau

SEQ ID NO: 750246 - RNA, 22 nt, Human
ucuacaguaaaaaaaaaaaaaa

SEQ ID NO: 750247 - RNA, 23 nt, Human
ugaaaacucaaaccaauuuuugc

SEQ ID NO: 750248 - RNA, 20 nt, Human
ugaaagccacuggcacaacu

SEQ ID NO: 750249 - RNA, 19 nt, Human
ugaaauuuuuggcauuuau

SEQ ID NO: 750250 - RNA, 19 nt, Human
ugacuuccucuaucaguaa

SEQ ID NO: 750251 - RNA, 24 nt, Human
ugagaagcgccaagcaccuccucc

SEQ ID NO: 750252 - RNA, 25 nt, Human
ugcaugaagucuccuauaucugaaa

SEQ ID NO: 750253 - RNA, 26 nt, Human
ugcugccauuugagaugaaaaaaaag

SEQ ID NO: 750254 - RNA, 21 nt, Human
uggcacaaagcagauuaucuu

SEQ ID NO: 750255 - RNA, 19 nt, Human
uggggagggaagagggaag

SEQ ID NO: 750256 - RNA, 24 nt, Human
uguauaacaggacagagcccuuaa

SEQ ID NO: 750257 - RNA, 22 nt, Human
ugucaguuugcccagcuuguac

SEQ ID NO: 750258 - RNA, 18 nt, Human
ugugaauauucaaagcua

SEQ ID NO: 750259 - RNA, 20 nt, Human
ugugugcuaucuuacauaua

SEQ ID NO: 750260 - RNA, 26 nt, Human
uguuuuggcacaaagcagauuaucuu

SEQ ID NO: 750261 - RNA, 19 nt, Human
uucacaaaauguacaagau

SEQ ID NO: 750262 - RNA, 28 nt, Human
uugugccaggcugucccaugcacugcag

SEQ ID NO: 750263 - RNA, 22 nt, Human
uuugcuuuuagaauuaaauucu

SEQ ID NO: 750264 - RNA, 22 nt, Human
aaaaaaaaaaaaagaaaaagaa

SEQ ID NO: 750265 - RNA, 23 nt, Human
aaaaaaaaaagaaaaagaaaaag

SEQ ID NO: 750266 - RNA, 19 nt, Human
aaaaaaaagaaaaagaaaa

SEQ ID NO: 750267 - RNA, 21 nt, Human
aaaaauaagaaaaccagcuug

SEQ ID NO: 750268 - RNA, 22 nt, Human
aaaaauaagaaaaccagcuugc

SEQ ID NO: 750269 - RNA, 21 nt, Human
aaaagaaaaagaaaaagaaaa

SEQ ID NO: 750270 - RNA, 23 nt, Human
aaaagaaaaagaaaaagaaaaag

SEQ ID NO: 750271 - RNA, 18 nt, Human
aacccaggcaaccgcagc

SEQ ID NO: 750272 - RNA, 20 nt, Human
aacuaaaccacccgacgcug

SEQ ID NO: 750273 - RNA, 24 nt, Human
aacuaaaccacccgacgcugguaa

SEQ ID NO: 750274 - RNA, 22 nt, Human
aagggccccgcacucuucagcu

SEQ ID NO: 750275 - RNA, 18 nt, Human
aaucagcuccugggaacc

SEQ ID NO: 750276 - RNA, 24 nt, Human
acaaaugccaccuuguucccggga

SEQ ID NO: 750277 - RNA, 18 nt, Human
acacugagggcaggcgag

SEQ ID NO: 750278 - RNA, 21 nt, Human
acaggggcugccagagccucu

SEQ ID NO: 750279 - RNA, 30 nt, Human
accaaaucguaaaaaaaaaaaaagaaaaaa

SEQ ID NO: 750280 - RNA, 19 nt, Human
accaacccaggcaaccgca

SEQ ID NO: 750281 - RNA, 22 nt, Human
accagcuugcucgcuguaaaaa

SEQ ID NO: 750282 - RNA, 24 nt, Human
acccacaccagcaaaugaggaucc

SEQ ID NO: 750283 - RNA, 20 nt, Human
accggcaccggcuaggcacg

SEQ ID NO: 750284 - RNA, 22 nt, Human
acguggucaguuuucaucuccc

SEQ ID NO: 750285 - RNA, 20 nt, Human
acuccuccccacuuccuccc

SEQ ID NO: 750286 - RNA, 21 nt, Human
acuccuccccacuuccucccc

SEQ ID NO: 750287 - RNA, 21 nt, Human
agaaaaagaaaaagaaaaaga

SEQ ID NO: 750288 - RNA, 22 nt, Human
agaaaaagaaaaagaaaaagaa

SEQ ID NO: 750289 - RNA, 18 nt, Human
agaccaggccugcgggcg

SEQ ID NO: 750290 - RNA, 19 nt, Human
agaccaggccugcgggcgc

SEQ ID NO: 750291 - RNA, 21 nt, Human
agagagccaguccccuacagg

SEQ ID NO: 750292 - RNA, 23 nt, Human
agaggaaggagggccgccaggcc

SEQ ID NO: 750293 - RNA, 19 nt, Human
agcaaggaaggugccacca

SEQ ID NO: 750294 - RNA, 19 nt, Human
aggaagaggcgcucauugg

SEQ ID NO: 750295 - RNA, 23 nt, Human
aggaaggagggccgccaggcccg

SEQ ID NO: 750296 - RNA, 22 nt, Human
aggaggcccaagccgccuuucc

SEQ ID NO: 750297 - RNA, 24 nt, Human
aggagggucucauguaagaggaag

SEQ ID NO: 750298 - RNA, 18 nt, Human
aggcagugcaggcccagg

SEQ ID NO: 750299 - RNA, 27 nt, Human
aggcagugcaggcccaggccucugggc

SEQ ID NO: 750300 - RNA, 18 nt, Human
aggcccaggccucugggc

SEQ ID NO: 750301 - RNA, 18 nt, Human
aggcgaggggugggcccu

SEQ ID NO: 750302 - RNA, 24 nt, Human
agucgguggcccucccccgacccc

SEQ ID NO: 750303 - RNA, 22 nt, Human
auagaaucuucuguuucuucaa

SEQ ID NO: 750304 - RNA, 23 nt, Human
auagaaucuucuguuucuucaaa

SEQ ID NO: 750305 - RNA, 20 nt, Human
aucugaaaaaggauacaaaa

SEQ ID NO: 750306 - RNA, 24 nt, Human
caaaaaacaacaaucucaacgaca

SEQ ID NO: 750307 - RNA, 21 nt, Human
caaagacacugagggcaggcg

SEQ ID NO: 750308 - RNA, 24 nt, Human
caaagcacccccggcaccagcgug

SEQ ID NO: 750309 - RNA, 18 nt, Human
caaaucguaaaaaaaaaa

SEQ ID NO: 750310 - RNA, 23 nt, Human
caccagcgugugacucugcggcc

SEQ ID NO: 750311 - RNA, 18 nt, Human
caccuccuuccaggaggc

SEQ ID NO: 750312 - RNA, 24 nt, Human
cacguggucaguuuucaucucccu

SEQ ID NO: 750313 - RNA, 21 nt, Human
cacugcgcccggccccagccc

SEQ ID NO: 750314 - RNA, 24 nt, Human
cagagccucucggauggcccaaag

SEQ ID NO: 750315 - RNA, 21 nt, Human
cagauccaaaauagacucagg

SEQ ID NO: 750316 - RNA, 18 nt, Human
cagcaccuaggaagaggc

SEQ ID NO: 750317 - RNA, 19 nt, Human
cagggcgggggcugggggg

SEQ ID NO: 750318 - RNA, 20 nt, Human
cauccuugggcacugccggg

SEQ ID NO: 750319 - RNA, 21 nt, Human
ccaaaauagacucaggcuuca

SEQ ID NO: 750320 - RNA, 24 nt, Human
ccaaagcacccccggcaccagcgu

SEQ ID NO: 750321 - RNA, 23 nt, Human
ccaacagccuucgcggauguucu

SEQ ID NO: 750322 - RNA, 22 nt, Human
ccacccgacgcugguaaagccc

SEQ ID NO: 750323 - RNA, 19 nt, Human
ccacggcucagagcggguu

SEQ ID NO: 750324 - RNA, 22 nt, Human
ccagagccucucggauggccca

SEQ ID NO: 750325 - RNA, 25 nt, Human
ccagagccucucggauggcccaaag

SEQ ID NO: 750326 - RNA, 22 nt, Human
ccagcaacguccugggcaaguc

SEQ ID NO: 750327 - RNA, 23 nt, Human
ccagggaggggccugugcuggca

SEQ ID NO: 750328 - RNA, 22 nt, Human
ccagggguccugugugucuucu

SEQ ID NO: 750329 - RNA, 22 nt, Human
cccaaagcacccccggcaccag

SEQ ID NO: 750330 - RNA, 23 nt, Human
ccccacuuccucccccaaccaac

SEQ ID NO: 750331 - RNA, 18 nt, Human
ccccaggaggaagggccc

SEQ ID NO: 750332 - RNA, 19 nt, Human
ccccgaccccccgcucccc

SEQ ID NO: 750333 - RNA, 19 nt, Human
ccccgaggccccggaccca

SEQ ID NO: 750334 - RNA, 19 nt, Human
cccgaggacuuccagggag

SEQ ID NO: 750335 - RNA, 18 nt, Human
cccgaggccccggaccca

SEQ ID NO: 750336 - RNA, 21 nt, Human
cccgaggccccggacccaucc

SEQ ID NO: 750337 - RNA, 26 nt, Human
cccggccccagcccggcaccaagggc

SEQ ID NO: 750338 - RNA, 19 nt, Human
cccgggaagcccaggcuuc

SEQ ID NO: 750339 - RNA, 21 nt, Human
cccgucccugugagcccuggc

SEQ ID NO: 750340 - RNA, 21 nt, Human
cccuccacaaaugccaccuug

SEQ ID NO: 750341 - RNA, 20 nt, Human
cccuggggcagggcgggggc

SEQ ID NO: 750342 - RNA, 21 nt, Human
ccggcaccagcgugugacucu

SEQ ID NO: 750343 - RNA, 20 nt, Human
ccggcaccggcuaggcacgc

SEQ ID NO: 750344 - RNA, 21 nt, Human
ccgucccugugagcccuggcc

SEQ ID NO: 750345 - RNA, 21 nt, Human
ccgugccgauccgcgcuccgc

SEQ ID NO: 750346 - RNA, 19 nt, Human
ccuacaggagccagaccca

SEQ ID NO: 750347 - RNA, 19 nt, Human
ccugcgggcgcucccucca

SEQ ID NO: 750348 - RNA, 19 nt, Human
ccugugcuggcagcagagc

SEQ ID NO: 750349 - RNA, 20 nt, Human
ccuugggcacugccgggccc

SEQ ID NO: 750350 - RNA, 21 nt, Human
ccuugggcacugccgggcccu

SEQ ID NO: 750351 - RNA, 23 nt, Human
ccuuguucccgggaagcccaggc

SEQ ID NO: 750352 - RNA, 19 nt, Human
ccuuuuguugaacaaaagu

SEQ ID NO: 750353 - RNA, 25 nt, Human
cgaggccccggacccauccuugggc

SEQ ID NO: 750354 - RNA, 27 nt, Human
cgcaggcccgcgggguggccaccuccu

SEQ ID NO: 750355 - RNA, 20 nt, Human
cgcuguguuuggggacugaa

SEQ ID NO: 750356 - RNA, 21 nt, Human
cggcgugucaggccgagagca

SEQ ID NO: 750357 - RNA, 21 nt, Human
cgugucaggccgagagcagca

SEQ ID NO: 750358 - RNA, 19 nt, Human
cuacagaccuccuggccgg

SEQ ID NO: 750359 - RNA, 21 nt, Human
cucaacgacacccaagggacu

SEQ ID NO: 750360 - RNA, 26 nt, Human
cucacccacaccagcaaaugaggauc

SEQ ID NO: 750361 - RNA, 24 nt, Human
cucccccaaccaacccaggcaacc

SEQ ID NO: 750362 - RNA, 18 nt, Human
cucccccgaccccccgcu

SEQ ID NO: 750363 - RNA, 20 nt, Human
cucccccgaccccccgcucc

SEQ ID NO: 750364 - RNA, 22 nt, Human
cucccccgaccccccgcucccc

SEQ ID NO: 750365 - RNA, 25 nt, Human
cuccugggaacccgcgugagccgcc

SEQ ID NO: 750366 - RNA, 21 nt, Human
cugagguccucugcuucaccc

SEQ ID NO: 750367 - RNA, 21 nt, Human
cugcggguggcccucagaggc

SEQ ID NO: 750368 - RNA, 25 nt, Human
cuugcucgcuguaaaaaauagaauc

SEQ ID NO: 750369 - RNA, 23 nt, Human
gaaaaagaaaauuccagcaacgu

SEQ ID NO: 750370 - RNA, 18 nt, Human
gaccaggccugcgggcgc

SEQ ID NO: 750371 - RNA, 22 nt, Human
gacucaggacaagcugagggag

SEQ ID NO: 750372 - RNA, 18 nt, Human
gagcggguucugucccca

SEQ ID NO: 750373 - RNA, 22 nt, Human
gcaggcccaggccucugggcuc

SEQ ID NO: 750374 - RNA, 26 nt, Human
gcagggcgggggcugggugcuggagc

SEQ ID NO: 750375 - RNA, 21 nt, Human
gccccagggaccccucccgcu

SEQ ID NO: 750376 - RNA, 19 nt, Human
gcccggccccagcccggca

SEQ ID NO: 750377 - RNA, 22 nt, Human
gcccuggggagagagguguggc

SEQ ID NO: 750378 - RNA, 19 nt, Human
gccucugcccccuccccca

SEQ ID NO: 750379 - RNA, 20 nt, Human
gcggccccagcagaccaggc

SEQ ID NO: 750380 - RNA, 18 nt, Human
gcuccccgaauguggccc

SEQ ID NO: 750381 - RNA, 22 nt, Human
gcuccgcucccgaggacuucca

SEQ ID NO: 750382 - RNA, 20 nt, Human
gcucggagcaccuccaacag

SEQ ID NO: 750383 - RNA, 21 nt, Human
gcugcagccugggccaccauu

SEQ ID NO: 750384 - RNA, 18 nt, Human
ggaacggagaagggcagg

SEQ ID NO: 750385 - RNA, 20 nt, Human
ggagcgaguguggagcgcag

SEQ ID NO: 750386 - RNA, 18 nt, Human
ggaggccagcaaggaagg

SEQ ID NO: 750387 - RNA, 21 nt, Human
ggcagggcgggggcugggggg

SEQ ID NO: 750388 - RNA, 25 nt, Human
ggcgccaaggugggguucacugggg

SEQ ID NO: 750389 - RNA, 18 nt, Human
ggcgggggcugggggggu

SEQ ID NO: 750390 - RNA, 18 nt, Human
gggcgggggcuggggggg

SEQ ID NO: 750391 - RNA, 19 nt, Human
ggggccaugugccagacau

SEQ ID NO: 750392 - RNA, 20 nt, Human
gggggucugugcccggaccg

SEQ ID NO: 750393 - RNA, 25 nt, Human
ggugaaaccagcccaugccgccgga

SEQ ID NO: 750394 - RNA, 24 nt, Human
guccaauuguuuccacuaccaaau

SEQ ID NO: 750395 - RNA, 20 nt, Human
gugccgauccgcgcuccgcc

SEQ ID NO: 750396 - RNA, 18 nt, Human
guggccauugucugcggg

SEQ ID NO: 750397 - RNA, 21 nt, Human
guggcccucccccgacccccc

SEQ ID NO: 750398 - RNA, 22 nt, Human
guuuucaucucccuuucuccac

SEQ ID NO: 750399 - RNA, 22 nt, Human
uaaaaacuacagcuucucucca

SEQ ID NO: 750400 - RNA, 18 nt, Human
uaaaacgcagaggucaac

SEQ ID NO: 750401 - RNA, 26 nt, Human
uaaaccacccgacgcugguaaagccc

SEQ ID NO: 750402 - RNA, 22 nt, Human
ucacagaaauuaaacaucugcc

SEQ ID NO: 750403 - RNA, 22 nt, Human
ucagcccagcgcaggcggcccc

SEQ ID NO: 750404 - RNA, 20 nt, Human
ucaggccgagagcagcaggc

SEQ ID NO: 750405 - RNA, 25 nt, Human
uccaaaauagacucaggcuucagac

SEQ ID NO: 750406 - RNA, 26 nt, Human
uccaacagccuucgcggauguucucc

SEQ ID NO: 750407 - RNA, 23 nt, Human
uccaggcuggaacggagaagggc

SEQ ID NO: 750408 - RNA, 26 nt, Human
uccccacuuccucccccaaccaaccc

SEQ ID NO: 750409 - RNA, 20 nt, Human
uccccaggaggaagggcccc

SEQ ID NO: 750410 - RNA, 22 nt, Human
uccccccaaagcacccccggca

SEQ ID NO: 750411 - RNA, 21 nt, Human
ucccucacccacaccagcaaa

SEQ ID NO: 750412 - RNA, 19 nt, Human
ucccuggggcagggcgggg

SEQ ID NO: 750413 - RNA, 19 nt, Human
uccgcgcaguccagagcca

SEQ ID NO: 750414 - RNA, 21 nt, Human
uccgcgcaguccagagccacg

SEQ ID NO: 750415 - RNA, 21 nt, Human
uccuccccacuuccuccccca

SEQ ID NO: 750416 - RNA, 21 nt, Human
ucgcggauguucuccugggcc

SEQ ID NO: 750417 - RNA, 22 nt, Human
ucggccacaccuggcacguggu

SEQ ID NO: 750418 - RNA, 24 nt, Human
ucgguggcccucccccgacccccc

SEQ ID NO: 750419 - RNA, 22 nt, Human
ucuccacaaaagggacucgaac

SEQ ID NO: 750420 - RNA, 25 nt, Human
ugagggcaggcgaggggugggcccu

SEQ ID NO: 750421 - RNA, 20 nt, Human
ugaucggcgcagcucccccc

SEQ ID NO: 750422 - RNA, 19 nt, Human
ugcaaaagcucaugaggau

SEQ ID NO: 750423 - RNA, 23 nt, Human
ugccacagugcucggagcaccuc

SEQ ID NO: 750424 - RNA, 18 nt, Human
ugccagagccucucggau

SEQ ID NO: 750425 - RNA, 25 nt, Human
ugccgauccgcgcuccgcucccgag

SEQ ID NO: 750426 - RNA, 22 nt, Human
ugcucggagcaccuccaacagc

SEQ ID NO: 750427 - RNA, 18 nt, Human
ugcugagcgcccuggagg

SEQ ID NO: 750428 - RNA, 22 nt, Human
uggagcgcaggcagggucacug

SEQ ID NO: 750429 - RNA, 24 nt, Human
uggccaccuccuuccaggaggccc

SEQ ID NO: 750430 - RNA, 18 nt, Human
uggcccaaaggcggcugc

SEQ ID NO: 750431 - RNA, 20 nt, Human
uggcccaaaggcggcugcag

SEQ ID NO: 750432 - RNA, 22 nt, Human
uggggagagagguguggccauu

SEQ ID NO: 750433 - RNA, 24 nt, Human
ugggggggucugugcccggaccgg

SEQ ID NO: 750434 - RNA, 21 nt, Human
ugggggugggucagugcccac

SEQ ID NO: 750435 - RNA, 19 nt, Human
ugguaaaaacuacagcuuc

SEQ ID NO: 750436 - RNA, 18 nt, Human
uggucccggaacacuccu

SEQ ID NO: 750437 - RNA, 19 nt, Human
uuccagaauuccugaaaau

SEQ ID NO: 750438 - RNA, 25 nt, Human
uuccagggaggggccugugcuggca

SEQ ID NO: 750439 - RNA, 18 nt, Human
uucuccugggccuuccaa

SEQ ID NO: 750440 - RNA, 20 nt, Human
uugccucaggcgccaaggug

SEQ ID NO: 750441 - RNA, 25 nt, Human
uugcucgcuguaaaaaauagaaucu

SEQ ID NO: 750442 - RNA, 18 nt, Human
uuggccccgaggccccgg

SEQ ID NO: 750443 - RNA, 21 nt, Human
uuggggacugaaucccagcac

SEQ ID NO: 750444 - RNA, 21 nt, Human
uuugguaaaaacuacagcuuc

SEQ ID NO: 750445 - RNA, 22 nt, Human
uuuucaucucccuuucuccaca

SEQ ID NO: 750446 - RNA, 26 nt, Human
aaaaaaaaaaaacaaaccacaaccgg

SEQ ID NO: 750447 - RNA, 21 nt, Human
aaaaaaaaaacaaaccacaag

SEQ ID NO: 750448 - RNA, 21 nt, Human
aaaaaaacaaaccacaaccgg

SEQ ID NO: 750449 - RNA, 23 nt, Human
aaaaaacaacaacgaaaaaaaac

SEQ ID NO: 750450 - RNA, 23 nt, Human
aaaacaacaacgaaaaaaaaccc

SEQ ID NO: 750451 - RNA, 24 nt, Human
aaaacaacaacgaaaaaaaacccc

SEQ ID NO: 750452 - RNA, 22 nt, Human
aaaaggaggcauguuuucacaa

SEQ ID NO: 750453 - RNA, 23 nt, Human
aaacaaaccacaaccggcgaaca

SEQ ID NO: 750454 - RNA, 28 nt, Human
aaacaacaacgaaaaaaaaccccaaauc

SEQ ID NO: 750455 - RNA, 23 nt, Human
aaaggaggcauguuuucacaacu

SEQ ID NO: 750456 - RNA, 21 nt, Human
aaauagaucaacagguuaaga

SEQ ID NO: 750457 - RNA, 21 nt, Human
aacaaaccacaaccggcgaac

SEQ ID NO: 750458 - RNA, 26 nt, Human
aacaacaacgaaaaaaaaccccaaaa

SEQ ID NO: 750459 - RNA, 26 nt, Human
aaccggcgaacaucccuuagucccuu

SEQ ID NO: 750460 - RNA, 25 nt, Human
aagaaagcacaucugcacagaggcu

SEQ ID NO: 750461 - RNA, 18 nt, Human
aaugacaacaaaaaaaaa

SEQ ID NO: 750462 - RNA, 23 nt, Human
acaacaaaaaaaaaaggcacgaa

SEQ ID NO: 750463 - RNA, 19 nt, Human
acacuugucuuuuccuggu

SEQ ID NO: 750464 - RNA, 25 nt, Human
acccaaauucaaggacaauuuggcu

SEQ ID NO: 750465 - RNA, 20 nt, Human
accugcugcugcaggcuugc

SEQ ID NO: 750466 - RNA, 23 nt, Human
agacagaauacaagacugggugg

SEQ ID NO: 750467 - RNA, 20 nt, Human
agcaaacuuuaaaaucuuaa

SEQ ID NO: 750468 - RNA, 21 nt, Human
agcaguuggucuggaccagcc

SEQ ID NO: 750469 - RNA, 22 nt, Human
agucuaugugaugaacaagaug

SEQ ID NO: 750470 - RNA, 25 nt, Human
aguuaucaccuuacuuuuggucaaa

SEQ ID NO: 750471 - RNA, 26 nt, Human
caaaagaccucaaauagaucaacagg

SEQ ID NO: 750472 - RNA, 22 nt, Human
caaaccacaaccggcgaacauc

SEQ ID NO: 750473 - RNA, 25 nt, Human
caaacuccaagccuggccuugauug

SEQ ID NO: 750474 - RNA, 21 nt, Human
caacaaaaaaaaaaggcacga

SEQ ID NO: 750475 - RNA, 23 nt, Human
caacaaaaaaaaaaggcacgaaa

SEQ ID NO: 750476 - RNA, 26 nt, Human
caacaaaaaaaaaaggcacgaaauau

SEQ ID NO: 750477 - RNA, 23 nt, Human
caacagguuaagaaguguaaaaa

SEQ ID NO: 750478 - RNA, 18 nt, Human
caaugcagguaugugucc

SEQ ID NO: 750479 - RNA, 22 nt, Human
cauagaaagcugguuuccucca

SEQ ID NO: 750480 - RNA, 19 nt, Human
ccaccagguucuuccuucc

SEQ ID NO: 750481 - RNA, 21 nt, Human
cccugugcauacucucuuuca

SEQ ID NO: 750482 - RNA, 22 nt, Human
ccggagaggaggggacggccca

SEQ ID NO: 750483 - RNA, 21 nt, Human
ccuggaaugaggccuguucuu

SEQ ID NO: 750484 - RNA, 23 nt, Human
ccuggaaugaggccuguucuuga

SEQ ID NO: 750485 - RNA, 19 nt, Human
cggcccagcgagcgcgcgc

SEQ ID NO: 750486 - RNA, 24 nt, Human
cucaaauagaucaacagguuaaga

SEQ ID NO: 750487 - RNA, 25 nt, Human
cucaaucagaugagcaaaagccacu

SEQ ID NO: 750488 - RNA, 19 nt, Human
cugccccccucuuugcucc

SEQ ID NO: 750489 - RNA, 18 nt, Human
cuggauuccauauccugg

SEQ ID NO: 750490 - RNA, 21 nt, Human
cuggcugucugggccggucug

SEQ ID NO: 750491 - RNA, 24 nt, Human
cugggccggucugcuggcuuggga

SEQ ID NO: 750492 - RNA, 25 nt, Human
cuguuuccuuauguagccaacauga

SEQ ID NO: 750493 - RNA, 19 nt, Human
cuuaaccaaggaaaaaaaa

SEQ ID NO: 750494 - RNA, 23 nt, Human
gaaaaaaaaccccaaaucaugga

SEQ ID NO: 750495 - RNA, 24 nt, Human
gaaaaaaaaccccaaaucauggag

SEQ ID NO: 750496 - RNA, 21 nt, Human
gaaaaauacccaaauacaaaa

SEQ ID NO: 750497 - RNA, 18 nt, Human
gagaagauucauuaaugg

SEQ ID NO: 750498 - RNA, 22 nt, Human
gagaaggccacuccuggcuuuc

SEQ ID NO: 750499 - RNA, 21 nt, Human
gagcaaaagccacuugaagaa

SEQ ID NO: 750500 - RNA, 25 nt, Human
gagcauuucaaguuuuuuaagauuc

SEQ ID NO: 750501 - RNA, 18 nt, Human
gcaugagggcugcccccc

SEQ ID NO: 750502 - RNA, 21 nt, Human
gcuaauucuaaaugaauggca

SEQ ID NO: 750503 - RNA, 21 nt, Human
gcuacuaguucagccccucca

SEQ ID NO: 750504 - RNA, 20 nt, Human
gcugcaggcuugcuggccug

SEQ ID NO: 750505 - RNA, 20 nt, Human
ggagaggaggggacggccca

SEQ ID NO: 750506 - RNA, 22 nt, Human
ggaggagccagccucuccugaa

SEQ ID NO: 750507 - RNA, 22 nt, Human
ggaggagggccggagaggaggg

SEQ ID NO: 750508 - RNA, 22 nt, Human
gggccggagaggaggggacggc

SEQ ID NO: 750509 - RNA, 19 nt, Human
gggcugccccccucuuugc

SEQ ID NO: 750510 - RNA, 21 nt, Human
gguaggagaaaugacauagaa

SEQ ID NO: 750511 - RNA, 21 nt, Human
guggaaaacccaaauucaagg

SEQ ID NO: 750512 - RNA, 19 nt, Human
uaaaaaaaccacccuuuua

SEQ ID NO: 750513 - RNA, 25 nt, Human
uaaaauuagcagcucuuccaaaaaa

SEQ ID NO: 750514 - RNA, 26 nt, Human
uaauuuagggacugugcccuggaauc

SEQ ID NO: 750515 - RNA, 21 nt, Human
uaccaggccacccagucacac

SEQ ID NO: 750516 - RNA, 20 nt, Human
uagagaagcucaacaaugca

SEQ ID NO: 750517 - RNA, 24 nt, Human
uaggauuugugcuaugguaggaga

SEQ ID NO: 750518 - RNA, 23 nt, Human
uagucccuagguauugugcuccc

SEQ ID NO: 750519 - RNA, 18 nt, Human
ucaaggacaauuuggcua

SEQ ID NO: 750520 - RNA, 20 nt, Human
ucaaggacaauuuggcuagc

SEQ ID NO: 750521 - RNA, 20 nt, Human
ucacacauaauccuccuugu

SEQ ID NO: 750522 - RNA, 21 nt, Human
ucagcaccugacgugggggca

SEQ ID NO: 750523 - RNA, 25 nt, Human
ucccugugacacacagaagacacuu

SEQ ID NO: 750524 - RNA, 23 nt, Human
ucuaccaggccacccagucacac

SEQ ID NO: 750525 - RNA, 18 nt, Human
ucucauagaaagcugguu

SEQ ID NO: 750526 - RNA, 22 nt, Human
ucuccugaaaucccuccuucug

SEQ ID NO: 750527 - RNA, 19 nt, Human
ucucuuucaauagcagccu

SEQ ID NO: 750528 - RNA, 24 nt, Human
ucugcuaauucuaaaugaauggca

SEQ ID NO: 750529 - RNA, 25 nt, Human
ucugggccggucugcuggcuuggga

SEQ ID NO: 750530 - RNA, 22 nt, Human
ugaaaaauacccaaauacaaaa

SEQ ID NO: 750531 - RNA, 22 nt, Human
ugaaaucccuccuucuguuucc

SEQ ID NO: 750532 - RNA, 21 nt, Human
ugauaaacacaaaagaccuca

SEQ ID NO: 750533 - RNA, 24 nt, Human
ugccggggcguccccaguagagaa

SEQ ID NO: 750534 - RNA, 21 nt, Human
uggaaaacccaaauucaagga

SEQ ID NO: 750535 - RNA, 24 nt, Human
ugggggcaccugcugcugcaggcu

SEQ ID NO: 750536 - RNA, 20 nt, Human
uggugcuaaauucagggcag

SEQ ID NO: 750537 - RNA, 23 nt, Human
uguuaggcaugagggcugccccc

SEQ ID NO: 750538 - RNA, 18 nt, Human
uuaggagggauggaguuu

SEQ ID NO: 750539 - RNA, 19 nt, Human
uuaggagggauggaguuuu

SEQ ID NO: 750540 - RNA, 21 nt, Human
uucaaggacaauuuggcuagc

SEQ ID NO: 750541 - RNA, 22 nt, Human
uuggugcuaaauucagggcagu

SEQ ID NO: 750542 - RNA, 22 nt, Human
uuuaaaauaaaauuagcagcuc

SEQ ID NO: 750543 - RNA, 23 nt, Human
uuuuaagauucuuaggagggaug

SEQ ID NO: 750544 - RNA, 25 nt, Human
aaaaaagaaaaucauuuagcaagag

SEQ ID NO: 750545 - RNA, 18 nt, Human
aaaaacagcccuguucca

SEQ ID NO: 750546 - RNA, 21 nt, Human
aaaaccccagagccugcagca

SEQ ID NO: 750547 - RNA, 20 nt, Human
aaaggaggcauucagacagc

SEQ ID NO: 750548 - RNA, 24 nt, Human
aacagcuucagaggacagggguga

SEQ ID NO: 750549 - RNA, 18 nt, Human
aacccccaugcacccugc

SEQ ID NO: 750550 - RNA, 20 nt, Human
aagagcaguuucauucacaa

SEQ ID NO: 750551 - RNA, 19 nt, Human
aagcaagagcuggagcagc

SEQ ID NO: 750552 - RNA, 29 nt, Human
aagcaagagugaaauggagaagggacccc

SEQ ID NO: 750553 - RNA, 19 nt, Human
aaggaggcauucagacagc

SEQ ID NO: 750554 - RNA, 18 nt, Human
aauccgcugauuuuccuc

SEQ ID NO: 750555 - RNA, 18 nt, Human
acacagaacccccugccc

SEQ ID NO: 750556 - RNA, 24 nt, Human
acagacccagaagcccacagccca

SEQ ID NO: 750557 - RNA, 20 nt, Human
acaugaacaugcaaaacccc

SEQ ID NO: 750558 - RNA, 18 nt, Human
acccagaagcccacagcc

SEQ ID NO: 750559 - RNA, 19 nt, Human
acccugagugcccaagaag

SEQ ID NO: 750560 - RNA, 19 nt, Human
acgaaagcugcuguggucu

SEQ ID NO: 750561 - RNA, 25 nt, Human
agaaacaccccaacucucaaccuuc

SEQ ID NO: 750562 - RNA, 24 nt, Human
agaauauaaaaacagcccuguucc

SEQ ID NO: 750563 - RNA, 22 nt, Human
agacagacccccaccugacuuc

SEQ ID NO: 750564 - RNA, 20 nt, Human
agaccaccucucagagcucc

SEQ ID NO: 750565 - RNA, 21 nt, Human
agagagaugcugaagccuggg

SEQ ID NO: 750566 - RNA, 21 nt, Human
agagcaaggggcuguguuugu

SEQ ID NO: 750567 - RNA, 19 nt, Human
agagccaagagucccaagg

SEQ ID NO: 750568 - RNA, 19 nt, Human
agaugcugaagccugggug

SEQ ID NO: 750569 - RNA, 18 nt, Human
agcaggagacgggugggg

SEQ ID NO: 750570 - RNA, 19 nt, Human
agcaggagacgggugggga

SEQ ID NO: 750571 - RNA, 23 nt, Human
agcccuggcugggucuuuuccca

SEQ ID NO: 750572 - RNA, 18 nt, Human
agccucuccacccucccc

SEQ ID NO: 750573 - RNA, 23 nt, Human
agccuuaaccccaaaggaaaagc

SEQ ID NO: 750574 - RNA, 21 nt, Human
agcugcgcugcccccguccuc

SEQ ID NO: 750575 - RNA, 20 nt, Human
agcuguccaccguggucugg

SEQ ID NO: 750576 - RNA, 22 nt, Human
aggaaagaaggagauagggcag

SEQ ID NO: 750577 - RNA, 29 nt, Human
aggauaaccauugucccccuuccauggaa

SEQ ID NO: 750578 - RNA, 26 nt, Human
aggcagggaggacagcugugaggcug

SEQ ID NO: 750579 - RNA, 19 nt, Human
aggccugggagccggagcc

SEQ ID NO: 750580 - RNA, 19 nt, Human
agggaccauuuggcuuccu

SEQ ID NO: 750581 - RNA, 19 nt, Human
agggaccccauggaaggaa

SEQ ID NO: 750582 - RNA, 25 nt, Human
agggauauauccccagugcucugga

SEQ ID NO: 750583 - RNA, 20 nt, Human
agggggaggaguggaagauu

SEQ ID NO: 750584 - RNA, 20 nt, Human
aggugggaguggaaggcagg

SEQ ID NO: 750585 - RNA, 27 nt, Human
auagggcagugagccucuuaggccucu

SEQ ID NO: 750586 - RNA, 24 nt, Human
aucacaucccucccacuuccccag

SEQ ID NO: 750587 - RNA, 18 nt, Human
aucauuuagcaagagcag

SEQ ID NO: 750588 - RNA, 24 nt, Human
cacagacccagaagcccacagccc

SEQ ID NO: 750589 - RNA, 18 nt, Human
cacagccauggcccucag

SEQ ID NO: 750590 - RNA, 21 nt, Human
cacagcccagguccuucucca

SEQ ID NO: 750591 - RNA, 23 nt, Human
cacagcccagguccuucuccaca

SEQ ID NO: 750592 - RNA, 20 nt, Human
cacauccaccuccuccucga

SEQ ID NO: 750593 - RNA, 22 nt, Human
cacaugccccuccccacccccu

SEQ ID NO: 750594 - RNA, 18 nt, Human
cacccccccuccaaaaaa

SEQ ID NO: 750595 - RNA, 19 nt, Human
caccggacuccucccucca

SEQ ID NO: 750596 - RNA, 19 nt, Human
caccuccuccucgacuccu

SEQ ID NO: 750597 - RNA, 20 nt, Human
caccuugccuacgcccaugu

SEQ ID NO: 750598 - RNA, 21 nt, Human
cacucaacccugagugcccaa

SEQ ID NO: 750599 - RNA, 23 nt, Human
cagaaaaauggauauuucccaga

SEQ ID NO: 750600 - RNA, 25 nt, Human
cagaagacagacccccaccugacuu

SEQ ID NO: 750601 - RNA, 22 nt, Human
cagaagcccacagcccaggucc

SEQ ID NO: 750602 - RNA, 23 nt, Human
cagaagcccacagcccagguccu

SEQ ID NO: 750603 - RNA, 19 nt, Human
cagacccagaagcccacag

SEQ ID NO: 750604 - RNA, 24 nt, Human
cagaccuggaggaugguguguggg

SEQ ID NO: 750605 - RNA, 21 nt, Human
cagccauguccaacagccccu

SEQ ID NO: 750606 - RNA, 21 nt, Human
cagcugccacauccaccuccu

SEQ ID NO: 750607 - RNA, 25 nt, Human
caucacaucccucccacuuccccag

SEQ ID NO: 750608 - RNA, 26 nt, Human
ccaacagccccugaggucuguucucu

SEQ ID NO: 750609 - RNA, 23 nt, Human
ccagcuccucagucucccucuuc

SEQ ID NO: 750610 - RNA, 21 nt, Human
ccagguccuucuccacagcca

SEQ ID NO: 750611 - RNA, 23 nt, Human
ccauuuggcuuccuugggaaagg

SEQ ID NO: 750612 - RNA, 18 nt, Human
cccaaaggaaaagcaacc

SEQ ID NO: 750613 - RNA, 22 nt, Human
cccaagaaguuauaaaaaugua

SEQ ID NO: 750614 - RNA, 20 nt, Human
cccaagauacccucuucaac

SEQ ID NO: 750615 - RNA, 25 nt, Human
cccacagcaccgcugcuuugcuccg

SEQ ID NO: 750616 - RNA, 21 nt, Human
cccagagccugcagcaggaga

SEQ ID NO: 750617 - RNA, 25 nt, Human
cccaggccaagagagaugcugaagc

SEQ ID NO: 750618 - RNA, 18 nt, Human
cccaugcacccugccccc

SEQ ID NO: 750619 - RNA, 21 nt, Human
cccaugcacccugcccccagc

SEQ ID NO: 750620 - RNA, 22 nt, Human
cccaugcacccugcccccagca

SEQ ID NO: 750621 - RNA, 24 nt, Human
cccaugcacccugcccccagcacc

SEQ ID NO: 750622 - RNA, 22 nt, Human
cccauguuuccuccaaaaacca

SEQ ID NO: 750623 - RNA, 23 nt, Human
ccccaaaggaaaagcaacccuuu

SEQ ID NO: 750624 - RNA, 18 nt, Human
ccccaagauacccucuuc

SEQ ID NO: 750625 - RNA, 18 nt, Human
ccccagagccugcagcag

SEQ ID NO: 750626 - RNA, 20 nt, Human
ccccagugcucuggaaaacu

SEQ ID NO: 750627 - RNA, 22 nt, Human
ccccaugcacccugcccccagc

SEQ ID NO: 750628 - RNA, 23 nt, Human
ccccaugcacccugcccccagca

SEQ ID NO: 750629 - RNA, 27 nt, Human
ccccaugcacccugcccccagcaccag

SEQ ID NO: 750630 - RNA, 19 nt, Human
ccccauggacgugcccuuc

SEQ ID NO: 750631 - RNA, 23 nt, Human
cccccugaaauagacgauaagca

SEQ ID NO: 750632 - RNA, 19 nt, Human
cccugagugcccaagaagu

SEQ ID NO: 750633 - RNA, 23 nt, Human
ccgcugauuuuccucucuuccuc

SEQ ID NO: 750634 - RNA, 19 nt, Human
ccucagcugcaacccugcc

SEQ ID NO: 750635 - RNA, 25 nt, Human
ccucccuccacuccacucaacccug

SEQ ID NO: 750636 - RNA, 22 nt, Human
ccuccuccucgacuccugaucu

SEQ ID NO: 750637 - RNA, 18 nt, Human
ccugcccccagcaccaga

SEQ ID NO: 750638 - RNA, 23 nt, Human
ccugcccugcuugcaucccagaa

SEQ ID NO: 750639 - RNA, 24 nt, Human
ccugcccugcuugcaucccagaag

SEQ ID NO: 750640 - RNA, 18 nt, Human
ccugccuggcugagggag

SEQ ID NO: 750641 - RNA, 21 nt, Human
ccugcugaggcagccucucca

SEQ ID NO: 750642 - RNA, 19 nt, Human
ccugggcaguggcagggcc

SEQ ID NO: 750643 - RNA, 20 nt, Human
ccugugccaagggcugggga

SEQ ID NO: 750644 - RNA, 24 nt, Human
cgauaagcaacccccaugcacccu

SEQ ID NO: 750645 - RNA, 19 nt, Human
cggacuccucccuccacuc

SEQ ID NO: 750646 - RNA, 22 nt, Human
cuagaccaccucucagagcucc

SEQ ID NO: 750647 - RNA, 24 nt, Human
cucaacccugagugcccaagaagu

SEQ ID NO: 750648 - RNA, 19 nt, Human
cucacggccaucuaguugc

SEQ ID NO: 750649 - RNA, 18 nt, Human
cucagcugcaacccugcc

SEQ ID NO: 750650 - RNA, 21 nt, Human
cucagcugccacauccaccuc

SEQ ID NO: 750651 - RNA, 24 nt, Human
cucaguccccaccagcauggaugc

SEQ ID NO: 750652 - RNA, 19 nt, Human
cucaguucccaggccugug

SEQ ID NO: 750653 - RNA, 23 nt, Human
cuccaaccccacagcaccgcugc

SEQ ID NO: 750654 - RNA, 22 nt, Human
cuccacagccacaccaagcuuu

SEQ ID NO: 750655 - RNA, 18 nt, Human
cuccacuccacucaaccc

SEQ ID NO: 750656 - RNA, 25 nt, Human
cuccuacccgaacucugccugugcc

SEQ ID NO: 750657 - RNA, 25 nt, Human
cuccucccuccacuccacucaaccc

SEQ ID NO: 750658 - RNA, 18 nt, Human
cucuugggccuggcgugg

SEQ ID NO: 750659 - RNA, 24 nt, Human
cugaaauagacgauaagcaacccc

SEQ ID NO: 750660 - RNA, 18 nt, Human
cugcccaguuucagcugu

SEQ ID NO: 750661 - RNA, 20 nt, Human
cuugcagaagacagaccccc

SEQ ID NO: 750662 - RNA, 18 nt, Human
gaaagaaggagauagggc

SEQ ID NO: 750663 - RNA, 22 nt, Human
gacaagaaggaagguguguggu

SEQ ID NO: 750664 - RNA, 22 nt, Human
gagcuguccaccguggucuggg

SEQ ID NO: 750665 - RNA, 21 nt, Human
gaguggaaggcagggcauugg

SEQ ID NO: 750666 - RNA, 22 nt, Human
gcaaaaccccagagccugcagc

SEQ ID NO: 750667 - RNA, 29 nt, Human
gcaaaaccccagagccugcagcaggagac

SEQ ID NO: 750668 - RNA, 22 nt, Human
gcacagacccagaagcccacag

SEQ ID NO: 750669 - RNA, 21 nt, Human
gcacagccuuaaccccaaagg

SEQ ID NO: 750670 - RNA, 19 nt, Human
gcagccucuccacccuccc

SEQ ID NO: 750671 - RNA, 19 nt, Human
gcagggccaagugcucucc

SEQ ID NO: 750672 - RNA, 22 nt, Human
gcccagguccuucuccacagcc

SEQ ID NO: 750673 - RNA, 22 nt, Human
gcccuggcugggucuuuuccca

SEQ ID NO: 750674 - RNA, 21 nt, Human
gcccuuguguacauaaucucu

SEQ ID NO: 750675 - RNA, 18 nt, Human
gccuuggaagggcgugag

SEQ ID NO: 750676 - RNA, 23 nt, Human
gcuuugcuccgcccauccucugc

SEQ ID NO: 750677 - RNA, 18 nt, Human
ggacaauggagggggagg

SEQ ID NO: 750678 - RNA, 22 nt, Human
ggagcagccagcccuggcuggg

SEQ ID NO: 750679 - RNA, 22 nt, Human
ggcacagacccagaagcccaca

SEQ ID NO: 750680 - RNA, 18 nt, Human
ggccaagugcucuccaac

SEQ ID NO: 750681 - RNA, 21 nt, Human
ggccaagugcucuccaacccc

SEQ ID NO: 750682 - RNA, 19 nt, Human
gggaggagcugaagaaggg

SEQ ID NO: 750683 - RNA, 24 nt, Human
gggaggggacaauggagggggagg

SEQ ID NO: 750684 - RNA, 20 nt, Human
gggcgugaggaaagaaggag

SEQ ID NO: 750685 - RNA, 24 nt, Human
gggcuggggaggggcuaccugggc

SEQ ID NO: 750686 - RNA, 21 nt, Human
ggggaggggacaauggagggg

SEQ ID NO: 750687 - RNA, 18 nt, Human
ggggaggggcuaccuggg

SEQ ID NO: 750688 - RNA, 19 nt, Human
gggggagggaggguauggg

SEQ ID NO: 750689 - RNA, 18 nt, Human
ggugaggucguggagaag

SEQ ID NO: 750690 - RNA, 19 nt, Human
ggugcacacacuggaggcu

SEQ ID NO: 750691 - RNA, 20 nt, Human
guaaaacgugcugcacagcc

SEQ ID NO: 750692 - RNA, 23 nt, Human
guagggaugagcuggggccacag

SEQ ID NO: 750693 - RNA, 19 nt, Human
gucccaggccagcuccuca

SEQ ID NO: 750694 - RNA, 25 nt, Human
guucuggggccugggggugagggca

SEQ ID NO: 750695 - RNA, 27 nt, Human
uaaaacgugcugcacagccuuaacccc

SEQ ID NO: 750696 - RNA, 21 nt, Human
uaacucccccgggccugagca

SEQ ID NO: 750697 - RNA, 18 nt, Human
uaagauggucccaggcca

SEQ ID NO: 750698 - RNA, 28 nt, Human
uaagcaacccccaugcacccugccccca

SEQ ID NO: 750699 - RNA, 21 nt, Human
uagcugccagggcgggcaugc

SEQ ID NO: 750700 - RNA, 20 nt, Human
uaggacacaggccugggagc

SEQ ID NO: 750701 - RNA, 22 nt, Human
uauaggugaggucguggagaag

SEQ ID NO: 750702 - RNA, 19 nt, Human
ucacaucccucccacuucc

SEQ ID NO: 750703 - RNA, 21 nt, Human
ucaccuugccuacgcccaugu

SEQ ID NO: 750704 - RNA, 19 nt, Human
ucagagcuccuggaaauga

SEQ ID NO: 750705 - RNA, 21 nt, Human
ucaggcagccuccccugcgcc

SEQ ID NO: 750706 - RNA, 21 nt, Human
ucaggugggaguggaaggcag

SEQ ID NO: 750707 - RNA, 21 nt, Human
uccaaaaaaagaaaaucauuu

SEQ ID NO: 750708 - RNA, 22 nt, Human
uccaaaaaaagaaaaucauuua

SEQ ID NO: 750709 - RNA, 21 nt, Human
uccaaaauaauaaguucuggg

SEQ ID NO: 750710 - RNA, 18 nt, Human
uccaccguggucuggggg

SEQ ID NO: 750711 - RNA, 23 nt, Human
uccauggaagacacagaaccccc

SEQ ID NO: 750712 - RNA, 19 nt, Human
uccauuuccaggagaggac

SEQ ID NO: 750713 - RNA, 19 nt, Human
ucccagagcaaggggcugu

SEQ ID NO: 750714 - RNA, 21 nt, Human
ucccauccugguccuccauuu

SEQ ID NO: 750715 - RNA, 20 nt, Human
uccccaauguugucugccca

SEQ ID NO: 750716 - RNA, 24 nt, Human
uccccaauguugucugcccaguuu

SEQ ID NO: 750717 - RNA, 20 nt, Human
uccccagugcucuggaaaac

SEQ ID NO: 750718 - RNA, 23 nt, Human
uccccagugcucuggaaaacugg

SEQ ID NO: 750719 - RNA, 18 nt, Human
uccuggaaaugagguccu

SEQ ID NO: 750720 - RNA, 21 nt, Human
uccuugcagaagacagacccc

SEQ ID NO: 750721 - RNA, 18 nt, Human
uccuugggaaagggaagg

SEQ ID NO: 750722 - RNA, 25 nt, Human
ucggcacagacccagaagcccacag

SEQ ID NO: 750723 - RNA, 23 nt, Human
ucucagaagccaaaugaccugcu

SEQ ID NO: 750724 - RNA, 19 nt, Human
ucuccacagccacaccaag

SEQ ID NO: 750725 - RNA, 21 nt, Human
ucuccacagccacaccaagcu

SEQ ID NO: 750726 - RNA, 21 nt, Human
ucuggaaaacuggggcacagg

SEQ ID NO: 750727 - RNA, 25 nt, Human
ugaaaaugaaagugcaccccccucu

SEQ ID NO: 750728 - RNA, 19 nt, Human
ugaaagugcacccccccuc

SEQ ID NO: 750729 - RNA, 18 nt, Human
ugaaauagacgauaagca

SEQ ID NO: 750730 - RNA, 22 nt, Human
ugaaauagacgauaagcaaccc

SEQ ID NO: 750731 - RNA, 22 nt, Human
ugaagccugggugggggacugg

SEQ ID NO: 750732 - RNA, 21 nt, Human
ugagcuggggccacagccaga

SEQ ID NO: 750733 - RNA, 24 nt, Human
ugaggaaagaaggagauagggcag

SEQ ID NO: 750734 - RNA, 18 nt, Human
ugaggaaccagggacccc

SEQ ID NO: 750735 - RNA, 21 nt, Human
ugaggaaccagggaccccaug

SEQ ID NO: 750736 - RNA, 19 nt, Human
ugcagcaggagacgggugg

SEQ ID NO: 750737 - RNA, 24 nt, Human
ugccaagggcuggggaggggcuac

SEQ ID NO: 750738 - RNA, 24 nt, Human
ugccuacgcccauguuuccuccaa

SEQ ID NO: 750739 - RNA, 21 nt, Human
ugccuggcugagggagugaca

SEQ ID NO: 750740 - RNA, 19 nt, Human
ugcugcacagccuuaaccc

SEQ ID NO: 750741 - RNA, 21 nt, Human
ugcugcacagccuuaacccca

SEQ ID NO: 750742 - RNA, 18 nt, Human
uggaagaaagcugaaagg

SEQ ID NO: 750743 - RNA, 20 nt, Human
uggaaggcagggcauugggg

SEQ ID NO: 750744 - RNA, 23 nt, Human
uggaagggcgugaggaaagaagg

SEQ ID NO: 750745 - RNA, 21 nt, Human
uggagaaaggaggcauucaga

SEQ ID NO: 750746 - RNA, 24 nt, Human
uggcagugggcauuugagcccaug

SEQ ID NO: 750747 - RNA, 26 nt, Human
uggccagaaaaauggauauuucccag

SEQ ID NO: 750748 - RNA, 22 nt, Human
ugggaauagcacacauuggaga

SEQ ID NO: 750749 - RNA, 21 nt, Human
ugggaggagcugaagaagggg

SEQ ID NO: 750750 - RNA, 23 nt, Human
uggggaauagcugccagggcggg

SEQ ID NO: 750751 - RNA, 20 nt, Human
uggggaggcagggaggacag

SEQ ID NO: 750752 - RNA, 19 nt, Human
uggggcacagguugagaac

SEQ ID NO: 750753 - RNA, 22 nt, Human
uggggcacagguugagaacgug

SEQ ID NO: 750754 - RNA, 18 nt, Human
uggguaggacacaggccu

SEQ ID NO: 750755 - RNA, 20 nt, Human
ugggucacagccauggcccu

SEQ ID NO: 750756 - RNA, 21 nt, Human
uggguguccccacacccuccu

SEQ ID NO: 750757 - RNA, 19 nt, Human
uggucccaggccagcuccu

SEQ ID NO: 750758 - RNA, 19 nt, Human
uggugggggaggggacaau

SEQ ID NO: 750759 - RNA, 18 nt, Human
uguccagccauguccaac

SEQ ID NO: 750760 - RNA, 20 nt, Human
uguggugggggaggggacaa

SEQ ID NO: 750761 - RNA, 28 nt, Human
uguguacauaaucucuaauauuuauaua

SEQ ID NO: 750762 - RNA, 20 nt, Human
uuaaccccaaaggaaaagca

SEQ ID NO: 750763 - RNA, 22 nt, Human
uuccuccaaaaaccaaccucag

SEQ ID NO: 750764 - RNA, 19 nt, Human
uuucccagaccuggaggau

SEQ ID NO: 750765 - RNA, 28 nt, Human
aagcugccgggacagcguggucugggac

SEQ ID NO: 750766 - RNA, 21 nt, Human
aagugucuuucuuuuggcucu

SEQ ID NO: 750767 - RNA, 22 nt, Human
aauauacacacauaucggugca

SEQ ID NO: 750768 - RNA, 23 nt, Human
agaaaacugcugaccuucacuaa

SEQ ID NO: 750769 - RNA, 19 nt, Human
aggaauaaaagccacauga

SEQ ID NO: 750770 - RNA, 25 nt, Human
aggguggagaccggaggacgagaag

SEQ ID NO: 750771 - RNA, 19 nt, Human
caaguuagaaaacugcuga

SEQ ID NO: 750772 - RNA, 22 nt, Human
cacaaguuagaaaacugcugac

SEQ ID NO: 750773 - RNA, 24 nt, Human
cacugcacaccugcaguacaugug

SEQ ID NO: 750774 - RNA, 23 nt, Human
cacugcccaaccgccuuuccucc

SEQ ID NO: 750775 - RNA, 19 nt, Human
cagauacccuuccugggcu

SEQ ID NO: 750776 - RNA, 21 nt, Human
caucccagauacccuuccugg

SEQ ID NO: 750777 - RNA, 21 nt, Human
ccacccccagguaucugaccc

SEQ ID NO: 750778 - RNA, 22 nt, Human
ccacccccagguaucugacccc

SEQ ID NO: 750779 - RNA, 20 nt, Human
cccacccccagguaucugac

SEQ ID NO: 750780 - RNA, 21 nt, Human
cccacccccagguaucugacc

SEQ ID NO: 750781 - RNA, 18 nt, Human
ccccacccccagguaucu

SEQ ID NO: 750782 - RNA, 21 nt, Human
cccccacuguuugggucucug

SEQ ID NO: 750783 - RNA, 21 nt, Human
ccuccccacccccagguaucu

SEQ ID NO: 750784 - RNA, 18 nt, Human
ccuccuguucaacucucc

SEQ ID NO: 750785 - RNA, 23 nt, Human
cgcagcuacugagcaugcgcaca

SEQ ID NO: 750786 - RNA, 21 nt, Human
cucaggguggagaccggagga

SEQ ID NO: 750787 - RNA, 18 nt, Human
cuccccuggguugacucc

SEQ ID NO: 750788 - RNA, 22 nt, Human
cugggaggaacauauuucagau

SEQ ID NO: 750789 - RNA, 19 nt, Human
gcacagggccagcuccggc

SEQ ID NO: 750790 - RNA, 19 nt, Human
gcagggaaagcugccggga

SEQ ID NO: 750791 - RNA, 22 nt, Human
gcccaaccgccuuuccuccuca

SEQ ID NO: 750792 - RNA, 24 nt, Human
ggccaagugcaucgguggcuuccg

SEQ ID NO: 750793 - RNA, 26 nt, Human
ggucggugcucccucaggguggagac

SEQ ID NO: 750794 - RNA, 27 nt, Human
uaaaaaaugaaauucagaaccgcagca

SEQ ID NO: 750795 - RNA, 19 nt, Human
uaaaacguuugcacaucag

SEQ ID NO: 750796 - RNA, 21 nt, Human
uacacacauaucggugcagua

SEQ ID NO: 750797 - RNA, 18 nt, Human
uaggaugcauucgcagcu

SEQ ID NO: 750798 - RNA, 21 nt, Human
ucagagcaggcucuggauggg

SEQ ID NO: 750799 - RNA, 19 nt, Human
ucagauccagcuuggccuc

SEQ ID NO: 750800 - RNA, 20 nt, Human
uccaguuuacuugggauuuc

SEQ ID NO: 750801 - RNA, 24 nt, Human
uccccacccccagguaucugaccc

SEQ ID NO: 750802 - RNA, 21 nt, Human
uccugggaagcuagauagaaa

SEQ ID NO: 750803 - RNA, 20 nt, Human
ucuucuguggccccucccca

SEQ ID NO: 750804 - RNA, 27 nt, Human
ugacagauucucuuccuuguggcaucc

SEQ ID NO: 750805 - RNA, 19 nt, Human
ugacuccucucuucucuuc

SEQ ID NO: 750806 - RNA, 24 nt, Human
ugagguacugucaguugcagggaa

SEQ ID NO: 750807 - RNA, 23 nt, Human
ugccaaagucaaauucagagcag

SEQ ID NO: 750808 - RNA, 24 nt, Human
ugcucugcuugcuuucugagguag

SEQ ID NO: 750809 - RNA, 20 nt, Human
uggaugggcggaaugugaug

SEQ ID NO: 750810 - RNA, 24 nt, Human
uggauguccuuucacccaacuucu

SEQ ID NO: 750811 - RNA, 21 nt, Human
uggcuuccgggugugcuuccc

SEQ ID NO: 750812 - RNA, 25 nt, Human
uggguugacuccucucuucucuuca

SEQ ID NO: 750813 - RNA, 24 nt, Human
uguuauaaaaaaugaaauucagaa

SEQ ID NO: 750814 - RNA, 23 nt, Human
uguuugggggugguguggagaga

SEQ ID NO: 750815 - RNA, 22 nt, Human
uuacuugggauuuccuucgaug

SEQ ID NO: 750816 - RNA, 20 nt, Human
uucuguggccccuccccacc

SEQ ID NO: 750817 - RNA, 21 nt, Human
aacccagggagaccuguggau

SEQ ID NO: 750818 - RNA, 19 nt, Human
aagaugccucccuccccca

SEQ ID NO: 750819 - RNA, 20 nt, Human
aagcagaaaccaggagcaug

SEQ ID NO: 750820 - RNA, 26 nt, Human
aagcagaaaccaggagcaugggggga

SEQ ID NO: 750821 - RNA, 22 nt, Human
aagcgccucccccgggcgcacc

SEQ ID NO: 750822 - RNA, 20 nt, Human
aaggaaggcccagagcugcg

SEQ ID NO: 750823 - RNA, 22 nt, Human
acacaagggcuccagggcaccu

SEQ ID NO: 750824 - RNA, 22 nt, Human
acagagcaggcucugggacccc

SEQ ID NO: 750825 - RNA, 20 nt, Human
acaggaaguccuuggcugag

SEQ ID NO: 750826 - RNA, 21 nt, Human
acaggggccccugccuccccu

SEQ ID NO: 750827 - RNA, 26 nt, Human
acagucggcacgcccucggcugcacc

SEQ ID NO: 750828 - RNA, 21 nt, Human
accaggagggcaugggccugg

SEQ ID NO: 750829 - RNA, 18 nt, Human
accccagcuccuccccaa

SEQ ID NO: 750830 - RNA, 23 nt, Human
accccgcugccaggguguugaca

SEQ ID NO: 750831 - RNA, 22 nt, Human
accuguggaugggagagggcug

SEQ ID NO: 750832 - RNA, 23 nt, Human
acucccauggccccuucccagac

SEQ ID NO: 750833 - RNA, 22 nt, Human
agaacagaaaggcagagggaga

SEQ ID NO: 750834 - RNA, 20 nt, Human
agaagccucuuuaggcuaga

SEQ ID NO: 750835 - RNA, 20 nt, Human
agaagccucuuuaggcuaga

SEQ ID NO: 750836 - RNA, 22 nt, Human
agagaagccucuuuaggcuaga

SEQ ID NO: 750837 - RNA, 30 nt, Human
agaggggaggggugcagggagguggggccc

SEQ ID NO: 750838 - RNA, 22 nt, Human
agcacaggggccccugccuccc

SEQ ID NO: 750839 - RNA, 21 nt, Human
agcagaaaccaggagcauggg

SEQ ID NO: 750840 - RNA, 22 nt, Human
agccaggccggcagcaggggca

SEQ ID NO: 750841 - RNA, 18 nt, Human
agcggccacugcucccca

SEQ ID NO: 750842 - RNA, 21 nt, Human
aggcagagggagaggccuggg

SEQ ID NO: 750843 - RNA, 21 nt, Human
agggagaggccugggaggggu

SEQ ID NO: 750844 - RNA, 24 nt, Human
augacacccacccagcuaacagag

SEQ ID NO: 750845 - RNA, 19 nt, Human
auuuggggaggggugcagg

SEQ ID NO: 750846 - RNA, 21 nt, Human
caaccguggacagggccgucu

SEQ ID NO: 750847 - RNA, 22 nt, Human
caagaaacaagaugccucccuc

SEQ ID NO: 750848 - RNA, 26 nt, Human
caagaaacaagaugccucccuccccc

SEQ ID NO: 750849 - RNA, 20 nt, Human
caagggcagggaccccccac

SEQ ID NO: 750850 - RNA, 26 nt, Human
cacagcacccugggcccguucucagg

SEQ ID NO: 750851 - RNA, 27 nt, Human
cacagucggcacgcccucggcugcacc

SEQ ID NO: 750852 - RNA, 26 nt, Human
cacccagagcugagaccugggagagg

SEQ ID NO: 750853 - RNA, 18 nt, Human
caccccaggcccaagcac

SEQ ID NO: 750854 - RNA, 23 nt, Human
cacccccgcccaacuuccccacu

SEQ ID NO: 750855 - RNA, 19 nt, Human
caccggggcuguggcagcg

SEQ ID NO: 750856 - RNA, 20 nt, Human
caccggggcuguggcagcgg

SEQ ID NO: 750857 - RNA, 19 nt, Human
cacgcccucggcugcaccc

SEQ ID NO: 750858 - RNA, 18 nt, Human
cagagcugagaccuggga

SEQ ID NO: 750859 - RNA, 18 nt, Human
cagcauucaaagugagug

SEQ ID NO: 750860 - RNA, 24 nt, Human
cagcauucaaagugaguguuuggg

SEQ ID NO: 750861 - RNA, 21 nt, Human
cagcccaaguccccaccuccu

SEQ ID NO: 750862 - RNA, 24 nt, Human
cagcccaaguccccaccuccuaag

SEQ ID NO: 750863 - RNA, 21 nt, Human
cagcuccuccccaaggaaggc

SEQ ID NO: 750864 - RNA, 23 nt, Human
caggaaaaggaagcgccuccccc

SEQ ID NO: 750865 - RNA, 25 nt, Human
caggaagagccagagcugaguggug

SEQ ID NO: 750866 - RNA, 23 nt, Human
caggagcaaccguggacagggcc

SEQ ID NO: 750867 - RNA, 22 nt, Human
caggagcauggggggagccucg

SEQ ID NO: 750868 - RNA, 20 nt, Human
cagugcacagagcaggcucu

SEQ ID NO: 750869 - RNA, 21 nt, Human
ccaaauaccucgccgccaagc

SEQ ID NO: 750870 - RNA, 24 nt, Human
ccaaauaccucgccgccaagcucc

SEQ ID NO: 750871 - RNA, 23 nt, Human
ccagagugggcagaacagggaaa

SEQ ID NO: 750872 - RNA, 18 nt, Human
ccagcccaaguccccacc

SEQ ID NO: 750873 - RNA, 19 nt, Human
ccaggccggcagcaggggc

SEQ ID NO: 750874 - RNA, 19 nt, Human
ccaggggcaccaggagggc

SEQ ID NO: 750875 - RNA, 20 nt, Human
ccaguggguggggcuggugc

SEQ ID NO: 750876 - RNA, 26 nt, Human
cccaaauaccucgccgccaagcuccu

SEQ ID NO: 750877 - RNA, 19 nt, Human
cccaagcacuggacaccuu

SEQ ID NO: 750878 - RNA, 18 nt, Human
cccaccccaggcccaagc

SEQ ID NO: 750879 - RNA, 23 nt, Human
cccagacagagccccgucugaga

SEQ ID NO: 750880 - RNA, 22 nt, Human
cccagagcugagaccugggaga

SEQ ID NO: 750881 - RNA, 18 nt, Human
cccagcccaaguccccac

SEQ ID NO: 750882 - RNA, 24 nt, Human
cccauggccccuucccagacuccu

SEQ ID NO: 750883 - RNA, 23 nt, Human
ccccaaauaccucgccgccaagc

SEQ ID NO: 750884 - RNA, 19 nt, Human
ccccaccccaggcccaagc

SEQ ID NO: 750885 - RNA, 18 nt, Human
ccccaccucagcccuggg

SEQ ID NO: 750886 - RNA, 30 nt, Human
ccccaccucagcccuggggacccccuggcc

SEQ ID NO: 750887 - RNA, 22 nt, Human
ccccaggccuuacuuccccaaa

SEQ ID NO: 750888 - RNA, 21 nt, Human
ccccauccucucugccgccuu

SEQ ID NO: 750889 - RNA, 21 nt, Human
ccccccaccccaggcccaagc

SEQ ID NO: 750890 - RNA, 28 nt, Human
ccccccaccccaggcccaagcacuggac

SEQ ID NO: 750891 - RNA, 22 nt, Human
cccccuuccccauuuccacucc

SEQ ID NO: 750892 - RNA, 24 nt, Human
ccccucuccaggcccccuucccca

SEQ ID NO: 750893 - RNA, 20 nt, Human
ccccugccuccccucuccag

SEQ ID NO: 750894 - RNA, 24 nt, Human
ccccugccuccccucuccaggccc

SEQ ID NO: 750895 - RNA, 20 nt, Human
ccccugcucuauagagggga

SEQ ID NO: 750896 - RNA, 21 nt, Human
ccccugcucuauagaggggag

SEQ ID NO: 750897 - RNA, 18 nt, Human
cccgaaagcaggaguagg

SEQ ID NO: 750898 - RNA, 18 nt, Human
cccgcccaacuuccccac

SEQ ID NO: 750899 - RNA, 22 nt, Human
cccugauuaagaacagaaaggc

SEQ ID NO: 750900 - RNA, 19 nt, Human
cccugguaccccucucccu

SEQ ID NO: 750901 - RNA, 22 nt, Human
cccuuggccccugaccugggac

SEQ ID NO: 750902 - RNA, 18 nt, Human
ccggcagcaggggcaggc

SEQ ID NO: 750903 - RNA, 18 nt, Human
ccguccccaucccagccc

SEQ ID NO: 750904 - RNA, 23 nt, Human
ccguccuucugaggguacaacuc

SEQ ID NO: 750905 - RNA, 19 nt, Human
ccucagccccauccucucu

SEQ ID NO: 750906 - RNA, 19 nt, Human
ccucagcccuggggacccc

SEQ ID NO: 750907 - RNA, 21 nt, Human
ccuccaggauccucccucucc

SEQ ID NO: 750908 - RNA, 22 nt, Human
ccucccaggaagagccagagcu

SEQ ID NO: 750909 - RNA, 19 nt, Human
ccucccucuccucuccucu

SEQ ID NO: 750910 - RNA, 20 nt, Human
ccucccucuccucuccucuc

SEQ ID NO: 750911 - RNA, 19 nt, Human
ccucgccgccaagcuccuc

SEQ ID NO: 750912 - RNA, 19 nt, Human
ccucucugccgccuugggg

SEQ ID NO: 750913 - RNA, 24 nt, Human
ccugcagggaaccacaagaaacaa

SEQ ID NO: 750914 - RNA, 23 nt, Human
ccuggaguccucuaacaccuucc

SEQ ID NO: 750915 - RNA, 20 nt, Human
ccugggaggcaggggcugau

SEQ ID NO: 750916 - RNA, 24 nt, Human
ccuuccccauuuccacucccuggg

SEQ ID NO: 750917 - RNA, 23 nt, Human
cggcuaagaugcaacccagaaac

SEQ ID NO: 750918 - RNA, 22 nt, Human
cgggccgcggcccacacggggc

SEQ ID NO: 750919 - RNA, 27 nt, Human
cucagccugggccucuggcaccccagc

SEQ ID NO: 750920 - RNA, 25 nt, Human
cuccacagucggcacgcccucggcu

SEQ ID NO: 750921 - RNA, 24 nt, Human
cuccaccccaggccuuacuucccc

SEQ ID NO: 750922 - RNA, 19 nt, Human
cuccaggauccucccucuc

SEQ ID NO: 750923 - RNA, 21 nt, Human
cucccauggccccuucccaga

SEQ ID NO: 750924 - RNA, 22 nt, Human
cuccccacccagagcugagacc

SEQ ID NO: 750925 - RNA, 22 nt, Human
cuccccaccucagcccugggga

SEQ ID NO: 750926 - RNA, 21 nt, Human
cuccccucccuauuccccaga

SEQ ID NO: 750927 - RNA, 19 nt, Human
cucccuggcucugcacucc

SEQ ID NO: 750928 - RNA, 21 nt, Human
cucuaacaccuuccccccacc

SEQ ID NO: 750929 - RNA, 22 nt, Human
cucuaacaccuuccccccaccc

SEQ ID NO: 750930 - RNA, 20 nt, Human
cucuggcaccccagcuccuc

SEQ ID NO: 750931 - RNA, 22 nt, Human
cugccagaacccagggagaccu

SEQ ID NO: 750932 - RNA, 18 nt, Human
cugccuccccucuccagg

SEQ ID NO: 750933 - RNA, 19 nt, Human
cuggcaccccagcuccucc

SEQ ID NO: 750934 - RNA, 19 nt, Human
cugggagaggcgcgcagug

SEQ ID NO: 750935 - RNA, 19 nt, Human
cugggggucgcaagggcag

SEQ ID NO: 750936 - RNA, 20 nt, Human
cuugacgaucugugccucag

SEQ ID NO: 750937 - RNA, 19 nt, Human
gaaacaagaugccucccuc

SEQ ID NO: 750938 - RNA, 27 nt, Human
gaaaggaggacaggacuggccugcagg

SEQ ID NO: 750939 - RNA, 26 nt, Human
gaaaggcagagggagaggccugggag

SEQ ID NO: 750940 - RNA, 24 nt, Human
gaaggcuccccaccucagcccugg

SEQ ID NO: 750941 - RNA, 20 nt, Human
gagcaggcucugggacccca

SEQ ID NO: 750942 - RNA, 20 nt, Human
gagcauggggggagccucgg

SEQ ID NO: 750943 - RNA, 21 nt, Human
gagccucggcuaaccucccag

SEQ ID NO: 750944 - RNA, 23 nt, Human
gagggggcaggaaugacucaggc

SEQ ID NO: 750945 - RNA, 19 nt, Human
gaguccucuaacaccuucc

SEQ ID NO: 750946 - RNA, 21 nt, Human
gcaggagcaaccguggacagg

SEQ ID NO: 750947 - RNA, 21 nt, Human
gccagaacccagggagaccug

SEQ ID NO: 750948 - RNA, 21 nt, Human
gccuccuaggagagcaggagc

SEQ ID NO: 750949 - RNA, 18 nt, Human
gcgcaaacuggggaaggg

SEQ ID NO: 750950 - RNA, 18 nt, Human
gcucccgaaagcaggagu

SEQ ID NO: 750951 - RNA, 20 nt, Human
ggacaggacuggccugcagg

SEQ ID NO: 750952 - RNA, 18 nt, Human
ggagagggcugccuuccc

SEQ ID NO: 750953 - RNA, 28 nt, Human
ggaguccucuaacaccuuccccccaccc

SEQ ID NO: 750954 - RNA, 21 nt, Human
ggauggaggaacuggggucag

SEQ ID NO: 750955 - RNA, 20 nt, Human
ggcagaacagggaaaggagg

SEQ ID NO: 750956 - RNA, 20 nt, Human
ggccacugcuccccacccag

SEQ ID NO: 750957 - RNA, 21 nt, Human
ggccugggaggcuggcagaca

SEQ ID NO: 750958 - RNA, 19 nt, Human
gggaacccuacgagggggc

SEQ ID NO: 750959 - RNA, 21 nt, Human
gggaagauggcacacacguug

SEQ ID NO: 750960 - RNA, 19 nt, Human
gggcaccaggagggcaugg

SEQ ID NO: 750961 - RNA, 21 nt, Human
gggcaggaaugacucaggcuc

SEQ ID NO: 750962 - RNA, 22 nt, Human
gggcaugggccugggaggcugg

SEQ ID NO: 750963 - RNA, 24 nt, Human
gggccgcggcccacacggggccuc

SEQ ID NO: 750964 - RNA, 20 nt, Human
gggcuggaaccaggugaaga

SEQ ID NO: 750965 - RNA, 18 nt, Human
ggggccuccuaggagagc

SEQ ID NO: 750966 - RNA, 23 nt, Human
ggugauaggagaggacggagaaa

SEQ ID NO: 750967 - RNA, 21 nt, Human
guggaugggagagggcugccu

SEQ ID NO: 750968 - RNA, 23 nt, Human
guucucagguucuggccugggag

SEQ ID NO: 750969 - RNA, 20 nt, Human
uaacaccuuccccccacccc

SEQ ID NO: 750970 - RNA, 18 nt, Human
uaaccucccaggaagagc

SEQ ID NO: 750971 - RNA, 27 nt, Human
uaagaugcaacccagaaacuuccugcc

SEQ ID NO: 750972 - RNA, 19 nt, Human
uaagccaggccggcagcag

SEQ ID NO: 750973 - RNA, 26 nt, Human
uacaacucugagguagauuucacaga

SEQ ID NO: 750974 - RNA, 20 nt, Human
uacccguccuucugagggua

SEQ ID NO: 750975 - RNA, 24 nt, Human
uaccucgccgccaagcuccucagc

SEQ ID NO: 750976 - RNA, 19 nt, Human
uagaaggcuccccaccuca

SEQ ID NO: 750977 - RNA, 19 nt, Human
uagcucuuuugaaguugau

SEQ ID NO: 750978 - RNA, 25 nt, Human
uaggagagcaggagcaaccguggac

SEQ ID NO: 750979 - RNA, 18 nt, Human
uaucugggggucgcaagg

SEQ ID NO: 750980 - RNA, 21 nt, Human
ucagcagggacucccauggcc

SEQ ID NO: 750981 - RNA, 20 nt, Human
ucagguucuggccugggagg

SEQ ID NO: 750982 - RNA, 22 nt, Human
uccaacccugauuaagaacaga

SEQ ID NO: 750983 - RNA, 21 nt, Human
uccacagcacccugggcccgu

SEQ ID NO: 750984 - RNA, 22 nt, Human
uccaggcccccuuccccauuuc

SEQ ID NO: 750985 - RNA, 24 nt, Human
ucccagaguucaggaaaaggaagc

SEQ ID NO: 750986 - RNA, 20 nt, Human
ucccagcccaaguccccacc

SEQ ID NO: 750987 - RNA, 21 nt, Human
ucccagcccaaguccccaccu

SEQ ID NO: 750988 - RNA, 20 nt, Human
ucccauggccccuucccaga

SEQ ID NO: 750989 - RNA, 22 nt, Human
uccccaaauaccucgccgccaa

SEQ ID NO: 750990 - RNA, 21 nt, Human
uccccaccucagcccugggga

SEQ ID NO: 750991 - RNA, 22 nt, Human
uccccaccucagcccuggggac

SEQ ID NO: 750992 - RNA, 18 nt, Human
uccccacuuccucccgca

SEQ ID NO: 750993 - RNA, 25 nt, Human
uccccacuuccucccgcaggauccc

SEQ ID NO: 750994 - RNA, 20 nt, Human
uccccagagugggcagaaca

SEQ ID NO: 750995 - RNA, 21 nt, Human
uccccauuuccacucccuggg

SEQ ID NO: 750996 - RNA, 20 nt, Human
uccccccaccccaggcccaa

SEQ ID NO: 750997 - RNA, 18 nt, Human
ucccccgggcgcaccggg

SEQ ID NO: 750998 - RNA, 23 nt, Human
ucccugguaccccucucccuggc

SEQ ID NO: 750999 - RNA, 18 nt, Human
uccucagccugggccucu

SEQ ID NO: 751000 - RNA, 20 nt, Human
uccuccaggauccucccucu

SEQ ID NO: 751001 - RNA, 21 nt, Human
uccucuaacaccuucccccca

SEQ ID NO: 751002 - RNA, 23 nt, Human
uccuuggcugaguguuacggggc

SEQ ID NO: 751003 - RNA, 22 nt, Human
ucuaacaccuuccccccacccc

SEQ ID NO: 751004 - RNA, 19 nt, Human
ucuccaggcccccuucccc

SEQ ID NO: 751005 - RNA, 20 nt, Human
ucugggggucgcaagggcag

SEQ ID NO: 751006 - RNA, 21 nt, Human
ucugugccucagugccagggg

SEQ ID NO: 751007 - RNA, 18 nt, Human
ugacucgguagcaagugg

SEQ ID NO: 751008 - RNA, 19 nt, Human
ugaggggguaccugccuug

SEQ ID NO: 751009 - RNA, 21 nt, Human
ugcacccccgcccaacuuccc

SEQ ID NO: 751010 - RNA, 20 nt, Human
ugcagggagguggggccugg

SEQ ID NO: 751011 - RNA, 21 nt, Human
ugcagggagguggggccugga

SEQ ID NO: 751012 - RNA, 20 nt, Human
ugccaugagcccuaggcugg

SEQ ID NO: 751013 - RNA, 21 nt, Human
ugccaugagcccuaggcuggc

SEQ ID NO: 751014 - RNA, 22 nt, Human
ugccuccccucuccaggccccc

SEQ ID NO: 751015 - RNA, 21 nt, Human
ugcgcgagggucggccccucc

SEQ ID NO: 751016 - RNA, 19 nt, Human
uggaaggggacgcgaacgg

SEQ ID NO: 751017 - RNA, 22 nt, Human
uggacauuuggggaggggugca

SEQ ID NO: 751018 - RNA, 20 nt, Human
uggaggaacuggggucagug

SEQ ID NO: 751019 - RNA, 25 nt, Human
uggcacacacguugacucgguagca

SEQ ID NO: 751020 - RNA, 22 nt, Human
uggcaccccagcuccuccccaa

SEQ ID NO: 751021 - RNA, 20 nt, Human
uggcagacaguccccuggcc

SEQ ID NO: 751022 - RNA, 21 nt, Human
uggcagacaguccccuggccg

SEQ ID NO: 751023 - RNA, 22 nt, Human
uggccugggaggcaggggcuga

SEQ ID NO: 751024 - RNA, 19 nt, Human
ugggaccccaaaggcagcc

SEQ ID NO: 751025 - RNA, 20 nt, Human
ugggagggguaugccguccc

SEQ ID NO: 751026 - RNA, 19 nt, Human
ugggccucuggcaccccag

SEQ ID NO: 751027 - RNA, 22 nt, Human
ugggccucuggcaccccagcuc

SEQ ID NO: 751028 - RNA, 18 nt, Human
ugggccugggaggcuggc

SEQ ID NO: 751029 - RNA, 20 nt, Human
ugggccugggaggcuggcag

SEQ ID NO: 751030 - RNA, 20 nt, Human
uggggccuggaagaguugga

SEQ ID NO: 751031 - RNA, 20 nt, Human
ugggguggcaggcuuucgcc

SEQ ID NO: 751032 - RNA, 21 nt, Human
ugggugcuccccagacagagc

SEQ ID NO: 751033 - RNA, 18 nt, Human
uggguggagugugggaag

SEQ ID NO: 751034 - RNA, 23 nt, Human
uggugucaggggcuccagugggg

SEQ ID NO: 751035 - RNA, 18 nt, Human
uguggaugggagagggcu

SEQ ID NO: 751036 - RNA, 23 nt, Human
uuugggggugauaggagaggacg

SEQ ID NO: 751037 - RNA, 20 nt, Human
uuugucccugguaccccucu

SEQ ID NO: 751038 - RNA, 19 nt, Human
aacaaaacgaaauuggggu

SEQ ID NO: 751039 - RNA, 22 nt, Human
aacaaaugaauccuuccccagg

SEQ ID NO: 751040 - RNA, 24 nt, Human
aaggcauccuugcagccccaacca

SEQ ID NO: 751041 - RNA, 23 nt, Human
aauauauaauagaaaauuaccca

SEQ ID NO: 751042 - RNA, 18 nt, Human
accuguaaaggcauccuu

SEQ ID NO: 751043 - RNA, 22 nt, Human
aggcauccuugcagccccaacc

SEQ ID NO: 751044 - RNA, 19 nt, Human
auacaaaaucagcuacgua

SEQ ID NO: 751045 - RNA, 24 nt, Human
auucaaauauuuuaaaauauaaag

SEQ ID NO: 751046 - RNA, 24 nt, Human
caaaaucaauguuuauucugccaa

SEQ ID NO: 751047 - RNA, 22 nt, Human
caacaaaagaagcauuuugaca

SEQ ID NO: 751048 - RNA, 22 nt, Human
caacaaaugaauccuuccccag

SEQ ID NO: 751049 - RNA, 27 nt, Human
caccuucaaccuugggggaaaaugcuu

SEQ ID NO: 751050 - RNA, 18 nt, Human
cacuuacagaugcuccua

SEQ ID NO: 751051 - RNA, 25 nt, Human
cauuuggaaagagaacaaaccugaa

SEQ ID NO: 751052 - RNA, 22 nt, Human
cauuugguugaaaugauuacuc

SEQ ID NO: 751053 - RNA, 18 nt, Human
cggccugacucgcaguag

SEQ ID NO: 751054 - RNA, 27 nt, Human
cucgcaacaaaugaauccuuccccagg

SEQ ID NO: 751055 - RNA, 24 nt, Human
cuguaaaggcauccuugcagcccc

SEQ ID NO: 751056 - RNA, 25 nt, Human
gcaacaaaagaagcauuuugacaaa

SEQ ID NO: 751057 - RNA, 21 nt, Human
ggagaggggaguuguauagug

SEQ ID NO: 751058 - RNA, 23 nt, Human
uaaugccaaguuggcaauuuaau

SEQ ID NO: 751059 - RNA, 19 nt, Human
uaauuuuucuuuuuuguaa

SEQ ID NO: 751060 - RNA, 25 nt, Human
uacaaaacaauaaaaacuguucuuu

SEQ ID NO: 751061 - RNA, 24 nt, Human
uagaagcugaauaaacaaaacgaa

SEQ ID NO: 751062 - RNA, 18 nt, Human
uagaauggaguagaggua

SEQ ID NO: 751063 - RNA, 19 nt, Human
uagcguucuugugcaccug

SEQ ID NO: 751064 - RNA, 24 nt, Human
uccaugaagaacccaauuuacaaa

SEQ ID NO: 751065 - RNA, 20 nt, Human
ugaaauucauuugguugaaa

SEQ ID NO: 751066 - RNA, 22 nt, Human
ugaaauucauuugguugaaaug

SEQ ID NO: 751067 - RNA, 18 nt, Human
ugccaaaaauaagagcaa

SEQ ID NO: 751068 - RNA, 24 nt, Human
ugcuucacugucucuucuauuuau

SEQ ID NO: 751069 - RNA, 20 nt, Human
uggaaaaaaacuuccaugaa

SEQ ID NO: 751070 - RNA, 22 nt, Human
uggaaagagaacaaaccugaaa

SEQ ID NO: 751071 - RNA, 24 nt, Human
uggguguucaauauuuuagaagcu

SEQ ID NO: 751072 - RNA, 19 nt, Human
uuaaucuuuacauacaaaa

SEQ ID NO: 751073 - RNA, 18 nt, Human
uugcauguguucucucuc

SEQ ID NO: 751074 - RNA, 24 nt, Human
uuuaaauaacuuucuuaacccugc

SEQ ID NO: 751075 - RNA, 19 nt, Human
uuucuaguuuuggaaaaaa

SEQ ID NO: 751076 - RNA, 22 nt, Human
uuugugaccacucaccuucaac

SEQ ID NO: 751077 - RNA, 24 nt, Human
uuuuucuuuuuuguaaauuucugu

SEQ ID NO: 751078 - RNA, 18 nt, Human
aaaaaaaaaaaaucccua

SEQ ID NO: 751079 - RNA, 24 nt, Human
aaaaaaccuuaaaagugcggccaa

SEQ ID NO: 751080 - RNA, 22 nt, Human
aaaaaagcacccuuguggcccu

SEQ ID NO: 751081 - RNA, 23 nt, Human
aaaacccaccuuugacacuaucc

SEQ ID NO: 751082 - RNA, 23 nt, Human
aaaagaacccaagaacaaccaca

SEQ ID NO: 751083 - RNA, 20 nt, Human
aaacaacaugcuggcucuga

SEQ ID NO: 751084 - RNA, 22 nt, Human
aaacagaugcaugguuacaaac

SEQ ID NO: 751085 - RNA, 20 nt, Human
aaacagauucacucaacucu

SEQ ID NO: 751086 - RNA, 20 nt, Human
aaagaaugaaaacagaugca

SEQ ID NO: 751087 - RNA, 21 nt, Human
aaagacaaccccagcccaaga

SEQ ID NO: 751088 - RNA, 26 nt, Human
aaagauuaaccaagcucucuagauaa

SEQ ID NO: 751089 - RNA, 23 nt, Human
aaagcacccuuguggcccugcuc

SEQ ID NO: 751090 - RNA, 19 nt, Human
aaauaggaacaguuucaau

SEQ ID NO: 751091 - RNA, 20 nt, Human
aacauuucacacccaaaacu

SEQ ID NO: 751092 - RNA, 25 nt, Human
aaccugacauuuccuucacugcucu

SEQ ID NO: 751093 - RNA, 19 nt, Human
aacugcaucucaaaacaaa

SEQ ID NO: 751094 - RNA, 18 nt, Human
aagaacccaagaacaacc

SEQ ID NO: 751095 - RNA, 23 nt, Human
aagacaaaagaacccaagaacaa

SEQ ID NO: 751096 - RNA, 21 nt, Human
aagacccucccaacccugucc

SEQ ID NO: 751097 - RNA, 24 nt, Human
aaggaaaaauaaaagacccuccca

SEQ ID NO: 751098 - RNA, 21 nt, Human
acaagacaaaagaacccaaga

SEQ ID NO: 751099 - RNA, 22 nt, Human
acaagacaaaagaacccaagaa

SEQ ID NO: 751100 - RNA, 25 nt, Human
acaaugaaagaaacucaaaaguaac

SEQ ID NO: 751101 - RNA, 19 nt, Human
acaguaaaguuagucuggg

SEQ ID NO: 751102 - RNA, 21 nt, Human
acauauaaaaaaaccuuaaaa

SEQ ID NO: 751103 - RNA, 23 nt, Human
acccuuguggcccugcucugggu

SEQ ID NO: 751104 - RNA, 27 nt, Human
accuuaaaagugcggccaagggauuuu

SEQ ID NO: 751105 - RNA, 20 nt, Human
acgaaaauccaccccgaauc

SEQ ID NO: 751106 - RNA, 25 nt, Human
acuagaacaaucuucuucacuacca

SEQ ID NO: 751107 - RNA, 23 nt, Human
acucccaaagccuuccccgcauc

SEQ ID NO: 751108 - RNA, 18 nt, Human
acuugcccuuccucuaaa

SEQ ID NO: 751109 - RNA, 22 nt, Human
agaagcuggaaaacccaccuuu

SEQ ID NO: 751110 - RNA, 26 nt, Human
agacaaaagaacccaagaacaaccac

SEQ ID NO: 751111 - RNA, 18 nt, Human
agacugaaaguuugaaau

SEQ ID NO: 751112 - RNA, 21 nt, Human
agcaaaagguacagcaaagaa

SEQ ID NO: 751113 - RNA, 20 nt, Human
agcagcagcagcagccagag

SEQ ID NO: 751114 - RNA, 18 nt, Human
agcuuagaaaaacuggug

SEQ ID NO: 751115 - RNA, 21 nt, Human
aggaagcacugagaguuugag

SEQ ID NO: 751116 - RNA, 21 nt, Human
agggacaagaaagccauuacu

SEQ ID NO: 751117 - RNA, 20 nt, Human
aguuugagaaaggaagauag

SEQ ID NO: 751118 - RNA, 26 nt, Human
auaaaagacccucccaacccugucca

SEQ ID NO: 751119 - RNA, 20 nt, Human
aucuuauaugcacuugguug

SEQ ID NO: 751120 - RNA, 23 nt, Human
augggcagcaaaagguacagcaa

SEQ ID NO: 751121 - RNA, 26 nt, Human
caaaaagcagcagcagcagccagagg

SEQ ID NO: 751122 - RNA, 23 nt, Human
caaaaaguucauaguguccuuug

SEQ ID NO: 751123 - RNA, 22 nt, Human
caaaacuuggguccugcuaacc

SEQ ID NO: 751124 - RNA, 20 nt, Human
caaaagaacccaagaacaac

SEQ ID NO: 751125 - RNA, 20 nt, Human
caaaaggaggcuggcaccau

SEQ ID NO: 751126 - RNA, 24 nt, Human
caagacaaaagaacccaagaacaa

SEQ ID NO: 751127 - RNA, 31 nt, Human
caagacaaaagaacccaagaacaaccacaaa

SEQ ID NO: 751128 - RNA, 21 nt, Human
cacaaaacuuaagucuucagg

SEQ ID NO: 751129 - RNA, 21 nt, Human
cacaacccuuuccucuucaaa

SEQ ID NO: 751130 - RNA, 20 nt, Human
cacaauuuagauugcccuuc

SEQ ID NO: 751131 - RNA, 24 nt, Human
cacccagaacaacuguuaagccau

SEQ ID NO: 751132 - RNA, 18 nt, Human
caccccgaauccaaaaau

SEQ ID NO: 751133 - RNA, 19 nt, Human
cagcaaaagguacagcaaa

SEQ ID NO: 751134 - RNA, 19 nt, Human
cagcaaagaaugaaaacag

SEQ ID NO: 751135 - RNA, 22 nt, Human
cagcagcagcagccagagggag

SEQ ID NO: 751136 - RNA, 21 nt, Human
cagcagcagccagagggaguu

SEQ ID NO: 751137 - RNA, 18 nt, Human
cagcaugggacuauuugg

SEQ ID NO: 751138 - RNA, 27 nt, Human
cagcuugccaaagcaaaaggccaaugg

SEQ ID NO: 751139 - RNA, 21 nt, Human
caucacuucuuuauuucaaag

SEQ ID NO: 751140 - RNA, 21 nt, Human
ccacaaugaaagaaacucaaa

SEQ ID NO: 751141 - RNA, 28 nt, Human
cccaaagccuuccccgcaucauccacuu

SEQ ID NO: 751142 - RNA, 18 nt, Human
cccacaaaacuuaagucu

SEQ ID NO: 751143 - RNA, 25 nt, Human
cccacaaaacuuaagucuucaggca

SEQ ID NO: 751144 - RNA, 21 nt, Human
cccacugagccugaaguggca

SEQ ID NO: 751145 - RNA, 18 nt, Human
cccuguccaaaaaaaccc

SEQ ID NO: 751146 - RNA, 28 nt, Human
ccuauccuacuacacugguuuuuggaaa

SEQ ID NO: 751147 - RNA, 27 nt, Human
ccucccaacccuguccaaaaaaaccca

SEQ ID NO: 751148 - RNA, 25 nt, Human
cgaauccaaaaauucagacauggaa

SEQ ID NO: 751149 - RNA, 18 nt, Human
cgggacaccaaaaagcag

SEQ ID NO: 751150 - RNA, 23 nt, Human
cgucccagggcaaauaggaacag

SEQ ID NO: 751151 - RNA, 19 nt, Human
cuaaagacaaccccagccc

SEQ ID NO: 751152 - RNA, 22 nt, Human
cuaaauguaaacagauucacuc

SEQ ID NO: 751153 - RNA, 20 nt, Human
cuaacucucugcugcaugcc

SEQ ID NO: 751154 - RNA, 24 nt, Human
cucuaaagaguccuucagguuggg

SEQ ID NO: 751155 - RNA, 19 nt, Human
cuucaacuaagccaaaccc

SEQ ID NO: 751156 - RNA, 18 nt, Human
cuuugagacuacagcgcc

SEQ ID NO: 751157 - RNA, 18 nt, Human
gaaaucacucccaaagcc

SEQ ID NO: 751158 - RNA, 22 nt, Human
gacaaggcaggguguuagguuu

SEQ ID NO: 751159 - RNA, 27 nt, Human
gacugugcagugauccuucgguucccc

SEQ ID NO: 751160 - RNA, 22 nt, Human
gagaaacugucaguucaaaaag

SEQ ID NO: 751161 - RNA, 18 nt, Human
gauguugucugcacugcc

SEQ ID NO: 751162 - RNA, 22 nt, Human
gcaaaaaaaaaaaaaaaaaucc

SEQ ID NO: 751163 - RNA, 22 nt, Human
gcaacauuucacacccaaaacu

SEQ ID NO: 751164 - RNA, 19 nt, Human
gcacugccaaauuuguucc

SEQ ID NO: 751165 - RNA, 18 nt, Human
gcggcagagggcagcauu

SEQ ID NO: 751166 - RNA, 19 nt, Human
ggaugaugcuuucacuuuu

SEQ ID NO: 751167 - RNA, 18 nt, Human
ggcaaaaaaaaaaaaaaa

SEQ ID NO: 751168 - RNA, 24 nt, Human
gguggauugcugcuagggcaucuu

SEQ ID NO: 751169 - RNA, 24 nt, Human
ggugugcuccagauuguugguuca

SEQ ID NO: 751170 - RNA, 23 nt, Human
gugaggcaaucucucugggcuuu

SEQ ID NO: 751171 - RNA, 23 nt, Human
guggcacuagaacaaucuucuuc

SEQ ID NO: 751172 - RNA, 19 nt, Human
uaaaaaauacuauugcaau

SEQ ID NO: 751173 - RNA, 23 nt, Human
uaaaaaauccuauuagaaaccau

SEQ ID NO: 751174 - RNA, 22 nt, Human
uaaaaauacuguaguaggacug

SEQ ID NO: 751175 - RNA, 23 nt, Human
uaaaaauacuguaguaggacugu

SEQ ID NO: 751176 - RNA, 18 nt, Human
uaaaagacccucccaacc

SEQ ID NO: 751177 - RNA, 19 nt, Human
uaaaagacccucccaaccc

SEQ ID NO: 751178 - RNA, 19 nt, Human
uaaagaaaaaaagcacccu

SEQ ID NO: 751179 - RNA, 20 nt, Human
uaaagaaaaaaagcacccuu

SEQ ID NO: 751180 - RNA, 21 nt, Human
uaaccaagcucucuagauaaa

SEQ ID NO: 751181 - RNA, 22 nt, Human
uaacuauacacauauaaaaaaa

SEQ ID NO: 751182 - RNA, 24 nt, Human
uaauaacaauaauaaaaaauccua

SEQ ID NO: 751183 - RNA, 18 nt, Human
uaccugaguuaaaauauc

SEQ ID NO: 751184 - RNA, 23 nt, Human
uauaugcacuugguugcacagaa

SEQ ID NO: 751185 - RNA, 23 nt, Human
uaucaaagugacuuccagugccc

SEQ ID NO: 751186 - RNA, 22 nt, Human
uauuuggcuggaggcagggggc

SEQ ID NO: 751187 - RNA, 23 nt, Human
ucaaagugacuuccagugcccac

SEQ ID NO: 751188 - RNA, 23 nt, Human
ucaagacaagagggagcagcaca

SEQ ID NO: 751189 - RNA, 23 nt, Human
uccaagauuuucgcccaaaaaac

SEQ ID NO: 751190 - RNA, 19 nt, Human
uccacccagaacaacuguu

SEQ ID NO: 751191 - RNA, 18 nt, Human
uccaccccgaauccaaaa

SEQ ID NO: 751192 - RNA, 22 nt, Human
uccacggacaacgaaaauccac

SEQ ID NO: 751193 - RNA, 23 nt, Human
uccacggacaacgaaaauccacc

SEQ ID NO: 751194 - RNA, 28 nt, Human
uccacggacaacgaaaauccaccccgaa

SEQ ID NO: 751195 - RNA, 18 nt, Human
ucccaaagccuuccccgc

SEQ ID NO: 751196 - RNA, 21 nt, Human
ucugacaagacaaaagaaccc

SEQ ID NO: 751197 - RNA, 24 nt, Human
ucuuggggcaaaaaaaaaaaaaaa

SEQ ID NO: 751198 - RNA, 24 nt, Human
ugaaaucacucccaaagccuuccc

SEQ ID NO: 751199 - RNA, 19 nt, Human
ugaagacagaagacuccac

SEQ ID NO: 751200 - RNA, 18 nt, Human
ugaauggguggccuggga

SEQ ID NO: 751201 - RNA, 21 nt, Human
ugacaagacaaaagaacccaa

SEQ ID NO: 751202 - RNA, 23 nt, Human
ugacaagacaaaagaacccaaga

SEQ ID NO: 751203 - RNA, 26 nt, Human
ugagcauaauuagguuagguuaacaa

SEQ ID NO: 751204 - RNA, 22 nt, Human
ugaugcuuucacuuuuguaucc

SEQ ID NO: 751205 - RNA, 19 nt, Human
ugcaugcacucgccagagg

SEQ ID NO: 751206 - RNA, 19 nt, Human
ugccuaaaaagucacugca

SEQ ID NO: 751207 - RNA, 20 nt, Human
ugcuccuacagcgaugcccc

SEQ ID NO: 751208 - RNA, 24 nt, Human
ugcuguucggauuuuuuauuuuua

SEQ ID NO: 751209 - RNA, 22 nt, Human
uggaaacaggcaaagcauacuu

SEQ ID NO: 751210 - RNA, 23 nt, Human
uggaaugugguaggauuucacag

SEQ ID NO: 751211 - RNA, 18 nt, Human
uggcucccacugagccug

SEQ ID NO: 751212 - RNA, 18 nt, Human
uggcuggaggcagggggc

SEQ ID NO: 751213 - RNA, 23 nt, Human
ugggagaagcuggaaaacccacc

SEQ ID NO: 751214 - RNA, 18 nt, Human
ugggugaacguuuucuug

SEQ ID NO: 751215 - RNA, 22 nt, Human
ugguaacuauacacauauaaaa

SEQ ID NO: 751216 - RNA, 21 nt, Human
ugguggauugcugcuagggca

SEQ ID NO: 751217 - RNA, 23 nt, Human
ugucgggacaccaaaaagcagca

SEQ ID NO: 751218 - RNA, 21 nt, Human
uuaaaaauacuguaguaggac

SEQ ID NO: 751219 - RNA, 24 nt, Human
uuagugcaguccuucaagccacaa

SEQ ID NO: 751220 - RNA, 18 nt, Human
uuauaugcacuugguugc

SEQ ID NO: 751221 - RNA, 21 nt, Human
uucaaaugaggggacguuucc

SEQ ID NO: 751222 - RNA, 18 nt, Human
uucaaguaugcuguucgg

SEQ ID NO: 751223 - RNA, 21 nt, Human
uugagggggcaacagagcuag

SEQ ID NO: 751224 - RNA, 18 nt, Human
uuggcuggaggcaggggg

SEQ ID NO: 751225 - RNA, 21 nt, Human
uuggcuggaggcagggggcuu

SEQ ID NO: 751226 - RNA, 20 nt, Human
uuuagagggcuacuuaaaaa

SEQ ID NO: 751227 - RNA, 22 nt, Human
uuucuacaggugaaaaccuucc

SEQ ID NO: 751228 - RNA, 22 nt, Human
uuugugggggcucucuacucug

SEQ ID NO: 751229 - RNA, 19 nt, Human
uuuguuccgaaugagugag

SEQ ID NO: 751230 - RNA, 24 nt, Human
uuuuuuuuuuuaaagaaaaaaagc

SEQ ID NO: 751231 - RNA, 20 nt, Human
aaacacagcucaugccccac

SEQ ID NO: 751232 - RNA, 25 nt, Human
aaacggauguaauccugcauaagac

SEQ ID NO: 751233 - RNA, 21 nt, Human
aaagacucaaaacagauuaga

SEQ ID NO: 751234 - RNA, 19 nt, Human
aacagauuagagaucuuaa

SEQ ID NO: 751235 - RNA, 22 nt, Human
aaccaggaggaagcaacaucca

SEQ ID NO: 751236 - RNA, 21 nt, Human
aacuggcuauuuuguaaagaa

SEQ ID NO: 751237 - RNA, 22 nt, Human
aagcacgagcaggaauaaacaa

SEQ ID NO: 751238 - RNA, 20 nt, Human
aagcaugaucugggggaaag

SEQ ID NO: 751239 - RNA, 18 nt, Human
aaggcaccgcacuaccac

SEQ ID NO: 751240 - RNA, 20 nt, Human
aaguuaccgacguugguagg

SEQ ID NO: 751241 - RNA, 19 nt, Human
acaaagcacagcuuuccuu

SEQ ID NO: 751242 - RNA, 24 nt, Human
acacugcccuuucccacugacacc

SEQ ID NO: 751243 - RNA, 20 nt, Human
acauccaccccagccagacc

SEQ ID NO: 751244 - RNA, 25 nt, Human
accgaagggcaggagccucagccua

SEQ ID NO: 751245 - RNA, 18 nt, Human
accucaauuccugugcug

SEQ ID NO: 751246 - RNA, 18 nt, Human
acugcuuugugauggccu

SEQ ID NO: 751247 - RNA, 19 nt, Human
agaaaacuuuguggugggg

SEQ ID NO: 751248 - RNA, 30 nt, Human
agaaaagaaagaauuaaagcaugaucuggg

SEQ ID NO: 751249 - RNA, 20 nt, Human
agaaacugcaggaagagccu

SEQ ID NO: 751250 - RNA, 18 nt, Human
agacacggcggacaggag

SEQ ID NO: 751251 - RNA, 25 nt, Human
agucccucucuuugugcuuuaagga

SEQ ID NO: 751252 - RNA, 23 nt, Human
aucacaaaaaugacaguccccac

SEQ ID NO: 751253 - RNA, 23 nt, Human
caaauauacaaagcucaauaaac

SEQ ID NO: 751254 - RNA, 23 nt, Human
caacauccaccccagccagacua

SEQ ID NO: 751255 - RNA, 23 nt, Human
caacucccagaagaagcuuaauu

SEQ ID NO: 751256 - RNA, 21 nt, Human
caagccauucuaaagggcaga

SEQ ID NO: 751257 - RNA, 24 nt, Human
cacacccuuucugcuuucaccaag

SEQ ID NO: 751258 - RNA, 23 nt, Human
cacagcucaugccccacugcuuu

SEQ ID NO: 751259 - RNA, 20 nt, Human
caccuggauguuaacugucc

SEQ ID NO: 751260 - RNA, 18 nt, Human
cacucggcaacccagggc

SEQ ID NO: 751261 - RNA, 19 nt, Human
cacugacaccaaguccaac

SEQ ID NO: 751262 - RNA, 18 nt, Human
cagcaacagggacugcuc

SEQ ID NO: 751263 - RNA, 20 nt, Human
cagcuuuccuuuauuuccug

SEQ ID NO: 751264 - RNA, 25 nt, Human
cauauauaugcaauagcacacaccc

SEQ ID NO: 751265 - RNA, 26 nt, Human
cauucaucugcugaugggacaagcca

SEQ ID NO: 751266 - RNA, 23 nt, Human
ccacacgucaccugccugaacgc

SEQ ID NO: 751267 - RNA, 23 nt, Human
ccacacugcccuuucccacugac

SEQ ID NO: 751268 - RNA, 25 nt, Human
ccacgugugacaccucuggaguccu

SEQ ID NO: 751269 - RNA, 18 nt, Human
ccaggcagucucuggcca

SEQ ID NO: 751270 - RNA, 21 nt, Human
cccauauauaugcaauagcac

SEQ ID NO: 751271 - RNA, 19 nt, Human
ccccacacugcccuuuccc

SEQ ID NO: 751272 - RNA, 22 nt, Human
ccccauauauaugcaauagcac

SEQ ID NO: 751273 - RNA, 21 nt, Human
cccuggagaccgacugcccgc

SEQ ID NO: 751274 - RNA, 18 nt, Human
cccuuucugcuuucacca

SEQ ID NO: 751275 - RNA, 22 nt, Human
ccugaaacacagcucaugcccc

SEQ ID NO: 751276 - RNA, 19 nt, Human
ccugacccaccucaauucc

SEQ ID NO: 751277 - RNA, 24 nt, Human
ccuuguagcaauaugugguugcuc

SEQ ID NO: 751278 - RNA, 22 nt, Human
cggcuuggcuugggcgacggcc

SEQ ID NO: 751279 - RNA, 20 nt, Human
cuccacgguggcgggucucc

SEQ ID NO: 751280 - RNA, 21 nt, Human
cugaaacacagcucaugcccc

SEQ ID NO: 751281 - RNA, 19 nt, Human
cugcaggaagagccugucu

SEQ ID NO: 751282 - RNA, 21 nt, Human
cugcccuuucccacugacacc

SEQ ID NO: 751283 - RNA, 23 nt, Human
cuggcacccauggugagcgcugg

SEQ ID NO: 751284 - RNA, 25 nt, Human
cugucaguuccacgugugacaccuc

SEQ ID NO: 751285 - RNA, 21 nt, Human
cuuaacacauucaucugcuga

SEQ ID NO: 751286 - RNA, 22 nt, Human
cuuaagcacgagcaggaauaaa

SEQ ID NO: 751287 - RNA, 23 nt, Human
cuucaccugacccaccucaauuc

SEQ ID NO: 751288 - RNA, 24 nt, Human
cuugaguuucuugcccccugccuc

SEQ ID NO: 751289 - RNA, 20 nt, Human
cuugcccccugccuccacgg

SEQ ID NO: 751290 - RNA, 18 nt, Human
cuuuccuuuauuuccugu

SEQ ID NO: 751291 - RNA, 22 nt, Human
gaacauacacucuuccuucacc

SEQ ID NO: 751292 - RNA, 18 nt, Human
gaacccccuagacuuucc

SEQ ID NO: 751293 - RNA, 24 nt, Human
gaauuaacacugacuuuguaacac

SEQ ID NO: 751294 - RNA, 20 nt, Human
gacaggagcgcgggcgggcg

SEQ ID NO: 751295 - RNA, 19 nt, Human
gagcuugcuccacucgacc

SEQ ID NO: 751296 - RNA, 23 nt, Human
gcccagggcuggugcucuugaug

SEQ ID NO: 751297 - RNA, 23 nt, Human
gcgcggcuuggcuugggcgacgg

SEQ ID NO: 751298 - RNA, 20 nt, Human
gcgguuucuggggucaguac

SEQ ID NO: 751299 - RNA, 23 nt, Human
gcucgcauggccagaauggaacc

SEQ ID NO: 751300 - RNA, 20 nt, Human
ggaggguuggcagcgcggcu

SEQ ID NO: 751301 - RNA, 23 nt, Human
ggcaccuucugaagggguguguc

SEQ ID NO: 751302 - RNA, 19 nt, Human
ggcccagggcuggugcucu

SEQ ID NO: 751303 - RNA, 19 nt, Human
ggggcagaaccaggaggaa

SEQ ID NO: 751304 - RNA, 18 nt, Human
gugcugcccucgagagcu

SEQ ID NO: 751305 - RNA, 20 nt, Human
guggggcagaaccaggagga

SEQ ID NO: 751306 - RNA, 20 nt, Human
guucuugaguuucuugcccc

SEQ ID NO: 751307 - RNA, 28 nt, Human
uaaaaauaggaacauacacucuuccuuc

SEQ ID NO: 751308 - RNA, 21 nt, Human
uaagaacuuaggauucaauga

SEQ ID NO: 751309 - RNA, 22 nt, Human
uaagcccuauaugaaacugucc

SEQ ID NO: 751310 - RNA, 23 nt, Human
uaggaacauacacucuuccuuca

SEQ ID NO: 751311 - RNA, 18 nt, Human
uauaugcaauagcacaca

SEQ ID NO: 751312 - RNA, 22 nt, Human
uauaugcaauagcacacacccu

SEQ ID NO: 751313 - RNA, 23 nt, Human
ucaaucuuaagcacgagcaggaa

SEQ ID NO: 751314 - RNA, 20 nt, Human
ucacaugggacagaaaaguu

SEQ ID NO: 751315 - RNA, 22 nt, Human
ucagucuaaacaaaucaagccc

SEQ ID NO: 751316 - RNA, 25 nt, Human
ucauuuaucauguccuuaaaaucuc

SEQ ID NO: 751317 - RNA, 22 nt, Human
uccagcacuugccacagaaaac

SEQ ID NO: 751318 - RNA, 19 nt, Human
uccugugcaucugauuucc

SEQ ID NO: 751319 - RNA, 23 nt, Human
ucugacacucggcaacccagggc

SEQ ID NO: 751320 - RNA, 21 nt, Human
ucuugcccccugccuccacgg

SEQ ID NO: 751321 - RNA, 24 nt, Human
ugaaacacagcucaugccccacug

SEQ ID NO: 751322 - RNA, 18 nt, Human
ugccccacugcuuuguga

SEQ ID NO: 751323 - RNA, 22 nt, Human
ugccugaacgcuaacuacaaag

SEQ ID NO: 751324 - RNA, 21 nt, Human
ugcuagacacggcggacagga

SEQ ID NO: 751325 - RNA, 24 nt, Human
uggaacccccuagacuuuccacac

SEQ ID NO: 751326 - RNA, 25 nt, Human
uggcccagggcuggugcucuugaug

SEQ ID NO: 751327 - RNA, 19 nt, Human
uggccccugaaacacagcu

SEQ ID NO: 751328 - RNA, 28 nt, Human
ugggacaagccauucuaaaaggucaucc

SEQ ID NO: 751329 - RNA, 18 nt, Human
ugguggggcagaaccagg

SEQ ID NO: 751330 - RNA, 19 nt, Human
ugguuaacacaucuguggu

SEQ ID NO: 751331 - RNA, 23 nt, Human
uguagcaauaugugguugcucag

SEQ ID NO: 751332 - RNA, 22 nt, Human
ugucagugcugcccucgagagc

SEQ ID NO: 751333 - RNA, 23 nt, Human
uguccaaauauacaaagcucaau

SEQ ID NO: 751334 - RNA, 19 nt, Human
ugugacaccucuggagucc

SEQ ID NO: 751335 - RNA, 20 nt, Human
ugugguggggcagaaccagg

SEQ ID NO: 751336 - RNA, 18 nt, Human
uguuauuaaaucacaaaa

SEQ ID NO: 751337 - RNA, 20 nt, Human
uuaaaucacaaaaaugacag

SEQ ID NO: 751338 - RNA, 27 nt, Human
uuaacuguccaaauggcaaauuauuca

SEQ ID NO: 751339 - RNA, 21 nt, Human
uuccagcacuugccacagaaa

SEQ ID NO: 751340 - RNA, 18 nt, Human
uuccuggauuuucacugu

SEQ ID NO: 751341 - RNA, 21 nt, Human
uucuuaggaacacauuuguca

SEQ ID NO: 751342 - RNA, 21 nt, Human
uugaugacugaauuguaagug

SEQ ID NO: 751343 - RNA, 18 nt, Human
uuggcagcgcggcuuggc

SEQ ID NO: 751344 - RNA, 20 nt, Human
uuggcagcgcggcuuggcuu

SEQ ID NO: 751345 - RNA, 19 nt, Human
uugggaaaacgucuuccuu

SEQ ID NO: 751346 - RNA, 23 nt, Human
uugugcuuuaaggaagaugcuuu

SEQ ID NO: 751347 - RNA, 19 nt, Human
uuuggauuuagcauugaca

SEQ ID NO: 751348 - RNA, 23 nt, Human
aaaagaagaaaaauaggaaaaaa

SEQ ID NO: 751349 - RNA, 19 nt, Human
aaacaauaaggacugaaua

SEQ ID NO: 751350 - RNA, 21 nt, Human
aaccccccgcccccccggccu

SEQ ID NO: 751351 - RNA, 23 nt, Human
aagcaaaaagaagaaaaauagga

SEQ ID NO: 751352 - RNA, 20 nt, Human
agaagaaaaaaaauuaaaga

SEQ ID NO: 751353 - RNA, 21 nt, Human
agaagaaaaaaaauuaaagaa

SEQ ID NO: 751354 - RNA, 25 nt, Human
agaagaaaaaaaauuaaagaaagaa

SEQ ID NO: 751355 - RNA, 21 nt, Human
agaguuuaauccacauuuuua

SEQ ID NO: 751356 - RNA, 19 nt, Human
agcaacgaaagaccagaaa

SEQ ID NO: 751357 - RNA, 22 nt, Human
agccccgcgguccccuaacccc

SEQ ID NO: 751358 - RNA, 22 nt, Human
agugacaagcuuauagaaagga

SEQ ID NO: 751359 - RNA, 22 nt, Human
agugcaaaaaaagcaaaaagaa

SEQ ID NO: 751360 - RNA, 24 nt, Human
auccaaaccugacaagcaaaaggc

SEQ ID NO: 751361 - RNA, 21 nt, Human
caagcuuauagaaaggacaau

SEQ ID NO: 751362 - RNA, 27 nt, Human
caauaaggacugaauauauuuggguag

SEQ ID NO: 751363 - RNA, 22 nt, Human
cagaauagcagacuaauggaau

SEQ ID NO: 751364 - RNA, 25 nt, Human
cagcgcagucaacccgaccccuugg

SEQ ID NO: 751365 - RNA, 28 nt, Human
caggagcccaggcagcgccgaggucggg

SEQ ID NO: 751366 - RNA, 20 nt, Human
ccaaagaagcaagagggaaa

SEQ ID NO: 751367 - RNA, 22 nt, Human
cccccccggccucgccuggccc

SEQ ID NO: 751368 - RNA, 21 nt, Human
ccccccggccucgccuggccc

SEQ ID NO: 751369 - RNA, 21 nt, Human
cccccgcccccccggccucgc

SEQ ID NO: 751370 - RNA, 23 nt, Human
ccccgcccccccggccucgccug

SEQ ID NO: 751371 - RNA, 20 nt, Human
ccccggggaguuaauuucuc

SEQ ID NO: 751372 - RNA, 21 nt, Human
ccccuaaccccccgccccccc

SEQ ID NO: 751373 - RNA, 21 nt, Human
cccgcgguccccuaacccccc

SEQ ID NO: 751374 - RNA, 25 nt, Human
cccguuaaaacuagaagaaaaaaaa

SEQ ID NO: 751375 - RNA, 19 nt, Human
cccuaaccccccgcccccc

SEQ ID NO: 751376 - RNA, 20 nt, Human
ccggagaagaccuccggccc

SEQ ID NO: 751377 - RNA, 23 nt, Human
ccuggaccagaagcaacgaaaga

SEQ ID NO: 751378 - RNA, 21 nt, Human
ccuggcccuggccgcucgagc

SEQ ID NO: 751379 - RNA, 22 nt, Human
cgcucgagccccuucccacagc

SEQ ID NO: 751380 - RNA, 24 nt, Human
cgguccccuaaccccccgcccccc

SEQ ID NO: 751381 - RNA, 24 nt, Human
cuagaagaaaaaaaauuaaagaaa

SEQ ID NO: 751382 - RNA, 21 nt, Human
cuggccgcucgagccccuucc

SEQ ID NO: 751383 - RNA, 20 nt, Human
gacuuagggagaggcugcag

SEQ ID NO: 751384 - RNA, 19 nt, Human
gcaaaaaaagcaaaaagaa

SEQ ID NO: 751385 - RNA, 23 nt, Human
gcaaaaaaagcaaaaagaagaaa

SEQ ID NO: 751386 - RNA, 24 nt, Human
gcaaaaaaagcaaaaagaagaaaa

SEQ ID NO: 751387 - RNA, 22 nt, Human
gcaaagagucucuucuaaauca

SEQ ID NO: 751388 - RNA, 24 nt, Human
gcagcgcagucaacccggcggccc

SEQ ID NO: 751389 - RNA, 21 nt, Human
gcagucaacccggcggccccg

SEQ ID NO: 751390 - RNA, 24 nt, Human
gcucccuggccggagaagaccucc

SEQ ID NO: 751391 - RNA, 22 nt, Human
ggagaggcugcaggagcccagg

SEQ ID NO: 751392 - RNA, 18 nt, Human
ggggacuggggccgcgaa

SEQ ID NO: 751393 - RNA, 19 nt, Human
uaaaacuagaagaaaaaaa

SEQ ID NO: 751394 - RNA, 21 nt, Human
uaaccccccgcccccccggcc

SEQ ID NO: 751395 - RNA, 23 nt, Human
uaagugcaauucaauuucagcaa

SEQ ID NO: 751396 - RNA, 19 nt, Human
uacucuaucgagaguuuaa

SEQ ID NO: 751397 - RNA, 18 nt, Human
uagaaugucauaugcuuc

SEQ ID NO: 751398 - RNA, 20 nt, Human
uagccuggaccagaagcaac

SEQ ID NO: 751399 - RNA, 27 nt, Human
uagcuguucuccuuuacuuuauguacu

SEQ ID NO: 751400 - RNA, 24 nt, Human
ucaacaaugcacacaucaaauauu

SEQ ID NO: 751401 - RNA, 18 nt, Human
ucauauuuaagguugaga

SEQ ID NO: 751402 - RNA, 20 nt, Human
uccaaaccugacaagcaaaa

SEQ ID NO: 751403 - RNA, 21 nt, Human
uccccuaaccccccgcccccc

SEQ ID NO: 751404 - RNA, 23 nt, Human
ucccuggccggagaagaccuccg

SEQ ID NO: 751405 - RNA, 21 nt, Human
uccgaaagaugcuauuuaaaa

SEQ ID NO: 751406 - RNA, 18 nt, Human
ucgccuggcccuggccgc

SEQ ID NO: 751407 - RNA, 19 nt, Human
ugacaagcuuauagaaagg

SEQ ID NO: 751408 - RNA, 19 nt, Human
ugcaaaaaaagcaaaaaga

SEQ ID NO: 751409 - RNA, 21 nt, Human
uggaccagaagcaacgaaaga

SEQ ID NO: 751410 - RNA, 19 nt, Human
ugucauaugcuucacaagu

SEQ ID NO: 751411 - RNA, 19 nt, Human
uguuuguuauuuguauugu

SEQ ID NO: 751412 - RNA, 25 nt, Human
uuaaagcuugaagaucaaauuuuaa

SEQ ID NO: 751413 - RNA, 24 nt, Human
uugcacagcgcgagggcggcugcc

SEQ ID NO: 751414 - RNA, 18 nt, Human
uuucacacuaggacuaau

SEQ ID NO: 751415 - RNA, 19 nt, Human
aaaagaacuaccaggaaca

SEQ ID NO: 751416 - RNA, 20 nt, Human
aaaagaacuaccaggaacau

SEQ ID NO: 751417 - RNA, 19 nt, Human
aaccccuaaccugugaucu

SEQ ID NO: 751418 - RNA, 24 nt, Human
acaaagacaaaugguuucuacaaa

SEQ ID NO: 751419 - RNA, 22 nt, Human
agacacugcaaauuucagaacc

SEQ ID NO: 751420 - RNA, 21 nt, Human
auuagaaugucagacucaaaa

SEQ ID NO: 751421 - RNA, 18 nt, Human
caagcacguuccuggcua

SEQ ID NO: 751422 - RNA, 18 nt, Human
caccuaaugagcaggucu

SEQ ID NO: 751423 - RNA, 21 nt, Human
caggaacaugccugaaaaugc

SEQ ID NO: 751424 - RNA, 23 nt, Human
caggaacaugccugaaaaugcua

SEQ ID NO: 751425 - RNA, 21 nt, Human
ccaccacgccucccuaccgca

SEQ ID NO: 751426 - RNA, 20 nt, Human
ccacugaggccaggccacag

SEQ ID NO: 751427 - RNA, 26 nt, Human
ccacugaggccaggccacagucgcau

SEQ ID NO: 751428 - RNA, 19 nt, Human
ccagacauacucauuaaca

SEQ ID NO: 751429 - RNA, 25 nt, Human
ccaucuagagaaaccccuaaccugu

SEQ ID NO: 751430 - RNA, 19 nt, Human
ccaugacaccugcugucac

SEQ ID NO: 751431 - RNA, 22 nt, Human
cccacaaccaggauuccuacaa

SEQ ID NO: 751432 - RNA, 24 nt, Human
cccaugacaccugcugucacugga

SEQ ID NO: 751433 - RNA, 18 nt, Human
cccucagguuggagaaag

SEQ ID NO: 751434 - RNA, 23 nt, Human
cccuggcuggccagaccugaggc

SEQ ID NO: 751435 - RNA, 18 nt, Human
ccuggcuaaaaaauaacc

SEQ ID NO: 751436 - RNA, 22 nt, Human
ccugugaucuagcuuccgaggc

SEQ ID NO: 751437 - RNA, 22 nt, Human
cuucagaccaccacgccucccu

SEQ ID NO: 751438 - RNA, 22 nt, Human
gacccaugacaccugcugucac

SEQ ID NO: 751439 - RNA, 24 nt, Human
gacucaaaagaacuaccaggaaca

SEQ ID NO: 751440 - RNA, 24 nt, Human
gagaaagaaaacuuuuaauuugga

SEQ ID NO: 751441 - RNA, 18 nt, Human
ggacagcaccagcccugg

SEQ ID NO: 751442 - RNA, 24 nt, Human
uaaccagaucuuuuuggccgugcc

SEQ ID NO: 751443 - RNA, 21 nt, Human
uaccgcaagcugcaaacggcc

SEQ ID NO: 751444 - RNA, 19 nt, Human
uagaaugucagacucaaaa

SEQ ID NO: 751445 - RNA, 21 nt, Human
ucaacucuccuuuacccaaaa

SEQ ID NO: 751446 - RNA, 27 nt, Human
ucagugcccuuucuggugcugccuccc

SEQ ID NO: 751447 - RNA, 23 nt, Human
uccagagugagcaagggaaagga

SEQ ID NO: 751448 - RNA, 20 nt, Human
ucccaggagcagacacugca

SEQ ID NO: 751449 - RNA, 21 nt, Human
uccccacaaccaggauuccua

SEQ ID NO: 751450 - RNA, 21 nt, Human
ucuggugcugccucccaggag

SEQ ID NO: 751451 - RNA, 22 nt, Human
ucuggugcugccucccaggagc

SEQ ID NO: 751452 - RNA, 19 nt, Human
ugagcaggucuguccucca

SEQ ID NO: 751453 - RNA, 20 nt, Human
uggcuaaaaaauaaccagau

SEQ ID NO: 751454 - RNA, 23 nt, Human
uguggguaccacugaggccaggc

SEQ ID NO: 751455 - RNA, 18 nt, Human
ugugguagugcugaugug

SEQ ID NO: 751456 - RNA, 22 nt, Human
uuaagacugggucacauccagc

SEQ ID NO: 751457 - RNA, 20 nt, Human
uuagaaaaccuguuuauuaa

SEQ ID NO: 751458 - RNA, 24 nt, Human
uugguucuugugguagugcugaug

SEQ ID NO: 751459 - RNA, 23 nt, Human
aaaaagugaucaccaaggccaga

SEQ ID NO: 751460 - RNA, 28 nt, Human
aaaaauauaucucuuuacacgcaccuuc

SEQ ID NO: 751461 - RNA, 20 nt, Human
aaaauacauucagagccccc

SEQ ID NO: 751462 - RNA, 23 nt, Human
aaagaaacacgguacaaaauaca

SEQ ID NO: 751463 - RNA, 22 nt, Human
aaagugaucaccaaggccagaa

SEQ ID NO: 751464 - RNA, 24 nt, Human
aacacucuugcugucucaccuggu

SEQ ID NO: 751465 - RNA, 18 nt, Human
aagaagacuaaaaauucu

SEQ ID NO: 751466 - RNA, 21 nt, Human
aaggggcuugguuucccaagc

SEQ ID NO: 751467 - RNA, 25 nt, Human
aaggggguuuugaggcucagaacac

SEQ ID NO: 751468 - RNA, 26 nt, Human
aaucauauuccucuuacaaaaauaua

SEQ ID NO: 751469 - RNA, 20 nt, Human
aaucucuucccuugagccuc

SEQ ID NO: 751470 - RNA, 20 nt, Human
aauuaaccuacugugagcac

SEQ ID NO: 751471 - RNA, 19 nt, Human
acacaauuucauucacccc

SEQ ID NO: 751472 - RNA, 24 nt, Human
acacgcaccuucuccauggucucu

SEQ ID NO: 751473 - RNA, 21 nt, Human
acagaagcuggugggccucca

SEQ ID NO: 751474 - RNA, 23 nt, Human
accaccagcaaagaacugaccca

SEQ ID NO: 751475 - RNA, 19 nt, Human
accagcagcugcaguucac

SEQ ID NO: 751476 - RNA, 20 nt, Human
accauggagagaugugucac

SEQ ID NO: 751477 - RNA, 25 nt, Human
accccauuccuuaaagggcccccaa

SEQ ID NO: 751478 - RNA, 24 nt, Human
accuucuccauggucucuuugcua

SEQ ID NO: 751479 - RNA, 22 nt, Human
agaacacacauaaguugguccc

SEQ ID NO: 751480 - RNA, 19 nt, Human
agaauagcacuuggagaag

SEQ ID NO: 751481 - RNA, 19 nt, Human
agacagaaaagaguccaug

SEQ ID NO: 751482 - RNA, 19 nt, Human
agaguccauguaacuagaa

SEQ ID NO: 751483 - RNA, 22 nt, Human
agcacuucuuggguggagauga

SEQ ID NO: 751484 - RNA, 19 nt, Human
aggaaaggggagccuggau

SEQ ID NO: 751485 - RNA, 20 nt, Human
aggaaaggggagccuggauu

SEQ ID NO: 751486 - RNA, 21 nt, Human
aggacucccagucuacccucc

SEQ ID NO: 751487 - RNA, 20 nt, Human
aggcagaagcuuguggucag

SEQ ID NO: 751488 - RNA, 18 nt, Human
agguaguggggguccauu

SEQ ID NO: 751489 - RNA, 21 nt, Human
aguggugggggcagggaccca

SEQ ID NO: 751490 - RNA, 18 nt, Human
aguuggucccauuuuccu

SEQ ID NO: 751491 - RNA, 24 nt, Human
auagaauagcaaagaggcuaugac

SEQ ID NO: 751492 - RNA, 20 nt, Human
aucaacaaaacucgcauuua

SEQ ID NO: 751493 - RNA, 18 nt, Human
augggacucuggaccaac

SEQ ID NO: 751494 - RNA, 18 nt, Human
auuuguaggggucagaag

SEQ ID NO: 751495 - RNA, 19 nt, Human
caaaauacauucagagccc

SEQ ID NO: 751496 - RNA, 19 nt, Human
caccagcaaagaacugacc

SEQ ID NO: 751497 - RNA, 20 nt, Human
caccauggagagauguguca

SEQ ID NO: 751498 - RNA, 21 nt, Human
cagcaggcgcccggggucccu

SEQ ID NO: 751499 - RNA, 21 nt, Human
cagcauggauagaaaggggca

SEQ ID NO: 751500 - RNA, 18 nt, Human
cagcccucccaaacugaa

SEQ ID NO: 751501 - RNA, 26 nt, Human
caggcaucaggacucagggaugccac

SEQ ID NO: 751502 - RNA, 22 nt, Human
cagggacccaggagacagaaaa

SEQ ID NO: 751503 - RNA, 24 nt, Human
ccaauggccccacauggugucucc

SEQ ID NO: 751504 - RNA, 24 nt, Human
ccacauggugucuccaauuaaccu

SEQ ID NO: 751505 - RNA, 19 nt, Human
ccaccaaggcuccuccugc

SEQ ID NO: 751506 - RNA, 21 nt, Human
ccaggagacagaaaagagucc

SEQ ID NO: 751507 - RNA, 23 nt, Human
ccauuaccuccccacacuaucca

SEQ ID NO: 751508 - RNA, 21 nt, Human
cccacaaauggaacccagagu

SEQ ID NO: 751509 - RNA, 19 nt, Human
ccccacauggugucuccaa

SEQ ID NO: 751510 - RNA, 18 nt, Human
ccccagcugaagaccaag

SEQ ID NO: 751511 - RNA, 19 nt, Human
cccccaagggaagcuggcc

SEQ ID NO: 751512 - RNA, 22 nt, Human
cccccugggugggccuggggca

SEQ ID NO: 751513 - RNA, 22 nt, Human
ccccuccacugcuucaugaaag

SEQ ID NO: 751514 - RNA, 24 nt, Human
ccccugggugggccuggggcagcc

SEQ ID NO: 751515 - RNA, 18 nt, Human
cccugggugggccugggg

SEQ ID NO: 751516 - RNA, 22 nt, Human
ccuacugugagcaccauuaccu

SEQ ID NO: 751517 - RNA, 20 nt, Human
ccucccaaacugaaggugag

SEQ ID NO: 751518 - RNA, 19 nt, Human
ccugaggaaucuucaggca

SEQ ID NO: 751519 - RNA, 19 nt, Human
ccuggauagcaaaggaccc

SEQ ID NO: 751520 - RNA, 18 nt, Human
cgacucccgcgucccgcu

SEQ ID NO: 751521 - RNA, 22 nt, Human
cgcccggggucccucucugcga

SEQ ID NO: 751522 - RNA, 24 nt, Human
cguggucaggacucccagucuacc

SEQ ID NO: 751523 - RNA, 19 nt, Human
cucagcccagaagggacaa

SEQ ID NO: 751524 - RNA, 22 nt, Human
cucagggaugccaccugaaggg

SEQ ID NO: 751525 - RNA, 21 nt, Human
cuccauggucucuuugcuacu

SEQ ID NO: 751526 - RNA, 21 nt, Human
cuccucaggccaauggaucug

SEQ ID NO: 751527 - RNA, 22 nt, Human
cucgccaccaaggcuccuccug

SEQ ID NO: 751528 - RNA, 20 nt, Human
cucugcgacucccgcguccc

SEQ ID NO: 751529 - RNA, 20 nt, Human
cugaagggucuccgccacuu

SEQ ID NO: 751530 - RNA, 19 nt, Human
cugcacuccaaggcuucag

SEQ ID NO: 751531 - RNA, 18 nt, Human
cugcgacucccgcguccc

SEQ ID NO: 751532 - RNA, 19 nt, Human
cuggguuauuucacugggg

SEQ ID NO: 751533 - RNA, 24 nt, Human
cuucuugcccuuucucugcuccuc

SEQ ID NO: 751534 - RNA, 18 nt, Human
cuucuuggguggagauga

SEQ ID NO: 751535 - RNA, 18 nt, Human
cuugcaaacucugccagc

SEQ ID NO: 751536 - RNA, 23 nt, Human
gaacacacauaaguuggucccau

SEQ ID NO: 751537 - RNA, 20 nt, Human
gaaucuucaggcagaagcuu

SEQ ID NO: 751538 - RNA, 21 nt, Human
gacccaggucuuggaccaaga

SEQ ID NO: 751539 - RNA, 20 nt, Human
gacucccagucuacccuccc

SEQ ID NO: 751540 - RNA, 23 nt, Human
gagggaauuggggaagugugcca

SEQ ID NO: 751541 - RNA, 24 nt, Human
gcagccaaggggauuguccccaga

SEQ ID NO: 751542 - RNA, 18 nt, Human
gcuccuccugccgggccc

SEQ ID NO: 751543 - RNA, 26 nt, Human
gcugcaguucacuucuugcccuuucu

SEQ ID NO: 751544 - RNA, 20 nt, Human
gcuggggugcuugggagagg

SEQ ID NO: 751545 - RNA, 26 nt, Human
gcuugguuucccaagcuuuccuuagg

SEQ ID NO: 751546 - RNA, 18 nt, Human
ggaagagaugggacucug

SEQ ID NO: 751547 - RNA, 21 nt, Human
ggacugggugggaagcuacug

SEQ ID NO: 751548 - RNA, 21 nt, Human
ggagaggauggaaggggcuug

SEQ ID NO: 751549 - RNA, 22 nt, Human
ggauggugcagguuuggacugg

SEQ ID NO: 751550 - RNA, 18 nt, Human
ggcauccagcaagucucc

SEQ ID NO: 751551 - RNA, 23 nt, Human
ggcgcgcccgcucugugggcgcc

SEQ ID NO: 751552 - RNA, 21 nt, Human
gggaagcuacugguauccagg

SEQ ID NO: 751553 - RNA, 19 nt, Human
gggaugccaccugaagggu

SEQ ID NO: 751554 - RNA, 22 nt, Human
gggcaggguucaugcccuggag

SEQ ID NO: 751555 - RNA, 21 nt, Human
ggggaagagaugggacucugg

SEQ ID NO: 751556 - RNA, 23 nt, Human
guggucaggacucccagucuacc

SEQ ID NO: 751557 - RNA, 19 nt, Human
uaaccuacugugagcacca

SEQ ID NO: 751558 - RNA, 24 nt, Human
uaaggaaaggggagccuggauuuc

SEQ ID NO: 751559 - RNA, 19 nt, Human
uacaauagcccccugggcu

SEQ ID NO: 751560 - RNA, 20 nt, Human
uaccuccccacacuauccag

SEQ ID NO: 751561 - RNA, 25 nt, Human
uagaacccccuaaacaagaugcccc

SEQ ID NO: 751562 - RNA, 21 nt, Human
ucaagagccuugacaauugcc

SEQ ID NO: 751563 - RNA, 22 nt, Human
ucacucuuccugaaaaagugau

SEQ ID NO: 751564 - RNA, 18 nt, Human
ucaggccaauggaucugg

SEQ ID NO: 751565 - RNA, 21 nt, Human
uccaggaugucagaaaccuaa

SEQ ID NO: 751566 - RNA, 21 nt, Human
uccauguaacuagaacccccu

SEQ ID NO: 751567 - RNA, 24 nt, Human
uccauguaacuagaacccccuaaa

SEQ ID NO: 751568 - RNA, 18 nt, Human
ucccagagagagucaacc

SEQ ID NO: 751569 - RNA, 20 nt, Human
uccccagaccaaagagagga

SEQ ID NO: 751570 - RNA, 21 nt, Human
ucccucccacaaauggaaccc

SEQ ID NO: 751571 - RNA, 23 nt, Human
uccucagucucacucuucccuuu

SEQ ID NO: 751572 - RNA, 21 nt, Human
uccucagucucacucuuccug

SEQ ID NO: 751573 - RNA, 19 nt, Human
uccugaaaaagugaucacc

SEQ ID NO: 751574 - RNA, 22 nt, Human
uccuucgguuuggcauuucagc

SEQ ID NO: 751575 - RNA, 20 nt, Human
ucuccaauuaaccuacugug

SEQ ID NO: 751576 - RNA, 23 nt, Human
ucuccauggucucuuugcuacuu

SEQ ID NO: 751577 - RNA, 24 nt, Human
ucucugcuccucaggccaauggau

SEQ ID NO: 751578 - RNA, 18 nt, Human
ucucuggggcuuggcugg

SEQ ID NO: 751579 - RNA, 21 nt, Human
ucucuggggcuuggcuggggu

SEQ ID NO: 751580 - RNA, 24 nt, Human
ucucuggggcuuggcuggggugcu

SEQ ID NO: 751581 - RNA, 19 nt, Human
ucugaggguuaccagcagc

SEQ ID NO: 751582 - RNA, 23 nt, Human
ugaaaaagugaucaccaaggcca

SEQ ID NO: 751583 - RNA, 24 nt, Human
ugaaaaagugaucaccaaggccag

SEQ ID NO: 751584 - RNA, 21 nt, Human
ugaaagaagacuaaaaauucu

SEQ ID NO: 751585 - RNA, 24 nt, Human
ugacuggagcccaccauggagaga

SEQ ID NO: 751586 - RNA, 19 nt, Human
ugagggaauuggggaagug

SEQ ID NO: 751587 - RNA, 23 nt, Human
ugaguccccagggccugcguggu

SEQ ID NO: 751588 - RNA, 19 nt, Human
ugaguuaaacaucggugcc

SEQ ID NO: 751589 - RNA, 21 nt, Human
ugauguggaugagcccucccu

SEQ ID NO: 751590 - RNA, 18 nt, Human
ugcaguggcuuuaaggaa

SEQ ID NO: 751591 - RNA, 25 nt, Human
ugccgggcccuggggcuauuucucc

SEQ ID NO: 751592 - RNA, 22 nt, Human
uggagcuuaccagcccucccaa

SEQ ID NO: 751593 - RNA, 19 nt, Human
uggcaugugaccauccucg

SEQ ID NO: 751594 - RNA, 21 nt, Human
uggcaugugaccauccucgug

SEQ ID NO: 751595 - RNA, 21 nt, Human
ugggaacagaagcuggugggc

SEQ ID NO: 751596 - RNA, 20 nt, Human
ugggagaggauggaaggggc

SEQ ID NO: 751597 - RNA, 19 nt, Human
ugggccuccauccagucag

SEQ ID NO: 751598 - RNA, 21 nt, Human
ugggccuggggcagcccaaau

SEQ ID NO: 751599 - RNA, 24 nt, Human
ugggcucacuguuggugccugagg

SEQ ID NO: 751600 - RNA, 19 nt, Human
uggggcuuggcuggggugc

SEQ ID NO: 751601 - RNA, 20 nt, Human
ugggggaaagaaacacggua

SEQ ID NO: 751602 - RNA, 23 nt, Human
uggggguaaccaggggucuugag

SEQ ID NO: 751603 - RNA, 21 nt, Human
uggggugcuugggagaggaug

SEQ ID NO: 751604 - RNA, 22 nt, Human
uggguggagaugagaagggggc

SEQ ID NO: 751605 - RNA, 24 nt, Human
uggguggagaugagaagggggcug

SEQ ID NO: 751606 - RNA, 23 nt, Human
ugggugggaagcuacugguaucc

SEQ ID NO: 751607 - RNA, 18 nt, Human
ugguauccaggguugggg

SEQ ID NO: 751608 - RNA, 20 nt, Human
uggucugggaagguaguggg

SEQ ID NO: 751609 - RNA, 20 nt, Human
uguaggggucagaagggcag

SEQ ID NO: 751610 - RNA, 21 nt, Human
uuccccagcugaagaccaagc

SEQ ID NO: 751611 - RNA, 24 nt, Human
uucccuugagccuccucugucaug

SEQ ID NO: 751612 - RNA, 21 nt, Human
uucuccaggucuggcucaagg

SEQ ID NO: 751613 - RNA, 18 nt, Human
uuggcuggggugcuuggg

SEQ ID NO: 751614 - RNA, 22 nt, Human
uuggcuggggugcuugggagag

SEQ ID NO: 751615 - RNA, 25 nt, Human
uuggggguccucagucucacucuuc

SEQ ID NO: 751616 - RNA, 20 nt, Human
uuucugagaagcaguguggc

SEQ ID NO: 751617 - RNA, 23 nt, Human
uuucugaggguuaccagcagcug

SEQ ID NO: 751618 - RNA, 22 nt, Human
aagggcacuaucagaaauggaa

SEQ ID NO: 751619 - RNA, 21 nt, Human
acaggguagcaggaggcaaag

SEQ ID NO: 751620 - RNA, 24 nt, Human
agacagaagagcaagggcacuauc

SEQ ID NO: 751621 - RNA, 20 nt, Human
aggagaggauccucaguccu

SEQ ID NO: 751622 - RNA, 19 nt, Human
aggcaaaguccgcaccacu

SEQ ID NO: 751623 - RNA, 21 nt, Human
agggagcuccccgggaccccu

SEQ ID NO: 751624 - RNA, 18 nt, Human
caaaggcguuucuuccug

SEQ ID NO: 751625 - RNA, 19 nt, Human
cagacagaagagcaagggc

SEQ ID NO: 751626 - RNA, 25 nt, Human
ccagaaacuuucccaccccgcucgg

SEQ ID NO: 751627 - RNA, 22 nt, Human
cccacugcaaaggcguuucuuc

SEQ ID NO: 751628 - RNA, 18 nt, Human
ccccgcgcugcaugcccc

SEQ ID NO: 751629 - RNA, 21 nt, Human
cccgcccgcggcgucaccgag

SEQ ID NO: 751630 - RNA, 20 nt, Human
cccgcggcgucaccgagccg

SEQ ID NO: 751631 - RNA, 22 nt, Human
cccgcggcgucaccgagccgcg

SEQ ID NO: 751632 - RNA, 22 nt, Human
cccgggaccccucucuucaaaa

SEQ ID NO: 751633 - RNA, 28 nt, Human
ccgcgcccccgcgcugcaugccccggcg

SEQ ID NO: 751634 - RNA, 25 nt, Human
ccgcgcugcaugccccggcggcccc

SEQ ID NO: 751635 - RNA, 19 nt, Human
ccgcucggcgcagcaacag

SEQ ID NO: 751636 - RNA, 18 nt, Human
ccuagcuaagcccaucug

SEQ ID NO: 751637 - RNA, 27 nt, Human
cgacugacaacuccagaaacuuuccca

SEQ ID NO: 751638 - RNA, 20 nt, Human
cgggaccccucucuucaaaa

SEQ ID NO: 751639 - RNA, 23 nt, Human
cgugucccgcgcgcgggccgugg

SEQ ID NO: 751640 - RNA, 20 nt, Human
cucuuguccagagaggccca

SEQ ID NO: 751641 - RNA, 22 nt, Human
cugcaagaugacagacagaaga

SEQ ID NO: 751642 - RNA, 22 nt, Human
cuggaggagaggauccucaguc

SEQ ID NO: 751643 - RNA, 19 nt, Human
gaaacuuucccaccccgcu

SEQ ID NO: 751644 - RNA, 22 nt, Human
gaaacuuucccaccccgcucgg

SEQ ID NO: 751645 - RNA, 23 nt, Human
gaagcaauuaaacccacugcaaa

SEQ ID NO: 751646 - RNA, 26 nt, Human
gacugacaacuccagaaacuuuccca

SEQ ID NO: 751647 - RNA, 23 nt, Human
gagcaagggcacuaucagaaaug

SEQ ID NO: 751648 - RNA, 19 nt, Human
gagggagcuccccgggacc

SEQ ID NO: 751649 - RNA, 18 nt, Human
gcaagucuuggcaggacc

SEQ ID NO: 751650 - RNA, 22 nt, Human
gcaauuaaacccacugcaaagg

SEQ ID NO: 751651 - RNA, 22 nt, Human
gcccccuacuccucccagccuc

SEQ ID NO: 751652 - RNA, 21 nt, Human
gccgcggagccucuagaucuu

SEQ ID NO: 751653 - RNA, 21 nt, Human
ggaacaggcugcccccuacuc

SEQ ID NO: 751654 - RNA, 18 nt, Human
ggaccccucucuucaaaa

SEQ ID NO: 751655 - RNA, 19 nt, Human
ggcgcagcaacaggguagc

SEQ ID NO: 751656 - RNA, 21 nt, Human
uaaaaauaagugcuugucuug

SEQ ID NO: 751657 - RNA, 22 nt, Human
ucaccgagccgcgcccccgcgc

SEQ ID NO: 751658 - RNA, 27 nt, Human
ucaguaauguacaauaacucuugaguc

SEQ ID NO: 751659 - RNA, 20 nt, Human
ucaguccugugccaagguuu

SEQ ID NO: 751660 - RNA, 20 nt, Human
uccagaaacuuucccacccc

SEQ ID NO: 751661 - RNA, 19 nt, Human
uccccgcggcgcccucgcc

SEQ ID NO: 751662 - RNA, 18 nt, Human
uccugugccaagguuuca

SEQ ID NO: 751663 - RNA, 24 nt, Human
ucgccccgcacccgcgcgcagccu

SEQ ID NO: 751664 - RNA, 21 nt, Human
ucuggucugcacguccagaga

SEQ ID NO: 751665 - RNA, 23 nt, Human
ucuuggcaggacccggcaggggu

SEQ ID NO: 751666 - RNA, 27 nt, Human
ugaacaaaugagcguggucaguaaugu

SEQ ID NO: 751667 - RNA, 21 nt, Human
ugcaucagcaucauaugcaca

SEQ ID NO: 751668 - RNA, 19 nt, Human
ugccaagguuucacgcugu

SEQ ID NO: 751669 - RNA, 21 nt, Human
ugccccggcggccccggccac

SEQ ID NO: 751670 - RNA, 18 nt, Human
ugccggguccccgcccgc

SEQ ID NO: 751671 - RNA, 18 nt, Human
uggagggagcuccccggg

SEQ ID NO: 751672 - RNA, 19 nt, Human
uggagggagcuccccgggg

SEQ ID NO: 751673 - RNA, 21 nt, Human
uggcaggacccggcaggggug

SEQ ID NO: 751674 - RNA, 22 nt, Human
uggcccucgggcauccugcaag

SEQ ID NO: 751675 - RNA, 21 nt, Human
uggccuagcuaagcccaucug

SEQ ID NO: 751676 - RNA, 20 nt, Human
aaaagcagccccagccaccu

SEQ ID NO: 751677 - RNA, 19 nt, Human
aacaugauacaaaaacaca

SEQ ID NO: 751678 - RNA, 22 nt, Human
aagcagccccagccaccuccca

SEQ ID NO: 751679 - RNA, 22 nt, Human
acccccacaccuuggagggagc

SEQ ID NO: 751680 - RNA, 21 nt, Human
acccccaucccgccccuacug

SEQ ID NO: 751681 - RNA, 22 nt, Human
agaggcacgggaggccugcugg

SEQ ID NO: 751682 - RNA, 19 nt, Human
agccaagggccugagcccc

SEQ ID NO: 751683 - RNA, 19 nt, Human
agcgcaggggcagcuugga

SEQ ID NO: 751684 - RNA, 18 nt, Human
aggaaggacuguggaugg

SEQ ID NO: 751685 - RNA, 21 nt, Human
aggaggcccugagcacugccc

SEQ ID NO: 751686 - RNA, 18 nt, Human
aggcagaagucuuaaguu

SEQ ID NO: 751687 - RNA, 20 nt, Human
aggcagggccuacagaggug

SEQ ID NO: 751688 - RNA, 22 nt, Human
aggccccccaggccaggacccu

SEQ ID NO: 751689 - RNA, 20 nt, Human
aggccugccugugcucuccu

SEQ ID NO: 751690 - RNA, 23 nt, Human
agggccugagccccaggccauuc

SEQ ID NO: 751691 - RNA, 23 nt, Human
aucccauuccccagaauccccag

SEQ ID NO: 751692 - RNA, 19 nt, Human
auggagcagggagcuggau

SEQ ID NO: 751693 - RNA, 21 nt, Human
caaaagcagccccagccaccu

SEQ ID NO: 751694 - RNA, 25 nt, Human
caaaagcagccccagccaccuccca

SEQ ID NO: 751695 - RNA, 21 nt, Human
caacaugauacaaaaacacag

SEQ ID NO: 751696 - RNA, 21 nt, Human
caagggccugagccccaggcc

SEQ ID NO: 751697 - RNA, 18 nt, Human
cacacccccaucccgccc

SEQ ID NO: 751698 - RNA, 23 nt, Human
cacacccccaucccgccccuacu

SEQ ID NO: 751699 - RNA, 24 nt, Human
cacagaacucuagcgggauacaga

SEQ ID NO: 751700 - RNA, 19 nt, Human
caccagaccaauggcaccg

SEQ ID NO: 751701 - RNA, 19 nt, Human
caccccagcugcagagcug

SEQ ID NO: 751702 - RNA, 23 nt, Human
caccccagcugcagagcuggaag

SEQ ID NO: 751703 - RNA, 27 nt, Human
caccccucccagcgcaggggcagcuug

SEQ ID NO: 751704 - RNA, 19 nt, Human
caccucccaagcugccaag

SEQ ID NO: 751705 - RNA, 18 nt, Human
cacugcccacccccacac

SEQ ID NO: 751706 - RNA, 22 nt, Human
cagaaaagaugggcaccugaua

SEQ ID NO: 751707 - RNA, 18 nt, Human
cagaauccccaggaggga

SEQ ID NO: 751708 - RNA, 25 nt, Human
cagaggcacgggaggccugcugggg

SEQ ID NO: 751709 - RNA, 19 nt, Human
cagcaucucuuugguuauc

SEQ ID NO: 751710 - RNA, 19 nt, Human
cagcccagguaccccuucc

SEQ ID NO: 751711 - RNA, 23 nt, Human
cagcgaguccugggguaccaaac

SEQ ID NO: 751712 - RNA, 21 nt, Human
caggccccccaggccagcgga

SEQ ID NO: 751713 - RNA, 19 nt, Human
cagggccuacagaggugcc

SEQ ID NO: 751714 - RNA, 22 nt, Human
cagguaccccuuccucugugcc

SEQ ID NO: 751715 - RNA, 20 nt, Human
ccacacccccaucccgcccc

SEQ ID NO: 751716 - RNA, 22 nt, Human
ccacacccccaucccgccccua

SEQ ID NO: 751717 - RNA, 21 nt, Human
ccacuggccagggcuaugcug

SEQ ID NO: 751718 - RNA, 23 nt, Human
ccagccaccucccaagcugccaa

SEQ ID NO: 751719 - RNA, 23 nt, Human
ccaucccgccccuacugcacagg

SEQ ID NO: 751720 - RNA, 22 nt, Human
cccacccccacaccuuggaggg

SEQ ID NO: 751721 - RNA, 18 nt, Human
cccagccaccucccaagc

SEQ ID NO: 751722 - RNA, 19 nt, Human
cccauuccccagaaucccc

SEQ ID NO: 751723 - RNA, 20 nt, Human
ccccaggagggagaagaggg

SEQ ID NO: 751724 - RNA, 24 nt, Human
ccccaggccaguugugcuaggagc

SEQ ID NO: 751725 - RNA, 20 nt, Human
ccccauagcuuacuccugga

SEQ ID NO: 751726 - RNA, 20 nt, Human
ccccucccagcgcaggggcu

SEQ ID NO: 751727 - RNA, 22 nt, Human
ccccugugcaagcagagcuggc

SEQ ID NO: 751728 - RNA, 19 nt, Human
cccgccccuacugcacagg

SEQ ID NO: 751729 - RNA, 21 nt, Human
cccugagcacugcccaccccc

SEQ ID NO: 751730 - RNA, 27 nt, Human
cccugcacccagcccagguaccccuuc

SEQ ID NO: 751731 - RNA, 19 nt, Human
ccgcugcgggggcaaguca

SEQ ID NO: 751732 - RNA, 23 nt, Human
ccucaguuggagcugucucuggc

SEQ ID NO: 751733 - RNA, 24 nt, Human
ccugacccagcuagcgucccugac

SEQ ID NO: 751734 - RNA, 20 nt, Human
ccugcggcggcggcgugucu

SEQ ID NO: 751735 - RNA, 19 nt, Human
ccuuggugcccccuggagg

SEQ ID NO: 751736 - RNA, 18 nt, Human
cucugugccgaccaugcu

SEQ ID NO: 751737 - RNA, 19 nt, Human
cugacccagcuagcguccc

SEQ ID NO: 751738 - RNA, 21 nt, Human
cugacccagcuagcgucccug

SEQ ID NO: 751739 - RNA, 18 nt, Human
cugcccacccccacaccu

SEQ ID NO: 751740 - RNA, 21 nt, Human
cugccccuccuuccugccaga

SEQ ID NO: 751741 - RNA, 20 nt, Human
cugcucuuccacacccccau

SEQ ID NO: 751742 - RNA, 18 nt, Human
cuuggugcccccuggagg

SEQ ID NO: 751743 - RNA, 19 nt, Human
gacacuaggggaaggaagg

SEQ ID NO: 751744 - RNA, 19 nt, Human
gaccugcucuuccacaccc

SEQ ID NO: 751745 - RNA, 19 nt, Human
gagcuggaugccagcggga

SEQ ID NO: 751746 - RNA, 18 nt, Human
gcagcagggaggaggcuu

SEQ ID NO: 751747 - RNA, 19 nt, Human
gcagcagggaggaggcuuc

SEQ ID NO: 751748 - RNA, 19 nt, Human
gcauucccacucagccaag

SEQ ID NO: 751749 - RNA, 21 nt, Human
gcauucccacucagccaaggg

SEQ ID NO: 751750 - RNA, 21 nt, Human
gccccagccaccucccaagcu

SEQ ID NO: 751751 - RNA, 19 nt, Human
gcuaggagccuggaccugc

SEQ ID NO: 751752 - RNA, 21 nt, Human
ggagaagagggaugggcugcc

SEQ ID NO: 751753 - RNA, 20 nt, Human
ggagcagaggcagcacuggc

SEQ ID NO: 751754 - RNA, 18 nt, Human
ggagggacugcugggcug

SEQ ID NO: 751755 - RNA, 20 nt, Human
ggcuggggagggacuggcca

SEQ ID NO: 751756 - RNA, 23 nt, Human
gggaaacugggugagcaagggag

SEQ ID NO: 751757 - RNA, 20 nt, Human
gggcaccugauagcucagcu

SEQ ID NO: 751758 - RNA, 21 nt, Human
gggcugccccuccuuccugcc

SEQ ID NO: 751759 - RNA, 21 nt, Human
gugcucuccucaccacugcug

SEQ ID NO: 751760 - RNA, 20 nt, Human
uaacacucauguccugcagg

SEQ ID NO: 751761 - RNA, 23 nt, Human
uaugcugcaccagaccaauggca

SEQ ID NO: 751762 - RNA, 21 nt, Human
ucagaccuggacugcagcauc

SEQ ID NO: 751763 - RNA, 21 nt, Human
uccacacccccaucccgcccc

SEQ ID NO: 751764 - RNA, 20 nt, Human
ucccacucagccaagggccu

SEQ ID NO: 751765 - RNA, 20 nt, Human
uccccagaauccccaggagg

SEQ ID NO: 751766 - RNA, 18 nt, Human
ucccugagugagaaggcc

SEQ ID NO: 751767 - RNA, 18 nt, Human
uccucaguuggagcuguc

SEQ ID NO: 751768 - RNA, 22 nt, Human
uccuuuggcuccgaggaggccc

SEQ ID NO: 751769 - RNA, 18 nt, Human
ucucucuccauauauucu

SEQ ID NO: 751770 - RNA, 21 nt, Human
ugacccagcuagcgucccuga

SEQ ID NO: 751771 - RNA, 18 nt, Human
ugagugguccuugucccu

SEQ ID NO: 751772 - RNA, 19 nt, Human
ugcacagagccugccugga

SEQ ID NO: 751773 - RNA, 19 nt, Human
ugcacagcuggcaggagca

SEQ ID NO: 751774 - RNA, 18 nt, Human
ugccaaggccccaggcca

SEQ ID NO: 751775 - RNA, 20 nt, Human
ugccaagggccaggcgucgg

SEQ ID NO: 751776 - RNA, 21 nt, Human
ugccaagggccaggcgucggg

SEQ ID NO: 751777 - RNA, 23 nt, Human
ugccagagccacagcucaagggc

SEQ ID NO: 751778 - RNA, 19 nt, Human
ugccggaggggaaacuggg

SEQ ID NO: 751779 - RNA, 20 nt, Human
ugccugugcucuccucacca

SEQ ID NO: 751780 - RNA, 18 nt, Human
ugccuuggugcccccugg

SEQ ID NO: 751781 - RNA, 25 nt, Human
ugccuuggugcccccuggaggcagc

SEQ ID NO: 751782 - RNA, 22 nt, Human
ugcugggcuggggagggacugg

SEQ ID NO: 751783 - RNA, 23 nt, Human
uggagcugucucuggcaaaggca

SEQ ID NO: 751784 - RNA, 19 nt, Human
uggagggacugcugggcug

SEQ ID NO: 751785 - RNA, 19 nt, Human
uggagggagcagacggagg

SEQ ID NO: 751786 - RNA, 19 nt, Human
uggcaaaggcaaaagcagc

SEQ ID NO: 751787 - RNA, 20 nt, Human
uggcaaaggcaaaagcagcc

SEQ ID NO: 751788 - RNA, 19 nt, Human
uggcaccgcccccaccccu

SEQ ID NO: 751789 - RNA, 19 nt, Human
uggcagaggcacgggaggc

SEQ ID NO: 751790 - RNA, 19 nt, Human
uggcaggagcacuggccac

SEQ ID NO: 751791 - RNA, 25 nt, Human
uggcaggagcacuggccaccucccu

SEQ ID NO: 751792 - RNA, 18 nt, Human
uggccagggcuaugcugc

SEQ ID NO: 751793 - RNA, 18 nt, Human
uggcccugcacccagccc

SEQ ID NO: 751794 - RNA, 24 nt, Human
ugggauggcccugcacccagccca

SEQ ID NO: 751795 - RNA, 22 nt, Human
ugggcugccccuccuuccugcc

SEQ ID NO: 751796 - RNA, 20 nt, Human
ugggcuggggagggacuggc

SEQ ID NO: 751797 - RNA, 22 nt, Human
ugucucuggcaaaggcaaaagc

SEQ ID NO: 751798 - RNA, 23 nt, Human
uguuacaucucucucuccauaua

SEQ ID NO: 751799 - RNA, 18 nt, Human
uuacuccuggauguagcc

SEQ ID NO: 751800 - RNA, 24 nt, Human
uuggagagguccucaguuggagcu

SEQ ID NO: 751801 - RNA, 22 nt, Human
uuuccugaccagcgaguccugg

SEQ ID NO: 751802 - RNA, 23 nt, Human
aagacucgcacauuuuucccagg

SEQ ID NO: 751803 - RNA, 24 nt, Human
aagcagucgcccaucuacuucccg

SEQ ID NO: 751804 - RNA, 18 nt, Human
accggccucgcccggccu

SEQ ID NO: 751805 - RNA, 19 nt, Human
acgcaggguguauggcagg

SEQ ID NO: 751806 - RNA, 18 nt, Human
acuugguucaccagaugg

SEQ ID NO: 751807 - RNA, 20 nt, Human
agccaggggccugggagcug

SEQ ID NO: 751808 - RNA, 19 nt, Human
aggggccugggagcugugg

SEQ ID NO: 751809 - RNA, 22 nt, Human
agugaagaaaacaccucggccu

SEQ ID NO: 751810 - RNA, 22 nt, Human
caagacucgcacauuuuuccca

SEQ ID NO: 751811 - RNA, 19 nt, Human
cagggugugcccaggcuuu

SEQ ID NO: 751812 - RNA, 23 nt, Human
cccacacugcuggugccaguggg

SEQ ID NO: 751813 - RNA, 19 nt, Human
cccacccacacugcuggug

SEQ ID NO: 751814 - RNA, 22 nt, Human
cccacccacacugcuggugcca

SEQ ID NO: 751815 - RNA, 18 nt, Human
cccagggccccagauagc

SEQ ID NO: 751816 - RNA, 19 nt, Human
ccccagauagcugcuggca

SEQ ID NO: 751817 - RNA, 23 nt, Human
ccccuggggcugccacuugguuc

SEQ ID NO: 751818 - RNA, 18 nt, Human
cccugcucuggggagaga

SEQ ID NO: 751819 - RNA, 20 nt, Human
ccgccgcguccucaccggcc

SEQ ID NO: 751820 - RNA, 20 nt, Human
ccgcguccucaccggccucg

SEQ ID NO: 751821 - RNA, 20 nt, Human
ccggccucgcccggccuccg

SEQ ID NO: 751822 - RNA, 21 nt, Human
ccugggagcuguggcuugagc

SEQ ID NO: 751823 - RNA, 24 nt, Human
cgcuugucugagaggguccuggca

SEQ ID NO: 751824 - RNA, 20 nt, Human
cuagguccugggugggggga

SEQ ID NO: 751825 - RNA, 25 nt, Human
cugcuguucuuuguaguugugucca

SEQ ID NO: 751826 - RNA, 21 nt, Human
cugugccacgcuugucugaga

SEQ ID NO: 751827 - RNA, 23 nt, Human
cuugguucaccagauggaagguc

SEQ ID NO: 751828 - RNA, 22 nt, Human
gaccacagccacuucccaucug

SEQ ID NO: 751829 - RNA, 20 nt, Human
gaggcccacccacacugcug

SEQ ID NO: 751830 - RNA, 20 nt, Human
gcagcagccgccagacucgc

SEQ ID NO: 751831 - RNA, 25 nt, Human
gcucuggggagagaggcagggugug

SEQ ID NO: 751832 - RNA, 23 nt, Human
gcuugucugagaggguccuggca

SEQ ID NO: 751833 - RNA, 22 nt, Human
ggcagggccucuuuuccagugc

SEQ ID NO: 751834 - RNA, 24 nt, Human
gggcacagggggacuuugguuucu

SEQ ID NO: 751835 - RNA, 22 nt, Human
gggcaggccccuggggcugcca

SEQ ID NO: 751836 - RNA, 24 nt, Human
guaguuguguccaaaccugggcag

SEQ ID NO: 751837 - RNA, 23 nt, Human
uaauaaauuagacggccccaccc

SEQ ID NO: 751838 - RNA, 19 nt, Human
uccugcuguucuuuguagu

SEQ ID NO: 751839 - RNA, 24 nt, Human
ucuguugagaagccucaggacaga

SEQ ID NO: 751840 - RNA, 19 nt, Human
ugagaccacagccacuucc

SEQ ID NO: 751841 - RNA, 19 nt, Human
ugagaggguccuggcagug

SEQ ID NO: 751842 - RNA, 22 nt, Human
ugagccaggggccugggagccg

SEQ ID NO: 751843 - RNA, 18 nt, Human
ugagcggcuccgcgcuca

SEQ ID NO: 751844 - RNA, 20 nt, Human
ugaggcccacccacacugcu

SEQ ID NO: 751845 - RNA, 24 nt, Human
ugagugaagaaaacaccucggccc

SEQ ID NO: 751846 - RNA, 19 nt, Human
ugcgucuuugagccagggg

SEQ ID NO: 751847 - RNA, 21 nt, Human
uggaaggaaugcugggcagua

SEQ ID NO: 751848 - RNA, 20 nt, Human
uggcaguggguacgcagggu

SEQ ID NO: 751849 - RNA, 23 nt, Human
uuagacggccccacccucccagg

SEQ ID NO: 751850 - RNA, 18 nt, Human
aaaaacaccaaaguguaa

SEQ ID NO: 751851 - RNA, 25 nt, Human
aaaaacaccaaaguguaaguauuac

SEQ ID NO: 751852 - RNA, 24 nt, Human
aaacagaagaggagaaagaaacaa

SEQ ID NO: 751853 - RNA, 20 nt, Human
aaacagaagaggagaaaggg

SEQ ID NO: 751854 - RNA, 24 nt, Human
aaagucaccccaugcuauaugcuc

SEQ ID NO: 751855 - RNA, 24 nt, Human
aaaguguugggauuacaggcauga

SEQ ID NO: 751856 - RNA, 19 nt, Human
aacaacacaggacaaucaa

SEQ ID NO: 751857 - RNA, 19 nt, Human
aacacguuggcaguucucc

SEQ ID NO: 751858 - RNA, 18 nt, Human
aacuaaucuuacugaccu

SEQ ID NO: 751859 - RNA, 20 nt, Human
aagaaacuugcagaggaagu

SEQ ID NO: 751860 - RNA, 19 nt, Human
aagaacacaacaaaaccaa

SEQ ID NO: 751861 - RNA, 23 nt, Human
aagaacacaacaaaaccaaaccc

SEQ ID NO: 751862 - RNA, 20 nt, Human
aagaggagaaagaaacaaag

SEQ ID NO: 751863 - RNA, 21 nt, Human
aaguguugggauuacaggcau

SEQ ID NO: 751864 - RNA, 20 nt, Human
aauguugucuucugaaugga

SEQ ID NO: 751865 - RNA, 20 nt, Human
acagauucaagauggccucu

SEQ ID NO: 751866 - RNA, 24 nt, Human
accauguugcucaggcuggccucg

SEQ ID NO: 751867 - RNA, 25 nt, Human
acccaccacaucuuguauuguagac

SEQ ID NO: 751868 - RNA, 23 nt, Human
accuccgccucccaaaguguugg

SEQ ID NO: 751869 - RNA, 18 nt, Human
acgggguuucaccauguu

SEQ ID NO: 751870 - RNA, 19 nt, Human
acgggguuucaccauguug

SEQ ID NO: 751871 - RNA, 24 nt, Human
acgggguuucaccauguugcucag

SEQ ID NO: 751872 - RNA, 23 nt, Human
acuaguaaccuccgccauccucc

SEQ ID NO: 751873 - RNA, 22 nt, Human
agaaaacagcaugcggacucau

SEQ ID NO: 751874 - RNA, 24 nt, Human
agaaccuaagaaaaaacaccaaag

SEQ ID NO: 751875 - RNA, 18 nt, Human
agagcacaaagcugagca

SEQ ID NO: 751876 - RNA, 20 nt, Human
agaggaaguaaggcaaacug

SEQ ID NO: 751877 - RNA, 20 nt, Human
agaggagaaagaaacaaagg

SEQ ID NO: 751878 - RNA, 22 nt, Human
agaucacugcagacucagacaa

SEQ ID NO: 751879 - RNA, 20 nt, Human
agcccaagacaucugaaaau

SEQ ID NO: 751880 - RNA, 21 nt, Human
agcgagaaaacagaagaggag

SEQ ID NO: 751881 - RNA, 22 nt, Human
agcugggaacaugaaaauccuu

SEQ ID NO: 751882 - RNA, 27 nt, Human
aggaaguaaggcaaacuggaagaagcc

SEQ ID NO: 751883 - RNA, 18 nt, Human
aggacaaugaaagucacc

SEQ ID NO: 751884 - RNA, 23 nt, Human
aggcagaaggguacggagugggg

SEQ ID NO: 751885 - RNA, 27 nt, Human
agggcuccaaaggaacuaauaugcugu

SEQ ID NO: 751886 - RNA, 24 nt, Human
aggugaucugcccaccuccgccuc

SEQ ID NO: 751887 - RNA, 18 nt, Human
aguagcugggauuacagg

SEQ ID NO: 751888 - RNA, 23 nt, Human
aguguaauggugcgaucuuggcu

SEQ ID NO: 751889 - RNA, 19 nt, Human
aucccaaaaaagugccgug

SEQ ID NO: 751890 - RNA, 22 nt, Human
augaagaacacaacaaaaccaa

SEQ ID NO: 751891 - RNA, 22 nt, Human
auggagugucgcuuugucgccc

SEQ ID NO: 751892 - RNA, 19 nt, Human
augguuuucuuuuucccca

SEQ ID NO: 751893 - RNA, 19 nt, Human
auuacaggugcacgccacc

SEQ ID NO: 751894 - RNA, 20 nt, Human
auuccugcugcuaguacuag

SEQ ID NO: 751895 - RNA, 24 nt, Human
auuuuuguauuuuuaguagagacg

SEQ ID NO: 751896 - RNA, 20 nt, Human
caaaaggacucacugaagaa

SEQ ID NO: 751897 - RNA, 24 nt, Human
caaaguguugggauuacaggcaug

SEQ ID NO: 751898 - RNA, 24 nt, Human
caaauccccuaauugccaagagag

SEQ ID NO: 751899 - RNA, 19 nt, Human
caagaaauaagagaaggaa

SEQ ID NO: 751900 - RNA, 19 nt, Human
caccagagccuuuuagaga

SEQ ID NO: 751901 - RNA, 24 nt, Human
caccauguugcucaggcuggccuc

SEQ ID NO: 751902 - RNA, 18 nt, Human
cacugcaaccucugccuc

SEQ ID NO: 751903 - RNA, 21 nt, Human
cacugcaaccucugccuccca

SEQ ID NO: 751904 - RNA, 21 nt, Human
cagaaaaagcccaagacaucu

SEQ ID NO: 751905 - RNA, 26 nt, Human
cagaaaaagcccaagacaucugaaaa

SEQ ID NO: 751906 - RNA, 19 nt, Human
cagaaucacgacuaccccc

SEQ ID NO: 751907 - RNA, 19 nt, Human
cagacucagacaauggagg

SEQ ID NO: 751908 - RNA, 20 nt, Human
cagaggaaguaaggcaaacu

SEQ ID NO: 751909 - RNA, 23 nt, Human
cagcugccuuccuacagaucacu

SEQ ID NO: 751910 - RNA, 19 nt, Human
caggacaaucaauaaccau

SEQ ID NO: 751911 - RNA, 22 nt, Human
cagggacauaccuaaguaugcc

SEQ ID NO: 751912 - RNA, 25 nt, Human
caucagagcacaaagcugagcaaac

SEQ ID NO: 751913 - RNA, 22 nt, Human
caugaagaacacaacaaaacca

SEQ ID NO: 751914 - RNA, 23 nt, Human
cauguugcucaggcuggccucga

SEQ ID NO: 751915 - RNA, 23 nt, Human
cauuagaaaccauauccuauaac

SEQ ID NO: 751916 - RNA, 18 nt, Human
cauuauuucuaaccaaaa

SEQ ID NO: 751917 - RNA, 23 nt, Human
ccaaaguguugggauuacaggca

SEQ ID NO: 751918 - RNA, 24 nt, Human
ccaaaguguugggauuacaggcau

SEQ ID NO: 751919 - RNA, 19 nt, Human
ccaccgcgcccggccuucc

SEQ ID NO: 751920 - RNA, 22 nt, Human
ccagaaucacgacuaccccccc

SEQ ID NO: 751921 - RNA, 24 nt, Human
cccaaaguguugggauuacaggca

SEQ ID NO: 751922 - RNA, 24 nt, Human
cccaaauccccuaauugccaagag

SEQ ID NO: 751923 - RNA, 23 nt, Human
cccacaguaacccgaguugaaga

SEQ ID NO: 751924 - RNA, 21 nt, Human
ccccugccucagccucugagu

SEQ ID NO: 751925 - RNA, 22 nt, Human
ccucccagguucaagccauucc

SEQ ID NO: 751926 - RNA, 21 nt, Human
ccucugcccuaaggagcaaag

SEQ ID NO: 751927 - RNA, 24 nt, Human
ccugaccuuaggugaucugcccac

SEQ ID NO: 751928 - RNA, 22 nt, Human
ccugccucagccucugaguagc

SEQ ID NO: 751929 - RNA, 24 nt, Human
cgggguuucaccauguugcucagg

SEQ ID NO: 751930 - RNA, 19 nt, Human
cuaaguaugccugaaacaa

SEQ ID NO: 751931 - RNA, 24 nt, Human
cucacugcaaccucugccucccag

SEQ ID NO: 751932 - RNA, 24 nt, Human
cucacugcaaccucugccucccag

SEQ ID NO: 751933 - RNA, 23 nt, Human
cucagccucugaguagcugggau

SEQ ID NO: 751934 - RNA, 23 nt, Human
cucauucugccaauaacacaugu

SEQ ID NO: 751935 - RNA, 21 nt, Human
cucccugaauuuuuggauuuc

SEQ ID NO: 751936 - RNA, 23 nt, Human
cucugaguagcugggauuacagg

SEQ ID NO: 751937 - RNA, 24 nt, Human
cucugaguagcugggauuacaggu

SEQ ID NO: 751938 - RNA, 21 nt, Human
cugaguagcugggauuacagg

SEQ ID NO: 751939 - RNA, 23 nt, Human
cugcaaccucugccucccagguu

SEQ ID NO: 751940 - RNA, 24 nt, Human
cugcaaccucugccucccagguuc

SEQ ID NO: 751941 - RNA, 22 nt, Human
cugccucagccucugaguagcu

SEQ ID NO: 751942 - RNA, 20 nt, Human
cugccucccagguucaagcc

SEQ ID NO: 751943 - RNA, 18 nt, Human
cuuugucgcccaggcugg

SEQ ID NO: 751944 - RNA, 20 nt, Human
cuuugucgcccaggcuggag

SEQ ID NO: 751945 - RNA, 22 nt, Human
gaaagaaaaguguggggggagg

SEQ ID NO: 751946 - RNA, 18 nt, Human
gaaauaagagaaggaagg

SEQ ID NO: 751947 - RNA, 23 nt, Human
gaagaacacaacaaaaccaaacc

SEQ ID NO: 751948 - RNA, 24 nt, Human
gaaucacgacuacccccccuucag

SEQ ID NO: 751949 - RNA, 24 nt, Human
gaccuuaggugaucugcccaccuc

SEQ ID NO: 751950 - RNA, 21 nt, Human
gacgggguuucaccauguugc

SEQ ID NO: 751951 - RNA, 25 nt, Human
gacuacccccccuucagaggacucc

SEQ ID NO: 751952 - RNA, 19 nt, Human
gagaaggaaggugacuugc

SEQ ID NO: 751953 - RNA, 23 nt, Human
gagacgggguuucaccauguugc

SEQ ID NO: 751954 - RNA, 18 nt, Human
gagcaaucauuacaaggg

SEQ ID NO: 751955 - RNA, 20 nt, Human
gaguaauaaggaaaacuguc

SEQ ID NO: 751956 - RNA, 26 nt, Human
gaguagcugggauuacaggugcacgc

SEQ ID NO: 751957 - RNA, 18 nt, Human
gauuacaggcaugagcca

SEQ ID NO: 751958 - RNA, 22 nt, Human
gauuacaggcaugagccaccgc

SEQ ID NO: 751959 - RNA, 22 nt, Human
gauuacaggcaugagccaccgc

SEQ ID NO: 751960 - RNA, 18 nt, Human
gauuacaggugcacgcca

SEQ ID NO: 751961 - RNA, 19 nt, Human
gcaaacuggaagaagcaua

SEQ ID NO: 751962 - RNA, 22 nt, Human
gcaaccucugccucccagguuc

SEQ ID NO: 751963 - RNA, 18 nt, Human
gcaucuuuuuuucuucuu

SEQ ID NO: 751964 - RNA, 19 nt, Human
gccaucagagcacaaagcu

SEQ ID NO: 751965 - RNA, 20 nt, Human
gcccaggcuggaguguaaug

SEQ ID NO: 751966 - RNA, 19 nt, Human
gcgagaaaacagaagagga

SEQ ID NO: 751967 - RNA, 21 nt, Human
gcucacugcaaccucugccuc

SEQ ID NO: 751968 - RNA, 24 nt, Human
gcuggaguacagaugggugccagu

SEQ ID NO: 751969 - RNA, 21 nt, Human
ggaaagaaccacacccucuca

SEQ ID NO: 751970 - RNA, 20 nt, Human
ggaggguuguucuuacucug

SEQ ID NO: 751971 - RNA, 22 nt, Human
ggauuacaggcaugagccaccg

SEQ ID NO: 751972 - RNA, 19 nt, Human
gggacuuacaaaaaaggga

SEQ ID NO: 751973 - RNA, 20 nt, Human
gggaggcagaaggguacgga

SEQ ID NO: 751974 - RNA, 21 nt, Human
gggaggcagaaggguacggag

SEQ ID NO: 751975 - RNA, 18 nt, Human
ggggagggggaggcagaa

SEQ ID NO: 751976 - RNA, 20 nt, Human
ggggagggggaggcagaagg

SEQ ID NO: 751977 - RNA, 20 nt, Human
ggggggagggggaggcagaa

SEQ ID NO: 751978 - RNA, 23 nt, Human
gggguuucaccauguugcucagg

SEQ ID NO: 751979 - RNA, 20 nt, Human
gguaaagaaaaggaaacaga

SEQ ID NO: 751980 - RNA, 24 nt, Human
guaagaaagaaaagugugggggga

SEQ ID NO: 751981 - RNA, 23 nt, Human
guaauuuuuguauuuuuaguaga

SEQ ID NO: 751982 - RNA, 23 nt, Human
guagagacgggguuucaccaugu

SEQ ID NO: 751983 - RNA, 24 nt, Human
gugaucugcccaccuccgccuccc

SEQ ID NO: 751984 - RNA, 22 nt, Human
uaaaacccaccacaucuuguau

SEQ ID NO: 751985 - RNA, 24 nt, Human
uaaaauaaaacccaccacaucuug

SEQ ID NO: 751986 - RNA, 24 nt, Human
uaacaugaaaaccaucuuucacuc

SEQ ID NO: 751987 - RNA, 20 nt, Human
uaaccuccgccauccuccuu

SEQ ID NO: 751988 - RNA, 19 nt, Human
uaagaaagaaaaguguggg

SEQ ID NO: 751989 - RNA, 24 nt, Human
uaauuuuuguauuuuuaguagaga

SEQ ID NO: 751990 - RNA, 21 nt, Human
uacaauuccaagccauuguac

SEQ ID NO: 751991 - RNA, 23 nt, Human
uacaggcaugagccaccgcgccc

SEQ ID NO: 751992 - RNA, 24 nt, Human
uacaggugcacgccaccacaccca

SEQ ID NO: 751993 - RNA, 18 nt, Human
uacccugugcccucccug

SEQ ID NO: 751994 - RNA, 22 nt, Human
uagagacgggguuucaccaugu

SEQ ID NO: 751995 - RNA, 21 nt, Human
uagcaagcaccuuccuauccc

SEQ ID NO: 751996 - RNA, 21 nt, Human
uaggacaaugaaagucacccc

SEQ ID NO: 751997 - RNA, 24 nt, Human
uaguagagacgggguuucaccaug

SEQ ID NO: 751998 - RNA, 20 nt, Human
uauuguagacaucccagcug

SEQ ID NO: 751999 - RNA, 25 nt, Human
ucaagccauuccccugccucagccu

SEQ ID NO: 752000 - RNA, 24 nt, Human
ucaagcuguguccaacacccacaa

SEQ ID NO: 752001 - RNA, 19 nt, Human
ucacugcaaccucugccuc

SEQ ID NO: 752002 - RNA, 23 nt, Human
ucacugcaaccucugccucccag

SEQ ID NO: 752003 - RNA, 24 nt, Human
ucacugcaaccucugccucccagg

SEQ ID NO: 752004 - RNA, 22 nt, Human
ucagcggauuaaauucuugagc

SEQ ID NO: 752005 - RNA, 24 nt, Human
ucccaaaguguugggauuacaggc

SEQ ID NO: 752006 - RNA, 23 nt, Human
ucccaaauccccuaauugccaag

SEQ ID NO: 752007 - RNA, 19 nt, Human
ucccagguucaagccauuc

SEQ ID NO: 752008 - RNA, 24 nt, Human
ucccagguucaagccauuccccug

SEQ ID NO: 752009 - RNA, 20 nt, Human
uccucagauaaaagaaucaa

SEQ ID NO: 752010 - RNA, 22 nt, Human
ucgcuuugucgcccaggcugga

SEQ ID NO: 752011 - RNA, 24 nt, Human
ucgcuuugucgcccaggcuggagu

SEQ ID NO: 752012 - RNA, 25 nt, Human
ucuaaccaaaagaacaugguuagca

SEQ ID NO: 752013 - RNA, 25 nt, Human
ucuaaccaaaagaacaugguuagca

SEQ ID NO: 752014 - RNA, 24 nt, Human
ucugaaaauuacuaguaaccuccg

SEQ ID NO: 752015 - RNA, 24 nt, Human
ucugaguagcugggauuacaggug

SEQ ID NO: 752016 - RNA, 21 nt, Human
ucuuucuuguucuuuuccucc

SEQ ID NO: 752017 - RNA, 18 nt, Human
ugaaaaagguuuuuaagu

SEQ ID NO: 752018 - RNA, 24 nt, Human
ugaccuuaggugaucugcccaccu

SEQ ID NO: 752019 - RNA, 20 nt, Human
ugagagaggucaagccaugg

SEQ ID NO: 752020 - RNA, 22 nt, Human
ugagcaaaccucucuucuuacc

SEQ ID NO: 752021 - RNA, 20 nt, Human
ugagcgauuugggcuucagc

SEQ ID NO: 752022 - RNA, 25 nt, Human
ugaggagauauaaaacucauucuuu

SEQ ID NO: 752023 - RNA, 24 nt, Human
ugaucugcccaccuccgccuccca

SEQ ID NO: 752024 - RNA, 20 nt, Human
ugauuuuggguuuuguuggc

SEQ ID NO: 752025 - RNA, 18 nt, Human
ugccaauaacacauguca

SEQ ID NO: 752026 - RNA, 21 nt, Human
ugcccaccuccgccucccaaa

SEQ ID NO: 752027 - RNA, 20 nt, Human
ugccucagccucugaguagc

SEQ ID NO: 752028 - RNA, 23 nt, Human
ugccucagccucugaguagcugg

SEQ ID NO: 752029 - RNA, 21 nt, Human
ugccugaaacaacacaggacc

SEQ ID NO: 752030 - RNA, 20 nt, Human
ugcuggaguacagauggggg

SEQ ID NO: 752031 - RNA, 18 nt, Human
uggcaaaaauagcaagca

SEQ ID NO: 752032 - RNA, 24 nt, Human
uggcaaaaauagcaagcaccuucc

SEQ ID NO: 752033 - RNA, 19 nt, Human
ugggauuacaggcaugagc

SEQ ID NO: 752034 - RNA, 21 nt, Human
ugggauuacaggcaugagcca

SEQ ID NO: 752035 - RNA, 22 nt, Human
ugggauuacaggcaugagccac

SEQ ID NO: 752036 - RNA, 23 nt, Human
ugggauuacaggcaugagccacc

SEQ ID NO: 752037 - RNA, 24 nt, Human
ugggauuacaggcaugagccaccg

SEQ ID NO: 752038 - RNA, 24 nt, Human
ugggauuacaggcaugagccaccg

SEQ ID NO: 752039 - RNA, 22 nt, Human
ugggauuacaggugcacgccac

SEQ ID NO: 752040 - RNA, 24 nt, Human
ugggauuacaggugcacgccacca

SEQ ID NO: 752041 - RNA, 18 nt, Human
uggggggagggggaggca

SEQ ID NO: 752042 - RNA, 24 nt, Human
uggggggagggggaggcagaaggg

SEQ ID NO: 752043 - RNA, 22 nt, Human
uguaauggugcgaucuuggcuc

SEQ ID NO: 752044 - RNA, 21 nt, Human
uguauuuuuaguagagacggg

SEQ ID NO: 752045 - RNA, 20 nt, Human
ugucgcccaggcuggagugu

SEQ ID NO: 752046 - RNA, 23 nt, Human
ugucgcuuugucgcccaggcugg

SEQ ID NO: 752047 - RNA, 24 nt, Human
ugucgcuuugucgcccaggcugga

SEQ ID NO: 752048 - RNA, 22 nt, Human
ugugguccuaugagccaaaaug

SEQ ID NO: 752049 - RNA, 18 nt, Human
uguguacuagcaacacau

SEQ ID NO: 752050 - RNA, 21 nt, Human
uguugucuucugaauggaguu

SEQ ID NO: 752051 - RNA, 18 nt, Human
uuaguagagacgggguuu

SEQ ID NO: 752052 - RNA, 22 nt, Human
uuaguagagacgggguuucacc

SEQ ID NO: 752053 - RNA, 24 nt, Human
uuaguagagacgggguuucaccau

SEQ ID NO: 752054 - RNA, 21 nt, Human
uucaagccauuccccugccuc

SEQ ID NO: 752055 - RNA, 24 nt, Human
uuccacguaaacaaaagccuggau

SEQ ID NO: 752056 - RNA, 28 nt, Human
uucuuuuccucccuagcuuuuuuuuuuu

SEQ ID NO: 752057 - RNA, 20 nt, Human
uugaaagaaaacagcaugcg

SEQ ID NO: 752058 - RNA, 22 nt, Human
uugaucccaaaaaagugccgug

SEQ ID NO: 752059 - RNA, 21 nt, Human
uuguagacaucccagcugcau

SEQ ID NO: 752060 - RNA, 23 nt, Human
uuguauuuuuaguagagacgggg

SEQ ID NO: 752061 - RNA, 23 nt, Human
uuuaacuaaucuuacugaccuca

SEQ ID NO: 752062 - RNA, 21 nt, Human
uuucaccauguugcucaggcu

SEQ ID NO: 752063 - RNA, 23 nt, Human
uuucaccauguugcucaggcugg

SEQ ID NO: 752064 - RNA, 23 nt, Human
uuucucauaaaugaauaugcacg

SEQ ID NO: 752065 - RNA, 24 nt, Human
uuugucgcccaggcuggaguguaa

SEQ ID NO: 752066 - RNA, 24 nt, Human
uuuuuaguagagacgggguuucac

SEQ ID NO: 752067 - RNA, 24 nt, Human
uuuuuccaugauuuccuugaggag

SEQ ID NO: 752068 - RNA, 20 nt, Human
uuuuuguauuuuuaguagag

SEQ ID NO: 752069 - RNA, 24 nt, Human
aaagugcugggauuauaggcguga

SEQ ID NO: 752070 - RNA, 18 nt, Human
aaccgggcccacacuaau

SEQ ID NO: 752071 - RNA, 18 nt, Human
aagcaaucagugcagagc

SEQ ID NO: 752072 - RNA, 23 nt, Human
aaggaaaggaauacccagagaac

SEQ ID NO: 752073 - RNA, 19 nt, Human
aaggaaccuacuccgaugc

SEQ ID NO: 752074 - RNA, 19 nt, Human
aaguagcugggauaacagg

SEQ ID NO: 752075 - RNA, 21 nt, Human
aagugcaugugugaggggagu

SEQ ID NO: 752076 - RNA, 19 nt, Human
aagugcugggauuauaggc

SEQ ID NO: 752077 - RNA, 19 nt, Human
aagugcugggauuauaggc

SEQ ID NO: 752078 - RNA, 26 nt, Human
aagugcugggauuauaggcgugagcc

SEQ ID NO: 752079 - RNA, 24 nt, Human
aaguggggauggugggaggaaagg

SEQ ID NO: 752080 - RNA, 24 nt, Human
aaguuccccaaaggacaaggugga

SEQ ID NO: 752081 - RNA, 19 nt, Human
acaacacaacuuccacaug

SEQ ID NO: 752082 - RNA, 20 nt, Human
acacagaaaaacaccuugga

SEQ ID NO: 752083 - RNA, 20 nt, Human
acacggagaagugcaccaga

SEQ ID NO: 752084 - RNA, 18 nt, Human
acaggguuucaccauguu

SEQ ID NO: 752085 - RNA, 23 nt, Human
acaggguuucaccauguuggcca

SEQ ID NO: 752086 - RNA, 24 nt, Human
acaggguuucaccauguuggccag

SEQ ID NO: 752087 - RNA, 25 nt, Human
acagugaaggaaaggaauacccaga

SEQ ID NO: 752088 - RNA, 18 nt, Human
acauccacaugcaaacgc

SEQ ID NO: 752089 - RNA, 18 nt, Human
accauguuggccaggcug

SEQ ID NO: 752090 - RNA, 20 nt, Human
acccaguaacaucaaagcaa

SEQ ID NO: 752091 - RNA, 24 nt, Human
acucuacugugugccccugcucgu

SEQ ID NO: 752092 - RNA, 25 nt, Human
acucugucaaccaggcuggaaugca

SEQ ID NO: 752093 - RNA, 21 nt, Human
agaacagacagcuguguggga

SEQ ID NO: 752094 - RNA, 19 nt, Human
agagaaguggagagagcag

SEQ ID NO: 752095 - RNA, 18 nt, Human
agagcagacacacaagga

SEQ ID NO: 752096 - RNA, 19 nt, Human
agagcagacacacaaggaa

SEQ ID NO: 752097 - RNA, 23 nt, Human
agcaaacuggcgcacacccaggc

SEQ ID NO: 752098 - RNA, 18 nt, Human
agcuagaauguacugagu

SEQ ID NO: 752099 - RNA, 18 nt, Human
agcuuuccucuccccucc

SEQ ID NO: 752100 - RNA, 21 nt, Human
aggaaaggaauacccagagaa

SEQ ID NO: 752101 - RNA, 19 nt, Human
aggcgugagccaccauacc

SEQ ID NO: 752102 - RNA, 19 nt, Human
aggcgugagccaccauacc

SEQ ID NO: 752103 - RNA, 23 nt, Human
agggggcccugggcagcuuuccu

SEQ ID NO: 752104 - RNA, 24 nt, Human
aggugauccgcccuccuuggccuc

SEQ ID NO: 752105 - RNA, 20 nt, Human
aguugaucagagccuccagg

SEQ ID NO: 752106 - RNA, 21 nt, Human
auauaagcagagaaguggaga

SEQ ID NO: 752107 - RNA, 18 nt, Human
aucuuccccggccgcugg

SEQ ID NO: 752108 - RNA, 19 nt, Human
augguuggggacacggagc

SEQ ID NO: 752109 - RNA, 22 nt, Human
caaaacagguguagaacaauau

SEQ ID NO: 752110 - RNA, 18 nt, Human
caaacauaggaagcugca

SEQ ID NO: 752111 - RNA, 21 nt, Human
caaagugcugggauuauaggc

SEQ ID NO: 752112 - RNA, 24 nt, Human
caaagugcugggauuauaggcgug

SEQ ID NO: 752113 - RNA, 18 nt, Human
caagacagcccucuaaac

SEQ ID NO: 752114 - RNA, 20 nt, Human
caagacagcccucuaaaccc

SEQ ID NO: 752115 - RNA, 25 nt, Human
caagacagcccucuaaacccaguaa

SEQ ID NO: 752116 - RNA, 22 nt, Human
cacaaauuuacuagacaugauc

SEQ ID NO: 752117 - RNA, 21 nt, Human
cacauccacaugcaaacgcug

SEQ ID NO: 752118 - RNA, 20 nt, Human
cacaugugaugacuccauca

SEQ ID NO: 752119 - RNA, 24 nt, Human
caccaugccuggcuaauuuuugua

SEQ ID NO: 752120 - RNA, 21 nt, Human
caccauguuggccaggcuggu

SEQ ID NO: 752121 - RNA, 24 nt, Human
caccauguuggccaggcuggucuc

SEQ ID NO: 752122 - RNA, 27 nt, Human
caccauguuggccaggcuggucucaaa

SEQ ID NO: 752123 - RNA, 23 nt, Human
caccucuucccugaaaucuucca

SEQ ID NO: 752124 - RNA, 21 nt, Human
cagaugggggcucgcucccag

SEQ ID NO: 752125 - RNA, 21 nt, Human
cagcaggcgucuuugaugcuc

SEQ ID NO: 752126 - RNA, 24 nt, Human
caggguuucaccauguuggccagg

SEQ ID NO: 752127 - RNA, 22 nt, Human
caguggcuggccuggcuccccc

SEQ ID NO: 752128 - RNA, 18 nt, Human
caguggcuggccuggcug

SEQ ID NO: 752129 - RNA, 31 nt, Human
caucagcaaugacuggacauuuugcuggucc

SEQ ID NO: 752130 - RNA, 22 nt, Human
caugccaccugucaccucagca

SEQ ID NO: 752131 - RNA, 24 nt, Human
cauguuggccaggcuggucucaaa

SEQ ID NO: 752132 - RNA, 18 nt, Human
ccaccauaccuggcuugc

SEQ ID NO: 752133 - RNA, 19 nt, Human
ccagaaagaggagagggac

SEQ ID NO: 752134 - RNA, 18 nt, Human
cccaaguagcugggauaa

SEQ ID NO: 752135 - RNA, 21 nt, Human
cccaccucuucccugaaaucu

SEQ ID NO: 752136 - RNA, 21 nt, Human
ccccugaaccagccagaaaga

SEQ ID NO: 752137 - RNA, 24 nt, Human
cccgccuccccgguuuaagcaauu

SEQ ID NO: 752138 - RNA, 20 nt, Human
cccucccagcucacauccac

SEQ ID NO: 752139 - RNA, 19 nt, Human
ccguagccgcgacuaggca

SEQ ID NO: 752140 - RNA, 26 nt, Human
ccuccaagacagcccucuaaacccag

SEQ ID NO: 752141 - RNA, 22 nt, Human
ccuccagggcacuuggguccau

SEQ ID NO: 752142 - RNA, 24 nt, Human
ccuccccgguuuaagcaauucucc

SEQ ID NO: 752143 - RNA, 18 nt, Human
ccugaccuuaggugaucc

SEQ ID NO: 752144 - RNA, 23 nt, Human
ccugccuuagccucccaaguagc

SEQ ID NO: 752145 - RNA, 24 nt, Human
ccugccuuagccucccaaguagcu

SEQ ID NO: 752146 - RNA, 25 nt, Human
ccuuagccucccaaguagcugggau

SEQ ID NO: 752147 - RNA, 19 nt, Human
cgacuaggcaacucagaca

SEQ ID NO: 752148 - RNA, 19 nt, Human
cguauucuccccagguagu

SEQ ID NO: 752149 - RNA, 19 nt, Human
cucagacacggagaagugc

SEQ ID NO: 752150 - RNA, 22 nt, Human
cucccagcucacauccacaugc

SEQ ID NO: 752151 - RNA, 26 nt, Human
cucccugccuuagccucccaaguagc

SEQ ID NO: 752152 - RNA, 19 nt, Human
cugacugcagucaaagcaa

SEQ ID NO: 752153 - RNA, 26 nt, Human
cugcagcugcaggaagcucgccccca

SEQ ID NO: 752154 - RNA, 21 nt, Human
cugcagucaaagcaaaaaagc

SEQ ID NO: 752155 - RNA, 21 nt, Human
cugcgccagcuuuucagcugc

SEQ ID NO: 752156 - RNA, 18 nt, Human
cuucccaaaggaaccuac

SEQ ID NO: 752157 - RNA, 22 nt, Human
gaacauugcuuugguucguauu

SEQ ID NO: 752158 - RNA, 19 nt, Human
gaagaucacaaauuuacua

SEQ ID NO: 752159 - RNA, 24 nt, Human
gaccuuaggugauccgcccuccuu

SEQ ID NO: 752160 - RNA, 22 nt, Human
gagaaaaugcugaucagcaugg

SEQ ID NO: 752161 - RNA, 24 nt, Human
gauaacaggcgcccgccaccaugc

SEQ ID NO: 752162 - RNA, 18 nt, Human
gauuauaggcgugagcca

SEQ ID NO: 752163 - RNA, 21 nt, Human
gauuauaggcgugagccacca

SEQ ID NO: 752164 - RNA, 24 nt, Human
gauuauaggcgugagccaccauac

SEQ ID NO: 752165 - RNA, 24 nt, Human
gcaaagugcugggauuauaggcgu

SEQ ID NO: 752166 - RNA, 21 nt, Human
gcaacccccgccuccccgguu

SEQ ID NO: 752167 - RNA, 22 nt, Human
gcaacccccgccuccccgguuu

SEQ ID NO: 752168 - RNA, 23 nt, Human
gcacugggaugucuucuaauccc

SEQ ID NO: 752169 - RNA, 19 nt, Human
gcgccagcuuuucagcugc

SEQ ID NO: 752170 - RNA, 19 nt, Human
gcuggaaugcaguggcacg

SEQ ID NO: 752171 - RNA, 19 nt, Human
ggagaagugcaccagaucc

SEQ ID NO: 752172 - RNA, 21 nt, Human
ggagaagugcaccagauccuc

SEQ ID NO: 752173 - RNA, 21 nt, Human
ggagcaaaaguggggauggug

SEQ ID NO: 752174 - RNA, 18 nt, Human
ggaguccuggggaaggaa

SEQ ID NO: 752175 - RNA, 23 nt, Human
ggcuggucucaaacuccugaccu

SEQ ID NO: 752176 - RNA, 21 nt, Human
gggacaugauaacugaccccc

SEQ ID NO: 752177 - RNA, 20 nt, Human
gggauggcguagaacacugg

SEQ ID NO: 752178 - RNA, 19 nt, Human
ggggauggugggaggaaag

SEQ ID NO: 752179 - RNA, 22 nt, Human
ggguuucaccauguuggccagg

SEQ ID NO: 752180 - RNA, 23 nt, Human
uaaaagaacauugcuuugguucg

SEQ ID NO: 752181 - RNA, 22 nt, Human
uaaagacaggguuucaccaugu

SEQ ID NO: 752182 - RNA, 22 nt, Human
uaacaaaacagguguagaacaa

SEQ ID NO: 752183 - RNA, 23 nt, Human
uaaccacagugaaggaaaggaau

SEQ ID NO: 752184 - RNA, 21 nt, Human
uaagaagggcuaaacaaaggc

SEQ ID NO: 752185 - RNA, 24 nt, Human
uaauuuuuguauuuuuaguaaaga

SEQ ID NO: 752186 - RNA, 24 nt, Human
uaguaaagacaggguuucaccaug

SEQ ID NO: 752187 - RNA, 26 nt, Human
uaguaaagacaggguuucaccauguu

SEQ ID NO: 752188 - RNA, 23 nt, Human
uauaggcgugagccaccauaccu

SEQ ID NO: 752189 - RNA, 19 nt, Human
uauucagacaauauaagca

SEQ ID NO: 752190 - RNA, 21 nt, Human
ucaaagcaaaaaagcuacuca

SEQ ID NO: 752191 - RNA, 26 nt, Human
ucaaccaggcuggaaugcaguggcac

SEQ ID NO: 752192 - RNA, 18 nt, Human
ucauugcaacccccgccu

SEQ ID NO: 752193 - RNA, 19 nt, Human
ucauugcaacccccgccuc

SEQ ID NO: 752194 - RNA, 27 nt, Human
ucauugcaacccccgccuccccgguuu

SEQ ID NO: 752195 - RNA, 22 nt, Human
uccacauguccacgccuggucu

SEQ ID NO: 752196 - RNA, 27 nt, Human
uccacauguccacgccuggucucccca

SEQ ID NO: 752197 - RNA, 22 nt, Human
uccaccaucuuccccggccgcu

SEQ ID NO: 752198 - RNA, 23 nt, Human
uccaguccaguuucucucccucu

SEQ ID NO: 752199 - RNA, 24 nt, Human
ucccaaguagcugggauaacaggc

SEQ ID NO: 752200 - RNA, 21 nt, Human
uccccgguuuaagcaauucuc

SEQ ID NO: 752201 - RNA, 25 nt, Human
uccccgguuuaagcaauucucccug

SEQ ID NO: 752202 - RNA, 21 nt, Human
ucccugaaaucuuccagaagu

SEQ ID NO: 752203 - RNA, 23 nt, Human
ucccugaaaucuuccagaaguuc

SEQ ID NO: 752204 - RNA, 24 nt, Human
ucgcaaagugcugggauuauaggc

SEQ ID NO: 752205 - RNA, 26 nt, Human
ucuaaacccaguaacaucaaagcaag

SEQ ID NO: 752206 - RNA, 24 nt, Human
ucucacucugucaaccaggcugga

SEQ ID NO: 752207 - RNA, 22 nt, Human
ugaaacaugccaccugucaccu

SEQ ID NO: 752208 - RNA, 18 nt, Human
ugacccccugaaccagcc

SEQ ID NO: 752209 - RNA, 20 nt, Human
ugaccuuaggugauccgccc

SEQ ID NO: 752210 - RNA, 21 nt, Human
ugaccuuaggugauccgcccu

SEQ ID NO: 752211 - RNA, 22 nt, Human
ugaccuuaggugauccgcccuc

SEQ ID NO: 752212 - RNA, 23 nt, Human
ugacugcagucaaagcaaaaaag

SEQ ID NO: 752213 - RNA, 20 nt, Human
ugagucacucaaacauagga

SEQ ID NO: 752214 - RNA, 24 nt, Human
ugagugacauaucaacuuggccca

SEQ ID NO: 752215 - RNA, 20 nt, Human
ugauccacagaaugucccuu

SEQ ID NO: 752216 - RNA, 18 nt, Human
ugcaccagauccuccagc

SEQ ID NO: 752217 - RNA, 22 nt, Human
ugcaguggcacgaucuuagcuc

SEQ ID NO: 752218 - RNA, 24 nt, Human
ugccuuagccucccaaguagcugg

SEQ ID NO: 752219 - RNA, 19 nt, Human
ugcuuugugaacuggucuc

SEQ ID NO: 752220 - RNA, 22 nt, Human
uggaaauacgggaucgaggcug

SEQ ID NO: 752221 - RNA, 21 nt, Human
uggaauaguccaguguaagaa

SEQ ID NO: 752222 - RNA, 24 nt, Human
uggaaugcaguggcacgaucuuag

SEQ ID NO: 752223 - RNA, 24 nt, Human
uggccaggcuggucucaaacuccu

SEQ ID NO: 752224 - RNA, 18 nt, Human
uggcgcacacccaggcag

SEQ ID NO: 752225 - RNA, 20 nt, Human
ugggaagaucacaaauuuac

SEQ ID NO: 752226 - RNA, 23 nt, Human
ugggagggcagaucuuacguauu

SEQ ID NO: 752227 - RNA, 21 nt, Human
ugggauaacaggcgcccgcca

SEQ ID NO: 752228 - RNA, 22 nt, Human
ugggauaacaggcgcccgccac

SEQ ID NO: 752229 - RNA, 25 nt, Human
ugggauaacaggcgcccgccaccau

SEQ ID NO: 752230 - RNA, 22 nt, Human
ugggauggcguagaacacuggg

SEQ ID NO: 752231 - RNA, 18 nt, Human
ugggauuauaggcgugag

SEQ ID NO: 752232 - RNA, 22 nt, Human
ugggauuauaggcgugagccac

SEQ ID NO: 752233 - RNA, 23 nt, Human
ugggauuauaggcgugagccacc

SEQ ID NO: 752234 - RNA, 24 nt, Human
ugggauuauaggcgugagccacca

SEQ ID NO: 752235 - RNA, 25 nt, Human
ugggauuauaggcgugagccaccau

SEQ ID NO: 752236 - RNA, 19 nt, Human
ugggcacugaauuuguggu

SEQ ID NO: 752237 - RNA, 20 nt, Human
uggggauggugggaggaaag

SEQ ID NO: 752238 - RNA, 18 nt, Human
ugggggagauaggaagga

SEQ ID NO: 752239 - RNA, 18 nt, Human
ugggugaagccguucucg

SEQ ID NO: 752240 - RNA, 21 nt, Human
ugucugggagaauguguguga

SEQ ID NO: 752241 - RNA, 24 nt, Human
ugucugggagaaugugugugaccu

SEQ ID NO: 752242 - RNA, 21 nt, Human
ugucuucuaaucccacuucuu

SEQ ID NO: 752243 - RNA, 18 nt, Human
ugugaggggaguccuggg

SEQ ID NO: 752244 - RNA, 24 nt, Human
uuaguaaagacaggguuucaccau

SEQ ID NO: 752245 - RNA, 18 nt, Human
uucaacuuuaaucccacc

SEQ ID NO: 752246 - RNA, 27 nt, Human
uucccugaaaucuuccagaaguuccaa

SEQ ID NO: 752247 - RNA, 23 nt, Human
uuccuccaagacagcccucuaaa

SEQ ID NO: 752248 - RNA, 21 nt, Human
uuccucuccccuccuugggcu

SEQ ID NO: 752249 - RNA, 21 nt, Human
uucucccugccuuagccuccc

SEQ ID NO: 752250 - RNA, 21 nt, Human
uucuucaaguuucaacuuuaa

SEQ ID NO: 752251 - RNA, 21 nt, Human
uucuugggagggcagaucuua

SEQ ID NO: 752252 - RNA, 24 nt, Human
uuucaccauguuggccaggcuggu

SEQ ID NO: 752253 - RNA, 24 nt, Human
uuuuuaguaaagacaggguuucac

SEQ ID NO: 752254 - RNA, 20 nt, Human
uuuuuguauuuuuaguaaag

SEQ ID NO: 752255 - RNA, 23 nt, Human
uuuuuguauuuuuaguaaagaca

SEQ ID NO: 752256 - RNA, 25 nt, Human
aaacaacccaaauguccaucaacag

SEQ ID NO: 752257 - RNA, 18 nt, Human
aaagaauucagagccuga

SEQ ID NO: 752258 - RNA, 19 nt, Human
aaagugcugggauuacagg

SEQ ID NO: 752259 - RNA, 23 nt, Human
aaagugcugggauuacaggugca

SEQ ID NO: 752260 - RNA, 21 nt, Human
aacaaagcccuaucucaaagc

SEQ ID NO: 752261 - RNA, 19 nt, Human
aacacagugaaaccccguc

SEQ ID NO: 752262 - RNA, 20 nt, Human
aacacagugaaaccccgucu

SEQ ID NO: 752263 - RNA, 21 nt, Human
aacacagugaaaccccgucuc

SEQ ID NO: 752264 - RNA, 21 nt, Human
aacacuggaaacaacccaaau

SEQ ID NO: 752265 - RNA, 21 nt, Human
aaccccgucucuaccaaaaau

SEQ ID NO: 752266 - RNA, 25 nt, Human
aacucaguaacaaaaauuaaaacua

SEQ ID NO: 752267 - RNA, 19 nt, Human
aagaacagcccgcuuuaca

SEQ ID NO: 752268 - RNA, 24 nt, Human
aagagguagcaagaggaggccagg

SEQ ID NO: 752269 - RNA, 24 nt, Human
aagugauccacccaccuuggccuc

SEQ ID NO: 752270 - RNA, 18 nt, Human
aagugcugggauuacagg

SEQ ID NO: 752271 - RNA, 19 nt, Human
aagugcugggauuacaggu

SEQ ID NO: 752272 - RNA, 26 nt, Human
aagugcugggauuacaggugcaagcc

SEQ ID NO: 752273 - RNA, 19 nt, Human
aauaacaccagauuggcac

SEQ ID NO: 752274 - RNA, 24 nt, Human
aaucucuugaaccugggaggcggg

SEQ ID NO: 752275 - RNA, 23 nt, Human
aauuuucuauacauugguacauc

SEQ ID NO: 752276 - RNA, 18 nt, Human
aauuuuguauuuuuagca

SEQ ID NO: 752277 - RNA, 22 nt, Human
acaccagauuggcacagaaaac

SEQ ID NO: 752278 - RNA, 19 nt, Human
acacuggaaacaacccaaa

SEQ ID NO: 752279 - RNA, 23 nt, Human
acagaauagauaucaaguguauc

SEQ ID NO: 752280 - RNA, 18 nt, Human
acaggugcaagccaccau

SEQ ID NO: 752281 - RNA, 24 nt, Human
accauguuggucaggcuggucucg

SEQ ID NO: 752282 - RNA, 24 nt, Human
accccgucucuaccaaaaauacaa

SEQ ID NO: 752283 - RNA, 21 nt, Human
acucugucuuugucuccucug

SEQ ID NO: 752284 - RNA, 22 nt, Human
acuggauuuugaaauaugauuu

SEQ ID NO: 752285 - RNA, 18 nt, Human
acugugaaaucucugaug

SEQ ID NO: 752286 - RNA, 20 nt, Human
agaaggcuuuccuagccuac

SEQ ID NO: 752287 - RNA, 18 nt, Human
agacuuuucugcauugga

SEQ ID NO: 752288 - RNA, 24 nt, Human
agcacuuugggaggcugaggcggg

SEQ ID NO: 752289 - RNA, 18 nt, Human
agccuccagaguagcugg

SEQ ID NO: 752290 - RNA, 24 nt, Human
agccuggccaacacagugaaaccc

SEQ ID NO: 752291 - RNA, 22 nt, Human
agcugggauuacaagcgugagc

SEQ ID NO: 752292 - RNA, 24 nt, Human
agcugggauuacaagcgugagcca

SEQ ID NO: 752293 - RNA, 22 nt, Human
aggcaggaaaaucucuugaacc

SEQ ID NO: 752294 - RNA, 24 nt, Human
aggcaggaaaaucucuugaaccug

SEQ ID NO: 752295 - RNA, 24 nt, Human
aggccaggcgugguggcucaugcc

SEQ ID NO: 752296 - RNA, 23 nt, Human
aggcgggguugcagugagccaag

SEQ ID NO: 752297 - RNA, 24 nt, Human
aggcgugguggcucaugccuguaa

SEQ ID NO: 752298 - RNA, 24 nt, Human
aggcugaggcaggaaaaucucuug

SEQ ID NO: 752299 - RNA, 20 nt, Human
aggcugaggcggguggaccg

SEQ ID NO: 752300 - RNA, 20 nt, Human
aggcugaggcggguggaccg

SEQ ID NO: 752301 - RNA, 22 nt, Human
agguucaagugauucuccagcc

SEQ ID NO: 752302 - RNA, 19 nt, Human
aguagcugggauuacaagc

SEQ ID NO: 752303 - RNA, 25 nt, Human
agugauaagaacagcccgcuuuaca

SEQ ID NO: 752304 - RNA, 19 nt, Human
agugauccacccaccuugg

SEQ ID NO: 752305 - RNA, 22 nt, Human
agugauucuccagcccagccuc

SEQ ID NO: 752306 - RNA, 21 nt, Human
auacuuuucaagacauaguua

SEQ ID NO: 752307 - RNA, 23 nt, Human
aucaguucagauucucugcaaaa

SEQ ID NO: 752308 - RNA, 19 nt, Human
auccacagacucucucuca

SEQ ID NO: 752309 - RNA, 24 nt, Human
aucgugcuauuacacuccaaccug

SEQ ID NO: 752310 - RNA, 19 nt, Human
augccuguaaucccagcac

SEQ ID NO: 752311 - RNA, 23 nt, Human
auguuguacaaggcagauuuucu

SEQ ID NO: 752312 - RNA, 18 nt, Human
auuacacuccaaccuggg

SEQ ID NO: 752313 - RNA, 23 nt, Human
auuacacuccaaccugggcaaca

SEQ ID NO: 752314 - RNA, 21 nt, Human
auuacaggugcaagccaccau

SEQ ID NO: 752315 - RNA, 18 nt, Human
caaaacacuggaaacaac

SEQ ID NO: 752316 - RNA, 24 nt, Human
caaaacacuggaaacaacccaaau

SEQ ID NO: 752317 - RNA, 24 nt, Human
caaagugcugggauuacaggugca

SEQ ID NO: 752318 - RNA, 24 nt, Human
caacacagugaaaccccgucucua

SEQ ID NO: 752319 - RNA, 21 nt, Human
caacccaaauguccaucaaca

SEQ ID NO: 752320 - RNA, 18 nt, Human
caagaggaggccaggcgu

SEQ ID NO: 752321 - RNA, 23 nt, Human
caagugauccacccaccuuggcc

SEQ ID NO: 752322 - RNA, 22 nt, Human
caauccacagacucucucucag

SEQ ID NO: 752323 - RNA, 21 nt, Human
caccauguuggucaggcuggu

SEQ ID NO: 752324 - RNA, 24 nt, Human
caccauguuggucaggcuggucuc

SEQ ID NO: 752325 - RNA, 22 nt, Human
cacccaccuuggccucccaaag

SEQ ID NO: 752326 - RNA, 23 nt, Human
cacccaccuuggccucccaaagu

SEQ ID NO: 752327 - RNA, 24 nt, Human
cacuccaaccugggcaacaagagc

SEQ ID NO: 752328 - RNA, 24 nt, Human
cagcacuuugggaggcugaggcgg

SEQ ID NO: 752329 - RNA, 24 nt, Human
cagcuacuuaggaggcugaggcag

SEQ ID NO: 752330 - RNA, 21 nt, Human
caugagacuuuuuuacuucau

SEQ ID NO: 752331 - RNA, 20 nt, Human
caugccuguaaucccagcac

SEQ ID NO: 752332 - RNA, 24 nt, Human
caugccuguaaucccagcacuuug

SEQ ID NO: 752333 - RNA, 21 nt, Human
cauugucuuccaagggugaaa

SEQ ID NO: 752334 - RNA, 21 nt, Human
ccaaagugcugggauuacagg

SEQ ID NO: 752335 - RNA, 21 nt, Human
ccaaagugcugggauuacagg

SEQ ID NO: 752336 - RNA, 22 nt, Human
ccaaagugcugggauuacaggu

SEQ ID NO: 752337 - RNA, 20 nt, Human
ccaaauauacugaauuacau

SEQ ID NO: 752338 - RNA, 18 nt, Human
ccacagaaaucauaucua

SEQ ID NO: 752339 - RNA, 19 nt, Human
ccagaguagcugggauuac

SEQ ID NO: 752340 - RNA, 23 nt, Human
ccagaguagcugggauuacaagc

SEQ ID NO: 752341 - RNA, 25 nt, Human
ccagaguagcugggauuacaagcgu

SEQ ID NO: 752342 - RNA, 21 nt, Human
ccagcccagccuccagaguag

SEQ ID NO: 752343 - RNA, 24 nt, Human
cccgaccucaagugauccacccac

SEQ ID NO: 752344 - RNA, 24 nt, Human
ccucccagguucaagugauucucc

SEQ ID NO: 752345 - RNA, 23 nt, Human
ccuggccaacacagugaaacccc

SEQ ID NO: 752346 - RNA, 24 nt, Human
ccuggccaacacagugaaaccccg

SEQ ID NO: 752347 - RNA, 21 nt, Human
ccuguaaucccagcuacuuag

SEQ ID NO: 752348 - RNA, 22 nt, Human
ccuguaaucccagcuacuuagg

SEQ ID NO: 752349 - RNA, 24 nt, Human
cuauuacacuccaaccugggcaac

SEQ ID NO: 752350 - RNA, 24 nt, Human
cucaagugauccacccaccuuggc

SEQ ID NO: 752351 - RNA, 22 nt, Human
cucacugaaaccucugccuccc

SEQ ID NO: 752352 - RNA, 23 nt, Human
cucacugaaaccucugccuccca

SEQ ID NO: 752353 - RNA, 24 nt, Human
cucacugaaaccucugccucccag

SEQ ID NO: 752354 - RNA, 23 nt, Human
cucaugccuguaaucccagcacu

SEQ ID NO: 752355 - RNA, 24 nt, Human
cucaugccuguaaucccagcacuu

SEQ ID NO: 752356 - RNA, 19 nt, Human
cucccagguucaagugauu

SEQ ID NO: 752357 - RNA, 18 nt, Human
cugaaaccucugccuccc

SEQ ID NO: 752358 - RNA, 24 nt, Human
cugaaaccucugccucccagguuc

SEQ ID NO: 752359 - RNA, 18 nt, Human
cuggccaacacagugaaa

SEQ ID NO: 752360 - RNA, 20 nt, Human
gaaccugggaggcgggguug

SEQ ID NO: 752361 - RNA, 24 nt, Human
gaccucaagugauccacccaccuu

SEQ ID NO: 752362 - RNA, 19 nt, Human
gagcguggucgugggugcc

SEQ ID NO: 752363 - RNA, 24 nt, Human
gaggaggccaggcgugguggcuca

SEQ ID NO: 752364 - RNA, 24 nt, Human
gaggcgggguugcagugagccaag

SEQ ID NO: 752365 - RNA, 27 nt, Human
gaguagcugggauuacaagcgugagcc

SEQ ID NO: 752366 - RNA, 18 nt, Human
gauuacaagcgugagcca

SEQ ID NO: 752367 - RNA, 24 nt, Human
gauuacaagcgugagccaccaugc

SEQ ID NO: 752368 - RNA, 18 nt, Human
gauuacaggugcaagcca

SEQ ID NO: 752369 - RNA, 24 nt, Human
gauuacaggugcaagccaccaugc

SEQ ID NO: 752370 - RNA, 20 nt, Human
gcaaaacacuggaaacaacc

SEQ ID NO: 752371 - RNA, 22 nt, Human
gcccagccuccagaguagcugg

SEQ ID NO: 752372 - RNA, 19 nt, Human
gcggguggaccgcccgggg

SEQ ID NO: 752373 - RNA, 21 nt, Human
gcucacugaaaccucugccuc

SEQ ID NO: 752374 - RNA, 19 nt, Human
gcuggaaugcaauggcgca

SEQ ID NO: 752375 - RNA, 23 nt, Human
gcuggucucgaacucccgaccuc

SEQ ID NO: 752376 - RNA, 19 nt, Human
ggaaucauugauaauauga

SEQ ID NO: 752377 - RNA, 24 nt, Human
ggaggccaggcgugguggcucaug

SEQ ID NO: 752378 - RNA, 24 nt, Human
ggauuacaagcgugagccaccaug

SEQ ID NO: 752379 - RNA, 24 nt, Human
ggauuacaggugcaagccaccaug

SEQ ID NO: 752380 - RNA, 18 nt, Human
ggcacagaaaacaccugu

SEQ ID NO: 752381 - RNA, 22 nt, Human
gggccucaccauguuggucagg

SEQ ID NO: 752382 - RNA, 22 nt, Human
ggggccucaccauguuggucag

SEQ ID NO: 752383 - RNA, 23 nt, Human
ggggccucaccauguuggucagg

SEQ ID NO: 752384 - RNA, 24 nt, Human
ggggggccucaccauguuggucag

SEQ ID NO: 752385 - RNA, 22 nt, Human
gggguugcagugagccaagauc

SEQ ID NO: 752386 - RNA, 23 nt, Human
gggguugcagugagccaagaucg

SEQ ID NO: 752387 - RNA, 22 nt, Human
ggguagccaggaccuguggaca

SEQ ID NO: 752388 - RNA, 24 nt, Human
ggucgugggugccuguaaucccag

SEQ ID NO: 752389 - RNA, 24 nt, Human
gguggcucaugccuguaaucccag

SEQ ID NO: 752390 - RNA, 21 nt, Human
gguugcagugagccaagaucg

SEQ ID NO: 752391 - RNA, 23 nt, Human
guccuggaaucuuccucuuucuu

SEQ ID NO: 752392 - RNA, 24 nt, Human
gugauccacccaccuuggccuccc

SEQ ID NO: 752393 - RNA, 21 nt, Human
gugcugggauuacaggugcaa

SEQ ID NO: 752394 - RNA, 23 nt, Human
guggcucaugccuguaaucccag

SEQ ID NO: 752395 - RNA, 19 nt, Human
gugggugccuguaauccca

SEQ ID NO: 752396 - RNA, 21 nt, Human
guuguacaaggcagauuuucu

SEQ ID NO: 752397 - RNA, 27 nt, Human
guuuuuuuuuuuuuuuuuuuuuugggg

SEQ ID NO: 752398 - RNA, 18 nt, Human
uaacagcaaaacacugga

SEQ ID NO: 752399 - RNA, 22 nt, Human
uaacuuggauaaacacauccaa

SEQ ID NO: 752400 - RNA, 21 nt, Human
uaagaacuaauaaauaacacc

SEQ ID NO: 752401 - RNA, 23 nt, Human
uaauuuuguauuuuuagcagaga

SEQ ID NO: 752402 - RNA, 18 nt, Human
uacaagcgugagccacca

SEQ ID NO: 752403 - RNA, 24 nt, Human
uacacaaacccuggugcauccauu

SEQ ID NO: 752404 - RNA, 23 nt, Human
uacaggugcaagccaccaugccc

SEQ ID NO: 752405 - RNA, 22 nt, Human
uagacaccuaacaacuuggaua

SEQ ID NO: 752406 - RNA, 25 nt, Human
uagcagagaggggggccucaccaug

SEQ ID NO: 752407 - RNA, 21 nt, Human
uauaacagcaaaacacuggaa

SEQ ID NO: 752408 - RNA, 18 nt, Human
uauacugaauuacauuua

SEQ ID NO: 752409 - RNA, 25 nt, Human
uauaugcauguaugcuaggagcaca

SEQ ID NO: 752410 - RNA, 23 nt, Human
uauuacacuccaaccugggcaac

SEQ ID NO: 752411 - RNA, 24 nt, Human
uauuacacuccaaccugggcaaca

SEQ ID NO: 752412 - RNA, 24 nt, Human
ucacugaaaccucugccucccagg

SEQ ID NO: 752413 - RNA, 25 nt, Human
ucacugaaaccucugccucccaggu

SEQ ID NO: 752414 - RNA, 18 nt, Human
ucacugccaucugaaacu

SEQ ID NO: 752415 - RNA, 24 nt, Human
uccacagaaaucauaucuaggucc

SEQ ID NO: 752416 - RNA, 23 nt, Human
ucccaaaggcaugaacaugucca

SEQ ID NO: 752417 - RNA, 23 nt, Human
ucccaaagugcugggauuacagg

SEQ ID NO: 752418 - RNA, 20 nt, Human
ucccaggguagccaggaccu

SEQ ID NO: 752419 - RNA, 22 nt, Human
ucccaggguagccaggaccugu

SEQ ID NO: 752420 - RNA, 21 nt, Human
ucccagguucaagugauucuc

SEQ ID NO: 752421 - RNA, 22 nt, Human
ucccagguucaagugauucucc

SEQ ID NO: 752422 - RNA, 22 nt, Human
ucgcucuuguugcccaggcugg

SEQ ID NO: 752423 - RNA, 23 nt, Human
ucgcucuuguugcccaggcugga

SEQ ID NO: 752424 - RNA, 21 nt, Human
ucucuugaaccugggaggcgg

SEQ ID NO: 752425 - RNA, 22 nt, Human
ucuuguugcccaggcuggaaug

SEQ ID NO: 752426 - RNA, 19 nt, Human
ugaaaccucugccucccag

SEQ ID NO: 752427 - RNA, 18 nt, Human
ugaaauaacaaaauuagg

SEQ ID NO: 752428 - RNA, 20 nt, Human
ugaaauaacaaaauuagggu

SEQ ID NO: 752429 - RNA, 23 nt, Human
ugaaccugggaggcgggguugca

SEQ ID NO: 752430 - RNA, 20 nt, Human
ugaggcaggaaaaucucuug

SEQ ID NO: 752431 - RNA, 24 nt, Human
ugaggcaggaaaaucucuugaacc

SEQ ID NO: 752432 - RNA, 25 nt, Human
ugaggcaggaaaaucucuugaaccu

SEQ ID NO: 752433 - RNA, 19 nt, Human
ugaggcggguggaccgccc

SEQ ID NO: 752434 - RNA, 24 nt, Human
ugauccacccaccuuggccuccca

SEQ ID NO: 752435 - RNA, 19 nt, Human
ugauucuccagcccagccu

SEQ ID NO: 752436 - RNA, 23 nt, Human
ugcaauggcgcaaucuuggcuca

SEQ ID NO: 752437 - RNA, 18 nt, Human
ugcauuggauguaucaag

SEQ ID NO: 752438 - RNA, 21 nt, Human
ugcccaggcuggaaugcaaug

SEQ ID NO: 752439 - RNA, 23 nt, Human
ugccuguaaucccagcacuuugg

SEQ ID NO: 752440 - RNA, 24 nt, Human
ugccuguaaucccagcacuuuggg

SEQ ID NO: 752441 - RNA, 24 nt, Human
ugccuguaaucccagcuacuuagg

SEQ ID NO: 752442 - RNA, 19 nt, Human
ugcuauuacacuccaaccu

SEQ ID NO: 752443 - RNA, 24 nt, Human
ugcuauuacacuccaaccugggca

SEQ ID NO: 752444 - RNA, 24 nt, Human
ugcugggauuacaggugcaagcca

SEQ ID NO: 752445 - RNA, 21 nt, Human
uggaaucauugauaauaugau

SEQ ID NO: 752446 - RNA, 24 nt, Human
uggaaugcaauggcgcaaucuugg

SEQ ID NO: 752447 - RNA, 22 nt, Human
uggcacagaaaacaccuguguu

SEQ ID NO: 752448 - RNA, 19 nt, Human
uggcucacugaaaccucug

SEQ ID NO: 752449 - RNA, 24 nt, Human
uggcucaugccuguaaucccagca

SEQ ID NO: 752450 - RNA, 23 nt, Human
ugggaggcgggguugcagugagc

SEQ ID NO: 752451 - RNA, 20 nt, Human
ugggaggcugaggcgggugg

SEQ ID NO: 752452 - RNA, 23 nt, Human
ugggaggcugaggcggguggacc

SEQ ID NO: 752453 - RNA, 24 nt, Human
ugggaggcugaggcggguggaccg

SEQ ID NO: 752454 - RNA, 18 nt, Human
ugggauuacaagcgugag

SEQ ID NO: 752455 - RNA, 22 nt, Human
ugggauuacaagcgugagccac

SEQ ID NO: 752456 - RNA, 23 nt, Human
ugggauuacaagcgugagccacc

SEQ ID NO: 752457 - RNA, 24 nt, Human
ugggauuacaagcgugagccacca

SEQ ID NO: 752458 - RNA, 25 nt, Human
ugggauuacaagcgugagccaccau

SEQ ID NO: 752459 - RNA, 22 nt, Human
ugggauuacaggugcaagccac

SEQ ID NO: 752460 - RNA, 24 nt, Human
ugggauuacaggugcaagccacca

SEQ ID NO: 752461 - RNA, 25 nt, Human
ugggauuacaggugcaagccaccau

SEQ ID NO: 752462 - RNA, 21 nt, Human
ugguaccuaguaacuuggaua

SEQ ID NO: 752463 - RNA, 23 nt, Human
uggucaggcuggucucgaacucc

SEQ ID NO: 752464 - RNA, 19 nt, Human
uggucucgaacucccgacc

SEQ ID NO: 752465 - RNA, 24 nt, Human
ugguggcucaugccuguaauccca

SEQ ID NO: 752466 - RNA, 20 nt, Human
uguaucaaguuuauuuccua

SEQ ID NO: 752467 - RNA, 22 nt, Human
uguaugcuaggagcacacugcu

SEQ ID NO: 752468 - RNA, 20 nt, Human
uguauuuuuagcagagaggg

SEQ ID NO: 752469 - RNA, 23 nt, Human
ugugaaucuagaauuauuucaaa

SEQ ID NO: 752470 - RNA, 20 nt, Human
uuaaggguaauuugcugagu

SEQ ID NO: 752471 - RNA, 23 nt, Human
uuaaucaccgaaggcacuagugc

SEQ ID NO: 752472 - RNA, 19 nt, Human
uuacacuccaaccugggca

SEQ ID NO: 752473 - RNA, 18 nt, Human
uuagcagagaggggggcc

SEQ ID NO: 752474 - RNA, 26 nt, Human
uucaagugauucuccaggacuccgug

SEQ ID NO: 752475 - RNA, 24 nt, Human
uucgcucuuguugcccaggcugga

SEQ ID NO: 752476 - RNA, 23 nt, Human
uugaaccugggaggcgggguugc

SEQ ID NO: 752477 - RNA, 22 nt, Human
uugcagugagccaagaucgugc

SEQ ID NO: 752478 - RNA, 18 nt, Human
uugcccaggcuggaaugc

SEQ ID NO: 752479 - RNA, 21 nt, Human
uuggcacagaaaacaccugug

SEQ ID NO: 752480 - RNA, 18 nt, Human
uuggccucccaaagugcu

SEQ ID NO: 752481 - RNA, 23 nt, Human
uuguauuuuuagcagagaggggg

SEQ ID NO: 752482 - RNA, 23 nt, Human
uuguugcccaggcuggaaugcaa

SEQ ID NO: 752483 - RNA, 24 nt, Human
uuucgcucuuguugcccaggcugg

SEQ ID NO: 752484 - RNA, 24 nt, Human
uuucugacauugauagcauucauc

SEQ ID NO: 752485 - RNA, 22 nt, Human
uuucugggcaaaggcuuuccca

SEQ ID NO: 752486 - RNA, 26 nt, Human
uuucuguaugaaguaaugaugaugag

SEQ ID NO: 752487 - RNA, 20 nt, Human
uuuuguauuuuuagcagaga

SEQ ID NO: 752488 - RNA, 20 nt, Human
uuuuuuuuuuugaggcagag

SEQ ID NO: 752489 - RNA, 21 nt, Human
uuuuuuuuuuuuuuuuugagg

SEQ ID NO: 752490 - RNA, 18 nt, Human
aaaaggaaacaugcuaga

SEQ ID NO: 752491 - RNA, 21 nt, Human
aaaaggaaacaugcuagaaaa

SEQ ID NO: 752492 - RNA, 22 nt, Human
aaagacaaaaaggcaacaugug

SEQ ID NO: 752493 - RNA, 20 nt, Human
aaaggugucccauggccccu

SEQ ID NO: 752494 - RNA, 22 nt, Human
aacacccuggcaugacauuccu

SEQ ID NO: 752495 - RNA, 18 nt, Human
aacucucaggccuuggcc

SEQ ID NO: 752496 - RNA, 26 nt, Human
aacuucuccaaaucucaauuuccuua

SEQ ID NO: 752497 - RNA, 18 nt, Human
aaguaaaaggaaacaugc

SEQ ID NO: 752498 - RNA, 22 nt, Human
aagugacuccgauuuucagccc

SEQ ID NO: 752499 - RNA, 22 nt, Human
aauuuguccccucuucucucug

SEQ ID NO: 752500 - RNA, 19 nt, Human
acacacacacagccucagg

SEQ ID NO: 752501 - RNA, 19 nt, Human
acaggagugggucuugucc

SEQ ID NO: 752502 - RNA, 19 nt, Human
accccgccaguggccacag

SEQ ID NO: 752503 - RNA, 19 nt, Human
acuauuccacugguuaagu

SEQ ID NO: 752504 - RNA, 24 nt, Human
acugcagugguuuuccugcagcuc

SEQ ID NO: 752505 - RNA, 22 nt, Human
agaaaacuuacuuacuucaggc

SEQ ID NO: 752506 - RNA, 20 nt, Human
agacaaaaaggcaacaugug

SEQ ID NO: 752507 - RNA, 20 nt, Human
aggugcucaggacccggaag

SEQ ID NO: 752508 - RNA, 21 nt, Human
aguaaaaggaaacaugcuaga

SEQ ID NO: 752509 - RNA, 21 nt, Human
caaccccucuucagagaaagg

SEQ ID NO: 752510 - RNA, 19 nt, Human
caaccugaauucugccucc

SEQ ID NO: 752511 - RNA, 21 nt, Human
caagaaauaccugugugacac

SEQ ID NO: 752512 - RNA, 20 nt, Human
cacaaccaaauuuguccccu

SEQ ID NO: 752513 - RNA, 24 nt, Human
cacacugcagugguuuuccugcag

SEQ ID NO: 752514 - RNA, 18 nt, Human
cacauguuccuaaggugu

SEQ ID NO: 752515 - RNA, 24 nt, Human
cagcagaguugagacuggcuccgg

SEQ ID NO: 752516 - RNA, 21 nt, Human
cagcagggcuuuaccugcccc

SEQ ID NO: 752517 - RNA, 21 nt, Human
caggucccgcacucacucucc

SEQ ID NO: 752518 - RNA, 21 nt, Human
cagguggucaauguccuggug

SEQ ID NO: 752519 - RNA, 23 nt, Human
caugcuagaaaacgugccuagag

SEQ ID NO: 752520 - RNA, 25 nt, Human
cauggccccaaaaagaacugccaag

SEQ ID NO: 752521 - RNA, 18 nt, Human
ccaaaaagaacugccaag

SEQ ID NO: 752522 - RNA, 23 nt, Human
ccaaauuuguccccucuucucuc

SEQ ID NO: 752523 - RNA, 20 nt, Human
ccacccaggguucaggcccu

SEQ ID NO: 752524 - RNA, 18 nt, Human
ccagugcccccacccagg

SEQ ID NO: 752525 - RNA, 23 nt, Human
ccagugcccccacccaggguuca

SEQ ID NO: 752526 - RNA, 18 nt, Human
cccaaaaagaacugccaa

SEQ ID NO: 752527 - RNA, 23 nt, Human
cccccccgaccccgccaguggcc

SEQ ID NO: 752528 - RNA, 20 nt, Human
ccccucuucucucugccaag

SEQ ID NO: 752529 - RNA, 21 nt, Human
ccccuggagaguuuuagccgu

SEQ ID NO: 752530 - RNA, 18 nt, Human
cccggaagaaucaucuac

SEQ ID NO: 752531 - RNA, 21 nt, Human
ccgcugcccccccccgacccc

SEQ ID NO: 752532 - RNA, 21 nt, Human
ccucacugguggugugccacu

SEQ ID NO: 752533 - RNA, 21 nt, Human
cggcuccgccgcugccccccc

SEQ ID NO: 752534 - RNA, 19 nt, Human
cuagaaaacgugccuagag

SEQ ID NO: 752535 - RNA, 24 nt, Human
cucaggacccggaagaaucaucua

SEQ ID NO: 752536 - RNA, 23 nt, Human
cuccgccgcugcccccccccgac

SEQ ID NO: 752537 - RNA, 21 nt, Human
cucugccaagaaucucuucca

SEQ ID NO: 752538 - RNA, 20 nt, Human
cucuuccaagcagugauggc

SEQ ID NO: 752539 - RNA, 21 nt, Human
cugcagugguuuuccugcagc

SEQ ID NO: 752540 - RNA, 22 nt, Human
cugccccacugagaaaacuuac

SEQ ID NO: 752541 - RNA, 24 nt, Human
cugccuccuaagugacuccgauuu

SEQ ID NO: 752542 - RNA, 21 nt, Human
cuucacaaccaaauuuguccc

SEQ ID NO: 752543 - RNA, 21 nt, Human
gaagaaucaucuaccucccag

SEQ ID NO: 752544 - RNA, 23 nt, Human
gaagcaggugcucaggacccgga

SEQ ID NO: 752545 - RNA, 22 nt, Human
gagacagaaccaaguaaaagga

SEQ ID NO: 752546 - RNA, 22 nt, Human
ggccccaaaaagaacugccaag

SEQ ID NO: 752547 - RNA, 26 nt, Human
guaaaaggaaacaugcuagaaaacgu

SEQ ID NO: 752548 - RNA, 22 nt, Human
uaaaaggaaacaugcuagaaaa

SEQ ID NO: 752549 - RNA, 21 nt, Human
uaagugacuccgauuuucagc

SEQ ID NO: 752550 - RNA, 22 nt, Human
uaccgccagaaacaggaguggg

SEQ ID NO: 752551 - RNA, 18 nt, Human
uaccugccccuggagagu

SEQ ID NO: 752552 - RNA, 22 nt, Human
uaccugccccuggagaguuuua

SEQ ID NO: 752553 - RNA, 21 nt, Human
uaccugugugacacagaccca

SEQ ID NO: 752554 - RNA, 20 nt, Human
uagccccuuagcacauguuc

SEQ ID NO: 752555 - RNA, 22 nt, Human
uagccccuuagcacauguuccu

SEQ ID NO: 752556 - RNA, 20 nt, Human
uagcugguaccgccagaaac

SEQ ID NO: 752557 - RNA, 18 nt, Human
uagugcuucugagcccag

SEQ ID NO: 752558 - RNA, 21 nt, Human
uauagugcuucugagcccagc

SEQ ID NO: 752559 - RNA, 18 nt, Human
uauccaaccccucuucag

SEQ ID NO: 752560 - RNA, 22 nt, Human
uaugagacugccccacugagaa

SEQ ID NO: 752561 - RNA, 21 nt, Human
ucaggcauccagugcccccac

SEQ ID NO: 752562 - RNA, 18 nt, Human
uccaaaacuucuucucug

SEQ ID NO: 752563 - RNA, 20 nt, Human
uccaaccccucuucagagaa

SEQ ID NO: 752564 - RNA, 20 nt, Human
uccacucacacacacacaca

SEQ ID NO: 752565 - RNA, 24 nt, Human
uccagaggaccaagaaauaccugu

SEQ ID NO: 752566 - RNA, 21 nt, Human
ucccagcagaguugagacugg

SEQ ID NO: 752567 - RNA, 18 nt, Human
ucuaccucccagcuuugu

SEQ ID NO: 752568 - RNA, 20 nt, Human
ucugccaagaaucucuucca

SEQ ID NO: 752569 - RNA, 21 nt, Human
ugaagcaaagagcugagugag

SEQ ID NO: 752570 - RNA, 19 nt, Human
ugagacuggcuccguugag

SEQ ID NO: 752571 - RNA, 18 nt, Human
ugagucacaggccagagc

SEQ ID NO: 752572 - RNA, 18 nt, Human
ugcagugguuuuccugca

SEQ ID NO: 752573 - RNA, 21 nt, Human
ugccaagaaucucuuccaagc

SEQ ID NO: 752574 - RNA, 23 nt, Human
ugccaagaaucucuuccaagcag

SEQ ID NO: 752575 - RNA, 21 nt, Human
ugccuuauccaaccccucuuc

SEQ ID NO: 752576 - RNA, 23 nt, Human
ugguagaauaaggaagacagcug

SEQ ID NO: 752577 - RNA, 18 nt, Human
uuaccugccccuggagag

SEQ ID NO: 752578 - RNA, 20 nt, Human
uuagccccuuagcacauguu

SEQ ID NO: 752579 - RNA, 20 nt, Human
uuaggggaggucaggugguc

SEQ ID NO: 752580 - RNA, 19 nt, Human
uuccaggguagcugguacc

SEQ ID NO: 752581 - RNA, 24 nt, Human
uuuauuuauuugccuguuuuuguu

SEQ ID NO: 752582 - RNA, 23 nt, Human
uuuggcucuuaagaccuagcagg

SEQ ID NO: 752583 - RNA, 19 nt, Human
aaggacaucauacucugaa

SEQ ID NO: 752584 - RNA, 21 nt, Human
acagcaacugccacauacauc

SEQ ID NO: 752585 - RNA, 19 nt, Human
aggacaucauacucugaaa

SEQ ID NO: 752586 - RNA, 24 nt, Human
caccuacagcuguggcggccaucc

SEQ ID NO: 752587 - RNA, 18 nt, Human
cagcacagguaaaaaucu

SEQ ID NO: 752588 - RNA, 21 nt, Human
cauuguaaacugcagacagca

SEQ ID NO: 752589 - RNA, 24 nt, Human
ccagcacagguaaaaaucuuuuuu

SEQ ID NO: 752590 - RNA, 25 nt, Human
cgaaccggacaaacaaggaggcuga

SEQ ID NO: 752591 - RNA, 21 nt, Human
cugcagacagcaacugccaca

SEQ ID NO: 752592 - RNA, 19 nt, Human
cuguggcggccaucccagc

SEQ ID NO: 752593 - RNA, 24 nt, Human
cuuguguacuuuauugucuucaau

SEQ ID NO: 752594 - RNA, 23 nt, Human
gccacauacaucauagaccagca

SEQ ID NO: 752595 - RNA, 22 nt, Human
gcgggaauacuggugcccuuga

SEQ ID NO: 752596 - RNA, 19 nt, Human
uaaaaaaucuucauuuaca

SEQ ID NO: 752597 - RNA, 19 nt, Human
uaacaucaagguggggaca

SEQ ID NO: 752598 - RNA, 24 nt, Human
uaccaaguaccaguuucuuauauu

SEQ ID NO: 752599 - RNA, 22 nt, Human
uagcagcaccuacagcuguggc

SEQ ID NO: 752600 - RNA, 25 nt, Human
uaugauagugaauuuuaccuuuucu

SEQ ID NO: 752601 - RNA, 21 nt, Human
ucaacgcccggcaaagaccag

SEQ ID NO: 752602 - RNA, 21 nt, Human
ucauauuguuccagagucaug

SEQ ID NO: 752603 - RNA, 24 nt, Human
uccggacauuuaaaauauugauau

SEQ ID NO: 752604 - RNA, 20 nt, Human
uggggacacaaaauaugaua

SEQ ID NO: 752605 - RNA, 19 nt, Human
uguaaacugcagacagcaa

SEQ ID NO: 752606 - RNA, 19 nt, Human
uguggcggccaucccagcg

SEQ ID NO: 752607 - RNA, 21 nt, Human
uuacauuaaaggacaucauac

SEQ ID NO: 752608 - RNA, 24 nt, Human
uucaaauauuuccauuuuuuaaac

SEQ ID NO: 752609 - RNA, 24 nt, Human
uucauauuguuccagagucaugua

SEQ ID NO: 752610 - RNA, 21 nt, Human
uucauugaaaguacaggauaa

SEQ ID NO: 752611 - RNA, 22 nt, Human
uuccagagucauguaacaucaa

SEQ ID NO: 752612 - RNA, 23 nt, Human
uuugaguuuacauuaaaggacau

SEQ ID NO: 752613 - RNA, 22 nt, Human
aaaacaguaacacugacaaaau

SEQ ID NO: 752614 - RNA, 25 nt, Human
aagaagaccaacaauaaaaguacag

SEQ ID NO: 752615 - RNA, 18 nt, Human
aagcagggcucuagggau

SEQ ID NO: 752616 - RNA, 19 nt, Human
acaaggaaauucacaacau

SEQ ID NO: 752617 - RNA, 19 nt, Human
acagugaauuuucuaagcc

SEQ ID NO: 752618 - RNA, 22 nt, Human
acucucggcaucgcugucccgg

SEQ ID NO: 752619 - RNA, 19 nt, Human
acuggcuucauggcuuuuu

SEQ ID NO: 752620 - RNA, 21 nt, Human
agaguuuuguucauggugaug

SEQ ID NO: 752621 - RNA, 21 nt, Human
agcagcgcgugguucucgugc

SEQ ID NO: 752622 - RNA, 19 nt, Human
agccgcagcuucagcucgg

SEQ ID NO: 752623 - RNA, 24 nt, Human
aggugauggcgaggacacaguagc

SEQ ID NO: 752624 - RNA, 20 nt, Human
caaaaucauccuguaucccc

SEQ ID NO: 752625 - RNA, 19 nt, Human
caacauggaaauaaacuga

SEQ ID NO: 752626 - RNA, 22 nt, Human
caacauggaaauaaacugaacc

SEQ ID NO: 752627 - RNA, 25 nt, Human
caacauggaaauaaacugaaccaaa

SEQ ID NO: 752628 - RNA, 22 nt, Human
caagaagaccaacaauaaaagu

SEQ ID NO: 752629 - RNA, 28 nt, Human
caccuccagcuccacgaucuuccggccc

SEQ ID NO: 752630 - RNA, 18 nt, Human
caccuugccgcugagcuc

SEQ ID NO: 752631 - RNA, 19 nt, Human
cacugaaucagacagucug

SEQ ID NO: 752632 - RNA, 20 nt, Human
cagaguccucccgggccuuc

SEQ ID NO: 752633 - RNA, 20 nt, Human
cagcagcgcgugguucucgu

SEQ ID NO: 752634 - RNA, 18 nt, Human
cagcuccuccugcagggg

SEQ ID NO: 752635 - RNA, 22 nt, Human
cagcuccuccugcaggggggcc

SEQ ID NO: 752636 - RNA, 24 nt, Human
caucgcugucccggggacuggggg

SEQ ID NO: 752637 - RNA, 24 nt, Human
ccaacaauaaaaguacaguacaag

SEQ ID NO: 752638 - RNA, 24 nt, Human
ccccaucacucuccuucuugcccg

SEQ ID NO: 752639 - RNA, 22 nt, Human
ccccgccaacaggcccuucccg

SEQ ID NO: 752640 - RNA, 22 nt, Human
ccccggcaccaggacuugcacc

SEQ ID NO: 752641 - RNA, 19 nt, Human
cccgcucccgaagcccgac

SEQ ID NO: 752642 - RNA, 21 nt, Human
cccgcuugggcuggggcaggc

SEQ ID NO: 752643 - RNA, 18 nt, Human
cccgggcccucccgcucc

SEQ ID NO: 752644 - RNA, 20 nt, Human
cccuucccgcuugggcuggg

SEQ ID NO: 752645 - RNA, 23 nt, Human
ccgacccgggcccucccgcuccu

SEQ ID NO: 752646 - RNA, 19 nt, Human
ccgcagcuucagcucggcc

SEQ ID NO: 752647 - RNA, 21 nt, Human
ccgcagcuucagcucggccuc

SEQ ID NO: 752648 - RNA, 22 nt, Human
ccgccaacaggcccuucccgcu

SEQ ID NO: 752649 - RNA, 23 nt, Human
ccuccaaggacgucgggucuccg

SEQ ID NO: 752650 - RNA, 19 nt, Human
ccucuucuacaaacugcag

SEQ ID NO: 752651 - RNA, 21 nt, Human
ccuguugggcagaguuuuguu

SEQ ID NO: 752652 - RNA, 18 nt, Human
ccuucccgcuugggcugg

SEQ ID NO: 752653 - RNA, 23 nt, Human
cgcauguccuccaucucugccuu

SEQ ID NO: 752654 - RNA, 20 nt, Human
cgcgugguucucgugcugca

SEQ ID NO: 752655 - RNA, 18 nt, Human
cgcucccgaagcccgacg

SEQ ID NO: 752656 - RNA, 21 nt, Human
cgcuugggcuggggcaggcga

SEQ ID NO: 752657 - RNA, 22 nt, Human
cggccucccgggugcugggggg

SEQ ID NO: 752658 - RNA, 22 nt, Human
cgggcggcuccucgccaccaug

SEQ ID NO: 752659 - RNA, 18 nt, Human
cucagaguccucccgggc

SEQ ID NO: 752660 - RNA, 18 nt, Human
cuccccaucacucuccuu

SEQ ID NO: 752661 - RNA, 21 nt, Human
cuccucgccaccaugcuccuc

SEQ ID NO: 752662 - RNA, 18 nt, Human
cucugccuugaggccacg

SEQ ID NO: 752663 - RNA, 22 nt, Human
cugacuucagcuccuccugcag

SEQ ID NO: 752664 - RNA, 21 nt, Human
cugcaggggggccccaccccc

SEQ ID NO: 752665 - RNA, 21 nt, Human
cuggagaagcagggcucuagg

SEQ ID NO: 752666 - RNA, 18 nt, Human
cuguauccccuccagcau

SEQ ID NO: 752667 - RNA, 19 nt, Human
cugugaggcagugggggaa

SEQ ID NO: 752668 - RNA, 18 nt, Human
cuucccgcucccgaagcc

SEQ ID NO: 752669 - RNA, 20 nt, Human
cuucccgcuugggcuggggc

SEQ ID NO: 752670 - RNA, 23 nt, Human
cuugcacccucuccuagccagcc

SEQ ID NO: 752671 - RNA, 20 nt, Human
gacaaaauaaaauuaacuua

SEQ ID NO: 752672 - RNA, 22 nt, Human
gacgugcaagccaaguaggaua

SEQ ID NO: 752673 - RNA, 23 nt, Human
gaggacuccagggagucaccgaa

SEQ ID NO: 752674 - RNA, 20 nt, Human
gaucuuccggcccaagaugu

SEQ ID NO: 752675 - RNA, 23 nt, Human
gaucuuccggcccaagauguugg

SEQ ID NO: 752676 - RNA, 25 nt, Human
gcucgcuggccuccgauggcuuccc

SEQ ID NO: 752677 - RNA, 20 nt, Human
gcucuagggauggagcuagu

SEQ ID NO: 752678 - RNA, 26 nt, Human
gcugaucugcagccuggcugacuuca

SEQ ID NO: 752679 - RNA, 23 nt, Human
gcuugggcuggggcaggcggcuc

SEQ ID NO: 752680 - RNA, 19 nt, Human
ggaauguggggcccaacgg

SEQ ID NO: 752681 - RNA, 19 nt, Human
ggcaccaggacuugcaccc

SEQ ID NO: 752682 - RNA, 21 nt, Human
ggcccucccgcuccugcuggc

SEQ ID NO: 752683 - RNA, 23 nt, Human
ggcucuccuccccaucacucucc

SEQ ID NO: 752684 - RNA, 21 nt, Human
gggcuggggcaggcggcucuc

SEQ ID NO: 752685 - RNA, 19 nt, Human
gggggcacgcagccccagg

SEQ ID NO: 752686 - RNA, 22 nt, Human
uacaaaaaguucacugaaucag

SEQ ID NO: 752687 - RNA, 22 nt, Human
uauaaggaucauacagugaauu

SEQ ID NO: 752688 - RNA, 26 nt, Human
uauauacaugcacccgaagacgugca

SEQ ID NO: 752689 - RNA, 23 nt, Human
uauuacaggcacauuuacuguuu

SEQ ID NO: 752690 - RNA, 22 nt, Human
ucacuacaaaaaguucacugaa

SEQ ID NO: 752691 - RNA, 23 nt, Human
ucaguggaggacuccagggaguc

SEQ ID NO: 752692 - RNA, 25 nt, Human
ucauucuagaaacaucucaguuuca

SEQ ID NO: 752693 - RNA, 22 nt, Human
uccaccguccgcucuagccgcu

SEQ ID NO: 752694 - RNA, 22 nt, Human
uccacucuaauucaacauggaa

SEQ ID NO: 752695 - RNA, 20 nt, Human
ucccgggccuucaggagcuc

SEQ ID NO: 752696 - RNA, 23 nt, Human
uccuagccagcccggcucccggg

SEQ ID NO: 752697 - RNA, 22 nt, Human
uccuccugcaggggggccccac

SEQ ID NO: 752698 - RNA, 18 nt, Human
uccucuucuacaaacugc

SEQ ID NO: 752699 - RNA, 18 nt, Human
uccuguauccccuccagc

SEQ ID NO: 752700 - RNA, 21 nt, Human
ucggagauggaccuccggagc

SEQ ID NO: 752701 - RNA, 23 nt, Human
ucggccucccgggugcugggggg

SEQ ID NO: 752702 - RNA, 21 nt, Human
ucgggccuggagaagcagggc

SEQ ID NO: 752703 - RNA, 20 nt, Human
ucgggcggcuccucgccacc

SEQ ID NO: 752704 - RNA, 20 nt, Human
ucgguguggcugcuccucgg

SEQ ID NO: 752705 - RNA, 25 nt, Human
ucugcagccuggcugacuucagcuc

SEQ ID NO: 752706 - RNA, 22 nt, Human
ugagaaaacuagaucucuccug

SEQ ID NO: 752707 - RNA, 22 nt, Human
ugagaaaacuagaucucuccug

SEQ ID NO: 752708 - RNA, 20 nt, Human
ugagcucgugggucaguugc

SEQ ID NO: 752709 - RNA, 22 nt, Human
ugagcucgugggucaguugccg

SEQ ID NO: 752710 - RNA, 20 nt, Human
ugaggcagugggggaaugug

SEQ ID NO: 752711 - RNA, 22 nt, Human
ugaggcagugggggaauguggg

SEQ ID NO: 752712 - RNA, 20 nt, Human
uggcggcggagcucagugga

SEQ ID NO: 752713 - RNA, 18 nt, Human
uggggcccaacgggacgg

SEQ ID NO: 752714 - RNA, 20 nt, Human
uguguaaaaaagauggagac

SEQ ID NO: 752715 - RNA, 20 nt, Human
uguucagaaucucuuaaaau

SEQ ID NO: 752716 - RNA, 19 nt, Human
uucagcucggccucccggg

SEQ ID NO: 752717 - RNA, 21 nt, Human
uuccuccuccaccagcuuuag

SEQ ID NO: 752718 - RNA, 20 nt, Human
uugaccuugagaaaacuaga

SEQ ID NO: 752719 - RNA, 20 nt, Human
uugcugagcucgugggucag

SEQ ID NO: 752720 - RNA, 23 nt, Human
uuggcuuccuccuccaccagcuu

SEQ ID NO: 752721 - RNA, 23 nt, Human
uuucccuuaagaaaacuuugaga

SEQ ID NO: 752722 - RNA, 24 nt, Human
uuuucuaagcccacugaggacuuu

SEQ ID NO: 752723 - RNA, 28 nt, Human
aaaaaaaaaauucacaagaauacaaaaa

SEQ ID NO: 752724 - RNA, 22 nt, Human
aaaaaaaauucacaagaauaca

SEQ ID NO: 752725 - RNA, 21 nt, Human
aaaaucuuugaccugguacca

SEQ ID NO: 752726 - RNA, 18 nt, Human
aaccacugaagaauccca

SEQ ID NO: 752727 - RNA, 28 nt, Human
aagcagaugcacaccagagcacaucccc

SEQ ID NO: 752728 - RNA, 20 nt, Human
aaggagcagacgcagcgcga

SEQ ID NO: 752729 - RNA, 22 nt, Human
acaagcagaugcacaccagagc

SEQ ID NO: 752730 - RNA, 19 nt, Human
acacuucccagaaggcucc

SEQ ID NO: 752731 - RNA, 21 nt, Human
accaaacaacgcauggcccac

SEQ ID NO: 752732 - RNA, 21 nt, Human
accacugaagaaucccaggca

SEQ ID NO: 752733 - RNA, 22 nt, Human
accauucugaagacuagggcaa

SEQ ID NO: 752734 - RNA, 20 nt, Human
agcaaaguagaacaucgaag

SEQ ID NO: 752735 - RNA, 27 nt, Human
agcagaugcacaccagagcacaucccc

SEQ ID NO: 752736 - RNA, 21 nt, Human
aggaggaucggcggagaagcu

SEQ ID NO: 752737 - RNA, 21 nt, Human
aggcuguaccaucuaaaggca

SEQ ID NO: 752738 - RNA, 18 nt, Human
aucuaaaggcaugcaagg

SEQ ID NO: 752739 - RNA, 18 nt, Human
caccagagcacaucccca

SEQ ID NO: 752740 - RNA, 21 nt, Human
cacuucccagaaggcuccaaa

SEQ ID NO: 752741 - RNA, 21 nt, Human
ccacugaagaaucccaggcac

SEQ ID NO: 752742 - RNA, 21 nt, Human
cccaggcacacuucccagaag

SEQ ID NO: 752743 - RNA, 28 nt, Human
cccucugccggugcugcacauuuuugau

SEQ ID NO: 752744 - RNA, 20 nt, Human
ccgaagccccggcugaaggc

SEQ ID NO: 752745 - RNA, 25 nt, Human
ccugaaaccacugaagaaucccagg

SEQ ID NO: 752746 - RNA, 18 nt, Human
ccuggacguggccuagaa

SEQ ID NO: 752747 - RNA, 21 nt, Human
cguaucuucccucugccggug

SEQ ID NO: 752748 - RNA, 23 nt, Human
cuagaagagcugccugcuagaaa

SEQ ID NO: 752749 - RNA, 20 nt, Human
cugccugaaaccacugaaga

SEQ ID NO: 752750 - RNA, 23 nt, Human
cugggcaauagggacaaaaaaaa

SEQ ID NO: 752751 - RNA, 21 nt, Human
gacaagcagaugcacaccaga

SEQ ID NO: 752752 - RNA, 24 nt, Human
gcacauauauuuacaaugacaucc

SEQ ID NO: 752753 - RNA, 19 nt, Human
gcacugucucccgaagccc

SEQ ID NO: 752754 - RNA, 19 nt, Human
gcggagaagcucagcagag

SEQ ID NO: 752755 - RNA, 21 nt, Human
uaaaugcacauauauuuacaa

SEQ ID NO: 752756 - RNA, 18 nt, Human
uaagaccaaacaacgcau

SEQ ID NO: 752757 - RNA, 21 nt, Human
uaagucucugcccagauuuca

SEQ ID NO: 752758 - RNA, 22 nt, Human
uaauaagucucugcccagauuu

SEQ ID NO: 752759 - RNA, 18 nt, Human
uaccaucuaaaggcaugc

SEQ ID NO: 752760 - RNA, 24 nt, Human
uagggacaaaaaaaaaaauucaca

SEQ ID NO: 752761 - RNA, 23 nt, Human
uauaagaccaaacaacgcauggc

SEQ ID NO: 752762 - RNA, 19 nt, Human
ucaaagccccagucucaac

SEQ ID NO: 752763 - RNA, 24 nt, Human
ucauaaagaaagaguaaagcaaau

SEQ ID NO: 752764 - RNA, 18 nt, Human
uccaaaguuauuuuugcu

SEQ ID NO: 752765 - RNA, 24 nt, Human
uccaaaguuauuuuugcuccuugg

SEQ ID NO: 752766 - RNA, 21 nt, Human
ucgguggcugcacugucuccc

SEQ ID NO: 752767 - RNA, 21 nt, Human
ucuuccugacaagcagaugca

SEQ ID NO: 752768 - RNA, 21 nt, Human
ucuuugaccugguaccaguug

SEQ ID NO: 752769 - RNA, 18 nt, Human
ugaccugguaccaguugg

SEQ ID NO: 752770 - RNA, 20 nt, Human
ugcaaggagcagacgcagcg

SEQ ID NO: 752771 - RNA, 23 nt, Human
ugcaaucauaaagaaagaguaaa

SEQ ID NO: 752772 - RNA, 22 nt, Human
ugcccagauuucauccugaagu

SEQ ID NO: 752773 - RNA, 18 nt, Human
ugccugaaaccacugaag

SEQ ID NO: 752774 - RNA, 22 nt, Human
ugccugcuagaaaaggaggauc

SEQ ID NO: 752775 - RNA, 24 nt, Human
ugccugcuagaaaaggaggaucgg

SEQ ID NO: 752776 - RNA, 22 nt, Human
uggaaagcaaaguagaacaucg

SEQ ID NO: 752777 - RNA, 20 nt, Human
uggccuagaagagcugccug

SEQ ID NO: 752778 - RNA, 24 nt, Human
uuaagcagcaaugugacucuuccu

SEQ ID NO: 752779 - RNA, 19 nt, Human
agcuuggugggcaaccugc

SEQ ID NO: 752780 - RNA, 19 nt, Human
agugagguggggaggggcu

SEQ ID NO: 752781 - RNA, 23 nt, Human
ccacuuuggccaaccacccuccu

SEQ ID NO: 752782 - RNA, 18 nt, Human
ccucuuccuuuucccucc

SEQ ID NO: 752783 - RNA, 24 nt, Human
ccuuuucccuccugccaagugucc

SEQ ID NO: 752784 - RNA, 19 nt, Human
cuuuggccaaccacccucc

SEQ ID NO: 752785 - RNA, 20 nt, Human
guccucuuccuuuucccucc

SEQ ID NO: 752786 - RNA, 25 nt, Human
guccucuuccuuuucccuccugcca

SEQ ID NO: 752787 - RNA, 20 nt, Human
gugggcaaccugcugggggc

SEQ ID NO: 752788 - RNA, 21 nt, Human
ugagguggggaggggcucccu

SEQ ID NO: 752789 - RNA, 23 nt, Human
ugagguggggaggggcucccuag

SEQ ID NO: 752790 - RNA, 22 nt, Human
ugccaaguguccuauucucaaa

SEQ ID NO: 752791 - RNA, 18 nt, Human
uggggaggggcucccuag

SEQ ID NO: 752792 - RNA, 22 nt, Human
ugggguccucggaggcuagguu

SEQ ID NO: 752793 - RNA, 19 nt, Human
aaacccuccucuccccuuu

SEQ ID NO: 752794 - RNA, 19 nt, Human
aagcaaaaugcagcaaccc

SEQ ID NO: 752795 - RNA, 20 nt, Human
aagcugcauguggaccucca

SEQ ID NO: 752796 - RNA, 20 nt, Human
aaucuuaggcugggaggagg

SEQ ID NO: 752797 - RNA, 19 nt, Human
acacagggguucugggcag

SEQ ID NO: 752798 - RNA, 18 nt, Human
acacagguucuuugcucc

SEQ ID NO: 752799 - RNA, 19 nt, Human
acagucgggagcagaaggc

SEQ ID NO: 752800 - RNA, 20 nt, Human
accccaccccgauuagcuca

SEQ ID NO: 752801 - RNA, 19 nt, Human
accccuccugcguccuccu

SEQ ID NO: 752802 - RNA, 22 nt, Human
acugucaccuggggcuccccac

SEQ ID NO: 752803 - RNA, 25 nt, Human
agaaaaggagaccuuugccucacgu

SEQ ID NO: 752804 - RNA, 20 nt, Human
agaaaauggagcguugggug

SEQ ID NO: 752805 - RNA, 20 nt, Human
agauggaaucuagaaacccu

SEQ ID NO: 752806 - RNA, 19 nt, Human
agcaaaaugcagcaaccca

SEQ ID NO: 752807 - RNA, 19 nt, Human
agccugcuccacugcggga

SEQ ID NO: 752808 - RNA, 18 nt, Human
agcuagugauucggggcu

SEQ ID NO: 752809 - RNA, 21 nt, Human
agcuguacacagccaggcugg

SEQ ID NO: 752810 - RNA, 18 nt, Human
aggaaaaacacggaggaa

SEQ ID NO: 752811 - RNA, 24 nt, Human
aggaugacacagguucuuugcucc

SEQ ID NO: 752812 - RNA, 26 nt, Human
aggccucugcucccagcuggccccag

SEQ ID NO: 752813 - RNA, 19 nt, Human
aggcggaugccaacagaaa

SEQ ID NO: 752814 - RNA, 21 nt, Human
aggcggcuggagcgccccugg

SEQ ID NO: 752815 - RNA, 22 nt, Human
aggcggcuggagcgccccuggc

SEQ ID NO: 752816 - RNA, 21 nt, Human
agggaagacuuaacucuccga

SEQ ID NO: 752817 - RNA, 20 nt, Human
agggccgaaggcggcucugc

SEQ ID NO: 752818 - RNA, 19 nt, Human
agucgggagcagaaggcug

SEQ ID NO: 752819 - RNA, 21 nt, Human
aguuuagucagccuugagucu

SEQ ID NO: 752820 - RNA, 18 nt, Human
auggacaagcaccccacc

SEQ ID NO: 752821 - RNA, 21 nt, Human
auuuggccacuuaggguccag

SEQ ID NO: 752822 - RNA, 23 nt, Human
caaaacagaacggaaaugcaccc

SEQ ID NO: 752823 - RNA, 19 nt, Human
caaaaugcagcaacccaca

SEQ ID NO: 752824 - RNA, 23 nt, Human
caagcaaaaugcagcaacccaca

SEQ ID NO: 752825 - RNA, 21 nt, Human
cacagccagcaagcggcccag

SEQ ID NO: 752826 - RNA, 22 nt, Human
cacaugauuccagggucccacc

SEQ ID NO: 752827 - RNA, 23 nt, Human
cacccucaucacaugaguggucc

SEQ ID NO: 752828 - RNA, 23 nt, Human
caccuccaugucuccugugaugc

SEQ ID NO: 752829 - RNA, 21 nt, Human
cacuccuuccaagccacuuug

SEQ ID NO: 752830 - RNA, 18 nt, Human
cacugccuggccaggcgg

SEQ ID NO: 752831 - RNA, 18 nt, Human
caggcggaugccaacaga

SEQ ID NO: 752832 - RNA, 20 nt, Human
cauacacgccgugcugcucc

SEQ ID NO: 752833 - RNA, 18 nt, Human
caucaucugggcaggccu

SEQ ID NO: 752834 - RNA, 22 nt, Human
caucugggcaggccuggaagcc

SEQ ID NO: 752835 - RNA, 21 nt, Human
ccaaaacagaacggaaaugca

SEQ ID NO: 752836 - RNA, 18 nt, Human
ccagcuggccccagccca

SEQ ID NO: 752837 - RNA, 23 nt, Human
ccauacacgccgugcugcuccuc

SEQ ID NO: 752838 - RNA, 24 nt, Human
cccacaagccucaggccacagccu

SEQ ID NO: 752839 - RNA, 23 nt, Human
ccccuccugcguccuccuaauuu

SEQ ID NO: 752840 - RNA, 19 nt, Human
cccuccucuccccuuuuuu

SEQ ID NO: 752841 - RNA, 18 nt, Human
ccuccucccaggaggugg

SEQ ID NO: 752842 - RNA, 20 nt, Human
ccuggggcuccccacugcac

SEQ ID NO: 752843 - RNA, 21 nt, Human
ccuugagucugggcugcuccc

SEQ ID NO: 752844 - RNA, 24 nt, Human
cgcugaucugcuugagaggcacca

SEQ ID NO: 752845 - RNA, 22 nt, Human
cgucucagauaaccacugucac

SEQ ID NO: 752846 - RNA, 19 nt, Human
cuccugcguccuccuaauu

SEQ ID NO: 752847 - RNA, 20 nt, Human
cugccggggcuggaccgguu

SEQ ID NO: 752848 - RNA, 22 nt, Human
cugcgcacauucucacagcuug

SEQ ID NO: 752849 - RNA, 18 nt, Human
cuggagccucugguuccc

SEQ ID NO: 752850 - RNA, 19 nt, Human
cuggggugggcaugacugg

SEQ ID NO: 752851 - RNA, 22 nt, Human
cugucaccuggggcuccccacu

SEQ ID NO: 752852 - RNA, 23 nt, Human
cuuugcuccuuugcagcugggau

SEQ ID NO: 752853 - RNA, 20 nt, Human
gaaaaaaggggcacagccag

SEQ ID NO: 752854 - RNA, 20 nt, Human
gaaggaagggcgggagucgc

SEQ ID NO: 752855 - RNA, 20 nt, Human
gacaagcaccccaccccgau

SEQ ID NO: 752856 - RNA, 18 nt, Human
gagcagaaggcuggggcg

SEQ ID NO: 752857 - RNA, 23 nt, Human
gagcagcuucccucucuuaccaa

SEQ ID NO: 752858 - RNA, 20 nt, Human
gagcgccccuggcaggcggg

SEQ ID NO: 752859 - RNA, 22 nt, Human
gaggagaggucugggaaaggcc

SEQ ID NO: 752860 - RNA, 21 nt, Human
gcagccccggaccaggucgcg

SEQ ID NO: 752861 - RNA, 23 nt, Human
gcauaaaacagacccauucccuu

SEQ ID NO: 752862 - RNA, 18 nt, Human
gccuccggccugcccucc

SEQ ID NO: 752863 - RNA, 24 nt, Human
gccucugguucccggcuucacugg

SEQ ID NO: 752864 - RNA, 20 nt, Human
gccuuggaggggccaggccu

SEQ ID NO: 752865 - RNA, 20 nt, Human
gcggcucugccggggcugga

SEQ ID NO: 752866 - RNA, 18 nt, Human
gcuccuuugcagcuggga

SEQ ID NO: 752867 - RNA, 19 nt, Human
gcuguggaggaugccacag

SEQ ID NO: 752868 - RNA, 20 nt, Human
ggaauucucaccagccacau

SEQ ID NO: 752869 - RNA, 18 nt, Human
ggacaagcaccccacccc

SEQ ID NO: 752870 - RNA, 20 nt, Human
ggagagagauggcagcuucu

SEQ ID NO: 752871 - RNA, 21 nt, Human
ggagaggucugggaaaggcca

SEQ ID NO: 752872 - RNA, 18 nt, Human
ggaggaggggacagaaag

SEQ ID NO: 752873 - RNA, 20 nt, Human
ggcauucgaggagaggucug

SEQ ID NO: 752874 - RNA, 21 nt, Human
ggcucuccugcuacgucuggc

SEQ ID NO: 752875 - RNA, 18 nt, Human
ggcuggagggcagacccc

SEQ ID NO: 752876 - RNA, 19 nt, Human
gggaagcugcauguggacc

SEQ ID NO: 752877 - RNA, 20 nt, Human
ggggacagaaagcugugagg

SEQ ID NO: 752878 - RNA, 18 nt, Human
gggguuugaagauggaau

SEQ ID NO: 752879 - RNA, 23 nt, Human
gggguuugaagauggaaucuaga

SEQ ID NO: 752880 - RNA, 23 nt, Human
gggugaaucuuaggcugggagga

SEQ ID NO: 752881 - RNA, 22 nt, Human
gguggaggaggggacagaaagc

SEQ ID NO: 752882 - RNA, 18 nt, Human
gguguucggcuggagggc

SEQ ID NO: 752883 - RNA, 21 nt, Human
gguucugggcagcucccugau

SEQ ID NO: 752884 - RNA, 18 nt, Human
guacacagccaggcuggu

SEQ ID NO: 752885 - RNA, 18 nt, Human
guggaaaaaaggggcaca

SEQ ID NO: 752886 - RNA, 19 nt, Human
gugguuuggaugccacugc

SEQ ID NO: 752887 - RNA, 21 nt, Human
uaaaaaauaaguuaauugaca

SEQ ID NO: 752888 - RNA, 19 nt, Human
uaaggcugaccaggaccag

SEQ ID NO: 752889 - RNA, 23 nt, Human
uaaguaaagagaaaagaaaagga

SEQ ID NO: 752890 - RNA, 18 nt, Human
uaucauugcuggucaaaa

SEQ ID NO: 752891 - RNA, 25 nt, Human
ucaaaaucggccugaggauggccgc

SEQ ID NO: 752892 - RNA, 19 nt, Human
ucaccagccacaugauucc

SEQ ID NO: 752893 - RNA, 19 nt, Human
ucccagcuggccccagccc

SEQ ID NO: 752894 - RNA, 22 nt, Human
ucccccaaagucagcauuuucc

SEQ ID NO: 752895 - RNA, 22 nt, Human
ucccugaugccagccaggccag

SEQ ID NO: 752896 - RNA, 21 nt, Human
uccugggucucgaucgcaccc

SEQ ID NO: 752897 - RNA, 22 nt, Human
ucgcugggcuaugugcugacug

SEQ ID NO: 752898 - RNA, 21 nt, Human
ucuacuagaacuggguguccu

SEQ ID NO: 752899 - RNA, 24 nt, Human
ucuagaaacccuccucuccccuuu

SEQ ID NO: 752900 - RNA, 24 nt, Human
ucuagaaacccuccucuccccuuu

SEQ ID NO: 752901 - RNA, 20 nt, Human
ucucagauaaccacugucac

SEQ ID NO: 752902 - RNA, 23 nt, Human
ucucagauaaccacugucaccuu

SEQ ID NO: 752903 - RNA, 20 nt, Human
ucuccgagagaaaaccugcc

SEQ ID NO: 752904 - RNA, 21 nt, Human
ucugcaaaggcucggguccac

SEQ ID NO: 752905 - RNA, 24 nt, Human
ucugcuguuggccuggcccaaaac

SEQ ID NO: 752906 - RNA, 18 nt, Human
ugaagaagacagugcccc

SEQ ID NO: 752907 - RNA, 19 nt, Human
ugagugggagguccaggug

SEQ ID NO: 752908 - RNA, 23 nt, Human
ugagugggagguccaggugggcc

SEQ ID NO: 752909 - RNA, 18 nt, Human
ugccaggccuccucagau

SEQ ID NO: 752910 - RNA, 19 nt, Human
ugcuggggugggcaugacu

SEQ ID NO: 752911 - RNA, 20 nt, Human
uggcccaaaacagaacggaa

SEQ ID NO: 752912 - RNA, 21 nt, Human
uggcccaaaacagaacggaaa

SEQ ID NO: 752913 - RNA, 21 nt, Human
ugggaaaggccacgcaggcag

SEQ ID NO: 752914 - RNA, 19 nt, Human
ugggagagagauggcagcu

SEQ ID NO: 752915 - RNA, 18 nt, Human
ugggagguccaggugggc

SEQ ID NO: 752916 - RNA, 19 nt, Human
ugggaugaauguucaaguu

SEQ ID NO: 752917 - RNA, 24 nt, Human
ugggcagcucccugaugccagcca

SEQ ID NO: 752918 - RNA, 18 nt, Human
ugggcaggccuggaagcc

SEQ ID NO: 752919 - RNA, 24 nt, Human
ugugcugacugcuuugauggacaa

SEQ ID NO: 752920 - RNA, 21 nt, Human
uugacaaaaaggguuugaagc

SEQ ID NO: 752921 - RNA, 18 nt, Human
uuggaugccacugccugg

SEQ ID NO: 752922 - RNA, 18 nt, Human
uuugcaaacuguuucccu

SEQ ID NO: 752923 - RNA, 21 nt, Human
aaaaaucacuuccuagcaguc

SEQ ID NO: 752924 - RNA, 20 nt, Human
aaaauuugacccaaaaaagg

SEQ ID NO: 752925 - RNA, 19 nt, Human
aaagaggagcuaaauaggg

SEQ ID NO: 752926 - RNA, 19 nt, Human
aaauauccugauaccacac

SEQ ID NO: 752927 - RNA, 22 nt, Human
aaauccugaaagugccaagaag

SEQ ID NO: 752928 - RNA, 23 nt, Human
aacuuuuuuucccccaguuuggg

SEQ ID NO: 752929 - RNA, 26 nt, Human
aagcaaaagaaaaauuugacccaaaa

SEQ ID NO: 752930 - RNA, 21 nt, Human
aagcaagugccaaagaugaca

SEQ ID NO: 752931 - RNA, 24 nt, Human
aaguaaacauucuccaugucagcc

SEQ ID NO: 752932 - RNA, 21 nt, Human
aaguuucaccuacacagcacc

SEQ ID NO: 752933 - RNA, 22 nt, Human
acaaaaccacauuuagcacaaa

SEQ ID NO: 752934 - RNA, 24 nt, Human
acaaaaccacauuuagcacaaagc

SEQ ID NO: 752935 - RNA, 25 nt, Human
acagcaccacauaauuuuaaacaua

SEQ ID NO: 752936 - RNA, 24 nt, Human
acauaauuuuaaacauagcaacca

SEQ ID NO: 752937 - RNA, 19 nt, Human
accacacauacuaaguaca

SEQ ID NO: 752938 - RNA, 21 nt, Human
agacaacagaauuacugucau

SEQ ID NO: 752939 - RNA, 21 nt, Human
agacaagcaagcaaaacaaag

SEQ ID NO: 752940 - RNA, 24 nt, Human
agacgucggagcccgccgccagcc

SEQ ID NO: 752941 - RNA, 19 nt, Human
agagcaaacagugcagacu

SEQ ID NO: 752942 - RNA, 23 nt, Human
agauacaaaugucuauggacauu

SEQ ID NO: 752943 - RNA, 22 nt, Human
agcaaaacacaaaaccacauuu

SEQ ID NO: 752944 - RNA, 21 nt, Human
agcaagugccaaagaugacaa

SEQ ID NO: 752945 - RNA, 20 nt, Human
agccucuaaaagguuagcag

SEQ ID NO: 752946 - RNA, 24 nt, Human
aggaaauuaaaguuaaguuaacau

SEQ ID NO: 752947 - RNA, 18 nt, Human
aggcaaaugauccccaaa

SEQ ID NO: 752948 - RNA, 18 nt, Human
aggcaaaugauccccaaa

SEQ ID NO: 752949 - RNA, 23 nt, Human
aguaaagaacaaaaauguaccca

SEQ ID NO: 752950 - RNA, 20 nt, Human
auaaagccucuaaaagguua

SEQ ID NO: 752951 - RNA, 18 nt, Human
auaauuccaauuagagac

SEQ ID NO: 752952 - RNA, 24 nt, Human
aucuugcacauugguuccauucac

SEQ ID NO: 752953 - RNA, 23 nt, Human
augaguucaacaguuagagaccu

SEQ ID NO: 752954 - RNA, 18 nt, Human
caaaacucauggcuuaag

SEQ ID NO: 752955 - RNA, 23 nt, Human
caaaagaaaaauuugacccaaaa

SEQ ID NO: 752956 - RNA, 22 nt, Human
caaacugguagcagacaaggca

SEQ ID NO: 752957 - RNA, 24 nt, Human
caaagcaaaagaaaaauuugaccc

SEQ ID NO: 752958 - RNA, 20 nt, Human
caaaggaagaagcaaaggga

SEQ ID NO: 752959 - RNA, 21 nt, Human
caagcaagcaaaacaaaggcu

SEQ ID NO: 752960 - RNA, 24 nt, Human
cacacacaaauagcagugcauaua

SEQ ID NO: 752961 - RNA, 19 nt, Human
cagagguuuuacuucuuac

SEQ ID NO: 752962 - RNA, 20 nt, Human
caugcaauauuuagcaugug

SEQ ID NO: 752963 - RNA, 18 nt, Human
cauuaccauguugucaug

SEQ ID NO: 752964 - RNA, 19 nt, Human
ccaauauaccaguaugaac

SEQ ID NO: 752965 - RNA, 19 nt, Human
ccauagaggaaaaaugacu

SEQ ID NO: 752966 - RNA, 18 nt, Human
cccaaaaaagggaaagua

SEQ ID NO: 752967 - RNA, 18 nt, Human
ccgccgccagcccgccgc

SEQ ID NO: 752968 - RNA, 20 nt, Human
ccgccgccagcccgccgcuu

SEQ ID NO: 752969 - RNA, 21 nt, Human
ccgccgccagcccgccgcuug

SEQ ID NO: 752970 - RNA, 18 nt, Human
ccgcgcugcccuggcugc

SEQ ID NO: 752971 - RNA, 27 nt, Human
ccgcgcugcccuggcugcugcugcugc

SEQ ID NO: 752972 - RNA, 21 nt, Human
cgggcucagccagccaggucc

SEQ ID NO: 752973 - RNA, 20 nt, Human
cuagaaaacuuguccaaagc

SEQ ID NO: 752974 - RNA, 24 nt, Human
cuagaagacucauuugagcuuuuu

SEQ ID NO: 752975 - RNA, 27 nt, Human
cucacacauacacacauucuuacauau

SEQ ID NO: 752976 - RNA, 20 nt, Human
cugcugcugcugcgccgggg

SEQ ID NO: 752977 - RNA, 22 nt, Human
cuuacauauauacaaagacaca

SEQ ID NO: 752978 - RNA, 20 nt, Human
cuucaaacaaagcaaaagaa

SEQ ID NO: 752979 - RNA, 24 nt, Human
cuuuuauucacuguugcauaugcu

SEQ ID NO: 752980 - RNA, 23 nt, Human
gaaaguaaaaauagacaagcaag

SEQ ID NO: 752981 - RNA, 19 nt, Human
gacaccccuacucagugaa

SEQ ID NO: 752982 - RNA, 26 nt, Human
gcaaaagaaaaauuugacccaaaaaa

SEQ ID NO: 752983 - RNA, 19 nt, Human
gccgcgcugcccuggcugc

SEQ ID NO: 752984 - RNA, 18 nt, Human
gcucauauuaauuaaaga

SEQ ID NO: 752985 - RNA, 22 nt, Human
ggaaaauuuugaaauacagcaa

SEQ ID NO: 752986 - RNA, 18 nt, Human
ggccuggugugcaugcug

SEQ ID NO: 752987 - RNA, 19 nt, Human
gggaauccuaaaaacaaga

SEQ ID NO: 752988 - RNA, 24 nt, Human
guggauucagauacaaaugucuau

SEQ ID NO: 752989 - RNA, 21 nt, Human
uaaaaauagacaagcaagcaa

SEQ ID NO: 752990 - RNA, 19 nt, Human
uaaaaaugcaguauguauc

SEQ ID NO: 752991 - RNA, 24 nt, Human
uaaaacuauauuuaccuaucaaau

SEQ ID NO: 752992 - RNA, 21 nt, Human
uaaaagcaagugccaaagaug

SEQ ID NO: 752993 - RNA, 25 nt, Human
uaaagaacaaaaauguacccacaaa

SEQ ID NO: 752994 - RNA, 23 nt, Human
uaaagaaucagcagagaagacaa

SEQ ID NO: 752995 - RNA, 18 nt, Human
uaaagauaggucuccaga

SEQ ID NO: 752996 - RNA, 21 nt, Human
uaacaaaaaaagaagcuuuua

SEQ ID NO: 752997 - RNA, 21 nt, Human
uaacacaaaucaaguaguacu

SEQ ID NO: 752998 - RNA, 20 nt, Human
uaacagaaggaaaauuuuga

SEQ ID NO: 752999 - RNA, 23 nt, Human
uaauaauaguaaaacuggaguua

SEQ ID NO: 753000 - RNA, 20 nt, Human
uaauauacuuuagaauaaag

SEQ ID NO: 753001 - RNA, 24 nt, Human
uacauauauuuauauauauacaca

SEQ ID NO: 753002 - RNA, 20 nt, Human
uaccucgugcuucuggaaaa

SEQ ID NO: 753003 - RNA, 26 nt, Human
uacuagaguuucagacuucauucaac

SEQ ID NO: 753004 - RNA, 26 nt, Human
uagacaacagaauuacugucauccua

SEQ ID NO: 753005 - RNA, 25 nt, Human
uagagcaaacagugcagacuuuucc

SEQ ID NO: 753006 - RNA, 18 nt, Human
uagcacaaagccaaaccc

SEQ ID NO: 753007 - RNA, 21 nt, Human
uagcaugaagcaaaacacauu

SEQ ID NO: 753008 - RNA, 19 nt, Human
uagccuagaaaacuugucc

SEQ ID NO: 753009 - RNA, 20 nt, Human
uauaaaacacggcuaaaagc

SEQ ID NO: 753010 - RNA, 23 nt, Human
uauacaguuacacugagccuguu

SEQ ID NO: 753011 - RNA, 23 nt, Human
uauacauauauuuauauauauac

SEQ ID NO: 753012 - RNA, 27 nt, Human
uauuacugccuaagaucaguggaagga

SEQ ID NO: 753013 - RNA, 21 nt, Human
uauuuaccuaucaaauaaaca

SEQ ID NO: 753014 - RNA, 19 nt, Human
ucaauauaaccuaccauga

SEQ ID NO: 753015 - RNA, 21 nt, Human
ucaauauaaccuaccaugagg

SEQ ID NO: 753016 - RNA, 19 nt, Human
ucagaaaaauccacuacuu

SEQ ID NO: 753017 - RNA, 20 nt, Human
uccucucucuugcucucaca

SEQ ID NO: 753018 - RNA, 21 nt, Human
ucucauaucugaagaauuacg

SEQ ID NO: 753019 - RNA, 19 nt, Human
ucucuuauauuuucagcaa

SEQ ID NO: 753020 - RNA, 22 nt, Human
ucucuuauauuuucagcaaauu

SEQ ID NO: 753021 - RNA, 21 nt, Human
ucugaggagauuccugucacu

SEQ ID NO: 753022 - RNA, 18 nt, Human
ucuguuguauuaucacag

SEQ ID NO: 753023 - RNA, 27 nt, Human
ucuuacauauauacaaagacacacaca

SEQ ID NO: 753024 - RNA, 23 nt, Human
ucuucaaaaucaucuagauucau

SEQ ID NO: 753025 - RNA, 25 nt, Human
ucuuguauuuucugauuuuuaccaa

SEQ ID NO: 753026 - RNA, 27 nt, Human
ugaaauacagcaaaacacaaaaccagu

SEQ ID NO: 753027 - RNA, 19 nt, Human
ugaaauacugcaacuguaa

SEQ ID NO: 753028 - RNA, 19 nt, Human
ugaaauagugucaugggac

SEQ ID NO: 753029 - RNA, 26 nt, Human
ugacaaaugccauuguuuauuacugc

SEQ ID NO: 753030 - RNA, 19 nt, Human
ugaguuuccucucucuugc

SEQ ID NO: 753031 - RNA, 19 nt, Human
ugauuaacaaaaaaagaag

SEQ ID NO: 753032 - RNA, 18 nt, Human
ugcauauauuacauaugc

SEQ ID NO: 753033 - RNA, 22 nt, Human
ugccauuucuacugacuucauu

SEQ ID NO: 753034 - RNA, 21 nt, Human
ugcccuggcugcugcugcugc

SEQ ID NO: 753035 - RNA, 23 nt, Human
uggguguaaacuacacaggaaau

SEQ ID NO: 753036 - RNA, 22 nt, Human
ugguuggggggaauaauuuuua

SEQ ID NO: 753037 - RNA, 22 nt, Human
uguauaucaacuuggcuuuuua

SEQ ID NO: 753038 - RNA, 20 nt, Human
uuaaaugugauuaucccaua

SEQ ID NO: 753039 - RNA, 21 nt, Human
uuaaggaguccuaauuuuaaa

SEQ ID NO: 753040 - RNA, 24 nt, Human
uuacaaauuagcacguaaagagug

SEQ ID NO: 753041 - RNA, 19 nt, Human
uuacaguuacaucacagga

SEQ ID NO: 753042 - RNA, 23 nt, Human
uucaaagggagacauuucaguug

SEQ ID NO: 753043 - RNA, 21 nt, Human
uuggggcagugcaacuguggg

SEQ ID NO: 753044 - RNA, 25 nt, Human
uuuacaguuuauuuucccaaauccu

SEQ ID NO: 753045 - RNA, 23 nt, Human
uuucccccaguuugggguuuggg

SEQ ID NO: 753046 - RNA, 22 nt, Human
uuuuaaaacauuucauaaugag

SEQ ID NO: 753047 - RNA, 21 nt, Human
uuuuauaaaaagaucucacug

SEQ ID NO: 753048 - RNA, 25 nt, Human
aaaccaccagccaccaccgcccagu

SEQ ID NO: 753049 - RNA, 18 nt, Human
aaggagcuucagagaaag

SEQ ID NO: 753050 - RNA, 22 nt, Human
aaguucucccuccucacucccc

SEQ ID NO: 753051 - RNA, 19 nt, Human
accaccgcccagucccccu

SEQ ID NO: 753052 - RNA, 19 nt, Human
acccgggccccccgcccgg

SEQ ID NO: 753053 - RNA, 22 nt, Human
acccuggcaccucaggccccca

SEQ ID NO: 753054 - RNA, 20 nt, Human
acccugucugugaacccugg

SEQ ID NO: 753055 - RNA, 24 nt, Human
agagcccugcccaggguucccucc

SEQ ID NO: 753056 - RNA, 23 nt, Human
agcaauggggaaggaggaggaga

SEQ ID NO: 753057 - RNA, 19 nt, Human
agcgcaggaggaaccuguc

SEQ ID NO: 753058 - RNA, 22 nt, Human
agcgccucucuggggucggccc

SEQ ID NO: 753059 - RNA, 19 nt, Human
aggaggagagaggaaggag

SEQ ID NO: 753060 - RNA, 21 nt, Human
caagagcaaggggaaaggagc

SEQ ID NO: 753061 - RNA, 21 nt, Human
caagcccaggacccacucccc

SEQ ID NO: 753062 - RNA, 18 nt, Human
caccaccgcccagucccc

SEQ ID NO: 753063 - RNA, 20 nt, Human
caccacggccuggaccaccg

SEQ ID NO: 753064 - RNA, 19 nt, Human
caccagagcccugcccagg

SEQ ID NO: 753065 - RNA, 18 nt, Human
caccccugugggcugggg

SEQ ID NO: 753066 - RNA, 19 nt, Human
caccgcccagucccccugc

SEQ ID NO: 753067 - RNA, 26 nt, Human
caccgccgccgaccaaaaauuaggaa

SEQ ID NO: 753068 - RNA, 21 nt, Human
caccucaggcccccagguuag

SEQ ID NO: 753069 - RNA, 18 nt, Human
cacugcucccucugggug

SEQ ID NO: 753070 - RNA, 21 nt, Human
cagagcccugcccaggguucc

SEQ ID NO: 753071 - RNA, 21 nt, Human
cagccaccaccgcccaguccc

SEQ ID NO: 753072 - RNA, 22 nt, Human
cagcgugucucuccugcggcuc

SEQ ID NO: 753073 - RNA, 20 nt, Human
caggacccacuccccaggga

SEQ ID NO: 753074 - RNA, 24 nt, Human
caggcccccagguuagaguccccu

SEQ ID NO: 753075 - RNA, 19 nt, Human
caggguucccucccuggcc

SEQ ID NO: 753076 - RNA, 20 nt, Human
cagucccccugcccugcggc

SEQ ID NO: 753077 - RNA, 22 nt, Human
cagucccccugcccugcggccu

SEQ ID NO: 753078 - RNA, 20 nt, Human
caguggccugugcggggggc

SEQ ID NO: 753079 - RNA, 23 nt, Human
caucaccuggcaggcaccacggc

SEQ ID NO: 753080 - RNA, 18 nt, Human
cauugggugcacugggag

SEQ ID NO: 753081 - RNA, 20 nt, Human
ccaccagccacugccuccau

SEQ ID NO: 753082 - RNA, 24 nt, Human
cccacaggacugggaacugcccaa

SEQ ID NO: 753083 - RNA, 24 nt, Human
cccagcaccgccgccgaccaaaaa

SEQ ID NO: 753084 - RNA, 18 nt, Human
ccccagauagccgagccc

SEQ ID NO: 753085 - RNA, 19 nt, Human
ccccgcccggcacaucucc

SEQ ID NO: 753086 - RNA, 20 nt, Human
ccccgcccggcacaucuccc

SEQ ID NO: 753087 - RNA, 24 nt, Human
ccccucccugcccaggaaacuaaa

SEQ ID NO: 753088 - RNA, 18 nt, Human
ccccuggcccagcaccgc

SEQ ID NO: 753089 - RNA, 25 nt, Human
cccggagccggggcuggggggaagc

SEQ ID NO: 753090 - RNA, 20 nt, Human
cccucucccaccagagcccu

SEQ ID NO: 753091 - RNA, 23 nt, Human
cccugcccaggguucccucccug

SEQ ID NO: 753092 - RNA, 23 nt, Human
ccggagcucucaguggccugugc

SEQ ID NO: 753093 - RNA, 19 nt, Human
ccggcagcauuucuggcug

SEQ ID NO: 753094 - RNA, 19 nt, Human
ccucacuacacuuccccca

SEQ ID NO: 753095 - RNA, 20 nt, Human
ccuggccugggccaccagcc

SEQ ID NO: 753096 - RNA, 20 nt, Human
cggcccagcgugucucuccu

SEQ ID NO: 753097 - RNA, 23 nt, Human
cggccuccgugucccuuccuucc

SEQ ID NO: 753098 - RNA, 23 nt, Human
cggccuuuucccagucuccaggg

SEQ ID NO: 753099 - RNA, 19 nt, Human
cucacuacacuucccccaa

SEQ ID NO: 753100 - RNA, 22 nt, Human
cucacuacacuucccccaaaua

SEQ ID NO: 753101 - RNA, 23 nt, Human
cuccccugggguccucugggcuc

SEQ ID NO: 753102 - RNA, 21 nt, Human
cucccucucccaccagagccc

SEQ ID NO: 753103 - RNA, 18 nt, Human
cucugggcuccuccucac

SEQ ID NO: 753104 - RNA, 23 nt, Human
cugccccucccugcccaggaaac

SEQ ID NO: 753105 - RNA, 19 nt, Human
gaagcugccccucccugcc

SEQ ID NO: 753106 - RNA, 24 nt, Human
gacccaaaaucugcuccccagaua

SEQ ID NO: 753107 - RNA, 18 nt, Human
gagccggggcugggggga

SEQ ID NO: 753108 - RNA, 21 nt, Human
gagccggggcuggggggaagc

SEQ ID NO: 753109 - RNA, 20 nt, Human
gaguaagagggcccccuagg

SEQ ID NO: 753110 - RNA, 24 nt, Human
gagucgccccaagggaggggguca

SEQ ID NO: 753111 - RNA, 21 nt, Human
gcccaggacccacuccccagg

SEQ ID NO: 753112 - RNA, 18 nt, Human
gcccaggguucccucccu

SEQ ID NO: 753113 - RNA, 22 nt, Human
gcccaggguucccucccuggcc

SEQ ID NO: 753114 - RNA, 21 nt, Human
gcgaacccgggccccccgccc

SEQ ID NO: 753115 - RNA, 20 nt, Human
gcggccuuuucccagucucc

SEQ ID NO: 753116 - RNA, 22 nt, Human
gcggcucggcgaacccgggccc

SEQ ID NO: 753117 - RNA, 20 nt, Human
ggaaggaggaggagagagga

SEQ ID NO: 753118 - RNA, 24 nt, Human
ggaggagagaggaaggaguaagag

SEQ ID NO: 753119 - RNA, 24 nt, Human
ggcagccgggugcguguccggagc

SEQ ID NO: 753120 - RNA, 20 nt, Human
ggcucggcgaacccgggccc

SEQ ID NO: 753121 - RNA, 21 nt, Human
gggaaggaggaggagagagga

SEQ ID NO: 753122 - RNA, 22 nt, Human
gggaggcagagggggcagguuu

SEQ ID NO: 753123 - RNA, 23 nt, Human
gggcagggaccaagagcaagggg

SEQ ID NO: 753124 - RNA, 18 nt, Human
gggcggccuccguguccc

SEQ ID NO: 753125 - RNA, 19 nt, Human
gggcugggggcccugcggg

SEQ ID NO: 753126 - RNA, 21 nt, Human
ggggacuguagggcccauggc

SEQ ID NO: 753127 - RNA, 23 nt, Human
gguaggagguggcgggacgaggg

SEQ ID NO: 753128 - RNA, 20 nt, Human
gucccuuccuuccccuggcc

SEQ ID NO: 753129 - RNA, 18 nt, Human
gugcguguggcugguggg

SEQ ID NO: 753130 - RNA, 20 nt, Human
uaaagcccucauuucccuuc

SEQ ID NO: 753131 - RNA, 26 nt, Human
uaacagguuccauccagugggggccu

SEQ ID NO: 753132 - RNA, 21 nt, Human
uacagcaauggggaaggagga

SEQ ID NO: 753133 - RNA, 30 nt, Human
uagggaaagauccaagcccaggacccacuu

SEQ ID NO: 753134 - RNA, 27 nt, Human
ucacuacacuucccccaaagggcccuc

SEQ ID NO: 753135 - RNA, 22 nt, Human
ucauugggugcacugggaggca

SEQ ID NO: 753136 - RNA, 19 nt, Human
uccccagauagccgagccc

SEQ ID NO: 753137 - RNA, 21 nt, Human
uccccagauagccgagcccac

SEQ ID NO: 753138 - RNA, 20 nt, Human
uccccuggcccagcaccgcc

SEQ ID NO: 753139 - RNA, 22 nt, Human
uccucugggcuccuccucacua

SEQ ID NO: 753140 - RNA, 19 nt, Human
ucucccggagccggggcug

SEQ ID NO: 753141 - RNA, 19 nt, Human
ucucuggggucggcccagc

SEQ ID NO: 753142 - RNA, 19 nt, Human
ugcccaggaaacuaaagcc

SEQ ID NO: 753143 - RNA, 25 nt, Human
ugcccugcggccuuuucccagucuc

SEQ ID NO: 753144 - RNA, 25 nt, Human
ugccuccaucugucucccucuccca

SEQ ID NO: 753145 - RNA, 22 nt, Human
ugcggagaggagcagcuaacag

SEQ ID NO: 753146 - RNA, 21 nt, Human
ugcguguggcuggugggaaac

SEQ ID NO: 753147 - RNA, 26 nt, Human
uggaagugggcugcacccuuccaagu

SEQ ID NO: 753148 - RNA, 24 nt, Human
uggcugaggggcaccuggagagag

SEQ ID NO: 753149 - RNA, 21 nt, Human
uggcugcggagaggagcagcu

SEQ ID NO: 753150 - RNA, 20 nt, Human
uggcuggugggaaacccugu

SEQ ID NO: 753151 - RNA, 19 nt, Human
ugggaggcagagggggcag

SEQ ID NO: 753152 - RNA, 20 nt, Human
ugggaggcagagggggcagg

SEQ ID NO: 753153 - RNA, 19 nt, Human
uggggaaggaggaggagag

SEQ ID NO: 753154 - RNA, 19 nt, Human
uguccggagcucucagugg

SEQ ID NO: 753155 - RNA, 22 nt, Human
uuaggaaaaaaaaaaaaaaaaa

SEQ ID NO: 753156 - RNA, 23 nt, Human
uuccaaguucucccuccucacuc

SEQ ID NO: 753157 - RNA, 22 nt, Human
uuuuuuuuuuucuuuuccauuu

SEQ ID NO: 753158 - RNA, 23 nt, Human
aaaaaaaaaagauauuuucaaag

SEQ ID NO: 753159 - RNA, 25 nt, Human
aaaaauauauucucuccaaaggaau

SEQ ID NO: 753160 - RNA, 24 nt, Human
aaagugcugggauuacaggcguga

SEQ ID NO: 753161 - RNA, 23 nt, Human
aacaaaaguaagcccaaugccau

SEQ ID NO: 753162 - RNA, 18 nt, Human
aacauuuuaaaaagagau

SEQ ID NO: 753163 - RNA, 24 nt, Human
aaccuuuggagaugacauaaaaug

SEQ ID NO: 753164 - RNA, 21 nt, Human
aagaaaacugauucagaaaac

SEQ ID NO: 753165 - RNA, 20 nt, Human
aaggagaauggacggcaaag

SEQ ID NO: 753166 - RNA, 19 nt, Human
aagugcugggauuacaggc

SEQ ID NO: 753167 - RNA, 19 nt, Human
aagugcugggauuacaggc

SEQ ID NO: 753168 - RNA, 24 nt, Human
aauggcgucuuggcucacugccau

SEQ ID NO: 753169 - RNA, 18 nt, Human
aauucagguuccaaagca

SEQ ID NO: 753170 - RNA, 24 nt, Human
aauuuuguauuuuuaguagaaacg

SEQ ID NO: 753171 - RNA, 18 nt, Human
acagcagugaaguuuuaa

SEQ ID NO: 753172 - RNA, 18 nt, Human
acucauugcccaggcugg

SEQ ID NO: 753173 - RNA, 21 nt, Human
acucauugcccaggcuggggu

SEQ ID NO: 753174 - RNA, 28 nt, Human
acucauugcccaggcuggggugcaaugg

SEQ ID NO: 753175 - RNA, 20 nt, Human
acuggucccuggugccaaaa

SEQ ID NO: 753176 - RNA, 20 nt, Human
agaaaacaaaaguaagccca

SEQ ID NO: 753177 - RNA, 20 nt, Human
agaaucacaaaauacuuuuc

SEQ ID NO: 753178 - RNA, 20 nt, Human
agacuacaucagaaacacaa

SEQ ID NO: 753179 - RNA, 18 nt, Human
agaguugaaaggagaaug

SEQ ID NO: 753180 - RNA, 18 nt, Human
agcugagguaauguaugc

SEQ ID NO: 753181 - RNA, 19 nt, Human
aggagaauggacggcaaag

SEQ ID NO: 753182 - RNA, 20 nt, Human
aggagaauggacggcaaagg

SEQ ID NO: 753183 - RNA, 25 nt, Human
aggagcacaaauccuauugugaacu

SEQ ID NO: 753184 - RNA, 19 nt, Human
aggcuggggugcaauggcg

SEQ ID NO: 753185 - RNA, 23 nt, Human
aguagcugggauugcaggcacau

SEQ ID NO: 753186 - RNA, 24 nt, Human
agugauucuccugccucagccucc

SEQ ID NO: 753187 - RNA, 18 nt, Human
agugcugggauuacaggc

SEQ ID NO: 753188 - RNA, 24 nt, Human
auaaaguuaucuauugcuaguuua

SEQ ID NO: 753189 - RNA, 19 nt, Human
auagaacaaagacagccuu

SEQ ID NO: 753190 - RNA, 20 nt, Human
auagcagcuuuauucaucga

SEQ ID NO: 753191 - RNA, 18 nt, Human
aucuaccuauacuauggc

SEQ ID NO: 753192 - RNA, 19 nt, Human
auggagccuaggaaauauu

SEQ ID NO: 753193 - RNA, 19 nt, Human
auucaauaaagacuacauc

SEQ ID NO: 753194 - RNA, 22 nt, Human
auuguuagcaaauuuauuucuu

SEQ ID NO: 753195 - RNA, 20 nt, Human
caaaacauaaucugugauaa

SEQ ID NO: 753196 - RNA, 20 nt, Human
caaaauacuuuucacaucuu

SEQ ID NO: 753197 - RNA, 23 nt, Human
caacauagaacaaagacagccuu

SEQ ID NO: 753198 - RNA, 23 nt, Human
caaccuccaccucccggguucaa

SEQ ID NO: 753199 - RNA, 18 nt, Human
caagaagcaguaagggaa

SEQ ID NO: 753200 - RNA, 20 nt, Human
caagugauucuccugccuca

SEQ ID NO: 753201 - RNA, 22 nt, Human
caagugauucuccugccucagc

SEQ ID NO: 753202 - RNA, 19 nt, Human
cacgacaaaaagcagguca

SEQ ID NO: 753203 - RNA, 21 nt, Human
cacugcaaccuccaccucccg

SEQ ID NO: 753204 - RNA, 23 nt, Human
cacugcaaccuccaccucccggg

SEQ ID NO: 753205 - RNA, 19 nt, Human
cagaaacuuuaaaugacag

SEQ ID NO: 753206 - RNA, 20 nt, Human
cagccuccugaguagcuggg

SEQ ID NO: 753207 - RNA, 24 nt, Human
cagcucuuacuuccccagaaacaa

SEQ ID NO: 753208 - RNA, 22 nt, Human
caggcacaugccaccaugccca

SEQ ID NO: 753209 - RNA, 23 nt, Human
cauagaacaaagacagccuuuca

SEQ ID NO: 753210 - RNA, 18 nt, Human
ccaaagcaggauaaaaga

SEQ ID NO: 753211 - RNA, 22 nt, Human
ccaaagugcugggauuacaggc

SEQ ID NO: 753212 - RNA, 22 nt, Human
ccaaagugcugggauuacaggc

SEQ ID NO: 753213 - RNA, 24 nt, Human
ccaaagugcugggauuacaggcgu

SEQ ID NO: 753214 - RNA, 18 nt, Human
cccaagaaucacaaaaua

SEQ ID NO: 753215 - RNA, 22 nt, Human
cccaggcuggggugcaauggcg

SEQ ID NO: 753216 - RNA, 24 nt, Human
ccccagaaacaacuaaaaucagca

SEQ ID NO: 753217 - RNA, 23 nt, Human
cccggguucaagugauucuccuc

SEQ ID NO: 753218 - RNA, 23 nt, Human
cccggguucaagugauucuccug

SEQ ID NO: 753219 - RNA, 18 nt, Human
ccuauacuauggcgcagg

SEQ ID NO: 753220 - RNA, 18 nt, Human
ccucauuuacaagccugu

SEQ ID NO: 753221 - RNA, 24 nt, Human
ccucccggguucaagugauucucc

SEQ ID NO: 753222 - RNA, 23 nt, Human
ccugaguagcugggauugcaggc

SEQ ID NO: 753223 - RNA, 24 nt, Human
ccugaguagcugggauugcaggca

SEQ ID NO: 753224 - RNA, 22 nt, Human
ccuuauacaucugaagaaaauc

SEQ ID NO: 753225 - RNA, 25 nt, Human
cuaaaaucagcagaggguggcagaa

SEQ ID NO: 753226 - RNA, 18 nt, Human
cucaauagcaaaacauaa

SEQ ID NO: 753227 - RNA, 24 nt, Human
cucacugcaaccuccaccucccgg

SEQ ID NO: 753228 - RNA, 24 nt, Human
cucagccuccugaguagcugggau

SEQ ID NO: 753229 - RNA, 21 nt, Human
cucauaaccacugcagguauc

SEQ ID NO: 753230 - RNA, 24 nt, Human
cucauugcccaggcuggggugcaa

SEQ ID NO: 753231 - RNA, 24 nt, Human
cuccauguuggucaagcuggucuc

SEQ ID NO: 753232 - RNA, 20 nt, Human
cucccggguucaagugauuc

SEQ ID NO: 753233 - RNA, 22 nt, Human
cuccugguggaaaaacugucuu

SEQ ID NO: 753234 - RNA, 18 nt, Human
cugcaaccuccaccuccc

SEQ ID NO: 753235 - RNA, 23 nt, Human
cugcaaccuccaccucccggguu

SEQ ID NO: 753236 - RNA, 24 nt, Human
cugcaaccuccaccucccggguuc

SEQ ID NO: 753237 - RNA, 23 nt, Human
cugccucagccuccugaguagcu

SEQ ID NO: 753238 - RNA, 19 nt, Human
cuggucccuggugccaaaa

SEQ ID NO: 753239 - RNA, 21 nt, Human
cuggugccaaaaauguugggg

SEQ ID NO: 753240 - RNA, 21 nt, Human
gagcaaaagaagcuagacaca

SEQ ID NO: 753241 - RNA, 21 nt, Human
gagcaacaacuuguauaaagg

SEQ ID NO: 753242 - RNA, 19 nt, Human
gaggugagcagcagguggg

SEQ ID NO: 753243 - RNA, 20 nt, Human
gaggugagcagcaggugggu

SEQ ID NO: 753244 - RNA, 25 nt, Human
gaguagcugggauugcaggcacaug

SEQ ID NO: 753245 - RNA, 18 nt, Human
gauuacaggcgugagcca

SEQ ID NO: 753246 - RNA, 21 nt, Human
gauuacaggcgugagccacca

SEQ ID NO: 753247 - RNA, 24 nt, Human
gauuacaggcgugagccaccaugc

SEQ ID NO: 753248 - RNA, 22 nt, Human
gauugcaggcacaugccaccau

SEQ ID NO: 753249 - RNA, 20 nt, Human
gcccaaugccauuaucgguc

SEQ ID NO: 753250 - RNA, 24 nt, Human
gcccaggcuggggugcaauggcgu

SEQ ID NO: 753251 - RNA, 18 nt, Human
gcugaauaaaugcaccca

SEQ ID NO: 753252 - RNA, 21 nt, Human
ggaaaaacugucuuccacaaa

SEQ ID NO: 753253 - RNA, 19 nt, Human
ggaaaaauauauucucucc

SEQ ID NO: 753254 - RNA, 19 nt, Human
ggaagcaagaagcaguaag

SEQ ID NO: 753255 - RNA, 24 nt, Human
ggauuacaggcgugagccaccaug

SEQ ID NO: 753256 - RNA, 18 nt, Human
gggauugcaggcacaugc

SEQ ID NO: 753257 - RNA, 20 nt, Human
ggggaggguuugcucacuac

SEQ ID NO: 753258 - RNA, 22 nt, Human
ggguucaagugauucuccugcc

SEQ ID NO: 753259 - RNA, 23 nt, Human
ggguucaagugauucuccugccu

SEQ ID NO: 753260 - RNA, 24 nt, Human
gguaauagagacaaucacuguguc

SEQ ID NO: 753261 - RNA, 20 nt, Human
ggucauaauaauaaaugccc

SEQ ID NO: 753262 - RNA, 19 nt, Human
ggugggugagcauuacugc

SEQ ID NO: 753263 - RNA, 18 nt, Human
gucaaagaugguucaaga

SEQ ID NO: 753264 - RNA, 23 nt, Human
gugauucuccugccucagccucc

SEQ ID NO: 753265 - RNA, 20 nt, Human
gugcaauggcgucuuggcuc

SEQ ID NO: 753266 - RNA, 25 nt, Human
uaaaaucagcagagggugacguagc

SEQ ID NO: 753267 - RNA, 21 nt, Human
uaaaggucuuuaugaggcuga

SEQ ID NO: 753268 - RNA, 20 nt, Human
uaaaugacagauuuggacuu

SEQ ID NO: 753269 - RNA, 23 nt, Human
uaaaugcacccaagaaucacaaa

SEQ ID NO: 753270 - RNA, 19 nt, Human
uaagaaggggaaugguucc

SEQ ID NO: 753271 - RNA, 19 nt, Human
uaagaaggggaaugguucc

SEQ ID NO: 753272 - RNA, 18 nt, Human
uaauagagacaaucacug

SEQ ID NO: 753273 - RNA, 21 nt, Human
uaauuuuguauuuuuaguaga

SEQ ID NO: 753274 - RNA, 18 nt, Human
uacaggcgugagccacca

SEQ ID NO: 753275 - RNA, 21 nt, Human
uacaggcgugagccaccaugc

SEQ ID NO: 753276 - RNA, 23 nt, Human
uacaggcgugagccaccaugcuu

SEQ ID NO: 753277 - RNA, 23 nt, Human
uacaucagaaacacaacaagcuu

SEQ ID NO: 753278 - RNA, 27 nt, Human
uaccuaggaauaugcccuuccuuuggg

SEQ ID NO: 753279 - RNA, 19 nt, Human
uagcugaaggaagaagaac

SEQ ID NO: 753280 - RNA, 19 nt, Human
uaggaagguaaggcacugu

SEQ ID NO: 753281 - RNA, 24 nt, Human
uauauagauuucuauuuauaugaa

SEQ ID NO: 753282 - RNA, 22 nt, Human
uauggucauaauaauaaaugcc

SEQ ID NO: 753283 - RNA, 26 nt, Human
ucaaaaguaaacuaucacgacaaaaa

SEQ ID NO: 753284 - RNA, 20 nt, Human
ucaaauauacaaccugcacu

SEQ ID NO: 753285 - RNA, 19 nt, Human
ucaagugauucuccugccu

SEQ ID NO: 753286 - RNA, 23 nt, Human
ucacugcaaccuccaccucccgg

SEQ ID NO: 753287 - RNA, 24 nt, Human
ucacugcaaccuccaccucccggg

SEQ ID NO: 753288 - RNA, 25 nt, Human
ucacugcaaccuccaccucccgggu

SEQ ID NO: 753289 - RNA, 27 nt, Human
ucacugcaaccuccaccucccggguuc

SEQ ID NO: 753290 - RNA, 20 nt, Human
ucagccuccugaguagcugg

SEQ ID NO: 753291 - RNA, 19 nt, Human
uccauguuggucaagcugg

SEQ ID NO: 753292 - RNA, 21 nt, Human
ucccaaagguugggagaaagu

SEQ ID NO: 753293 - RNA, 24 nt, Human
ucccaaagugcugggauuacaggc

SEQ ID NO: 753294 - RNA, 19 nt, Human
uccccagaaacaacuaaaa

SEQ ID NO: 753295 - RNA, 21 nt, Human
ucccccuccugguggaaaaac

SEQ ID NO: 753296 - RNA, 21 nt, Human
ucccggguucaagugauucuc

SEQ ID NO: 753297 - RNA, 24 nt, Human
ucccggguucaagugauucuccug

SEQ ID NO: 753298 - RNA, 21 nt, Human
ucccuugcaucuugucccaaa

SEQ ID NO: 753299 - RNA, 24 nt, Human
uccugaguagcugggauugcaggc

SEQ ID NO: 753300 - RNA, 21 nt, Human
uccugguggaaaaacugucuu

SEQ ID NO: 753301 - RNA, 24 nt, Human
ucuccugccucagccuccugagua

SEQ ID NO: 753302 - RNA, 21 nt, Human
ucugaccauguaggggagggu

SEQ ID NO: 753303 - RNA, 22 nt, Human
ucuuccacaaaacuggucccug

SEQ ID NO: 753304 - RNA, 22 nt, Human
ucuugguuguuugcuccuuaug

SEQ ID NO: 753305 - RNA, 21 nt, Human
ucuuuguccuuuuacccuaaa

SEQ ID NO: 753306 - RNA, 24 nt, Human
ugaaauccauuuauaucuucuagg

SEQ ID NO: 753307 - RNA, 28 nt, Human
ugaauaaaugcacccaagaaucacaaaa

SEQ ID NO: 753308 - RNA, 19 nt, Human
ugacaaaaggcucagaaua

SEQ ID NO: 753309 - RNA, 26 nt, Human
ugacuguaaaacagcuagaaugauau

SEQ ID NO: 753310 - RNA, 20 nt, Human
ugagcagaaauaaacuaauu

SEQ ID NO: 753311 - RNA, 21 nt, Human
ugagcagcaggugggugagca

SEQ ID NO: 753312 - RNA, 20 nt, Human
ugagcauuacugcuugagcu

SEQ ID NO: 753313 - RNA, 20 nt, Human
ugauucuccugccucagccu

SEQ ID NO: 753314 - RNA, 18 nt, Human
ugcccaggcuggggugca

SEQ ID NO: 753315 - RNA, 21 nt, Human
ugcccaggcuggggugcaaug

SEQ ID NO: 753316 - RNA, 23 nt, Human
ugcccuuccuuugggaagcaaga

SEQ ID NO: 753317 - RNA, 24 nt, Human
ugccucagccuccugaguagcugg

SEQ ID NO: 753318 - RNA, 22 nt, Human
ugccuuaggagagaggagaucu

SEQ ID NO: 753319 - RNA, 23 nt, Human
ugcugaauaaaugcacccaagaa

SEQ ID NO: 753320 - RNA, 24 nt, Human
ugcugggauuacaggcgugagcca

SEQ ID NO: 753321 - RNA, 23 nt, Human
uggagcaacaacuuguauaaagg

SEQ ID NO: 753322 - RNA, 19 nt, Human
uggcaacuaggagauaaca

SEQ ID NO: 753323 - RNA, 18 nt, Human
ugggaagcaagaagcagu

SEQ ID NO: 753324 - RNA, 22 nt, Human
ugggagaaaguuaagaaaacug

SEQ ID NO: 753325 - RNA, 18 nt, Human
ugggauuacaggcgugag

SEQ ID NO: 753326 - RNA, 22 nt, Human
ugggauuacaggcgugagccac

SEQ ID NO: 753327 - RNA, 23 nt, Human
ugggauuacaggcgugagccacc

SEQ ID NO: 753328 - RNA, 24 nt, Human
ugggauuacaggcgugagccacca

SEQ ID NO: 753329 - RNA, 25 nt, Human
ugggauuacaggcgugagccaccau

SEQ ID NO: 753330 - RNA, 21 nt, Human
ugggauugcaggcacaugcca

SEQ ID NO: 753331 - RNA, 22 nt, Human
ugggauugcaggcacaugccac

SEQ ID NO: 753332 - RNA, 24 nt, Human
ugggauugcaggcacaugccacca

SEQ ID NO: 753333 - RNA, 25 nt, Human
ugggauugcaggcacaugccaccau

SEQ ID NO: 753334 - RNA, 20 nt, Human
uggggcaacccaucaaaacu

SEQ ID NO: 753335 - RNA, 20 nt, Human
uggggcaacccaucaaaacu

SEQ ID NO: 753336 - RNA, 21 nt, Human
uggggugcaauggcgucuugg

SEQ ID NO: 753337 - RNA, 21 nt, Human
uggucaagcuggucucaaacu

SEQ ID NO: 753338 - RNA, 18 nt, Human
uggugccaaaaauguugg

SEQ ID NO: 753339 - RNA, 19 nt, Human
uguaaaacagcuagaauga

SEQ ID NO: 753340 - RNA, 20 nt, Human
uguacuuauagcuuuuguag

SEQ ID NO: 753341 - RNA, 19 nt, Human
uguauaaaggagaagggag

SEQ ID NO: 753342 - RNA, 20 nt, Human
ugugagaaaauccagcucuu

SEQ ID NO: 753343 - RNA, 18 nt, Human
uguuggggacugcugccu

SEQ ID NO: 753344 - RNA, 19 nt, Human
uguuugcuccuuaugagaa

SEQ ID NO: 753345 - RNA, 20 nt, Human
uucaaguaauaucuggagga

SEQ ID NO: 753346 - RNA, 21 nt, Human
uucaagugauucuccugccuc

SEQ ID NO: 753347 - RNA, 23 nt, Human
uucaagugauucuccugccucag

SEQ ID NO: 753348 - RNA, 24 nt, Human
uucaagugauucuccugccucagc

SEQ ID NO: 753349 - RNA, 19 nt, Human
uucagaaaacaaaaguaag

SEQ ID NO: 753350 - RNA, 22 nt, Human
uucagaaaacaaaaguaagccc

SEQ ID NO: 753351 - RNA, 21 nt, Human
uuucuccauguuggucaagcu

SEQ ID NO: 753352 - RNA, 19 nt, Human
uuugaaguucugccccuuu

SEQ ID NO: 753353 - RNA, 19 nt, Human
uuuggccucccaaagugcu

SEQ ID NO: 753354 - RNA, 18 nt, Human
uuuuguauuuuuaguaga

SEQ ID NO: 753355 - RNA, 25 nt, Human
aaaaaaacccaaacccuuaucccac

SEQ ID NO: 753356 - RNA, 20 nt, Human
aaaaaacaaaaaaacccaaa

SEQ ID NO: 753357 - RNA, 21 nt, Human
aaaaaacccaaacccuuaucc

SEQ ID NO: 753358 - RNA, 22 nt, Human
aaaaaacccaaacccuuauccc

SEQ ID NO: 753359 - RNA, 21 nt, Human
aaaaacaaaaaaacccaaacc

SEQ ID NO: 753360 - RNA, 22 nt, Human
aaaaagcaaauaucaacugaaa

SEQ ID NO: 753361 - RNA, 22 nt, Human
aaaacccaaacccuuaucccac

SEQ ID NO: 753362 - RNA, 27 nt, Human
aaacaaaaaaacccaaacccuuauccc

SEQ ID NO: 753363 - RNA, 23 nt, Human
aaacacaaaaagcaaauaucaac

SEQ ID NO: 753364 - RNA, 22 nt, Human
aaacuguuaaagguuauuacuu

SEQ ID NO: 753365 - RNA, 22 nt, Human
aaagcaaauaucaacugaaagg

SEQ ID NO: 753366 - RNA, 25 nt, Human
aaagcaaauaucaacugaaagguuu

SEQ ID NO: 753367 - RNA, 20 nt, Human
aaauaaacacaaaaagcaaa

SEQ ID NO: 753368 - RNA, 20 nt, Human
aacugcuagaaauccaagca

SEQ ID NO: 753369 - RNA, 21 nt, Human
aacuguuguuccuuagacucu

SEQ ID NO: 753370 - RNA, 22 nt, Human
aagaaaaacagaggacaguaag

SEQ ID NO: 753371 - RNA, 19 nt, Human
aauagacuuaguuacauau

SEQ ID NO: 753372 - RNA, 20 nt, Human
acacuguaaucauucauucu

SEQ ID NO: 753373 - RNA, 27 nt, Human
acauauccauacaucccaacucacaca

SEQ ID NO: 753374 - RNA, 21 nt, Human
acaugaaagaaucucacaaaa

SEQ ID NO: 753375 - RNA, 20 nt, Human
acaugaggcaaucugucagu

SEQ ID NO: 753376 - RNA, 20 nt, Human
accaaaaaacaaaaaaaccc

SEQ ID NO: 753377 - RNA, 22 nt, Human
accuugaaaauaugacuaucac

SEQ ID NO: 753378 - RNA, 20 nt, Human
acuaaugcccauauuuacaa

SEQ ID NO: 753379 - RNA, 27 nt, Human
acuacauucuuuuuuuuuuuuuuucuu

SEQ ID NO: 753380 - RNA, 20 nt, Human
agacuucaaagccugcaagu

SEQ ID NO: 753381 - RNA, 24 nt, Human
agauguuuuuuucuuucagaucuu

SEQ ID NO: 753382 - RNA, 22 nt, Human
agcaaauaucaacugaaagguu

SEQ ID NO: 753383 - RNA, 21 nt, Human
agccucauuucaccugcuuuu

SEQ ID NO: 753384 - RNA, 21 nt, Human
aucacuuuuagcccuuuucuu

SEQ ID NO: 753385 - RNA, 22 nt, Human
augaauaccuaaaacaugaaag

SEQ ID NO: 753386 - RNA, 19 nt, Human
auggugugcacagugccuu

SEQ ID NO: 753387 - RNA, 22 nt, Human
auguaaagugugauguaucucu

SEQ ID NO: 753388 - RNA, 19 nt, Human
caacugcuagaaauccaag

SEQ ID NO: 753389 - RNA, 23 nt, Human
caauugcagguuagguuuucaac

SEQ ID NO: 753390 - RNA, 23 nt, Human
cacaccccccaagaaaagguagu

SEQ ID NO: 753391 - RNA, 21 nt, Human
cacacuguaaucauucauucu

SEQ ID NO: 753392 - RNA, 23 nt, Human
caccaaacauccauaccuugaaa

SEQ ID NO: 753393 - RNA, 18 nt, Human
cagaccaaaaaacaaaaa

SEQ ID NO: 753394 - RNA, 23 nt, Human
cagaccaaaaaacaaaaaaaccc

SEQ ID NO: 753395 - RNA, 28 nt, Human
ccaaacauccauaccuugaaaauaugac

SEQ ID NO: 753396 - RNA, 22 nt, Human
ccacaccccccaagaaaaggua

SEQ ID NO: 753397 - RNA, 19 nt, Human
cccaacucacacacacaua

SEQ ID NO: 753398 - RNA, 22 nt, Human
cccacacccaaaaguuuuaaau

SEQ ID NO: 753399 - RNA, 23 nt, Human
ccccacacccaaaaguuuuaaau

SEQ ID NO: 753400 - RNA, 18 nt, Human
cccucucugccugcccca

SEQ ID NO: 753401 - RNA, 18 nt, Human
ccugccccacacccaaaa

SEQ ID NO: 753402 - RNA, 25 nt, Human
cgucaugaauaccuaaaacaugaaa

SEQ ID NO: 753403 - RNA, 19 nt, Human
cuaacauuuacauacuaug

SEQ ID NO: 753404 - RNA, 25 nt, Human
cucacaaaauaccuauagaauuaaa

SEQ ID NO: 753405 - RNA, 19 nt, Human
cugaauaaagauacaaaaa

SEQ ID NO: 753406 - RNA, 20 nt, Human
cugcaggcaucuacuuuggu

SEQ ID NO: 753407 - RNA, 23 nt, Human
cuuauacagaccaaaaaacaaaa

SEQ ID NO: 753408 - RNA, 20 nt, Human
gaaacuugcaaguggcaguu

SEQ ID NO: 753409 - RNA, 19 nt, Human
gaaagagaaagaucgucau

SEQ ID NO: 753410 - RNA, 20 nt, Human
gacaccaucccucucugccu

SEQ ID NO: 753411 - RNA, 23 nt, Human
gaccaaaaaacaaaaaaacccaa

SEQ ID NO: 753412 - RNA, 24 nt, Human
gaggguaagaaaaacagaggacag

SEQ ID NO: 753413 - RNA, 21 nt, Human
gcaggguccacaccccccaag

SEQ ID NO: 753414 - RNA, 21 nt, Human
ggccauuauugcaaacauucu

SEQ ID NO: 753415 - RNA, 22 nt, Human
guaaagcuaagcauuucauuuc

SEQ ID NO: 753416 - RNA, 24 nt, Human
gucucuacaguuucuauauggagu

SEQ ID NO: 753417 - RNA, 23 nt, Human
uaaaaaguagaugcugccagaaa

SEQ ID NO: 753418 - RNA, 18 nt, Human
uaaaauacaacacaaacc

SEQ ID NO: 753419 - RNA, 18 nt, Human
uaaaaugaaacagccuug

SEQ ID NO: 753420 - RNA, 25 nt, Human
uaaacacaaaaagcaaauaucaacu

SEQ ID NO: 753421 - RNA, 21 nt, Human
uaaauaaacacaaaaagcaaa

SEQ ID NO: 753422 - RNA, 24 nt, Human
uaaauaaacacaaaaagcaaauau

SEQ ID NO: 753423 - RNA, 18 nt, Human
uaagaaaaacagaggaca

SEQ ID NO: 753424 - RNA, 22 nt, Human
uaagcacugaucagagaacuga

SEQ ID NO: 753425 - RNA, 23 nt, Human
uaaugcacuugagcauacguagu

SEQ ID NO: 753426 - RNA, 23 nt, Human
uacagaccaaaaaacaaaaaaac

SEQ ID NO: 753427 - RNA, 18 nt, Human
uaccagaacaccaucaaa

SEQ ID NO: 753428 - RNA, 22 nt, Human
uacuaaugcccauauuuacaaa

SEQ ID NO: 753429 - RNA, 18 nt, Human
uacuggaaauguuuaacu

SEQ ID NO: 753430 - RNA, 20 nt, Human
uagccccagguuucuuuagg

SEQ ID NO: 753431 - RNA, 27 nt, Human
uauacagaccaaaaaacaaaaaaaccc

SEQ ID NO: 753432 - RNA, 21 nt, Human
uauauuaauagacuuaguuac

SEQ ID NO: 753433 - RNA, 20 nt, Human
uauugcauguuuugguaguc

SEQ ID NO: 753434 - RNA, 22 nt, Human
ucaaaaaauacagugauuauga

SEQ ID NO: 753435 - RNA, 19 nt, Human
uccaauggugugcacagug

SEQ ID NO: 753436 - RNA, 24 nt, Human
uccucugccgccaucugcugaaga

SEQ ID NO: 753437 - RNA, 20 nt, Human
ucucugcaggcaucuacuuu

SEQ ID NO: 753438 - RNA, 22 nt, Human
ucugccugccccacacccaaaa

SEQ ID NO: 753439 - RNA, 23 nt, Human
ucugccugccccacacccaaaag

SEQ ID NO: 753440 - RNA, 22 nt, Human
ucuuuagcuuuguacaccuauu

SEQ ID NO: 753441 - RNA, 20 nt, Human
ucuuucaaaucaggaguugu

SEQ ID NO: 753442 - RNA, 21 nt, Human
ugagcagcauuccaauaacgu

SEQ ID NO: 753443 - RNA, 18 nt, Human
ugaucagagaacugagca

SEQ ID NO: 753444 - RNA, 21 nt, Human
ugggacuacauucuuuuuuuu

SEQ ID NO: 753445 - RNA, 18 nt, Human
uuacauauaaauaaacac

SEQ ID NO: 753446 - RNA, 18 nt, Human
uuaguuaucaacaaucau

SEQ ID NO: 753447 - RNA, 21 nt, Human
uucaagaagguaacauuugaa

SEQ ID NO: 753448 - RNA, 26 nt, Human
uucaagaagguaacauuugaaagguu

SEQ ID NO: 753449 - RNA, 25 nt, Human
uucagcuaaaaugaaacagccuuga

SEQ ID NO: 753450 - RNA, 19 nt, Human
uuccauugcagaaaggcuc

SEQ ID NO: 753451 - RNA, 19 nt, Human
uucuucacgcaguuauugu

SEQ ID NO: 753452 - RNA, 21 nt, Human
uugcagugcucuuuuaggcau

SEQ ID NO: 753453 - RNA, 20 nt, Human
uuguuccuuagacucuaugg

SEQ ID NO: 753454 - RNA, 26 nt, Human
uuuuucuuucuuuucuuacaaaaugc

SEQ ID NO: 753455 - RNA, 25 nt, Human
aaaaaagaaaacugaauaucuccau

SEQ ID NO: 753456 - RNA, 19 nt, Human
aaaagaaagaaagaaggca

SEQ ID NO: 753457 - RNA, 19 nt, Human
aaaguuccacuucccuacu

SEQ ID NO: 753458 - RNA, 21 nt, Human
aaauaaccuaacacacagggu

SEQ ID NO: 753459 - RNA, 23 nt, Human
aacaaaccugagaguguuaaaaa

SEQ ID NO: 753460 - RNA, 26 nt, Human
aacaaaugucugacaaauaccaaaac

SEQ ID NO: 753461 - RNA, 20 nt, Human
aacacuggcaaccuaacuua

SEQ ID NO: 753462 - RNA, 20 nt, Human
aacauagugaaacccugucu

SEQ ID NO: 753463 - RNA, 21 nt, Human
aacauagugaaacccugucuc

SEQ ID NO: 753464 - RNA, 24 nt, Human
aagaaaacugaauaucuccauuaa

SEQ ID NO: 753465 - RNA, 19 nt, Human
aagaacuguagucuauggg

SEQ ID NO: 753466 - RNA, 24 nt, Human
aagcugaggcaggaggauugcuug

SEQ ID NO: 753467 - RNA, 22 nt, Human
aagcuuugcaggaguauguggu

SEQ ID NO: 753468 - RNA, 22 nt, Human
aauuuuccuuuauugaaaaagc

SEQ ID NO: 753469 - RNA, 19 nt, Human
acaaagagauaaguagccu

SEQ ID NO: 753470 - RNA, 25 nt, Human
accacacucugggccaacacuacag

SEQ ID NO: 753471 - RNA, 23 nt, Human
accccauuucuuuccuuccucag

SEQ ID NO: 753472 - RNA, 18 nt, Human
agaagccccguguggccc

SEQ ID NO: 753473 - RNA, 19 nt, Human
agaaggcaaaaaagugcca

SEQ ID NO: 753474 - RNA, 20 nt, Human
agaaucaucaaauggaagag

SEQ ID NO: 753475 - RNA, 19 nt, Human
agaccccugguaggcacag

SEQ ID NO: 753476 - RNA, 19 nt, Human
agacuaacucuuagaacca

SEQ ID NO: 753477 - RNA, 23 nt, Human
agagaggucaucugaaacucaga

SEQ ID NO: 753478 - RNA, 21 nt, Human
agcagguuaugauuuuugguc

SEQ ID NO: 753479 - RNA, 22 nt, Human
agccugggcaacauagugaaac

SEQ ID NO: 753480 - RNA, 24 nt, Human
agccugggcaacauagugaaaccc

SEQ ID NO: 753481 - RNA, 24 nt, Human
agccugggcaacauagugaaaccc

SEQ ID NO: 753482 - RNA, 20 nt, Human
aggaguuugagaccagccug

SEQ ID NO: 753483 - RNA, 24 nt, Human
aggauugcuugagcccaggaguuu

SEQ ID NO: 753484 - RNA, 27 nt, Human
aggcaaaaggaagaacugaagggaccc

SEQ ID NO: 753485 - RNA, 28 nt, Human
aggcaaaaggaagaacugaauggcuuag

SEQ ID NO: 753486 - RNA, 24 nt, Human
aggcacgguagcacacaccugugg

SEQ ID NO: 753487 - RNA, 23 nt, Human
aggcaggaggauugcuugagccc

SEQ ID NO: 753488 - RNA, 18 nt, Human
aggguagagggaauaaug

SEQ ID NO: 753489 - RNA, 24 nt, Human
aguaagcuccagagagcaaggcuu

SEQ ID NO: 753490 - RNA, 22 nt, Human
auaaaaugucacgcugcccaca

SEQ ID NO: 753491 - RNA, 24 nt, Human
auauauguauauauagaguuuaga

SEQ ID NO: 753492 - RNA, 21 nt, Human
aucccccuaagucccuggaaa

SEQ ID NO: 753493 - RNA, 25 nt, Human
augacaaggaaguaaaacuaugggu

SEQ ID NO: 753494 - RNA, 24 nt, Human
auugcuugagcccaggaguuugag

SEQ ID NO: 753495 - RNA, 25 nt, Human
caaaugaugcacugggagcaguaac

SEQ ID NO: 753496 - RNA, 21 nt, Human
caacauagugaaacccugucu

SEQ ID NO: 753497 - RNA, 22 nt, Human
caacauagugaaacccugucuc

SEQ ID NO: 753498 - RNA, 24 nt, Human
caacauagugaaacccugucucua

SEQ ID NO: 753499 - RNA, 23 nt, Human
caaccaccggcucagacuccagc

SEQ ID NO: 753500 - RNA, 24 nt, Human
caagcugagaaaagcaggugcuga

SEQ ID NO: 753501 - RNA, 24 nt, Human
caccugugguuccagcuacucagg

SEQ ID NO: 753502 - RNA, 25 nt, Human
cagaaucaucaaauggaagagguua

SEQ ID NO: 753503 - RNA, 21 nt, Human
cagacuaacucuuagaaccaa

SEQ ID NO: 753504 - RNA, 23 nt, Human
cagaggcaaauaacucaucaugg

SEQ ID NO: 753505 - RNA, 20 nt, Human
cagccugggcaacauaguga

SEQ ID NO: 753506 - RNA, 18 nt, Human
caggaaguuucaggaagc

SEQ ID NO: 753507 - RNA, 19 nt, Human
cagggcaguaaccacacuc

SEQ ID NO: 753508 - RNA, 25 nt, Human
caguccagacuaacucuuagaacca

SEQ ID NO: 753509 - RNA, 19 nt, Human
cauugcucugauuccaagg

SEQ ID NO: 753510 - RNA, 18 nt, Human
ccaaacggccucacccgg

SEQ ID NO: 753511 - RNA, 18 nt, Human
ccagucaaacugcaaugg

SEQ ID NO: 753512 - RNA, 23 nt, Human
cccuaagucccuggaaaaguaug

SEQ ID NO: 753513 - RNA, 21 nt, Human
ccuaagauagaacccaaauac

SEQ ID NO: 753514 - RNA, 20 nt, Human
ccuacuuccgaaaguaaggu

SEQ ID NO: 753515 - RNA, 24 nt, Human
ccuaucccccuaagucccuggaaa

SEQ ID NO: 753516 - RNA, 22 nt, Human
ccugggcaacauagugaaaccc

SEQ ID NO: 753517 - RNA, 24 nt, Human
ccugggcaacauagugaaacccug

SEQ ID NO: 753518 - RNA, 21 nt, Human
cugagaaacagcagguuauga

SEQ ID NO: 753519 - RNA, 18 nt, Human
cuggauuagaaagacagc

SEQ ID NO: 753520 - RNA, 22 nt, Human
gaagagaaucaggaugggaagg

SEQ ID NO: 753521 - RNA, 26 nt, Human
gaagagaaucaggaugggaagguuuu

SEQ ID NO: 753522 - RNA, 18 nt, Human
gaaucccuggacuaacuc

SEQ ID NO: 753523 - RNA, 21 nt, Human
gagguagaagaagagaaucag

SEQ ID NO: 753524 - RNA, 18 nt, Human
gauagggagggaggagag

SEQ ID NO: 753525 - RNA, 22 nt, Human
gauugcuugagcccaggaguuu

SEQ ID NO: 753526 - RNA, 24 nt, Human
gauugcuugagcccaggaguuuga

SEQ ID NO: 753527 - RNA, 22 nt, Human
gcccaggaguuugagaccagcc

SEQ ID NO: 753528 - RNA, 21 nt, Human
ggaaacaaacaaaccugagag

SEQ ID NO: 753529 - RNA, 24 nt, Human
ggagggaggagagcagagggaagg

SEQ ID NO: 753530 - RNA, 22 nt, Human
ggauugcuugagcccaggaguu

SEQ ID NO: 753531 - RNA, 18 nt, Human
gggaagguuuuggugauc

SEQ ID NO: 753532 - RNA, 22 nt, Human
gguagcacacaccugugguucc

SEQ ID NO: 753533 - RNA, 24 nt, Human
gguagcacacaccugugguuccag

SEQ ID NO: 753534 - RNA, 19 nt, Human
guaggcacagcacagcuga

SEQ ID NO: 753535 - RNA, 21 nt, Human
gucaccuuggucuugagacuu

SEQ ID NO: 753536 - RNA, 19 nt, Human
gucacgcugcccacaccac

SEQ ID NO: 753537 - RNA, 19 nt, Human
gugaaaagaaaagaaagaa

SEQ ID NO: 753538 - RNA, 23 nt, Human
uaaaagcuuugcaggaguaugug

SEQ ID NO: 753539 - RNA, 22 nt, Human
uaaaauggacauaaauauucaa

SEQ ID NO: 753540 - RNA, 18 nt, Human
uaaaaugucacgcugccc

SEQ ID NO: 753541 - RNA, 20 nt, Human
uaacucaucaugggcagcaa

SEQ ID NO: 753542 - RNA, 21 nt, Human
uaagaaggcaaaaaagugcca

SEQ ID NO: 753543 - RNA, 18 nt, Human
uacagaaucaucaaaugg

SEQ ID NO: 753544 - RNA, 23 nt, Human
uacauagucauuauugcugaucu

SEQ ID NO: 753545 - RNA, 18 nt, Human
uaccaaaguuccacuucc

SEQ ID NO: 753546 - RNA, 19 nt, Human
uaccaaaguuccacuuccc

SEQ ID NO: 753547 - RNA, 24 nt, Human
uaccagcacauaguaagcuccaga

SEQ ID NO: 753548 - RNA, 24 nt, Human
uagcacacaccugugguuccagcu

SEQ ID NO: 753549 - RNA, 23 nt, Human
uagggagggaggagagcagaggg

SEQ ID NO: 753550 - RNA, 22 nt, Human
uagggccaguccagacuaacuc

SEQ ID NO: 753551 - RNA, 22 nt, Human
uauaaccaguacuugcugagac

SEQ ID NO: 753552 - RNA, 24 nt, Human
uauagauauauauauauauaugua

SEQ ID NO: 753553 - RNA, 20 nt, Human
uauauagauauauauauaua

SEQ ID NO: 753554 - RNA, 22 nt, Human
uauauagauauauauauauaua

SEQ ID NO: 753555 - RNA, 18 nt, Human
uauauauauguauauaua

SEQ ID NO: 753556 - RNA, 22 nt, Human
uaucccccuaagucccuggaaa

SEQ ID NO: 753557 - RNA, 21 nt, Human
uauuccuuaaaaauucugguu

SEQ ID NO: 753558 - RNA, 21 nt, Human
ucaaauggaagagguuaaauc

SEQ ID NO: 753559 - RNA, 18 nt, Human
ucacuacagcaaggcaga

SEQ ID NO: 753560 - RNA, 20 nt, Human
ucacuacagcaaggcagaau

SEQ ID NO: 753561 - RNA, 23 nt, Human
uccaaaaggaauccaauuuuugg

SEQ ID NO: 753562 - RNA, 18 nt, Human
uccaaagccuaucccccu

SEQ ID NO: 753563 - RNA, 21 nt, Human
uccaagaacuucucagaaaug

SEQ ID NO: 753564 - RNA, 23 nt, Human
uccacagaucagacugcagaucu

SEQ ID NO: 753565 - RNA, 20 nt, Human
uccacauauaauuugcuggu

SEQ ID NO: 753566 - RNA, 21 nt, Human
ucccccuaagucccuggaaaa

SEQ ID NO: 753567 - RNA, 21 nt, Human
ucccuggacuaacucgugagc

SEQ ID NO: 753568 - RNA, 22 nt, Human
ucccuggacuaacucgugagcc

SEQ ID NO: 753569 - RNA, 22 nt, Human
uccucagcccauccucuguggc

SEQ ID NO: 753570 - RNA, 19 nt, Human
uccuuaaaaauucugguuu

SEQ ID NO: 753571 - RNA, 20 nt, Human
ucugguuugaguuacaggaa

SEQ ID NO: 753572 - RNA, 22 nt, Human
ucuucacuacagcaaggcagaa

SEQ ID NO: 753573 - RNA, 18 nt, Human
ucuuuccuuccucagccc

SEQ ID NO: 753574 - RNA, 18 nt, Human
ucuuucuucuuaaugguu

SEQ ID NO: 753575 - RNA, 23 nt, Human
ugaaaaaaagaaaacugaauauc

SEQ ID NO: 753576 - RNA, 24 nt, Human
ugaaaaagcuuaaugcaacaaugc

SEQ ID NO: 753577 - RNA, 18 nt, Human
ugagaaaaccacaggagc

SEQ ID NO: 753578 - RNA, 22 nt, Human
ugagaaaagcaggugcugaaaa

SEQ ID NO: 753579 - RNA, 20 nt, Human
ugagaccaacagaucagucu

SEQ ID NO: 753580 - RNA, 24 nt, Human
ugagaccagccugggcaacauagu

SEQ ID NO: 753581 - RNA, 23 nt, Human
ugagaguauaugugaagaccagu

SEQ ID NO: 753582 - RNA, 22 nt, Human
ugagauagugccaaucuggagg

SEQ ID NO: 753583 - RNA, 23 nt, Human
ugagcccaggaguuugagaccag

SEQ ID NO: 753584 - RNA, 23 nt, Human
ugaggcaaacagucauuuacccc

SEQ ID NO: 753585 - RNA, 24 nt, Human
ugaggcaggaggauugcuugagcc

SEQ ID NO: 753586 - RNA, 25 nt, Human
ugaggcaggaggauugcuugagccc

SEQ ID NO: 753587 - RNA, 19 nt, Human
ugauuggagaagcagcuug

SEQ ID NO: 753588 - RNA, 25 nt, Human
ugcaacaaugcauuuugauuccuuu

SEQ ID NO: 753589 - RNA, 18 nt, Human
ugcugguguugccuauuu

SEQ ID NO: 753590 - RNA, 18 nt, Human
ugcuugagcccaggaguu

SEQ ID NO: 753591 - RNA, 26 nt, Human
ugcuuuguuaggguaucaagcuguga

SEQ ID NO: 753592 - RNA, 21 nt, Human
uggaggggcuuccuuggaaac

SEQ ID NO: 753593 - RNA, 22 nt, Human
uggaggggcuuccuuggaaacu

SEQ ID NO: 753594 - RNA, 19 nt, Human
ugggaaacaaacaaaccug

SEQ ID NO: 753595 - RNA, 23 nt, Human
ugggaaacaaacaaaccugagag

SEQ ID NO: 753596 - RNA, 24 nt, Human
ugggcaacauagugaaacccuguc

SEQ ID NO: 753597 - RNA, 22 nt, Human
uggugaucuuuagaaguguuau

SEQ ID NO: 753598 - RNA, 20 nt, Human
ugucacgcugcccacaccac

SEQ ID NO: 753599 - RNA, 21 nt, Human
ugucacgcugcccacaccaca

SEQ ID NO: 753600 - RNA, 24 nt, Human
uuaaguaccagcacauaguaagcu

SEQ ID NO: 753601 - RNA, 19 nt, Human
uuauuccagaaaacuccag

SEQ ID NO: 753602 - RNA, 19 nt, Human
uucaaggagaagaaaggag

SEQ ID NO: 753603 - RNA, 21 nt, Human
uuccaaggguagagggaauaa

SEQ ID NO: 753604 - RNA, 24 nt, Human
uuccagcuacucaggaagcugagg

SEQ ID NO: 753605 - RNA, 22 nt, Human
uugagcccaggaguuugagacc

SEQ ID NO: 753606 - RNA, 21 nt, Human
uugcuugagcccaggaguuug

SEQ ID NO: 753607 - RNA, 24 nt, Human
uuuacaauuucaucucuguauccc

SEQ ID NO: 753608 - RNA, 19 nt, Human
uuugcugagaaacagcagg

SEQ ID NO: 753609 - RNA, 19 nt, Human
aaaacaagcagacaucccc

SEQ ID NO: 753610 - RNA, 19 nt, Human
aaacaacguuggcuccuaa

SEQ ID NO: 753611 - RNA, 18 nt, Human
aaacacacuguaaaaaua

SEQ ID NO: 753612 - RNA, 20 nt, Human
aaagagcaaugggaagaaca

SEQ ID NO: 753613 - RNA, 23 nt, Human
aaagggacauccaaacuuuaugc

SEQ ID NO: 753614 - RNA, 25 nt, Human
aaauaccagugcauuucaggugguc

SEQ ID NO: 753615 - RNA, 18 nt, Human
aagaagccguuuggaugc

SEQ ID NO: 753616 - RNA, 24 nt, Human
aagcagacauccccaccaaaggcc

SEQ ID NO: 753617 - RNA, 19 nt, Human
aagugcugaugcugaguga

SEQ ID NO: 753618 - RNA, 18 nt, Human
aauaaagggacauccaaa

SEQ ID NO: 753619 - RNA, 25 nt, Human
acaauggaaaagagaaguguccaaa

SEQ ID NO: 753620 - RNA, 22 nt, Human
acagaaacccauuguaaagaca

SEQ ID NO: 753621 - RNA, 21 nt, Human
acaugccaaauccaacugcuu

SEQ ID NO: 753622 - RNA, 18 nt, Human
accucaaagcccagcgua

SEQ ID NO: 753623 - RNA, 19 nt, Human
acugcuuugucagggccug

SEQ ID NO: 753624 - RNA, 18 nt, Human
acugugcuggguacuuau

SEQ ID NO: 753625 - RNA, 19 nt, Human
acuuauuucaugcauuaga

SEQ ID NO: 753626 - RNA, 20 nt, Human
acuuuuugcuuuauuguccc

SEQ ID NO: 753627 - RNA, 18 nt, Human
agccacacuaguagcuca

SEQ ID NO: 753628 - RNA, 20 nt, Human
aggaaaucuugccauggucc

SEQ ID NO: 753629 - RNA, 19 nt, Human
aggaagaggcuaaucccaa

SEQ ID NO: 753630 - RNA, 25 nt, Human
aggcuaaucccaaggccucagaaca

SEQ ID NO: 753631 - RNA, 19 nt, Human
aggcuucccuaauuuccau

SEQ ID NO: 753632 - RNA, 21 nt, Human
augguccagagaggcaacuga

SEQ ID NO: 753633 - RNA, 20 nt, Human
caaaacaaccauuuagggac

SEQ ID NO: 753634 - RNA, 18 nt, Human
caaacucuguuaugccac

SEQ ID NO: 753635 - RNA, 22 nt, Human
caagaagccguuuggaugcugu

SEQ ID NO: 753636 - RNA, 30 nt, Human
caagcagacauccccaccaaaggccaaaaa

SEQ ID NO: 753637 - RNA, 19 nt, Human
cacacaugccaaauccaac

SEQ ID NO: 753638 - RNA, 22 nt, Human
caccuacuaagagcagggcugu

SEQ ID NO: 753639 - RNA, 21 nt, Human
cacuacgcagccgagcagggu

SEQ ID NO: 753640 - RNA, 24 nt, Human
cagaaacccauuguaaagacaaac

SEQ ID NO: 753641 - RNA, 20 nt, Human
cagaugguucuagagaccca

SEQ ID NO: 753642 - RNA, 21 nt, Human
cagcaguccagccaccugcug

SEQ ID NO: 753643 - RNA, 20 nt, Human
caggauucuugaccaaucag

SEQ ID NO: 753644 - RNA, 19 nt, Human
cagggcagugggucucagc

SEQ ID NO: 753645 - RNA, 21 nt, Human
caguucaaccuugucaggcag

SEQ ID NO: 753646 - RNA, 20 nt, Human
caucucccuagcauggaccc

SEQ ID NO: 753647 - RNA, 27 nt, Human
cauuagaaaaaucuacuauguugcaga

SEQ ID NO: 753648 - RNA, 20 nt, Human
ccaaaggcauagcugaucca

SEQ ID NO: 753649 - RNA, 20 nt, Human
ccaauugugggaagcaaagu

SEQ ID NO: 753650 - RNA, 21 nt, Human
ccacacuaguagcucagggca

SEQ ID NO: 753651 - RNA, 24 nt, Human
ccacagcaagaucuuuaagccaga

SEQ ID NO: 753652 - RNA, 20 nt, Human
ccaccuucucuucucuucuu

SEQ ID NO: 753653 - RNA, 25 nt, Human
cccaaccucuaccucaaagcccagc

SEQ ID NO: 753654 - RNA, 22 nt, Human
cccacaggcacagccacacuag

SEQ ID NO: 753655 - RNA, 22 nt, Human
ccccaaccucuaccucaaagcc

SEQ ID NO: 753656 - RNA, 23 nt, Human
ccccaagaucaguauuucauacu

SEQ ID NO: 753657 - RNA, 21 nt, Human
ccucccaacuaccuagucugc

SEQ ID NO: 753658 - RNA, 20 nt, Human
cgaguugaggagaaagagaa

SEQ ID NO: 753659 - RNA, 20 nt, Human
cuaaucccaaggccucagaa

SEQ ID NO: 753660 - RNA, 24 nt, Human
cuaccucucagcaauucuuuaaaa

SEQ ID NO: 753661 - RNA, 22 nt, Human
cugcagcacuuacuuguccuuc

SEQ ID NO: 753662 - RNA, 18 nt, Human
cuggccacccaagaauaa

SEQ ID NO: 753663 - RNA, 20 nt, Human
cugggugugccuccgcuauu

SEQ ID NO: 753664 - RNA, 20 nt, Human
cuuaccauuaccuaaaaaug

SEQ ID NO: 753665 - RNA, 20 nt, Human
gaaagcuaagagauauagaa

SEQ ID NO: 753666 - RNA, 21 nt, Human
gaagaacaagcucccuuucuc

SEQ ID NO: 753667 - RNA, 23 nt, Human
gaccccaugcaaaugguugacau

SEQ ID NO: 753668 - RNA, 18 nt, Human
gagaaagagaagcaaaug

SEQ ID NO: 753669 - RNA, 23 nt, Human
gagauggccacaauaacuuuuau

SEQ ID NO: 753670 - RNA, 22 nt, Human
gagcgcggcggggccgagcggc

SEQ ID NO: 753671 - RNA, 23 nt, Human
gcaauucuuuaaaacauucagaa

SEQ ID NO: 753672 - RNA, 23 nt, Human
gccgagcggcugggcugccgcgg

SEQ ID NO: 753673 - RNA, 21 nt, Human
gcugaaauaaagggacaucca

SEQ ID NO: 753674 - RNA, 21 nt, Human
ggaaaagagaaguguccaaag

SEQ ID NO: 753675 - RNA, 22 nt, Human
ggcggggccgagcggcugggcu

SEQ ID NO: 753676 - RNA, 22 nt, Human
ggugugccuccgcuauuuuucu

SEQ ID NO: 753677 - RNA, 18 nt, Human
guccagccaccugcugug

SEQ ID NO: 753678 - RNA, 19 nt, Human
uaacugaaguuauuagugg

SEQ ID NO: 753679 - RNA, 24 nt, Human
uaacugacagugaacagaaaccca

SEQ ID NO: 753680 - RNA, 18 nt, Human
uaacuggagguaaacagc

SEQ ID NO: 753681 - RNA, 20 nt, Human
uaacuggagguaaacagcag

SEQ ID NO: 753682 - RNA, 19 nt, Human
uaccaagucaaacccucac

SEQ ID NO: 753683 - RNA, 18 nt, Human
uaccauguguucucucca

SEQ ID NO: 753684 - RNA, 26 nt, Human
uaccauguguucucuccacuagggaa

SEQ ID NO: 753685 - RNA, 25 nt, Human
uaccauuaccuaaaaaugauuuuuu

SEQ ID NO: 753686 - RNA, 21 nt, Human
uaccucaaagcccagcguagc

SEQ ID NO: 753687 - RNA, 21 nt, Human
uacgcucauguuucucaucca

SEQ ID NO: 753688 - RNA, 22 nt, Human
uagcucauuaggaacaggccag

SEQ ID NO: 753689 - RNA, 23 nt, Human
uaugccacauuuggcauaaaaaa

SEQ ID NO: 753690 - RNA, 19 nt, Human
uauguuuguagccucaaac

SEQ ID NO: 753691 - RNA, 21 nt, Human
uauguuuguagccucaaacac

SEQ ID NO: 753692 - RNA, 19 nt, Human
ucaguaauuacuuuauuga

SEQ ID NO: 753693 - RNA, 19 nt, Human
ucauacucccuaaccuugc

SEQ ID NO: 753694 - RNA, 23 nt, Human
uccaaggaacauguuauuaguac

SEQ ID NO: 753695 - RNA, 20 nt, Human
uccacagacuagaaaaucag

SEQ ID NO: 753696 - RNA, 18 nt, Human
uccauaaugaggaagagg

SEQ ID NO: 753697 - RNA, 20 nt, Human
ucccagggccuuggguuccu

SEQ ID NO: 753698 - RNA, 24 nt, Human
ucuaaaauuccuuuucuuuaucca

SEQ ID NO: 753699 - RNA, 21 nt, Human
ucuaaaguuguucuuuuucua

SEQ ID NO: 753700 - RNA, 21 nt, Human
ucuaccucaaagcccagcgua

SEQ ID NO: 753701 - RNA, 22 nt, Human
ucucagacaccuuuggucuaaa

SEQ ID NO: 753702 - RNA, 19 nt, Human
ucuccucugucaagucuaa

SEQ ID NO: 753703 - RNA, 19 nt, Human
ucuuccucuguuccaagga

SEQ ID NO: 753704 - RNA, 19 nt, Human
ugacugaauaaaugaagga

SEQ ID NO: 753705 - RNA, 24 nt, Human
ugaggaagaggcuaaucccaaggc

SEQ ID NO: 753706 - RNA, 24 nt, Human
ugaucaggauggcagcuugcuggc

SEQ ID NO: 753707 - RNA, 20 nt, Human
ugauccugggcgguagcccc

SEQ ID NO: 753708 - RNA, 20 nt, Human
ugauccugggcgguagcccc

SEQ ID NO: 753709 - RNA, 22 nt, Human
ugcaaaaacaagcagacauccc

SEQ ID NO: 753710 - RNA, 20 nt, Human
ugcaaccuugauguccaaau

SEQ ID NO: 753711 - RNA, 18 nt, Human
ugcaggcugggcggggag

SEQ ID NO: 753712 - RNA, 19 nt, Human
ugcauuguucaucucugca

SEQ ID NO: 753713 - RNA, 23 nt, Human
ugcauuguucaucucugcaaccu

SEQ ID NO: 753714 - RNA, 24 nt, Human
ugcauuguucaucucugcaaccuu

SEQ ID NO: 753715 - RNA, 20 nt, Human
ugccaaauccaacugcuuug

SEQ ID NO: 753716 - RNA, 22 nt, Human
ugccgcggcgcgagcucugcag

SEQ ID NO: 753717 - RNA, 18 nt, Human
ugccuccgcuauuuuucu

SEQ ID NO: 753718 - RNA, 20 nt, Human
ugccuuaaaucacaaagagc

SEQ ID NO: 753719 - RNA, 19 nt, Human
uguggcucuuuucuauaua

SEQ ID NO: 753720 - RNA, 24 nt, Human
uucauaaaccccaaccucuaccuc

SEQ ID NO: 753721 - RNA, 20 nt, Human
uucugccaucuucuuuugcc

SEQ ID NO: 753722 - RNA, 20 nt, Human
uucuuuccaccggagaggac

SEQ ID NO: 753723 - RNA, 18 nt, Human
uugaacuccucaaagaug

SEQ ID NO: 753724 - RNA, 24 nt, Human
uuggaugcugugcuccuuacaugg

SEQ ID NO: 753725 - RNA, 20 nt, Human
uuucaucacacaugccaaau

SEQ ID NO: 753726 - RNA, 22 nt, Human
uuucgugguuuuucuuccucug

SEQ ID NO: 753727 - RNA, 24 nt, Human
uuugcaaaaacaagcagacauccc

SEQ ID NO: 753728 - RNA, 23 nt, Human
uuuguggcucuuuucuauauagu

SEQ ID NO: 753729 - RNA, 23 nt, Human
uuuuaaucuguuuugccuuaaau

SEQ ID NO: 753730 - RNA, 20 nt, Human
aaaaagacaaaacaaaacaa

SEQ ID NO: 753731 - RNA, 24 nt, Human
aaaagaccacccacaacgagaaaa

SEQ ID NO: 753732 - RNA, 24 nt, Human
aaacaaaauauauccuauccauaa

SEQ ID NO: 753733 - RNA, 21 nt, Human
aaacaauggcagaaaaacucu

SEQ ID NO: 753734 - RNA, 22 nt, Human
aaacagagaucccagcagugua

SEQ ID NO: 753735 - RNA, 21 nt, Human
aaacccaaaauauuucagcag

SEQ ID NO: 753736 - RNA, 26 nt, Human
aaagaccacccacaacgagaaaagcc

SEQ ID NO: 753737 - RNA, 24 nt, Human
aaagugccgggauuacaggcguga

SEQ ID NO: 753738 - RNA, 19 nt, Human
aaagugcuaggauuacagg

SEQ ID NO: 753739 - RNA, 24 nt, Human
aaagugcuaggauuacaggcauga

SEQ ID NO: 753740 - RNA, 18 nt, Human
aacauggugaaaaccccc

SEQ ID NO: 753741 - RNA, 22 nt, Human
aacauggugaaaacccccgucu

SEQ ID NO: 753742 - RNA, 22 nt, Human
aacauggugaaaccccuaaccu

SEQ ID NO: 753743 - RNA, 23 nt, Human
aacauggugaaaccccuaaccuc

SEQ ID NO: 753744 - RNA, 22 nt, Human
aaccccuaaccucaggugaucc

SEQ ID NO: 753745 - RNA, 18 nt, Human
aaccucaggugauccacc

SEQ ID NO: 753746 - RNA, 19 nt, Human
aaccuccgccucccgguuc

SEQ ID NO: 753747 - RNA, 25 nt, Human
aacucaccccucccaaacaaaauca

SEQ ID NO: 753748 - RNA, 24 nt, Human
aagaaaaacaggaaugucugacaa

SEQ ID NO: 753749 - RNA, 21 nt, Human
aagaaucaccucuugugauuc

SEQ ID NO: 753750 - RNA, 25 nt, Human
aaggcaagcggaucacccgaagcca

SEQ ID NO: 753751 - RNA, 24 nt, Human
aagugauccgccugccucggccuc

SEQ ID NO: 753752 - RNA, 26 nt, Human
aagugcuaggauuacaggcaugagcc

SEQ ID NO: 753753 - RNA, 18 nt, Human
aaguggacaccacaagaa

SEQ ID NO: 753754 - RNA, 20 nt, Human
aaucgccugaacccaggaga

SEQ ID NO: 753755 - RNA, 26 nt, Human
acaaaacaaaacaacacuuuaaccuc

SEQ ID NO: 753756 - RNA, 26 nt, Human
acaccaaauauaccauuagcaaaagc

SEQ ID NO: 753757 - RNA, 18 nt, Human
acaggguuucaccauguu

SEQ ID NO: 753758 - RNA, 19 nt, Human
acaggguuucaccauguua

SEQ ID NO: 753759 - RNA, 20 nt, Human
acaggguuucaccauguuag

SEQ ID NO: 753760 - RNA, 24 nt, Human
acaggguuucaccauguuagccag

SEQ ID NO: 753761 - RNA, 21 nt, Human
acauggugaaaacccccgucu

SEQ ID NO: 753762 - RNA, 22 nt, Human
acauggugaaaacccccgucuc

SEQ ID NO: 753763 - RNA, 24 nt, Human
accaaaauacaaaaauuagcuggu

SEQ ID NO: 753764 - RNA, 21 nt, Human
accacacuccagccugggcag

SEQ ID NO: 753765 - RNA, 20 nt, Human
acccaaaucaacugcuuccu

SEQ ID NO: 753766 - RNA, 20 nt, Human
accccucccaaacaaaauca

SEQ ID NO: 753767 - RNA, 23 nt, Human
acgagaaaagccuacuuccuccu

SEQ ID NO: 753768 - RNA, 18 nt, Human
acguguaacucaccccuc

SEQ ID NO: 753769 - RNA, 24 nt, Human
agaaaaacaggaaugucugacaaa

SEQ ID NO: 753770 - RNA, 20 nt, Human
agaaaacauaaugaagaaaa

SEQ ID NO: 753771 - RNA, 18 nt, Human
agacaaaacaaaacaaca

SEQ ID NO: 753772 - RNA, 21 nt, Human
agacggaagaaucgccugaac

SEQ ID NO: 753773 - RNA, 19 nt, Human
agcacuuaaaacagagauc

SEQ ID NO: 753774 - RNA, 22 nt, Human
agccaggaguucaagaccagcc

SEQ ID NO: 753775 - RNA, 25 nt, Human
agccuggccaacauggugaaaaccc

SEQ ID NO: 753776 - RNA, 24 nt, Human
agccugggcagcugagcgagacuc

SEQ ID NO: 753777 - RNA, 23 nt, Human
agcugggcaugauggcaggugcc

SEQ ID NO: 753778 - RNA, 23 nt, Human
aggaggccaaggcaagcgguggg

SEQ ID NO: 753779 - RNA, 24 nt, Human
aggagggcagaucaagagguuagg

SEQ ID NO: 753780 - RNA, 26 nt, Human
aggcaagcggaucacccgaagccagg

SEQ ID NO: 753781 - RNA, 24 nt, Human
aggugauccaccugucuuggccuc

SEQ ID NO: 753782 - RNA, 19 nt, Human
aguagcugggauuacaggc

SEQ ID NO: 753783 - RNA, 23 nt, Human
aguagcugggauuacaggcgugc

SEQ ID NO: 753784 - RNA, 24 nt, Human
agugcaauggcacaaucucggcuc

SEQ ID NO: 753785 - RNA, 26 nt, Human
auacaaaaaacaauggcagaaaaacu

SEQ ID NO: 753786 - RNA, 23 nt, Human
aucacccgaagccaggaguucaa

SEQ ID NO: 753787 - RNA, 21 nt, Human
auccuggccaacauggugaaa

SEQ ID NO: 753788 - RNA, 24 nt, Human
auggcgccaccacacuccagccug

SEQ ID NO: 753789 - RNA, 23 nt, Human
caaaacaaaacaacacuuuaacc

SEQ ID NO: 753790 - RNA, 26 nt, Human
caaaacaaaacaacacuuuaaccucu

SEQ ID NO: 753791 - RNA, 28 nt, Human
caaaacaccaaauauaccauuagcaaaa

SEQ ID NO: 753792 - RNA, 26 nt, Human
caaaauacaaaaauuagcugggcaug

SEQ ID NO: 753793 - RNA, 23 nt, Human
caaaaugcucauaguguggaugg

SEQ ID NO: 753794 - RNA, 24 nt, Human
caaagugccgggauuacaggcgug

SEQ ID NO: 753795 - RNA, 24 nt, Human
caaagugcuaggauuacaggcaug

SEQ ID NO: 753796 - RNA, 24 nt, Human
caacaaacaaaauauauccuaucc

SEQ ID NO: 753797 - RNA, 26 nt, Human
caacauggugaaaacccccgucucua

SEQ ID NO: 753798 - RNA, 19 nt, Human
caacauggugaaaccccua

SEQ ID NO: 753799 - RNA, 20 nt, Human
caagacacgugagcugaaaa

SEQ ID NO: 753800 - RNA, 24 nt, Human
caagaccagccuggccaacauggu

SEQ ID NO: 753801 - RNA, 24 nt, Human
caagaccauccuggccaacauggu

SEQ ID NO: 753802 - RNA, 27 nt, Human
caagcggaucacccgaagccaggaguu

SEQ ID NO: 753803 - RNA, 24 nt, Human
caagcuccaaaucccacucuuaca

SEQ ID NO: 753804 - RNA, 18 nt, Human
caaggcaagcggaucacc

SEQ ID NO: 753805 - RNA, 22 nt, Human
caagugauccgccugccucggc

SEQ ID NO: 753806 - RNA, 25 nt, Human
caccacacuccagccugggcagcug

SEQ ID NO: 753807 - RNA, 19 nt, Human
caccaccaagcuccaaauc

SEQ ID NO: 753808 - RNA, 18 nt, Human
caccauguuagccaggcu

SEQ ID NO: 753809 - RNA, 22 nt, Human
caccauguuagccaggcugcuc

SEQ ID NO: 753810 - RNA, 27 nt, Human
caccauguuagccaggcugcucucaaa

SEQ ID NO: 753811 - RNA, 26 nt, Human
caccccucccaaacaaaaucaaagga

SEQ ID NO: 753812 - RNA, 23 nt, Human
caccgcaaggaccagcacacuga

SEQ ID NO: 753813 - RNA, 22 nt, Human
caccugccaccuacucaauccc

SEQ ID NO: 753814 - RNA, 23 nt, Human
caccugucuuggccucccaaagu

SEQ ID NO: 753815 - RNA, 24 nt, Human
caccugucuuggccucccaaagug

SEQ ID NO: 753816 - RNA, 24 nt, Human
cacgccuguaaucgcagcacuuug

SEQ ID NO: 753817 - RNA, 20 nt, Human
cacgugagcugaaaaugauc

SEQ ID NO: 753818 - RNA, 18 nt, Human
cacuccagccugggcagc

SEQ ID NO: 753819 - RNA, 24 nt, Human
cacuccagccugggcagcugagcg

SEQ ID NO: 753820 - RNA, 21 nt, Human
cacugacccauaucugugggc

SEQ ID NO: 753821 - RNA, 21 nt, Human
cacugcaaccuccgccucccg

SEQ ID NO: 753822 - RNA, 22 nt, Human
cagcaaucaaucaugaagcuga

SEQ ID NO: 753823 - RNA, 23 nt, Human
cagcaccgcaaggaccagcacac

SEQ ID NO: 753824 - RNA, 20 nt, Human
cagcacuuugggaggccaag

SEQ ID NO: 753825 - RNA, 24 nt, Human
cagcacuuugggaggccaaggagg

SEQ ID NO: 753826 - RNA, 22 nt, Human
cagcugaagucagucuccacca

SEQ ID NO: 753827 - RNA, 21 nt, Human
caggauuucuuccauuuaugg

SEQ ID NO: 753828 - RNA, 24 nt, Human
caggguuucaccauguuagccagg

SEQ ID NO: 753829 - RNA, 24 nt, Human
cagugcgguggcucacgccuguaa

SEQ ID NO: 753830 - RNA, 18 nt, Human
cauaagcauguuggucac

SEQ ID NO: 753831 - RNA, 19 nt, Human
cauaguguggauggcagga

SEQ ID NO: 753832 - RNA, 21 nt, Human
cauggaaaauucauagagcca

SEQ ID NO: 753833 - RNA, 24 nt, Human
cauguuagccaggcugcucucaaa

SEQ ID NO: 753834 - RNA, 33 nt, Human
cauguuagccaggcugcucucaaacuccugaag

SEQ ID NO: 753835 - RNA, 23 nt, Human
ccaaaaaaaaaaaagaccaccca

SEQ ID NO: 753836 - RNA, 20 nt, Human
ccaaaacuauacaaaacacc

SEQ ID NO: 753837 - RNA, 20 nt, Human
ccaaagugccgggauuacag

SEQ ID NO: 753838 - RNA, 22 nt, Human
ccaaagugccgggauuacaggc

SEQ ID NO: 753839 - RNA, 24 nt, Human
ccaaagugccgggauuacaggcgu

SEQ ID NO: 753840 - RNA, 19 nt, Human
ccaaagugcuaggauuaca

SEQ ID NO: 753841 - RNA, 24 nt, Human
ccaaagugcuaggauuacaggcau

SEQ ID NO: 753842 - RNA, 22 nt, Human
ccaaaucccacucuuacaacuc

SEQ ID NO: 753843 - RNA, 21 nt, Human
ccaccacacccgguaauuuuc

SEQ ID NO: 753844 - RNA, 18 nt, Human
ccaccaccaagcuccaaa

SEQ ID NO: 753845 - RNA, 19 nt, Human
ccagcacccuaggaggcca

SEQ ID NO: 753846 - RNA, 21 nt, Human
ccagcacccuaggaggccaag

SEQ ID NO: 753847 - RNA, 23 nt, Human
ccagccuccuuugcuucuaacuu

SEQ ID NO: 753848 - RNA, 23 nt, Human
cccgaguagcugggauuacaggc

SEQ ID NO: 753849 - RNA, 24 nt, Human
cccgaguagcugggauuacaggcg

SEQ ID NO: 753850 - RNA, 22 nt, Human
ccgaguagcugggauuacaggc

SEQ ID NO: 753851 - RNA, 24 nt, Human
ccgaguagcugggauuacaggcgu

SEQ ID NO: 753852 - RNA, 23 nt, Human
ccgccgcagccucccgaguagcu

SEQ ID NO: 753853 - RNA, 23 nt, Human
ccgccucccgguucaagcgauuc

SEQ ID NO: 753854 - RNA, 21 nt, Human
ccuaaccucaggugauccacc

SEQ ID NO: 753855 - RNA, 23 nt, Human
ccuaaccucaggugauccaccug

SEQ ID NO: 753856 - RNA, 24 nt, Human
ccuaaccucaggugauccaccugu

SEQ ID NO: 753857 - RNA, 21 nt, Human
ccuauaaucccagcuacucgg

SEQ ID NO: 753858 - RNA, 24 nt, Human
ccucgcucuuguugcccaggcugg

SEQ ID NO: 753859 - RNA, 25 nt, Human
ccucgcucuuguugcccaggcugga

SEQ ID NO: 753860 - RNA, 24 nt, Human
ccugaaaacaccugccaccuacuc

SEQ ID NO: 753861 - RNA, 19 nt, Human
ccugaccucaaagucgaca

SEQ ID NO: 753862 - RNA, 18 nt, Human
ccugaccucaagugaucc

SEQ ID NO: 753863 - RNA, 21 nt, Human
ccugaccucaagugauccgcc

SEQ ID NO: 753864 - RNA, 23 nt, Human
ccugaccucaagugauccgccug

SEQ ID NO: 753865 - RNA, 18 nt, Human
ccugcaacaugauacugu

SEQ ID NO: 753866 - RNA, 18 nt, Human
ccuggccaacauggugaa

SEQ ID NO: 753867 - RNA, 24 nt, Human
ccuggccaacauggugaaaacccc

SEQ ID NO: 753868 - RNA, 26 nt, Human
ccuggccaacauggugaaaacccccg

SEQ ID NO: 753869 - RNA, 22 nt, Human
ccuggccaacauggugaaaccc

SEQ ID NO: 753870 - RNA, 23 nt, Human
ccuggccaacauggugaaacccc

SEQ ID NO: 753871 - RNA, 23 nt, Human
ccuggccaacauggugaaacccc

SEQ ID NO: 753872 - RNA, 22 nt, Human
ccugggcagcugagcgagacuc

SEQ ID NO: 753873 - RNA, 24 nt, Human
ccuguaaucgcagcacuuugggag

SEQ ID NO: 753874 - RNA, 20 nt, Human
ccuguuuggugccugugggu

SEQ ID NO: 753875 - RNA, 24 nt, Human
cgccaccacacuccagccugggca

SEQ ID NO: 753876 - RNA, 23 nt, Human
cgccuguaaucgcagcacuuugg

SEQ ID NO: 753877 - RNA, 24 nt, Human
cgccuguaaucgcagcacuuuggg

SEQ ID NO: 753878 - RNA, 24 nt, Human
cgcucuuguugcccaggcuggagu

SEQ ID NO: 753879 - RNA, 21 nt, Human
cggaucacccgaagccaggag

SEQ ID NO: 753880 - RNA, 27 nt, Human
cggaucacccgaagccaggaguucaag

SEQ ID NO: 753881 - RNA, 21 nt, Human
cgggauuacaggcgugagcca

SEQ ID NO: 753882 - RNA, 24 nt, Human
cgggauuacaggcgugagccaccg

SEQ ID NO: 753883 - RNA, 22 nt, Human
cgggcccagagggaacccaaau

SEQ ID NO: 753884 - RNA, 21 nt, Human
cguucugcaacucuacccaaa

SEQ ID NO: 753885 - RNA, 21 nt, Human
cucaagugauccgccugccuc

SEQ ID NO: 753886 - RNA, 24 nt, Human
cucacgccuguaaucgcagcacuu

SEQ ID NO: 753887 - RNA, 24 nt, Human
cucacugcaaccuccgccucccgg

SEQ ID NO: 753888 - RNA, 24 nt, Human
cucaggugauccaccugucuuggc

SEQ ID NO: 753889 - RNA, 27 nt, Human
cuccaaaaaaaaaaaagaccacccaca

SEQ ID NO: 753890 - RNA, 24 nt, Human
cucccaaacaaaaucaaaggaccc

SEQ ID NO: 753891 - RNA, 26 nt, Human
cuccugaccucaagugauccgccugc

SEQ ID NO: 753892 - RNA, 22 nt, Human
cucgcucuuguugcccaggcug

SEQ ID NO: 753893 - RNA, 24 nt, Human
cucgcucuuguugcccaggcugga

SEQ ID NO: 753894 - RNA, 18 nt, Human
cucuuguugcccaggcug

SEQ ID NO: 753895 - RNA, 19 nt, Human
cugaccucaaagucgacac

SEQ ID NO: 753896 - RNA, 19 nt, Human
cugagcgagacuccgucuc

SEQ ID NO: 753897 - RNA, 23 nt, Human
cugcaaccuccgccucccgguuc

SEQ ID NO: 753898 - RNA, 20 nt, Human
cugccaccuacucaauccca

SEQ ID NO: 753899 - RNA, 23 nt, Human
cugucuuggccucccaaagugcu

SEQ ID NO: 753900 - RNA, 18 nt, Human
cuuaacuuaaacagaaaa

SEQ ID NO: 753901 - RNA, 24 nt, Human
cuuguugcccaggcuggagugcaa

SEQ ID NO: 753902 - RNA, 18 nt, Human
cuuuauauugugcuuucc

SEQ ID NO: 753903 - RNA, 23 nt, Human
gacaaaacaaaacaacacuuuaa

SEQ ID NO: 753904 - RNA, 24 nt, Human
gaccucaagugauccgccugccuc

SEQ ID NO: 753905 - RNA, 24 nt, Human
gaucacccgaagccaggaguucaa

SEQ ID NO: 753906 - RNA, 24 nt, Human
gauggcaggugccuauaaucccag

SEQ ID NO: 753907 - RNA, 18 nt, Human
gauuacaggcaugagcca

SEQ ID NO: 753908 - RNA, 21 nt, Human
gauuacaggcaugagccacug

SEQ ID NO: 753909 - RNA, 24 nt, Human
gauuacaggcaugagccacugugc

SEQ ID NO: 753910 - RNA, 18 nt, Human
gauuacaggcgugagcca

SEQ ID NO: 753911 - RNA, 22 nt, Human
gauuacaggcgugagccaccgc

SEQ ID NO: 753912 - RNA, 22 nt, Human
gauuacaggcgugagccaccgc

SEQ ID NO: 753913 - RNA, 18 nt, Human
gauuacaggcgugcgcca

SEQ ID NO: 753914 - RNA, 18 nt, Human
gcagcacuuugggaggcc

SEQ ID NO: 753915 - RNA, 26 nt, Human
gccaacauggugaaaacccccgucuc

SEQ ID NO: 753916 - RNA, 18 nt, Human
gccaacauggugaaaccc

SEQ ID NO: 753917 - RNA, 22 nt, Human
gccaccacacuccagccugggc

SEQ ID NO: 753918 - RNA, 19 nt, Human
gcccaggcuggagugcaau

SEQ ID NO: 753919 - RNA, 23 nt, Human
gccgcagccucccgaguagcugg

SEQ ID NO: 753920 - RNA, 24 nt, Human
gccucccgguucaagcgauucucc

SEQ ID NO: 753921 - RNA, 23 nt, Human
gccugaacccaggagaugguggu

SEQ ID NO: 753922 - RNA, 24 nt, Human
gcucuuguugcccaggcuggagug

SEQ ID NO: 753923 - RNA, 19 nt, Human
gcuggagugcaauggcaca

SEQ ID NO: 753924 - RNA, 18 nt, Human
ggacuuggaggcaaagua

SEQ ID NO: 753925 - RNA, 24 nt, Human
ggagauggcgccaccacacuccag

SEQ ID NO: 753926 - RNA, 22 nt, Human
ggauuacaggcaugagccacug

SEQ ID NO: 753927 - RNA, 24 nt, Human
ggauuacaggcaugagccacugug

SEQ ID NO: 753928 - RNA, 21 nt, Human
ggcagaucaagagguuaggag

SEQ ID NO: 753929 - RNA, 18 nt, Human
ggccaaggagggcagauc

SEQ ID NO: 753930 - RNA, 21 nt, Human
ggcccgggcccagagggaacc

SEQ ID NO: 753931 - RNA, 19 nt, Human
ggccgggcgcgguggcuca

SEQ ID NO: 753932 - RNA, 20 nt, Human
ggcgcgguggcucaggccug

SEQ ID NO: 753933 - RNA, 21 nt, Human
ggcucaggccugcaaucccag

SEQ ID NO: 753934 - RNA, 22 nt, Human
gggaggcugagacggaagaauc

SEQ ID NO: 753935 - RNA, 18 nt, Human
gggauuacaggcgugagc

SEQ ID NO: 753936 - RNA, 21 nt, Human
gggauuacaggcgugagccac

SEQ ID NO: 753937 - RNA, 22 nt, Human
gggauuacaggcgugagccacc

SEQ ID NO: 753938 - RNA, 23 nt, Human
gggauuacaggcgugagccaccg

SEQ ID NO: 753939 - RNA, 20 nt, Human
gggcccgguggcccgggccc

SEQ ID NO: 753940 - RNA, 24 nt, Human
gguggcucacgccuguaaucgcag

SEQ ID NO: 753941 - RNA, 18 nt, Human
guagcugggauuacaggc

SEQ ID NO: 753942 - RNA, 18 nt, Human
guagcugggauuacaggc

SEQ ID NO: 753943 - RNA, 24 nt, Human
gugauccaccugucuuggccuccc

SEQ ID NO: 753944 - RNA, 22 nt, Human
gugggcccgguggcccgggccc

SEQ ID NO: 753945 - RNA, 27 nt, Human
guggguccuaaagaaaaagacuuucau

SEQ ID NO: 753946 - RNA, 23 nt, Human
uaaaagauuuauugcaguaauac

SEQ ID NO: 753947 - RNA, 20 nt, Human
uaaaauggaaaacaugaccc

SEQ ID NO: 753948 - RNA, 18 nt, Human
uaaagaaaaagacuuuca

SEQ ID NO: 753949 - RNA, 18 nt, Human
uaaagugccucuaguuga

SEQ ID NO: 753950 - RNA, 23 nt, Human
uaaagugucaggaacagucucag

SEQ ID NO: 753951 - RNA, 23 nt, Human
uaaccaaaaaaugucuuuaacag

SEQ ID NO: 753952 - RNA, 19 nt, Human
uaaccucaggugauccacc

SEQ ID NO: 753953 - RNA, 24 nt, Human
uaaccucaggugauccaccugucu

SEQ ID NO: 753954 - RNA, 22 nt, Human
uaaccucuuuguuccagacacu

SEQ ID NO: 753955 - RNA, 20 nt, Human
uaacuaaguggcuuuucccc

SEQ ID NO: 753956 - RNA, 19 nt, Human
uaagaggcuuaagaaaacc

SEQ ID NO: 753957 - RNA, 19 nt, Human
uacaaaacaccaaauauac

SEQ ID NO: 753958 - RNA, 24 nt, Human
uacaggcaugagccacugugccca

SEQ ID NO: 753959 - RNA, 23 nt, Human
uacaggcgugagccaccgcgccc

SEQ ID NO: 753960 - RNA, 23 nt, Human
uacaggcgugcgccaccacaccc

SEQ ID NO: 753961 - RNA, 24 nt, Human
uaccagcuucaauuuuuuaaaaag

SEQ ID NO: 753962 - RNA, 25 nt, Human
uacccaaaacuauacaaaacaccaa

SEQ ID NO: 753963 - RNA, 20 nt, Human
uacccaauggugauauacug

SEQ ID NO: 753964 - RNA, 18 nt, Human
uacuagaguguaguggga

SEQ ID NO: 753965 - RNA, 21 nt, Human
uagaaagaaaguggacaccac

SEQ ID NO: 753966 - RNA, 24 nt, Human
uagcagaaacaggguuucaccaug

SEQ ID NO: 753967 - RNA, 24 nt, Human
uaggaggccaaggcaagcggauca

SEQ ID NO: 753968 - RNA, 21 nt, Human
uaggauuacaggcaugagcca

SEQ ID NO: 753969 - RNA, 22 nt, Human
uaggauuacaggcaugagccac

SEQ ID NO: 753970 - RNA, 22 nt, Human
uaggauuacaggcaugagccac

SEQ ID NO: 753971 - RNA, 24 nt, Human
uaggauuacaggcaugagccacug

SEQ ID NO: 753972 - RNA, 26 nt, Human
uaggauuacaggcaugagccacugug

SEQ ID NO: 753973 - RNA, 24 nt, Human
uaggccagugcgguggcucacgcc

SEQ ID NO: 753974 - RNA, 24 nt, Human
uagugggagaagaacuuucuugau

SEQ ID NO: 753975 - RNA, 20 nt, Human
uaguugauauuaacaacaac

SEQ ID NO: 753976 - RNA, 23 nt, Human
uauacaaaacaccaaauauacca

SEQ ID NO: 753977 - RNA, 28 nt, Human
uauacaaaacaccaaauauaccauuagc

SEQ ID NO: 753978 - RNA, 22 nt, Human
uaucuuaacuuaaacagaaaau

SEQ ID NO: 753979 - RNA, 20 nt, Human
ucaagaccauccuggccaac

SEQ ID NO: 753980 - RNA, 22 nt, Human
ucaagaccauccuggccaacau

SEQ ID NO: 753981 - RNA, 24 nt, Human
ucaagagguuaggagaucaagacc

SEQ ID NO: 753982 - RNA, 19 nt, Human
ucacugcaaccuccgccuc

SEQ ID NO: 753983 - RNA, 23 nt, Human
ucacugcaaccuccgccucccgg

SEQ ID NO: 753984 - RNA, 24 nt, Human
ucacugcaaccuccgccucccggu

SEQ ID NO: 753985 - RNA, 26 nt, Human
ucacugcaaccuccgccucccgguuc

SEQ ID NO: 753986 - RNA, 23 nt, Human
ucagcaguguaagccaguauguu

SEQ ID NO: 753987 - RNA, 29 nt, Human
ucauacaaaaaacaauggcagaaaaacuc

SEQ ID NO: 753988 - RNA, 22 nt, Human
uccaaaaaaaaaaaagaccacc

SEQ ID NO: 753989 - RNA, 23 nt, Human
uccaaaaaaaaaaaagaccaccc

SEQ ID NO: 753990 - RNA, 19 nt, Human
uccaccaccaagcuccaaa

SEQ ID NO: 753991 - RNA, 24 nt, Human
uccagccugggcagcugagcgaga

SEQ ID NO: 753992 - RNA, 24 nt, Human
ucccaaagugccgggauuacaggc

SEQ ID NO: 753993 - RNA, 24 nt, Human
ucccaaagugcuaggauuacaggc

SEQ ID NO: 753994 - RNA, 22 nt, Human
ucccccuuacagaugugcaaaa

SEQ ID NO: 753995 - RNA, 21 nt, Human
uccccucagaauacaagaaaa

SEQ ID NO: 753996 - RNA, 24 nt, Human
ucccgaguagcugggauuacaggc

SEQ ID NO: 753997 - RNA, 18 nt, Human
ucccgguucaagcgauuc

SEQ ID NO: 753998 - RNA, 20 nt, Human
ucccgguucaagcgauucuc

SEQ ID NO: 753999 - RNA, 18 nt, Human
ucccguccacucuaccca

SEQ ID NO: 754000 - RNA, 19 nt, Human
uccuaaagaaaaagacuuu

SEQ ID NO: 754001 - RNA, 21 nt, Human
uccuaaagaaaaagacuuuca

SEQ ID NO: 754002 - RNA, 24 nt, Human
ucgggaggcugagacggaagaauc

SEQ ID NO: 754003 - RNA, 18 nt, Human
ucuccaaaaaaaaaaaag

SEQ ID NO: 754004 - RNA, 20 nt, Human
ucuccaaaaaaaaaaaagaa

SEQ ID NO: 754005 - RNA, 27 nt, Human
ucuccaaaaaaaaaaaagaccacccac

SEQ ID NO: 754006 - RNA, 23 nt, Human
ucucuggauucuauucuuuagcu

SEQ ID NO: 754007 - RNA, 20 nt, Human
ucuuacuucugaggguuuua

SEQ ID NO: 754008 - RNA, 26 nt, Human
ucuuaugguuaauaugauuaucuacc

SEQ ID NO: 754009 - RNA, 21 nt, Human
ucuuggccucccaaagugcua

SEQ ID NO: 754010 - RNA, 22 nt, Human
ucuuguugcccaggcuggagug

SEQ ID NO: 754011 - RNA, 20 nt, Human
ugaaaaaagcauguaauaaa

SEQ ID NO: 754012 - RNA, 20 nt, Human
ugaaaacaccugccaccuac

SEQ ID NO: 754013 - RNA, 19 nt, Human
ugaacccaggagauggugg

SEQ ID NO: 754014 - RNA, 19 nt, Human
ugacaagacacgugagcug

SEQ ID NO: 754015 - RNA, 18 nt, Human
ugaccucaagugauccgc

SEQ ID NO: 754016 - RNA, 24 nt, Human
ugaccucaagugauccgccugccu

SEQ ID NO: 754017 - RNA, 23 nt, Human
ugacucaaacugguuuggaaguu

SEQ ID NO: 754018 - RNA, 20 nt, Human
ugagacggaagaaucgccug

SEQ ID NO: 754019 - RNA, 24 nt, Human
ugagacggaagaaucgccugaacc

SEQ ID NO: 754020 - RNA, 23 nt, Human
ugagcgagacuccgucuccaaaa

SEQ ID NO: 754021 - RNA, 18 nt, Human
ugauggcaggugccuaua

SEQ ID NO: 754022 - RNA, 19 nt, Human
ugcccaggcaggcauugag

SEQ ID NO: 754023 - RNA, 18 nt, Human
ugcccaggcuggagugca

SEQ ID NO: 754024 - RNA, 21 nt, Human
ugcccaggcuggagugcaaug

SEQ ID NO: 754025 - RNA, 24 nt, Human
ugcccaggcuggagugcaauggca

SEQ ID NO: 754026 - RNA, 24 nt, Human
ugccgggauuacaggcgugagcca

SEQ ID NO: 754027 - RNA, 23 nt, Human
ugccuauaaucccagcuacucgg

SEQ ID NO: 754028 - RNA, 24 nt, Human
ugccuauaaucccagcuacucggg

SEQ ID NO: 754029 - RNA, 22 nt, Human
ugccucggccucccaaagugcc

SEQ ID NO: 754030 - RNA, 24 nt, Human
ugccucggccucccaaagugccgg

SEQ ID NO: 754031 - RNA, 21 nt, Human
ugcucucaaacuccugaccuc

SEQ ID NO: 754032 - RNA, 25 nt, Human
ugcucuuccccaaauugaguccuua

SEQ ID NO: 754033 - RNA, 18 nt, Human
uggaaaauucauagagcc

SEQ ID NO: 754034 - RNA, 18 nt, Human
uggacaccacaagaauga

SEQ ID NO: 754035 - RNA, 23 nt, Human
uggagugcaauggcacaaucucg

SEQ ID NO: 754036 - RNA, 24 nt, Human
uggagugcaauggcacaaucucgg

SEQ ID NO: 754037 - RNA, 24 nt, Human
uggcacaaucucggcucacugcaa

SEQ ID NO: 754038 - RNA, 24 nt, Human
uggcaggugccuauaaucccagcu

SEQ ID NO: 754039 - RNA, 19 nt, Human
uggccaacauggugaaaac

SEQ ID NO: 754040 - RNA, 18 nt, Human
uggccaacauggugaaac

SEQ ID NO: 754041 - RNA, 18 nt, Human
uggcucacgccuguaauc

SEQ ID NO: 754042 - RNA, 24 nt, Human
uggcucacgccuguaaucgcagca

SEQ ID NO: 754043 - RNA, 19 nt, Human
uggcucaggccugcaaucc

SEQ ID NO: 754044 - RNA, 22 nt, Human
uggcucaggccugcaaucccag

SEQ ID NO: 754045 - RNA, 24 nt, Human
uggcucaggccugcaaucccagca

SEQ ID NO: 754046 - RNA, 24 nt, Human
ugggaggccaaggagggcagauca

SEQ ID NO: 754047 - RNA, 18 nt, Human
ugggauuacaggcgugcg

SEQ ID NO: 754048 - RNA, 19 nt, Human
ugggauuacaggcgugcgc

SEQ ID NO: 754049 - RNA, 21 nt, Human
ugggauuacaggcgugcgcca

SEQ ID NO: 754050 - RNA, 22 nt, Human
ugggauuacaggcgugcgccac

SEQ ID NO: 754051 - RNA, 24 nt, Human
ugggauuacaggcgugcgccacca

SEQ ID NO: 754052 - RNA, 24 nt, Human
uggugccuguggguuuuuauuaga

SEQ ID NO: 754053 - RNA, 23 nt, Human
uggugugugggggaaagaaaaac

SEQ ID NO: 754054 - RNA, 26 nt, Human
ugguuuggaaguugcagagcaauggg

SEQ ID NO: 754055 - RNA, 24 nt, Human
uguagaagaacccauaaggggccg

SEQ ID NO: 754056 - RNA, 24 nt, Human
ugucagaaaacauaaugaagaaaa

SEQ ID NO: 754057 - RNA, 19 nt, Human
uguccugaccucaaagucg

SEQ ID NO: 754058 - RNA, 23 nt, Human
ugucuuggccucccaaagugcua

SEQ ID NO: 754059 - RNA, 20 nt, Human
uguggaaguacucuagauga

SEQ ID NO: 754060 - RNA, 24 nt, Human
uguuaggacucuuucauaggauuu

SEQ ID NO: 754061 - RNA, 26 nt, Human
uguucaaaaccacaaaaggguucgau

SEQ ID NO: 754062 - RNA, 20 nt, Human
uguugcccaggcuggagugc

SEQ ID NO: 754063 - RNA, 24 nt, Human
uuagaaaacauuuguaugacucaa

SEQ ID NO: 754064 - RNA, 24 nt, Human
uuagcugggcaugauggcaggugc

SEQ ID NO: 754065 - RNA, 23 nt, Human
uuaggccagugcgguggcucacg

SEQ ID NO: 754066 - RNA, 21 nt, Human
uuauuaaagagcuuuuaucuu

SEQ ID NO: 754067 - RNA, 21 nt, Human
uucaacuagguaagaauaagc

SEQ ID NO: 754068 - RNA, 19 nt, Human
uucaagcgauucucccgcc

SEQ ID NO: 754069 - RNA, 22 nt, Human
uucaauuuuuuaaaaagcuguu

SEQ ID NO: 754070 - RNA, 19 nt, Human
uucaugguuucauaagagg

SEQ ID NO: 754071 - RNA, 23 nt, Human
uugguguucaaaaccacaaaagg

SEQ ID NO: 754072 - RNA, 21 nt, Human
uuucaccauguuagccaggcu

SEQ ID NO: 754073 - RNA, 23 nt, Human
uuugcuucuaacuuuccuaucuu

SEQ ID NO: 754074 - RNA, 22 nt, Human
uuuuuuuuuuugagacggagcc

SEQ ID NO: 754075 - RNA, 19 nt, Human
aaaaaaaaacacccaauga

SEQ ID NO: 754076 - RNA, 18 nt, Human
aaaaguacugugaccaaa

SEQ ID NO: 754077 - RNA, 20 nt, Human
aaaauacccuccccauucuc

SEQ ID NO: 754078 - RNA, 24 nt, Human
aaacaagaaaagcaaccacaagga

SEQ ID NO: 754079 - RNA, 25 nt, Human
aaaggucaaaagcuagggguaagcc

SEQ ID NO: 754080 - RNA, 22 nt, Human
aaagguucccagacuggagaaa

SEQ ID NO: 754081 - RNA, 22 nt, Human
aaauacccaacccauggaaugc

SEQ ID NO: 754082 - RNA, 19 nt, Human
aaaugcaaaggucaaaagc

SEQ ID NO: 754083 - RNA, 26 nt, Human
aacaaaaacaaaccuaauaccuauaa

SEQ ID NO: 754084 - RNA, 22 nt, Human
aacaaaugcaacaaauacucau

SEQ ID NO: 754085 - RNA, 21 nt, Human
aaccuaauaccuauaaucuua

SEQ ID NO: 754086 - RNA, 20 nt, Human
aagagaaacaagaaaagcaa

SEQ ID NO: 754087 - RNA, 21 nt, Human
aagcaguaccauacuguuauc

SEQ ID NO: 754088 - RNA, 22 nt, Human
acauaaccuuuuaaaaugugcc

SEQ ID NO: 754089 - RNA, 20 nt, Human
acccaaugaugcacagacuu

SEQ ID NO: 754090 - RNA, 19 nt, Human
acugaagccugaacacuga

SEQ ID NO: 754091 - RNA, 18 nt, Human
acuguuaucaucgagucu

SEQ ID NO: 754092 - RNA, 26 nt, Human
acuuaucacuuugauagaauccacaa

SEQ ID NO: 754093 - RNA, 24 nt, Human
agaaaggaaacaucuuuuuaaaaa

SEQ ID NO: 754094 - RNA, 19 nt, Human
agaaaggagaaggagccac

SEQ ID NO: 754095 - RNA, 24 nt, Human
agacagagccuguaguuucugugg

SEQ ID NO: 754096 - RNA, 21 nt, Human
agaggcugaagugcaguuuug

SEQ ID NO: 754097 - RNA, 21 nt, Human
agcaaagaaaaacuuaaagaa

SEQ ID NO: 754098 - RNA, 22 nt, Human
agcaaagaaaaacuuaaagaaa

SEQ ID NO: 754099 - RNA, 23 nt, Human
aggcaaaaaugcaauggauaguc

SEQ ID NO: 754100 - RNA, 21 nt, Human
aguagugcuugauaguuugaa

SEQ ID NO: 754101 - RNA, 20 nt, Human
agucugaaauaaaauacaaa

SEQ ID NO: 754102 - RNA, 18 nt, Human
agugcuugauaguuugaa

SEQ ID NO: 754103 - RNA, 18 nt, Human
aucauacuucacaggcag

SEQ ID NO: 754104 - RNA, 22 nt, Human
auccuguaaacacuuuauugca

SEQ ID NO: 754105 - RNA, 21 nt, Human
auggggguugggaagggauau

SEQ ID NO: 754106 - RNA, 19 nt, Human
auuccacaaaaguacugug

SEQ ID NO: 754107 - RNA, 22 nt, Human
caaaaaccuaguacauaaccuu

SEQ ID NO: 754108 - RNA, 19 nt, Human
caaaaagaaacugucacaa

SEQ ID NO: 754109 - RNA, 24 nt, Human
caaaggacuacccuucagaagggc

SEQ ID NO: 754110 - RNA, 18 nt, Human
caaauacucauuugcucc

SEQ ID NO: 754111 - RNA, 19 nt, Human
caaaugcaacaaauacuca

SEQ ID NO: 754112 - RNA, 23 nt, Human
caaaugcaacaaauacucauuug

SEQ ID NO: 754113 - RNA, 19 nt, Human
caaauugaacaaaugcaac

SEQ ID NO: 754114 - RNA, 26 nt, Human
caacaaauacucauuugcucccaaga

SEQ ID NO: 754115 - RNA, 21 nt, Human
caagaaaagcaaccacaagga

SEQ ID NO: 754116 - RNA, 23 nt, Human
caagaaaagcaaccacaaggagg

SEQ ID NO: 754117 - RNA, 23 nt, Human
caauaacuccuaaaaggucaaac

SEQ ID NO: 754118 - RNA, 22 nt, Human
cacccaaugaugcacagacuua

SEQ ID NO: 754119 - RNA, 20 nt, Human
cagcaaaaucaacaacccuc

SEQ ID NO: 754120 - RNA, 24 nt, Human
cagugcagaucuguaucuucuuug

SEQ ID NO: 754121 - RNA, 24 nt, Human
cauaauuaaauauucaccauauac

SEQ ID NO: 754122 - RNA, 21 nt, Human
cauccucuuagaaaauucugg

SEQ ID NO: 754123 - RNA, 22 nt, Human
ccauccacucugaagccacuac

SEQ ID NO: 754124 - RNA, 18 nt, Human
cccaagaaauuaaucuuu

SEQ ID NO: 754125 - RNA, 21 nt, Human
cccaagaaauuaaucuuuaga

SEQ ID NO: 754126 - RNA, 22 nt, Human
ccugaagcccuauagcagacac

SEQ ID NO: 754127 - RNA, 19 nt, Human
ccuguaaacacuuuauugc

SEQ ID NO: 754128 - RNA, 18 nt, Human
cucaagauaaguggaaaa

SEQ ID NO: 754129 - RNA, 24 nt, Human
cugucacaauggggguugggaagg

SEQ ID NO: 754130 - RNA, 25 nt, Human
gaaaaacaaaaacaaaccuaauacc

SEQ ID NO: 754131 - RNA, 21 nt, Human
gaaacugucacaauggggguu

SEQ ID NO: 754132 - RNA, 21 nt, Human
gaacaaaugcaacaaauacuc

SEQ ID NO: 754133 - RNA, 19 nt, Human
gaagcccuauagcagacac

SEQ ID NO: 754134 - RNA, 22 nt, Human
gaagcugaugaucaagaaugau

SEQ ID NO: 754135 - RNA, 21 nt, Human
gcuguugcaauguggaaggca

SEQ ID NO: 754136 - RNA, 19 nt, Human
gggaaguaaaaaagguucc

SEQ ID NO: 754137 - RNA, 22 nt, Human
guaagcagguaaccuaccuggc

SEQ ID NO: 754138 - RNA, 20 nt, Human
gucagacucgguccccugaa

SEQ ID NO: 754139 - RNA, 19 nt, Human
guggaaaaacaaaaacaaa

SEQ ID NO: 754140 - RNA, 20 nt, Human
uaaaaaaaaacacccaauga

SEQ ID NO: 754141 - RNA, 22 nt, Human
uaaaaugugccuaugcucuccu

SEQ ID NO: 754142 - RNA, 22 nt, Human
uaaagcaaagaaaaacuuaaag

SEQ ID NO: 754143 - RNA, 24 nt, Human
uaaagcuacuagcuccuuuccaaa

SEQ ID NO: 754144 - RNA, 18 nt, Human
uaaauuaaaaaaaaacac

SEQ ID NO: 754145 - RNA, 20 nt, Human
uaacaugugcacauugugcu

SEQ ID NO: 754146 - RNA, 18 nt, Human
uaacugaagccugaacac

SEQ ID NO: 754147 - RNA, 22 nt, Human
uaagcacaaacaauccauuuac

SEQ ID NO: 754148 - RNA, 23 nt, Human
uaaggcacgauauuugucacaga

SEQ ID NO: 754149 - RNA, 20 nt, Human
uaaucuuuagaaaggaaaca

SEQ ID NO: 754150 - RNA, 26 nt, Human
uacagcuuuacaaaggacuacccuuc

SEQ ID NO: 754151 - RNA, 23 nt, Human
uauauaaaacuaacaugugcaca

SEQ ID NO: 754152 - RNA, 20 nt, Human
uauggugguggccuuaaagc

SEQ ID NO: 754153 - RNA, 21 nt, Human
ucacaacgcuauuucuagauc

SEQ ID NO: 754154 - RNA, 22 nt, Human
ucacagauaaauguauuguguu

SEQ ID NO: 754155 - RNA, 22 nt, Human
ucacaucaauugggaguucaag

SEQ ID NO: 754156 - RNA, 19 nt, Human
ucauuugcucccaagaaau

SEQ ID NO: 754157 - RNA, 22 nt, Human
uccaaaauaaugucccaaaaau

SEQ ID NO: 754158 - RNA, 22 nt, Human
uccacaaaaguacugugaccaa

SEQ ID NO: 754159 - RNA, 19 nt, Human
uccaggcuacaaguacaua

SEQ ID NO: 754160 - RNA, 18 nt, Human
ucuguaguuguuuagagg

SEQ ID NO: 754161 - RNA, 18 nt, Human
ucuguaucuucuuugcuu

SEQ ID NO: 754162 - RNA, 25 nt, Human
ugaaaauagcagcuuucagugagaa

SEQ ID NO: 754163 - RNA, 20 nt, Human
ugaacaaaugcaacaaauac

SEQ ID NO: 754164 - RNA, 22 nt, Human
ugaacaaaugcaacaaauacuc

SEQ ID NO: 754165 - RNA, 22 nt, Human
ugaaccauucuaaauaauaaca

SEQ ID NO: 754166 - RNA, 21 nt, Human
ugacuagacuaucugcgaaac

SEQ ID NO: 754167 - RNA, 23 nt, Human
ugagaaaggagaaggagccacgu

SEQ ID NO: 754168 - RNA, 22 nt, Human
ugaucuugguaggaaaaaaaaa

SEQ ID NO: 754169 - RNA, 18 nt, Human
ugaugcuaacauauauau

SEQ ID NO: 754170 - RNA, 22 nt, Human
ugcaaaaaaucaaguuuugcug

SEQ ID NO: 754171 - RNA, 18 nt, Human
ugcaaaggucaaaagcua

SEQ ID NO: 754172 - RNA, 19 nt, Human
ugcaacaaauacucauuug

SEQ ID NO: 754173 - RNA, 24 nt, Human
ugcuguugcaauguggaaggcagu

SEQ ID NO: 754174 - RNA, 26 nt, Human
uggaaaaggacagccacagcgucgac

SEQ ID NO: 754175 - RNA, 27 nt, Human
uggaaacuggauugcuuugguuccaua

SEQ ID NO: 754176 - RNA, 24 nt, Human
uggggaaguaaaaaagguucccag

SEQ ID NO: 754177 - RNA, 24 nt, Human
uggucacaucaauugggaguucaa

SEQ ID NO: 754178 - RNA, 21 nt, Human
ugucagacucgguccccugaa

SEQ ID NO: 754179 - RNA, 18 nt, Human
uguguuugucagacucgg

SEQ ID NO: 754180 - RNA, 20 nt, Human
uguguuugucagacucgguc

SEQ ID NO: 754181 - RNA, 23 nt, Human
uuaagcacaaacaauccauuuac

SEQ ID NO: 754182 - RNA, 22 nt, Human
uuacacguuucaagaaaaccau

SEQ ID NO: 754183 - RNA, 26 nt, Human
uucaacauaaauauaaauaaucacau

SEQ ID NO: 754184 - RNA, 19 nt, Human
uucagugagagucugcacu

SEQ ID NO: 754185 - RNA, 21 nt, Human
uugaaugcucauuacaaaugc

SEQ ID NO: 754186 - RNA, 19 nt, Human
uuuaaagggggaaaaaucc

SEQ ID NO: 754187 - RNA, 25 nt, Human
uuucuaaguagugcuugauaguuug

SEQ ID NO: 754188 - RNA, 22 nt, Human
uuuuacugauuguagaucaagu

SEQ ID NO: 754189 - RNA, 20 nt, Human
uuuuucaaacccauccacuc

SEQ ID NO: 754190 - RNA, 28 nt, Human
aaaaaaaaaaaaaaaaaaaacaaaagaa

SEQ ID NO: 754191 - RNA, 22 nt, Human
aaaaaaaacaaaagaaaacaag

SEQ ID NO: 754192 - RNA, 25 nt, Human
aaaaaaacaaaagaaaacaagaaca

SEQ ID NO: 754193 - RNA, 21 nt, Human
aaaaaacaaaagaaaacaaga

SEQ ID NO: 754194 - RNA, 21 nt, Human
aaaaaagaaacuauacaaacu

SEQ ID NO: 754195 - RNA, 22 nt, Human
aaaaacaaaagaaaacaagaac

SEQ ID NO: 754196 - RNA, 23 nt, Human
aaaaagaaaagcaccuaagagaa

SEQ ID NO: 754197 - RNA, 19 nt, Human
aaaacaaaagaaaacaaga

SEQ ID NO: 754198 - RNA, 22 nt, Human
aaaacaagaacagauaugacaa

SEQ ID NO: 754199 - RNA, 23 nt, Human
aaaagaaaacaagaacagauaug

SEQ ID NO: 754200 - RNA, 21 nt, Human
aaaagcaccuaagagaaucca

SEQ ID NO: 754201 - RNA, 19 nt, Human
aaacaagaacagauaugac

SEQ ID NO: 754202 - RNA, 24 nt, Human
aaacagccagauucugucucaaaa

SEQ ID NO: 754203 - RNA, 19 nt, Human
aaagaaaagcaccuaagag

SEQ ID NO: 754204 - RNA, 18 nt, Human
aaaggcugggaaacagca

SEQ ID NO: 754205 - RNA, 23 nt, Human
aacagaaugagacugcaucucaa

SEQ ID NO: 754206 - RNA, 22 nt, Human
aacagccagauucugucucaaa

SEQ ID NO: 754207 - RNA, 18 nt, Human
aacaugaugaaaccccgu

SEQ ID NO: 754208 - RNA, 19 nt, Human
aacaugaugaaaccccguc

SEQ ID NO: 754209 - RNA, 20 nt, Human
aacaugaugaaaccccgucc

SEQ ID NO: 754210 - RNA, 20 nt, Human
aacaugguaaagcuccgacu

SEQ ID NO: 754211 - RNA, 18 nt, Human
aagaaagaaaaagaaaag

SEQ ID NO: 754212 - RNA, 22 nt, Human
aagaaagaaagaaagaaaaaga

SEQ ID NO: 754213 - RNA, 18 nt, Human
aagacaaaauuggaucca

SEQ ID NO: 754214 - RNA, 25 nt, Human
aagacuacaacuacaugagcucuga

SEQ ID NO: 754215 - RNA, 18 nt, Human
aagaucauaaagcugcca

SEQ ID NO: 754216 - RNA, 19 nt, Human
aagcccuuacucagccacc

SEQ ID NO: 754217 - RNA, 21 nt, Human
aagcuccgacucuacaaaaaa

SEQ ID NO: 754218 - RNA, 24 nt, Human
aaggacuacaugggaaagccaaug

SEQ ID NO: 754219 - RNA, 21 nt, Human
aagggacucuggaggccaaga

SEQ ID NO: 754220 - RNA, 24 nt, Human
aaucacuugaggccaggaguugga

SEQ ID NO: 754221 - RNA, 18 nt, Human
aauggcuugaaccuggga

SEQ ID NO: 754222 - RNA, 24 nt, Human
aauggcuugaaccugggaggcgga

SEQ ID NO: 754223 - RNA, 20 nt, Human
aauuguuugaauccaggagg

SEQ ID NO: 754224 - RNA, 23 nt, Human
acaaagcaggucuggagagaagc

SEQ ID NO: 754225 - RNA, 22 nt, Human
acaccaguaaaacuaccaucug

SEQ ID NO: 754226 - RNA, 24 nt, Human
acagaaugagacugcaucucaaaa

SEQ ID NO: 754227 - RNA, 28 nt, Human
acauguaaaaaaagaaacuauacaaacu

SEQ ID NO: 754228 - RNA, 24 nt, Human
accccgucccuacuaaaaguacaa

SEQ ID NO: 754229 - RNA, 20 nt, Human
accugggcaguguggcccuc

SEQ ID NO: 754230 - RNA, 22 nt, Human
acucuggaggccaagagaggag

SEQ ID NO: 754231 - RNA, 24 nt, Human
acugcacuccaacuugggcaacag

SEQ ID NO: 754232 - RNA, 18 nt, Human
acugcacuucagccuggg

SEQ ID NO: 754233 - RNA, 24 nt, Human
acugcacuucagccugggaaacag

SEQ ID NO: 754234 - RNA, 23 nt, Human
acuucagccugggaaacagccag

SEQ ID NO: 754235 - RNA, 24 nt, Human
acuugaggucaggaguucgagacc

SEQ ID NO: 754236 - RNA, 19 nt, Human
agaacagauaugacaaugu

SEQ ID NO: 754237 - RNA, 22 nt, Human
agagaagccagauauaacccaa

SEQ ID NO: 754238 - RNA, 18 nt, Human
agagguugcagugagcug

SEQ ID NO: 754239 - RNA, 24 nt, Human
agagguugcagugagcugaguuca

SEQ ID NO: 754240 - RNA, 20 nt, Human
agagguugcagugagcuggc

SEQ ID NO: 754241 - RNA, 23 nt, Human
agaucacuugaggucaggaguuc

SEQ ID NO: 754242 - RNA, 24 nt, Human
agcacuuugggaggccgaggcagg

SEQ ID NO: 754243 - RNA, 23 nt, Human
agccagauaugguggugggugcc

SEQ ID NO: 754244 - RNA, 22 nt, Human
agccugggaaacagccagauuc

SEQ ID NO: 754245 - RNA, 21 nt, Human
agcuacuggggaagcugaggc

SEQ ID NO: 754246 - RNA, 18 nt, Human
agcugggcgugguggugc

SEQ ID NO: 754247 - RNA, 18 nt, Human
agcugggcgugguggugc

SEQ ID NO: 754248 - RNA, 23 nt, Human
aggaguucgagaccagucuggcc

SEQ ID NO: 754249 - RNA, 20 nt, Human
aggcagagguugcagugagc

SEQ ID NO: 754250 - RNA, 24 nt, Human
aggcagagguugcagugagcugag

SEQ ID NO: 754251 - RNA, 26 nt, Human
aggcagaucacuugaggucaggaguu

SEQ ID NO: 754252 - RNA, 22 nt, Human
aggcaggcagaucacuugaggu

SEQ ID NO: 754253 - RNA, 26 nt, Human
aggcaggcagaucacuugaggucagg

SEQ ID NO: 754254 - RNA, 22 nt, Human
aggcaugagaauggcuugaacc

SEQ ID NO: 754255 - RNA, 24 nt, Human
aggcaugagaauggcuugaaccug

SEQ ID NO: 754256 - RNA, 24 nt, Human
aggcgcgguggcucaugccuguaa

SEQ ID NO: 754257 - RNA, 20 nt, Human
aggcggagguugcagugagc

SEQ ID NO: 754258 - RNA, 24 nt, Human
aggcggagguugcagugagcugag

SEQ ID NO: 754259 - RNA, 24 nt, Human
agguagaaucucaaaaauuuaaac

SEQ ID NO: 754260 - RNA, 24 nt, Human
agucuggccaacaugaugaaaccc

SEQ ID NO: 754261 - RNA, 20 nt, Human
aucacuugaggccaggaguu

SEQ ID NO: 754262 - RNA, 24 nt, Human
aucaugccacugcacuccaacuug

SEQ ID NO: 754263 - RNA, 19 nt, Human
augccuguaaucccagcac

SEQ ID NO: 754264 - RNA, 19 nt, Human
auucccaucagcuaggaca

SEQ ID NO: 754265 - RNA, 26 nt, Human
caaacuagaaggcaaucucaucuuuu

SEQ ID NO: 754266 - RNA, 21 nt, Human
caaaucacacaucccaccccc

SEQ ID NO: 754267 - RNA, 21 nt, Human
caaaucucuacaccugcguca

SEQ ID NO: 754268 - RNA, 20 nt, Human
caacugcuggaagacagggu

SEQ ID NO: 754269 - RNA, 25 nt, Human
caagaucauaaagcugccaaacuuc

SEQ ID NO: 754270 - RNA, 18 nt, Human
caagcccuuacucagcca

SEQ ID NO: 754271 - RNA, 18 nt, Human
caaucucaucuuuuaaua

SEQ ID NO: 754272 - RNA, 24 nt, Human
caauucaaaucacacaucccaccc

SEQ ID NO: 754273 - RNA, 22 nt, Human
cacaggccuuaagacuacaacu

SEQ ID NO: 754274 - RNA, 20 nt, Human
cacccccaaccuacacuguc

SEQ ID NO: 754275 - RNA, 23 nt, Human
cacuaaggacuacaugggaaagc

SEQ ID NO: 754276 - RNA, 23 nt, Human
cacugcacuccaacuugggcaac

SEQ ID NO: 754277 - RNA, 24 nt, Human
cacugcacuccaacuugggcaaca

SEQ ID NO: 754278 - RNA, 18 nt, Human
cacugcacuucagccugg

SEQ ID NO: 754279 - RNA, 19 nt, Human
cacugcacuucagccuggg

SEQ ID NO: 754280 - RNA, 19 nt, Human
cacugcacuucagccuggg

SEQ ID NO: 754281 - RNA, 24 nt, Human
cacugcacuucagccugggaaaca

SEQ ID NO: 754282 - RNA, 21 nt, Human
cacuucagccugggaaacagc

SEQ ID NO: 754283 - RNA, 23 nt, Human
cacuugaggucaggaguucgaga

SEQ ID NO: 754284 - RNA, 27 nt, Human
cagaucacuugaggucaggaguucgag

SEQ ID NO: 754285 - RNA, 24 nt, Human
cagcacuuugggaggccgaggcag

SEQ ID NO: 754286 - RNA, 25 nt, Human
cagcacuuugggaggccgaggcagg

SEQ ID NO: 754287 - RNA, 20 nt, Human
caggaguuggagagcagccu

SEQ ID NO: 754288 - RNA, 18 nt, Human
caggcagaucacuugagg

SEQ ID NO: 754289 - RNA, 20 nt, Human
cauccuggcucagggccuuu

SEQ ID NO: 754290 - RNA, 22 nt, Human
cauccuggcucagggccuuugc

SEQ ID NO: 754291 - RNA, 26 nt, Human
caucucaaaaaaaaaaaaaaaaaaaa

SEQ ID NO: 754292 - RNA, 20 nt, Human
caugccuguaaucccagcac

SEQ ID NO: 754293 - RNA, 24 nt, Human
caugccuguaaucccagcacuuug

SEQ ID NO: 754294 - RNA, 23 nt, Human
ccacugcacuccaacuugggcaa

SEQ ID NO: 754295 - RNA, 24 nt, Human
ccacugcacuccaacuugggcaac

SEQ ID NO: 754296 - RNA, 19 nt, Human
ccacugcacuucagccugg

SEQ ID NO: 754297 - RNA, 20 nt, Human
ccacugcacuucagccuggg

SEQ ID NO: 754298 - RNA, 24 nt, Human
ccacugcacuucagccugggaaac

SEQ ID NO: 754299 - RNA, 26 nt, Human
ccacugcacuucagccugggaaacag

SEQ ID NO: 754300 - RNA, 22 nt, Human
ccaggaggcagagguugcagug

SEQ ID NO: 754301 - RNA, 20 nt, Human
cccaaccuacacuguccccc

SEQ ID NO: 754302 - RNA, 22 nt, Human
ccccaaccuacacugucccccu

SEQ ID NO: 754303 - RNA, 24 nt, Human
ccccaaccuacacugucccccuca

SEQ ID NO: 754304 - RNA, 18 nt, Human
ccccuguugcuccugcuc

SEQ ID NO: 754305 - RNA, 24 nt, Human
cccucaauucaaaucacacauccc

SEQ ID NO: 754306 - RNA, 20 nt, Human
cccugccacccaccuucccu

SEQ ID NO: 754307 - RNA, 25 nt, Human
ccgcggcggcgacaccgccucccuc

SEQ ID NO: 754308 - RNA, 22 nt, Human
ccucagaggcaacugccacucu

SEQ ID NO: 754309 - RNA, 18 nt, Human
ccucagccucuucaagug

SEQ ID NO: 754310 - RNA, 23 nt, Human
ccugaccaacaugguaaagcucc

SEQ ID NO: 754311 - RNA, 24 nt, Human
ccugaccaacaugguaaagcuccg

SEQ ID NO: 754312 - RNA, 19 nt, Human
ccugggaggcggagguugc

SEQ ID NO: 754313 - RNA, 21 nt, Human
ccuguaaucccagcuauucag

SEQ ID NO: 754314 - RNA, 20 nt, Human
ccuuauugcagcacauccug

SEQ ID NO: 754315 - RNA, 21 nt, Human
cgagaccagucuggccaacau

SEQ ID NO: 754316 - RNA, 24 nt, Human
cgauagaaucacuugaggccagga

SEQ ID NO: 754317 - RNA, 23 nt, Human
cguaccuguaauccuagcuacug

SEQ ID NO: 754318 - RNA, 18 nt, Human
cuaaucccagcaggugaa

SEQ ID NO: 754319 - RNA, 21 nt, Human
cuacaccugcgucaccgccgc

SEQ ID NO: 754320 - RNA, 24 nt, Human
cucaugccuguaaucccagcacuu

SEQ ID NO: 754321 - RNA, 22 nt, Human
cuggccaacaugaugaaacccc

SEQ ID NO: 754322 - RNA, 19 nt, Human
cugugcauguuuuucuucu

SEQ ID NO: 754323 - RNA, 19 nt, Human
cuuaucuuguaaacucugu

SEQ ID NO: 754324 - RNA, 20 nt, Human
cuuguaaacucugucucccu

SEQ ID NO: 754325 - RNA, 22 nt, Human
cuuguaaacucugucucccugc

SEQ ID NO: 754326 - RNA, 23 nt, Human
gaaacagcagccaggggcaggag

SEQ ID NO: 754327 - RNA, 19 nt, Human
gaaaccccgucccuacuaa

SEQ ID NO: 754328 - RNA, 24 nt, Human
gaagauuugggaggcagaggcgau

SEQ ID NO: 754329 - RNA, 22 nt, Human
gaaucacuugaggccaggaguu

SEQ ID NO: 754330 - RNA, 22 nt, Human
gagaaugaaagugaugaagggg

SEQ ID NO: 754331 - RNA, 23 nt, Human
gagaauuguuugaauccaggagg

SEQ ID NO: 754332 - RNA, 24 nt, Human
gagacaugagaauuguuugaaucc

SEQ ID NO: 754333 - RNA, 18 nt, Human
gagaucaugccacugcac

SEQ ID NO: 754334 - RNA, 25 nt, Human
gaggcaggcagaucacuugagguca

SEQ ID NO: 754335 - RNA, 22 nt, Human
gagguugcagugagcugagauc

SEQ ID NO: 754336 - RNA, 23 nt, Human
gaguucaugccacugcacuucag

SEQ ID NO: 754337 - RNA, 24 nt, Human
gaucacuugaggucaggaguucga

SEQ ID NO: 754338 - RNA, 22 nt, Human
gaugaaaggacaggguccagga

SEQ ID NO: 754339 - RNA, 18 nt, Human
gcaaucucaucuuuuaau

SEQ ID NO: 754340 - RNA, 21 nt, Human
gcagaucacuugaggucagga

SEQ ID NO: 754341 - RNA, 19 nt, Human
gcagcagaacagcacauga

SEQ ID NO: 754342 - RNA, 22 nt, Human
gccaacaugaugaaaccccguc

SEQ ID NO: 754343 - RNA, 24 nt, Human
gccacugcacuccaacuugggcaa

SEQ ID NO: 754344 - RNA, 20 nt, Human
gcggcggcgacaccgccucc

SEQ ID NO: 754345 - RNA, 20 nt, Human
gcugagaucaugccacugca

SEQ ID NO: 754346 - RNA, 23 nt, Human
gcuggauuucccacacagcaguu

SEQ ID NO: 754347 - RNA, 19 nt, Human
gcuugaaccugggaggcgg

SEQ ID NO: 754348 - RNA, 22 nt, Human
gcuugaaccugggaggcggagg

SEQ ID NO: 754349 - RNA, 22 nt, Human
ggaggcagagguugcagugagc

SEQ ID NO: 754350 - RNA, 18 nt, Human
ggaggugagguguugggg

SEQ ID NO: 754351 - RNA, 22 nt, Human
ggagguugcagugagcugagau

SEQ ID NO: 754352 - RNA, 23 nt, Human
ggagguugcagugagcugagauc

SEQ ID NO: 754353 - RNA, 24 nt, Human
ggagguugcagugagcugagauca

SEQ ID NO: 754354 - RNA, 21 nt, Human
ggcaguguggcccucaauuca

SEQ ID NO: 754355 - RNA, 24 nt, Human
gggcaggaggaaagcugggagagu

SEQ ID NO: 754356 - RNA, 24 nt, Human
gggcgugguggugcguaccuguaa

SEQ ID NO: 754357 - RNA, 18 nt, Human
ggucaggcgcgguggcuc

SEQ ID NO: 754358 - RNA, 21 nt, Human
ggucaggcgcgguggcucaug

SEQ ID NO: 754359 - RNA, 23 nt, Human
gguggcucaugccuguaauccca

SEQ ID NO: 754360 - RNA, 24 nt, Human
gguggcucaugccuguaaucccag

SEQ ID NO: 754361 - RNA, 24 nt, Human
gguggugcguaccuguaauccuag

SEQ ID NO: 754362 - RNA, 24 nt, Human
gguggugggugccuguaaucccag

SEQ ID NO: 754363 - RNA, 19 nt, Human
gugcauguuuuucuucugg

SEQ ID NO: 754364 - RNA, 18 nt, Human
gugccuguaaucccagcu

SEQ ID NO: 754365 - RNA, 23 nt, Human
guggugggugccuguaaucccag

SEQ ID NO: 754366 - RNA, 24 nt, Human
guugcagugagcugagaucaugcc

SEQ ID NO: 754367 - RNA, 21 nt, Human
uaaagcugccaaacuuccaaa

SEQ ID NO: 754368 - RNA, 22 nt, Human
uaagguagaaucucaaaaauuu

SEQ ID NO: 754369 - RNA, 22 nt, Human
uaccuguaauccuagcuacugg

SEQ ID NO: 754370 - RNA, 23 nt, Human
uaccuguaauccuagcuacuggg

SEQ ID NO: 754371 - RNA, 21 nt, Human
uaggauaaauuccaaauggcu

SEQ ID NO: 754372 - RNA, 20 nt, Human
ucaaaaaaaaaaaaaaaaaa

SEQ ID NO: 754373 - RNA, 22 nt, Human
ucaaaaaaaaaaaaaaaaaaaa

SEQ ID NO: 754374 - RNA, 24 nt, Human
ucacacaucccacccccugcugga

SEQ ID NO: 754375 - RNA, 26 nt, Human
ucacuuaguuugggaaaaaaaauuua

SEQ ID NO: 754376 - RNA, 20 nt, Human
ucacuugaggucaggaguuc

SEQ ID NO: 754377 - RNA, 21 nt, Human
ucagccugggaaacagccaga

SEQ ID NO: 754378 - RNA, 23 nt, Human
ucaugccacugcacuccaacuug

SEQ ID NO: 754379 - RNA, 22 nt, Human
ucaugccuguaaucccagcacu

SEQ ID NO: 754380 - RNA, 24 nt, Human
uccaugugcuaggauaaauuccaa

SEQ ID NO: 754381 - RNA, 21 nt, Human
ucccuacuaaaaguacaaaaa

SEQ ID NO: 754382 - RNA, 19 nt, Human
ucucaaaaaaaaaaaaaaa

SEQ ID NO: 754383 - RNA, 24 nt, Human
ucuggccaacaugaugaaaccccg

SEQ ID NO: 754384 - RNA, 24 nt, Human
ugaaccugggaggcggagguugca

SEQ ID NO: 754385 - RNA, 19 nt, Human
ugacauuacaucacuacuu

SEQ ID NO: 754386 - RNA, 19 nt, Human
ugacggagcacgaccuggg

SEQ ID NO: 754387 - RNA, 19 nt, Human
ugagaaugaaagugaugaa

SEQ ID NO: 754388 - RNA, 22 nt, Human
ugagcugagaucaugccacugc

SEQ ID NO: 754389 - RNA, 20 nt, Human
ugagcugggcgugguggugc

SEQ ID NO: 754390 - RNA, 18 nt, Human
ugaggagagagaggagga

SEQ ID NO: 754391 - RNA, 24 nt, Human
ugaggcaugagaauggcuugaacc

SEQ ID NO: 754392 - RNA, 20 nt, Human
ugaguaacccacgcagugaa

SEQ ID NO: 754393 - RNA, 20 nt, Human
ugaguucaguugaagguggg

SEQ ID NO: 754394 - RNA, 23 nt, Human
ugaucccugccacccaccuuccc

SEQ ID NO: 754395 - RNA, 18 nt, Human
ugaugaaaccccgucccu

SEQ ID NO: 754396 - RNA, 19 nt, Human
ugaugaggagagagaggag

SEQ ID NO: 754397 - RNA, 19 nt, Human
ugcaagcccuuacucagcc

SEQ ID NO: 754398 - RNA, 19 nt, Human
ugccaguguuauuacuaac

SEQ ID NO: 754399 - RNA, 21 nt, Human
ugccaguguuauuacuaacaa

SEQ ID NO: 754400 - RNA, 24 nt, Human
ugcccuagaacucaacugcuggaa

SEQ ID NO: 754401 - RNA, 23 nt, Human
ugccuguaaucccagcacuuugg

SEQ ID NO: 754402 - RNA, 24 nt, Human
ugccuguaaucccagcacuuuggg

SEQ ID NO: 754403 - RNA, 24 nt, Human
ugccuguaaucccagcuauucagg

SEQ ID NO: 754404 - RNA, 18 nt, Human
uggagagcagccugacca

SEQ ID NO: 754405 - RNA, 18 nt, Human
uggaggccaagagaggag

SEQ ID NO: 754406 - RNA, 24 nt, Human
uggcucaugccuguaaucccagca

SEQ ID NO: 754407 - RNA, 24 nt, Human
uggcuugaaccugggaggcggagg

SEQ ID NO: 754408 - RNA, 19 nt, Human
ugggaaacagcagccaggg

SEQ ID NO: 754409 - RNA, 24 nt, Human
ugggaggcagaggcgauagaauca

SEQ ID NO: 754410 - RNA, 20 nt, Human
ugggaggccgaggcaggcag

SEQ ID NO: 754411 - RNA, 24 nt, Human
ugggaggccgaggcaggcagauca

SEQ ID NO: 754412 - RNA, 29 nt, Human
ugggaggcggagguugcagugacaacggu

SEQ ID NO: 754413 - RNA, 24 nt, Human
ugggaggcggagguugcagugagc

SEQ ID NO: 754414 - RNA, 22 nt, Human
ugggggaggugagguguugggg

SEQ ID NO: 754415 - RNA, 24 nt, Human
uggucaggcgcgguggcucaugcc

SEQ ID NO: 754416 - RNA, 22 nt, Human
ugguggugcguaccuguaaucc

SEQ ID NO: 754417 - RNA, 24 nt, Human
ugguggugggugccuguaauccca

SEQ ID NO: 754418 - RNA, 25 nt, Human
uguaaaaaaagaaacuauacaaacu

SEQ ID NO: 754419 - RNA, 22 nt, Human
ugucaaguucucggcuuccguu

SEQ ID NO: 754420 - RNA, 21 nt, Human
uguccugggggaggugaggug

SEQ ID NO: 754421 - RNA, 19 nt, Human
ugugaaagacuacagggug

SEQ ID NO: 754422 - RNA, 18 nt, Human
ugugcuguugccuccagc

SEQ ID NO: 754423 - RNA, 18 nt, Human
ugugugagagauggacag

SEQ ID NO: 754424 - RNA, 21 nt, Human
uuagccagauauggugguggg

SEQ ID NO: 754425 - RNA, 22 nt, Human
uucaguugaaggugggggcugg

SEQ ID NO: 754426 - RNA, 24 nt, Human
uucaugccacugcacuucagccug

SEQ ID NO: 754427 - RNA, 24 nt, Human
uugaaccugggaggcggagguugc

SEQ ID NO: 754428 - RNA, 18 nt, Human
uugaggccaggaguugga

SEQ ID NO: 754429 - RNA, 19 nt, Human
uugaguucaguugaaggug

SEQ ID NO: 754430 - RNA, 18 nt, Human
uugcagugagcugagauc

SEQ ID NO: 754431 - RNA, 20 nt, Human
uugcagugagcugagaucau

SEQ ID NO: 754432 - RNA, 21 nt, Human
uugcagugagcugagaucaug

SEQ ID NO: 754433 - RNA, 20 nt, Human
uugcagugagcugaguucau

SEQ ID NO: 754434 - RNA, 21 nt, Human
uugcagugagcugaguucaug

SEQ ID NO: 754435 - RNA, 19 nt, Human
uugcagugagcugaguucc

SEQ ID NO: 754436 - RNA, 25 nt, Human
uugggaggccgaggcaggcagauca

SEQ ID NO: 754437 - RNA, 24 nt, Human
uuguuugaauccaggaggcagagg

SEQ ID NO: 754438 - RNA, 24 nt, Human
uuuaauacauuccucacccccaac

SEQ ID NO: 754439 - RNA, 24 nt, Human
uuucugugucuccuccucaguuga

SEQ ID NO: 754440 - RNA, 20 nt, Human
aaacaaaaauauccaacaac

SEQ ID NO: 754441 - RNA, 21 nt, Human
aaagcuuuccugggucugcuc

SEQ ID NO: 754442 - RNA, 19 nt, Human
aaaggacagaguccccuca

SEQ ID NO: 754443 - RNA, 23 nt, Human
aaaucccuucccagaucccacag

SEQ ID NO: 754444 - RNA, 24 nt, Human
aaccacauggucagcaucagcccu

SEQ ID NO: 754445 - RNA, 22 nt, Human
aacugcauugccccaagagagc

SEQ ID NO: 754446 - RNA, 21 nt, Human
aaggacagaguccccucaaau

SEQ ID NO: 754447 - RNA, 19 nt, Human
aaggcuaaagaauacaagc

SEQ ID NO: 754448 - RNA, 20 nt, Human
acgaagcagagagaagagaa

SEQ ID NO: 754449 - RNA, 19 nt, Human
acgaagcagagagaagagg

SEQ ID NO: 754450 - RNA, 25 nt, Human
acucaccccgugcuccccucccccu

SEQ ID NO: 754451 - RNA, 28 nt, Human
acucaccccgugcuccccucccccuccc

SEQ ID NO: 754452 - RNA, 22 nt, Human
acugcauugccccaagagagca

SEQ ID NO: 754453 - RNA, 21 nt, Human
acugcugcagaucuucccaug

SEQ ID NO: 754454 - RNA, 22 nt, Human
agaaauccugcagcucugauuc

SEQ ID NO: 754455 - RNA, 21 nt, Human
agaagagagguuaagcuuucu

SEQ ID NO: 754456 - RNA, 18 nt, Human
agaaggaacagcccccac

SEQ ID NO: 754457 - RNA, 22 nt, Human
agaaggaggaggguuaaggagc

SEQ ID NO: 754458 - RNA, 22 nt, Human
agacaagagaggauuauaccga

SEQ ID NO: 754459 - RNA, 22 nt, Human
agaccagaggcauagaccaaga

SEQ ID NO: 754460 - RNA, 20 nt, Human
agagcacugagcuccuaauu

SEQ ID NO: 754461 - RNA, 19 nt, Human
agaggcauagaccaagaac

SEQ ID NO: 754462 - RNA, 23 nt, Human
agaguccccucaaaucccuuccc

SEQ ID NO: 754463 - RNA, 24 nt, Human
agaguugucugucugguuguucag

SEQ ID NO: 754464 - RNA, 24 nt, Human
agaguugucugucugguuguucag

SEQ ID NO: 754465 - RNA, 25 nt, Human
agaguugucugucugguuguucagu

SEQ ID NO: 754466 - RNA, 22 nt, Human
agauuuggacaagggagagguu

SEQ ID NO: 754467 - RNA, 18 nt, Human
agcaggaagggaagccac

SEQ ID NO: 754468 - RNA, 21 nt, Human
agcaggaagggaagccacugg

SEQ ID NO: 754469 - RNA, 24 nt, Human
aggaauccuagauuuggacaaggg

SEQ ID NO: 754470 - RNA, 23 nt, Human
aggcuucuccaagaaggaacagc

SEQ ID NO: 754471 - RNA, 20 nt, Human
agggaagggucaggaggugc

SEQ ID NO: 754472 - RNA, 19 nt, Human
agggcagaaggaggagggu

SEQ ID NO: 754473 - RNA, 18 nt, Human
aggggccacgaagcagag

SEQ ID NO: 754474 - RNA, 18 nt, Human
aggugcugggagcaguga

SEQ ID NO: 754475 - RNA, 20 nt, Human
agugguggagggaagggaag

SEQ ID NO: 754476 - RNA, 19 nt, Human
aucccuucccagaucccac

SEQ ID NO: 754477 - RNA, 23 nt, Human
caaaucccuucccagaucccaca

SEQ ID NO: 754478 - RNA, 22 nt, Human
caacaacaauaacaaaagcccu

SEQ ID NO: 754479 - RNA, 24 nt, Human
caacaacaauaacaaaagcccuuc

SEQ ID NO: 754480 - RNA, 22 nt, Human
caagaaauccugcagcucugau

SEQ ID NO: 754481 - RNA, 21 nt, Human
caagagaggauuauaccgagc

SEQ ID NO: 754482 - RNA, 20 nt, Human
caaguucuuaaccagugaca

SEQ ID NO: 754483 - RNA, 19 nt, Human
cagaaggaggaggguuaag

SEQ ID NO: 754484 - RNA, 22 nt, Human
cagaguccccucaaaucccuuc

SEQ ID NO: 754485 - RNA, 24 nt, Human
cagaucccacagcacuuagaaagg

SEQ ID NO: 754486 - RNA, 20 nt, Human
cagcacuuagaaaagagaaa

SEQ ID NO: 754487 - RNA, 21 nt, Human
cagccacucuuccaaaaguuu

SEQ ID NO: 754488 - RNA, 23 nt, Human
caggagccgaggacuggcgggag

SEQ ID NO: 754489 - RNA, 18 nt, Human
cagggcagaaggaggagg

SEQ ID NO: 754490 - RNA, 27 nt, Human
cauaagcagccacucuuccaaaaguuu

SEQ ID NO: 754491 - RNA, 22 nt, Human
cauccuuccuccaugaucucaa

SEQ ID NO: 754492 - RNA, 20 nt, Human
ccaacaacaauaacaaaagg

SEQ ID NO: 754493 - RNA, 20 nt, Human
ccagcccacagaccagaggc

SEQ ID NO: 754494 - RNA, 23 nt, Human
cccacagaccagaggcauagacc

SEQ ID NO: 754495 - RNA, 24 nt, Human
ccccaauaaaaggacagagucccc

SEQ ID NO: 754496 - RNA, 24 nt, Human
ccccucacccuaucaccccuucaa

SEQ ID NO: 754497 - RNA, 23 nt, Human
cccuaucaccccuucaauuuaga

SEQ ID NO: 754498 - RNA, 18 nt, Human
cccucacccuaucacccc

SEQ ID NO: 754499 - RNA, 18 nt, Human
cccugccccggccccugc

SEQ ID NO: 754500 - RNA, 19 nt, Human
cccugccccggccccugcg

SEQ ID NO: 754501 - RNA, 23 nt, Human
ccuacaugagaacacagcagacu

SEQ ID NO: 754502 - RNA, 22 nt, Human
ccucaaaucccuucccagaucc

SEQ ID NO: 754503 - RNA, 22 nt, Human
ccucacccuaucaccccuucaa

SEQ ID NO: 754504 - RNA, 20 nt, Human
ccucuggccccucacccuau

SEQ ID NO: 754505 - RNA, 22 nt, Human
cgaagcagagagaagagagacu

SEQ ID NO: 754506 - RNA, 21 nt, Human
cggaggccccggcugcuuuuu

SEQ ID NO: 754507 - RNA, 27 nt, Human
cucacccuuuuaacugcauugccccaa

SEQ ID NO: 754508 - RNA, 18 nt, Human
cuccaagaaggaacagcc

SEQ ID NO: 754509 - RNA, 20 nt, Human
cucccucucuuuuccucugg

SEQ ID NO: 754510 - RNA, 21 nt, Human
cucuuccagaaagcuuuccug

SEQ ID NO: 754511 - RNA, 18 nt, Human
cuucuucauccuuccucc

SEQ ID NO: 754512 - RNA, 18 nt, Human
gaacacagcagacuuccc

SEQ ID NO: 754513 - RNA, 21 nt, Human
gacuucuucaggcaccuucuu

SEQ ID NO: 754514 - RNA, 25 nt, Human
gagaaaguaaggagcauaaaaauau

SEQ ID NO: 754515 - RNA, 22 nt, Human
gagcaggaagggaagccacugg

SEQ ID NO: 754516 - RNA, 23 nt, Human
gagcagugagggagagaggaggg

SEQ ID NO: 754517 - RNA, 18 nt, Human
gagcugaggagaggccua

SEQ ID NO: 754518 - RNA, 20 nt, Human
gaggagaggccuaggcccug

SEQ ID NO: 754519 - RNA, 20 nt, Human
gaggccccugccccggcccc

SEQ ID NO: 754520 - RNA, 21 nt, Human
gcagcaggagccgaggacugg

SEQ ID NO: 754521 - RNA, 19 nt, Human
gcuccccucccccuccccc

SEQ ID NO: 754522 - RNA, 21 nt, Human
gcuccccucccccucccccau

SEQ ID NO: 754523 - RNA, 21 nt, Human
ggaagggucaggaggugcugg

SEQ ID NO: 754524 - RNA, 23 nt, Human
ggagcagugagggagagaggagg

SEQ ID NO: 754525 - RNA, 24 nt, Human
ggaggcgagcaggaagggaagcca

SEQ ID NO: 754526 - RNA, 23 nt, Human
ggccacgaagcagagagaagaga

SEQ ID NO: 754527 - RNA, 21 nt, Human
ggccccucacccuaucacccc

SEQ ID NO: 754528 - RNA, 23 nt, Human
gggaaacaaaaauauccaacaac

SEQ ID NO: 754529 - RNA, 20 nt, Human
gggaacauuagcccugcggu

SEQ ID NO: 754530 - RNA, 20 nt, Human
gggaagggucaggaggugcu

SEQ ID NO: 754531 - RNA, 21 nt, Human
gggccacgaagcagagagaag

SEQ ID NO: 754532 - RNA, 18 nt, Human
gggccuuuuccuuuuccu

SEQ ID NO: 754533 - RNA, 19 nt, Human
ggucaggcaaaggggccag

SEQ ID NO: 754534 - RNA, 23 nt, Human
ggugcucacugauuuggggagac

SEQ ID NO: 754535 - RNA, 25 nt, Human
ggugcugggagcagugagggagaga

SEQ ID NO: 754536 - RNA, 18 nt, Human
gugagggagagaggaggg

SEQ ID NO: 754537 - RNA, 18 nt, Human
gugcugggagcagugagg

SEQ ID NO: 754538 - RNA, 24 nt, Human
uaacaggugcccugcuccaucucc

SEQ ID NO: 754539 - RNA, 22 nt, Human
ucacgcacacuuucucauuccu

SEQ ID NO: 754540 - RNA, 19 nt, Human
ucaguuggagcucuggugg

SEQ ID NO: 754541 - RNA, 22 nt, Human
ucaguuggagcucuggugggaa

SEQ ID NO: 754542 - RNA, 23 nt, Human
uccaacaacaauaacaaaagccc

SEQ ID NO: 754543 - RNA, 23 nt, Human
uccaagaaggaacagcccccacc

SEQ ID NO: 754544 - RNA, 18 nt, Human
ucccagguugacucaccc

SEQ ID NO: 754545 - RNA, 23 nt, Human
ucccagguugacucaccccgugc

SEQ ID NO: 754546 - RNA, 23 nt, Human
ucccagguugacucaccccgugc

SEQ ID NO: 754547 - RNA, 19 nt, Human
ucccugagaccgaguccca

SEQ ID NO: 754548 - RNA, 24 nt, Human
uccuugaaagagggaagggucagg

SEQ ID NO: 754549 - RNA, 21 nt, Human
ugaaaagacauuggccaaaaa

SEQ ID NO: 754550 - RNA, 18 nt, Human
ugaaagguuuggagagga

SEQ ID NO: 754551 - RNA, 24 nt, Human
ugacaguacagaaaagcaagucuc

SEQ ID NO: 754552 - RNA, 20 nt, Human
ugacucaccccgugcucccc

SEQ ID NO: 754553 - RNA, 24 nt, Human
ugagaacacagcagacuucccucc

SEQ ID NO: 754554 - RNA, 21 nt, Human
ugagggagagaggaggguccc

SEQ ID NO: 754555 - RNA, 18 nt, Human
ugcccugcuccaucuccc

SEQ ID NO: 754556 - RNA, 23 nt, Human
uggaaaccacauggucagcauca

SEQ ID NO: 754557 - RNA, 19 nt, Human
uggaaucucauaagcagcc

SEQ ID NO: 754558 - RNA, 19 nt, Human
uggagggaagggaagggcc

SEQ ID NO: 754559 - RNA, 19 nt, Human
uggcaggcaguguguccca

SEQ ID NO: 754560 - RNA, 20 nt, Human
uggcaggcagugugucccau

SEQ ID NO: 754561 - RNA, 23 nt, Human
uggccaaaaagagaaguugcagg

SEQ ID NO: 754562 - RNA, 18 nt, Human
ugucacaucgccagccuc

SEQ ID NO: 754563 - RNA, 24 nt, Human
uucauccuuccuccaugaucucaa

SEQ ID NO: 754564 - RNA, 20 nt, Human
uuccaugauugcgucuggcu

SEQ ID NO: 754565 - RNA, 24 nt, Human
uuccugggucugcucuagcugcau

SEQ ID NO: 754566 - RNA, 20 nt, Human
uugcagggagggcugacauc

SEQ ID NO: 754567 - RNA, 22 nt, Human
uugcagggagggcugacauccu

SEQ ID NO: 754568 - RNA, 19 nt, Human
uugcccugccagcccacag

SEQ ID NO: 754569 - RNA, 19 nt, Human
uuuaaaucuuccguucuuc

SEQ ID NO: 754570 - RNA, 20 nt, Human
uuuccuaccaggaauccuag

SEQ ID NO: 754571 - RNA, 18 nt, Human
uuuuccucugguucucca

SEQ ID NO: 754572 - RNA, 22 nt, Human
aaaaaaccucaaucaaacaaac

SEQ ID NO: 754573 - RNA, 22 nt, Human
aaaaaauaacauggaaauucau

SEQ ID NO: 754574 - RNA, 21 nt, Human
aaaaaccacccaccacaaaca

SEQ ID NO: 754575 - RNA, 21 nt, Human
aaaaauaagacacaaacagga

SEQ ID NO: 754576 - RNA, 23 nt, Human
aaaaccacccaccacaaacacac

SEQ ID NO: 754577 - RNA, 19 nt, Human
aaaccacccaccacaaaca

SEQ ID NO: 754578 - RNA, 25 nt, Human
aaagcaagaaaagcgguucaaagga

SEQ ID NO: 754579 - RNA, 18 nt, Human
aaagccauuuuagggagg

SEQ ID NO: 754580 - RNA, 20 nt, Human
aaagugaaccacccagugga

SEQ ID NO: 754581 - RNA, 21 nt, Human
aacagcucuuuguggaaacua

SEQ ID NO: 754582 - RNA, 19 nt, Human
aagagaccugaugauauug

SEQ ID NO: 754583 - RNA, 27 nt, Human
aagcaaccgccuuaacucuaaggucaa

SEQ ID NO: 754584 - RNA, 24 nt, Human
aaugcaacauagagugaacacucc

SEQ ID NO: 754585 - RNA, 21 nt, Human
acacacacuuucuccaugagu

SEQ ID NO: 754586 - RNA, 22 nt, Human
acagaagcagcaggaggcaaag

SEQ ID NO: 754587 - RNA, 23 nt, Human
acagggcacagaagcagcaggag

SEQ ID NO: 754588 - RNA, 26 nt, Human
acauacauaacacauuucuuuauaug

SEQ ID NO: 754589 - RNA, 20 nt, Human
acaugaaugaucuacccccc

SEQ ID NO: 754590 - RNA, 20 nt, Human
accaaaaaaccucaaucaaa

SEQ ID NO: 754591 - RNA, 23 nt, Human
agaaugcaacauagagugaacac

SEQ ID NO: 754592 - RNA, 23 nt, Human
agaugccaagauuacuggagacu

SEQ ID NO: 754593 - RNA, 19 nt, Human
agauuacuggagacugggc

SEQ ID NO: 754594 - RNA, 18 nt, Human
agcaagaaaagcgguuca

SEQ ID NO: 754595 - RNA, 19 nt, Human
aggccugacauuuugugug

SEQ ID NO: 754596 - RNA, 23 nt, Human
aggccugacauuuuguguggccu

SEQ ID NO: 754597 - RNA, 23 nt, Human
aggcuggcagcauggucuguggg

SEQ ID NO: 754598 - RNA, 23 nt, Human
aucaaacaaacgaacugaaagac

SEQ ID NO: 754599 - RNA, 25 nt, Human
augcacgaugcaccaagcgugcagu

SEQ ID NO: 754600 - RNA, 18 nt, Human
caaaaaagcaaccgccuu

SEQ ID NO: 754601 - RNA, 22 nt, Human
caacugacuggcccugcagaau

SEQ ID NO: 754602 - RNA, 22 nt, Human
caauaauaaauaacuuuagagg

SEQ ID NO: 754603 - RNA, 18 nt, Human
cacaaacaggacauggua

SEQ ID NO: 754604 - RNA, 20 nt, Human
caccaaaaaaccucaaucaa

SEQ ID NO: 754605 - RNA, 23 nt, Human
cacccgcagugcuuccaggaugg

SEQ ID NO: 754606 - RNA, 23 nt, Human
cagaaacaaguugucauugcacc

SEQ ID NO: 754607 - RNA, 21 nt, Human
cagaagcagcaggaggcaaag

SEQ ID NO: 754608 - RNA, 20 nt, Human
cagcagagccguaaaucaga

SEQ ID NO: 754609 - RNA, 18 nt, Human
caggaggcaaagugaacc

SEQ ID NO: 754610 - RNA, 21 nt, Human
cagggcacagaagcagcagga

SEQ ID NO: 754611 - RNA, 20 nt, Human
caugaaugaucuaccccccc

SEQ ID NO: 754612 - RNA, 24 nt, Human
cauuccaaccaccuagccacccag

SEQ ID NO: 754613 - RNA, 20 nt, Human
ccacccagcccaugcugggu

SEQ ID NO: 754614 - RNA, 21 nt, Human
ccagauacuugguugaaagau

SEQ ID NO: 754615 - RNA, 22 nt, Human
cccagcccaugcugggugcuaa

SEQ ID NO: 754616 - RNA, 24 nt, Human
cccaugcugggugcuaaucaaaag

SEQ ID NO: 754617 - RNA, 19 nt, Human
ccccccauaaacugaaagu

SEQ ID NO: 754618 - RNA, 22 nt, Human
cccucuauguuagaugaaaauc

SEQ ID NO: 754619 - RNA, 18 nt, Human
ccgccgcaccuccgcgcc

SEQ ID NO: 754620 - RNA, 24 nt, Human
ccgccgcaccuccgcgccgggacc

SEQ ID NO: 754621 - RNA, 20 nt, Human
ccgccgccuccggugcugau

SEQ ID NO: 754622 - RNA, 21 nt, Human
cgaacugaaagacacccuguc

SEQ ID NO: 754623 - RNA, 22 nt, Human
cgacacccgcagugcuuccagg

SEQ ID NO: 754624 - RNA, 19 nt, Human
cgccgugggugcggggguu

SEQ ID NO: 754625 - RNA, 22 nt, Human
cggcggcguccagggcggagcg

SEQ ID NO: 754626 - RNA, 19 nt, Human
cgggccggcucccacuccc

SEQ ID NO: 754627 - RNA, 20 nt, Human
cuagccacccagcccaugcu

SEQ ID NO: 754628 - RNA, 21 nt, Human
cuccccagccauauccacaga

SEQ ID NO: 754629 - RNA, 19 nt, Human
cuccccgccgcaccuccgc

SEQ ID NO: 754630 - RNA, 24 nt, Human
cuccgcgccgggaccggcggcguc

SEQ ID NO: 754631 - RNA, 22 nt, Human
cugaagccuuaacagggcacag

SEQ ID NO: 754632 - RNA, 20 nt, Human
cugcugcugcagccgccgcc

SEQ ID NO: 754633 - RNA, 26 nt, Human
cuggaacagaauauuccaacuucugu

SEQ ID NO: 754634 - RNA, 27 nt, Human
gacaaagaaaauauuuaaaaauaagac

SEQ ID NO: 754635 - RNA, 21 nt, Human
gagaaagucaugcccauagca

SEQ ID NO: 754636 - RNA, 21 nt, Human
gagggaaggaggggaagacag

SEQ ID NO: 754637 - RNA, 21 nt, Human
gagggaaggaggggaagacag

SEQ ID NO: 754638 - RNA, 21 nt, Human
gcaaagugaaccacccagugg

SEQ ID NO: 754639 - RNA, 21 nt, Human
gcagagagagagagggccacu

SEQ ID NO: 754640 - RNA, 23 nt, Human
gcuaaucaaaagaggauuuuacu

SEQ ID NO: 754641 - RNA, 18 nt, Human
gcugcugcagccgccgcc

SEQ ID NO: 754642 - RNA, 19 nt, Human
gcugcugcugcagccgccg

SEQ ID NO: 754643 - RNA, 19 nt, Human
ggaaaaagcaagaaaagcg

SEQ ID NO: 754644 - RNA, 20 nt, Human
ggaagacagugucagauucu

SEQ ID NO: 754645 - RNA, 19 nt, Human
ggccuugguccugaaaauu

SEQ ID NO: 754646 - RNA, 28 nt, Human
gggaaaaagcaagaaaagcgguucaaag

SEQ ID NO: 754647 - RNA, 21 nt, Human
gggaagcaggucuuaggaaag

SEQ ID NO: 754648 - RNA, 23 nt, Human
gggguuauaauaaaauucugguu

SEQ ID NO: 754649 - RNA, 21 nt, Human
gguguaccaaaaucugaauaa

SEQ ID NO: 754650 - RNA, 22 nt, Human
guacaacugacuggcccugcag

SEQ ID NO: 754651 - RNA, 18 nt, Human
gucaaagagaguugccau

SEQ ID NO: 754652 - RNA, 22 nt, Human
guccacugucauuccaaccacc

SEQ ID NO: 754653 - RNA, 24 nt, Human
gucccgacuuguugcugcugcugc

SEQ ID NO: 754654 - RNA, 20 nt, Human
uaaaaauaagacacaaacag

SEQ ID NO: 754655 - RNA, 22 nt, Human
uaaaaauaagacacaaacagga

SEQ ID NO: 754656 - RNA, 21 nt, Human
uaaaaggcuaaggugcaauca

SEQ ID NO: 754657 - RNA, 18 nt, Human
uaacauggaaauucauuc

SEQ ID NO: 754658 - RNA, 20 nt, Human
uacaugaacaaacauauaua

SEQ ID NO: 754659 - RNA, 18 nt, Human
uacuggagacugggccag

SEQ ID NO: 754660 - RNA, 22 nt, Human
uacuuuaaauaaaacagaaaca

SEQ ID NO: 754661 - RNA, 22 nt, Human
uacuuuagaaugcaacauagag

SEQ ID NO: 754662 - RNA, 18 nt, Human
uagcagagagagagaggg

SEQ ID NO: 754663 - RNA, 25 nt, Human
uagcugaggggaagguuauacacaa

SEQ ID NO: 754664 - RNA, 21 nt, Human
uaggccaccaaaaaaccucaa

SEQ ID NO: 754665 - RNA, 24 nt, Human
uauauauauguauauauguauaua

SEQ ID NO: 754666 - RNA, 26 nt, Human
uauauaucacaugaaugaucuacccu

SEQ ID NO: 754667 - RNA, 18 nt, Human
uauguauauauguauaua

SEQ ID NO: 754668 - RNA, 20 nt, Human
uauguauauauguauauauu

SEQ ID NO: 754669 - RNA, 23 nt, Human
uauguauauauguauauauuugu

SEQ ID NO: 754670 - RNA, 19 nt, Human
uauguguuauauauaugua

SEQ ID NO: 754671 - RNA, 20 nt, Human
uauguguuauauauauguau

SEQ ID NO: 754672 - RNA, 23 nt, Human
uauguguuauauauauguauaua

SEQ ID NO: 754673 - RNA, 23 nt, Human
uauuuuggaggcuuucaaauuag

SEQ ID NO: 754674 - RNA, 21 nt, Human
ucaagaacauuuucauuaugg

SEQ ID NO: 754675 - RNA, 23 nt, Human
ugcagaauacucagccaaagaag

SEQ ID NO: 754676 - RNA, 23 nt, Human
ugcauagaagcccagaugccaag

SEQ ID NO: 754677 - RNA, 19 nt, Human
ugccaagauuacuggagac

SEQ ID NO: 754678 - RNA, 25 nt, Human
uggcuccuggaacaacguucccucc

SEQ ID NO: 754679 - RNA, 19 nt, Human
uguauaaugauaaguuaca

SEQ ID NO: 754680 - RNA, 21 nt, Human
uguguuauauauauguauaua

SEQ ID NO: 754681 - RNA, 26 nt, Human
uguguuauauauauguauauauguaa

SEQ ID NO: 754682 - RNA, 18 nt, Human
uuacaggacaaagagcau

SEQ ID NO: 754683 - RNA, 23 nt, Human
uuacugcuauuaacagaacuuua

SEQ ID NO: 754684 - RNA, 21 nt, Human
uuagccuaaacagugcuauuc

SEQ ID NO: 754685 - RNA, 18 nt, Human
uugcugcugcugcagccg

SEQ ID NO: 754686 - RNA, 18 nt, Human
uuugcaagcuucuaaaag

SEQ ID NO: 754687 - RNA, 20 nt, Human
aaaaaaaaaaucagggggac

SEQ ID NO: 754688 - RNA, 22 nt, Human
aaaaaaaucagggggaccuaaa

SEQ ID NO: 754689 - RNA, 25 nt, Human
aaaacaccuagagaguauaaaaaca

SEQ ID NO: 754690 - RNA, 25 nt, Human
aaacacuaaagccugcaaaauagcu

SEQ ID NO: 754691 - RNA, 22 nt, Human
aaacugacuagcagcuccaggc

SEQ ID NO: 754692 - RNA, 23 nt, Human
aaagguguucauucucaauacac

SEQ ID NO: 754693 - RNA, 21 nt, Human
aaaguuugaggauucuaagcc

SEQ ID NO: 754694 - RNA, 19 nt, Human
aaauaaacacacaagccaa

SEQ ID NO: 754695 - RNA, 21 nt, Human
aaauagcucuaguuagacuuu

SEQ ID NO: 754696 - RNA, 23 nt, Human
aacagacuucuuauauaaucuaa

SEQ ID NO: 754697 - RNA, 19 nt, Human
aagugcuaagaccacaccu

SEQ ID NO: 754698 - RNA, 19 nt, Human
acaagccaaauauacaugg

SEQ ID NO: 754699 - RNA, 19 nt, Human
acaggagaagcagguaaua

SEQ ID NO: 754700 - RNA, 24 nt, Human
acgaaauaaacacacaagccaaau

SEQ ID NO: 754701 - RNA, 21 nt, Human
acuaaagccugcaaaauagcu

SEQ ID NO: 754702 - RNA, 22 nt, Human
acucuugcucuaaaaaaaaaaa

SEQ ID NO: 754703 - RNA, 18 nt, Human
acuggcucccuggcaaca

SEQ ID NO: 754704 - RNA, 20 nt, Human
agcaaacacaaggucaaaca

SEQ ID NO: 754705 - RNA, 18 nt, Human
agcagaccaauuuaccug

SEQ ID NO: 754706 - RNA, 23 nt, Human
aggacccucugcagaaagugcua

SEQ ID NO: 754707 - RNA, 20 nt, Human
aggagaagcagguaauaaaa

SEQ ID NO: 754708 - RNA, 20 nt, Human
caaaauagcucuaguuagac

SEQ ID NO: 754709 - RNA, 19 nt, Human
caaacagaaagcacauaug

SEQ ID NO: 754710 - RNA, 25 nt, Human
caaauaucuuccucuuuacagcuuc

SEQ ID NO: 754711 - RNA, 22 nt, Human
caacagcaagcagaccaauuua

SEQ ID NO: 754712 - RNA, 18 nt, Human
caaccccccuaaaauucc

SEQ ID NO: 754713 - RNA, 19 nt, Human
caaggucaaacagaaagca

SEQ ID NO: 754714 - RNA, 19 nt, Human
cacacuuucuuucucuccc

SEQ ID NO: 754715 - RNA, 18 nt, Human
caccuagagaguauaaaa

SEQ ID NO: 754716 - RNA, 18 nt, Human
cagcaaacacaaggucaa

SEQ ID NO: 754717 - RNA, 19 nt, Human
cagcaaacacaaggucaaa

SEQ ID NO: 754718 - RNA, 21 nt, Human
cagcaaacacaaggucaaaca

SEQ ID NO: 754719 - RNA, 21 nt, Human
cagcuuaaaaaaugagagcuc

SEQ ID NO: 754720 - RNA, 18 nt, Human
cauagaaaguacagggac

SEQ ID NO: 754721 - RNA, 20 nt, Human
cauagaaaguacagggacac

SEQ ID NO: 754722 - RNA, 19 nt, Human
caucuucuaucuugaaggc

SEQ ID NO: 754723 - RNA, 23 nt, Human
ccccuaaaauuccauucuaucuc

SEQ ID NO: 754724 - RNA, 21 nt, Human
ccuaaucuacuugcugccugc

SEQ ID NO: 754725 - RNA, 22 nt, Human
cgaaauaaacacacaagccaaa

SEQ ID NO: 754726 - RNA, 22 nt, Human
cucccuggcaacagacuucuua

SEQ ID NO: 754727 - RNA, 25 nt, Human
cucuaaaaaaaaaaaaucaggggga

SEQ ID NO: 754728 - RNA, 18 nt, Human
cucuggucaguuuuccuu

SEQ ID NO: 754729 - RNA, 19 nt, Human
cugaagcagcaguaggagg

SEQ ID NO: 754730 - RNA, 21 nt, Human
cuucuuguacaaagacauuga

SEQ ID NO: 754731 - RNA, 24 nt, Human
cuuggauuuuugcucuauuuuucc

SEQ ID NO: 754732 - RNA, 21 nt, Human
cuuucuuuugcaagagaagau

SEQ ID NO: 754733 - RNA, 23 nt, Human
gaaagcacauauguuugcuagaa

SEQ ID NO: 754734 - RNA, 19 nt, Human
gaaauaaacacacaagcca

SEQ ID NO: 754735 - RNA, 21 nt, Human
gggaggguacuaggaaugagg

SEQ ID NO: 754736 - RNA, 22 nt, Human
gguaauaaaacauuaaaaaaga

SEQ ID NO: 754737 - RNA, 22 nt, Human
gguuuggcagcaaacacaaggu

SEQ ID NO: 754738 - RNA, 24 nt, Human
guaauauguuaagaacucuugcuc

SEQ ID NO: 754739 - RNA, 19 nt, Human
uaaaaaaaaaaaaucaggg

SEQ ID NO: 754740 - RNA, 25 nt, Human
uaaaauaaaagcagagaggggaggc

SEQ ID NO: 754741 - RNA, 22 nt, Human
uaaacacuaaagccugcaaaau

SEQ ID NO: 754742 - RNA, 24 nt, Human
uacaacacaaaacaccuagagagu

SEQ ID NO: 754743 - RNA, 20 nt, Human
uacuugcugccugccuuagg

SEQ ID NO: 754744 - RNA, 20 nt, Human
uagaacaaauaucuuccucu

SEQ ID NO: 754745 - RNA, 21 nt, Human
uagcagcuccaggcuggaguu

SEQ ID NO: 754746 - RNA, 22 nt, Human
uaggcaaccccccuaaaauucc

SEQ ID NO: 754747 - RNA, 24 nt, Human
uaucuguauauuguucugaagcag

SEQ ID NO: 754748 - RNA, 22 nt, Human
uauuacaaacaguuggaaccca

SEQ ID NO: 754749 - RNA, 20 nt, Human
ucaaagagaugcagccuggc

SEQ ID NO: 754750 - RNA, 20 nt, Human
uccuaaucuacuugcugccu

SEQ ID NO: 754751 - RNA, 26 nt, Human
ucuaaaaaaaaaaaaucagggggacc

SEQ ID NO: 754752 - RNA, 21 nt, Human
ucuccuauccucaacucuuuu

SEQ ID NO: 754753 - RNA, 21 nt, Human
ugaagcagcaguaggaggacc

SEQ ID NO: 754754 - RNA, 20 nt, Human
ugcucuaaaaaaaaaaaauc

SEQ ID NO: 754755 - RNA, 23 nt, Human
ugcucuauuuuuccuucuuguac

SEQ ID NO: 754756 - RNA, 19 nt, Human
uguaauauguuaagaacuc

SEQ ID NO: 754757 - RNA, 22 nt, Human
uguaauauguuaagaacucuug

SEQ ID NO: 754758 - RNA, 18 nt, Human
uguuaagaacucuugcuc

SEQ ID NO: 754759 - RNA, 20 nt, Human
uugaggcuuaaaaaaauuag

SEQ ID NO: 754760 - RNA, 31 nt, Human
uugcucuaaaaaaaaaaaaucagggggaccc

SEQ ID NO: 754761 - RNA, 21 nt, Human
uuuccuucuacucaaguuucu

SEQ ID NO: 754762 - RNA, 20 nt, Human
aaaaaaaaaaagcacuaaua

SEQ ID NO: 754763 - RNA, 19 nt, Human
aaaaaaaagcacuaauaua

SEQ ID NO: 754764 - RNA, 25 nt, Human
aaaagacacauugaauuuuacuuaa

SEQ ID NO: 754765 - RNA, 19 nt, Human
aaacaacgucuccuccuaa

SEQ ID NO: 754766 - RNA, 24 nt, Human
aaaccaccaggccucuacuucagu

SEQ ID NO: 754767 - RNA, 18 nt, Human
aagcagauugaguugaau

SEQ ID NO: 754768 - RNA, 19 nt, Human
aagcuauaccagaggcaua

SEQ ID NO: 754769 - RNA, 20 nt, Human
aaggagucaauauaggaaac

SEQ ID NO: 754770 - RNA, 25 nt, Human
aaucacugaaauuacagaauaaaua

SEQ ID NO: 754771 - RNA, 21 nt, Human
acagucaaagucucaaguuuc

SEQ ID NO: 754772 - RNA, 22 nt, Human
accagcaggaagaaacugcagg

SEQ ID NO: 754773 - RNA, 18 nt, Human
acccgcccccucccuccc

SEQ ID NO: 754774 - RNA, 25 nt, Human
agauagugagugagaacauucgagc

SEQ ID NO: 754775 - RNA, 26 nt, Human
agugaagggugguagaacuauggaga

SEQ ID NO: 754776 - RNA, 23 nt, Human
augaugauaagaaagaaagccac

SEQ ID NO: 754777 - RNA, 21 nt, Human
auuuauaaucacugaaauuac

SEQ ID NO: 754778 - RNA, 24 nt, Human
caaaaacuuuuuauuaggaaagcu

SEQ ID NO: 754779 - RNA, 21 nt, Human
caagacccgcccccucccucc

SEQ ID NO: 754780 - RNA, 19 nt, Human
cacuagcagugaagggugg

SEQ ID NO: 754781 - RNA, 19 nt, Human
cacugaaauuacagaauaa

SEQ ID NO: 754782 - RNA, 21 nt, Human
caggguaggaaagaucgugag

SEQ ID NO: 754783 - RNA, 20 nt, Human
caucuguauucucuaguuau

SEQ ID NO: 754784 - RNA, 18 nt, Human
ccacaaaugacaaauguc

SEQ ID NO: 754785 - RNA, 20 nt, Human
ccaccaggccucuacuucag

SEQ ID NO: 754786 - RNA, 24 nt, Human
ccagaggcauaaucacuauacaau

SEQ ID NO: 754787 - RNA, 18 nt, Human
ccaggcaugcagcaaacu

SEQ ID NO: 754788 - RNA, 19 nt, Human
cgcccccucccuccccauc

SEQ ID NO: 754789 - RNA, 24 nt, Human
cuacaacuauaaaaaaaauaguua

SEQ ID NO: 754790 - RNA, 23 nt, Human
cuccaaaaaaucuuggcaucagg

SEQ ID NO: 754791 - RNA, 19 nt, Human
cucccuccccaucuugcag

SEQ ID NO: 754792 - RNA, 23 nt, Human
gaaacgcagggcuggaaccugaa

SEQ ID NO: 754793 - RNA, 21 nt, Human
gacccgcccccucccucccca

SEQ ID NO: 754794 - RNA, 21 nt, Human
gagaaaacauuaaaagugcuu

SEQ ID NO: 754795 - RNA, 22 nt, Human
gcuauaccagaggcauaaucac

SEQ ID NO: 754796 - RNA, 20 nt, Human
gugugugugugugugugugu

SEQ ID NO: 754797 - RNA, 21 nt, Human
gugugugugugugugugugug

SEQ ID NO: 754798 - RNA, 21 nt, Human
gugugugugugugugugugug

SEQ ID NO: 754799 - RNA, 21 nt, Human
gugugugugugugugugugug

SEQ ID NO: 754800 - RNA, 21 nt, Human
gugugugugugugugugugug

SEQ ID NO: 754801 - RNA, 23 nt, Human
uaaaagugcuuccuacaaagcug

SEQ ID NO: 754802 - RNA, 22 nt, Human
uaaaucaaaacuacaacuauaa

SEQ ID NO: 754803 - RNA, 25 nt, Human
uaagaaagugcagauguucuccaaa

SEQ ID NO: 754804 - RNA, 20 nt, Human
uaaucacugaaauuacagaa

SEQ ID NO: 754805 - RNA, 26 nt, Human
uaaucacugaaauuacagaauaaaua

SEQ ID NO: 754806 - RNA, 25 nt, Human
uacaaaacaacgucuccuccuaaac

SEQ ID NO: 754807 - RNA, 19 nt, Human
uaggaaagcuauaccagag

SEQ ID NO: 754808 - RNA, 21 nt, Human
uaggaaagcuauaccagaggc

SEQ ID NO: 754809 - RNA, 22 nt, Human
uaggauccauacaaugaucccc

SEQ ID NO: 754810 - RNA, 25 nt, Human
uauggcccuuccuccaaaucgcauc

SEQ ID NO: 754811 - RNA, 22 nt, Human
ucaggaugaagugucacaaaga

SEQ ID NO: 754812 - RNA, 21 nt, Human
ucugugccaugaugauaagaa

SEQ ID NO: 754813 - RNA, 24 nt, Human
ugaaauuacagaauaaauauaugc

SEQ ID NO: 754814 - RNA, 23 nt, Human
ugaagggugguagaacuauggag

SEQ ID NO: 754815 - RNA, 20 nt, Human
ugaagugucacaaagagggu

SEQ ID NO: 754816 - RNA, 21 nt, Human
ugagaacauucgagcaagacc

SEQ ID NO: 754817 - RNA, 23 nt, Human
ugauauauacccaguugcuuuuu

SEQ ID NO: 754818 - RNA, 20 nt, Human
uggagugugugugugugugu

SEQ ID NO: 754819 - RNA, 27 nt, Human
uggaguguguguguguguguguguggu

SEQ ID NO: 754820 - RNA, 23 nt, Human
ugguauggagugugugugugugu

SEQ ID NO: 754821 - RNA, 24 nt, Human
uguguguguaccugcaccagcagg

SEQ ID NO: 754822 - RNA, 19 nt, Human
uguguguguguguguaccu

SEQ ID NO: 754823 - RNA, 22 nt, Human
uguguguguguguguguaccug

SEQ ID NO: 754824 - RNA, 18 nt, Human
ugugugugugugugugug

SEQ ID NO: 754825 - RNA, 18 nt, Human
ugugugugugugugugug

SEQ ID NO: 754826 - RNA, 18 nt, Human
ugugugugugugugugug

SEQ ID NO: 754827 - RNA, 18 nt, Human
ugugugugugugugugug

SEQ ID NO: 754828 - RNA, 18 nt, Human
ugugugugugugugugug

SEQ ID NO: 754829 - RNA, 18 nt, Human
ugugugugugugugugug

SEQ ID NO: 754830 - RNA, 18 nt, Human
ugugugugugugugugug

SEQ ID NO: 754831 - RNA, 18 nt, Human
ugugugugugugugugug

SEQ ID NO: 754832 - RNA, 18 nt, Human
ugugugugugugugugug

SEQ ID NO: 754833 - RNA, 18 nt, Human
ugugugugugugugugug

SEQ ID NO: 754834 - RNA, 18 nt, Human
ugugugugugugugugug

SEQ ID NO: 754835 - RNA, 18 nt, Human
ugugugugugugugugug

SEQ ID NO: 754836 - RNA, 21 nt, Human
ugugugugugugugugugugu

SEQ ID NO: 754837 - RNA, 21 nt, Human
ugugugugugugugugugugu

SEQ ID NO: 754838 - RNA, 21 nt, Human
ugugugugugugugugugugu

SEQ ID NO: 754839 - RNA, 21 nt, Human
ugugugugugugugugugugu

SEQ ID NO: 754840 - RNA, 21 nt, Human
ugugugugugugugugugugu

SEQ ID NO: 754841 - RNA, 21 nt, Human
ugugugugugugugugugugu

SEQ ID NO: 754842 - RNA, 21 nt, Human
ugugugugugugugugugugu

SEQ ID NO: 754843 - RNA, 21 nt, Human
ugugugugugugugugugugu

SEQ ID NO: 754844 - RNA, 21 nt, Human
ugugugugugugugugugugu

SEQ ID NO: 754845 - RNA, 21 nt, Human
ugugugugugugugugugugu

SEQ ID NO: 754846 - RNA, 21 nt, Human
ugugugugugugugugugugu

SEQ ID NO: 754847 - RNA, 21 nt, Human
ugugugugugugugugugugu

SEQ ID NO: 754848 - RNA, 21 nt, Human
ugugugugugugugugugugu

SEQ ID NO: 754849 - RNA, 21 nt, Human
ugugugugugugugugugugu

SEQ ID NO: 754850 - RNA, 21 nt, Human
ugugugugugugugugugugu

SEQ ID NO: 754851 - RNA, 21 nt, Human
ugugugugugugugugugugu

SEQ ID NO: 754852 - RNA, 21 nt, Human
ugugugugugugugugugugu

SEQ ID NO: 754853 - RNA, 21 nt, Human
ugugugugugugugugugugu

SEQ ID NO: 754854 - RNA, 21 nt, Human
ugugugugugugugugugugu

SEQ ID NO: 754855 - RNA, 21 nt, Human
ugugugugugugugugugugu

SEQ ID NO: 754856 - RNA, 21 nt, Human
ugugugugugugugugugugu

SEQ ID NO: 754857 - RNA, 22 nt, Human
ugugugugugugugugugugua

SEQ ID NO: 754858 - RNA, 22 nt, Human
ugugugugugugugugugugug

SEQ ID NO: 754859 - RNA, 22 nt, Human
ugugugugugugugugugugug

SEQ ID NO: 754860 - RNA, 22 nt, Human
ugugugugugugugugugugug

SEQ ID NO: 754861 - RNA, 22 nt, Human
ugugugugugugugugugugug

SEQ ID NO: 754862 - RNA, 22 nt, Human
ugugugugugugugugugugug

SEQ ID NO: 754863 - RNA, 22 nt, Human
ugugugugugugugugugugug

SEQ ID NO: 754864 - RNA, 25 nt, Human
uucaggguaggaaagaucgugagga

SEQ ID NO: 754865 - RNA, 22 nt, Human
uugaauggaaaugguauggagu

SEQ ID NO: 754866 - RNA, 22 nt, Human
uuggcaucaggaugaaguguca

SEQ ID NO: 754867 - RNA, 19 nt, Human
uuuaaaucaaaacuacaac

SEQ ID NO: 754868 - RNA, 25 nt, Human
uuuguucaggguaggaaagaucgug

SEQ ID NO: 754869 - RNA, 22 nt, Human
aaaaacacaaaugucccgugua

SEQ ID NO: 754870 - RNA, 22 nt, Human
aaaccaaggugcgaccaccaac

SEQ ID NO: 754871 - RNA, 24 nt, Human
aaagugcugggauuacaggcguga

SEQ ID NO: 754872 - RNA, 21 nt, Human
aaccugaaacauuccagacca

SEQ ID NO: 754873 - RNA, 25 nt, Human
aagaauucgugagugguucucggcc

SEQ ID NO: 754874 - RNA, 18 nt, Human
aaggaacuaugucauaaa

SEQ ID NO: 754875 - RNA, 19 nt, Human
aagugcugggauuacaggc

SEQ ID NO: 754876 - RNA, 19 nt, Human
aagugcugggauuacaggc

SEQ ID NO: 754877 - RNA, 26 nt, Human
aagugcugggauuacaggcgugagcc

SEQ ID NO: 754878 - RNA, 24 nt, Human
aaguuugcauuuagaaaauuuuga

SEQ ID NO: 754879 - RNA, 27 nt, Human
aaugccaacuucugaaaaaauaaaaau

SEQ ID NO: 754880 - RNA, 18 nt, Human
acauuucacuccaguggg

SEQ ID NO: 754881 - RNA, 19 nt, Human
accaaggugcgaccaccaa

SEQ ID NO: 754882 - RNA, 19 nt, Human
agauaaugccaacuucuga

SEQ ID NO: 754883 - RNA, 20 nt, Human
agcaagagcaccaaacaaga

SEQ ID NO: 754884 - RNA, 20 nt, Human
aggguaucuuuuccuccaaa

SEQ ID NO: 754885 - RNA, 21 nt, Human
aggugggcaggggagcugcuc

SEQ ID NO: 754886 - RNA, 20 nt, Human
aguccccucccccugcagcu

SEQ ID NO: 754887 - RNA, 19 nt, Human
augaacucaagaaccauga

SEQ ID NO: 754888 - RNA, 24 nt, Human
caaagugcugggauuacaggcgug

SEQ ID NO: 754889 - RNA, 23 nt, Human
caaauaacuaaaguuugcauuua

SEQ ID NO: 754890 - RNA, 26 nt, Human
caacuucugaaaaaauaaaaauuuuc

SEQ ID NO: 754891 - RNA, 19 nt, Human
caaguauuucacugaucuc

SEQ ID NO: 754892 - RNA, 20 nt, Human
cacagaccuaaacauccuuu

SEQ ID NO: 754893 - RNA, 18 nt, Human
cacugaucucaguucuuc

SEQ ID NO: 754894 - RNA, 27 nt, Human
caugaaugaaguccccucccccugcag

SEQ ID NO: 754895 - RNA, 18 nt, Human
cauuucacuccaguggga

SEQ ID NO: 754896 - RNA, 20 nt, Human
ccaaagugcugggauuacag

SEQ ID NO: 754897 - RNA, 22 nt, Human
ccaaagugcugggauuacaggc

SEQ ID NO: 754898 - RNA, 22 nt, Human
ccaaagugcugggauuacaggc

SEQ ID NO: 754899 - RNA, 24 nt, Human
ccaaagugcugggauuacaggcgu

SEQ ID NO: 754900 - RNA, 23 nt, Human
ccuaaacauccuuugcaugugau

SEQ ID NO: 754901 - RNA, 24 nt, Human
ccuauaaacacuugaaugaaacaa

SEQ ID NO: 754902 - RNA, 24 nt, Human
ccugcagcuacaggguugaggggc

SEQ ID NO: 754903 - RNA, 18 nt, Human
cgaagguccucucgucuu

SEQ ID NO: 754904 - RNA, 21 nt, Human
cuccaaaaacacaaauguccc

SEQ ID NO: 754905 - RNA, 18 nt, Human
gauuacaggcgugagcca

SEQ ID NO: 754906 - RNA, 23 nt, Human
gauuacaggcgugagccacagca

SEQ ID NO: 754907 - RNA, 27 nt, Human
gauuacuccuucaugaacucaagaacc

SEQ ID NO: 754908 - RNA, 22 nt, Human
ggccuagaaauucuuuucuuca

SEQ ID NO: 754909 - RNA, 20 nt, Human
ggggagcugcucucucuccu

SEQ ID NO: 754910 - RNA, 19 nt, Human
gugggcaggggagcugcuc

SEQ ID NO: 754911 - RNA, 24 nt, Human
uaacugggaaauauaaccuuauaa

SEQ ID NO: 754912 - RNA, 23 nt, Human
uacaggcgugagccacagcaccc

SEQ ID NO: 754913 - RNA, 18 nt, Human
uacaggguugaggggcag

SEQ ID NO: 754914 - RNA, 19 nt, Human
uagcucaauucagacaauc

SEQ ID NO: 754915 - RNA, 23 nt, Human
uaucaaggaacgaguuacugguu

SEQ ID NO: 754916 - RNA, 19 nt, Human
uaugcagagauguuuaaaa

SEQ ID NO: 754917 - RNA, 30 nt, Human
ucaaaccaaggugcgaccaccaacccaugg

SEQ ID NO: 754918 - RNA, 22 nt, Human
uccaagagagugggcauaugga

SEQ ID NO: 754919 - RNA, 24 nt, Human
ucccaaagugcugggauuacaggc

SEQ ID NO: 754920 - RNA, 23 nt, Human
ucgaagguccucucgucuuucug

SEQ ID NO: 754921 - RNA, 18 nt, Human
ucucaaaaagugaaaaag

SEQ ID NO: 754922 - RNA, 19 nt, Human
ugaaaaagcaaaauuuucu

SEQ ID NO: 754923 - RNA, 22 nt, Human
ugaacuucaucucaaaaguaac

SEQ ID NO: 754924 - RNA, 19 nt, Human
ugaaugaaacaacucaaca

SEQ ID NO: 754925 - RNA, 22 nt, Human
ugacuucaaauaacuaaaguuu

SEQ ID NO: 754926 - RNA, 18 nt, Human
ugauaucgauuucccagg

SEQ ID NO: 754927 - RNA, 20 nt, Human
ugauguaauauuuuggaagg

SEQ ID NO: 754928 - RNA, 24 nt, Human
ugccaggaagauaaugccaacuuc

SEQ ID NO: 754929 - RNA, 25 nt, Human
ugcugggauuacaggcgugagccac

SEQ ID NO: 754930 - RNA, 19 nt, Human
uggaaggaacuaugucaua

SEQ ID NO: 754931 - RNA, 18 nt, Human
ugggauuacaggcgugag

SEQ ID NO: 754932 - RNA, 19 nt, Human
ugggauuacaggcgugagc

SEQ ID NO: 754933 - RNA, 21 nt, Human
ugggauuacaggcgugagcca

SEQ ID NO: 754934 - RNA, 22 nt, Human
ugggauuacaggcgugagccac

SEQ ID NO: 754935 - RNA, 22 nt, Human
ugggauuacaggcgugagccac

SEQ ID NO: 754936 - RNA, 23 nt, Human
ugggauuacaggcgugagccaca

SEQ ID NO: 754937 - RNA, 24 nt, Human
ugggauuacaggcgugagccacag

SEQ ID NO: 754938 - RNA, 26 nt, Human
ugggauuacaggcgugagccacagca

SEQ ID NO: 754939 - RNA, 27 nt, Human
ugggauuacaggcgugagccacagcac

SEQ ID NO: 754940 - RNA, 21 nt, Human
ugggcauauggauuaaaccug

SEQ ID NO: 754941 - RNA, 18 nt, Human
uggggaaagacuaucuaa

SEQ ID NO: 754942 - RNA, 18 nt, Human
uguagcuuuaaggagcuu

SEQ ID NO: 754943 - RNA, 21 nt, Human
uuacuccuucaugaacucaag

SEQ ID NO: 754944 - RNA, 19 nt, Human
uucaaauaacuaaaguuug

SEQ ID NO: 754945 - RNA, 21 nt, Human
uucucggccucccaaagugcu

SEQ ID NO: 754946 - RNA, 23 nt, Human
uugauacuaaaauaguccaacug

SEQ ID NO: 754947 - RNA, 24 nt, Human
aaaaccaaaaccaaacaaccccua

SEQ ID NO: 754948 - RNA, 20 nt, Human
aaacaaccccuaccaccaga

SEQ ID NO: 754949 - RNA, 20 nt, Human
aaagaaugugaaggauaagg

SEQ ID NO: 754950 - RNA, 21 nt, Human
aaaggaagggcaugaauucau

SEQ ID NO: 754951 - RNA, 25 nt, Human
aaaguauuaguaaguugcaaaauaa

SEQ ID NO: 754952 - RNA, 19 nt, Human
aaccaaacaaccccuacca

SEQ ID NO: 754953 - RNA, 19 nt, Human
aaccaaccaaacaaggcag

SEQ ID NO: 754954 - RNA, 18 nt, Human
aagacaaagucuuuauuc

SEQ ID NO: 754955 - RNA, 23 nt, Human
aaggagaaugucuuuggucucag

SEQ ID NO: 754956 - RNA, 18 nt, Human
aagggcaaaccacugagc

SEQ ID NO: 754957 - RNA, 20 nt, Human
aaggucacagaaccaaccaa

SEQ ID NO: 754958 - RNA, 27 nt, Human
aaguauuaguaaguugcaaaauaaacu

SEQ ID NO: 754959 - RNA, 19 nt, Human
aaucauggcucacugcagc

SEQ ID NO: 754960 - RNA, 24 nt, Human
acaugcaacaccacgccuggccug

SEQ ID NO: 754961 - RNA, 19 nt, Human
accaaacaaccccuaccac

SEQ ID NO: 754962 - RNA, 23 nt, Human
accccuaccaccagaauccauaa

SEQ ID NO: 754963 - RNA, 21 nt, Human
accuccuuuuccuucuuuuua

SEQ ID NO: 754964 - RNA, 23 nt, Human
acugagcacuuugauauuagaac

SEQ ID NO: 754965 - RNA, 19 nt, Human
acugcagccucaauuuccu

SEQ ID NO: 754966 - RNA, 20 nt, Human
agaaccaaccaaacaaggca

SEQ ID NO: 754967 - RNA, 19 nt, Human
agaauccauaagcuagaua

SEQ ID NO: 754968 - RNA, 24 nt, Human
agacagagacagugaaaaccaaaa

SEQ ID NO: 754969 - RNA, 23 nt, Human
agacagugaaaaccaaaaccaaa

SEQ ID NO: 754970 - RNA, 21 nt, Human
agaccuuggcuugucucucuu

SEQ ID NO: 754971 - RNA, 24 nt, Human
agagacagugaaaaccaaaaccaa

SEQ ID NO: 754972 - RNA, 24 nt, Human
agagacagugaaaaccaaaaccaa

SEQ ID NO: 754973 - RNA, 21 nt, Human
agagguggguaagauuuuagg

SEQ ID NO: 754974 - RNA, 22 nt, Human
agagguggguaagauuuuaggg

SEQ ID NO: 754975 - RNA, 19 nt, Human
aggaagaugagugaugucu

SEQ ID NO: 754976 - RNA, 21 nt, Human
agggcaagaacuaagucuugg

SEQ ID NO: 754977 - RNA, 18 nt, Human
agguagguacuagaugag

SEQ ID NO: 754978 - RNA, 23 nt, Human
aguucuuuuucgacgaggagaag

SEQ ID NO: 754979 - RNA, 24 nt, Human
aucacuuuacaaauaaaauugagg

SEQ ID NO: 754980 - RNA, 19 nt, Human
aucuacucgucccucccca

SEQ ID NO: 754981 - RNA, 22 nt, Human
aucuacucgucccuccccauua

SEQ ID NO: 754982 - RNA, 23 nt, Human
augaauucauaaaacucauaaaa

SEQ ID NO: 754983 - RNA, 22 nt, Human
auuaccauaggaaguugguggu

SEQ ID NO: 754984 - RNA, 24 nt, Human
caaaaccaaacaaccccuaccacc

SEQ ID NO: 754985 - RNA, 26 nt, Human
caaacaaccccuaccaccagaaucca

SEQ ID NO: 754986 - RNA, 23 nt, Human
cacacagauuaaguaauagccag

SEQ ID NO: 754987 - RNA, 18 nt, Human
caccauagcagcaaaaau

SEQ ID NO: 754988 - RNA, 19 nt, Human
cacugcagccucaauuucc

SEQ ID NO: 754989 - RNA, 24 nt, Human
cagaaacaaauaucuuuagaggug

SEQ ID NO: 754990 - RNA, 23 nt, Human
cagcaaaaauagaagaagucuga

SEQ ID NO: 754991 - RNA, 20 nt, Human
cagccucaauuuccugggcu

SEQ ID NO: 754992 - RNA, 23 nt, Human
cagccucaauuuccugggcucca

SEQ ID NO: 754993 - RNA, 18 nt, Human
cagugaaaaccaaaacca

SEQ ID NO: 754994 - RNA, 21 nt, Human
cagugaaaaccaaaaccaaac

SEQ ID NO: 754995 - RNA, 22 nt, Human
ccaaaaccaaacaaccccuacc

SEQ ID NO: 754996 - RNA, 24 nt, Human
ccaaccaaacaaggcagauacagu

SEQ ID NO: 754997 - RNA, 21 nt, Human
ccauaagcuagauaaucugga

SEQ ID NO: 754998 - RNA, 23 nt, Human
ccucaauuuccugggcuccagca

SEQ ID NO: 754999 - RNA, 18 nt, Human
ccuccuuuuccuucuuuu

SEQ ID NO: 755000 - RNA, 22 nt, Human
ccugacuuacagaugaugacac

SEQ ID NO: 755001 - RNA, 26 nt, Human
ccugcugccucaaccucccugaguag

SEQ ID NO: 755002 - RNA, 18 nt, Human
ccuuacagaccaagcucu

SEQ ID NO: 755003 - RNA, 18 nt, Human
cgccuggccuguuaauaa

SEQ ID NO: 755004 - RNA, 23 nt, Human
cucaaaauaaauuuuaaagagaa

SEQ ID NO: 755005 - RNA, 24 nt, Human
cucacugcagccucaauuuccugg

SEQ ID NO: 755006 - RNA, 28 nt, Human
cugauaagauggugaaggaguucuuuuu

SEQ ID NO: 755007 - RNA, 23 nt, Human
cugcagccucaauuuccugggcu

SEQ ID NO: 755008 - RNA, 24 nt, Human
cugccucaaccucccugaguagcu

SEQ ID NO: 755009 - RNA, 24 nt, Human
cuucuuuuuaccaucuacucgucc

SEQ ID NO: 755010 - RNA, 24 nt, Human
cuugcucugucaccuagguuggag

SEQ ID NO: 755011 - RNA, 21 nt, Human
cuugucucucuuuucucuuug

SEQ ID NO: 755012 - RNA, 22 nt, Human
cuuuacagugcauauuuucacu

SEQ ID NO: 755013 - RNA, 19 nt, Human
cuuuucccaacuuuucugu

SEQ ID NO: 755014 - RNA, 24 nt, Human
gaacuguauuucauggguagcaaa

SEQ ID NO: 755015 - RNA, 18 nt, Human
gacaaagaaugugaagga

SEQ ID NO: 755016 - RNA, 21 nt, Human
gacuacagacaugcaacacca

SEQ ID NO: 755017 - RNA, 23 nt, Human
gagacagugaaaaccaaaaccaa

SEQ ID NO: 755018 - RNA, 24 nt, Human
gaguagcugugacuacagacaugc

SEQ ID NO: 755019 - RNA, 22 nt, Human
gcuugucucucuuuucucuuug

SEQ ID NO: 755020 - RNA, 23 nt, Human
ggcagagcgucguaaagguggag

SEQ ID NO: 755021 - RNA, 19 nt, Human
gguuggagugugguggcuc

SEQ ID NO: 755022 - RNA, 19 nt, Human
gugaggaagaugagugaug

SEQ ID NO: 755023 - RNA, 21 nt, Human
gugggauaacucuucuucuca

SEQ ID NO: 755024 - RNA, 20 nt, Human
uaacuugaaaugcuacuagc

SEQ ID NO: 755025 - RNA, 24 nt, Human
uaagaacagaucagaauccccuuc

SEQ ID NO: 755026 - RNA, 24 nt, Human
uaaguggugugccuacugaaaucc

SEQ ID NO: 755027 - RNA, 20 nt, Human
uaaguugcaaaauaaacuaa

SEQ ID NO: 755028 - RNA, 26 nt, Human
uaaguugcaaaauaaacuaagguagg

SEQ ID NO: 755029 - RNA, 23 nt, Human
uaauacaaccaccauagcagcaa

SEQ ID NO: 755030 - RNA, 22 nt, Human
uacaaauaaaauugaggcucac

SEQ ID NO: 755031 - RNA, 23 nt, Human
uacaaccaccauagcagcaaaaa

SEQ ID NO: 755032 - RNA, 23 nt, Human
uacagacaugcaacaccacgccu

SEQ ID NO: 755033 - RNA, 18 nt, Human
uaccauaggaaguuggug

SEQ ID NO: 755034 - RNA, 26 nt, Human
uaccuccuuuuccuucuuuuuaccau

SEQ ID NO: 755035 - RNA, 22 nt, Human
uagaugauccugauugugagga

SEQ ID NO: 755036 - RNA, 22 nt, Human
uagcaaaaggucacagaaacaa

SEQ ID NO: 755037 - RNA, 22 nt, Human
uagggcaagaacuaagucuugg

SEQ ID NO: 755038 - RNA, 22 nt, Human
uagggcaguaaacaagacaaag

SEQ ID NO: 755039 - RNA, 24 nt, Human
uauugguuaauuuguuuuuuuuuu

SEQ ID NO: 755040 - RNA, 21 nt, Human
uauuuuuuuauuuuguauuag

SEQ ID NO: 755041 - RNA, 25 nt, Human
ucaaaguagcaguuaauauuuauug

SEQ ID NO: 755042 - RNA, 23 nt, Human
ucacugcagccucaauuuccugg

SEQ ID NO: 755043 - RNA, 24 nt, Human
ucacugcagccucaauuuccuggg

SEQ ID NO: 755044 - RNA, 18 nt, Human
ucuacucgucccucccca

SEQ ID NO: 755045 - RNA, 19 nt, Human
ucucucuuuucucuuuguc

SEQ ID NO: 755046 - RNA, 19 nt, Human
ucucuggggagacgacaaa

SEQ ID NO: 755047 - RNA, 20 nt, Human
ucuugcucugucaccuaggu

SEQ ID NO: 755048 - RNA, 23 nt, Human
ucuugcucugucaccuagguugg

SEQ ID NO: 755049 - RNA, 24 nt, Human
ucuugcucugucaccuagguugga

SEQ ID NO: 755050 - RNA, 24 nt, Human
ugaaaaccaaaaccaaacaacccc

SEQ ID NO: 755051 - RNA, 18 nt, Human
ugaaggauaaggagaggc

SEQ ID NO: 755052 - RNA, 21 nt, Human
ugacuacagacaugcaacacc

SEQ ID NO: 755053 - RNA, 22 nt, Human
ugagacagggucuugcucuguc

SEQ ID NO: 755054 - RNA, 20 nt, Human
ugauugugaggaagaugagu

SEQ ID NO: 755055 - RNA, 21 nt, Human
ugccucaaccucccugaguag

SEQ ID NO: 755056 - RNA, 24 nt, Human
ugcucugucaccuagguuggagug

SEQ ID NO: 755057 - RNA, 20 nt, Human
ugcugcagugaggucaaaaa

SEQ ID NO: 755058 - RNA, 20 nt, Human
uggagagcgaugucuuggag

SEQ ID NO: 755059 - RNA, 24 nt, Human
uggcucacugcagccucaauuucc

SEQ ID NO: 755060 - RNA, 23 nt, Human
uggcuugucucucuuuuggaagc

SEQ ID NO: 755061 - RNA, 21 nt, Human
uggugguaugauuauuccuga

SEQ ID NO: 755062 - RNA, 20 nt, Human
uguagucuguuuuuccuggc

SEQ ID NO: 755063 - RNA, 22 nt, Human
uguccagggacaugacguaaaa

SEQ ID NO: 755064 - RNA, 19 nt, Human
ugucuuugaauagaugauc

SEQ ID NO: 755065 - RNA, 26 nt, Human
ugugaaggauaaggagaggggaacgc

SEQ ID NO: 755066 - RNA, 18 nt, Human
uuaaagacucaaccuaca

SEQ ID NO: 755067 - RNA, 23 nt, Human
uucaagauaauacaucaguucuc

SEQ ID NO: 755068 - RNA, 19 nt, Human
uuccuggcucugcuucauu

SEQ ID NO: 755069 - RNA, 23 nt, Human
uucuucucaaaauaaauuuuaaa

SEQ ID NO: 755070 - RNA, 22 nt, Human
uugagacagggucuugcucugu

SEQ ID NO: 755071 - RNA, 24 nt, Human
uugcucugucaccuagguuggagu

SEQ ID NO: 755072 - RNA, 21 nt, Human
uuuaccuccuuuuccuucuuu

SEQ ID NO: 755073 - RNA, 26 nt, Human
uuuguuuuuuuuuuuuugagacaggg

SEQ ID NO: 755074 - RNA, 24 nt, Human
uuuuuuuuuugagacagggucuug

SEQ ID NO: 755075 - RNA, 20 nt, Human
uuuuuuuuuuugagacaggg

SEQ ID NO: 755076 - RNA, 23 nt, Human
uuuuuuuuuuuugagacaggguc

SEQ ID NO: 755077 - RNA, 24 nt, Human
uuuuuuuuuuuugagacagggucu

SEQ ID NO: 755078 - RNA, 24 nt, Human
uuuuuuuuuuuuuuuuuuuuaggg

SEQ ID NO: 755079 - RNA, 23 nt, Human
aaaaaaagaaaaagagaaaagag

SEQ ID NO: 755080 - RNA, 24 nt, Human
aaaaaaaucaauucauggugaggc

SEQ ID NO: 755081 - RNA, 23 nt, Human
aaaaagagaaaagagaaaagcaa

SEQ ID NO: 755082 - RNA, 21 nt, Human
aaaaguuaggacuaacugaaa

SEQ ID NO: 755083 - RNA, 20 nt, Human
aaaauugucccaaaacaaac

SEQ ID NO: 755084 - RNA, 21 nt, Human
aaacaaacacacacacaaaca

SEQ ID NO: 755085 - RNA, 23 nt, Human
aaacaaacacacacacaaacaaa

SEQ ID NO: 755086 - RNA, 21 nt, Human
aaaggaaguugcccuugauua

SEQ ID NO: 755087 - RNA, 25 nt, Human
aaauugguuuuauucaaacuuccua

SEQ ID NO: 755088 - RNA, 21 nt, Human
aacaaaaauaaaaaaaagaaa

SEQ ID NO: 755089 - RNA, 23 nt, Human
aacacacacacaaacaaaaaaaa

SEQ ID NO: 755090 - RNA, 23 nt, Human
aaccacuaaacacaccaggaagc

SEQ ID NO: 755091 - RNA, 23 nt, Human
aagagaaaugaaaaccaaagcca

SEQ ID NO: 755092 - RNA, 20 nt, Human
aauggcuuauuuuuggaggg

SEQ ID NO: 755093 - RNA, 22 nt, Human
acaaacaaaaaaaaucaauuca

SEQ ID NO: 755094 - RNA, 24 nt, Human
acaccccuuuccccaaauuaauaa

SEQ ID NO: 755095 - RNA, 23 nt, Human
acacguacaccagauaugucucu

SEQ ID NO: 755096 - RNA, 20 nt, Human
acagccuggcccaagaggcc

SEQ ID NO: 755097 - RNA, 22 nt, Human
accacuaaacacaccaggaagc

SEQ ID NO: 755098 - RNA, 25 nt, Human
acuaaugcuaacaccccuuucccca

SEQ ID NO: 755099 - RNA, 22 nt, Human
agaaaaagagaaaagagaaaag

SEQ ID NO: 755100 - RNA, 21 nt, Human
agagaaaagagaaaagcaagg

SEQ ID NO: 755101 - RNA, 23 nt, Human
agcaaacuauguacaaggaccca

SEQ ID NO: 755102 - RNA, 24 nt, Human
agccuuguguggggcuaaggccaa

SEQ ID NO: 755103 - RNA, 26 nt, Human
aggcagccaggggaagaacuggaaag

SEQ ID NO: 755104 - RNA, 24 nt, Human
agggacccccaaaaaggcagccag

SEQ ID NO: 755105 - RNA, 18 nt, Human
agggggagggauugcaac

SEQ ID NO: 755106 - RNA, 18 nt, Human
agugugggagggggaggg

SEQ ID NO: 755107 - RNA, 21 nt, Human
auaaagucucccuacuuaaaa

SEQ ID NO: 755108 - RNA, 22 nt, Human
auacugcaacacguacaccaga

SEQ ID NO: 755109 - RNA, 21 nt, Human
auucaccucuguacccuccag

SEQ ID NO: 755110 - RNA, 22 nt, Human
caaaacaaacacacacacaaac

SEQ ID NO: 755111 - RNA, 25 nt, Human
caaaacaaacacacacacaaacaaa

SEQ ID NO: 755112 - RNA, 24 nt, Human
caaaagcagucgguacauccagac

SEQ ID NO: 755113 - RNA, 21 nt, Human
caaacacacacacaaacaaaa

SEQ ID NO: 755114 - RNA, 25 nt, Human
caaacacacacacaaacaaaaaaaa

SEQ ID NO: 755115 - RNA, 26 nt, Human
caaguuagaaaaauugguuuuauuca

SEQ ID NO: 755116 - RNA, 20 nt, Human
cacaccaggaagcaucauau

SEQ ID NO: 755117 - RNA, 24 nt, Human
cacacgcgagcuaaguaguuccac

SEQ ID NO: 755118 - RNA, 21 nt, Human
cacagccuggcccaagaggcc

SEQ ID NO: 755119 - RNA, 23 nt, Human
cacagccuggcccaagaggccga

SEQ ID NO: 755120 - RNA, 18 nt, Human
caccgagaaaaggcagug

SEQ ID NO: 755121 - RNA, 26 nt, Human
caccucucuccaaguugagacagggg

SEQ ID NO: 755122 - RNA, 19 nt, Human
caccugcuacccaguucuc

SEQ ID NO: 755123 - RNA, 20 nt, Human
cagcacagaaaauuggaaug

SEQ ID NO: 755124 - RNA, 23 nt, Human
cccaagaggccgagcaguugaga

SEQ ID NO: 755125 - RNA, 23 nt, Human
cccagggcuggcugggcacagcc

SEQ ID NO: 755126 - RNA, 18 nt, Human
cccauggcuggggagaga

SEQ ID NO: 755127 - RNA, 20 nt, Human
cccccaaaaaggcagccagg

SEQ ID NO: 755128 - RNA, 20 nt, Human
cccguguugcucacauccug

SEQ ID NO: 755129 - RNA, 18 nt, Human
ccucaaauggcuuuggcu

SEQ ID NO: 755130 - RNA, 21 nt, Human
ccuccugaaaaaaaccuuaca

SEQ ID NO: 755131 - RNA, 19 nt, Human
ccugcgcuggggcugugaa

SEQ ID NO: 755132 - RNA, 23 nt, Human
cucccagggcuggcugggcacag

SEQ ID NO: 755133 - RNA, 25 nt, Human
cucccagggcuggcugggcacagcc

SEQ ID NO: 755134 - RNA, 19 nt, Human
cugaaaaaaaccuuacaau

SEQ ID NO: 755135 - RNA, 21 nt, Human
cugcgcuggggcugugaacgc

SEQ ID NO: 755136 - RNA, 25 nt, Human
cugugugcaauggcuuauuuuugga

SEQ ID NO: 755137 - RNA, 24 nt, Human
cuuccugccgagaaaucucccaaa

SEQ ID NO: 755138 - RNA, 19 nt, Human
cuuuuuauuccaaaagcag

SEQ ID NO: 755139 - RNA, 19 nt, Human
gcaguaguaggacuuuggc

SEQ ID NO: 755140 - RNA, 18 nt, Human
gcgcuggggcugugaacg

SEQ ID NO: 755141 - RNA, 18 nt, Human
gcuaacaccccuuucccc

SEQ ID NO: 755142 - RNA, 18 nt, Human
ggacuuuggcacuaugaa

SEQ ID NO: 755143 - RNA, 19 nt, Human
ggcaccaaccacuaaacac

SEQ ID NO: 755144 - RNA, 21 nt, Human
ggcaccaaccacuaaacacac

SEQ ID NO: 755145 - RNA, 20 nt, Human
gggggcagugugggaggggg

SEQ ID NO: 755146 - RNA, 19 nt, Human
gucuacuguuugaguuuuc

SEQ ID NO: 755147 - RNA, 24 nt, Human
guuuagucuuugcuuuauugaguu

SEQ ID NO: 755148 - RNA, 26 nt, Human
uaaaaauaaagucucccuacuuaaaa

SEQ ID NO: 755149 - RNA, 20 nt, Human
uaaagucucccuacuuaaaa

SEQ ID NO: 755150 - RNA, 25 nt, Human
uaacugaaaaagugcacucagguau

SEQ ID NO: 755151 - RNA, 18 nt, Human
uaaggagggggcggugag

SEQ ID NO: 755152 - RNA, 18 nt, Human
uacaaugguagugcugga

SEQ ID NO: 755153 - RNA, 22 nt, Human
uacaaugguagugcuggaaaag

SEQ ID NO: 755154 - RNA, 19 nt, Human
uaccacaccgagaaaaggc

SEQ ID NO: 755155 - RNA, 25 nt, Human
uaggacuaacugaaaaagugcacuc

SEQ ID NO: 755156 - RNA, 26 nt, Human
uaggacuuuggcacuaugaacaauuc

SEQ ID NO: 755157 - RNA, 26 nt, Human
uaucauggcacuaaugcuaacacccc

SEQ ID NO: 755158 - RNA, 22 nt, Human
ucaaauggcuuuggcuuuccuu

SEQ ID NO: 755159 - RNA, 20 nt, Human
ucagguaucuaaaauugucc

SEQ ID NO: 755160 - RNA, 22 nt, Human
ucaugcuaacagaggcgggagc

SEQ ID NO: 755161 - RNA, 18 nt, Human
ucauggugaggcuuugag

SEQ ID NO: 755162 - RNA, 22 nt, Human
ucccaaaacaaacacacacaca

SEQ ID NO: 755163 - RNA, 24 nt, Human
ucccaaaacaaacacacacacaaa

SEQ ID NO: 755164 - RNA, 23 nt, Human
uccccaaauuaauaaaacaaaaa

SEQ ID NO: 755165 - RNA, 19 nt, Human
ucccccucaaauggcuuug

SEQ ID NO: 755166 - RNA, 22 nt, Human
ucgguacauccagaccugcgcu

SEQ ID NO: 755167 - RNA, 23 nt, Human
ucucuccaaguugagacaggggc

SEQ ID NO: 755168 - RNA, 21 nt, Human
ucugcugguauuuagaaaggu

SEQ ID NO: 755169 - RNA, 21 nt, Human
ucugugugcaauggcuuauuu

SEQ ID NO: 755170 - RNA, 18 nt, Human
ugaaaacgcaguaguagg

SEQ ID NO: 755171 - RNA, 25 nt, Human
ugagacaggggccuggaucggaucc

SEQ ID NO: 755172 - RNA, 21 nt, Human
ugcaaccagaguucauacugc

SEQ ID NO: 755173 - RNA, 22 nt, Human
ugcaaccagaguucauacugca

SEQ ID NO: 755174 - RNA, 19 nt, Human
ugcuggaaaaggaaguugc

SEQ ID NO: 755175 - RNA, 21 nt, Human
uggagggggauaaggaggggg

SEQ ID NO: 755176 - RNA, 20 nt, Human
uggcccaagaggccgagcag

SEQ ID NO: 755177 - RNA, 21 nt, Human
uguacaaggacccacugaaaa

SEQ ID NO: 755178 - RNA, 22 nt, Human
ugucacaauaguacugaucaug

SEQ ID NO: 755179 - RNA, 18 nt, Human
uuacaacaaaugagcaac

SEQ ID NO: 755180 - RNA, 25 nt, Human
uuagaaaggugcuuaaagaagucag

SEQ ID NO: 755181 - RNA, 24 nt, Human
uuagcccucccuccugaaaaaaac

SEQ ID NO: 755182 - RNA, 19 nt, Human
uuauuguuguuguuuuaau

SEQ ID NO: 755183 - RNA, 18 nt, Human
uucaaagacggagcgucc

SEQ ID NO: 755184 - RNA, 23 nt, Human
uugcccuugauuaaaaagguaac

SEQ ID NO: 755185 - RNA, 21 nt, Human
uuggcacuaugaacaauuccc

SEQ ID NO: 755186 - RNA, 27 nt, Human
uugguuuuauucaaacuuccuagcguu

SEQ ID NO: 755187 - RNA, 20 nt, Human
uuuggagggggauaaggagg

SEQ ID NO: 755188 - RNA, 21 nt, Human
aaaaaagaaaaaugcugaagg

SEQ ID NO: 755189 - RNA, 22 nt, Human
aaaaaagaaaaaugcugaagga

SEQ ID NO: 755190 - RNA, 21 nt, Human
aaaagaaguaaauuccuaugu

SEQ ID NO: 755191 - RNA, 19 nt, Human
aaacaauaccaccucuauc

SEQ ID NO: 755192 - RNA, 26 nt, Human
aaacagaggcccaaagagcucaagca

SEQ ID NO: 755193 - RNA, 19 nt, Human
aaauaaacuuaaacuauaa

SEQ ID NO: 755194 - RNA, 18 nt, Human
aagaaaacuuggcaaaua

SEQ ID NO: 755195 - RNA, 23 nt, Human
aagaagaaugccaaccagcgccc

SEQ ID NO: 755196 - RNA, 18 nt, Human
aagcccuuuuuaggucau

SEQ ID NO: 755197 - RNA, 20 nt, Human
aaggacccaauaucugcccu

SEQ ID NO: 755198 - RNA, 22 nt, Human
aauacauugauaaauucauaca

SEQ ID NO: 755199 - RNA, 21 nt, Human
acaaaguaauaaacagugcac

SEQ ID NO: 755200 - RNA, 22 nt, Human
acaaauccaaagggaacugcca

SEQ ID NO: 755201 - RNA, 27 nt, Human
acacagaaaauggaggaaaggggaccc

SEQ ID NO: 755202 - RNA, 25 nt, Human
acagaaauauugcacaaaguauguc

SEQ ID NO: 755203 - RNA, 24 nt, Human
acagcaaagaccauauccugggug

SEQ ID NO: 755204 - RNA, 23 nt, Human
accccacccugggggccuugcag

SEQ ID NO: 755205 - RNA, 18 nt, Human
accgcauauugagcuaua

SEQ ID NO: 755206 - RNA, 20 nt, Human
acgacuguuaauuagccgca

SEQ ID NO: 755207 - RNA, 18 nt, Human
acuagaaaacuccccacc

SEQ ID NO: 755208 - RNA, 22 nt, Human
acuccccaccccagggagcaca

SEQ ID NO: 755209 - RNA, 21 nt, Human
acuuuccucuucugugagauu

SEQ ID NO: 755210 - RNA, 23 nt, Human
agagucaguugaaguuacaagga

SEQ ID NO: 755211 - RNA, 18 nt, Human
agauaguaaaaucaaacu

SEQ ID NO: 755212 - RNA, 20 nt, Human
agauggucuaguaacuagaa

SEQ ID NO: 755213 - RNA, 21 nt, Human
aguugaaguuacaaggaccca

SEQ ID NO: 755214 - RNA, 18 nt, Human
auccuggguguccugggg

SEQ ID NO: 755215 - RNA, 24 nt, Human
augaaaaaagaaaaaugcugaagg

SEQ ID NO: 755216 - RNA, 20 nt, Human
augaaacacacuguauccug

SEQ ID NO: 755217 - RNA, 22 nt, Human
augagcccagagcacauacaaa

SEQ ID NO: 755218 - RNA, 23 nt, Human
augccagagugaacaucagugag

SEQ ID NO: 755219 - RNA, 19 nt, Human
auuuagaaagcucccccaa

SEQ ID NO: 755220 - RNA, 19 nt, Human
auuuuuuaauauuuauauu

SEQ ID NO: 755221 - RNA, 23 nt, Human
caaacagcaaagaccauauccug

SEQ ID NO: 755222 - RNA, 19 nt, Human
caacucugcgaucguauag

SEQ ID NO: 755223 - RNA, 19 nt, Human
caacugcugcagcucacga

SEQ ID NO: 755224 - RNA, 23 nt, Human
cacaccuacauaucucccuacaa

SEQ ID NO: 755225 - RNA, 24 nt, Human
cacagcuuuccuucacucuaauuc

SEQ ID NO: 755226 - RNA, 26 nt, Human
cauacaaauccaaagggaacugccac

SEQ ID NO: 755227 - RNA, 19 nt, Human
cauucuuggcaccggaaca

SEQ ID NO: 755228 - RNA, 20 nt, Human
ccaacuucucucacgguucu

SEQ ID NO: 755229 - RNA, 18 nt, Human
ccagagcacauacaaauc

SEQ ID NO: 755230 - RNA, 22 nt, Human
ccaugaacagagaggaaugcca

SEQ ID NO: 755231 - RNA, 19 nt, Human
cccaccaccccacccuggg

SEQ ID NO: 755232 - RNA, 21 nt, Human
cccaccauuucuuccuuuuaa

SEQ ID NO: 755233 - RNA, 19 nt, Human
ccccaccaccccacccugg

SEQ ID NO: 755234 - RNA, 23 nt, Human
ccccaccccagggagcacaccua

SEQ ID NO: 755235 - RNA, 21 nt, Human
ccccuugagacuggggaugag

SEQ ID NO: 755236 - RNA, 19 nt, Human
ccggaacagaugaaacaca

SEQ ID NO: 755237 - RNA, 19 nt, Human
ccuaugucagaguaaccga

SEQ ID NO: 755238 - RNA, 22 nt, Human
ccuguuucagagacauuuaaac

SEQ ID NO: 755239 - RNA, 22 nt, Human
ccuugcagugacuccugauggg

SEQ ID NO: 755240 - RNA, 21 nt, Human
cguauagacauguuuccugau

SEQ ID NO: 755241 - RNA, 24 nt, Human
cuaauucauucuugacuagagccu

SEQ ID NO: 755242 - RNA, 21 nt, Human
cucccaucaccaauacacaga

SEQ ID NO: 755243 - RNA, 19 nt, Human
cuccccaccaccccacccu

SEQ ID NO: 755244 - RNA, 18 nt, Human
cugcacauaccugccaga

SEQ ID NO: 755245 - RNA, 22 nt, Human
cuuaaacuauaaauuagaaaca

SEQ ID NO: 755246 - RNA, 23 nt, Human
cuugcagugacuccugaugggaa

SEQ ID NO: 755247 - RNA, 18 nt, Human
gagcacauacaaauccaa

SEQ ID NO: 755248 - RNA, 19 nt, Human
gagcccagagcacauacaa

SEQ ID NO: 755249 - RNA, 23 nt, Human
gcuggucucauuguccuggcuuc

SEQ ID NO: 755250 - RNA, 22 nt, Human
ggaacagaugaaacacacugua

SEQ ID NO: 755251 - RNA, 22 nt, Human
gggagccuauuccaaaccagcg

SEQ ID NO: 755252 - RNA, 21 nt, Human
gugaaaacagaggcccaaaga

SEQ ID NO: 755253 - RNA, 19 nt, Human
uaaaacagggaacacgaac

SEQ ID NO: 755254 - RNA, 19 nt, Human
uaaaaggaucaugaggcug

SEQ ID NO: 755255 - RNA, 22 nt, Human
uaaauuagaaacacaaauaauc

SEQ ID NO: 755256 - RNA, 22 nt, Human
uaacuagaaaacuccccacccc

SEQ ID NO: 755257 - RNA, 24 nt, Human
uaacuagaaaacuccccaccccag

SEQ ID NO: 755258 - RNA, 21 nt, Human
uaacuguugauucuuucccaa

SEQ ID NO: 755259 - RNA, 27 nt, Human
uaagcuaggaaagguuuuucacaccca

SEQ ID NO: 755260 - RNA, 19 nt, Human
uacaaaguaauaaacagug

SEQ ID NO: 755261 - RNA, 21 nt, Human
uacaagucaaacaauaccacc

SEQ ID NO: 755262 - RNA, 19 nt, Human
uacauuaagaagaaugcca

SEQ ID NO: 755263 - RNA, 21 nt, Human
uacauuaagaagaaugccaac

SEQ ID NO: 755264 - RNA, 21 nt, Human
uagaaacacaaauaaucauga

SEQ ID NO: 755265 - RNA, 19 nt, Human
uagaaagcucccccaaaag

SEQ ID NO: 755266 - RNA, 18 nt, Human
uagaagagcucacuguga

SEQ ID NO: 755267 - RNA, 22 nt, Human
uagaagagcucacugugauuaa

SEQ ID NO: 755268 - RNA, 19 nt, Human
uaucauacagacgugaaaa

SEQ ID NO: 755269 - RNA, 19 nt, Human
uaucuccccaccaccccac

SEQ ID NO: 755270 - RNA, 25 nt, Human
uauuacuuucuaaaguguuuuccac

SEQ ID NO: 755271 - RNA, 24 nt, Human
uccaugcugcaauaacauuagaaa

SEQ ID NO: 755272 - RNA, 23 nt, Human
ucccaccauuucuuccuuuuaaa

SEQ ID NO: 755273 - RNA, 18 nt, Human
uccugggguguugacagc

SEQ ID NO: 755274 - RNA, 22 nt, Human
ucggccuuuaaacagcucuaaa

SEQ ID NO: 755275 - RNA, 19 nt, Human
ucuaagaaaacuuggcaaa

SEQ ID NO: 755276 - RNA, 20 nt, Human
ucuuaucuccccaccacccc

SEQ ID NO: 755277 - RNA, 20 nt, Human
ugacuagagccuguaugccu

SEQ ID NO: 755278 - RNA, 19 nt, Human
uggcaaauaacgcuuuggc

SEQ ID NO: 755279 - RNA, 20 nt, Human
uggcuuccccuugagacugg

SEQ ID NO: 755280 - RNA, 24 nt, Human
uucacaaacaguagauugcaccac

SEQ ID NO: 755281 - RNA, 22 nt, Human
uucacaaauacaagucaaacaa

SEQ ID NO: 755282 - RNA, 21 nt, Human
uuccuuuuaaacuacaggauu

SEQ ID NO: 755283 - RNA, 20 nt, Human
uuggaagagucaguugaagu

SEQ ID NO: 755284 - RNA, 20 nt, Human
uuuaaaaauuucuugagcag

SEQ ID NO: 755285 - RNA, 18 nt, Human
uuuccaguucucggccuu

SEQ ID NO: 755286 - RNA, 21 nt, Human
uuucuuccuuuuaaacuacag

SEQ ID NO: 755287 - RNA, 21 nt, Human
aaaaaccauuccguauaaaua

SEQ ID NO: 755288 - RNA, 23 nt, Human
aaaacuaaaaauaaaauacaacu

SEQ ID NO: 755289 - RNA, 24 nt, Human
aaauacaacugaaacuaacaaaac

SEQ ID NO: 755290 - RNA, 19 nt, Human
aacacggggaaaccccguc

SEQ ID NO: 755291 - RNA, 20 nt, Human
aacacggggaaaccccgucu

SEQ ID NO: 755292 - RNA, 21 nt, Human
aacacggggaaaccccgucuc

SEQ ID NO: 755293 - RNA, 18 nt, Human
aagcccacgcagcaaaga

SEQ ID NO: 755294 - RNA, 24 nt, Human
aauaaccagaaagcuacaaagaaa

SEQ ID NO: 755295 - RNA, 20 nt, Human
acaccacugcacuccagccu

SEQ ID NO: 755296 - RNA, 24 nt, Human
acaccacugcacuccagccugggc

SEQ ID NO: 755297 - RNA, 20 nt, Human
acagagcgagacuccgucuc

SEQ ID NO: 755298 - RNA, 20 nt, Human
acagagcgagacuccgucuc

SEQ ID NO: 755299 - RNA, 22 nt, Human
accacugcacuccagccugggc

SEQ ID NO: 755300 - RNA, 24 nt, Human
accacugcacuccagccugggcga

SEQ ID NO: 755301 - RNA, 18 nt, Human
accccgucucuacuaaaa

SEQ ID NO: 755302 - RNA, 24 nt, Human
acugcacuccagccugggcgacag

SEQ ID NO: 755303 - RNA, 26 nt, Human
acugcacuccagccugggcgacagag

SEQ ID NO: 755304 - RNA, 22 nt, Human
agauaaagugaaauaacuauga

SEQ ID NO: 755305 - RNA, 24 nt, Human
agcacuuugggaggccgaggcagg

SEQ ID NO: 755306 - RNA, 24 nt, Human
agccugggcgacagagcgagacuc

SEQ ID NO: 755307 - RNA, 21 nt, Human
aggagcgggggcguccgcagg

SEQ ID NO: 755308 - RNA, 24 nt, Human
aggcaggagaauggcgugaacccg

SEQ ID NO: 755309 - RNA, 24 nt, Human
aggcagggggaucacgaggucagg

SEQ ID NO: 755310 - RNA, 22 nt, Human
aggccgaggcagggggaucacg

SEQ ID NO: 755311 - RNA, 19 nt, Human
aggcgguuugcagugagcc

SEQ ID NO: 755312 - RNA, 22 nt, Human
aggcgguuugcagugagccgag

SEQ ID NO: 755313 - RNA, 19 nt, Human
aggcugaggcaggagaaug

SEQ ID NO: 755314 - RNA, 19 nt, Human
agggggaucacgaggucag

SEQ ID NO: 755315 - RNA, 19 nt, Human
auaaagccaaacaaaacug

SEQ ID NO: 755316 - RNA, 23 nt, Human
auaacuaugaagguaaauaacuc

SEQ ID NO: 755317 - RNA, 21 nt, Human
auacaacugaaacuaacaaaa

SEQ ID NO: 755318 - RNA, 24 nt, Human
aucacaccacugcacuccagccug

SEQ ID NO: 755319 - RNA, 18 nt, Human
auuaaaaauaaauuccgg

SEQ ID NO: 755320 - RNA, 23 nt, Human
caaccgauucccaccccgcccug

SEQ ID NO: 755321 - RNA, 18 nt, Human
caacgaagcaaucuuggc

SEQ ID NO: 755322 - RNA, 21 nt, Human
cacaccacugcacuccagccu

SEQ ID NO: 755323 - RNA, 21 nt, Human
cacagagaagcccacgcagca

SEQ ID NO: 755324 - RNA, 26 nt, Human
caccacugcacuccagccugggcgac

SEQ ID NO: 755325 - RNA, 24 nt, Human
cacgccuguaaucccagcacuuug

SEQ ID NO: 755326 - RNA, 24 nt, Human
cacuccagccugggcgacagagcg

SEQ ID NO: 755327 - RNA, 19 nt, Human
cacugcacuccagccuggg

SEQ ID NO: 755328 - RNA, 21 nt, Human
cacugcacuccagccugggcg

SEQ ID NO: 755329 - RNA, 22 nt, Human
cacugcacuccagccugggcga

SEQ ID NO: 755330 - RNA, 23 nt, Human
cacugcacuccagccugggcgac

SEQ ID NO: 755331 - RNA, 24 nt, Human
cacugcacuccagccugggcgaca

SEQ ID NO: 755332 - RNA, 24 nt, Human
cagcacuuugggaggccgaggcag

SEQ ID NO: 755333 - RNA, 25 nt, Human
cagcacuuugggaggccgaggcagg

SEQ ID NO: 755334 - RNA, 24 nt, Human
cagcuacucaggaggcugaggcag

SEQ ID NO: 755335 - RNA, 20 nt, Human
ccaagcaaauuaauuugaac

SEQ ID NO: 755336 - RNA, 20 nt, Human
ccacugcacuccagccuggg

SEQ ID NO: 755337 - RNA, 21 nt, Human
ccacugcacuccagccugggc

SEQ ID NO: 755338 - RNA, 21 nt, Human
ccacugcacuccagccugggc

SEQ ID NO: 755339 - RNA, 24 nt, Human
ccacugcacuccagccugggcgac

SEQ ID NO: 755340 - RNA, 22 nt, Human
cccacaccgccucucccgggaa

SEQ ID NO: 755341 - RNA, 24 nt, Human
cccaccccgcccuggagaaaugcg

SEQ ID NO: 755342 - RNA, 22 nt, Human
cccacgcagcaaagaauugccc

SEQ ID NO: 755343 - RNA, 18 nt, Human
ccccacaccgccucuccc

SEQ ID NO: 755344 - RNA, 19 nt, Human
ccccaugaacgcucgcagg

SEQ ID NO: 755345 - RNA, 21 nt, Human
cccgucucuacuaaaaaucca

SEQ ID NO: 755346 - RNA, 18 nt, Human
ccgccgaggcuccggcug

SEQ ID NO: 755347 - RNA, 23 nt, Human
ccgccgccgaggcuccggcugcu

SEQ ID NO: 755348 - RNA, 23 nt, Human
ccuggcuaacacggggaaacccc

SEQ ID NO: 755349 - RNA, 24 nt, Human
ccuggcuaacacggggaaaccccg

SEQ ID NO: 755350 - RNA, 22 nt, Human
ccugggcgacagagcgagacuc

SEQ ID NO: 755351 - RNA, 19 nt, Human
ccuguagucccagcuacuc

SEQ ID NO: 755352 - RNA, 21 nt, Human
ccuguagucccagcuacucag

SEQ ID NO: 755353 - RNA, 22 nt, Human
ccuguagucccagcuacucagg

SEQ ID NO: 755354 - RNA, 19 nt, Human
cgagaccauccuggcuaac

SEQ ID NO: 755355 - RNA, 24 nt, Human
cgagaucacaccacugcacuccag

SEQ ID NO: 755356 - RNA, 24 nt, Human
cgaggcagggggaucacgagguca

SEQ ID NO: 755357 - RNA, 23 nt, Human
cgccuguaaucccagcacuuugg

SEQ ID NO: 755358 - RNA, 24 nt, Human
cgccuguaaucccagcacuuuggg

SEQ ID NO: 755359 - RNA, 21 nt, Human
cgcgcacccaggacaccccuc

SEQ ID NO: 755360 - RNA, 21 nt, Human
cguauaaauaaagccaaacaa

SEQ ID NO: 755361 - RNA, 22 nt, Human
cucacgccuguaaucccagcac

SEQ ID NO: 755362 - RNA, 24 nt, Human
cucacgccuguaaucccagcacuu

SEQ ID NO: 755363 - RNA, 21 nt, Human
cugcgggcucugcucgccucu

SEQ ID NO: 755364 - RNA, 22 nt, Human
cugcgggcucugcucgccucug

SEQ ID NO: 755365 - RNA, 23 nt, Human
cuuggcacuaacacgaacacccc

SEQ ID NO: 755366 - RNA, 21 nt, Human
gacagagcgagacuccgucuc

SEQ ID NO: 755367 - RNA, 21 nt, Human
gagaagcccacgcagcaaaga

SEQ ID NO: 755368 - RNA, 19 nt, Human
gcacccaggacaccccucg

SEQ ID NO: 755369 - RNA, 24 nt, Human
gcacuccagccugggcgacagagc

SEQ ID NO: 755370 - RNA, 19 nt, Human
gcccccacaccgccucucc

SEQ ID NO: 755371 - RNA, 19 nt, Human
gcccugguuguccccuuuc

SEQ ID NO: 755372 - RNA, 20 nt, Human
gccgagaucacaccacugca

SEQ ID NO: 755373 - RNA, 23 nt, Human
gccuguagucccagcuacucagg

SEQ ID NO: 755374 - RNA, 22 nt, Human
gcugaggcaggagaauggcgug

SEQ ID NO: 755375 - RNA, 24 nt, Human
ggaacgaacucucucuacaacgaa

SEQ ID NO: 755376 - RNA, 23 nt, Human
ggcgcgguggcucacgccuguaa

SEQ ID NO: 755377 - RNA, 18 nt, Human
ggcgugguggcgggcgcc

SEQ ID NO: 755378 - RNA, 21 nt, Human
ggcucacgccuguaaucccag

SEQ ID NO: 755379 - RNA, 21 nt, Human
gggaaaccccgucucuacuaa

SEQ ID NO: 755380 - RNA, 24 nt, Human
gggcgugguggcgggcgccuguag

SEQ ID NO: 755381 - RNA, 23 nt, Human
gggggcgggguggaggauggggu

SEQ ID NO: 755382 - RNA, 18 nt, Human
gguggcgcauuccuggca

SEQ ID NO: 755383 - RNA, 24 nt, Human
gguggcgggcgccuguagucccag

SEQ ID NO: 755384 - RNA, 23 nt, Human
gguggcucacgccuguaauccca

SEQ ID NO: 755385 - RNA, 24 nt, Human
gguggcucacgccuguaaucccag

SEQ ID NO: 755386 - RNA, 21 nt, Human
uaaaaacuaauaaaucgauac

SEQ ID NO: 755387 - RNA, 24 nt, Human
uaaaacaaaacaacuacauauaaa

SEQ ID NO: 755388 - RNA, 24 nt, Human
uaaaacuaaaaauaaaauacaacu

SEQ ID NO: 755389 - RNA, 18 nt, Human
uaaauaaauuccaagcaa

SEQ ID NO: 755390 - RNA, 24 nt, Human
uaacaaaacucauuuaaaaacuaa

SEQ ID NO: 755391 - RNA, 25 nt, Human
uaacacgaacaccccaugaacgcuc

SEQ ID NO: 755392 - RNA, 24 nt, Human
uaacacggggaaaccccgucucua

SEQ ID NO: 755393 - RNA, 18 nt, Human
uaagcggcucucaaccga

SEQ ID NO: 755394 - RNA, 24 nt, Human
uaagcggcucucaaccgauuccca

SEQ ID NO: 755395 - RNA, 22 nt, Human
uaggcgcgcacccaggacaccc

SEQ ID NO: 755396 - RNA, 23 nt, Human
uaugaagguaaauaacucagaua

SEQ ID NO: 755397 - RNA, 23 nt, Human
ucacaccacugcacuccagccug

SEQ ID NO: 755398 - RNA, 31 nt, Human; identical to SEQ ID NO: 55281

SEQ ID NO: 755399 - RNA, 18 nt, Human
ucacgaggucaggagauc

SEQ ID NO: 755400 - RNA, 24 nt, Human
ucacgaggucaggagaucgagacc

SEQ ID NO: 755401 - RNA, 21 nt, Human
uccaauaagauaaagugaaau

SEQ ID NO: 755402 - RNA, 23 nt, Human
uccagccugggcgacagagcgag

SEQ ID NO: 755403 - RNA, 24 nt, Human
uccagccugggcgacagagcgaga

SEQ ID NO: 755404 - RNA, 24 nt, Human
uccggcugggcgcgguggcucacg

SEQ ID NO: 755405 - RNA, 22 nt, Human
ucuacaacgaagcaaucuuggc

SEQ ID NO: 755406 - RNA, 25 nt, Human
ucucccgggaaugcgggcgcucugg

SEQ ID NO: 755407 - RNA, 19 nt, Human
ucucuacuaaaaauccaaa

SEQ ID NO: 755408 - RNA, 22 nt, Human
ucuggagccgaggagcgggggc

SEQ ID NO: 755409 - RNA, 21 nt, Human
ucuguaacuccuaaaacaaaa

SEQ ID NO: 755410 - RNA, 18 nt, Human
ugaaauaacuaugaaggu

SEQ ID NO: 755411 - RNA, 20 nt, Human
ugaaauaacuaugaagguaa

SEQ ID NO: 755412 - RNA, 23 nt, Human
ugaggcaggagaauggcgugaac

SEQ ID NO: 755413 - RNA, 24 nt, Human
ugaggcaggagaauggcgugaacc

SEQ ID NO: 755414 - RNA, 25 nt, Human
ugaggcaggagaauggcgugaaccc

SEQ ID NO: 755415 - RNA, 20 nt, Human
uggagaaaugcgggcguguc

SEQ ID NO: 755416 - RNA, 24 nt, Human
uggcucacgccuguaaucccagca

SEQ ID NO: 755417 - RNA, 18 nt, Human
ugggagcacagagaagcc

SEQ ID NO: 755418 - RNA, 18 nt, Human
ugggaggccgaggcaggg

SEQ ID NO: 755419 - RNA, 24 nt, Human
ugggaggccgaggcagggggauca

SEQ ID NO: 755420 - RNA, 20 nt, Human
ugggaggcggaccgggagcu

SEQ ID NO: 755421 - RNA, 23 nt, Human
ugggaggcggaccgggagcuccc

SEQ ID NO: 755422 - RNA, 20 nt, Human
ugggguggcgcauuccuggc

SEQ ID NO: 755423 - RNA, 24 nt, Human
ugguggcgggcgccuguaguccca

SEQ ID NO: 755424 - RNA, 23 nt, Human
ugucugcaggcauuuuugauugu

SEQ ID NO: 755425 - RNA, 18 nt, Human
uuaaaggcaucuccgccc

SEQ ID NO: 755426 - RNA, 18 nt, Human
uuagccgggcgugguggc

SEQ ID NO: 755427 - RNA, 22 nt, Human
uuagccgggcgugguggcgggc

SEQ ID NO: 755428 - RNA, 24 nt, Human
uuagccgggcgugguggcgggcgc

SEQ ID NO: 755429 - RNA, 22 nt, Human
uuccguauaaauaaagccaaac

SEQ ID NO: 755430 - RNA, 19 nt, Human
uugcagugagccgagauca

SEQ ID NO: 755431 - RNA, 20 nt, Human
uugcagugagccgagaucac

SEQ ID NO: 755432 - RNA, 25 nt, Human
uugggaggccgaggcagggggauca

SEQ ID NO: 755433 - RNA, 22 nt, Human
uugggggcgggguggaggaugg

SEQ ID NO: 755434 - RNA, 19 nt, Human
uuugcagugagccgagauc

SEQ ID NO: 755435 - RNA, 18 nt, Human
uuugggggcgggguggag

SEQ ID NO: 755436 - RNA, 19 nt, Human
aaaaaaaaaaaacagcuau

SEQ ID NO: 755437 - RNA, 24 nt, Human
aaaaaaaaaaaacagcuauuagga

SEQ ID NO: 755438 - RNA, 18 nt, Human
aaaaaaaaaaacagcuau

SEQ ID NO: 755439 - RNA, 23 nt, Human
aaaaaaaaaaacagcuauuagga

SEQ ID NO: 755440 - RNA, 27 nt, Human
aaaaaaacgagguuuaacauccacagg

SEQ ID NO: 755441 - RNA, 25 nt, Human
aaaaaaauacagaucuaaauuauaa

SEQ ID NO: 755442 - RNA, 25 nt, Human
aaaaaaauacagaucuaaauuauaa

SEQ ID NO: 755443 - RNA, 18 nt, Human
aaaaaaccugaaaacaac

SEQ ID NO: 755444 - RNA, 18 nt, Human
aaaaaaccugaaaacaac

SEQ ID NO: 755445 - RNA, 19 nt, Human
aaaauaacucuugauguau

SEQ ID NO: 755446 - RNA, 19 nt, Human
aaaauaacucuugauguau

SEQ ID NO: 755447 - RNA, 20 nt, Human
aaacaaggcgugcaugaaau

SEQ ID NO: 755448 - RNA, 20 nt, Human
aaacaaggcgugcaugaaau

SEQ ID NO: 755449 - RNA, 24 nt, Human
aaaccaguuucacaacugccucaa

SEQ ID NO: 755450 - RNA, 21 nt, Human
aaccagcuagagaaaagcccg

SEQ ID NO: 755451 - RNA, 21 nt, Human
aacugcaggaaacaauagaug

SEQ ID NO: 755452 - RNA, 21 nt, Human
aacugcaggaaacaauagaug

SEQ ID NO: 755453 - RNA, 27 nt, Human
aaggggccaaagcaaaaggggcaggug

SEQ ID NO: 755454 - RNA, 18 nt, Human
acaugacagagaaaaaaa

SEQ ID NO: 755455 - RNA, 18 nt, Human
acaugacagagaaaaaaa

SEQ ID NO: 755456 - RNA, 24 nt, Human
accaacaaucauaaaccaguuuca

SEQ ID NO: 755457 - RNA, 23 nt, Human
accauggagacugagaucucagu

SEQ ID NO: 755458 - RNA, 19 nt, Human
acuuuuuuuuuuuuuuugc

SEQ ID NO: 755459 - RNA, 21 nt, Human
agaaaaaaaccugaaaacaac

SEQ ID NO: 755460 - RNA, 21 nt, Human
agaaaaaaaccugaaaacaac

SEQ ID NO: 755461 - RNA, 24 nt, Human
agaauaaauuuauuuguaaaauaa

SEQ ID NO: 755462 - RNA, 24 nt, Human
agaauaaauuuauuuguaaaauaa

SEQ ID NO: 755463 - RNA, 21 nt, Human
agggaaaaucuacacugaaaa

SEQ ID NO: 755464 - RNA, 19 nt, Human
auauuucugcaucuacaga

SEQ ID NO: 755465 - RNA, 19 nt, Human
augcagcucauaggccuca

SEQ ID NO: 755466 - RNA, 19 nt, Human
caacagaguacaccaacaa

SEQ ID NO: 755467 - RNA, 20 nt, Human
caacugccucaaauaugaac

SEQ ID NO: 755468 - RNA, 21 nt, Human
cacagcuuccagccuaaacca

SEQ ID NO: 755469 - RNA, 22 nt, Human
cacauaguaacauuauguuucu

SEQ ID NO: 755470 - RNA, 19 nt, Human
caccugaaguaacucugca

SEQ ID NO: 755471 - RNA, 19 nt, Human
caccugaaguaacucugca

SEQ ID NO: 755472 - RNA, 20 nt, Human
cacuagugggaaaacaaggc

SEQ ID NO: 755473 - RNA, 20 nt, Human
cacuagugggaaaacaaggc

SEQ ID NO: 755474 - RNA, 23 nt, Human
cagaguacaccaacaaucauaaa

SEQ ID NO: 755475 - RNA, 18 nt, Human
cagcgcgcgcccaccccc

SEQ ID NO: 755476 - RNA, 21 nt, Human
cagcgguguaacaaauuuuaa

SEQ ID NO: 755477 - RNA, 21 nt, Human
caggaaacaauagaugugaaa

SEQ ID NO: 755478 - RNA, 21 nt, Human
caggaaacaauagaugugaaa

SEQ ID NO: 755479 - RNA, 22 nt, Human
caggacagugacgacaauggag

SEQ ID NO: 755480 - RNA, 23 nt, Human
cagggaaagcugaaggagaucga

SEQ ID NO: 755481 - RNA, 19 nt, Human
caugacagagaaaaaaacc

SEQ ID NO: 755482 - RNA, 19 nt, Human
caugacagagaaaaaaacc

SEQ ID NO: 755483 - RNA, 19 nt, Human
ccauguccccugaaacccu

SEQ ID NO: 755484 - RNA, 19 nt, Human
cccccagcgcgacuggucc

SEQ ID NO: 755485 - RNA, 24 nt, Human
cccccgccucagcgcgcgcccacc

SEQ ID NO: 755486 - RNA, 21 nt, Human
ccccgccucagcgcgcgccca

SEQ ID NO: 755487 - RNA, 21 nt, Human
ccccgcgcggcgggacccccc

SEQ ID NO: 755488 - RNA, 18 nt, Human
ccccugaaacccuaugcu

SEQ ID NO: 755489 - RNA, 18 nt, Human
cccgcccgcgccuccgcc

SEQ ID NO: 755490 - RNA, 22 nt, Human
cccgcccgcgccuccgccccgc

SEQ ID NO: 755491 - RNA, 18 nt, Human
ccgccgagcgcagccgcg

SEQ ID NO: 755492 - RNA, 21 nt, Human
ccucaguugucacaaaggggc

SEQ ID NO: 755493 - RNA, 20 nt, Human
cgccauguccccugaaaccc

SEQ ID NO: 755494 - RNA, 26 nt, Human
cgcccgcccgcgccuccgccccgcgc

SEQ ID NO: 755495 - RNA, 20 nt, Human
cgccugcgcccgcccgcgcc

SEQ ID NO: 755496 - RNA, 18 nt, Human
cgcugcugacucucgcag

SEQ ID NO: 755497 - RNA, 19 nt, Human
cugcuguguaccaccagaa

SEQ ID NO: 755498 - RNA, 22 nt, Human
cuguuacaaaucaaacugcagg

SEQ ID NO: 755499 - RNA, 22 nt, Human
cuguuacaaaucaaacugcagg

SEQ ID NO: 755500 - RNA, 19 nt, Human
cuucacauacacaggcacc

SEQ ID NO: 755501 - RNA, 22 nt, Human
cuuuuuuuuuuuuuuugcaagu

SEQ ID NO: 755502 - RNA, 22 nt, Human
gacuucccgcuccccaagcuuc

SEQ ID NO: 755503 - RNA, 20 nt, Human
gaguuacuuuuuuuuuuuuu

SEQ ID NO: 755504 - RNA, 21 nt, Human
gaguuacuuuuuuuuuuuuuu

SEQ ID NO: 755505 - RNA, 21 nt, Human
gcagagcagcacagugaccac

SEQ ID NO: 755506 - RNA, 21 nt, Human
gcagagcagcacagugaccac

SEQ ID NO: 755507 - RNA, 20 nt, Human
gcagugcauccucagggagc

SEQ ID NO: 755508 - RNA, 20 nt, Human
gcagugcauccucagggagc

SEQ ID NO: 755509 - RNA, 18 nt, Human
gccauguccccugaaacc

SEQ ID NO: 755510 - RNA, 25 nt, Human
gccuaaaccagcuagagaaaagccc

SEQ ID NO: 755511 - RNA, 25 nt, Human
ggacccccgccucagcgcgcgccca

SEQ ID NO: 755512 - RNA, 19 nt, Human
ggagaagaguuuuggggug

SEQ ID NO: 755513 - RNA, 19 nt, Human
ggccaaagcaaaaggggca

SEQ ID NO: 755514 - RNA, 19 nt, Human
ggccgccugcgcccgcccg

SEQ ID NO: 755515 - RNA, 20 nt, Human
gggaaagcugaaggagaucg

SEQ ID NO: 755516 - RNA, 19 nt, Human
ggggugcccucagccugag

SEQ ID NO: 755517 - RNA, 19 nt, Human
guguggggaaaaaaacgag

SEQ ID NO: 755518 - RNA, 23 nt, Human
uaaaauccacauaguaacauuau

SEQ ID NO: 755519 - RNA, 19 nt, Human
uaacaggggucucuccagc

SEQ ID NO: 755520 - RNA, 19 nt, Human
uaacaggggucucuccagc

SEQ ID NO: 755521 - RNA, 23 nt, Human
uaagcaaagaucuuacaaagaag

SEQ ID NO: 755522 - RNA, 23 nt, Human
uaagcaaagaucuuacaaagaag

SEQ ID NO: 755523 - RNA, 24 nt, Human
uaaguuaggagaagaguuuugggg

SEQ ID NO: 755524 - RNA, 20 nt, Human
uaaguuaguuuucacacuca

SEQ ID NO: 755525 - RNA, 23 nt, Human
uacacugaaaaauauuucugcau

SEQ ID NO: 755526 - RNA, 26 nt, Human
uacacugaaaaauauuucugcaucua

SEQ ID NO: 755527 - RNA, 24 nt, Human
uaccucugaacggagaaaugacuu

SEQ ID NO: 755528 - RNA, 20 nt, Human
uacuguaccaaccauggagg

SEQ ID NO: 755529 - RNA, 21 nt, Human
uacuuuuuuuuuuuuuugcaa

SEQ ID NO: 755530 - RNA, 19 nt, Human
uaggagaagaguuuugggg

SEQ ID NO: 755531 - RNA, 18 nt, Human
uauaagcaaagaucuuac

SEQ ID NO: 755532 - RNA, 18 nt, Human
uauaagcaaagaucuuac

SEQ ID NO: 755533 - RNA, 19 nt, Human
uaucccagccaggauugcc

SEQ ID NO: 755534 - RNA, 19 nt, Human
ucacaaaggggccaaagca

SEQ ID NO: 755535 - RNA, 18 nt, Human
uccgccgagcgcagccgc

SEQ ID NO: 755536 - RNA, 19 nt, Human
uccugaguaucauagaccu

SEQ ID NO: 755537 - RNA, 22 nt, Human
ucuaaauuauaaucuauaagca

SEQ ID NO: 755538 - RNA, 22 nt, Human
ucuaaauuauaaucuauaagca

SEQ ID NO: 755539 - RNA, 20 nt, Human
ucuccgcugcugacucucgc

SEQ ID NO: 755540 - RNA, 19 nt, Human
ucugaacggagaaaugacu

SEQ ID NO: 755541 - RNA, 18 nt, Human
ucugcagagcagcacagu

SEQ ID NO: 755542 - RNA, 18 nt, Human
ucugcagagcagcacagu

SEQ ID NO: 755543 - RNA, 22 nt, Human
ucuguaaacuucgccauguccc

SEQ ID NO: 755544 - RNA, 22 nt, Human
ugaaaaaggcugaaauguccuu

SEQ ID NO: 755545 - RNA, 22 nt, Human
ugaaaaaggcugaaauguccuu

SEQ ID NO: 755546 - RNA, 25 nt, Human
ugaaaaaggcugaaauguccuuaau

SEQ ID NO: 755547 - RNA, 25 nt, Human
ugaaaaaggcugaaauguccuuaau

SEQ ID NO: 755548 - RNA, 24 nt, Human
ugaaaacaacuguucuguuacaaa

SEQ ID NO: 755549 - RNA, 24 nt, Human
ugaaaacaacuguucuguuacaaa

SEQ ID NO: 755550 - RNA, 19 nt, Human
ugaaauguccuuaaugaaa

SEQ ID NO: 755551 - RNA, 19 nt, Human
ugaaauguccuuaaugaaa

SEQ ID NO: 755552 - RNA, 22 nt, Human
ugaaauguccuuaaugaaaaag

SEQ ID NO: 755553 - RNA, 19 nt, Human
ugaaguaacucugcagagc

SEQ ID NO: 755554 - RNA, 19 nt, Human
ugaaguaacucugcagagc

SEQ ID NO: 755555 - RNA, 23 nt, Human
ugacagagaaaaaaaccugaaaa

SEQ ID NO: 755556 - RNA, 23 nt, Human
ugacagagaaaaaaaccugaaaa

SEQ ID NO: 755557 - RNA, 22 nt, Human
ugaggacaacacugugaaauuu

SEQ ID NO: 755558 - RNA, 22 nt, Human
ugaggacaacacugugaaauuu

SEQ ID NO: 755559 - RNA, 25 nt, Human
ugaguuaugguuaaaaaaaaaaaaa

SEQ ID NO: 755560 - RNA, 24 nt, Human
ugccaaguagacuucccgcucccc

SEQ ID NO: 755561 - RNA, 23 nt, Human
uguggucaaagacuuacuguacc

SEQ ID NO: 755562 - RNA, 18 nt, Human
uuaaaaaaaaaaaaacag

SEQ ID NO: 755563 - RNA, 25 nt, Human
uuaaaaaaaaaaacagcuauuagga

SEQ ID NO: 755564 - RNA, 23 nt, Human
uucaaaauagacacucugaaaac

SEQ ID NO: 755565 - RNA, 19 nt, Human
aacccagaagccagccuca

SEQ ID NO: 755566 - RNA, 18 nt, Human
aagcugcaucaguggaac

SEQ ID NO: 755567 - RNA, 18 nt, Human
acaaacaaaaauaggaau

SEQ ID NO: 755568 - RNA, 24 nt, Human
acaacccagaagccagccucacgc

SEQ ID NO: 755569 - RNA, 21 nt, Human
acagaugcccucccagccccc

SEQ ID NO: 755570 - RNA, 22 nt, Human
accuugaggcgugcuggcuggg

SEQ ID NO: 755571 - RNA, 18 nt, Human
agccugcgcacgcuggcc

SEQ ID NO: 755572 - RNA, 18 nt, Human
aggagugcuccaggcucu

SEQ ID NO: 755573 - RNA, 19 nt, Human
aggagugcuccaggcucug

SEQ ID NO: 755574 - RNA, 21 nt, Human
auaauaauaaaacaaagguac

SEQ ID NO: 755575 - RNA, 23 nt, Human
cacgugcucugcgagccugcgca

SEQ ID NO: 755576 - RNA, 26 nt, Human
cacuuucuccucuuaacagccagacu

SEQ ID NO: 755577 - RNA, 19 nt, Human
cagaugcccucccagcccc

SEQ ID NO: 755578 - RNA, 20 nt, Human
cagaugcccucccagccccc

SEQ ID NO: 755579 - RNA, 19 nt, Human
cagcagagaguggugugga

SEQ ID NO: 755580 - RNA, 18 nt, Human
cagcccccacugcuggcc

SEQ ID NO: 755581 - RNA, 22 nt, Human
caggaaaggacuaacacagaug

SEQ ID NO: 755582 - RNA, 19 nt, Human
ccaccugcugugccugacc

SEQ ID NO: 755583 - RNA, 25 nt, Human
ccacggaaaaaagcuuugaugaaga

SEQ ID NO: 755584 - RNA, 19 nt, Human
cccggagcucagccacauc

SEQ ID NO: 755585 - RNA, 18 nt, Human
cccucccagcccccacug

SEQ ID NO: 755586 - RNA, 23 nt, Human
ccuccuccugggcuggaaggcag

SEQ ID NO: 755587 - RNA, 22 nt, Human
ccucgaaaguggcgcucagcuu

SEQ ID NO: 755588 - RNA, 21 nt, Human
cgcucagcuucuccuuccucg

SEQ ID NO: 755589 - RNA, 24 nt, Human
cgcuggccucucgugccuccagcu

SEQ ID NO: 755590 - RNA, 25 nt, Human
cgggucacagccaggaaaggacuaa

SEQ ID NO: 755591 - RNA, 22 nt, Human
cgucacagaggcucugcacgug

SEQ ID NO: 755592 - RNA, 18 nt, Human
cucacagcucuccagcag

SEQ ID NO: 755593 - RNA, 24 nt, Human
cucacgcauuccaugcccacaguu

SEQ ID NO: 755594 - RNA, 20 nt, Human
cucgugccuccagcugcucc

SEQ ID NO: 755595 - RNA, 19 nt, Human
cucucgugccuccagcugc

SEQ ID NO: 755596 - RNA, 24 nt, Human
cucucgugccuccagcugcuccuc

SEQ ID NO: 755597 - RNA, 20 nt, Human
cucugucagcuccuggaacc

SEQ ID NO: 755598 - RNA, 21 nt, Human
cugacccugcagcugguccuc

SEQ ID NO: 755599 - RNA, 25 nt, Human
cugcagcaaugccugcuucuccuuc

SEQ ID NO: 755600 - RNA, 20 nt, Human
cugcugcaagcuggggaagg

SEQ ID NO: 755601 - RNA, 21 nt, Human
cuggaaccgcugucugaggag

SEQ ID NO: 755602 - RNA, 19 nt, Human
cuggugcaccugcucacug

SEQ ID NO: 755603 - RNA, 18 nt, Human
cuucuccuucugcagggu

SEQ ID NO: 755604 - RNA, 24 nt, Human
gaacaaauacaaaaugcuguccuc

SEQ ID NO: 755605 - RNA, 25 nt, Human
gaagacaacaggaagucaacacagc

SEQ ID NO: 755606 - RNA, 19 nt, Human
gcagagagugguguggaca

SEQ ID NO: 755607 - RNA, 22 nt, Human
gccccguuuccacaccagcaca

SEQ ID NO: 755608 - RNA, 18 nt, Human
ggcgggucacagccagga

SEQ ID NO: 755609 - RNA, 20 nt, Human
ggugugcugcugcaagcugg

SEQ ID NO: 755610 - RNA, 27 nt, Human
uaaaaaacaaacaaaaauaggaauggu

SEQ ID NO: 755611 - RNA, 18 nt, Human
uaacacagaugcccuccc

SEQ ID NO: 755612 - RNA, 22 nt, Human
uaacgaugacaacaacagcaau

SEQ ID NO: 755613 - RNA, 19 nt, Human
uaagcugcaucaguggaac

SEQ ID NO: 755614 - RNA, 21 nt, Human
uacaaaaugcuguccuccucc

SEQ ID NO: 755615 - RNA, 20 nt, Human
uacaggugaaaagcagcgcu

SEQ ID NO: 755616 - RNA, 24 nt, Human
uagaauaccacggaaaaaagcuuu

SEQ ID NO: 755617 - RNA, 21 nt, Human
ucacagaggcucugcacgugc

SEQ ID NO: 755618 - RNA, 22 nt, Human
ucacagaggcucugcacgugcu

SEQ ID NO: 755619 - RNA, 18 nt, Human
ucacugcccucgaaagug

SEQ ID NO: 755620 - RNA, 22 nt, Human
ucugcagcaaugccugcuucuc

SEQ ID NO: 755621 - RNA, 21 nt, Human
ucugucagcuccuggaaccgc

SEQ ID NO: 755622 - RNA, 18 nt, Human
ugacccaggccaagcugg

SEQ ID NO: 755623 - RNA, 24 nt, Human
ugaggaggucccgcucgucacaga

SEQ ID NO: 755624 - RNA, 20 nt, Human
ugcaucaguggaacaaauac

SEQ ID NO: 755625 - RNA, 18 nt, Human
ugccugacccugcagcug

SEQ ID NO: 755626 - RNA, 22 nt, Human
ugccugacccugcagcuggucc

SEQ ID NO: 755627 - RNA, 21 nt, Human
ugccugcuucuccuucucaca

SEQ ID NO: 755628 - RNA, 19 nt, Human
ugcuguccuccuccugggc

SEQ ID NO: 755629 - RNA, 18 nt, Human
uggaacaaauacaaaaug

SEQ ID NO: 755630 - RNA, 19 nt, Human
uggaaggcagugcacuuuc

SEQ ID NO: 755631 - RNA, 21 nt, Human
uggcugggccccguuuccaca

SEQ ID NO: 755632 - RNA, 21 nt, Human
uggggugugcugcugcaagcu

SEQ ID NO: 755633 - RNA, 21 nt, Human
ugguguggacaacccagaagc

SEQ ID NO: 755634 - RNA, 19 nt, Human
ugucugaggaggucccgcu

SEQ ID NO: 755635 - RNA, 22 nt, Human
ugucugaggaggucccgcucga

SEQ ID NO: 755636 - RNA, 19 nt, Human
uucuaagcugcaucagugg

SEQ ID NO: 755637 - RNA, 18 nt, Human
aaaacacaaguagcuaca

SEQ ID NO: 755638 - RNA, 21 nt, Human
aaagaacagccuccucaucca

SEQ ID NO: 755639 - RNA, 20 nt, Human
aaagcacaucaaugaacaag

SEQ ID NO: 755640 - RNA, 23 nt, Human
aaaugcguggagagaagccccag

SEQ ID NO: 755641 - RNA, 27 nt, Human
aacacacacacacacacacgggaucuc

SEQ ID NO: 755642 - RNA, 24 nt, Human
aaccauuggaaguacaauaaacag

SEQ ID NO: 755643 - RNA, 28 nt, Human
acacacacacacaaacacacacacacac

SEQ ID NO: 755644 - RNA, 31 nt, Human
acacacacacacaaacacacacacacacaca

SEQ ID NO: 755645 - RNA, 26 nt, Human
acacacacacacacaaacacacacaa

SEQ ID NO: 755646 - RNA, 33 nt, Human
acacacacacacacaaacacacacacacacagu

SEQ ID NO: 755647 - RNA, 25 nt, Human
acacacacacacacacacgggaucu

SEQ ID NO: 755648 - RNA, 27 nt, Human
acacacacacacacacacgggaucuca

SEQ ID NO: 755649 - RNA, 21 nt, Human
acacuggcgaagcuaaaacaa

SEQ ID NO: 755650 - RNA, 22 nt, Human
accaguacauggcagcgugcuc

SEQ ID NO: 755651 - RNA, 21 nt, Human
acccacacacacacacacaaa

SEQ ID NO: 755652 - RNA, 18 nt, Human
accuaaaacauggggcuc

SEQ ID NO: 755653 - RNA, 24 nt, Human
acguguuuaaccgugugccaugug

SEQ ID NO: 755654 - RNA, 23 nt, Human
auaaaacacaaguagcuacaaag

SEQ ID NO: 755655 - RNA, 21 nt, Human
auuuuuuaaaaucuguauuuu

SEQ ID NO: 755656 - RNA, 21 nt, Human
caagacaagguggucuggagc

SEQ ID NO: 755657 - RNA, 25 nt, Human
cacaaguagcuacaaagaaauaaaa

SEQ ID NO: 755658 - RNA, 21 nt, Human
cacacacaaacacacacacac

SEQ ID NO: 755659 - RNA, 24 nt, Human
cacacacaaacacacacacacaca

SEQ ID NO: 755660 - RNA, 28 nt, Human
cacacacacacacacgggaucucauaua

SEQ ID NO: 755661 - RNA, 24 nt, Human
caccaccggcuauggauuugaagc

SEQ ID NO: 755662 - RNA, 18 nt, Human
cacugcucagaacuuucc

SEQ ID NO: 755663 - RNA, 18 nt, Human
cagaaggcagccuucugu

SEQ ID NO: 755664 - RNA, 21 nt, Human
cagcccggaaucaguaggcag

SEQ ID NO: 755665 - RNA, 19 nt, Human
ccacacuuuucccagccuc

SEQ ID NO: 755666 - RNA, 19 nt, Human
ccagaaauacagggcauag

SEQ ID NO: 755667 - RNA, 31 nt, Human
cccacacacacacacacaaacacacacacaa

SEQ ID NO: 755668 - RNA, 31 nt, Human
cccacacacacacacacaaacacacacacag

SEQ ID NO: 755669 - RNA, 22 nt, Human
cgacgaaagcacaucaaugaac

SEQ ID NO: 755670 - RNA, 21 nt, Human
gaucuaugcugaagucgggag

SEQ ID NO: 755671 - RNA, 21 nt, Human
gcguuaggugaaaaaaaagga

SEQ ID NO: 755672 - RNA, 19 nt, Human
gcucagaacuuuccgacag

SEQ ID NO: 755673 - RNA, 19 nt, Human
ggaaagaacagccuccuca

SEQ ID NO: 755674 - RNA, 18 nt, Human
gggcauaggaaagaacag

SEQ ID NO: 755675 - RNA, 22 nt, Human
uaaaacacaaguagcuacaaag

SEQ ID NO: 755676 - RNA, 24 nt, Human
uaaaacacaaguagcuacaaagaa

SEQ ID NO: 755677 - RNA, 25 nt, Human
uaagaaagaacccacacacacacac

SEQ ID NO: 755678 - RNA, 23 nt, Human
uacaauaaacagacuguugaacc

SEQ ID NO: 755679 - RNA, 20 nt, Human
uacuguguaggccuuugaau

SEQ ID NO: 755680 - RNA, 19 nt, Human
uaggaaagaacagccuccu

SEQ ID NO: 755681 - RNA, 24 nt, Human
uaggugcguuaggugaaaaaaaag

SEQ ID NO: 755682 - RNA, 23 nt, Human
uagugucuguguccugugcuuuu

SEQ ID NO: 755683 - RNA, 21 nt, Human
uauaauaccaauaaaacacaa

SEQ ID NO: 755684 - RNA, 25 nt, Human
uauccagaaauacagggcauaggag

SEQ ID NO: 755685 - RNA, 23 nt, Human
ucaaaccaguacauggcagcgug

SEQ ID NO: 755686 - RNA, 21 nt, Human
uccaugaguaacaccuaaaac

SEQ ID NO: 755687 - RNA, 18 nt, Human
ucccagccucucucuugc

SEQ ID NO: 755688 - RNA, 19 nt, Human
ucccgggggacgagcgcug

SEQ ID NO: 755689 - RNA, 20 nt, Human
uccgacagccgacgaaagca

SEQ ID NO: 755690 - RNA, 21 nt, Human
ucuguauuuugaagaaaggaa

SEQ ID NO: 755691 - RNA, 21 nt, Human
ucuguauuuugaagaaaggaa

SEQ ID NO: 755692 - RNA, 20 nt, Human
ugaaccguagaaaaacaacu

SEQ ID NO: 755693 - RNA, 20 nt, Human
ugacacuggcgaagcuaaaa

SEQ ID NO: 755694 - RNA, 23 nt, Human
ugcauggauugcuccuuuccucc

SEQ ID NO: 755695 - RNA, 18 nt, Human
ugcuccuuuccuccgcua

SEQ ID NO: 755696 - RNA, 21 nt, Human
uggcacaguaacuuuucaaag

SEQ ID NO: 755697 - RNA, 24 nt, Human
uggcacaguaacuuuucaaaggcu

SEQ ID NO: 755698 - RNA, 25 nt, Human
ugguaugaauaaaaaguuccaagua

SEQ ID NO: 755699 - RNA, 24 nt, Human
uguugaaccguagaaaaacaacug

SEQ ID NO: 755700 - RNA, 18 nt, Human
uguuuaaccgugugccau

SEQ ID NO: 755701 - RNA, 21 nt, Human
uucauaguuuugcaaggggug

SEQ ID NO: 755702 - RNA, 23 nt, Human
aaaaagucgguucaucuucaaac

SEQ ID NO: 755703 - RNA, 22 nt, Human
aauaacaacaguaggacccaaa

SEQ ID NO: 755704 - RNA, 22 nt, Human
acaaaccaaaaaaaaucuaaac

SEQ ID NO: 755705 - RNA, 25 nt, Human
accucugaaucccccccaaugguuu

SEQ ID NO: 755706 - RNA, 23 nt, Human
agccacagucaauguucacagcc

SEQ ID NO: 755707 - RNA, 25 nt, Human
agcccacccagccuaucacacugcc

SEQ ID NO: 755708 - RNA, 24 nt, Human
agcuguacaaaccaaaaaaaaucu

SEQ ID NO: 755709 - RNA, 22 nt, Human
aggauuaccgucccccaggcau

SEQ ID NO: 755710 - RNA, 18 nt, Human
aucuaaacgauuuuaaga

SEQ ID NO: 755711 - RNA, 19 nt, Human
caacaguaggacccaaacu

SEQ ID NO: 755712 - RNA, 21 nt, Human
caacaguaggacccaaacuaa

SEQ ID NO: 755713 - RNA, 20 nt, Human
cagcucaagaagauccgugg

SEQ ID NO: 755714 - RNA, 20 nt, Human
ccacauaaauaacuuuagcc

SEQ ID NO: 755715 - RNA, 21 nt, Human
ccacccagccuaucacacugc

SEQ ID NO: 755716 - RNA, 22 nt, Human
cguggaugcaccucugaauccc

SEQ ID NO: 755717 - RNA, 21 nt, Human
cuggucaguggaacaaaggaa

SEQ ID NO: 755718 - RNA, 19 nt, Human
gaguuccccacagcccucc

SEQ ID NO: 755719 - RNA, 18 nt, Human
ggaguuccccacagcccu

SEQ ID NO: 755720 - RNA, 23 nt, Human
uaaauuuucuuucccaaaaauac

SEQ ID NO: 755721 - RNA, 20 nt, Human
uaagaagagcagcaacucaa

SEQ ID NO: 755722 - RNA, 24 nt, Human
uagcccacccagccuaucacacug

SEQ ID NO: 755723 - RNA, 21 nt, Human
ucaaaccaacaagagcacuag

SEQ ID NO: 755724 - RNA, 19 nt, Human
uccacguugggcagccaca

SEQ ID NO: 755725 - RNA, 18 nt, Human
uccccacagcccuccccu

SEQ ID NO: 755726 - RNA, 19 nt, Human
ugcuuuaguucauuuaaau

SEQ ID NO: 755727 - RNA, 19 nt, Human
ugggcagccacauaaaaac

SEQ ID NO: 755728 - RNA, 19 nt, Human
uguguguguguguguuuug

SEQ ID NO: 755729 - RNA, 22 nt, Human
uguguguuuuguuuuuguucug

SEQ ID NO: 755730 - RNA, 27 nt, Human
uguuucuguuuuugugugugugugugu

SEQ ID NO: 755731 - RNA, 20 nt, Human
uguuuuugugugugugugug

SEQ ID NO: 755732 - RNA, 20 nt, Human
uucacagccuggucagugga

SEQ ID NO: 755733 - RNA, 26 nt, Human
uucuuucccaaaaauacacuccuaaa

SEQ ID NO: 755734 - RNA, 19 nt, Human
uuuaagaagagcagcaacu

SEQ ID NO: 755735 - RNA, 25 nt, Human
uuucuguuuuugugugugugugugu

SEQ ID NO: 755736 - RNA, 23 nt, Human
uuuuuuuuguuucuguuuuugug

SEQ ID NO: 755737 - RNA, 23 nt, Human
aaauccaaccucuccagagcuag

SEQ ID NO: 755738 - RNA, 19 nt, Human
aaccugguccguggugugg

SEQ ID NO: 755739 - RNA, 22 nt, Human
aagaaaagggaaaaaagacagc

SEQ ID NO: 755740 - RNA, 21 nt, Human
aagaaguuaguagcuacacaa

SEQ ID NO: 755741 - RNA, 23 nt, Human
acaccagaaccuuccguagaaca

SEQ ID NO: 755742 - RNA, 22 nt, Human
acagccuugggggaggaugagg

SEQ ID NO: 755743 - RNA, 25 nt, Human
acccgaaccacccuucucaggccuc

SEQ ID NO: 755744 - RNA, 21 nt, Human
accugugacucggccaagcug

SEQ ID NO: 755745 - RNA, 24 nt, Human
agacgugagggccacgggucaccu

SEQ ID NO: 755746 - RNA, 24 nt, Human
agauaccugagguuacaugaggac

SEQ ID NO: 755747 - RNA, 19 nt, Human
agcuccguggcccagcuug

SEQ ID NO: 755748 - RNA, 18 nt, Human
aggccucgcuggaggccc

SEQ ID NO: 755749 - RNA, 21 nt, Human
agggcuuuagaagagccaaua

SEQ ID NO: 755750 - RNA, 20 nt, Human
aguaaggaaagguaaaacca

SEQ ID NO: 755751 - RNA, 20 nt, Human
aguagcuacacaaagccaag

SEQ ID NO: 755752 - RNA, 22 nt, Human
caaaagcaaaauccaaccucuc

SEQ ID NO: 755753 - RNA, 24 nt, Human
caaaccgcaaaauaaagaugagaa

SEQ ID NO: 755754 - RNA, 24 nt, Human
caacaaaguaaccucccagcagag

SEQ ID NO: 755755 - RNA, 26 nt, Human
caacaaaguaaccucccagcagaggu

SEQ ID NO: 755756 - RNA, 19 nt, Human
cagacccaaccggaggccg

SEQ ID NO: 755757 - RNA, 20 nt, Human
cagccaagaucuuguugagu

SEQ ID NO: 755758 - RNA, 26 nt, Human
caucccaggagccuggcaaacacccc

SEQ ID NO: 755759 - RNA, 23 nt, Human
ccacauaauucucucugcccaca

SEQ ID NO: 755760 - RNA, 22 nt, Human
ccagccccggggcuuuguccug

SEQ ID NO: 755761 - RNA, 19 nt, Human
ccaucccaggagccuggca

SEQ ID NO: 755762 - RNA, 25 nt, Human
cccaagaaguuaguagcuacacaaa

SEQ ID NO: 755763 - RNA, 19 nt, Human
cccacagugguuacccgaa

SEQ ID NO: 755764 - RNA, 20 nt, Human
cccaggagccuggcaaacac

SEQ ID NO: 755765 - RNA, 19 nt, Human
cccaugugcuuuccugggc

SEQ ID NO: 755766 - RNA, 19 nt, Human
cccaugugcuuuccugggc

SEQ ID NO: 755767 - RNA, 26 nt, Human
ccccagagacccucaggaugcgccag

SEQ ID NO: 755768 - RNA, 18 nt, Human
ccccggggcuccaggcuc

SEQ ID NO: 755769 - RNA, 20 nt, Human
ccccggggcuccaggcuccc

SEQ ID NO: 755770 - RNA, 21 nt, Human
ccccggggcuccaggcucccu

SEQ ID NO: 755771 - RNA, 19 nt, Human
ccccugguuguggauucca

SEQ ID NO: 755772 - RNA, 26 nt, Human
ccugagacacaccccaacaggaaaca

SEQ ID NO: 755773 - RNA, 21 nt, Human
ccugccaccccuccaggcuuc

SEQ ID NO: 755774 - RNA, 23 nt, Human
ccugccaccccuccaggcuucug

SEQ ID NO: 755775 - RNA, 19 nt, Human
cgaaacacaaaacucaaac

SEQ ID NO: 755776 - RNA, 20 nt, Human
cgcuggaggccccggggcuc

SEQ ID NO: 755777 - RNA, 21 nt, Human
cguuagcguuucuaaucacac

SEQ ID NO: 755778 - RNA, 24 nt, Human
cucaaaccgcaaaauaaagaugag

SEQ ID NO: 755779 - RNA, 21 nt, Human
cuccacaagcugaagauaccu

SEQ ID NO: 755780 - RNA, 25 nt, Human
cuccaugcugagccugggcugcucc

SEQ ID NO: 755781 - RNA, 22 nt, Human
cuccggcuccaacaaccacacc

SEQ ID NO: 755782 - RNA, 26 nt, Human
cucuccaaaaugcagacccaaccgga

SEQ ID NO: 755783 - RNA, 19 nt, Human
cucugcccugccaccccuc

SEQ ID NO: 755784 - RNA, 18 nt, Human
cugccugagacacacccc

SEQ ID NO: 755785 - RNA, 22 nt, Human
cuggaggcacugcagggcuucu

SEQ ID NO: 755786 - RNA, 23 nt, Human
cuggcaaacacccccagagaccc

SEQ ID NO: 755787 - RNA, 22 nt, Human
cuucugcuccuggcaggcucua

SEQ ID NO: 755788 - RNA, 29 nt, Human
cuuucuaggcaacaaaguaaccucccagg

SEQ ID NO: 755789 - RNA, 20 nt, Human
gagaagcuggagcuccgugg

SEQ ID NO: 755790 - RNA, 19 nt, Human
gagcggcacgcuggaagac

SEQ ID NO: 755791 - RNA, 23 nt, Human
gagcuccguggcccagcuugugg

SEQ ID NO: 755792 - RNA, 23 nt, Human
gcacacugaagacgagaucacac

SEQ ID NO: 755793 - RNA, 21 nt, Human
gcuggcuccagugccagcccc

SEQ ID NO: 755794 - RNA, 20 nt, Human
ggaggcacugcagggcuucu

SEQ ID NO: 755795 - RNA, 19 nt, Human
ggccaugggucucgcggcu

SEQ ID NO: 755796 - RNA, 20 nt, Human
ggccccggggcuccaggcuc

SEQ ID NO: 755797 - RNA, 19 nt, Human
gggcaggccccaugcccuc

SEQ ID NO: 755798 - RNA, 23 nt, Human
guauagcaugcugcgcguacaca

SEQ ID NO: 755799 - RNA, 18 nt, Human
gugcaguuuaaccagggg

SEQ ID NO: 755800 - RNA, 21 nt, Human
gugcuuuccugggcaugauau

SEQ ID NO: 755801 - RNA, 23 nt, Human
uaaaaccagagacgugagggcca

SEQ ID NO: 755802 - RNA, 22 nt, Human
uaaagacagcuucgcagcgaaa

SEQ ID NO: 755803 - RNA, 18 nt, Human
uaaggaaagguaaaacca

SEQ ID NO: 755804 - RNA, 25 nt, Human
uaaguaaugaagucucaacauuaca

SEQ ID NO: 755805 - RNA, 24 nt, Human
uauagcaugcugcgcguacacaua

SEQ ID NO: 755806 - RNA, 23 nt, Human
uaucaccaacaagacgcagcugc

SEQ ID NO: 755807 - RNA, 19 nt, Human
uccaugcugagccugggcu

SEQ ID NO: 755808 - RNA, 21 nt, Human
ucccaugugcuuuccugggca

SEQ ID NO: 755809 - RNA, 19 nt, Human
uccguggcccagcuugugg

SEQ ID NO: 755810 - RNA, 18 nt, Human
uccuggcaggcucuaggg

SEQ ID NO: 755811 - RNA, 23 nt, Human
ucucaggccucgcuggaggcccc

SEQ ID NO: 755812 - RNA, 19 nt, Human
ucuccaaaaugcagaccca

SEQ ID NO: 755813 - RNA, 18 nt, Human
ucucucugcccacacucu

SEQ ID NO: 755814 - RNA, 25 nt, Human
ugacacgcucccuccggcuccaaca

SEQ ID NO: 755815 - RNA, 18 nt, Human
ugacucggccaagcugcu

SEQ ID NO: 755816 - RNA, 19 nt, Human
ugacucggccaagcugcug

SEQ ID NO: 755817 - RNA, 20 nt, Human
ugagaagcuggagcuccgug

SEQ ID NO: 755818 - RNA, 21 nt, Human
ugagacacaccccaacaggaa

SEQ ID NO: 755819 - RNA, 20 nt, Human
ugagagaaggugcguggcca

SEQ ID NO: 755820 - RNA, 22 nt, Human
ugauuguccacuucaaaaucuu

SEQ ID NO: 755821 - RNA, 19 nt, Human
ugcaaagggucucuuuuac

SEQ ID NO: 755822 - RNA, 27 nt, Human
ugcgcguacacauacgcagugugcaca

SEQ ID NO: 755823 - RNA, 19 nt, Human
ugcuccuggcaggcucuag

SEQ ID NO: 755824 - RNA, 21 nt, Human
ugcucugcccugccaccccuc

SEQ ID NO: 755825 - RNA, 23 nt, Human
ugcucugcccugccaccccucca

SEQ ID NO: 755826 - RNA, 19 nt, Human
ugcugagccugggcugcuc

SEQ ID NO: 755827 - RNA, 20 nt, Human
uggaggccccggggcuccag

SEQ ID NO: 755828 - RNA, 22 nt, Human
uggaggccccggggcuccaggc

SEQ ID NO: 755829 - RNA, 23 nt, Human
uggaggccccggggcuccaggcu

SEQ ID NO: 755830 - RNA, 24 nt, Human
uggcgggcuggguauuaaagacag

SEQ ID NO: 755831 - RNA, 24 nt, Human
ugggagagagcccacagugguuac

SEQ ID NO: 755832 - RNA, 19 nt, Human
ugguguggacucuccaaaa

SEQ ID NO: 755833 - RNA, 21 nt, Human
ugucgcaaacaccugaucgca

SEQ ID NO: 755834 - RNA, 22 nt, Human
uuaaaccagauuuauucuccac

SEQ ID NO: 755835 - RNA, 23 nt, Human
uuacccgaaccacccuucucagg

SEQ ID NO: 755836 - RNA, 20 nt, Human
uuccaucuggaggcacugca

SEQ ID NO: 755837 - RNA, 22 nt, Human
uuuacaaaagcaaaauccaacc

SEQ ID NO: 755838 - RNA, 21 nt, Human
uuucuggucugugaucuuugg

SEQ ID NO: 755839 - RNA, 19 nt, Human
aaaaaaaaaaaaaaggaaa

SEQ ID NO: 755840 - RNA, 18 nt, Human
aaaaaaacccaauacaaa

SEQ ID NO: 755841 - RNA, 29 nt, Human
aaaaaacccaauacaaagcucugaaaccg

SEQ ID NO: 755842 - RNA, 21 nt, Human
aaaaaagagaaaaaaacccaa

SEQ ID NO: 755843 - RNA, 27 nt, Human
aaaaagauaaagaauuuuaagagcugg

SEQ ID NO: 755844 - RNA, 21 nt, Human
aaaagaaaaaccugaacaaaa

SEQ ID NO: 755845 - RNA, 23 nt, Human
aaaagaaaaaccugaacaaaaaa

SEQ ID NO: 755846 - RNA, 21 nt, Human
aaaaggcaacccaucaccaca

SEQ ID NO: 755847 - RNA, 25 nt, Human
aaaauccauauccaaagccaaccuc

SEQ ID NO: 755848 - RNA, 25 nt, Human
aaagcagcugaaaugcugcaaagca

SEQ ID NO: 755849 - RNA, 23 nt, Human
aaaggcaacccaucaccacaaaa

SEQ ID NO: 755850 - RNA, 21 nt, Human
aacaaaagugaaaagggguca

SEQ ID NO: 755851 - RNA, 21 nt, Human
aacaauaaaacaucacuuuuu

SEQ ID NO: 755852 - RNA, 22 nt, Human
aacccaaccuauauuuccaacu

SEQ ID NO: 755853 - RNA, 25 nt, Human
aagaaaaagauaaagaauuuuaaga

SEQ ID NO: 755854 - RNA, 18 nt, Human
aagaaaagcaggauacga

SEQ ID NO: 755855 - RNA, 19 nt, Human
aagaaaagcaggauacgaa

SEQ ID NO: 755856 - RNA, 23 nt, Human
aagaaaugacaggccaggcagaa

SEQ ID NO: 755857 - RNA, 24 nt, Human
aagacucugaccauauucuccaga

SEQ ID NO: 755858 - RNA, 21 nt, Human
aagcacacauggaaucuaucu

SEQ ID NO: 755859 - RNA, 27 nt, Human
aagcagcugaaaugcugcaaagcauac

SEQ ID NO: 755860 - RNA, 21 nt, Human
aagcaggauacgaaaaauggg

SEQ ID NO: 755861 - RNA, 23 nt, Human
aaguaggaagcggaauugcagga

SEQ ID NO: 755862 - RNA, 21 nt, Human
aagugaaaaauccuccuccuu

SEQ ID NO: 755863 - RNA, 22 nt, Human
aauaagaaaaaaacccaaccua

SEQ ID NO: 755864 - RNA, 19 nt, Human
aauacaaagcucugaaaca

SEQ ID NO: 755865 - RNA, 24 nt, Human
aaugaaaaaaagagaaaaaaaccc

SEQ ID NO: 755866 - RNA, 21 nt, Human
aauucugguuuugccaagaaa

SEQ ID NO: 755867 - RNA, 23 nt, Human
acaaccuccucaccaaaaaaacc

SEQ ID NO: 755868 - RNA, 23 nt, Human
acacacacacacucacacacaca

SEQ ID NO: 755869 - RNA, 24 nt, Human
acacacacacacucacacacacag

SEQ ID NO: 755870 - RNA, 23 nt, Human
acacacacacagacacacacaca

SEQ ID NO: 755871 - RNA, 27 nt, Human
acacacacaccaaaaaaauaaauacaa

SEQ ID NO: 755872 - RNA, 22 nt, Human
acacacucacacacacacacca

SEQ ID NO: 755873 - RNA, 21 nt, Human
acacagacacacacacacuca

SEQ ID NO: 755874 - RNA, 21 nt, Human
accacaacacacacacagaca

SEQ ID NO: 755875 - RNA, 27 nt, Human
accacaacacacacacagacacacaca

SEQ ID NO: 755876 - RNA, 21 nt, Human
accuccucaccaaaaaaaccc

SEQ ID NO: 755877 - RNA, 25 nt, Human
accuccucaccaaaaaaacccaaua

SEQ ID NO: 755878 - RNA, 19 nt, Human
acuacaguuuacagccauu

SEQ ID NO: 755879 - RNA, 21 nt, Human
agaaaaaaaaauauaaaagaa

SEQ ID NO: 755880 - RNA, 23 nt, Human
agaaaaaaaaauauaaaagaaaa

SEQ ID NO: 755881 - RNA, 22 nt, Human
agaaaaaccugaacaaaaaaua

SEQ ID NO: 755882 - RNA, 19 nt, Human
agaaucugguauuaucaag

SEQ ID NO: 755883 - RNA, 18 nt, Human
agacaugaacaaugcacc

SEQ ID NO: 755884 - RNA, 23 nt, Human
agagguagaagaugacaaacaug

SEQ ID NO: 755885 - RNA, 22 nt, Human
agauacagacaugaacaaugca

SEQ ID NO: 755886 - RNA, 23 nt, Human
agcaaauccccaucugaacaaaa

SEQ ID NO: 755887 - RNA, 24 nt, Human
agcaaauccccaucugaacaaaaa

SEQ ID NO: 755888 - RNA, 19 nt, Human
agccugucucuucaaauca

SEQ ID NO: 755889 - RNA, 19 nt, Human
agcuggaagcgaagggguu

SEQ ID NO: 755890 - RNA, 24 nt, Human
agcuggcuuuaaaaaucuggccuc

SEQ ID NO: 755891 - RNA, 22 nt, Human
aggcaacccaucaccacaaaag

SEQ ID NO: 755892 - RNA, 24 nt, Human
agucuguggucacuuagaaacaga

SEQ ID NO: 755893 - RNA, 19 nt, Human
auaaauacaaccuccucac

SEQ ID NO: 755894 - RNA, 21 nt, Human
augaaaaaaagagaaaaaaac

SEQ ID NO: 755895 - RNA, 18 nt, Human
auuugaucacuccuucca

SEQ ID NO: 755896 - RNA, 25 nt, Human
caaaaaucaucuuaaaaaaucaaac

SEQ ID NO: 755897 - RNA, 20 nt, Human
caaagcauaccagaaugaaa

SEQ ID NO: 755898 - RNA, 22 nt, Human
caaccuccucaccaaaaaaacc

SEQ ID NO: 755899 - RNA, 24 nt, Human
caagaaaaagauaaagaauuuuaa

SEQ ID NO: 755900 - RNA, 24 nt, Human
caaggcaaaaaaaguugcaagcaa

SEQ ID NO: 755901 - RNA, 21 nt, Human
caauaagaaaaaaacccaacc

SEQ ID NO: 755902 - RNA, 19 nt, Human
cacaacacacacacagaca

SEQ ID NO: 755903 - RNA, 23 nt, Human
cacacacacaccaaaaaaauaaa

SEQ ID NO: 755904 - RNA, 24 nt, Human
cacacacacacucacacacacaca

SEQ ID NO: 755905 - RNA, 22 nt, Human
cacacacacagacacacacaca

SEQ ID NO: 755906 - RNA, 24 nt, Human
cacacacacucacacacacacacc

SEQ ID NO: 755907 - RNA, 25 nt, Human
cacacacacucacacacacacacca

SEQ ID NO: 755908 - RNA, 21 nt, Human
cacacucacacacacacacca

SEQ ID NO: 755909 - RNA, 24 nt, Human
cacauggaaucuaucuuacacucu

SEQ ID NO: 755910 - RNA, 20 nt, Human
caccaaagcagcugaaaugc

SEQ ID NO: 755911 - RNA, 27 nt, Human
caccaaggcaaaaaaaguugcaagcaa

SEQ ID NO: 755912 - RNA, 20 nt, Human
cacugggccuguuuaagacu

SEQ ID NO: 755913 - RNA, 24 nt, Human
cagaaaaaaaaauauaaaagaaaa

SEQ ID NO: 755914 - RNA, 21 nt, Human
cagaacaggcuugcagauaca

SEQ ID NO: 755915 - RNA, 23 nt, Human
cagauacagacaugaacaaugca

SEQ ID NO: 755916 - RNA, 23 nt, Human
cagcugaugcugccuuagcuggc

SEQ ID NO: 755917 - RNA, 20 nt, Human
caggaucuuccacuuccaug

SEQ ID NO: 755918 - RNA, 21 nt, Human
cauaccagaaugaaaaaaaga

SEQ ID NO: 755919 - RNA, 22 nt, Human
cauauucuccagaagauucuga

SEQ ID NO: 755920 - RNA, 25 nt, Human
cauggaaucuaucuuacacucuuaa

SEQ ID NO: 755921 - RNA, 20 nt, Human
ccaaaaaaacccaauacaaa

SEQ ID NO: 755922 - RNA, 22 nt, Human
ccaaaaaaacccaauacaaagc

SEQ ID NO: 755923 - RNA, 18 nt, Human
ccauucccacaaaagaug

SEQ ID NO: 755924 - RNA, 20 nt, Human
cccaccaaagcagcugaaau

SEQ ID NO: 755925 - RNA, 25 nt, Human
ccccaccaaagcagcugaaaugcuu

SEQ ID NO: 755926 - RNA, 19 nt, Human
ccccaccuuuuuuuucagc

SEQ ID NO: 755927 - RNA, 21 nt, Human
cccgcacagcugaugcugccu

SEQ ID NO: 755928 - RNA, 22 nt, Human
cccugccccccaccuuuuuuuu

SEQ ID NO: 755929 - RNA, 19 nt, Human
ccuaaguaggaagcggaau

SEQ ID NO: 755930 - RNA, 21 nt, Human
ccuccucaccaaaaaaaccca

SEQ ID NO: 755931 - RNA, 19 nt, Human
ccuuccuuucccauuccca

SEQ ID NO: 755932 - RNA, 18 nt, Human
cuuguggauaucuacugg

SEQ ID NO: 755933 - RNA, 24 nt, Human
cuuuuaucuucccuucccugcccc

SEQ ID NO: 755934 - RNA, 23 nt, Human
gaaaucacuuccaggaucugcuc

SEQ ID NO: 755935 - RNA, 20 nt, Human
gaagggguuaucuguguccc

SEQ ID NO: 755936 - RNA, 19 nt, Human
gccaaccucaaguacacag

SEQ ID NO: 755937 - RNA, 19 nt, Human
gcugucuccuuccuuuccc

SEQ ID NO: 755938 - RNA, 18 nt, Human
ggcagaacaggcuugcag

SEQ ID NO: 755939 - RNA, 18 nt, Human
ggcuuuauauaauagaau

SEQ ID NO: 755940 - RNA, 22 nt, Human
gggagguuuaaaaaaaaaaaaa

SEQ ID NO: 755941 - RNA, 21 nt, Human
gggcuuuauauaauagaauuu

SEQ ID NO: 755942 - RNA, 24 nt, Human
ggggagguuuaaaaaaaaaaaaaa

SEQ ID NO: 755943 - RNA, 22 nt, Human
guaaagccugucucuucaaauc

SEQ ID NO: 755944 - RNA, 21 nt, Human
guaaaugggcaacuaccuucu

SEQ ID NO: 755945 - RNA, 22 nt, Human
gucaacuuuuuggugacauuuu

SEQ ID NO: 755946 - RNA, 19 nt, Human
uaaaaaaaaaauccugagc

SEQ ID NO: 755947 - RNA, 21 nt, Human
uaaaauaaguucaagagcaca

SEQ ID NO: 755948 - RNA, 20 nt, Human
uaaauacaaccuccucacca

SEQ ID NO: 755949 - RNA, 22 nt, Human
uaaauacaaccuccucaccaaa

SEQ ID NO: 755950 - RNA, 24 nt, Human
uaaauccacuuuuuaaaaaaauuu

SEQ ID NO: 755951 - RNA, 23 nt, Human
uaaaucccgcacagcugaugcug

SEQ ID NO: 755952 - RNA, 21 nt, Human
uaacuuucagauuucuuccuu

SEQ ID NO: 755953 - RNA, 22 nt, Human
uaagaugaugcuugucuucucc

SEQ ID NO: 755954 - RNA, 20 nt, Human
uaagugaaaaauccuccucc

SEQ ID NO: 755955 - RNA, 21 nt, Human
uaccacauagcaaaauaagau

SEQ ID NO: 755956 - RNA, 22 nt, Human
uaccacauagcaaaauaagaug

SEQ ID NO: 755957 - RNA, 21 nt, Human
uagaaaggguuagucuguggu

SEQ ID NO: 755958 - RNA, 22 nt, Human
uagaagaugacaaacaugagga

SEQ ID NO: 755959 - RNA, 25 nt, Human
uaucaacccucaccuaggcuuuggg

SEQ ID NO: 755960 - RNA, 23 nt, Human
uauccaaagccaaccucaaguac

SEQ ID NO: 755961 - RNA, 18 nt, Human
uaucuacugggaaucuau

SEQ ID NO: 755962 - RNA, 25 nt, Human
uauguucuuuggacuuaauuuuggu

SEQ ID NO: 755963 - RNA, 21 nt, Human
uauuaucaaggacuggguugu

SEQ ID NO: 755964 - RNA, 18 nt, Human
ucagcugagcuauaggcu

SEQ ID NO: 755965 - RNA, 18 nt, Human
uccagguaagaaaugaca

SEQ ID NO: 755966 - RNA, 23 nt, Human
uccccaucugaacaaaaaguaac

SEQ ID NO: 755967 - RNA, 18 nt, Human
ucuuguccuuucccccaa

SEQ ID NO: 755968 - RNA, 23 nt, Human
ugccuaaguaggaagcggaauug

SEQ ID NO: 755969 - RNA, 21 nt, Human
ugcgacgugaccaacuuaaaa

SEQ ID NO: 755970 - RNA, 21 nt, Human
ugcucguagaaaaggcaaccc

SEQ ID NO: 755971 - RNA, 21 nt, Human
uggcagaacaggcuugcagaa

SEQ ID NO: 755972 - RNA, 18 nt, Human
uggggagaaaacaauaag

SEQ ID NO: 755973 - RNA, 21 nt, Human
ugguauuaucaaggacugggu

SEQ ID NO: 755974 - RNA, 23 nt, Human
uggucacuuagaaacagaagccc

SEQ ID NO: 755975 - RNA, 24 nt, Human
uuaaaccuauauaacaaaagugaa

SEQ ID NO: 755976 - RNA, 21 nt, Human
uuacugagaauagaaguguag

SEQ ID NO: 755977 - RNA, 20 nt, Human
uuagaaacagaagcccugcu

SEQ ID NO: 755978 - RNA, 18 nt, Human
uuaucuguguccccacca

SEQ ID NO: 755979 - RNA, 23 nt, Human
uucagauuucuuccuuuuacaau

SEQ ID NO: 755980 - RNA, 24 nt, Human
uucagauuucuuccuuuuacaauu

SEQ ID NO: 755981 - RNA, 24 nt, Human
uucaggaaaagggugggggagguu

SEQ ID NO: 755982 - RNA, 18 nt, Human
uucccuaggcuuuuuuaa

SEQ ID NO: 755983 - RNA, 22 nt, Human
uuccuaauagguuugguacuua

SEQ ID NO: 755984 - RNA, 25 nt, Human
uuggggcuuuauauaauagaauuua

SEQ ID NO: 755985 - RNA, 23 nt, Human
uuuaaaaaaaaaaaaaaggaaaa

SEQ ID NO: 755986 - RNA, 25 nt, Human
uuuaaaaaaaaaaaaaaggaaaaau

SEQ ID NO: 755987 - RNA, 22 nt, Human
uuuacaauuaaguugugauauc

SEQ ID NO: 755988 - RNA, 24 nt, Human
uuuuuuuucagcugagcuauaggc

SEQ ID NO: 755989 - RNA, 19 nt, Human
aaagugcugggauuacagg

SEQ ID NO: 755990 - RNA, 23 nt, Human
aaagugcugggauuacaggcaua

SEQ ID NO: 755991 - RNA, 24 nt, Human
aaagugcugggauuacaggcguga

SEQ ID NO: 755992 - RNA, 21 nt, Human
aacccgcgguuacgccagcgg

SEQ ID NO: 755993 - RNA, 24 nt, Human
aagcauagccuggcccugaagugc

SEQ ID NO: 755994 - RNA, 19 nt, Human
aagugcugggauuacaggc

SEQ ID NO: 755995 - RNA, 19 nt, Human
aagugcugggauuacaggc

SEQ ID NO: 755996 - RNA, 19 nt, Human
aagugcugggauuacaggc

SEQ ID NO: 755997 - RNA, 21 nt, Human
aagugcugggauuacaggcau

SEQ ID NO: 755998 - RNA, 26 nt, Human
aagugcugggauuacaggcauaagcc

SEQ ID NO: 755999 - RNA, 26 nt, Human
aagugcugggauuacaggcgugagcc

SEQ ID NO: 756000 - RNA, 24 nt, Human
acaaacaagggcagaacuagggua

SEQ ID NO: 756001 - RNA, 23 nt, Human
acacacacacauacauacauaca

SEQ ID NO: 756002 - RNA, 24 nt, Human
acacacauacauacauacauauaa

SEQ ID NO: 756003 - RNA, 21 nt, Human
acacauacacacauauguaua

SEQ ID NO: 756004 - RNA, 19 nt, Human
acacauuuccaggguagac

SEQ ID NO: 756005 - RNA, 23 nt, Human
acaggcccacaccaccgugcccg

SEQ ID NO: 756006 - RNA, 25 nt, Human
acauacauacauacauauaaauaca

SEQ ID NO: 756007 - RNA, 33 nt, Human
acauauaaauacacauacacacauauguauagu

SEQ ID NO: 756008 - RNA, 22 nt, Human
accauguuggucaggcuggccu

SEQ ID NO: 756009 - RNA, 24 nt, Human
accauguuggucaggcuggccucg

SEQ ID NO: 756010 - RNA, 19 nt, Human
acccaggcuggagugcagu

SEQ ID NO: 756011 - RNA, 22 nt, Human
accccuccacccuccuuugccu

SEQ ID NO: 756012 - RNA, 25 nt, Human
acccgccucggccuuccaaagugcu

SEQ ID NO: 756013 - RNA, 22 nt, Human
accuccgccucucggguucaag

SEQ ID NO: 756014 - RNA, 20 nt, Human
acgagguuucgccaugcugg

SEQ ID NO: 756015 - RNA, 24 nt, Human
acgagguuucgccaugcuggccag

SEQ ID NO: 756016 - RNA, 18 nt, Human
acucugucacccaggcug

SEQ ID NO: 756017 - RNA, 25 nt, Human
acucugucacccaggcuggagugca

SEQ ID NO: 756018 - RNA, 22 nt, Human
agacagaagguaaaaaacaaag

SEQ ID NO: 756019 - RNA, 22 nt, Human
agagggaagggagagggaggcc

SEQ ID NO: 756020 - RNA, 19 nt, Human
agagggaggccuaaggauu

SEQ ID NO: 756021 - RNA, 23 nt, Human
aggaggcagaccacggaagcaag

SEQ ID NO: 756022 - RNA, 18 nt, Human
aggcauaagccaccaagc

SEQ ID NO: 756023 - RNA, 21 nt, Human
aggcauaagccaccaagcccg

SEQ ID NO: 756024 - RNA, 23 nt, Human
aggcgugagccuccgugcccggc

SEQ ID NO: 756025 - RNA, 25 nt, Human
aggcuggagugcagugacaugaucu

SEQ ID NO: 756026 - RNA, 20 nt, Human
aggcugugggggaggccaug

SEQ ID NO: 756027 - RNA, 21 nt, Human
agggagaauuuuuuuucuuuu

SEQ ID NO: 756028 - RNA, 20 nt, Human
agggagagggaggccuaagg

SEQ ID NO: 756029 - RNA, 18 nt, Human
aggugacccacccgccuc

SEQ ID NO: 756030 - RNA, 22 nt, Human
aguagagacgagguuucgccau

SEQ ID NO: 756031 - RNA, 18 nt, Human
aguagcugcgauuacagg

SEQ ID NO: 756032 - RNA, 24 nt, Human
agugcagugacaugaucucggcuc

SEQ ID NO: 756033 - RNA, 21 nt, Human
agugcaguggcgcaaugucag

SEQ ID NO: 756034 - RNA, 18 nt, Human
agugcugggauuacaggc

SEQ ID NO: 756035 - RNA, 21 nt, Human
auacacacauauguauaugua

SEQ ID NO: 756036 - RNA, 25 nt, Human
auacauacauacauauaaauacaca

SEQ ID NO: 756037 - RNA, 23 nt, Human
auauacauauauauauauauaua

SEQ ID NO: 756038 - RNA, 20 nt, Human
auauauauauacacauauac

SEQ ID NO: 756039 - RNA, 20 nt, Human
aucggugggcccucagaccu

SEQ ID NO: 756040 - RNA, 24 nt, Human
augacuggccacagacacaccccc

SEQ ID NO: 756041 - RNA, 21 nt, Human
augguguuucaccauguuggu

SEQ ID NO: 756042 - RNA, 24 nt, Human
augguguuucaccauguuggucag

SEQ ID NO: 756043 - RNA, 21 nt, Human
auuccccugccucagccuccc

SEQ ID NO: 756044 - RNA, 24 nt, Human
auuuuuguauuuuuaguagagacg

SEQ ID NO: 756045 - RNA, 24 nt, Human
caaagugcugggauuacaggcaua

SEQ ID NO: 756046 - RNA, 24 nt, Human
caaagugcugggauuacaggcgug

SEQ ID NO: 756047 - RNA, 21 nt, Human
caaauccucaucaaagaguuc

SEQ ID NO: 756048 - RNA, 20 nt, Human
caagugauucuccugccuca

SEQ ID NO: 756049 - RNA, 22 nt, Human
caagugauucuccugccucagc

SEQ ID NO: 756050 - RNA, 23 nt, Human
caauaacaaaaggcuuaacauuu

SEQ ID NO: 756051 - RNA, 22 nt, Human
caaugacuggccacagacacac

SEQ ID NO: 756052 - RNA, 24 nt, Human
caauuuuuguauuuuuaguagaga

SEQ ID NO: 756053 - RNA, 22 nt, Human
cacacauacauacauacauaua

SEQ ID NO: 756054 - RNA, 18 nt, Human
cacaccaccgugcccggc

SEQ ID NO: 756055 - RNA, 22 nt, Human
cacagguggacacugaaggcca

SEQ ID NO: 756056 - RNA, 24 nt, Human
caccauguuggucaggcuggccuc

SEQ ID NO: 756057 - RNA, 20 nt, Human
caccccuccacccuccuuug

SEQ ID NO: 756058 - RNA, 23 nt, Human
cacccgccucggccuuccaaagu

SEQ ID NO: 756059 - RNA, 20 nt, Human
cacccuagacaccuuggcca

SEQ ID NO: 756060 - RNA, 23 nt, Human
cacgauaaccucugccucccggg

SEQ ID NO: 756061 - RNA, 23 nt, Human
cacucugucacccaggcuggagu

SEQ ID NO: 756062 - RNA, 24 nt, Human
cacucugucacccaggcuggagug

SEQ ID NO: 756063 - RNA, 18 nt, Human
cacucugucuuccgcgcu

SEQ ID NO: 756064 - RNA, 24 nt, Human
cacucugucuuccgcgcuggagug

SEQ ID NO: 756065 - RNA, 23 nt, Human
cacugcaaccuccgccucucggg

SEQ ID NO: 756066 - RNA, 21 nt, Human
cagcacacaugcuacaaccuu

SEQ ID NO: 756067 - RNA, 22 nt, Human
cagcuuccccgccauuuuccaa

SEQ ID NO: 756068 - RNA, 18 nt, Human
cagcuuccugaguagcug

SEQ ID NO: 756069 - RNA, 18 nt, Human
cagcuucuggcgccucca

SEQ ID NO: 756070 - RNA, 21 nt, Human
caggcgcccgccaccacaccc

SEQ ID NO: 756071 - RNA, 24 nt, Human
caguagcugggacuacaggcgccc

SEQ ID NO: 756072 - RNA, 24 nt, Human
caguuggggagugaggguagugug

SEQ ID NO: 756073 - RNA, 24 nt, Human
cauacauacauacauauaaauaca

SEQ ID NO: 756074 - RNA, 20 nt, Human
cauauacauauauauauaua

SEQ ID NO: 756075 - RNA, 18 nt, Human
cauauauauauauauaca

SEQ ID NO: 756076 - RNA, 24 nt, Human
caugcuggccaggcuggucucaaa

SEQ ID NO: 756077 - RNA, 20 nt, Human
ccaaagugcugggauuacag

SEQ ID NO: 756078 - RNA, 22 nt, Human
ccaaagugcugggauuacaggc

SEQ ID NO: 756079 - RNA, 22 nt, Human
ccaaagugcugggauuacaggc

SEQ ID NO: 756080 - RNA, 22 nt, Human
ccaaagugcugggauuacaggc

SEQ ID NO: 756081 - RNA, 24 nt, Human
ccaaagugcugggauuacaggcau

SEQ ID NO: 756082 - RNA, 24 nt, Human
ccaaagugcugggauuacaggcgu

SEQ ID NO: 756083 - RNA, 18 nt, Human
ccaccuucucauuaaugu

SEQ ID NO: 756084 - RNA, 21 nt, Human
ccagcacacaugcuacaaccu

SEQ ID NO: 756085 - RNA, 19 nt, Human
ccaugcuggccaggcuggu

SEQ ID NO: 756086 - RNA, 22 nt, Human
ccaugcuggccaggcuggucuc

SEQ ID NO: 756087 - RNA, 24 nt, Human
cccaagcauagccuggcccugaag

SEQ ID NO: 756088 - RNA, 21 nt, Human
cccacacacauuuccagggua

SEQ ID NO: 756089 - RNA, 23 nt, Human
cccaguagcugggacuacaggcg

SEQ ID NO: 756090 - RNA, 22 nt, Human
ccccuccacccuccuuugccug

SEQ ID NO: 756091 - RNA, 18 nt, Human
cccgccaccacacccgga

SEQ ID NO: 756092 - RNA, 20 nt, Human
cccggguucaagcaauuccc

SEQ ID NO: 756093 - RNA, 23 nt, Human
cccggguucaagcaauuccccug

SEQ ID NO: 756094 - RNA, 19 nt, Human
cccuagacaccuuggccag

SEQ ID NO: 756095 - RNA, 18 nt, Human
cccugccucagccucccc

SEQ ID NO: 756096 - RNA, 18 nt, Human
ccgccaccacacccggac

SEQ ID NO: 756097 - RNA, 21 nt, Human
ccgcgcuggagugcaguggcg

SEQ ID NO: 756098 - RNA, 22 nt, Human
ccucccggguucaagcaauucc

SEQ ID NO: 756099 - RNA, 18 nt, Human
ccucccuccuuucugccc

SEQ ID NO: 756100 - RNA, 21 nt, Human
ccucucggguucaagugauuc

SEQ ID NO: 756101 - RNA, 24 nt, Human
ccucucggguucaagugauucucc

SEQ ID NO: 756102 - RNA, 22 nt, Human
ccugaccucaggugacccaccc

SEQ ID NO: 756103 - RNA, 23 nt, Human
ccugaccucaggugacccacccg

SEQ ID NO: 756104 - RNA, 19 nt, Human
ccugaguagcugcgauuac

SEQ ID NO: 756105 - RNA, 23 nt, Human
ccugaguagcugcgauuacaggc

SEQ ID NO: 756106 - RNA, 19 nt, Human
ccugccucagccuccccag

SEQ ID NO: 756107 - RNA, 21 nt, Human
ccuggcccugaagugccaauu

SEQ ID NO: 756108 - RNA, 24 nt, Human
cgagguuucgccaugcuggccagg

SEQ ID NO: 756109 - RNA, 24 nt, Human
cgccaugcuggccaggcuggucuc

SEQ ID NO: 756110 - RNA, 27 nt, Human
cgccaugcuggccaggcuggucucaaa

SEQ ID NO: 756111 - RNA, 21 nt, Human
cggguucaagugauucuccug

SEQ ID NO: 756112 - RNA, 24 nt, Human
cucacgauaaccucugccucccgg

SEQ ID NO: 756113 - RNA, 25 nt, Human
cucacgauaaccucugccucccggg

SEQ ID NO: 756114 - RNA, 24 nt, Human
cucacucugucacccaggcuggag

SEQ ID NO: 756115 - RNA, 24 nt, Human
cucacugcaaccuccgccucucgg

SEQ ID NO: 756116 - RNA, 22 nt, Human
cucagcagcuucuggcgccucc

SEQ ID NO: 756117 - RNA, 24 nt, Human
cucagccuccccaguagcugggac

SEQ ID NO: 756118 - RNA, 19 nt, Human
cucagggcugagauucaac

SEQ ID NO: 756119 - RNA, 24 nt, Human
cuccuaaccucgugaucugcccgc

SEQ ID NO: 756120 - RNA, 23 nt, Human
cucggguucaagugauucuccuc

SEQ ID NO: 756121 - RNA, 20 nt, Human
cugaagugccaauuccagca

SEQ ID NO: 756122 - RNA, 19 nt, Human
cugauugccagcacacaug

SEQ ID NO: 756123 - RNA, 24 nt, Human
cugcaaccuccgccucucggguuc

SEQ ID NO: 756124 - RNA, 23 nt, Human
cugccucagccuccccaguagcu

SEQ ID NO: 756125 - RNA, 23 nt, Human
cugccucagcuuccugaguagcu

SEQ ID NO: 756126 - RNA, 24 nt, Human
cuggagugcagugacaugaucucg

SEQ ID NO: 756127 - RNA, 19 nt, Human
cuuacuuuuaggccuuuua

SEQ ID NO: 756128 - RNA, 22 nt, Human
cuucagccuccucagcagcuuc

SEQ ID NO: 756129 - RNA, 25 nt, Human
cuugcccucacuaccuucagccucc

SEQ ID NO: 756130 - RNA, 22 nt, Human
cuuuucagcacgcaugcgugca

SEQ ID NO: 756131 - RNA, 23 nt, Human
gaccacggaagcaaguuuggagg

SEQ ID NO: 756132 - RNA, 22 nt, Human
gacuggccacagacacaccccc

SEQ ID NO: 756133 - RNA, 24 nt, Human
gagaugguguuucaccauguuggu

SEQ ID NO: 756134 - RNA, 18 nt, Human
gauuacaggcauaagcca

SEQ ID NO: 756135 - RNA, 21 nt, Human
gauuacaggcauaagccacca

SEQ ID NO: 756136 - RNA, 19 nt, Human
gauuacaggcccacaccac

SEQ ID NO: 756137 - RNA, 21 nt, Human
gauuacaggcgugagccuccg

SEQ ID NO: 756138 - RNA, 24 nt, Human
gauuacaggcgugagccuccgugc

SEQ ID NO: 756139 - RNA, 21 nt, Human
gauucuccugccucagcuucc

SEQ ID NO: 756140 - RNA, 19 nt, Human
gcagccugcucgccuggcg

SEQ ID NO: 756141 - RNA, 21 nt, Human
gccaagggagaauuuuuuuuc

SEQ ID NO: 756142 - RNA, 20 nt, Human
gccacccuagacaccuuggc

SEQ ID NO: 756143 - RNA, 23 nt, Human
gccaccuucucauuaauguuagc

SEQ ID NO: 756144 - RNA, 19 nt, Human
gcccgccaccacacccgga

SEQ ID NO: 756145 - RNA, 18 nt, Human
gccucagcuuccugagua

SEQ ID NO: 756146 - RNA, 23 nt, Human
gccucggccucccaaagugcugg

SEQ ID NO: 756147 - RNA, 21 nt, Human
gcugcuugucuugugcagguu

SEQ ID NO: 756148 - RNA, 19 nt, Human
gcuggagugcagugacaug

SEQ ID NO: 756149 - RNA, 19 nt, Human
gcuggagugcaguggcgca

SEQ ID NO: 756150 - RNA, 23 nt, Human
gcuggccucgaacuccuaaccuc

SEQ ID NO: 756151 - RNA, 23 nt, Human
gcuggucucaaacuccugaccuc

SEQ ID NO: 756152 - RNA, 19 nt, Human
ggaggagaugagacagagg

SEQ ID NO: 756153 - RNA, 19 nt, Human
ggauuacaggcauaagcca

SEQ ID NO: 756154 - RNA, 18 nt, Human
ggcaggcgcagaacacac

SEQ ID NO: 756155 - RNA, 24 nt, Human
ggcuggucucaaacuccugaccuc

SEQ ID NO: 756156 - RNA, 20 nt, Human
gggcaaaggaauauccuugu

SEQ ID NO: 756157 - RNA, 22 nt, Human
ggguucaagugauucuccugcc

SEQ ID NO: 756158 - RNA, 23 nt, Human
ggguucaagugauucuccugccu

SEQ ID NO: 756159 - RNA, 22 nt, Human
gguguuucaccauguuggucag

SEQ ID NO: 756160 - RNA, 24 nt, Human
gguguuucaccauguuggucaggc

SEQ ID NO: 756161 - RNA, 19 nt, Human
gguucaagugauucuccug

SEQ ID NO: 756162 - RNA, 18 nt, Human
guagcugggacuacaggc

SEQ ID NO: 756163 - RNA, 19 nt, Human
guauauauauauauauaua

SEQ ID NO: 756164 - RNA, 18 nt, Human
guauauguauauauaguu

SEQ ID NO: 756165 - RNA, 24 nt, Human
gugacccacccgccucggccuucc

SEQ ID NO: 756166 - RNA, 24 nt, Human
gugaucugcccgccucggccuccc

SEQ ID NO: 756167 - RNA, 23 nt, Human
gugauucuccugccucagcuucc

SEQ ID NO: 756168 - RNA, 18 nt, Human
gugcagucaggugcugug

SEQ ID NO: 756169 - RNA, 19 nt, Human
guguauauauauauauaua

SEQ ID NO: 756170 - RNA, 21 nt, Human
guguauauauauauauauaaa

SEQ ID NO: 756171 - RNA, 23 nt, Human
uaaaaaacaaaggugguugcucc

SEQ ID NO: 756172 - RNA, 23 nt, Human
uaaaauacccucaggccaguccc

SEQ ID NO: 756173 - RNA, 19 nt, Human
uaacuccacaaacaagggc

SEQ ID NO: 756174 - RNA, 21 nt, Human
uaagaguccaucaaaguguca

SEQ ID NO: 756175 - RNA, 24 nt, Human
uaagccaccaagcccggccaaggg

SEQ ID NO: 756176 - RNA, 28 nt, Human
uacacacacacauacauacauacauaua

SEQ ID NO: 756177 - RNA, 22 nt, Human
uacacauacacacauauguaua

SEQ ID NO: 756178 - RNA, 20 nt, Human
uacacauauacauauauaua

SEQ ID NO: 756179 - RNA, 20 nt, Human
uacaggcauaagccaccaag

SEQ ID NO: 756180 - RNA, 23 nt, Human
uacaggcgcccgccaccacaccc

SEQ ID NO: 756181 - RNA, 22 nt, Human
uaccuucagccuccucagcagc

SEQ ID NO: 756182 - RNA, 22 nt, Human
uagacagaagguaaaaaacaaa

SEQ ID NO: 756183 - RNA, 22 nt, Human
uagagaugguguuucaccaugu

SEQ ID NO: 756184 - RNA, 19 nt, Human
uagccuggcccugaagugc

SEQ ID NO: 756185 - RNA, 20 nt, Human
uaggccgacaccccuccacc

SEQ ID NO: 756186 - RNA, 24 nt, Human
uaguagagacgagguuucgccaug

SEQ ID NO: 756187 - RNA, 24 nt, Human
uaguagagaugguguuucaccaug

SEQ ID NO: 756188 - RNA, 19 nt, Human
uagugugcacacacacagu

SEQ ID NO: 756189 - RNA, 20 nt, Human
uauacacauauauauauaua

SEQ ID NO: 756190 - RNA, 22 nt, Human
uauacacauauauauauauaua

SEQ ID NO: 756191 - RNA, 24 nt, Human
uauacacauauauauauauauaca

SEQ ID NO: 756192 - RNA, 22 nt, Human
uauacacuacaguugacaaaag

SEQ ID NO: 756193 - RNA, 19 nt, Human
uauacauauauauauauau

SEQ ID NO: 756194 - RNA, 22 nt, Human
uauacauauauauauauauaua

SEQ ID NO: 756195 - RNA, 24 nt, Human
uauacauauauauauauauauaca

SEQ ID NO: 756196 - RNA, 24 nt, Human
uauauacacacacacauacauaca

SEQ ID NO: 756197 - RNA, 26 nt, Human
uauauacacacacacauacauacaua

SEQ ID NO: 756198 - RNA, 22 nt, Human
uauauacacauauacauauaua

SEQ ID NO: 756199 - RNA, 24 nt, Human
uauauacacauauacauauauaua

SEQ ID NO: 756200 - RNA, 24 nt, Human
uauauacacauauauauauauaua

SEQ ID NO: 756201 - RNA, 19 nt, Human
uauauauacacauauacau

SEQ ID NO: 756202 - RNA, 23 nt, Human
uauauauacacauauauauauau

SEQ ID NO: 756203 - RNA, 24 nt, Human
uauauauacacauauauauauaua

SEQ ID NO: 756204 - RNA, 27 nt, Human
uauauauacacauauauauauauauua

SEQ ID NO: 756205 - RNA, 20 nt, Human
uauauauauacacauauaca

SEQ ID NO: 756206 - RNA, 22 nt, Human
uauauauauacacauauauaua

SEQ ID NO: 756207 - RNA, 24 nt, Human
uauauauauacacauauauauaua

SEQ ID NO: 756208 - RNA, 27 nt, Human
uauauauauauacacauauacauagug

SEQ ID NO: 756209 - RNA, 24 nt, Human
uauauauauauacacauauauaua

SEQ ID NO: 756210 - RNA, 21 nt, Human
uauauauauauacacauaugc

SEQ ID NO: 756211 - RNA, 24 nt, Human
uauauauauauauacacauauaua

SEQ ID NO: 756212 - RNA, 18 nt, Human
uauguauauguauauaua

SEQ ID NO: 756213 - RNA, 18 nt, Human
uauguauauguauauaua

SEQ ID NO: 756214 - RNA, 20 nt, Human
uauguauauguauauauagu

SEQ ID NO: 756215 - RNA, 19 nt, Human
ucaagugauucuccugccu

SEQ ID NO: 756216 - RNA, 24 nt, Human
ucaauaacaaaaggcuuaacauuu

SEQ ID NO: 756217 - RNA, 24 nt, Human
ucacccaggcuggagugcagugac

SEQ ID NO: 756218 - RNA, 24 nt, Human
ucacgauaaccucugccucccggg

SEQ ID NO: 756219 - RNA, 25 nt, Human
ucacgauaaccucugccucccgggu

SEQ ID NO: 756220 - RNA, 24 nt, Human
ucacucugucacccaggcuggagu

SEQ ID NO: 756221 - RNA, 23 nt, Human
ucacugcaaccuccgccucucgg

SEQ ID NO: 756222 - RNA, 24 nt, Human
ucacugcaaccuccgccucucggg

SEQ ID NO: 756223 - RNA, 25 nt, Human
ucacugcaaccuccgccucucgggu

SEQ ID NO: 756224 - RNA, 27 nt, Human
ucacugcaaccuccgccucucggguuc

SEQ ID NO: 756225 - RNA, 21 nt, Human
ucagcagcuucuggcgccucc

SEQ ID NO: 756226 - RNA, 18 nt, Human
ucagccuccccaguagcu

SEQ ID NO: 756227 - RNA, 20 nt, Human
ucagccuccccaguagcugg

SEQ ID NO: 756228 - RNA, 20 nt, Human
ucagccuccucagcagcuuc

SEQ ID NO: 756229 - RNA, 23 nt, Human
ucagccuccucagcagcuucugg

SEQ ID NO: 756230 - RNA, 23 nt, Human
uccaaagugcugggauuacaggc

SEQ ID NO: 756231 - RNA, 24 nt, Human
uccaaagugcugggauuacaggca

SEQ ID NO: 756232 - RNA, 28 nt, Human
uccacaaacaagggcagaaccggggucc

SEQ ID NO: 756233 - RNA, 24 nt, Human
ucccaaagugcugggauuacaggc

SEQ ID NO: 756234 - RNA, 22 nt, Human
uccccaguagcugggacuacag

SEQ ID NO: 756235 - RNA, 24 nt, Human
uccccaguagcugggacuacaggc

SEQ ID NO: 756236 - RNA, 25 nt, Human
uccccugccucagccuccccaguag

SEQ ID NO: 756237 - RNA, 19 nt, Human
ucccggguucaagcaauuc

SEQ ID NO: 756238 - RNA, 24 nt, Human
ucccggguucaagcaauuccccug

SEQ ID NO: 756239 - RNA, 20 nt, Human
uccgcgcuggagugcagugg

SEQ ID NO: 756240 - RNA, 21 nt, Human
uccgcgcuggagugcaguggc

SEQ ID NO: 756241 - RNA, 24 nt, Human
uccugaguagcugcgauuacaggc

SEQ ID NO: 756242 - RNA, 18 nt, Human
ucggccucccaaagugcu

SEQ ID NO: 756243 - RNA, 23 nt, Human
ucucacucugucacccaggcugg

SEQ ID NO: 756244 - RNA, 24 nt, Human
ucucacucugucacccaggcugga

SEQ ID NO: 756245 - RNA, 26 nt, Human
ucucacucugucacccaggcuggagu

SEQ ID NO: 756246 - RNA, 27 nt, Human
ucucacucugucacccaggcuggagug

SEQ ID NO: 756247 - RNA, 21 nt, Human
ucucggguucaagugauucuc

SEQ ID NO: 756248 - RNA, 24 nt, Human
ucucggguucaagugauucuccug

SEQ ID NO: 756249 - RNA, 19 nt, Human
ucucuccugcuuuaggcug

SEQ ID NO: 756250 - RNA, 24 nt, Human
ucugccucccggguucaagcaauu

SEQ ID NO: 756251 - RNA, 24 nt, Human
ucugucacccaggcuggagugcag

SEQ ID NO: 756252 - RNA, 24 nt, Human
ugaccucaggugacccacccgccu

SEQ ID NO: 756253 - RNA, 25 nt, Human
ugaccucaggugacccacccgccuc

SEQ ID NO: 756254 - RNA, 20 nt, Human
ugacuggccacagacacacc

SEQ ID NO: 756255 - RNA, 25 nt, Human
ugacugggcagggaaagcagccugc

SEQ ID NO: 756256 - RNA, 21 nt, Human
ugagaacauccccaccgcccc

SEQ ID NO: 756257 - RNA, 22 nt, Human
ugagacggagucucacucuguc

SEQ ID NO: 756258 - RNA, 21 nt, Human
ugaugacugguuaaaaaagaa

SEQ ID NO: 756259 - RNA, 24 nt, Human
ugauuaguguguguauauauauau

SEQ ID NO: 756260 - RNA, 20 nt, Human
ugauucuccugccucagcuu

SEQ ID NO: 756261 - RNA, 19 nt, Human
ugcagucaggugcuguguc

SEQ ID NO: 756262 - RNA, 22 nt, Human
ugcagugacaugaucucggcuc

SEQ ID NO: 756263 - RNA, 21 nt, Human
ugccucagccuccccaguagc

SEQ ID NO: 756264 - RNA, 24 nt, Human
ugccucagccuccccaguagcugg

SEQ ID NO: 756265 - RNA, 24 nt, Human
ugccucagcuuccugaguagcugc

SEQ ID NO: 756266 - RNA, 23 nt, Human
ugcgauuacaggcccacaccacc

SEQ ID NO: 756267 - RNA, 24 nt, Human
ugcgauuacaggcccacaccaccg

SEQ ID NO: 756268 - RNA, 21 nt, Human
ugcuggauuucagccacugug

SEQ ID NO: 756269 - RNA, 18 nt, Human
ugcuggccaggcuggucu

SEQ ID NO: 756270 - RNA, 24 nt, Human
ugcugggauuacaggcauaagcca

SEQ ID NO: 756271 - RNA, 20 nt, Human
ugcugggauuacaggcguga

SEQ ID NO: 756272 - RNA, 21 nt, Human
uggagaaaagaggcugugggg

SEQ ID NO: 756273 - RNA, 19 nt, Human
uggagugcagugacaugau

SEQ ID NO: 756274 - RNA, 24 nt, Human
uggagugcagugacaugaucucgg

SEQ ID NO: 756275 - RNA, 19 nt, Human
uggagugcaguggcgcaau

SEQ ID NO: 756276 - RNA, 24 nt, Human
uggccaggcuggucucaaacuccu

SEQ ID NO: 756277 - RNA, 20 nt, Human
uggccucgaacuccuaaccu

SEQ ID NO: 756278 - RNA, 19 nt, Human
uggcgcaaugucagcucac

SEQ ID NO: 756279 - RNA, 21 nt, Human
ugggacuacaggcgcccgcca

SEQ ID NO: 756280 - RNA, 22 nt, Human
ugggacuacaggcgcccgccac

SEQ ID NO: 756281 - RNA, 24 nt, Human
ugggacuacaggcgcccgccacca

SEQ ID NO: 756282 - RNA, 18 nt, Human
ugggauuacaggcauaag

SEQ ID NO: 756283 - RNA, 22 nt, Human
ugggauuacaggcauaagccac

SEQ ID NO: 756284 - RNA, 24 nt, Human
ugggauuacaggcauaagccacca

SEQ ID NO: 756285 - RNA, 18 nt, Human
ugggauuacaggcgugag

SEQ ID NO: 756286 - RNA, 19 nt, Human
ugggauuacaggcgugagc

SEQ ID NO: 756287 - RNA, 20 nt, Human
ugggauuacaggcgugagcc

SEQ ID NO: 756288 - RNA, 23 nt, Human
ugggauuacaggcgugagccucc

SEQ ID NO: 756289 - RNA, 23 nt, Human
ugggauuacaggcgugagccucc

SEQ ID NO: 756290 - RNA, 24 nt, Human
ugggauuacaggcgugagccuccg

SEQ ID NO: 756291 - RNA, 24 nt, Human
uggucaggcuggccucgaacuccu

SEQ ID NO: 756292 - RNA, 24 nt, Human
ugguguuucaccauguuggucagg

SEQ ID NO: 756293 - RNA, 18 nt, Human
uguauauauauauauaua

SEQ ID NO: 756294 - RNA, 22 nt, Human
uguauauauauauauauauaca

SEQ ID NO: 756295 - RNA, 22 nt, Human
ugugcacacacacaaaacccua

SEQ ID NO: 756296 - RNA, 18 nt, Human
uguguauauauauauaua

SEQ ID NO: 756297 - RNA, 20 nt, Human
uguguauauauauauauaua

SEQ ID NO: 756298 - RNA, 22 nt, Human
uguguauauauauauauauaua

SEQ ID NO: 756299 - RNA, 22 nt, Human
uguguguauauauauauauaua

SEQ ID NO: 756300 - RNA, 24 nt, Human
uguguguauauauauauauauaac

SEQ ID NO: 756301 - RNA, 24 nt, Human
uuaggcugcuugucuugugcaggu

SEQ ID NO: 756302 - RNA, 24 nt, Human
uuaguagagacgagguuucgccau

SEQ ID NO: 756303 - RNA, 18 nt, Human
uuaguagagaugguguuu

SEQ ID NO: 756304 - RNA, 24 nt, Human
uuaguagagaugguguuucaccau

SEQ ID NO: 756305 - RNA, 19 nt, Human
uucaacuaggaggcagacc

SEQ ID NO: 756306 - RNA, 21 nt, Human
uucaagcaauuccccugccuc

SEQ ID NO: 756307 - RNA, 24 nt, Human
uucaagcaauuccccugccucagc

SEQ ID NO: 756308 - RNA, 21 nt, Human
uucaagugauucuccugccuc

SEQ ID NO: 756309 - RNA, 23 nt, Human
uucaagugauucuccugccucag

SEQ ID NO: 756310 - RNA, 24 nt, Human
uucaagugauucuccugccucagc

SEQ ID NO: 756311 - RNA, 21 nt, Human
uuccagcacccccgugggcca

SEQ ID NO: 756312 - RNA, 19 nt, Human
uuccccugccucagccucc

SEQ ID NO: 756313 - RNA, 23 nt, Human
uuuaaaauacccucaggccaguc

SEQ ID NO: 756314 - RNA, 21 nt, Human
uuucaccauguuggucaggcu

SEQ ID NO: 756315 - RNA, 21 nt, Human
uuucgccaugcuggccaggcu

SEQ ID NO: 756316 - RNA, 22 nt, Human
uuuuuaguagagacgagguuuc

SEQ ID NO: 756317 - RNA, 24 nt, Human
uuuuuaguagagaugguguuucac

SEQ ID NO: 756318 - RNA, 20 nt, Human
uuuuuguauuuuuaguagag

SEQ ID NO: 756319 - RNA, 18 nt, Human
uuuuuuaguagagauggu

SEQ ID NO: 756320 - RNA, 25 nt, Human
aaacaaagauagacaaaccccagga

SEQ ID NO: 756321 - RNA, 23 nt, Human
aaacaacaacaaaaaaacagcga

SEQ ID NO: 756322 - RNA, 18 nt, Human
aaacuccugccucagcca

SEQ ID NO: 756323 - RNA, 21 nt, Human
aacaacaaaaaaacagcgaga

SEQ ID NO: 756324 - RNA, 21 nt, Human
aacccacuccuaagaagcaga

SEQ ID NO: 756325 - RNA, 19 nt, Human
aagcaaauuaucuccucca

SEQ ID NO: 756326 - RNA, 20 nt, Human
aagcaauccucccaccacag

SEQ ID NO: 756327 - RNA, 25 nt, Human
aagcaauccucccaccacagccucc

SEQ ID NO: 756328 - RNA, 22 nt, Human
aagcaggcgaaaggggccccga

SEQ ID NO: 756329 - RNA, 19 nt, Human
aagcgaacgcccggggcau

SEQ ID NO: 756330 - RNA, 20 nt, Human
aaggggccccgaaggccugc

SEQ ID NO: 756331 - RNA, 18 nt, Human
acaacaaaaaaacagcga

SEQ ID NO: 756332 - RNA, 21 nt, Human
accacagccucccgaguagcu

SEQ ID NO: 756333 - RNA, 23 nt, Human
acccccaagggacaagggcagca

SEQ ID NO: 756334 - RNA, 18 nt, Human
acugcagccucaaccucc

SEQ ID NO: 756335 - RNA, 18 nt, Human
agaagugacaaucucaaa

SEQ ID NO: 756336 - RNA, 25 nt, Human
agcaauccucccaccacagccuccc

SEQ ID NO: 756337 - RNA, 23 nt, Human
agccacaaaucuagaaaacaacu

SEQ ID NO: 756338 - RNA, 22 nt, Human
agcugacugcagccucaaccuc

SEQ ID NO: 756339 - RNA, 19 nt, Human
aggaggugcaggggugcuu

SEQ ID NO: 756340 - RNA, 19 nt, Human
aggcaaaaaauacagcgua

SEQ ID NO: 756341 - RNA, 23 nt, Human
aggcagggacauuaggcaaaaaa

SEQ ID NO: 756342 - RNA, 22 nt, Human
aggccgugagugaccgggcugu

SEQ ID NO: 756343 - RNA, 18 nt, Human
aggcgaaaggggccccga

SEQ ID NO: 756344 - RNA, 24 nt, Human
aggcggcgugcgcggcccgguccg

SEQ ID NO: 756345 - RNA, 25 nt, Human
aggcuggagugcaguggugcaaucu

SEQ ID NO: 756346 - RNA, 21 nt, Human
agggacaagggcagcaggggc

SEQ ID NO: 756347 - RNA, 23 nt, Human
aguagcugggaccacaggugcgc

SEQ ID NO: 756348 - RNA, 18 nt, Human
agugcaguggugcaaucu

SEQ ID NO: 756349 - RNA, 24 nt, Human
agugcaguggugcaaucugagcug

SEQ ID NO: 756350 - RNA, 22 nt, Human
auuaucuccuccaucccucccu

SEQ ID NO: 756351 - RNA, 24 nt, Human
caaccgccccccucccccaccaag

SEQ ID NO: 756352 - RNA, 25 nt, Human
caaccuccuggacucaagcaauccu

SEQ ID NO: 756353 - RNA, 20 nt, Human
caagcaauccucccaccaca

SEQ ID NO: 756354 - RNA, 23 nt, Human
caagcgaacgcccggggcaugcc

SEQ ID NO: 756355 - RNA, 24 nt, Human
cacagcaagcgaacgcccggggca

SEQ ID NO: 756356 - RNA, 22 nt, Human
cacaggcacuggcaccagacca

SEQ ID NO: 756357 - RNA, 22 nt, Human
cacaggugcgcaccaccacacc

SEQ ID NO: 756358 - RNA, 24 nt, Human
caccacagccucccgaguagcugg

SEQ ID NO: 756359 - RNA, 21 nt, Human
caccagaccaucaaagcccag

SEQ ID NO: 756360 - RNA, 18 nt, Human
caccaggccucgucccug

SEQ ID NO: 756361 - RNA, 22 nt, Human
caccccccaaccuccccgaccc

SEQ ID NO: 756362 - RNA, 20 nt, Human
caccuggagaaggcgcuucc

SEQ ID NO: 756363 - RNA, 20 nt, Human
cagacccccgggcuuccccu

SEQ ID NO: 756364 - RNA, 22 nt, Human
cagaguaagacacagagauacc

SEQ ID NO: 756365 - RNA, 22 nt, Human
cagcagcguggguggguggagc

SEQ ID NO: 756366 - RNA, 19 nt, Human
cagcaggggcacccgcccg

SEQ ID NO: 756367 - RNA, 20 nt, Human
cagccucaaccuccuggacu

SEQ ID NO: 756368 - RNA, 23 nt, Human
cagccucaaccuccuggacucaa

SEQ ID NO: 756369 - RNA, 25 nt, Human
cagccucaaccuccuggacucaagc

SEQ ID NO: 756370 - RNA, 19 nt, Human
cagcggcgcgcucuccccc

SEQ ID NO: 756371 - RNA, 23 nt, Human
caggagccggggugaggcgagag

SEQ ID NO: 756372 - RNA, 24 nt, Human
cagggcaaccgccccccuccccca

SEQ ID NO: 756373 - RNA, 21 nt, Human
caggggcggccaccagagagc

SEQ ID NO: 756374 - RNA, 24 nt, Human
cagggucucgcucuguugcccagg

SEQ ID NO: 756375 - RNA, 24 nt, Human
caggugacagcagcgugggugggu

SEQ ID NO: 756376 - RNA, 27 nt, Human
cauaauauuuuaaaacaacaacaaaaa

SEQ ID NO: 756377 - RNA, 22 nt, Human
caucucggguggggaaaaacca

SEQ ID NO: 756378 - RNA, 23 nt, Human
ccaccacagccucccgaguagcu

SEQ ID NO: 756379 - RNA, 25 nt, Human
ccagcaacagugaugguuccugagg

SEQ ID NO: 756380 - RNA, 21 nt, Human
cccaaccuccccgaccccggc

SEQ ID NO: 756381 - RNA, 23 nt, Human
cccacuccuaagaagcagauucc

SEQ ID NO: 756382 - RNA, 20 nt, Human
cccaggagcccaccagggga

SEQ ID NO: 756383 - RNA, 19 nt, Human
cccaggcuggagugcagug

SEQ ID NO: 756384 - RNA, 30 nt, Human
ccccaaccuccccgaccccggcccucuccu

SEQ ID NO: 756385 - RNA, 21 nt, Human
ccccccaaccuccccgacccc

SEQ ID NO: 756386 - RNA, 23 nt, Human
ccccccaaccuccccgaccccgg

SEQ ID NO: 756387 - RNA, 18 nt, Human
ccccccccccgaggcuca

SEQ ID NO: 756388 - RNA, 19 nt, Human
cccccgagcccgccuggcc

SEQ ID NO: 756389 - RNA, 24 nt, Human
cccccgagcccgccuggcccugcu

SEQ ID NO: 756390 - RNA, 25 nt, Human
cccccgagcccgccuggcccugcuc

SEQ ID NO: 756391 - RNA, 19 nt, Human
cccccgggcuuccccuggc

SEQ ID NO: 756392 - RNA, 24 nt, Human
ccccgaaggccugccucggcccug

SEQ ID NO: 756393 - RNA, 19 nt, Human
ccccgagcccgccuggccc

SEQ ID NO: 756394 - RNA, 20 nt, Human
ccccgagcccgccuggcccu

SEQ ID NO: 756395 - RNA, 22 nt, Human
cccucggcgucgcacccccagg

SEQ ID NO: 756396 - RNA, 21 nt, Human
ccgccccccucccccaccaag

SEQ ID NO: 756397 - RNA, 22 nt, Human
ccgcucgggccgggccccgcuc

SEQ ID NO: 756398 - RNA, 19 nt, Human
ccgcuggcuccugucgccc

SEQ ID NO: 756399 - RNA, 25 nt, Human
ccgggagcagcggcgcgcucucccc

SEQ ID NO: 756400 - RNA, 19 nt, Human
ccgggcuuccccuggccag

SEQ ID NO: 756401 - RNA, 22 nt, Human
ccuccaucccucccuggggcag

SEQ ID NO: 756402 - RNA, 23 nt, Human
ccucccaccacagccucccgagu

SEQ ID NO: 756403 - RNA, 18 nt, Human
ccucucagagaauccugg

SEQ ID NO: 756404 - RNA, 24 nt, Human
ccugccucagccauuuuuuguuuu

SEQ ID NO: 756405 - RNA, 20 nt, Human
ccuggacucaagcaauccuc

SEQ ID NO: 756406 - RNA, 19 nt, Human
ccugggggccucccucauc

SEQ ID NO: 756407 - RNA, 22 nt, Human
cgagguuccuggguggagaugc

SEQ ID NO: 756408 - RNA, 23 nt, Human
cgagguuccuggguggagaugcu

SEQ ID NO: 756409 - RNA, 25 nt, Human
cgcgugcggcgucccgcuggcuccu

SEQ ID NO: 756410 - RNA, 24 nt, Human
cggcccccgagcccgccuggcccu

SEQ ID NO: 756411 - RNA, 22 nt, Human
cggcccgguccgggagcagcgg

SEQ ID NO: 756412 - RNA, 24 nt, Human
cucaacccacuccuaagaagcaga

SEQ ID NO: 756413 - RNA, 19 nt, Human
cucaagcaauccucccacc

SEQ ID NO: 756414 - RNA, 24 nt, Human
cucaagcaauccucccaccacagc

SEQ ID NO: 756415 - RNA, 27 nt, Human
cucacaaaggugguuuauguacagaag

SEQ ID NO: 756416 - RNA, 21 nt, Human
cuccagggcaaccgccccccu

SEQ ID NO: 756417 - RNA, 23 nt, Human
cuccccgaccccggcccucucca

SEQ ID NO: 756418 - RNA, 24 nt, Human
cucccgaguagcugggaccacagg

SEQ ID NO: 756419 - RNA, 21 nt, Human
cucgcucuguugcccaggcug

SEQ ID NO: 756420 - RNA, 24 nt, Human
cucgcucuguugcccaggcuggag

SEQ ID NO: 756421 - RNA, 18 nt, Human
cucggcgucgcaccccca

SEQ ID NO: 756422 - RNA, 23 nt, Human
cucgggccgggccccgcucgguu

SEQ ID NO: 756423 - RNA, 20 nt, Human
cucuguugcccaggcuggag

SEQ ID NO: 756424 - RNA, 22 nt, Human
cugcagccucaaccuccuggac

SEQ ID NO: 756425 - RNA, 20 nt, Human
gaagcaggcgaaaggggccc

SEQ ID NO: 756426 - RNA, 19 nt, Human
gacagcagcgugggugggu

SEQ ID NO: 756427 - RNA, 20 nt, Human
gacagcagcgugggugggug

SEQ ID NO: 756428 - RNA, 18 nt, Human
gacccccgggcuuccccu

SEQ ID NO: 756429 - RNA, 20 nt, Human
gagacagggucucgcucugu

SEQ ID NO: 756430 - RNA, 20 nt, Human
gagagaaacaaagauagaca

SEQ ID NO: 756431 - RNA, 20 nt, Human
gagcugggaagcuguccaca

SEQ ID NO: 756432 - RNA, 20 nt, Human
gaggccccagacccccgggc

SEQ ID NO: 756433 - RNA, 22 nt, Human
gaggccccagacccccgggcuu

SEQ ID NO: 756434 - RNA, 21 nt, Human
gaggcggcgugcgcggcccgg

SEQ ID NO: 756435 - RNA, 18 nt, Human
gagggagaggcaccugga

SEQ ID NO: 756436 - RNA, 20 nt, Human
gagguuccuggguggagaug

SEQ ID NO: 756437 - RNA, 22 nt, Human
gauagacaaaccccaggagaga

SEQ ID NO: 756438 - RNA, 22 nt, Human
gcagcggcgcgcucucccccgc

SEQ ID NO: 756439 - RNA, 18 nt, Human
gcaggggcacccgcccgc

SEQ ID NO: 756440 - RNA, 20 nt, Human
gcccaggcuggagugcagug

SEQ ID NO: 756441 - RNA, 20 nt, Human
gccccagacccccgggcuuc

SEQ ID NO: 756442 - RNA, 23 nt, Human
gccccagacccccgggcuucccu

SEQ ID NO: 756443 - RNA, 19 nt, Human
gccccgaaggccugccucu

SEQ ID NO: 756444 - RNA, 18 nt, Human
gccucaaccuccuggacu

SEQ ID NO: 756445 - RNA, 23 nt, Human
gccucggcccugugucccccgac

SEQ ID NO: 756446 - RNA, 19 nt, Human
gcguccugccccccccccg

SEQ ID NO: 756447 - RNA, 20 nt, Human
gcuauauagcccaggcuggu

SEQ ID NO: 756448 - RNA, 25 nt, Human
gcucuguugcccaggcuggagugca

SEQ ID NO: 756449 - RNA, 19 nt, Human
gcugacaccccccaaccuc

SEQ ID NO: 756450 - RNA, 24 nt, Human
gcuggagugcaguggugcaaucug

SEQ ID NO: 756451 - RNA, 21 nt, Human
gcuucccagccugggcugaag

SEQ ID NO: 756452 - RNA, 20 nt, Human
ggacaccaggccucgucccu

SEQ ID NO: 756453 - RNA, 22 nt, Human
ggagacagggucucgcucuguu

SEQ ID NO: 756454 - RNA, 21 nt, Human
ggagaggcaccuggagaaggc

SEQ ID NO: 756455 - RNA, 21 nt, Human
ggcgcagacggagggaggccc

SEQ ID NO: 756456 - RNA, 21 nt, Human
ggcugacaccccccaaccucc

SEQ ID NO: 756457 - RNA, 22 nt, Human
gggagaggcaccuggagaaggc

SEQ ID NO: 756458 - RNA, 19 nt, Human
gggccucccucauccugag

SEQ ID NO: 756459 - RNA, 23 nt, Human
ggggucggggacacgaggacagg

SEQ ID NO: 756460 - RNA, 22 nt, Human
gggucuugcuauauagcccagg

SEQ ID NO: 756461 - RNA, 21 nt, Human
gucagcgccacgccgggcgag

SEQ ID NO: 756462 - RNA, 20 nt, Human
gucgcacccccaggccccgc

SEQ ID NO: 756463 - RNA, 22 nt, Human
gugcaggggugcuuugucugca

SEQ ID NO: 756464 - RNA, 21 nt, Human
guggagaugcuccaaaaauuc

SEQ ID NO: 756465 - RNA, 21 nt, Human
uaaaacaacaacaaaaaaaca

SEQ ID NO: 756466 - RNA, 25 nt, Human
uaauauaagcaaauuaucuccucca

SEQ ID NO: 756467 - RNA, 20 nt, Human
uagaaagagccucacaaagg

SEQ ID NO: 756468 - RNA, 24 nt, Human
uauauagcccaggcuggucccaaa

SEQ ID NO: 756469 - RNA, 24 nt, Human
uaucuccuccaucccucccugggg

SEQ ID NO: 756470 - RNA, 21 nt, Human
ucaacccacuccuaagaagca

SEQ ID NO: 756471 - RNA, 23 nt, Human
ucaucucggguggggaaaaacca

SEQ ID NO: 756472 - RNA, 20 nt, Human
uccacacucacuaccaacca

SEQ ID NO: 756473 - RNA, 22 nt, Human
ucccaccacagccucccgagua

SEQ ID NO: 756474 - RNA, 19 nt, Human
uccccuggccggcccccga

SEQ ID NO: 756475 - RNA, 23 nt, Human
ucccgaguagcugggaccacagg

SEQ ID NO: 756476 - RNA, 24 nt, Human
ucccgaguagcugggaccacaggu

SEQ ID NO: 756477 - RNA, 20 nt, Human
ucccuggggcaggagacagc

SEQ ID NO: 756478 - RNA, 23 nt, Human
uccugucgcccuagggggcaccc

SEQ ID NO: 756479 - RNA, 24 nt, Human
ucgcucuguugcccaggcuggagu

SEQ ID NO: 756480 - RNA, 19 nt, Human
ucucgcucuguugcccagg

SEQ ID NO: 756481 - RNA, 23 nt, Human
ucucgcucuguugcccaggcugg

SEQ ID NO: 756482 - RNA, 24 nt, Human
ucucgcucuguugcccaggcugga

SEQ ID NO: 756483 - RNA, 26 nt, Human
ucucgcucuguugcccaggcuggagu

SEQ ID NO: 756484 - RNA, 27 nt, Human
ucucgcucuguugcccaggcuggagug

SEQ ID NO: 756485 - RNA, 19 nt, Human
ucugcgcaggccgcccagg

SEQ ID NO: 756486 - RNA, 21 nt, Human
ucugcgcaggccgcccaggag

SEQ ID NO: 756487 - RNA, 24 nt, Human
ucuguugcccaggcuggagugcag

SEQ ID NO: 756488 - RNA, 23 nt, Human
ucuugcuauauagcccaggcugg

SEQ ID NO: 756489 - RNA, 24 nt, Human
ucuugcuauauagcccaggcuggu

SEQ ID NO: 756490 - RNA, 19 nt, Human
ugaccgggcugugccgaaa

SEQ ID NO: 756491 - RNA, 20 nt, Human
ugacugcagccucaaccucc

SEQ ID NO: 756492 - RNA, 23 nt, Human
ugacugcagccucaaccuccugg

SEQ ID NO: 756493 - RNA, 23 nt, Human
ugagagaaacaaagauagacaaa

SEQ ID NO: 756494 - RNA, 20 nt, Human
ugaugguuccugaggcggcg

SEQ ID NO: 756495 - RNA, 21 nt, Human
ugcacagaguaagacacagag

SEQ ID NO: 756496 - RNA, 21 nt, Human
ugcagcuccggccugcccuuc

SEQ ID NO: 756497 - RNA, 20 nt, Human
ugcaguagcaccuuuucgag

SEQ ID NO: 756498 - RNA, 18 nt, Human
ugcccaggcuggagugca

SEQ ID NO: 756499 - RNA, 21 nt, Human
ugcccaggcuggagugcagug

SEQ ID NO: 756500 - RNA, 24 nt, Human
ugcccaggcuggagugcaguggug

SEQ ID NO: 756501 - RNA, 21 nt, Human
ugccuccagcaacagugaugg

SEQ ID NO: 756502 - RNA, 19 nt, Human
ugcgcaggccgcccaggag

SEQ ID NO: 756503 - RNA, 21 nt, Human
ugcgcaggccgcccaggagcc

SEQ ID NO: 756504 - RNA, 22 nt, Human
ugcuuugucugcaaggaagccu

SEQ ID NO: 756505 - RNA, 20 nt, Human
ugcuuuuuuuuuuuuuugga

SEQ ID NO: 756506 - RNA, 18 nt, Human
uggagugcaguggugcaa

SEQ ID NO: 756507 - RNA, 21 nt, Human
uggagugcaguggugcaaucu

SEQ ID NO: 756508 - RNA, 19 nt, Human
uggcaccagaccaucaaag

SEQ ID NO: 756509 - RNA, 22 nt, Human
uggcaccagaccaucaaagccc

SEQ ID NO: 756510 - RNA, 18 nt, Human
uggccaggugcacagggg

SEQ ID NO: 756511 - RNA, 21 nt, Human
ugggaccacaggugcgcacca

SEQ ID NO: 756512 - RNA, 24 nt, Human
ugggaccacaggugcgcaccacca

SEQ ID NO: 756513 - RNA, 20 nt, Human
ugggggccucccucauccug

SEQ ID NO: 756514 - RNA, 24 nt, Human
uggggucuugcuauauagcccagg

SEQ ID NO: 756515 - RNA, 23 nt, Human
uggguggagaugcuccaaaaauu

SEQ ID NO: 756516 - RNA, 21 nt, Human
uguaaaaaauuuguagugaug

SEQ ID NO: 756517 - RNA, 18 nt, Human
uguacccgaagagcuggg

SEQ ID NO: 756518 - RNA, 19 nt, Human
uguagugauggggucuugc

SEQ ID NO: 756519 - RNA, 21 nt, Human
uguuuuguuuuguuuuucuua

SEQ ID NO: 756520 - RNA, 19 nt, Human
uucuuaaagccacaaaucu

SEQ ID NO: 756521 - RNA, 28 nt, Human
uuuaaaacaacaacaaaaaaacagcgag

SEQ ID NO: 756522 - RNA, 21 nt, Human
uuuuggcugacaccccccaac

SEQ ID NO: 756523 - RNA, 26 nt, Human
uuuuuuuuuuuuggagacagggucuc

SEQ ID NO: 756524 - RNA, 24 nt, Human
uuuuuuuuuuuuuuggagacaggg

SEQ ID NO: 756525 - RNA, 23 nt, Human
aaacauagagucacaacaauuau

SEQ ID NO: 756526 - RNA, 21 nt, Human
aaauccgguaccaacuggcca

SEQ ID NO: 756527 - RNA, 19 nt, Human
aggcagcaggucauguagc

SEQ ID NO: 756528 - RNA, 22 nt, Human
caacuggccaaaauuaccucag

SEQ ID NO: 756529 - RNA, 20 nt, Human
caacuggccaaaauuaccuu

SEQ ID NO: 756530 - RNA, 19 nt, Human
cgguaccaacuggccaaaa

SEQ ID NO: 756531 - RNA, 22 nt, Human
gugacaauaaaagcucuguguc

SEQ ID NO: 756532 - RNA, 18 nt, Human
ucuccguaggcagcaggu

SEQ ID NO: 756533 - RNA, 24 nt, Human
ucugugucuggagcaaaccggggc

SEQ ID NO: 756534 - RNA, 22 nt, Human
ugcacagacugaaugauaaagc

SEQ ID NO: 756535 - RNA, 19 nt, Human
ugucuggagcaaacauaga

SEQ ID NO: 756536 - RNA, 20 nt, Human
ugucuggagcaaacauagag

SEQ ID NO: 756537 - RNA, 26 nt, Human
aaaaaaaggacacaauguauaauaaa

SEQ ID NO: 756538 - RNA, 18 nt, Human
aaaaaaucccuccccucc

SEQ ID NO: 756539 - RNA, 22 nt, Human
aaaaagccugaauacacaaaug

SEQ ID NO: 756540 - RNA, 24 nt, Human
aaaacaaaagcaaagcaaaagcaa

SEQ ID NO: 756541 - RNA, 22 nt, Human
aaacaaaagcaaagcaaaagca

SEQ ID NO: 756542 - RNA, 23 nt, Human
aaacaacagcagcaauagcuaaa

SEQ ID NO: 756543 - RNA, 26 nt, Human
aacaacagcagcaauagcuaaaaaaa

SEQ ID NO: 756544 - RNA, 18 nt, Human
aagaaagaaaaaacucaa

SEQ ID NO: 756545 - RNA, 23 nt, Human
aagaacauaaaaaaucccucccc

SEQ ID NO: 756546 - RNA, 27 nt, Human
aagaacauaaaaaaucccuccccuccc

SEQ ID NO: 756547 - RNA, 21 nt, Human
aagcaaaaaccugucaugagc

SEQ ID NO: 756548 - RNA, 20 nt, Human
aagcaaaagcaaaaaccugu

SEQ ID NO: 756549 - RNA, 21 nt, Human
aagcaaaagcaaaaaccuguc

SEQ ID NO: 756550 - RNA, 26 nt, Human
aagcaaaagcaaaaaccugucaugag

SEQ ID NO: 756551 - RNA, 19 nt, Human
aauccccuccccgcaacaa

SEQ ID NO: 756552 - RNA, 19 nt, Human
acaaaagcaaagcaaaagc

SEQ ID NO: 756553 - RNA, 24 nt, Human
acaaaagcaaagcaaaagcaaaaa

SEQ ID NO: 756554 - RNA, 23 nt, Human
acacagaagaacauaaaaaaucc

SEQ ID NO: 756555 - RNA, 18 nt, Human
acgaaauaaacuguauuc

SEQ ID NO: 756556 - RNA, 23 nt, Human
acuuauguuuuugcaguaagaag

SEQ ID NO: 756557 - RNA, 24 nt, Human
agaaagaaaaaacucaacacagaa

SEQ ID NO: 756558 - RNA, 26 nt, Human
agaaagaaaaaacucaacacagaaga

SEQ ID NO: 756559 - RNA, 21 nt, Human
agaauaaaaaacaacagcagc

SEQ ID NO: 756560 - RNA, 23 nt, Human
agcaaagcaaaagcaaaaaccug

SEQ ID NO: 756561 - RNA, 19 nt, Human
aggaauguguugaaagaaa

SEQ ID NO: 756562 - RNA, 20 nt, Human
auaaaaaacaacagcagcaa

SEQ ID NO: 756563 - RNA, 24 nt, Human
aucccuccccucccucuccuccca

SEQ ID NO: 756564 - RNA, 23 nt, Human
auuuguggcuuuucauuuuccuu

SEQ ID NO: 756565 - RNA, 30 nt, Human
caaaagcaaagcaaaagcaaaaaccugucu

SEQ ID NO: 756566 - RNA, 23 nt, Human
caaagcaaaagcaaaaaccuguc

SEQ ID NO: 756567 - RNA, 19 nt, Human
caacacagaagaacauaaa

SEQ ID NO: 756568 - RNA, 25 nt, Human
caacacagaagaacauaaaaaaucc

SEQ ID NO: 756569 - RNA, 27 nt, Human
caacagcagcaauagcuaaaaaaagga

SEQ ID NO: 756570 - RNA, 19 nt, Human
cagaacaauuucuuaaaug

SEQ ID NO: 756571 - RNA, 19 nt, Human
cagcagcaauagcuaaaaa

SEQ ID NO: 756572 - RNA, 24 nt, Human
cagcagcaauagcuaaaaaaagga

SEQ ID NO: 756573 - RNA, 27 nt, Human
cauaacaguaauaaaaaagaagcaaga

SEQ ID NO: 756574 - RNA, 25 nt, Human
caucuguaaaaagcaaaaucauaac

SEQ ID NO: 756575 - RNA, 21 nt, Human
ccaacaucuguaaaaagcaaa

SEQ ID NO: 756576 - RNA, 18 nt, Human
ccccaaauguuuucccuu

SEQ ID NO: 756577 - RNA, 18 nt, Human
cccccgggaaggcgcccg

SEQ ID NO: 756578 - RNA, 19 nt, Human
ccccucccucuccucccac

SEQ ID NO: 756579 - RNA, 19 nt, Human
ccuccccucccucuccucc

SEQ ID NO: 756580 - RNA, 27 nt, Human
cgaaauaaacuguauucugguaaaucc

SEQ ID NO: 756581 - RNA, 20 nt, Human
cuaaaaaaaggacacaaugu

SEQ ID NO: 756582 - RNA, 24 nt, Human
cucuccucccacucccccgggaag

SEQ ID NO: 756583 - RNA, 18 nt, Human
cugguaaauccccucccc

SEQ ID NO: 756584 - RNA, 18 nt, Human
gaauucuaaugaguugac

SEQ ID NO: 756585 - RNA, 21 nt, Human
gcaaagcaaaagcaaaaaccu

SEQ ID NO: 756586 - RNA, 19 nt, Human
gcuuucauuuccacaucca

SEQ ID NO: 756587 - RNA, 21 nt, Human
ggaacaucuguggaauaugau

SEQ ID NO: 756588 - RNA, 22 nt, Human
guuauaauacacacauaucacu

SEQ ID NO: 756589 - RNA, 26 nt, Human
uaaaaaaaggacacaauguauaauaa

SEQ ID NO: 756590 - RNA, 18 nt, Human
uaaaaaaucccuccccuc

SEQ ID NO: 756591 - RNA, 24 nt, Human
uaauuuaaaagaaagaaagaaaaa

SEQ ID NO: 756592 - RNA, 19 nt, Human
uacauugauuugauggaaa

SEQ ID NO: 756593 - RNA, 24 nt, Human
uacuauucuuuuauauaaagugac

SEQ ID NO: 756594 - RNA, 23 nt, Human
uacucuuucaaaaacaaaagcug

SEQ ID NO: 756595 - RNA, 19 nt, Human
uagaauucacgaaauaaac

SEQ ID NO: 756596 - RNA, 21 nt, Human
uauaauacacacauaucacug

SEQ ID NO: 756597 - RNA, 23 nt, Human
uauaggauuuacccucgcugacu

SEQ ID NO: 756598 - RNA, 23 nt, Human
uaucagaagcaucaguacuuuua

SEQ ID NO: 756599 - RNA, 26 nt, Human
ucaaaaacaaaagcaaagcaaaagca

SEQ ID NO: 756600 - RNA, 19 nt, Human
ucaagccagguacuaauaa

SEQ ID NO: 756601 - RNA, 19 nt, Human
uccauucaggaaauagagc

SEQ ID NO: 756602 - RNA, 18 nt, Human
ucccucuccucccacucc

SEQ ID NO: 756603 - RNA, 18 nt, Human
ucucugugacaaaagacu

SEQ ID NO: 756604 - RNA, 25 nt, Human
ucucugugacaaaagacuguuacuu

SEQ ID NO: 756605 - RNA, 23 nt, Human
ucuggaaucauguaaaaaucacu

SEQ ID NO: 756606 - RNA, 23 nt, Human
ugaaaacacuaggcuucaagcca

SEQ ID NO: 756607 - RNA, 21 nt, Human
ugaaggggaacaucuguggaa

SEQ ID NO: 756608 - RNA, 19 nt, Human
ugaguugacguaaauaauc

SEQ ID NO: 756609 - RNA, 23 nt, Human
uggaaagauggucauaugcgaua

SEQ ID NO: 756610 - RNA, 21 nt, Human
uggguccaguccugcacccac

SEQ ID NO: 756611 - RNA, 22 nt, Human
uuaacacuacuucauuugacag

SEQ ID NO: 756612 - RNA, 24 nt, Human
uuagcauuaaacaguacuauuuuu

SEQ ID NO: 756613 - RNA, 25 nt, Human
uuagcauuaaacaguacuauuuuuu

SEQ ID NO: 756614 - RNA, 23 nt, Human
uucaacaaucagaagaaaaaauc

SEQ ID NO: 756615 - RNA, 29 nt, Human
uuuaaaccauguauacagcucaacagcaa

SEQ ID NO: 756616 - RNA, 19 nt, Human
uuugaaggggaacaucugu

SEQ ID NO: 756617 - RNA, 20 nt, Human
uuugaaggggaacaucugug

SEQ ID NO: 756618 - RNA, 18 nt, Human
uuuguggcuuuucauuuu

SEQ ID NO: 756619 - RNA, 19 nt, Human
uuuguggcuuuucauuuuc

SEQ ID NO: 756620 - RNA, 23 nt, Human
uuuuuuucaguuuacauuaucuc

SEQ ID NO: 756621 - RNA, 21 nt, Human
aaaaggacagaaauggauuag

SEQ ID NO: 756622 - RNA, 24 nt, Human
aaaaggucagaaauaauccacaaa

SEQ ID NO: 756623 - RNA, 20 nt, Human
aaaauauucauuuggaccuc

SEQ ID NO: 756624 - RNA, 26 nt, Human
aaacaaauaaacaacugcagaucaaa

SEQ ID NO: 756625 - RNA, 19 nt, Human
aaaggagaaaaagaaaagg

SEQ ID NO: 756626 - RNA, 24 nt, Human
aaagugcugggaugacaggcguga

SEQ ID NO: 756627 - RNA, 18 nt, Human
aacauggugaaaccucac

SEQ ID NO: 756628 - RNA, 20 nt, Human
aacauggugaaaccucaccu

SEQ ID NO: 756629 - RNA, 21 nt, Human
aacauggugaaaccucaccuc

SEQ ID NO: 756630 - RNA, 19 nt, Human
aagaaaccagccaacgaau

SEQ ID NO: 756631 - RNA, 18 nt, Human
aaggagaaaaagaaaagg

SEQ ID NO: 756632 - RNA, 26 nt, Human
aaggagaaaaagaaaaggucagaaau

SEQ ID NO: 756633 - RNA, 21 nt, Human
aaguaauuuuccugccucagc

SEQ ID NO: 756634 - RNA, 30 nt, Human
aaguguugaaaauguugaguuacugaacuu

SEQ ID NO: 756635 - RNA, 19 nt, Human
aaugugaaaacaaaaauga

SEQ ID NO: 756636 - RNA, 19 nt, Human
aauuacuuaaaaacaagca

SEQ ID NO: 756637 - RNA, 18 nt, Human
acaggguuucaccauguu

SEQ ID NO: 756638 - RNA, 19 nt, Human
acaggguuucaccauguug

SEQ ID NO: 756639 - RNA, 24 nt, Human
acaggguuucaccauguugaccag

SEQ ID NO: 756640 - RNA, 19 nt, Human
acccagguuggaguacagu

SEQ ID NO: 756641 - RNA, 19 nt, Human
acuaaacuagcagcugcuc

SEQ ID NO: 756642 - RNA, 25 nt, Human
acucuguuacccagguuggaguaca

SEQ ID NO: 756643 - RNA, 23 nt, Human
acuggucucgaacuccugaccuc

SEQ ID NO: 756644 - RNA, 18 nt, Human
acuugaguuucuugaagg

SEQ ID NO: 756645 - RNA, 23 nt, Human
agaaaccagccaacgaaugacaa

SEQ ID NO: 756646 - RNA, 24 nt, Human
agcaaaaauaacuuuaaaaaaaac

SEQ ID NO: 756647 - RNA, 23 nt, Human
agccugggcaacauggugaaacc

SEQ ID NO: 756648 - RNA, 24 nt, Human
agccugggcaacauggugaaaccu

SEQ ID NO: 756649 - RNA, 25 nt, Human
agccugggcaacauggugaaaccuc

SEQ ID NO: 756650 - RNA, 21 nt, Human
aggagaaaaagaaaaggucag

SEQ ID NO: 756651 - RNA, 18 nt, Human
aggccgaggcaggcgggu

SEQ ID NO: 756652 - RNA, 21 nt, Human
aggccgaggcaggcgggucac

SEQ ID NO: 756653 - RNA, 23 nt, Human
aguagcugggaugacaggcgugu

SEQ ID NO: 756654 - RNA, 20 nt, Human
auaugccauaaaugugcaua

SEQ ID NO: 756655 - RNA, 18 nt, Human
augagguccuguaugugg

SEQ ID NO: 756656 - RNA, 20 nt, Human
augaguuuauaauaaacacc

SEQ ID NO: 756657 - RNA, 18 nt, Human
auggucugugacauuuuc

SEQ ID NO: 756658 - RNA, 22 nt, Human
auuaacaagugauaauguuacu

SEQ ID NO: 756659 - RNA, 21 nt, Human
auuguggggggacaagaggag

SEQ ID NO: 756660 - RNA, 24 nt, Human
auuuuuguauuuuuaguagagaca

SEQ ID NO: 756661 - RNA, 24 nt, Human
caaagugcugggaugacaggcgug

SEQ ID NO: 756662 - RNA, 20 nt, Human
caaauuaaaagcauucugua

SEQ ID NO: 756663 - RNA, 23 nt, Human
caacaaauuaaaagcauucugua

SEQ ID NO: 756664 - RNA, 19 nt, Human
caacaacugccaacuccca

SEQ ID NO: 756665 - RNA, 25 nt, Human
caacacccagcaaucuaaaaagaaa

SEQ ID NO: 756666 - RNA, 24 nt, Human
caacauggugaaaccucaccucua

SEQ ID NO: 756667 - RNA, 23 nt, Human
caacugccaacucccaacaccca

SEQ ID NO: 756668 - RNA, 25 nt, Human
caacugccaacucccaacacccagc

SEQ ID NO: 756669 - RNA, 22 nt, Human
caauacuacagagacuagauga

SEQ ID NO: 756670 - RNA, 21 nt, Human
cacaaaccagaaaauuagggc

SEQ ID NO: 756671 - RNA, 24 nt, Human
caccaugaucagcuaauuuuugua

SEQ ID NO: 756672 - RNA, 21 nt, Human
caccauguugaccagacuggu

SEQ ID NO: 756673 - RNA, 24 nt, Human
caccauguugaccagacuggucuc

SEQ ID NO: 756674 - RNA, 27 nt, Human
caccauguugaccagacuggucucgaa

SEQ ID NO: 756675 - RNA, 23 nt, Human
cacccguaaucuugggaggccga

SEQ ID NO: 756676 - RNA, 21 nt, Human
caccugcaaaacugccugggu

SEQ ID NO: 756677 - RNA, 23 nt, Human
caccugccuuugccucccaaagu

SEQ ID NO: 756678 - RNA, 21 nt, Human
cacgacauaauguggcuuugg

SEQ ID NO: 756679 - RNA, 22 nt, Human
cacucuguuacccagguuggag

SEQ ID NO: 756680 - RNA, 21 nt, Human
cagaaagaaaccagccaacga

SEQ ID NO: 756681 - RNA, 30 nt, Human
cagaaauaauccacaaaccagaaaauuagg

SEQ ID NO: 756682 - RNA, 25 nt, Human
cagaagcuuaagaccagccugggca

SEQ ID NO: 756683 - RNA, 25 nt, Human
cagcaaaaauaaaagguuagggaga

SEQ ID NO: 756684 - RNA, 18 nt, Human
caggguuucaccauguug

SEQ ID NO: 756685 - RNA, 19 nt, Human
caguggccaacucuuccca

SEQ ID NO: 756686 - RNA, 24 nt, Human
caucccagguuuaaguaauuuucc

SEQ ID NO: 756687 - RNA, 24 nt, Human
cauguugaccagacuggucucgaa

SEQ ID NO: 756688 - RNA, 23 nt, Human
cauuuuacuagccuugaaacacu

SEQ ID NO: 756689 - RNA, 22 nt, Human
ccaaagugcugggaugacaggc

SEQ ID NO: 756690 - RNA, 24 nt, Human
ccaaagugcugggaugacaggcgu

SEQ ID NO: 756691 - RNA, 24 nt, Human
ccagccagaaagaaaccagccaac

SEQ ID NO: 756692 - RNA, 23 nt, Human
cccagguuuaaguaauuuuccug

SEQ ID NO: 756693 - RNA, 21 nt, Human
ccucuuacaugccucagcaaa

SEQ ID NO: 756694 - RNA, 19 nt, Human
ccucuucucuuuuuucucc

SEQ ID NO: 756695 - RNA, 21 nt, Human
ccugaccucaggugauccacc

SEQ ID NO: 756696 - RNA, 23 nt, Human
ccugaccucaggugauccaccug

SEQ ID NO: 756697 - RNA, 23 nt, Human
ccugaccucaggugauccaccug

SEQ ID NO: 756698 - RNA, 23 nt, Human
ccugccucagccuaccgaguagc

SEQ ID NO: 756699 - RNA, 24 nt, Human
ccugggcaacauggugaaaccuca

SEQ ID NO: 756700 - RNA, 24 nt, Human
cgggucacuugagcucagaagcuu

SEQ ID NO: 756701 - RNA, 22 nt, Human
cggugugggguagcuauaaagg

SEQ ID NO: 756702 - RNA, 19 nt, Human
cguuuacacauaucugugu

SEQ ID NO: 756703 - RNA, 23 nt, Human
cuaaaauaacagcaauguaucua

SEQ ID NO: 756704 - RNA, 20 nt, Human
cuaacuacaacucgaaaaug

SEQ ID NO: 756705 - RNA, 26 nt, Human
cucagcaaaaauaaaagguuagggag

SEQ ID NO: 756706 - RNA, 24 nt, Human
cucagccuaccgaguagcugggau

SEQ ID NO: 756707 - RNA, 18 nt, Human
cucccaacacccagcaau

SEQ ID NO: 756708 - RNA, 23 nt, Human
cucuugcaugaacaaagguuuuu

SEQ ID NO: 756709 - RNA, 19 nt, Human
cugaaguuuuuuuccaaau

SEQ ID NO: 756710 - RNA, 20 nt, Human
cugcaaccuccacaucccaa

SEQ ID NO: 756711 - RNA, 24 nt, Human
cugcaaccuccacaucccagguuu

SEQ ID NO: 756712 - RNA, 23 nt, Human
cugccucagccuaccgaguagcu

SEQ ID NO: 756713 - RNA, 18 nt, Human
cuguguguaaauauagac

SEQ ID NO: 756714 - RNA, 21 nt, Human
cuuaaaaugugaaaacaaaaa

SEQ ID NO: 756715 - RNA, 22 nt, Human
cuuaagaccagccugggcaaca

SEQ ID NO: 756716 - RNA, 18 nt, Human
cuugggaggccgaggcag

SEQ ID NO: 756717 - RNA, 22 nt, Human
cuuguaaaagcaauucaugcaa

SEQ ID NO: 756718 - RNA, 22 nt, Human
gaaaaguccaaaauauuuacaa

SEQ ID NO: 756719 - RNA, 22 nt, Human
gaaaauguugaguuacugaacc

SEQ ID NO: 756720 - RNA, 19 nt, Human
gaaacaacauacuagagac

SEQ ID NO: 756721 - RNA, 19 nt, Human
gaacaaagguuuuuccucu

SEQ ID NO: 756722 - RNA, 20 nt, Human
gacaagaggagugauuucuu

SEQ ID NO: 756723 - RNA, 23 nt, Human
gaccucaggugauccaccugccu

SEQ ID NO: 756724 - RNA, 19 nt, Human
gaccucaguucacugcaac

SEQ ID NO: 756725 - RNA, 22 nt, Human
gacuucaaaaucagacauucaa

SEQ ID NO: 756726 - RNA, 22 nt, Human
gagacagucucacucuguuacc

SEQ ID NO: 756727 - RNA, 22 nt, Human
gagauguacacauuuagguuug

SEQ ID NO: 756728 - RNA, 21 nt, Human
gagccguuuuuugcccaacug

SEQ ID NO: 756729 - RNA, 23 nt, Human
gagccguuuuuugcccaacugga

SEQ ID NO: 756730 - RNA, 21 nt, Human
gaguacaguggcagcacgacc

SEQ ID NO: 756731 - RNA, 18 nt, Human
gaguggaggauuaaugag

SEQ ID NO: 756732 - RNA, 18 nt, Human
gaugacaggcgugagcca

SEQ ID NO: 756733 - RNA, 24 nt, Human
gaugacaggcgugagccacggugc

SEQ ID NO: 756734 - RNA, 22 nt, Human
gcaaccuccacaucccagguuu

SEQ ID NO: 756735 - RNA, 24 nt, Human
gcaagacuucaccuuccaucccag

SEQ ID NO: 756736 - RNA, 21 nt, Human
gccuuugccucccaaagugcu

SEQ ID NO: 756737 - RNA, 22 nt, Human
gccuuugccucccaaagugcug

SEQ ID NO: 756738 - RNA, 26 nt, Human
ggaaaucacuaacuacaacucgaaaa

SEQ ID NO: 756739 - RNA, 18 nt, Human
ggaccucuacuuuuaaau

SEQ ID NO: 756740 - RNA, 18 nt, Human
ggccgggugugguggcuc

SEQ ID NO: 756741 - RNA, 21 nt, Human
ggccgggugugguggcucaca

SEQ ID NO: 756742 - RNA, 20 nt, Human
gggaggucugaagaagugau

SEQ ID NO: 756743 - RNA, 20 nt, Human
ggguucuguaguucugucug

SEQ ID NO: 756744 - RNA, 19 nt, Human
ggucucgaacuccugaccu

SEQ ID NO: 756745 - RNA, 20 nt, Human
ggucucgaacuccugaccuc

SEQ ID NO: 756746 - RNA, 24 nt, Human
gguggcucacacccguaaucuugg

SEQ ID NO: 756747 - RNA, 23 nt, Human
ggugugguggcucacacccguaa

SEQ ID NO: 756748 - RNA, 24 nt, Human
gugauccaccugccuuugccuccc

SEQ ID NO: 756749 - RNA, 21 nt, Human
gugggaagggcaggcuauuuu

SEQ ID NO: 756750 - RNA, 20 nt, Human
guuuuuugcccaacuggaau

SEQ ID NO: 756751 - RNA, 19 nt, Human
uaaaaaaauucauaaaagg

SEQ ID NO: 756752 - RNA, 24 nt, Human
uaaaaagccaaaaccuacauuccc

SEQ ID NO: 756753 - RNA, 18 nt, Human
uaaaacucagacaacaaa

SEQ ID NO: 756754 - RNA, 22 nt, Human
uaaaaugaauaaaacucagaca

SEQ ID NO: 756755 - RNA, 25 nt, Human
uaaacaaauaaacaacugcagauca

SEQ ID NO: 756756 - RNA, 19 nt, Human
uaaacggguuucuuaaaag

SEQ ID NO: 756757 - RNA, 19 nt, Human
uaacuguaaacaaauaaac

SEQ ID NO: 756758 - RNA, 20 nt, Human
uaacuguaaacaaauaaaca

SEQ ID NO: 756759 - RNA, 18 nt, Human
uaauaaacaccugcaaaa

SEQ ID NO: 756760 - RNA, 19 nt, Human
uaauaaaucugaucacagg

SEQ ID NO: 756761 - RNA, 24 nt, Human
uaauuuuuguauuuuuaguagaga

SEQ ID NO: 756762 - RNA, 23 nt, Human
uacaaaaucuagcaaaaggacau

SEQ ID NO: 756763 - RNA, 23 nt, Human
uacaauacuugaaaauaaugcaa

SEQ ID NO: 756764 - RNA, 21 nt, Human
uacccagguuggaguacagug

SEQ ID NO: 756765 - RNA, 23 nt, Human
uacuagagacauauuuaacuuaa

SEQ ID NO: 756766 - RNA, 22 nt, Human
uacugaacuaaaaagccaaaac

SEQ ID NO: 756767 - RNA, 20 nt, Human
uacuugaaaauauucauuug

SEQ ID NO: 756768 - RNA, 21 nt, Human
uagaagugcuucaagaaaaua

SEQ ID NO: 756769 - RNA, 22 nt, Human
uagagacaggguuucaccaugu

SEQ ID NO: 756770 - RNA, 24 nt, Human
uagauaauacuacuuguaaaagca

SEQ ID NO: 756771 - RNA, 24 nt, Human
uaguagagacaggguuucaccaug

SEQ ID NO: 756772 - RNA, 25 nt, Human
uaguagagacaggguuucaccaugu

SEQ ID NO: 756773 - RNA, 24 nt, Human
uauaaagaaacaacauacuagaga

SEQ ID NO: 756774 - RNA, 25 nt, Human
uauaauaaacaccugcaaaacugcc

SEQ ID NO: 756775 - RNA, 21 nt, Human
uauaaucaaauguaagaugcc

SEQ ID NO: 756776 - RNA, 25 nt, Human
uaucuguguguucauccagaagauu

SEQ ID NO: 756777 - RNA, 19 nt, Human
uauggcauauuugcauaug

SEQ ID NO: 756778 - RNA, 18 nt, Human
uauugugguuacgcagaa

SEQ ID NO: 756779 - RNA, 21 nt, Human
ucacugcaaccuccacauccc

SEQ ID NO: 756780 - RNA, 24 nt, Human
ucacugcaaccuccacaucccagg

SEQ ID NO: 756781 - RNA, 20 nt, Human
ucagccuaccgaguagcugg

SEQ ID NO: 756782 - RNA, 22 nt, Human
uccacaaaccagaaaauuaggg

SEQ ID NO: 756783 - RNA, 24 nt, Human
uccacaaaccagaaaauuagggcu

SEQ ID NO: 756784 - RNA, 18 nt, Human
uccacaucccagguuuaa

SEQ ID NO: 756785 - RNA, 23 nt, Human
uccaggcaacuauaagggucuau

SEQ ID NO: 756786 - RNA, 24 nt, Human
ucccaaagugcugggaugacaggc

SEQ ID NO: 756787 - RNA, 18 nt, Human
ucccaaaguucucgggag

SEQ ID NO: 756788 - RNA, 19 nt, Human
ucccaaaguucucgggaga

SEQ ID NO: 756789 - RNA, 18 nt, Human
ucccagguuuaaguaauu

SEQ ID NO: 756790 - RNA, 20 nt, Human
ucccagguuuaaguaauuuu

SEQ ID NO: 756791 - RNA, 24 nt, Human
ucccagguuuaaguaauuuuccug

SEQ ID NO: 756792 - RNA, 21 nt, Human
ucccuuggaacuguagaaaag

SEQ ID NO: 756793 - RNA, 21 nt, Human
uccugcaagucgaccugccaa

SEQ ID NO: 756794 - RNA, 19 nt, Human
ucucacucuguuacccagg

SEQ ID NO: 756795 - RNA, 24 nt, Human
ucucacucuguuacccagguugga

SEQ ID NO: 756796 - RNA, 19 nt, Human
ucuccuucuuccauugaaa

SEQ ID NO: 756797 - RNA, 19 nt, Human
ucucgaacuccugaccuca

SEQ ID NO: 756798 - RNA, 21 nt, Human
ucucgggagauguacacauuu

SEQ ID NO: 756799 - RNA, 20 nt, Human
ucuguaguucugucuguuuu

SEQ ID NO: 756800 - RNA, 19 nt, Human
ucuguguguucauccagaa

SEQ ID NO: 756801 - RNA, 24 nt, Human
ucuguuacccagguuggaguacag

SEQ ID NO: 756802 - RNA, 18 nt, Human
ucuuuuuucuccuucuuc

SEQ ID NO: 756803 - RNA, 19 nt, Human
ucuuuuuucuccuucuucc

SEQ ID NO: 756804 - RNA, 27 nt, Human
ugaaaacaaaaaugaaaauccccuuuc

SEQ ID NO: 756805 - RNA, 18 nt, Human
ugaaaauccccuuucuug

SEQ ID NO: 756806 - RNA, 24 nt, Human
ugaaugacuauguauuuuagaagu

SEQ ID NO: 756807 - RNA, 26 nt, Human
ugacaauacugacaguaagucauccc

SEQ ID NO: 756808 - RNA, 21 nt, Human
ugacaguaagucaucccaaag

SEQ ID NO: 756809 - RNA, 24 nt, Human
ugaccagacuggucucgaacuccu

SEQ ID NO: 756810 - RNA, 24 nt, Human
ugaccucaggugauccaccugccu

SEQ ID NO: 756811 - RNA, 19 nt, Human
ugagcaacacaagcagcau

SEQ ID NO: 756812 - RNA, 20 nt, Human
ugauauaaacuguuuuccuu

SEQ ID NO: 756813 - RNA, 25 nt, Human
ugaucacaggauaaaaaaauucaua

SEQ ID NO: 756814 - RNA, 24 nt, Human
ugccucagccuaccgaguagcugg

SEQ ID NO: 756815 - RNA, 18 nt, Human
uggcaagacuucaccuuc

SEQ ID NO: 756816 - RNA, 22 nt, Human
uggcaucuucaguacagauucc

SEQ ID NO: 756817 - RNA, 18 nt, Human
uggcucacacccguaauc

SEQ ID NO: 756818 - RNA, 20 nt, Human
ugggaggccgaggcaggcgg

SEQ ID NO: 756819 - RNA, 24 nt, Human
ugggaggccgaggcaggcggguca

SEQ ID NO: 756820 - RNA, 18 nt, Human
ugggaugacaggcgugag

SEQ ID NO: 756821 - RNA, 19 nt, Human
ugggaugacaggcgugagc

SEQ ID NO: 756822 - RNA, 22 nt, Human
ugggaugacaggcgugagccac

SEQ ID NO: 756823 - RNA, 23 nt, Human
ugggaugacaggcgugagccacg

SEQ ID NO: 756824 - RNA, 22 nt, Human
ugggaugacaggcgugugccac

SEQ ID NO: 756825 - RNA, 24 nt, Human
ugggaugacaggcgugugccacca

SEQ ID NO: 756826 - RNA, 25 nt, Human
ugggaugacaggcgugugccaccau

SEQ ID NO: 756827 - RNA, 21 nt, Human
ugggccgggugugguggcuca

SEQ ID NO: 756828 - RNA, 18 nt, Human
uggggggacaagaggagu

SEQ ID NO: 756829 - RNA, 21 nt, Human
ugguuuucuuuguucuuccau

SEQ ID NO: 756830 - RNA, 22 nt, Human
uguaaacaaauaaacaacugca

SEQ ID NO: 756831 - RNA, 18 nt, Human
ugugcauauaugugcugu

SEQ ID NO: 756832 - RNA, 23 nt, Human
ugugcauauaugugcugugugua

SEQ ID NO: 756833 - RNA, 22 nt, Human
ugugguuuuggcuccagccaga

SEQ ID NO: 756834 - RNA, 20 nt, Human
uguucuuccauucuaaacuu

SEQ ID NO: 756835 - RNA, 19 nt, Human
uguuuggaaaaauauaagg

SEQ ID NO: 756836 - RNA, 19 nt, Human
uuaaaagcauucuguaaua

SEQ ID NO: 756837 - RNA, 23 nt, Human
uuaauugaugaauuuauauaaag

SEQ ID NO: 756838 - RNA, 18 nt, Human
uuacuuagguuucccaag

SEQ ID NO: 756839 - RNA, 24 nt, Human
uuaguagagacaggguuucaccau

SEQ ID NO: 756840 - RNA, 20 nt, Human
uucaaaaucagacauucaau

SEQ ID NO: 756841 - RNA, 23 nt, Human
uucaaugucugugagauguucuu

SEQ ID NO: 756842 - RNA, 22 nt, Human
uugaaaauauucauuuggaccu

SEQ ID NO: 756843 - RNA, 18 nt, Human
uugcccuuuaucuccuga

SEQ ID NO: 756844 - RNA, 19 nt, Human
uuggaacuguagaaaagcu

SEQ ID NO: 756845 - RNA, 20 nt, Human
uuuaaauuucuuccuuucgu

SEQ ID NO: 756846 - RNA, 21 nt, Human
uuuaaauuucuuccuuucguc

SEQ ID NO: 756847 - RNA, 23 nt, Human
uuuaaguaauuuuccugccucag

SEQ ID NO: 756848 - RNA, 21 nt, Human
uuucaccauguugaccagacu

SEQ ID NO: 756849 - RNA, 20 nt, Human
uuuccucuucucuuuuuucu

SEQ ID NO: 756850 - RNA, 25 nt, Human
uuuguacaauagauugcuucauugg

SEQ ID NO: 756851 - RNA, 24 nt, Human
uuuuccucuucucuuuuuucuccu

SEQ ID NO: 756852 - RNA, 24 nt, Human
uuuuuaguagagacaggguuucac

SEQ ID NO: 756853 - RNA, 20 nt, Human
uuuuuguauuuuuaguagag

SEQ ID NO: 756854 - RNA, 23 nt, Human
aaagaaaauauaauaugaucugg

SEQ ID NO: 756855 - RNA, 24 nt, Human
aaauaucuucaugaaccuuugacc

SEQ ID NO: 756856 - RNA, 19 nt, Human
aagaggccaaaaccaaaau

SEQ ID NO: 756857 - RNA, 25 nt, Human
aaggagccucauacuucugaaauau

SEQ ID NO: 756858 - RNA, 22 nt, Human
aagggaagcaaaaaacugcaua

SEQ ID NO: 756859 - RNA, 25 nt, Human
aauaaaaauaaaaaauugcauuuac

SEQ ID NO: 756860 - RNA, 20 nt, Human
acacauaauauuuccaaaga

SEQ ID NO: 756861 - RNA, 24 nt, Human
aggaccagaaguccaaauuaaacc

SEQ ID NO: 756862 - RNA, 20 nt, Human
auaaagaaaauauaauauga

SEQ ID NO: 756863 - RNA, 23 nt, Human
caaaaauggacaucaagggcaua

SEQ ID NO: 756864 - RNA, 22 nt, Human
caacauccccaaacaaaauuua

SEQ ID NO: 756865 - RNA, 18 nt, Human
cacaaagucuuaguuucu

SEQ ID NO: 756866 - RNA, 18 nt, Human
cagaaguagaugaaagcu

SEQ ID NO: 756867 - RNA, 23 nt, Human
cagggcgagugcggcugccuccc

SEQ ID NO: 756868 - RNA, 22 nt, Human
caguacucaguacaaaucaaaa

SEQ ID NO: 756869 - RNA, 18 nt, Human
ccagggcgagugcggcug

SEQ ID NO: 756870 - RNA, 19 nt, Human
cccaggccgcacagcucgc

SEQ ID NO: 756871 - RNA, 26 nt, Human
ccccacaugccacaguuaaaucccug

SEQ ID NO: 756872 - RNA, 23 nt, Human
ccccgggagccgcuggaagagcc

SEQ ID NO: 756873 - RNA, 21 nt, Human
ccuccaaaccuacccaaaaau

SEQ ID NO: 756874 - RNA, 19 nt, Human
cgaaaauaccaacaucccc

SEQ ID NO: 756875 - RNA, 24 nt, Human
cuaaacuucuaggcgucugcacau

SEQ ID NO: 756876 - RNA, 24 nt, Human
cuauuuuugucugcuuuaagauuu

SEQ ID NO: 756877 - RNA, 21 nt, Human
cucccgcucgccccggacgcc

SEQ ID NO: 756878 - RNA, 19 nt, Human
cugaaauauagauguuaac

SEQ ID NO: 756879 - RNA, 19 nt, Human
gaccuccggccggucccag

SEQ ID NO: 756880 - RNA, 22 nt, Human
gauagugaagucaaaggaaaaa

SEQ ID NO: 756881 - RNA, 19 nt, Human
gcggcugccagggcgagug

SEQ ID NO: 756882 - RNA, 24 nt, Human
ggaagcaaaaaacugcauaguaag

SEQ ID NO: 756883 - RNA, 18 nt, Human
uaaaacccuuaguauaaa

SEQ ID NO: 756884 - RNA, 22 nt, Human
uaacaggccagcuugcaaccag

SEQ ID NO: 756885 - RNA, 25 nt, Human
uaacuugaucgaaaauaccaacauc

SEQ ID NO: 756886 - RNA, 18 nt, Human
uaagaggccaaaaccaaa

SEQ ID NO: 756887 - RNA, 25 nt, Human
uaagaggccaaaaccaaaauaucuu

SEQ ID NO: 756888 - RNA, 24 nt, Human
uaagauuuuaacuugaucgaaaau

SEQ ID NO: 756889 - RNA, 23 nt, Human
uaagccggcaggcaggaagaucu

SEQ ID NO: 756890 - RNA, 21 nt, Human
uaauuaguccccacaugccaa

SEQ ID NO: 756891 - RNA, 23 nt, Human
uacacauaauauuuccaaagagu

SEQ ID NO: 756892 - RNA, 21 nt, Human
uacagaaguagaugaaagcug

SEQ ID NO: 756893 - RNA, 21 nt, Human
uacccaaaaauggacaucaag

SEQ ID NO: 756894 - RNA, 18 nt, Human
uaccucaaauaaugacac

SEQ ID NO: 756895 - RNA, 22 nt, Human
uagcuaccucaaauaaugacac

SEQ ID NO: 756896 - RNA, 23 nt, Human
uaggauuaagaggccaaaaccaa

SEQ ID NO: 756897 - RNA, 22 nt, Human
uauagacugaauacacuuucaa

SEQ ID NO: 756898 - RNA, 22 nt, Human
ucaaaacauucuccaacuuaag

SEQ ID NO: 756899 - RNA, 20 nt, Human
uccccaaacaaaauuuacug

SEQ ID NO: 756900 - RNA, 18 nt, Human
uccccacaugccacaguu

SEQ ID NO: 756901 - RNA, 19 nt, Human
ucccugacaguacuguuaa

SEQ ID NO: 756902 - RNA, 22 nt, Human
ucuaggauuaagaggccaaaac

SEQ ID NO: 756903 - RNA, 21 nt, Human
ugaaauuuuggaaauuuuugu

SEQ ID NO: 756904 - RNA, 20 nt, Human
ugaaucagaaacagauuuua

SEQ ID NO: 756905 - RNA, 21 nt, Human
ugaauggagccggcggcugcu

SEQ ID NO: 756906 - RNA, 23 nt, Human
ugaguacacauaauauuuccaaa

SEQ ID NO: 756907 - RNA, 20 nt, Human
ugaguuacagaaguagauga

SEQ ID NO: 756908 - RNA, 20 nt, Human
ugcaccuccaaaccuaccca

SEQ ID NO: 756909 - RNA, 21 nt, Human
ugcaccuccaaaccuacccaa

SEQ ID NO: 756910 - RNA, 24 nt, Human
ugcagacaaaaaaaauuacagcaa

SEQ ID NO: 756911 - RNA, 21 nt, Human
ugcauaaggaucaagaucaag

SEQ ID NO: 756912 - RNA, 22 nt, Human
uggaagagcccgggaaaggagg

SEQ ID NO: 756913 - RNA, 18 nt, Human
uggggugcaccuccaaac

SEQ ID NO: 756914 - RNA, 26 nt, Human
uuaaaaacaacaacuauguuacaaag

SEQ ID NO: 756915 - RNA, 22 nt, Human
uuaaaacuucuagaacccucac

SEQ ID NO: 756916 - RNA, 24 nt, Human
uuaaauggucucaaaacauucucc

SEQ ID NO: 756917 - RNA, 18 nt, Human
uuagggagguggcaagau

SEQ ID NO: 756918 - RNA, 22 nt, Human
uuuuaacuugaucgaaaauacc

SEQ ID NO: 756919 - RNA, 22 nt, Human
aaaaaaaaaaaaacccacagag

SEQ ID NO: 756920 - RNA, 21 nt, Human
aaaaaaaaaaaacccacagag

SEQ ID NO: 756921 - RNA, 19 nt, Human
aaaacaaaaacaaaaacaa

SEQ ID NO: 756922 - RNA, 24 nt, Human
aaaacaauaaaaaaaaaaaaaccc

SEQ ID NO: 756923 - RNA, 19 nt, Human
aaaaccaaaaaagcuugga

SEQ ID NO: 756924 - RNA, 24 nt, Human
aaacaaaaacaaaaacaauaaaaa

SEQ ID NO: 756925 - RNA, 24 nt, Human
aaacaauaaaaaaaaaaaaaccca

SEQ ID NO: 756926 - RNA, 22 nt, Human
aaaccccgucuccaccaaaaaa

SEQ ID NO: 756927 - RNA, 24 nt, Human
aaagugcugggauuacaggcauga

SEQ ID NO: 756928 - RNA, 24 nt, Human
aaagugcugggauuagagacauga

SEQ ID NO: 756929 - RNA, 19 nt, Human
aacacggugaaaccccguc

SEQ ID NO: 756930 - RNA, 20 nt, Human
aacacggugaaaccccgucu

SEQ ID NO: 756931 - RNA, 21 nt, Human
aacacggugaaaccccgucuc

SEQ ID NO: 756932 - RNA, 24 nt, Human
aacacuuugggaggccaagguggg

SEQ ID NO: 756933 - RNA, 25 nt, Human
aaggccccuucccuggaggggaugc

SEQ ID NO: 756934 - RNA, 19 nt, Human
aagugcugggauuacaggc

SEQ ID NO: 756935 - RNA, 21 nt, Human
aagugcugggauuacaggcau

SEQ ID NO: 756936 - RNA, 26 nt, Human
aagugcugggauuacaggcaugagcc

SEQ ID NO: 756937 - RNA, 26 nt, Human
aagugcugggauuagagacaugagcc

SEQ ID NO: 756938 - RNA, 23 nt, Human
aauaaaaaaaaaaaaacccacag

SEQ ID NO: 756939 - RNA, 20 nt, Human
aauuguuugaacccaggagg

SEQ ID NO: 756940 - RNA, 24 nt, Human
aauuguuugaacccaggaggcgga

SEQ ID NO: 756941 - RNA, 19 nt, Human
acagacaggguuucaccau

SEQ ID NO: 756942 - RNA, 22 nt, Human
acaggcgcaugccaccacgccc

SEQ ID NO: 756943 - RNA, 20 nt, Human
acaggguuucaccauauugg

SEQ ID NO: 756944 - RNA, 24 nt, Human
acaggguuucaccauauuggccag

SEQ ID NO: 756945 - RNA, 21 nt, Human
acaugagccauugcaccuggc

SEQ ID NO: 756946 - RNA, 24 nt, Human
accauguugcucagacuggucuug

SEQ ID NO: 756947 - RNA, 24 nt, Human
accauguuggccagaccggucucg

SEQ ID NO: 756948 - RNA, 19 nt, Human
acccaggcuggagugcaau

SEQ ID NO: 756949 - RNA, 19 nt, Human
acccaggcuggagugcagu

SEQ ID NO: 756950 - RNA, 25 nt, Human
acccgccucggccucccaaagugcu

SEQ ID NO: 756951 - RNA, 21 nt, Human
accucagucucccaaagugcu

SEQ ID NO: 756952 - RNA, 23 nt, Human
accucagucucccaaagugcugg

SEQ ID NO: 756953 - RNA, 24 nt, Human
accuugugauccacccgccucggc

SEQ ID NO: 756954 - RNA, 18 nt, Human
acucugucacccaggcug

SEQ ID NO: 756955 - RNA, 25 nt, Human
acucugucacccaggcuggagugca

SEQ ID NO: 756956 - RNA, 19 nt, Human
acugcagccucaaacuccu

SEQ ID NO: 756957 - RNA, 18 nt, Human
acugcagccuccgccucc

SEQ ID NO: 756958 - RNA, 20 nt, Human
agaaaaaggaggaauaugau

SEQ ID NO: 756959 - RNA, 21 nt, Human
agacagaauuguuugaaccca

SEQ ID NO: 756960 - RNA, 18 nt, Human
agacagacagacagacag

SEQ ID NO: 756961 - RNA, 18 nt, Human
agacagacagacagacag

SEQ ID NO: 756962 - RNA, 18 nt, Human
agacagacagacagacag

SEQ ID NO: 756963 - RNA, 18 nt, Human
agacagacagacagacag

SEQ ID NO: 756964 - RNA, 18 nt, Human
agacagacagacagacag

SEQ ID NO: 756965 - RNA, 18 nt, Human
agacagacagacagacag

SEQ ID NO: 756966 - RNA, 18 nt, Human
agacagacagacagacag

SEQ ID NO: 756967 - RNA, 19 nt, Human
agacagacagacagacaga

SEQ ID NO: 756968 - RNA, 19 nt, Human
agacagacagacagacaga

SEQ ID NO: 756969 - RNA, 19 nt, Human
agacagacagacagacaga

SEQ ID NO: 756970 - RNA, 19 nt, Human
agacagacagacagacaga

SEQ ID NO: 756971 - RNA, 19 nt, Human
agacagacagacagacaga

SEQ ID NO: 756972 - RNA, 19 nt, Human
agacagacagacagacaga

SEQ ID NO: 756973 - RNA, 21 nt, Human
agacagacagacagauagaua

SEQ ID NO: 756974 - RNA, 25 nt, Human
agacagggagaagcugcugagguug

SEQ ID NO: 756975 - RNA, 18 nt, Human
agagagggugaagcuuaa

SEQ ID NO: 756976 - RNA, 24 nt, Human
agagagggugaagcuuaaagagag

SEQ ID NO: 756977 - RNA, 18 nt, Human
agagcaguaaggccccuu

SEQ ID NO: 756978 - RNA, 24 nt, Human
agauagauagacagacagacagac

SEQ ID NO: 756979 - RNA, 23 nt, Human
agccgggcaugguggcaggcgcc

SEQ ID NO: 756980 - RNA, 18 nt, Human
agccuccagagcagcugg

SEQ ID NO: 756981 - RNA, 18 nt, Human
agccuccugaguagcuag

SEQ ID NO: 756982 - RNA, 24 nt, Human
agccugggggacaagaacgagacu

SEQ ID NO: 756983 - RNA, 23 nt, Human
agcucaagugaucugcccaccuc

SEQ ID NO: 756984 - RNA, 21 nt, Human
aggccaaggugggcggaucac

SEQ ID NO: 756985 - RNA, 24 nt, Human
aggcgcgguggcucacgccuguaa

SEQ ID NO: 756986 - RNA, 21 nt, Human
aggcggagguuacagugagcc

SEQ ID NO: 756987 - RNA, 24 nt, Human
aggcggagguuacagugagccgag

SEQ ID NO: 756988 - RNA, 25 nt, Human
aggcuggagugcagugguaccaucu

SEQ ID NO: 756989 - RNA, 23 nt, Human
aggugggcggaucacuugagguc

SEQ ID NO: 756990 - RNA, 19 nt, Human
agguugucagguuccuacu

SEQ ID NO: 756991 - RNA, 22 nt, Human
aguacagacaggguuucaccau

SEQ ID NO: 756992 - RNA, 23 nt, Human
agucauugcacucaagccugggg

SEQ ID NO: 756993 - RNA, 27 nt, Human
agucugucacccaggcuggagugcaau

SEQ ID NO: 756994 - RNA, 24 nt, Human
agugauucuccugccucagccucc

SEQ ID NO: 756995 - RNA, 24 nt, Human
agugcagugguaccaucucagcuc

SEQ ID NO: 756996 - RNA, 18 nt, Human
agugcugggauuacaggc

SEQ ID NO: 756997 - RNA, 18 nt, Human
auagcucacugcagccuc

SEQ ID NO: 756998 - RNA, 21 nt, Human
aucacuugaggucgggaguuc

SEQ ID NO: 756999 - RNA, 18 nt, Human
augggguuucaccauguu

SEQ ID NO: 757000 - RNA, 22 nt, Human
augggguuucaccauguuggcc

SEQ ID NO: 757001 - RNA, 23 nt, Human
augggguuucaccauguuggcca

SEQ ID NO: 757002 - RNA, 24 nt, Human
augggguuucaccauguuggccag

SEQ ID NO: 757003 - RNA, 21 nt, Human
auuuuauauauauagauauau

SEQ ID NO: 757004 - RNA, 23 nt, Human
caaacuccugaccuugugaucca

SEQ ID NO: 757005 - RNA, 24 nt, Human
caaagugcugggauuacaggcaug

SEQ ID NO: 757006 - RNA, 24 nt, Human
caaagugcugggauuagagacaug

SEQ ID NO: 757007 - RNA, 24 nt, Human
caacacuuugggaggccaaggugg

SEQ ID NO: 757008 - RNA, 19 nt, Human
caagaacgagacuucucuc

SEQ ID NO: 757009 - RNA, 20 nt, Human
caagaacgagacuucucuca

SEQ ID NO: 757010 - RNA, 24 nt, Human
caaggugggcggaucacuugaggu

SEQ ID NO: 757011 - RNA, 22 nt, Human
caagugauucuccugccucagc

SEQ ID NO: 757012 - RNA, 27 nt, Human
caagugauucuccugccucagccucca

SEQ ID NO: 757013 - RNA, 19 nt, Human
caauuggcuccugcaagcc

SEQ ID NO: 757014 - RNA, 21 nt, Human
caccauauuggccaggcugau

SEQ ID NO: 757015 - RNA, 24 nt, Human
caccauauuggccaggcugaucuc

SEQ ID NO: 757016 - RNA, 27 nt, Human
caccauauuggccaggcugaucucaaa

SEQ ID NO: 757017 - RNA, 23 nt, Human
caccauguugcucagacuggucu

SEQ ID NO: 757018 - RNA, 24 nt, Human
caccauguugcucagacuggucuu

SEQ ID NO: 757019 - RNA, 27 nt, Human
caccauguugcucagacuggucuugaa

SEQ ID NO: 757020 - RNA, 18 nt, Human
caccauguuggccagacc

SEQ ID NO: 757021 - RNA, 21 nt, Human
caccauguuggccagaccggu

SEQ ID NO: 757022 - RNA, 24 nt, Human
caccauguuggccagaccggucuc

SEQ ID NO: 757023 - RNA, 27 nt, Human
caccauguuggccagaccggucucgaa

SEQ ID NO: 757024 - RNA, 23 nt, Human
cacccgccucggccucccaaagu

SEQ ID NO: 757025 - RNA, 24 nt, Human
cacgccuguaaucccaacacuuug

SEQ ID NO: 757026 - RNA, 22 nt, Human
cacgcgauucuccugccucagc

SEQ ID NO: 757027 - RNA, 24 nt, Human
cacuaugcccggcuaauuuuugua

SEQ ID NO: 757028 - RNA, 18 nt, Human
cacucgccucuagcugca

SEQ ID NO: 757029 - RNA, 22 nt, Human
cacucugucacccaggcuggag

SEQ ID NO: 757030 - RNA, 23 nt, Human
cacucugucacccaggcuggagu

SEQ ID NO: 757031 - RNA, 23 nt, Human
cacugcagccuccgccuccuggg

SEQ ID NO: 757032 - RNA, 19 nt, Human
cacuggguggcaggagagc

SEQ ID NO: 757033 - RNA, 23 nt, Human
cacuggguggcaggagagcagua

SEQ ID NO: 757034 - RNA, 21 nt, Human
cacuuuugaaaaacaauuugg

SEQ ID NO: 757035 - RNA, 20 nt, Human
cagcagaccacaugguacca

SEQ ID NO: 757036 - RNA, 24 nt, Human
cagccucaaacuccugggcucaag

SEQ ID NO: 757037 - RNA, 18 nt, Human
cagccuccugaguagcua

SEQ ID NO: 757038 - RNA, 19 nt, Human
cagcucaagugaucugccc

SEQ ID NO: 757039 - RNA, 18 nt, Human
caggaguggggugugaaa

SEQ ID NO: 757040 - RNA, 24 nt, Human
caggcgauccacccaccucggccc

SEQ ID NO: 757041 - RNA, 22 nt, Human
caggcgcgguggcucacgccug

SEQ ID NO: 757042 - RNA, 21 nt, Human
caggcugaucucaaacuccug

SEQ ID NO: 757043 - RNA, 24 nt, Human
caggguuucaccauauuggccagg

SEQ ID NO: 757044 - RNA, 24 nt, Human
cauauuggccaggcugaucucaaa

SEQ ID NO: 757045 - RNA, 22 nt, Human
caugccaccacgcccggccaau

SEQ ID NO: 757046 - RNA, 19 nt, Human
caugucucugugccccaca

SEQ ID NO: 757047 - RNA, 24 nt, Human
cauguugcucagacuggucuugaa

SEQ ID NO: 757048 - RNA, 24 nt, Human
cauguuggccagaccggucucgaa

SEQ ID NO: 757049 - RNA, 23 nt, Human
cauucaaauaaugcucacuaaca

SEQ ID NO: 757050 - RNA, 19 nt, Human
cauugcacucaagccuggg

SEQ ID NO: 757051 - RNA, 22 nt, Human
cauugcacucaagccuggggga

SEQ ID NO: 757052 - RNA, 23 nt, Human
cauugcacucaagccugggggac

SEQ ID NO: 757053 - RNA, 24 nt, Human
cauugcacucaagccugggggaca

SEQ ID NO: 757054 - RNA, 25 nt, Human
cauugcacucaagccugggggacaa

SEQ ID NO: 757055 - RNA, 18 nt, Human
ccaaaaaagcuuggacca

SEQ ID NO: 757056 - RNA, 23 nt, Human
ccaaagugcugggauuacaggca

SEQ ID NO: 757057 - RNA, 24 nt, Human
ccaaagugcugggauuacaggcau

SEQ ID NO: 757058 - RNA, 24 nt, Human
ccaaagugcugggauuagagacau

SEQ ID NO: 757059 - RNA, 19 nt, Human
ccaacacuuugggaggcca

SEQ ID NO: 757060 - RNA, 24 nt, Human
ccacaugguaccacucccagccau

SEQ ID NO: 757061 - RNA, 19 nt, Human
ccaccaaaaaauacaaaaa

SEQ ID NO: 757062 - RNA, 18 nt, Human
ccaggucugggaccuucc

SEQ ID NO: 757063 - RNA, 21 nt, Human
ccauugcaccuggccaaaaaa

SEQ ID NO: 757064 - RNA, 22 nt, Human
ccauugcaccuggccaaaaaag

SEQ ID NO: 757065 - RNA, 24 nt, Human
cccaaagugcugggauuacaggca

SEQ ID NO: 757066 - RNA, 18 nt, Human
cccagccauagacuggac

SEQ ID NO: 757067 - RNA, 24 nt, Human
cccgaucucaggcgauccacccac

SEQ ID NO: 757068 - RNA, 23 nt, Human
cccggccaacacggugaaacccc

SEQ ID NO: 757069 - RNA, 24 nt, Human
cccggccaacacggugaaaccccg

SEQ ID NO: 757070 - RNA, 24 nt, Human
ccuacuggguucaagugauucucc

SEQ ID NO: 757071 - RNA, 19 nt, Human
ccuccgccuccuggguuca

SEQ ID NO: 757072 - RNA, 19 nt, Human
ccuccgccuccuggguuca

SEQ ID NO: 757073 - RNA, 24 nt, Human
ccuccuggguucacgcgauucucc

SEQ ID NO: 757074 - RNA, 20 nt, Human
ccugaccuugugauccaccc

SEQ ID NO: 757075 - RNA, 24 nt, Human
ccugaguagcuaggacuacaggug

SEQ ID NO: 757076 - RNA, 21 nt, Human
ccuuaaucccagcuacuuggg

SEQ ID NO: 757077 - RNA, 25 nt, Human
cgauccacccaccucggcccauauc

SEQ ID NO: 757078 - RNA, 26 nt, Human
cgcaugccaccacgcccggccaaucu

SEQ ID NO: 757079 - RNA, 23 nt, Human
cgccuguaaucccaacacuuugg

SEQ ID NO: 757080 - RNA, 24 nt, Human
cgccuguaaucccaacacuuuggg

SEQ ID NO: 757081 - RNA, 24 nt, Human
cggaucacuugaggucgggaguuc

SEQ ID NO: 757082 - RNA, 20 nt, Human
cuacaggugaccaccacuau

SEQ ID NO: 757083 - RNA, 18 nt, Human
cuaguagagaugggguuu

SEQ ID NO: 757084 - RNA, 22 nt, Human
cuaguagagaugggguuucacc

SEQ ID NO: 757085 - RNA, 24 nt, Human
cuaguagagaugggguuucaccau

SEQ ID NO: 757086 - RNA, 24 nt, Human
cucaagugaucugcccaccucagu

SEQ ID NO: 757087 - RNA, 22 nt, Human
cucacgccuguaaucccaacac

SEQ ID NO: 757088 - RNA, 24 nt, Human
cucacgccuguaaucccaacacuu

SEQ ID NO: 757089 - RNA, 24 nt, Human
cucacucugucacccaggcuggag

SEQ ID NO: 757090 - RNA, 21 nt, Human
cucacugcagccucaaacucc

SEQ ID NO: 757091 - RNA, 24 nt, Human
cucacugcagccucaaacuccugg

SEQ ID NO: 757092 - RNA, 24 nt, Human
cucacugcagccuccgccuccugg

SEQ ID NO: 757093 - RNA, 22 nt, Human
cucccacuguggccaaucucaa

SEQ ID NO: 757094 - RNA, 24 nt, Human
cuccugaccuugugauccacccgc

SEQ ID NO: 757095 - RNA, 24 nt, Human
cuccugaguagcuaggacuacagg

SEQ ID NO: 757096 - RNA, 19 nt, Human
cuccugcaagccaaacaag

SEQ ID NO: 757097 - RNA, 21 nt, Human
cuccuggguucacgcgauucu

SEQ ID NO: 757098 - RNA, 20 nt, Human
cucuuggaauucagaccaug

SEQ ID NO: 757099 - RNA, 31 nt, Human
cugcaagccaaacaagcuggcucuagcacag

SEQ ID NO: 757100 - RNA, 23 nt, Human
cugcagccucaaacuccugggcu

SEQ ID NO: 757101 - RNA, 23 nt, Human
cugcagccuccgccuccuggguu

SEQ ID NO: 757102 - RNA, 23 nt, Human
cugccucagccuccugaguagcu

SEQ ID NO: 757103 - RNA, 18 nt, Human
cuggaccaagggguacac

SEQ ID NO: 757104 - RNA, 18 nt, Human
cuggcagucucugguggg

SEQ ID NO: 757105 - RNA, 22 nt, Human
cuggcagucucuggugggugga

SEQ ID NO: 757106 - RNA, 22 nt, Human
cuguagauauggcacacuuuug

SEQ ID NO: 757107 - RNA, 19 nt, Human
cugucacccaggcuggagu

SEQ ID NO: 757108 - RNA, 24 nt, Human
cuucuaguagagaugggguuucac

SEQ ID NO: 757109 - RNA, 24 nt, Human
gaaaccccgucuccaccaaaaaau

SEQ ID NO: 757110 - RNA, 19 nt, Human
gaacacauggccauauccc

SEQ ID NO: 757111 - RNA, 26 nt, Human
gaacuggaagauguuguugagccucu

SEQ ID NO: 757112 - RNA, 19 nt, Human
gaagacagggagaagcugc

SEQ ID NO: 757113 - RNA, 23 nt, Human
gacagacagacagacagacagac

SEQ ID NO: 757114 - RNA, 23 nt, Human
gacagacagacagacagacagac

SEQ ID NO: 757115 - RNA, 19 nt, Human
gaccaugugaccaucaggu

SEQ ID NO: 757116 - RNA, 22 nt, Human
gaccuugugauccacccgccuc

SEQ ID NO: 757117 - RNA, 22 nt, Human
gaccuugugauccacccgccuc

SEQ ID NO: 757118 - RNA, 24 nt, Human
gaccuugugauccacccgccucgg

SEQ ID NO: 757119 - RNA, 21 nt, Human
gacuacaggugaccaccacua

SEQ ID NO: 757120 - RNA, 26 nt, Human
gagaggaagacagggagaagcugccg

SEQ ID NO: 757121 - RNA, 20 nt, Human
gagaugggguuucaccaugu

SEQ ID NO: 757122 - RNA, 24 nt, Human
gagaugggguuucaccauguuggc

SEQ ID NO: 757123 - RNA, 23 nt, Human
gagguuacagugagccgagauug

SEQ ID NO: 757124 - RNA, 25 nt, Human
gaguagcuaggacuacaggugacca

SEQ ID NO: 757125 - RNA, 24 nt, Human
gaucacuugaggucgggaguucga

SEQ ID NO: 757126 - RNA, 24 nt, Human
gaucucaggcgauccacccaccuc

SEQ ID NO: 757127 - RNA, 18 nt, Human
gauuacaggcaugagcca

SEQ ID NO: 757128 - RNA, 22 nt, Human
gauuacaggcaugagccaccgc

SEQ ID NO: 757129 - RNA, 22 nt, Human
gauuacaggcaugagccaccgc

SEQ ID NO: 757130 - RNA, 18 nt, Human
gauuagagacaugagcca

SEQ ID NO: 757131 - RNA, 23 nt, Human
gauuagagacaugagccauugca

SEQ ID NO: 757132 - RNA, 25 nt, Human
gcaacagagagagaaacagagaaaa

SEQ ID NO: 757133 - RNA, 26 nt, Human
gcaacagagagagaaacagagaaaaa

SEQ ID NO: 757134 - RNA, 25 nt, Human
gcaugccaccacgcccggccaaucu

SEQ ID NO: 757135 - RNA, 24 nt, Human
gccaacacggugaaaccccgucuc

SEQ ID NO: 757136 - RNA, 22 nt, Human
gcccggcuaauuuuuguauuuu

SEQ ID NO: 757137 - RNA, 20 nt, Human
gccucagccuccugaguagc

SEQ ID NO: 757138 - RNA, 23 nt, Human
gccucggccucccaaagugcugg

SEQ ID NO: 757139 - RNA, 22 nt, Human
gccuuaaucccagcuacuuggg

SEQ ID NO: 757140 - RNA, 24 nt, Human
gcgauucuccugccucagccuccu

SEQ ID NO: 757141 - RNA, 19 nt, Human
gcuggagugcaauagcaca

SEQ ID NO: 757142 - RNA, 20 nt, Human
gcuggagugcagugguacca

SEQ ID NO: 757143 - RNA, 18 nt, Human
ggacagcccacccagucc

SEQ ID NO: 757144 - RNA, 28 nt, Human
ggaggcagagacagaauuguuugaaccc

SEQ ID NO: 757145 - RNA, 21 nt, Human
ggaggcggagguuacagugag

SEQ ID NO: 757146 - RNA, 22 nt, Human
ggagguuacagugagccgagau

SEQ ID NO: 757147 - RNA, 24 nt, Human
ggagguuacagugagccgagauug

SEQ ID NO: 757148 - RNA, 23 nt, Human
ggaucacuugaggucgggaguuc

SEQ ID NO: 757149 - RNA, 22 nt, Human
ggauuacaggcaugagccaccg

SEQ ID NO: 757150 - RNA, 21 nt, Human
ggccaggcgcgguggcucacg

SEQ ID NO: 757151 - RNA, 22 nt, Human
gggguuucaccauguuggccag

SEQ ID NO: 757152 - RNA, 20 nt, Human
ggguucaagugauucuccug

SEQ ID NO: 757153 - RNA, 23 nt, Human
gguggcucacgccuguaauccca

SEQ ID NO: 757154 - RNA, 23 nt, Human
guagagaugggguuucaccaugu

SEQ ID NO: 757155 - RNA, 24 nt, Human
gugauccacccgccucggccuccc

SEQ ID NO: 757156 - RNA, 24 nt, Human
gugaucugcccaccucagucuccc

SEQ ID NO: 757157 - RNA, 21 nt, Human
gugauucuccugccucagccu

SEQ ID NO: 757158 - RNA, 22 nt, Human
guggcucacgccuguaauccca

SEQ ID NO: 757159 - RNA, 19 nt, Human
gugggcggaucacuugagg

SEQ ID NO: 757160 - RNA, 20 nt, Human
guguuguuccaggucuggga

SEQ ID NO: 757161 - RNA, 21 nt, Human
uaaaaaaaaaaaaacccacag

SEQ ID NO: 757162 - RNA, 23 nt, Human
uaaaaaaaaaaaaacccacagag

SEQ ID NO: 757163 - RNA, 18 nt, Human
uaaggccccuucccugga

SEQ ID NO: 757164 - RNA, 24 nt, Human
uaauuuuuguauuuuuaguacaga

SEQ ID NO: 757165 - RNA, 23 nt, Human
uacaggcaugagccaccgcgccc

SEQ ID NO: 757166 - RNA, 23 nt, Human
uacaggugaccaccacuaugccc

SEQ ID NO: 757167 - RNA, 24 nt, Human
uacuggguucaagugauucuccug

SEQ ID NO: 757168 - RNA, 18 nt, Human
uagacuggaccaaggggu

SEQ ID NO: 757169 - RNA, 22 nt, Human
uagagaugggguuucaccaugu

SEQ ID NO: 757170 - RNA, 22 nt, Human
uagauagauagauagauagaca

SEQ ID NO: 757171 - RNA, 22 nt, Human
uagauagauagauagauagaua

SEQ ID NO: 757172 - RNA, 24 nt, Human
uagcacaauuucagcucacugcaa

SEQ ID NO: 757173 - RNA, 24 nt, Human
uagcucacugcagccucaaacucc

SEQ ID NO: 757174 - RNA, 24 nt, Human
uaguacagacaggguuucaccaua

SEQ ID NO: 757175 - RNA, 24 nt, Human
uaguagagaugggguuucaccaug

SEQ ID NO: 757176 - RNA, 26 nt, Human
uaguagagaugggguuucaccauguu

SEQ ID NO: 757177 - RNA, 24 nt, Human
uagucugucacccaggcuggagug

SEQ ID NO: 757178 - RNA, 24 nt, Human
uagugcaauaauagcucacugcag

SEQ ID NO: 757179 - RNA, 22 nt, Human
uauaaaacaugccauccuucaa

SEQ ID NO: 757180 - RNA, 22 nt, Human
uauccuagaccagcauaagaac

SEQ ID NO: 757181 - RNA, 24 nt, Human
uaugucacccaggcuggaaugcag

SEQ ID NO: 757182 - RNA, 31 nt, Human
uauuuuuuuuuuuguguggagauggagucuu

SEQ ID NO: 757183 - RNA, 19 nt, Human
ucaagugauucuccugccu

SEQ ID NO: 757184 - RNA, 19 nt, Human
ucacccaggcuggaaugca

SEQ ID NO: 757185 - RNA, 18 nt, Human
ucacccaggcuggagugc

SEQ ID NO: 757186 - RNA, 24 nt, Human
ucacccaggcuggagugcaguggu

SEQ ID NO: 757187 - RNA, 24 nt, Human
ucacucugucacccaggcuggagu

SEQ ID NO: 757188 - RNA, 24 nt, Human
ucacugcaacuuccgccuacuggg

SEQ ID NO: 757189 - RNA, 24 nt, Human
ucacugcagccucaaacuccuggg

SEQ ID NO: 757190 - RNA, 23 nt, Human
ucacugcagccuccgccuccugg

SEQ ID NO: 757191 - RNA, 24 nt, Human
ucacugcagccuccgccuccuggg

SEQ ID NO: 757192 - RNA, 25 nt, Human
ucacugcagccuccgccuccugggu

SEQ ID NO: 757193 - RNA, 20 nt, Human
ucaggcgauccacccaccuc

SEQ ID NO: 757194 - RNA, 19 nt, Human
ucauugcacucaagccugg

SEQ ID NO: 757195 - RNA, 22 nt, Human
ucauugcacucaagccuggggg

SEQ ID NO: 757196 - RNA, 24 nt, Human
ucauugcacucaagccugggggac

SEQ ID NO: 757197 - RNA, 20 nt, Human
uccacacacagcccuucuca

SEQ ID NO: 757198 - RNA, 18 nt, Human
ucccaaagugcugggauu

SEQ ID NO: 757199 - RNA, 24 nt, Human
ucccaaagugcugggauuacaggc

SEQ ID NO: 757200 - RNA, 22 nt, Human
ucccagccauagacuggaccaa

SEQ ID NO: 757201 - RNA, 23 nt, Human
ucccagccauagacuggaccaag

SEQ ID NO: 757202 - RNA, 20 nt, Human
ucccuuucugcaaaguuaac

SEQ ID NO: 757203 - RNA, 24 nt, Human
uccugaguagcuaggacuacaggu

SEQ ID NO: 757204 - RNA, 20 nt, Human
uccugcaagccaaacaagcu

SEQ ID NO: 757205 - RNA, 18 nt, Human
uccugggcucaagcgauc

SEQ ID NO: 757206 - RNA, 21 nt, Human
uccuggguucacgcgauucuc

SEQ ID NO: 757207 - RNA, 24 nt, Human
uccuggguucacgcgauucuccug

SEQ ID NO: 757208 - RNA, 18 nt, Human
ucggccucccaaagugcu

SEQ ID NO: 757209 - RNA, 19 nt, Human
ucucaccauguugcucaga

SEQ ID NO: 757210 - RNA, 23 nt, Human
ucucacucugucacccaggcugg

SEQ ID NO: 757211 - RNA, 24 nt, Human
ucucacucugucacccaggcugga

SEQ ID NO: 757212 - RNA, 26 nt, Human
ucucacucugucacccaggcuggagu

SEQ ID NO: 757213 - RNA, 27 nt, Human
ucucacucugucacccaggcuggagug

SEQ ID NO: 757214 - RNA, 23 nt, Human
ucuccugccucagccuccagagc

SEQ ID NO: 757215 - RNA, 24 nt, Human
ucuccugccucagccuccugagua

SEQ ID NO: 757216 - RNA, 25 nt, Human
ucucucaaaacaaaaacaaaaacaa

SEQ ID NO: 757217 - RNA, 21 nt, Human
ucugcccaccucagucuccca

SEQ ID NO: 757218 - RNA, 24 nt, Human
ucugucacccaggcuggagugcaa

SEQ ID NO: 757219 - RNA, 24 nt, Human
ucugucacccaggcuggagugcag

SEQ ID NO: 757220 - RNA, 20 nt, Human
ucuguguuguuccaggucug

SEQ ID NO: 757221 - RNA, 24 nt, Human
ucuuagucugucacccaggcugga

SEQ ID NO: 757222 - RNA, 24 nt, Human
ucuugauaugucacccaggcugga

SEQ ID NO: 757223 - RNA, 22 nt, Human
ugaaaccccgucuccaccaaaa

SEQ ID NO: 757224 - RNA, 23 nt, Human
ugaccuugugauccacccgccuc

SEQ ID NO: 757225 - RNA, 22 nt, Human
ugagacggagucuuagucuguc

SEQ ID NO: 757226 - RNA, 24 nt, Human
ugaucugcccaccucagucuccca

SEQ ID NO: 757227 - RNA, 25 nt, Human
ugaucugcccaccucagucucccaa

SEQ ID NO: 757228 - RNA, 20 nt, Human
ugauucuccugccucagccu

SEQ ID NO: 757229 - RNA, 23 nt, Human
ugcaguagggacaaacuagaaac

SEQ ID NO: 757230 - RNA, 24 nt, Human
ugcccggcuaauuuuuguauuuuu

SEQ ID NO: 757231 - RNA, 24 nt, Human
ugccucagccuccagagcagcugg

SEQ ID NO: 757232 - RNA, 24 nt, Human
ugccucagccuccugaguagcuag

SEQ ID NO: 757233 - RNA, 18 nt, Human
ugcuggcagucucuggug

SEQ ID NO: 757234 - RNA, 24 nt, Human
ugcuggcagucucuggugggugga

SEQ ID NO: 757235 - RNA, 20 nt, Human
uggaauugggagacagggau

SEQ ID NO: 757236 - RNA, 25 nt, Human
uggaauugggagacagggauuugug

SEQ ID NO: 757237 - RNA, 18 nt, Human
uggagaagugguaugccc

SEQ ID NO: 757238 - RNA, 18 nt, Human
uggagcaaaagcugcuag

SEQ ID NO: 757239 - RNA, 19 nt, Human
uggagugcagugguaccau

SEQ ID NO: 757240 - RNA, 23 nt, Human
uggagugcagugguaccaucuca

SEQ ID NO: 757241 - RNA, 20 nt, Human
uggcacacuuuugaaaaaca

SEQ ID NO: 757242 - RNA, 18 nt, Human
uggcaguauuuaucaaau

SEQ ID NO: 757243 - RNA, 23 nt, Human
uggcaguauuuaucaaauaacug

SEQ ID NO: 757244 - RNA, 22 nt, Human
uggccaaaaaaggaauaaauau

SEQ ID NO: 757245 - RNA, 24 nt, Human
uggccaggcgcgguggcucacgcc

SEQ ID NO: 757246 - RNA, 24 nt, Human
uggccaggcugaucucaaacuccu

SEQ ID NO: 757247 - RNA, 24 nt, Human
uggcucacgccuguaaucccaaca

SEQ ID NO: 757248 - RNA, 23 nt, Human
uggcucuagcacaccacugggug

SEQ ID NO: 757249 - RNA, 21 nt, Human
ugggaggcagagacagaauug

SEQ ID NO: 757250 - RNA, 19 nt, Human
ugggaggccaaggugggcg

SEQ ID NO: 757251 - RNA, 24 nt, Human
ugggaggccaaggugggcggauca

SEQ ID NO: 757252 - RNA, 18 nt, Human
ugggauuacaggcaugag

SEQ ID NO: 757253 - RNA, 19 nt, Human
ugggauuacaggcaugagc

SEQ ID NO: 757254 - RNA, 21 nt, Human
ugggauuacaggcaugagcca

SEQ ID NO: 757255 - RNA, 22 nt, Human
ugggauuacaggcaugagccac

SEQ ID NO: 757256 - RNA, 23 nt, Human
ugggauuacaggcaugagccacc

SEQ ID NO: 757257 - RNA, 24 nt, Human
ugggauuacaggcaugagccaccg

SEQ ID NO: 757258 - RNA, 24 nt, Human
ugggauuacaggcaugagccaccg

SEQ ID NO: 757259 - RNA, 21 nt, Human
ugggauuagagacaugagcca

SEQ ID NO: 757260 - RNA, 22 nt, Human
ugggauuagagacaugagccau

SEQ ID NO: 757261 - RNA, 24 nt, Human
ugggauuagagacaugagccauug

SEQ ID NO: 757262 - RNA, 24 nt, Human
ugggauuagagacaugagccauug

SEQ ID NO: 757263 - RNA, 23 nt, Human
ugggguuucaccauguuggccag

SEQ ID NO: 757264 - RNA, 20 nt, Human
uggguggcaggagagcagua

SEQ ID NO: 757265 - RNA, 23 nt, Human
uggguucaagugauucuccugcc

SEQ ID NO: 757266 - RNA, 20 nt, Human
uggguucacgcgauucuccu

SEQ ID NO: 757267 - RNA, 19 nt, Human
ugguaccaucucagcucac

SEQ ID NO: 757268 - RNA, 24 nt, Human
ugguaccaucucagcucacugcag

SEQ ID NO: 757269 - RNA, 18 nt, Human
uguaaagucagagcuggg

SEQ ID NO: 757270 - RNA, 23 nt, Human
uguagagaugagcucucaccaug

SEQ ID NO: 757271 - RNA, 22 nt, Human
uguagauauggcacacuuuuga

SEQ ID NO: 757272 - RNA, 20 nt, Human
ugucacccaggcuggagugc

SEQ ID NO: 757273 - RNA, 20 nt, Human
uguugcucagacuggucuug

SEQ ID NO: 757274 - RNA, 25 nt, Human
uuacagugagccgagauugagucau

SEQ ID NO: 757275 - RNA, 18 nt, Human
uuagccgggcaugguggc

SEQ ID NO: 757276 - RNA, 24 nt, Human
uuaguacagacaggguuucaccau

SEQ ID NO: 757277 - RNA, 21 nt, Human
uucaagugauucuccugccuc

SEQ ID NO: 757278 - RNA, 23 nt, Human
uucaagugauucuccugccucag

SEQ ID NO: 757279 - RNA, 24 nt, Human
uucaagugauucuccugccucagc

SEQ ID NO: 757280 - RNA, 20 nt, Human
uuccaacucuauccuagacc

SEQ ID NO: 757281 - RNA, 22 nt, Human
uucccuggaggggaugcuggca

SEQ ID NO: 757282 - RNA, 20 nt, Human
uucuuuuuuuuuuuuuucuu

SEQ ID NO: 757283 - RNA, 22 nt, Human
uugcaccaagauguucaccaca

SEQ ID NO: 757284 - RNA, 24 nt, Human
uugcacucaagccugggggacaag

SEQ ID NO: 757285 - RNA, 18 nt, Human
uuggcuccugcaagccaa

SEQ ID NO: 757286 - RNA, 20 nt, Human
uugggaggcagagacagaau

SEQ ID NO: 757287 - RNA, 24 nt, Human
uuguuugaacccaggaggcggagg

SEQ ID NO: 757288 - RNA, 21 nt, Human
uuucaccauauuggccaggcu

SEQ ID NO: 757289 - RNA, 24 nt, Human
uuucaccauguuggccagaccggu

SEQ ID NO: 757290 - RNA, 25 nt, Human
uuuuauuuuauauauauagauauau

SEQ ID NO: 757291 - RNA, 24 nt, Human
uuuuuaguacagacaggguuucac

SEQ ID NO: 757292 - RNA, 20 nt, Human
uuuuuguauuuuuaguacag

SEQ ID NO: 757293 - RNA, 23 nt, Human
uuuuuguauuuuuaguacagaca

SEQ ID NO: 757294 - RNA, 19 nt, Human
aaaaccaaacgcugcuguc

SEQ ID NO: 757295 - RNA, 21 nt, Human
aaaagcuuugugucaugagaa

SEQ ID NO: 757296 - RNA, 22 nt, Human
aaacccucaccagccccgcccu

SEQ ID NO: 757297 - RNA, 19 nt, Human
aaagugcugggaucugugc

SEQ ID NO: 757298 - RNA, 23 nt, Human
aaagugcugggaucugugcuucg

SEQ ID NO: 757299 - RNA, 19 nt, Human
aaauaaauagauggggaug

SEQ ID NO: 757300 - RNA, 25 nt, Human
aacccgggugggcaggagcacauug

SEQ ID NO: 757301 - RNA, 25 nt, Human
aagaaaaguggauaaaaccaaacgc

SEQ ID NO: 757302 - RNA, 19 nt, Human
aagcacuuuaacaucagga

SEQ ID NO: 757303 - RNA, 18 nt, Human
aagcuagcugaggaggug

SEQ ID NO: 757304 - RNA, 20 nt, Human
aagugcugggaucugugcuu

SEQ ID NO: 757305 - RNA, 21 nt, Human
acacacacacaugcacaugau

SEQ ID NO: 757306 - RNA, 23 nt, Human
acacugugaccacuggggcaccu

SEQ ID NO: 757307 - RNA, 20 nt, Human
accagccccgcccucugacc

SEQ ID NO: 757308 - RNA, 21 nt, Human
acccaggcuggagugcagugu

SEQ ID NO: 757309 - RNA, 21 nt, Human
acccccuguagcagggagagg

SEQ ID NO: 757310 - RNA, 24 nt, Human
acccgggugggcaggagcacauug

SEQ ID NO: 757311 - RNA, 24 nt, Human
accgucacccaggcuggagugcag

SEQ ID NO: 757312 - RNA, 19 nt, Human
acugcagccucaaucuccu

SEQ ID NO: 757313 - RNA, 21 nt, Human
agaaaaguggauaaaaccaaa

SEQ ID NO: 757314 - RNA, 24 nt, Human
agacaggacagggacaguuugugg

SEQ ID NO: 757315 - RNA, 18 nt, Human
agacgagcccacuccccc

SEQ ID NO: 757316 - RNA, 20 nt, Human
agaucucgggggcggggggc

SEQ ID NO: 757317 - RNA, 18 nt, Human
agcagggagaggcuccug

SEQ ID NO: 757318 - RNA, 19 nt, Human
agccugggagccccaagca

SEQ ID NO: 757319 - RNA, 23 nt, Human
agcugaccugagcaauccagcgu

SEQ ID NO: 757320 - RNA, 21 nt, Human
aggcaggacuggcacugaggu

SEQ ID NO: 757321 - RNA, 22 nt, Human
aggcaggacuggcacugagguc

SEQ ID NO: 757322 - RNA, 23 nt, Human
aggcaugcgccaccgugucuggc

SEQ ID NO: 757323 - RNA, 22 nt, Human
aggcuccugggccccagaagcu

SEQ ID NO: 757324 - RNA, 21 nt, Human
aggcugagcagggaaggccac

SEQ ID NO: 757325 - RNA, 19 nt, Human
agggugacaagaccuaaaa

SEQ ID NO: 757326 - RNA, 21 nt, Human
agguccacucugaaggauggc

SEQ ID NO: 757327 - RNA, 20 nt, Human
agugcagugucgcgaucaug

SEQ ID NO: 757328 - RNA, 24 nt, Human
aguuagcugggacuacaggcaugc

SEQ ID NO: 757329 - RNA, 20 nt, Human
aucuccacagaucuucaccg

SEQ ID NO: 757330 - RNA, 20 nt, Human
augcacacccguguuuacaa

SEQ ID NO: 757331 - RNA, 20 nt, Human
augggccugggggcagcccu

SEQ ID NO: 757332 - RNA, 23 nt, Human
auguaggggaggauguggggggc

SEQ ID NO: 757333 - RNA, 21 nt, Human
caaagcucccagaggcaguuc

SEQ ID NO: 757334 - RNA, 22 nt, Human
caacaacaagccgccgccacag

SEQ ID NO: 757335 - RNA, 22 nt, Human
caacaggagccucagcucccag

SEQ ID NO: 757336 - RNA, 21 nt, Human
caagaaaaguggauaaaacca

SEQ ID NO: 757337 - RNA, 18 nt, Human
caagcagcugaccugagc

SEQ ID NO: 757338 - RNA, 22 nt, Human
caagugauccuccugccucagc

SEQ ID NO: 757339 - RNA, 27 nt, Human
caagugauccuccugccucagccuccc

SEQ ID NO: 757340 - RNA, 27 nt, Human
caagugauccuccugccucagccuccc

SEQ ID NO: 757341 - RNA, 23 nt, Human
caaucaggaaggaagcacgccuc

SEQ ID NO: 757342 - RNA, 23 nt, Human
cacaacaacaagccgccgccaca

SEQ ID NO: 757343 - RNA, 21 nt, Human
cacacccagccugggagcccc

SEQ ID NO: 757344 - RNA, 21 nt, Human
cacagaucuucaccgcacacc

SEQ ID NO: 757345 - RNA, 19 nt, Human
cacaugcacacccguguuu

SEQ ID NO: 757346 - RNA, 19 nt, Human
cacauucccaggacuugga

SEQ ID NO: 757347 - RNA, 18 nt, Human
caccgcacacccgugugc

SEQ ID NO: 757348 - RNA, 21 nt, Human
caccgucacccaggcuggagu

SEQ ID NO: 757349 - RNA, 27 nt, Human
cacgcacacacacacaugcacaugauu

SEQ ID NO: 757350 - RNA, 19 nt, Human
cacugcagccucaaucucc

SEQ ID NO: 757351 - RNA, 18 nt, Human
cagcagggaaggugaggc

SEQ ID NO: 757352 - RNA, 23 nt, Human
cagccucaaucuccugggcucaa

SEQ ID NO: 757353 - RNA, 24 nt, Human
cagccucaaucuccugggcucaag

SEQ ID NO: 757354 - RNA, 21 nt, Human
caggaagaaagucccugggcu

SEQ ID NO: 757355 - RNA, 21 nt, Human
caggaaggaagcacgccucgg

SEQ ID NO: 757356 - RNA, 22 nt, Human
cagggaaggccacagaucugcc

SEQ ID NO: 757357 - RNA, 20 nt, Human
cagggccaggcucucccccu

SEQ ID NO: 757358 - RNA, 22 nt, Human
cagggccaggcucucccccugg

SEQ ID NO: 757359 - RNA, 23 nt, Human
cagugcggaacccgggugggcag

SEQ ID NO: 757360 - RNA, 18 nt, Human
caguuccacugagugagg

SEQ ID NO: 757361 - RNA, 18 nt, Human
cauaaagcucgaguagaa

SEQ ID NO: 757362 - RNA, 20 nt, Human
cauccacaugcacacccgug

SEQ ID NO: 757363 - RNA, 19 nt, Human
ccaagcagcugaccugagc

SEQ ID NO: 757364 - RNA, 22 nt, Human
ccacacugugaccacuggggca

SEQ ID NO: 757365 - RNA, 23 nt, Human
ccacuggggcaccuccugauuau

SEQ ID NO: 757366 - RNA, 22 nt, Human
ccagcggaggcucccuggggcc

SEQ ID NO: 757367 - RNA, 20 nt, Human
ccaggcucucccccuggaga

SEQ ID NO: 757368 - RNA, 18 nt, Human
ccagugccacacgcucuc

SEQ ID NO: 757369 - RNA, 19 nt, Human
ccaguuagcugggacuaca

SEQ ID NO: 757370 - RNA, 24 nt, Human
cccaguuagcugggacuacaggca

SEQ ID NO: 757371 - RNA, 19 nt, Human
ccccacccccuguagcagg

SEQ ID NO: 757372 - RNA, 22 nt, Human
ccccagaagcuggagggggugg

SEQ ID NO: 757373 - RNA, 22 nt, Human
ccccgcccucugaccagccugu

SEQ ID NO: 757374 - RNA, 22 nt, Human
ccccuguagcagggagaggcuc

SEQ ID NO: 757375 - RNA, 20 nt, Human
cccgugccacgcacucuaag

SEQ ID NO: 757376 - RNA, 19 nt, Human
cccugacaccugcugcugc

SEQ ID NO: 757377 - RNA, 23 nt, Human
cccugcugagcaggacccccacc

SEQ ID NO: 757378 - RNA, 18 nt, Human
cccugggcuccagaucuc

SEQ ID NO: 757379 - RNA, 24 nt, Human
cccuggggccuggcuagggugccg

SEQ ID NO: 757380 - RNA, 22 nt, Human
cccuggguagcaaaggacaggg

SEQ ID NO: 757381 - RNA, 21 nt, Human
ccgcccucugaccagccuguc

SEQ ID NO: 757382 - RNA, 19 nt, Human
ccgggcucuggaaauugcc

SEQ ID NO: 757383 - RNA, 22 nt, Human
ccucaaucuccugggcucaagu

SEQ ID NO: 757384 - RNA, 21 nt, Human
ccuccugccucagccucccag

SEQ ID NO: 757385 - RNA, 22 nt, Human
ccuccugggagggcagggacug

SEQ ID NO: 757386 - RNA, 20 nt, Human
ccugccucagccucccaguu

SEQ ID NO: 757387 - RNA, 23 nt, Human
ccugccucagccucccaguuagc

SEQ ID NO: 757388 - RNA, 25 nt, Human
ccugcugcugcuaucuugacccgac

SEQ ID NO: 757389 - RNA, 22 nt, Human
ccugggcucaagugauccuccu

SEQ ID NO: 757390 - RNA, 23 nt, Human
ccugggcucaagugauccuccug

SEQ ID NO: 757391 - RNA, 33 nt, Human
ccuguggcuaaggcacacccagccugggagccg

SEQ ID NO: 757392 - RNA, 22 nt, Human
cgagcccacucccccgcuuccu

SEQ ID NO: 757393 - RNA, 22 nt, Human
cgcacacacacacaugcacaug

SEQ ID NO: 757394 - RNA, 21 nt, Human
cgccaaagcucccagaggcag

SEQ ID NO: 757395 - RNA, 21 nt, Human
cgcuuccugccccucagcagc

SEQ ID NO: 757396 - RNA, 19 nt, Human
cggaacccgggugggcagg

SEQ ID NO: 757397 - RNA, 20 nt, Human
cggcgggauggcgaguccgg

SEQ ID NO: 757398 - RNA, 20 nt, Human
cgugugcauccacaugcaca

SEQ ID NO: 757399 - RNA, 18 nt, Human
cuaaaaccaccaccuacc

SEQ ID NO: 757400 - RNA, 21 nt, Human
cuaaaaccaccaccuacccug

SEQ ID NO: 757401 - RNA, 20 nt, Human
cuaugaggcgcugagcgacc

SEQ ID NO: 757402 - RNA, 24 nt, Human
cucaagugauccuccugccucagc

SEQ ID NO: 757403 - RNA, 21 nt, Human
cucacugcagccucaaucucc

SEQ ID NO: 757404 - RNA, 24 nt, Human
cucacugcagccucaaucuccugg

SEQ ID NO: 757405 - RNA, 21 nt, Human
cucccccgcuuccugccccuc

SEQ ID NO: 757406 - RNA, 20 nt, Human
cuccugauuauccaagaaaa

SEQ ID NO: 757407 - RNA, 19 nt, Human
cuccugggccccagaagcu

SEQ ID NO: 757408 - RNA, 25 nt, Human
cuccugggcucaagugauccuccug

SEQ ID NO: 757409 - RNA, 20 nt, Human
cucuacauacaaaaugcccu

SEQ ID NO: 757410 - RNA, 19 nt, Human
cugagcaggacccccaccc

SEQ ID NO: 757411 - RNA, 23 nt, Human
cuggccgacgugacccagaugcu

SEQ ID NO: 757412 - RNA, 21 nt, Human
cugugaccacuggggcaccuc

SEQ ID NO: 757413 - RNA, 24 nt, Human
cuugacccgaccacccgccccaac

SEQ ID NO: 757414 - RNA, 19 nt, Human
gacaguuugugggccagug

SEQ ID NO: 757415 - RNA, 20 nt, Human
gacccgaccacccgccccaa

SEQ ID NO: 757416 - RNA, 22 nt, Human
gaccugcuggaggccugcaccc

SEQ ID NO: 757417 - RNA, 20 nt, Human
gacuacaggcaugcgccacc

SEQ ID NO: 757418 - RNA, 21 nt, Human
gacuggcacugagguccacuc

SEQ ID NO: 757419 - RNA, 19 nt, Human
gaggaagacaggacaggga

SEQ ID NO: 757420 - RNA, 18 nt, Human
gaggcgguggagggagug

SEQ ID NO: 757421 - RNA, 20 nt, Human
gauguggggggcuccuucaa

SEQ ID NO: 757422 - RNA, 27 nt, Human
gcacacccagccugggagccccaagca

SEQ ID NO: 757423 - RNA, 21 nt, Human
gccucagcucccagcuccauc

SEQ ID NO: 757424 - RNA, 21 nt, Human
gcggaacccgggugggcagga

SEQ ID NO: 757425 - RNA, 21 nt, Human
gcucacugcagccucaaucuc

SEQ ID NO: 757426 - RNA, 23 nt, Human
gcugcugucugggcccagcggag

SEQ ID NO: 757427 - RNA, 20 nt, Human
ggaaggugaggcgguggagg

SEQ ID NO: 757428 - RNA, 19 nt, Human
ggacagugcggaacccggg

SEQ ID NO: 757429 - RNA, 19 nt, Human
ggaccaagaggcugagcag

SEQ ID NO: 757430 - RNA, 21 nt, Human
ggacuacaggcaugcgccacc

SEQ ID NO: 757431 - RNA, 24 nt, Human
ggacuacaggcaugcgccaccgug

SEQ ID NO: 757432 - RNA, 28 nt, Human
ggagacgagcccacucccccgcuuccuu

SEQ ID NO: 757433 - RNA, 24 nt, Human
ggaggauguggggggcuccuucaa

SEQ ID NO: 757434 - RNA, 21 nt, Human
ggaggggguggugucuugagc

SEQ ID NO: 757435 - RNA, 20 nt, Human
ggcaguuccacugagugagg

SEQ ID NO: 757436 - RNA, 23 nt, Human
ggccacagaucugccaggaagaa

SEQ ID NO: 757437 - RNA, 18 nt, Human
ggccaggcucucccccug

SEQ ID NO: 757438 - RNA, 21 nt, Human
ggccccgcacauucccaggac

SEQ ID NO: 757439 - RNA, 24 nt, Human
gggaccaagaggcugagcagggaa

SEQ ID NO: 757440 - RNA, 21 nt, Human
gggcucaagugauccuccugc

SEQ ID NO: 757441 - RNA, 22 nt, Human
gggcucaagugauccuccugcc

SEQ ID NO: 757442 - RNA, 25 nt, Human
ggggggaccaagaggcugagcaggg

SEQ ID NO: 757443 - RNA, 24 nt, Human
gucaggcguggugccccuggggca

SEQ ID NO: 757444 - RNA, 23 nt, Human
gucccugggcuccagaucucggg

SEQ ID NO: 757445 - RNA, 23 nt, Human
gucucaccgucacccaggcugga

SEQ ID NO: 757446 - RNA, 24 nt, Human
gugauccuccugccucagccuccc

SEQ ID NO: 757447 - RNA, 27 nt, Human
gugcauccacaugcacacccguguuua

SEQ ID NO: 757448 - RNA, 18 nt, Human
guggagcuagcagaggcc

SEQ ID NO: 757449 - RNA, 20 nt, Human
guggggggaccaagaggcug

SEQ ID NO: 757450 - RNA, 19 nt, Human
uaaacuuaagaucucaucc

SEQ ID NO: 757451 - RNA, 20 nt, Human
uaggacaaacccucaccagc

SEQ ID NO: 757452 - RNA, 25 nt, Human
uaggacaaacccucaccagccccgc

SEQ ID NO: 757453 - RNA, 24 nt, Human
uaucaaaagcuuugugucaugaga

SEQ ID NO: 757454 - RNA, 24 nt, Human
ucacccaggcuggagugcaguguc

SEQ ID NO: 757455 - RNA, 23 nt, Human
ucacugcagccucaaucuccugg

SEQ ID NO: 757456 - RNA, 24 nt, Human
ucacugcagccucaaucuccuggg

SEQ ID NO: 757457 - RNA, 24 nt, Human
ucagcagccacaagaugggggaag

SEQ ID NO: 757458 - RNA, 24 nt, Human
ucagcucccagcuccaucuccaca

SEQ ID NO: 757459 - RNA, 21 nt, Human
uccacaacaacaagccgccgc

SEQ ID NO: 757460 - RNA, 23 nt, Human
uccagaucucgggggcggggggc

SEQ ID NO: 757461 - RNA, 23 nt, Human
uccaucuccacagaucuucaccg

SEQ ID NO: 757462 - RNA, 18 nt, Human
ucccaggacuuggaagcu

SEQ ID NO: 757463 - RNA, 24 nt, Human
ucccaguuagcugggacuacaggc

SEQ ID NO: 757464 - RNA, 24 nt, Human
ucccccgcuuccugccccucagca

SEQ ID NO: 757465 - RNA, 19 nt, Human
ucccugggcuccagaucuc

SEQ ID NO: 757466 - RNA, 25 nt, Human
ucccugggcuccagaucucgggggc

SEQ ID NO: 757467 - RNA, 23 nt, Human
ucccuggggccuggcuagggugc

SEQ ID NO: 757468 - RNA, 22 nt, Human
uccuccugccucagccucccag

SEQ ID NO: 757469 - RNA, 27 nt, Human
uccuccugccucagccucccaguuagc

SEQ ID NO: 757470 - RNA, 21 nt, Human
uccugggcucaagugauccuc

SEQ ID NO: 757471 - RNA, 22 nt, Human
uccugggcucaagugauccucc

SEQ ID NO: 757472 - RNA, 24 nt, Human
uccugggcucaagugauccuccug

SEQ ID NO: 757473 - RNA, 19 nt, Human
uccugggucccugaggguu

SEQ ID NO: 757474 - RNA, 20 nt, Human
uccugggucccugaggguuc

SEQ ID NO: 757475 - RNA, 22 nt, Human
ucucaccgucacccaggcugga

SEQ ID NO: 757476 - RNA, 24 nt, Human
ucucaccgucacccaggcuggagu

SEQ ID NO: 757477 - RNA, 21 nt, Human
ucuugagcccugacaccugcu

SEQ ID NO: 757478 - RNA, 20 nt, Human
ugacccagaugcugaggcag

SEQ ID NO: 757479 - RNA, 21 nt, Human
ugacccgaccacccgccccaa

SEQ ID NO: 757480 - RNA, 19 nt, Human
ugagaagaugcggcugugg

SEQ ID NO: 757481 - RNA, 22 nt, Human
ugagaagaugcggcuguggaag

SEQ ID NO: 757482 - RNA, 18 nt, Human
ugagcaggacccccaccc

SEQ ID NO: 757483 - RNA, 24 nt, Human
ugaggcaggacuggcacugagguc

SEQ ID NO: 757484 - RNA, 19 nt, Human
ugcacacacgcacacacac

SEQ ID NO: 757485 - RNA, 26 nt, Human
ugcacacacgcacacacacacaugca

SEQ ID NO: 757486 - RNA, 25 nt, Human
ugcacacacgcacacacacacaugg

SEQ ID NO: 757487 - RNA, 21 nt, Human
ugccaggaagaaagucccugg

SEQ ID NO: 757488 - RNA, 23 nt, Human
ugccaggaagaaagucccugggc

SEQ ID NO: 757489 - RNA, 26 nt, Human
ugccaggaagaaagucccugggcucc

SEQ ID NO: 757490 - RNA, 18 nt, Human
ugccucagccucccaguu

SEQ ID NO: 757491 - RNA, 24 nt, Human
ugccucagccucccaguuagcugg

SEQ ID NO: 757492 - RNA, 18 nt, Human
ugccuguggcuaaggcaa

SEQ ID NO: 757493 - RNA, 19 nt, Human
ugcuggagagaaagcuggg

SEQ ID NO: 757494 - RNA, 18 nt, Human
uggagacacaaguggugg

SEQ ID NO: 757495 - RNA, 22 nt, Human
uggaggccugcacccuacuccu

SEQ ID NO: 757496 - RNA, 22 nt, Human
uggaggggguggugucuugagc

SEQ ID NO: 757497 - RNA, 19 nt, Human
uggagugcagugucgcgau

SEQ ID NO: 757498 - RNA, 19 nt, Human
uggcucgggaggaagacag

SEQ ID NO: 757499 - RNA, 21 nt, Human
ugggacuacaggcaugcgcca

SEQ ID NO: 757500 - RNA, 22 nt, Human
ugggacuacaggcaugcgccac

SEQ ID NO: 757501 - RNA, 23 nt, Human
ugggacuacaggcaugcgccacc

SEQ ID NO: 757502 - RNA, 24 nt, Human
ugggacuacaggcaugcgccaccg

SEQ ID NO: 757503 - RNA, 21 nt, Human
ugggagggcagggacuggccc

SEQ ID NO: 757504 - RNA, 20 nt, Human
ugggcucaagugauccuccu

SEQ ID NO: 757505 - RNA, 24 nt, Human
ugggcucaagugauccuccugccu

SEQ ID NO: 757506 - RNA, 30 nt, Human
uucaaagcuugcacacacgcacacacacag

SEQ ID NO: 757507 - RNA, 23 nt, Human
uuccugccccucagcagccacaa

SEQ ID NO: 757508 - RNA, 22 nt, Human
uuccugggucccugaggguucc

SEQ ID NO: 757509 - RNA, 20 nt, Human
uuggaagcucuagagacaau

SEQ ID NO: 757510 - RNA, 22 nt, Human
uuuggaagcugaguuccugggu

SEQ ID NO: 757511 - RNA, 25 nt, Human
aaaaaagggccuauaccauguagua

SEQ ID NO: 757512 - RNA, 25 nt, Human
aaacagugcaagaaaaaaauccaaa

SEQ ID NO: 757513 - RNA, 19 nt, Human
aaagaccaaggaaugcauu

SEQ ID NO: 757514 - RNA, 22 nt, Human
aaauguuagaaucuacaaagcu

SEQ ID NO: 757515 - RNA, 29 nt, Human
aagaaaaaaauccaaauaagcuuuuggaa

SEQ ID NO: 757516 - RNA, 18 nt, Human
aagaaaaaagggccuaua

SEQ ID NO: 757517 - RNA, 22 nt, Human
aagcaaccauguaacuuuugag

SEQ ID NO: 757518 - RNA, 23 nt, Human
aagcaaccauguaacuuuugagu

SEQ ID NO: 757519 - RNA, 22 nt, Human
aauaacaccacccaacaccucc

SEQ ID NO: 757520 - RNA, 22 nt, Human
aaucugggaggaacuugguugc

SEQ ID NO: 757521 - RNA, 24 nt, Human
aauuuucacaacucaguagucuua

SEQ ID NO: 757522 - RNA, 21 nt, Human
acauagcauuucaagccaugc

SEQ ID NO: 757523 - RNA, 20 nt, Human
acuaagaagcaguuuuucau

SEQ ID NO: 757524 - RNA, 22 nt, Human
acuguuauuuaggcaaagacca

SEQ ID NO: 757525 - RNA, 21 nt, Human
agcggcggaggagaacgcggc

SEQ ID NO: 757526 - RNA, 18 nt, Human
augcuugcuacauacagu

SEQ ID NO: 757527 - RNA, 22 nt, Human
caacagaugaaaaaugcuugcu

SEQ ID NO: 757528 - RNA, 20 nt, Human
caacgagacuacauauagca

SEQ ID NO: 757529 - RNA, 20 nt, Human
caagaaaaaaauccaaauaa

SEQ ID NO: 757530 - RNA, 22 nt, Human
caagaaaaaaauccaaauaagc

SEQ ID NO: 757531 - RNA, 23 nt, Human
cacaaaacagugcaagaaaaaaa

SEQ ID NO: 757532 - RNA, 24 nt, Human
cacagcagcacgagcucacaugga

SEQ ID NO: 757533 - RNA, 21 nt, Human
cacaguuacacuucuaauacc

SEQ ID NO: 757534 - RNA, 18 nt, Human
cacauggaagacugaaag

SEQ ID NO: 757535 - RNA, 21 nt, Human
caccacccaacaccuccuauc

SEQ ID NO: 757536 - RNA, 25 nt, Human
cauuucaagccaugcuauggucuau

SEQ ID NO: 757537 - RNA, 23 nt, Human
ccaaauaagcuuuuggagugcaa

SEQ ID NO: 757538 - RNA, 18 nt, Human
ccccgaagcggccggcuc

SEQ ID NO: 757539 - RNA, 18 nt, Human
ccggaggagcggcggagg

SEQ ID NO: 757540 - RNA, 22 nt, Human
ccggcggccagggccccgaagc

SEQ ID NO: 757541 - RNA, 23 nt, Human
ccuucucacguccgccccucccg

SEQ ID NO: 757542 - RNA, 19 nt, Human
cucuucugcagacuuuggc

SEQ ID NO: 757543 - RNA, 25 nt, Human
cuguaccaucaaguguugcaucaca

SEQ ID NO: 757544 - RNA, 20 nt, Human
cuucgugcuaaaccacuuuc

SEQ ID NO: 757545 - RNA, 24 nt, Human
gaagacaagugauaauacaauaug

SEQ ID NO: 757546 - RNA, 18 nt, Human
gaaucuacaaagcuguag

SEQ ID NO: 757547 - RNA, 22 nt, Human
gccggcggccagggccccgaag

SEQ ID NO: 757548 - RNA, 19 nt, Human
ggaauaacaccacccaaca

SEQ ID NO: 757549 - RNA, 20 nt, Human
ggcggccagggccccgaagc

SEQ ID NO: 757550 - RNA, 26 nt, Human
uaaacuaagaagcaguuuuucauuca

SEQ ID NO: 757551 - RNA, 25 nt, Human
uaagucucugugcuuuugcugcaua

SEQ ID NO: 757552 - RNA, 25 nt, Human
uauuauggaauucugaccucuagaa

SEQ ID NO: 757553 - RNA, 23 nt, Human
ucacagcagcacgagcucacaug

SEQ ID NO: 757554 - RNA, 18 nt, Human
ucccuggguuuaagaaaa

SEQ ID NO: 757555 - RNA, 21 nt, Human
ugaaauaauagcacaguuaca

SEQ ID NO: 757556 - RNA, 24 nt, Human
ugcaagaaaaaaauccaaauaagc

SEQ ID NO: 757557 - RNA, 20 nt, Human
ugcauucaaaaaacugaagu

SEQ ID NO: 757558 - RNA, 21 nt, Human
uggagugcacaccaacaacug

SEQ ID NO: 757559 - RNA, 19 nt, Human
uucaaaaaacugaaguuaa

SEQ ID NO: 757560 - RNA, 23 nt, Human
uucaucuuuaaacuccauaauga

SEQ ID NO: 757561 - RNA, 21 nt, Human
uuccuggacacuauguucuuc

SEQ ID NO: 757562 - RNA, 22 nt, Human
uuucauucaucuuuaaacucca

SEQ ID NO: 757563 - RNA, 18 nt, Human
uuuugagugacauauauu

SEQ ID NO: 757564 - RNA, 19 nt, Human
aaaaaaaaaaagcaucaag

SEQ ID NO: 757565 - RNA, 25 nt, Human
aaaaaagacauggaaacugccaaaa

SEQ ID NO: 757566 - RNA, 18 nt, Human
aaaaaauuccacccccca

SEQ ID NO: 757567 - RNA, 22 nt, Human
aaaaagaaaaaaggagagguaa

SEQ ID NO: 757568 - RNA, 26 nt, Human
aaacaaacaaacaaacaaacaaaccc

SEQ ID NO: 757569 - RNA, 22 nt, Human
aaacaaacaaacaaacaaaccc

SEQ ID NO: 757570 - RNA, 23 nt, Human
aaacaaacaaacaaacaaaccca

SEQ ID NO: 757571 - RNA, 18 nt, Human
aaacaaacaaacccacaa

SEQ ID NO: 757572 - RNA, 22 nt, Human
aaacaaacaaacccacaacaca

SEQ ID NO: 757573 - RNA, 24 nt, Human
aaacaguagucagaaagccaugca

SEQ ID NO: 757574 - RNA, 20 nt, Human
aaagaaaagaugggaaagaa

SEQ ID NO: 757575 - RNA, 18 nt, Human
aaagacauggaaacugcc

SEQ ID NO: 757576 - RNA, 22 nt, Human
aaagcugaaagcugcuaaaaag

SEQ ID NO: 757577 - RNA, 24 nt, Human
aaauugcugggauuacaggcguga

SEQ ID NO: 757578 - RNA, 26 nt, Human
aacaaacaaacaaacaaacaaaccca

SEQ ID NO: 757579 - RNA, 21 nt, Human
aacaaacccacaacacacuca

SEQ ID NO: 757580 - RNA, 20 nt, Human
aacacacucacacuaaccaa

SEQ ID NO: 757581 - RNA, 25 nt, Human
aacacacucacacuaaccaaggcua

SEQ ID NO: 757582 - RNA, 22 nt, Human
aacacaguuuggugguuagucu

SEQ ID NO: 757583 - RNA, 21 nt, Human
aacauuugguuuuuuccuccu

SEQ ID NO: 757584 - RNA, 19 nt, Human
aaccaaggcuagagagcac

SEQ ID NO: 757585 - RNA, 22 nt, Human
aaccagcuugcgaaaagaguuc

SEQ ID NO: 757586 - RNA, 22 nt, Human
aagaaaacaaagcacagcuuga

SEQ ID NO: 757587 - RNA, 19 nt, Human
aagaaaaccaagcaaaaau

SEQ ID NO: 757588 - RNA, 19 nt, Human
aagaagaaaacaaagcaca

SEQ ID NO: 757589 - RNA, 27 nt, Human
aagaagaaaacaaagcacagcuugaaa

SEQ ID NO: 757590 - RNA, 19 nt, Human
aagaagguuuuaguuuaga

SEQ ID NO: 757591 - RNA, 20 nt, Human
aagagaauaaggugggagag

SEQ ID NO: 757592 - RNA, 18 nt, Human
aagaugccaagcucaaaa

SEQ ID NO: 757593 - RNA, 27 nt, Human
aaggcaaaaggugagcaaaagggaccc

SEQ ID NO: 757594 - RNA, 24 nt, Human
aagugauccacuugccucggccuc

SEQ ID NO: 757595 - RNA, 19 nt, Human
aagugucccuacaaagagg

SEQ ID NO: 757596 - RNA, 18 nt, Human
acaaacaaacaaacaaac

SEQ ID NO: 757597 - RNA, 18 nt, Human
acaaacaaacaaacaaac

SEQ ID NO: 757598 - RNA, 21 nt, Human
acaaacaaacaaacccacaac

SEQ ID NO: 757599 - RNA, 30 nt, Human
acaaacccacaacacacucacacuaaccaa

SEQ ID NO: 757600 - RNA, 19 nt, Human
acaaagaagaaaacaaagc

SEQ ID NO: 757601 - RNA, 22 nt, Human
acacuaaccaaggcuagagagc

SEQ ID NO: 757602 - RNA, 18 nt, Human
acacuacuacucugagag

SEQ ID NO: 757603 - RNA, 21 nt, Human
accaaaaaaaaaaaaagcauc

SEQ ID NO: 757604 - RNA, 19 nt, Human
accaugggguauguugggg

SEQ ID NO: 757605 - RNA, 18 nt, Human
acuggguuucaucauguu

SEQ ID NO: 757606 - RNA, 19 nt, Human
acuggguuucaucauguug

SEQ ID NO: 757607 - RNA, 20 nt, Human
acuggguuucaucauguugg

SEQ ID NO: 757608 - RNA, 23 nt, Human
acuggguuucaucauguuggcca

SEQ ID NO: 757609 - RNA, 18 nt, Human
agaaaacaaagcacagcu

SEQ ID NO: 757610 - RNA, 19 nt, Human
agaaagccaugcagccuaa

SEQ ID NO: 757611 - RNA, 23 nt, Human
agacauggaaacugccaaaaaug

SEQ ID NO: 757612 - RNA, 23 nt, Human
agacuggguuucaucauguuggc

SEQ ID NO: 757613 - RNA, 22 nt, Human
agaggugugaucucagcucugc

SEQ ID NO: 757614 - RNA, 22 nt, Human
agccaugcagccuaaaauagcc

SEQ ID NO: 757615 - RNA, 24 nt, Human
agcgauucuccugccucagccucc

SEQ ID NO: 757616 - RNA, 21 nt, Human
agcugggaauacagaggccug

SEQ ID NO: 757617 - RNA, 21 nt, Human
aggcaguucuaugaacauuug

SEQ ID NO: 757618 - RNA, 22 nt, Human
agguuuuaguuuagaggaaagg

SEQ ID NO: 757619 - RNA, 19 nt, Human
agugcagaggugugaucuc

SEQ ID NO: 757620 - RNA, 23 nt, Human
auagaacaaagaagaaaacaaag

SEQ ID NO: 757621 - RNA, 24 nt, Human
auagaacaaagaagaaaacaaagc

SEQ ID NO: 757622 - RNA, 19 nt, Human
auagagcagucuccaggag

SEQ ID NO: 757623 - RNA, 24 nt, Human
augcagaauaaaauaaauagaccc

SEQ ID NO: 757624 - RNA, 24 nt, Human
caaaagaaaaccaagcaaaaauga

SEQ ID NO: 757625 - RNA, 21 nt, Human
caaaaggcaaaaggugagcaa

SEQ ID NO: 757626 - RNA, 23 nt, Human
caaacaaacaaacaaacccacaa

SEQ ID NO: 757627 - RNA, 21 nt, Human
caaacaaacaaacccacaaca

SEQ ID NO: 757628 - RNA, 21 nt, Human
caaacacuacuacucugagag

SEQ ID NO: 757629 - RNA, 24 nt, Human
caaauugcugggauuacaggcgug

SEQ ID NO: 757630 - RNA, 27 nt, Human
caacuacaucaaaaaccauagaacaaa

SEQ ID NO: 757631 - RNA, 18 nt, Human
caagaguucaaaugaaca

SEQ ID NO: 757632 - RNA, 22 nt, Human
caagcgauucuccugccucagc

SEQ ID NO: 757633 - RNA, 27 nt, Human
caagcgauucuccugccucagccuccc

SEQ ID NO: 757634 - RNA, 22 nt, Human
caagugauccacuugccucggc

SEQ ID NO: 757635 - RNA, 19 nt, Human
cacacacucacacacauau

SEQ ID NO: 757636 - RNA, 24 nt, Human
cacacaguccaacggaggaggcac

SEQ ID NO: 757637 - RNA, 24 nt, Human
cacacucacacacauauagggcca

SEQ ID NO: 757638 - RNA, 19 nt, Human
caccaugcacagaaagggu

SEQ ID NO: 757639 - RNA, 24 nt, Human
caccaugccuggcuaauuuuugua

SEQ ID NO: 757640 - RNA, 23 nt, Human
caccccccaccccauuuuuugga

SEQ ID NO: 757641 - RNA, 21 nt, Human
caccucaacuacaucaaaaac

SEQ ID NO: 757642 - RNA, 22 nt, Human
cagaauaaaauaaauagaccca

SEQ ID NO: 757643 - RNA, 23 nt, Human
cagcuugcgaaaagaguucaccu

SEQ ID NO: 757644 - RNA, 22 nt, Human
caggcaaagauuucgcuggaaa

SEQ ID NO: 757645 - RNA, 21 nt, Human
cagucuccaggaguauaaucc

SEQ ID NO: 757646 - RNA, 25 nt, Human
cagucuccaggaguauaaucccaua

SEQ ID NO: 757647 - RNA, 24 nt, Human
caucauguuggccacgcuggucuu

SEQ ID NO: 757648 - RNA, 22 nt, Human
cauggaaacugccaaaaauggc

SEQ ID NO: 757649 - RNA, 20 nt, Human
cauguuggccacgcuggucu

SEQ ID NO: 757650 - RNA, 20 nt, Human
cauguuggccacgcuggucu

SEQ ID NO: 757651 - RNA, 23 nt, Human
cauugagaacuuucugaacuuuc

SEQ ID NO: 757652 - RNA, 24 nt, Human
ccaaauagcugggaauacagaggc

SEQ ID NO: 757653 - RNA, 20 nt, Human
ccaaauugcugggauuacag

SEQ ID NO: 757654 - RNA, 22 nt, Human
ccaaauugcugggauuacaggc

SEQ ID NO: 757655 - RNA, 22 nt, Human
ccaaauugcugggauuacaggc

SEQ ID NO: 757656 - RNA, 24 nt, Human
ccaaauugcugggauuacaggcgu

SEQ ID NO: 757657 - RNA, 23 nt, Human
ccacaacacacucacacuaacca

SEQ ID NO: 757658 - RNA, 18 nt, Human
ccaccgcgcccggccucc

SEQ ID NO: 757659 - RNA, 23 nt, Human
ccagcaucaccauccgucaccuc

SEQ ID NO: 757660 - RNA, 18 nt, Human
ccaggcaguucuaugaac

SEQ ID NO: 757661 - RNA, 22 nt, Human
cccacaacacacucacacuaac

SEQ ID NO: 757662 - RNA, 24 nt, Human
cccacaacacacucacacuaacca

SEQ ID NO: 757663 - RNA, 20 nt, Human
cccaggcuggagugcagagg

SEQ ID NO: 757664 - RNA, 20 nt, Human
ccugaccucaagugauccac

SEQ ID NO: 757665 - RNA, 20 nt, Human
ccugaccucaagugauccac

SEQ ID NO: 757666 - RNA, 23 nt, Human
ccugaccucaagugauccacuug

SEQ ID NO: 757667 - RNA, 24 nt, Human
cgcucugucacccaggcuggagug

SEQ ID NO: 757668 - RNA, 19 nt, Human
cuacuuaccaugaugucuu

SEQ ID NO: 757669 - RNA, 23 nt, Human
cucaagugauccacuugccucgg

SEQ ID NO: 757670 - RNA, 25 nt, Human
cuccugccucagccucccaaauagc

SEQ ID NO: 757671 - RNA, 24 nt, Human
cucgcucugucacccaggcuggag

SEQ ID NO: 757672 - RNA, 25 nt, Human
cucucucucucuuacucucucucgu

SEQ ID NO: 757673 - RNA, 24 nt, Human
cucugcauauauuugaagaauccc

SEQ ID NO: 757674 - RNA, 23 nt, Human
cugccucagccucccaaauagcu

SEQ ID NO: 757675 - RNA, 24 nt, Human
cugccucccgaauucaagcgauuc

SEQ ID NO: 757676 - RNA, 24 nt, Human
cuggagugcagaggugugaucuca

SEQ ID NO: 757677 - RNA, 19 nt, Human
cuggguuucaucauguugg

SEQ ID NO: 757678 - RNA, 20 nt, Human
cuugccucggccucccaaau

SEQ ID NO: 757679 - RNA, 21 nt, Human
cuugccucggccucccaaauu

SEQ ID NO: 757680 - RNA, 20 nt, Human
gaaacugaucuuugagguug

SEQ ID NO: 757681 - RNA, 20 nt, Human
gaaagccaugcagccuaaaa

SEQ ID NO: 757682 - RNA, 24 nt, Human
gaagaaaacaaagcacagcuugaa

SEQ ID NO: 757683 - RNA, 25 nt, Human
gaaggcagacagaggcaaaggaagg

SEQ ID NO: 757684 - RNA, 24 nt, Human
gaccucaagugauccacuugccuc

SEQ ID NO: 757685 - RNA, 19 nt, Human
gaggcugacgggaagcaga

SEQ ID NO: 757686 - RNA, 23 nt, Human
gauggcaugagaaaaacuaggaa

SEQ ID NO: 757687 - RNA, 18 nt, Human
gauuacaggcgugagcca

SEQ ID NO: 757688 - RNA, 22 nt, Human
gauuacaggcgugagccaccgc

SEQ ID NO: 757689 - RNA, 22 nt, Human
gauuacaggcgugagccaccgc

SEQ ID NO: 757690 - RNA, 25 nt, Human
gcacagcuugaaaaggaagggaacc

SEQ ID NO: 757691 - RNA, 24 nt, Human
gcgauucuccugccucagccuccc

SEQ ID NO: 757692 - RNA, 25 nt, Human
gcucugucacccaggcuggagugca

SEQ ID NO: 757693 - RNA, 23 nt, Human
gcugacgggaagcagaggaggaa

SEQ ID NO: 757694 - RNA, 21 nt, Human
gcugcuaaaaagaaaaaagga

SEQ ID NO: 757695 - RNA, 19 nt, Human
gcuggagugcagaggugug

SEQ ID NO: 757696 - RNA, 23 nt, Human
gcuggucuugaacuccugaccuc

SEQ ID NO: 757697 - RNA, 21 nt, Human
ggaaaaaaaaauuccaccccc

SEQ ID NO: 757698 - RNA, 22 nt, Human
ggagaaagaauggaagguuacg

SEQ ID NO: 757699 - RNA, 22 nt, Human
ggcacacacucacacacauaua

SEQ ID NO: 757700 - RNA, 24 nt, Human
ggcagacagaggcaaaggaaggga

SEQ ID NO: 757701 - RNA, 23 nt, Human
gggaagcagaggaggaaaugaag

SEQ ID NO: 757702 - RNA, 20 nt, Human
ggguuucaucauguuggcca

SEQ ID NO: 757703 - RNA, 19 nt, Human
ggucuugaacuccugaccu

SEQ ID NO: 757704 - RNA, 18 nt, Human
guagucagaaagccaugc

SEQ ID NO: 757705 - RNA, 24 nt, Human
gugauccacuugccucggccuccc

SEQ ID NO: 757706 - RNA, 24 nt, Human
guggcacguuugcacugggugcuu

SEQ ID NO: 757707 - RNA, 23 nt, Human
uaaaaaauuuccagucgaggucc

SEQ ID NO: 757708 - RNA, 19 nt, Human
uaaaacaacaaaguagagu

SEQ ID NO: 757709 - RNA, 20 nt, Human
uaaaacaguagucagaaagc

SEQ ID NO: 757710 - RNA, 22 nt, Human
uaaaacaguagucagaaagcca

SEQ ID NO: 757711 - RNA, 20 nt, Human
uaaaauaaauagacccauua

SEQ ID NO: 757712 - RNA, 23 nt, Human
uaaaauagccagcaucaccaucc

SEQ ID NO: 757713 - RNA, 26 nt, Human
uaaccaaaaaaaaaaaaagcaucaag

SEQ ID NO: 757714 - RNA, 23 nt, Human
uaagaaaacaaacaaacaaacaa

SEQ ID NO: 757715 - RNA, 27 nt, Human
uaagaaaacaaacaaacaaacaaacaa

SEQ ID NO: 757716 - RNA, 19 nt, Human
uaagcgucuccauuuuuuc

SEQ ID NO: 757717 - RNA, 24 nt, Human
uaauuuuuguauuuuuaguagaga

SEQ ID NO: 757718 - RNA, 23 nt, Human
uacaggcgugagccaccgcgccc

SEQ ID NO: 757719 - RNA, 27 nt, Human
uacaucaaaaaccauagaacaaagaag

SEQ ID NO: 757720 - RNA, 24 nt, Human
uaccuaaccaaaaaaaaaaaaagc

SEQ ID NO: 757721 - RNA, 26 nt, Human
uagaacaaagaagaaaacaaagcaca

SEQ ID NO: 757722 - RNA, 23 nt, Human
uagccagcaucaccauccgucac

SEQ ID NO: 757723 - RNA, 24 nt, Human
uaguagagacuggguuucaucaug

SEQ ID NO: 757724 - RNA, 18 nt, Human
uaguuuagaggaaaggga

SEQ ID NO: 757725 - RNA, 20 nt, Human
ucaaaugaacacauuucuca

SEQ ID NO: 757726 - RNA, 21 nt, Human
ucaagugauccacuugccucg

SEQ ID NO: 757727 - RNA, 18 nt, Human
ucacccaggcuggagugc

SEQ ID NO: 757728 - RNA, 22 nt, Human
ucagagaaggcagacagaggca

SEQ ID NO: 757729 - RNA, 18 nt, Human
ucagaguguggugacagu

SEQ ID NO: 757730 - RNA, 20 nt, Human
ucagccucccaaauagcugg

SEQ ID NO: 757731 - RNA, 24 nt, Human
ucccaaauugcugggauuacaggc

SEQ ID NO: 757732 - RNA, 21 nt, Human
ucccgaauucaagcgauucuc

SEQ ID NO: 757733 - RNA, 24 nt, Human
ucccgaauucaagcgauucuccug

SEQ ID NO: 757734 - RNA, 24 nt, Human
ucgcucugucacccaggcuggagu

SEQ ID NO: 757735 - RNA, 26 nt, Human
ucuaacucugucuggcagaggcugag

SEQ ID NO: 757736 - RNA, 25 nt, Human
ucuaggaaggauagagcagucucca

SEQ ID NO: 757737 - RNA, 19 nt, Human
ucucgcucugucacccagg

SEQ ID NO: 757738 - RNA, 23 nt, Human
ucucgcucugucacccaggcugg

SEQ ID NO: 757739 - RNA, 24 nt, Human
ucucgcucugucacccaggcugga

SEQ ID NO: 757740 - RNA, 26 nt, Human
ucucgcucugucacccaggcuggagu

SEQ ID NO: 757741 - RNA, 27 nt, Human
ucucgcucugucacccaggcuggagug

SEQ ID NO: 757742 - RNA, 18 nt, Human
ucucuaaagauaccuuuu

SEQ ID NO: 757743 - RNA, 24 nt, Human
ucugucacccaggcuggagugcag

SEQ ID NO: 757744 - RNA, 21 nt, Human
ucuugaacuccugaccucaag

SEQ ID NO: 757745 - RNA, 19 nt, Human
ucuuucucucucucucucc

SEQ ID NO: 757746 - RNA, 23 nt, Human
ucuuuuuucagaguguggugaca

SEQ ID NO: 757747 - RNA, 20 nt, Human
ugaaaaggaacugauggcau

SEQ ID NO: 757748 - RNA, 19 nt, Human
ugaacuggguagguguggg

SEQ ID NO: 757749 - RNA, 21 nt, Human
ugaagucaucagagcuucaaa

SEQ ID NO: 757750 - RNA, 23 nt, Human
ugacaaacacuacuacucugaga

SEQ ID NO: 757751 - RNA, 19 nt, Human
ugaccucaagugauccacu

SEQ ID NO: 757752 - RNA, 20 nt, Human
ugaccucaagugauccacuu

SEQ ID NO: 757753 - RNA, 24 nt, Human
ugaccucaagugauccacuugccu

SEQ ID NO: 757754 - RNA, 19 nt, Human
ugagaaaaacuaggaaaua

SEQ ID NO: 757755 - RNA, 19 nt, Human
ugagaaaaacuaggaaaua

SEQ ID NO: 757756 - RNA, 22 nt, Human
ugagacggagucucgcucuguc

SEQ ID NO: 757757 - RNA, 22 nt, Human
ugagguugguaucucccagggc

SEQ ID NO: 757758 - RNA, 19 nt, Human
ugauggcaugagaaaaacu

SEQ ID NO: 757759 - RNA, 23 nt, Human
ugcacagaaaggguacccaaagc

SEQ ID NO: 757760 - RNA, 22 nt, Human
ugcagaggugugaucucagcuc

SEQ ID NO: 757761 - RNA, 21 nt, Human
ugcagccuaaaauagccagca

SEQ ID NO: 757762 - RNA, 29 nt, Human
ugcagccuaaaauagccagcaucaccauu

SEQ ID NO: 757763 - RNA, 18 nt, Human
ugcauuuuucauugagaa

SEQ ID NO: 757764 - RNA, 22 nt, Human
ugccaagcucaaaagaaaacca

SEQ ID NO: 757765 - RNA, 23 nt, Human
ugccaagcucaaaagaaaaccaa

SEQ ID NO: 757766 - RNA, 24 nt, Human
ugccucagccucccaaauagcugg

SEQ ID NO: 757767 - RNA, 21 nt, Human
ugccucggccucccaaauugc

SEQ ID NO: 757768 - RNA, 24 nt, Human
ugccucggccucccaaauugcugg

SEQ ID NO: 757769 - RNA, 24 nt, Human
ugcugggauuacaggcgugagcca

SEQ ID NO: 757770 - RNA, 20 nt, Human
uggaaaccagcuugcgaaaa

SEQ ID NO: 757771 - RNA, 19 nt, Human
uggagugcagaggugugau

SEQ ID NO: 757772 - RNA, 28 nt, Human
uggagugcagaggugugauggcucuagc

SEQ ID NO: 757773 - RNA, 19 nt, Human
uggauuuauuugugaacua

SEQ ID NO: 757774 - RNA, 24 nt, Human
uggccacgcuggucuugaacuccu

SEQ ID NO: 757775 - RNA, 24 nt, Human
ugggaauacagaggccugccacca

SEQ ID NO: 757776 - RNA, 18 nt, Human
ugggauuacaggcgugag

SEQ ID NO: 757777 - RNA, 19 nt, Human
ugggauuacaggcgugagc

SEQ ID NO: 757778 - RNA, 21 nt, Human
ugggauuacaggcgugagcca

SEQ ID NO: 757779 - RNA, 22 nt, Human
ugggauuacaggcgugagccac

SEQ ID NO: 757780 - RNA, 23 nt, Human
ugggauuacaggcgugagccacc

SEQ ID NO: 757781 - RNA, 24 nt, Human
ugggauuacaggcgugagccaccg

SEQ ID NO: 757782 - RNA, 28 nt, Human
ugggguauguuggggauugaccacuggg

SEQ ID NO: 757783 - RNA, 18 nt, Human
uggguuucaucauguugg

SEQ ID NO: 757784 - RNA, 24 nt, Human
ugguaagcaugcagaauaaaauaa

SEQ ID NO: 757785 - RNA, 24 nt, Human
ugguuuuuuccuccuuggaaaccu

SEQ ID NO: 757786 - RNA, 21 nt, Human
ugucacccaggcuggagugca

SEQ ID NO: 757787 - RNA, 19 nt, Human
ugucagggagcccuccagg

SEQ ID NO: 757788 - RNA, 21 nt, Human
uguuuugucagggagcccucc

SEQ ID NO: 757789 - RNA, 21 nt, Human
uuaguagagacuggguuucau

SEQ ID NO: 757790 - RNA, 24 nt, Human
uuaguagagacuggguuucaucau

SEQ ID NO: 757791 - RNA, 21 nt, Human
uucaagcgauucuccugccuc

SEQ ID NO: 757792 - RNA, 23 nt, Human
uucaagcgauucuccugccucag

SEQ ID NO: 757793 - RNA, 24 nt, Human
uucaagcgauucuccugccucagc

SEQ ID NO: 757794 - RNA, 23 nt, Human
uuggauuuauuugugaacuaguu

SEQ ID NO: 757795 - RNA, 23 nt, Human
uuuaagaaaacaaacaaacaaac

SEQ ID NO: 757796 - RNA, 21 nt, Human
uuucaucauguuggccacgcu

SEQ ID NO: 757797 - RNA, 24 nt, Human
uuuuuaguagagacuggguuucau

SEQ ID NO: 757798 - RNA, 19 nt, Human
uuuuucuuaguguuauacu

SEQ ID NO: 757799 - RNA, 20 nt, Human
uuuuuguauuuuuaguagag

SEQ ID NO: 757800 - RNA, 21 nt, Human
aaaccuaacaguuuaccagaa

SEQ ID NO: 757801 - RNA, 21 nt, Human
aaccggacaaaaagaggugau

SEQ ID NO: 757802 - RNA, 18 nt, Human
aagagauaaccggacaaa

SEQ ID NO: 757803 - RNA, 19 nt, Human
aagaugcccaaagauauac

SEQ ID NO: 757804 - RNA, 21 nt, Human
aauucagccagucuccaguug

SEQ ID NO: 757805 - RNA, 20 nt, Human
acacacuacccagcauggca

SEQ ID NO: 757806 - RNA, 22 nt, Human
agauauacaaaacaaacaauac

SEQ ID NO: 757807 - RNA, 24 nt, Human
agcaaaacagaacucucauuuuaa

SEQ ID NO: 757808 - RNA, 18 nt, Human
agcaaaugaaaacauagu

SEQ ID NO: 757809 - RNA, 23 nt, Human
agcaaucuugagugggguguuua

SEQ ID NO: 757810 - RNA, 18 nt, Human
agccuaugacaaauaacu

SEQ ID NO: 757811 - RNA, 24 nt, Human
agcuagcuuuuuggagcaacacaa

SEQ ID NO: 757812 - RNA, 23 nt, Human
aggagaaauacagcaaaacagaa

SEQ ID NO: 757813 - RNA, 23 nt, Human
aggcagaagcacuaggccagugc

SEQ ID NO: 757814 - RNA, 23 nt, Human
agucuauuuguccucugcuuguu

SEQ ID NO: 757815 - RNA, 18 nt, Human
agugcacaacucugcuac

SEQ ID NO: 757816 - RNA, 21 nt, Human
auaaaaaaggugaguagcccu

SEQ ID NO: 757817 - RNA, 25 nt, Human
auaaaacacuuaaugaaaaauuuuc

SEQ ID NO: 757818 - RNA, 21 nt, Human
auaaaauauacugaaccaaua

SEQ ID NO: 757819 - RNA, 20 nt, Human
auauaaagaaaugaagacua

SEQ ID NO: 757820 - RNA, 21 nt, Human
aucaucaauagccuaugacaa

SEQ ID NO: 757821 - RNA, 20 nt, Human
auggauuuauguuugcaaac

SEQ ID NO: 757822 - RNA, 25 nt, Human
caaaacagaacucucauuuuaaaau

SEQ ID NO: 757823 - RNA, 20 nt, Human
caacucugcuacaacgagau

SEQ ID NO: 757824 - RNA, 19 nt, Human
cacaaugcugagaaagugc

SEQ ID NO: 757825 - RNA, 22 nt, Human
caccauuauuuaagccugcacu

SEQ ID NO: 757826 - RNA, 21 nt, Human
cacguaguuggggagcagggg

SEQ ID NO: 757827 - RNA, 21 nt, Human
cagcaaaacagaacucucauu

SEQ ID NO: 757828 - RNA, 19 nt, Human
caguuuaccagaauuugua

SEQ ID NO: 757829 - RNA, 19 nt, Human
cauuauuuaagccugcacu

SEQ ID NO: 757830 - RNA, 23 nt, Human
ccaaagauauacaaaacaaacaa

SEQ ID NO: 757831 - RNA, 24 nt, Human
ccaagagucuucaaaaaugcuccu

SEQ ID NO: 757832 - RNA, 22 nt, Human
ccagaaccuacguuuaaccagg

SEQ ID NO: 757833 - RNA, 20 nt, Human
ccccugcaaccuauagaaac

SEQ ID NO: 757834 - RNA, 23 nt, Human
ccccugcaaccuauagaaacauu

SEQ ID NO: 757835 - RNA, 20 nt, Human
ccgcugaauacugaagaccc

SEQ ID NO: 757836 - RNA, 19 nt, Human
ccucucccuuuaaaauccc

SEQ ID NO: 757837 - RNA, 21 nt, Human
cuaggccagugcuuacugcuc

SEQ ID NO: 757838 - RNA, 20 nt, Human
cuggcccuuuacugcuaaaa

SEQ ID NO: 757839 - RNA, 20 nt, Human
cuuuauuucugcuaaucuga

SEQ ID NO: 757840 - RNA, 18 nt, Human
cuuuuccaaaucagacaa

SEQ ID NO: 757841 - RNA, 21 nt, Human
gacacuguuuucacaaucacu

SEQ ID NO: 757842 - RNA, 20 nt, Human
gauacacacuacccagcaug

SEQ ID NO: 757843 - RNA, 28 nt, Human
gcaaguccuucuagauaugugaaagaga

SEQ ID NO: 757844 - RNA, 19 nt, Human
gcuagacacaagaugccca

SEQ ID NO: 757845 - RNA, 19 nt, Human
ggguagaaauuccagcagc

SEQ ID NO: 757846 - RNA, 24 nt, Human
guaaggcaaaaaagcaguuccuuu

SEQ ID NO: 757847 - RNA, 19 nt, Human
guaguuggggagcaggggc

SEQ ID NO: 757848 - RNA, 23 nt, Human
guauauauauacaaguauauacu

SEQ ID NO: 757849 - RNA, 20 nt, Human
gugcuacccaucaacaucca

SEQ ID NO: 757850 - RNA, 21 nt, Human
uaaaagaaauaagaaagcuga

SEQ ID NO: 757851 - RNA, 20 nt, Human
uaaaagauuucccaaaauca

SEQ ID NO: 757852 - RNA, 24 nt, Human
uaaaccaucaauacccagaaauuu

SEQ ID NO: 757853 - RNA, 19 nt, Human
uaaagauaaacucucagac

SEQ ID NO: 757854 - RNA, 18 nt, Human
uaaagcucuuuauuucug

SEQ ID NO: 757855 - RNA, 19 nt, Human
uaagaucuguacuuaaccu

SEQ ID NO: 757856 - RNA, 21 nt, Human
uaagauuagcagugcuauucc

SEQ ID NO: 757857 - RNA, 19 nt, Human
uaagcugauaaggugaaac

SEQ ID NO: 757858 - RNA, 25 nt, Human
uacaaauuuuaaacacuuuuacaaa

SEQ ID NO: 757859 - RNA, 22 nt, Human
uacaacgagauacaugcuagag

SEQ ID NO: 757860 - RNA, 18 nt, Human
uacccaucaacauccaga

SEQ ID NO: 757861 - RNA, 18 nt, Human
uagaaaacacuacacaau

SEQ ID NO: 757862 - RNA, 23 nt, Human
uagaugcaauuagaaaacacuac

SEQ ID NO: 757863 - RNA, 22 nt, Human
uagcuagacacaagaugcccaa

SEQ ID NO: 757864 - RNA, 23 nt, Human
uagcuagcuuuuuggagcaacac

SEQ ID NO: 757865 - RNA, 23 nt, Human
uauaaagaaaugaagacuaugga

SEQ ID NO: 757866 - RNA, 23 nt, Human
uauauauauacaaguauauacug

SEQ ID NO: 757867 - RNA, 18 nt, Human
uauuuguccucugcuugu

SEQ ID NO: 757868 - RNA, 26 nt, Human
ucaacauccagaaccuacguuuaacc

SEQ ID NO: 757869 - RNA, 19 nt, Human
ucaucaauagccuaugaca

SEQ ID NO: 757870 - RNA, 19 nt, Human
ucccucaacauauaaaaga

SEQ ID NO: 757871 - RNA, 24 nt, Human
uccuuauaccaaagcaguaaggca

SEQ ID NO: 757872 - RNA, 21 nt, Human
ucuggcccuuuacugcuaaaa

SEQ ID NO: 757873 - RNA, 23 nt, Human
ucuuucuucuuuuauaaaucuuc

SEQ ID NO: 757874 - RNA, 23 nt, Human
ugaaagagaaaaaucauguaacc

SEQ ID NO: 757875 - RNA, 18 nt, Human
ugagaaagugcacaacuc

SEQ ID NO: 757876 - RNA, 19 nt, Human
ugagcauuggcacagucug

SEQ ID NO: 757877 - RNA, 22 nt, Human
ugauaaggugaaacaauaaugu

SEQ ID NO: 757878 - RNA, 24 nt, Human
ugcaagaaccuuugggcaccagcu

SEQ ID NO: 757879 - RNA, 23 nt, Human
ugcccaaagauauacaaaacaaa

SEQ ID NO: 757880 - RNA, 19 nt, Human
ugcucauguuuuucauccu

SEQ ID NO: 757881 - RNA, 18 nt, Human
ugcugugauuuuccuuua

SEQ ID NO: 757882 - RNA, 22 nt, Human
uggcacguaguuggggagcagg

SEQ ID NO: 757883 - RNA, 20 nt, Human
ugggcaccagcuagaguaua

SEQ ID NO: 757884 - RNA, 21 nt, Human
uguguaggaaaaccucucugg

SEQ ID NO: 757885 - RNA, 23 nt, Human
uguuugcaaacauuaauuuccuu

SEQ ID NO: 757886 - RNA, 30 nt, Human
uucuagcaugaaugugaaccaggcuucacu

SEQ ID NO: 757887 - RNA, 27 nt, Human
uuuauaaaucuucuggugcuaacugcc

SEQ ID NO: 757888 - RNA, 25 nt, Human
uuuaucaugcaauuugaccaagagu

SEQ ID NO: 757889 - RNA, 21 nt, Human
uuucuuuuuucagagcauggu

SEQ ID NO: 757890 - RNA, 23 nt, Human
uuugcaagaaccuuugggcacca

SEQ ID NO: 757891 - RNA, 22 nt, Human
uuuucuagcaugaaugugaacc

SEQ ID NO: 757892 - RNA, 24 nt, Human
aaaacuccacugguaaauagaaca

SEQ ID NO: 757893 - RNA, 19 nt, Human
aaaauccuuaaaugaagcu

SEQ ID NO: 757894 - RNA, 22 nt, Human
aaaauguaggaaucaagcauga

SEQ ID NO: 757895 - RNA, 24 nt, Human
aaauauuaacagcauucgugagcc

SEQ ID NO: 757896 - RNA, 21 nt, Human
aagaagaaaauauuaaauggg

SEQ ID NO: 757897 - RNA, 22 nt, Human
aagaagaaaauauuaaaugggg

SEQ ID NO: 757898 - RNA, 19 nt, Human
agacccaacaaaauguagg

SEQ ID NO: 757899 - RNA, 18 nt, Human
agauuggauaugaucuaa

SEQ ID NO: 757900 - RNA, 20 nt, Human
agucugacuuuuucugguuu

SEQ ID NO: 757901 - RNA, 22 nt, Human
agucugacuuuuucugguuugg

SEQ ID NO: 757902 - RNA, 22 nt, Human
agugaaacgcaaccacugcaga

SEQ ID NO: 757903 - RNA, 22 nt, Human
auaaaaagagucuucuguuuuu

SEQ ID NO: 757904 - RNA, 23 nt, Human
auccccuuguaccccucccacug

SEQ ID NO: 757905 - RNA, 30 nt, Human
auuuuucuuauccccuuguaccccucccaa

SEQ ID NO: 757906 - RNA, 23 nt, Human
caagacucuaaaauguugggaga

SEQ ID NO: 757907 - RNA, 19 nt, Human
cagaaaaacuccacuggua

SEQ ID NO: 757908 - RNA, 21 nt, Human
caggaucuccaaauggauuua

SEQ ID NO: 757909 - RNA, 21 nt, Human
ccacagggcuuguuucuggcu

SEQ ID NO: 757910 - RNA, 18 nt, Human
ccucugaggaaagcagag

SEQ ID NO: 757911 - RNA, 19 nt, Human
ccuucaaaccacagggcuu

SEQ ID NO: 757912 - RNA, 21 nt, Human
cgaacaguuucuugaacaccu

SEQ ID NO: 757913 - RNA, 20 nt, Human
cgcaaccacugcagaaaaac

SEQ ID NO: 757914 - RNA, 18 nt, Human
cuaugcuaaagaagaaaa

SEQ ID NO: 757915 - RNA, 19 nt, Human
cuccacugguaaauagaac

SEQ ID NO: 757916 - RNA, 21 nt, Human
cuuauccccuuguaccccucc

SEQ ID NO: 757917 - RNA, 26 nt, Human
cuuuauggucacaaaugcuucuggcu

SEQ ID NO: 757918 - RNA, 21 nt, Human
gaaaaaaaucaugacauuuuu

SEQ ID NO: 757919 - RNA, 18 nt, Human
gaaaggagggaggaaaag

SEQ ID NO: 757920 - RNA, 18 nt, Human
gaaaggagggaggaaaag

SEQ ID NO: 757921 - RNA, 19 nt, Human
gaaaggagggaggaaaagg

SEQ ID NO: 757922 - RNA, 19 nt, Human
gcaaccacugcagaaaaac

SEQ ID NO: 757923 - RNA, 20 nt, Human
ggaggaaaagggugguggug

SEQ ID NO: 757924 - RNA, 24 nt, Human
ggaggaaaagggugguggugguaa

SEQ ID NO: 757925 - RNA, 21 nt, Human
guaguacaauccagccaaaca

SEQ ID NO: 757926 - RNA, 19 nt, Human
uaaaaagagucuucuguuu

SEQ ID NO: 757927 - RNA, 21 nt, Human
uaacagcauucgugagccaau

SEQ ID NO: 757928 - RNA, 19 nt, Human
uaacucacaaaaaaauccu

SEQ ID NO: 757929 - RNA, 20 nt, Human
uacaauccagccaaacaaaa

SEQ ID NO: 757930 - RNA, 23 nt, Human
uauuuggaaaggagggaggaaaa

SEQ ID NO: 757931 - RNA, 26 nt, Human
uauuuggaaaggagggaggaaaaggg

SEQ ID NO: 757932 - RNA, 23 nt, Human
ucaaauacuguggagucugcacc

SEQ ID NO: 757933 - RNA, 20 nt, Human
ucaauuagucccauccucac

SEQ ID NO: 757934 - RNA, 26 nt, Human
ugacagugcuaugcuaaagaagaaaa

SEQ ID NO: 757935 - RNA, 23 nt, Human
ugagagaaaauaacgagggaagu

SEQ ID NO: 757936 - RNA, 25 nt, Human
ugagagaaaauaacgagggaagugu

SEQ ID NO: 757937 - RNA, 19 nt, Human
ugaggaaagcagaggagag

SEQ ID NO: 757938 - RNA, 21 nt, Human
uggaaaggagggaggaaaagg

SEQ ID NO: 757939 - RNA, 19 nt, Human
uggcaggaccggaaaaaaa

SEQ ID NO: 757940 - RNA, 19 nt, Human
uggugcauaucaauuaguc

SEQ ID NO: 757941 - RNA, 27 nt, Human
uguaccccucccacugucauuaugcua

SEQ ID NO: 757942 - RNA, 24 nt, Human
uuucuuauccccuuguaccccucc

SEQ ID NO: 757943 - RNA, 28 nt, Human
aaacaaaaauaaagcaccaggguucuga

SEQ ID NO: 757944 - RNA, 19 nt, Human
aagcaccaggguucugagc

SEQ ID NO: 757945 - RNA, 19 nt, Human
acaaaaauaaagcaccagg

SEQ ID NO: 757946 - RNA, 19 nt, Human
acaaaagauuaaaacaaaa

SEQ ID NO: 757947 - RNA, 20 nt, Human
agcaccaggguucugagcag

SEQ ID NO: 757948 - RNA, 26 nt, Human
auacacuauuugcagaauaggaaaau

SEQ ID NO: 757949 - RNA, 24 nt, Human
cacuauuugcagaauaggaaaauc

SEQ ID NO: 757950 - RNA, 24 nt, Human
cagaaauaguguaaaugcucuuga

SEQ ID NO: 757951 - RNA, 20 nt, Human
cagaauacuucaggaaacca

SEQ ID NO: 757952 - RNA, 20 nt, Human
gcagaaauaguguaaaugcu

SEQ ID NO: 757953 - RNA, 22 nt, Human
gcagaaauaguguaaaugcucu

SEQ ID NO: 757954 - RNA, 23 nt, Human
uaacauguuucuuuggaaaaaug

SEQ ID NO: 757955 - RNA, 20 nt, Human
uaaggugaguauaucagcaa

SEQ ID NO: 757956 - RNA, 18 nt, Human
uaggaaaaucaucacugg

SEQ ID NO: 757957 - RNA, 18 nt, Human
ugaguggaagagaagcug

SEQ ID NO: 757958 - RNA, 22 nt, Human
ugcagaauaggaaaaucaucac

SEQ ID NO: 757959 - RNA, 24 nt, Human
uggcaacaaaagauuaaaacaaaa

SEQ ID NO: 757960 - RNA, 22 nt, Human
aaaaaaaagaaaaaaaggaaag

SEQ ID NO: 757961 - RNA, 20 nt, Human
aaaaaacaaccccaacccca

SEQ ID NO: 757962 - RNA, 22 nt, Human
aaaaaagaaacacaaaaaaaaa

SEQ ID NO: 757963 - RNA, 26 nt, Human
aaaaaagaaacacaaaaaaaagaaaa

SEQ ID NO: 757964 - RNA, 22 nt, Human
aaaaacguauuuucuucuguuc

SEQ ID NO: 757965 - RNA, 21 nt, Human
aaaacaaaacagggaugcaga

SEQ ID NO: 757966 - RNA, 20 nt, Human
aaaauaccauaaauucguua

SEQ ID NO: 757967 - RNA, 24 nt, Human
aaacguugaagaucacacgaaaaa

SEQ ID NO: 757968 - RNA, 24 nt, Human
aaagugcugggauuacaggcguga

SEQ ID NO: 757969 - RNA, 24 nt, Human
aaagugcugggauuacaggcguga

SEQ ID NO: 757970 - RNA, 21 nt, Human
aacagagaaagaaaaaagaaa

SEQ ID NO: 757971 - RNA, 18 nt, Human
aagaaaaaaaaagaaaaa

SEQ ID NO: 757972 - RNA, 19 nt, Human
aagaaaacagagaaagaaa

SEQ ID NO: 757973 - RNA, 20 nt, Human
aagaaaacagagaaagaaaa

SEQ ID NO: 757974 - RNA, 20 nt, Human
aagaaacacaaaaaaaagag

SEQ ID NO: 757975 - RNA, 24 nt, Human
aagccgcuggaauuacaggcaugc

SEQ ID NO: 757976 - RNA, 19 nt, Human
aagugcugggauuacaggc

SEQ ID NO: 757977 - RNA, 19 nt, Human
aagugcugggauuacaggc

SEQ ID NO: 757978 - RNA, 19 nt, Human
aagugcugggauuacaggc

SEQ ID NO: 757979 - RNA, 19 nt, Human
aagugcugggauuacaggc

SEQ ID NO: 757980 - RNA, 26 nt, Human
aagugcugggauuacaggcgugagcc

SEQ ID NO: 757981 - RNA, 26 nt, Human
aagugcugggauuacaggcgugagcc

SEQ ID NO: 757982 - RNA, 21 nt, Human
aaguucaagugauucuccugc

SEQ ID NO: 757983 - RNA, 22 nt, Human
aaguucaagugauucuccugcc

SEQ ID NO: 757984 - RNA, 23 nt, Human
aauaucucaaacuauuccugguu

SEQ ID NO: 757985 - RNA, 21 nt, Human
aaucauuuccccacuaauaaa

SEQ ID NO: 757986 - RNA, 19 nt, Human
aaugcaguggugugaucuc

SEQ ID NO: 757987 - RNA, 20 nt, Human
aaugcaguggugugaucucg

SEQ ID NO: 757988 - RNA, 24 nt, Human
aauuacaggcaugcaccaccaugc

SEQ ID NO: 757989 - RNA, 24 nt, Human
aauuacaggcgcccaccaccaugc

SEQ ID NO: 757990 - RNA, 22 nt, Human
acaaccccaaccccauccccgc

SEQ ID NO: 757991 - RNA, 21 nt, Human
acacaaaaaaaagaaaaaaaa

SEQ ID NO: 757992 - RNA, 22 nt, Human
acacgaaaaacagcaccagcau

SEQ ID NO: 757993 - RNA, 21 nt, Human
acaggcaaagaauaaaauauc

SEQ ID NO: 757994 - RNA, 23 nt, Human
accaguucugggagagagagacc

SEQ ID NO: 757995 - RNA, 18 nt, Human
acgggguuucaccguguu

SEQ ID NO: 757996 - RNA, 19 nt, Human
acgggguuucaccguguua

SEQ ID NO: 757997 - RNA, 20 nt, Human
acgggguuucaccguguuag

SEQ ID NO: 757998 - RNA, 24 nt, Human
acuauguuggccaagcuggucuug

SEQ ID NO: 757999 - RNA, 25 nt, Human
acucuagugcccaggcuggaaugca

SEQ ID NO: 758000 - RNA, 22 nt, Human
agaaaagaaguuaagaaaagaa

SEQ ID NO: 758001 - RNA, 20 nt, Human
agaaauaauccaaaacaaaa

SEQ ID NO: 758002 - RNA, 19 nt, Human
agacagagucucacucuag

SEQ ID NO: 758003 - RNA, 18 nt, Human
agccaaaucccuucucug

SEQ ID NO: 758004 - RNA, 18 nt, Human
agccaccgugcccagccc

SEQ ID NO: 758005 - RNA, 23 nt, Human
agcuggucuugaacuccugaccu

SEQ ID NO: 758006 - RNA, 20 nt, Human
aggcaugcaccaccaugccc

SEQ ID NO: 758007 - RNA, 23 nt, Human
agggaugcagaucugucagaauu

SEQ ID NO: 758008 - RNA, 24 nt, Human
aggugaucugcccaccucggccuc

SEQ ID NO: 758009 - RNA, 24 nt, Human
agguuauccgcccaccuuggccuc

SEQ ID NO: 758010 - RNA, 20 nt, Human
aguagagacgggguuucacc

SEQ ID NO: 758011 - RNA, 18 nt, Human
aguagcuggaauuacagg

SEQ ID NO: 758012 - RNA, 25 nt, Human
aguaguaaaauacaaauaaaacuuu

SEQ ID NO: 758013 - RNA, 18 nt, Human
agugcugggauuacaggc

SEQ ID NO: 758014 - RNA, 18 nt, Human
agugcugggauuacaggc

SEQ ID NO: 758015 - RNA, 19 nt, Human
auagagaaaaaacaacccc

SEQ ID NO: 758016 - RNA, 22 nt, Human
aucccaaacuccagcccugugg

SEQ ID NO: 758017 - RNA, 22 nt, Human
aucugcagcauaagccaccaag

SEQ ID NO: 758018 - RNA, 24 nt, Human
augagacagcauuuuccaaaacag

SEQ ID NO: 758019 - RNA, 22 nt, Human
auggcuaugagaccaaugugcc

SEQ ID NO: 758020 - RNA, 18 nt, Human
augggauuucacuauguu

SEQ ID NO: 758021 - RNA, 20 nt, Human
augggauuucacuauguugg

SEQ ID NO: 758022 - RNA, 18 nt, Human
auucuccugccucagccu

SEQ ID NO: 758023 - RNA, 24 nt, Human
auuuuucuauuuuuaguagagacg

SEQ ID NO: 758024 - RNA, 22 nt, Human
caaaaucuguaaugccaagaaa

SEQ ID NO: 758025 - RNA, 24 nt, Human
caaagugcugggauuacaggcgug

SEQ ID NO: 758026 - RNA, 24 nt, Human
caaagugcugggauuacaggcgug

SEQ ID NO: 758027 - RNA, 23 nt, Human
caaccuccaccucccaaguucaa

SEQ ID NO: 758028 - RNA, 22 nt, Human
caagugauucuccugccucagc

SEQ ID NO: 758029 - RNA, 23 nt, Human
caccaccaugcccagcuuaauuu

SEQ ID NO: 758030 - RNA, 22 nt, Human
caccagaaccauguaagaaaac

SEQ ID NO: 758031 - RNA, 23 nt, Human
caccaugcccgcuaguuuuugua

SEQ ID NO: 758032 - RNA, 23 nt, Human
cacccaaaaacguugaagaucac

SEQ ID NO: 758033 - RNA, 20 nt, Human
caccccaauuaaaaaacaca

SEQ ID NO: 758034 - RNA, 21 nt, Human
caccguguuagccacgcuggu

SEQ ID NO: 758035 - RNA, 24 nt, Human
caccguguuagccacgcuggucuc

SEQ ID NO: 758036 - RNA, 24 nt, Human
caccucggccucccaaagugcugg

SEQ ID NO: 758037 - RNA, 22 nt, Human
caccuggaaaaggcugaccagg

SEQ ID NO: 758038 - RNA, 21 nt, Human
cacuauguuggccaagcuggu

SEQ ID NO: 758039 - RNA, 24 nt, Human
cacuauguuggccaagcuggucuu

SEQ ID NO: 758040 - RNA, 21 nt, Human
cacugcaaccuccaccuccca

SEQ ID NO: 758041 - RNA, 18 nt, Human
cacugcaaccucugccuc

SEQ ID NO: 758042 - RNA, 21 nt, Human
cacugcaaccucugccuccca

SEQ ID NO: 758043 - RNA, 25 nt, Human
cagaaauaauccaaaacaaaacagg

SEQ ID NO: 758044 - RNA, 19 nt, Human
cagcaccagcaucagcaaa

SEQ ID NO: 758045 - RNA, 26 nt, Human
cagcaucagcaaaugugaauccacca

SEQ ID NO: 758046 - RNA, 21 nt, Human
caggcgcccaccaccaugccc

SEQ ID NO: 758047 - RNA, 20 nt, Human
cauccagaauggcaucuguu

SEQ ID NO: 758048 - RNA, 25 nt, Human
caugcccgcuaguuuuuguauuuuu

SEQ ID NO: 758049 - RNA, 21 nt, Human
cauguaagaaaacagagaaag

SEQ ID NO: 758050 - RNA, 22 nt, Human
ccaaagugcugggauuacaggc

SEQ ID NO: 758051 - RNA, 22 nt, Human
ccaaagugcugggauuacaggc

SEQ ID NO: 758052 - RNA, 22 nt, Human
ccaaagugcugggauuacaggc

SEQ ID NO: 758053 - RNA, 22 nt, Human
ccaaagugcugggauuacaggc

SEQ ID NO: 758054 - RNA, 24 nt, Human
ccaaagugcugggauuacaggcgu

SEQ ID NO: 758055 - RNA, 24 nt, Human
ccaaagugcugggauuacaggcgu

SEQ ID NO: 758056 - RNA, 24 nt, Human
ccaagccgcuggaauuacaggcau

SEQ ID NO: 758057 - RNA, 24 nt, Human
ccaccucccaaguucaagugauuc

SEQ ID NO: 758058 - RNA, 19 nt, Human
ccacugcaaccuccaccuc

SEQ ID NO: 758059 - RNA, 27 nt, Human
ccacugcaaccuccaccucccaaguuc

SEQ ID NO: 758060 - RNA, 19 nt, Human
ccagcuauauccaacaguu

SEQ ID NO: 758061 - RNA, 24 nt, Human
cccacugcaaccuccaccucccaa

SEQ ID NO: 758062 - RNA, 20 nt, Human
cccaggcuggaaugcagugg

SEQ ID NO: 758063 - RNA, 19 nt, Human
ccccaaccccauccccgcc

SEQ ID NO: 758064 - RNA, 22 nt, Human
ccccaaccccauccccgccaag

SEQ ID NO: 758065 - RNA, 24 nt, Human
ccccagagucuuguuaaaucaaau

SEQ ID NO: 758066 - RNA, 20 nt, Human
ccgugcccagcccaaaagua

SEQ ID NO: 758067 - RNA, 24 nt, Human
ccucccaaguucaagugauucucc

SEQ ID NO: 758068 - RNA, 24 nt, Human
ccucccagguugaagcgauucucc

SEQ ID NO: 758069 - RNA, 24 nt, Human
ccugaccuuaggugaucugcccac

SEQ ID NO: 758070 - RNA, 23 nt, Human
ccugaguagcuggaauuacaggc

SEQ ID NO: 758071 - RNA, 24 nt, Human
ccugccucagccuuccaagccgcu

SEQ ID NO: 758072 - RNA, 21 nt, Human
cgcuggaauuacaggcaugca

SEQ ID NO: 758073 - RNA, 19 nt, Human
cgggguuucaccguguuag

SEQ ID NO: 758074 - RNA, 24 nt, Human
cucacugcaaccucugccucccag

SEQ ID NO: 758075 - RNA, 24 nt, Human
cucacugcaaccucugccucccag

SEQ ID NO: 758076 - RNA, 24 nt, Human
cucagguuauccgcccaccuuggc

SEQ ID NO: 758077 - RNA, 24 nt, Human
cuccugccucaacccccugaguag

SEQ ID NO: 758078 - RNA, 23 nt, Human
cuccugccucagccuuccaagcc

SEQ ID NO: 758079 - RNA, 23 nt, Human
cugcaaccuccaccucccaaguu

SEQ ID NO: 758080 - RNA, 24 nt, Human
cugcaaccuccaccucccaaguuc

SEQ ID NO: 758081 - RNA, 23 nt, Human
cugcaaccucugccucccagguu

SEQ ID NO: 758082 - RNA, 23 nt, Human
cugccucaacccccugaguagcu

SEQ ID NO: 758083 - RNA, 21 nt, Human
cuuccaagccgcuggaauuac

SEQ ID NO: 758084 - RNA, 20 nt, Human
gaaaaacagcaccagcaucg

SEQ ID NO: 758085 - RNA, 22 nt, Human
gaaucugcagcauaagccacca

SEQ ID NO: 758086 - RNA, 24 nt, Human
gaccucagguuauccgcccaccuu

SEQ ID NO: 758087 - RNA, 24 nt, Human
gaccuuaggugaucugcccaccuc

SEQ ID NO: 758088 - RNA, 24 nt, Human
gagaaagaaaaaagaaacacaaaa

SEQ ID NO: 758089 - RNA, 24 nt, Human
gagacgggguuucaccguguuagc

SEQ ID NO: 758090 - RNA, 25 nt, Human
gaguagcuggaauuacaggcgccca

SEQ ID NO: 758091 - RNA, 25 nt, Human
gagucucacucuagugcccaggcug

SEQ ID NO: 758092 - RNA, 18 nt, Human
gauuacaggcgugagcca

SEQ ID NO: 758093 - RNA, 18 nt, Human
gauuacaggcgugagcca

SEQ ID NO: 758094 - RNA, 19 nt, Human
gauuacaggcgugagccac

SEQ ID NO: 758095 - RNA, 21 nt, Human
gauuacaggcgugagccaccg

SEQ ID NO: 758096 - RNA, 24 nt, Human
gauuacaggcgugagccaccgugc

SEQ ID NO: 758097 - RNA, 22 nt, Human
gauuacaggcgugagccacugc

SEQ ID NO: 758098 - RNA, 19 nt, Human
gauucuccugccucagccu

SEQ ID NO: 758099 - RNA, 21 nt, Human
gcaaccucugccucccagguu

SEQ ID NO: 758100 - RNA, 21 nt, Human
gcaguggucugaucuuggcuc

SEQ ID NO: 758101 - RNA, 21 nt, Human
gcucacugcaaccucugccuc

SEQ ID NO: 758102 - RNA, 21 nt, Human
gcucagcucccaauauaaagc

SEQ ID NO: 758103 - RNA, 25 nt, Human
gcucuauugcccaggcuggagggca

SEQ ID NO: 758104 - RNA, 23 nt, Human
gcuggucucaaacuccugaccuc

SEQ ID NO: 758105 - RNA, 23 nt, Human
ggagucuugcucuauugcccagg

SEQ ID NO: 758106 - RNA, 22 nt, Human
ggauuucacuauguuggccaag

SEQ ID NO: 758107 - RNA, 22 nt, Human
ggcuggaaugcaguggugugau

SEQ ID NO: 758108 - RNA, 18 nt, Human
gggauuucacuauguugg

SEQ ID NO: 758109 - RNA, 18 nt, Human
gggguuucaccguguuag

SEQ ID NO: 758110 - RNA, 21 nt, Human
gguccagaugguucccagcac

SEQ ID NO: 758111 - RNA, 19 nt, Human
ggucuugaacuccugaccu

SEQ ID NO: 758112 - RNA, 23 nt, Human
guagagacgggguuucaccgugu

SEQ ID NO: 758113 - RNA, 24 nt, Human
gucuugcucuauugcccaggcugg

SEQ ID NO: 758114 - RNA, 22 nt, Human
gugagccaccgugcccagccca

SEQ ID NO: 758115 - RNA, 24 nt, Human
gugaucugcccaccucggccuccc

SEQ ID NO: 758116 - RNA, 24 nt, Human
gugauucuccugccucagccuucc

SEQ ID NO: 758117 - RNA, 23 nt, Human
gugccugaaggugccagcuuugg

SEQ ID NO: 758118 - RNA, 19 nt, Human
gugguuguuaaggaacccc

SEQ ID NO: 758119 - RNA, 20 nt, Human
guuauaaggggagguguggc

SEQ ID NO: 758120 - RNA, 21 nt, Human
guuuucucugacccagcugaa

SEQ ID NO: 758121 - RNA, 24 nt, Human
guuuuuguauuuuuaguagagaug

SEQ ID NO: 758122 - RNA, 20 nt, Human
uaaaauaucccauguaccuc

SEQ ID NO: 758123 - RNA, 22 nt, Human
uaacuucugcaaagguccagau

SEQ ID NO: 758124 - RNA, 20 nt, Human
uaagaaaagaaaaaaacgua

SEQ ID NO: 758125 - RNA, 23 nt, Human
uaauuuuucuauuuuuaguagag

SEQ ID NO: 758126 - RNA, 24 nt, Human
uaauuuuucuauuuuuaguagaga

SEQ ID NO: 758127 - RNA, 24 nt, Human
uacaggcaugcaccaccaugccca

SEQ ID NO: 758128 - RNA, 24 nt, Human
uacaggcgugagccaccgugccca

SEQ ID NO: 758129 - RNA, 19 nt, Human
uacaggcgugagccacugc

SEQ ID NO: 758130 - RNA, 23 nt, Human
uacaggcgugagccacugcgccc

SEQ ID NO: 758131 - RNA, 23 nt, Human
uagagaaaaaacaaccccaaccc

SEQ ID NO: 758132 - RNA, 22 nt, Human
uagagaugggauuucacuaugu

SEQ ID NO: 758133 - RNA, 20 nt, Human
uagcuggaauuacaggcgcc

SEQ ID NO: 758134 - RNA, 21 nt, Human
uaguagagacgggguuucacc

SEQ ID NO: 758135 - RNA, 24 nt, Human
uaguagagacgggguuucaccgug

SEQ ID NO: 758136 - RNA, 25 nt, Human
uaguagagacgggguuucaccgugu

SEQ ID NO: 758137 - RNA, 26 nt, Human
uaguagagacgggguuucaccguugg

SEQ ID NO: 758138 - RNA, 24 nt, Human
uaguagagaugggauuucacuaug

SEQ ID NO: 758139 - RNA, 24 nt, Human
uaguuuuuguauuuuuaguagaga

SEQ ID NO: 758140 - RNA, 25 nt, Human
uauccaggauccagcuauauccaac

SEQ ID NO: 758141 - RNA, 24 nt, Human
uauguuggccaagcuggucuugaa

SEQ ID NO: 758142 - RNA, 23 nt, Human
uauuuauuuaugagauggagucu

SEQ ID NO: 758143 - RNA, 19 nt, Human
ucaaaacucuguuccacug

SEQ ID NO: 758144 - RNA, 18 nt, Human
ucaagugauucuccugcc

SEQ ID NO: 758145 - RNA, 24 nt, Human
ucaccguguuagccacgcuggucu

SEQ ID NO: 758146 - RNA, 22 nt, Human
ucacuauguuggccaagcuggu

SEQ ID NO: 758147 - RNA, 19 nt, Human
ucacugcaaccucugccuc

SEQ ID NO: 758148 - RNA, 24 nt, Human
ucacugcaaccucugccucccagg

SEQ ID NO: 758149 - RNA, 25 nt, Human
ucacugcaaccucugccucccaggu

SEQ ID NO: 758150 - RNA, 26 nt, Human
uccaaaacagaaauaauccaaaacaa

SEQ ID NO: 758151 - RNA, 24 nt, Human
ucccaaagugcugggauuacaggc

SEQ ID NO: 758152 - RNA, 24 nt, Human
ucccaaagugcugggauuacaggc

SEQ ID NO: 758153 - RNA, 21 nt, Human
ucccaaguucaagugauucuc

SEQ ID NO: 758154 - RNA, 24 nt, Human
ucccaaguucaagugauucuccug

SEQ ID NO: 758155 - RNA, 21 nt, Human
ucccagguugaagcgauucuc

SEQ ID NO: 758156 - RNA, 24 nt, Human
ucccagguugaagcgauucuccug

SEQ ID NO: 758157 - RNA, 23 nt, Human
uccccgccaagggaaaaaaaaaa

SEQ ID NO: 758158 - RNA, 21 nt, Human
uccgcccaccuuggccuccca

SEQ ID NO: 758159 - RNA, 18 nt, Human
ucggccucccaaagugcu

SEQ ID NO: 758160 - RNA, 24 nt, Human
ucuaugccacugcagaaauaagga

SEQ ID NO: 758161 - RNA, 23 nt, Human
ucucacucuagugcccaggcugg

SEQ ID NO: 758162 - RNA, 24 nt, Human
ucucacucuagugcccaggcugga

SEQ ID NO: 758163 - RNA, 24 nt, Human
ucuccugccucaacccccugagua

SEQ ID NO: 758164 - RNA, 22 nt, Human
ucucucggcacacguuuguugg

SEQ ID NO: 758165 - RNA, 20 nt, Human
ucugccucccagguugaagc

SEQ ID NO: 758166 - RNA, 19 nt, Human
ucuguaguuuucaucuucu

SEQ ID NO: 758167 - RNA, 23 nt, Human
ucuugaacuccugaccuuaggug

SEQ ID NO: 758168 - RNA, 19 nt, Human
ucuugcucuauugcccagg

SEQ ID NO: 758169 - RNA, 22 nt, Human
ucuugcucuauugcccaggcug

SEQ ID NO: 758170 - RNA, 23 nt, Human
ucuugcucuauugcccaggcugg

SEQ ID NO: 758171 - RNA, 24 nt, Human
ucuugcucuauugcccaggcugga

SEQ ID NO: 758172 - RNA, 20 nt, Human
ucuuuuuuuuugagacagag

SEQ ID NO: 758173 - RNA, 22 nt, Human
ucuuuuuuuuugagacagaguc

SEQ ID NO: 758174 - RNA, 24 nt, Human
ugaccaguuuuagucaagaaguuu

SEQ ID NO: 758175 - RNA, 18 nt, Human
ugaccucagguuauccgc

SEQ ID NO: 758176 - RNA, 20 nt, Human
ugaccucagguuauccgccc

SEQ ID NO: 758177 - RNA, 19 nt, Human
ugaccuccauguuccuccu

SEQ ID NO: 758178 - RNA, 20 nt, Human
ugaccuuaggugaucugccc

SEQ ID NO: 758179 - RNA, 24 nt, Human
ugaccuuaggugaucugcccaccu

SEQ ID NO: 758180 - RNA, 23 nt, Human
ugagacagagucucacucuagug

SEQ ID NO: 758181 - RNA, 22 nt, Human
ugagacagcauuuuccaaaaca

SEQ ID NO: 758182 - RNA, 22 nt, Human
ugagauggagucuugcucuauu

SEQ ID NO: 758183 - RNA, 24 nt, Human
ugaggucacagggucaauggucac

SEQ ID NO: 758184 - RNA, 24 nt, Human
ugaucugcccaccucggccuccca

SEQ ID NO: 758185 - RNA, 19 nt, Human
ugcccagcuuaauuuuucu

SEQ ID NO: 758186 - RNA, 21 nt, Human
ugcccaggcuggaaugcagug

SEQ ID NO: 758187 - RNA, 24 nt, Human
ugcccaggcuggaaugcaguggug

SEQ ID NO: 758188 - RNA, 21 nt, Human
ugccucaacccccugaguagc

SEQ ID NO: 758189 - RNA, 24 nt, Human
ugccucaacccccugaguagcugg

SEQ ID NO: 758190 - RNA, 24 nt, Human
ugccucagccuuccaagccgcugg

SEQ ID NO: 758191 - RNA, 22 nt, Human
ugcgcccggcugagaaaacuaa

SEQ ID NO: 758192 - RNA, 24 nt, Human
ugcugggauuacaggcgugagcca

SEQ ID NO: 758193 - RNA, 24 nt, Human
ugcugggauuacaggcgugagcca

SEQ ID NO: 758194 - RNA, 23 nt, Human
uggaaauaaaagguugucuguau

SEQ ID NO: 758195 - RNA, 19 nt, Human
uggaaugcaguggugugau

SEQ ID NO: 758196 - RNA, 23 nt, Human
uggaaugcaguggugugaucucg

SEQ ID NO: 758197 - RNA, 24 nt, Human
uggaaugcaguggugugaucucgg

SEQ ID NO: 758198 - RNA, 23 nt, Human
uggaaugcuaaaaggcaacauuu

SEQ ID NO: 758199 - RNA, 21 nt, Human
uggaauuacaggcaugcacca

SEQ ID NO: 758200 - RNA, 24 nt, Human
uggaauuacaggcaugcaccacca

SEQ ID NO: 758201 - RNA, 21 nt, Human
uggaauuacaggcgcccacca

SEQ ID NO: 758202 - RNA, 24 nt, Human
uggaauuacaggcgcccaccacca

SEQ ID NO: 758203 - RNA, 25 nt, Human
uggaauuacaggcgcccaccaccau

SEQ ID NO: 758204 - RNA, 24 nt, Human
uggagucuugcucuauugcccagg

SEQ ID NO: 758205 - RNA, 24 nt, Human
uggccaagcuggucuugaacuccu

SEQ ID NO: 758206 - RNA, 19 nt, Human
ugggauuacaggcgugagc

SEQ ID NO: 758207 - RNA, 21 nt, Human
ugggauuacaggcgugagcca

SEQ ID NO: 758208 - RNA, 21 nt, Human
ugggauuacaggcgugagcca

SEQ ID NO: 758209 - RNA, 22 nt, Human
ugggauuacaggcgugagccac

SEQ ID NO: 758210 - RNA, 22 nt, Human
ugggauuacaggcgugagccac

SEQ ID NO: 758211 - RNA, 22 nt, Human
ugggauuacaggcgugagccac

SEQ ID NO: 758212 - RNA, 23 nt, Human
ugggauuacaggcgugagccacc

SEQ ID NO: 758213 - RNA, 23 nt, Human
ugggauuacaggcgugagccacc

SEQ ID NO: 758214 - RNA, 24 nt, Human
ugggauuacaggcgugagccaccg

SEQ ID NO: 758215 - RNA, 24 nt, Human
ugggauuacaggcgugagccacug

SEQ ID NO: 758216 - RNA, 26 nt, Human
ugggauuacaggcgugagccacugcg

SEQ ID NO: 758217 - RNA, 19 nt, Human
ugggauuucacuauguugg

SEQ ID NO: 758218 - RNA, 24 nt, Human
ugggauuucacuauguuggccaag

SEQ ID NO: 758219 - RNA, 21 nt, Human
ugugguuguuaaggaaccccu

SEQ ID NO: 758220 - RNA, 25 nt, Human
ugugguuguuaaggaaccccuuuaa

SEQ ID NO: 758221 - RNA, 19 nt, Human
uuaagugguuaguuggaca

SEQ ID NO: 758222 - RNA, 22 nt, Human
uuacaacauauaggaaaccaga

SEQ ID NO: 758223 - RNA, 18 nt, Human
uuaguagagacgggguuu

SEQ ID NO: 758224 - RNA, 22 nt, Human
uuaguagagacgggguuucacc

SEQ ID NO: 758225 - RNA, 24 nt, Human
uuaguagagacgggguuucaccgu

SEQ ID NO: 758226 - RNA, 18 nt, Human
uuaguagagaugggauuu

SEQ ID NO: 758227 - RNA, 24 nt, Human
uuaguagagaugggauuucacuau

SEQ ID NO: 758228 - RNA, 21 nt, Human
uucaagugauucuccugccuc

SEQ ID NO: 758229 - RNA, 23 nt, Human
uucaagugauucuccugccucag

SEQ ID NO: 758230 - RNA, 24 nt, Human
uucaagugauucuccugccucagc

SEQ ID NO: 758231 - RNA, 18 nt, Human
uucucucucucuccgggc

SEQ ID NO: 758232 - RNA, 18 nt, Human
uugcccaggcuggagggc

SEQ ID NO: 758233 - RNA, 18 nt, Human
uuggccucccaaagugcu

SEQ ID NO: 758234 - RNA, 21 nt, Human
uuucaccguguuagccacgcu

SEQ ID NO: 758235 - RNA, 21 nt, Human
uuucacuauguuggccaagcu

SEQ ID NO: 758236 - RNA, 19 nt, Human
uuugaaaugaccuaccacu

SEQ ID NO: 758237 - RNA, 23 nt, Human
uuugagacagagucucacucuag

SEQ ID NO: 758238 - RNA, 22 nt, Human
uuugaggucacagggucaaugg

SEQ ID NO: 758239 - RNA, 19 nt, Human
uuuguaaccaguuauauau

SEQ ID NO: 758240 - RNA, 22 nt, Human
uuugugguuguuaaggaacccc

SEQ ID NO: 758241 - RNA, 18 nt, Human
uuuucaucuucuuggcug

SEQ ID NO: 758242 - RNA, 24 nt, Human
uuuuuaguagagacgggguuucac

SEQ ID NO: 758243 - RNA, 24 nt, Human
uuuuuaguagagaugggauuucac

SEQ ID NO: 758244 - RNA, 20 nt, Human
uuuuuguauuuuuaguagag

SEQ ID NO: 758245 - RNA, 21 nt, Human
uuuuuguauuuuuaguagaga

SEQ ID NO: 758246 - RNA, 20 nt, Human
aaaacauacaaaacuucacc

SEQ ID NO: 758247 - RNA, 24 nt, Human
aaagugcugggauuacagguguga

SEQ ID NO: 758248 - RNA, 22 nt, Human
aagaaaagauagaaaaagggac

SEQ ID NO: 758249 - RNA, 20 nt, Human
aagaagaaaagauagaaaaa

SEQ ID NO: 758250 - RNA, 18 nt, Human
aagugcugggauuacagg

SEQ ID NO: 758251 - RNA, 19 nt, Human
aagugcugggauuacaggu

SEQ ID NO: 758252 - RNA, 26 nt, Human
aagugcugggauuacaggugugagcc

SEQ ID NO: 758253 - RNA, 19 nt, Human
aaucauagcuuacugcaac

SEQ ID NO: 758254 - RNA, 24 nt, Human
accaacuucuagcagauccccuua

SEQ ID NO: 758255 - RNA, 18 nt, Human
acucugucacccaggcug

SEQ ID NO: 758256 - RNA, 25 nt, Human
acucugucacccaggcuggaguaca

SEQ ID NO: 758257 - RNA, 21 nt, Human
acugcaaccucaaauuccugg

SEQ ID NO: 758258 - RNA, 22 nt, Human
acugcaaccucaaauuccuggg

SEQ ID NO: 758259 - RNA, 23 nt, Human
acugcaacuuuuuaaaacccacu

SEQ ID NO: 758260 - RNA, 24 nt, Human
agggauccucccaccucagccucc

SEQ ID NO: 758261 - RNA, 21 nt, Human
agggauggaagcagcaauagg

SEQ ID NO: 758262 - RNA, 23 nt, Human
aguacaguggcacaaucauagcu

SEQ ID NO: 758263 - RNA, 18 nt, Human
auagcuuacugcaaccuc

SEQ ID NO: 758264 - RNA, 24 nt, Human
auauuaaauagcuaaagaagaaaa

SEQ ID NO: 758265 - RNA, 24 nt, Human
caaagugcugggauuacaggugug

SEQ ID NO: 758266 - RNA, 18 nt, Human
caacuucuagcagauccc

SEQ ID NO: 758267 - RNA, 24 nt, Human
caccucagccucccaaagugcugg

SEQ ID NO: 758268 - RNA, 22 nt, Human
cacucugucacccaggcuggag

SEQ ID NO: 758269 - RNA, 23 nt, Human
cacucugucacccaggcuggagu

SEQ ID NO: 758270 - RNA, 21 nt, Human
ccaaagugcugggauuacagg

SEQ ID NO: 758271 - RNA, 21 nt, Human
ccaaagugcugggauuacagg

SEQ ID NO: 758272 - RNA, 24 nt, Human
ccaaagugcugggauuacaggugu

SEQ ID NO: 758273 - RNA, 21 nt, Human
cccacuuauaauuucuucuuu

SEQ ID NO: 758274 - RNA, 22 nt, Human
ccucacucugucacccaggcug

SEQ ID NO: 758275 - RNA, 24 nt, Human
ccucacucugucacccaggcugga

SEQ ID NO: 758276 - RNA, 25 nt, Human
ccucacucugucacccaggcuggag

SEQ ID NO: 758277 - RNA, 26 nt, Human
ccucacucugucacccaggcuggagu

SEQ ID NO: 758278 - RNA, 21 nt, Human
ccuccggaggccacggaggcu

SEQ ID NO: 758279 - RNA, 22 nt, Human
cuaguccacuagcuccuuccua

SEQ ID NO: 758280 - RNA, 20 nt, Human
cucacuccuuaccuucccug

SEQ ID NO: 758281 - RNA, 24 nt, Human
cucacucugucacccaggcuggag

SEQ ID NO: 758282 - RNA, 21 nt, Human
cuuacugcaaccucaaauucc

SEQ ID NO: 758283 - RNA, 21 nt, Human
gaaacuguguacucuuuuugc

SEQ ID NO: 758284 - RNA, 20 nt, Human
gaggccacggaggcuguuac

SEQ ID NO: 758285 - RNA, 18 nt, Human
gaugccuggcccacugca

SEQ ID NO: 758286 - RNA, 18 nt, Human
gauuacaggugugagcca

SEQ ID NO: 758287 - RNA, 18 nt, Human
gauuacaggugugagcca

SEQ ID NO: 758288 - RNA, 18 nt, Human
gauuacaggugugagcca

SEQ ID NO: 758289 - RNA, 19 nt, Human
gcuggaguacaguggcaca

SEQ ID NO: 758290 - RNA, 21 nt, Human
ggaggccacggaggcuguuac

SEQ ID NO: 758291 - RNA, 22 nt, Human
gggauggaagcagcaauaggaa

SEQ ID NO: 758292 - RNA, 23 nt, Human
uacaggugugagccaugaugccu

SEQ ID NO: 758293 - RNA, 25 nt, Human
uacccuggcucuaguccacuagcuc

SEQ ID NO: 758294 - RNA, 23 nt, Human
uacugcaaccucaaauuccuggg

SEQ ID NO: 758295 - RNA, 18 nt, Human
uagaaaaaccauuuggcg

SEQ ID NO: 758296 - RNA, 22 nt, Human
uagcagauccccuuacccuggc

SEQ ID NO: 758297 - RNA, 24 nt, Human
uagcagauccccuuacccuggcuc

SEQ ID NO: 758298 - RNA, 24 nt, Human
ucacucugucacccaggcuggagu

SEQ ID NO: 758299 - RNA, 18 nt, Human
ucagccucccaaagugcu

SEQ ID NO: 758300 - RNA, 23 nt, Human
ucccaaagugcugggauuacagg

SEQ ID NO: 758301 - RNA, 27 nt, Human
uccucccaccucagccucccaaagugc

SEQ ID NO: 758302 - RNA, 19 nt, Human
ucuagcagauccccuuacc

SEQ ID NO: 758303 - RNA, 24 nt, Human
ucuaucauuucgagggauggaagc

SEQ ID NO: 758304 - RNA, 18 nt, Human
ucugucacccaggcugga

SEQ ID NO: 758305 - RNA, 24 nt, Human
ucugucacccaggcuggaguacag

SEQ ID NO: 758306 - RNA, 19 nt, Human
ugcaacuuuuuaaaaccca

SEQ ID NO: 758307 - RNA, 24 nt, Human
ugcugggauuacaggugugagcca

SEQ ID NO: 758308 - RNA, 19 nt, Human
uggaaacuguguacucuuu

SEQ ID NO: 758309 - RNA, 23 nt, Human
uggaagcagcaauaggaaacuga

SEQ ID NO: 758310 - RNA, 19 nt, Human
uggaguacaguggcacaau

SEQ ID NO: 758311 - RNA, 24 nt, Human
uggcacaaucauagcuuacugcaa

SEQ ID NO: 758312 - RNA, 18 nt, Human
uggcggaagaccaacuuc

SEQ ID NO: 758313 - RNA, 18 nt, Human
ugggauuacaggugugag

SEQ ID NO: 758314 - RNA, 19 nt, Human
ugggauuacaggugugagc

SEQ ID NO: 758315 - RNA, 21 nt, Human
ugggauuacaggugugagcca

SEQ ID NO: 758316 - RNA, 21 nt, Human
ugggauuacaggugugagcca

SEQ ID NO: 758317 - RNA, 21 nt, Human
ugggauuacaggugugagcca

SEQ ID NO: 758318 - RNA, 22 nt, Human
ugggauuacaggugugagccau

SEQ ID NO: 758319 - RNA, 23 nt, Human
ugggauuacaggugugagccaug

SEQ ID NO: 758320 - RNA, 27 nt, Human
ugggauuacaggugugagccaugaugc

SEQ ID NO: 758321 - RNA, 24 nt, Human
uuacugcaaccucaaauuccuggg

SEQ ID NO: 758322 - RNA, 21 nt, Human
aaacaggucgugcuccucccc

SEQ ID NO: 758323 - RNA, 18 nt, Human
acccaacgcccccuccca

SEQ ID NO: 758324 - RNA, 21 nt, Human
agggaacugagugaggaugau

SEQ ID NO: 758325 - RNA, 24 nt, Human
caaacaggucgugcuccuccccag

SEQ ID NO: 758326 - RNA, 21 nt, Human
cacccaacgcccccucccaga

SEQ ID NO: 758327 - RNA, 20 nt, Human
cagcaaacaggucgugcucc

SEQ ID NO: 758328 - RNA, 24 nt, Human
cagcugucagucugugcuaccagg

SEQ ID NO: 758329 - RNA, 19 nt, Human
ccaaauaaauaccagaggc

SEQ ID NO: 758330 - RNA, 24 nt, Human
ccaaauaaauaccagaggccaccc

SEQ ID NO: 758331 - RNA, 24 nt, Human
ccaaauaaauaccagaggccaccc

SEQ ID NO: 758332 - RNA, 23 nt, Human
ccagaggccacccaacgcccccu

SEQ ID NO: 758333 - RNA, 25 nt, Human
ccagcaaacaggucgugcuccuccc

SEQ ID NO: 758334 - RNA, 20 nt, Human
ccagccccauccugggcauu

SEQ ID NO: 758335 - RNA, 19 nt, Human
cccaagcuauagcccaaga

SEQ ID NO: 758336 - RNA, 22 nt, Human
cccagccccgcccucggccuuc

SEQ ID NO: 758337 - RNA, 22 nt, Human
ccccaagcuauagcccaagagc

SEQ ID NO: 758338 - RNA, 19 nt, Human
ccccagccccauccugggc

SEQ ID NO: 758339 - RNA, 23 nt, Human
ccccagccccauccugggcauuc

SEQ ID NO: 758340 - RNA, 19 nt, Human
cccccauagccacaggccu

SEQ ID NO: 758341 - RNA, 22 nt, Human
ccccgcccucggccuucucuuc

SEQ ID NO: 758342 - RNA, 20 nt, Human
ccccucccagacagggcugu

SEQ ID NO: 758343 - RNA, 21 nt, Human
ccccugugugaggggccccca

SEQ ID NO: 758344 - RNA, 20 nt, Human
cuuggccccaagcuauagcc

SEQ ID NO: 758345 - RNA, 23 nt, Human
gccacccaacgcccccucccaga

SEQ ID NO: 758346 - RNA, 23 nt, Human
gcccagcaaacaggucgugcucc

SEQ ID NO: 758347 - RNA, 23 nt, Human
gccugggucccuguauaggaccc

SEQ ID NO: 758348 - RNA, 23 nt, Human
gcuaccagggaacugagugagga

SEQ ID NO: 758349 - RNA, 25 nt, Human
uaaauaccagaggccacccaacgcc

SEQ ID NO: 758350 - RNA, 23 nt, Human
uaccagaggccacccaacgcccc

SEQ ID NO: 758351 - RNA, 18 nt, Human
uaccagggaacugaguga

SEQ ID NO: 758352 - RNA, 18 nt, Human
uagcccaagagcagcugu

SEQ ID NO: 758353 - RNA, 24 nt, Human
uccccagccccgcccucggccuuc

SEQ ID NO: 758354 - RNA, 21 nt, Human
ucccccagcccuaggcuucua

SEQ ID NO: 758355 - RNA, 23 nt, Human
ucccuguauaggacccuaagggu

SEQ ID NO: 758356 - RNA, 19 nt, Human
ugagacaucuuggccccaa

SEQ ID NO: 758357 - RNA, 24 nt, Human
ugcuaccagggaacugagugagga

SEQ ID NO: 758358 - RNA, 18 nt, Human
uuccucgcccccagcccc

SEQ ID NO: 758359 - RNA, 22 nt, Human
uuggccccaagcuauagcccaa

SEQ ID NO: 758360 - RNA, 19 nt, Human
aaacauccugaagaugaug

SEQ ID NO: 758361 - RNA, 21 nt, Human
aaauagugugauuuagauucu

SEQ ID NO: 758362 - RNA, 19 nt, Human
aaauuauaauuggccacac

SEQ ID NO: 758363 - RNA, 21 nt, Human
aacacauagcucaagcuucca

SEQ ID NO: 758364 - RNA, 18 nt, Human
aagaauuccaaacuauau

SEQ ID NO: 758365 - RNA, 21 nt, Human
aagcaccuucucuggucagcc

SEQ ID NO: 758366 - RNA, 19 nt, Human
aagggcugcaugcuuugca

SEQ ID NO: 758367 - RNA, 24 nt, Human
aaguacucaggaggcugagaacac

SEQ ID NO: 758368 - RNA, 23 nt, Human
acaacaaaacagccccaaacaga

SEQ ID NO: 758369 - RNA, 23 nt, Human
acaguagagcaaagaauuccaaa

SEQ ID NO: 758370 - RNA, 20 nt, Human
acaguggcuaagcuggguug

SEQ ID NO: 758371 - RNA, 21 nt, Human
acgacccuuuaaaacugaaaa

SEQ ID NO: 758372 - RNA, 22 nt, Human
agaaacaacagauuccaaaaca

SEQ ID NO: 758373 - RNA, 21 nt, Human
agaagagagcugcuaccucac

SEQ ID NO: 758374 - RNA, 20 nt, Human
agaaggcaacuuucaaaaca

SEQ ID NO: 758375 - RNA, 24 nt, Human
agaauggcagcggcagcaaauagg

SEQ ID NO: 758376 - RNA, 26 nt, Human
agacaguuuugugacaaagucuuuga

SEQ ID NO: 758377 - RNA, 18 nt, Human
agccguggcaggcgagca

SEQ ID NO: 758378 - RNA, 22 nt, Human
agcugaggaaguccugaagaaa

SEQ ID NO: 758379 - RNA, 30 nt, Human
aggaaggcgcagcucuguggaaaggucacc

SEQ ID NO: 758380 - RNA, 21 nt, Human
aggcagggaccaaaauuccuu

SEQ ID NO: 758381 - RNA, 22 nt, Human
auuuccuggucccuccaaaaug

SEQ ID NO: 758382 - RNA, 19 nt, Human
caaaacagccccaaacaga

SEQ ID NO: 758383 - RNA, 19 nt, Human
caaaacagccccaaacaga

SEQ ID NO: 758384 - RNA, 23 nt, Human
caaagguggacacagaacccacu

SEQ ID NO: 758385 - RNA, 20 nt, Human
caacaaaacagccccaaaca

SEQ ID NO: 758386 - RNA, 19 nt, Human
cacagcaaguuugcucuau

SEQ ID NO: 758387 - RNA, 19 nt, Human
caccgcacggcuggagaaa

SEQ ID NO: 758388 - RNA, 22 nt, Human
caccgcacggcuggagaaacaa

SEQ ID NO: 758389 - RNA, 22 nt, Human
caccgcagcugccagcccccug

SEQ ID NO: 758390 - RNA, 24 nt, Human
cacuacugugugugugugugcgug

SEQ ID NO: 758391 - RNA, 18 nt, Human
cagagcuccugaagcacc

SEQ ID NO: 758392 - RNA, 18 nt, Human
cagcccccugugcuugga

SEQ ID NO: 758393 - RNA, 19 nt, Human
cagcggcagcaaauagggc

SEQ ID NO: 758394 - RNA, 19 nt, Human
caggaggcugagaacacaa

SEQ ID NO: 758395 - RNA, 23 nt, Human
caggcaauggaaacaggagccga

SEQ ID NO: 758396 - RNA, 19 nt, Human
cagggccagccccaaggcu

SEQ ID NO: 758397 - RNA, 21 nt, Human
caguaaacucucaccgcagcu

SEQ ID NO: 758398 - RNA, 19 nt, Human
caucucauuuauuuguagc

SEQ ID NO: 758399 - RNA, 23 nt, Human
caugacuucuuuuuuuucuuuuu

SEQ ID NO: 758400 - RNA, 18 nt, Human
caugaggcugcaccgcac

SEQ ID NO: 758401 - RNA, 21 nt, Human
caugaggcugcaccgcacggc

SEQ ID NO: 758402 - RNA, 23 nt, Human
ccaaaaacauagucuuaaacaaa

SEQ ID NO: 758403 - RNA, 18 nt, Human
ccaaaacaauuaguagca

SEQ ID NO: 758404 - RNA, 20 nt, Human
ccaaacagauugccaugagc

SEQ ID NO: 758405 - RNA, 23 nt, Human
ccagcccccugugcuuggccaug

SEQ ID NO: 758406 - RNA, 18 nt, Human
ccagggcacuuccaacac

SEQ ID NO: 758407 - RNA, 22 nt, Human
ccauccuuaacauucagcugac

SEQ ID NO: 758408 - RNA, 18 nt, Human
ccccuucucuccccgauc

SEQ ID NO: 758409 - RNA, 19 nt, Human
ccccuucucuccccgaucc

SEQ ID NO: 758410 - RNA, 21 nt, Human
cccugugcuuggccaugcccc

SEQ ID NO: 758411 - RNA, 24 nt, Human
cccuuucagaaggcaacuuucaaa

SEQ ID NO: 758412 - RNA, 23 nt, Human
ccgguccuaggcagggaccaaaa

SEQ ID NO: 758413 - RNA, 19 nt, Human
ccuccacagcaaguuugcu

SEQ ID NO: 758414 - RNA, 22 nt, Human
ccugaagcaccuucucugguca

SEQ ID NO: 758415 - RNA, 22 nt, Human
cgguccuaggcagggaccaaaa

SEQ ID NO: 758416 - RNA, 19 nt, Human
cucugcuaguguuaggaaa

SEQ ID NO: 758417 - RNA, 20 nt, Human
cugcaugcuuugcagggcca

SEQ ID NO: 758418 - RNA, 20 nt, Human
cugccagcccccugugcuug

SEQ ID NO: 758419 - RNA, 24 nt, Human
cuuacauuuccuggucccuccaaa

SEQ ID NO: 758420 - RNA, 22 nt, Human
cuuccagagcugcacuuucucu

SEQ ID NO: 758421 - RNA, 21 nt, Human
gaagcaccuucucuggucagc

SEQ ID NO: 758422 - RNA, 19 nt, Human
gagcagaugccugggcucg

SEQ ID NO: 758423 - RNA, 25 nt, Human
gagcuuguuuuuaucacaguuagac

SEQ ID NO: 758424 - RNA, 21 nt, Human
gccacaacaaaacagccccaa

SEQ ID NO: 758425 - RNA, 20 nt, Human
gcuacauuuaccugucaguu

SEQ ID NO: 758426 - RNA, 19 nt, Human
gcugagcucugagggcuac

SEQ ID NO: 758427 - RNA, 19 nt, Human
ggcagaagggcugcaugcu

SEQ ID NO: 758428 - RNA, 20 nt, Human
ggguugggggcaugaggcug

SEQ ID NO: 758429 - RNA, 24 nt, Human
gucaggucacauugucuucuucca

SEQ ID NO: 758430 - RNA, 28 nt, Human
gugugugugugugcgugcaugcggugug

SEQ ID NO: 758431 - RNA, 19 nt, Human
uaaagugcaucauuuuauu

SEQ ID NO: 758432 - RNA, 20 nt, Human
uacauucuuuuucuuuuccu

SEQ ID NO: 758433 - RNA, 19 nt, Human
uaccugagggcugaagggg

SEQ ID NO: 758434 - RNA, 19 nt, Human
uagaauaaaguccugagcu

SEQ ID NO: 758435 - RNA, 23 nt, Human
uagaauaaaguccugagcuuguu

SEQ ID NO: 758436 - RNA, 20 nt, Human
uagaggcagaagggcugcaa

SEQ ID NO: 758437 - RNA, 21 nt, Human
uaguagcaucucauuuauuug

SEQ ID NO: 758438 - RNA, 21 nt, Human
uaguuuuacauucuuuuucuu

SEQ ID NO: 758439 - RNA, 18 nt, Human
uauguaccgucuuugugu

SEQ ID NO: 758440 - RNA, 21 nt, Human
uauguaccgucuuuguguaug

SEQ ID NO: 758441 - RNA, 19 nt, Human
ucacacacgugaggaaggc

SEQ ID NO: 758442 - RNA, 22 nt, Human
ucagaaggcaacuuucaaaaca

SEQ ID NO: 758443 - RNA, 21 nt, Human
ucagccuccaaacuucuucag

SEQ ID NO: 758444 - RNA, 22 nt, Human
uccaaaaugucuaauauagaca

SEQ ID NO: 758445 - RNA, 24 nt, Human
uccacagcaaguuugcucuauaga

SEQ ID NO: 758446 - RNA, 19 nt, Human
uccuggucccuccaaaaug

SEQ ID NO: 758447 - RNA, 20 nt, Human
ucggcugcuucucuacauuu

SEQ ID NO: 758448 - RNA, 18 nt, Human
ucuccaggcucuucuccc

SEQ ID NO: 758449 - RNA, 20 nt, Human
ucucucuguccucugcagau

SEQ ID NO: 758450 - RNA, 22 nt, Human
ucugcaauguaaacaguagagc

SEQ ID NO: 758451 - RNA, 20 nt, Human
ugaagagauggaggauuugg

SEQ ID NO: 758452 - RNA, 22 nt, Human
ugaagagauggaggauuuggug

SEQ ID NO: 758453 - RNA, 23 nt, Human
ugacagaagagagcugcuaccuc

SEQ ID NO: 758454 - RNA, 18 nt, Human
ugacgauaaaaucagacu

SEQ ID NO: 758455 - RNA, 20 nt, Human
ugacuuaagccccuuuaugu

SEQ ID NO: 758456 - RNA, 23 nt, Human
ugagaacacaggccccuucucuc

SEQ ID NO: 758457 - RNA, 18 nt, Human
ugcaugcgcgugcgcaug

SEQ ID NO: 758458 - RNA, 26 nt, Human
ugccacaacaaaacagccccaaacag

SEQ ID NO: 758459 - RNA, 19 nt, Human
ugccaugagcaugcuagcc

SEQ ID NO: 758460 - RNA, 24 nt, Human
ugccuugggcugagcucugagggc

SEQ ID NO: 758461 - RNA, 21 nt, Human
ugcgcgugcgcaugugcacau

SEQ ID NO: 758462 - RNA, 23 nt, Human
ugcgugcaugcgcgugcgcaugu

SEQ ID NO: 758463 - RNA, 20 nt, Human
ugcuaguguuaggaaagcuc

SEQ ID NO: 758464 - RNA, 23 nt, Human
uggcagaaacaacagauuccaaa

SEQ ID NO: 758465 - RNA, 22 nt, Human
uggcuagugccacaacaaaaca

SEQ ID NO: 758466 - RNA, 21 nt, Human
uggguugggggcaugaggcug

SEQ ID NO: 758467 - RNA, 21 nt, Human
uggugucuuacauuuccuggu

SEQ ID NO: 758468 - RNA, 20 nt, Human
uguaaacaguagagcaaaga

SEQ ID NO: 758469 - RNA, 21 nt, Human
uguaugcaggcugacuuaagc

SEQ ID NO: 758470 - RNA, 27 nt, Human
ugucuuacauuuccuggucccuccaaa

SEQ ID NO: 758471 - RNA, 21 nt, Human
ugugcacauacugcagucuug

SEQ ID NO: 758472 - RNA, 18 nt, Human
ugugcgugcaugcgcgug

SEQ ID NO: 758473 - RNA, 25 nt, Human
ugugugcgugcaugcgcgugcgcag

SEQ ID NO: 758474 - RNA, 20 nt, Human
ugugugugugugcgugcaug

SEQ ID NO: 758475 - RNA, 18 nt, Human
ugugugugugugugcgug

SEQ ID NO: 758476 - RNA, 25 nt, Human
uuaaaaaaguaacagcaaaucauga

SEQ ID NO: 758477 - RNA, 22 nt, Human
uuccacggcaaguuuggucguc

SEQ ID NO: 758478 - RNA, 22 nt, Human
uucucuggggacaguaaacucu

SEQ ID NO: 758479 - RNA, 23 nt, Human
uucuuuuucuuuuccuuaaaacu

SEQ ID NO: 758480 - RNA, 18 nt, Human
uuggaccagccaguuucu

SEQ ID NO: 758481 - RNA, 22 nt, Human
uuugcaguuaacuggguccaag

SEQ ID NO: 758482 - RNA, 20 nt, Human
aaaauggucccguccuuaug

SEQ ID NO: 758483 - RNA, 19 nt, Human
aaacuuaaccuagaaguuu

SEQ ID NO: 758484 - RNA, 19 nt, Human
acagugguuuuauugacau

SEQ ID NO: 758485 - RNA, 25 nt, Human
aggaggaggcggugccgccacugcc

SEQ ID NO: 758486 - RNA, 18 nt, Human
auaaaccagaauauuccu

SEQ ID NO: 758487 - RNA, 25 nt, Human
auaaugaggcacacucaguauugca

SEQ ID NO: 758488 - RNA, 27 nt, Human
caaaauaauggggaaacuuuucauagc

SEQ ID NO: 758489 - RNA, 21 nt, Human
caccucacaaguuugauguca

SEQ ID NO: 758490 - RNA, 24 nt, Human
cagaauauuccucuuuuuaucccc

SEQ ID NO: 758491 - RNA, 20 nt, Human
cagcaucguucuuaguccau

SEQ ID NO: 758492 - RNA, 19 nt, Human
ccccggcgccgcgacuggg

SEQ ID NO: 758493 - RNA, 19 nt, Human
cucaaacuuaaccuagaag

SEQ ID NO: 758494 - RNA, 18 nt, Human
gaggaggaggcggugccg

SEQ ID NO: 758495 - RNA, 26 nt, Human
gauaaugaggcacacucaguauugca

SEQ ID NO: 758496 - RNA, 19 nt, Human
gcaucguucuuaguccaug

SEQ ID NO: 758497 - RNA, 25 nt, Human
gcauuuguaauuuaguaauucuuau

SEQ ID NO: 758498 - RNA, 20 nt, Human
gcccccggcgccgcgacugg

SEQ ID NO: 758499 - RNA, 18 nt, Human
gggaaugugaggaggagg

SEQ ID NO: 758500 - RNA, 20 nt, Human
uaaauguccaaugcuucaca

SEQ ID NO: 758501 - RNA, 18 nt, Human
uaauucuuauacaggaca

SEQ ID NO: 758502 - RNA, 24 nt, Human
uauuugguauccuucuugcacugu

SEQ ID NO: 758503 - RNA, 26 nt, Human
ucaccgcauccucuuggggggcccuc

SEQ ID NO: 758504 - RNA, 21 nt, Human
ucuaaccccgccaccccggga

SEQ ID NO: 758505 - RNA, 20 nt, Human
ucuaggaaauaaaccagaau

SEQ ID NO: 758506 - RNA, 20 nt, Human
ucucucuguagacaaaggau

SEQ ID NO: 758507 - RNA, 19 nt, Human
ugacauguacauuccaaua

SEQ ID NO: 758508 - RNA, 25 nt, Human
ugacauguacauuccaauauguuua

SEQ ID NO: 758509 - RNA, 21 nt, Human
ugagaaacugagaacgcucca

SEQ ID NO: 758510 - RNA, 18 nt, Human
ugaggaggaggcggugcc

SEQ ID NO: 758511 - RNA, 22 nt, Human
ugauauguuuauauacagugug

SEQ ID NO: 758512 - RNA, 27 nt, Human
uguuuacagcugcaagauaaugaggca

SEQ ID NO: 758513 - RNA, 23 nt, Human
uuacagcugcaagauaaugaggc

SEQ ID NO: 758514 - RNA, 22 nt, Human
uuaguaauucuuauacaggaca

SEQ ID NO: 758515 - RNA, 20 nt, Human
uuuagacuuuaucacuguau

SEQ ID NO: 758516 - RNA, 24 nt, Human
uuuguaauuuaguaauucuuauac

SEQ ID NO: 758517 - RNA, 19 nt, Human
uuuuuugcuugaaagccag

SEQ ID NO: 758518 - RNA, 23 nt, Human
aaaagccaguuagacccacccau

SEQ ID NO: 758519 - RNA, 23 nt, Human
aaacaaucgaaaaucggcuacaa

SEQ ID NO: 758520 - RNA, 23 nt, Human
aaacuugcaaacaauucucucgg

SEQ ID NO: 758521 - RNA, 22 nt, Human
aaagacauuguauagagacuug

SEQ ID NO: 758522 - RNA, 23 nt, Human
aaagcccuucuccacaccugccc

SEQ ID NO: 758523 - RNA, 19 nt, Human
aaaggggagaaagagaggu

SEQ ID NO: 758524 - RNA, 20 nt, Human
aaaugccuuccugauaccac

SEQ ID NO: 758525 - RNA, 19 nt, Human
aacaacaguagccccaucu

SEQ ID NO: 758526 - RNA, 19 nt, Human
aacaacaguagccccaucu

SEQ ID NO: 758527 - RNA, 18 nt, Human
aacuugcaaacaauucuc

SEQ ID NO: 758528 - RNA, 18 nt, Human
aagaaaaugcagauucaa

SEQ ID NO: 758529 - RNA, 23 nt, Human
aaggaaugagaagggaggggagg

SEQ ID NO: 758530 - RNA, 19 nt, Human
aauacagugugacaccucu

SEQ ID NO: 758531 - RNA, 20 nt, Human
aaugcaaaagcuccaagaga

SEQ ID NO: 758532 - RNA, 23 nt, Human
acaacaguagccccaucuuacag

SEQ ID NO: 758533 - RNA, 19 nt, Human
acaggucacccgcgcagca

SEQ ID NO: 758534 - RNA, 20 nt, Human
acauccuuuaaaaacaaaga

SEQ ID NO: 758535 - RNA, 20 nt, Human
acccuaaacguugaaacaac

SEQ ID NO: 758536 - RNA, 21 nt, Human
acccuuuucguaucuuccacc

SEQ ID NO: 758537 - RNA, 23 nt, Human
agaaggagaggggcggaaaaaga

SEQ ID NO: 758538 - RNA, 21 nt, Human
agaagggaggggaggggagga

SEQ ID NO: 758539 - RNA, 23 nt, Human
agaaugcauacaaacacauccuu

SEQ ID NO: 758540 - RNA, 21 nt, Human
agauucaauuggguggguugc

SEQ ID NO: 758541 - RNA, 22 nt, Human
aggaaagaggaaugcuaaaugu

SEQ ID NO: 758542 - RNA, 19 nt, Human
aggaagcaaaagaggaaga

SEQ ID NO: 758543 - RNA, 18 nt, Human
aggggaggggaggagaga

SEQ ID NO: 758544 - RNA, 19 nt, Human
aggggaggggaggagagau

SEQ ID NO: 758545 - RNA, 19 nt, Human
aguagaaucuaugcucugc

SEQ ID NO: 758546 - RNA, 24 nt, Human
auaaaacccaaaacuugcaaacaa

SEQ ID NO: 758547 - RNA, 25 nt, Human
auacaaacacauccuuuaaaaacaa

SEQ ID NO: 758548 - RNA, 19 nt, Human
augugcugggauacauaug

SEQ ID NO: 758549 - RNA, 23 nt, Human
auuuagccauuaaauucuccaca

SEQ ID NO: 758550 - RNA, 21 nt, Human
cacacgcaagaagagaaagug

SEQ ID NO: 758551 - RNA, 25 nt, Human
cacauccuuuaaaaacaaagaaaag

SEQ ID NO: 758552 - RNA, 18 nt, Human
cagaaugcauacaaacac

SEQ ID NO: 758553 - RNA, 24 nt, Human
cagaaugcauacaaacacauccuu

SEQ ID NO: 758554 - RNA, 22 nt, Human
caguuuacacaaauguuuccca

SEQ ID NO: 758555 - RNA, 21 nt, Human
cauggcuuaaaaggggagaaa

SEQ ID NO: 758556 - RNA, 21 nt, Human
cauugcuugcugcccacaggg

SEQ ID NO: 758557 - RNA, 23 nt, Human
ccacaaaagccaguuagacccac

SEQ ID NO: 758558 - RNA, 21 nt, Human
cccacacgcaagaagagaaag

SEQ ID NO: 758559 - RNA, 18 nt, Human
ccugccccacacgcaaga

SEQ ID NO: 758560 - RNA, 20 nt, Human
cuaaacguugaaacaacaca

SEQ ID NO: 758561 - RNA, 19 nt, Human
cuuccaccgaagcugagaa

SEQ ID NO: 758562 - RNA, 20 nt, Human
cuugcugcccacagggauaa

SEQ ID NO: 758563 - RNA, 27 nt, Human
gaaauugcacacccuuuucguaucuuc

SEQ ID NO: 758564 - RNA, 22 nt, Human
gagaaaucccgugccaaggcac

SEQ ID NO: 758565 - RNA, 19 nt, Human
gagaagggaggggagggga

SEQ ID NO: 758566 - RNA, 18 nt, Human
gaggagagaaggagaggg

SEQ ID NO: 758567 - RNA, 20 nt, Human
gaggggaggggaggagagaa

SEQ ID NO: 758568 - RNA, 19 nt, Human
gcauauaaaaauaggugcu

SEQ ID NO: 758569 - RNA, 23 nt, Human
ggcaggggcgggggagggggagg

SEQ ID NO: 758570 - RNA, 20 nt, Human
gggagaaagagagguggggc

SEQ ID NO: 758571 - RNA, 24 nt, Human
gggagaaagagagguggggcaggg

SEQ ID NO: 758572 - RNA, 22 nt, Human
gggaggggaggagagaaggaga

SEQ ID NO: 758573 - RNA, 19 nt, Human
gggcaggggcgggggaggg

SEQ ID NO: 758574 - RNA, 22 nt, Human
gggcgggggagggggaggaagc

SEQ ID NO: 758575 - RNA, 26 nt, Human
ggggaggggaggagagaaggagaggg

SEQ ID NO: 758576 - RNA, 21 nt, Human
ggggagggggaggaagcaaaa

SEQ ID NO: 758577 - RNA, 23 nt, Human
ggggcgggggagggggaggaagc

SEQ ID NO: 758578 - RNA, 22 nt, Human
uaauaaaacccaaaacuugcaa

SEQ ID NO: 758579 - RNA, 19 nt, Human
uacaauaguagucaaauga

SEQ ID NO: 758580 - RNA, 23 nt, Human
uagccccaucuuacagauauccu

SEQ ID NO: 758581 - RNA, 24 nt, Human
uccacaaaagccaguuagacccac

SEQ ID NO: 758582 - RNA, 25 nt, Human
uccacaaaagccaguuagacccacc

SEQ ID NO: 758583 - RNA, 18 nt, Human
uccaccauucuuagcacu

SEQ ID NO: 758584 - RNA, 19 nt, Human
ucccgugccaaggcacuuc

SEQ ID NO: 758585 - RNA, 25 nt, Human
ucguaucuuccaccgaagcugagaa

SEQ ID NO: 758586 - RNA, 26 nt, Human
ucuguacaaaugcaacuggguuuggu

SEQ ID NO: 758587 - RNA, 23 nt, Human
ugaaaaugccuuccugauaccac

SEQ ID NO: 758588 - RNA, 22 nt, Human
ugaaacaacacaauuaaucaaa

SEQ ID NO: 758589 - RNA, 18 nt, Human
ugaaggaaagaggaaugg

SEQ ID NO: 758590 - RNA, 21 nt, Human
ugagaagggaggggaggggag

SEQ ID NO: 758591 - RNA, 22 nt, Human
uggggcaggggcgggggagggg

SEQ ID NO: 758592 - RNA, 24 nt, Human
uguccagaaugcauacaaacacau

SEQ ID NO: 758593 - RNA, 25 nt, Human
uuaaaggaaauugcacacccuuucc

SEQ ID NO: 758594 - RNA, 19 nt, Human
uuacacaaauguuucccac

SEQ ID NO: 758595 - RNA, 22 nt, Human
uuuguccacaucuauggugauc

SEQ ID NO: 758596 - RNA, 23 nt, Human
uuuuuuuaauucaaauguccaga

SEQ ID NO: 758597 - RNA, 21 nt, Human
cuuuuaccugcaaagcagcua

SEQ ID NO: 758598 - RNA, 21 nt, Human
ucaaaacacaagccucuuuau

SEQ ID NO: 758599 - RNA, 25 nt, Human
ucaaaacacaagccucuuuauucac

SEQ ID NO: 758600 - RNA, 18 nt, Human
uguuuaaaaauccaauua

SEQ ID NO: 758601 - RNA, 24 nt, Human
uucacauuguuuaaaaauccaauu

SEQ ID NO: 758602 - RNA, 24 nt, Human
uuuuuuuuuuucaaaacacaagcc

SEQ ID NO: 758603 - RNA, 22 nt, Human
aaaaacaaauguggccuggagc

SEQ ID NO: 758604 - RNA, 20 nt, Human
aaaacaaacaaaaacaaaaa

SEQ ID NO: 758605 - RNA, 22 nt, Human
aaaacaaacaaaaacaaaaaca

SEQ ID NO: 758606 - RNA, 21 nt, Human
aaaaggacaaaaauagggaaa

SEQ ID NO: 758607 - RNA, 24 nt, Human
aaacaaaaacaaaaacaacaaaaa

SEQ ID NO: 758608 - RNA, 21 nt, Human
aaacaaacaaaaacaaaaaca

SEQ ID NO: 758609 - RNA, 19 nt, Human
aaacacgcaacaaaaaaca

SEQ ID NO: 758610 - RNA, 21 nt, Human
aaauagcaaaacaaacaaaaa

SEQ ID NO: 758611 - RNA, 31 nt, Human
aaauagcaaaacaaacaaaaacaaaaacaaa

SEQ ID NO: 758612 - RNA, 23 nt, Human
aaauggaaguacacucuagaacc

SEQ ID NO: 758613 - RNA, 24 nt, Human
aaauuguugccaaauguauccauu

SEQ ID NO: 758614 - RNA, 23 nt, Human
aacaucuauacauuccuuuauuc

SEQ ID NO: 758615 - RNA, 22 nt, Human
aacuugaugaacacauuaauga

SEQ ID NO: 758616 - RNA, 24 nt, Human
aagaaagcacuuaucaggaggacu

SEQ ID NO: 758617 - RNA, 19 nt, Human
aagacagggaaguccaaac

SEQ ID NO: 758618 - RNA, 21 nt, Human
aagucuaugaacaauucuggu

SEQ ID NO: 758619 - RNA, 26 nt, Human
aagugaccaugcaucaagcugaaggu

SEQ ID NO: 758620 - RNA, 23 nt, Human
aaugucauaaaaaucucaaaaau

SEQ ID NO: 758621 - RNA, 23 nt, Human
acaaacaaaaacaaaaacaacaa

SEQ ID NO: 758622 - RNA, 20 nt, Human
acauuacagagacugaagag

SEQ ID NO: 758623 - RNA, 23 nt, Human
acucagcucagauuccuaauagg

SEQ ID NO: 758624 - RNA, 27 nt, Human
agaaaacaaaaucuagcaaacaaucau

SEQ ID NO: 758625 - RNA, 30 nt, Human
aggaguuuuguguguggaguccuggguuuu

SEQ ID NO: 758626 - RNA, 19 nt, Human
auagaacucuuuacaaaua

SEQ ID NO: 758627 - RNA, 19 nt, Human
aucaauauccacccacucu

SEQ ID NO: 758628 - RNA, 21 nt, Human
aucaugcgcacaaaauguguu

SEQ ID NO: 758629 - RNA, 24 nt, Human
augaauuuaaaauagccacaaaca

SEQ ID NO: 758630 - RNA, 24 nt, Human
auggaagccuagccacguuacugu

SEQ ID NO: 758631 - RNA, 22 nt, Human
caaacaaaaacaaaaacaacaa

SEQ ID NO: 758632 - RNA, 26 nt, Human
caaacaaaaacaaaaacaacaaaaau

SEQ ID NO: 758633 - RNA, 23 nt, Human
caaaguacaccauggaaaacccu

SEQ ID NO: 758634 - RNA, 19 nt, Human
caacaaaaaacagaugcug

SEQ ID NO: 758635 - RNA, 22 nt, Human
caacaaaaaacagaugcugcuu

SEQ ID NO: 758636 - RNA, 22 nt, Human
caacucagaccaucuuaaguua

SEQ ID NO: 758637 - RNA, 22 nt, Human
caauacaaagcccuaguuagua

SEQ ID NO: 758638 - RNA, 24 nt, Human
cacaaaauguguuuucccauaaca

SEQ ID NO: 758639 - RNA, 23 nt, Human
caccaaggauuggaaagcaguag

SEQ ID NO: 758640 - RNA, 20 nt, Human
cacugacauuacaguacuuc

SEQ ID NO: 758641 - RNA, 18 nt, Human
caggaguuuugugugugg

SEQ ID NO: 758642 - RNA, 20 nt, Human
caggggaagguaaaugggcc

SEQ ID NO: 758643 - RNA, 24 nt, Human
caucuccgucacggcccccgggag

SEQ ID NO: 758644 - RNA, 20 nt, Human
caucuguaaacagaauacca

SEQ ID NO: 758645 - RNA, 19 nt, Human
ccaaacaaacaacucagac

SEQ ID NO: 758646 - RNA, 24 nt, Human
ccaacuauauuugagacaaaauua

SEQ ID NO: 758647 - RNA, 25 nt, Human
ccagcagcgccucgcagcgccuccc

SEQ ID NO: 758648 - RNA, 26 nt, Human
ccauggaaaacccucgggggaaaauu

SEQ ID NO: 758649 - RNA, 18 nt, Human
ccccgggagcggcgggga

SEQ ID NO: 758650 - RNA, 21 nt, Human
cccgcccgcggccccuccucc

SEQ ID NO: 758651 - RNA, 19 nt, Human
ccgcccgcggccccuccuc

SEQ ID NO: 758652 - RNA, 19 nt, Human
ccgcugcgggcucccgccu

SEQ ID NO: 758653 - RNA, 23 nt, Human
ccuacauuuauuauuauuacuau

SEQ ID NO: 758654 - RNA, 19 nt, Human
ccuaucagcccugaaaaaa

SEQ ID NO: 758655 - RNA, 19 nt, Human
ccuccgcugcgggcucccg

SEQ ID NO: 758656 - RNA, 20 nt, Human
cuaaacuaugauaccuagca

SEQ ID NO: 758657 - RNA, 20 nt, Human
cuaauacaucuguaaacaga

SEQ ID NO: 758658 - RNA, 19 nt, Human
cuccuccgcugcgggcucc

SEQ ID NO: 758659 - RNA, 20 nt, Human
cuccuggagucccaagggcu

SEQ ID NO: 758660 - RNA, 25 nt, Human
cucugcuguuucuuucacacuuuag

SEQ ID NO: 758661 - RNA, 21 nt, Human
cugucacucuucuauguaggc

SEQ ID NO: 758662 - RNA, 22 nt, Human
cuuccaaugccaacuauauuug

SEQ ID NO: 758663 - RNA, 21 nt, Human
cuuuugucgucuugccccuau

SEQ ID NO: 758664 - RNA, 22 nt, Human
gagugcuuauuucuugcaaagu

SEQ ID NO: 758665 - RNA, 18 nt, Human
gcaaaacaaacaaaaaca

SEQ ID NO: 758666 - RNA, 23 nt, Human
gcaaaacaaacaaaaacaaaaac

SEQ ID NO: 758667 - RNA, 31 nt, Human
gcaaaacaaacaaaaacaaaaacaacaaaag

SEQ ID NO: 758668 - RNA, 22 nt, Human
gcaacuccaaagaguuacauag

SEQ ID NO: 758669 - RNA, 19 nt, Human
gcagcccgagggccagcag

SEQ ID NO: 758670 - RNA, 20 nt, Human
gcccgcggccccuccuccgc

SEQ ID NO: 758671 - RNA, 20 nt, Human
gccuggagcagacccaucag

SEQ ID NO: 758672 - RNA, 19 nt, Human
gcucccgccuuccccgccc

SEQ ID NO: 758673 - RNA, 19 nt, Human
ggagcagacccaucagucc

SEQ ID NO: 758674 - RNA, 19 nt, Human
ggauuggaaagcaguagua

SEQ ID NO: 758675 - RNA, 18 nt, Human
ggcccccgggagcggcgg

SEQ ID NO: 758676 - RNA, 21 nt, Human
gggaagacagggaaguccaaa

SEQ ID NO: 758677 - RNA, 22 nt, Human
gguaauuucaaaccacacuaaa

SEQ ID NO: 758678 - RNA, 20 nt, Human
guagguuuaauaguuggccu

SEQ ID NO: 758679 - RNA, 18 nt, Human
guccauguuuuaugaaca

SEQ ID NO: 758680 - RNA, 22 nt, Human
gugauuggggaucauucuggag

SEQ ID NO: 758681 - RNA, 25 nt, Human
uaaaaaucucaaaaauguaauguua

SEQ ID NO: 758682 - RNA, 23 nt, Human
uaaaauagccacaaacaggguga

SEQ ID NO: 758683 - RNA, 25 nt, Human
uaaaauggaaacacgcaacaaaaaa

SEQ ID NO: 758684 - RNA, 18 nt, Human
uaaaauuucugauugccu

SEQ ID NO: 758685 - RNA, 22 nt, Human
uaaagaagugaccaugcaucaa

SEQ ID NO: 758686 - RNA, 23 nt, Human
uaacaccauauuaucacaagucu

SEQ ID NO: 758687 - RNA, 19 nt, Human
uaacaguauuucaauuaug

SEQ ID NO: 758688 - RNA, 23 nt, Human
uaccaaaagacugaaaaaggaca

SEQ ID NO: 758689 - RNA, 25 nt, Human
uaccugaggaacuaguucagcaguu

SEQ ID NO: 758690 - RNA, 25 nt, Human
uagaaagagaugggaaacaaaaucc

SEQ ID NO: 758691 - RNA, 22 nt, Human
uagacugcagaugcaaacauuu

SEQ ID NO: 758692 - RNA, 23 nt, Human
uagacugcagaugcaaacauuua

SEQ ID NO: 758693 - RNA, 21 nt, Human
uagcaaaacaaacaaaaacaa

SEQ ID NO: 758694 - RNA, 24 nt, Human
uagcauacaugcugcaaaaaccuc

SEQ ID NO: 758695 - RNA, 18 nt, Human
uaugccauguaaguaaac

SEQ ID NO: 758696 - RNA, 23 nt, Human
uaugucacugacauuacaguacu

SEQ ID NO: 758697 - RNA, 20 nt, Human
ucaaauguuccaccaggggc

SEQ ID NO: 758698 - RNA, 18 nt, Human
uccaccauuguuuauuac

SEQ ID NO: 758699 - RNA, 19 nt, Human
ucccaggaguuuugugugg

SEQ ID NO: 758700 - RNA, 22 nt, Human
ucccggccuccgcagguuuccg

SEQ ID NO: 758701 - RNA, 21 nt, Human
uccugggaaagagcugagccu

SEQ ID NO: 758702 - RNA, 23 nt, Human
uccuuuagcauaugguagugucu

SEQ ID NO: 758703 - RNA, 21 nt, Human
ucuacaguauacauucaagua

SEQ ID NO: 758704 - RNA, 21 nt, Human
ucuagaaauaacaugacucau

SEQ ID NO: 758705 - RNA, 20 nt, Human
ucuaucaucaauaguccuuu

SEQ ID NO: 758706 - RNA, 21 nt, Human
ucuucauaucaccaaggauug

SEQ ID NO: 758707 - RNA, 18 nt, Human
ucuuugggggaagacagg

SEQ ID NO: 758708 - RNA, 18 nt, Human
ucuuugggggaagacagg

SEQ ID NO: 758709 - RNA, 24 nt, Human
ugaaaaacacuguauuuagaaaaa

SEQ ID NO: 758710 - RNA, 19 nt, Human
ugaaaaaggacaaaaauag

SEQ ID NO: 758711 - RNA, 24 nt, Human
ugaaaaaggacaaaaauagggaaa

SEQ ID NO: 758712 - RNA, 19 nt, Human
ugaaauacuauacuuaugg

SEQ ID NO: 758713 - RNA, 21 nt, Human
ugaacacauuaaugaaaaaaa

SEQ ID NO: 758714 - RNA, 18 nt, Human
ugaagaaacaugcaauca

SEQ ID NO: 758715 - RNA, 23 nt, Human
ugacacacccuguuucaacuuag

SEQ ID NO: 758716 - RNA, 22 nt, Human
ugacauguuuuuccagaguauc

SEQ ID NO: 758717 - RNA, 19 nt, Human
ugacuaaugcucaagagcu

SEQ ID NO: 758718 - RNA, 21 nt, Human
ugaggaacuaguucagcaguu

SEQ ID NO: 758719 - RNA, 23 nt, Human
ugaggaacuaguucagcaguuaa

SEQ ID NO: 758720 - RNA, 19 nt, Human
ugagucuggcuuuuacucu

SEQ ID NO: 758721 - RNA, 23 nt, Human
ugcuaaauagcaaaacaaacaaa

SEQ ID NO: 758722 - RNA, 18 nt, Human
ugcuguuucuuucacacu

SEQ ID NO: 758723 - RNA, 23 nt, Human
uggccuggagcagacccaucagu

SEQ ID NO: 758724 - RNA, 22 nt, Human
uguacagagacaagcaggguua

SEQ ID NO: 758725 - RNA, 22 nt, Human
ugugagauuagcacagcuguau

SEQ ID NO: 758726 - RNA, 23 nt, Human
uguguaucuauguacaaaacaua

SEQ ID NO: 758727 - RNA, 21 nt, Human
uguguguggaguccuggguuu

SEQ ID NO: 758728 - RNA, 19 nt, Human
uguuccaccaggggcaguc

SEQ ID NO: 758729 - RNA, 22 nt, Human
uguugauuaucuaaagaacuca

SEQ ID NO: 758730 - RNA, 23 nt, Human
uuauuuguaaauguucaaaaaaa

SEQ ID NO: 758731 - RNA, 20 nt, Human
uucacagaaccagaugcuuc

SEQ ID NO: 758732 - RNA, 18 nt, Human
uucaugaagaaacaugca

SEQ ID NO: 758733 - RNA, 22 nt, Human
uuccccgccccuugcagccgcc

SEQ ID NO: 758734 - RNA, 23 nt, Human
uuuacaauaaucaguuuccuaaa

SEQ ID NO: 758735 - RNA, 20 nt, Human
aaaaaaaacagaacaaaaua

SEQ ID NO: 758736 - RNA, 27 nt, Human
aaaaaaacagaacaaaauauaaccaag

SEQ ID NO: 758737 - RNA, 18 nt, Human
aaaaagccaauagagaac

SEQ ID NO: 758738 - RNA, 19 nt, Human
aaaaauacaaaacuuagcc

SEQ ID NO: 758739 - RNA, 19 nt, Human
aaacagacgugacugagau

SEQ ID NO: 758740 - RNA, 23 nt, Human
aaacagccuuauucaaauuuuca

SEQ ID NO: 758741 - RNA, 20 nt, Human
aaagaauuccuuaccauaca

SEQ ID NO: 758742 - RNA, 24 nt, Human
aaagauauuccuggaaacugugug

SEQ ID NO: 758743 - RNA, 23 nt, Human
aaaggccccauccccugcaaauc

SEQ ID NO: 758744 - RNA, 22 nt, Human
aagcagaacauggaggacagga

SEQ ID NO: 758745 - RNA, 18 nt, Human
aaguaugucuugauauac

SEQ ID NO: 758746 - RNA, 20 nt, Human
aauauggugaaaccccaucu

SEQ ID NO: 758747 - RNA, 22 nt, Human
aaucacucaaaugaaaaaaaga

SEQ ID NO: 758748 - RNA, 18 nt, Human
aaugaaaaaucaaagaug

SEQ ID NO: 758749 - RNA, 22 nt, Human
aaugaaaaaucaaagaugacua

SEQ ID NO: 758750 - RNA, 24 nt, Human
acagaacaagacucugccucaaaa

SEQ ID NO: 758751 - RNA, 22 nt, Human
acagggcaguaaaacuuaggag

SEQ ID NO: 758752 - RNA, 20 nt, Human
accauacacagugauacaaa

SEQ ID NO: 758753 - RNA, 21 nt, Human
accgacucccucugugcacgc

SEQ ID NO: 758754 - RNA, 18 nt, Human
accuggucuggagacccu

SEQ ID NO: 758755 - RNA, 24 nt, Human
accuggucuggagacccucucaga

SEQ ID NO: 758756 - RNA, 24 nt, Human
acgccacugcacuccagcccaggc

SEQ ID NO: 758757 - RNA, 25 nt, Human
acgccacugcacuccagcccaggca

SEQ ID NO: 758758 - RNA, 28 nt, Human
acucugccucaaaaaaaaaaaaaaaaaa

SEQ ID NO: 758759 - RNA, 25 nt, Human
acucuguagcuggcaccaaaagcug

SEQ ID NO: 758760 - RNA, 20 nt, Human
acugcaagcuccgccuccug

SEQ ID NO: 758761 - RNA, 24 nt, Human
acugcacuccagcccaggcaacag

SEQ ID NO: 758762 - RNA, 18 nt, Human
acugcacucuagccuggg

SEQ ID NO: 758763 - RNA, 25 nt, Human
acugcacucuagccugggcaacaua

SEQ ID NO: 758764 - RNA, 19 nt, Human
acuuuccuuauuggcuugg

SEQ ID NO: 758765 - RNA, 21 nt, Human
agaaaaaugaagaaauuucaa

SEQ ID NO: 758766 - RNA, 24 nt, Human
agcacuuucggaggcugagguggg

SEQ ID NO: 758767 - RNA, 20 nt, Human
agccaagcagaacauggagg

SEQ ID NO: 758768 - RNA, 23 nt, Human
agccgggcgugcuggcgcaugcc

SEQ ID NO: 758769 - RNA, 19 nt, Human
agccuggccaauaugguga

SEQ ID NO: 758770 - RNA, 22 nt, Human
agccuggccaauauggugaaac

SEQ ID NO: 758771 - RNA, 24 nt, Human
agccuggccaauauggugaaaccc

SEQ ID NO: 758772 - RNA, 23 nt, Human
agccugggcaacauagcaagacc

SEQ ID NO: 758773 - RNA, 24 nt, Human
agccugggcaacauagcaagaccu

SEQ ID NO: 758774 - RNA, 20 nt, Human
agcgcaguggcgcaaucucg

SEQ ID NO: 758775 - RNA, 24 nt, Human
agcgcaguggcgcaaucucggcuc

SEQ ID NO: 758776 - RNA, 24 nt, Human
agcuauacugagucuggauaaaua

SEQ ID NO: 758777 - RNA, 18 nt, Human
agcuccgccuccuggguu

SEQ ID NO: 758778 - RNA, 19 nt, Human
agcugaggcaggguugcuu

SEQ ID NO: 758779 - RNA, 20 nt, Human
aggaguuugagaccagccug

SEQ ID NO: 758780 - RNA, 18 nt, Human
aggcaggagaaucacuug

SEQ ID NO: 758781 - RNA, 24 nt, Human
aggcaggagaaucacuugaacccg

SEQ ID NO: 758782 - RNA, 24 nt, Human
aggcugaggcaggagaaucacuug

SEQ ID NO: 758783 - RNA, 19 nt, Human
aggcugaggugggcggauc

SEQ ID NO: 758784 - RNA, 24 nt, Human
aggugggcggaucacaaggucagg

SEQ ID NO: 758785 - RNA, 21 nt, Human
auaagacaggcaaaaucagaa

SEQ ID NO: 758786 - RNA, 20 nt, Human
auacacuucacuaagaauug

SEQ ID NO: 758787 - RNA, 21 nt, Human
aucacaaggucaggaguuuga

SEQ ID NO: 758788 - RNA, 23 nt, Human
aucacgccacugcacuccagccc

SEQ ID NO: 758789 - RNA, 19 nt, Human
auggugaaaccccaucucu

SEQ ID NO: 758790 - RNA, 18 nt, Human
auuuuaagcuauacugag

SEQ ID NO: 758791 - RNA, 20 nt, Human
caaaaauacaaaacuuagcc

SEQ ID NO: 758792 - RNA, 19 nt, Human
caaaagcugaaaagaauuc

SEQ ID NO: 758793 - RNA, 26 nt, Human
caaaaucagaaggagaaaauuuagaa

SEQ ID NO: 758794 - RNA, 18 nt, Human
caaagaugacuaccugaa

SEQ ID NO: 758795 - RNA, 24 nt, Human
caaaggaaaccaggccuauccccu

SEQ ID NO: 758796 - RNA, 24 nt, Human
caacagaacaagacucugccucaa

SEQ ID NO: 758797 - RNA, 22 nt, Human
caacauagcaagaccuugucuc

SEQ ID NO: 758798 - RNA, 24 nt, Human
caacauagcaagaccuugucucuu

SEQ ID NO: 758799 - RNA, 24 nt, Human
caagaucacgccacugcacuccag

SEQ ID NO: 758800 - RNA, 20 nt, Human
caagggacuugggagcaucu

SEQ ID NO: 758801 - RNA, 24 nt, Human
caauauggugaaaccccaucucug

SEQ ID NO: 758802 - RNA, 24 nt, Human
cacaaggucaggaguuugagacca

SEQ ID NO: 758803 - RNA, 22 nt, Human
caccaaaagcugaaaagaauuc

SEQ ID NO: 758804 - RNA, 23 nt, Human
caccuguagucccagcuacuugg

SEQ ID NO: 758805 - RNA, 23 nt, Human
cacgccuguaaucccagcacuuu

SEQ ID NO: 758806 - RNA, 25 nt, Human
cacuaaaccaaaaagccaauagaga

SEQ ID NO: 758807 - RNA, 19 nt, Human
cacugcacuccagcccagg

SEQ ID NO: 758808 - RNA, 21 nt, Human
cacugcacuccagcccaggca

SEQ ID NO: 758809 - RNA, 22 nt, Human
cacugcacuccagcccaggcaa

SEQ ID NO: 758810 - RNA, 23 nt, Human
cacugcacuccagcccaggcaac

SEQ ID NO: 758811 - RNA, 27 nt, Human
cacugcacuccagcccaggcaacagaa

SEQ ID NO: 758812 - RNA, 18 nt, Human
cacugcacucuagccugg

SEQ ID NO: 758813 - RNA, 19 nt, Human
cacugcacucuagccuggg

SEQ ID NO: 758814 - RNA, 21 nt, Human
cacugcacucuagccugggca

SEQ ID NO: 758815 - RNA, 23 nt, Human
cacugcacucuagccugggcaac

SEQ ID NO: 758816 - RNA, 24 nt, Human
cacugcacucuagccugggcaaca

SEQ ID NO: 758817 - RNA, 25 nt, Human
cagaacaaaauaaggcaguuggacg

SEQ ID NO: 758818 - RNA, 22 nt, Human
cagagcacuagugauuuuucuu

SEQ ID NO: 758819 - RNA, 24 nt, Human
cagcaaugucauguuugugauuuu

SEQ ID NO: 758820 - RNA, 20 nt, Human
cagcaccaaagcaugaguca

SEQ ID NO: 758821 - RNA, 24 nt, Human
cagcacuuucggaggcugaggugg

SEQ ID NO: 758822 - RNA, 20 nt, Human
cagcccaggcaacagaacaa

SEQ ID NO: 758823 - RNA, 24 nt, Human
cagcuacucgggaggcugaggcag

SEQ ID NO: 758824 - RNA, 25 nt, Human
cauagcaagaccuugucucuuaaaa

SEQ ID NO: 758825 - RNA, 18 nt, Human
cauccaaaaccaggaagu

SEQ ID NO: 758826 - RNA, 20 nt, Human
cauccccugcaaaucauuuc

SEQ ID NO: 758827 - RNA, 23 nt, Human
ccaaagaagucuauacaaaaacu

SEQ ID NO: 758828 - RNA, 21 nt, Human
ccaagcagaacauggaggaca

SEQ ID NO: 758829 - RNA, 21 nt, Human
ccaaguauuuacgccaaaucc

SEQ ID NO: 758830 - RNA, 18 nt, Human
ccacaaagaaucacucaa

SEQ ID NO: 758831 - RNA, 20 nt, Human
ccacuacuuccuccuccugu

SEQ ID NO: 758832 - RNA, 19 nt, Human
ccacugcacuccagcccag

SEQ ID NO: 758833 - RNA, 20 nt, Human
ccacugcacuccagcccagg

SEQ ID NO: 758834 - RNA, 20 nt, Human
ccacugcacuccagcccagg

SEQ ID NO: 758835 - RNA, 21 nt, Human
ccacugcacuccagcccaggc

SEQ ID NO: 758836 - RNA, 24 nt, Human
ccacugcacuccagcccaggcaac

SEQ ID NO: 758837 - RNA, 20 nt, Human
ccacugcacucuagccuggg

SEQ ID NO: 758838 - RNA, 20 nt, Human
ccacugcacucuagccuggg

SEQ ID NO: 758839 - RNA, 21 nt, Human
ccacugcacucuagccugggc

SEQ ID NO: 758840 - RNA, 23 nt, Human
ccacugcacucuagccugggcaa

SEQ ID NO: 758841 - RNA, 24 nt, Human
ccacugcacucuagccugggcaac

SEQ ID NO: 758842 - RNA, 23 nt, Human
cccucugugagcucaagguaguc

SEQ ID NO: 758843 - RNA, 21 nt, Human
ccuccuccugucagcaaacag

SEQ ID NO: 758844 - RNA, 23 nt, Human
ccuggccaauauggugaaacccc

SEQ ID NO: 758845 - RNA, 24 nt, Human
ccuggccaauauggugaaacccca

SEQ ID NO: 758846 - RNA, 21 nt, Human
ccugggcaacauagcaagacc

SEQ ID NO: 758847 - RNA, 21 nt, Human
ccugggugcucaaagaaugug

SEQ ID NO: 758848 - RNA, 21 nt, Human
ccuguaauuccagcuacucgg

SEQ ID NO: 758849 - RNA, 22 nt, Human
ccuguaauuccagcuacucggg

SEQ ID NO: 758850 - RNA, 21 nt, Human
ccuguagucccagcuacuugg

SEQ ID NO: 758851 - RNA, 28 nt, Human
ccugugaauagccacugcacucuagccu

SEQ ID NO: 758852 - RNA, 24 nt, Human
cgccacugcacuccagcccaggca

SEQ ID NO: 758853 - RNA, 24 nt, Human
cgccuguaaucccagcacuuucgg

SEQ ID NO: 758854 - RNA, 21 nt, Human
cggaucacaaggucaggaguu

SEQ ID NO: 758855 - RNA, 20 nt, Human
cuaacgaagccaagcagaaa

SEQ ID NO: 758856 - RNA, 25 nt, Human
cuagaaaaauaaagcaaccucaaaa

SEQ ID NO: 758857 - RNA, 23 nt, Human
cucaaaaaaaaaaaaaaaaaaaa

SEQ ID NO: 758858 - RNA, 24 nt, Human
cucacgccuguaaucccagcacuu

SEQ ID NO: 758859 - RNA, 25 nt, Human
cucacgccuguaaucccagcacuuu

SEQ ID NO: 758860 - RNA, 24 nt, Human
cucgcucuguugcccaggcuggag

SEQ ID NO: 758861 - RNA, 19 nt, Human
cucugccucaaaaaaaaaa

SEQ ID NO: 758862 - RNA, 22 nt, Human
cucugccucaaaaaaaaaaaaa

SEQ ID NO: 758863 - RNA, 22 nt, Human
cucuguugcccaggcuggagcg

SEQ ID NO: 758864 - RNA, 23 nt, Human
cucuguugcccaggcuggagcgc

SEQ ID NO: 758865 - RNA, 23 nt, Human
cugaggcaggguugcuugaaccc

SEQ ID NO: 758866 - RNA, 23 nt, Human
cugcaccugugaauagccacugc

SEQ ID NO: 758867 - RNA, 18 nt, Human
cuggauuaaucucacagc

SEQ ID NO: 758868 - RNA, 27 nt, Human
cuuaaaaaaaaaauuggagaggggguu

SEQ ID NO: 758869 - RNA, 19 nt, Human
cuuguucauucccuuggau

SEQ ID NO: 758870 - RNA, 21 nt, Human
gaaaugcucaccgacucccuc

SEQ ID NO: 758871 - RNA, 24 nt, Human
gaagagagcugcaagggacuuggg

SEQ ID NO: 758872 - RNA, 24 nt, Human
gaauagccacugcacucuagccug

SEQ ID NO: 758873 - RNA, 20 nt, Human
gacgugguggcucacgccug

SEQ ID NO: 758874 - RNA, 23 nt, Human
gacgugguggcucacgccuguaa

SEQ ID NO: 758875 - RNA, 23 nt, Human
gagaaucacuugaacccgggggg

SEQ ID NO: 758876 - RNA, 20 nt, Human
gagagggggugggagguaag

SEQ ID NO: 758877 - RNA, 21 nt, Human
gaucacaaggucaggaguuug

SEQ ID NO: 758878 - RNA, 22 nt, Human
gaucacaaggucaggaguuuga

SEQ ID NO: 758879 - RNA, 24 nt, Human
gaucacaaggucaggaguuugaga

SEQ ID NO: 758880 - RNA, 21 nt, Human
gcaggagaaucacuugaaccc

SEQ ID NO: 758881 - RNA, 21 nt, Human
gcaguggcgcaaucucggcuc

SEQ ID NO: 758882 - RNA, 23 nt, Human
gcaguuggacgugguggcucacg

SEQ ID NO: 758883 - RNA, 20 nt, Human
gccaagaucacgccacugca

SEQ ID NO: 758884 - RNA, 24 nt, Human
gccaauauggugaaaccccaucuc

SEQ ID NO: 758885 - RNA, 21 nt, Human
gccacugcacucuagccuggg

SEQ ID NO: 758886 - RNA, 22 nt, Human
gccacugcacucuagccugggc

SEQ ID NO: 758887 - RNA, 24 nt, Human
gccacugcacucuagccugggcaa

SEQ ID NO: 758888 - RNA, 19 nt, Human
gcuggagcgcaguggcgca

SEQ ID NO: 758889 - RNA, 24 nt, Human
gcuggcgcaugccuguaauuccag

SEQ ID NO: 758890 - RNA, 22 nt, Human
ggaaaugcucaccgacucccuc

SEQ ID NO: 758891 - RNA, 22 nt, Human
ggaggcugaggugggcggauca

SEQ ID NO: 758892 - RNA, 23 nt, Human
ggagucucgcucuguugcccagg

SEQ ID NO: 758893 - RNA, 20 nt, Human
ggaucacaaggucaggaguu

SEQ ID NO: 758894 - RNA, 23 nt, Human
ggaucacaaggucaggaguuuga

SEQ ID NO: 758895 - RNA, 24 nt, Human
ggcaaagauuuuaagaaaccgaag

SEQ ID NO: 758896 - RNA, 23 nt, Human
ggcggaucacaaggucaggaguu

SEQ ID NO: 758897 - RNA, 19 nt, Human
ggcggggguugcagugagc

SEQ ID NO: 758898 - RNA, 23 nt, Human
ggcggggguugcagugagccaag

SEQ ID NO: 758899 - RNA, 23 nt, Human
ggcgugcuggcgcaugccuguaa

SEQ ID NO: 758900 - RNA, 23 nt, Human
gggaggcugaggcaggagaauca

SEQ ID NO: 758901 - RNA, 19 nt, Human
gggcaugguagcaugcacc

SEQ ID NO: 758902 - RNA, 24 nt, Human
gggcaugguagcaugcaccuguag

SEQ ID NO: 758903 - RNA, 19 nt, Human
gggguugcagugagccaag

SEQ ID NO: 758904 - RNA, 23 nt, Human
gggguugcagugagccaagauca

SEQ ID NO: 758905 - RNA, 24 nt, Human
gguggcucacgccuguaaucccag

SEQ ID NO: 758906 - RNA, 20 nt, Human
gguugcagugagccaagauc

SEQ ID NO: 758907 - RNA, 24 nt, Human
gucucgcucuguugcccaggcugg

SEQ ID NO: 758908 - RNA, 19 nt, Human
guuuagaugacagucccuc

SEQ ID NO: 758909 - RNA, 24 nt, Human
uaaaacuuacauccaaaaccagga

SEQ ID NO: 758910 - RNA, 19 nt, Human
uaaagguacuagaggugcu

SEQ ID NO: 758911 - RNA, 19 nt, Human
uaacgaagccaagcagaac

SEQ ID NO: 758912 - RNA, 18 nt, Human
uaaguguaaucaauacac

SEQ ID NO: 758913 - RNA, 23 nt, Human
uacaaaggaaaccaggccuaucc

SEQ ID NO: 758914 - RNA, 24 nt, Human
uacacagugauacaauuaaugcuc

SEQ ID NO: 758915 - RNA, 19 nt, Human
uacacugaaaaaauuacac

SEQ ID NO: 758916 - RNA, 24 nt, Human
uaccaaguauuuacgccaaauccu

SEQ ID NO: 758917 - RNA, 19 nt, Human
uacuuccuccuccugucag

SEQ ID NO: 758918 - RNA, 19 nt, Human
uacuugguuagcugaggca

SEQ ID NO: 758919 - RNA, 18 nt, Human
uagaaguuauaugcaucu

SEQ ID NO: 758920 - RNA, 22 nt, Human
uagcaugcaccuguagucccag

SEQ ID NO: 758921 - RNA, 23 nt, Human
uagcugaggcaggguugcuugaa

SEQ ID NO: 758922 - RNA, 23 nt, Human
uagugauuuuucuucugaagaga

SEQ ID NO: 758923 - RNA, 20 nt, Human
uauaagacaggcaaaaucag

SEQ ID NO: 758924 - RNA, 23 nt, Human
uaugaaauuauaaaauuccacaa

SEQ ID NO: 758925 - RNA, 19 nt, Human
uauuaaacaguucagacua

SEQ ID NO: 758926 - RNA, 23 nt, Human
ucaaaaaaaaaaaaaaaaaaaaa

SEQ ID NO: 758927 - RNA, 24 nt, Human
ucacaaggucaggaguuugagacc

SEQ ID NO: 758928 - RNA, 18 nt, Human
ucacugcaagcuccgccu

SEQ ID NO: 758929 - RNA, 23 nt, Human
ucacugcaagcuccgccuccugg

SEQ ID NO: 758930 - RNA, 24 nt, Human
ucacugcaagcuccgccuccuggg

SEQ ID NO: 758931 - RNA, 23 nt, Human
ucacuugaacccggggggcgggg

SEQ ID NO: 758932 - RNA, 21 nt, Human
ucagugguuccccugguuuag

SEQ ID NO: 758933 - RNA, 22 nt, Human
uccacaauacacuucacuaaga

SEQ ID NO: 758934 - RNA, 24 nt, Human
uccccugcaaaucauuucauguaa

SEQ ID NO: 758935 - RNA, 24 nt, Human
ucccuggaaaaggccccauccccu

SEQ ID NO: 758936 - RNA, 21 nt, Human
uccgccgcccagauaaccgcc

SEQ ID NO: 758937 - RNA, 20 nt, Human
uccugaaagcaaaaccucau

SEQ ID NO: 758938 - RNA, 21 nt, Human
uccuggguucaauguugugaa

SEQ ID NO: 758939 - RNA, 18 nt, Human
uccuuauuggcuugggua

SEQ ID NO: 758940 - RNA, 24 nt, Human
ucggaggcugaggugggcggauca

SEQ ID NO: 758941 - RNA, 25 nt, Human
ucgggaggcugaggcaggagaauca

SEQ ID NO: 758942 - RNA, 19 nt, Human
ucucgcucuguugcccagg

SEQ ID NO: 758943 - RNA, 23 nt, Human
ucucgcucuguugcccaggcugg

SEQ ID NO: 758944 - RNA, 24 nt, Human
ucucgcucuguugcccaggcugga

SEQ ID NO: 758945 - RNA, 26 nt, Human
ucucgcucuguugcccaggcuggagc

SEQ ID NO: 758946 - RNA, 29 nt, Human
ucucuuaaaaaaaaaauuggagagggggu

SEQ ID NO: 758947 - RNA, 23 nt, Human
ucugaagcaccuuuugaguugua

SEQ ID NO: 758948 - RNA, 23 nt, Human
ucugccucauuccaaaauuuucc

SEQ ID NO: 758949 - RNA, 19 nt, Human
ucuggauuaaucucacagc

SEQ ID NO: 758950 - RNA, 21 nt, Human
ucuguagcuggcaccaaaagc

SEQ ID NO: 758951 - RNA, 18 nt, Human
ucuguugcccaggcugga

SEQ ID NO: 758952 - RNA, 19 nt, Human
ucuuguucauucccuugga

SEQ ID NO: 758953 - RNA, 20 nt, Human
ugaaaugguugauucugugg

SEQ ID NO: 758954 - RNA, 24 nt, Human
ugaagaccacaagucucaagucaa

SEQ ID NO: 758955 - RNA, 21 nt, Human
ugaaguuccccaaacuugaaa

SEQ ID NO: 758956 - RNA, 23 nt, Human
ugagaccagccuggccaauaugg

SEQ ID NO: 758957 - RNA, 24 nt, Human
ugagaccagccuggccaauauggu

SEQ ID NO: 758958 - RNA, 20 nt, Human
ugaggcaggagaaucacuug

SEQ ID NO: 758959 - RNA, 24 nt, Human
ugaggcaggagaaucacuugaacc

SEQ ID NO: 758960 - RNA, 25 nt, Human
ugaggcaggagaaucacuugaaccc

SEQ ID NO: 758961 - RNA, 21 nt, Human
ugaggcaggguugcuugaacc

SEQ ID NO: 758962 - RNA, 21 nt, Human
ugaggugggcggaucacaagg

SEQ ID NO: 758963 - RNA, 24 nt, Human
ugaggugggcggaucacaagguca

SEQ ID NO: 758964 - RNA, 26 nt, Human
ugaggugggcggaucacaaggucagg

SEQ ID NO: 758965 - RNA, 23 nt, Human
ugaggugggcggaucacaagguu

SEQ ID NO: 758966 - RNA, 23 nt, Human
ugagucaaaaagguuugguauua

SEQ ID NO: 758967 - RNA, 23 nt, Human
ugauauacugugaaacauggcca

SEQ ID NO: 758968 - RNA, 24 nt, Human
ugcaccuguagucccagcuacuug

SEQ ID NO: 758969 - RNA, 19 nt, Human
ugcacgcucacacaugggg

SEQ ID NO: 758970 - RNA, 22 nt, Human
ugcaguaaccuggucuggagac

SEQ ID NO: 758971 - RNA, 21 nt, Human
ugccaaaaauacaaaacuuag

SEQ ID NO: 758972 - RNA, 21 nt, Human
ugcccaggcuggagcgcagug

SEQ ID NO: 758973 - RNA, 24 nt, Human
ugcccaggcuggagcgcaguggcg

SEQ ID NO: 758974 - RNA, 19 nt, Human
ugccucauuccaaaauuuu

SEQ ID NO: 758975 - RNA, 23 nt, Human
ugccuguaauuccagcuacucgg

SEQ ID NO: 758976 - RNA, 24 nt, Human
ugccuguaauuccagcuacucggg

SEQ ID NO: 758977 - RNA, 24 nt, Human
ugcuggcgcaugccuguaauucca

SEQ ID NO: 758978 - RNA, 21 nt, Human
ugcuugauauacugugaaaca

SEQ ID NO: 758979 - RNA, 19 nt, Human
uggacgugguggcucacgc

SEQ ID NO: 758980 - RNA, 21 nt, Human
uggagagggggugggagguaa

SEQ ID NO: 758981 - RNA, 24 nt, Human
uggagcgcaguggcgcaaucucgg

SEQ ID NO: 758982 - RNA, 24 nt, Human
uggagucucgcucuguugcccagg

SEQ ID NO: 758983 - RNA, 24 nt, Human
uggccaauauggugaaaccccauc

SEQ ID NO: 758984 - RNA, 21 nt, Human
uggcgcaugccuguaauucca

SEQ ID NO: 758985 - RNA, 22 nt, Human
uggcucacgccuguaaucccag

SEQ ID NO: 758986 - RNA, 24 nt, Human
uggcucacgccuguaaucccagca

SEQ ID NO: 758987 - RNA, 24 nt, Human
ugguagcaugcaccuguaguccca

SEQ ID NO: 758988 - RNA, 24 nt, Human
ugguggcucacgccuguaauccca

SEQ ID NO: 758989 - RNA, 21 nt, Human
ugugaaacauggccagcucaa

SEQ ID NO: 758990 - RNA, 22 nt, Human
ugugcaauucuuccaguguugc

SEQ ID NO: 758991 - RNA, 22 nt, Human
uguuccacaauacacuucacua

SEQ ID NO: 758992 - RNA, 19 nt, Human
uuacauaauuugcagagga

SEQ ID NO: 758993 - RNA, 22 nt, Human
uuauggucuuuugaaguucccc

SEQ ID NO: 758994 - RNA, 24 nt, Human
uugaacccggggggcggggguugc

SEQ ID NO: 758995 - RNA, 20 nt, Human
uugcagugagccaagaucac

SEQ ID NO: 758996 - RNA, 19 nt, Human
uuuaucgccuaagaaugcu

SEQ ID NO: 758997 - RNA, 24 nt, Human
aaaaaaacauagcaacaaagagac

SEQ ID NO: 758998 - RNA, 25 nt, Human
aaacaaaaaaacauagcaacaaaga

SEQ ID NO: 758999 - RNA, 26 nt, Human
aaacaaaaaaacauagcaacaaagag

SEQ ID NO: 759000 - RNA, 21 nt, Human
aaacagaugggagaacaagac

SEQ ID NO: 759001 - RNA, 24 nt, Human
aaacuuggaagcagcauuuggcag

SEQ ID NO: 759002 - RNA, 18 nt, Human
aaagacacccccgccccc

SEQ ID NO: 759003 - RNA, 24 nt, Human
aaagugcugggauuacaggcguga

SEQ ID NO: 759004 - RNA, 21 nt, Human
aaaguucacauccccccacca

SEQ ID NO: 759005 - RNA, 22 nt, Human
aaaguucacauccccccaccaa

SEQ ID NO: 759006 - RNA, 18 nt, Human
aaccaggggaagaguucc

SEQ ID NO: 759007 - RNA, 21 nt, Human
aagaauaaacagaugggagaa

SEQ ID NO: 759008 - RNA, 23 nt, Human
aagacacccccgcccccagaaga

SEQ ID NO: 759009 - RNA, 20 nt, Human
aagacccuccucuuccuugg

SEQ ID NO: 759010 - RNA, 30 nt, Human
aagacccuccucuuccuuuucccccacagg

SEQ ID NO: 759011 - RNA, 22 nt, Human
aagaguuccugaagaaaugggu

SEQ ID NO: 759012 - RNA, 23 nt, Human
aaggucuuaaagggguuuuggga

SEQ ID NO: 759013 - RNA, 19 nt, Human
aagugcugggauuacaggc

SEQ ID NO: 759014 - RNA, 19 nt, Human
aagugcugggauuacaggc

SEQ ID NO: 759015 - RNA, 24 nt, Human
aaugcaauggcgugaucucggcuc

SEQ ID NO: 759016 - RNA, 22 nt, Human
acaaaaaaacauagcaacaaag

SEQ ID NO: 759017 - RNA, 24 nt, Human
accaugcucggggcucccugaggc

SEQ ID NO: 759018 - RNA, 19 nt, Human
agaaagccccaaaguaguc

SEQ ID NO: 759019 - RNA, 22 nt, Human
agacaaccuucucccgccccuc

SEQ ID NO: 759020 - RNA, 24 nt, Human
agacauggguuuaggaacaugaaa

SEQ ID NO: 759021 - RNA, 22 nt, Human
agagauggguggggggcgaugg

SEQ ID NO: 759022 - RNA, 24 nt, Human
agagcugagcugucaggccugagc

SEQ ID NO: 759023 - RNA, 24 nt, Human
agcauguuagucaggcuggucuug

SEQ ID NO: 759024 - RNA, 20 nt, Human
agccacauggacucaaacuu

SEQ ID NO: 759025 - RNA, 18 nt, Human
agccccaccccacaucag

SEQ ID NO: 759026 - RNA, 23 nt, Human
agccccaccccacaucagacacc

SEQ ID NO: 759027 - RNA, 18 nt, Human
agccccauuucacaggug

SEQ ID NO: 759028 - RNA, 20 nt, Human
agccccauuucacagguggg

SEQ ID NO: 759029 - RNA, 18 nt, Human
agccucugagcaacuccu

SEQ ID NO: 759030 - RNA, 26 nt, Human
agcugcacaugguaggcgcugugugu

SEQ ID NO: 759031 - RNA, 19 nt, Human
aggacuuuggggacccugg

SEQ ID NO: 759032 - RNA, 18 nt, Human
agggcgagggggaggagg

SEQ ID NO: 759033 - RNA, 24 nt, Human
aggugauccacccaucucagccuc

SEQ ID NO: 759034 - RNA, 19 nt, Human
agguucaagugauucuccu

SEQ ID NO: 759035 - RNA, 21 nt, Human
aguagcugggauuacaggugc

SEQ ID NO: 759036 - RNA, 24 nt, Human
agugauucuccuuccucagccuuc

SEQ ID NO: 759037 - RNA, 22 nt, Human
aguggcucugagcaaguuuuaa

SEQ ID NO: 759038 - RNA, 20 nt, Human
augggguuucagcauguuag

SEQ ID NO: 759039 - RNA, 21 nt, Human
augggguuucagcauguuagu

SEQ ID NO: 759040 - RNA, 20 nt, Human
auuccugggaacuucaaaca

SEQ ID NO: 759041 - RNA, 24 nt, Human
caaagugcugggauuacaggcgug

SEQ ID NO: 759042 - RNA, 22 nt, Human
caacaaagagacccagcuucca

SEQ ID NO: 759043 - RNA, 23 nt, Human
caacaaagagacccagcuuccag

SEQ ID NO: 759044 - RNA, 22 nt, Human
caacauacaaaagucuggagaa

SEQ ID NO: 759045 - RNA, 22 nt, Human
caagugauucuccuuccucagc

SEQ ID NO: 759046 - RNA, 24 nt, Human
cacaggugggcaaacugaggcaga

SEQ ID NO: 759047 - RNA, 24 nt, Human
cacauccccccaccaagcacgguc

SEQ ID NO: 759048 - RNA, 24 nt, Human
caccauguccagcuaauuuuucua

SEQ ID NO: 759049 - RNA, 24 nt, Human
caccauguggcucagcaugcaggc

SEQ ID NO: 759050 - RNA, 22 nt, Human
cacccaucucagccucccaaag

SEQ ID NO: 759051 - RNA, 23 nt, Human
cacccaucucagccucccaaagu

SEQ ID NO: 759052 - RNA, 26 nt, Human
caccggaaccccucaaauauuccugg

SEQ ID NO: 759053 - RNA, 19 nt, Human
cagaaugacgggugaccac

SEQ ID NO: 759054 - RNA, 18 nt, Human
cagagauggguggggggc

SEQ ID NO: 759055 - RNA, 19 nt, Human
cagcagugcuggccaagcc

SEQ ID NO: 759056 - RNA, 24 nt, Human
cagcauguuagucaggcuggucuu

SEQ ID NO: 759057 - RNA, 19 nt, Human
cagcccaccgcgugcccug

SEQ ID NO: 759058 - RNA, 19 nt, Human
cagcgagcgcuccucggcc

SEQ ID NO: 759059 - RNA, 21 nt, Human
caggugccugccaccaugucc

SEQ ID NO: 759060 - RNA, 22 nt, Human
caucaccggaaccccucaaaua

SEQ ID NO: 759061 - RNA, 27 nt, Human
caucagacacccuuuggcagauauccu

SEQ ID NO: 759062 - RNA, 24 nt, Human
cauccccccaccaagcacggucuc

SEQ ID NO: 759063 - RNA, 24 nt, Human
caucucagccucccaaagugcugg

SEQ ID NO: 759064 - RNA, 24 nt, Human
cauguuagucaggcuggucuugaa

SEQ ID NO: 759065 - RNA, 22 nt, Human
ccaaagugcugggauuacaggc

SEQ ID NO: 759066 - RNA, 22 nt, Human
ccaaagugcugggauuacaggc

SEQ ID NO: 759067 - RNA, 24 nt, Human
ccaaagugcugggauuacaggcgu

SEQ ID NO: 759068 - RNA, 23 nt, Human
ccaagauccccagaacaaccagg

SEQ ID NO: 759069 - RNA, 24 nt, Human
ccacagagaagaucccuaaacaca

SEQ ID NO: 759070 - RNA, 22 nt, Human
ccacaucagacacccuuuggca

SEQ ID NO: 759071 - RNA, 26 nt, Human
ccacccaucucagccucccaaagugc

SEQ ID NO: 759072 - RNA, 19 nt, Human
ccaccuagaaccuuccugg

SEQ ID NO: 759073 - RNA, 19 nt, Human
ccacugcgcccagccccaa

SEQ ID NO: 759074 - RNA, 20 nt, Human
ccacugcgcccagccccaau

SEQ ID NO: 759075 - RNA, 23 nt, Human
ccagaaucuuccaccggcuuucc

SEQ ID NO: 759076 - RNA, 25 nt, Human
ccagccccaccccacaucagacacc

SEQ ID NO: 759077 - RNA, 24 nt, Human
cccaagauccccagaacaaccagg

SEQ ID NO: 759078 - RNA, 19 nt, Human
cccaccccacaucagacac

SEQ ID NO: 759079 - RNA, 22 nt, Human
cccaccccacaucagacacccu

SEQ ID NO: 759080 - RNA, 22 nt, Human
ccccagaacaaccaggggaaga

SEQ ID NO: 759081 - RNA, 21 nt, Human
ccccccaccaagcacggucuc

SEQ ID NO: 759082 - RNA, 21 nt, Human
cccgacuacccucagaaucca

SEQ ID NO: 759083 - RNA, 18 nt, Human
cccgcccccagaagacgg

SEQ ID NO: 759084 - RNA, 20 nt, Human
cccgcccccagaagacgggg

SEQ ID NO: 759085 - RNA, 21 nt, Human
cccgccccucaccucugagaa

SEQ ID NO: 759086 - RNA, 22 nt, Human
cccucagaauccaaauucugca

SEQ ID NO: 759087 - RNA, 22 nt, Human
cccugaggcucuguccccacac

SEQ ID NO: 759088 - RNA, 21 nt, Human
ccgaguagcugggauuacagg

SEQ ID NO: 759089 - RNA, 23 nt, Human
ccgaguagcugggauuacaggug

SEQ ID NO: 759090 - RNA, 21 nt, Human
ccgccgcucuggccccgcucu

SEQ ID NO: 759091 - RNA, 23 nt, Human
ccgccgcucuggccccgcucugg

SEQ ID NO: 759092 - RNA, 19 nt, Human
ccgcugaggaaaccuaagg

SEQ ID NO: 759093 - RNA, 22 nt, Human
ccggccccugcuguuaguuccg

SEQ ID NO: 759094 - RNA, 24 nt, Human
ccuacuagguucaagugauucucc

SEQ ID NO: 759095 - RNA, 23 nt, Human
ccugaucucaggugauccaccca

SEQ ID NO: 759096 - RNA, 18 nt, Human
ccuggcucugugcugccc

SEQ ID NO: 759097 - RNA, 24 nt, Human
ccuuccucagccuuccgaguagcu

SEQ ID NO: 759098 - RNA, 26 nt, Human
cgagggggaggagggcaucccaggag

SEQ ID NO: 759099 - RNA, 18 nt, Human
cgaguggccucgccuggc

SEQ ID NO: 759100 - RNA, 21 nt, Human
cgagugucuguccaucugucc

SEQ ID NO: 759101 - RNA, 23 nt, Human
cgcugugcuccucacaaccugga

SEQ ID NO: 759102 - RNA, 19 nt, Human
cgggaucggggccgucugc

SEQ ID NO: 759103 - RNA, 22 nt, Human
cguugcccaggcuagaaugcaa

SEQ ID NO: 759104 - RNA, 19 nt, Human
cucaaacuuggaagcagca

SEQ ID NO: 759105 - RNA, 19 nt, Human
cucaaguggcuaaguggcu

SEQ ID NO: 759106 - RNA, 19 nt, Human
cucacugcaaccucugccu

SEQ ID NO: 759107 - RNA, 24 nt, Human
cucagccuuccgaguagcugggau

SEQ ID NO: 759108 - RNA, 21 nt, Human
cucccaagauccccagaacaa

SEQ ID NO: 759109 - RNA, 18 nt, Human
cuccgugcgaggcccagc

SEQ ID NO: 759110 - RNA, 21 nt, Human
cuccucggccucggcgccgcc

SEQ ID NO: 759111 - RNA, 24 nt, Human
cuccucggccucggcgccgcccgc

SEQ ID NO: 759112 - RNA, 18 nt, Human
cuccucuuccuuuucccc

SEQ ID NO: 759113 - RNA, 19 nt, Human
cuccuuccgcucucucuca

SEQ ID NO: 759114 - RNA, 18 nt, Human
cucugccucagugagcug

SEQ ID NO: 759115 - RNA, 20 nt, Human
cugcaaccucugccuacuag

SEQ ID NO: 759116 - RNA, 24 nt, Human
cugcaaccucugccuacuagguuc

SEQ ID NO: 759117 - RNA, 23 nt, Human
cugccuacuagguucaagugauu

SEQ ID NO: 759118 - RNA, 20 nt, Human
cugcggcuccagcacuggcg

SEQ ID NO: 759119 - RNA, 22 nt, Human
cuggccccagaggagacaaccu

SEQ ID NO: 759120 - RNA, 21 nt, Human
cugguucuggcccugccacuu

SEQ ID NO: 759121 - RNA, 19 nt, Human
cuucaugcuggaccaggcc

SEQ ID NO: 759122 - RNA, 23 nt, Human
cuuuggggacccugguucuggcc

SEQ ID NO: 759123 - RNA, 21 nt, Human
gaaaagacacccccgccccca

SEQ ID NO: 759124 - RNA, 21 nt, Human
gacaaccuucucccgccccuc

SEQ ID NO: 759125 - RNA, 25 nt, Human
gacccuccucuuccuuuucccccac

SEQ ID NO: 759126 - RNA, 19 nt, Human
gacccugguucuggcccug

SEQ ID NO: 759127 - RNA, 23 nt, Human
gacuucagugagguaggugguau

SEQ ID NO: 759128 - RNA, 21 nt, Human
gagaacaagacccuccucuuc

SEQ ID NO: 759129 - RNA, 19 nt, Human
gagcccaaagaauaaacag

SEQ ID NO: 759130 - RNA, 21 nt, Human
gagcugagcugucaggccuga

SEQ ID NO: 759131 - RNA, 19 nt, Human
gaggcucuguccccacacu

SEQ ID NO: 759132 - RNA, 21 nt, Human
gagguauucccagcccagggc

SEQ ID NO: 759133 - RNA, 18 nt, Human
gaguggccucgccuggcu

SEQ ID NO: 759134 - RNA, 24 nt, Human
gaucucaggugauccacccaucuc

SEQ ID NO: 759135 - RNA, 18 nt, Human
gauuacaggcgugagcca

SEQ ID NO: 759136 - RNA, 19 nt, Human
gauuacaggcgugagccac

SEQ ID NO: 759137 - RNA, 22 nt, Human
gauuacaggcgugagccacugc

SEQ ID NO: 759138 - RNA, 18 nt, Human
gauuacaggugccugcca

SEQ ID NO: 759139 - RNA, 22 nt, Human
gauuacaggugccugccaccau

SEQ ID NO: 759140 - RNA, 22 nt, Human
gcaaccucugccuacuagguuc

SEQ ID NO: 759141 - RNA, 21 nt, Human
gcagagggcucuccagagaug

SEQ ID NO: 759142 - RNA, 24 nt, Human
gcccaggcuagaaugcaauggcgu

SEQ ID NO: 759143 - RNA, 21 nt, Human
gccgcugugcuccucacaacc

SEQ ID NO: 759144 - RNA, 18 nt, Human
gccucgccuggcugcggc

SEQ ID NO: 759145 - RNA, 22 nt, Human
gcgugggugagguauucccagc

SEQ ID NO: 759146 - RNA, 19 nt, Human
gcuagaaugcaauggcgug

SEQ ID NO: 759147 - RNA, 25 nt, Human
gcucagcuggaggccuuucuggaac

SEQ ID NO: 759148 - RNA, 23 nt, Human
gcugggcccggccggggcucugc

SEQ ID NO: 759149 - RNA, 18 nt, Human
ggaaaaacaaaccuggga

SEQ ID NO: 759150 - RNA, 22 nt, Human
ggaaaaacaaaccugggaguaa

SEQ ID NO: 759151 - RNA, 23 nt, Human
ggacagcaccauguggcucagca

SEQ ID NO: 759152 - RNA, 22 nt, Human
ggagagggauuuagggccugag

SEQ ID NO: 759153 - RNA, 20 nt, Human
ggcagcugcacaugguaggc

SEQ ID NO: 759154 - RNA, 24 nt, Human
ggcuggucuugaacuccugaucuc

SEQ ID NO: 759155 - RNA, 18 nt, Human
gggacgugaacauagacc

SEQ ID NO: 759156 - RNA, 19 nt, Human
gggcacagggcggagcagc

SEQ ID NO: 759157 - RNA, 19 nt, Human
gggcaggccuggggcuggg

SEQ ID NO: 759158 - RNA, 24 nt, Human
gggcggagcagcgccagcagggga

SEQ ID NO: 759159 - RNA, 18 nt, Human
gggguuucagcauguuag

SEQ ID NO: 759160 - RNA, 22 nt, Human
ggguuucagcauguuagucagg

SEQ ID NO: 759161 - RNA, 18 nt, Human
guagcugggauuacaggu

SEQ ID NO: 759162 - RNA, 22 nt, Human
gucggccccggccccgggaguc

SEQ ID NO: 759163 - RNA, 23 nt, Human
gugaacauagacccgccgcucug

SEQ ID NO: 759164 - RNA, 24 nt, Human
gugauccacccaucucagccuccc

SEQ ID NO: 759165 - RNA, 18 nt, Human
gugauucuccuuccucag

SEQ ID NO: 759166 - RNA, 20 nt, Human
gugauucuccuuccucagcc

SEQ ID NO: 759167 - RNA, 24 nt, Human
gugauucuccuuccucagccuucc

SEQ ID NO: 759168 - RNA, 19 nt, Human
gugcagagggcucuccaga

SEQ ID NO: 759169 - RNA, 23 nt, Human
uaaacagaugggagaacaagacc

SEQ ID NO: 759170 - RNA, 21 nt, Human
uaagauggggucggacaggca

SEQ ID NO: 759171 - RNA, 23 nt, Human
uaaggucuuaaagggguuuuggg

SEQ ID NO: 759172 - RNA, 19 nt, Human
uacaggcgugagccacugc

SEQ ID NO: 759173 - RNA, 24 nt, Human
uacaggcgugagccacugcgccca

SEQ ID NO: 759174 - RNA, 24 nt, Human
uaccgugcauccuugcagauggaa

SEQ ID NO: 759175 - RNA, 20 nt, Human
uacuagguucaagugauucu

SEQ ID NO: 759176 - RNA, 23 nt, Human
uagaaugcaauggcgugaucucg

SEQ ID NO: 759177 - RNA, 24 nt, Human
uagaaugcaauggcgugaucucgg

SEQ ID NO: 759178 - RNA, 23 nt, Human
uagcaacaaagagacccagcuuc

SEQ ID NO: 759179 - RNA, 19 nt, Human
uagggccugagaaaggcag

SEQ ID NO: 759180 - RNA, 23 nt, Human
uaguagacaugggguuucagcau

SEQ ID NO: 759181 - RNA, 24 nt, Human
uaguagacaugggguuucagcaug

SEQ ID NO: 759182 - RNA, 24 nt, Human
uagucaggcuggucuugaacuccu

SEQ ID NO: 759183 - RNA, 20 nt, Human
uaguuccggacaguuccuug

SEQ ID NO: 759184 - RNA, 20 nt, Human
ucaaauggggcuggaccaug

SEQ ID NO: 759185 - RNA, 23 nt, Human
ucacaaccuggacugccucccug

SEQ ID NO: 759186 - RNA, 18 nt, Human
ucacugcaaccucugccu

SEQ ID NO: 759187 - RNA, 19 nt, Human
ucacugcaaccucugccua

SEQ ID NO: 759188 - RNA, 24 nt, Human
ucacugcaaccucugccuacuagg

SEQ ID NO: 759189 - RNA, 20 nt, Human
ucagccuuccgaguagcugg

SEQ ID NO: 759190 - RNA, 18 nt, Human
ucagugagcuggucugag

SEQ ID NO: 759191 - RNA, 24 nt, Human
ucccaaagugcugggauuacaggc

SEQ ID NO: 759192 - RNA, 24 nt, Human
ucccaagauccccagaacaaccag

SEQ ID NO: 759193 - RNA, 18 nt, Human
ucccaccuagaaccuucc

SEQ ID NO: 759194 - RNA, 19 nt, Human
ucccgccccucaccucuga

SEQ ID NO: 759195 - RNA, 23 nt, Human
ucccugaggcucuguccccacac

SEQ ID NO: 759196 - RNA, 22 nt, Human
uccgagcuuggccaaaugcugg

SEQ ID NO: 759197 - RNA, 24 nt, Human
uccgagggcugggcccggccgggg

SEQ ID NO: 759198 - RNA, 22 nt, Human
uccgaguagcugggauuacagg

SEQ ID NO: 759199 - RNA, 23 nt, Human
uccgaguagcugggauuacaggu

SEQ ID NO: 759200 - RNA, 24 nt, Human
uccgaguagcugggauuacaggug

SEQ ID NO: 759201 - RNA, 24 nt, Human
ucgaguggccucgccuggcugcgg

SEQ ID NO: 759202 - RNA, 18 nt, Human
ucgcagaccccgguggcg

SEQ ID NO: 759203 - RNA, 23 nt, Human
ucgcucucguugcccaggcuaga

SEQ ID NO: 759204 - RNA, 21 nt, Human
ucucaaguggcuaaguggcuc

SEQ ID NO: 759205 - RNA, 20 nt, Human
ucucagccucccaaagugcu

SEQ ID NO: 759206 - RNA, 22 nt, Human
ucucccaagauccccagaacaa

SEQ ID NO: 759207 - RNA, 24 nt, Human
ucucccgccccucaccucugagaa

SEQ ID NO: 759208 - RNA, 19 nt, Human
ucucuaaaauagcaugauu

SEQ ID NO: 759209 - RNA, 19 nt, Human
ucugcagguuccuccgugc

SEQ ID NO: 759210 - RNA, 23 nt, Human
ucugcagguuccuccgugcgagg

SEQ ID NO: 759211 - RNA, 23 nt, Human
ucuugaacuccugaucucaggug

SEQ ID NO: 759212 - RNA, 22 nt, Human
ucuuuggcuggaagcaaaaggc

SEQ ID NO: 759213 - RNA, 18 nt, Human
ugaaaccaccagcccacc

SEQ ID NO: 759214 - RNA, 20 nt, Human
ugacucccaucgccggcccc

SEQ ID NO: 759215 - RNA, 20 nt, Human
ugagcaacuccucugccuca

SEQ ID NO: 759216 - RNA, 19 nt, Human
ugagccauccagcagugcu

SEQ ID NO: 759217 - RNA, 21 nt, Human
ugagguaggugguaucagccc

SEQ ID NO: 759218 - RNA, 20 nt, Human
ugagugcccuggcugggugg

SEQ ID NO: 759219 - RNA, 24 nt, Human
ugauccacccaucucagccuccca

SEQ ID NO: 759220 - RNA, 24 nt, Human
ugaucucaggugauccacccaucu

SEQ ID NO: 759221 - RNA, 20 nt, Human
ugauucuccuuccucagccu

SEQ ID NO: 759222 - RNA, 18 nt, Human
ugcaauggcgugaucucg

SEQ ID NO: 759223 - RNA, 21 nt, Human
ugcagcgagcgcuccucggcc

SEQ ID NO: 759224 - RNA, 21 nt, Human
ugcccuggcugggugguuccg

SEQ ID NO: 759225 - RNA, 22 nt, Human
ugccuacuagguucaagugauu

SEQ ID NO: 759226 - RNA, 20 nt, Human
ugcuccucacaaccuggacu

SEQ ID NO: 759227 - RNA, 20 nt, Human
ugcuccuuccgcucucucuc

SEQ ID NO: 759228 - RNA, 24 nt, Human
ugcugggauuacaggcgugagcca

SEQ ID NO: 759229 - RNA, 19 nt, Human
uggaaaaacaaaccuggga

SEQ ID NO: 759230 - RNA, 19 nt, Human
uggccaaaugcuggcccca

SEQ ID NO: 759231 - RNA, 22 nt, Human
uggccccgcucugggcaucagc

SEQ ID NO: 759232 - RNA, 20 nt, Human
uggcgugaucucggcucacu

SEQ ID NO: 759233 - RNA, 24 nt, Human
uggcugcggcuccagcacuggcgu

SEQ ID NO: 759234 - RNA, 19 nt, Human
uggcuggaagcaaaaggcc

SEQ ID NO: 759235 - RNA, 21 nt, Human
uggcuggaagcaaaaggccgu

SEQ ID NO: 759236 - RNA, 24 nt, Human
ugggaacuucaaacaaaaaaacau

SEQ ID NO: 759237 - RNA, 23 nt, Human
ugggaguaacaccuuacugucug

SEQ ID NO: 759238 - RNA, 19 nt, Human
ugggauuacaggcgugagc

SEQ ID NO: 759239 - RNA, 21 nt, Human
ugggauuacaggcgugagcca

SEQ ID NO: 759240 - RNA, 22 nt, Human
ugggauuacaggcgugagccac

SEQ ID NO: 759241 - RNA, 22 nt, Human
ugggauuacaggcgugagccac

SEQ ID NO: 759242 - RNA, 24 nt, Human
ugggauuacaggcgugagccacug

SEQ ID NO: 759243 - RNA, 26 nt, Human
ugggauuacaggcgugagccacugcg

SEQ ID NO: 759244 - RNA, 21 nt, Human
ugggauuacaggugccugcca

SEQ ID NO: 759245 - RNA, 22 nt, Human
ugggauuacaggugccugccac

SEQ ID NO: 759246 - RNA, 24 nt, Human
ugggauuacaggugccugccacca

SEQ ID NO: 759247 - RNA, 25 nt, Human
ugggauuacaggugccugccaccau

SEQ ID NO: 759248 - RNA, 20 nt, Human
ugggcugguguucguggagu

SEQ ID NO: 759249 - RNA, 18 nt, Human
uggggaggaugagcuggg

SEQ ID NO: 759250 - RNA, 20 nt, Human
uggggaggaugagcugggac

SEQ ID NO: 759251 - RNA, 22 nt, Human
ugggggagagagaaaguucaca

SEQ ID NO: 759252 - RNA, 24 nt, Human
ugggguuucagcauguuagucagg

SEQ ID NO: 759253 - RNA, 26 nt, Human
uggguggggggcgaugggcggggggc

SEQ ID NO: 759254 - RNA, 22 nt, Human
ugguaucagccccauuucacag

SEQ ID NO: 759255 - RNA, 18 nt, Human
uggugccugugugcuggu

SEQ ID NO: 759256 - RNA, 20 nt, Human
ugguucuggcccugccacuu

SEQ ID NO: 759257 - RNA, 19 nt, Human
ugucugguucucaaguggc

SEQ ID NO: 759258 - RNA, 24 nt, Human
uguggcucagcaugcaggccaggc

SEQ ID NO: 759259 - RNA, 22 nt, Human
uguguuucucccaagaucccca

SEQ ID NO: 759260 - RNA, 28 nt, Human
uuacaaagggcgagggggaggagggcau

SEQ ID NO: 759261 - RNA, 24 nt, Human
uuacuuuggaaaaacaaaccuggg

SEQ ID NO: 759262 - RNA, 18 nt, Human
uuaguagacaugggguuu

SEQ ID NO: 759263 - RNA, 20 nt, Human
uuaguagacaugggguuuca

SEQ ID NO: 759264 - RNA, 24 nt, Human
uuaguagacaugggguuucagcau

SEQ ID NO: 759265 - RNA, 23 nt, Human
uucaaacaaaaaaacauagcaac

SEQ ID NO: 759266 - RNA, 23 nt, Human
uucaagugauucuccuuccucag

SEQ ID NO: 759267 - RNA, 24 nt, Human
uucaagugauucuccuuccucagc

SEQ ID NO: 759268 - RNA, 20 nt, Human
uucacauccccccaccaagc

SEQ ID NO: 759269 - RNA, 23 nt, Human
uucccaucuccuauuagaacaaa

SEQ ID NO: 759270 - RNA, 24 nt, Human
uuccgaguagcugggauuacaggu

SEQ ID NO: 759271 - RNA, 24 nt, Human
uuccugggaacuucaaacaaaaaa

SEQ ID NO: 759272 - RNA, 24 nt, Human
uucgcucucguugcccaggcuaga

SEQ ID NO: 759273 - RNA, 19 nt, Human
uugcucugagccauccagc

SEQ ID NO: 759274 - RNA, 18 nt, Human
uugggauuaaaguacagu

SEQ ID NO: 759275 - RNA, 23 nt, Human
uuggguaggggacaggccugcuc

SEQ ID NO: 759276 - RNA, 26 nt, Human
aaaaaaaaaacgaacaaacaaaaagg

SEQ ID NO: 759277 - RNA, 22 nt, Human
aaaacaaacaaacaaaaaaaaa

SEQ ID NO: 759278 - RNA, 23 nt, Human
aaaacacucuuguucccaucuuu

SEQ ID NO: 759279 - RNA, 23 nt, Human
aaaacacucuuguucccaucuuu

SEQ ID NO: 759280 - RNA, 25 nt, Human
aaaaucuucccaaaaauacacacua

SEQ ID NO: 759281 - RNA, 21 nt, Human
aaaauucaaagcacauucccc

SEQ ID NO: 759282 - RNA, 25 nt, Human
aaacaaaaaaaaaacgaacaaacaa

SEQ ID NO: 759283 - RNA, 24 nt, Human
aaacaaacaaaaaaaaaacgaaca

SEQ ID NO: 759284 - RNA, 20 nt, Human
aaacucugugugagccacua

SEQ ID NO: 759285 - RNA, 22 nt, Human
aaaucccccaagaguguauccc

SEQ ID NO: 759286 - RNA, 24 nt, Human
aacacauuucaaaaauaucaaaaa

SEQ ID NO: 759287 - RNA, 21 nt, Human
aacaccagccuggccaacaug

SEQ ID NO: 759288 - RNA, 24 nt, Human
aacagagcaggauugacuguagcc

SEQ ID NO: 759289 - RNA, 19 nt, Human
aacauggugaaaccccguc

SEQ ID NO: 759290 - RNA, 20 nt, Human
aacauggugaaaccccgucu

SEQ ID NO: 759291 - RNA, 21 nt, Human
aacauggugaaaccccgucuc

SEQ ID NO: 759292 - RNA, 18 nt, Human
aacgaauagcagacaaga

SEQ ID NO: 759293 - RNA, 18 nt, Human
aacuaguaaagagaauca

SEQ ID NO: 759294 - RNA, 21 nt, Human
aagaaauguagaggcagaaug

SEQ ID NO: 759295 - RNA, 20 nt, Human
aagaagauuggcucgagugc

SEQ ID NO: 759296 - RNA, 21 nt, Human
aaggucauuucagaacugggu

SEQ ID NO: 759297 - RNA, 24 nt, Human
aaguuaccucauaggucaaagagu

SEQ ID NO: 759298 - RNA, 22 nt, Human
aaguucagauucucgagggguu

SEQ ID NO: 759299 - RNA, 24 nt, Human
aauggcaggugccuguaaucccag

SEQ ID NO: 759300 - RNA, 25 nt, Human
acaaagccaugaaaaagauuccacu

SEQ ID NO: 759301 - RNA, 21 nt, Human
acagaaguaugaagaaacugc

SEQ ID NO: 759302 - RNA, 22 nt, Human
acaggagaauggcuugaaccca

SEQ ID NO: 759303 - RNA, 22 nt, Human
accaauguauugcacacauaca

SEQ ID NO: 759304 - RNA, 20 nt, Human
accacgcugcuccugcuggc

SEQ ID NO: 759305 - RNA, 24 nt, Human
accaguaguuugacaaucugggga

SEQ ID NO: 759306 - RNA, 22 nt, Human
accauugcacuccagccugagc

SEQ ID NO: 759307 - RNA, 23 nt, Human
acccagggacagaggcugcagug

SEQ ID NO: 759308 - RNA, 18 nt, Human
acccaguucucucucugc

SEQ ID NO: 759309 - RNA, 24 nt, Human
accccaccauugcacuccagccug

SEQ ID NO: 759310 - RNA, 18 nt, Human
acgcagggcugggcaugg

SEQ ID NO: 759311 - RNA, 19 nt, Human
acucaaacucuccucucca

SEQ ID NO: 759312 - RNA, 26 nt, Human
agaaggaaguaaaaagugagggaccc

SEQ ID NO: 759313 - RNA, 18 nt, Human
agacaggagaauggcuug

SEQ ID NO: 759314 - RNA, 27 nt, Human
agacaggagaauggcuugaacccaggg

SEQ ID NO: 759315 - RNA, 19 nt, Human
agacuauuugcagaugcau

SEQ ID NO: 759316 - RNA, 22 nt, Human
agaggcugcagugacccgagac

SEQ ID NO: 759317 - RNA, 20 nt, Human
agcaacuaguaaagagaauc

SEQ ID NO: 759318 - RNA, 22 nt, Human
agcaacuaguaaagagaaucaa

SEQ ID NO: 759319 - RNA, 20 nt, Human
agcaaugaccacgcugcucc

SEQ ID NO: 759320 - RNA, 24 nt, Human
agcacuuugggaggcagaggaggg

SEQ ID NO: 759321 - RNA, 22 nt, Human
agccuggccaacauggugaaac

SEQ ID NO: 759322 - RNA, 24 nt, Human
agccuggccaacauggugaaaccc

SEQ ID NO: 759323 - RNA, 20 nt, Human
agccuugggcccccgcuccc

SEQ ID NO: 759324 - RNA, 22 nt, Human
aggaacaagucuaaccugagug

SEQ ID NO: 759325 - RNA, 22 nt, Human
aggaggguggaucaccugaggu

SEQ ID NO: 759326 - RNA, 20 nt, Human
aggcaggcaaauucucaaag

SEQ ID NO: 759327 - RNA, 24 nt, Human
aggcugagacaggagaauggcuug

SEQ ID NO: 759328 - RNA, 24 nt, Human
aggguggaucaccugaggucaaga

SEQ ID NO: 759329 - RNA, 18 nt, Human
agucugacauccaaaagu

SEQ ID NO: 759330 - RNA, 22 nt, Human
auggcaggugccuguaauccca

SEQ ID NO: 759331 - RNA, 21 nt, Human
auucaguagaucugccacacc

SEQ ID NO: 759332 - RNA, 18 nt, Human
auugcacuccagccugag

SEQ ID NO: 759333 - RNA, 20 nt, Human
auuucagaacuggguuuuga

SEQ ID NO: 759334 - RNA, 19 nt, Human
caaaaagaaauguagaggc

SEQ ID NO: 759335 - RNA, 20 nt, Human
caaaaagaaauguagaggca

SEQ ID NO: 759336 - RNA, 22 nt, Human
caaaaauacaccauggcugcca

SEQ ID NO: 759337 - RNA, 21 nt, Human
caaaaauacacuauaaugagu

SEQ ID NO: 759338 - RNA, 18 nt, Human
caaaaugauccuaggaga

SEQ ID NO: 759339 - RNA, 24 nt, Human
caaacucuccucuccagugcaggc

SEQ ID NO: 759340 - RNA, 24 nt, Human
caacauggugaaaccccgucucua

SEQ ID NO: 759341 - RNA, 26 nt, Human
caacauuuggaauuacagaguucugc

SEQ ID NO: 759342 - RNA, 20 nt, Human
caagaaggguucaccauaau

SEQ ID NO: 759343 - RNA, 24 nt, Human
caauacaaccuaaugguuccugaa

SEQ ID NO: 759344 - RNA, 22 nt, Human
cacagucaaugaaaagugcucu

SEQ ID NO: 759345 - RNA, 18 nt, Human
caccaaaugaggcaaaca

SEQ ID NO: 759346 - RNA, 21 nt, Human
caccagccuggccaacauggu

SEQ ID NO: 759347 - RNA, 21 nt, Human
caccaguaaaugaacucacca

SEQ ID NO: 759348 - RNA, 18 nt, Human
cacucaucacuaucaucc

SEQ ID NO: 759349 - RNA, 18 nt, Human
cagcacuuugggaggcag

SEQ ID NO: 759350 - RNA, 26 nt, Human
cagcacuuugggaggcagaggagggu

SEQ ID NO: 759351 - RNA, 19 nt, Human
caggugguaggacugauac

SEQ ID NO: 759352 - RNA, 20 nt, Human
cagugacccgagaccccacc

SEQ ID NO: 759353 - RNA, 22 nt, Human
cauaauggcaggugccuguaau

SEQ ID NO: 759354 - RNA, 27 nt, Human
cauauaaaaauaagguggcaaaacacu

SEQ ID NO: 759355 - RNA, 24 nt, Human
cauggugaaaccccgucucuaaaa

SEQ ID NO: 759356 - RNA, 26 nt, Human
cauuagaguguaccaaaucccccaag

SEQ ID NO: 759357 - RNA, 19 nt, Human
cauugcacuccagccugag

SEQ ID NO: 759358 - RNA, 20 nt, Human
cauugcacuccagccugagc

SEQ ID NO: 759359 - RNA, 21 nt, Human
cauugcacuccagccugagcg

SEQ ID NO: 759360 - RNA, 22 nt, Human
cauugcacuccagccugagcga

SEQ ID NO: 759361 - RNA, 23 nt, Human
cauugcacuccagccugagcgac

SEQ ID NO: 759362 - RNA, 27 nt, Human
cauugcacuccagccugagcgacugag

SEQ ID NO: 759363 - RNA, 19 nt, Human
cauuuacuuuugguaaggu

SEQ ID NO: 759364 - RNA, 24 nt, Human
cauuuacuuuugguaaggucauuu

SEQ ID NO: 759365 - RNA, 24 nt, Human
ccaacacccaguucucucucugcc

SEQ ID NO: 759366 - RNA, 22 nt, Human
ccacacugugcccaguggggca

SEQ ID NO: 759367 - RNA, 28 nt, Human
ccaccauugcacuccagccugagcgacu

SEQ ID NO: 759368 - RNA, 20 nt, Human
ccauugcacuccagccugag

SEQ ID NO: 759369 - RNA, 21 nt, Human
ccauugcacuccagccugagc

SEQ ID NO: 759370 - RNA, 24 nt, Human
ccauugcacuccagccugagcgac

SEQ ID NO: 759371 - RNA, 22 nt, Human
cccaaaagaagauccuauuacc

SEQ ID NO: 759372 - RNA, 22 nt, Human
cccacugucuggaugacaucca

SEQ ID NO: 759373 - RNA, 25 nt, Human
ccccaacuauggggcaaaagucacu

SEQ ID NO: 759374 - RNA, 21 nt, Human
ccccgcuccccgcccuuagga

SEQ ID NO: 759375 - RNA, 18 nt, Human
ccucuaagaagauuggcu

SEQ ID NO: 759376 - RNA, 19 nt, Human
ccugauggcucucacacuu

SEQ ID NO: 759377 - RNA, 23 nt, Human
ccuggccaacauggugaaacccc

SEQ ID NO: 759378 - RNA, 24 nt, Human
ccuggccaacauggugaaaccccg

SEQ ID NO: 759379 - RNA, 24 nt, Human
ccuguaaucacagcacuuugggag

SEQ ID NO: 759380 - RNA, 21 nt, Human
ccuguaaucccagcuacucgg

SEQ ID NO: 759381 - RNA, 24 nt, Human
ccuuccccauuuucauccccaaaa

SEQ ID NO: 759382 - RNA, 21 nt, Human
cgaacaaacaaaaagaaaugu

SEQ ID NO: 759383 - RNA, 22 nt, Human
cguagagaagaaugaaaagcca

SEQ ID NO: 759384 - RNA, 19 nt, Human
cgucucaaaacaaacaaac

SEQ ID NO: 759385 - RNA, 21 nt, Human
cuaaaauucucaauagcugac

SEQ ID NO: 759386 - RNA, 23 nt, Human
cuacaacccgaagguucugccau

SEQ ID NO: 759387 - RNA, 24 nt, Human
cuauucuacaacccgaagguucug

SEQ ID NO: 759388 - RNA, 23 nt, Human
cucaaaacaaacaaacaaaaaaa

SEQ ID NO: 759389 - RNA, 18 nt, Human
cucaaacucuccucucca

SEQ ID NO: 759390 - RNA, 19 nt, Human
cucaaacucuccucuccag

SEQ ID NO: 759391 - RNA, 23 nt, Human
cucaccuccaacauucuagagaa

SEQ ID NO: 759392 - RNA, 20 nt, Human
cuccaacauucuagagaacc

SEQ ID NO: 759393 - RNA, 22 nt, Human
cuuaagcuucucuacucaaugg

SEQ ID NO: 759394 - RNA, 21 nt, Human
cuucccaaaaauacacacgaa

SEQ ID NO: 759395 - RNA, 25 nt, Human
gaaaauauauuuauauuuaacccuc

SEQ ID NO: 759396 - RNA, 18 nt, Human
gaauagcagacaagaagg

SEQ ID NO: 759397 - RNA, 21 nt, Human
gagcaagacuccgucucaaaa

SEQ ID NO: 759398 - RNA, 23 nt, Human
gaggaggguggaucaccugaggu

SEQ ID NO: 759399 - RNA, 23 nt, Human
gaucaccugaggucaagaguuca

SEQ ID NO: 759400 - RNA, 24 nt, Human
gaucaccugaggucaagaguucaa

SEQ ID NO: 759401 - RNA, 22 nt, Human
gauugguucuacauuuccaaca

SEQ ID NO: 759402 - RNA, 24 nt, Human
gccaacauggugaaaccccgucuc

SEQ ID NO: 759403 - RNA, 22 nt, Human
gccacacccaacuggcuccauc

SEQ ID NO: 759404 - RNA, 25 nt, Human
gccuggccaacauggugaaaccccg

SEQ ID NO: 759405 - RNA, 21 nt, Human
ggaaagccuccacccagaagg

SEQ ID NO: 759406 - RNA, 20 nt, Human
ggaagaagagcaucauuuga

SEQ ID NO: 759407 - RNA, 19 nt, Human
gggaggcagaggagggugg

SEQ ID NO: 759408 - RNA, 24 nt, Human
gggcauaauggcaggugccuguaa

SEQ ID NO: 759409 - RNA, 21 nt, Human
gggcaugguggcugaggccug

SEQ ID NO: 759410 - RNA, 24 nt, Human
gggcaugguggcugaggccuguaa

SEQ ID NO: 759411 - RNA, 20 nt, Human
gggguugaacauuagacauc

SEQ ID NO: 759412 - RNA, 25 nt, Human
guaccaaaucccccaagaguguauc

SEQ ID NO: 759413 - RNA, 24 nt, Human
gucuggaugacauccacuggcaac

SEQ ID NO: 759414 - RNA, 20 nt, Human
guuuagaaaacacaaugucu

SEQ ID NO: 759415 - RNA, 18 nt, Human
uaaaaaaaauuucccaua

SEQ ID NO: 759416 - RNA, 21 nt, Human
uaaaaguguuccaaaaauuca

SEQ ID NO: 759417 - RNA, 18 nt, Human
uaaaaucaagcaaugcca

SEQ ID NO: 759418 - RNA, 22 nt, Human
uaaaauucucaauagcugacca

SEQ ID NO: 759419 - RNA, 18 nt, Human
uaaagcagacugcaaaaa

SEQ ID NO: 759420 - RNA, 19 nt, Human
uaagcaaaucuuccaaugg

SEQ ID NO: 759421 - RNA, 24 nt, Human
uaagcaaaucuuccaauggaaaaa

SEQ ID NO: 759422 - RNA, 23 nt, Human
uacacuguucaacauucaagagg

SEQ ID NO: 759423 - RNA, 18 nt, Human
uacagaacagcugcuuuc

SEQ ID NO: 759424 - RNA, 23 nt, Human
uacaucacucaucacuaucaucc

SEQ ID NO: 759425 - RNA, 21 nt, Human
uacauuuccaacagacaucau

SEQ ID NO: 759426 - RNA, 19 nt, Human
uaccacacagaacaacauu

SEQ ID NO: 759427 - RNA, 19 nt, Human
uaccacacagaacaacauu

SEQ ID NO: 759428 - RNA, 21 nt, Human
uaccacacagaacaacauuug

SEQ ID NO: 759429 - RNA, 21 nt, Human
uaccaguuuauccagagccag

SEQ ID NO: 759430 - RNA, 19 nt, Human
uaccccaacccugcacagc

SEQ ID NO: 759431 - RNA, 21 nt, Human
uacgacaaugauugcacaaaa

SEQ ID NO: 759432 - RNA, 22 nt, Human
uacgacaaugauugcacaaaac

SEQ ID NO: 759433 - RNA, 24 nt, Human
uagaaaacacaaugucuguaaguu

SEQ ID NO: 759434 - RNA, 20 nt, Human
uagcacccagcaaugaccac

SEQ ID NO: 759435 - RNA, 19 nt, Human
uagucccuuuccugcccag

SEQ ID NO: 759436 - RNA, 23 nt, Human
ucaaaacaaacaaacaaaaaaaa

SEQ ID NO: 759437 - RNA, 20 nt, Human
ucacagagauccaucagcag

SEQ ID NO: 759438 - RNA, 18 nt, Human
ucacucaucacuaucauc

SEQ ID NO: 759439 - RNA, 20 nt, Human
uccaaaaauucaaagcacau

SEQ ID NO: 759440 - RNA, 28 nt, Human
uccaaaaauucaaagcacauuccccauu

SEQ ID NO: 759441 - RNA, 21 nt, Human
uccaucagcagcaacuaguaa

SEQ ID NO: 759442 - RNA, 19 nt, Human
ucccauauaaaaauaaggu

SEQ ID NO: 759443 - RNA, 26 nt, Human
uccccaaaagaagauccuauuacccc

SEQ ID NO: 759444 - RNA, 24 nt, Human
ucccuaccccaacccugcacagcc

SEQ ID NO: 759445 - RNA, 19 nt, Human
ucuauagugcacugcagcu

SEQ ID NO: 759446 - RNA, 25 nt, Human
ucucaaaacaaacaaacaaaaaaaa

SEQ ID NO: 759447 - RNA, 21 nt, Human
ucuccuggaaaacagcacuca

SEQ ID NO: 759448 - RNA, 25 nt, Human
ucucucagaaauuaucuuaagcucc

SEQ ID NO: 759449 - RNA, 20 nt, Human
ucucuucauuaauaauuauu

SEQ ID NO: 759450 - RNA, 19 nt, Human
ucugccauaacuuaagguc

SEQ ID NO: 759451 - RNA, 22 nt, Human
ucugccauaacuuaaggucacg

SEQ ID NO: 759452 - RNA, 18 nt, Human
ucugggagaagugcauga

SEQ ID NO: 759453 - RNA, 20 nt, Human
ugaagacaucacugaauggc

SEQ ID NO: 759454 - RNA, 23 nt, Human
ugaagugucuuucuuauguuuua

SEQ ID NO: 759455 - RNA, 22 nt, Human
ugacagccuguuuagaaaacac

SEQ ID NO: 759456 - RNA, 24 nt, Human
ugacccgagaccccaccauugcac

SEQ ID NO: 759457 - RNA, 20 nt, Human
ugacuugacucuauagugca

SEQ ID NO: 759458 - RNA, 24 nt, Human
ugagacaggagaauggcuugaacc

SEQ ID NO: 759459 - RNA, 19 nt, Human
ugagagaaaacccuauagc

SEQ ID NO: 759460 - RNA, 21 nt, Human
ugagagaaaacccuauagcau

SEQ ID NO: 759461 - RNA, 21 nt, Human
ugagcaagacuccgucucaaa

SEQ ID NO: 759462 - RNA, 22 nt, Human
ugagcaagacuccgucucaaaa

SEQ ID NO: 759463 - RNA, 19 nt, Human
ugagucuuaagacuacaau

SEQ ID NO: 759464 - RNA, 23 nt, Human
ugccuguaaucccagcuacucgg

SEQ ID NO: 759465 - RNA, 24 nt, Human
ugccuguaaucccagcuacucggg

SEQ ID NO: 759466 - RNA, 18 nt, Human
ugcugaaggucuacaugg

SEQ ID NO: 759467 - RNA, 21 nt, Human
ugcuuaccccaacuauggggc

SEQ ID NO: 759468 - RNA, 23 nt, Human
uggaaugugcaaagaguauaggu

SEQ ID NO: 759469 - RNA, 19 nt, Human
uggaauuacagaguucugc

SEQ ID NO: 759470 - RNA, 23 nt, Human
uggacaaaaauacaccaaccccg

SEQ ID NO: 759471 - RNA, 20 nt, Human
uggacuccuaaacugcuccc

SEQ ID NO: 759472 - RNA, 24 nt, Human
uggaucaccugaggucaagaguuc

SEQ ID NO: 759473 - RNA, 26 nt, Human
uggaucaccugaggucaagaguucaa

SEQ ID NO: 759474 - RNA, 19 nt, Human
uggcaacagugagagaaaa

SEQ ID NO: 759475 - RNA, 24 nt, Human
uggcaggugccuguaaucccagcu

SEQ ID NO: 759476 - RNA, 24 nt, Human
uggccaacauggugaaaccccguc

SEQ ID NO: 759477 - RNA, 19 nt, Human
uggcuccgaguucaacccc

SEQ ID NO: 759478 - RNA, 19 nt, Human
ugggaggcagaggagggug

SEQ ID NO: 759479 - RNA, 24 nt, Human
ugggaggcagaggaggguggauca

SEQ ID NO: 759480 - RNA, 23 nt, Human
ugggagguacacacagagaccug

SEQ ID NO: 759481 - RNA, 23 nt, Human
uggguaaaaucaagcaaugccaa

SEQ ID NO: 759482 - RNA, 22 nt, Human
uggguuuugaggugguuccaau

SEQ ID NO: 759483 - RNA, 20 nt, Human
ugguacauuuaucgauaaca

SEQ ID NO: 759484 - RNA, 23 nt, Human
uguaucaggagugguaauucaau

SEQ ID NO: 759485 - RNA, 20 nt, Human
ugugacugacugaucaccaa

SEQ ID NO: 759486 - RNA, 24 nt, Human
uguuauuucauuuucauuuuuucu

SEQ ID NO: 759487 - RNA, 20 nt, Human
uuagaguguaccaaaucccc

SEQ ID NO: 759488 - RNA, 23 nt, Human
uuauuguuauuguuauuuuuaca

SEQ ID NO: 759489 - RNA, 21 nt, Human
uucaacaccagccuggccaac

SEQ ID NO: 759490 - RNA, 20 nt, Human
uugggaggcagaggagggug

SEQ ID NO: 759491 - RNA, 25 nt, Human
uugggcccccgcuccccgcccuuag

SEQ ID NO: 759492 - RNA, 24 nt, Human
uuucacagucugacauccaaaagu

SEQ ID NO: 759493 - RNA, 18 nt, Human
uuuucuguaagcuuaaga

SEQ ID NO: 759494 - RNA, 23 nt, Human
aaaaaagaaagaaaagaaaagaa

SEQ ID NO: 759495 - RNA, 25 nt, Human
aaaaaugaugaaaaacauugugcaa

SEQ ID NO: 759496 - RNA, 21 nt, Human
aaaagaacccaucuggagggc

SEQ ID NO: 759497 - RNA, 21 nt, Human
aaaguccauggaagccaagag

SEQ ID NO: 759498 - RNA, 20 nt, Human
aacauaaugaaagaucaucu

SEQ ID NO: 759499 - RNA, 18 nt, Human
aagaaacuuuuagacagg

SEQ ID NO: 759500 - RNA, 21 nt, Human
aaggaccaaaaaaagaugaca

SEQ ID NO: 759501 - RNA, 22 nt, Human
aauuaaaaaagaaagaaaagaa

SEQ ID NO: 759502 - RNA, 18 nt, Human
aauuguuuaaaagaaccc

SEQ ID NO: 759503 - RNA, 20 nt, Human
acaaacugaaggcaguaauc

SEQ ID NO: 759504 - RNA, 18 nt, Human
acaggcggcaaacgacgc

SEQ ID NO: 759505 - RNA, 21 nt, Human
accacauuuacgaagaaagca

SEQ ID NO: 759506 - RNA, 24 nt, Human
agaaaacaauucuuugucacacua

SEQ ID NO: 759507 - RNA, 21 nt, Human
agaaagacgcugcccacaaca

SEQ ID NO: 759508 - RNA, 18 nt, Human
agccggagcucuggcaug

SEQ ID NO: 759509 - RNA, 21 nt, Human
agccuuggaucucagaaguca

SEQ ID NO: 759510 - RNA, 18 nt, Human
aggacuucuugcuucagc

SEQ ID NO: 759511 - RNA, 26 nt, Human
aggcggcaaacgacgcagcuggagga

SEQ ID NO: 759512 - RNA, 18 nt, Human
agguuuucucguaccuca

SEQ ID NO: 759513 - RNA, 19 nt, Human
auaauuaaaaaagaaagaa

SEQ ID NO: 759514 - RNA, 19 nt, Human
auauagcaaaggcagagaa

SEQ ID NO: 759515 - RNA, 22 nt, Human
aucuggagggcaggauauuuuu

SEQ ID NO: 759516 - RNA, 23 nt, Human
augacacauuaaaacagagaaaa

SEQ ID NO: 759517 - RNA, 22 nt, Human
caaacgacgcagcuggaggacc

SEQ ID NO: 759518 - RNA, 23 nt, Human
cacaacauaaugaaagaucaucu

SEQ ID NO: 759519 - RNA, 20 nt, Human
cacugagcgagggagcccca

SEQ ID NO: 759520 - RNA, 19 nt, Human
cacuuuguccacuccacau

SEQ ID NO: 759521 - RNA, 26 nt, Human
cagaacacaucuuucucggagugcag

SEQ ID NO: 759522 - RNA, 21 nt, Human
caguggacacggagaacaaug

SEQ ID NO: 759523 - RNA, 23 nt, Human
caugacacauuaaaacagagaaa

SEQ ID NO: 759524 - RNA, 18 nt, Human
caugccaaucguggcugc

SEQ ID NO: 759525 - RNA, 26 nt, Human
cccccaugccaaucguggcugcugug

SEQ ID NO: 759526 - RNA, 19 nt, Human
cccgcacggccuccucuuu

SEQ ID NO: 759527 - RNA, 23 nt, Human
ccuccucuuccuccuccacucuc

SEQ ID NO: 759528 - RNA, 23 nt, Human
ccucuuuguucgcaggcggaggu

SEQ ID NO: 759529 - RNA, 19 nt, Human
cgacugcuggcaacagcag

SEQ ID NO: 759530 - RNA, 22 nt, Human
cgcuucaguggacacggagaac

SEQ ID NO: 759531 - RNA, 18 nt, Human
cggaggucucggcggcuc

SEQ ID NO: 759532 - RNA, 20 nt, Human
cguagcaaggaccaaaaaaa

SEQ ID NO: 759533 - RNA, 23 nt, Human
cuagaaaaguccauggaagccaa

SEQ ID NO: 759534 - RNA, 26 nt, Human
cugcauauagcaaaggcagagaaaga

SEQ ID NO: 759535 - RNA, 19 nt, Human
cuuuguucgcaggcggagg

SEQ ID NO: 759536 - RNA, 25 nt, Human
gaaauacaccuuauuuauaauuucu

SEQ ID NO: 759537 - RNA, 22 nt, Human
gcagagaaagacgcugcccaca

SEQ ID NO: 759538 - RNA, 26 nt, Human
ggauauuuuuuuaauugccagagagc

SEQ ID NO: 759539 - RNA, 20 nt, Human
guccucuuccuccuccucuu

SEQ ID NO: 759540 - RNA, 19 nt, Human
guuacagaacacaucuuuc

SEQ ID NO: 759541 - RNA, 23 nt, Human
uaaaagaacccaucuggagggca

SEQ ID NO: 759542 - RNA, 21 nt, Human
uaaaaucuccuuuguucauua

SEQ ID NO: 759543 - RNA, 21 nt, Human
uaacaaaaaugaugaaaaaca

SEQ ID NO: 759544 - RNA, 20 nt, Human
uaacaaaauaccacauuuac

SEQ ID NO: 759545 - RNA, 19 nt, Human
uagcaaggaccaaaaaaag

SEQ ID NO: 759546 - RNA, 20 nt, Human
uagcaaggaccaaaaaaaga

SEQ ID NO: 759547 - RNA, 21 nt, Human
uauuugccaaccuaaagcccc

SEQ ID NO: 759548 - RNA, 25 nt, Human
ucaccacaaauggcuguauucuggu

SEQ ID NO: 759549 - RNA, 24 nt, Human
ucagcacauuucugacaaagaaag

SEQ ID NO: 759550 - RNA, 25 nt, Human
uccaauaauuaaaaaagaaagaaaa

SEQ ID NO: 759551 - RNA, 20 nt, Human
uccacaggcggcaaacgacg

SEQ ID NO: 759552 - RNA, 21 nt, Human
uccacaggcggcaaacgacgc

SEQ ID NO: 759553 - RNA, 22 nt, Human
uccacauuggccaucagagggg

SEQ ID NO: 759554 - RNA, 25 nt, Human
uccacucucaccacaaauggcugua

SEQ ID NO: 759555 - RNA, 23 nt, Human
uccauggaagccaagagacgaga

SEQ ID NO: 759556 - RNA, 22 nt, Human
uccuccuccucuuccuccucca

SEQ ID NO: 759557 - RNA, 20 nt, Human
ucgcgcccggcggaaccgca

SEQ ID NO: 759558 - RNA, 24 nt, Human
ucggagugcagaugcuccuucuug

SEQ ID NO: 759559 - RNA, 20 nt, Human
ucuuccuccuccucuucccc

SEQ ID NO: 759560 - RNA, 23 nt, Human
ugagaucuagcaauggcuuaaau

SEQ ID NO: 759561 - RNA, 20 nt, Human
ugcaagugacaaguucugca

SEQ ID NO: 759562 - RNA, 21 nt, Human
ugcagggucacacuggggcag

SEQ ID NO: 759563 - RNA, 23 nt, Human
ugcuucagccggagcucuggcau

SEQ ID NO: 759564 - RNA, 20 nt, Human
ugggucuuaagacgagggga

SEQ ID NO: 759565 - RNA, 20 nt, Human
uugucccacagcaaagaaaa

SEQ ID NO: 759566 - RNA, 25 nt, Human
uuuauaauuucuucucauucuauac

SEQ ID NO: 759567 - RNA, 24 nt, Human
uuugcccagcaucaaucuuaguca

SEQ ID NO: 759568 - RNA, 18 nt, Human
uuuuuauauuagcaaaca

SEQ ID NO: 759569 - RNA, 19 nt, Human
aacuuccucuccugcccug

SEQ ID NO: 759570 - RNA, 25 nt, Human
aauuuuuguuuaaaaaaauuaggga

SEQ ID NO: 759571 - RNA, 23 nt, Human
acagguauuguguggauggaugu

SEQ ID NO: 759572 - RNA, 18 nt, Human
agcccuggggccggggca

SEQ ID NO: 759573 - RNA, 22 nt, Human
auggaguuccugggggaagccc

SEQ ID NO: 759574 - RNA, 24 nt, Human
auggccaaauaauauuccauugua

SEQ ID NO: 759575 - RNA, 23 nt, Human
caaauaauauuccauuguaugga

SEQ ID NO: 759576 - RNA, 18 nt, Human
cacagauuugccuauucu

SEQ ID NO: 759577 - RNA, 21 nt, Human
cacguggcacgcaguaggucc

SEQ ID NO: 759578 - RNA, 20 nt, Human
caggcuguggcaugcgucag

SEQ ID NO: 759579 - RNA, 27 nt, Human
cauuccacaauuucaucaucuuccaaa

SEQ ID NO: 759580 - RNA, 18 nt, Human
ccccaaauaugaccauuu

SEQ ID NO: 759581 - RNA, 20 nt, Human
cccuccgcacugcuuuuccc

SEQ ID NO: 759582 - RNA, 27 nt, Human
ccuggggccggggcaucugcccagggc

SEQ ID NO: 759583 - RNA, 19 nt, Human
ccugggggaagcccugggg

SEQ ID NO: 759584 - RNA, 24 nt, Human
ccuguggcagagccaagccggggc

SEQ ID NO: 759585 - RNA, 18 nt, Human
cuccaguaccuggcaacc

SEQ ID NO: 759586 - RNA, 19 nt, Human
cuggaacucucgcuaggcg

SEQ ID NO: 759587 - RNA, 19 nt, Human
cuugugcucugccuuaggc

SEQ ID NO: 759588 - RNA, 22 nt, Human
gcagaugagcagcugacucccc

SEQ ID NO: 759589 - RNA, 21 nt, Human
gccaaauauccuuuacgugac

SEQ ID NO: 759590 - RNA, 21 nt, Human
gcugugccuucucugcucggc

SEQ ID NO: 759591 - RNA, 24 nt, Human
ggaguuccugggggaagcccuggg

SEQ ID NO: 759592 - RNA, 20 nt, Human
gggggggaagaaccuggauc

SEQ ID NO: 759593 - RNA, 19 nt, Human
guccacaguuaccacuggc

SEQ ID NO: 759594 - RNA, 26 nt, Human
uaaaaaaauuagggaaaaaccccaaa

SEQ ID NO: 759595 - RNA, 21 nt, Human
uauuggacaucccugcugugu

SEQ ID NO: 759596 - RNA, 23 nt, Human
ucaucaucuuccaaagaaagccc

SEQ ID NO: 759597 - RNA, 20 nt, Human
ucaugccucuucucucuucc

SEQ ID NO: 759598 - RNA, 23 nt, Human
uccacaauuucaucaucuuccaa

SEQ ID NO: 759599 - RNA, 21 nt, Human
ucccugcugugugguuucacc

SEQ ID NO: 759600 - RNA, 20 nt, Human
ucucuugggcauagaccugg

SEQ ID NO: 759601 - RNA, 21 nt, Human
ucugacggcugcugugccuuc

SEQ ID NO: 759602 - RNA, 19 nt, Human
ugacggcugcugugccuuc

SEQ ID NO: 759603 - RNA, 20 nt, Human
ugacuccccagucccauccc

SEQ ID NO: 759604 - RNA, 22 nt, Human
ugagcagcugacuccccagucc

SEQ ID NO: 759605 - RNA, 21 nt, Human
ugaggcacaggugggcgucug

SEQ ID NO: 759606 - RNA, 20 nt, Human
ugagugugggggggaagaac

SEQ ID NO: 759607 - RNA, 19 nt, Human
ugccucuucucucuuccuc

SEQ ID NO: 759608 - RNA, 21 nt, Human
ugcugugagucuugugcucug

SEQ ID NO: 759609 - RNA, 21 nt, Human
uggauggauguuuucaauucu

SEQ ID NO: 759610 - RNA, 27 nt, Human
uggauggauguuuucaauucucuuggg

SEQ ID NO: 759611 - RNA, 18 nt, Human
uggcagagccaagccccu

SEQ ID NO: 759612 - RNA, 19 nt, Human
uggcagagccaagccccuu

SEQ ID NO: 759613 - RNA, 18 nt, Human
uggcagggcccggacggc

SEQ ID NO: 759614 - RNA, 21 nt, Human
uggcuucuuucacuuagcgua

SEQ ID NO: 759615 - RNA, 20 nt, Human
ugggaagguuauacuuuuau

SEQ ID NO: 759616 - RNA, 25 nt, Human
ugggucuguucuguuacauggaguu

SEQ ID NO: 759617 - RNA, 23 nt, Human
ugugcaaccaucauuccacaauu

SEQ ID NO: 759618 - RNA, 18 nt, Human
uguggauggacauuuggg

SEQ ID NO: 759619 - RNA, 22 nt, Human
uucacaaaguugugcaaccauc

SEQ ID NO: 759620 - RNA, 18 nt, Human
uuccugccauuagccugc

SEQ ID NO: 759621 - RNA, 18 nt, Human
uugauugagugugggggg

SEQ ID NO: 759622 - RNA, 24 nt, Human
uuggacaucccugcugugugguuu

SEQ ID NO: 759623 - RNA, 19 nt, Human
uuuguaggauucacucagg

SEQ ID NO: 759624 - RNA, 22 nt, Human
aaacacacacuauauugcagcc

SEQ ID NO: 759625 - RNA, 20 nt, Human
aaacagcagaaggccaacaa

SEQ ID NO: 759626 - RNA, 23 nt, Human
aaaggcacacgcagccacaaaua

SEQ ID NO: 759627 - RNA, 22 nt, Human
aacacauaguucaaagaaccca

SEQ ID NO: 759628 - RNA, 22 nt, Human
aacaccaaagacuucaaaaaca

SEQ ID NO: 759629 - RNA, 19 nt, Human
aagagaccuuuaaaaguga

SEQ ID NO: 759630 - RNA, 23 nt, Human
aagcagaguggaaguagcaagaa

SEQ ID NO: 759631 - RNA, 21 nt, Human
aauccccuacuugggccagga

SEQ ID NO: 759632 - RNA, 18 nt, Human
acaaaaaugggaagagaa

SEQ ID NO: 759633 - RNA, 21 nt, Human
acaacagugcaauaccaagac

SEQ ID NO: 759634 - RNA, 18 nt, Human
acacacgcccacacacac

SEQ ID NO: 759635 - RNA, 19 nt, Human
acagacacaaucaaaagcc

SEQ ID NO: 759636 - RNA, 26 nt, Human
acagacccaggauggcccucauccca

SEQ ID NO: 759637 - RNA, 21 nt, Human
acauccacagaacugggugac

SEQ ID NO: 759638 - RNA, 20 nt, Human
acccccuuccccaccuauac

SEQ ID NO: 759639 - RNA, 21 nt, Human
acccccuuccccaccuauacc

SEQ ID NO: 759640 - RNA, 19 nt, Human
accuccuccgcuuccuccu

SEQ ID NO: 759641 - RNA, 19 nt, Human
acucugugucaagguagua

SEQ ID NO: 759642 - RNA, 21 nt, Human
agaaacagcaucaugggaugc

SEQ ID NO: 759643 - RNA, 22 nt, Human
agaaagccacacaagaacagca

SEQ ID NO: 759644 - RNA, 23 nt, Human
agaacccacuuucaaagggggaa

SEQ ID NO: 759645 - RNA, 24 nt, Human
agaagaccaaaauguacaaaaaug

SEQ ID NO: 759646 - RNA, 19 nt, Human
agaaggaaaggggucaggg

SEQ ID NO: 759647 - RNA, 24 nt, Human
agaauagcagaaacuccagucuca

SEQ ID NO: 759648 - RNA, 18 nt, Human
agaauguuggggaggaga

SEQ ID NO: 759649 - RNA, 23 nt, Human
agagcugugaggaggagaggagg

SEQ ID NO: 759650 - RNA, 21 nt, Human
agaggaacuucccccaaacac

SEQ ID NO: 759651 - RNA, 19 nt, Human
agcagcuauggggcuggcu

SEQ ID NO: 759652 - RNA, 22 nt, Human
agcggcucccuuuccaucuuga

SEQ ID NO: 759653 - RNA, 21 nt, Human
aggaacgucaaaggaccacag

SEQ ID NO: 759654 - RNA, 18 nt, Human
aggagagcagagcagagc

SEQ ID NO: 759655 - RNA, 22 nt, Human
aggcaaacaaagucuagccagg

SEQ ID NO: 759656 - RNA, 24 nt, Human
aggcaaacaaagucuagccagguc

SEQ ID NO: 759657 - RNA, 24 nt, Human
aggcaagaaaccccggcuucccaa

SEQ ID NO: 759658 - RNA, 23 nt, Human
aggcaggugaaucgacugacagg

SEQ ID NO: 759659 - RNA, 21 nt, Human
agggacccagcagcucugggc

SEQ ID NO: 759660 - RNA, 22 nt, Human
agggcagaggaaugcuccccgc

SEQ ID NO: 759661 - RNA, 18 nt, Human
aggggaaaaggcuugaag

SEQ ID NO: 759662 - RNA, 18 nt, Human
aguacuuuugaccaagua

SEQ ID NO: 759663 - RNA, 19 nt, Human
auauauauauauauauaua

SEQ ID NO: 759664 - RNA, 19 nt, Human
auauauauauauauauaua

SEQ ID NO: 759665 - RNA, 19 nt, Human
auauauaugcauauauaua

SEQ ID NO: 759666 - RNA, 25 nt, Human
augccacuccaaagaggaaccccag

SEQ ID NO: 759667 - RNA, 19 nt, Human
auggccccucccaccucaa

SEQ ID NO: 759668 - RNA, 22 nt, Human
auggggcuggcuuuaugaaaga

SEQ ID NO: 759669 - RNA, 22 nt, Human
auuccaguuacaaacagaacaa

SEQ ID NO: 759670 - RNA, 18 nt, Human
caaaacagagugcaggga

SEQ ID NO: 759671 - RNA, 19 nt, Human
caaaacagagugcagggac

SEQ ID NO: 759672 - RNA, 20 nt, Human
caaacccccaaaacaugagg

SEQ ID NO: 759673 - RNA, 21 nt, Human
caaaggcucagcaccagcaca

SEQ ID NO: 759674 - RNA, 24 nt, Human
caacaccaaagacuucaaaaacau

SEQ ID NO: 759675 - RNA, 25 nt, Human
caacuccauuaggaaugagcuaaag

SEQ ID NO: 759676 - RNA, 21 nt, Human
caagacuggauggagaugagc

SEQ ID NO: 759677 - RNA, 21 nt, Human
cacaaaggcacacgcagccac

SEQ ID NO: 759678 - RNA, 20 nt, Human
cacacacgcccacacacaca

SEQ ID NO: 759679 - RNA, 21 nt, Human
cacagacacaaucaaaagccc

SEQ ID NO: 759680 - RNA, 18 nt, Human
cacagccuggcuguugga

SEQ ID NO: 759681 - RNA, 18 nt, Human
cacagggcaggaggggag

SEQ ID NO: 759682 - RNA, 21 nt, Human
cacaguucugucuucauuggg

SEQ ID NO: 759683 - RNA, 23 nt, Human
caccaaaaacuccaugggaacag

SEQ ID NO: 759684 - RNA, 24 nt, Human
caccaaagacuucaaaaacauucc

SEQ ID NO: 759685 - RNA, 21 nt, Human
caccagcacauccacagaacu

SEQ ID NO: 759686 - RNA, 22 nt, Human
cacccccuuccccaccuauacc

SEQ ID NO: 759687 - RNA, 22 nt, Human
cacgcagccacaaauacacaau

SEQ ID NO: 759688 - RNA, 24 nt, Human
cacguucacuuacucauuuuccca

SEQ ID NO: 759689 - RNA, 19 nt, Human
cacuauauugcagccaggc

SEQ ID NO: 759690 - RNA, 26 nt, Human
cacucacagugacucgaugaaacuca

SEQ ID NO: 759691 - RNA, 22 nt, Human
cacuccaaagaggaaccccaga

SEQ ID NO: 759692 - RNA, 19 nt, Human
cagacacagagggcacaga

SEQ ID NO: 759693 - RNA, 20 nt, Human
cagagaaggaaaggggucag

SEQ ID NO: 759694 - RNA, 19 nt, Human
cagagaggacaagaaaggg

SEQ ID NO: 759695 - RNA, 19 nt, Human
cagcacgaggaugagguag

SEQ ID NO: 759696 - RNA, 22 nt, Human
cagcagaaggccaacaagagua

SEQ ID NO: 759697 - RNA, 24 nt, Human
cagcaguuuagugauucaccccuu

SEQ ID NO: 759698 - RNA, 20 nt, Human
cagccuauuucugcauccuu

SEQ ID NO: 759699 - RNA, 19 nt, Human
caggaggggaggauagaaa

SEQ ID NO: 759700 - RNA, 25 nt, Human
cauauauauauauauauauauacgg

SEQ ID NO: 759701 - RNA, 22 nt, Human
ccaaaaacuccaugggaacaga

SEQ ID NO: 759702 - RNA, 19 nt, Human
ccacccccuuccccaccua

SEQ ID NO: 759703 - RNA, 21 nt, Human
ccagaaagccacacaagaaca

SEQ ID NO: 759704 - RNA, 18 nt, Human
ccagaccauauugugauc

SEQ ID NO: 759705 - RNA, 22 nt, Human
ccaggcaaagagaccuuuaaaa

SEQ ID NO: 759706 - RNA, 26 nt, Human
cccaacuccauuaggaaugagcuaaa

SEQ ID NO: 759707 - RNA, 20 nt, Human
cccagaacccccaaucuaau

SEQ ID NO: 759708 - RNA, 22 nt, Human
cccagaacccccaaucuaaugc

SEQ ID NO: 759709 - RNA, 22 nt, Human
cccagcaaugcacacacgccca

SEQ ID NO: 759710 - RNA, 27 nt, Human
cccagcaccaaaaacuccaugggaaca

SEQ ID NO: 759711 - RNA, 18 nt, Human
ccccagaguccauccauc

SEQ ID NO: 759712 - RNA, 19 nt, Human
cccccuuccccaccuauac

SEQ ID NO: 759713 - RNA, 20 nt, Human
cccccuuccccaccuauacc

SEQ ID NO: 759714 - RNA, 18 nt, Human
ccccgagcgcccgaccuu

SEQ ID NO: 759715 - RNA, 21 nt, Human
ccccuacuugggagguggggu

SEQ ID NO: 759716 - RNA, 18 nt, Human
cccgccucccgggccccg

SEQ ID NO: 759717 - RNA, 19 nt, Human
ccgccgccuccgggccucg

SEQ ID NO: 759718 - RNA, 21 nt, Human
ccggcugaggcaagaaacccc

SEQ ID NO: 759719 - RNA, 18 nt, Human
ccucaccucauugcaucu

SEQ ID NO: 759720 - RNA, 22 nt, Human
ccugcagucuccauggccccuc

SEQ ID NO: 759721 - RNA, 25 nt, Human
cgcagccacaaauacacaauuaacc

SEQ ID NO: 759722 - RNA, 23 nt, Human
cgccucccgggccccgagcgccc

SEQ ID NO: 759723 - RNA, 23 nt, Human
cggccaagaagcucagcagauac

SEQ ID NO: 759724 - RNA, 22 nt, Human
cggcugaggcaagaaaccccgg

SEQ ID NO: 759725 - RNA, 20 nt, Human
cgggauagguuggcaacagg

SEQ ID NO: 759726 - RNA, 21 nt, Human
cuauccaccccaaugucaaaa

SEQ ID NO: 759727 - RNA, 21 nt, Human
cuccugcgccgccgccuccgg

SEQ ID NO: 759728 - RNA, 19 nt, Human
cuccuggccacccccuucc

SEQ ID NO: 759729 - RNA, 19 nt, Human
cucuacaccaaggcaucag

SEQ ID NO: 759730 - RNA, 24 nt, Human
cucuugggaagaagugcuuccuug

SEQ ID NO: 759731 - RNA, 22 nt, Human
cugaggcaagaaaccccggcuu

SEQ ID NO: 759732 - RNA, 18 nt, Human
cugccgacaggagacaca

SEQ ID NO: 759733 - RNA, 22 nt, Human
cugccgacaggagacacaggga

SEQ ID NO: 759734 - RNA, 19 nt, Human
cugcgccgccgccuccggg

SEQ ID NO: 759735 - RNA, 23 nt, Human
cugcgccgccgccuccgggccuc

SEQ ID NO: 759736 - RNA, 21 nt, Human
cugcgcggcccgccucccggg

SEQ ID NO: 759737 - RNA, 18 nt, Human
cugcuccuggccaccccc

SEQ ID NO: 759738 - RNA, 24 nt, Human
cugcuccuggccacccccuucccc

SEQ ID NO: 759739 - RNA, 19 nt, Human
cuugagucuucuuccuucu

SEQ ID NO: 759740 - RNA, 22 nt, Human
cuugccgggcacaguguuagaa

SEQ ID NO: 759741 - RNA, 23 nt, Human
gaaucgacuauccaccccaaugu

SEQ ID NO: 759742 - RNA, 24 nt, Human
gaccagaccauauugugaucccaa

SEQ ID NO: 759743 - RNA, 23 nt, Human
gaccagugugcgaagguagagac

SEQ ID NO: 759744 - RNA, 20 nt, Human
gacugugaugacagcagaau

SEQ ID NO: 759745 - RNA, 18 nt, Human
gagaaggaaaggggucag

SEQ ID NO: 759746 - RNA, 19 nt, Human
gagaaggaaaggggucagg

SEQ ID NO: 759747 - RNA, 24 nt, Human
gagcugaucaacaucccuguaacc

SEQ ID NO: 759748 - RNA, 23 nt, Human
gagcugugaggaggagaggaggg

SEQ ID NO: 759749 - RNA, 22 nt, Human
gaguacuuuugaccaaguauaa

SEQ ID NO: 759750 - RNA, 25 nt, Human
gcaacaccaaagacuucaaaaacau

SEQ ID NO: 759751 - RNA, 18 nt, Human
gcaaugcacacacgccca

SEQ ID NO: 759752 - RNA, 21 nt, Human
gcacagacacaaucaaaagcc

SEQ ID NO: 759753 - RNA, 18 nt, Human
gcacagagcccagcaugg

SEQ ID NO: 759754 - RNA, 20 nt, Human
gcaggacaccaacuucuucu

SEQ ID NO: 759755 - RNA, 19 nt, Human
gcauggaauccccuacuug

SEQ ID NO: 759756 - RNA, 24 nt, Human
gcauggaauccccuacuugggcca

SEQ ID NO: 759757 - RNA, 20 nt, Human
gccgccgccuccgggccucg

SEQ ID NO: 759758 - RNA, 19 nt, Human
gccgggcacaguguuagaa

SEQ ID NO: 759759 - RNA, 22 nt, Human
gccuaauuccauuuugaaaguc

SEQ ID NO: 759760 - RNA, 24 nt, Human
gcgcugcgcggcccgccucccggg

SEQ ID NO: 759761 - RNA, 21 nt, Human
gcggcccgccucccgggcccc

SEQ ID NO: 759762 - RNA, 25 nt, Human
ggacuucccccacccaguggcaggg

SEQ ID NO: 759763 - RNA, 19 nt, Human
ggagggcaggacaccaacu

SEQ ID NO: 759764 - RNA, 20 nt, Human
ggcaaacaaagucuagccag

SEQ ID NO: 759765 - RNA, 18 nt, Human
ggcaggaaauugcccugu

SEQ ID NO: 759766 - RNA, 22 nt, Human
ggcucugguuugaucagagagg

SEQ ID NO: 759767 - RNA, 23 nt, Human
ggcuggaggccuaacagcaagca

SEQ ID NO: 759768 - RNA, 24 nt, Human
ggcuguuggagccccaucagaacu

SEQ ID NO: 759769 - RNA, 22 nt, Human
gggaggagauagggucuuggga

SEQ ID NO: 759770 - RNA, 23 nt, Human
gggcagaggaaugcuccccgccu

SEQ ID NO: 759771 - RNA, 19 nt, Human
gggcaggacaccaacuucu

SEQ ID NO: 759772 - RNA, 23 nt, Human
ggggaggagauagggucuuggga

SEQ ID NO: 759773 - RNA, 24 nt, Human
ggggaggagauagggucuugggac

SEQ ID NO: 759774 - RNA, 24 nt, Human
ggugcacuaaucuacaaacagcag

SEQ ID NO: 759775 - RNA, 23 nt, Human
guauaaaaccacagagaagacca

SEQ ID NO: 759776 - RNA, 21 nt, Human
gucaaaggaccacagccuggc

SEQ ID NO: 759777 - RNA, 23 nt, Human
gucuucuuuucuuccccaccucc

SEQ ID NO: 759778 - RNA, 21 nt, Human
gucuuucuucccauggacccu

SEQ ID NO: 759779 - RNA, 19 nt, Human
gugagagcucccugccucc

SEQ ID NO: 759780 - RNA, 22 nt, Human
gugaggaggagaggagggccca

SEQ ID NO: 759781 - RNA, 22 nt, Human
guuuggcaucuugcaaaacaga

SEQ ID NO: 759782 - RNA, 20 nt, Human
uaaaaccacagagaagacca

SEQ ID NO: 759783 - RNA, 22 nt, Human
uaacccaaaucccucacagaua

SEQ ID NO: 759784 - RNA, 18 nt, Human
uacccuaggugugcugac

SEQ ID NO: 759785 - RNA, 22 nt, Human
uacugggcaucugcagagagga

SEQ ID NO: 759786 - RNA, 19 nt, Human
uagaaaguugggagggcag

SEQ ID NO: 759787 - RNA, 24 nt, Human
uagcaucaaaaaccuuccaaauau

SEQ ID NO: 759788 - RNA, 19 nt, Human
uaggacauucaccugccuc

SEQ ID NO: 759789 - RNA, 21 nt, Human
uaggacauucaccugccucuc

SEQ ID NO: 759790 - RNA, 22 nt, Human
uaggacauucaccugccucucc

SEQ ID NO: 759791 - RNA, 22 nt, Human
uauauacgucaaacccccaaaa

SEQ ID NO: 759792 - RNA, 20 nt, Human
uauauauauauauauauacg

SEQ ID NO: 759793 - RNA, 18 nt, Human
uauauaugcauauauaua

SEQ ID NO: 759794 - RNA, 21 nt, Human
uauauaugcauauauauauau

SEQ ID NO: 759795 - RNA, 25 nt, Human
uauauaugcauauauauauauauau

SEQ ID NO: 759796 - RNA, 22 nt, Human
uauaugcauauauauauauaua

SEQ ID NO: 759797 - RNA, 25 nt, Human
uauaugcauauauauauauauauau

SEQ ID NO: 759798 - RNA, 22 nt, Human
uaugcauauauauauauauaua

SEQ ID NO: 759799 - RNA, 18 nt, Human
ucaaaugugugggugggu

SEQ ID NO: 759800 - RNA, 20 nt, Human
ucaccccuuugcccaccccc

SEQ ID NO: 759801 - RNA, 21 nt, Human
ucagcaccagcacauccacag

SEQ ID NO: 759802 - RNA, 24 nt, Human
uccaaguaaucucuguacauggua

SEQ ID NO: 759803 - RNA, 23 nt, Human
uccacagaacugggugacaggca

SEQ ID NO: 759804 - RNA, 22 nt, Human
uccaccccaaugucaaaauggc

SEQ ID NO: 759805 - RNA, 21 nt, Human
ucccagaggcuuuuccuucuc

SEQ ID NO: 759806 - RNA, 18 nt, Human
ucccauggacccucagcc

SEQ ID NO: 759807 - RNA, 21 nt, Human
ucccccaaacacauaguucaa

SEQ ID NO: 759808 - RNA, 18 nt, Human
ucccgggccccgagcgcc

SEQ ID NO: 759809 - RNA, 19 nt, Human
ucccgggccccgagcgccc

SEQ ID NO: 759810 - RNA, 19 nt, Human
ucccugaggacaguucaga

SEQ ID NO: 759811 - RNA, 24 nt, Human
ucccugcuguaagucaaucuauaa

SEQ ID NO: 759812 - RNA, 23 nt, Human
uccugcgccgccgccuccgggcc

SEQ ID NO: 759813 - RNA, 24 nt, Human
uccuuuaggcaaacaaagucuagc

SEQ ID NO: 759814 - RNA, 23 nt, Human
ucuacaccaaggcaucaguuucu

SEQ ID NO: 759815 - RNA, 19 nt, Human
ucuagaaugaguugggaag

SEQ ID NO: 759816 - RNA, 20 nt, Human
ucuccaaguaaucucuguac

SEQ ID NO: 759817 - RNA, 28 nt, Human
ucuccaauccaauuugucauccccuuua

SEQ ID NO: 759818 - RNA, 21 nt, Human
ucucuuccauuuaguucaggu

SEQ ID NO: 759819 - RNA, 25 nt, Human
ucugcaaagacaccucaugagcacc

SEQ ID NO: 759820 - RNA, 19 nt, Human
ucugucuucuuuucuuccc

SEQ ID NO: 759821 - RNA, 24 nt, Human
ucuguuccuuuaggcaaacaaagu

SEQ ID NO: 759822 - RNA, 23 nt, Human
ucuugucaguuugggaaugauua

SEQ ID NO: 759823 - RNA, 25 nt, Human
ugaaaacacaaaggcacacgcagcc

SEQ ID NO: 759824 - RNA, 26 nt, Human
ugaaaacacaaaggcacacgcagcca

SEQ ID NO: 759825 - RNA, 20 nt, Human
ugaaaagaaauauaaaagga

SEQ ID NO: 759826 - RNA, 21 nt, Human
ugaaaagaaauauaaaaggau

SEQ ID NO: 759827 - RNA, 24 nt, Human
ugagagcugugaggaggagaggag

SEQ ID NO: 759828 - RNA, 19 nt, Human
ugaggaggagaggagggcc

SEQ ID NO: 759829 - RNA, 21 nt, Human
ugagggacccagcagcucugg

SEQ ID NO: 759830 - RNA, 24 nt, Human
ugagggacccagcagcucugggcu

SEQ ID NO: 759831 - RNA, 21 nt, Human
ugagggauggacacagggcag

SEQ ID NO: 759832 - RNA, 20 nt, Human
ugauccccccuguucuccuc

SEQ ID NO: 759833 - RNA, 23 nt, Human
ugcaaagacaccucaugagcacc

SEQ ID NO: 759834 - RNA, 19 nt, Human
ugcacagacacagagggca

SEQ ID NO: 759835 - RNA, 25 nt, Human
ugcacagacacagagggcacagagc

SEQ ID NO: 759836 - RNA, 20 nt, Human
ugcacuaaucuacaaacagc

SEQ ID NO: 759837 - RNA, 20 nt, Human
ugcaucuccccaggcacagu

SEQ ID NO: 759838 - RNA, 21 nt, Human
ugcccuguggugcaguaaccu

SEQ ID NO: 759839 - RNA, 22 nt, Human
ugccuacccagcaccaaaaacu

SEQ ID NO: 759840 - RNA, 24 nt, Human
uggaaaauuuguuuuuaagugggg

SEQ ID NO: 759841 - RNA, 18 nt, Human
uggaagggagaaacuagg

SEQ ID NO: 759842 - RNA, 22 nt, Human
uggaaguagcaagaagccggcu

SEQ ID NO: 759843 - RNA, 24 nt, Human
uggaaguagcaagaagccggcuga

SEQ ID NO: 759844 - RNA, 20 nt, Human
uggaauccccuacuugggcc

SEQ ID NO: 759845 - RNA, 18 nt, Human
uggaaucuuugagcuggu

SEQ ID NO: 759846 - RNA, 23 nt, Human
uggaugagauuuaugaaugaugu

SEQ ID NO: 759847 - RNA, 20 nt, Human
uggcacaagacaaagggcag

SEQ ID NO: 759848 - RNA, 19 nt, Human
uggccuccaguucccaucu

SEQ ID NO: 759849 - RNA, 21 nt, Human
ugggaaaacacucugugucaa

SEQ ID NO: 759850 - RNA, 24 nt, Human
ugggagggcaggacaccaacuucu

SEQ ID NO: 759851 - RNA, 25 nt, Human
ugggaugccacuccaaagaggaacc

SEQ ID NO: 759852 - RNA, 22 nt, Human
uggggaaacugaucucucccca

SEQ ID NO: 759853 - RNA, 18 nt, Human
uggggagggacuuccccc

SEQ ID NO: 759854 - RNA, 20 nt, Human
ugggguagggaggggauucc

SEQ ID NO: 759855 - RNA, 20 nt, Human
ugggugugauauuaaacacc

SEQ ID NO: 759856 - RNA, 19 nt, Human
ugugaggaggagaggaggg

SEQ ID NO: 759857 - RNA, 25 nt, Human
uguuagaaaggaaauucaagauccc

SEQ ID NO: 759858 - RNA, 19 nt, Human
uuaugaaagauuggccucc

SEQ ID NO: 759859 - RNA, 18 nt, Human
uuccuguccugcagucuc

SEQ ID NO: 759860 - RNA, 19 nt, Human
uucuugauccccccuguuc

SEQ ID NO: 759861 - RNA, 23 nt, Human
uugacucacucuccucacuuccu

SEQ ID NO: 759862 - RNA, 22 nt, Human
uugagaaacaacagccuguaaa

SEQ ID NO: 759863 - RNA, 26 nt, Human
uugcccaccccccaaccuugcacagu

SEQ ID NO: 759864 - RNA, 19 nt, Human
uuggaaagagagcaaaggc

SEQ ID NO: 759865 - RNA, 21 nt, Human
uuggcaucuugcaaaacagag

SEQ ID NO: 759866 - RNA, 21 nt, Human
uuuggcaucuugcaaaacaga

SEQ ID NO: 759867 - RNA, 21 nt, Human
uuugugguuguucauuugcca

SEQ ID NO: 759868 - RNA, 25 nt, Human
aaaaaacugacccagaaaaacagac

SEQ ID NO: 759869 - RNA, 23 nt, Human
aaaaaugaguaagucuggccuuc

SEQ ID NO: 759870 - RNA, 18 nt, Human
aaaacugacccagaaaaa

SEQ ID NO: 759871 - RNA, 21 nt, Human
aaacaggggccuaacaggggc

SEQ ID NO: 759872 - RNA, 25 nt, Human
aaacauucagaacaugcccagagaa

SEQ ID NO: 759873 - RNA, 19 nt, Human
aaaggaaaugaugaaaagg

SEQ ID NO: 759874 - RNA, 20 nt, Human
aaaggggagaugaggagagg

SEQ ID NO: 759875 - RNA, 20 nt, Human
aaaguaaacagugugcuucc

SEQ ID NO: 759876 - RNA, 24 nt, Human
aacccagcacucgucauuuuuaca

SEQ ID NO: 759877 - RNA, 18 nt, Human
aagccccacaugcucuuc

SEQ ID NO: 759878 - RNA, 26 nt, Human
aagcccccgcagagcagccggggaga

SEQ ID NO: 759879 - RNA, 21 nt, Human
aagcuucgucauuuugaggac

SEQ ID NO: 759880 - RNA, 20 nt, Human
aagggcaccagaggccacag

SEQ ID NO: 759881 - RNA, 21 nt, Human
aaugucuaacuguuggacaac

SEQ ID NO: 759882 - RNA, 21 nt, Human
acacccacaccccagccugcc

SEQ ID NO: 759883 - RNA, 22 nt, Human
acacgacuguucauacaucuau

SEQ ID NO: 759884 - RNA, 24 nt, Human
acaggaaguaucacaaaaggcagc

SEQ ID NO: 759885 - RNA, 24 nt, Human
accccagccugccccauccucagc

SEQ ID NO: 759886 - RNA, 20 nt, Human
accccaggccacacccacac

SEQ ID NO: 759887 - RNA, 19 nt, Human
acccugagauggcugaggg

SEQ ID NO: 759888 - RNA, 20 nt, Human
acugcagggccucagcacag

SEQ ID NO: 759889 - RNA, 23 nt, Human
acuucgcgcucacuccgaagcca

SEQ ID NO: 759890 - RNA, 24 nt, Human
agaaagaaauccuggcaaacugag

SEQ ID NO: 759891 - RNA, 20 nt, Human
agaccccacacaagccacgg

SEQ ID NO: 759892 - RNA, 22 nt, Human
agaggagggagcacugggugcu

SEQ ID NO: 759893 - RNA, 20 nt, Human
agaggcucucagcacuuugc

SEQ ID NO: 759894 - RNA, 24 nt, Human
agaguagaggagggagcacugggg

SEQ ID NO: 759895 - RNA, 20 nt, Human
agauggagggcgugaaaugg

SEQ ID NO: 759896 - RNA, 21 nt, Human
agcacaucacugcucaggaaa

SEQ ID NO: 759897 - RNA, 19 nt, Human
agcacugggugcugcugcu

SEQ ID NO: 759898 - RNA, 19 nt, Human
aggaaaugaugaaaaggaa

SEQ ID NO: 759899 - RNA, 25 nt, Human
aggaauccugugggcuaaccugggc

SEQ ID NO: 759900 - RNA, 23 nt, Human
aggcaaaaaaaacugacccagaa

SEQ ID NO: 759901 - RNA, 20 nt, Human
aggcgaggugguaggaucgg

SEQ ID NO: 759902 - RNA, 24 nt, Human
agggaacugggagaggggaaagag

SEQ ID NO: 759903 - RNA, 22 nt, Human
agggagcacugggugcugcugc

SEQ ID NO: 759904 - RNA, 21 nt, Human
agggcugguuuccuccagcgc

SEQ ID NO: 759905 - RNA, 19 nt, Human
aggggaaagaggauggaac

SEQ ID NO: 759906 - RNA, 24 nt, Human
agggggcagaagaggcucagagga

SEQ ID NO: 759907 - RNA, 23 nt, Human
agggggcucuaaagaagauacca

SEQ ID NO: 759908 - RNA, 23 nt, Human
agguggcugaccccuggcucugc

SEQ ID NO: 759909 - RNA, 20 nt, Human
aguacgggaaugguggggag

SEQ ID NO: 759910 - RNA, 20 nt, Human
aucucugacccgccuucccc

SEQ ID NO: 759911 - RNA, 23 nt, Human
caaaaaaaacugacccagaaaaa

SEQ ID NO: 759912 - RNA, 25 nt, Human
caaaaaaaacugacccagaaaaaca

SEQ ID NO: 759913 - RNA, 24 nt, Human
caaaaaguaaacagugugcuuccu

SEQ ID NO: 759914 - RNA, 19 nt, Human
caaaggggagaugaggaga

SEQ ID NO: 759915 - RNA, 19 nt, Human
caagauaaaagccuagagu

SEQ ID NO: 759916 - RNA, 19 nt, Human
caagggcaccagaggccag

SEQ ID NO: 759917 - RNA, 19 nt, Human
cacacaagccacggggugg

SEQ ID NO: 759918 - RNA, 19 nt, Human
caccaagccccacaugcuc

SEQ ID NO: 759919 - RNA, 22 nt, Human
caccaagccccacaugcucuuc

SEQ ID NO: 759920 - RNA, 23 nt, Human
caccagcacuucgcgcucacucc

SEQ ID NO: 759921 - RNA, 19 nt, Human
caccccaggccacacccac

SEQ ID NO: 759922 - RNA, 20 nt, Human
cacccccuuugcccccaaca

SEQ ID NO: 759923 - RNA, 27 nt, Human
cacccugagauggcugagggggccagg

SEQ ID NO: 759924 - RNA, 21 nt, Human
cacugugucccuugagaagca

SEQ ID NO: 759925 - RNA, 18 nt, Human
cagcaaacgcccauccug

SEQ ID NO: 759926 - RNA, 22 nt, Human
cagcacaucacugcucaggaaa

SEQ ID NO: 759927 - RNA, 18 nt, Human
cagcagaaguggccuggc

SEQ ID NO: 759928 - RNA, 22 nt, Human
cagcagugccuguggucggcgc

SEQ ID NO: 759929 - RNA, 24 nt, Human
cagcaugaaggcaguggcugggga

SEQ ID NO: 759930 - RNA, 19 nt, Human
cagccaguaccucgccccg

SEQ ID NO: 759931 - RNA, 25 nt, Human
cagccaguaccucgccccgcccucu

SEQ ID NO: 759932 - RNA, 24 nt, Human
caggaugcuggggccccaggucag

SEQ ID NO: 759933 - RNA, 24 nt, Human
caggccccugggacagggcugggg

SEQ ID NO: 759934 - RNA, 21 nt, Human
caggcugcagaaagcauggga

SEQ ID NO: 759935 - RNA, 26 nt, Human
caguggcagcaaacggccacugagcu

SEQ ID NO: 759936 - RNA, 22 nt, Human
caguucuccuguaccauggccu

SEQ ID NO: 759937 - RNA, 19 nt, Human
cauaacaacuacaggcugc

SEQ ID NO: 759938 - RNA, 19 nt, Human
caucccccugcacacuuau

SEQ ID NO: 759939 - RNA, 19 nt, Human
caugccagccagcccagcc

SEQ ID NO: 759940 - RNA, 22 nt, Human
caugcccagagaagggcagcag

SEQ ID NO: 759941 - RNA, 21 nt, Human
ccaagaagagcagcacaucac

SEQ ID NO: 759942 - RNA, 20 nt, Human
ccacccuuagccuggcccug

SEQ ID NO: 759943 - RNA, 22 nt, Human
ccaccgaguucggagccgcggg

SEQ ID NO: 759944 - RNA, 18 nt, Human
ccagcccaaagccccacc

SEQ ID NO: 759945 - RNA, 25 nt, Human
ccagcccugagccaccccaggccac

SEQ ID NO: 759946 - RNA, 22 nt, Human
ccaggaccaccgaguucggagc

SEQ ID NO: 759947 - RNA, 19 nt, Human
ccaggccacacccacaccc

SEQ ID NO: 759948 - RNA, 22 nt, Human
ccaggccacacccacaccccag

SEQ ID NO: 759949 - RNA, 21 nt, Human
ccauccucagcagaaguggcc

SEQ ID NO: 759950 - RNA, 18 nt, Human
ccaucuuucagcauucca

SEQ ID NO: 759951 - RNA, 18 nt, Human
cccacugcucaccagcac

SEQ ID NO: 759952 - RNA, 18 nt, Human
cccagcccaaagccccac

SEQ ID NO: 759953 - RNA, 18 nt, Human
cccagcccagcucaccca

SEQ ID NO: 759954 - RNA, 19 nt, Human
cccaugcucccuccccucu

SEQ ID NO: 759955 - RNA, 30 nt, Human
ccccaggccacacccacaccccagccugcc

SEQ ID NO: 759956 - RNA, 19 nt, Human
cccccaucucugacccgcc

SEQ ID NO: 759957 - RNA, 20 nt, Human
ccccucccagcccaaagccc

SEQ ID NO: 759958 - RNA, 19 nt, Human
ccccucugugggcugagga

SEQ ID NO: 759959 - RNA, 22 nt, Human
ccccucugugggcugaggagga

SEQ ID NO: 759960 - RNA, 20 nt, Human
cccgcaagauaaaagccuag

SEQ ID NO: 759961 - RNA, 18 nt, Human
cccgccacccccuuugcc

SEQ ID NO: 759962 - RNA, 27 nt, Human
cccgccacccccuuugcccccaacaaa

SEQ ID NO: 759963 - RNA, 18 nt, Human
cccgcccccagcaagggc

SEQ ID NO: 759964 - RNA, 28 nt, Human
cccuccaccaagccccacaugcucuucc

SEQ ID NO: 759965 - RNA, 23 nt, Human
cccucccagcccaaagccccacc

SEQ ID NO: 759966 - RNA, 23 nt, Human
cccugggacagggcuggggugug

SEQ ID NO: 759967 - RNA, 20 nt, Human
ccgaagccagugaagccccc

SEQ ID NO: 759968 - RNA, 24 nt, Human
ccucagcagaaguggccuggccuc

SEQ ID NO: 759969 - RNA, 19 nt, Human
ccuccagcgcucccuggcu

SEQ ID NO: 759970 - RNA, 22 nt, Human
ccuccccaucccagccugaggc

SEQ ID NO: 759971 - RNA, 21 nt, Human
ccucuagcuuuucccucuaga

SEQ ID NO: 759972 - RNA, 23 nt, Human
ccucuggacagugugucugaccu

SEQ ID NO: 759973 - RNA, 18 nt, Human
ccugaagccuuggcaccu

SEQ ID NO: 759974 - RNA, 22 nt, Human
ccugcccgcacucgcccagggg

SEQ ID NO: 759975 - RNA, 18 nt, Human
ccugcugaggacucucca

SEQ ID NO: 759976 - RNA, 20 nt, Human
ccuggccccaugcucccucc

SEQ ID NO: 759977 - RNA, 21 nt, Human
ccuggcuccagaggccuguca

SEQ ID NO: 759978 - RNA, 25 nt, Human
ccugggacccagaaccacauacgga

SEQ ID NO: 759979 - RNA, 22 nt, Human
ccuggggccccuccaccaagcc

SEQ ID NO: 759980 - RNA, 26 nt, Human
ccuguaccauggccuagacccagaag

SEQ ID NO: 759981 - RNA, 22 nt, Human
ccuuuuguuaccaaggugagcc

SEQ ID NO: 759982 - RNA, 19 nt, Human
cgaagccagugaagccccc

SEQ ID NO: 759983 - RNA, 24 nt, Human
cgagaacaaucuggucucagaucc

SEQ ID NO: 759984 - RNA, 22 nt, Human
cgauggcaccuuugccaaaggu

SEQ ID NO: 759985 - RNA, 21 nt, Human
cgauuagacaaaagaacaacu

SEQ ID NO: 759986 - RNA, 19 nt, Human
cggcagggaaugcgggggg

SEQ ID NO: 759987 - RNA, 21 nt, Human
cggcagggaaugcggggggug

SEQ ID NO: 759988 - RNA, 23 nt, Human
cggggaccuagaagccagcccuu

SEQ ID NO: 759989 - RNA, 21 nt, Human
cuagacccagaagaaaauaaa

SEQ ID NO: 759990 - RNA, 21 nt, Human
cuaugcauucacugccccaaa

SEQ ID NO: 759991 - RNA, 19 nt, Human
cucagaucccugcccgcac

SEQ ID NO: 759992 - RNA, 20 nt, Human
cucccugggacccagaacca

SEQ ID NO: 759993 - RNA, 22 nt, Human
cugccgauggcaccuuugccaa

SEQ ID NO: 759994 - RNA, 22 nt, Human
cugcugaggacucuccaagcau

SEQ ID NO: 759995 - RNA, 20 nt, Human
cuggcaccuggccccaugcu

SEQ ID NO: 759996 - RNA, 22 nt, Human
cuggccccugccccagugcuuu

SEQ ID NO: 759997 - RNA, 22 nt, Human
cuggcgcucaggccuaccccuu

SEQ ID NO: 759998 - RNA, 19 nt, Human
cuggcucagggaggagucg

SEQ ID NO: 759999 - RNA, 22 nt, Human
cuuccaggaccaccgaguucgg

SEQ ID NO: 760000 - RNA, 20 nt, Human
cuugcagcucacuuggggga

SEQ ID NO: 760001 - RNA, 19 nt, Human
gaaaugguggaaaccaaaa

SEQ ID NO: 760002 - RNA, 20 nt, Human
gaacacggaccugagacuuc

SEQ ID NO: 760003 - RNA, 20 nt, Human
gaagauaccagaagguacca

SEQ ID NO: 760004 - RNA, 18 nt, Human
gaagcaggaaugcacaug

SEQ ID NO: 760005 - RNA, 21 nt, Human
gagcacugggugcugcugcuc

SEQ ID NO: 760006 - RNA, 21 nt, Human
gaggagccacacugagcggag

SEQ ID NO: 760007 - RNA, 24 nt, Human
gauuagacaaaagaacaacugagu

SEQ ID NO: 760008 - RNA, 19 nt, Human
gcagcaugaaggcaguggc

SEQ ID NO: 760009 - RNA, 20 nt, Human
gccaaggaacacggggugcc

SEQ ID NO: 760010 - RNA, 26 nt, Human
gccacacccacaccccagccugcccc

SEQ ID NO: 760011 - RNA, 19 nt, Human
gccacugagcuucucccca

SEQ ID NO: 760012 - RNA, 23 nt, Human
gccccacaugcucuuccgccaca

SEQ ID NO: 760013 - RNA, 19 nt, Human
gcccugagccaccccaggc

SEQ ID NO: 760014 - RNA, 21 nt, Human
gcgaggugguaggaucgggcc

SEQ ID NO: 760015 - RNA, 22 nt, Human
gcugaccccuggcucugccagu

SEQ ID NO: 760016 - RNA, 21 nt, Human
gcuggcagcugacuuuugacc

SEQ ID NO: 760017 - RNA, 20 nt, Human
ggacccagaaccacauacgg

SEQ ID NO: 760018 - RNA, 18 nt, Human
ggcagcaugaaggcagug

SEQ ID NO: 760019 - RNA, 20 nt, Human
ggcaggaggcgacuagaggc

SEQ ID NO: 760020 - RNA, 25 nt, Human
ggcagggaaugcgggggguggaggg

SEQ ID NO: 760021 - RNA, 21 nt, Human
ggcucuuuauucucgaggccu

SEQ ID NO: 760022 - RNA, 18 nt, Human
ggcuggcucagggaggag

SEQ ID NO: 760023 - RNA, 22 nt, Human
gggaacacggaccugagacuuc

SEQ ID NO: 760024 - RNA, 21 nt, Human
gggagagggggaugggauggg

SEQ ID NO: 760025 - RNA, 23 nt, Human
gggagcacugggugcugcugcuc

SEQ ID NO: 760026 - RNA, 20 nt, Human
gggccccuccaccaagcccc

SEQ ID NO: 760027 - RNA, 18 nt, Human
ggggaugggauggggcag

SEQ ID NO: 760028 - RNA, 22 nt, Human
ggggaugggauggggcaggggg

SEQ ID NO: 760029 - RNA, 21 nt, Human
ggggcacucucccaggcugcu

SEQ ID NO: 760030 - RNA, 21 nt, Human
ggggcuggcucuuuauucucg

SEQ ID NO: 760031 - RNA, 21 nt, Human
ggggugcccucaucucuuggg

SEQ ID NO: 760032 - RNA, 20 nt, Human
ggguguguguuagucuuccc

SEQ ID NO: 760033 - RNA, 20 nt, Human
gguaggaucgggccuggccu

SEQ ID NO: 760034 - RNA, 18 nt, Human
gguaggggccgagagggc

SEQ ID NO: 760035 - RNA, 19 nt, Human
gguuccaaggcucccuggg

SEQ ID NO: 760036 - RNA, 23 nt, Human
guaaacauucagaacaugcccag

SEQ ID NO: 760037 - RNA, 22 nt, Human
gugcuugcucuagcccaggguc

SEQ ID NO: 760038 - RNA, 19 nt, Human
uaaaagccuagaguugcag

SEQ ID NO: 760039 - RNA, 19 nt, Human
uaaaaggaaaugguggaaa

SEQ ID NO: 760040 - RNA, 22 nt, Human
uaacuguuggacaacuguuugg

SEQ ID NO: 760041 - RNA, 22 nt, Human
uaagaaggguccccagucaccc

SEQ ID NO: 760042 - RNA, 22 nt, Human
uaagcaaggcaauggcucaaau

SEQ ID NO: 760043 - RNA, 23 nt, Human
uacccgcccccagcaagggcagc

SEQ ID NO: 760044 - RNA, 22 nt, Human
uacuuuucaugcaaaaaguaaa

SEQ ID NO: 760045 - RNA, 20 nt, Human
ucacucggcagggaaugcgg

SEQ ID NO: 760046 - RNA, 19 nt, Human
ucagaauuguggcugcaga

SEQ ID NO: 760047 - RNA, 20 nt, Human
ucaguucugccucuggacag

SEQ ID NO: 760048 - RNA, 21 nt, Human
ucaguucugccucuggacagu

SEQ ID NO: 760049 - RNA, 20 nt, Human
uccaccaagccccacaugcc

SEQ ID NO: 760050 - RNA, 19 nt, Human
uccaugcuggcccaugugg

SEQ ID NO: 760051 - RNA, 21 nt, Human
ucccaagaagucgccuggcuc

SEQ ID NO: 760052 - RNA, 20 nt, Human
ucccauccaaucacaggccc

SEQ ID NO: 760053 - RNA, 23 nt, Human
uccccagagaagcaggaaugcac

SEQ ID NO: 760054 - RNA, 22 nt, Human
ucccugcccgcacucgcccagg

SEQ ID NO: 760055 - RNA, 23 nt, Human
uccugcuuggcuggccugcucug

SEQ ID NO: 760056 - RNA, 20 nt, Human
uccugggccugccugccuga

SEQ ID NO: 760057 - RNA, 21 nt, Human
ucuauggccuuuuguuaccaa

SEQ ID NO: 760058 - RNA, 18 nt, Human
ucucugagggagcacagg

SEQ ID NO: 760059 - RNA, 23 nt, Human
ucucuugggggcacucucccagg

SEQ ID NO: 760060 - RNA, 21 nt, Human
ucugcagccaguaccucgccc

SEQ ID NO: 760061 - RNA, 19 nt, Human
ugaagagggguggcuggcu

SEQ ID NO: 760062 - RNA, 25 nt, Human
ugaaggcaguggcuggggaauggca

SEQ ID NO: 760063 - RNA, 21 nt, Human
ugacccgccuuccccucccag

SEQ ID NO: 760064 - RNA, 21 nt, Human
ugacgcaggggcuccugcaug

SEQ ID NO: 760065 - RNA, 23 nt, Human
ugagcagacacugcagggccuca

SEQ ID NO: 760066 - RNA, 19 nt, Human
ugagccacccuuagccugg

SEQ ID NO: 760067 - RNA, 19 nt, Human
ugaggccaggugugaccug

SEQ ID NO: 760068 - RNA, 18 nt, Human
ugaggucagucccuccug

SEQ ID NO: 760069 - RNA, 24 nt, Human
ugaguacgggaaugguggggaggg

SEQ ID NO: 760070 - RNA, 19 nt, Human
ugauggaacugagccaccc

SEQ ID NO: 760071 - RNA, 22 nt, Human
ugcaugugaaauccuugucagu

SEQ ID NO: 760072 - RNA, 23 nt, Human
ugcccagagaagggcagcagccg

SEQ ID NO: 760073 - RNA, 23 nt, Human
ugccgauggcaccuuugccaaag

SEQ ID NO: 760074 - RNA, 21 nt, Human
ugccucuggacagugugucug

SEQ ID NO: 760075 - RNA, 23 nt, Human
ugcucaggaaacaggggccuaac

SEQ ID NO: 760076 - RNA, 20 nt, Human
ugcugcugcucuggccccug

SEQ ID NO: 760077 - RNA, 23 nt, Human
ugcuugcucuagcccagggucca

SEQ ID NO: 760078 - RNA, 19 nt, Human
ugcuuuggggacccuagca

SEQ ID NO: 760079 - RNA, 22 nt, Human
uggcaaacugaguuugcaaaac

SEQ ID NO: 760080 - RNA, 19 nt, Human
uggcacagaggaaccugga

SEQ ID NO: 760081 - RNA, 25 nt, Human
uggcagcaaacggccacugagcuuc

SEQ ID NO: 760082 - RNA, 22 nt, Human
uggcaggaggcgacuagaggcu

SEQ ID NO: 760083 - RNA, 25 nt, Human
uggccccugccccagugcuuugggg

SEQ ID NO: 760084 - RNA, 20 nt, Human
uggcuaaagggcugguuucc

SEQ ID NO: 760085 - RNA, 19 nt, Human
uggcucagggaggagucgg

SEQ ID NO: 760086 - RNA, 22 nt, Human
uggcucagggaggagucgggag

SEQ ID NO: 760087 - RNA, 20 nt, Human
uggcuccagaggccugucag

SEQ ID NO: 760088 - RNA, 18 nt, Human
uggcugaccccuggcucu

SEQ ID NO: 760089 - RNA, 18 nt, Human
uggcugagggggccaggc

SEQ ID NO: 760090 - RNA, 25 nt, Human
uggcugagggggccaggccccuggg

SEQ ID NO: 760091 - RNA, 22 nt, Human
uggcuggcuuaggguaggggcc

SEQ ID NO: 760092 - RNA, 18 nt, Human
uggcuggggaauggcaca

SEQ ID NO: 760093 - RNA, 21 nt, Human
ugucugugcgcagcaaacgcc

SEQ ID NO: 760094 - RNA, 24 nt, Human
uguggagaugccuucccgaggacu

SEQ ID NO: 760095 - RNA, 20 nt, Human
uguggcugcagaggcaucuu

SEQ ID NO: 760096 - RNA, 19 nt, Human
uuaaaacaaaaacccagca

SEQ ID NO: 760097 - RNA, 22 nt, Human
uuagccuggcccuggcccaucc

SEQ ID NO: 760098 - RNA, 23 nt, Human
uucuaugcauucacugccccaaa

SEQ ID NO: 760099 - RNA, 26 nt, Human
uuugcccccaacaaauccuggggccc

SEQ ID NO: 760100 - RNA, 24 nt, Human
aaaaaaacaaacaaaaccacaccu

SEQ ID NO: 760101 - RNA, 26 nt, Human
aaaaaaacaaacaaaaccacaccugg

SEQ ID NO: 760102 - RNA, 21 nt, Human
aaaaaaauacaaacagaagaa

SEQ ID NO: 760103 - RNA, 24 nt, Human
aaaaaacaaacaaaaccacaccug

SEQ ID NO: 760104 - RNA, 22 nt, Human
aaaaacaagcaacacuaacuua

SEQ ID NO: 760105 - RNA, 19 nt, Human
aaaaacacaaauaagcaug

SEQ ID NO: 760106 - RNA, 20 nt, Human
aaaacaaacaaaaccacacc

SEQ ID NO: 760107 - RNA, 23 nt, Human
aaaauaauauuaugacauugacc

SEQ ID NO: 760108 - RNA, 22 nt, Human
aaacaaaaacaagcaacacuaa

SEQ ID NO: 760109 - RNA, 22 nt, Human
aaacaaaaccacaccugggcug

SEQ ID NO: 760110 - RNA, 27 nt, Human
aaacaaaaccacaccugggcuggaaaa

SEQ ID NO: 760111 - RNA, 18 nt, Human
aaacaaaagaaucacaga

SEQ ID NO: 760112 - RNA, 18 nt, Human
aaacaaaagaaucacaga

SEQ ID NO: 760113 - RNA, 24 nt, Human
aaacagaagaacucuuucacaauc

SEQ ID NO: 760114 - RNA, 24 nt, Human
aaacauagaaaaaaacaaacaaaa

SEQ ID NO: 760115 - RNA, 19 nt, Human
aacaaacaaaaccacaccu

SEQ ID NO: 760116 - RNA, 25 nt, Human
aacaacaccacaacaacaaacaaaa

SEQ ID NO: 760117 - RNA, 20 nt, Human
aacccacaaacauagaaaaa

SEQ ID NO: 760118 - RNA, 22 nt, Human
aacccacaaacauagaaaaaaa

SEQ ID NO: 760119 - RNA, 24 nt, Human
aagcagacaaaggugugaaucaaa

SEQ ID NO: 760120 - RNA, 21 nt, Human
aaggacaucacagcacagaaa

SEQ ID NO: 760121 - RNA, 19 nt, Human
aagugucacaccaaggaaa

SEQ ID NO: 760122 - RNA, 22 nt, Human
aaugcuagaaaaauguccacgc

SEQ ID NO: 760123 - RNA, 24 nt, Human
acaaaaaguaguagugcauaacaa

SEQ ID NO: 760124 - RNA, 26 nt, Human
acaaaaaucaaacaugaaggaaaaau

SEQ ID NO: 760125 - RNA, 23 nt, Human
acaaaaccacaccugggcuggaa

SEQ ID NO: 760126 - RNA, 21 nt, Human
acaaacagaagaacucuuuca

SEQ ID NO: 760127 - RNA, 21 nt, Human
acaaacaguauugcacauaac

SEQ ID NO: 760128 - RNA, 24 nt, Human
acaacaaacaaaagaaucacagag

SEQ ID NO: 760129 - RNA, 26 nt, Human
acaccacaacaacaaacaaaagaauc

SEQ ID NO: 760130 - RNA, 18 nt, Human
acagaggcuuuaaacagu

SEQ ID NO: 760131 - RNA, 28 nt, Human
acagauuuccagaacacuguaagccccg

SEQ ID NO: 760132 - RNA, 19 nt, Human
acaguacaaggacaucaca

SEQ ID NO: 760133 - RNA, 23 nt, Human
acaguauugcacauaacaacaaa

SEQ ID NO: 760134 - RNA, 21 nt, Human
accaaaauccucggcaaaaca

SEQ ID NO: 760135 - RNA, 18 nt, Human
acuauugaaaaaauacca

SEQ ID NO: 760136 - RNA, 22 nt, Human
acucuaucccuaaaaucacaaa

SEQ ID NO: 760137 - RNA, 23 nt, Human
agaacucuuucacaauccugguc

SEQ ID NO: 760138 - RNA, 18 nt, Human
agaagaacucuuucacaa

SEQ ID NO: 760139 - RNA, 21 nt, Human
agaagaacucuuucacaaucc

SEQ ID NO: 760140 - RNA, 21 nt, Human
agacaguagccugacggccgc

SEQ ID NO: 760141 - RNA, 21 nt, Human
agagagcaacuaaaggcuuau

SEQ ID NO: 760142 - RNA, 20 nt, Human
agaggcuuuaaacaguuaag

SEQ ID NO: 760143 - RNA, 20 nt, Human
agcuauguaaaauggugcaa

SEQ ID NO: 760144 - RNA, 20 nt, Human
agcuuuuaaaaaaaucucag

SEQ ID NO: 760145 - RNA, 22 nt, Human
aggaagaagauuaaaaaaagau

SEQ ID NO: 760146 - RNA, 22 nt, Human
agucagaaauagugaccuucca

SEQ ID NO: 760147 - RNA, 25 nt, Human
auaaauuucacaauauauaacagag

SEQ ID NO: 760148 - RNA, 22 nt, Human
auccaguaaaaaacuauuuugu

SEQ ID NO: 760149 - RNA, 20 nt, Human
auugcaacuaaacaugggag

SEQ ID NO: 760150 - RNA, 23 nt, Human
auugcacauaacaacaaauaguc

SEQ ID NO: 760151 - RNA, 19 nt, Human
auuuaugccuuuuuucuuu

SEQ ID NO: 760152 - RNA, 20 nt, Human
caaaaaucaaacaugaagga

SEQ ID NO: 760153 - RNA, 22 nt, Human
caaaagaucaugucagucagaa

SEQ ID NO: 760154 - RNA, 23 nt, Human
caaaauagagagcaacuaaaggc

SEQ ID NO: 760155 - RNA, 20 nt, Human
caaacaaaagaaucacagac

SEQ ID NO: 760156 - RNA, 23 nt, Human
caagucaaaauagagagcaacua

SEQ ID NO: 760157 - RNA, 22 nt, Human
caaucagaacaacaccacaaca

SEQ ID NO: 760158 - RNA, 20 nt, Human
cacaacaacaaacaaaagaa

SEQ ID NO: 760159 - RNA, 18 nt, Human
cacaauauauaacagagc

SEQ ID NO: 760160 - RNA, 18 nt, Human
cacagaaaacacagcgac

SEQ ID NO: 760161 - RNA, 24 nt, Human
cacagaaaacacagcgacuuaaau

SEQ ID NO: 760162 - RNA, 21 nt, Human
cacagauuuccagaacacuuc

SEQ ID NO: 760163 - RNA, 18 nt, Human
caccacaacaacaaacaa

SEQ ID NO: 760164 - RNA, 19 nt, Human
caccugggcuggaaaaaag

SEQ ID NO: 760165 - RNA, 19 nt, Human
cacuuuacauaaccaagca

SEQ ID NO: 760166 - RNA, 23 nt, Human
cagaugaaaaaaaacccacaaac

SEQ ID NO: 760167 - RNA, 25 nt, Human
cagcaaccugauuaaguaaacaugc

SEQ ID NO: 760168 - RNA, 21 nt, Human
cagcacagaaaacacagcggu

SEQ ID NO: 760169 - RNA, 24 nt, Human
caggaccuguguuacccaggggcu

SEQ ID NO: 760170 - RNA, 22 nt, Human
cauucuagaccacgcuagugcu

SEQ ID NO: 760171 - RNA, 21 nt, Human
ccagaacacuguaagcccuga

SEQ ID NO: 760172 - RNA, 26 nt, Human
ccauccacaaauuugcuugaagagga

SEQ ID NO: 760173 - RNA, 19 nt, Human
cccaggccaucuuauuuug

SEQ ID NO: 760174 - RNA, 19 nt, Human
cccucucuuuucccuccuu

SEQ ID NO: 760175 - RNA, 22 nt, Human
cccugaggcagugcccucucuu

SEQ ID NO: 760176 - RNA, 25 nt, Human
ccuaaaaucacaaaaguguguuguu

SEQ ID NO: 760177 - RNA, 19 nt, Human
ccugggcuggaaaaaagcc

SEQ ID NO: 760178 - RNA, 24 nt, Human
cgagaacgaaugcacagauuucca

SEQ ID NO: 760179 - RNA, 21 nt, Human
cuagaaaaauguccacgcuag

SEQ ID NO: 760180 - RNA, 19 nt, Human
cuagaccacgcuagugcua

SEQ ID NO: 760181 - RNA, 21 nt, Human
cucagacaaccaacucugccc

SEQ ID NO: 760182 - RNA, 21 nt, Human
cuuccagcuuuuaaaaaaauc

SEQ ID NO: 760183 - RNA, 20 nt, Human
cuuuaugcuguacaaucuuc

SEQ ID NO: 760184 - RNA, 20 nt, Human
gaaaaaaacaaacaaaacca

SEQ ID NO: 760185 - RNA, 23 nt, Human
gaaaaaauaccagcaugaagaaa

SEQ ID NO: 760186 - RNA, 19 nt, Human
gaaaacaaacuauagcuug

SEQ ID NO: 760187 - RNA, 24 nt, Human
gaaaacaaacuauagcuugagagc

SEQ ID NO: 760188 - RNA, 21 nt, Human
gaagaaaagguacauauuuga

SEQ ID NO: 760189 - RNA, 19 nt, Human
gaagaagauuaaaaaaaga

SEQ ID NO: 760190 - RNA, 22 nt, Human
gaaugcacagauuuccagaaca

SEQ ID NO: 760191 - RNA, 19 nt, Human
gacaguacaaggacaucac

SEQ ID NO: 760192 - RNA, 19 nt, Human
gcacagaaaacacagcgac

SEQ ID NO: 760193 - RNA, 25 nt, Human
gcagcaaaagcuauugcagcauaaa

SEQ ID NO: 760194 - RNA, 24 nt, Human
gcagcugacucuaucccuaaaauc

SEQ ID NO: 760195 - RNA, 20 nt, Human
gcagcuuugaguguccaguu

SEQ ID NO: 760196 - RNA, 23 nt, Human
gcauuuuuaauccaguaaaaaac

SEQ ID NO: 760197 - RNA, 21 nt, Human
gcccaagggugaaugcuagaa

SEQ ID NO: 760198 - RNA, 21 nt, Human
gcccucucuuuucccuccuug

SEQ ID NO: 760199 - RNA, 25 nt, Human
ggggcacauuuauuuacaaaacaaa

SEQ ID NO: 760200 - RNA, 22 nt, Human
guaacaauauuacaaagguuuu

SEQ ID NO: 760201 - RNA, 21 nt, Human
guacaaucuuccagcuuuuaa

SEQ ID NO: 760202 - RNA, 18 nt, Human
uaaaaucacaaaagugug

SEQ ID NO: 760203 - RNA, 18 nt, Human
uaaccaagcauuuucauc

SEQ ID NO: 760204 - RNA, 21 nt, Human
uaaguaaacaugcagucagaa

SEQ ID NO: 760205 - RNA, 25 nt, Human
uaagugcaugcuccaguucaaaaca

SEQ ID NO: 760206 - RNA, 19 nt, Human
uaauaaaaagacccaauuc

SEQ ID NO: 760207 - RNA, 21 nt, Human
uaauaauaaaaagacccaauu

SEQ ID NO: 760208 - RNA, 21 nt, Human
uaauauaacauuaacaacuug

SEQ ID NO: 760209 - RNA, 20 nt, Human
uacuccaguacuuguggcug

SEQ ID NO: 760210 - RNA, 20 nt, Human
uagaauacaaaaaguaguag

SEQ ID NO: 760211 - RNA, 18 nt, Human
uauauaacagagcaccgc

SEQ ID NO: 760212 - RNA, 21 nt, Human
uaugccuuuuuucuuuucuuu

SEQ ID NO: 760213 - RNA, 23 nt, Human
uaugccuuuuuucuuuucuuuuu

SEQ ID NO: 760214 - RNA, 26 nt, Human
uauguaaaauggugcaagcacuaaga

SEQ ID NO: 760215 - RNA, 24 nt, Human
uauuuucuucuuucagguugauua

SEQ ID NO: 760216 - RNA, 18 nt, Human
ucaguuaugaacugucaa

SEQ ID NO: 760217 - RNA, 18 nt, Human
ucccagucaaguugcagg

SEQ ID NO: 760218 - RNA, 20 nt, Human
uccuuaaagaaaauacgaaa

SEQ ID NO: 760219 - RNA, 24 nt, Human
ucggcagcugacucuaucccuaaa

SEQ ID NO: 760220 - RNA, 24 nt, Human
ucucuuuaaaaaaauacaaacaga

SEQ ID NO: 760221 - RNA, 21 nt, Human
ucugcaauucugcauuauacu

SEQ ID NO: 760222 - RNA, 23 nt, Human
ucugccaacuuuugaaaacuguc

SEQ ID NO: 760223 - RNA, 19 nt, Human
ugaaaaaaaacccacaaac

SEQ ID NO: 760224 - RNA, 21 nt, Human
ugaaaaaaaacccacaaacau

SEQ ID NO: 760225 - RNA, 22 nt, Human
ugaaaaaaaacccacaaacaua

SEQ ID NO: 760226 - RNA, 25 nt, Human
ugaaaaaaaacccacaaacauagaa

SEQ ID NO: 760227 - RNA, 19 nt, Human
ugacucuaucccuaaaauc

SEQ ID NO: 760228 - RNA, 21 nt, Human
ugagaaagcacuccuuaaaga

SEQ ID NO: 760229 - RNA, 23 nt, Human
ugaggcagugcccucucuuuucc

SEQ ID NO: 760230 - RNA, 20 nt, Human
ugauugagaaagcacuccuu

SEQ ID NO: 760231 - RNA, 24 nt, Human
ugcaacuaaacaugggagaacaaa

SEQ ID NO: 760232 - RNA, 21 nt, Human
ugcauaacaaaauuucuugua

SEQ ID NO: 760233 - RNA, 21 nt, Human
ugcuccaguucaaaacaauca

SEQ ID NO: 760234 - RNA, 26 nt, Human
uggaaaaaagcaauuauuaccaaaaa

SEQ ID NO: 760235 - RNA, 22 nt, Human
uggaguuuauuuuuuguaaccu

SEQ ID NO: 760236 - RNA, 21 nt, Human
ugggagaacaaaacaaaaaca

SEQ ID NO: 760237 - RNA, 23 nt, Human
uguaagcccugaggcagugcccc

SEQ ID NO: 760238 - RNA, 20 nt, Human
uguacagaugaaaaaaaacc

SEQ ID NO: 760239 - RNA, 21 nt, Human
uguacagaugaaaaaaaaccc

SEQ ID NO: 760240 - RNA, 18 nt, Human
uguuaugggcucuuccca

SEQ ID NO: 760241 - RNA, 25 nt, Human
uuagaaaauaucauuuucuuuccua

SEQ ID NO: 760242 - RNA, 22 nt, Human
uucaaaaaaucgacuaguucaa

SEQ ID NO: 760243 - RNA, 24 nt, Human
uucuuguacagaugaaaaaaaacc

SEQ ID NO: 760244 - RNA, 21 nt, Human
uuguaacuaagagcucaugug

SEQ ID NO: 760245 - RNA, 22 nt, Human
uuuaaaaaaauacaaacagaag

SEQ ID NO: 760246 - RNA, 18 nt, Human
uuuacaaaacaaaaggga

SEQ ID NO: 760247 - RNA, 27 nt, Human
uuuacauagucuugcaaucauugugug

SEQ ID NO: 760248 - RNA, 26 nt, Human
uuugaucacaguuagacauaaucacu

SEQ ID NO: 760249 - RNA, 23 nt, Human
uuugguuuucuggacaaggucug

SEQ ID NO: 760250 - RNA, 18 nt, Human
uuuuugaaggacccucuc

SEQ ID NO: 760251 - RNA, 23 nt, Human
aaaccaggaucaacacacaaaaa

SEQ ID NO: 760252 - RNA, 21 nt, Human
aagccuccaggccucacccaa

SEQ ID NO: 760253 - RNA, 19 nt, Human
aagccugcuggguucaucu

SEQ ID NO: 760254 - RNA, 18 nt, Human
aagcuggcccccacuccc

SEQ ID NO: 760255 - RNA, 25 nt, Human
aaggagcugugucuugggcaccugg

SEQ ID NO: 760256 - RNA, 21 nt, Human
aagucaaugcucuggaagccg

SEQ ID NO: 760257 - RNA, 24 nt, Human
acaggccagcaaacuuaggccucu

SEQ ID NO: 760258 - RNA, 20 nt, Human
accccgagccccacuugccc

SEQ ID NO: 760259 - RNA, 21 nt, Human
acgugugaaguucugcaagag

SEQ ID NO: 760260 - RNA, 19 nt, Human
acucccucucccaccauac

SEQ ID NO: 760261 - RNA, 23 nt, Human
agaacccacaggggccccugccc

SEQ ID NO: 760262 - RNA, 24 nt, Human
agaacccacaggggccccugcccu

SEQ ID NO: 760263 - RNA, 23 nt, Human
agacaccuuccuccaaacagcuu

SEQ ID NO: 760264 - RNA, 18 nt, Human
agacagacaccuuccucc

SEQ ID NO: 760265 - RNA, 23 nt, Human
agacccuaccuccugggaggagg

SEQ ID NO: 760266 - RNA, 22 nt, Human
agagcugugcugggaucuagga

SEQ ID NO: 760267 - RNA, 18 nt, Human
agaguucugaugcuuuuc

SEQ ID NO: 760268 - RNA, 28 nt, Human
agcacccaucuucccucccagauaugac

SEQ ID NO: 760269 - RNA, 21 nt, Human
agccacagcacuccuuugguu

SEQ ID NO: 760270 - RNA, 20 nt, Human
agccuggucccaggcugaag

SEQ ID NO: 760271 - RNA, 18 nt, Human
aggaaagccagagaaaag

SEQ ID NO: 760272 - RNA, 18 nt, Human
aggcaagaggaaaaaucu

SEQ ID NO: 760273 - RNA, 20 nt, Human
aggccagcaaacuuaggccu

SEQ ID NO: 760274 - RNA, 19 nt, Human
aggccucacccaaacccaa

SEQ ID NO: 760275 - RNA, 19 nt, Human
agugcccccuaccccgagc

SEQ ID NO: 760276 - RNA, 24 nt, Human
agugcccccuaccccgagccccac

SEQ ID NO: 760277 - RNA, 19 nt, Human
aguggcugcagcucagcag

SEQ ID NO: 760278 - RNA, 18 nt, Human
aguucugcaagagguuuc

SEQ ID NO: 760279 - RNA, 18 nt, Human
aucaggcuucccaagcau

SEQ ID NO: 760280 - RNA, 21 nt, Human
auucaccucugaagccuccag

SEQ ID NO: 760281 - RNA, 23 nt, Human
caaacccaaugaccaaucaggag

SEQ ID NO: 760282 - RNA, 18 nt, Human
caacacacaaaaagugca

SEQ ID NO: 760283 - RNA, 23 nt, Human
caacccucucccagcacccaucu

SEQ ID NO: 760284 - RNA, 21 nt, Human
caagaaaaccacaggccagca

SEQ ID NO: 760285 - RNA, 22 nt, Human
caagcagugcccccuaccccga

SEQ ID NO: 760286 - RNA, 19 nt, Human
cacacugcacuccacuccc

SEQ ID NO: 760287 - RNA, 21 nt, Human
cacaggccagcaaacuuaggc

SEQ ID NO: 760288 - RNA, 20 nt, Human
cacaggggccccugcccucc

SEQ ID NO: 760289 - RNA, 18 nt, Human
cacccaaacccaaugacc

SEQ ID NO: 760290 - RNA, 19 nt, Human
cacccaucuucccucccag

SEQ ID NO: 760291 - RNA, 23 nt, Human
caccucccucugcagccccugcc

SEQ ID NO: 760292 - RNA, 24 nt, Human
caccucccucugcagccccugccc

SEQ ID NO: 760293 - RNA, 22 nt, Human
cacucugccaaccucauuuacu

SEQ ID NO: 760294 - RNA, 26 nt, Human
cacugaaauacagaucugggaaacca

SEQ ID NO: 760295 - RNA, 18 nt, Human
cagcaccaggcccaagcc

SEQ ID NO: 760296 - RNA, 21 nt, Human
cagcaugaggugagaacaggg

SEQ ID NO: 760297 - RNA, 19 nt, Human
cagccaagacccuaccucc

SEQ ID NO: 760298 - RNA, 22 nt, Human
cagcucccuccccuggagcccc

SEQ ID NO: 760299 - RNA, 21 nt, Human
cagggcugcaguucucagccc

SEQ ID NO: 760300 - RNA, 20 nt, Human
ccacaaggacaacaggggac

SEQ ID NO: 760301 - RNA, 23 nt, Human
ccacagacgugcccucccaagcc

SEQ ID NO: 760302 - RNA, 22 nt, Human
ccacaucuaagagauuucaaaa

SEQ ID NO: 760303 - RNA, 20 nt, Human
ccaccuccuaagccugcugg

SEQ ID NO: 760304 - RNA, 24 nt, Human
ccagacagacaccuuccuccaaac

SEQ ID NO: 760305 - RNA, 22 nt, Human
ccagacucuggcucucuaugcc

SEQ ID NO: 760306 - RNA, 22 nt, Human
ccaggcccaagccacacugcac

SEQ ID NO: 760307 - RNA, 24 nt, Human
ccaggcccaagccacacugcacuc

SEQ ID NO: 760308 - RNA, 22 nt, Human
ccauggguagccccagcauggg

SEQ ID NO: 760309 - RNA, 25 nt, Human
cccaagcauaaauucaccucugaag

SEQ ID NO: 760310 - RNA, 23 nt, Human
cccaagccacacugcacuccacu

SEQ ID NO: 760311 - RNA, 22 nt, Human
cccacagacgugcccucccaag

SEQ ID NO: 760312 - RNA, 24 nt, Human
cccacagacgugcccucccaagcc

SEQ ID NO: 760313 - RNA, 19 nt, Human
cccacccuccuagggcccc

SEQ ID NO: 760314 - RNA, 18 nt, Human
cccagaaugagcaggcuc

SEQ ID NO: 760315 - RNA, 21 nt, Human
cccaggcugaaggggaagccg

SEQ ID NO: 760316 - RNA, 19 nt, Human
ccccacagacgugcccucc

SEQ ID NO: 760317 - RNA, 20 nt, Human
ccccacagacgugcccuccc

SEQ ID NO: 760318 - RNA, 23 nt, Human
cccccaacccucucccagcaccc

SEQ ID NO: 760319 - RNA, 25 nt, Human
cccccaacccucucccagcacccau

SEQ ID NO: 760320 - RNA, 23 nt, Human
cccccacccuccuagggccccau

SEQ ID NO: 760321 - RNA, 23 nt, Human
cccccacugccacucugccaacc

SEQ ID NO: 760322 - RNA, 22 nt, Human
ccccccaagaaaaccacaggcc

SEQ ID NO: 760323 - RNA, 20 nt, Human
cccccuaccccgagccccac

SEQ ID NO: 760324 - RNA, 26 nt, Human
cccccugcccccaacccucucccagc

SEQ ID NO: 760325 - RNA, 19 nt, Human
ccccuccuucccgccccca

SEQ ID NO: 760326 - RNA, 22 nt, Human
ccccugcccagcuguccucacc

SEQ ID NO: 760327 - RNA, 24 nt, Human
ccccugcccucccccccaagaaaa

SEQ ID NO: 760328 - RNA, 18 nt, Human
cccucaggcuuggcccag

SEQ ID NO: 760329 - RNA, 22 nt, Human
cccucccaagcccgagcacgcu

SEQ ID NO: 760330 - RNA, 24 nt, Human
cccucugcagccccugcccagcug

SEQ ID NO: 760331 - RNA, 21 nt, Human
cccugcccccaacccucuccc

SEQ ID NO: 760332 - RNA, 22 nt, Human
cccugcccccaacccucuccca

SEQ ID NO: 760333 - RNA, 19 nt, Human
cccuggccuccccagcucc

SEQ ID NO: 760334 - RNA, 23 nt, Human
ccuagggccccauuucccucagg

SEQ ID NO: 760335 - RNA, 23 nt, Human
ccucacagagucucagggccagg

SEQ ID NO: 760336 - RNA, 20 nt, Human
ccucccuuguaaacacugaa

SEQ ID NO: 760337 - RNA, 21 nt, Human
ccugaaagaccuugccccucc

SEQ ID NO: 760338 - RNA, 21 nt, Human
ccugcccagcuguccucaccc

SEQ ID NO: 760339 - RNA, 23 nt, Human
ccugcccccaacccucucccagc

SEQ ID NO: 760340 - RNA, 20 nt, Human
ccugcccucccccccaagaa

SEQ ID NO: 760341 - RNA, 22 nt, Human
ccuggccuccccagcucccucc

SEQ ID NO: 760342 - RNA, 18 nt, Human
ccugggaggagggccuuc

SEQ ID NO: 760343 - RNA, 20 nt, Human
ccuucccgcccccacccucc

SEQ ID NO: 760344 - RNA, 23 nt, Human
ccuugccccuccuucccgccccc

SEQ ID NO: 760345 - RNA, 20 nt, Human
cuacugcagggcaaaggagg

SEQ ID NO: 760346 - RNA, 22 nt, Human
cucagccccagccccugccccc

SEQ ID NO: 760347 - RNA, 19 nt, Human
cuccagcccccucacagag

SEQ ID NO: 760348 - RNA, 21 nt, Human
cuccaggccucacccaaaccu

SEQ ID NO: 760349 - RNA, 22 nt, Human
cucccaagcccgagcacgcucg

SEQ ID NO: 760350 - RNA, 21 nt, Human
cuccccagcucccuccccugg

SEQ ID NO: 760351 - RNA, 21 nt, Human
cucccucucccaccauacucc

SEQ ID NO: 760352 - RNA, 22 nt, Human
cugcaguucucagccccagccc

SEQ ID NO: 760353 - RNA, 24 nt, Human
cugccacucugccaaccucauuua

SEQ ID NO: 760354 - RNA, 21 nt, Human
cugcccccaacccucucccag

SEQ ID NO: 760355 - RNA, 18 nt, Human
cuggcccccacucccccu

SEQ ID NO: 760356 - RNA, 22 nt, Human
cuuauacccuggccuccccagc

SEQ ID NO: 760357 - RNA, 22 nt, Human
cuugcccauggguagccccagc

SEQ ID NO: 760358 - RNA, 20 nt, Human
cuuggcccagccucagagaa

SEQ ID NO: 760359 - RNA, 23 nt, Human
cuuggcccagccucagagaagac

SEQ ID NO: 760360 - RNA, 18 nt, Human
cuugggccaagcugagag

SEQ ID NO: 760361 - RNA, 19 nt, Human
cuuguaaacacugaaauac

SEQ ID NO: 760362 - RNA, 18 nt, Human
gaacccacaggggccccu

SEQ ID NO: 760363 - RNA, 18 nt, Human
gaagugcucagcuagcag

SEQ ID NO: 760364 - RNA, 24 nt, Human
gacgugcccucccaagcccgagca

SEQ ID NO: 760365 - RNA, 23 nt, Human
gacuacuuuucggaaaucuccac

SEQ ID NO: 760366 - RNA, 21 nt, Human
gaggugagaacagggccucug

SEQ ID NO: 760367 - RNA, 25 nt, Human
gcagggcaaaggaggaaagccagag

SEQ ID NO: 760368 - RNA, 26 nt, Human
gcccagccucagagaagagggaacgc

SEQ ID NO: 760369 - RNA, 19 nt, Human
gcccauggguagccccagg

SEQ ID NO: 760370 - RNA, 29 nt, Human
gccccacuugcccauggguagccccagcc

SEQ ID NO: 760371 - RNA, 24 nt, Human
gcccccacccuccuagggccccau

SEQ ID NO: 760372 - RNA, 23 nt, Human
gcccucccccccaagaaaaccac

SEQ ID NO: 760373 - RNA, 19 nt, Human
gccgucucugggaggugga

SEQ ID NO: 760374 - RNA, 21 nt, Human
gcuccgucucucacccccaca

SEQ ID NO: 760375 - RNA, 22 nt, Human
ggagcagcaugaggugagaaca

SEQ ID NO: 760376 - RNA, 18 nt, Human
gggaaggagcugugucuu

SEQ ID NO: 760377 - RNA, 18 nt, Human
gggagcccucaggguuca

SEQ ID NO: 760378 - RNA, 21 nt, Human
gggcacagcaggcuaagggca

SEQ ID NO: 760379 - RNA, 22 nt, Human
gggcacagcaggcuaagggcac

SEQ ID NO: 760380 - RNA, 20 nt, Human
gggcauggcaaguuggggga

SEQ ID NO: 760381 - RNA, 18 nt, Human
gggcugcaguucucagcc

SEQ ID NO: 760382 - RNA, 20 nt, Human
ggggucaguggggugggugg

SEQ ID NO: 760383 - RNA, 23 nt, Human
gguaaagcuggcccccacucccc

SEQ ID NO: 760384 - RNA, 22 nt, Human
ggucccaggcugaaggggaagc

SEQ ID NO: 760385 - RNA, 20 nt, Human
ggugagaacagggccucugg

SEQ ID NO: 760386 - RNA, 19 nt, Human
gguuugauuucaggugggu

SEQ ID NO: 760387 - RNA, 22 nt, Human
gucuugggcaccugguggugcc

SEQ ID NO: 760388 - RNA, 19 nt, Human
guggcuccgucucucaccc

SEQ ID NO: 760389 - RNA, 18 nt, Human
uaaggagauccaaguccc

SEQ ID NO: 760390 - RNA, 21 nt, Human
uaagggcacagagagagaugg

SEQ ID NO: 760391 - RNA, 20 nt, Human
uaggccucuguggcccccua

SEQ ID NO: 760392 - RNA, 22 nt, Human
ucacagagucucagggccaggg

SEQ ID NO: 760393 - RNA, 23 nt, Human
ucacagagucucagggccagggc

SEQ ID NO: 760394 - RNA, 22 nt, Human
ucacccagugccaccuccuaag

SEQ ID NO: 760395 - RNA, 20 nt, Human
ucaccucugaagccuccagg

SEQ ID NO: 760396 - RNA, 22 nt, Human
ucagagcugugcugggaucuag

SEQ ID NO: 760397 - RNA, 18 nt, Human
ucagggccagggccaagg

SEQ ID NO: 760398 - RNA, 23 nt, Human
uccaagucccuucccuucagguu

SEQ ID NO: 760399 - RNA, 23 nt, Human
uccaggccucacccaaacccaau

SEQ ID NO: 760400 - RNA, 20 nt, Human
ucccaagcccgagcacgcuc

SEQ ID NO: 760401 - RNA, 21 nt, Human
ucccagacagacaccuuccuc

SEQ ID NO: 760402 - RNA, 26 nt, Human
ucccagacagacaccuuccuccaaac

SEQ ID NO: 760403 - RNA, 21 nt, Human
ucccagcaccaggcccaagcc

SEQ ID NO: 760404 - RNA, 18 nt, Human
ucccagcacccaucuucc

SEQ ID NO: 760405 - RNA, 19 nt, Human
ucccaggcugaaggggaag

SEQ ID NO: 760406 - RNA, 21 nt, Human
ucccccccaagaaaaccacag

SEQ ID NO: 760407 - RNA, 22 nt, Human
ucccucaggcuuggcccagccu

SEQ ID NO: 760408 - RNA, 21 nt, Human
ucccucugcagccccugccca

SEQ ID NO: 760409 - RNA, 18 nt, Human
uccucacccagugccacc

SEQ ID NO: 760410 - RNA, 18 nt, Human
uccucccagacagacacc

SEQ ID NO: 760411 - RNA, 19 nt, Human
uccuucccgcccccacccu

SEQ ID NO: 760412 - RNA, 19 nt, Human
uccuuggcagcaagggccc

SEQ ID NO: 760413 - RNA, 22 nt, Human
ucuccacccaggggaaccacag

SEQ ID NO: 760414 - RNA, 23 nt, Human
ucucccaccauacuccucuuugg

SEQ ID NO: 760415 - RNA, 21 nt, Human
ucucccagcacccaucuuccc

SEQ ID NO: 760416 - RNA, 20 nt, Human
ucugcagagcccccacugcc

SEQ ID NO: 760417 - RNA, 19 nt, Human
ucugcagccccugcccagc

SEQ ID NO: 760418 - RNA, 26 nt, Human
ucugcagccccugcccagcuguccuc

SEQ ID NO: 760419 - RNA, 22 nt, Human
ugaaagaccuugccccuccuuc

SEQ ID NO: 760420 - RNA, 23 nt, Human
ugacaaaccccacaaucaucagu

SEQ ID NO: 760421 - RNA, 19 nt, Human
ugaggcugggcuccuuggc

SEQ ID NO: 760422 - RNA, 18 nt, Human
ugagggcaagggggaggc

SEQ ID NO: 760423 - RNA, 18 nt, Human
ugagguaaagcuggcccc

SEQ ID NO: 760424 - RNA, 27 nt, Human
ugcagagcccccacugccacucugcca

SEQ ID NO: 760425 - RNA, 20 nt, Human
ugccccauccucccagacag

SEQ ID NO: 760426 - RNA, 20 nt, Human
ugcccccuaccccgagcccc

SEQ ID NO: 760427 - RNA, 21 nt, Human
ugcccccugcccccaacccuc

SEQ ID NO: 760428 - RNA, 22 nt, Human
ugcccucccccccaagaaaacc

SEQ ID NO: 760429 - RNA, 21 nt, Human
ugcuucaagcagugcccccua

SEQ ID NO: 760430 - RNA, 18 nt, Human
uggcagcaagggcccaga

SEQ ID NO: 760431 - RNA, 21 nt, Human
uggcugcagcucagcaggucc

SEQ ID NO: 760432 - RNA, 18 nt, Human
ugggcaccugguggugcc

SEQ ID NO: 760433 - RNA, 23 nt, Human
ugggucugguuccugaaagaccu

SEQ ID NO: 760434 - RNA, 19 nt, Human
uggguggccgucucuggga

SEQ ID NO: 760435 - RNA, 19 nt, Human
ugugcugggaucuaggaaa

SEQ ID NO: 760436 - RNA, 20 nt, Human
uguggcuugaagaaucacgu

SEQ ID NO: 760437 - RNA, 24 nt, Human
uuccacaucuaagagauuucaaaa

SEQ ID NO: 760438 - RNA, 21 nt, Human
uucucagccccagccccugcc

SEQ ID NO: 760439 - RNA, 23 nt, Human
uucucagccccagccccugcccc

SEQ ID NO: 760440 - RNA, 21 nt, Human
uugcccccugcccccaacccu

SEQ ID NO: 760441 - RNA, 21 nt, Human
uugguuugauuucaggugggu

SEQ ID NO: 760442 - RNA, 22 nt, Human
uuuacugccccauccucccaga

SEQ ID NO: 760443 - RNA, 22 nt, Human
uuuccaccucccucugcagccc

SEQ ID NO: 760444 - RNA, 23 nt, Human
aacaacaacagcucaggaaccaa

SEQ ID NO: 760445 - RNA, 23 nt, Human
aacacaaguccaacaacaacagc

SEQ ID NO: 760446 - RNA, 21 nt, Human
aagaaauaacgaauauaagac

SEQ ID NO: 760447 - RNA, 19 nt, Human
aagaagccacuaaaaggac

SEQ ID NO: 760448 - RNA, 20 nt, Human
aagccucaguggcaucccag

SEQ ID NO: 760449 - RNA, 23 nt, Human
aagggaacuucuacucuucaguu

SEQ ID NO: 760450 - RNA, 23 nt, Human
agaaaacucuagguuuuugccaa

SEQ ID NO: 760451 - RNA, 24 nt, Human
augccacucaauuuuaagaagcca

SEQ ID NO: 760452 - RNA, 19 nt, Human
caauuuauuuuuuccuagu

SEQ ID NO: 760453 - RNA, 23 nt, Human
cagcaaaaaaagggcuaaguuca

SEQ ID NO: 760454 - RNA, 18 nt, Human
cauagcacgguccauaug

SEQ ID NO: 760455 - RNA, 18 nt, Human
ccaaacaauaaggagagc

SEQ ID NO: 760456 - RNA, 26 nt, Human
ccaacaacaacagcucaggaaccaaa

SEQ ID NO: 760457 - RNA, 20 nt, Human
cgacugcuuguuucuccugu

SEQ ID NO: 760458 - RNA, 20 nt, Human
gauaaaaaaaucugcaaggg

SEQ ID NO: 760459 - RNA, 20 nt, Human
ggugaguuauuaaacccauu

SEQ ID NO: 760460 - RNA, 22 nt, Human
uaaaaggacacuuucugcagca

SEQ ID NO: 760461 - RNA, 24 nt, Human
uaaaauucccaaaguggaauauca

SEQ ID NO: 760462 - RNA, 18 nt, Human
uaagacaaaucaaaacca

SEQ ID NO: 760463 - RNA, 22 nt, Human
uacaaauacuaaaauucccaaa

SEQ ID NO: 760464 - RNA, 22 nt, Human
uacuaaaauucccaaaguggaa

SEQ ID NO: 760465 - RNA, 22 nt, Human
uagauuuagggaaaaacgacua

SEQ ID NO: 760466 - RNA, 27 nt, Human
ucugcagcaaaaaaagggccggggucc

SEQ ID NO: 760467 - RNA, 19 nt, Human
ugcagcaaaaaaagggcua

SEQ ID NO: 760468 - RNA, 21 nt, Human
ugcgacugcuuguuucuccug

SEQ ID NO: 760469 - RNA, 19 nt, Human
ugucacugauaaaaaaauc

SEQ ID NO: 760470 - RNA, 21 nt, Human
uuccuagucacucauuggaac

SEQ ID NO: 760471 - RNA, 22 nt, Human
uugagaaaaacuuuugcaacuc

SEQ ID NO: 760472 - RNA, 21 nt, Human
uuuaagaagccacuaaaagga

SEQ ID NO: 760473 - RNA, 23 nt, Human
uuugacaaagacacaauaauaua

SEQ ID NO: 760474 - RNA, 19 nt, Human
uuuuaaggaacuuuaggga

SEQ ID NO: 760475 - RNA, 18 nt, Human
aaccaagccaugccaggu

SEQ ID NO: 760476 - RNA, 22 nt, Human
ccagcgcgccccgaucuuucuc

SEQ ID NO: 760477 - RNA, 19 nt, Human
cccccaagccuuaucuuau

SEQ ID NO: 760478 - RNA, 27 nt, Human
ccgaagcugucuaagugagguggcucc

SEQ ID NO: 760479 - RNA, 21 nt, Human
ggagaugaaggaagggaaaaa

SEQ ID NO: 760480 - RNA, 19 nt, Human
ggcuccaaggagacaaagc

SEQ ID NO: 760481 - RNA, 22 nt, Human
uaagucuuucgaaaaagucauu

SEQ ID NO: 760482 - RNA, 19 nt, Human
ucgaaaaagucauuucauc

SEQ ID NO: 760483 - RNA, 23 nt, Human
ucgaaaaagucauuucaucuuca

SEQ ID NO: 760484 - RNA, 24 nt, Human
ucugcauccacauccgaagcuguc

SEQ ID NO: 760485 - RNA, 21 nt, Human
uggauuauuucgugcaucccc

SEQ ID NO: 760486 - RNA, 23 nt, Human
aaaaaaaaaaaaaaaacaucuug

SEQ ID NO: 760487 - RNA, 19 nt, Human
aaaaaagauucuuuauuga

SEQ ID NO: 760488 - RNA, 19 nt, Human
aaaagcagcagacacagaa

SEQ ID NO: 760489 - RNA, 24 nt, Human
aaaauguugggaucacagguguga

SEQ ID NO: 760490 - RNA, 23 nt, Human
aaacauaaucuuaagcaaaagca

SEQ ID NO: 760491 - RNA, 24 nt, Human
aaagugcugagauuacaggcauga

SEQ ID NO: 760492 - RNA, 26 nt, Human
aaauguugggaucacaggugugagcc

SEQ ID NO: 760493 - RNA, 23 nt, Human
aaccucaggugauccaccugccu

SEQ ID NO: 760494 - RNA, 27 nt, Human
aacugauacugguggcccaggaggcca

SEQ ID NO: 760495 - RNA, 23 nt, Human
aagcaaaagcagcagacacagaa

SEQ ID NO: 760496 - RNA, 25 nt, Human
aagcaguccuccugccucagccucc

SEQ ID NO: 760497 - RNA, 25 nt, Human
aagcaguccuccugccucagccucc

SEQ ID NO: 760498 - RNA, 26 nt, Human
aagugcugagauuacaggcaugagcc

SEQ ID NO: 760499 - RNA, 23 nt, Human
acaauuuuuccgaagggaaguau

SEQ ID NO: 760500 - RNA, 22 nt, Human
acagcagccuugaccucccagg

SEQ ID NO: 760501 - RNA, 22 nt, Human
accauguugaucaggcuggucu

SEQ ID NO: 760502 - RNA, 19 nt, Human
accucauuuuacuugucca

SEQ ID NO: 760503 - RNA, 19 nt, Human
acgggguuucaccauguug

SEQ ID NO: 760504 - RNA, 21 nt, Human
acgggguuucaccauguugau

SEQ ID NO: 760505 - RNA, 24 nt, Human
acgggguuucaccauguugaucag

SEQ ID NO: 760506 - RNA, 18 nt, Human
acuacaugcaggacugua

SEQ ID NO: 760507 - RNA, 21 nt, Human
acucugucaccuaggcugaag

SEQ ID NO: 760508 - RNA, 21 nt, Human
agaugaagagguggagcacag

SEQ ID NO: 760509 - RNA, 19 nt, Human
agauuacaggcaugagcca

SEQ ID NO: 760510 - RNA, 22 nt, Human
agauuacaggcaugagccacca

SEQ ID NO: 760511 - RNA, 22 nt, Human
agcauuuauucaccccugcggc

SEQ ID NO: 760512 - RNA, 24 nt, Human
agggagcagacgcgggggccggcc

SEQ ID NO: 760513 - RNA, 21 nt, Human
aggggaggggagggggcaaag

SEQ ID NO: 760514 - RNA, 23 nt, Human
aggggccgggcgcuggagaacag

SEQ ID NO: 760515 - RNA, 24 nt, Human
aggugauccaccugccuuggccuc

SEQ ID NO: 760516 - RNA, 22 nt, Human
aguaaagacgggguuucaccau

SEQ ID NO: 760517 - RNA, 18 nt, Human
agucggggcggggacugg

SEQ ID NO: 760518 - RNA, 20 nt, Human
aguggucgagggcacaguua

SEQ ID NO: 760519 - RNA, 24 nt, Human
auccugaguaccugggaccacagg

SEQ ID NO: 760520 - RNA, 19 nt, Human
aucgagagcagccccacca

SEQ ID NO: 760521 - RNA, 19 nt, Human
augaaggccccugcacccc

SEQ ID NO: 760522 - RNA, 20 nt, Human
augaggaaacugaacagggg

SEQ ID NO: 760523 - RNA, 24 nt, Human
augguacucuggugggggaugcau

SEQ ID NO: 760524 - RNA, 21 nt, Human
caaaagcagcagacacagaac

SEQ ID NO: 760525 - RNA, 22 nt, Human
caaaagcagcagacacagaaca

SEQ ID NO: 760526 - RNA, 25 nt, Human
caaaagcagcagacacagaacagaa

SEQ ID NO: 760527 - RNA, 24 nt, Human
caaaauguugggaucacaggugug

SEQ ID NO: 760528 - RNA, 25 nt, Human
caaacuccugggcucaagcaguccu

SEQ ID NO: 760529 - RNA, 24 nt, Human
caaagugcugagauuacaggcaug

SEQ ID NO: 760530 - RNA, 23 nt, Human
caacucaccccgaugccuaacgc

SEQ ID NO: 760531 - RNA, 21 nt, Human
caagagcagggagagagaagu

SEQ ID NO: 760532 - RNA, 22 nt, Human
caagcaguccuccugccucagc

SEQ ID NO: 760533 - RNA, 24 nt, Human
cacaggugugagccaccaucccca

SEQ ID NO: 760534 - RNA, 18 nt, Human
caccauccccagccaggc

SEQ ID NO: 760535 - RNA, 23 nt, Human
caccauguugaucaggcuggucu

SEQ ID NO: 760536 - RNA, 24 nt, Human
caccauguugaucaggcuggucuu

SEQ ID NO: 760537 - RNA, 19 nt, Human
cacccagauguguguccuc

SEQ ID NO: 760538 - RNA, 22 nt, Human
caccuaggcugaagugccgugc

SEQ ID NO: 760539 - RNA, 24 nt, Human
caccucagcauccugaguaccugg

SEQ ID NO: 760540 - RNA, 23 nt, Human
caccugccuuggccucccaaagu

SEQ ID NO: 760541 - RNA, 24 nt, Human
caccugccuuggccucccaaagug

SEQ ID NO: 760542 - RNA, 22 nt, Human
cacucugucaccuaggcugaag

SEQ ID NO: 760543 - RNA, 23 nt, Human
cacucugucaccuaggcugaagu

SEQ ID NO: 760544 - RNA, 22 nt, Human
cagcagacacagaacagaauga

SEQ ID NO: 760545 - RNA, 20 nt, Human
cagcauccugaguaccuggg

SEQ ID NO: 760546 - RNA, 23 nt, Human
cagccuugaccucccaggcucag

SEQ ID NO: 760547 - RNA, 19 nt, Human
cagcugcaccaguguggag

SEQ ID NO: 760548 - RNA, 18 nt, Human
caggggaggggagggggc

SEQ ID NO: 760549 - RNA, 19 nt, Human
caggggcccgggcggggag

SEQ ID NO: 760550 - RNA, 22 nt, Human
caggugauucucccaccucagc

SEQ ID NO: 760551 - RNA, 22 nt, Human
cagucggggcggggacuggcgg

SEQ ID NO: 760552 - RNA, 20 nt, Human
cauccaggcgugguugcgug

SEQ ID NO: 760553 - RNA, 24 nt, Human
caugcagccuuaagcccacuaugc

SEQ ID NO: 760554 - RNA, 24 nt, Human
cauguugaucaggcuggucuugaa

SEQ ID NO: 760555 - RNA, 20 nt, Human
ccaaaauguugggaucacag

SEQ ID NO: 760556 - RNA, 24 nt, Human
ccaaaauguugggaucacaggugu

SEQ ID NO: 760557 - RNA, 27 nt, Human
ccaaacccacagaauguacaacgcuga

SEQ ID NO: 760558 - RNA, 23 nt, Human
ccaaagugcugagauuacaggca

SEQ ID NO: 760559 - RNA, 24 nt, Human
ccaaagugcugagauuacaggcau

SEQ ID NO: 760560 - RNA, 19 nt, Human
ccaccauccccagccaggc

SEQ ID NO: 760561 - RNA, 18 nt, Human
ccaguguaaacgacagac

SEQ ID NO: 760562 - RNA, 23 nt, Human
cccacagaauguacaacgcugag

SEQ ID NO: 760563 - RNA, 23 nt, Human
cccaggcucaggugauucuccca

SEQ ID NO: 760564 - RNA, 18 nt, Human
ccccuagagacuucuccu

SEQ ID NO: 760565 - RNA, 22 nt, Human
ccccugcaccccugcuuugcca

SEQ ID NO: 760566 - RNA, 24 nt, Human
cccuaggaaccaccgugggacucu

SEQ ID NO: 760567 - RNA, 18 nt, Human
cccugugaguggggaaug

SEQ ID NO: 760568 - RNA, 21 nt, Human
ccuaaccucaggugauccacc

SEQ ID NO: 760569 - RNA, 23 nt, Human
ccuaaccucaggugauccaccug

SEQ ID NO: 760570 - RNA, 23 nt, Human
ccuaaccucaggugauccaccug

SEQ ID NO: 760571 - RNA, 21 nt, Human
ccuagagacuucuccuaccuc

SEQ ID NO: 760572 - RNA, 24 nt, Human
ccucccaggcucaggugauucucc

SEQ ID NO: 760573 - RNA, 18 nt, Human
ccuccugccucagccucc

SEQ ID NO: 760574 - RNA, 22 nt, Human
ccugaguaccugggaccacagg

SEQ ID NO: 760575 - RNA, 23 nt, Human
ccugccucagccuccaaaauguu

SEQ ID NO: 760576 - RNA, 20 nt, Human
ccugggcucaagcaguccuc

SEQ ID NO: 760577 - RNA, 23 nt, Human
ccugggcucaagcaguccuccug

SEQ ID NO: 760578 - RNA, 21 nt, Human
ccuuccgugggaagguucugg

SEQ ID NO: 760579 - RNA, 22 nt, Human
cgcgcgccucucgagaggccgg

SEQ ID NO: 760580 - RNA, 23 nt, Human
cgcuucugagucacuucacuccu

SEQ ID NO: 760581 - RNA, 21 nt, Human
cggaagcaacacuaugaaagc

SEQ ID NO: 760582 - RNA, 23 nt, Human
cggcaaggcugggcaguacggcc

SEQ ID NO: 760583 - RNA, 21 nt, Human
cggcggccgacaggggcccgg

SEQ ID NO: 760584 - RNA, 24 nt, Human
cgggguuucaccauguugaucagg

SEQ ID NO: 760585 - RNA, 19 nt, Human
cuaaaauugcuuuaaaaau

SEQ ID NO: 760586 - RNA, 24 nt, Human
cucaggugauccaccugccuuggc

SEQ ID NO: 760587 - RNA, 21 nt, Human
cucaggugauucucccaccuc

SEQ ID NO: 760588 - RNA, 23 nt, Human
cucaggugauucucccaccucag

SEQ ID NO: 760589 - RNA, 24 nt, Human
cucaggugauucucccaccucagc

SEQ ID NO: 760590 - RNA, 21 nt, Human
cucccaaagugcugagauuac

SEQ ID NO: 760591 - RNA, 19 nt, Human
cucccaggcucaggugauu

SEQ ID NO: 760592 - RNA, 25 nt, Human
cuccugggcucaagcaguccuccug

SEQ ID NO: 760593 - RNA, 19 nt, Human
cucugggcuaagcugacuc

SEQ ID NO: 760594 - RNA, 24 nt, Human
cugcaccccugcuuugccaccaag

SEQ ID NO: 760595 - RNA, 23 nt, Human
cugccuuggccucccaaagugcu

SEQ ID NO: 760596 - RNA, 25 nt, Human
cuggcggcggccgacaggggcccuu

SEQ ID NO: 760597 - RNA, 24 nt, Human
cuggugggggaugcaugucauuac

SEQ ID NO: 760598 - RNA, 22 nt, Human
cuugauccugaccccuagagac

SEQ ID NO: 760599 - RNA, 25 nt, Human
cuuuccaugcagccuuaagcccacu

SEQ ID NO: 760600 - RNA, 18 nt, Human
cuuugccaccaagcuacc

SEQ ID NO: 760601 - RNA, 18 nt, Human
gaaacugaacaggggccg

SEQ ID NO: 760602 - RNA, 24 nt, Human
gaacaggggccgggcgcuggagaa

SEQ ID NO: 760603 - RNA, 22 nt, Human
gaaggccccugcaccccugcuu

SEQ ID NO: 760604 - RNA, 19 nt, Human
gacuggcacugauggcuga

SEQ ID NO: 760605 - RNA, 22 nt, Human
gagaacagacaguucacaggcg

SEQ ID NO: 760606 - RNA, 18 nt, Human
gagauggcggagcgcagc

SEQ ID NO: 760607 - RNA, 23 nt, Human
gagauggggucuccuuauauugc

SEQ ID NO: 760608 - RNA, 20 nt, Human
gagcagccccaccagagugg

SEQ ID NO: 760609 - RNA, 26 nt, Human
gaggaugccucguucaaccucauuuu

SEQ ID NO: 760610 - RNA, 18 nt, Human
gaggggagggggcaaagg

SEQ ID NO: 760611 - RNA, 19 nt, Human
gagguucccaguccuugga

SEQ ID NO: 760612 - RNA, 25 nt, Human
gaguuuuaugauauccucaugggag

SEQ ID NO: 760613 - RNA, 18 nt, Human
gaucacaggugugagcca

SEQ ID NO: 760614 - RNA, 25 nt, Human
gaucaucucaaacuccugggcucaa

SEQ ID NO: 760615 - RNA, 18 nt, Human
gaucucuguaccuuccuc

SEQ ID NO: 760616 - RNA, 20 nt, Human
gaugaaggccccugcacccc

SEQ ID NO: 760617 - RNA, 18 nt, Human
gauuacaggcaugagcca

SEQ ID NO: 760618 - RNA, 22 nt, Human
gauuacaggcaugagccaccac

SEQ ID NO: 760619 - RNA, 22 nt, Human
gccuuggccucccaaagugcug

SEQ ID NO: 760620 - RNA, 23 nt, Human
gcuggucuugaacuccuaaccuc

SEQ ID NO: 760621 - RNA, 18 nt, Human
gcuuugagggcccugggg

SEQ ID NO: 760622 - RNA, 21 nt, Human
ggagaacagacaguucacagg

SEQ ID NO: 760623 - RNA, 18 nt, Human
ggagcucccuuaggggag

SEQ ID NO: 760624 - RNA, 20 nt, Human
ggagcuggaagggccaugga

SEQ ID NO: 760625 - RNA, 21 nt, Human
ggaggccacuagugaggaggu

SEQ ID NO: 760626 - RNA, 27 nt, Human
ggagguggcucuguagcuccgaccacg

SEQ ID NO: 760627 - RNA, 20 nt, Human
ggcagagcccagacuaugca

SEQ ID NO: 760628 - RNA, 24 nt, Human
ggcuggucuugaacuccuaaccuc

SEQ ID NO: 760629 - RNA, 19 nt, Human
gggaagggagaaucgccac

SEQ ID NO: 760630 - RNA, 23 nt, Human
gggacaguggauacgggccagag

SEQ ID NO: 760631 - RNA, 22 nt, Human
gggagagaugaagagguggagc

SEQ ID NO: 760632 - RNA, 19 nt, Human
gggagggagcagacgcggg

SEQ ID NO: 760633 - RNA, 19 nt, Human
gggccagagcaggugggga

SEQ ID NO: 760634 - RNA, 19 nt, Human
gggccagagcaggugggga

SEQ ID NO: 760635 - RNA, 21 nt, Human
ggggaggggagggggcaaagg

SEQ ID NO: 760636 - RNA, 22 nt, Human
ggggaggggagggggcaaaggg

SEQ ID NO: 760637 - RNA, 23 nt, Human
ggggaggggagggggcaaagggc

SEQ ID NO: 760638 - RNA, 22 nt, Human
ggggguuuuagggcaggaaaug

SEQ ID NO: 760639 - RNA, 23 nt, Human
gggguuucaccauguugaucagg

SEQ ID NO: 760640 - RNA, 24 nt, Human
guacaaguguggaauuacucgaga

SEQ ID NO: 760641 - RNA, 24 nt, Human
gugauccaccugccuuggccuccc

SEQ ID NO: 760642 - RNA, 21 nt, Human
guuaggggagagaugaagagg

SEQ ID NO: 760643 - RNA, 24 nt, Human
uaaaaaaaaaaaaaaaaaaaacau

SEQ ID NO: 760644 - RNA, 24 nt, Human
uaaacgacagacuucagaugauac

SEQ ID NO: 760645 - RNA, 22 nt, Human
uaaagacgggguuucaccaugu

SEQ ID NO: 760646 - RNA, 24 nt, Human
uaaccucaggugauccaccugccu

SEQ ID NO: 760647 - RNA, 19 nt, Human
uaauuuuuuguaguuuuag

SEQ ID NO: 760648 - RNA, 22 nt, Human
uacagcagccuugaccucccag

SEQ ID NO: 760649 - RNA, 24 nt, Human
uacaggcaugagccaccacgccca

SEQ ID NO: 760650 - RNA, 24 nt, Human
uacuguuguguuaaggcagguuga

SEQ ID NO: 760651 - RNA, 24 nt, Human
uaguaaagacgggguuucaccaug

SEQ ID NO: 760652 - RNA, 26 nt, Human
uaguaaagacgggguuucaccauguu

SEQ ID NO: 760653 - RNA, 19 nt, Human
uaugcaggcaggggagccu

SEQ ID NO: 760654 - RNA, 18 nt, Human
ucacaggcgcucagcugc

SEQ ID NO: 760655 - RNA, 21 nt, Human
ucaccaugccuggcugauuuu

SEQ ID NO: 760656 - RNA, 21 nt, Human
ucagauguggcauucugcacu

SEQ ID NO: 760657 - RNA, 27 nt, Human
ucagcauuaaaaaaaaaaaaaaaaaaa

SEQ ID NO: 760658 - RNA, 18 nt, Human
ucagcccuaaugggcaga

SEQ ID NO: 760659 - RNA, 21 nt, Human
ucaggugauccaccugccuug

SEQ ID NO: 760660 - RNA, 21 nt, Human
ucaugggagcagggaggaccc

SEQ ID NO: 760661 - RNA, 21 nt, Human
uccaugcagccuuaagcccac

SEQ ID NO: 760662 - RNA, 23 nt, Human
uccaugccugaggaccauguaag

SEQ ID NO: 760663 - RNA, 24 nt, Human
ucccaaagugcugagauuacaggc

SEQ ID NO: 760664 - RNA, 21 nt, Human
ucccaggcucaggugauucuc

SEQ ID NO: 760665 - RNA, 23 nt, Human
ucccaggcucaggugauucuccc

SEQ ID NO: 760666 - RNA, 18 nt, Human
ucccugggcaagagcagg

SEQ ID NO: 760667 - RNA, 25 nt, Human
uccuccaugucuauaucagcccuaa

SEQ ID NO: 760668 - RNA, 22 nt, Human
uccugggcucaagcaguccucc

SEQ ID NO: 760669 - RNA, 24 nt, Human
uccugggcucaagcaguccuccug

SEQ ID NO: 760670 - RNA, 24 nt, Human
uccuuggagcuggaagggccaugg

SEQ ID NO: 760671 - RNA, 21 nt, Human
ucgagagcagccccaccagag

SEQ ID NO: 760672 - RNA, 24 nt, Human
ucucaaacuccugggcucaagcag

SEQ ID NO: 760673 - RNA, 19 nt, Human
ucucacucugucaccuagg

SEQ ID NO: 760674 - RNA, 24 nt, Human
ucucacucugucaccuaggcugaa

SEQ ID NO: 760675 - RNA, 19 nt, Human
ucuguaugguacucuggug

SEQ ID NO: 760676 - RNA, 18 nt, Human
ugaaggccccugcacccc

SEQ ID NO: 760677 - RNA, 20 nt, Human
ugaaguggucgagggcacag

SEQ ID NO: 760678 - RNA, 21 nt, Human
ugaccccuagagacuucuccu

SEQ ID NO: 760679 - RNA, 22 nt, Human
ugagacgaggucucacucuguc

SEQ ID NO: 760680 - RNA, 22 nt, Human
ugagauuacaggcaugagccac

SEQ ID NO: 760681 - RNA, 23 nt, Human
ugagauuacaggcaugagccacc

SEQ ID NO: 760682 - RNA, 24 nt, Human
ugagauuacaggcaugagccacca

SEQ ID NO: 760683 - RNA, 24 nt, Human
ugagauuacaggcaugagccacca

SEQ ID NO: 760684 - RNA, 19 nt, Human
ugaggaaacugaacagggg

SEQ ID NO: 760685 - RNA, 24 nt, Human
ugaucaggcuggucuugaacuccu

SEQ ID NO: 760686 - RNA, 22 nt, Human
ugaugacaguguuccacucucu

SEQ ID NO: 760687 - RNA, 22 nt, Human
ugaugaccagcaugccuuucuu

SEQ ID NO: 760688 - RNA, 20 nt, Human
ugccaggcaccaggauucag

SEQ ID NO: 760689 - RNA, 25 nt, Human
ugcccggcuaauuuuuuguaguuuu

SEQ ID NO: 760690 - RNA, 23 nt, Human
ugccucagccuccaaaauguugg

SEQ ID NO: 760691 - RNA, 19 nt, Human
uggauaggaggggaggcug

SEQ ID NO: 760692 - RNA, 19 nt, Human
uggcugggaaugccaggca

SEQ ID NO: 760693 - RNA, 24 nt, Human
uggcuuacagcagccuugaccucc

SEQ ID NO: 760694 - RNA, 24 nt, Human
ugggaccacaggugcacgucacca

SEQ ID NO: 760695 - RNA, 18 nt, Human
ugggaucacaggugugag

SEQ ID NO: 760696 - RNA, 22 nt, Human
ugggaucacaggugugagccac

SEQ ID NO: 760697 - RNA, 23 nt, Human
ugggaucacaggugugagccacc

SEQ ID NO: 760698 - RNA, 24 nt, Human
ugggaucacaggugugagccacca

SEQ ID NO: 760699 - RNA, 25 nt, Human
ugggaucacaggugugagccaccau

SEQ ID NO: 760700 - RNA, 24 nt, Human
ugggcucaagcaguccuccugccu

SEQ ID NO: 760701 - RNA, 18 nt, Human
ugggggauauggauagga

SEQ ID NO: 760702 - RNA, 19 nt, Human
ugugagccaccauccccag

SEQ ID NO: 760703 - RNA, 20 nt, Human
ugugguggcaacagucaaag

SEQ ID NO: 760704 - RNA, 19 nt, Human
ugugucaggggaggggagg

SEQ ID NO: 760705 - RNA, 18 nt, Human
uguuccacucucucaucc

SEQ ID NO: 760706 - RNA, 20 nt, Human
uuaaaaaaaaaaaaaaaaaa

SEQ ID NO: 760707 - RNA, 23 nt, Human
uuacagcagccuugaccucccag

SEQ ID NO: 760708 - RNA, 23 nt, Human
uuaggggagggggcacagaggca

SEQ ID NO: 760709 - RNA, 24 nt, Human
uuaguaaagacgggguuucaccau

SEQ ID NO: 760710 - RNA, 25 nt, Human
uuauugauacauacggaagcaacac

SEQ ID NO: 760711 - RNA, 18 nt, Human
uucacagucggggcgggg

SEQ ID NO: 760712 - RNA, 21 nt, Human
uucacugagucgugcauuuuu

SEQ ID NO: 760713 - RNA, 18 nt, Human
uucauccacugucagcac

SEQ ID NO: 760714 - RNA, 19 nt, Human
uucauccacugucagcacc

SEQ ID NO: 760715 - RNA, 21 nt, Human
uucucacccuuaucucuccag

SEQ ID NO: 760716 - RNA, 22 nt, Human
uuggcauuuuuguuugaguagg

SEQ ID NO: 760717 - RNA, 18 nt, Human
uuggccucccaaagugcu

SEQ ID NO: 760718 - RNA, 24 nt, Human
uuguagagauggggucuccuuaua

SEQ ID NO: 760719 - RNA, 24 nt, Human
uuucaccauguugaucaggcuggu

SEQ ID NO: 760720 - RNA, 20 nt, Human
uuugcuguaacuaaaauugc

SEQ ID NO: 760721 - RNA, 18 nt, Human
uuuguagagauggggucu

SEQ ID NO: 760722 - RNA, 24 nt, Human
uuuguagagauggggucuccuuau

SEQ ID NO: 760723 - RNA, 19 nt, Human
uuuuuuguagagauggggu

SEQ ID NO: 760724 - RNA, 22 nt, Human
aagacacuaguacuuguccagc

SEQ ID NO: 760725 - RNA, 21 nt, Human
aaguacauaaucugacauaau

SEQ ID NO: 760726 - RNA, 23 nt, Human
acagcagguguaauagcugauuu

SEQ ID NO: 760727 - RNA, 20 nt, Human
acugguuguugccaggaaaa

SEQ ID NO: 760728 - RNA, 23 nt, Human
agccacuccaggguccagagccg

SEQ ID NO: 760729 - RNA, 23 nt, Human
aggcaaccaguuugaaaaucagg

SEQ ID NO: 760730 - RNA, 22 nt, Human
caguggauuuucugcuuagcuu

SEQ ID NO: 760731 - RNA, 20 nt, Human
ccugcagccacuccaggguc

SEQ ID NO: 760732 - RNA, 19 nt, Human
cgcggugguggccguggcc

SEQ ID NO: 760733 - RNA, 25 nt, Human
cuaaaucuccuauaauucucacggu

SEQ ID NO: 760734 - RNA, 24 nt, Human
cuagucauaaacagccuucaaaga

SEQ ID NO: 760735 - RNA, 25 nt, Human
cuagucauaaacagccuucaaagaa

SEQ ID NO: 760736 - RNA, 28 nt, Human
cucuuuccugcuauuguucgcuucagau

SEQ ID NO: 760737 - RNA, 25 nt, Human
gaagucuuaaaaaagaggcuuuguc

SEQ ID NO: 760738 - RNA, 21 nt, Human
gagaugaaagugguuuuucag

SEQ ID NO: 760739 - RNA, 25 nt, Human
gagccguagcacgcucggcagggaa

SEQ ID NO: 760740 - RNA, 22 nt, Human
gccguggccgcugccgccgccg

SEQ ID NO: 760741 - RNA, 18 nt, Human
gcggugguggccguggcc

SEQ ID NO: 760742 - RNA, 20 nt, Human
ggccguggccgcugccgccg

SEQ ID NO: 760743 - RNA, 26 nt, Human
ggucaauaaaaucuaccaucgaccac

SEQ ID NO: 760744 - RNA, 22 nt, Human
uaaaacuuucagaaugcagcau

SEQ ID NO: 760745 - RNA, 18 nt, Human
uacauuuguuguggccuc

SEQ ID NO: 760746 - RNA, 24 nt, Human
uagaggaauccaccuuuuagaggg

SEQ ID NO: 760747 - RNA, 24 nt, Human
uagcaaaaaagaugcaggcaacca

SEQ ID NO: 760748 - RNA, 23 nt, Human
uauagcaaaaaagaugcaggcaa

SEQ ID NO: 760749 - RNA, 21 nt, Human
ucagaaagccgaaacugguug

SEQ ID NO: 760750 - RNA, 19 nt, Human
uccacacaguuuggauaca

SEQ ID NO: 760751 - RNA, 26 nt, Human
uccauauagcaaaaaagaugcaggca

SEQ ID NO: 760752 - RNA, 18 nt, Human
ucggcagggaauuuuucu

SEQ ID NO: 760753 - RNA, 25 nt, Human
ucuaagacacuaguacuuguccagc

SEQ ID NO: 760754 - RNA, 18 nt, Human
ucuauggcaauacugguu

SEQ ID NO: 760755 - RNA, 22 nt, Human
ugaaaagaggcaguuucuaugg

SEQ ID NO: 760756 - RNA, 24 nt, Human
ugaaaagaggcaguuucuauggca

SEQ ID NO: 760757 - RNA, 21 nt, Human
ugaaaaucagggaaaguagaa

SEQ ID NO: 760758 - RNA, 18 nt, Human
ugauuuucacucuugucu

SEQ ID NO: 760759 - RNA, 18 nt, Human
ugcaaaaaugugccuucc

SEQ ID NO: 760760 - RNA, 25 nt, Human
ugcagugaugaggaaguguguguac

SEQ ID NO: 760761 - RNA, 22 nt, Human
ugccauuuuuaaaaauuaaaau

SEQ ID NO: 760762 - RNA, 23 nt, Human
uguaucaggcauccuaacuggcc

SEQ ID NO: 760763 - RNA, 24 nt, Human
uguaucaggcauccuaacuggcca

SEQ ID NO: 760764 - RNA, 22 nt, Human
uguuguggccucuggacaucua

SEQ ID NO: 760765 - RNA, 20 nt, Human
uuagaggguuaagggguuag

SEQ ID NO: 760766 - RNA, 20 nt, Human
aaaaggacauuccagauaua

SEQ ID NO: 760767 - RNA, 25 nt, Human
aaacaaauaaaaaccauguauccaa

SEQ ID NO: 760768 - RNA, 23 nt, Human
aaaccauguauccaagacuuagg

SEQ ID NO: 760769 - RNA, 25 nt, Human
aaagaacaucauggaaaauuuuaaa

SEQ ID NO: 760770 - RNA, 24 nt, Human
aaagagcgagacuccgucucaaaa

SEQ ID NO: 760771 - RNA, 19 nt, Human
aaagugcugggacuacagg

SEQ ID NO: 760772 - RNA, 24 nt, Human
aaagugcugggacuacaggcacga

SEQ ID NO: 760773 - RNA, 25 nt, Human
aaauaaaaaccauguauccaagacu

SEQ ID NO: 760774 - RNA, 19 nt, Human
aacauggugaaaccccauc

SEQ ID NO: 760775 - RNA, 20 nt, Human
aacauggugaaaccccaucu

SEQ ID NO: 760776 - RNA, 21 nt, Human
aacauggugaaaccccaucuc

SEQ ID NO: 760777 - RNA, 21 nt, Human
aacauggugaaaccccaucuc

SEQ ID NO: 760778 - RNA, 23 nt, Human
aacccacccuccacgcuucccug

SEQ ID NO: 760779 - RNA, 20 nt, Human
aaccucugccucccgggccc

SEQ ID NO: 760780 - RNA, 23 nt, Human
aaccuguacagagaaucaugccu

SEQ ID NO: 760781 - RNA, 19 nt, Human
aacuuguuauucauccuca

SEQ ID NO: 760782 - RNA, 19 nt, Human
aagugcugggacuacaggc

SEQ ID NO: 760783 - RNA, 26 nt, Human
aagugcugggacuacaggcacgagcc

SEQ ID NO: 760784 - RNA, 24 nt, Human
aauggcuugaacccgggaggcaga

SEQ ID NO: 760785 - RNA, 23 nt, Human
acaaaacaaauaaaaaccaugua

SEQ ID NO: 760786 - RNA, 23 nt, Human
accacaggccgcacccacgaacc

SEQ ID NO: 760787 - RNA, 18 nt, Human
accacgccuggcuaauuu

SEQ ID NO: 760788 - RNA, 18 nt, Human
accaugauggucaggcug

SEQ ID NO: 760789 - RNA, 20 nt, Human
accuaggaguuccaccuuau

SEQ ID NO: 760790 - RNA, 30 nt, Human
accuaggaguuccaccuuauuucuuaaaaa

SEQ ID NO: 760791 - RNA, 23 nt, Human
accucaugaucugcccaccggcc

SEQ ID NO: 760792 - RNA, 28 nt, Human
acuccgucucaaaaaaaaaaaaaaaaaa

SEQ ID NO: 760793 - RNA, 22 nt, Human
acucgauuggaacccacccucc

SEQ ID NO: 760794 - RNA, 18 nt, Human
acugcacgccagccuggg

SEQ ID NO: 760795 - RNA, 24 nt, Human
acugugccacugcacgccagccug

SEQ ID NO: 760796 - RNA, 25 nt, Human
acuucccucuugggccuuuucgcua

SEQ ID NO: 760797 - RNA, 22 nt, Human
agaaugaagugguucccuagcc

SEQ ID NO: 760798 - RNA, 24 nt, Human
agagcuugcagugagccgagacug

SEQ ID NO: 760799 - RNA, 21 nt, Human
agccgagacugugccacugca

SEQ ID NO: 760800 - RNA, 21 nt, Human
agccgggcaugguggcucacg

SEQ ID NO: 760801 - RNA, 22 nt, Human
agccuggccaacauggugaaac

SEQ ID NO: 760802 - RNA, 24 nt, Human
agccuggccaacauggugaaaccc

SEQ ID NO: 760803 - RNA, 24 nt, Human
agccugggcgaaagagcgagacuc

SEQ ID NO: 760804 - RNA, 18 nt, Human
aggaaaugcagacuaaau

SEQ ID NO: 760805 - RNA, 21 nt, Human
aggcacgagccaccgggccca

SEQ ID NO: 760806 - RNA, 21 nt, Human
aggcagagcuugcagugagcc

SEQ ID NO: 760807 - RNA, 24 nt, Human
aggcagagcuugcagugagccgag

SEQ ID NO: 760808 - RNA, 18 nt, Human
aggcagguggaucaccug

SEQ ID NO: 760809 - RNA, 22 nt, Human
aggcagguggaucaccugaggu

SEQ ID NO: 760810 - RNA, 26 nt, Human
aggcagguggaucaccugaggucagg

SEQ ID NO: 760811 - RNA, 21 nt, Human
aggccgaggcagguggaucac

SEQ ID NO: 760812 - RNA, 18 nt, Human
agggaggagaauggcuug

SEQ ID NO: 760813 - RNA, 24 nt, Human
agggaggagaauggcuugaacccg

SEQ ID NO: 760814 - RNA, 22 nt, Human
agguggaucaccugaggucagg

SEQ ID NO: 760815 - RNA, 25 nt, Human
aguagcugggauuacaggcgcaugu

SEQ ID NO: 760816 - RNA, 20 nt, Human
agugcaauggcgugaucucg

SEQ ID NO: 760817 - RNA, 24 nt, Human
agugcaauggcgugaucucggcuc

SEQ ID NO: 760818 - RNA, 27 nt, Human
auaaaaaccauguauccaagacuuagg

SEQ ID NO: 760819 - RNA, 22 nt, Human
auaaagaagaacuuuaccuccu

SEQ ID NO: 760820 - RNA, 23 nt, Human
auaauagguaagaucaaaagcuu

SEQ ID NO: 760821 - RNA, 19 nt, Human
aucucuucuuuuacauguu

SEQ ID NO: 760822 - RNA, 24 nt, Human
augagguuucaccaugauggucag

SEQ ID NO: 760823 - RNA, 22 nt, Human
caaaaacaaaacaaauaaaaac

SEQ ID NO: 760824 - RNA, 19 nt, Human
caaaaaccuuuccucuaga

SEQ ID NO: 760825 - RNA, 23 nt, Human
caaagugcugggacuacaggcac

SEQ ID NO: 760826 - RNA, 24 nt, Human
caaagugcugggacuacaggcacg

SEQ ID NO: 760827 - RNA, 19 nt, Human
caacauaaaauucgcaaag

SEQ ID NO: 760828 - RNA, 18 nt, Human
caacauggugaaacccca

SEQ ID NO: 760829 - RNA, 23 nt, Human
caaccucugccucccgggcccaa

SEQ ID NO: 760830 - RNA, 24 nt, Human
caaccucugccucccgggcccaag

SEQ ID NO: 760831 - RNA, 22 nt, Human
caagugauucuccugucucagc

SEQ ID NO: 760832 - RNA, 21 nt, Human
cacaguuacuaccgcccgggc

SEQ ID NO: 760833 - RNA, 21 nt, Human
caccaugauggucaggcuggu

SEQ ID NO: 760834 - RNA, 24 nt, Human
caccaugauggucaggcuggucuc

SEQ ID NO: 760835 - RNA, 21 nt, Human
cacccacgaaccugguccggc

SEQ ID NO: 760836 - RNA, 23 nt, Human
cacgccagccugggcgaaagagc

SEQ ID NO: 760837 - RNA, 24 nt, Human
cacgccugcaaucccagcaccuug

SEQ ID NO: 760838 - RNA, 23 nt, Human
cacuauaaaguucacaaccuuca

SEQ ID NO: 760839 - RNA, 21 nt, Human
cacugcaaccucugccucccg

SEQ ID NO: 760840 - RNA, 23 nt, Human
cacugcaaccucugccucccggg

SEQ ID NO: 760841 - RNA, 20 nt, Human
cacugcacgccagccugggc

SEQ ID NO: 760842 - RNA, 23 nt, Human
cacugcacgccagccugggcgaa

SEQ ID NO: 760843 - RNA, 24 nt, Human
cagcaccuugggaggccgaggcag

SEQ ID NO: 760844 - RNA, 25 nt, Human
cagcaccuugggaggccgaggcagg

SEQ ID NO: 760845 - RNA, 23 nt, Human
cagcagcgauucguuucuccuuc

SEQ ID NO: 760846 - RNA, 26 nt, Human
caggaaccuuuucuccaccuuggccc

SEQ ID NO: 760847 - RNA, 24 nt, Human
caggacaccccaggcuuuucuuga

SEQ ID NO: 760848 - RNA, 24 nt, Human
cagguggaucaccugaggucagga

SEQ ID NO: 760849 - RNA, 19 nt, Human
ccaaagugcugggacuaca

SEQ ID NO: 760850 - RNA, 22 nt, Human
ccaccgggcccagccagaaauu

SEQ ID NO: 760851 - RNA, 21 nt, Human
ccacugcacgccagccugggc

SEQ ID NO: 760852 - RNA, 21 nt, Human
ccacugcacgccagccugggc

SEQ ID NO: 760853 - RNA, 24 nt, Human
cccaaagugcugggacuacaggca

SEQ ID NO: 760854 - RNA, 23 nt, Human
cccaacuaaccgccaccucugac

SEQ ID NO: 760855 - RNA, 19 nt, Human
cccacgaaccugguccggc

SEQ ID NO: 760856 - RNA, 21 nt, Human
cccaggcuggagugcaauggc

SEQ ID NO: 760857 - RNA, 21 nt, Human
cccaucuccacuaaaaauaca

SEQ ID NO: 760858 - RNA, 23 nt, Human
cccgaguagcugggauuacaggc

SEQ ID NO: 760859 - RNA, 24 nt, Human
cccgaguagcugggauuacaggcg

SEQ ID NO: 760860 - RNA, 23 nt, Human
cccgggcccaagugauucuccuc

SEQ ID NO: 760861 - RNA, 22 nt, Human
cccucagaaaagcagcggccac

SEQ ID NO: 760862 - RNA, 22 nt, Human
ccgaguagcugggauuacaggc

SEQ ID NO: 760863 - RNA, 18 nt, Human
ccgcccgggccuccaggc

SEQ ID NO: 760864 - RNA, 19 nt, Human
ccuacaggaaaugcagacu

SEQ ID NO: 760865 - RNA, 19 nt, Human
ccuccacgcuucccuggcc

SEQ ID NO: 760866 - RNA, 24 nt, Human
ccucccgggcccaagugauucucc

SEQ ID NO: 760867 - RNA, 20 nt, Human
ccugaaauacaguuccuaca

SEQ ID NO: 760868 - RNA, 21 nt, Human
ccugaggucaggaguugagac

SEQ ID NO: 760869 - RNA, 22 nt, Human
ccugcaaucccagcaccuuggg

SEQ ID NO: 760870 - RNA, 23 nt, Human
ccuggccaacauggugaaacccc

SEQ ID NO: 760871 - RNA, 24 nt, Human
ccuggccaacauggugaaacccca

SEQ ID NO: 760872 - RNA, 22 nt, Human
ccuggccccaacuaaccgccac

SEQ ID NO: 760873 - RNA, 22 nt, Human
ccugggcgaaagagcgagacuc

SEQ ID NO: 760874 - RNA, 19 nt, Human
ccuguaaucccagccacuc

SEQ ID NO: 760875 - RNA, 24 nt, Human
cgaggcagguggaucaccugaggu

SEQ ID NO: 760876 - RNA, 26 nt, Human
cgaggcagguggaucaccugagguca

SEQ ID NO: 760877 - RNA, 22 nt, Human
cgcccgggccuccaggccucag

SEQ ID NO: 760878 - RNA, 21 nt, Human
cgccugcaaucccagcaccuu

SEQ ID NO: 760879 - RNA, 23 nt, Human
cgccugcaaucccagcaccuugg

SEQ ID NO: 760880 - RNA, 23 nt, Human
cgccuguaaucccagccacucgg

SEQ ID NO: 760881 - RNA, 23 nt, Human
cuaaauaaaauguggaccuacau

SEQ ID NO: 760882 - RNA, 20 nt, Human
cuaccgcccgggccuccagg

SEQ ID NO: 760883 - RNA, 22 nt, Human
cucaagcgccuucucuggaaac

SEQ ID NO: 760884 - RNA, 23 nt, Human
cucacgccugcaaucccagcacc

SEQ ID NO: 760885 - RNA, 24 nt, Human
cucacgccugcaaucccagcaccu

SEQ ID NO: 760886 - RNA, 24 nt, Human
cucacugcaaccucugccucccgg

SEQ ID NO: 760887 - RNA, 23 nt, Human
cucagcugcccgaguagcuggga

SEQ ID NO: 760888 - RNA, 23 nt, Human
cuccacgcuucccuggccccaac

SEQ ID NO: 760889 - RNA, 22 nt, Human
cuccaggccucagggcugcaga

SEQ ID NO: 760890 - RNA, 20 nt, Human
cucccgggcccaagugauuc

SEQ ID NO: 760891 - RNA, 19 nt, Human
cuccgucucaaaaaaaaaa

SEQ ID NO: 760892 - RNA, 20 nt, Human
cuccugaccucaugaucugc

SEQ ID NO: 760893 - RNA, 20 nt, Human
cucuuguugcccaggcugga

SEQ ID NO: 760894 - RNA, 22 nt, Human
cugcaaccucugccucccgggc

SEQ ID NO: 760895 - RNA, 23 nt, Human
cugcaaccucugccucccgggcc

SEQ ID NO: 760896 - RNA, 19 nt, Human
cugcaccacaggccgcacc

SEQ ID NO: 760897 - RNA, 24 nt, Human
cugcccaccggccucccaaagugc

SEQ ID NO: 760898 - RNA, 23 nt, Human
cuggccaacauggugaaacccca

SEQ ID NO: 760899 - RNA, 23 nt, Human
cugucucagcugcccgaguagcu

SEQ ID NO: 760900 - RNA, 24 nt, Human
cuugcagugagccgagacugugcc

SEQ ID NO: 760901 - RNA, 25 nt, Human
cuuggcccggccugcaaaaccuggc

SEQ ID NO: 760902 - RNA, 24 nt, Human
cuuguugcccaggcuggagugcaa

SEQ ID NO: 760903 - RNA, 20 nt, Human
gaacccgggaggcagagcuu

SEQ ID NO: 760904 - RNA, 19 nt, Human
gaaguugagaugaugagug

SEQ ID NO: 760905 - RNA, 23 nt, Human
gagaccagccuggccaacauggu

SEQ ID NO: 760906 - RNA, 19 nt, Human
gagcgagacuccgucucaa

SEQ ID NO: 760907 - RNA, 18 nt, Human
gagcuugcagugagccga

SEQ ID NO: 760908 - RNA, 19 nt, Human
gaggcagguggaucaccug

SEQ ID NO: 760909 - RNA, 19 nt, Human
gagggaaccggcuuuuaga

SEQ ID NO: 760910 - RNA, 18 nt, Human
gagguuucaccaugaugg

SEQ ID NO: 760911 - RNA, 22 nt, Human
gagguuucaccaugauggucag

SEQ ID NO: 760912 - RNA, 22 nt, Human
gaguagcugggauuacaggcgc

SEQ ID NO: 760913 - RNA, 21 nt, Human
gaucaccugaggucaggaguu

SEQ ID NO: 760914 - RNA, 23 nt, Human
gaucaccugaggucaggaguuga

SEQ ID NO: 760915 - RNA, 24 nt, Human
gaucaccugaggucaggaguugag

SEQ ID NO: 760916 - RNA, 24 nt, Human
gcacccacgaaccugguccggcac

SEQ ID NO: 760917 - RNA, 22 nt, Human
gcagcagcgauucguuucuccu

SEQ ID NO: 760918 - RNA, 24 nt, Human
gccaacauggugaaaccccaucuc

SEQ ID NO: 760919 - RNA, 24 nt, Human
gccacugcacgccagccugggcga

SEQ ID NO: 760920 - RNA, 24 nt, Human
gcccgaguagcugggauuacaggc

SEQ ID NO: 760921 - RNA, 26 nt, Human
gccgcacccacgaaccugguccggca

SEQ ID NO: 760922 - RNA, 21 nt, Human
gcucuuguugcccaggcugga

SEQ ID NO: 760923 - RNA, 24 nt, Human
gcucuuguugcccaggcuggagug

SEQ ID NO: 760924 - RNA, 19 nt, Human
gcuggagugcaauggcgug

SEQ ID NO: 760925 - RNA, 23 nt, Human
gcuggucucaaacuccugaccuc

SEQ ID NO: 760926 - RNA, 21 nt, Human
ggacuacaggcacgagccacc

SEQ ID NO: 760927 - RNA, 22 nt, Human
ggacuacaggcacgagccaccg

SEQ ID NO: 760928 - RNA, 22 nt, Human
ggaguuccaccuuauuucuuaa

SEQ ID NO: 760929 - RNA, 22 nt, Human
ggcuggagugcaauggcgugau

SEQ ID NO: 760930 - RNA, 24 nt, Human
ggcuggucucaaacuccugaccuc

SEQ ID NO: 760931 - RNA, 24 nt, Human
gggcaugguggcucacgccugcaa

SEQ ID NO: 760932 - RNA, 19 nt, Human
gggcccaagugauucuccu

SEQ ID NO: 760933 - RNA, 24 nt, Human
gguggcgggcgccuguaaucccag

SEQ ID NO: 760934 - RNA, 24 nt, Human
gguggcucacgccugcaaucccag

SEQ ID NO: 760935 - RNA, 23 nt, Human
gguucaauauuuuuggcaagaug

SEQ ID NO: 760936 - RNA, 20 nt, Human
guagaauagcaaaaacaaaa

SEQ ID NO: 760937 - RNA, 22 nt, Human
gucaauauuccauucucccaau

SEQ ID NO: 760938 - RNA, 19 nt, Human
gugaaguugagaugaugag

SEQ ID NO: 760939 - RNA, 23 nt, Human
gugaaguugagaugaugaguggg

SEQ ID NO: 760940 - RNA, 23 nt, Human
guggcgggcgccuguaaucccag

SEQ ID NO: 760941 - RNA, 23 nt, Human
uaaaguucacaaccuucacugaa

SEQ ID NO: 760942 - RNA, 20 nt, Human
uaaaguucuuuucuaggaug

SEQ ID NO: 760943 - RNA, 25 nt, Human
uaaauacacaaaaguagaauagcaa

SEQ ID NO: 760944 - RNA, 24 nt, Human
uaauuuuugcauuuuuagcggaga

SEQ ID NO: 760945 - RNA, 19 nt, Human
uaccuaggaguuccaccuu

SEQ ID NO: 760946 - RNA, 21 nt, Human
uagaauagcaaaaacaaaaca

SEQ ID NO: 760947 - RNA, 23 nt, Human
uagaauagcaaaaacaaaacaaa

SEQ ID NO: 760948 - RNA, 20 nt, Human
uagaauguacuuccuaugcu

SEQ ID NO: 760949 - RNA, 21 nt, Human
uagcaaaaacaaaacaaauaa

SEQ ID NO: 760950 - RNA, 24 nt, Human
uagcggagaugagguuucaccaug

SEQ ID NO: 760951 - RNA, 21 nt, Human
ucaaaaaaaaaaaaaaaaaaa

SEQ ID NO: 760952 - RNA, 23 nt, Human
ucaaaagcuuuuccacauucagu

SEQ ID NO: 760953 - RNA, 24 nt, Human
ucacacauaacaaaguuucuuaau

SEQ ID NO: 760954 - RNA, 23 nt, Human
ucacugcaaccucugccucccgg

SEQ ID NO: 760955 - RNA, 24 nt, Human
ucacugcaaccucugccucccggg

SEQ ID NO: 760956 - RNA, 20 nt, Human
ucagaaaagcagcggccaca

SEQ ID NO: 760957 - RNA, 22 nt, Human
ucagaaaagcagcggccacagu

SEQ ID NO: 760958 - RNA, 18 nt, Human
ucagaagcaggguccaca

SEQ ID NO: 760959 - RNA, 24 nt, Human
uccacagacaccagagagggaacc

SEQ ID NO: 760960 - RNA, 21 nt, Human
uccacaggaaccuuuucucca

SEQ ID NO: 760961 - RNA, 22 nt, Human
uccacauucaguccuguaauaa

SEQ ID NO: 760962 - RNA, 23 nt, Human
uccaggccucagggcugcagaag

SEQ ID NO: 760963 - RNA, 20 nt, Human
uccauuauuucauuaugugu

SEQ ID NO: 760964 - RNA, 24 nt, Human
ucccaaagugcugggacuacaggc

SEQ ID NO: 760965 - RNA, 21 nt, Human
ucccgggcccaagugauucuc

SEQ ID NO: 760966 - RNA, 24 nt, Human
ucccgggcccaagugauucuccug

SEQ ID NO: 760967 - RNA, 25 nt, Human
ucccuggccccaacuaaccgccacc

SEQ ID NO: 760968 - RNA, 23 nt, Human
uccgucucaaaaaaaaaaaaaaa

SEQ ID NO: 760969 - RNA, 19 nt, Human
uccuuaacuucugguugcc

SEQ ID NO: 760970 - RNA, 24 nt, Human
ucuccaacugcaccacaggccgcu

SEQ ID NO: 760971 - RNA, 22 nt, Human
ucucuaaacugggaguuggcuc

SEQ ID NO: 760972 - RNA, 24 nt, Human
ucuuaaaaugccauuuuauugguu

SEQ ID NO: 760973 - RNA, 22 nt, Human
ucuuguugcccaggcuggagug

SEQ ID NO: 760974 - RNA, 19 nt, Human
ugaaaccccaucuccacua

SEQ ID NO: 760975 - RNA, 22 nt, Human
ugaaaccccaucuccacuaaaa

SEQ ID NO: 760976 - RNA, 19 nt, Human
ugaaaggcuucuauauguu

SEQ ID NO: 760977 - RNA, 22 nt, Human
ugaagugagagccgggcauggu

SEQ ID NO: 760978 - RNA, 22 nt, Human
ugaauuuccuaaaguuuaacau

SEQ ID NO: 760979 - RNA, 23 nt, Human
ugagaccagccuggccaacaugg

SEQ ID NO: 760980 - RNA, 22 nt, Human
ugagccgagacugugccacugc

SEQ ID NO: 760981 - RNA, 24 nt, Human
ugagggaggagaauggcuugaacc

SEQ ID NO: 760982 - RNA, 24 nt, Human
ugagguuucaccaugauggucagg

SEQ ID NO: 760983 - RNA, 22 nt, Human
ugaucugcccaccggccuccca

SEQ ID NO: 760984 - RNA, 18 nt, Human
ugcccaggcuggagugca

SEQ ID NO: 760985 - RNA, 21 nt, Human
ugcccaggcuggagugcaaug

SEQ ID NO: 760986 - RNA, 21 nt, Human
ugcccaggcuggagugcaaug

SEQ ID NO: 760987 - RNA, 24 nt, Human
ugcccaggcuggagugcaauggcg

SEQ ID NO: 760988 - RNA, 24 nt, Human
ugcucuuguugcccaggcuggagu

SEQ ID NO: 760989 - RNA, 19 nt, Human
ugcugggacuacaggcacg

SEQ ID NO: 760990 - RNA, 24 nt, Human
ugcugggacuacaggcacgagcca

SEQ ID NO: 760991 - RNA, 19 nt, Human
uggagugcaauggcgugau

SEQ ID NO: 760992 - RNA, 23 nt, Human
uggagugcaauggcgugaucucg

SEQ ID NO: 760993 - RNA, 24 nt, Human
uggagugcaauggcgugaucucgg

SEQ ID NO: 760994 - RNA, 23 nt, Human
uggaucaccugaggucaggaguu

SEQ ID NO: 760995 - RNA, 26 nt, Human
uggaucaccugaggucaggaguugag

SEQ ID NO: 760996 - RNA, 20 nt, Human
uggcaacauccacaaguuuu

SEQ ID NO: 760997 - RNA, 23 nt, Human
uggcaacauccacaaguuuuaau

SEQ ID NO: 760998 - RNA, 24 nt, Human
uggcagggcuggggaagcaggcag

SEQ ID NO: 760999 - RNA, 24 nt, Human
uggccaacauggugaaaccccauc

SEQ ID NO: 761000 - RNA, 23 nt, Human
uggcccggccugcaaaaccuggc

SEQ ID NO: 761001 - RNA, 22 nt, Human
uggcgggcgccuguaaucccag

SEQ ID NO: 761002 - RNA, 20 nt, Human
uggcgugaucucggcucacu

SEQ ID NO: 761003 - RNA, 22 nt, Human
uggcucacgccugcaaucccag

SEQ ID NO: 761004 - RNA, 24 nt, Human
uggcucacgccugcaaucccagca

SEQ ID NO: 761005 - RNA, 20 nt, Human
uggcuugaacccgggaggca

SEQ ID NO: 761006 - RNA, 21 nt, Human
ugggacuacaggcacgagcca

SEQ ID NO: 761007 - RNA, 22 nt, Human
ugggacuacaggcacgagccac

SEQ ID NO: 761008 - RNA, 23 nt, Human
ugggacuacaggcacgagccacc

SEQ ID NO: 761009 - RNA, 24 nt, Human
ugggacuacaggcacgagccaccg

SEQ ID NO: 761010 - RNA, 26 nt, Human
ugggacuacaggcacgagccaccggg

SEQ ID NO: 761011 - RNA, 24 nt, Human
ugggaggccgaggcagguggauca

SEQ ID NO: 761012 - RNA, 19 nt, Human
ugggauuacaggcgcauca

SEQ ID NO: 761013 - RNA, 24 nt, Human
ugggauuacaggcgcaugugacca

SEQ ID NO: 761014 - RNA, 24 nt, Human
uggucaggcuggucucaaacuccu

SEQ ID NO: 761015 - RNA, 24 nt, Human
ugguggcgggcgccuguaauccca

SEQ ID NO: 761016 - RNA, 24 nt, Human
ugguggcucacgccugcaauccca

SEQ ID NO: 761017 - RNA, 21 nt, Human
uggugucaaccuguacagaga

SEQ ID NO: 761018 - RNA, 24 nt, Human
uggugugguggcgggcgccuguaa

SEQ ID NO: 761019 - RNA, 23 nt, Human
uguaauaaaguucuuuucuagga

SEQ ID NO: 761020 - RNA, 19 nt, Human
ugugguggcgggcgccugu

SEQ ID NO: 761021 - RNA, 24 nt, Human
uguguauaucuuacuguagcacau

SEQ ID NO: 761022 - RNA, 20 nt, Human
uguugcccaggcuggagugc

SEQ ID NO: 761023 - RNA, 24 nt, Human
uuaaacuggcuauaauuucaugga

SEQ ID NO: 761024 - RNA, 23 nt, Human
uuaccuccuuaacuucugguugc

SEQ ID NO: 761025 - RNA, 24 nt, Human
uuagcggagaugagguuucaccau

SEQ ID NO: 761026 - RNA, 21 nt, Human
uucagaagcaggguccacaga

SEQ ID NO: 761027 - RNA, 23 nt, Human
uucaggacaccccaggcuuuucu

SEQ ID NO: 761028 - RNA, 23 nt, Human
uuccaaucccaauguguagagcu

SEQ ID NO: 761029 - RNA, 22 nt, Human
uucccacauuuagcaguaguaa

SEQ ID NO: 761030 - RNA, 18 nt, Human
uugcagugagccgagacu

SEQ ID NO: 761031 - RNA, 19 nt, Human
uugcagugagccgagacug

SEQ ID NO: 761032 - RNA, 22 nt, Human
uugcagugagccgagacugugc

SEQ ID NO: 761033 - RNA, 18 nt, Human
uugcccaggcuggagugc

SEQ ID NO: 761034 - RNA, 18 nt, Human
uugcuccuuuuuguguca

SEQ ID NO: 761035 - RNA, 23 nt, Human
uugcucuuguugcccaggcugga

SEQ ID NO: 761036 - RNA, 25 nt, Human
uugggaggccgaggcagguggauca

SEQ ID NO: 761037 - RNA, 18 nt, Human
uuuaaacauaugaaguga

SEQ ID NO: 761038 - RNA, 19 nt, Human
uuuacauaaccacaaugcu

SEQ ID NO: 761039 - RNA, 21 nt, Human
uuucaccaugauggucaggcu

SEQ ID NO: 761040 - RNA, 20 nt, Human
uuugacugaugucucaaguc

SEQ ID NO: 761041 - RNA, 24 nt, Human
uuugcucuuguugcccaggcugga

SEQ ID NO: 761042 - RNA, 24 nt, Human
uuuuacaaaaaaacaccauuugaa

SEQ ID NO: 761043 - RNA, 24 nt, Human
uuuugcucuuguugcccaggcugg

SEQ ID NO: 761044 - RNA, 24 nt, Human
uuuuuagcggagaugagguuucac

SEQ ID NO: 761045 - RNA, 22 nt, Human
uuuuuuucuuugagauagaguu

SEQ ID NO: 761046 - RNA, 22 nt, Human
aacuugcuauaaauacauagaa

SEQ ID NO: 761047 - RNA, 22 nt, Human
acauagaaaccgcaggcgccac

SEQ ID NO: 761048 - RNA, 21 nt, Human
acccggagccccuuccuacuu

SEQ ID NO: 761049 - RNA, 23 nt, Human
agcaguggucaggggaccuuggc

SEQ ID NO: 761050 - RNA, 18 nt, Human
agggcccugccacgcccc

SEQ ID NO: 761051 - RNA, 21 nt, Human
agggcuccucugagcaguggu

SEQ ID NO: 761052 - RNA, 23 nt, Human
agugggccccgccagggcugacc

SEQ ID NO: 761053 - RNA, 19 nt, Human
caaggguuugggcccacug

SEQ ID NO: 761054 - RNA, 21 nt, Human
cacccugccagcuccgcggcc

SEQ ID NO: 761055 - RNA, 24 nt, Human
caccugggguuuccugaguuucua

SEQ ID NO: 761056 - RNA, 19 nt, Human
cagagcagccacccggagc

SEQ ID NO: 761057 - RNA, 19 nt, Human
caggacccggggccgccgg

SEQ ID NO: 761058 - RNA, 22 nt, Human
caggcgccacccugccagcucc

SEQ ID NO: 761059 - RNA, 23 nt, Human
ccacgccccggcccccagcuguc

SEQ ID NO: 761060 - RNA, 21 nt, Human
ccagucccagagcagccaccc

SEQ ID NO: 761061 - RNA, 18 nt, Human
ccccacggagcccccgag

SEQ ID NO: 761062 - RNA, 26 nt, Human
ccccacggagcccccgagacgcgggg

SEQ ID NO: 761063 - RNA, 23 nt, Human
cccgguuucacggauuucaaggg

SEQ ID NO: 761064 - RNA, 20 nt, Human
ccgcaggcgccacccugccg

SEQ ID NO: 761065 - RNA, 26 nt, Human
ccggagccccuuccuacuuaggaaag

SEQ ID NO: 761066 - RNA, 18 nt, Human
ccucgcagcugccgccgc

SEQ ID NO: 761067 - RNA, 19 nt, Human
ccucgcagcugccgccgcu

SEQ ID NO: 761068 - RNA, 20 nt, Human
ccuuggcccugcuccccacc

SEQ ID NO: 761069 - RNA, 18 nt, Human
ccuuuacauauguacauc

SEQ ID NO: 761070 - RNA, 24 nt, Human
cgccuguuucuccgagccucgcag

SEQ ID NO: 761071 - RNA, 26 nt, Human
cggagcccccgagacgcggggcccug

SEQ ID NO: 761072 - RNA, 20 nt, Human
cggccuggggccugggagag

SEQ ID NO: 761073 - RNA, 21 nt, Human
cggccuggggccugggagagg

SEQ ID NO: 761074 - RNA, 20 nt, Human
cggcgccuguuucuccgagc

SEQ ID NO: 761075 - RNA, 21 nt, Human
cgugguggcggcgguggcggc

SEQ ID NO: 761076 - RNA, 20 nt, Human
cugcggccagggccuagggc

SEQ ID NO: 761077 - RNA, 22 nt, Human
cugggguuuccugaguuucuag

SEQ ID NO: 761078 - RNA, 21 nt, Human
gagcaccugggguuuccugag

SEQ ID NO: 761079 - RNA, 25 nt, Human
gagcccgcggcgccuguuucuccga

SEQ ID NO: 761080 - RNA, 21 nt, Human
gccuagggcuccucugagcag

SEQ ID NO: 761081 - RNA, 21 nt, Human
gcgcggagcccgcggcgccug

SEQ ID NO: 761082 - RNA, 18 nt, Human
gcggcaggcggggugggg

SEQ ID NO: 761083 - RNA, 20 nt, Human
ggacuccaggacccggggcc

SEQ ID NO: 761084 - RNA, 21 nt, Human
ggaggagaggcacagagaggg

SEQ ID NO: 761085 - RNA, 21 nt, Human
ggccagggccuagggcuccuc

SEQ ID NO: 761086 - RNA, 18 nt, Human
ggcccugagcaccugggg

SEQ ID NO: 761087 - RNA, 23 nt, Human
ggcgggacuccaggacccggggc

SEQ ID NO: 761088 - RNA, 22 nt, Human
gggcagcaggcggcgggacucc

SEQ ID NO: 761089 - RNA, 19 nt, Human
gggcugggggagggagaau

SEQ ID NO: 761090 - RNA, 19 nt, Human
ggggucagggaagggcugg

SEQ ID NO: 761091 - RNA, 20 nt, Human
ggggucagggaagggcuggg

SEQ ID NO: 761092 - RNA, 18 nt, Human
guccggccgggcgcggag

SEQ ID NO: 761093 - RNA, 23 nt, Human
guggcggcgguggcggcagcauc

SEQ ID NO: 761094 - RNA, 24 nt, Human
gugggccccgccagggcugaccag

SEQ ID NO: 761095 - RNA, 25 nt, Human
gugguggcggcgguggcggcagcaa

SEQ ID NO: 761096 - RNA, 22 nt, Human
uaacuuaggggucagggaaggg

SEQ ID NO: 761097 - RNA, 20 nt, Human
uaggggucagggaagggcug

SEQ ID NO: 761098 - RNA, 20 nt, Human
ucacuuccggguuucgggcc

SEQ ID NO: 761099 - RNA, 23 nt, Human
ucagaacuugcuauaaauacaua

SEQ ID NO: 761100 - RNA, 21 nt, Human
ucagggaagggcugggggagg

SEQ ID NO: 761101 - RNA, 22 nt, Human
ucccagagcagccacccggagc

SEQ ID NO: 761102 - RNA, 23 nt, Human
ucccagagcagccacccggagcc

SEQ ID NO: 761103 - RNA, 22 nt, Human
uccgugguggcggcgguggcuu

SEQ ID NO: 761104 - RNA, 18 nt, Human
uccugaguuucuagcucu

SEQ ID NO: 761105 - RNA, 25 nt, Human
ucgcagcugccgccgcucacuuccg

SEQ ID NO: 761106 - RNA, 19 nt, Human
ucgcuccgugguggcggcg

SEQ ID NO: 761107 - RNA, 27 nt, Human
ucgcuccgugguggcggcgguggcggc

SEQ ID NO: 761108 - RNA, 20 nt, Human
ucggccgggcagcaggcggc

SEQ ID NO: 761109 - RNA, 22 nt, Human
ugaaggcacugcggccagggcc

SEQ ID NO: 761110 - RNA, 21 nt, Human
ugagcaccugggguuuccuga

SEQ ID NO: 761111 - RNA, 22 nt, Human
ugagugggccccgccagggcug

SEQ ID NO: 761112 - RNA, 23 nt, Human
ugcuccuaggggagaaacggucc

SEQ ID NO: 761113 - RNA, 20 nt, Human
uggcggcgguggcggcagca

SEQ ID NO: 761114 - RNA, 19 nt, Human
ugggagaggugagcgggca

SEQ ID NO: 761115 - RNA, 19 nt, Human
ugggggagggagaauugca

SEQ ID NO: 761116 - RNA, 24 nt, Human
ugggguccucggccgggcagcagg

SEQ ID NO: 761117 - RNA, 22 nt, Human
uguccugagugggccccgccag

SEQ ID NO: 761118 - RNA, 19 nt, Human
aaacucagaggcugggcag

SEQ ID NO: 761119 - RNA, 21 nt, Human
aaagagaaaaacauaagaaug

SEQ ID NO: 761120 - RNA, 20 nt, Human
aaauauaugcuauucacaca

SEQ ID NO: 761121 - RNA, 19 nt, Human
aaaucguuucuuuccuccu

SEQ ID NO: 761122 - RNA, 20 nt, Human
aacagaaaacucagaggcug

SEQ ID NO: 761123 - RNA, 19 nt, Human
aacaugccugugagguagg

SEQ ID NO: 761124 - RNA, 19 nt, Human
aacaugccugugagguagg

SEQ ID NO: 761125 - RNA, 19 nt, Human
aacgaguaaaaagaccgca

SEQ ID NO: 761126 - RNA, 24 nt, Human
aagagaaaaacauaagaaugaaaa

SEQ ID NO: 761127 - RNA, 21 nt, Human
aagccaaauugugagcccuug

SEQ ID NO: 761128 - RNA, 18 nt, Human
aaggaagaaggggcugga

SEQ ID NO: 761129 - RNA, 24 nt, Human
aaggucacagacggcggccaagcu

SEQ ID NO: 761130 - RNA, 22 nt, Human
aauaaaagggcaggagucugga

SEQ ID NO: 761131 - RNA, 25 nt, Human
aaucuucauaaccuaaagcugggag

SEQ ID NO: 761132 - RNA, 19 nt, Human
acacccgccuccugccagg

SEQ ID NO: 761133 - RNA, 22 nt, Human
acaggcacaggaaacacggcaa

SEQ ID NO: 761134 - RNA, 22 nt, Human
acauacagacaccgccgcccgc

SEQ ID NO: 761135 - RNA, 25 nt, Human
accgcagagagggcugagacccaga

SEQ ID NO: 761136 - RNA, 18 nt, Human
accgccgcccgccccucg

SEQ ID NO: 761137 - RNA, 20 nt, Human
accuaaagcugggagggacc

SEQ ID NO: 761138 - RNA, 24 nt, Human
agaauaaccauagcaaaaggucac

SEQ ID NO: 761139 - RNA, 19 nt, Human
agagagggcugagacccag

SEQ ID NO: 761140 - RNA, 19 nt, Human
agaggcugggcagaugggc

SEQ ID NO: 761141 - RNA, 20 nt, Human
agcagccccucagguacuga

SEQ ID NO: 761142 - RNA, 23 nt, Human
agcucaggagcgggcacuggacc

SEQ ID NO: 761143 - RNA, 22 nt, Human
aggaagcagcuugggacagggg

SEQ ID NO: 761144 - RNA, 23 nt, Human
aggcacacagaggucaagugacu

SEQ ID NO: 761145 - RNA, 24 nt, Human
aggccccaagguuccuggcagagg

SEQ ID NO: 761146 - RNA, 18 nt, Human
agggcuggcacacacauc

SEQ ID NO: 761147 - RNA, 20 nt, Human
aggugccccgagagccagcg

SEQ ID NO: 761148 - RNA, 23 nt, Human
aguaaaaucuucauaaccuaaag

SEQ ID NO: 761149 - RNA, 25 nt, Human
auagagcagccccucagguacugag

SEQ ID NO: 761150 - RNA, 22 nt, Human
auggcaggugcccaaggcugcc

SEQ ID NO: 761151 - RNA, 22 nt, Human
caaggccccaagguuccuggca

SEQ ID NO: 761152 - RNA, 24 nt, Human
caaggccccaagguuccuggcaga

SEQ ID NO: 761153 - RNA, 20 nt, Human
caagugacuugcccaagguc

SEQ ID NO: 761154 - RNA, 22 nt, Human
cacaacaugccugugagguagg

SEQ ID NO: 761155 - RNA, 18 nt, Human
cacagcauagagcagccc

SEQ ID NO: 761156 - RNA, 23 nt, Human
cacuggaccgagggcuggcacac

SEQ ID NO: 761157 - RNA, 22 nt, Human
cagacaccgccgcccgccccuc

SEQ ID NO: 761158 - RNA, 24 nt, Human
cagcaagaggaaaaaaaaaguuuu

SEQ ID NO: 761159 - RNA, 18 nt, Human
cagcauagagcagccccu

SEQ ID NO: 761160 - RNA, 20 nt, Human
caucuuguaaacaagcuagu

SEQ ID NO: 761161 - RNA, 23 nt, Human
cauggcaggugcccaaggcugcc

SEQ ID NO: 761162 - RNA, 20 nt, Human
cccccugcagcaagcgccag

SEQ ID NO: 761163 - RNA, 20 nt, Human
cccccugcagcaagcgccag

SEQ ID NO: 761164 - RNA, 21 nt, Human
ccccggcccccgccccggcuc

SEQ ID NO: 761165 - RNA, 24 nt, Human
ccccuaccccgcccugcaggcccc

SEQ ID NO: 761166 - RNA, 21 nt, Human
ccccugcagcaagcgccagcc

SEQ ID NO: 761167 - RNA, 20 nt, Human
ccccugcccuccccuacccc

SEQ ID NO: 761168 - RNA, 20 nt, Human
ccccuggaagccacucggga

SEQ ID NO: 761169 - RNA, 22 nt, Human
cccgccuccugccaggugcccc

SEQ ID NO: 761170 - RNA, 18 nt, Human
cccgcucugccguuccgc

SEQ ID NO: 761171 - RNA, 24 nt, Human
cccggcccccgccccggcuccggc

SEQ ID NO: 761172 - RNA, 19 nt, Human
cccugcaggcccgggccau

SEQ ID NO: 761173 - RNA, 28 nt, Human
cccugcccuccccuaccccgcccugcag

SEQ ID NO: 761174 - RNA, 24 nt, Human
ccgcagagagggcugagacccaga

SEQ ID NO: 761175 - RNA, 18 nt, Human
ccgccccggcuccggccc

SEQ ID NO: 761176 - RNA, 23 nt, Human
ccgccgcccgccccucgggcacc

SEQ ID NO: 761177 - RNA, 19 nt, Human
ccgcugcgccgccgccgcc

SEQ ID NO: 761178 - RNA, 22 nt, Human
ccgcugcgccgccgccgccucu

SEQ ID NO: 761179 - RNA, 25 nt, Human
ccguuccgcugcgccgccgccgccu

SEQ ID NO: 761180 - RNA, 24 nt, Human
ccuccugccaggugccccgagagc

SEQ ID NO: 761181 - RNA, 24 nt, Human
ccucgggcaccggacacaggcgcg

SEQ ID NO: 761182 - RNA, 19 nt, Human
ccugacacugcccagggcu

SEQ ID NO: 761183 - RNA, 19 nt, Human
ccuggggacgggggggggg

SEQ ID NO: 761184 - RNA, 21 nt, Human
cgcauacacagcauagagcag

SEQ ID NO: 761185 - RNA, 18 nt, Human
cggcggcggcgcugggug

SEQ ID NO: 761186 - RNA, 20 nt, Human
cggggcugagccccugcccu

SEQ ID NO: 761187 - RNA, 23 nt, Human
cgggggcaggagagagagaagga

SEQ ID NO: 761188 - RNA, 18 nt, Human
cgggugccugcgccgggc

SEQ ID NO: 761189 - RNA, 24 nt, Human
cuaggccccggcccccgccccggc

SEQ ID NO: 761190 - RNA, 20 nt, Human
cuauccaaccagggagcuac

SEQ ID NO: 761191 - RNA, 23 nt, Human
cucccgggcggcagcuccgaccc

SEQ ID NO: 761192 - RNA, 23 nt, Human
cucugaagggaaaagagaaaaac

SEQ ID NO: 761193 - RNA, 21 nt, Human
cugggagugggaugcgggggc

SEQ ID NO: 761194 - RNA, 22 nt, Human
cuuguacacacaccuagauaua

SEQ ID NO: 761195 - RNA, 18 nt, Human
gagccccugcccuccccu

SEQ ID NO: 761196 - RNA, 23 nt, Human
gagcggggauagcuggggaaagg

SEQ ID NO: 761197 - RNA, 19 nt, Human
gaguccugccugacacugc

SEQ ID NO: 761198 - RNA, 19 nt, Human
gaugggcccuuaggagugc

SEQ ID NO: 761199 - RNA, 18 nt, Human
gcagaggggaggcacggg

SEQ ID NO: 761200 - RNA, 25 nt, Human
gccccgagagccagcggcggcggcg

SEQ ID NO: 761201 - RNA, 22 nt, Human
gccgggcgccucggccgccucc

SEQ ID NO: 761202 - RNA, 22 nt, Human
gccuaggccccggcccccgccc

SEQ ID NO: 761203 - RNA, 20 nt, Human
gcggcggcgcugggugggca

SEQ ID NO: 761204 - RNA, 20 nt, Human
ggacacaggcgcggcugagg

SEQ ID NO: 761205 - RNA, 25 nt, Human
ggagagagagaaggauaauuggggu

SEQ ID NO: 761206 - RNA, 24 nt, Human
ggaggaaguugaggcacacagagg

SEQ ID NO: 761207 - RNA, 23 nt, Human
ggagugcggggcggggggagggg

SEQ ID NO: 761208 - RNA, 19 nt, Human
ggagugggaugcgggggca

SEQ ID NO: 761209 - RNA, 19 nt, Human
ggcagaggggaggcacggg

SEQ ID NO: 761210 - RNA, 18 nt, Human
gggagugggaugcggggg

SEQ ID NO: 761211 - RNA, 23 nt, Human
gggaugcgggggcaggagagaga

SEQ ID NO: 761212 - RNA, 21 nt, Human
gggcaggagagagagaaggau

SEQ ID NO: 761213 - RNA, 20 nt, Human
gggcaggagucuggagugug

SEQ ID NO: 761214 - RNA, 21 nt, Human
gggcaugggugagcagauggg

SEQ ID NO: 761215 - RNA, 19 nt, Human
gggccgggaguugccgacg

SEQ ID NO: 761216 - RNA, 20 nt, Human
gggccgggaguugccgacgu

SEQ ID NO: 761217 - RNA, 19 nt, Human
ggggcaggagagagagaag

SEQ ID NO: 761218 - RNA, 19 nt, Human
gggggagggaggggacgca

SEQ ID NO: 761219 - RNA, 20 nt, Human
gggggagggggguggagacc

SEQ ID NO: 761220 - RNA, 23 nt, Human
gguacugagcuggcuucggggcu

SEQ ID NO: 761221 - RNA, 22 nt, Human
ggucacacacaaggccccaagg

SEQ ID NO: 761222 - RNA, 22 nt, Human
guaaaaucuucauaaccuaaag

SEQ ID NO: 761223 - RNA, 22 nt, Human
gugacacccugggagugggaug

SEQ ID NO: 761224 - RNA, 23 nt, Human
gugcggggcggggggaggggggu

SEQ ID NO: 761225 - RNA, 19 nt, Human
gugugugcgcgugagguug

SEQ ID NO: 761226 - RNA, 20 nt, Human
uacacagcauagagcagccc

SEQ ID NO: 761227 - RNA, 19 nt, Human
uacaggcacaggaaacacg

SEQ ID NO: 761228 - RNA, 18 nt, Human
uaugugcauauguacaca

SEQ ID NO: 761229 - RNA, 22 nt, Human
uaugugcauauguacacauaca

SEQ ID NO: 761230 - RNA, 25 nt, Human
uaugugcauauguacacauacauac

SEQ ID NO: 761231 - RNA, 22 nt, Human
uccaaccagggagcuacaggca

SEQ ID NO: 761232 - RNA, 22 nt, Human
uccaccacggccagcaagagga

SEQ ID NO: 761233 - RNA, 21 nt, Human
ucccgggccgagggcaggggc

SEQ ID NO: 761234 - RNA, 20 nt, Human
ucucucuguccucugggccc

SEQ ID NO: 761235 - RNA, 18 nt, Human
ugaaggaagaaggggcug

SEQ ID NO: 761236 - RNA, 19 nt, Human
ugaaggaagaaggggcugg

SEQ ID NO: 761237 - RNA, 21 nt, Human
ugaaggaagaaggggcuggag

SEQ ID NO: 761238 - RNA, 19 nt, Human
ugacacccugggaguggga

SEQ ID NO: 761239 - RNA, 18 nt, Human
ugagccccugcccucccc

SEQ ID NO: 761240 - RNA, 21 nt, Human
ugaguaaaaucuucauaaccu

SEQ ID NO: 761241 - RNA, 19 nt, Human
ugcauauguacacauacau

SEQ ID NO: 761242 - RNA, 18 nt, Human
ugccaggugccccgagag

SEQ ID NO: 761243 - RNA, 20 nt, Human
ugcgccgccgccgccucucg

SEQ ID NO: 761244 - RNA, 22 nt, Human
ugcgccgggcgccucggccgcc

SEQ ID NO: 761245 - RNA, 21 nt, Human
ugcgugugugugugugcgcgu

SEQ ID NO: 761246 - RNA, 22 nt, Human
ugcgugugugugugugcgcgug

SEQ ID NO: 761247 - RNA, 21 nt, Human
ugcuuacacacaagguauaua

SEQ ID NO: 761248 - RNA, 22 nt, Human
uggaagccacucgggaguccua

SEQ ID NO: 761249 - RNA, 21 nt, Human
uggcucagggucucuagacag

SEQ ID NO: 761250 - RNA, 24 nt, Human
ugggcccucaaccgcagagagggc

SEQ ID NO: 761251 - RNA, 20 nt, Human
uggggacggggggggggucc

SEQ ID NO: 761252 - RNA, 23 nt, Human
uggggacgggggggggguccccc

SEQ ID NO: 761253 - RNA, 23 nt, Human
ugggugagcagaugggcguuugu

SEQ ID NO: 761254 - RNA, 26 nt, Human
uguacacauacauacagacaccgccg

SEQ ID NO: 761255 - RNA, 19 nt, Human
uguccaucucucuguccuc

SEQ ID NO: 761256 - RNA, 20 nt, Human
uguccucugggcccucaacc

SEQ ID NO: 761257 - RNA, 22 nt, Human
ugugcgcgugagguugugugug

SEQ ID NO: 761258 - RNA, 24 nt, Human
uuacacacacuuguacacacaccu

SEQ ID NO: 761259 - RNA, 23 nt, Human
uucgcacuuaguuuuuguguuuu

SEQ ID NO: 761260 - RNA, 23 nt, Human
uugcccaaggucacagacggcgg

SEQ ID NO: 761261 - RNA, 18 nt, Human
agagggugggugggagag

SEQ ID NO: 761262 - RNA, 20 nt, Human
gcagaggaggugccgcccgc

SEQ ID NO: 761263 - RNA, 18 nt, Human
gggugggugggagagugg

SEQ ID NO: 761264 - RNA, 20 nt, Human
ggugggagaguggaaggggc

SEQ ID NO: 761265 - RNA, 22 nt, Human
uccaaggcaggacagggcagga

SEQ ID NO: 761266 - RNA, 24 nt, Human
uuaccugcagaggaggugccgccc

SEQ ID NO: 761267 - RNA, 22 nt, Human
uugaauacucuauauaguaaac

SEQ ID NO: 761268 - RNA, 22 nt, Human
aaaaaaagagagagggaaagaa

SEQ ID NO: 761269 - RNA, 31 nt, Human
aaaaaagaagacccacccuaacaaaaaaaaa

SEQ ID NO: 761270 - RNA, 23 nt, Human
aaaaaagagagagggaaagaaaa

SEQ ID NO: 761271 - RNA, 20 nt, Human
aaaaaagagagagggaaagg

SEQ ID NO: 761272 - RNA, 19 nt, Human
aaaagaaauucuucagaga

SEQ ID NO: 761273 - RNA, 19 nt, Human
aaaagaaauucuucagaga

SEQ ID NO: 761274 - RNA, 24 nt, Human
aaaagaagacccacccuaacaaaa

SEQ ID NO: 761275 - RNA, 18 nt, Human
aaaauuagccuauaccag

SEQ ID NO: 761276 - RNA, 23 nt, Human
aaacauacaguauauuauaguga

SEQ ID NO: 761277 - RNA, 19 nt, Human
aaaugccaaccucagcaag

SEQ ID NO: 761278 - RNA, 20 nt, Human
aagaaaaaaagaagacccac

SEQ ID NO: 761279 - RNA, 24 nt, Human
aaggugauauguuugguaguguau

SEQ ID NO: 761280 - RNA, 23 nt, Human
aauuguuuucuccucugcacuaa

SEQ ID NO: 761281 - RNA, 21 nt, Human
acaaaugcaagcucacaaaac

SEQ ID NO: 761282 - RNA, 22 nt, Human
acaugcccauucuauuauaaaa

SEQ ID NO: 761283 - RNA, 18 nt, Human
acccuauacauaagagau

SEQ ID NO: 761284 - RNA, 19 nt, Human
accuaacaauauaagcacu

SEQ ID NO: 761285 - RNA, 22 nt, Human
acuguuguuucuggggaagguu

SEQ ID NO: 761286 - RNA, 18 nt, Human
agaaaacaaucgcaauca

SEQ ID NO: 761287 - RNA, 21 nt, Human
agaaaacaaucgcaaucacug

SEQ ID NO: 761288 - RNA, 21 nt, Human
agaaagcagcuugaaguuuac

SEQ ID NO: 761289 - RNA, 19 nt, Human
aggcaagauguacaaugug

SEQ ID NO: 761290 - RNA, 19 nt, Human
aggugguaaagauuucagc

SEQ ID NO: 761291 - RNA, 23 nt, Human
auauauguauguguauacccuua

SEQ ID NO: 761292 - RNA, 21 nt, Human
caaaauucagucugaucaucc

SEQ ID NO: 761293 - RNA, 22 nt, Human
caaaauucuccauuuccuuuuc

SEQ ID NO: 761294 - RNA, 23 nt, Human
caacauuaaccacaugcaaucaa

SEQ ID NO: 761295 - RNA, 22 nt, Human
cacagaucauuugacauaaaac

SEQ ID NO: 761296 - RNA, 21 nt, Human
cacccuaacaaaaaaaacaaa

SEQ ID NO: 761297 - RNA, 21 nt, Human
cccacccuaacaaaaaaaaca

SEQ ID NO: 761298 - RNA, 23 nt, Human
cccacccuaacaaaaaaaacaaa

SEQ ID NO: 761299 - RNA, 19 nt, Human
cucacaaaugcaagcucac

SEQ ID NO: 761300 - RNA, 20 nt, Human
gaauucugauggugguggca

SEQ ID NO: 761301 - RNA, 20 nt, Human
gacagaagugcuuaauaauc

SEQ ID NO: 761302 - RNA, 20 nt, Human
gacauuuacuaucaaaaaua

SEQ ID NO: 761303 - RNA, 25 nt, Human
gagaagcagcagaaacuuaugggag

SEQ ID NO: 761304 - RNA, 19 nt, Human
gcacuagauugcuuucaca

SEQ ID NO: 761305 - RNA, 22 nt, Human
ggaguucuucaaaauuagccua

SEQ ID NO: 761306 - RNA, 21 nt, Human
ggauaacagaugugcuaaaac

SEQ ID NO: 761307 - RNA, 19 nt, Human
gggaaagaaaaaaagaagg

SEQ ID NO: 761308 - RNA, 21 nt, Human
guauacccuuauacacauaca

SEQ ID NO: 761309 - RNA, 19 nt, Human
gugguggcagcaguuaugg

SEQ ID NO: 761310 - RNA, 18 nt, Human
guguauguauguaauaua

SEQ ID NO: 761311 - RNA, 22 nt, Human
guuaaaaaaagagagagggaaa

SEQ ID NO: 761312 - RNA, 18 nt, Human
guuucuaagccccuccag

SEQ ID NO: 761313 - RNA, 19 nt, Human
guuugauuaugaauucuga

SEQ ID NO: 761314 - RNA, 19 nt, Human
uaaaacaaacagaucaggu

SEQ ID NO: 761315 - RNA, 24 nt, Human
uaaaacaaacagaucagguuauca

SEQ ID NO: 761316 - RNA, 21 nt, Human
uaacaaaaaaaacaaaauuga

SEQ ID NO: 761317 - RNA, 21 nt, Human
uaacaauauaagcacugaaaa

SEQ ID NO: 761318 - RNA, 18 nt, Human
uaacagaugugcuaaaac

SEQ ID NO: 761319 - RNA, 19 nt, Human
uaauaaauuaaaaaagcua

SEQ ID NO: 761320 - RNA, 28 nt, Human
uaauauauacuucuacacuuguuauguu

SEQ ID NO: 761321 - RNA, 24 nt, Human
uaaugaauuaugcaauugcaaagu

SEQ ID NO: 761322 - RNA, 23 nt, Human
uacaguauaugagguaaaaucaa

SEQ ID NO: 761323 - RNA, 23 nt, Human
uacggauaacagaugugcuaaaa

SEQ ID NO: 761324 - RNA, 25 nt, Human
uacuaugaaaaacauaagccacugu

SEQ ID NO: 761325 - RNA, 21 nt, Human
uagaaaguuuuucuauaagaa

SEQ ID NO: 761326 - RNA, 28 nt, Human
uagaguuuuuggaauguacaguauauga

SEQ ID NO: 761327 - RNA, 21 nt, Human
uagcacuagauugcuuucaca

SEQ ID NO: 761328 - RNA, 23 nt, Human
uagccuauaccagacagagugag

SEQ ID NO: 761329 - RNA, 21 nt, Human
uaggaagguguccacuaaaag

SEQ ID NO: 761330 - RNA, 19 nt, Human
uagguauaucagguucaca

SEQ ID NO: 761331 - RNA, 21 nt, Human
uaggugccuuccauugcaaag

SEQ ID NO: 761332 - RNA, 26 nt, Human
uaggugccuuccauugcaaagugagu

SEQ ID NO: 761333 - RNA, 24 nt, Human
uaguacaugacaaaauaaaaugua

SEQ ID NO: 761334 - RNA, 21 nt, Human
uauaaaagcaauacagaaaua

SEQ ID NO: 761335 - RNA, 20 nt, Human
uauaagaaggcauuuguuaa

SEQ ID NO: 761336 - RNA, 18 nt, Human
uauacacauacauauagu

SEQ ID NO: 761337 - RNA, 21 nt, Human
uauaugccauauauguaugug

SEQ ID NO: 761338 - RNA, 26 nt, Human
uauauguauguguauacccuuauaca

SEQ ID NO: 761339 - RNA, 20 nt, Human
uaucagguucacagcucaag

SEQ ID NO: 761340 - RNA, 24 nt, Human
uauggugauaaaauaaauaguuuu

SEQ ID NO: 761341 - RNA, 22 nt, Human
uauguaauauauacuucuacac

SEQ ID NO: 761342 - RNA, 20 nt, Human
uauguguacacuuguuauau

SEQ ID NO: 761343 - RNA, 28 nt, Human
uauguguauacccuuauacacauacaua

SEQ ID NO: 761344 - RNA, 22 nt, Human
ucaaaaauaggaaguucauuug

SEQ ID NO: 761345 - RNA, 20 nt, Human
ucaauagugucaccuuuaag

SEQ ID NO: 761346 - RNA, 19 nt, Human
ucacagcucaaggugguaa

SEQ ID NO: 761347 - RNA, 20 nt, Human
ucagccuuauacaauuuuaa

SEQ ID NO: 761348 - RNA, 22 nt, Human
ucuacacuuguuauguguauau

SEQ ID NO: 761349 - RNA, 21 nt, Human
ucuccauuuccuuuuccuuca

SEQ ID NO: 761350 - RNA, 21 nt, Human
ucuucagagaucuucaaagca

SEQ ID NO: 761351 - RNA, 21 nt, Human
ugacaaaauucuccauuuccu

SEQ ID NO: 761352 - RNA, 23 nt, Human
ugagguaaaaucaagauuacauu

SEQ ID NO: 761353 - RNA, 18 nt, Human
ugcaacauuaaccacaug

SEQ ID NO: 761354 - RNA, 22 nt, Human
ugcuaaaacaagaauuguagau

SEQ ID NO: 761355 - RNA, 22 nt, Human
uggaacaguauccaaacagaca

SEQ ID NO: 761356 - RNA, 30 nt, Human
uggcagcaguuaugggagaagcagcagaag

SEQ ID NO: 761357 - RNA, 19 nt, Human
ugggagaagcagcagaaac

SEQ ID NO: 761358 - RNA, 21 nt, Human
ugggagaagcagcagaaacuu

SEQ ID NO: 761359 - RNA, 21 nt, Human
ugggaguucuucaaaauuagc

SEQ ID NO: 761360 - RNA, 19 nt, Human
uggugauaaaauaaauagu

SEQ ID NO: 761361 - RNA, 20 nt, Human
uggugguggcagcaguuaug

SEQ ID NO: 761362 - RNA, 18 nt, Human
uguagauaguuucauuau

SEQ ID NO: 761363 - RNA, 26 nt, Human
uguauguguauacccuuauacacaua

SEQ ID NO: 761364 - RNA, 18 nt, Human
uguggcacuuuaaagaag

SEQ ID NO: 761365 - RNA, 22 nt, Human
uguguauacccuuauacacaua

SEQ ID NO: 761366 - RNA, 19 nt, Human
uguguauauguguacacuu

SEQ ID NO: 761367 - RNA, 20 nt, Human
uguuuucuccucugcacuaa

SEQ ID NO: 761368 - RNA, 24 nt, Human
uuaguacaugacaaaauaaaaugu

SEQ ID NO: 761369 - RNA, 25 nt, Human
uuaugaauucugauggugguggcag

SEQ ID NO: 761370 - RNA, 21 nt, Human
uuaugauuacuuucuaaaaag

SEQ ID NO: 761371 - RNA, 24 nt, Human
uuccuucaucccauucuaauacaa

SEQ ID NO: 761372 - RNA, 21 nt, Human
uuuuguuucuaagccccucca

SEQ ID NO: 761373 - RNA, 25 nt, Human
aaaaaaaaagacauuuauauccuua

SEQ ID NO: 761374 - RNA, 20 nt, Human
aaaagaaaacugaucuugga

SEQ ID NO: 761375 - RNA, 23 nt, Human
aaacaaaacaagaacaguuauug

SEQ ID NO: 761376 - RNA, 20 nt, Human
aaacauccuguaacagcuuc

SEQ ID NO: 761377 - RNA, 20 nt, Human
aacaaaacaagaacaguuau

SEQ ID NO: 761378 - RNA, 21 nt, Human
aacaacauuuguaaaagcucu

SEQ ID NO: 761379 - RNA, 19 nt, Human
aacacgugcugucguuuuc

SEQ ID NO: 761380 - RNA, 21 nt, Human
aacccaaacaauaagcagauc

SEQ ID NO: 761381 - RNA, 20 nt, Human
aagaaaacugaucuuggaau

SEQ ID NO: 761382 - RNA, 22 nt, Human
aaugucugucucauuaaaugac

SEQ ID NO: 761383 - RNA, 19 nt, Human
acuauuuagucuugcugca

SEQ ID NO: 761384 - RNA, 19 nt, Human
acugacccacgggugugug

SEQ ID NO: 761385 - RNA, 21 nt, Human
agaaaacaccaagagaaaggc

SEQ ID NO: 761386 - RNA, 24 nt, Human
agaaaacaccaagagaaaggcaag

SEQ ID NO: 761387 - RNA, 28 nt, Human
agaaaacaccaagagaaaggcaagacug

SEQ ID NO: 761388 - RNA, 21 nt, Human
agaaagaaaacaccaagagaa

SEQ ID NO: 761389 - RNA, 23 nt, Human
agaaagaggugaaagucacagaa

SEQ ID NO: 761390 - RNA, 25 nt, Human
agaaagcagcauuuaaaaaacagaa

SEQ ID NO: 761391 - RNA, 23 nt, Human
agaauagcggaguacccgaaaaa

SEQ ID NO: 761392 - RNA, 18 nt, Human
agaggcuguucaagagaa

SEQ ID NO: 761393 - RNA, 27 nt, Human
agcaaaugugaccuuauaacuacucau

SEQ ID NO: 761394 - RNA, 22 nt, Human
agcucaauuccauugacaacug

SEQ ID NO: 761395 - RNA, 22 nt, Human
agggaugggcagauaagagcuu

SEQ ID NO: 761396 - RNA, 20 nt, Human
auagauuccaacagcaacau

SEQ ID NO: 761397 - RNA, 18 nt, Human
auaugaagucuuuuagaa

SEQ ID NO: 761398 - RNA, 22 nt, Human
auggcuacauuuuugaagagga

SEQ ID NO: 761399 - RNA, 20 nt, Human
auggugcaaaaacugcuuuc

SEQ ID NO: 761400 - RNA, 20 nt, Human
auugaagcauaagagggaag

SEQ ID NO: 761401 - RNA, 25 nt, Human
caaaugccgcauuuucauagcaagg

SEQ ID NO: 761402 - RNA, 23 nt, Human
cacacaggccaugaaaacaaagc

SEQ ID NO: 761403 - RNA, 24 nt, Human
cacagcuacucugaaaacaaaaau

SEQ ID NO: 761404 - RNA, 21 nt, Human
cacaggccaugaaaacaaagc

SEQ ID NO: 761405 - RNA, 22 nt, Human
cacauagcacagcuacucugaa

SEQ ID NO: 761406 - RNA, 22 nt, Human
caccaagagaaaggcaagacug

SEQ ID NO: 761407 - RNA, 29 nt, Human
caccaagagaaaggcaagacuguuaaaau

SEQ ID NO: 761408 - RNA, 24 nt, Human
caccgaccacaauccuugauauuc

SEQ ID NO: 761409 - RNA, 22 nt, Human
cagaacccaaaucguguacuag

SEQ ID NO: 761410 - RNA, 22 nt, Human
cagcaacaggaagagcuucuac

SEQ ID NO: 761411 - RNA, 19 nt, Human
cagcagcaacaggaagagc

SEQ ID NO: 761412 - RNA, 22 nt, Human
caggauccauguagcagagcuu

SEQ ID NO: 761413 - RNA, 20 nt, Human
caguuuaauuaaaaaacuac

SEQ ID NO: 761414 - RNA, 22 nt, Human
cauacaaacaucaagucuuaga

SEQ ID NO: 761415 - RNA, 19 nt, Human
cauauuuaugugugugugu

SEQ ID NO: 761416 - RNA, 22 nt, Human
cauauuuauguguguguguguu

SEQ ID NO: 761417 - RNA, 20 nt, Human
ccacacguaauccauuucca

SEQ ID NO: 761418 - RNA, 23 nt, Human
cccaaacaauaagcagaucugga

SEQ ID NO: 761419 - RNA, 18 nt, Human
cccuuuaaggauggcuac

SEQ ID NO: 761420 - RNA, 24 nt, Human
cgaaaaagaaaacugaucuuggaa

SEQ ID NO: 761421 - RNA, 21 nt, Human
cuaaagcacucauuccaauaa

SEQ ID NO: 761422 - RNA, 24 nt, Human
cugagcagaacccaaaucguguac

SEQ ID NO: 761423 - RNA, 20 nt, Human
cugggagaaagaaagaaaaa

SEQ ID NO: 761424 - RNA, 19 nt, Human
cuucacuucuuuuacuugg

SEQ ID NO: 761425 - RNA, 24 nt, Human
gaaaacaaaaauaaacaaaacaag

SEQ ID NO: 761426 - RNA, 19 nt, Human
gaaaauuuucagacaugaa

SEQ ID NO: 761427 - RNA, 20 nt, Human
gagaaaggagucaucuuaau

SEQ ID NO: 761428 - RNA, 19 nt, Human
gagccaaagaaacaacuua

SEQ ID NO: 761429 - RNA, 18 nt, Human
gcaacaaacauccuguaa

SEQ ID NO: 761430 - RNA, 19 nt, Human
gcaggauguucucucaugg

SEQ ID NO: 761431 - RNA, 23 nt, Human
ggccaugaaaacaaagcuuuaac

SEQ ID NO: 761432 - RNA, 18 nt, Human
gguggcuugaacccaaac

SEQ ID NO: 761433 - RNA, 21 nt, Human
guaacugacccacgggugugu

SEQ ID NO: 761434 - RNA, 19 nt, Human
gugagacgauacuaacaaa

SEQ ID NO: 761435 - RNA, 20 nt, Human
uaaaaaaaugucugucucau

SEQ ID NO: 761436 - RNA, 18 nt, Human
uaaccuggaaauuaaaua

SEQ ID NO: 761437 - RNA, 20 nt, Human
uaagaaagcuuuaacuguga

SEQ ID NO: 761438 - RNA, 19 nt, Human
uaagagaaaggagucaucu

SEQ ID NO: 761439 - RNA, 22 nt, Human
uacccgaaaaagaaaacugauc

SEQ ID NO: 761440 - RNA, 23 nt, Human
uacuuggccucugcagauauucc

SEQ ID NO: 761441 - RNA, 23 nt, Human
uagcaaaaaaggauuaaagcuga

SEQ ID NO: 761442 - RNA, 27 nt, Human
uagcaucauauuucuccccagagacac

SEQ ID NO: 761443 - RNA, 23 nt, Human
uagcggaguacccgaaaaagaaa

SEQ ID NO: 761444 - RNA, 24 nt, Human
uagcuucaaaaccuaauuuuaaaa

SEQ ID NO: 761445 - RNA, 25 nt, Human
ucaaagaaaacaguaacuaaagcac

SEQ ID NO: 761446 - RNA, 22 nt, Human
ucacacaggccaugaaaacaaa

SEQ ID NO: 761447 - RNA, 21 nt, Human
ucacaugaaaacccauugcau

SEQ ID NO: 761448 - RNA, 18 nt, Human
ucacauucuucacuucuc

SEQ ID NO: 761449 - RNA, 21 nt, Human
ucacuucuacuagugaaaaag

SEQ ID NO: 761450 - RNA, 22 nt, Human
ucaguucccuuuaaggauggcu

SEQ ID NO: 761451 - RNA, 22 nt, Human
uccucuaaauggugcaaaaacu

SEQ ID NO: 761452 - RNA, 21 nt, Human
ucuacacugcauugauaguuu

SEQ ID NO: 761453 - RNA, 19 nt, Human
ucuuagauuuacuacugcu

SEQ ID NO: 761454 - RNA, 18 nt, Human
ugaaaaagaacacgugcu

SEQ ID NO: 761455 - RNA, 30 nt, Human
ugaaaacaaaaauaaacaaaacaagaacag

SEQ ID NO: 761456 - RNA, 19 nt, Human
ugaggggagauggguagca

SEQ ID NO: 761457 - RNA, 20 nt, Human
ugaggucagagagaaagccu

SEQ ID NO: 761458 - RNA, 23 nt, Human
ugauggcaugaucuuaugcaucu

SEQ ID NO: 761459 - RNA, 18 nt, Human
uggaaaagucuugguggu

SEQ ID NO: 761460 - RNA, 21 nt, Human
uggaaaagucuuggugguaga

SEQ ID NO: 761461 - RNA, 21 nt, Human
uggaaugaggucagagagaaa

SEQ ID NO: 761462 - RNA, 24 nt, Human
uggaaugaggucagagagaaagcc

SEQ ID NO: 761463 - RNA, 18 nt, Human
uggcaugaucuuaugcau

SEQ ID NO: 761464 - RNA, 23 nt, Human
uggcaugaucuuaugcaucuacu

SEQ ID NO: 761465 - RNA, 18 nt, Human
ugggagaaagaaagaaaa

SEQ ID NO: 761466 - RNA, 19 nt, Human
uguagugcugauuucugau

SEQ ID NO: 761467 - RNA, 20 nt, Human
uguccaaagucuacacugca

SEQ ID NO: 761468 - RNA, 23 nt, Human
ugugcaaugauggcaugaucuua

SEQ ID NO: 761469 - RNA, 23 nt, Human
uguggaagguguaauuuguuuuu

SEQ ID NO: 761470 - RNA, 18 nt, Human
ugugugugugugugucca

SEQ ID NO: 761471 - RNA, 21 nt, Human
uguguguguguguguccagug

SEQ ID NO: 761472 - RNA, 18 nt, Human
uuaacaucuuuccuuccc

SEQ ID NO: 761473 - RNA, 19 nt, Human
uuacuuggccucugcagau

SEQ ID NO: 761474 - RNA, 24 nt, Human
uuauguguguguguguguccagug

SEQ ID NO: 761475 - RNA, 23 nt, Human
uucaaccauaacguccacauuua

SEQ ID NO: 761476 - RNA, 21 nt, Human
uucauuguuccuggcacuuug

SEQ ID NO: 761477 - RNA, 20 nt, Human
uucuacuagugaaaaagaag

SEQ ID NO: 761478 - RNA, 19 nt, Human
uugaaagcaaaugugaccu

SEQ ID NO: 761479 - RNA, 19 nt, Human
uuugcauucuucuucuuag

SEQ ID NO: 761480 - RNA, 19 nt, Human
uuuguagaagccucgaguc

SEQ ID NO: 761481 - RNA, 25 nt, Human
uuuucuggcaacaaacauccuguaa

SEQ ID NO: 761482 - RNA, 27 nt, Human
aaagacacagaagaggagaauuuugcu

SEQ ID NO: 761483 - RNA, 21 nt, Human
aaauagacucaaacaugugaa

SEQ ID NO: 761484 - RNA, 23 nt, Human
aacaaauagacucaaacauguga

SEQ ID NO: 761485 - RNA, 23 nt, Human
aaccaagucaauccccuggcccc

SEQ ID NO: 761486 - RNA, 21 nt, Human
aagcagauauagcugggguau

SEQ ID NO: 761487 - RNA, 19 nt, Human
acagaagcuuucugccuuc

SEQ ID NO: 761488 - RNA, 24 nt, Human
acagagagagacuugaagcccaaa

SEQ ID NO: 761489 - RNA, 23 nt, Human
acauccagagccaaggcuuaaca

SEQ ID NO: 761490 - RNA, 19 nt, Human
acccugacaggugaucuga

SEQ ID NO: 761491 - RNA, 19 nt, Human
accugguacccuugucagg

SEQ ID NO: 761492 - RNA, 19 nt, Human
acugggaaagacacagaag

SEQ ID NO: 761493 - RNA, 18 nt, Human
agaauucucucuauaacu

SEQ ID NO: 761494 - RNA, 23 nt, Human
agagacuugaagcccaaaaugau

SEQ ID NO: 761495 - RNA, 22 nt, Human
agagagagacuugaagcccaaa

SEQ ID NO: 761496 - RNA, 18 nt, Human
aggggggacuacuguaua

SEQ ID NO: 761497 - RNA, 20 nt, Human
aguagccagucacaaagacc

SEQ ID NO: 761498 - RNA, 21 nt, Human
auacccugacaggugaucuga

SEQ ID NO: 761499 - RNA, 21 nt, Human
augaaauuggugcuggugaag

SEQ ID NO: 761500 - RNA, 23 nt, Human
augggagagcaggagggcaugag

SEQ ID NO: 761501 - RNA, 18 nt, Human
caaaguaccucacccaua

SEQ ID NO: 761502 - RNA, 23 nt, Human
caaauaucuaggccacauccaga

SEQ ID NO: 761503 - RNA, 22 nt, Human
caaaucaagaccugcuccuuuc

SEQ ID NO: 761504 - RNA, 19 nt, Human
caagcacugucauacccug

SEQ ID NO: 761505 - RNA, 22 nt, Human
caagcacugucauacccugaca

SEQ ID NO: 761506 - RNA, 21 nt, Human
caagucaauccccuggccccc

SEQ ID NO: 761507 - RNA, 19 nt, Human
cacuguacaaagaaagggu

SEQ ID NO: 761508 - RNA, 20 nt, Human
cacuguacaaagaaagggug

SEQ ID NO: 761509 - RNA, 24 nt, Human
cauggauucaauaaagccauauaa

SEQ ID NO: 761510 - RNA, 23 nt, Human
cauuacauugaaaggaugucuuu

SEQ ID NO: 761511 - RNA, 24 nt, Human
ccagaaaugcucuugcaauuucag

SEQ ID NO: 761512 - RNA, 22 nt, Human
ccagcucccaagggcugccccc

SEQ ID NO: 761513 - RNA, 20 nt, Human
cccacaggaacuaguaagau

SEQ ID NO: 761514 - RNA, 19 nt, Human
cccauugccaaaccccauu

SEQ ID NO: 761515 - RNA, 23 nt, Human
cccauugccaaaccccauuagcu

SEQ ID NO: 761516 - RNA, 21 nt, Human
ccccucucuggagguuuccca

SEQ ID NO: 761517 - RNA, 18 nt, Human
ccccuggcccccagcucc

SEQ ID NO: 761518 - RNA, 21 nt, Human
ccccuggcccccagcucccaa

SEQ ID NO: 761519 - RNA, 22 nt, Human
ccuccccucucuggagguuucc

SEQ ID NO: 761520 - RNA, 18 nt, Human
ccuguuccuggggcuccc

SEQ ID NO: 761521 - RNA, 19 nt, Human
cuagguguccuguaccccc

SEQ ID NO: 761522 - RNA, 20 nt, Human
cuccuaauaagguuugugcc

SEQ ID NO: 761523 - RNA, 22 nt, Human
cucuaugaauugagggcucuac

SEQ ID NO: 761524 - RNA, 27 nt, Human
cucuggagguuucccauaauacuuggg

SEQ ID NO: 761525 - RNA, 22 nt, Human
cugaagguugcauuuuggacac

SEQ ID NO: 761526 - RNA, 18 nt, Human
cugcccccuuuugccaga

SEQ ID NO: 761527 - RNA, 18 nt, Human
cugcccccuuuugccaga

SEQ ID NO: 761528 - RNA, 20 nt, Human
cugcccccuuuugccagaag

SEQ ID NO: 761529 - RNA, 24 nt, Human
cugggguauauggaggugucaggg

SEQ ID NO: 761530 - RNA, 18 nt, Human
cuucaucugguuucuuuc

SEQ ID NO: 761531 - RNA, 18 nt, Human
cuugcuggguccuuuuca

SEQ ID NO: 761532 - RNA, 24 nt, Human
gaaagacacagaagaggagaauuu

SEQ ID NO: 761533 - RNA, 20 nt, Human
gaauuaaucccuacuacacu

SEQ ID NO: 761534 - RNA, 24 nt, Human
gagagacuugaagcccaaaaugau

SEQ ID NO: 761535 - RNA, 18 nt, Human
gauacauuauuucccuuc

SEQ ID NO: 761536 - RNA, 20 nt, Human
gccaaaccccauuagcuaaa

SEQ ID NO: 761537 - RNA, 19 nt, Human
gccacauccagagccaagg

SEQ ID NO: 761538 - RNA, 19 nt, Human
gccagagcugagaacaucc

SEQ ID NO: 761539 - RNA, 19 nt, Human
ggaagcccuggugaggagg

SEQ ID NO: 761540 - RNA, 24 nt, Human
ggaggugucaggaggugugggggc

SEQ ID NO: 761541 - RNA, 21 nt, Human
ggauaugcuagacuaaggaau

SEQ ID NO: 761542 - RNA, 18 nt, Human
ggcgaaagcaucagugag

SEQ ID NO: 761543 - RNA, 24 nt, Human
guaguauacucuacuggcccaaag

SEQ ID NO: 761544 - RNA, 22 nt, Human
guuccuggggcucccuccuucc

SEQ ID NO: 761545 - RNA, 21 nt, Human
guugccuugggcauggauuca

SEQ ID NO: 761546 - RNA, 22 nt, Human
guugggcaaaucaagaccugcu

SEQ ID NO: 761547 - RNA, 24 nt, Human
uaacuaaauuauguguagaaacaa

SEQ ID NO: 761548 - RNA, 22 nt, Human
uaacuuaugggaauuaaucccu

SEQ ID NO: 761549 - RNA, 19 nt, Human
uacaagcacugucauaccc

SEQ ID NO: 761550 - RNA, 21 nt, Human
uacaguacaugguacuguaaa

SEQ ID NO: 761551 - RNA, 20 nt, Human
uacauauacacaugccuaug

SEQ ID NO: 761552 - RNA, 21 nt, Human
uaccucugugcaauuaaggca

SEQ ID NO: 761553 - RNA, 19 nt, Human
uacuggcccaaaguaccuc

SEQ ID NO: 761554 - RNA, 18 nt, Human
uagaaacaaauagacuca

SEQ ID NO: 761555 - RNA, 23 nt, Human
uagaaacaaauagacucaaacau

SEQ ID NO: 761556 - RNA, 23 nt, Human
uagacuaaggaaugauucaauaa

SEQ ID NO: 761557 - RNA, 19 nt, Human
uaggguaugacuucauuca

SEQ ID NO: 761558 - RNA, 23 nt, Human
ucaauaaagccauauaaaucuga

SEQ ID NO: 761559 - RNA, 18 nt, Human
ucagauguaaacauaacu

SEQ ID NO: 761560 - RNA, 18 nt, Human
ucaggaggugugggggca

SEQ ID NO: 761561 - RNA, 24 nt, Human
ucaugggagagcaggagggcauga

SEQ ID NO: 761562 - RNA, 20 nt, Human
uccaauguguaaaagagccc

SEQ ID NO: 761563 - RNA, 24 nt, Human
ucccaagggcugcccccuuuugcc

SEQ ID NO: 761564 - RNA, 20 nt, Human
ucccauaauacuuggguggg

SEQ ID NO: 761565 - RNA, 24 nt, Human
uccccucucuggagguuucccaua

SEQ ID NO: 761566 - RNA, 19 nt, Human
uccuacauauacacaugcc

SEQ ID NO: 761567 - RNA, 20 nt, Human
uccuggggcucccuccuucc

SEQ ID NO: 761568 - RNA, 18 nt, Human
ucucuuauguuucagacu

SEQ ID NO: 761569 - RNA, 20 nt, Human
ucucuuauguuucagacugg

SEQ ID NO: 761570 - RNA, 21 nt, Human
ucugggacugucuucuuacau

SEQ ID NO: 761571 - RNA, 23 nt, Human
ucuggguucuucugcaucuguuu

SEQ ID NO: 761572 - RNA, 22 nt, Human
ugaaaauacagauaagggggga

SEQ ID NO: 761573 - RNA, 20 nt, Human
ugaacacacacaggauccua

SEQ ID NO: 761574 - RNA, 22 nt, Human
ugaacacacacaggauccuaga

SEQ ID NO: 761575 - RNA, 23 nt, Human
ugaauacaagcacugucauaccc

SEQ ID NO: 761576 - RNA, 20 nt, Human
ugagaacauccucgugcucu

SEQ ID NO: 761577 - RNA, 18 nt, Human
ugaggcuugcuggguccu

SEQ ID NO: 761578 - RNA, 24 nt, Human
ugaguuugaacacacacaggaucc

SEQ ID NO: 761579 - RNA, 22 nt, Human
ugccagaaguuucaacccacaa

SEQ ID NO: 761580 - RNA, 18 nt, Human
uggccuuuggagccaggg

SEQ ID NO: 761581 - RNA, 21 nt, Human
uggcuuacacagaagcuuucu

SEQ ID NO: 761582 - RNA, 18 nt, Human
ugggacuccuguuccugg

SEQ ID NO: 761583 - RNA, 21 nt, Human
ugggugauuuuuugccauacc

SEQ ID NO: 761584 - RNA, 19 nt, Human
uguacccccacaggaacua

SEQ ID NO: 761585 - RNA, 20 nt, Human
ugugacuuuuacccccacug

SEQ ID NO: 761586 - RNA, 22 nt, Human
ugugauauacaucauggacauc

SEQ ID NO: 761587 - RNA, 21 nt, Human
uuagaauucucucuauaacuu

SEQ ID NO: 761588 - RNA, 23 nt, Human
uucaucccacuacucagaaucgg

SEQ ID NO: 761589 - RNA, 21 nt, Human
uucauuuuguuaguuguugag

SEQ ID NO: 761590 - RNA, 20 nt, Human
uuccacaagugaggcuugcu

SEQ ID NO: 761591 - RNA, 23 nt, Human
uugagggcucuacuaagccagca

SEQ ID NO: 761592 - RNA, 24 nt, Human
uuucauuccacaagugaggcuugc

SEQ ID NO: 761593 - RNA, 24 nt, Human
uuuguuugccuucccauugccaaa

SEQ ID NO: 761594 - RNA, 21 nt, Human
uuuucagaagggguggaccug

SEQ ID NO: 761595 - RNA, 18 nt, Human
uuuuguacaguacauggu

SEQ ID NO: 761596 - RNA, 23 nt, Human
aaaacaaaacaaaacaaaacaga

SEQ ID NO: 761597 - RNA, 24 nt, Human
aaaacaaaacaaaacaaaacagaa

SEQ ID NO: 761598 - RNA, 25 nt, Human
aaaacaaaacaaaacagaaauuucc

SEQ ID NO: 761599 - RNA, 20 nt, Human
aaaaccaacacaaaaaugca

SEQ ID NO: 761600 - RNA, 24 nt, Human
aaaagcacuggcaaacacccauaa

SEQ ID NO: 761601 - RNA, 22 nt, Human
aaacaaaacaaaacaaaacaaa

SEQ ID NO: 761602 - RNA, 24 nt, Human
aaacaaaacaaaacaaaacagaaa

SEQ ID NO: 761603 - RNA, 22 nt, Human
aaacagaaagacaccccaacgc

SEQ ID NO: 761604 - RNA, 21 nt, Human
aaacauuuuuagcagaugauc

SEQ ID NO: 761605 - RNA, 21 nt, Human
aaagacaccccaacgccaaag

SEQ ID NO: 761606 - RNA, 18 nt, Human
aaagcaacuuauaagccc

SEQ ID NO: 761607 - RNA, 18 nt, Human
aaagcacuggcaaacacc

SEQ ID NO: 761608 - RNA, 19 nt, Human
aacaaaacaaaacaaaaca

SEQ ID NO: 761609 - RNA, 23 nt, Human
aaccaaauaugaagaguuaagau

SEQ ID NO: 761610 - RNA, 22 nt, Human
aagcagagcuugcuuuaugauc

SEQ ID NO: 761611 - RNA, 20 nt, Human
aagcagaucccaaaaccaaa

SEQ ID NO: 761612 - RNA, 27 nt, Human
aagcauccuuucaggucaccacugauu

SEQ ID NO: 761613 - RNA, 23 nt, Human
aaggaugaccacccuauccaugc

SEQ ID NO: 761614 - RNA, 27 nt, Human
aauacccauugcauucuaagcggaaca

SEQ ID NO: 761615 - RNA, 23 nt, Human
aauccagucuaagagagaguuca

SEQ ID NO: 761616 - RNA, 22 nt, Human
aaugaugauuaucuaaggaauu

SEQ ID NO: 761617 - RNA, 18 nt, Human
aaugcaauugucaaggcc

SEQ ID NO: 761618 - RNA, 24 nt, Human
aauuuauuagggcuccaaaaccuu

SEQ ID NO: 761619 - RNA, 27 nt, Human
acaaaacaaaacaaaacaaaacagaaa

SEQ ID NO: 761620 - RNA, 19 nt, Human
acaaaauucccuucccuug

SEQ ID NO: 761621 - RNA, 24 nt, Human
acaacaaagcaaagcuagccuaga

SEQ ID NO: 761622 - RNA, 21 nt, Human
accccauucccgugcccucug

SEQ ID NO: 761623 - RNA, 21 nt, Human
acccuauuacaucagaaaugg

SEQ ID NO: 761624 - RNA, 21 nt, Human
accuugaaaaccccauucccg

SEQ ID NO: 761625 - RNA, 22 nt, Human
acuuauauuuuuccugaaugaa

SEQ ID NO: 761626 - RNA, 22 nt, Human
acuuugacagguagaugagggg

SEQ ID NO: 761627 - RNA, 28 nt, Human
agaaaaccaacacaaaaaugcaauucac

SEQ ID NO: 761628 - RNA, 19 nt, Human
agaaagacaccccaacgcc

SEQ ID NO: 761629 - RNA, 24 nt, Human
agaaagacaccccaacgccaaaga

SEQ ID NO: 761630 - RNA, 18 nt, Human
agaggaagagaggaugag

SEQ ID NO: 761631 - RNA, 19 nt, Human
agcagguacgaaugaccuu

SEQ ID NO: 761632 - RNA, 24 nt, Human
agccauggccaaagcagaucagaa

SEQ ID NO: 761633 - RNA, 18 nt, Human
aggaagagaggaugagaa

SEQ ID NO: 761634 - RNA, 18 nt, Human
aggaugcuguagcauuag

SEQ ID NO: 761635 - RNA, 19 nt, Human
aggcaaaugccaaggggga

SEQ ID NO: 761636 - RNA, 20 nt, Human
agggggaauuccuucccguu

SEQ ID NO: 761637 - RNA, 20 nt, Human
aggugaacaacaaagcaagc

SEQ ID NO: 761638 - RNA, 23 nt, Human
agucauugauuccuucuuugggg

SEQ ID NO: 761639 - RNA, 24 nt, Human
auaaagguuaauauauuuuuuuca

SEQ ID NO: 761640 - RNA, 23 nt, Human
auaaugguaucuuucuauauagu

SEQ ID NO: 761641 - RNA, 21 nt, Human
auaccggggaaguguucuaca

SEQ ID NO: 761642 - RNA, 23 nt, Human
augcaacauacaacugacacucc

SEQ ID NO: 761643 - RNA, 21 nt, Human
augcuguagcauuaggcuggu

SEQ ID NO: 761644 - RNA, 20 nt, Human
caaaaagcaacuuauaagcc

SEQ ID NO: 761645 - RNA, 20 nt, Human
caaaaagcacuggcaaacac

SEQ ID NO: 761646 - RNA, 24 nt, Human
caaaaagcacuggcaaacacccau

SEQ ID NO: 761647 - RNA, 21 nt, Human
caaaacaaaacaaaacaaaac

SEQ ID NO: 761648 - RNA, 24 nt, Human
caaaacaaaacaaaacaaaacaaa

SEQ ID NO: 761649 - RNA, 25 nt, Human
caaaacaaaacaaaacaaaacagaa

SEQ ID NO: 761650 - RNA, 21 nt, Human
caaaacaaaacagaaauuucc

SEQ ID NO: 761651 - RNA, 25 nt, Human
caaaggcacaacgaagcuggagacc

SEQ ID NO: 761652 - RNA, 27 nt, Human
caacugacacuccaaacagaaagacac

SEQ ID NO: 761653 - RNA, 20 nt, Human
caagcaggcugagauaucag

SEQ ID NO: 761654 - RNA, 23 nt, Human
caauguucacagcucacaaggga

SEQ ID NO: 761655 - RNA, 22 nt, Human
caauugcagauaauaauuuagc

SEQ ID NO: 761656 - RNA, 20 nt, Human
cacagcaccuaugacacaag

SEQ ID NO: 761657 - RNA, 25 nt, Human
caccacugauuucaaaacaaaacaa

SEQ ID NO: 761658 - RNA, 25 nt, Human
cagaucccaaaaccaaauaugaaga

SEQ ID NO: 761659 - RNA, 23 nt, Human
cagcagguacgaaugaccuuaau

SEQ ID NO: 761660 - RNA, 18 nt, Human
cagccauggccaaagcag

SEQ ID NO: 761661 - RNA, 22 nt, Human
cagcuuuuucuuugucuuagaa

SEQ ID NO: 761662 - RNA, 21 nt, Human
cauauauauacacauauguau

SEQ ID NO: 761663 - RNA, 24 nt, Human
cauauauauacacauauguaugua

SEQ ID NO: 761664 - RNA, 20 nt, Human
cauauguauguaugcguacg

SEQ ID NO: 761665 - RNA, 22 nt, Human
caugcaacauacaacugacacu

SEQ ID NO: 761666 - RNA, 21 nt, Human
cauucuuuucuucuggcacca

SEQ ID NO: 761667 - RNA, 24 nt, Human
ccaaaaccuuuaaucacuguguau

SEQ ID NO: 761668 - RNA, 23 nt, Human
ccaaacagaaagacaccccaacg

SEQ ID NO: 761669 - RNA, 18 nt, Human
ccagagagacuacugauc

SEQ ID NO: 761670 - RNA, 23 nt, Human
ccagaucugugcagaaaaccaac

SEQ ID NO: 761671 - RNA, 26 nt, Human
cccauugcauucuaagcggaacagcc

SEQ ID NO: 761672 - RNA, 23 nt, Human
cccuucgccuccgcccccggggg

SEQ ID NO: 761673 - RNA, 24 nt, Human
ccuccugcaagucgcccccucucg

SEQ ID NO: 761674 - RNA, 23 nt, Human
ccucuggaaccggcagugucguc

SEQ ID NO: 761675 - RNA, 21 nt, Human
ccugaaaggagcacauugugg

SEQ ID NO: 761676 - RNA, 18 nt, Human
cgcccccucucggagccc

SEQ ID NO: 761677 - RNA, 24 nt, Human
cgccuccgcccccggggggagccu

SEQ ID NO: 761678 - RNA, 19 nt, Human
cuaaggaauugcaccugag

SEQ ID NO: 761679 - RNA, 27 nt, Human
cuaugcugugauaaucggggucucagg

SEQ ID NO: 761680 - RNA, 21 nt, Human
cucaaagcagaucccaaaacc

SEQ ID NO: 761681 - RNA, 19 nt, Human
cuccaaacagaaagacacc

SEQ ID NO: 761682 - RNA, 25 nt, Human
cuccugcaagucgcccccucucgga

SEQ ID NO: 761683 - RNA, 21 nt, Human
cugauuucaaaacaaaacaaa

SEQ ID NO: 761684 - RNA, 21 nt, Human
cuggcaccaacacccuucgcc

SEQ ID NO: 761685 - RNA, 24 nt, Human
cuuauaagcccacaaagaaggaac

SEQ ID NO: 761686 - RNA, 23 nt, Human
cuucuacuugcuucccuguugca

SEQ ID NO: 761687 - RNA, 20 nt, Human
gaggacuuugguggaagccu

SEQ ID NO: 761688 - RNA, 19 nt, Human
gaguaagggugggcggaga

SEQ ID NO: 761689 - RNA, 24 nt, Human
gauuaucuaaggaauugcaccuga

SEQ ID NO: 761690 - RNA, 25 nt, Human
gcaaaaagcaacuuauaagcccaca

SEQ ID NO: 761691 - RNA, 21 nt, Human
gcugggaaucgcaaucauuca

SEQ ID NO: 761692 - RNA, 23 nt, Human
gggaauuccuucccguugacguc

SEQ ID NO: 761693 - RNA, 23 nt, Human
gggagaguccaaaauaucacuuu

SEQ ID NO: 761694 - RNA, 18 nt, Human
gguuugguguuuuuuuug

SEQ ID NO: 761695 - RNA, 22 nt, Human
guaaaagauguccaauugcaga

SEQ ID NO: 761696 - RNA, 24 nt, Human
guauuuuuuuuuaaaugaagaugg

SEQ ID NO: 761697 - RNA, 20 nt, Human
gugauguugggugaccucug

SEQ ID NO: 761698 - RNA, 19 nt, Human
uaaaagccaggaaacaggu

SEQ ID NO: 761699 - RNA, 21 nt, Human
uaagcccacaaagaaggaacu

SEQ ID NO: 761700 - RNA, 21 nt, Human
uacaacugacacuccaaacag

SEQ ID NO: 761701 - RNA, 23 nt, Human
uacacaugaagcgggagcuacac

SEQ ID NO: 761702 - RNA, 20 nt, Human
uacaccugguucucccauga

SEQ ID NO: 761703 - RNA, 21 nt, Human
uacacugcgaucacccugccu

SEQ ID NO: 761704 - RNA, 24 nt, Human
uacauauauauacacauauguaug

SEQ ID NO: 761705 - RNA, 20 nt, Human
uaccuuaaaagccaggaaac

SEQ ID NO: 761706 - RNA, 20 nt, Human
uacucucacucccaaauucu

SEQ ID NO: 761707 - RNA, 27 nt, Human
uagacaacagcagguacgaaugaccuu

SEQ ID NO: 761708 - RNA, 20 nt, Human
uagacucaggucuaguuuga

SEQ ID NO: 761709 - RNA, 22 nt, Human
uagcaaagcgauggcucucccg

SEQ ID NO: 761710 - RNA, 18 nt, Human
uaggauuaugggaaaccu

SEQ ID NO: 761711 - RNA, 21 nt, Human
uaggauuaugggaaaccuauu

SEQ ID NO: 761712 - RNA, 19 nt, Human
uaggcguuaacaacuugca

SEQ ID NO: 761713 - RNA, 21 nt, Human
uaguuuacauauauauacaca

SEQ ID NO: 761714 - RNA, 21 nt, Human
uauagcccggugucuguuucc

SEQ ID NO: 761715 - RNA, 24 nt, Human
uauauacacauauguauguaugcg

SEQ ID NO: 761716 - RNA, 24 nt, Human
uauauauacacauauguauguaug

SEQ ID NO: 761717 - RNA, 21 nt, Human
uaucacuuuuagucagagggu

SEQ ID NO: 761718 - RNA, 22 nt, Human
uaucauggacuuuuucuugggu

SEQ ID NO: 761719 - RNA, 22 nt, Human
uauccaaacagcuuccuuuucu

SEQ ID NO: 761720 - RNA, 21 nt, Human
uauggggaaugugguggaggc

SEQ ID NO: 761721 - RNA, 21 nt, Human
ucaaagcagaucccaaaacca

SEQ ID NO: 761722 - RNA, 22 nt, Human
ucaaagcagaucccaaaaccaa

SEQ ID NO: 761723 - RNA, 22 nt, Human
ucaccagcauuuuuucagccau

SEQ ID NO: 761724 - RNA, 18 nt, Human
ucccaugauagcuggaag

SEQ ID NO: 761725 - RNA, 19 nt, Human
uccuugagcuaugcuguga

SEQ ID NO: 761726 - RNA, 19 nt, Human
ucgcccccucucggagccc

SEQ ID NO: 761727 - RNA, 21 nt, Human
ucuucaauugcuuggauucau

SEQ ID NO: 761728 - RNA, 18 nt, Human
ucuucuggcaccaacacc

SEQ ID NO: 761729 - RNA, 23 nt, Human
ugaaaggagcacauuguggggua

SEQ ID NO: 761730 - RNA, 25 nt, Human
ugaacaacaaagcaaagcuagccua

SEQ ID NO: 761731 - RNA, 23 nt, Human
ugaacacuacuucuauuuacaaa

SEQ ID NO: 761732 - RNA, 28 nt, Human
ugaagaugggaccucaaagcagauccca

SEQ ID NO: 761733 - RNA, 19 nt, Human
ugaagcaaaaggaugagug

SEQ ID NO: 761734 - RNA, 27 nt, Human
ugaagguuuucauuugcaaguuuuuaa

SEQ ID NO: 761735 - RNA, 24 nt, Human
ugacaauaucaccagcauuuuuuc

SEQ ID NO: 761736 - RNA, 22 nt, Human
ugagaaaggugccucucccucc

SEQ ID NO: 761737 - RNA, 22 nt, Human
ugagauaucaguaucugaagca

SEQ ID NO: 761738 - RNA, 22 nt, Human
ugaguucuaagucaaguauccu

SEQ ID NO: 761739 - RNA, 21 nt, Human
ugauaaucggggucucagggg

SEQ ID NO: 761740 - RNA, 19 nt, Human
ugcaaguuuuuaacacuga

SEQ ID NO: 761741 - RNA, 21 nt, Human
ugcaauguauaaaaaaaaaau

SEQ ID NO: 761742 - RNA, 21 nt, Human
ugcaauugucaaggccugaaa

SEQ ID NO: 761743 - RNA, 19 nt, Human
ugccucucccuccaaaaau

SEQ ID NO: 761744 - RNA, 23 nt, Human
ugcuggaaaucugagaaaauacc

SEQ ID NO: 761745 - RNA, 22 nt, Human
uggaaaucugagaaaauaccca

SEQ ID NO: 761746 - RNA, 22 nt, Human
uggcaaacacccauaacuuagc

SEQ ID NO: 761747 - RNA, 20 nt, Human
uggcaugagggcaucauuau

SEQ ID NO: 761748 - RNA, 21 nt, Human
uggcauuuugagaucuauacu

SEQ ID NO: 761749 - RNA, 18 nt, Human
ugggugaccucuggaagc

SEQ ID NO: 761750 - RNA, 27 nt, Human
uggguugauuuauaaauugggacaccu

SEQ ID NO: 761751 - RNA, 23 nt, Human
ugguaucauggacuuuuucuugg

SEQ ID NO: 761752 - RNA, 18 nt, Human
ugguuuuuguaaaagaug

SEQ ID NO: 761753 - RNA, 18 nt, Human
uguauacagaauauguau

SEQ ID NO: 761754 - RNA, 18 nt, Human
uguauacagaauauguau

SEQ ID NO: 761755 - RNA, 21 nt, Human
uguguauacagaauauguaug

SEQ ID NO: 761756 - RNA, 23 nt, Human
uguguauacagaauauguaugua

SEQ ID NO: 761757 - RNA, 21 nt, Human
uguugcacuaaaaugcacgug

SEQ ID NO: 761758 - RNA, 23 nt, Human
uguugggugaccucuggaagcuc

SEQ ID NO: 761759 - RNA, 20 nt, Human
uuacauccuguuugcuggaa

SEQ ID NO: 761760 - RNA, 24 nt, Human
uuaccacaucuagcgcuuaacaaa

SEQ ID NO: 761761 - RNA, 23 nt, Human
uuaggcguuaacaacuugcagcu

SEQ ID NO: 761762 - RNA, 21 nt, Human
uucagccauggccaaagcaga

SEQ ID NO: 761763 - RNA, 22 nt, Human
uuggcauuuugagaucuauacu

SEQ ID NO: 761764 - RNA, 18 nt, Human
uuuacauauauauacaca

SEQ ID NO: 761765 - RNA, 23 nt, Human
uuuacauauauauacacauaugu

SEQ ID NO: 761766 - RNA, 24 nt, Human
uuuacauauauauacacauaugua

SEQ ID NO: 761767 - RNA, 22 nt, Human
uuucauggcauuuaccacaucu

SEQ ID NO: 761768 - RNA, 24 nt, Human
uuuuagcagaugaucggaaaggau

SEQ ID NO: 761769 - RNA, 18 nt, Human
uuuuuagauggaugcugg

SEQ ID NO: 761770 - RNA, 22 nt, Human
aaauauuaaaauacuaugagcu

SEQ ID NO: 761771 - RNA, 23 nt, Human
aacaggcucuagacuccggaaga

SEQ ID NO: 761772 - RNA, 19 nt, Human
aagagcccgcccgagccgc

SEQ ID NO: 761773 - RNA, 22 nt, Human
aagagcccgcccgagccgcucc

SEQ ID NO: 761774 - RNA, 22 nt, Human
aaggcaaaaaaaagaucaaaaa

SEQ ID NO: 761775 - RNA, 20 nt, Human
aauauaaacauaaacuaacc

SEQ ID NO: 761776 - RNA, 20 nt, Human
aaugacuauuuuaucauuuu

SEQ ID NO: 761777 - RNA, 23 nt, Human
agacuccggaagagcuguaagcc

SEQ ID NO: 761778 - RNA, 21 nt, Human
agccccggccggcccgccucc

SEQ ID NO: 761779 - RNA, 24 nt, Human
agcuggcugagcgucaagagcccg

SEQ ID NO: 761780 - RNA, 20 nt, Human
aggcaaaaaaaagaucaaaa

SEQ ID NO: 761781 - RNA, 27 nt, Human
aggcaaaaaaaagaucaaaagggaccc

SEQ ID NO: 761782 - RNA, 21 nt, Human
aggcuucuggcacauaaaaug

SEQ ID NO: 761783 - RNA, 22 nt, Human
auacauuugccaaaauguuccc

SEQ ID NO: 761784 - RNA, 20 nt, Human
caaauauaaagucuaugaau

SEQ ID NO: 761785 - RNA, 22 nt, Human
caacucuuaaggcaaaaaaaag

SEQ ID NO: 761786 - RNA, 23 nt, Human
cagaacaccaacaggcucuagac

SEQ ID NO: 761787 - RNA, 21 nt, Human
caggcucuagacuccggaaga

SEQ ID NO: 761788 - RNA, 21 nt, Human
caucugaacuauauaaugacu

SEQ ID NO: 761789 - RNA, 23 nt, Human
cauuguuuugcuuaacaguuuua

SEQ ID NO: 761790 - RNA, 24 nt, Human
cauuuuacuugaauuaaaaccaga

SEQ ID NO: 761791 - RNA, 19 nt, Human
cccauaaaauugacaguga

SEQ ID NO: 761792 - RNA, 23 nt, Human
ccccggccggcccgccucccggg

SEQ ID NO: 761793 - RNA, 21 nt, Human
ccgagccgcuccagccccggc

SEQ ID NO: 761794 - RNA, 19 nt, Human
cuaaaucauucuuucagcc

SEQ ID NO: 761795 - RNA, 21 nt, Human
cuauguuuguccuaguuguau

SEQ ID NO: 761796 - RNA, 18 nt, Human
cuccagccccggccggcc

SEQ ID NO: 761797 - RNA, 21 nt, Human
cugcuggggugggagaggccg

SEQ ID NO: 761798 - RNA, 26 nt, Human
cuuaaggcaaaaaaaagaucaaaaaa

SEQ ID NO: 761799 - RNA, 21 nt, Human
cuuauaaauauuuccaauugc

SEQ ID NO: 761800 - RNA, 22 nt, Human
cuucuggcauuaaaagccacaa

SEQ ID NO: 761801 - RNA, 19 nt, Human
cuugaauuaaaaccagaau

SEQ ID NO: 761802 - RNA, 20 nt, Human
gagcgaagcuggcugagcgu

SEQ ID NO: 761803 - RNA, 19 nt, Human
gcaaaaaaaagaucaaaaa

SEQ ID NO: 761804 - RNA, 22 nt, Human
gcauuaaaagccacaacacaaa

SEQ ID NO: 761805 - RNA, 19 nt, Human
gcccgagccgcuccagccc

SEQ ID NO: 761806 - RNA, 21 nt, Human
gccggcgggucagggcgggac

SEQ ID NO: 761807 - RNA, 20 nt, Human
gcuccagccccggccggccc

SEQ ID NO: 761808 - RNA, 19 nt, Human
gugcgcuuccaccugcggg

SEQ ID NO: 761809 - RNA, 19 nt, Human
uaaacauaaacuaaccccu

SEQ ID NO: 761810 - RNA, 24 nt, Human
uaaagauuaaaaaaacaagaguuc

SEQ ID NO: 761811 - RNA, 25 nt, Human
uaaagucuaugaaucuuauacuuuu

SEQ ID NO: 761812 - RNA, 20 nt, Human
uaaguucuaaagauuaaaaa

SEQ ID NO: 761813 - RNA, 20 nt, Human
uaaugacuauuuuaucauuu

SEQ ID NO: 761814 - RNA, 20 nt, Human
uacacugaggcagcaaaugu

SEQ ID NO: 761815 - RNA, 19 nt, Human
uauaaauucugguaacuuu

SEQ ID NO: 761816 - RNA, 23 nt, Human
uauacagaaaauauuuaaaauuc

SEQ ID NO: 761817 - RNA, 21 nt, Human
uaucagcauuuucacagaaag

SEQ ID NO: 761818 - RNA, 21 nt, Human
ucccgaggccggagcgaagcu

SEQ ID NO: 761819 - RNA, 18 nt, Human
ucuuaaggcaaaaaaaag

SEQ ID NO: 761820 - RNA, 22 nt, Human
ucuucuggcauuaaaagccaca

SEQ ID NO: 761821 - RNA, 18 nt, Human
ugaagugcaguggugugg

SEQ ID NO: 761822 - RNA, 19 nt, Human
ugaagugcagugguguggc

SEQ ID NO: 761823 - RNA, 22 nt, Human
ugaagugcagugguguggcagg

SEQ ID NO: 761824 - RNA, 26 nt, Human
ugaagugcagugguguggggcucuag

SEQ ID NO: 761825 - RNA, 19 nt, Human
ugcagugguguggcagggu

SEQ ID NO: 761826 - RNA, 22 nt, Human
ugggagaggccggcgggucagg

SEQ ID NO: 761827 - RNA, 19 nt, Human
uggggugggagaggccggc

SEQ ID NO: 761828 - RNA, 22 nt, Human
uggggugggagaggccggcggg

SEQ ID NO: 761829 - RNA, 22 nt, Human
uggucugaaguggaagugaagu

SEQ ID NO: 761830 - RNA, 21 nt, Human
uguaaaaaaugaaaaucauuu

SEQ ID NO: 761831 - RNA, 18 nt, Human
uguacaucugaauauaca

SEQ ID NO: 761832 - RNA, 20 nt, Human
uguacaucugaauauacauu

SEQ ID NO: 761833 - RNA, 18 nt, Human
ugucauacaaauauaaag

SEQ ID NO: 761834 - RNA, 25 nt, Human
uuaaauucuuaaaguagggacagaa

SEQ ID NO: 761835 - RNA, 23 nt, Human
uuaaguucuaaagauuaaaaaaa

SEQ ID NO: 761836 - RNA, 23 nt, Human
uucagaauaagugagcaauuaaa

SEQ ID NO: 761837 - RNA, 22 nt, Human
uuugccaaaauguuccauuagu

SEQ ID NO: 761838 - RNA, 26 nt, Human
aaaauacacacacuaaauauacaaug

SEQ ID NO: 761839 - RNA, 19 nt, Human
aaaauauaaaaauaagaaa

SEQ ID NO: 761840 - RNA, 23 nt, Human
aaaaugccacaucagauuaaaug

SEQ ID NO: 761841 - RNA, 22 nt, Human
aaagaguauuauaucaaugaua

SEQ ID NO: 761842 - RNA, 18 nt, Human
aacuugcuccgucaacug

SEQ ID NO: 761843 - RNA, 19 nt, Human
aagaagaggacuggacaug

SEQ ID NO: 761844 - RNA, 19 nt, Human
aagcacuuaacacuggugg

SEQ ID NO: 761845 - RNA, 24 nt, Human
aaggccuuccugggggcugcccag

SEQ ID NO: 761846 - RNA, 20 nt, Human
acccaacagggcaucgggca

SEQ ID NO: 761847 - RNA, 18 nt, Human
accccauuguccaagcag

SEQ ID NO: 761848 - RNA, 25 nt, Human
acucaguggcucugacaacagaugu

SEQ ID NO: 761849 - RNA, 23 nt, Human
acugcauucuaaaucaccacauc

SEQ ID NO: 761850 - RNA, 20 nt, Human
agaaacacacacugcuuuga

SEQ ID NO: 761851 - RNA, 21 nt, Human
agaagaaaagauggcagggag

SEQ ID NO: 761852 - RNA, 21 nt, Human
agaugcguuugcucgguggca

SEQ ID NO: 761853 - RNA, 18 nt, Human
agauguagagaaggagau

SEQ ID NO: 761854 - RNA, 20 nt, Human
agauguagagaaggagauua

SEQ ID NO: 761855 - RNA, 19 nt, Human
agcaacagaaccaagguca

SEQ ID NO: 761856 - RNA, 24 nt, Human
agcagaagaaaagauggcagggag

SEQ ID NO: 761857 - RNA, 18 nt, Human
agcaggugcaccagcccc

SEQ ID NO: 761858 - RNA, 19 nt, Human
aggcaggaaacaaggcaag

SEQ ID NO: 761859 - RNA, 20 nt, Human
aggcaggaaacaaggcaagg

SEQ ID NO: 761860 - RNA, 18 nt, Human
aggcauggcuuuguuucu

SEQ ID NO: 761861 - RNA, 20 nt, Human
aggcugcagcagguccagcc

SEQ ID NO: 761862 - RNA, 21 nt, Human
agggaggggguaguggaagac

SEQ ID NO: 761863 - RNA, 23 nt, Human
agggaggggguaguggaagacug

SEQ ID NO: 761864 - RNA, 22 nt, Human
aggugcaccagcccccuggugg

SEQ ID NO: 761865 - RNA, 18 nt, Human
agguuccagcagagggaa

SEQ ID NO: 761866 - RNA, 24 nt, Human
aucuggacggcugacucacaaggg

SEQ ID NO: 761867 - RNA, 22 nt, Human
caacagggcaucgggcaaccug

SEQ ID NO: 761868 - RNA, 26 nt, Human
caacuccccaaaguagcagaagaaaa

SEQ ID NO: 761869 - RNA, 22 nt, Human
caagugacagagggcuuuagca

SEQ ID NO: 761870 - RNA, 25 nt, Human
caauaccacaagagacauacagaag

SEQ ID NO: 761871 - RNA, 21 nt, Human
caaugccaggaguuacuuuaa

SEQ ID NO: 761872 - RNA, 18 nt, Human
cacaaggucuacagaugg

SEQ ID NO: 761873 - RNA, 22 nt, Human
caccacaucauucccaacuugu

SEQ ID NO: 761874 - RNA, 19 nt, Human
cacccaugaauccagaagc

SEQ ID NO: 761875 - RNA, 19 nt, Human
caccccccgcaaccccacu

SEQ ID NO: 761876 - RNA, 24 nt, Human
cagcagagggaagaagaggacugg

SEQ ID NO: 761877 - RNA, 21 nt, Human
cagcaggugcaccagcccccu

SEQ ID NO: 761878 - RNA, 21 nt, Human
caggagagcucaggcuggcug

SEQ ID NO: 761879 - RNA, 20 nt, Human
caggcaguccccccaccccc

SEQ ID NO: 761880 - RNA, 21 nt, Human
caggcaguccccccacccccc

SEQ ID NO: 761881 - RNA, 23 nt, Human
caguacuguguacaacauauaaa

SEQ ID NO: 761882 - RNA, 20 nt, Human
cauacuuacagaagccaaaa

SEQ ID NO: 761883 - RNA, 25 nt, Human
cauagagcauacuuacagaagccaa

SEQ ID NO: 761884 - RNA, 20 nt, Human
caugaauccagaagcacuuu

SEQ ID NO: 761885 - RNA, 23 nt, Human
ccaaagguuccagcagagggaag

SEQ ID NO: 761886 - RNA, 19 nt, Human
ccagaagcacuuaacacug

SEQ ID NO: 761887 - RNA, 21 nt, Human
ccagcagagggaagaagagga

SEQ ID NO: 761888 - RNA, 22 nt, Human
cccacagcucuccacaucagcc

SEQ ID NO: 761889 - RNA, 23 nt, Human
cccauuguccaagcagagcuauu

SEQ ID NO: 761890 - RNA, 20 nt, Human
ccccaaccccauuguccaag

SEQ ID NO: 761891 - RNA, 21 nt, Human
ccccaccccccgcaaccccac

SEQ ID NO: 761892 - RNA, 20 nt, Human
ccccauuguccaagcagagc

SEQ ID NO: 761893 - RNA, 20 nt, Human
cccccaccccccgcaacccc

SEQ ID NO: 761894 - RNA, 25 nt, Human
cccccaccccccgcaaccccacucc

SEQ ID NO: 761895 - RNA, 18 nt, Human
cccccgcaaccccacucc

SEQ ID NO: 761896 - RNA, 22 nt, Human
cccccgcaaccccacuccgugc

SEQ ID NO: 761897 - RNA, 23 nt, Human
cccgcaaccccacuccgugccac

SEQ ID NO: 761898 - RNA, 18 nt, Human
ccucuggcuccucucccu

SEQ ID NO: 761899 - RNA, 21 nt, Human
ccucugggagucaggcagucc

SEQ ID NO: 761900 - RNA, 19 nt, Human
ccuggccaucaacucccca

SEQ ID NO: 761901 - RNA, 24 nt, Human
cgcaaccccacuccgugccacauu

SEQ ID NO: 761902 - RNA, 24 nt, Human
cgucaaaaggagccucacaguccc

SEQ ID NO: 761903 - RNA, 21 nt, Human
cuaaaucaccacaucauuccc

SEQ ID NO: 761904 - RNA, 18 nt, Human
cucuccacaucagccgug

SEQ ID NO: 761905 - RNA, 22 nt, Human
cucugagauucuguagaacagg

SEQ ID NO: 761906 - RNA, 20 nt, Human
cuguagcuggauggcgagac

SEQ ID NO: 761907 - RNA, 21 nt, Human
gaaagacaacccuauucccca

SEQ ID NO: 761908 - RNA, 19 nt, Human
gaagagacguucauguucu

SEQ ID NO: 761909 - RNA, 22 nt, Human
gaaggccuuccugggggcugcc

SEQ ID NO: 761910 - RNA, 22 nt, Human
gagaaaaaaaccuuucagauaa

SEQ ID NO: 761911 - RNA, 21 nt, Human
gcagaagaaaagauggcaggg

SEQ ID NO: 761912 - RNA, 21 nt, Human
gcagcccaauggguuauaccc

SEQ ID NO: 761913 - RNA, 18 nt, Human
gcuggauggcgagaccac

SEQ ID NO: 761914 - RNA, 18 nt, Human
gcuggcuucuuuccuggc

SEQ ID NO: 761915 - RNA, 18 nt, Human
gcuucuuuccuggccauc

SEQ ID NO: 761916 - RNA, 18 nt, Human
ggcaggcugacuguggcu

SEQ ID NO: 761917 - RNA, 20 nt, Human
ggcauggcuuuguuucuucc

SEQ ID NO: 761918 - RNA, 23 nt, Human
gggaggggguaguggaagacugg

SEQ ID NO: 761919 - RNA, 23 nt, Human
gggcagcccaauggguuauaccc

SEQ ID NO: 761920 - RNA, 18 nt, Human
ggggaaggcaagagugcu

SEQ ID NO: 761921 - RNA, 19 nt, Human
guauugcugugacaggugg

SEQ ID NO: 761922 - RNA, 23 nt, Human
gucacauauggcagcaagcagcc

SEQ ID NO: 761923 - RNA, 21 nt, Human
guccaaagugacagggaggau

SEQ ID NO: 761924 - RNA, 19 nt, Human
gucuacagauggcauuuuc

SEQ ID NO: 761925 - RNA, 23 nt, Human
guuccagcagagggaagaagagg

SEQ ID NO: 761926 - RNA, 26 nt, Human
uaaaaauaagaaacacacacugcuuu

SEQ ID NO: 761927 - RNA, 22 nt, Human
uaaaaugacuuucacauacaca

SEQ ID NO: 761928 - RNA, 26 nt, Human
uaaaaugacuuucacauacacaggug

SEQ ID NO: 761929 - RNA, 22 nt, Human
uaaacagacgcuuaaguugaca

SEQ ID NO: 761930 - RNA, 24 nt, Human
uaagaaacacacacugcuuugaaa

SEQ ID NO: 761931 - RNA, 18 nt, Human
uaagcaagaacccucaac

SEQ ID NO: 761932 - RNA, 21 nt, Human
uacaauacauccauuuacaga

SEQ ID NO: 761933 - RNA, 18 nt, Human
uacagaagcagugcuuuc

SEQ ID NO: 761934 - RNA, 18 nt, Human
uacaucguuuucaccacu

SEQ ID NO: 761935 - RNA, 25 nt, Human
uaccacaagagacauacagaagcag

SEQ ID NO: 761936 - RNA, 22 nt, Human
uacuuuaacccugugcuggcuu

SEQ ID NO: 761937 - RNA, 23 nt, Human
uagacccacagcucuccacauca

SEQ ID NO: 761938 - RNA, 26 nt, Human
ucaaaauacacacacuaaauauacaa

SEQ ID NO: 761939 - RNA, 20 nt, Human
ucaccugcaaacaucuggac

SEQ ID NO: 761940 - RNA, 19 nt, Human
ucacucaugcuucagauga

SEQ ID NO: 761941 - RNA, 20 nt, Human
ucaggcuggcuggccuuggg

SEQ ID NO: 761942 - RNA, 19 nt, Human
ucaucaagagauacaucgu

SEQ ID NO: 761943 - RNA, 21 nt, Human
uccaagcagagcuauucaagg

SEQ ID NO: 761944 - RNA, 26 nt, Human
uccacaucagccguguccucuggcuc

SEQ ID NO: 761945 - RNA, 18 nt, Human
uccagaagcacuuaacac

SEQ ID NO: 761946 - RNA, 21 nt, Human
uccagaagcacuuaacacugg

SEQ ID NO: 761947 - RNA, 22 nt, Human
uccccaaaguagcagaagaaaa

SEQ ID NO: 761948 - RNA, 21 nt, Human
uccccccaccccccgcaaccc

SEQ ID NO: 761949 - RNA, 22 nt, Human
uccccccaccccccgcaacccc

SEQ ID NO: 761950 - RNA, 19 nt, Human
uccucuggcuccucucccu

SEQ ID NO: 761951 - RNA, 22 nt, Human
uccucuggcuccucucccucca

SEQ ID NO: 761952 - RNA, 20 nt, Human
ucgaagauguuucaucaaga

SEQ ID NO: 761953 - RNA, 21 nt, Human
ucucccuccacuguagcugga

SEQ ID NO: 761954 - RNA, 19 nt, Human
ucugacaacagauguagag

SEQ ID NO: 761955 - RNA, 21 nt, Human
ucugcaggcugcagcaggucc

SEQ ID NO: 761956 - RNA, 21 nt, Human
ucuggaaggccuuccuggggg

SEQ ID NO: 761957 - RNA, 18 nt, Human
ucugucuugcaggagagc

SEQ ID NO: 761958 - RNA, 18 nt, Human
ucugucuugcaggagagc

SEQ ID NO: 761959 - RNA, 19 nt, Human
ucuucccaaaccugccuga

SEQ ID NO: 761960 - RNA, 22 nt, Human
ugaaaagcaagaugcguuugcu

SEQ ID NO: 761961 - RNA, 19 nt, Human
ugacagguggugacccugg

SEQ ID NO: 761962 - RNA, 21 nt, Human
ugacgaaaaugccacaucaga

SEQ ID NO: 761963 - RNA, 25 nt, Human
ugagaaaaaaaccuuucagauaaaa

SEQ ID NO: 761964 - RNA, 26 nt, Human
ugaucuaaauuaagcaagaacccuca

SEQ ID NO: 761965 - RNA, 26 nt, Human
uggaucacacugagacagaaaaguuc

SEQ ID NO: 761966 - RNA, 24 nt, Human
uggauggcgagaccacugcagggc

SEQ ID NO: 761967 - RNA, 25 nt, Human
uggcaaaugacucaacugugacccu

SEQ ID NO: 761968 - RNA, 23 nt, Human
uggcagggaggggguaguggaag

SEQ ID NO: 761969 - RNA, 18 nt, Human
uggcuccucucccuccac

SEQ ID NO: 761970 - RNA, 21 nt, Human
uguagaacaggaugcguucga

SEQ ID NO: 761971 - RNA, 23 nt, Human
uguccaagcagagcuauucaagg

SEQ ID NO: 761972 - RNA, 21 nt, Human
ugugacccugaggucagcagg

SEQ ID NO: 761973 - RNA, 18 nt, Human
ugugcuggcuucuuuccu

SEQ ID NO: 761974 - RNA, 23 nt, Human
uguguacaacauauaaauacaug

SEQ ID NO: 761975 - RNA, 21 nt, Human
uguuucuucccaaaccugccu

SEQ ID NO: 761976 - RNA, 23 nt, Human
uuaaugcaaugaugcugaagaug

SEQ ID NO: 761977 - RNA, 20 nt, Human
uuccuggccaucaacucccc

SEQ ID NO: 761978 - RNA, 24 nt, Human
uugcaggagagcucaggcuggcug

SEQ ID NO: 761979 - RNA, 21 nt, Human
uuuccuggccaucaacucccc

SEQ ID NO: 761980 - RNA, 22 nt, Human
aaaaaaaaaaaaaaagaaagaa

SEQ ID NO: 761981 - RNA, 26 nt, Human
aaaaaaaaaagaaagaaagaaaagaa

SEQ ID NO: 761982 - RNA, 23 nt, Human
aaaaagaaaaaagauauuuacaa

SEQ ID NO: 761983 - RNA, 22 nt, Human
aaaccaauguauguugauccca

SEQ ID NO: 761984 - RNA, 23 nt, Human
aaagaaaaaagauauuuacaagu

SEQ ID NO: 761985 - RNA, 25 nt, Human
aaagaccugcucuaaauccaaauaa

SEQ ID NO: 761986 - RNA, 25 nt, Human
aaauucuuuucaaaucaauagaucc

SEQ ID NO: 761987 - RNA, 23 nt, Human
aacacuuuuuaaaaaauaaaugg

SEQ ID NO: 761988 - RNA, 18 nt, Human
aagaaaaaaaaagaccug

SEQ ID NO: 761989 - RNA, 19 nt, Human
aagaaaaaaaaagaccugc

SEQ ID NO: 761990 - RNA, 24 nt, Human
aagauuuuuccaaagcuuucacag

SEQ ID NO: 761991 - RNA, 20 nt, Human
aaucgccuucuccccccccc

SEQ ID NO: 761992 - RNA, 21 nt, Human
aaucuggacaaaguggaauuu

SEQ ID NO: 761993 - RNA, 19 nt, Human
aauuugcaugguuguccuc

SEQ ID NO: 761994 - RNA, 21 nt, Human
acagacaggucguaaaauuac

SEQ ID NO: 761995 - RNA, 21 nt, Human
accacuucuacgcugccccca

SEQ ID NO: 761996 - RNA, 19 nt, Human
acuguccacucuucagcag

SEQ ID NO: 761997 - RNA, 23 nt, Human
agagauaugccuaauuuaaacaa

SEQ ID NO: 761998 - RNA, 25 nt, Human
agagugcagcaagauaaccucacug

SEQ ID NO: 761999 - RNA, 20 nt, Human
agcacaucccauuuucagca

SEQ ID NO: 762000 - RNA, 22 nt, Human
aggccagaaaauucugggacaa

SEQ ID NO: 762001 - RNA, 23 nt, Human
agugaagaucacugaaaaagccu

SEQ ID NO: 762002 - RNA, 24 nt, Human
auaacagcaccuaaaauacuaaaa

SEQ ID NO: 762003 - RNA, 24 nt, Human
auaauccccuaagauggagacuca

SEQ ID NO: 762004 - RNA, 23 nt, Human
auacaagcacuucagaaaucaga

SEQ ID NO: 762005 - RNA, 21 nt, Human
auacacaaagggaagagacca

SEQ ID NO: 762006 - RNA, 24 nt, Human
auuuacauauacagugaagaucac

SEQ ID NO: 762007 - RNA, 20 nt, Human
caaaguucacaagacuguga

SEQ ID NO: 762008 - RNA, 21 nt, Human
caaauucuuuucaaaucaaua

SEQ ID NO: 762009 - RNA, 18 nt, Human
cacaagacuccauaguca

SEQ ID NO: 762010 - RNA, 18 nt, Human
cagaaaauucugggacaa

SEQ ID NO: 762011 - RNA, 22 nt, Human
cagagaauacaaauacaaacac

SEQ ID NO: 762012 - RNA, 21 nt, Human
cagagugcagcaagauaaccu

SEQ ID NO: 762013 - RNA, 21 nt, Human
cagccucaagcuugaccaaaa

SEQ ID NO: 762014 - RNA, 21 nt, Human
caucaagaaaaugacaccaau

SEQ ID NO: 762015 - RNA, 22 nt, Human
ccaaaaaaaaaaaaaaaaaaaa

SEQ ID NO: 762016 - RNA, 23 nt, Human
ccaaaaaaaaaaaaaaaaaaaaa

SEQ ID NO: 762017 - RNA, 22 nt, Human
ccaaaguaagguccaacugucc

SEQ ID NO: 762018 - RNA, 23 nt, Human
ccaaauaaauuuccacuucuccc

SEQ ID NO: 762019 - RNA, 21 nt, Human
ccaccccccagaaucaauuuu

SEQ ID NO: 762020 - RNA, 23 nt, Human
ccccccccuccccuuccgcagcc

SEQ ID NO: 762021 - RNA, 21 nt, Human
ccgccgccgccgccgcaucca

SEQ ID NO: 762022 - RNA, 23 nt, Human
ccuaagauggagacucaagacau

SEQ ID NO: 762023 - RNA, 18 nt, Human
ccuccggguugccgacuc

SEQ ID NO: 762024 - RNA, 20 nt, Human
cgccgccgccgccgcauccc

SEQ ID NO: 762025 - RNA, 23 nt, Human
cguaaaauuacagacucauuggc

SEQ ID NO: 762026 - RNA, 20 nt, Human
cuacgcugcccccacccccc

SEQ ID NO: 762027 - RNA, 23 nt, Human
cucauuggcauugaacauaacaa

SEQ ID NO: 762028 - RNA, 21 nt, Human
cuccggggcucuccgggaucc

SEQ ID NO: 762029 - RNA, 21 nt, Human
cugcugaaacagaaauuaugu

SEQ ID NO: 762030 - RNA, 20 nt, Human
cuggacaaaguggaauuuca

SEQ ID NO: 762031 - RNA, 19 nt, Human
cuguacagcauuacaaaaa

SEQ ID NO: 762032 - RNA, 20 nt, Human
cuuaaguaauuuauuucuac

SEQ ID NO: 762033 - RNA, 23 nt, Human
cuucuacgcugcccccacccccc

SEQ ID NO: 762034 - RNA, 19 nt, Human
cuuuaugucuacauagcca

SEQ ID NO: 762035 - RNA, 19 nt, Human
gaagauuaagggugcccag

SEQ ID NO: 762036 - RNA, 22 nt, Human
gacucgcuacuccgcucacucc

SEQ ID NO: 762037 - RNA, 25 nt, Human
gcauccaaucgccuucucccccccc

SEQ ID NO: 762038 - RNA, 22 nt, Human
gccgcagauaaaagcuauacaa

SEQ ID NO: 762039 - RNA, 18 nt, Human
gcugcccccaccccccag

SEQ ID NO: 762040 - RNA, 21 nt, Human
ggcuaaagcaugugaccacaa

SEQ ID NO: 762041 - RNA, 20 nt, Human
uaaaagaaaaauaaucacau

SEQ ID NO: 762042 - RNA, 20 nt, Human
uaaaaugucauuuuccaaaa

SEQ ID NO: 762043 - RNA, 20 nt, Human
uaaaauguucuuaauauuuc

SEQ ID NO: 762044 - RNA, 21 nt, Human
uaaaauuacagacucauuggc

SEQ ID NO: 762045 - RNA, 22 nt, Human
uaaaauuacagacucauuggca

SEQ ID NO: 762046 - RNA, 21 nt, Human
uaaagcaugugaccacaaaug

SEQ ID NO: 762047 - RNA, 23 nt, Human
uaaagccgcagauaaaagcuaua

SEQ ID NO: 762048 - RNA, 23 nt, Human
uaacucuccaacaaauagugaca

SEQ ID NO: 762049 - RNA, 22 nt, Human
uaagauaauccccuaagaugga

SEQ ID NO: 762050 - RNA, 24 nt, Human
uaaggaaacauuucaaaaccaaug

SEQ ID NO: 762051 - RNA, 24 nt, Human
uaaguaauuuauuucuacauuuug

SEQ ID NO: 762052 - RNA, 18 nt, Human
uaaguuagaauaugauuu

SEQ ID NO: 762053 - RNA, 19 nt, Human
uacaaugaagaaaaaaaaa

SEQ ID NO: 762054 - RNA, 22 nt, Human
uacagaaaacagcacaucccau

SEQ ID NO: 762055 - RNA, 27 nt, Human
uacagcauuacaaaaaugugaaaugaa

SEQ ID NO: 762056 - RNA, 24 nt, Human
uacaguacauauuuucaaaaugaa

SEQ ID NO: 762057 - RNA, 23 nt, Human
uagcugauauacuuggauauacc

SEQ ID NO: 762058 - RNA, 23 nt, Human
uagugacaucaagaaaaugacac

SEQ ID NO: 762059 - RNA, 27 nt, Human
uauuauaauguagauuaaacaaauuug

SEQ ID NO: 762060 - RNA, 25 nt, Human
ucaaaaacaugcaacucacuauaaa

SEQ ID NO: 762061 - RNA, 22 nt, Human
ucagccucaagcuugaccaaaa

SEQ ID NO: 762062 - RNA, 24 nt, Human
uccgccgccgccgccgcauccaau

SEQ ID NO: 762063 - RNA, 22 nt, Human
ucuacacaaaaaaaaaaaaaaa

SEQ ID NO: 762064 - RNA, 24 nt, Human
ucuacgcugcccccaccccccaga

SEQ ID NO: 762065 - RNA, 25 nt, Human
ucuccgggauccgccgccgccgccg

SEQ ID NO: 762066 - RNA, 21 nt, Human
ucuggacaaaguggaauuuca

SEQ ID NO: 762067 - RNA, 19 nt, Human
ugaaaaagccuccuguugc

SEQ ID NO: 762068 - RNA, 20 nt, Human
ugaaacagaaauuauguguu

SEQ ID NO: 762069 - RNA, 23 nt, Human
ugaaaggccagaaaauucuggga

SEQ ID NO: 762070 - RNA, 21 nt, Human
ugaagaaaaaaaaagaccugc

SEQ ID NO: 762071 - RNA, 22 nt, Human
ugacaaaaauacaaagcuauuc

SEQ ID NO: 762072 - RNA, 24 nt, Human
ugacagccucucauaauuacuggu

SEQ ID NO: 762073 - RNA, 23 nt, Human
ugacauaauacuaugugauggca

SEQ ID NO: 762074 - RNA, 21 nt, Human
ugcaauuuaaucaaugacaaa

SEQ ID NO: 762075 - RNA, 21 nt, Human
ugcaucaaaggcuuuauucag

SEQ ID NO: 762076 - RNA, 20 nt, Human
ugccccaucuauuauaacca

SEQ ID NO: 762077 - RNA, 21 nt, Human
ugccccaucuauuauaaccaa

SEQ ID NO: 762078 - RNA, 24 nt, Human
ugccccaucuauuauaaccaaucu

SEQ ID NO: 762079 - RNA, 19 nt, Human
uggaauauuucuaaugugu

SEQ ID NO: 762080 - RNA, 22 nt, Human
uggcuaaagcaugugaccacaa

SEQ ID NO: 762081 - RNA, 21 nt, Human
ugucuacauagccaucgcaca

SEQ ID NO: 762082 - RNA, 21 nt, Human
ugugaaaugaaauuugcuuaa

SEQ ID NO: 762083 - RNA, 23 nt, Human
ugugauaaauuuaauaaguuaga

SEQ ID NO: 762084 - RNA, 19 nt, Human
uuaaccaugaaaaaacaua

SEQ ID NO: 762085 - RNA, 21 nt, Human
uucacaguaaaauugcagaga

SEQ ID NO: 762086 - RNA, 20 nt, Human
uugcaugguuguccuccuau

SEQ ID NO: 762087 - RNA, 22 nt, Human
uuguacugcugaaacagaaauu

SEQ ID NO: 762088 - RNA, 23 nt, Human
uuucaaaucaauagauccaauaa

SEQ ID NO: 762089 - RNA, 27 nt, Human
uuucuacacaaaaaaaaaaaaaaagaa

SEQ ID NO: 762090 - RNA, 20 nt, Human
uuuuauuauaauguagauua

SEQ ID NO: 762091 - RNA, 25 nt, Human
aaacaacgaccacgccaguucuccu

SEQ ID NO: 762092 - RNA, 18 nt, Human
aaagugcuguccauaacu

SEQ ID NO: 762093 - RNA, 28 nt, Human
aaggacacccccaccugcaagggccagg

SEQ ID NO: 762094 - RNA, 22 nt, Human
acagugcuagagugcagaaaac

SEQ ID NO: 762095 - RNA, 19 nt, Human
acccacggaaucuaaggca

SEQ ID NO: 762096 - RNA, 18 nt, Human
acccccaccugcaagggc

SEQ ID NO: 762097 - RNA, 21 nt, Human
acccccaccugcaagggcaag

SEQ ID NO: 762098 - RNA, 27 nt, Human
accuccugucagacccagacucugcug

SEQ ID NO: 762099 - RNA, 19 nt, Human
acgcacccuccaccaagag

SEQ ID NO: 762100 - RNA, 18 nt, Human
acucaggaccgcuaauaa

SEQ ID NO: 762101 - RNA, 20 nt, Human
agaacagugaaauggcaaaa

SEQ ID NO: 762102 - RNA, 26 nt, Human
agaguucuaauaagcuaagcuuaaag

SEQ ID NO: 762103 - RNA, 21 nt, Human
agcagaacagugaaauggcaa

SEQ ID NO: 762104 - RNA, 22 nt, Human
agcccauuucuuuggaauucgg

SEQ ID NO: 762105 - RNA, 18 nt, Human
agcgcuuccacacagugc

SEQ ID NO: 762106 - RNA, 20 nt, Human
agcucccaggaucuggcucc

SEQ ID NO: 762107 - RNA, 21 nt, Human
agugaaccuugcuggggccug

SEQ ID NO: 762108 - RNA, 19 nt, Human
auauucccccagcccccac

SEQ ID NO: 762109 - RNA, 20 nt, Human
auguccaucacccucaaaau

SEQ ID NO: 762110 - RNA, 18 nt, Human
caaagaaucccaauccuc

SEQ ID NO: 762111 - RNA, 24 nt, Human
caacaugcauauucccccagcccc

SEQ ID NO: 762112 - RNA, 24 nt, Human
caauaaacaccaucaucccugagu

SEQ ID NO: 762113 - RNA, 24 nt, Human
cacagacuacccagacaacacgga

SEQ ID NO: 762114 - RNA, 24 nt, Human
cacccccaccugcaagggcaagga

SEQ ID NO: 762115 - RNA, 22 nt, Human
caccugcaagggcaaggaaagc

SEQ ID NO: 762116 - RNA, 22 nt, Human
cagacaacacggacugcugaag

SEQ ID NO: 762117 - RNA, 20 nt, Human
cagcccccaccuccaucuug

SEQ ID NO: 762118 - RNA, 23 nt, Human
cagcucccaggaucuggcuccag

SEQ ID NO: 762119 - RNA, 19 nt, Human
cagugaaccuugcuggggc

SEQ ID NO: 762120 - RNA, 21 nt, Human
cagugaaccuugcuggggccu

SEQ ID NO: 762121 - RNA, 19 nt, Human
cauguccaucacccucaaa

SEQ ID NO: 762122 - RNA, 21 nt, Human
cauguccaucacccucaaaau

SEQ ID NO: 762123 - RNA, 22 nt, Human
cauucauuaacuaucugcgggg

SEQ ID NO: 762124 - RNA, 25 nt, Human
cauucauuaacuaucugcgggguug

SEQ ID NO: 762125 - RNA, 22 nt, Human
ccacggaaucuaaggcagcaca

SEQ ID NO: 762126 - RNA, 18 nt, Human
ccccggagaaggggcuuc

SEQ ID NO: 762127 - RNA, 22 nt, Human
ccugcaagggcaaggaaagcgu

SEQ ID NO: 762128 - RNA, 22 nt, Human
cuaaggcagcacaguggcuuau

SEQ ID NO: 762129 - RNA, 20 nt, Human
cucccaggaucuggcuccag

SEQ ID NO: 762130 - RNA, 20 nt, Human
cugcuccuugcugacagcuc

SEQ ID NO: 762131 - RNA, 21 nt, Human
cugcuccuugcugacagcucc

SEQ ID NO: 762132 - RNA, 21 nt, Human
gaaaacauguccaucacccuc

SEQ ID NO: 762133 - RNA, 20 nt, Human
gagaaggggcuuccccuccu

SEQ ID NO: 762134 - RNA, 21 nt, Human
gcaaggaaagcgugugcuccc

SEQ ID NO: 762135 - RNA, 25 nt, Human
gcagaaaacauguccaucacccuca

SEQ ID NO: 762136 - RNA, 23 nt, Human
gcuagagugcagaaaacaugucc

SEQ ID NO: 762137 - RNA, 23 nt, Human
ggacacccccaccugcaagggca

SEQ ID NO: 762138 - RNA, 22 nt, Human
gggaagguggggccagggcugg

SEQ ID NO: 762139 - RNA, 22 nt, Human
uaaaaacgccggcuucugcaac

SEQ ID NO: 762140 - RNA, 23 nt, Human
uaaaaacgccggcuucugcaaca

SEQ ID NO: 762141 - RNA, 24 nt, Human
uacagagcccugacuuuacauuuc

SEQ ID NO: 762142 - RNA, 23 nt, Human
uacccagacaacacggacugcug

SEQ ID NO: 762143 - RNA, 21 nt, Human
uaccugcuccuugcugacagc

SEQ ID NO: 762144 - RNA, 24 nt, Human
uacgcacccuccaccaagaguucu

SEQ ID NO: 762145 - RNA, 24 nt, Human
ucaaaauggugacgcugaccuccu

SEQ ID NO: 762146 - RNA, 18 nt, Human
uccacacagugcuagagu

SEQ ID NO: 762147 - RNA, 22 nt, Human
uccacacagugcuagagugcag

SEQ ID NO: 762148 - RNA, 18 nt, Human
ucgcuggguugacguucc

SEQ ID NO: 762149 - RNA, 18 nt, Human
ucggacagccaggcugcu

SEQ ID NO: 762150 - RNA, 24 nt, Human
ugaacaaagaaucccaauccucag

SEQ ID NO: 762151 - RNA, 23 nt, Human
ugaagccuuuucuggaaugugug

SEQ ID NO: 762152 - RNA, 22 nt, Human
ugacagccagggucggaagcac

SEQ ID NO: 762153 - RNA, 22 nt, Human
ugacauuucaaugggaaaaaga

SEQ ID NO: 762154 - RNA, 24 nt, Human
ugcaagggcaaggaaagcgugugc

SEQ ID NO: 762155 - RNA, 19 nt, Human
ugcagaaaacauguccauc

SEQ ID NO: 762156 - RNA, 21 nt, Human
ugcccagggcagaccauucau

SEQ ID NO: 762157 - RNA, 20 nt, Human
ugggaaaaagauugugcauu

SEQ ID NO: 762158 - RNA, 18 nt, Human
uuccacacagugcuagag

SEQ ID NO: 762159 - RNA, 21 nt, Human
uuccacacagugcuagagugc

SEQ ID NO: 762160 - RNA, 18 nt, Human
uucccccagcccccaccu

SEQ ID NO: 762161 - RNA, 20 nt, Human
uucccccagcccccaccucc

SEQ ID NO: 762162 - RNA, 18 nt, Human
uugcuggggccugauucu

SEQ ID NO: 762163 - RNA, 22 nt, Human
uugcuggggccugauucuuuuc

SEQ ID NO: 762164 - RNA, 28 nt, Human
aaaaaaaaacaaaaacaaaaacauugca

SEQ ID NO: 762165 - RNA, 25 nt, Human
aaaaacacaaaacaaauucagcagu

SEQ ID NO: 762166 - RNA, 24 nt, Human
aaaaacaucaaacauacucaaaaa

SEQ ID NO: 762167 - RNA, 26 nt, Human
aaacaauucuccugccucagccaccc

SEQ ID NO: 762168 - RNA, 25 nt, Human
aaacacaaaacaaauucagcagcuc

SEQ ID NO: 762169 - RNA, 18 nt, Human
aaacagacaggaauaaua

SEQ ID NO: 762170 - RNA, 20 nt, Human
aaacauacucaaaaacaggc

SEQ ID NO: 762171 - RNA, 26 nt, Human
aaagaaacaaccuaauugcaccuagg

SEQ ID NO: 762172 - RNA, 20 nt, Human
aaagacacuuuaccucugug

SEQ ID NO: 762173 - RNA, 18 nt, Human
aaagguuucagaaauucu

SEQ ID NO: 762174 - RNA, 24 nt, Human
aaagugauaggauuauaggcguga

SEQ ID NO: 762175 - RNA, 20 nt, Human
aacuaaaaacaaagaaacaa

SEQ ID NO: 762176 - RNA, 23 nt, Human
aagcuagaaaaucacucacugcu

SEQ ID NO: 762177 - RNA, 23 nt, Human
aagcugauaucgauauaacccua

SEQ ID NO: 762178 - RNA, 19 nt, Human
aaggcaguuaucuuuuaaa

SEQ ID NO: 762179 - RNA, 23 nt, Human
aauuuaugagacacuguuuucuu

SEQ ID NO: 762180 - RNA, 23 nt, Human
acaaaauccauuguuccuagaca

SEQ ID NO: 762181 - RNA, 27 nt, Human
acagacagcuccacagguaucaaaaac

SEQ ID NO: 762182 - RNA, 22 nt, Human
acagccacagaacugaaaagcc

SEQ ID NO: 762183 - RNA, 19 nt, Human
acagguaucaaaaaccaaa

SEQ ID NO: 762184 - RNA, 21 nt, Human
acagguaucaaaaaccaaagu

SEQ ID NO: 762185 - RNA, 20 nt, Human
accaaauaccaaacuacugc

SEQ ID NO: 762186 - RNA, 23 nt, Human
agaaaaucacucacugcuaaauc

SEQ ID NO: 762187 - RNA, 24 nt, Human
agagaugggguuucgucauguugg

SEQ ID NO: 762188 - RNA, 21 nt, Human
agcaaacuccuacagguaauu

SEQ ID NO: 762189 - RNA, 19 nt, Human
agccaccgcacuuggccua

SEQ ID NO: 762190 - RNA, 18 nt, Human
aggcgugagccaccgcac

SEQ ID NO: 762191 - RNA, 18 nt, Human
aggcgugagccaccgcac

SEQ ID NO: 762192 - RNA, 19 nt, Human
agggaaacagucauucaau

SEQ ID NO: 762193 - RNA, 19 nt, Human
agguuucagaaauucugau

SEQ ID NO: 762194 - RNA, 18 nt, Human
auaaaacaaguguuuccu

SEQ ID NO: 762195 - RNA, 24 nt, Human
aucaaaaagcuucacauuuauaaa

SEQ ID NO: 762196 - RNA, 23 nt, Human
augcccacguguuuaaccggcca

SEQ ID NO: 762197 - RNA, 23 nt, Human
augggguuucgucauguuggcca

SEQ ID NO: 762198 - RNA, 24 nt, Human
augggguuucgucauguuggccag

SEQ ID NO: 762199 - RNA, 24 nt, Human
caaaaaaaaaacaaaaacaaaaac

SEQ ID NO: 762200 - RNA, 22 nt, Human
caaaacugacacagcaguauua

SEQ ID NO: 762201 - RNA, 22 nt, Human
caaacaauucuccugccucagc

SEQ ID NO: 762202 - RNA, 27 nt, Human
caaacaauucuccugccucagccaccc

SEQ ID NO: 762203 - RNA, 21 nt, Human
caaagcuagaaaaucacucac

SEQ ID NO: 762204 - RNA, 24 nt, Human
caaagugauaggauuauaggcgug

SEQ ID NO: 762205 - RNA, 20 nt, Human
caacaggacagauuauuguc

SEQ ID NO: 762206 - RNA, 18 nt, Human
caacaugucaaaagacau

SEQ ID NO: 762207 - RNA, 21 nt, Human
caagcuggaaagauaaacaac

SEQ ID NO: 762208 - RNA, 18 nt, Human
caaggaaaacaaaaucaa

SEQ ID NO: 762209 - RNA, 20 nt, Human
caauagaaauaaauuguaua

SEQ ID NO: 762210 - RNA, 21 nt, Human
cacauuuuuaauaagcaccaa

SEQ ID NO: 762211 - RNA, 18 nt, Human
cacccuaucuacucaucu

SEQ ID NO: 762212 - RNA, 21 nt, Human
cacccuaucuacucaucucca

SEQ ID NO: 762213 - RNA, 21 nt, Human
cagaaaaaaugaacagagaca

SEQ ID NO: 762214 - RNA, 24 nt, Human
cagauacaaaauccauuguuccua

SEQ ID NO: 762215 - RNA, 21 nt, Human
cagcaagggaccagacauaua

SEQ ID NO: 762216 - RNA, 24 nt, Human
cagcuccacagguaucaaaaacca

SEQ ID NO: 762217 - RNA, 21 nt, Human
cagguaucaaaaaccaaagug

SEQ ID NO: 762218 - RNA, 18 nt, Human
cauguuggccaggcuggu

SEQ ID NO: 762219 - RNA, 20 nt, Human
cauguuggccaggcuggucu

SEQ ID NO: 762220 - RNA, 20 nt, Human
cauguuggccaggcuggucu

SEQ ID NO: 762221 - RNA, 24 nt, Human
cauguuggccaggcuggucuugaa

SEQ ID NO: 762222 - RNA, 22 nt, Human
cauucaauacuuaacacugagu

SEQ ID NO: 762223 - RNA, 18 nt, Human
ccaaaaacagugaaaucc

SEQ ID NO: 762224 - RNA, 22 nt, Human
ccaaagugauaggauuauaggc

SEQ ID NO: 762225 - RNA, 24 nt, Human
ccaaagugauaggauuauaggcgu

SEQ ID NO: 762226 - RNA, 24 nt, Human
ccacccaaguaguugggguuacag

SEQ ID NO: 762227 - RNA, 22 nt, Human
cccaaccuacagacagcuccac

SEQ ID NO: 762228 - RNA, 22 nt, Human
cccaaguaguugggguuacagg

SEQ ID NO: 762229 - RNA, 23 nt, Human
cccaaguaguugggguuacaggu

SEQ ID NO: 762230 - RNA, 24 nt, Human
cccaaguaguugggguuacaggua

SEQ ID NO: 762231 - RNA, 21 nt, Human
ccccuucauuaauacugucca

SEQ ID NO: 762232 - RNA, 21 nt, Human
cccuaaaaauagagaaaaaac

SEQ ID NO: 762233 - RNA, 22 nt, Human
ccuacagacagcuccacaggua

SEQ ID NO: 762234 - RNA, 24 nt, Human
ccucccagguucaaacaauucucc

SEQ ID NO: 762235 - RNA, 27 nt, Human
ccuccugucuuccacagagaagacaaa

SEQ ID NO: 762236 - RNA, 21 nt, Human
ccucugugaauaaaacaagug

SEQ ID NO: 762237 - RNA, 21 nt, Human
ccugaccucaggugaucugcc

SEQ ID NO: 762238 - RNA, 23 nt, Human
ccugaccucaggugaucugccug

SEQ ID NO: 762239 - RNA, 23 nt, Human
cgauauaacccuacuauuuacaa

SEQ ID NO: 762240 - RNA, 24 nt, Human
cgucauguuggccaggcuggucuu

SEQ ID NO: 762241 - RNA, 27 nt, Human
cgucauguuggccaggcuggucuugaa

SEQ ID NO: 762242 - RNA, 20 nt, Human
cuaaacagccacagaacuga

SEQ ID NO: 762243 - RNA, 18 nt, Human
cucacugcuaaaucaugg

SEQ ID NO: 762244 - RNA, 20 nt, Human
cucagucuuccaggacuugg

SEQ ID NO: 762245 - RNA, 26 nt, Human
cuccugaccucaggugaucugccugc

SEQ ID NO: 762246 - RNA, 20 nt, Human
cucuguugcccaggcuggaa

SEQ ID NO: 762247 - RNA, 20 nt, Human
cugacacagcaguauuaaaa

SEQ ID NO: 762248 - RNA, 23 nt, Human
cugcagccuccgccucccagguu

SEQ ID NO: 762249 - RNA, 21 nt, Human
cuuaaaacaauuaagcuagca

SEQ ID NO: 762250 - RNA, 19 nt, Human
cuuccacagagaagacaaa

SEQ ID NO: 762251 - RNA, 21 nt, Human
cuugcucuguugcccaggcug

SEQ ID NO: 762252 - RNA, 24 nt, Human
cuuuuuaguagagaugggguuucg

SEQ ID NO: 762253 - RNA, 19 nt, Human
gaacugaaaagccuuggca

SEQ ID NO: 762254 - RNA, 19 nt, Human
gacacuguuuucuucuuaa

SEQ ID NO: 762255 - RNA, 21 nt, Human
gaccacaaugccaucacaaaa

SEQ ID NO: 762256 - RNA, 22 nt, Human
gaccucaggugaucugccugcc

SEQ ID NO: 762257 - RNA, 23 nt, Human
gagaugggguuucgucauguugg

SEQ ID NO: 762258 - RNA, 24 nt, Human
gagaugggguuucgucauguuggc

SEQ ID NO: 762259 - RNA, 18 nt, Human
gauuauaggcgugagcca

SEQ ID NO: 762260 - RNA, 20 nt, Human
gauuauaggcgugagccacc

SEQ ID NO: 762261 - RNA, 23 nt, Human
gauuauaggcgugagccaccgca

SEQ ID NO: 762262 - RNA, 18 nt, Human
gcaaggaaaacaaaauca

SEQ ID NO: 762263 - RNA, 22 nt, Human
gcagccuccgccucccagguuc

SEQ ID NO: 762264 - RNA, 24 nt, Human
gcccaggcuggaaugcaauggugu

SEQ ID NO: 762265 - RNA, 25 nt, Human
gcucuguugcccaggcuggaaugca

SEQ ID NO: 762266 - RNA, 23 nt, Human
gcuggucuugaacuccugaccuc

SEQ ID NO: 762267 - RNA, 20 nt, Human
gcuguagccuccugucuucc

SEQ ID NO: 762268 - RNA, 23 nt, Human
ggaaagauaaacaacaugacagg

SEQ ID NO: 762269 - RNA, 22 nt, Human
ggauuauaggcgugagccaccg

SEQ ID NO: 762270 - RNA, 24 nt, Human
ggcuggucuugaacuccugaccuc

SEQ ID NO: 762271 - RNA, 22 nt, Human
gggguuucgucauguuggccag

SEQ ID NO: 762272 - RNA, 24 nt, Human
ggguuacagguauaugccaccaug

SEQ ID NO: 762273 - RNA, 19 nt, Human
ggucuugaacuccugaccu

SEQ ID NO: 762274 - RNA, 24 nt, Human
gucaacuugcuuccaguucaaaac

SEQ ID NO: 762275 - RNA, 22 nt, Human
guccuuggucaacuugcuucca

SEQ ID NO: 762276 - RNA, 24 nt, Human
gucuugcucuguugcccaggcugg

SEQ ID NO: 762277 - RNA, 21 nt, Human
guggugaacacgaugaagaaa

SEQ ID NO: 762278 - RNA, 21 nt, Human
guuccuguccccuuuuccuuc

SEQ ID NO: 762279 - RNA, 27 nt, Human
uaaaaacaucaaacauacucaaaaaca

SEQ ID NO: 762280 - RNA, 23 nt, Human
uaaauuaaaagaggcuacuauga

SEQ ID NO: 762281 - RNA, 24 nt, Human
uaaauuaaaagaggcuacuaugau

SEQ ID NO: 762282 - RNA, 23 nt, Human
uaagagccaaagcuagaaaauca

SEQ ID NO: 762283 - RNA, 23 nt, Human
uaaguagauaacauguuaaaugu

SEQ ID NO: 762284 - RNA, 22 nt, Human
uaagugcaauuuaauauaugaa

SEQ ID NO: 762285 - RNA, 24 nt, Human
uaaguuaauaauguuccacauuua

SEQ ID NO: 762286 - RNA, 22 nt, Human
uaauaagcaccaaauaccaaac

SEQ ID NO: 762287 - RNA, 24 nt, Human
uaauuuuuugucuuuuuaguagag

SEQ ID NO: 762288 - RNA, 25 nt, Human
uaauuuuuugucuuuuuaguagaga

SEQ ID NO: 762289 - RNA, 21 nt, Human
uacaaugucauuucccuaguu

SEQ ID NO: 762290 - RNA, 23 nt, Human
uacacugcaccuguguuaccaaa

SEQ ID NO: 762291 - RNA, 24 nt, Human
uacagguauaugccaccaugccca

SEQ ID NO: 762292 - RNA, 22 nt, Human
uaccaaaaaaaaaacaaaaaca

SEQ ID NO: 762293 - RNA, 23 nt, Human
uaccaaaaaaaaaacaaaaacaa

SEQ ID NO: 762294 - RNA, 24 nt, Human
uaccaaaaaaaaaacaaaaacaaa

SEQ ID NO: 762295 - RNA, 25 nt, Human
uaccaaaaaaaaaacaaaaacaaaa

SEQ ID NO: 762296 - RNA, 22 nt, Human
uaccuaauaagagccaaagcua

SEQ ID NO: 762297 - RNA, 25 nt, Human
uacuagacuacaguacuuuaaaaca

SEQ ID NO: 762298 - RNA, 19 nt, Human
uagacuacaaaagagcuug

SEQ ID NO: 762299 - RNA, 18 nt, Human
uaggauuauaggcgugag

SEQ ID NO: 762300 - RNA, 19 nt, Human
uaggauuauaggcgugagc

SEQ ID NO: 762301 - RNA, 21 nt, Human
uaggauuauaggcgugagcca

SEQ ID NO: 762302 - RNA, 22 nt, Human
uaggauuauaggcgugagccac

SEQ ID NO: 762303 - RNA, 23 nt, Human
uaggauuauaggcgugagccacc

SEQ ID NO: 762304 - RNA, 24 nt, Human
uaggauuauaggcgugagccaccg

SEQ ID NO: 762305 - RNA, 23 nt, Human
uaggucagaauuagaaaaaagua

SEQ ID NO: 762306 - RNA, 24 nt, Human
uaguagagaugggguuucgucaug

SEQ ID NO: 762307 - RNA, 19 nt, Human
uauacaauacauuaaguac

SEQ ID NO: 762308 - RNA, 23 nt, Human
uauaggcgugagccaccgcacuu

SEQ ID NO: 762309 - RNA, 22 nt, Human
uauauacaauacauuaaguacu

SEQ ID NO: 762310 - RNA, 24 nt, Human
uaucuugcuuucuuccccuugucu

SEQ ID NO: 762311 - RNA, 18 nt, Human
ucaaacauacucaaaaac

SEQ ID NO: 762312 - RNA, 19 nt, Human
ucacugcagccuccgccuc

SEQ ID NO: 762313 - RNA, 23 nt, Human
ucacugcagccuccgccucccag

SEQ ID NO: 762314 - RNA, 24 nt, Human
ucacugcagccuccgccucccagg

SEQ ID NO: 762315 - RNA, 25 nt, Human
ucagcaaacuccuacagguaauuac

SEQ ID NO: 762316 - RNA, 21 nt, Human
ucaguguuuuguguaucuuca

SEQ ID NO: 762317 - RNA, 21 nt, Human
ucaugacuaggggaguacagg

SEQ ID NO: 762318 - RNA, 19 nt, Human
uccaacuuuagcccuuuga

SEQ ID NO: 762319 - RNA, 21 nt, Human
uccacaauguuccuaauucaa

SEQ ID NO: 762320 - RNA, 24 nt, Human
uccaguucaaaacaaaccacauuu

SEQ ID NO: 762321 - RNA, 24 nt, Human
ucccaaagugauaggauuauaggc

SEQ ID NO: 762322 - RNA, 23 nt, Human
ucccagcucacugcagccuccgc

SEQ ID NO: 762323 - RNA, 21 nt, Human
ucccagguucaaacaauucuc

SEQ ID NO: 762324 - RNA, 24 nt, Human
ucccagguucaaacaauucuccug

SEQ ID NO: 762325 - RNA, 23 nt, Human
ucccuaaauuauccuuguuacaa

SEQ ID NO: 762326 - RNA, 22 nt, Human
ucgucauguuggccaggcuggu

SEQ ID NO: 762327 - RNA, 22 nt, Human
ucuaccacucaauagaaauaaa

SEQ ID NO: 762328 - RNA, 22 nt, Human
ucuguauuuuagcuuaagaaaa

SEQ ID NO: 762329 - RNA, 18 nt, Human
ucuguugcccaggcugga

SEQ ID NO: 762330 - RNA, 24 nt, Human
ucuguugcccaggcuggaaugcaa

SEQ ID NO: 762331 - RNA, 18 nt, Human
ucuuccucauuccuaaau

SEQ ID NO: 762332 - RNA, 23 nt, Human
ucuugaacuccugaccucaggug

SEQ ID NO: 762333 - RNA, 23 nt, Human
ucuugcucuguugcccaggcugg

SEQ ID NO: 762334 - RNA, 24 nt, Human
ucuugcucuguugcccaggcugga

SEQ ID NO: 762335 - RNA, 19 nt, Human
ucuuggauugggccuaauu

SEQ ID NO: 762336 - RNA, 24 nt, Human
ugaaacuaaaaacaaagaaacaac

SEQ ID NO: 762337 - RNA, 21 nt, Human
ugaacagagacaaaacagugu

SEQ ID NO: 762338 - RNA, 18 nt, Human
ugaccucaggugaucugc

SEQ ID NO: 762339 - RNA, 20 nt, Human
ugaccucaggugaucugccu

SEQ ID NO: 762340 - RNA, 24 nt, Human
ugaccucaggugaucugccugccu

SEQ ID NO: 762341 - RNA, 23 nt, Human
ugauacccuaaaaauagagaaaa

SEQ ID NO: 762342 - RNA, 22 nt, Human
ugauuuacaaugucauuucccu

SEQ ID NO: 762343 - RNA, 22 nt, Human
ugauuuacuaugauacccuaaa

SEQ ID NO: 762344 - RNA, 20 nt, Human
ugcaaugguguaaucccagc

SEQ ID NO: 762345 - RNA, 23 nt, Human
ugcagccuccgccucccagguuc

SEQ ID NO: 762346 - RNA, 20 nt, Human
ugcccagcuaauuuuuuguc

SEQ ID NO: 762347 - RNA, 21 nt, Human
ugcccaggcuggaaugcaaug

SEQ ID NO: 762348 - RNA, 20 nt, Human
ugccucagccacccaaguag

SEQ ID NO: 762349 - RNA, 20 nt, Human
uggaaaaggggauguccaca

SEQ ID NO: 762350 - RNA, 20 nt, Human
uggaaagauaaacaacauga

SEQ ID NO: 762351 - RNA, 20 nt, Human
uggaaagauaaacaacauga

SEQ ID NO: 762352 - RNA, 24 nt, Human
uggccaggcuggucuugaacuccu

SEQ ID NO: 762353 - RNA, 20 nt, Human
uggccugguccguuuuauga

SEQ ID NO: 762354 - RNA, 22 nt, Human
ugggguuacagguauaugccac

SEQ ID NO: 762355 - RNA, 24 nt, Human
ugggguuacagguauaugccacca

SEQ ID NO: 762356 - RNA, 24 nt, Human
ugggguuucgucauguuggccagg

SEQ ID NO: 762357 - RNA, 24 nt, Human
ugguguaaucccagcucacugcag

SEQ ID NO: 762358 - RNA, 22 nt, Human
uguccccuuuuccuucacaguc

SEQ ID NO: 762359 - RNA, 25 nt, Human
ugucucagucuuccaggacuuggag

SEQ ID NO: 762360 - RNA, 19 nt, Human
ugucuuuuuaguagagaug

SEQ ID NO: 762361 - RNA, 18 nt, Human
uguuccuguccccuuuuc

SEQ ID NO: 762362 - RNA, 20 nt, Human
uguuccuguccccuuuuccu

SEQ ID NO: 762363 - RNA, 20 nt, Human
uuacagguauaugccaccau

SEQ ID NO: 762364 - RNA, 18 nt, Human
uuaguagagaugggguuu

SEQ ID NO: 762365 - RNA, 19 nt, Human
uuaguagagaugggguuuc

SEQ ID NO: 762366 - RNA, 24 nt, Human
uuaguagagaugggguuucgucau

SEQ ID NO: 762367 - RNA, 23 nt, Human
uuauuacagaaaaacacaaaaca

SEQ ID NO: 762368 - RNA, 26 nt, Human
uucaaacaauucuccugccucagcca

SEQ ID NO: 762369 - RNA, 20 nt, Human
uuccuguccccuuuuccuuc

SEQ ID NO: 762370 - RNA, 22 nt, Human
uuccuuggcaguuuuacacagg

SEQ ID NO: 762371 - RNA, 23 nt, Human
uugagacagucuugcucuguugc

SEQ ID NO: 762372 - RNA, 24 nt, Human
uugagacagucuugcucuguugcc

SEQ ID NO: 762373 - RNA, 18 nt, Human
uugcccaggcuggaaugc

SEQ ID NO: 762374 - RNA, 22 nt, Human
uugcuacuaucaauuauucucg

SEQ ID NO: 762375 - RNA, 21 nt, Human
uugggguuacagguauaugcc

SEQ ID NO: 762376 - RNA, 19 nt, Human
uuguauguuaaggaaggaa

SEQ ID NO: 762377 - RNA, 19 nt, Human
uuuacuaugauacccuaaa

SEQ ID NO: 762378 - RNA, 19 nt, Human
uuuauagaugccaccuaaa

SEQ ID NO: 762379 - RNA, 24 nt, Human
uuucgucauguuggccaggcuggu

SEQ ID NO: 762380 - RNA, 24 nt, Human
uuucuuuauuuacaguacaagucu

SEQ ID NO: 762381 - RNA, 21 nt, Human
uuuugagacagucuugcucug

SEQ ID NO: 762382 - RNA, 22 nt, Human
uuuuuaguagagaugggguuuc

SEQ ID NO: 762383 - RNA, 21 nt, Human
uuuuugucuuuuuaguagaga

SEQ ID NO: 762384 - RNA, 24 nt, Human
uuuuugucuuuuuaguagagaugg

SEQ ID NO: 762385 - RNA, 24 nt, Human
uuuuuugucuuuuuaguagagaug

SEQ ID NO: 762386 - RNA, 18 nt, Human
aaaacacaaagaccuggg

SEQ ID NO: 762387 - RNA, 20 nt, Human
aaaacuguucccacuuccaa

SEQ ID NO: 762388 - RNA, 23 nt, Human
aaacaccaccacgggagugagcc

SEQ ID NO: 762389 - RNA, 25 nt, Human
aaacaccaccacgggagugagccca

SEQ ID NO: 762390 - RNA, 18 nt, Human
aaacagggcaaaacacaa

SEQ ID NO: 762391 - RNA, 24 nt, Human
aaacaugaaaaacuauaaaaauaa

SEQ ID NO: 762392 - RNA, 25 nt, Human
aaacaugaaaaacuauaaaaauaau

SEQ ID NO: 762393 - RNA, 18 nt, Human
aacacuguuucagacgag

SEQ ID NO: 762394 - RNA, 18 nt, Human
aaccauagcuauaaauua

SEQ ID NO: 762395 - RNA, 24 nt, Human
aaccauagcuauaaauuaaagugc

SEQ ID NO: 762396 - RNA, 25 nt, Human
aagcaaaacaugaaaaacuauaaaa

SEQ ID NO: 762397 - RNA, 18 nt, Human
aagcucgaaagcgaacac

SEQ ID NO: 762398 - RNA, 18 nt, Human
aagugcuuuacauuuugc

SEQ ID NO: 762399 - RNA, 18 nt, Human
aaguuucccaaagacccg

SEQ ID NO: 762400 - RNA, 23 nt, Human
aauauacauacauauacaagaca

SEQ ID NO: 762401 - RNA, 21 nt, Human
aauccuggagcaauccugcug

SEQ ID NO: 762402 - RNA, 19 nt, Human
aauggcugauuaauacgca

SEQ ID NO: 762403 - RNA, 21 nt, Human
aauuaaacuccgaggaaccca

SEQ ID NO: 762404 - RNA, 21 nt, Human
acaagacacaggaaaugagag

SEQ ID NO: 762405 - RNA, 23 nt, Human
acacacacacacacgcacacaca

SEQ ID NO: 762406 - RNA, 23 nt, Human
acacacacacacgcacacacaca

SEQ ID NO: 762407 - RNA, 24 nt, Human
acacacacacacgcacacacacac

SEQ ID NO: 762408 - RNA, 23 nt, Human
acagugagacccaaaguuuccca

SEQ ID NO: 762409 - RNA, 21 nt, Human
acccaaaguuucccaaagacc

SEQ ID NO: 762410 - RNA, 23 nt, Human
agacaaaaguaaaaaauacgacc

SEQ ID NO: 762411 - RNA, 22 nt, Human
agcaagaaacauuaacguacag

SEQ ID NO: 762412 - RNA, 22 nt, Human
agccaacacaggcagccucaca

SEQ ID NO: 762413 - RNA, 25 nt, Human
agccacacacacgugcacacacaca

SEQ ID NO: 762414 - RNA, 21 nt, Human
agccgacgccgcaacguaaua

SEQ ID NO: 762415 - RNA, 22 nt, Human
agcguggaacaccccacacccc

SEQ ID NO: 762416 - RNA, 22 nt, Human
agcuguggcaguaaagggcacc

SEQ ID NO: 762417 - RNA, 21 nt, Human
aggaaauaaugucggacaaaa

SEQ ID NO: 762418 - RNA, 23 nt, Human
aggaaauaaugucggacaaaaac

SEQ ID NO: 762419 - RNA, 19 nt, Human
aggaacccaagcagguggc

SEQ ID NO: 762420 - RNA, 20 nt, Human
aggcaacagugagacccaaa

SEQ ID NO: 762421 - RNA, 18 nt, Human
aggcagccucacagucuu

SEQ ID NO: 762422 - RNA, 20 nt, Human
agugaccaguauuauauuug

SEQ ID NO: 762423 - RNA, 19 nt, Human
aguuacuccagggaacgca

SEQ ID NO: 762424 - RNA, 20 nt, Human
aguuacuccagggaacgcag

SEQ ID NO: 762425 - RNA, 18 nt, Human
aucauccuaagacacccg

SEQ ID NO: 762426 - RNA, 20 nt, Human
auggaacacuuauaaaugca

SEQ ID NO: 762427 - RNA, 22 nt, Human
auuaaagugcuuuacauuuugc

SEQ ID NO: 762428 - RNA, 19 nt, Human
auuaacguacagauaccag

SEQ ID NO: 762429 - RNA, 20 nt, Human
caaaacacaaagaccugggg

SEQ ID NO: 762430 - RNA, 20 nt, Human
caaacagugaaacuaagggc

SEQ ID NO: 762431 - RNA, 24 nt, Human
caaaggacggguccaaaaguccca

SEQ ID NO: 762432 - RNA, 19 nt, Human
caaauguaaugcccuacug

SEQ ID NO: 762433 - RNA, 26 nt, Human
caagcagguggccugugcuguaauga

SEQ ID NO: 762434 - RNA, 20 nt, Human
caauaaaaacugauuccaug

SEQ ID NO: 762435 - RNA, 19 nt, Human
caaugucaacaacucacaa

SEQ ID NO: 762436 - RNA, 23 nt, Human
caauguuucaccaaagcaaaaca

SEQ ID NO: 762437 - RNA, 18 nt, Human
cacacacacacacacaca

SEQ ID NO: 762438 - RNA, 20 nt, Human
cacacacacacacacacaca

SEQ ID NO: 762439 - RNA, 26 nt, Human
cacacacacacacacacacacgcaca

SEQ ID NO: 762440 - RNA, 25 nt, Human
cacacacacacacacacacgcacac

SEQ ID NO: 762441 - RNA, 26 nt, Human
cacacacacacacacgcacacacaca

SEQ ID NO: 762442 - RNA, 22 nt, Human
cacacacacacgcacacacaca

SEQ ID NO: 762443 - RNA, 33 nt, Human
cacacacacgugcacacacacacacacacagug

SEQ ID NO: 762444 - RNA, 18 nt, Human
cacacgcacacacacacc

SEQ ID NO: 762445 - RNA, 21 nt, Human
cacagcccugcaucaggcaag

SEQ ID NO: 762446 - RNA, 19 nt, Human
caccaggcucacucagcag

SEQ ID NO: 762447 - RNA, 20 nt, Human
cacccuuuccagggucaaag

SEQ ID NO: 762448 - RNA, 26 nt, Human
cacgugcacacacacacacacacaca

SEQ ID NO: 762449 - RNA, 23 nt, Human
cagaaauuagaguagaagcugac

SEQ ID NO: 762450 - RNA, 23 nt, Human
cagauuccaaaauauguacagag

SEQ ID NO: 762451 - RNA, 20 nt, Human
cagcaacaucuggacacagc

SEQ ID NO: 762452 - RNA, 22 nt, Human
cagcaaggugccccggcuccug

SEQ ID NO: 762453 - RNA, 18 nt, Human
cagcagcaguggaugagc

SEQ ID NO: 762454 - RNA, 24 nt, Human
caggaguccaguuucugagguccc

SEQ ID NO: 762455 - RNA, 21 nt, Human
cagggcaaaacacaaagaccu

SEQ ID NO: 762456 - RNA, 21 nt, Human
caguaaagggcaccagugugc

SEQ ID NO: 762457 - RNA, 18 nt, Human
caugagaccucaggagac

SEQ ID NO: 762458 - RNA, 22 nt, Human
cauuaaaugaaauucuggacac

SEQ ID NO: 762459 - RNA, 24 nt, Human
cauuucaugugcuacaugggaggu

SEQ ID NO: 762460 - RNA, 22 nt, Human
ccaaagcaaaacaugaaaaacu

SEQ ID NO: 762461 - RNA, 22 nt, Human
ccaagagaaaaagugaggcccc

SEQ ID NO: 762462 - RNA, 25 nt, Human
ccagccaggcaacagugagacccaa

SEQ ID NO: 762463 - RNA, 19 nt, Human
cccaccacaagaccuggaa

SEQ ID NO: 762464 - RNA, 24 nt, Human
cccacuuccaaacacuguuucaga

SEQ ID NO: 762465 - RNA, 19 nt, Human
ccccggcuccugagagcuc

SEQ ID NO: 762466 - RNA, 21 nt, Human
cccuccuaccucaccguaaaa

SEQ ID NO: 762467 - RNA, 25 nt, Human
ccgacgccgcaacguaauacagaag

SEQ ID NO: 762468 - RNA, 23 nt, Human
ccuaagacacccagacuuucaaa

SEQ ID NO: 762469 - RNA, 21 nt, Human
ccuacugcaccugcaccuacc

SEQ ID NO: 762470 - RNA, 24 nt, Human
ccuccaaagaaauauguuuuucac

SEQ ID NO: 762471 - RNA, 21 nt, Human
ccugaagacccaaguagggag

SEQ ID NO: 762472 - RNA, 24 nt, Human
ccugcaccuaccgguccccagaug

SEQ ID NO: 762473 - RNA, 20 nt, Human
ccugugucucuccaaguggu

SEQ ID NO: 762474 - RNA, 22 nt, Human
cgacacagcagcgaacagcaag

SEQ ID NO: 762475 - RNA, 18 nt, Human
cgagguaaacacaaaauc

SEQ ID NO: 762476 - RNA, 25 nt, Human
cgugcacacacacacacacacacac

SEQ ID NO: 762477 - RNA, 20 nt, Human
cgugcacacacacacacagu

SEQ ID NO: 762478 - RNA, 25 nt, Human
cuaccgguccccagauggguucccu

SEQ ID NO: 762479 - RNA, 23 nt, Human
cucccaacauagcguggaacacc

SEQ ID NO: 762480 - RNA, 25 nt, Human
cugagcaccacagggcugcgccccc

SEQ ID NO: 762481 - RNA, 27 nt, Human
cugcaccuaccgguccccagauggguu

SEQ ID NO: 762482 - RNA, 18 nt, Human
cuguaaauauuaccuucc

SEQ ID NO: 762483 - RNA, 20 nt, Human
cuugugcgccuaaguggaga

SEQ ID NO: 762484 - RNA, 20 nt, Human
cuuugccucuacugcccaga

SEQ ID NO: 762485 - RNA, 21 nt, Human
gaaaagaacauauacaaagca

SEQ ID NO: 762486 - RNA, 20 nt, Human
gacacagcagcgaacagcaa

SEQ ID NO: 762487 - RNA, 18 nt, Human
gaggugccucucaucccu

SEQ ID NO: 762488 - RNA, 23 nt, Human
gcaauccugcuggucgccagcca

SEQ ID NO: 762489 - RNA, 23 nt, Human
gcacccuuuccagggucaaacuc

SEQ ID NO: 762490 - RNA, 27 nt, Human
gcaguaaagggcaccagugugccugga

SEQ ID NO: 762491 - RNA, 23 nt, Human
gcaguggaugagcucacauuaga

SEQ ID NO: 762492 - RNA, 19 nt, Human
gcagugugggaggcucugg

SEQ ID NO: 762493 - RNA, 24 nt, Human
gccacacacacgugcacacacaca

SEQ ID NO: 762494 - RNA, 18 nt, Human
gcugacuacacgacagca

SEQ ID NO: 762495 - RNA, 23 nt, Human
ggacaaaaacacaacaaccccgg

SEQ ID NO: 762496 - RNA, 21 nt, Human
ggcaaaacacaaagaccuggg

SEQ ID NO: 762497 - RNA, 23 nt, Human
ggcucucaaacaccaccacggga

SEQ ID NO: 762498 - RNA, 21 nt, Human
gggaggcucuggcaauuggac

SEQ ID NO: 762499 - RNA, 21 nt, Human
gucagcuugugcgccuaagug

SEQ ID NO: 762500 - RNA, 27 nt, Human
gugaaaagaacauauacaaagcacccu

SEQ ID NO: 762501 - RNA, 20 nt, Human
uaaaaauaauaagacuccca

SEQ ID NO: 762502 - RNA, 22 nt, Human
uaaacacaaaauccuggagcaa

SEQ ID NO: 762503 - RNA, 22 nt, Human
uaaagugcuuuacauuuugcuu

SEQ ID NO: 762504 - RNA, 24 nt, Human
uaacuucuaaacuccagguuaccu

SEQ ID NO: 762505 - RNA, 27 nt, Human
uaauuuagccacacacacgugcacaca

SEQ ID NO: 762506 - RNA, 22 nt, Human
uacaggacaaaacuguucccac

SEQ ID NO: 762507 - RNA, 19 nt, Human
uagaagacgacacagcagc

SEQ ID NO: 762508 - RNA, 23 nt, Human
uagaagacgacacagcagcgaac

SEQ ID NO: 762509 - RNA, 18 nt, Human
uagcuauaaauuaaagug

SEQ ID NO: 762510 - RNA, 22 nt, Human
uaguguccuggucacuccugca

SEQ ID NO: 762511 - RNA, 21 nt, Human
ucaaacucucacaaaaauggc

SEQ ID NO: 762512 - RNA, 24 nt, Human
ucaccaaagcaaaacaugaaaaac

SEQ ID NO: 762513 - RNA, 19 nt, Human
ucaccggggccugcuggcu

SEQ ID NO: 762514 - RNA, 21 nt, Human
ucaggacagcaggagcugaaa

SEQ ID NO: 762515 - RNA, 22 nt, Human
ucauuaaaugaaauucuggaca

SEQ ID NO: 762516 - RNA, 21 nt, Human
uccaaaagucccacguccuuc

SEQ ID NO: 762517 - RNA, 20 nt, Human
uccaaauggugcaaauccaa

SEQ ID NO: 762518 - RNA, 24 nt, Human
uccauggaacacuuauaaaugcau

SEQ ID NO: 762519 - RNA, 18 nt, Human
ucccaaagacccgucucu

SEQ ID NO: 762520 - RNA, 18 nt, Human
ucccaacauagcguggaa

SEQ ID NO: 762521 - RNA, 24 nt, Human
ucccggucgcagacaccgcagaaa

SEQ ID NO: 762522 - RNA, 24 nt, Human
uccuuggaccagcuccugaagacc

SEQ ID NO: 762523 - RNA, 21 nt, Human
ucggacaaaaacacaacacau

SEQ ID NO: 762524 - RNA, 20 nt, Human
ucuaaaaccuguuuauaacc

SEQ ID NO: 762525 - RNA, 24 nt, Human
ucucugagguaguguuguuggcuc

SEQ ID NO: 762526 - RNA, 22 nt, Human
ugaaaagaacauauacaaagca

SEQ ID NO: 762527 - RNA, 23 nt, Human
ugaaaagaacauauacaaagcac

SEQ ID NO: 762528 - RNA, 21 nt, Human
ugaaacuaagggcugccggug

SEQ ID NO: 762529 - RNA, 22 nt, Human
ugaagacccaaguagggaggug

SEQ ID NO: 762530 - RNA, 20 nt, Human
ugacuccugaucaccacgcu

SEQ ID NO: 762531 - RNA, 23 nt, Human
ugagagccucuuuaucaaaacug

SEQ ID NO: 762532 - RNA, 23 nt, Human
ugagccuccagguggacguauug

SEQ ID NO: 762533 - RNA, 21 nt, Human
ugaggucccuccaguuugcca

SEQ ID NO: 762534 - RNA, 20 nt, Human
ugaucaccacgcugcagcag

SEQ ID NO: 762535 - RNA, 24 nt, Human
ugcaauaagcucgaaagcgaacac

SEQ ID NO: 762536 - RNA, 25 nt, Human
ugcacacacacacacacacacacgc

SEQ ID NO: 762537 - RNA, 18 nt, Human
ugccccggcuccugagag

SEQ ID NO: 762538 - RNA, 24 nt, Human
ugccccggcuccugagagcucugc

SEQ ID NO: 762539 - RNA, 18 nt, Human
ugcccugggcucagaccu

SEQ ID NO: 762540 - RNA, 20 nt, Human
ugcccugggcucagaccuuu

SEQ ID NO: 762541 - RNA, 19 nt, Human
ugccugagcaccacagggc

SEQ ID NO: 762542 - RNA, 21 nt, Human
ugcuccgccuuggucccgguc

SEQ ID NO: 762543 - RNA, 18 nt, Human
uggaacaccccacacccc

SEQ ID NO: 762544 - RNA, 22 nt, Human
uggaacaccccacacccccggc

SEQ ID NO: 762545 - RNA, 26 nt, Human
uggaacaccccacacccccggcgacu

SEQ ID NO: 762546 - RNA, 20 nt, Human
uggcacugagaggcgucccc

SEQ ID NO: 762547 - RNA, 20 nt, Human
ugugcaguggccccagaagc

SEQ ID NO: 762548 - RNA, 19 nt, Human
uuacuccagggaacgcagg

SEQ ID NO: 762549 - RNA, 20 nt, Human
uuagccacacacacgugcaa

SEQ ID NO: 762550 - RNA, 21 nt, Human
uucacacaaauguaaugcccu

SEQ ID NO: 762551 - RNA, 20 nt, Human
uucacagacuuaaguaacaa

SEQ ID NO: 762552 - RNA, 27 nt, Human
uuccagcuauaaaccaaagugcuccag

SEQ ID NO: 762553 - RNA, 21 nt, Human
uucuugggcccggggcuguca

SEQ ID NO: 762554 - RNA, 21 nt, Human
uugaaacaucuaaaaccuguu

SEQ ID NO: 762555 - RNA, 21 nt, Human
uuggaccuccagccaagagaa

SEQ ID NO: 762556 - RNA, 25 nt, Human
uuucauauugcaaugaagacaguca

SEQ ID NO: 762557 - RNA, 18 nt, Human
uuugcagaacuguaacag

SEQ ID NO: 762558 - RNA, 22 nt, Human
uuugccucuacugcccagagga

SEQ ID NO: 762559 - RNA, 22 nt, Human
uuuuuuaacuucuaaacuccag

SEQ ID NO: 762560 - RNA, 24 nt, Human
aaaaauugggaaaacuucacacua

SEQ ID NO: 762561 - RNA, 21 nt, Human
aaaauaagcccaucucuccac

SEQ ID NO: 762562 - RNA, 21 nt, Human
aaagcauaugccaaguguguc

SEQ ID NO: 762563 - RNA, 26 nt, Human
aacaauauuccugcaaguaucgccaa

SEQ ID NO: 762564 - RNA, 21 nt, Human
aaccauuuccuugaacccaga

SEQ ID NO: 762565 - RNA, 22 nt, Human
aauaccgagaguacugaccuug

SEQ ID NO: 762566 - RNA, 25 nt, Human
acaaaccucaggaaaaggggaacgc

SEQ ID NO: 762567 - RNA, 23 nt, Human
acagaauucaagaccaaaacugg

SEQ ID NO: 762568 - RNA, 19 nt, Human
acaggugcaugaagcauuu

SEQ ID NO: 762569 - RNA, 20 nt, Human
acccagaccaucagggagcu

SEQ ID NO: 762570 - RNA, 20 nt, Human
accucauccauccccuucuc

SEQ ID NO: 762571 - RNA, 24 nt, Human
agacaaacaugaaggcugagucua

SEQ ID NO: 762572 - RNA, 18 nt, Human
agacaagaggugcuaucc

SEQ ID NO: 762573 - RNA, 19 nt, Human
agagagagcuagaaagggc

SEQ ID NO: 762574 - RNA, 23 nt, Human
agagucacaggugcuguguucug

SEQ ID NO: 762575 - RNA, 21 nt, Human
agccagcaggcaucugcagug

SEQ ID NO: 762576 - RNA, 19 nt, Human
agccauucagcugcaaccc

SEQ ID NO: 762577 - RNA, 22 nt, Human
agcuagaaagggcaggagugag

SEQ ID NO: 762578 - RNA, 18 nt, Human
agcucaguggcgcgagcc

SEQ ID NO: 762579 - RNA, 21 nt, Human
agcugggugagugucugcggc

SEQ ID NO: 762580 - RNA, 20 nt, Human
agcuggugggugagugagcu

SEQ ID NO: 762581 - RNA, 22 nt, Human
agcuguguggugggggaugcag

SEQ ID NO: 762582 - RNA, 20 nt, Human
aggaagaccaacccuggaaa

SEQ ID NO: 762583 - RNA, 22 nt, Human
aggcaguguucaauuaacaaag

SEQ ID NO: 762584 - RNA, 20 nt, Human
aggcugaggcaggagaucgc

SEQ ID NO: 762585 - RNA, 22 nt, Human
aggcugaggcaggagaucgcuc

SEQ ID NO: 762586 - RNA, 18 nt, Human
aguacugaccuugaguaa

SEQ ID NO: 762587 - RNA, 21 nt, Human
aucuucaguuccuuugggggu

SEQ ID NO: 762588 - RNA, 22 nt, Human
caaaaaaagcccacacaaccac

SEQ ID NO: 762589 - RNA, 19 nt, Human
caaaauaagcccaucucuc

SEQ ID NO: 762590 - RNA, 23 nt, Human
caaaauaagcccaucucuccacc

SEQ ID NO: 762591 - RNA, 18 nt, Human
caaaggacuccaaucaaa

SEQ ID NO: 762592 - RNA, 23 nt, Human
caagaccaaaacugcaauaacug

SEQ ID NO: 762593 - RNA, 23 nt, Human
caagggacucuguaccaucugga

SEQ ID NO: 762594 - RNA, 19 nt, Human
cacaaaauucaaguaacag

SEQ ID NO: 762595 - RNA, 20 nt, Human
cacagaauucaagaccaaaa

SEQ ID NO: 762596 - RNA, 22 nt, Human
caccuacagccuucccaaaaaa

SEQ ID NO: 762597 - RNA, 19 nt, Human
cagcaaugguacaauccca

SEQ ID NO: 762598 - RNA, 18 nt, Human
cagccggcuggugcugga

SEQ ID NO: 762599 - RNA, 19 nt, Human
cagguccuuugagucagga

SEQ ID NO: 762600 - RNA, 20 nt, Human
caucaacaauauuccugcaa

SEQ ID NO: 762601 - RNA, 19 nt, Human
caucaagucauccguacca

SEQ ID NO: 762602 - RNA, 21 nt, Human
cauccccuucucaggaagacc

SEQ ID NO: 762603 - RNA, 28 nt, Human
caucucuccaccuacagccuucccaaaa

SEQ ID NO: 762604 - RNA, 22 nt, Human
ccaauacaucuguguacaaaga

SEQ ID NO: 762605 - RNA, 21 nt, Human
ccacaauauuuauuuugccac

SEQ ID NO: 762606 - RNA, 25 nt, Human
ccaccuacagccuucccaaaaaaca

SEQ ID NO: 762607 - RNA, 22 nt, Human
ccauccccuucucaggaagacc

SEQ ID NO: 762608 - RNA, 21 nt, Human
cccaaaaaacaggcuguaggc

SEQ ID NO: 762609 - RNA, 20 nt, Human
ccccgcuaccccacucgcug

SEQ ID NO: 762610 - RNA, 21 nt, Human
ccccuccguaaagcaugaaaa

SEQ ID NO: 762611 - RNA, 20 nt, Human
cccuucucaggaagaccaaa

SEQ ID NO: 762612 - RNA, 21 nt, Human
cgacacaauccccuccguaaa

SEQ ID NO: 762613 - RNA, 20 nt, Human
cgucaguuagcaaguagcug

SEQ ID NO: 762614 - RNA, 24 nt, Human
cuaacuccuauuauaaaacuucca

SEQ ID NO: 762615 - RNA, 23 nt, Human
cuacagccuucccaaaaaacagg

SEQ ID NO: 762616 - RNA, 18 nt, Human
cuccagagaaaggcagug

SEQ ID NO: 762617 - RNA, 25 nt, Human
cucucauaguaaaagccugcucuac

SEQ ID NO: 762618 - RNA, 24 nt, Human
cucuccaccuacagccuucccaaa

SEQ ID NO: 762619 - RNA, 19 nt, Human
cucugaaggcccccagaac

SEQ ID NO: 762620 - RNA, 18 nt, Human
cucuguguggcucagagu

SEQ ID NO: 762621 - RNA, 23 nt, Human
cuguguguuaccucauccauccc

SEQ ID NO: 762622 - RNA, 23 nt, Human
cuucucaggaagaccaacccugg

SEQ ID NO: 762623 - RNA, 19 nt, Human
cuuuggggguaaaaauacc

SEQ ID NO: 762624 - RNA, 23 nt, Human
cuuuuuacaguuucuguccuagc

SEQ ID NO: 762625 - RNA, 21 nt, Human
gaacaugacuauucugacuca

SEQ ID NO: 762626 - RNA, 20 nt, Human
gagaaggggcaaagaaaagg

SEQ ID NO: 762627 - RNA, 18 nt, Human
gagcgcagggaagccagc

SEQ ID NO: 762628 - RNA, 21 nt, Human
gagcgccccgggcucuggcac

SEQ ID NO: 762629 - RNA, 18 nt, Human
gagcugugugguggggga

SEQ ID NO: 762630 - RNA, 26 nt, Human
gcacuggggccuucuccaaccggagg

SEQ ID NO: 762631 - RNA, 22 nt, Human
gcccaucucuccaccuacagcc

SEQ ID NO: 762632 - RNA, 20 nt, Human
gccgagcgcagggaagccag

SEQ ID NO: 762633 - RNA, 26 nt, Human
gcgaacacaaaccucaggaaaagcug

SEQ ID NO: 762634 - RNA, 21 nt, Human
gcugagcggcugagcucgcgg

SEQ ID NO: 762635 - RNA, 19 nt, Human
ggaaaacagcccuguucua

SEQ ID NO: 762636 - RNA, 24 nt, Human
ggacagcaaugguacaaucccaag

SEQ ID NO: 762637 - RNA, 20 nt, Human
ggccucuaccucauuaacca

SEQ ID NO: 762638 - RNA, 24 nt, Human
gggaaaucucacacgacacaaucc

SEQ ID NO: 762639 - RNA, 25 nt, Human
gggcaggagugagagggagcuagaa

SEQ ID NO: 762640 - RNA, 23 nt, Human
gggcucuggcacggcuaccgucc

SEQ ID NO: 762641 - RNA, 18 nt, Human
ggggccuucuccagagaa

SEQ ID NO: 762642 - RNA, 18 nt, Human
gggucucugggcccugag

SEQ ID NO: 762643 - RNA, 20 nt, Human
gguuucuuuauuuucuaaag

SEQ ID NO: 762644 - RNA, 18 nt, Human
gugcaugaagcauuuuua

SEQ ID NO: 762645 - RNA, 20 nt, Human
gugggggaugcaggccaggc

SEQ ID NO: 762646 - RNA, 20 nt, Human
guugcucaucccugaaccua

SEQ ID NO: 762647 - RNA, 20 nt, Human
uaaaaaguaguaccucucau

SEQ ID NO: 762648 - RNA, 26 nt, Human
uaaaaaguaguaccucucauaguaaa

SEQ ID NO: 762649 - RNA, 29 nt, Human
uaacugaagugcuacuucaccucugguua

SEQ ID NO: 762650 - RNA, 19 nt, Human
uaauauuggcugcaucaac

SEQ ID NO: 762651 - RNA, 22 nt, Human
uacaaugcaugcauguuauugg

SEQ ID NO: 762652 - RNA, 25 nt, Human
uaccacgaagaagauaaaauggcuu

SEQ ID NO: 762653 - RNA, 25 nt, Human
uaccccacucgcugagcggcugagc

SEQ ID NO: 762654 - RNA, 22 nt, Human
uagagccauucagcugcaaccc

SEQ ID NO: 762655 - RNA, 18 nt, Human
uagcauaagaauaaaaaa

SEQ ID NO: 762656 - RNA, 24 nt, Human
uagcucaaauuaauauuggcugca

SEQ ID NO: 762657 - RNA, 24 nt, Human
uauuggcugcaucaacaauauucc

SEQ ID NO: 762658 - RNA, 25 nt, Human
ucaaaaaaagcccacacaaccacau

SEQ ID NO: 762659 - RNA, 20 nt, Human
ucaaaaaaagcccacacaag

SEQ ID NO: 762660 - RNA, 23 nt, Human
ucaaaaagcacaaaauucaagua

SEQ ID NO: 762661 - RNA, 21 nt, Human
ucaagucagacaucccucaag

SEQ ID NO: 762662 - RNA, 23 nt, Human
ucacagggacucugaaggccccc

SEQ ID NO: 762663 - RNA, 23 nt, Human
ucagaauuaacaauccauuagcu

SEQ ID NO: 762664 - RNA, 21 nt, Human
ucauccguaccacugaggauc

SEQ ID NO: 762665 - RNA, 23 nt, Human
uccaccuacagccuucccaaaaa

SEQ ID NO: 762666 - RNA, 19 nt, Human
uccagagacaaacaugaag

SEQ ID NO: 762667 - RNA, 23 nt, Human
uccagauacaaaguuucggggag

SEQ ID NO: 762668 - RNA, 19 nt, Human
ucccaaaaaacaggcugua

SEQ ID NO: 762669 - RNA, 20 nt, Human
uccccuucucaggaagacca

SEQ ID NO: 762670 - RNA, 25 nt, Human
ucgcggagcugggugagugucugcc

SEQ ID NO: 762671 - RNA, 21 nt, Human
ucuaacuccuauuauaaaacu

SEQ ID NO: 762672 - RNA, 24 nt, Human
ucucacacgacacaauccccuccg

SEQ ID NO: 762673 - RNA, 18 nt, Human
ucucugggcccugagggu

SEQ ID NO: 762674 - RNA, 18 nt, Human
ucugcagucuagagcugg

SEQ ID NO: 762675 - RNA, 20 nt, Human
ucugcagucuagagcuggug

SEQ ID NO: 762676 - RNA, 24 nt, Human
ucugcagugcggagccugcaaggc

SEQ ID NO: 762677 - RNA, 21 nt, Human
ucuguaaaguuuagcugaugg

SEQ ID NO: 762678 - RNA, 18 nt, Human
ucuugguuuuuacacgcu

SEQ ID NO: 762679 - RNA, 22 nt, Human
ugaaaaauugggaaaacuucac

SEQ ID NO: 762680 - RNA, 25 nt, Human
ugaacccagaccaucagggagcuag

SEQ ID NO: 762681 - RNA, 20 nt, Human
ugaccggcccgugggagcag

SEQ ID NO: 762682 - RNA, 22 nt, Human
ugagaaggggcaaagaaaagga

SEQ ID NO: 762683 - RNA, 23 nt, Human
ugagagagagcuagaaagggcag

SEQ ID NO: 762684 - RNA, 25 nt, Human
ugagagggagcuagaaagcacuggg

SEQ ID NO: 762685 - RNA, 18 nt, Human
ugagcucgcggagcuggg

SEQ ID NO: 762686 - RNA, 24 nt, Human
ugagguggaaacacuauuaucugu

SEQ ID NO: 762687 - RNA, 20 nt, Human
ugagugucugcggcugaccg

SEQ ID NO: 762688 - RNA, 23 nt, Human
ugcaaggcugaggcaggagaucg

SEQ ID NO: 762689 - RNA, 22 nt, Human
ugcaucaacaauauuccugcaa

SEQ ID NO: 762690 - RNA, 25 nt, Human
ugccacaagaauccacuucgucagu

SEQ ID NO: 762691 - RNA, 22 nt, Human
ugcuguguucuggcuucugagc

SEQ ID NO: 762692 - RNA, 18 nt, Human
uggaaauaggugagagga

SEQ ID NO: 762693 - RNA, 28 nt, Human
uggcacagaauucaagaccaaaacugca

SEQ ID NO: 762694 - RNA, 24 nt, Human
uggcgaggagaaggggauugagga

SEQ ID NO: 762695 - RNA, 20 nt, Human
uggcuucugagcagaggccu

SEQ ID NO: 762696 - RNA, 24 nt, Human
ugggaaaucucacacgacacaauc

SEQ ID NO: 762697 - RNA, 23 nt, Human
ugguaugcaaaauaagcccaucu

SEQ ID NO: 762698 - RNA, 24 nt, Human
ugucugcggcugaccggcccgugg

SEQ ID NO: 762699 - RNA, 23 nt, Human
ugugcauaagaucuucagcuggg

SEQ ID NO: 762700 - RNA, 18 nt, Human
uguggcucagaguuccca

SEQ ID NO: 762701 - RNA, 23 nt, Human
uuaccucauccauccccuucuca

SEQ ID NO: 762702 - RNA, 18 nt, Human
uuacuugguacaaugcau

SEQ ID NO: 762703 - RNA, 22 nt, Human
uuagagccauucagcugcaacc

SEQ ID NO: 762704 - RNA, 21 nt, Human
uucaaaaaaagcccacacaac

SEQ ID NO: 762705 - RNA, 18 nt, Human
uucaagagaggaaagaac

SEQ ID NO: 762706 - RNA, 21 nt, Human
uucuucauuuugcagguagaa

SEQ ID NO: 762707 - RNA, 21 nt, Human
uugaacccagaccaucaggga

SEQ ID NO: 762708 - RNA, 21 nt, Human
uuugcagguagaaauagacag

SEQ ID NO: 762709 - RNA, 24 nt, Human
aagcggcagguggugcacgguggg

SEQ ID NO: 762710 - RNA, 26 nt, Human
aagcggcagguggugcacgguggguu

SEQ ID NO: 762711 - RNA, 22 nt, Human
aauaaaccagaugaaacaagua

SEQ ID NO: 762712 - RNA, 19 nt, Human
acaaagcaagauuggaagc

SEQ ID NO: 762713 - RNA, 24 nt, Human
accuccuccccuccuuccucuuua

SEQ ID NO: 762714 - RNA, 25 nt, Human
agacauuuugugaaaauuaaaaaug

SEQ ID NO: 762715 - RNA, 19 nt, Human
agccagcgccuggucaugg

SEQ ID NO: 762716 - RNA, 22 nt, Human
aggcuuuuugacaaucuuuaau

SEQ ID NO: 762717 - RNA, 18 nt, Human
auggucaaugucugcauc

SEQ ID NO: 762718 - RNA, 19 nt, Human
augucagggugcugcucuu

SEQ ID NO: 762719 - RNA, 18 nt, Human
auuacuguuuauggguga

SEQ ID NO: 762720 - RNA, 21 nt, Human
caaguacaaguuguuuacuga

SEQ ID NO: 762721 - RNA, 22 nt, Human
caccaacacggucuccugcacc

SEQ ID NO: 762722 - RNA, 26 nt, Human
caccacacgccgcuccuccaccaaca

SEQ ID NO: 762723 - RNA, 25 nt, Human
cacgccuggcuccagaucugugccu

SEQ ID NO: 762724 - RNA, 19 nt, Human
cagcggcugucucuuccug

SEQ ID NO: 762725 - RNA, 19 nt, Human
cauggucaaugucugcauc

SEQ ID NO: 762726 - RNA, 23 nt, Human
ccagggccugcugcugcuccucc

SEQ ID NO: 762727 - RNA, 21 nt, Human
cccccgccgccccugcgcccc

SEQ ID NO: 762728 - RNA, 22 nt, Human
ccccgccgccccugcgcccccg

SEQ ID NO: 762729 - RNA, 18 nt, Human
ccccgcugucucccgccg

SEQ ID NO: 762730 - RNA, 21 nt, Human
ccccuccuuccucuuuagccc

SEQ ID NO: 762731 - RNA, 20 nt, Human
ccccugcgcccccgccgccu

SEQ ID NO: 762732 - RNA, 18 nt, Human
cccgccgccuccuggggc

SEQ ID NO: 762733 - RNA, 20 nt, Human
cccucuuucccuuuaaugcc

SEQ ID NO: 762734 - RNA, 18 nt, Human
ccgccccugcgcccccgc

SEQ ID NO: 762735 - RNA, 19 nt, Human
ccuccuccccuccuuccuc

SEQ ID NO: 762736 - RNA, 21 nt, Human
ccuugucagugaccucccucg

SEQ ID NO: 762737 - RNA, 25 nt, Human
cuccagggccugcugcugcuccucc

SEQ ID NO: 762738 - RNA, 21 nt, Human
cucugcuccucuugucgcuca

SEQ ID NO: 762739 - RNA, 23 nt, Human
cucugcuccucuugucgcucacg

SEQ ID NO: 762740 - RNA, 21 nt, Human
cugcgcccccgccgccucccc

SEQ ID NO: 762741 - RNA, 21 nt, Human
cugcugcuccuccuugggcgg

SEQ ID NO: 762742 - RNA, 20 nt, Human
cuucucaauucuugucucug

SEQ ID NO: 762743 - RNA, 20 nt, Human
gaaaggcaugaauuguuuau

SEQ ID NO: 762744 - RNA, 22 nt, Human
gacagcuucuagcauuugaggg

SEQ ID NO: 762745 - RNA, 21 nt, Human
gaccuccuccccuccuuccuc

SEQ ID NO: 762746 - RNA, 24 nt, Human
gagaccacgguuuauauuguuggu

SEQ ID NO: 762747 - RNA, 20 nt, Human
gagcagguauagcugaaaac

SEQ ID NO: 762748 - RNA, 21 nt, Human
gccagugucuuuauuaauggu

SEQ ID NO: 762749 - RNA, 19 nt, Human
gcccucuuucccuuuaaug

SEQ ID NO: 762750 - RNA, 22 nt, Human
gcccucuuucccuuuaaugccu

SEQ ID NO: 762751 - RNA, 20 nt, Human
gcccuggcagcaaacuccug

SEQ ID NO: 762752 - RNA, 21 nt, Human
gcccuggcagcaaacuccugu

SEQ ID NO: 762753 - RNA, 24 nt, Human
gccgcuccuccaccaacacggucu

SEQ ID NO: 762754 - RNA, 21 nt, Human
gcgcugcagcggcggcgaacu

SEQ ID NO: 762755 - RNA, 21 nt, Human
gcugaaucagauugcuuuauu

SEQ ID NO: 762756 - RNA, 18 nt, Human
ggcucggccuccuggucc

SEQ ID NO: 762757 - RNA, 23 nt, Human
ggguagugguggugguacuggug

SEQ ID NO: 762758 - RNA, 22 nt, Human
gucaaggucaauucuucuggac

SEQ ID NO: 762759 - RNA, 25 nt, Human
uaauaauaauaaacuaugaaaggca

SEQ ID NO: 762760 - RNA, 20 nt, Human
uccagggccugcugcugcuc

SEQ ID NO: 762761 - RNA, 21 nt, Human
uccucuggucaauccucucca

SEQ ID NO: 762762 - RNA, 21 nt, Human
uccuguuccaggacagcuuua

SEQ ID NO: 762763 - RNA, 20 nt, Human
ucgcucacgggaagcagcgg

SEQ ID NO: 762764 - RNA, 23 nt, Human
ucgcuucucaauucuugucucug

SEQ ID NO: 762765 - RNA, 19 nt, Human
ucugaaaugcccccuuuca

SEQ ID NO: 762766 - RNA, 20 nt, Human
ucugaaaugcccccuuucac

SEQ ID NO: 762767 - RNA, 21 nt, Human
ucuggucaauccucuccaucu

SEQ ID NO: 762768 - RNA, 23 nt, Human
ugaaaggcaugaauuguuuaugu

SEQ ID NO: 762769 - RNA, 24 nt, Human
ugaaaugcccccuuucacaguuuu

SEQ ID NO: 762770 - RNA, 22 nt, Human
ugacugcauucaugugcaagcu

SEQ ID NO: 762771 - RNA, 21 nt, Human
ugaggaaaucugacacaccgg

SEQ ID NO: 762772 - RNA, 19 nt, Human
ugccugagccagcgccugg

SEQ ID NO: 762773 - RNA, 19 nt, Human
uggauuccgagucugaucc

SEQ ID NO: 762774 - RNA, 22 nt, Human
uggcugcacucugcuccucuug

SEQ ID NO: 762775 - RNA, 22 nt, Human
ugggaagaucucucugccagug

SEQ ID NO: 762776 - RNA, 21 nt, Human
ugggaucagcagggagcccgg

SEQ ID NO: 762777 - RNA, 18 nt, Human
uggggcucggccuccugg

SEQ ID NO: 762778 - RNA, 21 nt, Human
uggucauggucaaugucugca

SEQ ID NO: 762779 - RNA, 19 nt, Human
ugguggugguacugguggu

SEQ ID NO: 762780 - RNA, 23 nt, Human
ugucgcucacgggaagcagcggc

SEQ ID NO: 762781 - RNA, 22 nt, Human
ugugaaugcgggcugugcugca

SEQ ID NO: 762782 - RNA, 24 nt, Human
ugugaugguuuugguuucggugug

SEQ ID NO: 762783 - RNA, 20 nt, Human
uuaauaauaauaaacuauga

SEQ ID NO: 762784 - RNA, 21 nt, Human
uuccucuggucaauccucucc

SEQ ID NO: 762785 - RNA, 24 nt, Human
uuccucuuuagcccccuccgucaa

SEQ ID NO: 762786 - RNA, 24 nt, Human
uucgagcuguuuugcagcccuggc

SEQ ID NO: 762787 - RNA, 18 nt, Human
uugucagugaccucccuc

SEQ ID NO: 762788 - RNA, 23 nt, Human
uuucggugugaacuacuggcacu

SEQ ID NO: 762789 - RNA, 24 nt, Human
aaacauuucacacuaucaggcuac

SEQ ID NO: 762790 - RNA, 20 nt, Human
aaacccagcaaaucagcaaa

SEQ ID NO: 762791 - RNA, 25 nt, Human
aaacuguguucuuuucaaugcuugg

SEQ ID NO: 762792 - RNA, 21 nt, Human
aaagaaaaaaaauguuaagaa

SEQ ID NO: 762793 - RNA, 21 nt, Human
aaagaaacuugaaccacacug

SEQ ID NO: 762794 - RNA, 18 nt, Human
aaagaaguagaaagcugu

SEQ ID NO: 762795 - RNA, 22 nt, Human
aacccagcaaaucagcaaaaaa

SEQ ID NO: 762796 - RNA, 18 nt, Human
aaccccugauuccuccaa

SEQ ID NO: 762797 - RNA, 19 nt, Human
aagaaaaccaaagaaaagc

SEQ ID NO: 762798 - RNA, 22 nt, Human
aaggccagaggcacuggaaacu

SEQ ID NO: 762799 - RNA, 20 nt, Human
acacagcaccuauaucuugu

SEQ ID NO: 762800 - RNA, 24 nt, Human
acagauauaaaauuauuuuaaaaa

SEQ ID NO: 762801 - RNA, 22 nt, Human
acagcaauuccaaaguuuuaaa

SEQ ID NO: 762802 - RNA, 23 nt, Human
accugugaacaauugauuuccuu

SEQ ID NO: 762803 - RNA, 20 nt, Human
acucugugucugcuuucagu

SEQ ID NO: 762804 - RNA, 21 nt, Human
agaggugaugaauuucagaug

SEQ ID NO: 762805 - RNA, 18 nt, Human
auagaacaucugccaccc

SEQ ID NO: 762806 - RNA, 22 nt, Human
auggagguuguggccuugccua

SEQ ID NO: 762807 - RNA, 22 nt, Human
caaaauaaugcuaguuaauccc

SEQ ID NO: 762808 - RNA, 20 nt, Human
caaaccccugauuccuccaa

SEQ ID NO: 762809 - RNA, 23 nt, Human
caaauauuuauugauguuaaauc

SEQ ID NO: 762810 - RNA, 18 nt, Human
caauagagauagguccau

SEQ ID NO: 762811 - RNA, 23 nt, Human
cacauucagaaaaauuugccaag

SEQ ID NO: 762812 - RNA, 22 nt, Human
caccagcacaacaauccaaagu

SEQ ID NO: 762813 - RNA, 21 nt, Human
cacuacuacacaaaccucaga

SEQ ID NO: 762814 - RNA, 21 nt, Human
cacugugcuucagaaucauug

SEQ ID NO: 762815 - RNA, 18 nt, Human
cagcaaaaaaaggucaca

SEQ ID NO: 762816 - RNA, 20 nt, Human
cagcaugugugcuccacacu

SEQ ID NO: 762817 - RNA, 20 nt, Human
cagguccucacuuucuacca

SEQ ID NO: 762818 - RNA, 21 nt, Human
caguaggaaggccagaggcac

SEQ ID NO: 762819 - RNA, 26 nt, Human
ccagcaccuucuuaaggcaaaguuuc

SEQ ID NO: 762820 - RNA, 19 nt, Human
ccuaaaaucuuccacuacu

SEQ ID NO: 762821 - RNA, 21 nt, Human
ccuaaaaucuuccacuacuac

SEQ ID NO: 762822 - RNA, 20 nt, Human
ccucagacacacugcaaucu

SEQ ID NO: 762823 - RNA, 23 nt, Human
ccuggccuuugcuaccucuccug

SEQ ID NO: 762824 - RNA, 22 nt, Human
ccuuggaauccagcaccuucuu

SEQ ID NO: 762825 - RNA, 20 nt, Human
cuccacacuuccagcuggcc

SEQ ID NO: 762826 - RNA, 20 nt, Human
cuccagagaggugaugaauu

SEQ ID NO: 762827 - RNA, 19 nt, Human
cuccucccuacuccuucca

SEQ ID NO: 762828 - RNA, 20 nt, Human
cugccacccggugcucaagc

SEQ ID NO: 762829 - RNA, 23 nt, Human
cuggcccuggguuccuugacuug

SEQ ID NO: 762830 - RNA, 22 nt, Human
cuguguucuuuucaaugcuugg

SEQ ID NO: 762831 - RNA, 23 nt, Human
cuugaaccacacugcauagaaca

SEQ ID NO: 762832 - RNA, 20 nt, Human
gaacuaagguauuaaccuug

SEQ ID NO: 762833 - RNA, 21 nt, Human
gaaucaacucagucuagcuga

SEQ ID NO: 762834 - RNA, 20 nt, Human
gcagcagggaagugaacuaa

SEQ ID NO: 762835 - RNA, 21 nt, Human
gccaccaugcagucucaaucc

SEQ ID NO: 762836 - RNA, 23 nt, Human
gcuggcccuggguuccuugaccg

SEQ ID NO: 762837 - RNA, 20 nt, Human
ggcaguauucagugucaggu

SEQ ID NO: 762838 - RNA, 18 nt, Human
ggucaaggcaauggcugu

SEQ ID NO: 762839 - RNA, 21 nt, Human
gucugcuuucaguaggaaggc

SEQ ID NO: 762840 - RNA, 24 nt, Human
uaaauacaauauaaagguggcaaa

SEQ ID NO: 762841 - RNA, 24 nt, Human
uaauaugaaauauaugggguggua

SEQ ID NO: 762842 - RNA, 24 nt, Human
uaauaugguuuguaaauaaguuuc

SEQ ID NO: 762843 - RNA, 24 nt, Human
uacaauagagauagguccaugaga

SEQ ID NO: 762844 - RNA, 18 nt, Human
uacacugugcuucagaau

SEQ ID NO: 762845 - RNA, 22 nt, Human
uacagguccucacuuucuacca

SEQ ID NO: 762846 - RNA, 20 nt, Human
uacuuuuuuuggcuuggugc

SEQ ID NO: 762847 - RNA, 24 nt, Human
uaggaaggccagaggcacuggaaa

SEQ ID NO: 762848 - RNA, 18 nt, Human
uaucaggcuacacagcac

SEQ ID NO: 762849 - RNA, 21 nt, Human
uauuagcauuaucuacuuaaa

SEQ ID NO: 762850 - RNA, 24 nt, Human
ucaagccuauuaaucacuuaaacc

SEQ ID NO: 762851 - RNA, 24 nt, Human
ucaguguuucagcuuuaacaagaa

SEQ ID NO: 762852 - RNA, 23 nt, Human
uccauacuagcaaugcauauaag

SEQ ID NO: 762853 - RNA, 20 nt, Human
ucuccacagcaugugugcuc

SEQ ID NO: 762854 - RNA, 26 nt, Human
ucuccugugccuucuacuuuuaucua

SEQ ID NO: 762855 - RNA, 23 nt, Human
ugaaaacacuacacauaaagaaa

SEQ ID NO: 762856 - RNA, 19 nt, Human
ugaaacaguaauaugaaau

SEQ ID NO: 762857 - RNA, 24 nt, Human
ugaacggucuucaugcacucugug

SEQ ID NO: 762858 - RNA, 20 nt, Human
ugaagaaaaccaaagaaaag

SEQ ID NO: 762859 - RNA, 19 nt, Human
ugacaaaggaauauguugg

SEQ ID NO: 762860 - RNA, 25 nt, Human
ugcucuacauaccuaaaaucuucca

SEQ ID NO: 762861 - RNA, 23 nt, Human
uggccucagguuggaacgcugcu

SEQ ID NO: 762862 - RNA, 18 nt, Human
uguaaauaaguuuccuac

SEQ ID NO: 762863 - RNA, 19 nt, Human
ugucucuccuuaugucucc

SEQ ID NO: 762864 - RNA, 22 nt, Human
ugugcaauguguauauuuguau

SEQ ID NO: 762865 - RNA, 22 nt, Human
ugugugcuccacagcaugugug

SEQ ID NO: 762866 - RNA, 23 nt, Human
uuaaacuaaguuugguauaucaa

SEQ ID NO: 762867 - RNA, 20 nt, Human
uuagcauuaucuacuuaaac

SEQ ID NO: 762868 - RNA, 18 nt, Human
uuccagcuggcccugggu

SEQ ID NO: 762869 - RNA, 18 nt, Human
uuccagcuggcccugggu

SEQ ID NO: 762870 - RNA, 18 nt, Human
uuuaacaagaaugcugga

SEQ ID NO: 762871 - RNA, 19 nt, Human
uuugaagaaaaccaaagaa

SEQ ID NO: 762872 - RNA, 18 nt, Human
aaaagagaguuaauaagu

SEQ ID NO: 762873 - RNA, 22 nt, Human
aaaaguguagaauaacacugcu

SEQ ID NO: 762874 - RNA, 26 nt, Human
aaaauguauuuaaaugauacaaagca

SEQ ID NO: 762875 - RNA, 26 nt, Human
aaacaaaauguauuuaaaugauacaa

SEQ ID NO: 762876 - RNA, 18 nt, Human
aaacagauauugguuucu

SEQ ID NO: 762877 - RNA, 21 nt, Human
aacacugcuacaaaucaucua

SEQ ID NO: 762878 - RNA, 20 nt, Human
aacacuucaaacacguggua

SEQ ID NO: 762879 - RNA, 19 nt, Human
aaccauuuucuaaaagccu

SEQ ID NO: 762880 - RNA, 22 nt, Human
aacuaaucucuuagccccuucc

SEQ ID NO: 762881 - RNA, 20 nt, Human
aagaaacccgauugaacaaa

SEQ ID NO: 762882 - RNA, 18 nt, Human
aagaucaccauuguacca

SEQ ID NO: 762883 - RNA, 23 nt, Human
aagcugguuucagccgugacaca

SEQ ID NO: 762884 - RNA, 20 nt, Human
aaguaguucauugaguuagu

SEQ ID NO: 762885 - RNA, 21 nt, Human
acaaccauuuucuaaaagccu

SEQ ID NO: 762886 - RNA, 23 nt, Human
accaaacagcaguccacauacaa

SEQ ID NO: 762887 - RNA, 23 nt, Human
acccguuuuauucaaugaucccu

SEQ ID NO: 762888 - RNA, 20 nt, Human
agaaaaagaaugcagaccau

SEQ ID NO: 762889 - RNA, 20 nt, Human
agaaugcagaccauacuaag

SEQ ID NO: 762890 - RNA, 19 nt, Human
aggcaaaaagaaaagaaac

SEQ ID NO: 762891 - RNA, 22 nt, Human
agguauuuauuugaaaugaaaa

SEQ ID NO: 762892 - RNA, 18 nt, Human
aguggaguuugcuugcug

SEQ ID NO: 762893 - RNA, 20 nt, Human
auccagagaaauaauuaguu

SEQ ID NO: 762894 - RNA, 25 nt, Human
auggaacacagaaagauauccagag

SEQ ID NO: 762895 - RNA, 22 nt, Human
augugcauuuuagugcauaagu

SEQ ID NO: 762896 - RNA, 26 nt, Human
auuaguggaguuugcuugcuggcagg

SEQ ID NO: 762897 - RNA, 25 nt, Human
caaaaacaaaaaaauagacauugau

SEQ ID NO: 762898 - RNA, 22 nt, Human
caaaugaacagguggauggaug

SEQ ID NO: 762899 - RNA, 24 nt, Human
caacacugagguggugcguagcca

SEQ ID NO: 762900 - RNA, 23 nt, Human
cacaguucauuuaccaaaacaaa

SEQ ID NO: 762901 - RNA, 24 nt, Human
caccaagaaacagauauugguuuc

SEQ ID NO: 762902 - RNA, 23 nt, Human
cacugcuacaaaucaucuagagg

SEQ ID NO: 762903 - RNA, 25 nt, Human
cacugcuacaaaucaucuagagggc

SEQ ID NO: 762904 - RNA, 18 nt, Human
cagaaaaagaaugcagac

SEQ ID NO: 762905 - RNA, 22 nt, Human
cagcuacugucaucagggagaa

SEQ ID NO: 762906 - RNA, 24 nt, Human
caguuuuacaacaaaguuuauaug

SEQ ID NO: 762907 - RNA, 22 nt, Human
caugauucauggacaaaaggag

SEQ ID NO: 762908 - RNA, 21 nt, Human
cauuaguugagacagggcugu

SEQ ID NO: 762909 - RNA, 22 nt, Human
ccagacaggggcaaggcccaca

SEQ ID NO: 762910 - RNA, 21 nt, Human
ccagaggaaauacuaccauga

SEQ ID NO: 762911 - RNA, 18 nt, Human
ccaguaucuucaauuuac

SEQ ID NO: 762912 - RNA, 20 nt, Human
cccacagcaccagcugccag

SEQ ID NO: 762913 - RNA, 24 nt, Human
ccccauuccuguacucuacacccg

SEQ ID NO: 762914 - RNA, 26 nt, Human
cggcuggacuccuauucucccacacu

SEQ ID NO: 762915 - RNA, 21 nt, Human
cguagccagguacaagacgcc

SEQ ID NO: 762916 - RNA, 24 nt, Human
cuauuauccagacggauggcugcu

SEQ ID NO: 762917 - RNA, 22 nt, Human
cuuucuuuccuuuuuuuacccc

SEQ ID NO: 762918 - RNA, 18 nt, Human
gaacacagaaagauaucc

SEQ ID NO: 762919 - RNA, 22 nt, Human
gagugagacagagguugucuau

SEQ ID NO: 762920 - RNA, 20 nt, Human
gcacaauuucugcaacuguu

SEQ ID NO: 762921 - RNA, 19 nt, Human
gccagguacaagacgccca

SEQ ID NO: 762922 - RNA, 24 nt, Human
ggaaaaaaagaccacagauaaugu

SEQ ID NO: 762923 - RNA, 22 nt, Human
ggaaaacagaacacaacuuuuc

SEQ ID NO: 762924 - RNA, 23 nt, Human
ggaaaguuuaaaaguguucaucc

SEQ ID NO: 762925 - RNA, 20 nt, Human
ggacaggagaaucgggaagg

SEQ ID NO: 762926 - RNA, 21 nt, Human
ggagaguguggggggaguaag

SEQ ID NO: 762927 - RNA, 18 nt, Human
ggagggagaguguggggg

SEQ ID NO: 762928 - RNA, 21 nt, Human
gggguaaacaugauucaugga

SEQ ID NO: 762929 - RNA, 19 nt, Human
gguuaauuuuaagcaguuc

SEQ ID NO: 762930 - RNA, 26 nt, Human
guaaauaaauuuacauggaacacaga

SEQ ID NO: 762931 - RNA, 25 nt, Human
guaagacacagaaaggaaaacagaa

SEQ ID NO: 762932 - RNA, 19 nt, Human
guagaacauuagugucacc

SEQ ID NO: 762933 - RNA, 18 nt, Human
guccacaaucaauccagu

SEQ ID NO: 762934 - RNA, 19 nt, Human
gugauucuguugauuucug

SEQ ID NO: 762935 - RNA, 21 nt, Human
guuacuagccuaguuuaagug

SEQ ID NO: 762936 - RNA, 18 nt, Human
guuauggaaguucuguua

SEQ ID NO: 762937 - RNA, 18 nt, Human
uaaagaacaccucugcca

SEQ ID NO: 762938 - RNA, 25 nt, Human
uacaauauacauaguuacuugcaaa

SEQ ID NO: 762939 - RNA, 26 nt, Human
uacauaacacacauuuaaaaaaaucc

SEQ ID NO: 762940 - RNA, 23 nt, Human
uacuugcaaagaagucagauuua

SEQ ID NO: 762941 - RNA, 18 nt, Human
uagaaaguuaguaaugga

SEQ ID NO: 762942 - RNA, 19 nt, Human
uagaauaacacugcuacaa

SEQ ID NO: 762943 - RNA, 18 nt, Human
uaguagaacaaauuaaau

SEQ ID NO: 762944 - RNA, 21 nt, Human
uauauauauauauauguacau

SEQ ID NO: 762945 - RNA, 23 nt, Human
uauauauauauguacauaacaca

SEQ ID NO: 762946 - RNA, 24 nt, Human
uauauauguacauaacacacauuu

SEQ ID NO: 762947 - RNA, 19 nt, Human
uauauauuauauauauaua

SEQ ID NO: 762948 - RNA, 23 nt, Human
uauauauuauauauauauauaua

SEQ ID NO: 762949 - RNA, 19 nt, Human
uauauguacauaacacaca

SEQ ID NO: 762950 - RNA, 25 nt, Human
uauauuauauauauauauauaugua

SEQ ID NO: 762951 - RNA, 19 nt, Human
uauauucauagcaaaaaca

SEQ ID NO: 762952 - RNA, 23 nt, Human
uaucaggaagaacaaauuuguuc

SEQ ID NO: 762953 - RNA, 20 nt, Human
uauuuuugaaugcaugugca

SEQ ID NO: 762954 - RNA, 22 nt, Human
ucaccugaaucgcgucugcccc

SEQ ID NO: 762955 - RNA, 21 nt, Human
ucagauaucacagacugcaca

SEQ ID NO: 762956 - RNA, 19 nt, Human
ucagcauuauuuauuagaa

SEQ ID NO: 762957 - RNA, 19 nt, Human
ucaugcaacaaguaaccaa

SEQ ID NO: 762958 - RNA, 24 nt, Human
ucccaccaccaagccuuuucucug

SEQ ID NO: 762959 - RNA, 21 nt, Human
ucccauauaguuuccuauuac

SEQ ID NO: 762960 - RNA, 22 nt, Human
uccuuuuauuaacaaguauauu

SEQ ID NO: 762961 - RNA, 20 nt, Human
ugaaaggaaaaaaagaccac

SEQ ID NO: 762962 - RNA, 27 nt, Human
ugaaaugaaaaaaaaauuacuuaagua

SEQ ID NO: 762963 - RNA, 19 nt, Human
ugaacaaaacaguugccca

SEQ ID NO: 762964 - RNA, 26 nt, Human
ugaacaaacuacaaagaucaggcugu

SEQ ID NO: 762965 - RNA, 20 nt, Human
ugaaugaacaaacuacaaag

SEQ ID NO: 762966 - RNA, 24 nt, Human
ugaaugaacaaacuacaaagauca

SEQ ID NO: 762967 - RNA, 21 nt, Human
ugaccaaacagcaguccacau

SEQ ID NO: 762968 - RNA, 25 nt, Human
ugaccaaacagcaguccacauacaa

SEQ ID NO: 762969 - RNA, 18 nt, Human
ugauauguaaucauaaau

SEQ ID NO: 762970 - RNA, 22 nt, Human
ugcaugaugccucugugagggu

SEQ ID NO: 762971 - RNA, 23 nt, Human
ugcuacaaaucaucuagagggcc

SEQ ID NO: 762972 - RNA, 31 nt, Human
ugcugaaauuaaaaauacuuucuaaaaacaa

SEQ ID NO: 762973 - RNA, 22 nt, Human
uggaugaacaaaugaacaggug

SEQ ID NO: 762974 - RNA, 20 nt, Human
uggaugaaugaacaaacuac

SEQ ID NO: 762975 - RNA, 24 nt, Human
uggauggaugaaugaacaaacuac

SEQ ID NO: 762976 - RNA, 24 nt, Human
ugggcaacuugaaagaaaugacau

SEQ ID NO: 762977 - RNA, 19 nt, Human
ugggggagggagagugugg

SEQ ID NO: 762978 - RNA, 21 nt, Human
uguaugugaguguacuuguau

SEQ ID NO: 762979 - RNA, 22 nt, Human
uguauuuaaaugauacaaagca

SEQ ID NO: 762980 - RNA, 22 nt, Human
ugugaaggccuuuccuuucgca

SEQ ID NO: 762981 - RNA, 22 nt, Human
ugugaaggugugaaggccuauc

SEQ ID NO: 762982 - RNA, 19 nt, Human
uguugauuucugcauuaga

SEQ ID NO: 762983 - RNA, 21 nt, Human
uuaaaaaaaucccaccaccaa

SEQ ID NO: 762984 - RNA, 22 nt, Human
uuaaucauguauuguaauugug

SEQ ID NO: 762985 - RNA, 26 nt, Human
uuaaugccgauaauccuuuuauuaac

SEQ ID NO: 762986 - RNA, 19 nt, Human
uuauauauauauauauauu

SEQ ID NO: 762987 - RNA, 19 nt, Human
uucauggacaaaaggagga

SEQ ID NO: 762988 - RNA, 26 nt, Human
uucauuuaccaaaacaaaauguauuu

SEQ ID NO: 762989 - RNA, 24 nt, Human
uuccagcuuuaaucccccuggauu

SEQ ID NO: 762990 - RNA, 20 nt, Human
uucuugugcuguucaccuga

SEQ ID NO: 762991 - RNA, 21 nt, Human
uugcuggcaggagugagacag

SEQ ID NO: 762992 - RNA, 18 nt, Human
uuggaaaagccaaagccg

SEQ ID NO: 762993 - RNA, 24 nt, Human
uuguagaccuuucaggggaagccu

SEQ ID NO: 762994 - RNA, 30 nt, Human
uuuaauauauauuauauauauauauauauu

SEQ ID NO: 762995 - RNA, 20 nt, Human
uuuacauaaccaccaagaaa

SEQ ID NO: 762996 - RNA, 21 nt, Human
uuuacauaaccaccaagaaac

SEQ ID NO: 762997 - RNA, 18 nt, Human
uuugcaugaugccucugu

SEQ ID NO: 762998 - RNA, 20 nt, Human
uuugguuuccaccuucuagu

SEQ ID NO: 762999 - RNA, 23 nt, Human
uuuguucuuaagcugguuucagc

SEQ ID NO: 763000 - RNA, 21 nt, Human
agacagugacaggagucaggg

SEQ ID NO: 763001 - RNA, 18 nt, Human
agccgcgcccccuccagc

SEQ ID NO: 763002 - RNA, 21 nt, Human
aggagacccgagaggaggagg

SEQ ID NO: 763003 - RNA, 19 nt, Human
aggaggaggagacccgaga

SEQ ID NO: 763004 - RNA, 19 nt, Human
aggaggcggcgagcggcgg

SEQ ID NO: 763005 - RNA, 22 nt, Human
aucuugucuccuaacacccgga

SEQ ID NO: 763006 - RNA, 22 nt, Human
auucuauuuucagucgcuccca

SEQ ID NO: 763007 - RNA, 20 nt, Human
cacugccgccgccgcgaccc

SEQ ID NO: 763008 - RNA, 21 nt, Human
caggaggaggaggaggcagca

SEQ ID NO: 763009 - RNA, 18 nt, Human
cccacauaggaucaaagu

SEQ ID NO: 763010 - RNA, 19 nt, Human
cccccuccagcuccuccuc

SEQ ID NO: 763011 - RNA, 23 nt, Human
ccccgccccggccccagcucggc

SEQ ID NO: 763012 - RNA, 24 nt, Human
cccggccccagcucggccucgguc

SEQ ID NO: 763013 - RNA, 19 nt, Human
ccgagaggaggaggcggcg

SEQ ID NO: 763014 - RNA, 18 nt, Human
ccgccagcgcccccacug

SEQ ID NO: 763015 - RNA, 18 nt, Human
ccgccgccgccgccgccg

SEQ ID NO: 763016 - RNA, 27 nt, Human
ccgccgccgccgccguccccgccccgg

SEQ ID NO: 763017 - RNA, 18 nt, Human
ccgccgccgccguccccg

SEQ ID NO: 763018 - RNA, 19 nt, Human
ccgccgccgccguccccgc

SEQ ID NO: 763019 - RNA, 19 nt, Human
ccgccgccguccccgcccc

SEQ ID NO: 763020 - RNA, 20 nt, Human
ccgccgccguccccgccccg

SEQ ID NO: 763021 - RNA, 18 nt, Human
ccgccgccgucgccgccg

SEQ ID NO: 763022 - RNA, 24 nt, Human
ccgccgccgucgccgccgccgccg

SEQ ID NO: 763023 - RNA, 21 nt, Human
ccgccgcgacccccgccggcc

SEQ ID NO: 763024 - RNA, 24 nt, Human
ccgccguccccgccccggccccag

SEQ ID NO: 763025 - RNA, 18 nt, Human
ccgccgucgccgccgccg

SEQ ID NO: 763026 - RNA, 24 nt, Human
ccgccgucgccgccgccgccgccg

SEQ ID NO: 763027 - RNA, 21 nt, Human
ccgcggcccgccagcgccccc

SEQ ID NO: 763028 - RNA, 23 nt, Human
ccggagccgcggcccggcccccg

SEQ ID NO: 763029 - RNA, 22 nt, Human
ccggcgccagggagcgaccgag

SEQ ID NO: 763030 - RNA, 24 nt, Human
ccggcgccgccgccgucgccgccg

SEQ ID NO: 763031 - RNA, 24 nt, Human
ccgucgccgccgccgccgccgccg

SEQ ID NO: 763032 - RNA, 27 nt, Human
ccgucgccgccgccgccgccgccgucc

SEQ ID NO: 763033 - RNA, 24 nt, Human
cgacccccgccggccgccagcccu

SEQ ID NO: 763034 - RNA, 18 nt, Human
cgagcggcggggcggagg

SEQ ID NO: 763035 - RNA, 24 nt, Human
cgcccccacugccgccgccgcgac

SEQ ID NO: 763036 - RNA, 22 nt, Human
cgccccggccccagcucggccu

SEQ ID NO: 763037 - RNA, 23 nt, Human
cgccgccgccgccgccgccgucc

SEQ ID NO: 763038 - RNA, 23 nt, Human
cgccgccgccgccgccguccccg

SEQ ID NO: 763039 - RNA, 24 nt, Human
cgccgccgccgucgccgccgccgg

SEQ ID NO: 763040 - RNA, 22 nt, Human
cgccggagccugcagcugcccc

SEQ ID NO: 763041 - RNA, 27 nt, Human
cgcggcccggcccccgccacccgcggc

SEQ ID NO: 763042 - RNA, 20 nt, Human
cggcccggcccccgccaccc

SEQ ID NO: 763043 - RNA, 21 nt, Human
cuucugagagccgccgccauc

SEQ ID NO: 763044 - RNA, 18 nt, Human
gacccgagaggaggaggc

SEQ ID NO: 763045 - RNA, 22 nt, Human
gacccgagaggaggaggcggcg

SEQ ID NO: 763046 - RNA, 18 nt, Human
gaccggccuucugagagc

SEQ ID NO: 763047 - RNA, 20 nt, Human
gaggaggcggcgagcggcgg

SEQ ID NO: 763048 - RNA, 20 nt, Human
gauggagacagugacaggag

SEQ ID NO: 763049 - RNA, 19 nt, Human
ggagccgcggcccggcccc

SEQ ID NO: 763050 - RNA, 21 nt, Human
ggaggagacccgagaggagga

SEQ ID NO: 763051 - RNA, 19 nt, Human
gggauggagacagugacag

SEQ ID NO: 763052 - RNA, 21 nt, Human
ucagcuuuauuuggggaugga

SEQ ID NO: 763053 - RNA, 20 nt, Human
ucagggugaagggcaaagga

SEQ ID NO: 763054 - RNA, 21 nt, Human
ucgccgccgccgccgccgccg

SEQ ID NO: 763055 - RNA, 21 nt, Human
ucuucugcuuguuccucucuu

SEQ ID NO: 763056 - RNA, 19 nt, Human
ugacaggagucagggugaa

SEQ ID NO: 763057 - RNA, 23 nt, Human
ugccccgucuauccaccuccgga

SEQ ID NO: 763058 - RNA, 23 nt, Human
uucggcggucgcuggugcugcug

SEQ ID NO: 763059 - RNA, 20 nt, Human
uucugcuuguuccucucuuu

SEQ ID NO: 763060 - RNA, 20 nt, Human
aaccagagcugcggagauuu

SEQ ID NO: 763061 - RNA, 22 nt, Human
aauuccaccagucaaucaaaaa

SEQ ID NO: 763062 - RNA, 22 nt, Human
acaggaaccagagcugcggaga

SEQ ID NO: 763063 - RNA, 21 nt, Human
acccauuacuucuuacacucu

SEQ ID NO: 763064 - RNA, 22 nt, Human
acuaaaauacagaaaauaauca

SEQ ID NO: 763065 - RNA, 21 nt, Human
agaaagaaguaaaacuacaag

SEQ ID NO: 763066 - RNA, 18 nt, Human
agaagaaacaaaauaauc

SEQ ID NO: 763067 - RNA, 21 nt, Human
agagcugcggagauuuuaggg

SEQ ID NO: 763068 - RNA, 22 nt, Human
agcugcggagauuuuagggagu

SEQ ID NO: 763069 - RNA, 18 nt, Human
aguagccuaacaaccccc

SEQ ID NO: 763070 - RNA, 20 nt, Human
auaaaaauaagcauuucuca

SEQ ID NO: 763071 - RNA, 18 nt, Human
auaaaaguacuuuaaccc

SEQ ID NO: 763072 - RNA, 25 nt, Human
auaaacagaaagaaguaaaacuaca

SEQ ID NO: 763073 - RNA, 24 nt, Human
aucuuugcaacuggaacuuuuugg

SEQ ID NO: 763074 - RNA, 23 nt, Human
auucaaguuauccuacuuuacag

SEQ ID NO: 763075 - RNA, 19 nt, Human
auuuaagcuauaauucuag

SEQ ID NO: 763076 - RNA, 22 nt, Human
auuuuaaguuuagaauuauuua

SEQ ID NO: 763077 - RNA, 21 nt, Human
caaaucagccgcgggaaaggc

SEQ ID NO: 763078 - RNA, 21 nt, Human
cacaaauauuagagucaccau

SEQ ID NO: 763079 - RNA, 22 nt, Human
caccaaauauuuaacuucucca

SEQ ID NO: 763080 - RNA, 22 nt, Human
caccgcacugagccggccccgc

SEQ ID NO: 763081 - RNA, 20 nt, Human
cacucuaaacuacagauuuu

SEQ ID NO: 763082 - RNA, 19 nt, Human
cagaucugauauuccuggg

SEQ ID NO: 763083 - RNA, 18 nt, Human
cagccgcgggaaaggcgg

SEQ ID NO: 763084 - RNA, 20 nt, Human
caggaaccagagcugcggag

SEQ ID NO: 763085 - RNA, 22 nt, Human
caggaagacagaaaagauggug

SEQ ID NO: 763086 - RNA, 21 nt, Human
cccauguccucuccaaauuca

SEQ ID NO: 763087 - RNA, 23 nt, Human
ccccuuuuauuuuagaaagaccc

SEQ ID NO: 763088 - RNA, 18 nt, Human
ccgcacugagccggcccc

SEQ ID NO: 763089 - RNA, 18 nt, Human
ccgcugccgcacagccgc

SEQ ID NO: 763090 - RNA, 20 nt, Human
ccgcugccgcacagccgcgc

SEQ ID NO: 763091 - RNA, 23 nt, Human
cgaaggggccgcgagcugcagug

SEQ ID NO: 763092 - RNA, 18 nt, Human
cgcucgggcugggcugcg

SEQ ID NO: 763093 - RNA, 19 nt, Human
cucuccuuucuacccacua

SEQ ID NO: 763094 - RNA, 22 nt, Human
cuucuuacacucuaaacuacag

SEQ ID NO: 763095 - RNA, 19 nt, Human
cuuuuuggguugauggaag

SEQ ID NO: 763096 - RNA, 23 nt, Human
gacugugcugcaacaaaggacuu

SEQ ID NO: 763097 - RNA, 18 nt, Human
gcggcgcucggcgcucgg

SEQ ID NO: 763098 - RNA, 21 nt, Human
ggcugcgcggagaggcucugg

SEQ ID NO: 763099 - RNA, 23 nt, Human
gguuuuucucuccuuucuaccca

SEQ ID NO: 763100 - RNA, 19 nt, Human
guggcggcggcgcgcggcg

SEQ ID NO: 763101 - RNA, 19 nt, Human
uaacagguuuaaaagggag

SEQ ID NO: 763102 - RNA, 22 nt, Human
uaagaauacuauaaaucucugu

SEQ ID NO: 763103 - RNA, 18 nt, Human
uaaggcaaaucagccgcg

SEQ ID NO: 763104 - RNA, 18 nt, Human
uaaguuuagaauuauuua

SEQ ID NO: 763105 - RNA, 23 nt, Human
uacuauauacuaaaauacagaaa

SEQ ID NO: 763106 - RNA, 19 nt, Human
uacuucuuacacucuaaac

SEQ ID NO: 763107 - RNA, 19 nt, Human
uagccagacuaaaaucuca

SEQ ID NO: 763108 - RNA, 20 nt, Human
uagccagacuaaaaucucac

SEQ ID NO: 763109 - RNA, 23 nt, Human
uagccagacuaaaaucucaccaa

SEQ ID NO: 763110 - RNA, 22 nt, Human
uagcuguaaccacugauguugu

SEQ ID NO: 763111 - RNA, 18 nt, Human
uauaaaugaucaagauug

SEQ ID NO: 763112 - RNA, 22 nt, Human
uauauauaugugcacauauaua

SEQ ID NO: 763113 - RNA, 20 nt, Human
uauauaugugcacauauaua

SEQ ID NO: 763114 - RNA, 22 nt, Human
uauauaugugcacauauauaua

SEQ ID NO: 763115 - RNA, 18 nt, Human
uaugugcacauauauaua

SEQ ID NO: 763116 - RNA, 24 nt, Human
uauucugccuuauuagguuauauu

SEQ ID NO: 763117 - RNA, 24 nt, Human
uauugcagaagaaacaaaauaauc

SEQ ID NO: 763118 - RNA, 21 nt, Human
ucaaaauaaauaacaucuuga

SEQ ID NO: 763119 - RNA, 19 nt, Human
ucagaagaaaauaaugugu

SEQ ID NO: 763120 - RNA, 21 nt, Human
uccucuccaaauucagaucuc

SEQ ID NO: 763121 - RNA, 18 nt, Human
ucggcgcucgggcugggc

SEQ ID NO: 763122 - RNA, 21 nt, Human
ucucagauuuucacuuagucu

SEQ ID NO: 763123 - RNA, 23 nt, Human
ucuccauuaaagauuuuuuaaaa

SEQ ID NO: 763124 - RNA, 21 nt, Human
ugaaguaauaccauuucuguu

SEQ ID NO: 763125 - RNA, 19 nt, Human
ugauuuguggaaaucuacc

SEQ ID NO: 763126 - RNA, 21 nt, Human
ugcacauauauauaucaaaca

SEQ ID NO: 763127 - RNA, 21 nt, Human
ugcagaagaaacaaaauaauc

SEQ ID NO: 763128 - RNA, 21 nt, Human
ugccgcacagccgcgccugcc

SEQ ID NO: 763129 - RNA, 18 nt, Human
uggaacuuuuuggguuga

SEQ ID NO: 763130 - RNA, 19 nt, Human
uggaacuuuuuggguugau

SEQ ID NO: 763131 - RNA, 27 nt, Human
uggaauaaauagucauaaaaauaagca

SEQ ID NO: 763132 - RNA, 20 nt, Human
uggcggcggcgcgcggcgcu

SEQ ID NO: 763133 - RNA, 23 nt, Human
uggcggcggcgcgcggcgcucgg

SEQ ID NO: 763134 - RNA, 22 nt, Human
uguaauaaaaguacuuuaaccc

SEQ ID NO: 763135 - RNA, 24 nt, Human
uguacccauuacuucuuacacucu

SEQ ID NO: 763136 - RNA, 20 nt, Human
uuaaagcaguagaauucaca

SEQ ID NO: 763137 - RNA, 20 nt, Human
uuauuagaaugaauauucaa

SEQ ID NO: 763138 - RNA, 21 nt, Human
uucagcagauuuacacaaaua

SEQ ID NO: 763139 - RNA, 19 nt, Human
uucaguggguuuuucuccu

SEQ ID NO: 763140 - RNA, 18 nt, Human
uuccccauguccucucca

SEQ ID NO: 763141 - RNA, 23 nt, Human
uucuuccccauguccucuccaaa

SEQ ID NO: 763142 - RNA, 21 nt, Human
uuuauauuugcaguagccuaa

SEQ ID NO: 763143 - RNA, 24 nt, Human
uuugcaguagccuaacaaccccuu

SEQ ID NO: 763144 - RNA, 19 nt, Human
aagagacaguucagaugca

SEQ ID NO: 763145 - RNA, 21 nt, Human
aaucaccuaagcccaggguaa

SEQ ID NO: 763146 - RNA, 22 nt, Human
aaucaccuaagcccaggguaaa

SEQ ID NO: 763147 - RNA, 21 nt, Human
accaccaacuuccacucaggu

SEQ ID NO: 763148 - RNA, 21 nt, Human
accacuguccugggugcugac

SEQ ID NO: 763149 - RNA, 20 nt, Human
acugcaguucagucuguguu

SEQ ID NO: 763150 - RNA, 21 nt, Human
agaguaugauucuggcucuga

SEQ ID NO: 763151 - RNA, 21 nt, Human
agguuacaacaucuuuggccc

SEQ ID NO: 763152 - RNA, 24 nt, Human
cacagaaccacccaacuucccugg

SEQ ID NO: 763153 - RNA, 18 nt, Human
ccaacuuccacucagguc

SEQ ID NO: 763154 - RNA, 22 nt, Human
cccaguccugauggcuuuccuc

SEQ ID NO: 763155 - RNA, 20 nt, Human
ccuugugccuggcaaacuuc

SEQ ID NO: 763156 - RNA, 22 nt, Human
cucagguuucuuucuccauauu

SEQ ID NO: 763157 - RNA, 25 nt, Human
cucccagguuacaacaucuuuggcc

SEQ ID NO: 763158 - RNA, 19 nt, Human
cuccucagguuucuuucuc

SEQ ID NO: 763159 - RNA, 19 nt, Human
cuucagagaagucucccag

SEQ ID NO: 763160 - RNA, 24 nt, Human
cuuucuucagagaagucucccagg

SEQ ID NO: 763161 - RNA, 18 nt, Human
gacagaccaagcacagaa

SEQ ID NO: 763162 - RNA, 22 nt, Human
gcacagaaccacccaacuuccc

SEQ ID NO: 763163 - RNA, 20 nt, Human
ggugcugacacagaacaguc

SEQ ID NO: 763164 - RNA, 18 nt, Human
ucccagguuacaacaucu

SEQ ID NO: 763165 - RNA, 19 nt, Human
ucuuaaacaguuuucuuuc

SEQ ID NO: 763166 - RNA, 22 nt, Human
ugaaaaaagcucauuuacaaga

SEQ ID NO: 763167 - RNA, 25 nt, Human
ugaugagaaucaccuaagcccaggg

SEQ ID NO: 763168 - RNA, 18 nt, Human
ugcauguaguuguuugua

SEQ ID NO: 763169 - RNA, 22 nt, Human
ugcauguaguuguuuguaggcu

SEQ ID NO: 763170 - RNA, 19 nt, Human
uuaccaccaacuuccacuc

SEQ ID NO: 763171 - RNA, 18 nt, Human
uucccuggcccuuucucc

SEQ ID NO: 763172 - RNA, 21 nt, Human
uucccuggcccuuucucccga

SEQ ID NO: 763173 - RNA, 21 nt, Human
uucccuggcccuuucucccgg

SEQ ID NO: 763174 - RNA, 21 nt, Human
uucuggcucugaaaaaagcuc

SEQ ID NO: 763175 - RNA, 27 nt, Human
aaaagaacagcacacggaugaaccaaa

SEQ ID NO: 763176 - RNA, 23 nt, Human
aacauggcaaaacccucucagaa

SEQ ID NO: 763177 - RNA, 22 nt, Human
aacccucucagaacccaaaaga

SEQ ID NO: 763178 - RNA, 20 nt, Human
aagcaaacauggcaaaaccc

SEQ ID NO: 763179 - RNA, 22 nt, Human
agaaacacaagggcaauuuggc

SEQ ID NO: 763180 - RNA, 24 nt, Human
agcaaacauggcaaaacccucuca

SEQ ID NO: 763181 - RNA, 24 nt, Human
caaaacccucucagaacccaaaag

SEQ ID NO: 763182 - RNA, 23 nt, Human
caaucaaccuuuucauucccaag

SEQ ID NO: 763183 - RNA, 21 nt, Human
cccaaaagaacagcacacgga

SEQ ID NO: 763184 - RNA, 19 nt, Human
gaacagcacacggaugaac

SEQ ID NO: 763185 - RNA, 24 nt, Human
gcaaaacccucucagaacccaaaa

SEQ ID NO: 763186 - RNA, 24 nt, Human
ggcaaaacccucucagaacccaaa

SEQ ID NO: 763187 - RNA, 21 nt, Human
ggguggagagaaacacaaggg

SEQ ID NO: 763188 - RNA, 21 nt, Human
gguggagagaaacacaagggc

SEQ ID NO: 763189 - RNA, 19 nt, Human
uacaagcaaacauggcaaa

SEQ ID NO: 763190 - RNA, 19 nt, Human
ucagaacccaaaagaacag

SEQ ID NO: 763191 - RNA, 18 nt, Human
uccuguuuauuuccuugg

SEQ ID NO: 763192 - RNA, 19 nt, Human
ugacuuggucauacaagca

SEQ ID NO: 763193 - RNA, 20 nt, Human
ugaggaaagcagcugugaua

SEQ ID NO: 763194 - RNA, 19 nt, Human
uggagagaaacacaagggc

SEQ ID NO: 763195 - RNA, 20 nt, Human
ugugaggaaagcagcuguga

SEQ ID NO: 763196 - RNA, 18 nt, Human
uucccaagcuguacacaa

SEQ ID NO: 763197 - RNA, 23 nt, Human
aaacagaacccaugucugucuca

SEQ ID NO: 763198 - RNA, 22 nt, Human
aagaggaaauauggacaaagga

SEQ ID NO: 763199 - RNA, 21 nt, Human
aaucaagccaaaguugccuaa

SEQ ID NO: 763200 - RNA, 24 nt, Human
aguauaaaauagcugcugaucaaa

SEQ ID NO: 763201 - RNA, 21 nt, Human
auugaaaagguucuuccauuu

SEQ ID NO: 763202 - RNA, 19 nt, Human
auuuaaucugucaugugaa

SEQ ID NO: 763203 - RNA, 19 nt, Human
cacaccuggccaguacuuu

SEQ ID NO: 763204 - RNA, 21 nt, Human
caccaacaugcccuagucccc

SEQ ID NO: 763205 - RNA, 22 nt, Human
caggaaaagcugaugcugguug

SEQ ID NO: 763206 - RNA, 21 nt, Human
cauuaacuguggaagcaauga

SEQ ID NO: 763207 - RNA, 22 nt, Human
ccauuaacuguggaagcaauga

SEQ ID NO: 763208 - RNA, 23 nt, Human
cccauuaacuguggaagcaauga

SEQ ID NO: 763209 - RNA, 24 nt, Human
ccuuaugaguauaaaauagcugcu

SEQ ID NO: 763210 - RNA, 20 nt, Human
cugggccugaagucacugua

SEQ ID NO: 763211 - RNA, 27 nt, Human
cugguucugggccugaagucacuguag

SEQ ID NO: 763212 - RNA, 21 nt, Human
cuguaggucgacugugaaugc

SEQ ID NO: 763213 - RNA, 18 nt, Human
gaagggaaguccauaaga

SEQ ID NO: 763214 - RNA, 20 nt, Human
gagcuggaagagcucugggu

SEQ ID NO: 763215 - RNA, 22 nt, Human
gcuggcaggagcuggaagagcu

SEQ ID NO: 763216 - RNA, 20 nt, Human
ggagaagucuaggccaggcu

SEQ ID NO: 763217 - RNA, 20 nt, Human
ggucuguacacugaccuuau

SEQ ID NO: 763218 - RNA, 25 nt, Human
ggugugaaaagcaauuuaaacaugu

SEQ ID NO: 763219 - RNA, 21 nt, Human
uaaguuuuuggccaugaaaca

SEQ ID NO: 763220 - RNA, 23 nt, Human
uaguuuacuugcauuugaggauc

SEQ ID NO: 763221 - RNA, 19 nt, Human
ucaaaacauucaucuucga

SEQ ID NO: 763222 - RNA, 19 nt, Human
ucacugaaugucucgugug

SEQ ID NO: 763223 - RNA, 19 nt, Human
ucagaauugaaaagguucu

SEQ ID NO: 763224 - RNA, 23 nt, Human
ucagccuuacacaauugugggug

SEQ ID NO: 763225 - RNA, 19 nt, Human
uccagggagcugucucugg

SEQ ID NO: 763226 - RNA, 21 nt, Human
ucucaggaaaagcugaugcug

SEQ ID NO: 763227 - RNA, 21 nt, Human
ucuggucucuucuagcucccc

SEQ ID NO: 763228 - RNA, 27 nt, Human
ucuucuaugaguccuacccauuaagag

SEQ ID NO: 763229 - RNA, 22 nt, Human
ugaagggaaguccauaagaaca

SEQ ID NO: 763230 - RNA, 18 nt, Human
ugaaugucucgugugggg

SEQ ID NO: 763231 - RNA, 19 nt, Human
ugaaugucucguguggggu

SEQ ID NO: 763232 - RNA, 20 nt, Human
ugcccuaguccccaugaagc

SEQ ID NO: 763233 - RNA, 23 nt, Human
ugcugguugccauggagcugcac

SEQ ID NO: 763234 - RNA, 20 nt, Human
uggguccagggagcugucuc

SEQ ID NO: 763235 - RNA, 19 nt, Human
ugucucacggccuccacug

SEQ ID NO: 763236 - RNA, 23 nt, Human
uuccuuguacuucuccagcuguu

SEQ ID NO: 763237 - RNA, 23 nt, Human
uugcaaagcugaaggaggaggcu

SEQ ID NO: 763238 - RNA, 19 nt, Human
uugccuaacuauagcuaua

SEQ ID NO: 763239 - RNA, 18 nt, Human
uuuaaagcauguaccagc

SEQ ID NO: 763240 - RNA, 22 nt, Human
aaaaaagagaaaagagagagaa

SEQ ID NO: 763241 - RNA, 20 nt, Human
aaacuugccuaauuuccagg

SEQ ID NO: 763242 - RNA, 18 nt, Human
aaagugcugggacuacag

SEQ ID NO: 763243 - RNA, 19 nt, Human
aaagugcugggacuacagg

SEQ ID NO: 763244 - RNA, 22 nt, Human
aaagugcugggacuacaggugu

SEQ ID NO: 763245 - RNA, 24 nt, Human
aaagugcugggacuacagguguga

SEQ ID NO: 763246 - RNA, 23 nt, Human
aaaugaccagagaaacugggaac

SEQ ID NO: 763247 - RNA, 21 nt, Human
aacuccaagacuaaacuaaag

SEQ ID NO: 763248 - RNA, 19 nt, Human
aagaguaaggccauucugu

SEQ ID NO: 763249 - RNA, 21 nt, Human
aagaugcugguggcaguggug

SEQ ID NO: 763250 - RNA, 19 nt, Human
aagcucugggacuacaggc

SEQ ID NO: 763251 - RNA, 19 nt, Human
aaguagcugggguuucagg

SEQ ID NO: 763252 - RNA, 24 nt, Human
aaguagcugggguuucaggcacgc

SEQ ID NO: 763253 - RNA, 19 nt, Human
aagugcugggacuacaggu

SEQ ID NO: 763254 - RNA, 26 nt, Human
aagugcugggacuacaggugugagcc

SEQ ID NO: 763255 - RNA, 22 nt, Human
aauagugauugagcaguccaug

SEQ ID NO: 763256 - RNA, 24 nt, Human
aauuuuguauuuuuagcagagaca

SEQ ID NO: 763257 - RNA, 24 nt, Human
acaggauuucaccauguuggccag

SEQ ID NO: 763258 - RNA, 18 nt, Human
accauguuggccaggcug

SEQ ID NO: 763259 - RNA, 18 nt, Human
accauguuggccaggcug

SEQ ID NO: 763260 - RNA, 19 nt, Human
acccaggcuggagugcagu

SEQ ID NO: 763261 - RNA, 23 nt, Human
acccaggcuggagugcaguggug

SEQ ID NO: 763262 - RNA, 22 nt, Human
accgcagcucaguaaaaugacu

SEQ ID NO: 763263 - RNA, 23 nt, Human
accucagccucccaaagcucugg

SEQ ID NO: 763264 - RNA, 19 nt, Human
acuacaggugugagccacu

SEQ ID NO: 763265 - RNA, 19 nt, Human
acucccugcccagagccag

SEQ ID NO: 763266 - RNA, 25 nt, Human
acugcagccuccaccuccccgguuc

SEQ ID NO: 763267 - RNA, 19 nt, Human
agaaacugggaaccagaga

SEQ ID NO: 763268 - RNA, 24 nt, Human
agagucucacucugucccucaggc

SEQ ID NO: 763269 - RNA, 18 nt, Human
aggaaaaaaagagaaaag

SEQ ID NO: 763270 - RNA, 19 nt, Human
aggaaaaaaagagaaaaga

SEQ ID NO: 763271 - RNA, 22 nt, Human
aggaaggggauugggccacaga

SEQ ID NO: 763272 - RNA, 25 nt, Human
aggaaucccgggugcuccccccgag

SEQ ID NO: 763273 - RNA, 19 nt, Human
aggagggacaggauacaga

SEQ ID NO: 763274 - RNA, 23 nt, Human
aggauuucaccauguuggccagg

SEQ ID NO: 763275 - RNA, 25 nt, Human
aggcuggagugcaguggugcgaucu

SEQ ID NO: 763276 - RNA, 24 nt, Human
aggugguuuuggagaaaacaagga

SEQ ID NO: 763277 - RNA, 18 nt, Human
aguagccgggauuacagg

SEQ ID NO: 763278 - RNA, 22 nt, Human
aguagcgaugggguuucaccau

SEQ ID NO: 763279 - RNA, 19 nt, Human
agugauccacccaccucag

SEQ ID NO: 763280 - RNA, 20 nt, Human
agugcaguggugcgaucucg

SEQ ID NO: 763281 - RNA, 23 nt, Human
agugcaguggugcgaucucggcu

SEQ ID NO: 763282 - RNA, 24 nt, Human
agugcaguggugcgaucucggcuc

SEQ ID NO: 763283 - RNA, 23 nt, Human
agugccucagccucccaaguagc

SEQ ID NO: 763284 - RNA, 24 nt, Human
agugccucagccucccaaguagcu

SEQ ID NO: 763285 - RNA, 20 nt, Human
auaggaacaucucuuugaau

SEQ ID NO: 763286 - RNA, 22 nt, Human
aucaaugucaacaacugcucuu

SEQ ID NO: 763287 - RNA, 20 nt, Human
aucacccaggcuggagugca

SEQ ID NO: 763288 - RNA, 18 nt, Human
aucauggcaaugcauuuu

SEQ ID NO: 763289 - RNA, 18 nt, Human
augggguuucaccauguu

SEQ ID NO: 763290 - RNA, 22 nt, Human
augggguuucaccauguuggcc

SEQ ID NO: 763291 - RNA, 24 nt, Human
augggguuucaccauguuggccag

SEQ ID NO: 763292 - RNA, 21 nt, Human
caaaagaaucaggaaauuugc

SEQ ID NO: 763293 - RNA, 24 nt, Human
caaagcucugggacuacaggcgug

SEQ ID NO: 763294 - RNA, 30 nt, Human
caaagcucugggacuacaggcgugagccaa

SEQ ID NO: 763295 - RNA, 23 nt, Human
caaccuccaccucccaggcucaa

SEQ ID NO: 763296 - RNA, 24 nt, Human
caaccuccaccucccaggcucaag

SEQ ID NO: 763297 - RNA, 19 nt, Human
caagaagaugcugguggca

SEQ ID NO: 763298 - RNA, 27 nt, Human
caagcgauucuagugccucagccuccc

SEQ ID NO: 763299 - RNA, 24 nt, Human
caagcgauucucuccugccucagc

SEQ ID NO: 763300 - RNA, 21 nt, Human
cacagcacaggccuuacaucu

SEQ ID NO: 763301 - RNA, 23 nt, Human
caccaaaaugaccagagaaacug

SEQ ID NO: 763302 - RNA, 24 nt, Human
caccaugcccggcuaauuuuugua

SEQ ID NO: 763303 - RNA, 21 nt, Human
caccauguuggccaggcuggu

SEQ ID NO: 763304 - RNA, 21 nt, Human
caccauguuggccaggcuggu

SEQ ID NO: 763305 - RNA, 24 nt, Human
caccauguuggccaggcuggucuc

SEQ ID NO: 763306 - RNA, 24 nt, Human
caccauguuggccaggcuggucuc

SEQ ID NO: 763307 - RNA, 27 nt, Human
caccauguuggccaggcuggucucaaa

SEQ ID NO: 763308 - RNA, 27 nt, Human
caccauguuggccaggcuggucucaaa

SEQ ID NO: 763309 - RNA, 22 nt, Human
cacccaccucagccucccaaag

SEQ ID NO: 763310 - RNA, 23 nt, Human
cacccaccucagccucccaaagc

SEQ ID NO: 763311 - RNA, 24 nt, Human
cacccaggcuggagugcaguggug

SEQ ID NO: 763312 - RNA, 24 nt, Human
cacucugucccucaggcuagaaug

SEQ ID NO: 763313 - RNA, 21 nt, Human
cacugcaaccuccaccuccca

SEQ ID NO: 763314 - RNA, 22 nt, Human
cagagacaggauuucaccaugu

SEQ ID NO: 763315 - RNA, 19 nt, Human
cagcgcagcucagcugcuc

SEQ ID NO: 763316 - RNA, 19 nt, Human
cagcgcagcucagcugcuc

SEQ ID NO: 763317 - RNA, 24 nt, Human
caggauuucaccauguuggccagg

SEQ ID NO: 763318 - RNA, 20 nt, Human
caggcacgccaccaugccca

SEQ ID NO: 763319 - RNA, 24 nt, Human
cauguuggccaggcuggucucaaa

SEQ ID NO: 763320 - RNA, 24 nt, Human
cauguuggccaggcuggucucaaa

SEQ ID NO: 763321 - RNA, 22 nt, Human
ccaagcuucccacgacccuggu

SEQ ID NO: 763322 - RNA, 24 nt, Human
ccacccaccucagccucccaaagc

SEQ ID NO: 763323 - RNA, 24 nt, Human
ccaccucccaggcucaagcgauuc

SEQ ID NO: 763324 - RNA, 20 nt, Human
ccacugcgcccagccuaaac

SEQ ID NO: 763325 - RNA, 20 nt, Human
ccacugcgcccagccuaaac

SEQ ID NO: 763326 - RNA, 24 nt, Human
ccacugcgcccagccuaaacugac

SEQ ID NO: 763327 - RNA, 27 nt, Human
ccagugauccacccaccucagccuccc

SEQ ID NO: 763328 - RNA, 18 nt, Human
ccaucacccaggcuggag

SEQ ID NO: 763329 - RNA, 24 nt, Human
cccaaagcucugggacuacaggcg

SEQ ID NO: 763330 - RNA, 25 nt, Human
ccccgguucaagcgauucucuccug

SEQ ID NO: 763331 - RNA, 19 nt, Human
cccgaguagccgggauuac

SEQ ID NO: 763332 - RNA, 24 nt, Human
cccgaguagccgggauuacaggug

SEQ ID NO: 763333 - RNA, 18 nt, Human
ccgcgcccagccuaaacu

SEQ ID NO: 763334 - RNA, 21 nt, Human
ccguggaaaucagaagggcaa

SEQ ID NO: 763335 - RNA, 22 nt, Human
ccuaaagugcugggacuacagg

SEQ ID NO: 763336 - RNA, 24 nt, Human
ccuaaagugcugggacuacaggug

SEQ ID NO: 763337 - RNA, 25 nt, Human
ccucagaaaucaggacauccccccu

SEQ ID NO: 763338 - RNA, 19 nt, Human
ccucagagccacagcacag

SEQ ID NO: 763339 - RNA, 24 nt, Human
ccucagagccacagcacaggccuu

SEQ ID NO: 763340 - RNA, 22 nt, Human
ccucagccuccuaaagugcugg

SEQ ID NO: 763341 - RNA, 19 nt, Human
ccucaggugaucacccccc

SEQ ID NO: 763342 - RNA, 24 nt, Human
ccuccccgguucaagcgauucucu

SEQ ID NO: 763343 - RNA, 19 nt, Human
ccugaccucaggugaucac

SEQ ID NO: 763344 - RNA, 19 nt, Human
ccugugccugacuccaaag

SEQ ID NO: 763345 - RNA, 30 nt, Human; identical to SEQ ID NO: 675786

SEQ ID NO: 763346 - RNA, 22 nt, Human
cgggauuacaggugagcgccac

SEQ ID NO: 763347 - RNA, 24 nt, Human
cgggauuacaggugagcgccacca

SEQ ID NO: 763348 - RNA, 24 nt, Human
cuaaagugcugggacuacaggugu

SEQ ID NO: 763349 - RNA, 24 nt, Human
cuaacuccaaaacuaaacuccaag

SEQ ID NO: 763350 - RNA, 21 nt, Human
cucaaacuccugacccaguga

SEQ ID NO: 763351 - RNA, 24 nt, Human
cucacugcaaccuccaccucccag

SEQ ID NO: 763352 - RNA, 24 nt, Human
cucagccucccaaguagcuggggu

SEQ ID NO: 763353 - RNA, 20 nt, Human
cuccacugcuuaaaccacag

SEQ ID NO: 763354 - RNA, 20 nt, Human
cuccaucacccaggcuggag

SEQ ID NO: 763355 - RNA, 23 nt, Human
cuccugccucagccucccgagua

SEQ ID NO: 763356 - RNA, 23 nt, Human
cugcaaccuccaccucccaggcu

SEQ ID NO: 763357 - RNA, 24 nt, Human
cugcagccuccaccuccccgguuc

SEQ ID NO: 763358 - RNA, 22 nt, Human
cugccucagccucccgaguagc

SEQ ID NO: 763359 - RNA, 26 nt, Human
cuggaaaacgaccuaacuuuggucua

SEQ ID NO: 763360 - RNA, 20 nt, Human
cuggagcuggcaccugugcc

SEQ ID NO: 763361 - RNA, 23 nt, Human
cuggucucaaacuccugacccag

SEQ ID NO: 763362 - RNA, 22 nt, Human
gaaaacaaggaaggcggaagaa

SEQ ID NO: 763363 - RNA, 22 nt, Human
gacccagugauccacccaccuc

SEQ ID NO: 763364 - RNA, 23 nt, Human
gaccucaggugaucaccccccuc

SEQ ID NO: 763365 - RNA, 18 nt, Human
gacuacaggcgugagcca

SEQ ID NO: 763366 - RNA, 21 nt, Human
gacuacaggcgugagccaccg

SEQ ID NO: 763367 - RNA, 22 nt, Human
gacuacaggcgugagccaccgc

SEQ ID NO: 763368 - RNA, 18 nt, Human
gacuacaggugugagcca

SEQ ID NO: 763369 - RNA, 19 nt, Human
gacuacaggugugagccac

SEQ ID NO: 763370 - RNA, 22 nt, Human
gacuacaggugugagccacugc

SEQ ID NO: 763371 - RNA, 19 nt, Human
gacuuauccauggacucgu

SEQ ID NO: 763372 - RNA, 19 nt, Human
gagauuuuucugagagcuu

SEQ ID NO: 763373 - RNA, 20 nt, Human
gagcagaaaggggggcagga

SEQ ID NO: 763374 - RNA, 26 nt, Human
gaggagggacaggauacagaagggau

SEQ ID NO: 763375 - RNA, 25 nt, Human
gaguagccgggauuacaggugagcg

SEQ ID NO: 763376 - RNA, 22 nt, Human
gauagaaauguaggauuucagg

SEQ ID NO: 763377 - RNA, 22 nt, Human
gaucuccacucacugcaaccuc

SEQ ID NO: 763378 - RNA, 24 nt, Human
gauuacaggugagcgccaccaugc

SEQ ID NO: 763379 - RNA, 21 nt, Human
gauucuagugccucagccucc

SEQ ID NO: 763380 - RNA, 22 nt, Human
gcaaccuccaccucccaggcuc

SEQ ID NO: 763381 - RNA, 22 nt, Human
gcagccuccaccuccccgguuc

SEQ ID NO: 763382 - RNA, 22 nt, Human
gccaggcauuuucauguaugcc

SEQ ID NO: 763383 - RNA, 22 nt, Human
gcccggcuaauuuuuguauuuu

SEQ ID NO: 763384 - RNA, 20 nt, Human
gccucagccucccgaguagc

SEQ ID NO: 763385 - RNA, 24 nt, Human
gcgauucuagugccucagccuccc

SEQ ID NO: 763386 - RNA, 25 nt, Human
gcuccaucacccaggcuggagugca

SEQ ID NO: 763387 - RNA, 24 nt, Human
gcucuuuggccacuaagaaaguga

SEQ ID NO: 763388 - RNA, 23 nt, Human
gcuggucucaaacuccugaccuc

SEQ ID NO: 763389 - RNA, 19 nt, Human
ggaaccagagaaacaagga

SEQ ID NO: 763390 - RNA, 21 nt, Human
ggacuacaggcgugagccacc

SEQ ID NO: 763391 - RNA, 22 nt, Human
ggacuacaggcgugagccaccg

SEQ ID NO: 763392 - RNA, 20 nt, Human
ggacuacaggugugagccac

SEQ ID NO: 763393 - RNA, 22 nt, Human
ggacuacaggugugagccacug

SEQ ID NO: 763394 - RNA, 19 nt, Human
ggagaccagugaguacacu

SEQ ID NO: 763395 - RNA, 20 nt, Human
ggagcgacggcagccaccac

SEQ ID NO: 763396 - RNA, 22 nt, Human
ggcaaugcauuuuugagguuuu

SEQ ID NO: 763397 - RNA, 18 nt, Human
ggccaugagcgaguucag

SEQ ID NO: 763398 - RNA, 24 nt, Human
ggccaugagcgaguucagacagaa

SEQ ID NO: 763399 - RNA, 21 nt, Human
ggccucagagccacagcacag

SEQ ID NO: 763400 - RNA, 24 nt, Human
ggcuggucucaaacuccugaccuc

SEQ ID NO: 763401 - RNA, 21 nt, Human
ggcuugaucuucuauggucag

SEQ ID NO: 763402 - RNA, 21 nt, Human
gggauuacaggugagcgccac

SEQ ID NO: 763403 - RNA, 23 nt, Human
gggauuacaggugagcgccacca

SEQ ID NO: 763404 - RNA, 21 nt, Human
ggggagcagggguggaaucug

SEQ ID NO: 763405 - RNA, 22 nt, Human
gggguuucaccauguuggccag

SEQ ID NO: 763406 - RNA, 18 nt, Human
ggguuucaccauguuggc

SEQ ID NO: 763407 - RNA, 23 nt, Human
ggugaucaccccccucagccucc

SEQ ID NO: 763408 - RNA, 21 nt, Human
gguuauaggggacaggaggaa

SEQ ID NO: 763409 - RNA, 21 nt, Human
gguuucaggcacgccaccaug

SEQ ID NO: 763410 - RNA, 19 nt, Human
guagccgggauuacaggug

SEQ ID NO: 763411 - RNA, 23 nt, Human
gugaucaccccccucagccuccu

SEQ ID NO: 763412 - RNA, 24 nt, Human
gugauccacccaccucagccuccc

SEQ ID NO: 763413 - RNA, 24 nt, Human
gugucagguaauuugccaggcauu

SEQ ID NO: 763414 - RNA, 19 nt, Human
uaaaaggagaggaagggga

SEQ ID NO: 763415 - RNA, 21 nt, Human
uaaaauacguucaaacuauag

SEQ ID NO: 763416 - RNA, 24 nt, Human
uaaagugcugggacuacaggugug

SEQ ID NO: 763417 - RNA, 26 nt, Human
uaaauacauacacacacacacagaga

SEQ ID NO: 763418 - RNA, 24 nt, Human
uaaauuuuguauuuuuagcagaga

SEQ ID NO: 763419 - RNA, 20 nt, Human
uaacuccaaaacuaaacucc

SEQ ID NO: 763420 - RNA, 22 nt, Human
uaacuccaaaacuaaacuccaa

SEQ ID NO: 763421 - RNA, 21 nt, Human
uaacuccucaccaagcuuccc

SEQ ID NO: 763422 - RNA, 23 nt, Human
uaacuccucaccaagcuucccac

SEQ ID NO: 763423 - RNA, 23 nt, Human
uaauaauaaaaucauggcaaugc

SEQ ID NO: 763424 - RNA, 19 nt, Human
uaauuuuuguauuuuuuag

SEQ ID NO: 763425 - RNA, 24 nt, Human
uacagaagggauaugcaaggcuag

SEQ ID NO: 763426 - RNA, 24 nt, Human
uacaggcgugagccaccgcgccca

SEQ ID NO: 763427 - RNA, 19 nt, Human
uacaggugugagccacugc

SEQ ID NO: 763428 - RNA, 24 nt, Human
uacaggugugagccacugcgccca

SEQ ID NO: 763429 - RNA, 24 nt, Human
uagcagagacaggauuucaccaug

SEQ ID NO: 763430 - RNA, 25 nt, Human
uagcagagacaggauuucaccaugu

SEQ ID NO: 763431 - RNA, 18 nt, Human
uagcugggguuucaggca

SEQ ID NO: 763432 - RNA, 19 nt, Human
uaggaauguugggggcugu

SEQ ID NO: 763433 - RNA, 24 nt, Human
uaguagcgaugggguuucaccaug

SEQ ID NO: 763434 - RNA, 22 nt, Human
uauacauauacauauaaauaca

SEQ ID NO: 763435 - RNA, 24 nt, Human
uauauacauauacauauaaauaca

SEQ ID NO: 763436 - RNA, 21 nt, Human
uauggucaguguuuccucacc

SEQ ID NO: 763437 - RNA, 24 nt, Human
ucacccaggcuggagugcaguggu

SEQ ID NO: 763438 - RNA, 24 nt, Human
ucacugcaaccuccaccucccagg

SEQ ID NO: 763439 - RNA, 25 nt, Human
ucacugcaaccuccaccucccaggc

SEQ ID NO: 763440 - RNA, 27 nt, Human
ucacugcaaccuccaccucccaggcuc

SEQ ID NO: 763441 - RNA, 19 nt, Human
ucacugcagccuccaccuc

SEQ ID NO: 763442 - RNA, 24 nt, Human
ucacugcagccuccaccuccccgg

SEQ ID NO: 763443 - RNA, 25 nt, Human
ucacugcagccuccaccuccccggu

SEQ ID NO: 763444 - RNA, 27 nt, Human
ucacugcagccuccaccuccccgguuc

SEQ ID NO: 763445 - RNA, 20 nt, Human
ucagccucccaaagcucugg

SEQ ID NO: 763446 - RNA, 23 nt, Human
ucagccucccaaagcucugggac

SEQ ID NO: 763447 - RNA, 18 nt, Human
ucagccucccaaguagcu

SEQ ID NO: 763448 - RNA, 20 nt, Human
ucagccucccaaguagcugg

SEQ ID NO: 763449 - RNA, 20 nt, Human
ucagccucccaaguagcugg

SEQ ID NO: 763450 - RNA, 21 nt, Human
ucagccucccgaguagccggg

SEQ ID NO: 763451 - RNA, 19 nt, Human
ucaggcacgccaccaugcc

SEQ ID NO: 763452 - RNA, 20 nt, Human
ucaguauuuucuagaacugu

SEQ ID NO: 763453 - RNA, 24 nt, Human
ucauguaugccuuuauuuaacccu

SEQ ID NO: 763454 - RNA, 27 nt, Human
uccacagugcccagccucucccugcuc

SEQ ID NO: 763455 - RNA, 21 nt, Human
uccacccaccucagccuccca

SEQ ID NO: 763456 - RNA, 19 nt, Human
uccagguacuccuccucgu

SEQ ID NO: 763457 - RNA, 24 nt, Human
uccaucacccaggcuggagugcag

SEQ ID NO: 763458 - RNA, 21 nt, Human
uccauggacucgucugcucug

SEQ ID NO: 763459 - RNA, 22 nt, Human
ucccaaagcucugggacuacag

SEQ ID NO: 763460 - RNA, 24 nt, Human
ucccaaagcucugggacuacaggc

SEQ ID NO: 763461 - RNA, 24 nt, Human
ucccaaguagcugggguuucaggc

SEQ ID NO: 763462 - RNA, 18 nt, Human
ucccacgacccugguugc

SEQ ID NO: 763463 - RNA, 19 nt, Human
ucccaggcucaagcgauuc

SEQ ID NO: 763464 - RNA, 24 nt, Human
ucccaggcucaagcgauucuagug

SEQ ID NO: 763465 - RNA, 21 nt, Human
uccccgguucaagcgauucuc

SEQ ID NO: 763466 - RNA, 26 nt, Human
uccccgguucaagcgauucucuccug

SEQ ID NO: 763467 - RNA, 23 nt, Human
ucccgaguagccgggauuacagg

SEQ ID NO: 763468 - RNA, 24 nt, Human
ucccgaguagccgggauuacaggu

SEQ ID NO: 763469 - RNA, 18 nt, Human
ucccgggugcuccacugc

SEQ ID NO: 763470 - RNA, 20 nt, Human
ucccugcucacucugcaugg

SEQ ID NO: 763471 - RNA, 20 nt, Human
ucccugcucacucugcaugg

SEQ ID NO: 763472 - RNA, 24 nt, Human
uccuaaagugcugggacuacaggu

SEQ ID NO: 763473 - RNA, 22 nt, Human
uccucguggaauaaaaauuggu

SEQ ID NO: 763474 - RNA, 18 nt, Human
ucuaaaucugugcuccuc

SEQ ID NO: 763475 - RNA, 18 nt, Human
ucucacucugucccucag

SEQ ID NO: 763476 - RNA, 24 nt, Human
ucucacucugucccucaggcuaga

SEQ ID NO: 763477 - RNA, 18 nt, Human
ucucuggggagcaggggu

SEQ ID NO: 763478 - RNA, 28 nt, Human
ucucuggggagcaggggugacguaaacg

SEQ ID NO: 763479 - RNA, 21 nt, Human
ucucuggggagcaggggugga

SEQ ID NO: 763480 - RNA, 26 nt, Human
ucuguggccaugagcgaguucagaca

SEQ ID NO: 763481 - RNA, 23 nt, Human
ucuugcuccaucacccaggcugg

SEQ ID NO: 763482 - RNA, 24 nt, Human
ucuugcuccaucacccaggcugga

SEQ ID NO: 763483 - RNA, 26 nt, Human
ucuuuggccacuaagaaagugacccu

SEQ ID NO: 763484 - RNA, 21 nt, Human
ugaccucaggugaucaccccc

SEQ ID NO: 763485 - RNA, 22 nt, Human
ugaccucaggugaucacccccc

SEQ ID NO: 763486 - RNA, 23 nt, Human
ugaccucaggugaucaccccccu

SEQ ID NO: 763487 - RNA, 23 nt, Human
ugaccucaggugaucaccccccu

SEQ ID NO: 763488 - RNA, 18 nt, Human
ugacuccaaagcccgugu

SEQ ID NO: 763489 - RNA, 18 nt, Human
ugagaagcacaccucaga

SEQ ID NO: 763490 - RNA, 23 nt, Human
ugagaagcacaccucagaaauca

SEQ ID NO: 763491 - RNA, 21 nt, Human
ugagacagaauccggauucuc

SEQ ID NO: 763492 - RNA, 24 nt, Human
ugagacagaauccggauucucaca

SEQ ID NO: 763493 - RNA, 18 nt, Human
ugagagcuuccuuucugc

SEQ ID NO: 763494 - RNA, 22 nt, Human
ugagauggagucuugcuccauc

SEQ ID NO: 763495 - RNA, 24 nt, Human
ugauccacccaccucagccuccca

SEQ ID NO: 763496 - RNA, 21 nt, Human
ugcaaggcuaacuccaaaacu

SEQ ID NO: 763497 - RNA, 22 nt, Human
ugccaaugggcgcgggagacau

SEQ ID NO: 763498 - RNA, 25 nt, Human
ugcccggcuaauuuuuguauuuuuu

SEQ ID NO: 763499 - RNA, 24 nt, Human
ugccucagccucccaaguagcugg

SEQ ID NO: 763500 - RNA, 24 nt, Human
ugccucagccucccgaguagccgg

SEQ ID NO: 763501 - RNA, 23 nt, Human
ugccugacuccaaagcccgugug

SEQ ID NO: 763502 - RNA, 24 nt, Human
ugcugggacuacaggugugagcca

SEQ ID NO: 763503 - RNA, 22 nt, Human
ugcugguggcaguggugauggc

SEQ ID NO: 763504 - RNA, 20 nt, Human
ugcuuaaaccacaggaccug

SEQ ID NO: 763505 - RNA, 21 nt, Human
ugcuucccauuaaggcacacu

SEQ ID NO: 763506 - RNA, 18 nt, Human
uggaaggaaaaaaagaga

SEQ ID NO: 763507 - RNA, 21 nt, Human
uggaggagggacaggauacag

SEQ ID NO: 763508 - RNA, 23 nt, Human
uggagugcaguggugcgaucucg

SEQ ID NO: 763509 - RNA, 24 nt, Human
uggagugcaguggugcgaucucgg

SEQ ID NO: 763510 - RNA, 24 nt, Human
uggccaggcuggucucaaacuccu

SEQ ID NO: 763511 - RNA, 24 nt, Human
uggccaggcuggucucaaacuccu

SEQ ID NO: 763512 - RNA, 18 nt, Human
ugggacuacaggcgugag

SEQ ID NO: 763513 - RNA, 19 nt, Human
ugggacuacaggcgugagc

SEQ ID NO: 763514 - RNA, 21 nt, Human
ugggacuacaggcgugagcca

SEQ ID NO: 763515 - RNA, 22 nt, Human
ugggacuacaggcgugagccac

SEQ ID NO: 763516 - RNA, 23 nt, Human
ugggacuacaggcgugagccacc

SEQ ID NO: 763517 - RNA, 24 nt, Human
ugggacuacaggcgugagccaccg

SEQ ID NO: 763518 - RNA, 19 nt, Human
ugggacuacaggugugagc

SEQ ID NO: 763519 - RNA, 21 nt, Human
ugggacuacaggugugagcca

SEQ ID NO: 763520 - RNA, 22 nt, Human
ugggacuacaggugugagccac

SEQ ID NO: 763521 - RNA, 22 nt, Human
ugggacuacaggugugagccac

SEQ ID NO: 763522 - RNA, 24 nt, Human
ugggacuacaggugugagccacug

SEQ ID NO: 763523 - RNA, 24 nt, Human
ugggguuucaccauguuggccagg

SEQ ID NO: 763524 - RNA, 22 nt, Human
ugggguuucaggcacgccacca

SEQ ID NO: 763525 - RNA, 23 nt, Human
ugggguuucaggcacgccaccau

SEQ ID NO: 763526 - RNA, 23 nt, Human
ugggugaccauucuguggccaug

SEQ ID NO: 763527 - RNA, 25 nt, Human
uggucaguguuuccucaccgcagcu

SEQ ID NO: 763528 - RNA, 24 nt, Human
uggugcgaucucggcucacugcag

SEQ ID NO: 763529 - RNA, 18 nt, Human
uguagaaaugaggccccc

SEQ ID NO: 763530 - RNA, 18 nt, Human
ugucuggagcgacggcag

SEQ ID NO: 763531 - RNA, 18 nt, Human
uguggaaggaaaaaaaga

SEQ ID NO: 763532 - RNA, 24 nt, Human
uuagcagagacaggauuucaccau

SEQ ID NO: 763533 - RNA, 18 nt, Human
uuaguagcgaugggguuu

SEQ ID NO: 763534 - RNA, 24 nt, Human
uuaguagcgaugggguuucaccau

SEQ ID NO: 763535 - RNA, 22 nt, Human
uucaaaagcuggagcuggcacc

SEQ ID NO: 763536 - RNA, 23 nt, Human
uucaagcgauucucuccugccuc

SEQ ID NO: 763537 - RNA, 25 nt, Human
uucaagcgauucucuccugccucag

SEQ ID NO: 763538 - RNA, 24 nt, Human
uucaauaauuagacaucaauguca

SEQ ID NO: 763539 - RNA, 24 nt, Human
uucuauggucaguguuuccucacc

SEQ ID NO: 763540 - RNA, 22 nt, Human
uucucuccugccucagccuccc

SEQ ID NO: 763541 - RNA, 24 nt, Human
uugcuccaucacccaggcuggagu

SEQ ID NO: 763542 - RNA, 24 nt, Human
uugugugagcagaaaggggggcag

SEQ ID NO: 763543 - RNA, 21 nt, Human
uuuacaaguaagaugagccuu

SEQ ID NO: 763544 - RNA, 22 nt, Human
uuuacaccaaaaugaccagaga

SEQ ID NO: 763545 - RNA, 24 nt, Human
uuucaccauguuggccaggcuggu

SEQ ID NO: 763546 - RNA, 24 nt, Human
uuucaccauguuggccaggcuggu

SEQ ID NO: 763547 - RNA, 19 nt, Human
uuugccaggcauuuucaug

SEQ ID NO: 763548 - RNA, 24 nt, Human
uuuuuaguagcgaugggguuucac

SEQ ID NO: 763549 - RNA, 23 nt, Human
aaauggucugugaucacugaagc

SEQ ID NO: 763550 - RNA, 24 nt, Human
aaauguugaaaaugcaaauagacu

SEQ ID NO: 763551 - RNA, 21 nt, Human
aagaaagacaaaaaacuugca

SEQ ID NO: 763552 - RNA, 25 nt, Human
aauaaacaaaugaaaaaguauacaa

SEQ ID NO: 763553 - RNA, 23 nt, Human
aauaaauuacuuaucucccugaa

SEQ ID NO: 763554 - RNA, 20 nt, Human
acccagauacacccuggcac

SEQ ID NO: 763555 - RNA, 22 nt, Human
acuaucuccuuuuuauauauac

SEQ ID NO: 763556 - RNA, 19 nt, Human
acuuaaguccugaggggug

SEQ ID NO: 763557 - RNA, 22 nt, Human
agaaauaaacaaaugaaaaagu

SEQ ID NO: 763558 - RNA, 18 nt, Human
agaaggagggaauagaga

SEQ ID NO: 763559 - RNA, 20 nt, Human
agcugcuuuucgaggaucug

SEQ ID NO: 763560 - RNA, 21 nt, Human
agcugcuuuucgaggaucugg

SEQ ID NO: 763561 - RNA, 20 nt, Human
aggagaugccucuggagcau

SEQ ID NO: 763562 - RNA, 24 nt, Human
aggcuuugaauguucacaaauagg

SEQ ID NO: 763563 - RNA, 23 nt, Human
agugggacgauuagggauaacau

SEQ ID NO: 763564 - RNA, 22 nt, Human
auaaaaucuucacaguauaaaa

SEQ ID NO: 763565 - RNA, 18 nt, Human
augaaaugcauuauaucc

SEQ ID NO: 763566 - RNA, 27 nt, Human
augaacuuuuaagaaagaaagacaaaa

SEQ ID NO: 763567 - RNA, 23 nt, Human
caaaugaaaaaguauacaaaacu

SEQ ID NO: 763568 - RNA, 23 nt, Human
caacacuucaaacccaggucucc

SEQ ID NO: 763569 - RNA, 21 nt, Human
cacagccuauaaaaauccuuu

SEQ ID NO: 763570 - RNA, 26 nt, Human
ccuguuugcaaacagugaaaacccac

SEQ ID NO: 763571 - RNA, 22 nt, Human
cugguuacccagauacacccug

SEQ ID NO: 763572 - RNA, 22 nt, Human
gaaaacccacagccuauaaaaa

SEQ ID NO: 763573 - RNA, 22 nt, Human
gcaaacagugaaaacccacagc

SEQ ID NO: 763574 - RNA, 21 nt, Human
ggagcaaagaacucauuuucc

SEQ ID NO: 763575 - RNA, 20 nt, Human
ggcaaauuagguagauuuua

SEQ ID NO: 763576 - RNA, 24 nt, Human
ggguggcaguuaugagaaggaggg

SEQ ID NO: 763577 - RNA, 23 nt, Human
uaaaaucuucacaguauaaaacu

SEQ ID NO: 763578 - RNA, 23 nt, Human
uaagaaggaacauagccuguuug

SEQ ID NO: 763579 - RNA, 18 nt, Human
uaaguuuucaacguguaa

SEQ ID NO: 763580 - RNA, 26 nt, Human
uaaguuuucaacguguaaauuucaca

SEQ ID NO: 763581 - RNA, 19 nt, Human
uacauaugcuuaagaagga

SEQ ID NO: 763582 - RNA, 18 nt, Human
uacccagauacacccugg

SEQ ID NO: 763583 - RNA, 21 nt, Human
uagcauuuuaaagaggaagau

SEQ ID NO: 763584 - RNA, 22 nt, Human
uagcauuuuaaagaggaagauu

SEQ ID NO: 763585 - RNA, 24 nt, Human
uaugagaaggagggaauagagaaa

SEQ ID NO: 763586 - RNA, 24 nt, Human
ucagagcugcuuuucgaggaucug

SEQ ID NO: 763587 - RNA, 23 nt, Human
uccaaguaauuuucauauauugc

SEQ ID NO: 763588 - RNA, 24 nt, Human
ucccugggucaccauuacaaaugu

SEQ ID NO: 763589 - RNA, 23 nt, Human
uccuagaccucuagagacaauuc

SEQ ID NO: 763590 - RNA, 20 nt, Human
ugaaaugcauuauauccuag

SEQ ID NO: 763591 - RNA, 24 nt, Human
ugagaaggagggaauagagaaaua

SEQ ID NO: 763592 - RNA, 21 nt, Human
ugcaaacagugaaaacccaca

SEQ ID NO: 763593 - RNA, 25 nt, Human
ugcuuauuaaaaauaaaaaugggaa

SEQ ID NO: 763594 - RNA, 23 nt, Human
uguaaugaauugucucauaaucu

SEQ ID NO: 763595 - RNA, 20 nt, Human
ugugagcauuuacugaggag

SEQ ID NO: 763596 - RNA, 24 nt, Human
uguuugcaaacagugaaaacccac

SEQ ID NO: 763597 - RNA, 19 nt, Human
uuaaaaauaaaaaugggaa

SEQ ID NO: 763598 - RNA, 22 nt, Human
uuaaaaauaucaauuaaauccu

SEQ ID NO: 763599 - RNA, 21 nt, Human
uucaacacuucaaacccaggu

SEQ ID NO: 763600 - RNA, 20 nt, Human
uucaugugagcauuuacuga

SEQ ID NO: 763601 - RNA, 22 nt, Human
uuuacauaugcuuaagaaggaa

SEQ ID NO: 763602 - RNA, 18 nt, Human
uuucagagcugcuuuucg

SEQ ID NO: 763603 - RNA, 22 nt, Human
uuugcaaacagugaaaacccac

SEQ ID NO: 763604 - RNA, 19 nt, Human
aacuggcuucuagcaguug

SEQ ID NO: 763605 - RNA, 24 nt, Human
aaugauguaaaacauggagagaga

SEQ ID NO: 763606 - RNA, 21 nt, Human
agacucuugccauaagaauuc

SEQ ID NO: 763607 - RNA, 20 nt, Human
aggcgggcuccggccgcuuc

SEQ ID NO: 763608 - RNA, 21 nt, Human
aggcgggcuccggccgcuucu

SEQ ID NO: 763609 - RNA, 21 nt, Human
gaggagaaaacucuggguucu

SEQ ID NO: 763610 - RNA, 22 nt, Human
gcaaagauuuuuuuucauuaag

SEQ ID NO: 763611 - RNA, 23 nt, Human
gcuuuuuuuucuuuuccccuuaa

SEQ ID NO: 763612 - RNA, 23 nt, Human
gcuuuuuuuucuuuuccccuuaa

SEQ ID NO: 763613 - RNA, 21 nt, Human
ggaaaaggcaaauucagccgu

SEQ ID NO: 763614 - RNA, 20 nt, Human
gggaagcugagggggccgag

SEQ ID NO: 763615 - RNA, 20 nt, Human
gggaagcugagggggccgag

SEQ ID NO: 763616 - RNA, 18 nt, Human
uacagaugaggagaaaac

SEQ ID NO: 763617 - RNA, 19 nt, Human
ucaaagcagucacagcuuc

SEQ ID NO: 763618 - RNA, 19 nt, Human
ucucugggcccucuggucg

SEQ ID NO: 763619 - RNA, 20 nt, Human
ugaaaugcacugacaucuuc

SEQ ID NO: 763620 - RNA, 25 nt, Human
ugcaaagauuuuuuuucauuaagug

SEQ ID NO: 763621 - RNA, 21 nt, Human
ugccauaagaauucaauaagg

SEQ ID NO: 763622 - RNA, 20 nt, Human
uggcaauauuugauuuugac

SEQ ID NO: 763623 - RNA, 24 nt, Human
ugggaaaaggcaaauucagccgua

SEQ ID NO: 763624 - RNA, 18 nt, Human
uguuuuguuuuccguuuc

SEQ ID NO: 763625 - RNA, 23 nt, Human
uuugggauuuuaaccagggcucc

SEQ ID NO: 763626 - RNA, 24 nt, Human
aaagucaggaagagcugaaaggau

SEQ ID NO: 763627 - RNA, 22 nt, Human
aacgugcccacauaagacagga

SEQ ID NO: 763628 - RNA, 18 nt, Human
aagcaggcggccgagccc

SEQ ID NO: 763629 - RNA, 19 nt, Human
aaguccugggccacaucaa

SEQ ID NO: 763630 - RNA, 22 nt, Human
aauuuuggccaagagucaaaaa

SEQ ID NO: 763631 - RNA, 21 nt, Human
acacaaguucaaaaugauauu

SEQ ID NO: 763632 - RNA, 18 nt, Human
acauggcaccucaggcgg

SEQ ID NO: 763633 - RNA, 19 nt, Human
agacaaggccagcgagagc

SEQ ID NO: 763634 - RNA, 20 nt, Human
agacaaggccagcgagagcg

SEQ ID NO: 763635 - RNA, 21 nt, Human
agacaggaggcugaucccaac

SEQ ID NO: 763636 - RNA, 21 nt, Human
agagucaaaaaaaugcauuua

SEQ ID NO: 763637 - RNA, 23 nt, Human
agcaggcggccgagcccggcgca

SEQ ID NO: 763638 - RNA, 20 nt, Human
agcccggcgcaaaaucacca

SEQ ID NO: 763639 - RNA, 21 nt, Human
aggcagguuaaugcuuucuuu

SEQ ID NO: 763640 - RNA, 18 nt, Human
aggcggccgagcccggcg

SEQ ID NO: 763641 - RNA, 21 nt, Human
augcuguauuuccugcuggcu

SEQ ID NO: 763642 - RNA, 19 nt, Human
cacaaaccaaagggcuggg

SEQ ID NO: 763643 - RNA, 21 nt, Human
cagauacccacaaaccaaagg

SEQ ID NO: 763644 - RNA, 22 nt, Human
caggaaacuccuggguccccga

SEQ ID NO: 763645 - RNA, 22 nt, Human
caggaagagcugaaaggauucu

SEQ ID NO: 763646 - RNA, 20 nt, Human
caggcggcuccggcagcgcu

SEQ ID NO: 763647 - RNA, 23 nt, Human
cauggcaccucaggcggcuccgg

SEQ ID NO: 763648 - RNA, 28 nt, Human
ccacugaaauccacaugcgaaaauaggg

SEQ ID NO: 763649 - RNA, 23 nt, Human
cccacaaaccaaagggcugggaa

SEQ ID NO: 763650 - RNA, 19 nt, Human
cccacauaagacaggaggc

SEQ ID NO: 763651 - RNA, 22 nt, Human
ccggcucuccucgacccccucu

SEQ ID NO: 763652 - RNA, 21 nt, Human
cgacuccggcucuccucgacc

SEQ ID NO: 763653 - RNA, 22 nt, Human
cgacuccggcucuccucgaccc

SEQ ID NO: 763654 - RNA, 23 nt, Human
cgcacacuccugaaucagaaacu

SEQ ID NO: 763655 - RNA, 21 nt, Human
cguaauaaaugccugucugcc

SEQ ID NO: 763656 - RNA, 24 nt, Human
cuggcuggcucgguaauuuuucuu

SEQ ID NO: 763657 - RNA, 18 nt, Human
gacuccggcucuccucga

SEQ ID NO: 763658 - RNA, 18 nt, Human
gagacaauuuggcuuugu

SEQ ID NO: 763659 - RNA, 21 nt, Human
gcagcgcuggacacaggaaac

SEQ ID NO: 763660 - RNA, 21 nt, Human
gcuggacacaggaaacuccug

SEQ ID NO: 763661 - RNA, 18 nt, Human
gcuguauuuccugcuggc

SEQ ID NO: 763662 - RNA, 24 nt, Human
ggaagcaggcggccgagcccggcg

SEQ ID NO: 763663 - RNA, 21 nt, Human
guaauaaaugccugucugccu

SEQ ID NO: 763664 - RNA, 18 nt, Human
uaaaugccugucugccuc

SEQ ID NO: 763665 - RNA, 23 nt, Human
uaagacaggaggcugaucccaac

SEQ ID NO: 763666 - RNA, 18 nt, Human
uaccaucgccacugaaau

SEQ ID NO: 763667 - RNA, 23 nt, Human
uagacugacacguacaacagaga

SEQ ID NO: 763668 - RNA, 23 nt, Human
ucagaggcagguuaaugcuuucu

SEQ ID NO: 763669 - RNA, 21 nt, Human
uccacaugcgaaaauaggcag

SEQ ID NO: 763670 - RNA, 23 nt, Human
uccuggguccccgacuccggcuc

SEQ ID NO: 763671 - RNA, 26 nt, Human
ucgccacugaaauccacaugcgaaaa

SEQ ID NO: 763672 - RNA, 19 nt, Human
ucuucgguuaacuccgcuu

SEQ ID NO: 763673 - RNA, 21 nt, Human
ugagacaaggccagcgagagc

SEQ ID NO: 763674 - RNA, 19 nt, Human
ugggaaagucaggaagagc

SEQ ID NO: 763675 - RNA, 20 nt, Human
uuuacacaaguucaaaauga

SEQ ID NO: 763676 - RNA, 20 nt, Human
aacacuuguuuuucauaagc

SEQ ID NO: 763677 - RNA, 19 nt, Human
aagcguugaaaaauuaccu

SEQ ID NO: 763678 - RNA, 22 nt, Human
aauagcucacauuuguuccaag

SEQ ID NO: 763679 - RNA, 25 nt, Human
aaucacuuaaaaugagacugguuaa

SEQ ID NO: 763680 - RNA, 25 nt, Human
aaucaucugaaagcucugccucuga

SEQ ID NO: 763681 - RNA, 22 nt, Human
aggaggaauaacccggaguuca

SEQ ID NO: 763682 - RNA, 21 nt, Human
aguaagcguugaaaaauuacc

SEQ ID NO: 763683 - RNA, 23 nt, Human
auaaagauggagauaacagacac

SEQ ID NO: 763684 - RNA, 19 nt, Human
aucaucugaaagcucugcc

SEQ ID NO: 763685 - RNA, 18 nt, Human
caaaagaaucaucugaaa

SEQ ID NO: 763686 - RNA, 18 nt, Human
caacaagcacauguaccc

SEQ ID NO: 763687 - RNA, 21 nt, Human
caacaagcacauguacccccu

SEQ ID NO: 763688 - RNA, 29 nt, Human
caacaagcacauguacccccuggaucuaa

SEQ ID NO: 763689 - RNA, 24 nt, Human
caacauggauagagcuggaggcca

SEQ ID NO: 763690 - RNA, 24 nt, Human
cacaaucccauccaucuucaggcc

SEQ ID NO: 763691 - RNA, 27 nt, Human
cacauuuguuccaagaagucagugaaa

SEQ ID NO: 763692 - RNA, 19 nt, Human
caugucauuugcagcaaca

SEQ ID NO: 763693 - RNA, 22 nt, Human
ccaaccuaaguaucuaccaaca

SEQ ID NO: 763694 - RNA, 19 nt, Human
ccccuggaucuaaaauaaa

SEQ ID NO: 763695 - RNA, 19 nt, Human
cuggauaaagaaaacguga

SEQ ID NO: 763696 - RNA, 20 nt, Human
cuuucuucuucaucucuuuu

SEQ ID NO: 763697 - RNA, 20 nt, Human
cuuugaggaaugaggaggaa

SEQ ID NO: 763698 - RNA, 24 nt, Human
ggccauuauccuaugugaacuaaa

SEQ ID NO: 763699 - RNA, 20 nt, Human
gggaaagagugugagcggca

SEQ ID NO: 763700 - RNA, 21 nt, Human
uaaaauacaccauuauauguu

SEQ ID NO: 763701 - RNA, 21 nt, Human
uaaaucacuuaaaaugagacu

SEQ ID NO: 763702 - RNA, 23 nt, Human
uaacagacacuggggacuccaau

SEQ ID NO: 763703 - RNA, 18 nt, Human
uaacccggaguucaguag

SEQ ID NO: 763704 - RNA, 19 nt, Human
uauccaccaaggcacugua

SEQ ID NO: 763705 - RNA, 26 nt, Human
uaugcaacuauaaaaaagaaugaaau

SEQ ID NO: 763706 - RNA, 19 nt, Human
uauuaugcaacuauaaaaa

SEQ ID NO: 763707 - RNA, 24 nt, Human
uccauaaaucacuuaaaaugagac

SEQ ID NO: 763708 - RNA, 20 nt, Human
ucucacuuaaaaguaggagc

SEQ ID NO: 763709 - RNA, 23 nt, Human
ucucuuuuuuagauugucuagcu

SEQ ID NO: 763710 - RNA, 24 nt, Human
ucuuucuucuucaucucuuuuccu

SEQ ID NO: 763711 - RNA, 19 nt, Human
ugaaaucaugucauuugca

SEQ ID NO: 763712 - RNA, 25 nt, Human
ugaacuaaaucagacauaaaaaaua

SEQ ID NO: 763713 - RNA, 20 nt, Human
ugacuggauaaagaaaacgu

SEQ ID NO: 763714 - RNA, 23 nt, Human
ugagaagucuucuuuguuuucaa

SEQ ID NO: 763715 - RNA, 22 nt, Human
ugcaacuauaaaaaagaaugaa

SEQ ID NO: 763716 - RNA, 21 nt, Human
ugcuuugguuguuugcuuucu

SEQ ID NO: 763717 - RNA, 23 nt, Human
uggaaacauauuggaacacuugu

SEQ ID NO: 763718 - RNA, 28 nt, Human
uggaacacuuguuuuucauuggacaucc

SEQ ID NO: 763719 - RNA, 24 nt, Human
uggaaccaaccuaaguaucuacca

SEQ ID NO: 763720 - RNA, 22 nt, Human
uggagauaacagacacugggga

SEQ ID NO: 763721 - RNA, 18 nt, Human
uggauagagcuggaggcc

SEQ ID NO: 763722 - RNA, 22 nt, Human
uugaaaaauuaccuguugggua

SEQ ID NO: 763723 - RNA, 22 nt, Human
uugcagcaauauuuacaauagg

SEQ ID NO: 763724 - RNA, 18 nt, Human
uuuuagauugucuagcug

SEQ ID NO: 763725 - RNA, 20 nt, Human
aaacaagguuacagaaugua

SEQ ID NO: 763726 - RNA, 23 nt, Human
aaacacucuucacaaaaggacuc

SEQ ID NO: 763727 - RNA, 20 nt, Human
aacauagcaagaccccaucu

SEQ ID NO: 763728 - RNA, 21 nt, Human
aacauagcaagaccccaucuc

SEQ ID NO: 763729 - RNA, 25 nt, Human
aagaagaaagacauccagucuucca

SEQ ID NO: 763730 - RNA, 24 nt, Human
acacugggcuucugacugcaaguu

SEQ ID NO: 763731 - RNA, 24 nt, Human
acauagcaagaccccaucucaaaa

SEQ ID NO: 763732 - RNA, 18 nt, Human
accccaucucaaaaaaaa

SEQ ID NO: 763733 - RNA, 25 nt, Human
acccucggcggacugaaagcaaagg

SEQ ID NO: 763734 - RNA, 20 nt, Human
acuaagucauuugcaaagcc

SEQ ID NO: 763735 - RNA, 21 nt, Human
agcacaaccauuaccaacacu

SEQ ID NO: 763736 - RNA, 24 nt, Human
agccugggcaacauagcaagaccc

SEQ ID NO: 763737 - RNA, 21 nt, Human
aggcuauuucuucccuuucuu

SEQ ID NO: 763738 - RNA, 22 nt, Human
agggaagagaaucuuucagaug

SEQ ID NO: 763739 - RNA, 18 nt, Human
aguuaguggugaaaaaaa

SEQ ID NO: 763740 - RNA, 25 nt, Human
aguuucuccuuuccaaaagccagcu

SEQ ID NO: 763741 - RNA, 20 nt, Human
aucaauuauugaguccaggg

SEQ ID NO: 763742 - RNA, 18 nt, Human
aucccgacaaacucccag

SEQ ID NO: 763743 - RNA, 20 nt, Human
auggaacauggggccacccc

SEQ ID NO: 763744 - RNA, 20 nt, Human
caacagaaaauaaagacccc

SEQ ID NO: 763745 - RNA, 24 nt, Human
caacccaaucgaggagaacaagau

SEQ ID NO: 763746 - RNA, 22 nt, Human
caacgcagacagggccuguguc

SEQ ID NO: 763747 - RNA, 22 nt, Human
caagauaggcuucauagcuggg

SEQ ID NO: 763748 - RNA, 19 nt, Human
caagaucuguggugugcuc

SEQ ID NO: 763749 - RNA, 20 nt, Human
caagguuacagaauguagug

SEQ ID NO: 763750 - RNA, 20 nt, Human
cacaaccauuaccaacacug

SEQ ID NO: 763751 - RNA, 19 nt, Human
caccuguaaucucagcagg

SEQ ID NO: 763752 - RNA, 19 nt, Human
caccuguaaucucagcagg

SEQ ID NO: 763753 - RNA, 23 nt, Human
cacuaagucauuugcaaagcccc

SEQ ID NO: 763754 - RNA, 23 nt, Human
cacugccucacggggugcccaga

SEQ ID NO: 763755 - RNA, 21 nt, Human
cagcucuaagacuugucucuc

SEQ ID NO: 763756 - RNA, 19 nt, Human
cagggccugugucucagga

SEQ ID NO: 763757 - RNA, 20 nt, Human
caggguccauuucaaauucu

SEQ ID NO: 763758 - RNA, 23 nt, Human
cauagcaagaccccaucucaaaa

SEQ ID NO: 763759 - RNA, 23 nt, Human
cauggaacauggggccaccccaa

SEQ ID NO: 763760 - RNA, 23 nt, Human
cccaaacgccguacagcacaacc

SEQ ID NO: 763761 - RNA, 21 nt, Human
cccaucucaaaaaaaaaagcg

SEQ ID NO: 763762 - RNA, 19 nt, Human
ccccaucucaaaaaaaaaa

SEQ ID NO: 763763 - RNA, 23 nt, Human
cccgacucccaggauuuuaaggc

SEQ ID NO: 763764 - RNA, 21 nt, Human
cccuuucuuuuaaaagacaaa

SEQ ID NO: 763765 - RNA, 22 nt, Human
ccgccagaacccucggcggacu

SEQ ID NO: 763766 - RNA, 18 nt, Human
ccucacggggugcccaga

SEQ ID NO: 763767 - RNA, 24 nt, Human
ccugggcaacauagcaagacccca

SEQ ID NO: 763768 - RNA, 24 nt, Human
cgguaugguggcuuacaccuguaa

SEQ ID NO: 763769 - RNA, 19 nt, Human
cuacuuaaauauaaacauc

SEQ ID NO: 763770 - RNA, 25 nt, Human
cucccagccaugugcaagcacugcc

SEQ ID NO: 763771 - RNA, 19 nt, Human
cucuugcauuacugccuuc

SEQ ID NO: 763772 - RNA, 21 nt, Human
cugccucacggggugcccaga

SEQ ID NO: 763773 - RNA, 20 nt, Human
cuggguggcaggcaacgugg

SEQ ID NO: 763774 - RNA, 18 nt, Human
cugguuucagcucaaagc

SEQ ID NO: 763775 - RNA, 26 nt, Human
cuuacaccuguaaucucagcagggag

SEQ ID NO: 763776 - RNA, 19 nt, Human
gacacuggaggugucccag

SEQ ID NO: 763777 - RNA, 24 nt, Human
gagcaggcgcccucucggugggcc

SEQ ID NO: 763778 - RNA, 24 nt, Human
gaggcgggaggguugcuugagccc

SEQ ID NO: 763779 - RNA, 18 nt, Human
gauccuuccagccagcca

SEQ ID NO: 763780 - RNA, 19 nt, Human
gccagaacccucggcggac

SEQ ID NO: 763781 - RNA, 26 nt, Human
gccguacagcacaaccauuaccaaca

SEQ ID NO: 763782 - RNA, 20 nt, Human
ggaagagaaucuuucagaug

SEQ ID NO: 763783 - RNA, 18 nt, Human
ggacacuggagguguccc

SEQ ID NO: 763784 - RNA, 19 nt, Human
ggaggugucccaggagcuu

SEQ ID NO: 763785 - RNA, 24 nt, Human
gggaauggaguaaaagaaacaagg

SEQ ID NO: 763786 - RNA, 22 nt, Human
gggaggguugcuugagcccagg

SEQ ID NO: 763787 - RNA, 24 nt, Human
gguggcuuacaccuguaaucucag

SEQ ID NO: 763788 - RNA, 19 nt, Human
guaaggcuauuucuucccu

SEQ ID NO: 763789 - RNA, 21 nt, Human
guacagcacaaccauuaccaa

SEQ ID NO: 763790 - RNA, 20 nt, Human
gucacagguguuauguuguc

SEQ ID NO: 763791 - RNA, 19 nt, Human
gugcacuuggaggaacagg

SEQ ID NO: 763792 - RNA, 18 nt, Human
gugcuggacacuggaggu

SEQ ID NO: 763793 - RNA, 24 nt, Human
guugcgguaugguggcuuacaccu

SEQ ID NO: 763794 - RNA, 19 nt, Human
uaaaagaaacaagguuaca

SEQ ID NO: 763795 - RNA, 21 nt, Human
uaaaagaaacaagguuacaga

SEQ ID NO: 763796 - RNA, 22 nt, Human
uaaaagaaacaagguuacagaa

SEQ ID NO: 763797 - RNA, 26 nt, Human
uaaaagaaacaagguuacagaaugua

SEQ ID NO: 763798 - RNA, 19 nt, Human
uaaaagacaaauuucaugg

SEQ ID NO: 763799 - RNA, 19 nt, Human
uaaauauaaacaucucuac

SEQ ID NO: 763800 - RNA, 18 nt, Human
uaaucugggaauggagua

SEQ ID NO: 763801 - RNA, 20 nt, Human
uacaccuguaaucucagcag

SEQ ID NO: 763802 - RNA, 18 nt, Human
uaccuaacaagggaagag

SEQ ID NO: 763803 - RNA, 18 nt, Human
uagcaagaccccaucuca

SEQ ID NO: 763804 - RNA, 22 nt, Human
uaugaucaggcacuugggaauc

SEQ ID NO: 763805 - RNA, 18 nt, Human
uauuucuucccuuucuuu

SEQ ID NO: 763806 - RNA, 21 nt, Human
ucaaaaaaaaaagcggggggg

SEQ ID NO: 763807 - RNA, 29 nt, Human
ucagggauccuuccagccagccaucuucc

SEQ ID NO: 763808 - RNA, 19 nt, Human
ucaugguuucccauuccaa

SEQ ID NO: 763809 - RNA, 23 nt, Human
uccagggcaggggggccaccaga

SEQ ID NO: 763810 - RNA, 23 nt, Human
uccuuuccaaaagccagcucuaa

SEQ ID NO: 763811 - RNA, 18 nt, Human
ucggcggacugaaagcaa

SEQ ID NO: 763812 - RNA, 27 nt, Human
ucuauugcuagagcacagccggggucc

SEQ ID NO: 763813 - RNA, 19 nt, Human
ugacugcaaguuucuccuu

SEQ ID NO: 763814 - RNA, 23 nt, Human
ugagcauggaacauggggccacc

SEQ ID NO: 763815 - RNA, 23 nt, Human
ugagcccaggcguuuaagaccag

SEQ ID NO: 763816 - RNA, 18 nt, Human
ugccuguccugcccuuca

SEQ ID NO: 763817 - RNA, 18 nt, Human
uggaggaacaggggcugu

SEQ ID NO: 763818 - RNA, 21 nt, Human
uggcauccggucagcugagca

SEQ ID NO: 763819 - RNA, 21 nt, Human
uggcuggagcucucauacuuu

SEQ ID NO: 763820 - RNA, 21 nt, Human
uggcuuacaccuguaaucuca

SEQ ID NO: 763821 - RNA, 24 nt, Human
uggcuuacaccuguaaucucagca

SEQ ID NO: 763822 - RNA, 22 nt, Human
uggcuuugaaugucaucucugg

SEQ ID NO: 763823 - RNA, 22 nt, Human
ugggcaacauagcaagacccca

SEQ ID NO: 763824 - RNA, 24 nt, Human
ugguggcuuacaccuguaaucuca

SEQ ID NO: 763825 - RNA, 24 nt, Human
uguccugcccuucagggauccuuc

SEQ ID NO: 763826 - RNA, 25 nt, Human
uguccugcccuucagggauccuucc

SEQ ID NO: 763827 - RNA, 21 nt, Human
ugugugcuggacacuggaggu

SEQ ID NO: 763828 - RNA, 25 nt, Human
uugaaugucaucucugaagcaugga

SEQ ID NO: 763829 - RNA, 24 nt, Human
uugcaaagccccaggguccauuuc

SEQ ID NO: 763830 - RNA, 23 nt, Human
uuucaugguuucccauuccaaga

SEQ ID NO: 763831 - RNA, 23 nt, Human
aaaaacugauuauuguggauuuc

SEQ ID NO: 763832 - RNA, 19 nt, Human
aacaggaguacugccaaca

SEQ ID NO: 763833 - RNA, 25 nt, Human
acucuaugaccaaaguucaaaacug

SEQ ID NO: 763834 - RNA, 21 nt, Human
aucaaucaaccuccauaacaa

SEQ ID NO: 763835 - RNA, 27 nt, Human
aucaucaacaaaaugacaagucaaagu

SEQ ID NO: 763836 - RNA, 21 nt, Human
caacaaaaugacaagucaaag

SEQ ID NO: 763837 - RNA, 21 nt, Human
cagcaaaaacugauuauugug

SEQ ID NO: 763838 - RNA, 18 nt, Human
cagcacaggcagcggcgg

SEQ ID NO: 763839 - RNA, 25 nt, Human
caggcagcggcggcgcccgcccucc

SEQ ID NO: 763840 - RNA, 25 nt, Human
caguaaagcuggaauuuagagacua

SEQ ID NO: 763841 - RNA, 24 nt, Human
ccaacgugcuuugcaucaucaaca

SEQ ID NO: 763842 - RNA, 20 nt, Human
ccgcccuccggcccacccug

SEQ ID NO: 763843 - RNA, 18 nt, Human
cguauaccauugacaagu

SEQ ID NO: 763844 - RNA, 18 nt, Human
cugcuguaaaacccaucc

SEQ ID NO: 763845 - RNA, 23 nt, Human
cuuuccuuucucagaaucaucuc

SEQ ID NO: 763846 - RNA, 18 nt, Human
ggaauuuagagacuaaug

SEQ ID NO: 763847 - RNA, 23 nt, Human
uaaagcuggaauuuagagacuaa

SEQ ID NO: 763848 - RNA, 19 nt, Human
uagaacuucacaguaaagc

SEQ ID NO: 763849 - RNA, 22 nt, Human
uagggaccaccaaauacugaaa

SEQ ID NO: 763850 - RNA, 24 nt, Human
ucaaaacugauuuuaaggaacugu

SEQ ID NO: 763851 - RNA, 23 nt, Human
ucaacaaaaugacaagucaaagu

SEQ ID NO: 763852 - RNA, 18 nt, Human
ucagauaucaaucaaccu

SEQ ID NO: 763853 - RNA, 25 nt, Human
ucagauaucaaucaaccuccauaac

SEQ ID NO: 763854 - RNA, 21 nt, Human
ugcacaaauaugcugauaucc

SEQ ID NO: 763855 - RNA, 20 nt, Human
uuaaguauucucaguccaac

SEQ ID NO: 763856 - RNA, 21 nt, Human
aaaaaacaaacaaacaaaacc

SEQ ID NO: 763857 - RNA, 23 nt, Human
aaaaaagaucaaucuggaauaug

SEQ ID NO: 763858 - RNA, 18 nt, Human
aaaacccuacaauaaacc

SEQ ID NO: 763859 - RNA, 18 nt, Human
aaaagaauaugcaaaaag

SEQ ID NO: 763860 - RNA, 21 nt, Human
aaacaaaacccuacaauaaac

SEQ ID NO: 763861 - RNA, 27 nt, Human
aacaaacaaacaaaacccuacaauaaa

SEQ ID NO: 763862 - RNA, 21 nt, Human
aacgcagugcuuggucaggag

SEQ ID NO: 763863 - RNA, 22 nt, Human
aagugagcaaugacuccggagc

SEQ ID NO: 763864 - RNA, 20 nt, Human
acaaaaaagaucaaucugga

SEQ ID NO: 763865 - RNA, 19 nt, Human
acacugaguccucucuugg

SEQ ID NO: 763866 - RNA, 24 nt, Human
acucuuugucagcucacgaauuca

SEQ ID NO: 763867 - RNA, 18 nt, Human
acuuggaacuacuugugg

SEQ ID NO: 763868 - RNA, 18 nt, Human
agcuucaaguaauuuucc

SEQ ID NO: 763869 - RNA, 22 nt, Human
aggaaaaaggagcuccaugaua

SEQ ID NO: 763870 - RNA, 22 nt, Human
agguaaucaguuuuuccagaac

SEQ ID NO: 763871 - RNA, 21 nt, Human
augacaaaaaagaucaaucug

SEQ ID NO: 763872 - RNA, 24 nt, Human
auguucuccaagcagacuuuguca

SEQ ID NO: 763873 - RNA, 19 nt, Human
caaacaaacaaaacccuac

SEQ ID NO: 763874 - RNA, 21 nt, Human
caaccuuugaugucuuuaggu

SEQ ID NO: 763875 - RNA, 20 nt, Human
caauaugaacaagaaacuug

SEQ ID NO: 763876 - RNA, 21 nt, Human
cagccccgaccccagcggccu

SEQ ID NO: 763877 - RNA, 21 nt, Human
caugaaaauccagcuucaagu

SEQ ID NO: 763878 - RNA, 19 nt, Human
ccagaacaauagcucauca

SEQ ID NO: 763879 - RNA, 23 nt, Human
ccccuucucucauccugcugaau

SEQ ID NO: 763880 - RNA, 20 nt, Human
ccuacaguuacguuagugcc

SEQ ID NO: 763881 - RNA, 21 nt, Human
cuauucacaauaugaacaaga

SEQ ID NO: 763882 - RNA, 26 nt, Human
cucguacgugcagccccgaccccagc

SEQ ID NO: 763883 - RNA, 18 nt, Human
cucuuggcaauacuucaa

SEQ ID NO: 763884 - RNA, 26 nt, Human
cugcugaauugugcucugagauuucc

SEQ ID NO: 763885 - RNA, 19 nt, Human
cuucacacugaguccucuc

SEQ ID NO: 763886 - RNA, 23 nt, Human
cuucgcucugaacccgggcgucc

SEQ ID NO: 763887 - RNA, 23 nt, Human
cuugaaaagucagaacaauaaaa

SEQ ID NO: 763888 - RNA, 19 nt, Human
cuuuguggggcuuggugug

SEQ ID NO: 763889 - RNA, 20 nt, Human
gacaaaaaagaucaaucugg

SEQ ID NO: 763890 - RNA, 20 nt, Human
gccccgaccccagcggccug

SEQ ID NO: 763891 - RNA, 19 nt, Human
gccuagaguuugaaaggcc

SEQ ID NO: 763892 - RNA, 22 nt, Human
gggaaaggagcaccuuuuaugu

SEQ ID NO: 763893 - RNA, 20 nt, Human
ggugacuuggaacuacuugu

SEQ ID NO: 763894 - RNA, 23 nt, Human
guuccaaaaaaguuguucagaaa

SEQ ID NO: 763895 - RNA, 24 nt, Human
uaaaaaacaaacaaacaaaacccu

SEQ ID NO: 763896 - RNA, 19 nt, Human
uaaaagaagggggaaagga

SEQ ID NO: 763897 - RNA, 19 nt, Human
uagguuucuaaaacgaaca

SEQ ID NO: 763898 - RNA, 21 nt, Human
uaugcaaaaaaggaauaaguu

SEQ ID NO: 763899 - RNA, 23 nt, Human
ucagaacaauaaaagaauaugca

SEQ ID NO: 763900 - RNA, 18 nt, Human
uccaaggaaaguaugagg

SEQ ID NO: 763901 - RNA, 19 nt, Human
ucccaaacuucauuucuaa

SEQ ID NO: 763902 - RNA, 22 nt, Human
ucguacgugcagccccgacccc

SEQ ID NO: 763903 - RNA, 20 nt, Human
ucuaaaacgaacauccucuc

SEQ ID NO: 763904 - RNA, 19 nt, Human
ucucggaagacaaauacaa

SEQ ID NO: 763905 - RNA, 22 nt, Human
ucuuaaaaugcuuuuucaaacu

SEQ ID NO: 763906 - RNA, 23 nt, Human
ucuuuagguuucuaaaacgaaca

SEQ ID NO: 763907 - RNA, 20 nt, Human
ugaagugagcaaugacuccc

SEQ ID NO: 763908 - RNA, 22 nt, Human
ugacuaaggaccaguuuaacaa

SEQ ID NO: 763909 - RNA, 22 nt, Human
ugagaacgcagugcuuggucag

SEQ ID NO: 763910 - RNA, 22 nt, Human
ugaugucuuuagguuucuaaaa

SEQ ID NO: 763911 - RNA, 22 nt, Human
ugcaaaaagguuauuucugauu

SEQ ID NO: 763912 - RNA, 22 nt, Human
uggaaaucauuugcuuuaaaaa

SEQ ID NO: 763913 - RNA, 20 nt, Human
ugucuaaauuguccaugucu

SEQ ID NO: 763914 - RNA, 23 nt, Human
uguucagaaacuuuucuauucac

SEQ ID NO: 763915 - RNA, 24 nt, Human
uguuguuguuuuucuuuuuuaaug

SEQ ID NO: 763916 - RNA, 20 nt, Human
uucaaguaauuuuccaauac

SEQ ID NO: 763917 - RNA, 23 nt, Human
uucgcucugaacccgggcguccc

SEQ ID NO: 763918 - RNA, 24 nt, Human
uugaagcaaagaugacaaaaaaga

SEQ ID NO: 763919 - RNA, 21 nt, Human
uuguuguuguuuuucuuuuuu

SEQ ID NO: 763920 - RNA, 25 nt, Human
uuuaaaaaacaaacaaacaaaaccc

SEQ ID NO: 763921 - RNA, 22 nt, Human
uuuacacucauucagaacuuca

SEQ ID NO: 763922 - RNA, 22 nt, Human
uuuccaaaauuuuuucccaaac

SEQ ID NO: 763923 - RNA, 22 nt, Human
uuugcuugucuuuuuuccaaaa

SEQ ID NO: 763924 - RNA, 23 nt, Human
uuuuucuuuuuuaauguuaaccu

SEQ ID NO: 763925 - RNA, 19 nt, Human
uuuuuuccaaaauuuuuuc

SEQ ID NO: 763926 - RNA, 19 nt, Human
uuuuuuuucuguuguuuug

SEQ ID NO: 763927 - RNA, 25 nt, Human
aaaacaaacaauaauacaaaaaagu

SEQ ID NO: 763928 - RNA, 20 nt, Human
aagaggccagaaaaagccgu

SEQ ID NO: 763929 - RNA, 25 nt, Human
aagaggccagaaaaagcuucagaca

SEQ ID NO: 763930 - RNA, 20 nt, Human
aagcaauuccaaucaccuca

SEQ ID NO: 763931 - RNA, 21 nt, Human
aauugcacuuguucuggagga

SEQ ID NO: 763932 - RNA, 24 nt, Human
acaaaacaaacaauaauacaaaaa

SEQ ID NO: 763933 - RNA, 19 nt, Human
acaaauuuacaaggucaga

SEQ ID NO: 763934 - RNA, 19 nt, Human
accagcugcugcuguuucc

SEQ ID NO: 763935 - RNA, 20 nt, Human
accuagugugcgaaacgacc

SEQ ID NO: 763936 - RNA, 20 nt, Human
accuagugugcgaaacgacc

SEQ ID NO: 763937 - RNA, 23 nt, Human
accugauugugauacaacagaaa

SEQ ID NO: 763938 - RNA, 19 nt, Human
agcauggucaaagcaauuc

SEQ ID NO: 763939 - RNA, 19 nt, Human
agccuugcucuccaauccu

SEQ ID NO: 763940 - RNA, 23 nt, Human
aggcagcauggucaaagcaauuc

SEQ ID NO: 763941 - RNA, 18 nt, Human
auacaccuaacaugcuaa

SEQ ID NO: 763942 - RNA, 24 nt, Human
caaacaauaauacaaaaaaguuuu

SEQ ID NO: 763943 - RNA, 22 nt, Human
caagguagaaugcagagcugcc

SEQ ID NO: 763944 - RNA, 23 nt, Human
cacauaaagaaaggaggugaauu

SEQ ID NO: 763945 - RNA, 18 nt, Human
caccgccuccagcccgga

SEQ ID NO: 763946 - RNA, 19 nt, Human
cauacacucuugcccagga

SEQ ID NO: 763947 - RNA, 23 nt, Human
caugagccacauguucuucaaga

SEQ ID NO: 763948 - RNA, 19 nt, Human
ccagaaaaagcuucagaca

SEQ ID NO: 763949 - RNA, 23 nt, Human
cgacuagagaaaagaggccagaa

SEQ ID NO: 763950 - RNA, 19 nt, Human
cgagcagagagcgucgggc

SEQ ID NO: 763951 - RNA, 22 nt, Human
cgccuccagcccggauccgcuu

SEQ ID NO: 763952 - RNA, 18 nt, Human
cgccucggacccuucggc

SEQ ID NO: 763953 - RNA, 20 nt, Human
cuggaacuagaauuguccuc

SEQ ID NO: 763954 - RNA, 19 nt, Human
cugggcccugggcgcugcg

SEQ ID NO: 763955 - RNA, 19 nt, Human
cuuaugagaacuacucuaa

SEQ ID NO: 763956 - RNA, 20 nt, Human
gaggagaaguuaauucuuca

SEQ ID NO: 763957 - RNA, 21 nt, Human
gcaagcgccucggacccuucg

SEQ ID NO: 763958 - RNA, 18 nt, Human
gccucggacccuucggcu

SEQ ID NO: 763959 - RNA, 22 nt, Human
gcugcugccuguaugccaccua

SEQ ID NO: 763960 - RNA, 20 nt, Human
ggcacuggaggcugggcgcu

SEQ ID NO: 763961 - RNA, 19 nt, Human
gggcacuggaggcugggcg

SEQ ID NO: 763962 - RNA, 22 nt, Human
gggcacuggaggcugggcgcug

SEQ ID NO: 763963 - RNA, 23 nt, Human
gggcacuggaggcugggcgcugg

SEQ ID NO: 763964 - RNA, 23 nt, Human
gugauacaacagaaaguacagaa

SEQ ID NO: 763965 - RNA, 21 nt, Human
guuuuggaacaggguuaagac

SEQ ID NO: 763966 - RNA, 20 nt, Human
uaaaaaaagcuuuauuagug

SEQ ID NO: 763967 - RNA, 21 nt, Human
uaaaaacuuaaaaacuaugug

SEQ ID NO: 763968 - RNA, 24 nt, Human
uaaaccacuuagaccucagcacuu

SEQ ID NO: 763969 - RNA, 26 nt, Human
uaaucaauauucauacaccgugacac

SEQ ID NO: 763970 - RNA, 18 nt, Human
uacaaagagcuuuaaaac

SEQ ID NO: 763971 - RNA, 23 nt, Human
uacaaagagcuuuaaaacacaau

SEQ ID NO: 763972 - RNA, 20 nt, Human
uacaacagaaaguacagaac

SEQ ID NO: 763973 - RNA, 23 nt, Human
uacaacagaaaguacagaacagu

SEQ ID NO: 763974 - RNA, 24 nt, Human
uaccugauugugauacaacagaaa

SEQ ID NO: 763975 - RNA, 18 nt, Human
uaugccaccuagugugcg

SEQ ID NO: 763976 - RNA, 20 nt, Human
ucagacaauuccagucaagc

SEQ ID NO: 763977 - RNA, 21 nt, Human
ucaggaagggcuucaaaauua

SEQ ID NO: 763978 - RNA, 22 nt, Human
ucccuuugcaaaaacagaaaaa

SEQ ID NO: 763979 - RNA, 18 nt, Human
ugaacacaaaacaaacaa

SEQ ID NO: 763980 - RNA, 28 nt, Human
ugacaccgccuccagcccggauccgcuu

SEQ ID NO: 763981 - RNA, 22 nt, Human
ugauacaacagaaaguacagaa

SEQ ID NO: 763982 - RNA, 18 nt, Human
ugccuucugaauugcacu

SEQ ID NO: 763983 - RNA, 20 nt, Human
uggaauuuuauggagaauac

SEQ ID NO: 763984 - RNA, 24 nt, Human
uggagccauuuuccuucucuucag

SEQ ID NO: 763985 - RNA, 19 nt, Human
uggaggcugggcgcugggc

SEQ ID NO: 763986 - RNA, 21 nt, Human
uguauuuacugccacauacuu

SEQ ID NO: 763987 - RNA, 19 nt, Human
ugucagggaguccucuaca

SEQ ID NO: 763988 - RNA, 19 nt, Human
uguccucuucaucuaacuc

SEQ ID NO: 763989 - RNA, 22 nt, Human
uguggccaucuaucagcacgag

SEQ ID NO: 763990 - RNA, 20 nt, Human
uguuuggagccauuuuccuu

SEQ ID NO: 763991 - RNA, 22 nt, Human
uucuggaggagaaguuaauucu

SEQ ID NO: 763992 - RNA, 21 nt, Human
uugauucccgauccucuucac

SEQ ID NO: 763993 - RNA, 22 nt, Human
uugcgcaagcgccucggacccu

SEQ ID NO: 763994 - RNA, 22 nt, Human
uuguaugcauacacucuugccc

SEQ ID NO: 763995 - RNA, 21 nt, Human
uuuauaagaucucccccauaa

SEQ ID NO: 763996 - RNA, 20 nt, Human
uuuauuugacaauaaaacug

SEQ ID NO: 763997 - RNA, 19 nt, Human
uuuuccuucucuucagccu

SEQ ID NO: 763998 - RNA, 24 nt, Human
aaaaauagaaaucucucuggaaaa

SEQ ID NO: 763999 - RNA, 22 nt, Human
aacugcguggcacugcugcugg

SEQ ID NO: 764000 - RNA, 18 nt, Human
aacuuuaccaaggaaaga

SEQ ID NO: 764001 - RNA, 22 nt, Human
aacuuuaccaaggaaagaucua

SEQ ID NO: 764002 - RNA, 22 nt, Human
aagacaccccugaauccaggga

SEQ ID NO: 764003 - RNA, 19 nt, Human
aagcaugcggugugcauac

SEQ ID NO: 764004 - RNA, 24 nt, Human
aaggacccugcaaagguugagggc

SEQ ID NO: 764005 - RNA, 24 nt, Human
aaggcucaaagguaggaaggaccc

SEQ ID NO: 764006 - RNA, 19 nt, Human
aaguucagguaagucagca

SEQ ID NO: 764007 - RNA, 19 nt, Human
aaguuggcggccacacugc

SEQ ID NO: 764008 - RNA, 23 nt, Human
acaaagucaggaggaaaaaaaac

SEQ ID NO: 764009 - RNA, 20 nt, Human
accaggaccaagaauguucc

SEQ ID NO: 764010 - RNA, 19 nt, Human
accccgguucaagggcagg

SEQ ID NO: 764011 - RNA, 20 nt, Human
acccugcauuucaccaauca

SEQ ID NO: 764012 - RNA, 19 nt, Human
agaggucgugcccgggggc

SEQ ID NO: 764013 - RNA, 24 nt, Human
agauugaagaguacaagauagcac

SEQ ID NO: 764014 - RNA, 21 nt, Human
agcugauuucgacucaaguuc

SEQ ID NO: 764015 - RNA, 22 nt, Human
aggaaaagucaaacuuuaccaa

SEQ ID NO: 764016 - RNA, 25 nt, Human
aggaggggaggagggugugggcagg

SEQ ID NO: 764017 - RNA, 21 nt, Human
aggcaggcaggcagggcggac

SEQ ID NO: 764018 - RNA, 21 nt, Human
aggcaggcagggcggacagcu

SEQ ID NO: 764019 - RNA, 20 nt, Human
aggcagggcggacagcugau

SEQ ID NO: 764020 - RNA, 26 nt, Human
aggcggccguggcagcucggcgggcg

SEQ ID NO: 764021 - RNA, 18 nt, Human
agugaaaaucaaaggcua

SEQ ID NO: 764022 - RNA, 27 nt, Human
auagcaccaaaaguaauucaguacauc

SEQ ID NO: 764023 - RNA, 22 nt, Human
aucauaacccaagcaccaggac

SEQ ID NO: 764024 - RNA, 22 nt, Human
aucuccccaagcuaagaaacaa

SEQ ID NO: 764025 - RNA, 22 nt, Human
aucuucuucuugacuccugcca

SEQ ID NO: 764026 - RNA, 19 nt, Human
auggcucagggugcucauu

SEQ ID NO: 764027 - RNA, 26 nt, Human
auuaagcaguaaaaaacugguguuua

SEQ ID NO: 764028 - RNA, 19 nt, Human
auucuuuuuuuuccuuuua

SEQ ID NO: 764029 - RNA, 23 nt, Human
caaaauguuaguuuucuguccuc

SEQ ID NO: 764030 - RNA, 19 nt, Human
caaagacaccccugaaucc

SEQ ID NO: 764031 - RNA, 23 nt, Human
caagguggccccuauacagcuca

SEQ ID NO: 764032 - RNA, 19 nt, Human
caaucaacacaaagucagg

SEQ ID NO: 764033 - RNA, 22 nt, Human
cagaccccgguucaagggcagg

SEQ ID NO: 764034 - RNA, 19 nt, Human
cagcaacgacacuuccuuc

SEQ ID NO: 764035 - RNA, 20 nt, Human
cagcgcccuucgcggcuccg

SEQ ID NO: 764036 - RNA, 20 nt, Human
caggcagggcggacagcuga

SEQ ID NO: 764037 - RNA, 21 nt, Human
cagugugaguacguguacacg

SEQ ID NO: 764038 - RNA, 22 nt, Human
cauaacccaagcaccaggacca

SEQ ID NO: 764039 - RNA, 24 nt, Human
caucuucucccgggcccccccacc

SEQ ID NO: 764040 - RNA, 20 nt, Human
cauguaaaauaaggaggcuu

SEQ ID NO: 764041 - RNA, 19 nt, Human
ccaaaggaaagacuuccau

SEQ ID NO: 764042 - RNA, 23 nt, Human
ccaagcaccaggaccaagaaugu

SEQ ID NO: 764043 - RNA, 20 nt, Human
ccacacaggcaggcaggcag

SEQ ID NO: 764044 - RNA, 26 nt, Human
ccaccacccgccccgccgggggcgcc

SEQ ID NO: 764045 - RNA, 26 nt, Human
ccaccgccgccaccacccgccccgcc

SEQ ID NO: 764046 - RNA, 18 nt, Human
ccagaccccgguucaagg

SEQ ID NO: 764047 - RNA, 23 nt, Human
cccccaccccgccccgccgcucc

SEQ ID NO: 764048 - RNA, 24 nt, Human
ccccccggaguuggccgccuccuc

SEQ ID NO: 764049 - RNA, 25 nt, Human
ccccgcugccaccgccgccaccacc

SEQ ID NO: 764050 - RNA, 22 nt, Human
ccccuauacagcucaauugccc

SEQ ID NO: 764051 - RNA, 27 nt, Human
ccccuauacagcucaauugcccagucc

SEQ ID NO: 764052 - RNA, 18 nt, Human
cccgccccgccgcuccug

SEQ ID NO: 764053 - RNA, 20 nt, Human
cccgggcccccccaccccgc

SEQ ID NO: 764054 - RNA, 18 nt, Human
ccgccccgccgcuccugc

SEQ ID NO: 764055 - RNA, 23 nt, Human
ccgccgccaccacccgccccgcc

SEQ ID NO: 764056 - RNA, 22 nt, Human
ccgccgggggcgccgguuccuc

SEQ ID NO: 764057 - RNA, 25 nt, Human
ccgcugccaccgccgccaccacccg

SEQ ID NO: 764058 - RNA, 24 nt, Human
ccucaagcgcgcgcuccagacccc

SEQ ID NO: 764059 - RNA, 18 nt, Human
ccuggaauucuccucccc

SEQ ID NO: 764060 - RNA, 20 nt, Human
ccuggaauucuccuccccuc

SEQ ID NO: 764061 - RNA, 18 nt, Human
ccuugaccuuggaacaag

SEQ ID NO: 764062 - RNA, 24 nt, Human
cgcuccugcgggggggucacagcg

SEQ ID NO: 764063 - RNA, 20 nt, Human
cgcugugaucucguugcagc

SEQ ID NO: 764064 - RNA, 22 nt, Human
cucccgggcccccccaccccgc

SEQ ID NO: 764065 - RNA, 21 nt, Human
cuccuccacgugaggcucuaa

SEQ ID NO: 764066 - RNA, 21 nt, Human
cuccugcgggggggucacagc

SEQ ID NO: 764067 - RNA, 18 nt, Human
cuggcuaagauaaaauuc

SEQ ID NO: 764068 - RNA, 22 nt, Human
cuucccggcgucgccaucuucu

SEQ ID NO: 764069 - RNA, 18 nt, Human
cuugacacucuuguccug

SEQ ID NO: 764070 - RNA, 23 nt, Human
gaaaagucaaacuuuaccaagga

SEQ ID NO: 764071 - RNA, 19 nt, Human
gaaauuccuucaauuuccu

SEQ ID NO: 764072 - RNA, 20 nt, Human
gaggggaggagggugugggc

SEQ ID NO: 764073 - RNA, 21 nt, Human
gauuucaacugaccuaucugc

SEQ ID NO: 764074 - RNA, 23 nt, Human
gcaacgacacuuccuucccuuga

SEQ ID NO: 764075 - RNA, 19 nt, Human
gcaagguggccccuauaca

SEQ ID NO: 764076 - RNA, 18 nt, Human
gccacacugcccagcgcc

SEQ ID NO: 764077 - RNA, 20 nt, Human
gcccccccaccccgccccgc

SEQ ID NO: 764078 - RNA, 22 nt, Human
gcccuucgcggcucccuuuuua

SEQ ID NO: 764079 - RNA, 19 nt, Human
gccgggguggaaguuggcg

SEQ ID NO: 764080 - RNA, 18 nt, Human
gcgcgcgcuccagacccc

SEQ ID NO: 764081 - RNA, 23 nt, Human
ggaaguuugcaaggcaaaggcuc

SEQ ID NO: 764082 - RNA, 24 nt, Human
ggaccaagaauguuccacggcuca

SEQ ID NO: 764083 - RNA, 19 nt, Human
ggaggcggccguggcagcu

SEQ ID NO: 764084 - RNA, 22 nt, Human
ggaggcggccguggcagcucgg

SEQ ID NO: 764085 - RNA, 20 nt, Human
ggcagcagcucaccgggagg

SEQ ID NO: 764086 - RNA, 22 nt, Human
ggcagcagcucaccgggaggga

SEQ ID NO: 764087 - RNA, 20 nt, Human
ggccacacugcccagcgccc

SEQ ID NO: 764088 - RNA, 23 nt, Human
ggcgacagagcacagcguuugga

SEQ ID NO: 764089 - RNA, 19 nt, Human
ggcucauggcuuuauuuga

SEQ ID NO: 764090 - RNA, 24 nt, Human
gggaggcggccguggcagcucggu

SEQ ID NO: 764091 - RNA, 23 nt, Human
gggauggaaguuugcaaggcaaa

SEQ ID NO: 764092 - RNA, 18 nt, Human
gggcccccccaccccgcc

SEQ ID NO: 764093 - RNA, 18 nt, Human
gguaggaaggacccugca

SEQ ID NO: 764094 - RNA, 21 nt, Human
ggugguggggaugaugaagug

SEQ ID NO: 764095 - RNA, 21 nt, Human
gugaaaaucaaaggcuaaaug

SEQ ID NO: 764096 - RNA, 21 nt, Human
guggugguggggaugaugaag

SEQ ID NO: 764097 - RNA, 21 nt, Human
guggugguggugguggggaug

SEQ ID NO: 764098 - RNA, 21 nt, Human
guguuacagauugaagaguac

SEQ ID NO: 764099 - RNA, 20 nt, Human
uaaaugaacauuucaaauaa

SEQ ID NO: 764100 - RNA, 19 nt, Human
uacccugcauuucaccaau

SEQ ID NO: 764101 - RNA, 18 nt, Human
uacuaaacuguauucuac

SEQ ID NO: 764102 - RNA, 18 nt, Human
uagccaucuaugagagcu

SEQ ID NO: 764103 - RNA, 22 nt, Human
uaggacagaggggcuugccggg

SEQ ID NO: 764104 - RNA, 25 nt, Human
uauacuaaacuguauucuacaaagu

SEQ ID NO: 764105 - RNA, 19 nt, Human
ucaccaaucaacacaaagu

SEQ ID NO: 764106 - RNA, 21 nt, Human
ucacccaaaauguguuuauua

SEQ ID NO: 764107 - RNA, 19 nt, Human
ucaccgggagggagaggag

SEQ ID NO: 764108 - RNA, 22 nt, Human
ucaggaggaaaaaaaacucaca

SEQ ID NO: 764109 - RNA, 19 nt, Human
uccacggcucauggcuuua

SEQ ID NO: 764110 - RNA, 27 nt, Human
uccaucaucuccccaagcuaagaaaca

SEQ ID NO: 764111 - RNA, 20 nt, Human
uccauuaacuguuugagcug

SEQ ID NO: 764112 - RNA, 19 nt, Human
uccccuggauucaugaaaa

SEQ ID NO: 764113 - RNA, 18 nt, Human
ucccgggcccccccaccc

SEQ ID NO: 764114 - RNA, 19 nt, Human
ucccugcaagguggccccu

SEQ ID NO: 764115 - RNA, 22 nt, Human
uccgagaggucgugcccggggg

SEQ ID NO: 764116 - RNA, 21 nt, Human
uccucaagcgcgcgcuccaga

SEQ ID NO: 764117 - RNA, 23 nt, Human
ucuccccaagcuaagaaacaaga

SEQ ID NO: 764118 - RNA, 20 nt, Human
ucugaucugacuuagcagca

SEQ ID NO: 764119 - RNA, 18 nt, Human
ucugcagauuaacgaugg

SEQ ID NO: 764120 - RNA, 19 nt, Human
ucuucugguaaugauccaa

SEQ ID NO: 764121 - RNA, 18 nt, Human
ugagcgcccuucugcaua

SEQ ID NO: 764122 - RNA, 20 nt, Human
ugccaccgccgccaccaccc

SEQ ID NO: 764123 - RNA, 20 nt, Human
ugccgcagugcuccaccgaa

SEQ ID NO: 764124 - RNA, 24 nt, Human
ugccuugaccuuggaacaaggccc

SEQ ID NO: 764125 - RNA, 22 nt, Human
ugcgauuaagacuuugagaggc

SEQ ID NO: 764126 - RNA, 21 nt, Human
ugcuaaaucccuguccuugac

SEQ ID NO: 764127 - RNA, 18 nt, Human
ugcugauggugguggugg

SEQ ID NO: 764128 - RNA, 23 nt, Human
uggaauucuccuccccucugccc

SEQ ID NO: 764129 - RNA, 21 nt, Human
uggaugaggaagcaugcggug

SEQ ID NO: 764130 - RNA, 23 nt, Human
ugggaggaauccaaucgaauggu

SEQ ID NO: 764131 - RNA, 18 nt, Human
uggggggcgggcggggag

SEQ ID NO: 764132 - RNA, 19 nt, Human
uggugguggugguggggau

SEQ ID NO: 764133 - RNA, 20 nt, Human
uggugguggugguggugguc

SEQ ID NO: 764134 - RNA, 24 nt, Human
uguaaaauaaggaggcugccuuga

SEQ ID NO: 764135 - RNA, 19 nt, Human
uguaaagaaugcuuccugu

SEQ ID NO: 764136 - RNA, 20 nt, Human
uguaaagaaugcuuccuguu

SEQ ID NO: 764137 - RNA, 19 nt, Human
uguauagaucaaguugggc

SEQ ID NO: 764138 - RNA, 24 nt, Human
uguauagaucaaguugggccaaaa

SEQ ID NO: 764139 - RNA, 22 nt, Human
uguccuggaauucuccuccccc

SEQ ID NO: 764140 - RNA, 22 nt, Human
uuaagcaguaaaaaacuggugu

SEQ ID NO: 764141 - RNA, 26 nt, Human
uucaauacugacccaaaggaaagacu

SEQ ID NO: 764142 - RNA, 19 nt, Human
uuccagugauacaaaaugg

SEQ ID NO: 764143 - RNA, 18 nt, Human
uugggguucgcuucccgg

SEQ ID NO: 764144 - RNA, 25 nt, Human
uuuaagugacuccuccacgugaggc

SEQ ID NO: 764145 - RNA, 23 nt, Human
uuugcagucgucgucguuguauu

SEQ ID NO: 764146 - RNA, 24 nt, Human
aaagaaaaagccugugcuuccagc

SEQ ID NO: 764147 - RNA, 22 nt, Human
aaagcuucugcucccaacaugg

SEQ ID NO: 764148 - RNA, 19 nt, Human
aaaggguugggauuacagg

SEQ ID NO: 764149 - RNA, 26 nt, Human
aaguagccccaauaagauggcaggau

SEQ ID NO: 764150 - RNA, 19 nt, Human
acaaggacugacucuuuuc

SEQ ID NO: 764151 - RNA, 25 nt, Human
acagacacugacaaaaguagcccca

SEQ ID NO: 764152 - RNA, 24 nt, Human
acuauguugcccaggcuggucuug

SEQ ID NO: 764153 - RNA, 25 nt, Human
acuauguugcccaggcuggucuuga

SEQ ID NO: 764154 - RNA, 19 nt, Human
acuuugguuaagaaaugcu

SEQ ID NO: 764155 - RNA, 21 nt, Human
agacagggucuuucucugucc

SEQ ID NO: 764156 - RNA, 24 nt, Human
aggguugggauuacaggccugagc

SEQ ID NO: 764157 - RNA, 24 nt, Human
auccucccgucuuuaccuuccaaa

SEQ ID NO: 764158 - RNA, 23 nt, Human
auggcacaaacacaucucauugc

SEQ ID NO: 764159 - RNA, 22 nt, Human
auguugcccaggcuggucuuga

SEQ ID NO: 764160 - RNA, 24 nt, Human
caaagccaaccauuuccgagacac

SEQ ID NO: 764161 - RNA, 27 nt, Human
caagugauccucccgucuuuaccuucc

SEQ ID NO: 764162 - RNA, 22 nt, Human
cacaguaagaaaagaaucuguc

SEQ ID NO: 764163 - RNA, 19 nt, Human
cacuauguugcccaggcug

SEQ ID NO: 764164 - RNA, 24 nt, Human
cacuauguugcccaggcuggucuu

SEQ ID NO: 764165 - RNA, 18 nt, Human
cagaugccgaugccaagg

SEQ ID NO: 764166 - RNA, 27 nt, Human
ccaaagccaaccauuuccgagacacag

SEQ ID NO: 764167 - RNA, 19 nt, Human
ccaaaggguugggauuaca

SEQ ID NO: 764168 - RNA, 22 nt, Human
ccaaaggguugggauuacaggc

SEQ ID NO: 764169 - RNA, 18 nt, Human
ccacugcacccaguccca

SEQ ID NO: 764170 - RNA, 18 nt, Human
cccaaagccaaccauuuc

SEQ ID NO: 764171 - RNA, 24 nt, Human
ccgucuuuaccuuccaaaggguug

SEQ ID NO: 764172 - RNA, 21 nt, Human
ccucaagugauccucccgucu

SEQ ID NO: 764173 - RNA, 19 nt, Human
ccucccgucuuuaccuucc

SEQ ID NO: 764174 - RNA, 22 nt, Human
ccucccgucuuuaccuuccaaa

SEQ ID NO: 764175 - RNA, 18 nt, Human
ccuggccucaagugaucc

SEQ ID NO: 764176 - RNA, 22 nt, Human
ccuggccucaagugauccuccc

SEQ ID NO: 764177 - RNA, 22 nt, Human
ccuggccucaagugauccuccc

SEQ ID NO: 764178 - RNA, 24 nt, Human
cucaagugauccucccgucuuuac

SEQ ID NO: 764179 - RNA, 20 nt, Human
gagacagggucuuucucugu

SEQ ID NO: 764180 - RNA, 18 nt, Human
gauuacaggccugagcca

SEQ ID NO: 764181 - RNA, 19 nt, Human
gauuacaggccugagccac

SEQ ID NO: 764182 - RNA, 23 nt, Human
gauuacaggccugagccacugca

SEQ ID NO: 764183 - RNA, 23 nt, Human
gcucgugcacgcgcacuaagagc

SEQ ID NO: 764184 - RNA, 23 nt, Human
gcuggucuugaacuccuggccuc

SEQ ID NO: 764185 - RNA, 20 nt, Human
ggagcaugauuuaguuuuuc

SEQ ID NO: 764186 - RNA, 24 nt, Human
ggcuggucuugaacuccuggccuc

SEQ ID NO: 764187 - RNA, 25 nt, Human
uaaauaucaaauucaaaucuucagu

SEQ ID NO: 764188 - RNA, 20 nt, Human
uaagaaaugcugaguacaac

SEQ ID NO: 764189 - RNA, 22 nt, Human
uaagaaaugcugaguacaacuu

SEQ ID NO: 764190 - RNA, 19 nt, Human
uaauucccaaacaaccaca

SEQ ID NO: 764191 - RNA, 24 nt, Human
uaauuuuuuuuauuuuuuguagag

SEQ ID NO: 764192 - RNA, 24 nt, Human
uacaggccugagccacugcaccca

SEQ ID NO: 764193 - RNA, 23 nt, Human
uauguugcccaggcuggucuuga

SEQ ID NO: 764194 - RNA, 24 nt, Human
uauguugcccaggcuggucuugaa

SEQ ID NO: 764195 - RNA, 20 nt, Human
uauugugccagacaagauau

SEQ ID NO: 764196 - RNA, 24 nt, Human
ucauugcggccuggaccuccuggc

SEQ ID NO: 764197 - RNA, 23 nt, Human
uccaaaggguugggauuacaggc

SEQ ID NO: 764198 - RNA, 22 nt, Human
ucccaaacaaccacaagaccuu

SEQ ID NO: 764199 - RNA, 18 nt, Human
ucccgucuuuaccuucca

SEQ ID NO: 764200 - RNA, 19 nt, Human
uccugaacugcccaaagcc

SEQ ID NO: 764201 - RNA, 19 nt, Human
ucucacuauguugcccagg

SEQ ID NO: 764202 - RNA, 23 nt, Human
ucucacuauguugcccaggcugg

SEQ ID NO: 764203 - RNA, 24 nt, Human
ucucacuauguugcccaggcuggu

SEQ ID NO: 764204 - RNA, 26 nt, Human
ucucacuauguugcccaggcuggucu

SEQ ID NO: 764205 - RNA, 27 nt, Human
ucucacuauguugcccaggcuggucuu

SEQ ID NO: 764206 - RNA, 30 nt, Human
ucucugucacccagacuggugugcaauggg

SEQ ID NO: 764207 - RNA, 24 nt, Human
ucugucacccagacuggugugcaa

SEQ ID NO: 764208 - RNA, 21 nt, Human
ucuugaacuccuggccucaag

SEQ ID NO: 764209 - RNA, 19 nt, Human
ucuuucucugucacccaga

SEQ ID NO: 764210 - RNA, 19 nt, Human
ugacucuuuucaaaauuca

SEQ ID NO: 764211 - RNA, 22 nt, Human
ugagacagggucuuucucuguc

SEQ ID NO: 764212 - RNA, 24 nt, Human
ugcauucucacuauguugcccagg

SEQ ID NO: 764213 - RNA, 19 nt, Human
ugccagacaagauauaaaa

SEQ ID NO: 764214 - RNA, 24 nt, Human
ugcccaggcuggucuugaacuccu

SEQ ID NO: 764215 - RNA, 26 nt, Human
uggcaggauuuggggguggugucuuu

SEQ ID NO: 764216 - RNA, 18 nt, Human
uggccucaagugauccuc

SEQ ID NO: 764217 - RNA, 20 nt, Human
uggccucaagugauccuccc

SEQ ID NO: 764218 - RNA, 24 nt, Human
uggccucaagugauccucccgucu

SEQ ID NO: 764219 - RNA, 19 nt, Human
ugggauuacaggccugagc

SEQ ID NO: 764220 - RNA, 21 nt, Human
ugggauuacaggccugagcca

SEQ ID NO: 764221 - RNA, 22 nt, Human
ugggauuacaggccugagccac

SEQ ID NO: 764222 - RNA, 22 nt, Human
ugggauuacaggccugagccac

SEQ ID NO: 764223 - RNA, 24 nt, Human
ugggauuacaggccugagccacug

SEQ ID NO: 764224 - RNA, 26 nt, Human
ugggauuacaggccugagccacugca

SEQ ID NO: 764225 - RNA, 19 nt, Human
ugucaugacauccugcuga

SEQ ID NO: 764226 - RNA, 25 nt, Human
uucaguguucuacuuauuuugggug

SEQ ID NO: 764227 - RNA, 24 nt, Human
uucucacuauguugcccaggcugg

SEQ ID NO: 764228 - RNA, 20 nt, Human
uuggggguggugucuuuccu

SEQ ID NO: 764229 - RNA, 24 nt, Human
uuguagagaugcauucucacuaug

SEQ ID NO: 764230 - RNA, 22 nt, Human
uuucucugucacccagacuggu

SEQ ID NO: 764231 - RNA, 24 nt, Human
uuuguagagaugcauucucacuau

SEQ ID NO: 764232 - RNA, 19 nt, Human
aaacaccucuuuuucagaa

SEQ ID NO: 764233 - RNA, 19 nt, Human
aaacggacaaagguaaauc

SEQ ID NO: 764234 - RNA, 20 nt, Human
aacauaauaaaaucucuucu

SEQ ID NO: 764235 - RNA, 20 nt, Human
aaccaaacaccucuuuuuca

SEQ ID NO: 764236 - RNA, 19 nt, Human
aaccaaagccagauccagc

SEQ ID NO: 764237 - RNA, 18 nt, Human
aacccgccaaccugcacg

SEQ ID NO: 764238 - RNA, 22 nt, Human
aaggacacaaaggaagggagga

SEQ ID NO: 764239 - RNA, 19 nt, Human
aauuccaggggaggaggau

SEQ ID NO: 764240 - RNA, 21 nt, Human
acaccgacaccucggggacac

SEQ ID NO: 764241 - RNA, 19 nt, Human
acagcuaacaaaacgugau

SEQ ID NO: 764242 - RNA, 18 nt, Human
agaaaauuugcagacuac

SEQ ID NO: 764243 - RNA, 20 nt, Human
agaacagagagcguuaaaag

SEQ ID NO: 764244 - RNA, 24 nt, Human
agaauaaggacacaaaggaaggga

SEQ ID NO: 764245 - RNA, 21 nt, Human
agagucaacacauaaaaaagu

SEQ ID NO: 764246 - RNA, 23 nt, Human
agccacucucccugcucccuagg

SEQ ID NO: 764247 - RNA, 18 nt, Human
agcucagcaaaccgacag

SEQ ID NO: 764248 - RNA, 22 nt, Human
aggaagggaggaaaauguucuu

SEQ ID NO: 764249 - RNA, 20 nt, Human
aggcaguuccaagaguaaca

SEQ ID NO: 764250 - RNA, 21 nt, Human
agggccuggcugcccucgcgu

SEQ ID NO: 764251 - RNA, 22 nt, Human
auaaaacuguggaaacugugcu

SEQ ID NO: 764252 - RNA, 23 nt, Human
auccaauugggugaugagaaggg

SEQ ID NO: 764253 - RNA, 21 nt, Human
augauucaagccgccacugug

SEQ ID NO: 764254 - RNA, 25 nt, Human
caaagguaaaucacagcuaacaaaa

SEQ ID NO: 764255 - RNA, 20 nt, Human
cacaagcucucccuccuggc

SEQ ID NO: 764256 - RNA, 21 nt, Human
cacacauaaaacuguggaaac

SEQ ID NO: 764257 - RNA, 19 nt, Human
cacaccgacaccucgggga

SEQ ID NO: 764258 - RNA, 18 nt, Human
cacacguaaccaaacacc

SEQ ID NO: 764259 - RNA, 19 nt, Human
cacagcuaacaaaacguga

SEQ ID NO: 764260 - RNA, 26 nt, Human
caccacaccgacaccucggggacacc

SEQ ID NO: 764261 - RNA, 19 nt, Human
cacgguguuauucugccac

SEQ ID NO: 764262 - RNA, 22 nt, Human
cacguaaccaaacaccucuuuu

SEQ ID NO: 764263 - RNA, 26 nt, Human
cagaauggcuccgugaagucuuuuaa

SEQ ID NO: 764264 - RNA, 20 nt, Human
cagcgcaguggcccccugga

SEQ ID NO: 764265 - RNA, 21 nt, Human
cauuucuugaugauucaagcc

SEQ ID NO: 764266 - RNA, 23 nt, Human
ccacaaagucucaguaccugaga

SEQ ID NO: 764267 - RNA, 23 nt, Human
ccacaccgacaccucggggacac

SEQ ID NO: 764268 - RNA, 24 nt, Human
ccacuguggcagggaaugccgccu

SEQ ID NO: 764269 - RNA, 19 nt, Human
cccacaaagucucaguacc

SEQ ID NO: 764270 - RNA, 19 nt, Human
cccagaucagccugggugg

SEQ ID NO: 764271 - RNA, 19 nt, Human
cccgaggcccagaucagcc

SEQ ID NO: 764272 - RNA, 19 nt, Human
cccucaccacaccgacacc

SEQ ID NO: 764273 - RNA, 27 nt, Human
ccgacagccagaacagugauacggagc

SEQ ID NO: 764274 - RNA, 19 nt, Human
cgacagccagaacagugau

SEQ ID NO: 764275 - RNA, 23 nt, Human
cgacguacugagcaggaugcugc

SEQ ID NO: 764276 - RNA, 21 nt, Human
cggcaacagcgcaguggcccc

SEQ ID NO: 764277 - RNA, 19 nt, Human
cguaaccaaacaccucuuu

SEQ ID NO: 764278 - RNA, 24 nt, Human
cguaaccaaacaccucuuuuucag

SEQ ID NO: 764279 - RNA, 21 nt, Human
cucacacguaaccaaacaccu

SEQ ID NO: 764280 - RNA, 22 nt, Human
cucacacguaaccaaacaccuc

SEQ ID NO: 764281 - RNA, 25 nt, Human
cucgacaauuucuucuuccuggggc

SEQ ID NO: 764282 - RNA, 25 nt, Human
cuggaggccugcuauggggagcugg

SEQ ID NO: 764283 - RNA, 22 nt, Human
cuucuguauagaaaagcuacag

SEQ ID NO: 764284 - RNA, 24 nt, Human
gagccacucucccugcucccuagg

SEQ ID NO: 764285 - RNA, 18 nt, Human
gagcccgagccacucucc

SEQ ID NO: 764286 - RNA, 23 nt, Human
gagguacucucaucccgccccca

SEQ ID NO: 764287 - RNA, 19 nt, Human
gcccacaaagucucaguac

SEQ ID NO: 764288 - RNA, 21 nt, Human
gcucacacguaaccaaacacc

SEQ ID NO: 764289 - RNA, 23 nt, Human
ggucauucccuuuuuaacucaaa

SEQ ID NO: 764290 - RNA, 19 nt, Human
guaaaucacagcuaacaaa

SEQ ID NO: 764291 - RNA, 20 nt, Human
guggcagggaaugccgccug

SEQ ID NO: 764292 - RNA, 21 nt, Human
uaaaaagggaauccccggaac

SEQ ID NO: 764293 - RNA, 20 nt, Human
uaacucaaaugacuguaucc

SEQ ID NO: 764294 - RNA, 25 nt, Human
uacuaaagccccauuuauccauuuc

SEQ ID NO: 764295 - RNA, 20 nt, Human
uagaaaagcuacagcuccac

SEQ ID NO: 764296 - RNA, 20 nt, Human
uagaaaagcuacagcuccac

SEQ ID NO: 764297 - RNA, 18 nt, Human
uaucccaacuuucuuccu

SEQ ID NO: 764298 - RNA, 19 nt, Human
uaucccaacuuucuuccug

SEQ ID NO: 764299 - RNA, 18 nt, Human
uauuuauuuauuuauuuu

SEQ ID NO: 764300 - RNA, 23 nt, Human
ucacagccuuucacaagcucucc

SEQ ID NO: 764301 - RNA, 21 nt, Human
ucagacauuuggccuccugac

SEQ ID NO: 764302 - RNA, 22 nt, Human
ucauugauauuaaaaccaaagc

SEQ ID NO: 764303 - RNA, 25 nt, Human
ucauuuccauuuucuccuguaggga

SEQ ID NO: 764304 - RNA, 20 nt, Human
uccaggggaggaggauuaga

SEQ ID NO: 764305 - RNA, 19 nt, Human
uccccggaacauaauaaaa

SEQ ID NO: 764306 - RNA, 20 nt, Human
ucccgaggcccagaucagcc

SEQ ID NO: 764307 - RNA, 19 nt, Human
uccgcuggguucccgaggc

SEQ ID NO: 764308 - RNA, 22 nt, Human
uccgcuggguucccgaggccca

SEQ ID NO: 764309 - RNA, 24 nt, Human
uccugacugcuauauucuuguccu

SEQ ID NO: 764310 - RNA, 23 nt, Human
ucuacauuggaaagagccggggc

SEQ ID NO: 764311 - RNA, 18 nt, Human
ucucuccuccucauuucc

SEQ ID NO: 764312 - RNA, 18 nt, Human
ucugaggcccacaaaguc

SEQ ID NO: 764313 - RNA, 21 nt, Human
ucugccuuaaagaauggaauc

SEQ ID NO: 764314 - RNA, 18 nt, Human
ugccuuaaagaauggaau

SEQ ID NO: 764315 - RNA, 18 nt, Human
uggaaucaucagugacca

SEQ ID NO: 764316 - RNA, 22 nt, Human
uggcagggaaugccgccuggcc

SEQ ID NO: 764317 - RNA, 19 nt, Human
uguacuucaacgccagcgg

SEQ ID NO: 764318 - RNA, 18 nt, Human
uuccuggugucugaggcc

SEQ ID NO: 764319 - RNA, 19 nt, Human
uuccuggugucugaggccc

SEQ ID NO: 764320 - RNA, 23 nt, Human
uucuuguccuaauaacauucauu

SEQ ID NO: 764321 - RNA, 22 nt, Human
uugaggcugaaauuccauuaau

SEQ ID NO: 764322 - RNA, 18 nt, Human
uugggugaugagaagggc

SEQ ID NO: 764323 - RNA, 20 nt, Human
uuuaaacggacaaagguaaa

SEQ ID NO: 764324 - RNA, 19 nt, Human
uuuuccauaaccccuucua

SEQ ID NO: 764325 - RNA, 18 nt, Human
uuuuucuagcccgucuua

SEQ ID NO: 764326 - RNA, 23 nt, Human
aaaaugcagccaagcuuuugcug

SEQ ID NO: 764327 - RNA, 25 nt, Human
aaacacguacacaagccaggccccc

SEQ ID NO: 764328 - RNA, 26 nt, Human
aaacacguacacaagccaggcccccc

SEQ ID NO: 764329 - RNA, 24 nt, Human
aaagagacacgacgcagaugcuga

SEQ ID NO: 764330 - RNA, 19 nt, Human
aaagcacaaagagacacga

SEQ ID NO: 764331 - RNA, 19 nt, Human
aacaacaccugccaccaac

SEQ ID NO: 764332 - RNA, 18 nt, Human
aaccaaauuccuuccugg

SEQ ID NO: 764333 - RNA, 19 nt, Human
aacccacagaccaaauaag

SEQ ID NO: 764334 - RNA, 18 nt, Human
aagcaagugugaugcugc

SEQ ID NO: 764335 - RNA, 20 nt, Human
aagcagggauggcuugggaa

SEQ ID NO: 764336 - RNA, 23 nt, Human
aagcagggauggcuugggacagc

SEQ ID NO: 764337 - RNA, 22 nt, Human
aaggaugucccuggagcccucc

SEQ ID NO: 764338 - RNA, 25 nt, Human
acaaacaaaagcacaaagagacacg

SEQ ID NO: 764339 - RNA, 31 nt, Human
acaaacaaaagcacaaagagacacgacgcag

SEQ ID NO: 764340 - RNA, 22 nt, Human
acacaagcaagagaugggcacu

SEQ ID NO: 764341 - RNA, 21 nt, Human
acacugcagcguuccaggacc

SEQ ID NO: 764342 - RNA, 26 nt, Human
acacugcagcguuccaggaccacaga

SEQ ID NO: 764343 - RNA, 18 nt, Human
acaggcugggcuggggac

SEQ ID NO: 764344 - RNA, 18 nt, Human
accagaugcaacacgccc

SEQ ID NO: 764345 - RNA, 20 nt, Human
acccagccguggucuguacc

SEQ ID NO: 764346 - RNA, 18 nt, Human
acgcccggcccagcccag

SEQ ID NO: 764347 - RNA, 20 nt, Human
acugcaccuguggcucacca

SEQ ID NO: 764348 - RNA, 18 nt, Human
acugggagagaacaggcu

SEQ ID NO: 764349 - RNA, 19 nt, Human
acugugcgcuucccccagg

SEQ ID NO: 764350 - RNA, 19 nt, Human
agaacagccaggcaggcug

SEQ ID NO: 764351 - RNA, 23 nt, Human
agacaccaggccugggcugugca

SEQ ID NO: 764352 - RNA, 18 nt, Human
agacagugacggggaccu

SEQ ID NO: 764353 - RNA, 18 nt, Human
agagaacaggcugggcug

SEQ ID NO: 764354 - RNA, 22 nt, Human
agagaugggcacuggacacugu

SEQ ID NO: 764355 - RNA, 19 nt, Human
agaugcaacacgccccacc

SEQ ID NO: 764356 - RNA, 20 nt, Human
agaugcaacacgccccacca

SEQ ID NO: 764357 - RNA, 18 nt, Human
agcaagggcuaaucucac

SEQ ID NO: 764358 - RNA, 19 nt, Human
agccacgggagagcaaacg

SEQ ID NO: 764359 - RNA, 19 nt, Human
agcccccacagcuccgccc

SEQ ID NO: 764360 - RNA, 21 nt, Human
agcccccacagcuccgcccag

SEQ ID NO: 764361 - RNA, 23 nt, Human
agcuggugccucugcugaggucu

SEQ ID NO: 764362 - RNA, 21 nt, Human
aggcccugccagcagccccca

SEQ ID NO: 764363 - RNA, 21 nt, Human
aggccucugcagcugcuggcu

SEQ ID NO: 764364 - RNA, 24 nt, Human
aggcugcacgccucucuggcauca

SEQ ID NO: 764365 - RNA, 18 nt, Human
agggcagcucuggagggc

SEQ ID NO: 764366 - RNA, 20 nt, Human
agggcagcucuggagggcag

SEQ ID NO: 764367 - RNA, 20 nt, Human
agugggagcagcugccacaa

SEQ ID NO: 764368 - RNA, 18 nt, Human
aguuggcacagcguaggc

SEQ ID NO: 764369 - RNA, 21 nt, Human
auagaaucucauucagaucuu

SEQ ID NO: 764370 - RNA, 22 nt, Human
auagaaucucauucagaucuug

SEQ ID NO: 764371 - RNA, 22 nt, Human
augacccaggcucagcuuaggu

SEQ ID NO: 764372 - RNA, 20 nt, Human
augacuaggccccgcccaca

SEQ ID NO: 764373 - RNA, 20 nt, Human
augacuaggccccgcccaca

SEQ ID NO: 764374 - RNA, 18 nt, Human
auggaacaaaaccacacu

SEQ ID NO: 764375 - RNA, 24 nt, Human
auggagcuugggagugcagaggcc

SEQ ID NO: 764376 - RNA, 20 nt, Human
auggcuaggccccacccaca

SEQ ID NO: 764377 - RNA, 20 nt, Human
auggcuaggccccauccaca

SEQ ID NO: 764378 - RNA, 20 nt, Human
auggcuaggcccuguccaca

SEQ ID NO: 764379 - RNA, 26 nt, Human
caaaaaugcagccaagcuuuugcugu

SEQ ID NO: 764380 - RNA, 23 nt, Human
caaaagcacaaagagacacgacg

SEQ ID NO: 764381 - RNA, 23 nt, Human
caaacgcugcuuccaaaaccaaa

SEQ ID NO: 764382 - RNA, 25 nt, Human
cacaaacaaaagcacaaagagacac

SEQ ID NO: 764383 - RNA, 23 nt, Human
cacacugcaaaacaacuuuuuau

SEQ ID NO: 764384 - RNA, 20 nt, Human
cacagcucaccccucccaug

SEQ ID NO: 764385 - RNA, 18 nt, Human
cacagcuccgcccagccc

SEQ ID NO: 764386 - RNA, 28 nt, Human
caccccacccauagcuagccccauucac

SEQ ID NO: 764387 - RNA, 23 nt, Human
cacccugcuguucucagaagcaa

SEQ ID NO: 764388 - RNA, 21 nt, Human
cacgagccuaugcugucccuu

SEQ ID NO: 764389 - RNA, 20 nt, Human
cacgccucucuggcaucacg

SEQ ID NO: 764390 - RNA, 24 nt, Human
cagacaaacgagcaaagggaguuc

SEQ ID NO: 764391 - RNA, 19 nt, Human
cagacgucauuucuguugc

SEQ ID NO: 764392 - RNA, 21 nt, Human
cagaggccgcacacauggggu

SEQ ID NO: 764393 - RNA, 21 nt, Human
cagaugcaacacgccccacca

SEQ ID NO: 764394 - RNA, 21 nt, Human
cagcagacagaccacagccag

SEQ ID NO: 764395 - RNA, 20 nt, Human
cagccaccugcacggggcca

SEQ ID NO: 764396 - RNA, 18 nt, Human
cagcccacuccaccagcu

SEQ ID NO: 764397 - RNA, 18 nt, Human
cagccccacucacagcuc

SEQ ID NO: 764398 - RNA, 24 nt, Human
cagcgccccagggaguggacccgg

SEQ ID NO: 764399 - RNA, 24 nt, Human
cagcgcugccaucacggcguggag

SEQ ID NO: 764400 - RNA, 18 nt, Human
cagcggguccacuccuuc

SEQ ID NO: 764401 - RNA, 23 nt, Human
cagcucaccccucccauggcucc

SEQ ID NO: 764402 - RNA, 21 nt, Human
cagcugucuggugggugaugu

SEQ ID NO: 764403 - RNA, 18 nt, Human
caggagacaaaaauagac

SEQ ID NO: 764404 - RNA, 18 nt, Human
caggcccuugggagcuug

SEQ ID NO: 764405 - RNA, 18 nt, Human
caggguggggcggguccu

SEQ ID NO: 764406 - RNA, 23 nt, Human
ccaaagcucuaggccacugguuc

SEQ ID NO: 764407 - RNA, 18 nt, Human
ccaacaccgggcccuggg

SEQ ID NO: 764408 - RNA, 20 nt, Human
ccacacugcagcguuccagg

SEQ ID NO: 764409 - RNA, 21 nt, Human
ccagaaccccuggcccccagg

SEQ ID NO: 764410 - RNA, 31 nt, Human
ccagcagcccccacagcuccgcccagcccaa

SEQ ID NO: 764411 - RNA, 22 nt, Human
ccaggccugggcugugcagggg

SEQ ID NO: 764412 - RNA, 18 nt, Human
ccagggguuaagccuguc

SEQ ID NO: 764413 - RNA, 18 nt, Human
cccagcccagcccagccc

SEQ ID NO: 764414 - RNA, 18 nt, Human
cccagcccagcccagccc

SEQ ID NO: 764415 - RNA, 25 nt, Human
cccagccccucccugcacucucucc

SEQ ID NO: 764416 - RNA, 21 nt, Human
ccccacacaggcuaaggcucc

SEQ ID NO: 764417 - RNA, 19 nt, Human
ccccacccacagcucgccc

SEQ ID NO: 764418 - RNA, 20 nt, Human
ccccauccacagcucacccc

SEQ ID NO: 764419 - RNA, 22 nt, Human
ccccauccacagcucaccccuc

SEQ ID NO: 764420 - RNA, 22 nt, Human
cccccacagcuccgcccagccc

SEQ ID NO: 764421 - RNA, 23 nt, Human
cccccaggaacucccuccuaggc

SEQ ID NO: 764422 - RNA, 22 nt, Human
ccccgcccacagcucaccccuc

SEQ ID NO: 764423 - RNA, 22 nt, Human
ccccgcccacagcucaccccuc

SEQ ID NO: 764424 - RNA, 23 nt, Human
ccccgcugacucgcuuccaccca

SEQ ID NO: 764425 - RNA, 23 nt, Human
ccccggcaggaguccccacaggg

SEQ ID NO: 764426 - RNA, 21 nt, Human
ccccucccauggcuccauggg

SEQ ID NO: 764427 - RNA, 24 nt, Human
cccgcagggccagaaccccuggcc

SEQ ID NO: 764428 - RNA, 18 nt, Human
cccgccaccagcuuggga

SEQ ID NO: 764429 - RNA, 20 nt, Human
cccuccucuccuccucuucc

SEQ ID NO: 764430 - RNA, 23 nt, Human
cccuggguuggaguuuagcccug

SEQ ID NO: 764431 - RNA, 21 nt, Human
cccugugccaggaaagccucc

SEQ ID NO: 764432 - RNA, 22 nt, Human
ccuacaaaggccuccuaagagc

SEQ ID NO: 764433 - RNA, 19 nt, Human
ccuccggguacugcaccug

SEQ ID NO: 764434 - RNA, 24 nt, Human
ccuccucucucccuuucacaagcc

SEQ ID NO: 764435 - RNA, 21 nt, Human
ccucuccuaagccaucuugac

SEQ ID NO: 764436 - RNA, 23 nt, Human
ccugccaccaacgucgacccuga

SEQ ID NO: 764437 - RNA, 22 nt, Human
ccuggcuucugagccuggggcc

SEQ ID NO: 764438 - RNA, 18 nt, Human
ccugggaagggcagcucu

SEQ ID NO: 764439 - RNA, 26 nt, Human
ccuguaacccaaagcucuaggccacu

SEQ ID NO: 764440 - RNA, 27 nt, Human
ccuguccccguggacggaagccuuggg

SEQ ID NO: 764441 - RNA, 21 nt, Human
ccuuaucccuuccaaaagauc

SEQ ID NO: 764442 - RNA, 28 nt, Human
ccuuccacaaacaaaagcacaaagagac

SEQ ID NO: 764443 - RNA, 19 nt, Human
cgcccagcccacuccacca

SEQ ID NO: 764444 - RNA, 21 nt, Human
cgcccagcccacuccaccagc

SEQ ID NO: 764445 - RNA, 22 nt, Human
cgccucucuggcaucacagucc

SEQ ID NO: 764446 - RNA, 18 nt, Human
cggcgcuggcuucgugcc

SEQ ID NO: 764447 - RNA, 19 nt, Human
cggguccugcacuuugggu

SEQ ID NO: 764448 - RNA, 23 nt, Human
cuaaauacaaaaugccaaagacc

SEQ ID NO: 764449 - RNA, 18 nt, Human
cucacucucuacuucguc

SEQ ID NO: 764450 - RNA, 18 nt, Human
cucccauggcucagcccc

SEQ ID NO: 764451 - RNA, 18 nt, Human
cuccgcccagcccacucc

SEQ ID NO: 764452 - RNA, 24 nt, Human
cuccuccucuuucuccccauccug

SEQ ID NO: 764453 - RNA, 24 nt, Human
cucuaggccacugguucccaagag

SEQ ID NO: 764454 - RNA, 24 nt, Human
cugaagcuuugagcuggcaagcag

SEQ ID NO: 764455 - RNA, 18 nt, Human
cugagcuagguugggcua

SEQ ID NO: 764456 - RNA, 24 nt, Human
cuuggaacggcgagccugccuccu

SEQ ID NO: 764457 - RNA, 27 nt, Human
gaaaacacguacacaagccaggccccc

SEQ ID NO: 764458 - RNA, 25 nt, Human
gaacagacaucacccugcuguucuc

SEQ ID NO: 764459 - RNA, 21 nt, Human
gcaaacgcugcuuccaaaacc

SEQ ID NO: 764460 - RNA, 23 nt, Human
gcagacaccaggccugggcugug

SEQ ID NO: 764461 - RNA, 23 nt, Human
gcagggccagaaccccuggcccc

SEQ ID NO: 764462 - RNA, 28 nt, Human
gccaugcugcagaaaaggcgcccagggg

SEQ ID NO: 764463 - RNA, 20 nt, Human
gcccagcccacuccaccagc

SEQ ID NO: 764464 - RNA, 20 nt, Human
gccccaggcacacccaccuc

SEQ ID NO: 764465 - RNA, 18 nt, Human
gcccugcuuggcucugcc

SEQ ID NO: 764466 - RNA, 22 nt, Human
gccuccuccucuuucuccccau

SEQ ID NO: 764467 - RNA, 21 nt, Human
gccucucuggcaucacagucc

SEQ ID NO: 764468 - RNA, 19 nt, Human
gccugaggcaggaaagccc

SEQ ID NO: 764469 - RNA, 23 nt, Human
gccuggggccuccuccucuuucu

SEQ ID NO: 764470 - RNA, 19 nt, Human
gcgaccagcgucguuuggc

SEQ ID NO: 764471 - RNA, 23 nt, Human
gcucaccagccaccugcacgggg

SEQ ID NO: 764472 - RNA, 18 nt, Human
gcugaggucugugagcag

SEQ ID NO: 764473 - RNA, 18 nt, Human
gcuguaaggcuccacuga

SEQ ID NO: 764474 - RNA, 22 nt, Human
gcuugagaaugcauugccauuu

SEQ ID NO: 764475 - RNA, 21 nt, Human
gcuuugcugcuguucuugaag

SEQ ID NO: 764476 - RNA, 24 nt, Human
ggaccugaagcuuugagcuggcag

SEQ ID NO: 764477 - RNA, 24 nt, Human
ggacggaagccuugggagaagcug

SEQ ID NO: 764478 - RNA, 18 nt, Human
ggagacaggggccaggcu

SEQ ID NO: 764479 - RNA, 21 nt, Human
ggagcuugggagugcagaggc

SEQ ID NO: 764480 - RNA, 19 nt, Human
ggauagcaagggugacggg

SEQ ID NO: 764481 - RNA, 20 nt, Human
ggcaggagucccuuucuugg

SEQ ID NO: 764482 - RNA, 19 nt, Human
ggcccuggggccgugggca

SEQ ID NO: 764483 - RNA, 18 nt, Human
ggcggguggggugaaggc

SEQ ID NO: 764484 - RNA, 19 nt, Human
ggcuguaaggcuccacuga

SEQ ID NO: 764485 - RNA, 20 nt, Human
gggaagggcagcucuggagg

SEQ ID NO: 764486 - RNA, 19 nt, Human
ggggaggaguuggggacag

SEQ ID NO: 764487 - RNA, 22 nt, Human
ggguaguuggcacagcguaggc

SEQ ID NO: 764488 - RNA, 22 nt, Human
ggguggggcggguccugcacuu

SEQ ID NO: 764489 - RNA, 21 nt, Human
ggugauguggagguguugcag

SEQ ID NO: 764490 - RNA, 20 nt, Human
ggugccucugcugaggucug

SEQ ID NO: 764491 - RNA, 18 nt, Human
guauggaacauuggccuc

SEQ ID NO: 764492 - RNA, 19 nt, Human
gucccuggcuucugagccu

SEQ ID NO: 764493 - RNA, 21 nt, Human
gugaacaacaccugccaccaa

SEQ ID NO: 764494 - RNA, 20 nt, Human
gugacuaggccccgcccaca

SEQ ID NO: 764495 - RNA, 18 nt, Human
gugccucugcugaggucu

SEQ ID NO: 764496 - RNA, 18 nt, Human
gugcuuucugcagguuuu

SEQ ID NO: 764497 - RNA, 18 nt, Human
guggucuucucuggcccu

SEQ ID NO: 764498 - RNA, 22 nt, Human
guggucuugguggucuucucug

SEQ ID NO: 764499 - RNA, 18 nt, Human
guuccaggaccacagaac

SEQ ID NO: 764500 - RNA, 22 nt, Human
uaaaaggccaauaaugagaaua

SEQ ID NO: 764501 - RNA, 21 nt, Human
uaaauacaaaaugccaaagac

SEQ ID NO: 764502 - RNA, 24 nt, Human
uacacaguccaucaaguuaccagc

SEQ ID NO: 764503 - RNA, 21 nt, Human
uagacauucagcagacagacc

SEQ ID NO: 764504 - RNA, 21 nt, Human
uagcccugcuuggcucugccc

SEQ ID NO: 764505 - RNA, 21 nt, Human
uaggcccugccagcagccccc

SEQ ID NO: 764506 - RNA, 20 nt, Human
ucaccccucccaugacuagg

SEQ ID NO: 764507 - RNA, 22 nt, Human
ucaccccucccaugacuaggcc

SEQ ID NO: 764508 - RNA, 28 nt, Human
ucaccccucccauggcuccaugggccaa

SEQ ID NO: 764509 - RNA, 24 nt, Human
ucacggcguggagacagugacggg

SEQ ID NO: 764510 - RNA, 20 nt, Human
ucacuucugccucuuuucug

SEQ ID NO: 764511 - RNA, 21 nt, Human
ucagcagacagaccacagcca

SEQ ID NO: 764512 - RNA, 23 nt, Human
ucagccccacucacagcucaccc

SEQ ID NO: 764513 - RNA, 22 nt, Human
ucagccucagcagugucagcuc

SEQ ID NO: 764514 - RNA, 21 nt, Human
ucagcugaagacacuggcuug

SEQ ID NO: 764515 - RNA, 19 nt, Human
ucagucaggucacucaccc

SEQ ID NO: 764516 - RNA, 19 nt, Human
uccacaaacaaaagcacaa

SEQ ID NO: 764517 - RNA, 21 nt, Human
uccacugaaauccccccggcg

SEQ ID NO: 764518 - RNA, 23 nt, Human
uccaggaccacagaacagccagg

SEQ ID NO: 764519 - RNA, 24 nt, Human
ucccuggagcccuccagcuggugc

SEQ ID NO: 764520 - RNA, 19 nt, Human
ucccuggcuucugagccug

SEQ ID NO: 764521 - RNA, 20 nt, Human
ucccuggcuucugagccugg

SEQ ID NO: 764522 - RNA, 21 nt, Human
ucccuggcuucugagccuggg

SEQ ID NO: 764523 - RNA, 22 nt, Human
uccuaggcccugccagcagccc

SEQ ID NO: 764524 - RNA, 22 nt, Human
ucuaaauacaaaaugccaaaga

SEQ ID NO: 764525 - RNA, 21 nt, Human
ucuccuuccacaaacaaaagc

SEQ ID NO: 764526 - RNA, 18 nt, Human
ucucuggcccuuccaccu

SEQ ID NO: 764527 - RNA, 24 nt, Human
ucugccucuuuucugcugguuucu

SEQ ID NO: 764528 - RNA, 21 nt, Human
ucugucccuggcuucugagcc

SEQ ID NO: 764529 - RNA, 22 nt, Human
ugaagacacuggcuugagaaug

SEQ ID NO: 764530 - RNA, 26 nt, Human
ugagaaugcauugccauugucguaga

SEQ ID NO: 764531 - RNA, 18 nt, Human
ugagccuggggccuccuc

SEQ ID NO: 764532 - RNA, 19 nt, Human
ugaugugaaccaagggaca

SEQ ID NO: 764533 - RNA, 18 nt, Human
ugcagacaccaggccugg

SEQ ID NO: 764534 - RNA, 21 nt, Human
ugcagacaccaggccugggcu

SEQ ID NO: 764535 - RNA, 23 nt, Human
ugcagagccuccucucucccuuu

SEQ ID NO: 764536 - RNA, 22 nt, Human
ugcagccaagcuuuugcugugc

SEQ ID NO: 764537 - RNA, 23 nt, Human
ugcgggaacgguggucuuggugg

SEQ ID NO: 764538 - RNA, 20 nt, Human
ugcugcucccauggcucagc

SEQ ID NO: 764539 - RNA, 19 nt, Human
uggaacaaaaccacacugc

SEQ ID NO: 764540 - RNA, 22 nt, Human
uggaacaaaaccacacugcagc

SEQ ID NO: 764541 - RNA, 21 nt, Human
uggcaagcagggauggcuugg

SEQ ID NO: 764542 - RNA, 24 nt, Human
uggcacugccuggauucaguuugg

SEQ ID NO: 764543 - RNA, 18 nt, Human
uggcaucacaguccgcac

SEQ ID NO: 764544 - RNA, 22 nt, Human
uggcuaggccccacccacagcu

SEQ ID NO: 764545 - RNA, 22 nt, Human
uggcuaggccccauccacagcu

SEQ ID NO: 764546 - RNA, 18 nt, Human
uggcucaccagccaccug

SEQ ID NO: 764547 - RNA, 24 nt, Human
uggcuccacaggcuccgcacgccc

SEQ ID NO: 764548 - RNA, 19 nt, Human
uggcucggacccauggcgg

SEQ ID NO: 764549 - RNA, 20 nt, Human
uggcucggacccauggcggg

SEQ ID NO: 764550 - RNA, 21 nt, Human
uggcuucugagccuggggccu

SEQ ID NO: 764551 - RNA, 24 nt, Human
uggcuucugagccuggggccuccu

SEQ ID NO: 764552 - RNA, 25 nt, Human
ugggaagggcagcucuggagggcag

SEQ ID NO: 764553 - RNA, 25 nt, Human
ugggaagggcagcucuggagggcag

SEQ ID NO: 764554 - RNA, 26 nt, Human
ugggaagggcagcucuggagggcagu

SEQ ID NO: 764555 - RNA, 19 nt, Human
ugggagaagcugucagcug

SEQ ID NO: 764556 - RNA, 22 nt, Human
ugggagagaacaggcugggcug

SEQ ID NO: 764557 - RNA, 25 nt, Human
uggggacaccuguguccuccuccca

SEQ ID NO: 764558 - RNA, 21 nt, Human
uggugccucugcugaggucug

SEQ ID NO: 764559 - RNA, 18 nt, Human
uguauggaacauuggccu

SEQ ID NO: 764560 - RNA, 21 nt, Human
ugugcaggugucucacuuucu

SEQ ID NO: 764561 - RNA, 19 nt, Human
uuacccagcgagcuucaag

SEQ ID NO: 764562 - RNA, 20 nt, Human
uuccaaaagaucggccuaua

SEQ ID NO: 764563 - RNA, 23 nt, Human
uucucagaagcaagugugaugcu

SEQ ID NO: 764564 - RNA, 21 nt, Human
uucuggccuguuuggucccag

SEQ ID NO: 764565 - RNA, 24 nt, Human
uucuggccuguuuggucccagccc

SEQ ID NO: 764566 - RNA, 22 nt, Human
uucuuggggacucacucucuac

SEQ ID NO: 764567 - RNA, 21 nt, Human
uuggggccaucggccuucuga

SEQ ID NO: 764568 - RNA, 20 nt, Human
uuuagcccugcuuggcucuu

SEQ ID NO: 764569 - RNA, 24 nt, Human
uuucuaaccauugggucucuccug

SEQ ID NO: 764570 - RNA, 19 nt, Human
uuucugcugguuucuggcc

SEQ ID NO: 764571 - RNA, 25 nt, Human
uuuucacacugcaaaacaacuuuuu

SEQ ID NO: 764572 - RNA, 21 nt, Human
aaaaaaaaaaacaacaacaac

SEQ ID NO: 764573 - RNA, 26 nt, Human
aaaaaaaacaacaacaacaaaugugg

SEQ ID NO: 764574 - RNA, 21 nt, Human
aaacagauaauauuuuuugca

SEQ ID NO: 764575 - RNA, 23 nt, Human
aaacaucaucaaaauggaaagaa

SEQ ID NO: 764576 - RNA, 19 nt, Human
aaagacagucccugccuuc

SEQ ID NO: 764577 - RNA, 24 nt, Human
aagagcucucugacuacacugaaa

SEQ ID NO: 764578 - RNA, 22 nt, Human
aagcuccaacugugaaccucac

SEQ ID NO: 764579 - RNA, 18 nt, Human
aauagcuccaagccaugg

SEQ ID NO: 764580 - RNA, 19 nt, Human
acacaccaaagcaagaaca

SEQ ID NO: 764581 - RNA, 20 nt, Human
acuagauuuuucuuauccug

SEQ ID NO: 764582 - RNA, 23 nt, Human
agaauccuuucauuuccaagccu

SEQ ID NO: 764583 - RNA, 18 nt, Human
agacauauagauaagugg

SEQ ID NO: 764584 - RNA, 23 nt, Human
agagcaccauucagcagguggaa

SEQ ID NO: 764585 - RNA, 21 nt, Human
agcagguggaaacagaucaaa

SEQ ID NO: 764586 - RNA, 23 nt, Human
agccaugguaaugauucauaacc

SEQ ID NO: 764587 - RNA, 19 nt, Human
agcuaguaauggaugaugu

SEQ ID NO: 764588 - RNA, 21 nt, Human
agcuccaacugugaaccucac

SEQ ID NO: 764589 - RNA, 22 nt, Human
aggaagaagguccagaauguuu

SEQ ID NO: 764590 - RNA, 25 nt, Human
aggaaggcuggggugagcuuggggu

SEQ ID NO: 764591 - RNA, 19 nt, Human
aggaaguuuguugcauuuc

SEQ ID NO: 764592 - RNA, 21 nt, Human
aggcuggggugagcuuggggu

SEQ ID NO: 764593 - RNA, 23 nt, Human
agggacacacacccuguuacuuc

SEQ ID NO: 764594 - RNA, 19 nt, Human
agugccuuuauuauuauua

SEQ ID NO: 764595 - RNA, 21 nt, Human
aguuuucgguuacugaaauug

SEQ ID NO: 764596 - RNA, 26 nt, Human
auagaaaagacagucccugccuucaa

SEQ ID NO: 764597 - RNA, 21 nt, Human
auagacauauagauaaguggu

SEQ ID NO: 764598 - RNA, 22 nt, Human
aucaaaauggaaagaacccaau

SEQ ID NO: 764599 - RNA, 19 nt, Human
aucaaauuuggaugaaauu

SEQ ID NO: 764600 - RNA, 20 nt, Human
aucaaggaauggagccacac

SEQ ID NO: 764601 - RNA, 23 nt, Human
aucucccccucuucugcaaaucc

SEQ ID NO: 764602 - RNA, 21 nt, Human
caaagcaagaacaggagaucc

SEQ ID NO: 764603 - RNA, 23 nt, Human
caagaauacccauuccuucagga

SEQ ID NO: 764604 - RNA, 23 nt, Human
caaggaauggagccacacaccaa

SEQ ID NO: 764605 - RNA, 21 nt, Human
cacacacccuguuacuucacc

SEQ ID NO: 764606 - RNA, 22 nt, Human
caccaaagcaagaacaggagau

SEQ ID NO: 764607 - RNA, 21 nt, Human
caccucuuuucuucuuauguu

SEQ ID NO: 764608 - RNA, 23 nt, Human
cagagcaccauucagcaggugga

SEQ ID NO: 764609 - RNA, 22 nt, Human
cagaugaaaacauucaucccuc

SEQ ID NO: 764610 - RNA, 19 nt, Human
cauccaauagcuccaagcc

SEQ ID NO: 764611 - RNA, 20 nt, Human
ccaagaccccaagcauccaa

SEQ ID NO: 764612 - RNA, 23 nt, Human
ccaagaccccaagcauccaauag

SEQ ID NO: 764613 - RNA, 21 nt, Human
ccacacaccaaagcaagaaca

SEQ ID NO: 764614 - RNA, 23 nt, Human
ccacacaccaaagcaagaacagg

SEQ ID NO: 764615 - RNA, 22 nt, Human
cccaccuuauuaucaaaaaaua

SEQ ID NO: 764616 - RNA, 18 nt, Human
ccccauugaaaacagagc

SEQ ID NO: 764617 - RNA, 23 nt, Human
ccccauugaaaacagagcaccaa

SEQ ID NO: 764618 - RNA, 21 nt, Human
ccuccaugauuucaucuccau

SEQ ID NO: 764619 - RNA, 21 nt, Human
ccuggccugaauaccuuggcc

SEQ ID NO: 764620 - RNA, 20 nt, Human
ccuguuacuucaccagcaau

SEQ ID NO: 764621 - RNA, 20 nt, Human
cgaaagaaaccuugcucuca

SEQ ID NO: 764622 - RNA, 22 nt, Human
cguaugucaccugcgggaacuc

SEQ ID NO: 764623 - RNA, 23 nt, Human
cuaguuucugucaauccuuuuuu

SEQ ID NO: 764624 - RNA, 23 nt, Human
cucaaaucuuuuagaaauuuauu

SEQ ID NO: 764625 - RNA, 25 nt, Human
gaaaugccuccaugauuucaucucc

SEQ ID NO: 764626 - RNA, 20 nt, Human
gaaggcuggggugagcuugg

SEQ ID NO: 764627 - RNA, 21 nt, Human
gaaggcuggggugagcuuggg

SEQ ID NO: 764628 - RNA, 20 nt, Human
gaauaggggagauagauagg

SEQ ID NO: 764629 - RNA, 21 nt, Human
gaauuuugauaacguuguaau

SEQ ID NO: 764630 - RNA, 20 nt, Human
gaccccaagcauccaauagc

SEQ ID NO: 764631 - RNA, 19 nt, Human
gaguggccaugauuuucaa

SEQ ID NO: 764632 - RNA, 19 nt, Human
gauuagagagauggauaga

SEQ ID NO: 764633 - RNA, 21 nt, Human
gcagagcaucugguaccacca

SEQ ID NO: 764634 - RNA, 21 nt, Human
gcauaccuuaaaauacuaaca

SEQ ID NO: 764635 - RNA, 22 nt, Human
gccacacaccaaagcaagaaca

SEQ ID NO: 764636 - RNA, 22 nt, Human
ggaaaaacgaagugaauuuuga

SEQ ID NO: 764637 - RNA, 24 nt, Human
ggcaagaaaagcuccaacugugaa

SEQ ID NO: 764638 - RNA, 25 nt, Human
gggcaagaaugaaacgucaguagcc

SEQ ID NO: 764639 - RNA, 20 nt, Human
guccguaugucaccugcggg

SEQ ID NO: 764640 - RNA, 26 nt, Human
gucuaagaacauuauggaaaagagaa

SEQ ID NO: 764641 - RNA, 19 nt, Human
guuauuuaacagagaagac

SEQ ID NO: 764642 - RNA, 18 nt, Human
guuuacagauagaauguc

SEQ ID NO: 764643 - RNA, 21 nt, Human
guuuccaugaagaucugcagu

SEQ ID NO: 764644 - RNA, 18 nt, Human
uaaccuaguagucucuuu

SEQ ID NO: 764645 - RNA, 24 nt, Human
uaaccucagcgucagacuugguau

SEQ ID NO: 764646 - RNA, 22 nt, Human
uaacuuguaaacagaaacagca

SEQ ID NO: 764647 - RNA, 23 nt, Human
uaauaugccccauugaaaacaga

SEQ ID NO: 764648 - RNA, 18 nt, Human
uaccaggucuagauguuu

SEQ ID NO: 764649 - RNA, 21 nt, Human
uacuguggacucagagcaaga

SEQ ID NO: 764650 - RNA, 19 nt, Human
uagaauauucuauagaauc

SEQ ID NO: 764651 - RNA, 23 nt, Human
uagaauguauacuuucugaaaac

SEQ ID NO: 764652 - RNA, 26 nt, Human
uagauagauagauagacauauagaua

SEQ ID NO: 764653 - RNA, 26 nt, Human
uagauagauagauagacauauagaua

SEQ ID NO: 764654 - RNA, 19 nt, Human
uagcacgucuauuaaacua

SEQ ID NO: 764655 - RNA, 19 nt, Human
uaucagacugaggaugacc

SEQ ID NO: 764656 - RNA, 24 nt, Human
uaucagacugaggaugaccccuuu

SEQ ID NO: 764657 - RNA, 24 nt, Human
uaucccaagaccccaagcauccaa

SEQ ID NO: 764658 - RNA, 22 nt, Human
uaugccccauugaaaacagagc

SEQ ID NO: 764659 - RNA, 18 nt, Human
uauguugcuauuucccuu

SEQ ID NO: 764660 - RNA, 21 nt, Human
uauguugcuauuucccuuagu

SEQ ID NO: 764661 - RNA, 19 nt, Human
uauuccccaccaugaaaca

SEQ ID NO: 764662 - RNA, 22 nt, Human
uauugagcaagcuuucaaaauc

SEQ ID NO: 764663 - RNA, 20 nt, Human
ucaaauacugaccuuacauc

SEQ ID NO: 764664 - RNA, 20 nt, Human
ucaagcaccaagagugugcu

SEQ ID NO: 764665 - RNA, 18 nt, Human
ucaaggaauggagccaca

SEQ ID NO: 764666 - RNA, 19 nt, Human
ucaccacagaugaaaacau

SEQ ID NO: 764667 - RNA, 22 nt, Human
ucaccuucuaucuaucccaaga

SEQ ID NO: 764668 - RNA, 20 nt, Human
ucauaguacaguauacagua

SEQ ID NO: 764669 - RNA, 22 nt, Human
ucccaagaccccaagcauccaa

SEQ ID NO: 764670 - RNA, 18 nt, Human
ucggcaaaauuugagcgg

SEQ ID NO: 764671 - RNA, 23 nt, Human
ucuauagaauccuuucauuucca

SEQ ID NO: 764672 - RNA, 19 nt, Human
ucugcaaauccagagcaag

SEQ ID NO: 764673 - RNA, 19 nt, Human
ucugguaccaccaggagau

SEQ ID NO: 764674 - RNA, 22 nt, Human
ucuguauaacuuauuccccacc

SEQ ID NO: 764675 - RNA, 19 nt, Human
ucugucaauccuuuuuucu

SEQ ID NO: 764676 - RNA, 20 nt, Human
ucugucaauccuuuuuucuu

SEQ ID NO: 764677 - RNA, 20 nt, Human
ucuuauguugcuauuucccu

SEQ ID NO: 764678 - RNA, 24 nt, Human
ucuucugcaaauccagagcaagag

SEQ ID NO: 764679 - RNA, 24 nt, Human
ugaaaaaagaucuaaaaaugugcu

SEQ ID NO: 764680 - RNA, 21 nt, Human
ugaaaacagagcaccaaagac

SEQ ID NO: 764681 - RNA, 26 nt, Human
ugaaacgucaguagcccuugauaaaa

SEQ ID NO: 764682 - RNA, 26 nt, Human
ugaaagaaacaaccuuauguaauaug

SEQ ID NO: 764683 - RNA, 19 nt, Human
ugacuuauagucaugccuu

SEQ ID NO: 764684 - RNA, 23 nt, Human
ugagaugcucucaaaucuuuuag

SEQ ID NO: 764685 - RNA, 18 nt, Human
ugagcuuggggucaaugg

SEQ ID NO: 764686 - RNA, 18 nt, Human
ugcacauaaaauuucacc

SEQ ID NO: 764687 - RNA, 24 nt, Human
ugccagaguauggugggagauggc

SEQ ID NO: 764688 - RNA, 21 nt, Human
ugcgggaacucauugcaacag

SEQ ID NO: 764689 - RNA, 27 nt, Human
ugcuagacuccuauugcuuuaaaaauu

SEQ ID NO: 764690 - RNA, 19 nt, Human
ugcuauuucccuuaguuuc

SEQ ID NO: 764691 - RNA, 26 nt, Human
ugcuauuucccuuaguuucuucuaaa

SEQ ID NO: 764692 - RNA, 23 nt, Human
uggaaaagagaagccaccucuuu

SEQ ID NO: 764693 - RNA, 23 nt, Human
ugguaaugauucauaaccucagc

SEQ ID NO: 764694 - RNA, 20 nt, Human
ugguaggaaaagauauugca

SEQ ID NO: 764695 - RNA, 20 nt, Human
ugguguagagucuuacuggu

SEQ ID NO: 764696 - RNA, 19 nt, Human
ugucaauccuuuuuucuuu

SEQ ID NO: 764697 - RNA, 20 nt, Human
ugucagagcaccauucagca

SEQ ID NO: 764698 - RNA, 18 nt, Human
ugugaugccacugcucuu

SEQ ID NO: 764699 - RNA, 26 nt, Human
uuaccaggucuagauguuuccguuac

SEQ ID NO: 764700 - RNA, 18 nt, Human
uucauaaggcauaaauaa

SEQ ID NO: 764701 - RNA, 21 nt, Human
uuccccaccaugaaacaucau

SEQ ID NO: 764702 - RNA, 19 nt, Human
uugaaaacagagcaccaaa

SEQ ID NO: 764703 - RNA, 22 nt, Human
uuuagacucagguacaagaaau

SEQ ID NO: 764704 - RNA, 21 nt, Human
uuuagccauugucucuacucu

SEQ ID NO: 764705 - RNA, 19 nt, Human
uuuauaccacuuaacaaaa

SEQ ID NO: 764706 - RNA, 20 nt, Human
uuuugcuuuucugcaaggcu

SEQ ID NO: 764707 - RNA, 21 nt, Human
aaaaacucacaaguaaaauaa

SEQ ID NO: 764708 - RNA, 20 nt, Human
aaaacuaauuaagguacuug

SEQ ID NO: 764709 - RNA, 22 nt, Human
aaaacuuaaauaaaagacacca

SEQ ID NO: 764710 - RNA, 22 nt, Human
aaaaggaaacaaaagaaauuca

SEQ ID NO: 764711 - RNA, 19 nt, Human
aaacaggguuucaaagaca

SEQ ID NO: 764712 - RNA, 24 nt, Human
aaaccuacugcugggugguuuuga

SEQ ID NO: 764713 - RNA, 19 nt, Human
aaagucacaaaaaccauau

SEQ ID NO: 764714 - RNA, 21 nt, Human
aaagucacaaaaaccauauga

SEQ ID NO: 764715 - RNA, 24 nt, Human
aaccauaugacaaaacaaauuaaa

SEQ ID NO: 764716 - RNA, 18 nt, Human
aagcaaccccaaaguggu

SEQ ID NO: 764717 - RNA, 25 nt, Human
aagcaaccccaaagugguaaaagau

SEQ ID NO: 764718 - RNA, 21 nt, Human
aagcugucuccagaccuucug

SEQ ID NO: 764719 - RNA, 20 nt, Human
aaggaaaaaaggaaacaaaa

SEQ ID NO: 764720 - RNA, 20 nt, Human
aaggaaacaaaagaaauuca

SEQ ID NO: 764721 - RNA, 25 nt, Human
acacaccaccgcacuggcugaaagu

SEQ ID NO: 764722 - RNA, 19 nt, Human
acaccaccgcacuggcuga

SEQ ID NO: 764723 - RNA, 18 nt, Human
acagaaacacacaacaca

SEQ ID NO: 764724 - RNA, 18 nt, Human
accagcuuuucuuaacuu

SEQ ID NO: 764725 - RNA, 18 nt, Human
agaaacacacaacacaag

SEQ ID NO: 764726 - RNA, 23 nt, Human
agaaacacacaacacaaggguua

SEQ ID NO: 764727 - RNA, 19 nt, Human
agacaacccucugggccag

SEQ ID NO: 764728 - RNA, 27 nt, Human
agacagaaacacacaacaaccccgggg

SEQ ID NO: 764729 - RNA, 19 nt, Human
agacagaaaccccaguaug

SEQ ID NO: 764730 - RNA, 21 nt, Human
agccaucaaccaccaccacuu

SEQ ID NO: 764731 - RNA, 20 nt, Human
agcucacugcaaaaugcuug

SEQ ID NO: 764732 - RNA, 23 nt, Human
aggccuugagaauuuuccuuucu

SEQ ID NO: 764733 - RNA, 23 nt, Human
agguaacccacaggccauacacc

SEQ ID NO: 764734 - RNA, 23 nt, Human
aucccacccuuuuccccucccca

SEQ ID NO: 764735 - RNA, 18 nt, Human
caaaggccuggucacagu

SEQ ID NO: 764736 - RNA, 19 nt, Human
caaaggccuggucacagug

SEQ ID NO: 764737 - RNA, 19 nt, Human
caaccaccaccacuuccug

SEQ ID NO: 764738 - RNA, 19 nt, Human
cacacaccaccgcacuggc

SEQ ID NO: 764739 - RNA, 26 nt, Human
cacacaccaccgcacuggcugaaagu

SEQ ID NO: 764740 - RNA, 18 nt, Human
cacaccaccgcacuggcu

SEQ ID NO: 764741 - RNA, 26 nt, Human
cacagguuugaagucaaccaaagcac

SEQ ID NO: 764742 - RNA, 19 nt, Human
caccgcacuggcugaaagu

SEQ ID NO: 764743 - RNA, 19 nt, Human
cagaaagaaugugaaagca

SEQ ID NO: 764744 - RNA, 21 nt, Human
cagagagaacaagugcuuuuc

SEQ ID NO: 764745 - RNA, 23 nt, Human
cagguuugaagucaaccaaagca

SEQ ID NO: 764746 - RNA, 24 nt, Human
cauauuuuuguauucuuucaaauu

SEQ ID NO: 764747 - RNA, 22 nt, Human
ccacagaugacaagagcucaaa

SEQ ID NO: 764748 - RNA, 21 nt, Human
cccacccuuuuccccucccca

SEQ ID NO: 764749 - RNA, 21 nt, Human
ccccauuuccccuuuuuuugu

SEQ ID NO: 764750 - RNA, 22 nt, Human
ccccauuuccccuuuuuuuguu

SEQ ID NO: 764751 - RNA, 20 nt, Human
cccuccccauuuccccuuuu

SEQ ID NO: 764752 - RNA, 21 nt, Human
cccuuuuccccuccccauuuc

SEQ ID NO: 764753 - RNA, 24 nt, Human
ccuaugguccagaaaaaauucacc

SEQ ID NO: 764754 - RNA, 24 nt, Human
cuauacauugcgaaagucaacccc

SEQ ID NO: 764755 - RNA, 24 nt, Human
cuccacacuugugcauacauuacu

SEQ ID NO: 764756 - RNA, 26 nt, Human
cuccccauuuccccuuuuuuuguuca

SEQ ID NO: 764757 - RNA, 18 nt, Human
cugcagaauugacaugug

SEQ ID NO: 764758 - RNA, 21 nt, Human
cugggccaggaaugaggaguc

SEQ ID NO: 764759 - RNA, 24 nt, Human
cuggucacaguggcucccgggagg

SEQ ID NO: 764760 - RNA, 18 nt, Human
cugucucuucuguuuccc

SEQ ID NO: 764761 - RNA, 18 nt, Human
gaaaagccaucaaccacc

SEQ ID NO: 764762 - RNA, 22 nt, Human
gaugaaaacuacccuuugcugc

SEQ ID NO: 764763 - RNA, 22 nt, Human
gccaucaaccaccaccacuucc

SEQ ID NO: 764764 - RNA, 18 nt, Human
gcgaaagucaaccccccc

SEQ ID NO: 764765 - RNA, 21 nt, Human
gcuacacacaccaccgcacug

SEQ ID NO: 764766 - RNA, 22 nt, Human
ggaaaaaaggaaacaaaagaaa

SEQ ID NO: 764767 - RNA, 20 nt, Human
ggaaguuuccagguccauga

SEQ ID NO: 764768 - RNA, 20 nt, Human
gggaagaaaagccccugcau

SEQ ID NO: 764769 - RNA, 27 nt, Human
uaaaaaaaaaauucaaaguucugauga

SEQ ID NO: 764770 - RNA, 25 nt, Human
uaaauaaaagacaccagaugaaaac

SEQ ID NO: 764771 - RNA, 18 nt, Human
uaaccaggacauggaagu

SEQ ID NO: 764772 - RNA, 19 nt, Human
uaacccacaggccauacac

SEQ ID NO: 764773 - RNA, 28 nt, Human
uaacuuaaaaaacuuaaauaaaagacac

SEQ ID NO: 764774 - RNA, 24 nt, Human
uacaaaugguuugauauaucagau

SEQ ID NO: 764775 - RNA, 20 nt, Human
uacaccaguaacuaagagga

SEQ ID NO: 764776 - RNA, 19 nt, Human
uacagacuuuuucacacag

SEQ ID NO: 764777 - RNA, 20 nt, Human
uaugucaccagcuuuucuua

SEQ ID NO: 764778 - RNA, 26 nt, Human
uauuuuuguauucuuucaaauuguuu

SEQ ID NO: 764779 - RNA, 19 nt, Human
ucaaagacaacccucuggg

SEQ ID NO: 764780 - RNA, 19 nt, Human
ucacagugcaggacugugg

SEQ ID NO: 764781 - RNA, 21 nt, Human
ucagacagaaacacacaacac

SEQ ID NO: 764782 - RNA, 20 nt, Human
ucagguaacccacaggccau

SEQ ID NO: 764783 - RNA, 19 nt, Human
ucccacccuuuuccccucc

SEQ ID NO: 764784 - RNA, 23 nt, Human
ucccacccuuuuccccuccccau

SEQ ID NO: 764785 - RNA, 19 nt, Human
ucugaagaaaaggaugugg

SEQ ID NO: 764786 - RNA, 20 nt, Human
ucuguagcaaauccagggcu

SEQ ID NO: 764787 - RNA, 26 nt, Human
ugaagucaaccaaagcacucaugcua

SEQ ID NO: 764788 - RNA, 20 nt, Human
ugaauuggguuucagcuacu

SEQ ID NO: 764789 - RNA, 18 nt, Human
ugagaggagagaccuggc

SEQ ID NO: 764790 - RNA, 19 nt, Human
ugagaggagagaccuggcu

SEQ ID NO: 764791 - RNA, 22 nt, Human
ugagaggagagaccuggcuucc

SEQ ID NO: 764792 - RNA, 19 nt, Human
ugagccagagagaacaagu

SEQ ID NO: 764793 - RNA, 22 nt, Human
ugaguugagcuugacugccuuc

SEQ ID NO: 764794 - RNA, 19 nt, Human
ugcaaaaggacacugucuc

SEQ ID NO: 764795 - RNA, 24 nt, Human
ugcauacauuacuuucuccaugca

SEQ ID NO: 764796 - RNA, 23 nt, Human
ugcauugacacacagguuugaag

SEQ ID NO: 764797 - RNA, 24 nt, Human
uggccacuuaacauggcagaacuu

SEQ ID NO: 764798 - RNA, 22 nt, Human
ugggaacacuagggagacagaa

SEQ ID NO: 764799 - RNA, 21 nt, Human
uggggaccagugguuggggcu

SEQ ID NO: 764800 - RNA, 19 nt, Human
uggggcuacacacaccacc

SEQ ID NO: 764801 - RNA, 24 nt, Human
uggucugaagaaaaggaugugggu

SEQ ID NO: 764802 - RNA, 21 nt, Human
uguuaacaaaaccuacugcug

SEQ ID NO: 764803 - RNA, 19 nt, Human
uucuagggaagaaaagccc

SEQ ID NO: 764804 - RNA, 22 nt, Human
uucugcuuagaauuggguuucu

SEQ ID NO: 764805 - RNA, 23 nt, Human
uuuaaaaagucccagauuaugga

SEQ ID NO: 764806 - RNA, 18 nt, Human
uuugcaugauucucucca

SEQ ID NO: 764807 - RNA, 19 nt, Human
uuuguucaaaccaugguaa

SEQ ID NO: 764808 - RNA, 21 nt, Human
uuuuaaaguuuuuuuguaggg

SEQ ID NO: 764809 - RNA, 18 nt, Human
uuuuuguucaaaccaugg

SEQ ID NO: 764810 - RNA, 29 nt, Human
aaaaaaacaaaaacaaaaacaaaccgagg

SEQ ID NO: 764811 - RNA, 27 nt, Human
aaaacaaaaacaaaaacaaaccgacga

SEQ ID NO: 764812 - RNA, 21 nt, Human
aaaagaaaaagaaaaaccaaa

SEQ ID NO: 764813 - RNA, 20 nt, Human
aaaagccuucacuacauccc

SEQ ID NO: 764814 - RNA, 21 nt, Human
aaacaaaccgacgaaccaaac

SEQ ID NO: 764815 - RNA, 23 nt, Human
aaacagaccacauccucugccag

SEQ ID NO: 764816 - RNA, 22 nt, Human
aaagaaauguacuuuuauagaa

SEQ ID NO: 764817 - RNA, 18 nt, Human
aaagcaccaguauaaaac

SEQ ID NO: 764818 - RNA, 31 nt, Human
aaagggggaaaaaaacaaaaacaaaaacaaa

SEQ ID NO: 764819 - RNA, 26 nt, Human
aaaugaggaggugcuggggaggcccc

SEQ ID NO: 764820 - RNA, 24 nt, Human
aacaaaccgacgaaccaaacaaaa

SEQ ID NO: 764821 - RNA, 20 nt, Human
aacauggugaaaucucaucu

SEQ ID NO: 764822 - RNA, 19 nt, Human
aacccagccaagacaaggc

SEQ ID NO: 764823 - RNA, 21 nt, Human
aaccgacgaaccaaacaaaaa

SEQ ID NO: 764824 - RNA, 24 nt, Human
aacuguccucagaagcucaaccca

SEQ ID NO: 764825 - RNA, 24 nt, Human
aagaggaagaugaaacagcagaga

SEQ ID NO: 764826 - RNA, 18 nt, Human
aagcacaaaauagagaau

SEQ ID NO: 764827 - RNA, 23 nt, Human
aagcaccaguauaaaacagagaa

SEQ ID NO: 764828 - RNA, 18 nt, Human
aagcacccauuuccuggc

SEQ ID NO: 764829 - RNA, 24 nt, Human
aagcagauacccccagauggcuua

SEQ ID NO: 764830 - RNA, 23 nt, Human
aaggaggaggggaggagaaaggg

SEQ ID NO: 764831 - RNA, 31 nt, Human
aagggaaaugaggaggugcuggggaggcccc

SEQ ID NO: 764832 - RNA, 18 nt, Human
aauugggggcugucagau

SEQ ID NO: 764833 - RNA, 20 nt, Human
aauuguuugagccuggaagg

SEQ ID NO: 764834 - RNA, 22 nt, Human
acaaaaacaaaccgacgaacca

SEQ ID NO: 764835 - RNA, 19 nt, Human
acaagagugaaacuccauc

SEQ ID NO: 764836 - RNA, 20 nt, Human
acaauaggguugugcagguu

SEQ ID NO: 764837 - RNA, 26 nt, Human
acgcacggccacacgcgcacccacgc

SEQ ID NO: 764838 - RNA, 18 nt, Human
acugcacuccauccuggg

SEQ ID NO: 764839 - RNA, 24 nt, Human
acugcgucacugcacuccauccug

SEQ ID NO: 764840 - RNA, 24 nt, Human
acuuugggagacugaggugggcag

SEQ ID NO: 764841 - RNA, 28 nt, Human
agaaaaagaaaaaccaaacacugaagaa

SEQ ID NO: 764842 - RNA, 18 nt, Human
agaaggaggaggaggagc

SEQ ID NO: 764843 - RNA, 21 nt, Human
agaauuguuugagccuggaag

SEQ ID NO: 764844 - RNA, 21 nt, Human
agacaggugacacaggagagc

SEQ ID NO: 764845 - RNA, 22 nt, Human
agaccagccuggccaacauggu

SEQ ID NO: 764846 - RNA, 25 nt, Human
agacuccuggugguuauuucuggaa

SEQ ID NO: 764847 - RNA, 21 nt, Human
agacugaggugggcagaucgc

SEQ ID NO: 764848 - RNA, 20 nt, Human
agagagcagagcuuacccug

SEQ ID NO: 764849 - RNA, 22 nt, Human
agaggaagaugaaacagcagag

SEQ ID NO: 764850 - RNA, 21 nt, Human
agaggaggagaaggaggagga

SEQ ID NO: 764851 - RNA, 19 nt, Human
agcacccauuuccuggcag

SEQ ID NO: 764852 - RNA, 24 nt, Human
agcacuuugggagacugagguggg

SEQ ID NO: 764853 - RNA, 23 nt, Human
agccgggugugauggcaggcauc

SEQ ID NO: 764854 - RNA, 21 nt, Human
agccuggccaacauggugaaa

SEQ ID NO: 764855 - RNA, 19 nt, Human
aggaggagaaggaggagga

SEQ ID NO: 764856 - RNA, 20 nt, Human
aggaggaggagcagcgaucg

SEQ ID NO: 764857 - RNA, 19 nt, Human
aggaggggaggagaaaggg

SEQ ID NO: 764858 - RNA, 22 nt, Human
aggcaggagaauuguuugagcc

SEQ ID NO: 764859 - RNA, 23 nt, Human
aggcaggagaauuguuugagccu

SEQ ID NO: 764860 - RNA, 24 nt, Human
aggcaggagaauuguuugagccug

SEQ ID NO: 764861 - RNA, 19 nt, Human
aggcagucauuaguccagg

SEQ ID NO: 764862 - RNA, 19 nt, Human
aggcccugagcucuggaag

SEQ ID NO: 764863 - RNA, 21 nt, Human
aggcugaggcaggagaauugu

SEQ ID NO: 764864 - RNA, 24 nt, Human
aggcugaggcaggagaauuguuug

SEQ ID NO: 764865 - RNA, 24 nt, Human
aggugcaguggcucaugucuauaa

SEQ ID NO: 764866 - RNA, 22 nt, Human
aggugggcagaucgccugaggu

SEQ ID NO: 764867 - RNA, 26 nt, Human
aggugggcagaucgccugaggucagg

SEQ ID NO: 764868 - RNA, 21 nt, Human
agguguugguugcagugagcu

SEQ ID NO: 764869 - RNA, 24 nt, Human
agguguugguugcagugagcugag

SEQ ID NO: 764870 - RNA, 24 nt, Human
aguggcucaugucuauaaucccag

SEQ ID NO: 764871 - RNA, 18 nt, Human
aucccaucuucucuuucu

SEQ ID NO: 764872 - RNA, 21 nt, Human
auggggccugcucacugaaac

SEQ ID NO: 764873 - RNA, 19 nt, Human
auggugcagggacacugcu

SEQ ID NO: 764874 - RNA, 19 nt, Human
augucuauaaucccagcac

SEQ ID NO: 764875 - RNA, 24 nt, Human
auucaaggugguccccacacccag

SEQ ID NO: 764876 - RNA, 23 nt, Human
caaaccgacgaaccaaacaaaaa

SEQ ID NO: 764877 - RNA, 22 nt, Human
caaaggaaacaaacuuagacca

SEQ ID NO: 764878 - RNA, 24 nt, Human
caaaggguuaccuguagccggggc

SEQ ID NO: 764879 - RNA, 27 nt, Human
caacacaacuguaucgcuccaaagacc

SEQ ID NO: 764880 - RNA, 24 nt, Human
caacauggugaaaucucaucucua

SEQ ID NO: 764881 - RNA, 24 nt, Human
caacccaccuucaauuuacuccca

SEQ ID NO: 764882 - RNA, 19 nt, Human
caagacaaggccccuuggc

SEQ ID NO: 764883 - RNA, 22 nt, Human
caagagaggcagcagacagucc

SEQ ID NO: 764884 - RNA, 24 nt, Human
caauaaaaaagagaaucccaggcc

SEQ ID NO: 764885 - RNA, 22 nt, Human
cacacccagcacccaugugugc

SEQ ID NO: 764886 - RNA, 22 nt, Human
cacacgcccacacgcacagaca

SEQ ID NO: 764887 - RNA, 24 nt, Human
caccaguauaaaacagagaauccc

SEQ ID NO: 764888 - RNA, 21 nt, Human
cacccagcacccaugugugcc

SEQ ID NO: 764889 - RNA, 18 nt, Human
cacccauuuccuggcagc

SEQ ID NO: 764890 - RNA, 19 nt, Human
caccggcagcgccgguucc

SEQ ID NO: 764891 - RNA, 20 nt, Human
cacgcaccccacgcacggcc

SEQ ID NO: 764892 - RNA, 19 nt, Human
cacugcacuccauccuggg

SEQ ID NO: 764893 - RNA, 19 nt, Human
cacugcacuccauccuggg

SEQ ID NO: 764894 - RNA, 23 nt, Human
cacugcacuccauccugggugac

SEQ ID NO: 764895 - RNA, 24 nt, Human
cacugcacuccauccugggugaca

SEQ ID NO: 764896 - RNA, 18 nt, Human
cagaaucagucugcccug

SEQ ID NO: 764897 - RNA, 20 nt, Human
cagacacgccugcgggcagc

SEQ ID NO: 764898 - RNA, 22 nt, Human
cagagacaggugacacaggaga

SEQ ID NO: 764899 - RNA, 22 nt, Human
cagaguccccaugggcccacca

SEQ ID NO: 764900 - RNA, 20 nt, Human
cagauaucaagagaggcagc

SEQ ID NO: 764901 - RNA, 22 nt, Human
cagauaucaagagaggcagcag

SEQ ID NO: 764902 - RNA, 27 nt, Human
cagaucgccugaggucaggaguugaag

SEQ ID NO: 764903 - RNA, 24 nt, Human
cagcacuuugggagacugaggugg

SEQ ID NO: 764904 - RNA, 19 nt, Human
cagccaagacaaggccccu

SEQ ID NO: 764905 - RNA, 21 nt, Human
cagcuagggccuuugccuccu

SEQ ID NO: 764906 - RNA, 24 nt, Human
cagcuagggccuuugccuccuggg

SEQ ID NO: 764907 - RNA, 24 nt, Human
cagcugcucgggaggcugaggcag

SEQ ID NO: 764908 - RNA, 23 nt, Human
caggauagagagcuggcucuaaa

SEQ ID NO: 764909 - RNA, 21 nt, Human
caguauaaaacagagaauccc

SEQ ID NO: 764910 - RNA, 22 nt, Human
cagugguccuucaggaucaggg

SEQ ID NO: 764911 - RNA, 23 nt, Human
caucuccugaagcagauaccccc

SEQ ID NO: 764912 - RNA, 20 nt, Human
caucucuacuaaaaauacaa

SEQ ID NO: 764913 - RNA, 20 nt, Human
caugucuauaaucccagcac

SEQ ID NO: 764914 - RNA, 24 nt, Human
caugucuauaaucccagcacuuug

SEQ ID NO: 764915 - RNA, 20 nt, Human
ccagcgcacacgugcacacg

SEQ ID NO: 764916 - RNA, 19 nt, Human
cccaaggcaaaggguuacc

SEQ ID NO: 764917 - RNA, 23 nt, Human
cccacacccagaccccaauauuu

SEQ ID NO: 764918 - RNA, 22 nt, Human
cccacacgcacagacacgccug

SEQ ID NO: 764919 - RNA, 20 nt, Human
cccacgcacggccacacgcg

SEQ ID NO: 764920 - RNA, 26 nt, Human
cccacgcacggccacacgcgcaccca

SEQ ID NO: 764921 - RNA, 21 nt, Human
cccacuggggcagaguuccag

SEQ ID NO: 764922 - RNA, 19 nt, Human
cccagaaucagucugcccu

SEQ ID NO: 764923 - RNA, 25 nt, Human
cccaucuucucuuucuucuuuuucc

SEQ ID NO: 764924 - RNA, 24 nt, Human
ccccagauggcuuauugauggggc

SEQ ID NO: 764925 - RNA, 22 nt, Human
ccccaggcaccggcagcgccgg

SEQ ID NO: 764926 - RNA, 20 nt, Human
ccccaugggcccaccacgag

SEQ ID NO: 764927 - RNA, 21 nt, Human
cccccggcucuaccuguugug

SEQ ID NO: 764928 - RNA, 21 nt, Human
cccgcgccccgacccccaggc

SEQ ID NO: 764929 - RNA, 23 nt, Human
cccgcgccccgacccccaggcac

SEQ ID NO: 764930 - RNA, 22 nt, Human
ccgcggcgguggcgaggcggcg

SEQ ID NO: 764931 - RNA, 20 nt, Human
ccggcagcgccgguuccucc

SEQ ID NO: 764932 - RNA, 24 nt, Human
ccggcuucgcccgcgccccgaccc

SEQ ID NO: 764933 - RNA, 22 nt, Human
ccuagccgcggcgguggcgagg

SEQ ID NO: 764934 - RNA, 19 nt, Human
ccuccagcccuagccgcgg

SEQ ID NO: 764935 - RNA, 19 nt, Human
ccuggccaacauggugaaa

SEQ ID NO: 764936 - RNA, 19 nt, Human
ccuggccaacauggugaaa

SEQ ID NO: 764937 - RNA, 24 nt, Human
ccuggccaacauggugaaaucuca

SEQ ID NO: 764938 - RNA, 19 nt, Human
ccugggagcuggugcccag

SEQ ID NO: 764939 - RNA, 24 nt, Human
cgaagacgcgggagauggagccga

SEQ ID NO: 764940 - RNA, 20 nt, Human
cgccccgacccccaggcacc

SEQ ID NO: 764941 - RNA, 18 nt, Human
cgcccuguagccagagga

SEQ ID NO: 764942 - RNA, 26 nt, Human
cgcggccgggcacccccggcucuacc

SEQ ID NO: 764943 - RNA, 23 nt, Human
cggaggagaaaaaagaggaggag

SEQ ID NO: 764944 - RNA, 23 nt, Human
cggccgacccaggcccgcuuccu

SEQ ID NO: 764945 - RNA, 24 nt, Human
cggcuucgcccgcgccccgacccc

SEQ ID NO: 764946 - RNA, 22 nt, Human
cuagccgcggcgguggcgaggc

SEQ ID NO: 764947 - RNA, 21 nt, Human
cuagggccuuugccuccuggg

SEQ ID NO: 764948 - RNA, 21 nt, Human
cuauaaucccagcacuuuggg

SEQ ID NO: 764949 - RNA, 21 nt, Human
cucaggggccacccugccucu

SEQ ID NO: 764950 - RNA, 23 nt, Human
cucaugucuauaaucccagcacu

SEQ ID NO: 764951 - RNA, 24 nt, Human
cucaugucuauaaucccagcacuu

SEQ ID NO: 764952 - RNA, 22 nt, Human
cuccaaccucucuaugcugagu

SEQ ID NO: 764953 - RNA, 20 nt, Human
cuccucuauguaauaaucag

SEQ ID NO: 764954 - RNA, 20 nt, Human
cuccuggugguuauuucugg

SEQ ID NO: 764955 - RNA, 22 nt, Human
cucuuagcuauuuuuauaagca

SEQ ID NO: 764956 - RNA, 23 nt, Human
cugaacuccuucccuuuuuccua

SEQ ID NO: 764957 - RNA, 23 nt, Human
cuggccaacauggugaaaucuca

SEQ ID NO: 764958 - RNA, 19 nt, Human
cuggggcagaguuccaggc

SEQ ID NO: 764959 - RNA, 21 nt, Human
cugugccugcggccgacccag

SEQ ID NO: 764960 - RNA, 26 nt, Human
cuugcacacacgcccacacgcacaga

SEQ ID NO: 764961 - RNA, 18 nt, Human
cuugccuugguucuguua

SEQ ID NO: 764962 - RNA, 24 nt, Human
cuuucuucuuuuuccguuuuuggu

SEQ ID NO: 764963 - RNA, 18 nt, Human
gaagaugaaacagcagag

SEQ ID NO: 764964 - RNA, 24 nt, Human
gaauuuugggacagaaacaaacuu

SEQ ID NO: 764965 - RNA, 18 nt, Human
gaccucugacaaacccag

SEQ ID NO: 764966 - RNA, 18 nt, Human
gagaacuccuucugcaga

SEQ ID NO: 764967 - RNA, 19 nt, Human
gagacaggugacacaggag

SEQ ID NO: 764968 - RNA, 20 nt, Human
gagagaggugacaaagagcu

SEQ ID NO: 764969 - RNA, 20 nt, Human
gaggaggccaucuaaagucc

SEQ ID NO: 764970 - RNA, 21 nt, Human
gaggaggggaggagaaagggg

SEQ ID NO: 764971 - RNA, 23 nt, Human
gaucgccugaggucaggaguuga

SEQ ID NO: 764972 - RNA, 24 nt, Human
gaucgccugaggucaggaguugaa

SEQ ID NO: 764973 - RNA, 23 nt, Human
gauugaaaaaaaugguuccauaa

SEQ ID NO: 764974 - RNA, 18 nt, Human
gcaaaagacuaggacugg

SEQ ID NO: 764975 - RNA, 26 nt, Human
gcagagcuacagcuccaauuggggga

SEQ ID NO: 764976 - RNA, 22 nt, Human
gcagcuagggccuuugccuccu

SEQ ID NO: 764977 - RNA, 24 nt, Human
gccaacauggugaaaucucaucuc

SEQ ID NO: 764978 - RNA, 18 nt, Human
gccaagacuccuggguca

SEQ ID NO: 764979 - RNA, 21 nt, Human
gcccagucuggccucucaacc

SEQ ID NO: 764980 - RNA, 18 nt, Human
gccgcccaccugagcaga

SEQ ID NO: 764981 - RNA, 28 nt, Human
gcgcacccccaggacaggggggaacgcc

SEQ ID NO: 764982 - RNA, 19 nt, Human
gcgucacugcacuccaucc

SEQ ID NO: 764983 - RNA, 18 nt, Human
ggacaucaaaaacagacc

SEQ ID NO: 764984 - RNA, 21 nt, Human
ggacaucaaaaacagaccaca

SEQ ID NO: 764985 - RNA, 18 nt, Human
ggagaaaaaagaggagga

SEQ ID NO: 764986 - RNA, 18 nt, Human
ggaggagaaggaggagga

SEQ ID NO: 764987 - RNA, 21 nt, Human
ggaggaggggaggagaaaggg

SEQ ID NO: 764988 - RNA, 25 nt, Human
ggcagaucgccugaggucaggaguu

SEQ ID NO: 764989 - RNA, 24 nt, Human
gggaacccuuaauagccuacaggu

SEQ ID NO: 764990 - RNA, 20 nt, Human
gggacagaaacaaacuuggg

SEQ ID NO: 764991 - RNA, 24 nt, Human
gggggcgagagaggugacaaagag

SEQ ID NO: 764992 - RNA, 20 nt, Human
gucacugcacuccauccugg

SEQ ID NO: 764993 - RNA, 24 nt, Human
gucacugcacuccauccuggguga

SEQ ID NO: 764994 - RNA, 21 nt, Human
guccccacacccagaccccaa

SEQ ID NO: 764995 - RNA, 19 nt, Human
guccucuccugcccagucu

SEQ ID NO: 764996 - RNA, 18 nt, Human
gucgagggacuuccgcug

SEQ ID NO: 764997 - RNA, 26 nt, Human
guggagggaacccuuaauagccuaca

SEQ ID NO: 764998 - RNA, 19 nt, Human
guugcagugagcugagacu

SEQ ID NO: 764999 - RNA, 21 nt, Human
guugcagugagcugagacugc

SEQ ID NO: 765000 - RNA, 23 nt, Human
guuucauaaaaaggaggagggga

SEQ ID NO: 765001 - RNA, 21 nt, Human
uaaaaaagagaaucccaggcc

SEQ ID NO: 765002 - RNA, 24 nt, Human
uaaaacaauaaaaaagagaauccc

SEQ ID NO: 765003 - RNA, 24 nt, Human
uaaaccagauuaacaacacaacug

SEQ ID NO: 765004 - RNA, 24 nt, Human
uaaagaaagaaacggcaaugcaac

SEQ ID NO: 765005 - RNA, 23 nt, Human
uaaguuccugucccagucugucc

SEQ ID NO: 765006 - RNA, 23 nt, Human
uacaaaagccuucacuacauccc

SEQ ID NO: 765007 - RNA, 21 nt, Human
uacaagcacagagugcacaau

SEQ ID NO: 765008 - RNA, 20 nt, Human
uacagcuccaauugggggcu

SEQ ID NO: 765009 - RNA, 24 nt, Human
uacucuuagcuauuuuuauaagca

SEQ ID NO: 765010 - RNA, 18 nt, Human
uagccucuagcuuccccc

SEQ ID NO: 765011 - RNA, 23 nt, Human
uagcgguuuggacgagggacauu

SEQ ID NO: 765012 - RNA, 19 nt, Human
uauggccguggggggaagg

SEQ ID NO: 765013 - RNA, 26 nt, Human
ucaaguuucauaaaaaggaggagggg

SEQ ID NO: 765014 - RNA, 19 nt, Human
ucacaccaggggggcggga

SEQ ID NO: 765015 - RNA, 19 nt, Human
ucacugcacuccauccugg

SEQ ID NO: 765016 - RNA, 21 nt, Human
ucacugcacuccauccugggu

SEQ ID NO: 765017 - RNA, 24 nt, Human
ucacugcacuccauccugggugac

SEQ ID NO: 765018 - RNA, 22 nt, Human
ucagagaccccuccaguggccc

SEQ ID NO: 765019 - RNA, 24 nt, Human
ucauaaaaaggaggaggggaggag

SEQ ID NO: 765020 - RNA, 21 nt, Human
uccaggcugugccugcggccg

SEQ ID NO: 765021 - RNA, 25 nt, Human
uccaucacacacacauacaaauaaa

SEQ ID NO: 765022 - RNA, 19 nt, Human
uccauccugggugacaaga

SEQ ID NO: 765023 - RNA, 19 nt, Human
ucccaucuucucuuucuuc

SEQ ID NO: 765024 - RNA, 24 nt, Human
ucccgccaggugcaguggcucaug

SEQ ID NO: 765025 - RNA, 21 nt, Human
ucccuagaguuccuggggucc

SEQ ID NO: 765026 - RNA, 22 nt, Human
ucccucuggcgaagacgcggga

SEQ ID NO: 765027 - RNA, 18 nt, Human
ucccuuuuuccuagggag

SEQ ID NO: 765028 - RNA, 18 nt, Human
uccuccgcggcccggcuu

SEQ ID NO: 765029 - RNA, 21 nt, Human
uccuccgcggcccggcuucgc

SEQ ID NO: 765030 - RNA, 18 nt, Human
uccuggcagcaggaaugu

SEQ ID NO: 765031 - RNA, 21 nt, Human
uccugggagcuggugcccagu

SEQ ID NO: 765032 - RNA, 22 nt, Human
uccuuccaggcaggagcuccag

SEQ ID NO: 765033 - RNA, 24 nt, Human
ucgacauggcuuccaacuguccuc

SEQ ID NO: 765034 - RNA, 23 nt, Human
ucgggaggcugaggcaggagaau

SEQ ID NO: 765035 - RNA, 20 nt, Human
ucucaggggccacccugccu

SEQ ID NO: 765036 - RNA, 21 nt, Human
ucuccugcccagucuggccuc

SEQ ID NO: 765037 - RNA, 21 nt, Human
ucucuacuaaaaauacaaaaa

SEQ ID NO: 765038 - RNA, 22 nt, Human
ucugaccaacaaauuagccacu

SEQ ID NO: 765039 - RNA, 21 nt, Human
ucugaguuagagcuagagcuu

SEQ ID NO: 765040 - RNA, 18 nt, Human
ucuuucuucuuuuuccgu

SEQ ID NO: 765041 - RNA, 18 nt, Human
ugaagcagauacccccag

SEQ ID NO: 765042 - RNA, 21 nt, Human
ugaagcagauacccccagaug

SEQ ID NO: 765043 - RNA, 20 nt, Human
ugacaaagagcugcaugaug

SEQ ID NO: 765044 - RNA, 22 nt, Human
ugacauuaacugaguuuuggaa

SEQ ID NO: 765045 - RNA, 23 nt, Human
ugagaauggugcagggacacugc

SEQ ID NO: 765046 - RNA, 21 nt, Human
ugagacugcgucacugcacuc

SEQ ID NO: 765047 - RNA, 20 nt, Human
ugagauggggggauaaaaag

SEQ ID NO: 765048 - RNA, 22 nt, Human
ugagauggggggauaaaaaggg

SEQ ID NO: 765049 - RNA, 25 nt, Human
ugagauggggggauaaaaaggguuu

SEQ ID NO: 765050 - RNA, 24 nt, Human
ugagccuggaagguguugguugca

SEQ ID NO: 765051 - RNA, 22 nt, Human
ugagcugagacugcgucacugc

SEQ ID NO: 765052 - RNA, 24 nt, Human
ugaggcaggagaauuguuugagcc

SEQ ID NO: 765053 - RNA, 25 nt, Human
ugaggcaggagaauuguuugagccu

SEQ ID NO: 765054 - RNA, 18 nt, Human
ugaggcagucauuagucc

SEQ ID NO: 765055 - RNA, 24 nt, Human
ugaggugggcagaucgccugaggu

SEQ ID NO: 765056 - RNA, 26 nt, Human
ugaggugggcagaucgccugagguca

SEQ ID NO: 765057 - RNA, 24 nt, Human
ugaugaaauaaacaaaggaaacaa

SEQ ID NO: 765058 - RNA, 25 nt, Human
ugccaagguccgucaaccuucucca

SEQ ID NO: 765059 - RNA, 19 nt, Human
ugccagaguccccaugggc

SEQ ID NO: 765060 - RNA, 20 nt, Human
ugccagcugcucgggaggcu

SEQ ID NO: 765061 - RNA, 18 nt, Human
ugccuugguucuguuagu

SEQ ID NO: 765062 - RNA, 19 nt, Human
ugcgcggggggcgcgcggc

SEQ ID NO: 765063 - RNA, 19 nt, Human
ugcgggcagcaggcgcagg

SEQ ID NO: 765064 - RNA, 24 nt, Human
uggaagguguugguugcagugagc

SEQ ID NO: 765065 - RNA, 22 nt, Human
uggaauugcaagcauaaugcca

SEQ ID NO: 765066 - RNA, 20 nt, Human
uggauaggaacaucuuugcc

SEQ ID NO: 765067 - RNA, 23 nt, Human
uggccaacauggugaaaucucau

SEQ ID NO: 765068 - RNA, 21 nt, Human
uggcucaugucuauaauccca

SEQ ID NO: 765069 - RNA, 22 nt, Human
uggcucaugucuauaaucccag

SEQ ID NO: 765070 - RNA, 24 nt, Human
uggcucaugucuauaaucccagca

SEQ ID NO: 765071 - RNA, 21 nt, Human
uggcuguagguauaacuccac

SEQ ID NO: 765072 - RNA, 20 nt, Human
ugggagacugaggugggcag

SEQ ID NO: 765073 - RNA, 23 nt, Human
ugggagacugaggugggcagauc

SEQ ID NO: 765074 - RNA, 24 nt, Human
ugggagacugaggugggcagaucg

SEQ ID NO: 765075 - RNA, 25 nt, Human
ugggaggagaagcccacggucccag

SEQ ID NO: 765076 - RNA, 21 nt, Human
ugggcaaaagacuaggacugg

SEQ ID NO: 765077 - RNA, 24 nt, Human
ugggcagaucgccugaggucagga

SEQ ID NO: 765078 - RNA, 22 nt, Human
ugggggcugucagauuccuccu

SEQ ID NO: 765079 - RNA, 23 nt, Human
uggugcagggacacugcuggcug

SEQ ID NO: 765080 - RNA, 23 nt, Human
ugguggacgucagaugcccaagg

SEQ ID NO: 765081 - RNA, 19 nt, Human
ugucccagucuguccucug

SEQ ID NO: 765082 - RNA, 18 nt, Human
ugucgcccuguagccaga

SEQ ID NO: 765083 - RNA, 21 nt, Human
uguguccuccgcggcccggcu

SEQ ID NO: 765084 - RNA, 20 nt, Human
uguguucaccucauuucuuu

SEQ ID NO: 765085 - RNA, 19 nt, Human
uguuagaggcgcucggcca

SEQ ID NO: 765086 - RNA, 20 nt, Human
uuccauuguguugccagccc

SEQ ID NO: 765087 - RNA, 18 nt, Human
uuccuggcagcaggaaug

SEQ ID NO: 765088 - RNA, 18 nt, Human
uugcagagcccaucuguc

SEQ ID NO: 765089 - RNA, 19 nt, Human
uugcagugagcugagacug

SEQ ID NO: 765090 - RNA, 22 nt, Human
uugcagugagcugagacugcgu

SEQ ID NO: 765091 - RNA, 24 nt, Human
uugggagacugaggugggcagauc

SEQ ID NO: 765092 - RNA, 21 nt, Human
uugguccugagcuuugggcug

SEQ ID NO: 765093 - RNA, 22 nt, Human
uuuaaaagagccgguuugaccu

SEQ ID NO: 765094 - RNA, 21 nt, Human
uuuccaagcaacacuguuaug

SEQ ID NO: 765095 - RNA, 24 nt, Human
uuucugcugccagaguccccaugg

SEQ ID NO: 765096 - RNA, 23 nt, Human
uuucuucuuuuuccguuuuuggu

SEQ ID NO: 765097 - RNA, 18 nt, Human
uuuggaaaaagccgucuc

SEQ ID NO: 765098 - RNA, 22 nt, Human
uuuuacacacugauuuccaagc

SEQ ID NO: 765099 - RNA, 23 nt, Human
aaaaaggacaccuucaguccaga

SEQ ID NO: 765100 - RNA, 23 nt, Human
aaaacagcaucauuuuagaggca

SEQ ID NO: 765101 - RNA, 19 nt, Human
aaaaggacaccuucagucc

SEQ ID NO: 765102 - RNA, 23 nt, Human
aaacacacaccuccccagaaagc

SEQ ID NO: 765103 - RNA, 18 nt, Human
aacagcucuggacaguga

SEQ ID NO: 765104 - RNA, 18 nt, Human
aaccauagugauugcuac

SEQ ID NO: 765105 - RNA, 21 nt, Human
aaccugcuucaucuucagucu

SEQ ID NO: 765106 - RNA, 23 nt, Human
aagaaaacauuuaaaacaaggcu

SEQ ID NO: 765107 - RNA, 23 nt, Human
aagaucgugccacugcacuccag

SEQ ID NO: 765108 - RNA, 23 nt, Human
aagcuacagucaucucuauaacc

SEQ ID NO: 765109 - RNA, 24 nt, Human
aagcuacagucaucucuauaacca

SEQ ID NO: 765110 - RNA, 21 nt, Human
aagcuaccuuaccuugagcuc

SEQ ID NO: 765111 - RNA, 19 nt, Human
aagcuccuuaaggacaaga

SEQ ID NO: 765112 - RNA, 22 nt, Human
aaggacaagaaguaugcccugu

SEQ ID NO: 765113 - RNA, 20 nt, Human
aauagggugaaaccccaucu

SEQ ID NO: 765114 - RNA, 19 nt, Human
acagaagugcugggauuag

SEQ ID NO: 765115 - RNA, 24 nt, Human
acagagcaacacuccgucucaaaa

SEQ ID NO: 765116 - RNA, 23 nt, Human
accaagaauauaaaauaaaugca

SEQ ID NO: 765117 - RNA, 24 nt, Human
accccaucucuacuaaaaauacaa

SEQ ID NO: 765118 - RNA, 20 nt, Human
accccggccccagccccacc

SEQ ID NO: 765119 - RNA, 24 nt, Human
acugcacuccagcuugggugacag

SEQ ID NO: 765120 - RNA, 26 nt, Human
acugcacuccagcuugggugacagag

SEQ ID NO: 765121 - RNA, 22 nt, Human
acugccuuucucuacucccuag

SEQ ID NO: 765122 - RNA, 19 nt, Human
acuggagugcugauaaucc

SEQ ID NO: 765123 - RNA, 18 nt, Human
acuuugggacaguaacag

SEQ ID NO: 765124 - RNA, 22 nt, Human
agacaggcggaugaccugaggg

SEQ ID NO: 765125 - RNA, 18 nt, Human
agaggcacgggacgcggg

SEQ ID NO: 765126 - RNA, 23 nt, Human
agaguagccaagugugcucuggg

SEQ ID NO: 765127 - RNA, 23 nt, Human
agaguauguucugccuacaagga

SEQ ID NO: 765128 - RNA, 18 nt, Human
agcacaaaccucgcagug

SEQ ID NO: 765129 - RNA, 23 nt, Human
agccagacgugguggugcgugcc

SEQ ID NO: 765130 - RNA, 23 nt, Human
agcuggucaguaccggugggccu

SEQ ID NO: 765131 - RNA, 19 nt, Human
aggaagacaucaucauaga

SEQ ID NO: 765132 - RNA, 22 nt, Human
aggaagucaggucaacucaaaa

SEQ ID NO: 765133 - RNA, 21 nt, Human
aggagauaacagugcauuaag

SEQ ID NO: 765134 - RNA, 22 nt, Human
aggcaggagaaucacuugaacc

SEQ ID NO: 765135 - RNA, 24 nt, Human
aggcaggagaaucacuugaaccug

SEQ ID NO: 765136 - RNA, 24 nt, Human
aggccucgcuggggugcagcgaca

SEQ ID NO: 765137 - RNA, 24 nt, Human
aggcugaggcaggagaaucacuug

SEQ ID NO: 765138 - RNA, 21 nt, Human
aggggcauaguauuuugguuu

SEQ ID NO: 765139 - RNA, 19 nt, Human
agguggagguuggagugag

SEQ ID NO: 765140 - RNA, 24 nt, Human
agguggagguuggagugagccaag

SEQ ID NO: 765141 - RNA, 18 nt, Human
agguucccucugucccac

SEQ ID NO: 765142 - RNA, 23 nt, Human
aguaaguauggccuuagguacaa

SEQ ID NO: 765143 - RNA, 19 nt, Human
agugcaguuguuacucucu

SEQ ID NO: 765144 - RNA, 25 nt, Human
auaaaaccuaaauuuuuaacaugcu

SEQ ID NO: 765145 - RNA, 18 nt, Human
aucaguaagguccuggcu

SEQ ID NO: 765146 - RNA, 24 nt, Human
aucgugccacugcacuccagcuug

SEQ ID NO: 765147 - RNA, 21 nt, Human
caagggacuccucggcggcca

SEQ ID NO: 765148 - RNA, 24 nt, Human
cacaccuauaaucccagcacuucg

SEQ ID NO: 765149 - RNA, 22 nt, Human
caccuauaaucccagcacuucg

SEQ ID NO: 765150 - RNA, 22 nt, Human
cacuccagcuugggugacagag

SEQ ID NO: 765151 - RNA, 19 nt, Human
cacugcacuccagcuuggg

SEQ ID NO: 765152 - RNA, 21 nt, Human
cacugcacuccagcuugggug

SEQ ID NO: 765153 - RNA, 22 nt, Human
cacugcacuccagcuuggguga

SEQ ID NO: 765154 - RNA, 23 nt, Human
cacugcacuccagcuugggugac

SEQ ID NO: 765155 - RNA, 24 nt, Human
cacugcacuccagcuugggugaca

SEQ ID NO: 765156 - RNA, 24 nt, Human
cacugcacuccagcuugggugaca

SEQ ID NO: 765157 - RNA, 18 nt, Human
cagaaacuccuuccaaug

SEQ ID NO: 765158 - RNA, 20 nt, Human
cagcacuucgggaggccgag

SEQ ID NO: 765159 - RNA, 28 nt, Human
cagcacuucgggaggccgagacaggcgg

SEQ ID NO: 765160 - RNA, 22 nt, Human
cagcaucauuuuagaggcauag

SEQ ID NO: 765161 - RNA, 20 nt, Human
cagccccaccugcggucccg

SEQ ID NO: 765162 - RNA, 23 nt, Human
cagcuaagaaagaacucagccac

SEQ ID NO: 765163 - RNA, 24 nt, Human
cagcuacucgggaggcugaggcag

SEQ ID NO: 765164 - RNA, 22 nt, Human
cagggaaggggugcuggggaaa

SEQ ID NO: 765165 - RNA, 20 nt, Human
caguugcuucaccaggaaug

SEQ ID NO: 765166 - RNA, 26 nt, Human
cauaacaguaucuaauaaauuucaaa

SEQ ID NO: 765167 - RNA, 24 nt, Human
caucccaggagggcuuacugucac

SEQ ID NO: 765168 - RNA, 20 nt, Human
ccaccugaguuugcgccuga

SEQ ID NO: 765169 - RNA, 18 nt, Human
ccacugcacuccagcuug

SEQ ID NO: 765170 - RNA, 20 nt, Human
ccacugcacuccagcuuggg

SEQ ID NO: 765171 - RNA, 20 nt, Human
ccacugcacuccagcuuggg

SEQ ID NO: 765172 - RNA, 20 nt, Human
ccacugcacuccagcuuggg

SEQ ID NO: 765173 - RNA, 21 nt, Human
ccacugcacuccagcuugggu

SEQ ID NO: 765174 - RNA, 21 nt, Human
ccacugcacuccagcuugggu

SEQ ID NO: 765175 - RNA, 23 nt, Human
ccacugcacuccagcuuggguga

SEQ ID NO: 765176 - RNA, 24 nt, Human
ccacugcacuccagcuugggugac

SEQ ID NO: 765177 - RNA, 22 nt, Human
cccccgaccccggccccagccc

SEQ ID NO: 765178 - RNA, 19 nt, Human
cccccgcgaccgccgcucc

SEQ ID NO: 765179 - RNA, 26 nt, Human
ccccggccccagccccaccugcgguc

SEQ ID NO: 765180 - RNA, 18 nt, Human
cccggccccagccccacc

SEQ ID NO: 765181 - RNA, 19 nt, Human
cccguagucccagcuacuc

SEQ ID NO: 765182 - RNA, 21 nt, Human
cccguagucccagcuacucgg

SEQ ID NO: 765183 - RNA, 21 nt, Human
cccucugucccaccgcuuguc

SEQ ID NO: 765184 - RNA, 21 nt, Human
cccucugucccaccgcuuguc

SEQ ID NO: 765185 - RNA, 18 nt, Human
ccgcccgccgcccgccgc

SEQ ID NO: 765186 - RNA, 20 nt, Human
ccgcccgccgcccgccgcuc

SEQ ID NO: 765187 - RNA, 21 nt, Human
ccgccgcccgccgcuccgcgg

SEQ ID NO: 765188 - RNA, 30 nt, Human
ccgccgcccgccgcuccgcgguccgccuuc

SEQ ID NO: 765189 - RNA, 20 nt, Human
ccgccgcuccgcgguccgcc

SEQ ID NO: 765190 - RNA, 20 nt, Human
ccgccgcuccgcgguccgcc

SEQ ID NO: 765191 - RNA, 21 nt, Human
ccgcgaccgccgcuccacuuc

SEQ ID NO: 765192 - RNA, 20 nt, Human
ccggugggccuggugagaug

SEQ ID NO: 765193 - RNA, 24 nt, Human
ccugaccaauagggugaaacccca

SEQ ID NO: 765194 - RNA, 21 nt, Human
cgcgccgcccgccgcccgccg

SEQ ID NO: 765195 - RNA, 20 nt, Human
cgcgcgcgcgccgcccgccg

SEQ ID NO: 765196 - RNA, 24 nt, Human
cgggaggcugaggcaggagaauca

SEQ ID NO: 765197 - RNA, 24 nt, Human
cucacaccuauaaucccagcacuu

SEQ ID NO: 765198 - RNA, 25 nt, Human
cucacaccuauaaucccagcacuuc

SEQ ID NO: 765199 - RNA, 24 nt, Human
cuccgucucaaaaaaaaaaaaggc

SEQ ID NO: 765200 - RNA, 23 nt, Human
cucucgcgcgcgcgcgcgcgccg

SEQ ID NO: 765201 - RNA, 19 nt, Human
cucucuucagcguuuuggu

SEQ ID NO: 765202 - RNA, 20 nt, Human
cuggagccugugcucugggc

SEQ ID NO: 765203 - RNA, 18 nt, Human
cuggcuauguccuggagg

SEQ ID NO: 765204 - RNA, 19 nt, Human
cuggcuauguccuggagga

SEQ ID NO: 765205 - RNA, 18 nt, Human
cugguucaggcuggaguc

SEQ ID NO: 765206 - RNA, 18 nt, Human
cugugcucugggcugggc

SEQ ID NO: 765207 - RNA, 20 nt, Human
cuuuguaugucacugcauga

SEQ ID NO: 765208 - RNA, 22 nt, Human
cuuuguucccaacugggugcgg

SEQ ID NO: 765209 - RNA, 18 nt, Human
gaaaaagauucuugauag

SEQ ID NO: 765210 - RNA, 18 nt, Human
gaacaguuauugucugug

SEQ ID NO: 765211 - RNA, 24 nt, Human
gacagagcaacacuccgucucaaa

SEQ ID NO: 765212 - RNA, 22 nt, Human
gaccacaaagguaaaguuugcc

SEQ ID NO: 765213 - RNA, 19 nt, Human
gagccugugcucugggcug

SEQ ID NO: 765214 - RNA, 23 nt, Human
gagguuggagugagccaagaucg

SEQ ID NO: 765215 - RNA, 24 nt, Human
gcacuccagcuugggugacagagc

SEQ ID NO: 765216 - RNA, 24 nt, Human
gcagaaaaugacugaaaaaagaga

SEQ ID NO: 765217 - RNA, 24 nt, Human
gcagacccagaugugaagaaacca

SEQ ID NO: 765218 - RNA, 21 nt, Human
gcaggagaaucacuugaaccu

SEQ ID NO: 765219 - RNA, 18 nt, Human
gcagggaaggggugcugg

SEQ ID NO: 765220 - RNA, 19 nt, Human
gcaucauaguuugcauuuu

SEQ ID NO: 765221 - RNA, 20 nt, Human
gccaagaucgugccacugca

SEQ ID NO: 765222 - RNA, 19 nt, Human
gccacugcacuccagcuug

SEQ ID NO: 765223 - RNA, 21 nt, Human
gccacugcacuccagcuuggg

SEQ ID NO: 765224 - RNA, 19 nt, Human
gcugcugccugcuguggag

SEQ ID NO: 765225 - RNA, 18 nt, Human
gcuggggugcagcggcuc

SEQ ID NO: 765226 - RNA, 18 nt, Human
gcuguggaggggcugugg

SEQ ID NO: 765227 - RNA, 21 nt, Human
ggacaagaaguaugcccuguc

SEQ ID NO: 765228 - RNA, 24 nt, Human
ggagguuggagugagccaagaucg

SEQ ID NO: 765229 - RNA, 23 nt, Human
ggaugaccugaggugaggaauuc

SEQ ID NO: 765230 - RNA, 21 nt, Human
ggcucacaccuauaaucccag

SEQ ID NO: 765231 - RNA, 18 nt, Human
gggaccacaaagguaaag

SEQ ID NO: 765232 - RNA, 23 nt, Human
gggagugaggggcuccuuaaagc

SEQ ID NO: 765233 - RNA, 22 nt, Human
gggcaccaggcacauggugagg

SEQ ID NO: 765234 - RNA, 20 nt, Human
ggggcauaguauuuugguuu

SEQ ID NO: 765235 - RNA, 24 nt, Human
gggugcgguggcucacaccuauaa

SEQ ID NO: 765236 - RNA, 24 nt, Human
gguggcucacaccuauaaucccag

SEQ ID NO: 765237 - RNA, 25 nt, Human
guaaaacagcaggagacuaucagaa

SEQ ID NO: 765238 - RNA, 30 nt, Human
guaaaguuugcccucaaaaagcuucaaagg

SEQ ID NO: 765239 - RNA, 19 nt, Human
guagacuuagcuacaugaa

SEQ ID NO: 765240 - RNA, 19 nt, Human
gucaccuuuuucuucagga

SEQ ID NO: 765241 - RNA, 20 nt, Human
uaaaaacccuaaaacaauga

SEQ ID NO: 765242 - RNA, 21 nt, Human
uaaaaauacaaaaauuagcca

SEQ ID NO: 765243 - RNA, 24 nt, Human
uaaaacagcaggagacuaucagaa

SEQ ID NO: 765244 - RNA, 18 nt, Human
uaacaacagcaaaauuau

SEQ ID NO: 765245 - RNA, 18 nt, Human
uaacaguaucuaauaaau

SEQ ID NO: 765246 - RNA, 21 nt, Human
uaagaugaugcugggaacuca

SEQ ID NO: 765247 - RNA, 25 nt, Human
uaaggacaagaaguaugcccugucc

SEQ ID NO: 765248 - RNA, 19 nt, Human
uaagguagacugacauaga

SEQ ID NO: 765249 - RNA, 26 nt, Human
uaagguagacugacauagaaaccccc

SEQ ID NO: 765250 - RNA, 18 nt, Human
uacacagacaaaucuuua

SEQ ID NO: 765251 - RNA, 21 nt, Human
uaccggugggccuggugagau

SEQ ID NO: 765252 - RNA, 24 nt, Human
uacuucaucacaaggauuguuuca

SEQ ID NO: 765253 - RNA, 23 nt, Human
uagaauucuuccuucauuguaua

SEQ ID NO: 765254 - RNA, 19 nt, Human
uagaggcacgggacgcggg

SEQ ID NO: 765255 - RNA, 19 nt, Human
uagcucaagaaaacauuua

SEQ ID NO: 765256 - RNA, 18 nt, Human
uagguaaaugucaucccu

SEQ ID NO: 765257 - RNA, 21 nt, Human
uaguaucagcccugcugccaa

SEQ ID NO: 765258 - RNA, 21 nt, Human
uauaauacauacauaucaccc

SEQ ID NO: 765259 - RNA, 19 nt, Human
uauacaaggaaaacagggu

SEQ ID NO: 765260 - RNA, 23 nt, Human
uauuaaggggcauaguauuuugg

SEQ ID NO: 765261 - RNA, 24 nt, Human
uauuuacagaacagauuuggggau

SEQ ID NO: 765262 - RNA, 19 nt, Human
ucaaagaaaugcugaaggu

SEQ ID NO: 765263 - RNA, 19 nt, Human
ucaaaggucuccuuagagg

SEQ ID NO: 765264 - RNA, 23 nt, Human
ucacaaacacacaccuccccaga

SEQ ID NO: 765265 - RNA, 19 nt, Human
ucacuugaaccuggaaggu

SEQ ID NO: 765266 - RNA, 22 nt, Human
ucaucccuuuccauucuuaaga

SEQ ID NO: 765267 - RNA, 18 nt, Human
uccagcuugggugacaga

SEQ ID NO: 765268 - RNA, 22 nt, Human
uccauagaauucuuccuucauu

SEQ ID NO: 765269 - RNA, 19 nt, Human
ucccacgguuugagggccc

SEQ ID NO: 765270 - RNA, 19 nt, Human
ucccaggagggcuuacugu

SEQ ID NO: 765271 - RNA, 18 nt, Human
ucccuccuccuccucccc

SEQ ID NO: 765272 - RNA, 24 nt, Human
ucccucugucccaccgcuugucuu

SEQ ID NO: 765273 - RNA, 23 nt, Human
ucccugaaacuagauaaauacga

SEQ ID NO: 765274 - RNA, 25 nt, Human
ucgggaggcugaggcaggagaauca

SEQ ID NO: 765275 - RNA, 23 nt, Human
ucgugccacugcacuccagcuug

SEQ ID NO: 765276 - RNA, 21 nt, Human
ucuccuuagaggucccacggu

SEQ ID NO: 765277 - RNA, 23 nt, Human
ucucuacuaaaaauacaaaaauu

SEQ ID NO: 765278 - RNA, 19 nt, Human
ucugggcugggcuggccug

SEQ ID NO: 765279 - RNA, 24 nt, Human
ucuuauuuuaaaaaauggaagggg

SEQ ID NO: 765280 - RNA, 18 nt, Human
ucuucagcguuuuggugu

SEQ ID NO: 765281 - RNA, 19 nt, Human
ugaaaccccaucucuacua

SEQ ID NO: 765282 - RNA, 21 nt, Human
ugagaugggugguacugugag

SEQ ID NO: 765283 - RNA, 22 nt, Human
ugagccaagaucgugccacugc

SEQ ID NO: 765284 - RNA, 20 nt, Human
ugaggcaggagaaucacuug

SEQ ID NO: 765285 - RNA, 24 nt, Human
ugaggcaggagaaucacuugaacc

SEQ ID NO: 765286 - RNA, 25 nt, Human
ugaggcaggagaaucacuugaaccu

SEQ ID NO: 765287 - RNA, 18 nt, Human
ugaugagugucacuaugc

SEQ ID NO: 765288 - RNA, 24 nt, Human
ugcaacccugcuccggugcccccg

SEQ ID NO: 765289 - RNA, 21 nt, Human
ugcagggaaggggugcugggg

SEQ ID NO: 765290 - RNA, 24 nt, Human
ugccacugcacuccagcuugggug

SEQ ID NO: 765291 - RNA, 24 nt, Human
ugcccguagucccagcuacucggg

SEQ ID NO: 765292 - RNA, 18 nt, Human
ugcgugcagaaaaugacu

SEQ ID NO: 765293 - RNA, 18 nt, Human
ugcuccggugcccccgac

SEQ ID NO: 765294 - RNA, 19 nt, Human
ugcugggaacucaguucca

SEQ ID NO: 765295 - RNA, 21 nt, Human
ugcugguucugcugcuguugc

SEQ ID NO: 765296 - RNA, 21 nt, Human
ugcuguucugcuguggugggg

SEQ ID NO: 765297 - RNA, 19 nt, Human
uggaacacaugcagggaag

SEQ ID NO: 765298 - RNA, 24 nt, Human
uggaagguggagguuggagugagc

SEQ ID NO: 765299 - RNA, 24 nt, Human
uggagauuucuggcuauguccugg

SEQ ID NO: 765300 - RNA, 22 nt, Human
uggagcacgaaaagcuacaguc

SEQ ID NO: 765301 - RNA, 19 nt, Human
uggcacagacaucccagga

SEQ ID NO: 765302 - RNA, 24 nt, Human
uggcucacaccuauaaucccagca

SEQ ID NO: 765303 - RNA, 20 nt, Human
ugggugacagagcaacacuc

SEQ ID NO: 765304 - RNA, 18 nt, Human
uggugcgugcccguaguc

SEQ ID NO: 765305 - RNA, 24 nt, Human
uggugcgugcccguagucccagcu

SEQ ID NO: 765306 - RNA, 24 nt, Human
ugguggugcgugcccguaguccca

SEQ ID NO: 765307 - RNA, 18 nt, Human
uguauaguuucugcugca

SEQ ID NO: 765308 - RNA, 18 nt, Human
ugucacagaucacaagcu

SEQ ID NO: 765309 - RNA, 20 nt, Human
uguggaggggcugugggcug

SEQ ID NO: 765310 - RNA, 18 nt, Human
uguugcuaaaucaguuca

SEQ ID NO: 765311 - RNA, 24 nt, Human
uuaaaaauagucacucuauaucua

SEQ ID NO: 765312 - RNA, 21 nt, Human
uuaaagcagcuaagaaagaac

SEQ ID NO: 765313 - RNA, 20 nt, Human
uuagaaguaaacaaaaagac

SEQ ID NO: 765314 - RNA, 20 nt, Human
uuagccagacgugguggugc

SEQ ID NO: 765315 - RNA, 18 nt, Human
uuaggcacaauuauuaag

SEQ ID NO: 765316 - RNA, 24 nt, Human
uuagugagcauuauuaugcugaga

SEQ ID NO: 765317 - RNA, 21 nt, Human
uucacaaauaggaauuauagg

SEQ ID NO: 765318 - RNA, 22 nt, Human
uucauuguauaguuucugcugc

SEQ ID NO: 765319 - RNA, 18 nt, Human
uucuuguuuggaggcacc

SEQ ID NO: 765320 - RNA, 21 nt, Human
uucuuguuuggaggcaccugg

SEQ ID NO: 765321 - RNA, 18 nt, Human
uugcuggagccugugcuc

SEQ ID NO: 765322 - RNA, 22 nt, Human
uuggagugagccaagaucgugc

SEQ ID NO: 765323 - RNA, 24 nt, Human
uuggugugggccaucgagacugua

SEQ ID NO: 765324 - RNA, 18 nt, Human
uuguuaaaaaggacaccu

SEQ ID NO: 765325 - RNA, 22 nt, Human
uuucacaaacacacaccucccc

SEQ ID NO: 765326 - RNA, 18 nt, Human
uuuggauuuguaauuucc

SEQ ID NO: 765327 - RNA, 22 nt, Human
aaagcacccugucccaacccua

SEQ ID NO: 765328 - RNA, 19 nt, Human
aaagccuccggcaaaggca

SEQ ID NO: 765329 - RNA, 21 nt, Human
aacccuaucuuccauacugac

SEQ ID NO: 765330 - RNA, 19 nt, Human
aagaaggggacauuuccaa

SEQ ID NO: 765331 - RNA, 21 nt, Human
aagcaaccccaaacugagggc

SEQ ID NO: 765332 - RNA, 23 nt, Human
aagcaaccccaaacugagggcaa

SEQ ID NO: 765333 - RNA, 21 nt, Human
aagcuucccccuggaugcucc

SEQ ID NO: 765334 - RNA, 19 nt, Human
aaugagagaacagccaggc

SEQ ID NO: 765335 - RNA, 20 nt, Human
acagucugaacugggaugga

SEQ ID NO: 765336 - RNA, 27 nt, Human
accccagagcucuccucugcugacccc

SEQ ID NO: 765337 - RNA, 21 nt, Human
accccgcuugccagacuccag

SEQ ID NO: 765338 - RNA, 19 nt, Human
accuuaacucccuccagcc

SEQ ID NO: 765339 - RNA, 18 nt, Human
accuugagcuggccuggg

SEQ ID NO: 765340 - RNA, 18 nt, Human
acucguucacccucugcc

SEQ ID NO: 765341 - RNA, 24 nt, Human
agaacagccaggcgcuggcuuggg

SEQ ID NO: 765342 - RNA, 20 nt, Human
agacagcagagccaggaggg

SEQ ID NO: 765343 - RNA, 22 nt, Human
agacccuaacuuaacacccugc

SEQ ID NO: 765344 - RNA, 22 nt, Human
agagcaagggcuagaacucaag

SEQ ID NO: 765345 - RNA, 22 nt, Human
agaggagagguuggggagaggg

SEQ ID NO: 765346 - RNA, 20 nt, Human
agaggccugauggugucccu

SEQ ID NO: 765347 - RNA, 26 nt, Human
agagggcagugacaaugagagaacag

SEQ ID NO: 765348 - RNA, 19 nt, Human
agaugggaaagcugagggu

SEQ ID NO: 765349 - RNA, 26 nt, Human
agcaccuucucaucuucacagcagca

SEQ ID NO: 765350 - RNA, 19 nt, Human
agccaggaggggagggacg

SEQ ID NO: 765351 - RNA, 19 nt, Human
agccauauuccucccugag

SEQ ID NO: 765352 - RNA, 27 nt, Human
agcccaacuagcccaccaccaccaccc

SEQ ID NO: 765353 - RNA, 18 nt, Human
agcuggccugggagaccu

SEQ ID NO: 765354 - RNA, 23 nt, Human
aggaccuucugaacacaccccgc

SEQ ID NO: 765355 - RNA, 22 nt, Human
aggagcauuccugaggcccaag

SEQ ID NO: 765356 - RNA, 21 nt, Human
aggcaagaggcaggacacagg

SEQ ID NO: 765357 - RNA, 22 nt, Human
aggcagccaauugcuuggcuga

SEQ ID NO: 765358 - RNA, 25 nt, Human
aggcucccccaggucacugggcacc

SEQ ID NO: 765359 - RNA, 24 nt, Human
agggaaccagugagggccugcagc

SEQ ID NO: 765360 - RNA, 21 nt, Human
agggguggucagcugggcugc

SEQ ID NO: 765361 - RNA, 22 nt, Human
agguagcaaguccaggggucca

SEQ ID NO: 765362 - RNA, 18 nt, Human
agugcacuggggaaggga

SEQ ID NO: 765363 - RNA, 20 nt, Human
caacaugaaggagcuggaug

SEQ ID NO: 765364 - RNA, 21 nt, Human
caaccccagagcucuccucug

SEQ ID NO: 765365 - RNA, 25 nt, Human
caacucuggaaacuacagaacucag

SEQ ID NO: 765366 - RNA, 20 nt, Human
caaggugaacucguucaccc

SEQ ID NO: 765367 - RNA, 20 nt, Human
caaguccugggccuaaggga

SEQ ID NO: 765368 - RNA, 22 nt, Human
cacaugguagcucuguaucucu

SEQ ID NO: 765369 - RNA, 23 nt, Human
caccccgguaagucccaaaccca

SEQ ID NO: 765370 - RNA, 25 nt, Human
caccccgguaagucccaaacccaaa

SEQ ID NO: 765371 - RNA, 20 nt, Human
cacccugucccaacccuauc

SEQ ID NO: 765372 - RNA, 22 nt, Human
cagaaauacaggcagacccuaa

SEQ ID NO: 765373 - RNA, 22 nt, Human
cagaacucagccauauuccucc

SEQ ID NO: 765374 - RNA, 24 nt, Human
cagaaggaacagaugagcuggagg

SEQ ID NO: 765375 - RNA, 19 nt, Human
cagagccaggaggggaggg

SEQ ID NO: 765376 - RNA, 18 nt, Human
cagagcucuccucugcug

SEQ ID NO: 765377 - RNA, 22 nt, Human
cagcagcagguaggggcuuugg

SEQ ID NO: 765378 - RNA, 22 nt, Human
cagcagguaggggcuuugggac

SEQ ID NO: 765379 - RNA, 18 nt, Human
cauccccaaccccagagc

SEQ ID NO: 765380 - RNA, 25 nt, Human
caucggccccuaaauucaagcccaa

SEQ ID NO: 765381 - RNA, 20 nt, Human
caucugagccaauccugucc

SEQ ID NO: 765382 - RNA, 19 nt, Human
ccaccaccaccacccaccc

SEQ ID NO: 765383 - RNA, 19 nt, Human
ccaccaccaccacccaccc

SEQ ID NO: 765384 - RNA, 22 nt, Human
ccaccaccaccacccacccccg

SEQ ID NO: 765385 - RNA, 23 nt, Human
ccaccaccaccacccacccccga

SEQ ID NO: 765386 - RNA, 23 nt, Human
ccaccaccacccacccccgacuu

SEQ ID NO: 765387 - RNA, 19 nt, Human
ccaccacccacccccgacu

SEQ ID NO: 765388 - RNA, 19 nt, Human
ccagacagcagagccagga

SEQ ID NO: 765389 - RNA, 21 nt, Human
ccagagcucuccucugcugac

SEQ ID NO: 765390 - RNA, 21 nt, Human
cccaaacccaaacugucccuc

SEQ ID NO: 765391 - RNA, 21 nt, Human
cccaaagaggccagacccuuu

SEQ ID NO: 765392 - RNA, 18 nt, Human
cccaacuagcccaccacc

SEQ ID NO: 765393 - RNA, 18 nt, Human
cccaaggagcccucuaag

SEQ ID NO: 765394 - RNA, 25 nt, Human
cccaccaccaccacccacccccgac

SEQ ID NO: 765395 - RNA, 19 nt, Human
ccccagagcucuccucugc

SEQ ID NO: 765396 - RNA, 24 nt, Human
ccccaggucacugggcaccaggca

SEQ ID NO: 765397 - RNA, 19 nt, Human
ccccaggucuaaugagccu

SEQ ID NO: 765398 - RNA, 19 nt, Human
cccccagcugauccugaag

SEQ ID NO: 765399 - RNA, 22 nt, Human
ccccgcuugccagacuccagaa

SEQ ID NO: 765400 - RNA, 23 nt, Human
cccggggagaauuuuccugccuc

SEQ ID NO: 765401 - RNA, 20 nt, Human
ccggcagcgagguggaacuc

SEQ ID NO: 765402 - RNA, 18 nt, Human
ccgggguggggucggggg

SEQ ID NO: 765403 - RNA, 20 nt, Human
ccggugcauggccugggagg

SEQ ID NO: 765404 - RNA, 21 nt, Human
ccuaacuuaacacccugcuca

SEQ ID NO: 765405 - RNA, 26 nt, Human
ccuaggaccuucugaacacacccuuu

SEQ ID NO: 765406 - RNA, 22 nt, Human
ccuccugcuaguccucugggaa

SEQ ID NO: 765407 - RNA, 19 nt, Human
ccugaggcccaaggagccc

SEQ ID NO: 765408 - RNA, 22 nt, Human
ccugcuagaaucuccucuaugc

SEQ ID NO: 765409 - RNA, 24 nt, Human
ccuugagcuggccugggagaccuc

SEQ ID NO: 765410 - RNA, 23 nt, Human
cgagguggaacucaggcugagcc

SEQ ID NO: 765411 - RNA, 24 nt, Human
cgcgccuuggcuucuuucagaucc

SEQ ID NO: 765412 - RNA, 20 nt, Human
cggccccuaaauucaagccc

SEQ ID NO: 765413 - RNA, 23 nt, Human
cgggguggggucggggguggggc

SEQ ID NO: 765414 - RNA, 26 nt, Human
cuaaauucaagcccaacuagcccacc

SEQ ID NO: 765415 - RNA, 23 nt, Human
cuaaugagccuucuucuggcucu

SEQ ID NO: 765416 - RNA, 20 nt, Human
cuacaagggacccagcagca

SEQ ID NO: 765417 - RNA, 18 nt, Human
cuaugcauccuggccaug

SEQ ID NO: 765418 - RNA, 21 nt, Human
cuccagccucacuuggggguu

SEQ ID NO: 765419 - RNA, 22 nt, Human
cucuuugucucucucuuuccca

SEQ ID NO: 765420 - RNA, 19 nt, Human
cugaaccucuagaaggcuc

SEQ ID NO: 765421 - RNA, 21 nt, Human
cugaagccaagcuucccccug

SEQ ID NO: 765422 - RNA, 23 nt, Human
cugcauucuacaagaggcaagag

SEQ ID NO: 765423 - RNA, 21 nt, Human
cugcccaaagaggccagaccc

SEQ ID NO: 765424 - RNA, 18 nt, Human
cugcuccugccugggacu

SEQ ID NO: 765425 - RNA, 19 nt, Human
cuggaaacuacagaacuca

SEQ ID NO: 765426 - RNA, 24 nt, Human
cuggcucugcccucccgggguggg

SEQ ID NO: 765427 - RNA, 22 nt, Human
cuguccccucuggccguggcuc

SEQ ID NO: 765428 - RNA, 23 nt, Human
cuguccccucuggccguggcucu

SEQ ID NO: 765429 - RNA, 22 nt, Human
cugucggggcucuggggacugg

SEQ ID NO: 765430 - RNA, 19 nt, Human
cuucuggcucugcccuccc

SEQ ID NO: 765431 - RNA, 20 nt, Human
cuuuagcaacauccugguau

SEQ ID NO: 765432 - RNA, 20 nt, Human
gaaaguagcaugacagggac

SEQ ID NO: 765433 - RNA, 21 nt, Human
gaacacaccccgcuugccaga

SEQ ID NO: 765434 - RNA, 23 nt, Human
gaaccagugagggccugcagcca

SEQ ID NO: 765435 - RNA, 23 nt, Human
gaccccucugucggggcucuggg

SEQ ID NO: 765436 - RNA, 22 nt, Human
gaccuuaacucccuccagccuc

SEQ ID NO: 765437 - RNA, 18 nt, Human
gagagagaaagagagagu

SEQ ID NO: 765438 - RNA, 20 nt, Human
gagagagagagagaaagaga

SEQ ID NO: 765439 - RNA, 23 nt, Human
gagcacucugagggacuccuggc

SEQ ID NO: 765440 - RNA, 19 nt, Human
gagcuggaugugacuuuuc

SEQ ID NO: 765441 - RNA, 21 nt, Human
gaggccagacccuuugggucc

SEQ ID NO: 765442 - RNA, 19 nt, Human
gaggcccaaguccugggcc

SEQ ID NO: 765443 - RNA, 22 nt, Human
gagugugugugcaucggugugu

SEQ ID NO: 765444 - RNA, 24 nt, Human
gauauggacacugggacugagguc

SEQ ID NO: 765445 - RNA, 20 nt, Human
gauggugucccuucccuggg

SEQ ID NO: 765446 - RNA, 23 nt, Human
gcagcaacaugaaggagcuggau

SEQ ID NO: 765447 - RNA, 19 nt, Human
gcagcagguaggggcuuug

SEQ ID NO: 765448 - RNA, 20 nt, Human
gccacgggaauuggagcugg

SEQ ID NO: 765449 - RNA, 28 nt, Human
gcccucaggggucaucugagccaauccu

SEQ ID NO: 765450 - RNA, 24 nt, Human
gcccucccgggguggggucggggg

SEQ ID NO: 765451 - RNA, 19 nt, Human
gcgccuguugaagagcugg

SEQ ID NO: 765452 - RNA, 20 nt, Human
gcugccuccugcuaguccuc

SEQ ID NO: 765453 - RNA, 18 nt, Human
ggaaaugcagguagaaau

SEQ ID NO: 765454 - RNA, 18 nt, Human
ggaggcccaaguccuggg

SEQ ID NO: 765455 - RNA, 24 nt, Human
ggcagugacaaugagagaacagcc

SEQ ID NO: 765456 - RNA, 21 nt, Human
ggccccuaaauucaagcccaa

SEQ ID NO: 765457 - RNA, 22 nt, Human
ggcugggcuucuguccccucug

SEQ ID NO: 765458 - RNA, 21 nt, Human
gggaauuggagcugggagggg

SEQ ID NO: 765459 - RNA, 21 nt, Human
gggacuggggugccguggagg

SEQ ID NO: 765460 - RNA, 24 nt, Human
gggccugcagccaggcucccccag

SEQ ID NO: 765461 - RNA, 19 nt, Human
ggggaagggauggggcagg

SEQ ID NO: 765462 - RNA, 22 nt, Human
ggggacuggggugccguggaga

SEQ ID NO: 765463 - RNA, 22 nt, Human
ggggagagggcagugacaauga

SEQ ID NO: 765464 - RNA, 24 nt, Human
guauggaacccugaagguagcaag

SEQ ID NO: 765465 - RNA, 24 nt, Human
guccagggguccauauacacacug

SEQ ID NO: 765466 - RNA, 23 nt, Human
gugugugugcaucggugugugua

SEQ ID NO: 765467 - RNA, 21 nt, Human
gugugugugugugugugugug

SEQ ID NO: 765468 - RNA, 27 nt, Human
uaacuagugugugugugugugugugug

SEQ ID NO: 765469 - RNA, 18 nt, Human
uaagagcaccuucucauc

SEQ ID NO: 765470 - RNA, 19 nt, Human
uaagauguccuggacaguc

SEQ ID NO: 765471 - RNA, 21 nt, Human
uaaggucacucuuucauucca

SEQ ID NO: 765472 - RNA, 20 nt, Human
uacccccagcugauccugaa

SEQ ID NO: 765473 - RNA, 18 nt, Human
uagaaggcucuaccagcc

SEQ ID NO: 765474 - RNA, 23 nt, Human
uaucauggaaugcauuucaagag

SEQ ID NO: 765475 - RNA, 19 nt, Human
uccaaggggaccagaaaua

SEQ ID NO: 765476 - RNA, 18 nt, Human
uccccaaccccagagcuc

SEQ ID NO: 765477 - RNA, 23 nt, Human
ucccccaggucacugggcaccag

SEQ ID NO: 765478 - RNA, 20 nt, Human
ucccgggguggggucggggg

SEQ ID NO: 765479 - RNA, 26 nt, Human
ucccuccagccucacuuggggguucc

SEQ ID NO: 765480 - RNA, 22 nt, Human
ucccugaguccccccuggggac

SEQ ID NO: 765481 - RNA, 22 nt, Human
uccucagccaauuccauacccc

SEQ ID NO: 765482 - RNA, 21 nt, Human
uccucuaugcuacugccucag

SEQ ID NO: 765483 - RNA, 19 nt, Human
uccugaggcccaaggagcc

SEQ ID NO: 765484 - RNA, 22 nt, Human
ucuacaagaggcaagaggcagg

SEQ ID NO: 765485 - RNA, 25 nt, Human
ucuaugcuacugccucagccagagg

SEQ ID NO: 765486 - RNA, 27 nt, Human
ucucaaagccuccggcaaaggcagcca

SEQ ID NO: 765487 - RNA, 21 nt, Human
ucuccgugaggcuagugcucc

SEQ ID NO: 765488 - RNA, 24 nt, Human
ucucuggggcugcccaaagaggcc

SEQ ID NO: 765489 - RNA, 24 nt, Human
ucugcuagguccucccugaagcca

SEQ ID NO: 765490 - RNA, 25 nt, Human
ucuggcucugcccucccgggguggg

SEQ ID NO: 765491 - RNA, 19 nt, Human
ucuguaucucuucucuccc

SEQ ID NO: 765492 - RNA, 21 nt, Human
ucuuauggcugcagauaagau

SEQ ID NO: 765493 - RNA, 18 nt, Human
ugaaucacagccaccaag

SEQ ID NO: 765494 - RNA, 20 nt, Human
ugacgaagccaggaaaaucc

SEQ ID NO: 765495 - RNA, 18 nt, Human
ugagcccagaaccugcca

SEQ ID NO: 765496 - RNA, 23 nt, Human
ugaggcccaaggagcccucuaag

SEQ ID NO: 765497 - RNA, 19 nt, Human
ugagggcaaucagguaaag

SEQ ID NO: 765498 - RNA, 19 nt, Human
ugagggccugcagccaggc

SEQ ID NO: 765499 - RNA, 22 nt, Human
ugauaaaaauagagcuugucug

SEQ ID NO: 765500 - RNA, 18 nt, Human
ugcccaaagaggccagac

SEQ ID NO: 765501 - RNA, 21 nt, Human
ugccccgccucauccaaggca

SEQ ID NO: 765502 - RNA, 19 nt, Human
ugccucuucccuccagagg

SEQ ID NO: 765503 - RNA, 21 nt, Human
ugcgacacaggccuaggaccu

SEQ ID NO: 765504 - RNA, 19 nt, Human
uggaacucaggcugagccc

SEQ ID NO: 765505 - RNA, 21 nt, Human
uggaacucaggcugagccccg

SEQ ID NO: 765506 - RNA, 19 nt, Human
uggaaugcauuucaagacu

SEQ ID NO: 765507 - RNA, 22 nt, Human
uggaggcccaaguccugggccu

SEQ ID NO: 765508 - RNA, 23 nt, Human
uggccugggaggcuugaagggag

SEQ ID NO: 765509 - RNA, 24 nt, Human
uggcucugcccucccggggugggg

SEQ ID NO: 765510 - RNA, 23 nt, Human
ugggaagggauggaaaacagcug

SEQ ID NO: 765511 - RNA, 19 nt, Human
ugggacuuggugccaggga

SEQ ID NO: 765512 - RNA, 20 nt, Human
ugggagggguggucagcugg

SEQ ID NO: 765513 - RNA, 21 nt, Human
ugggagggguggucagcugga

SEQ ID NO: 765514 - RNA, 22 nt, Human
ugggagggguggucagcugggc

SEQ ID NO: 765515 - RNA, 23 nt, Human
ugggagggguggucagcugggcc

SEQ ID NO: 765516 - RNA, 19 nt, Human
uggggacuggggugccgug

SEQ ID NO: 765517 - RNA, 20 nt, Human
uggggucggggguggggcuu

SEQ ID NO: 765518 - RNA, 22 nt, Human
uggggugccguggagggccugg

SEQ ID NO: 765519 - RNA, 20 nt, Human
ugugugcaucggugugugua

SEQ ID NO: 765520 - RNA, 20 nt, Human
ugugugugcaucggugugug

SEQ ID NO: 765521 - RNA, 21 nt, Human
ugugugugcaucggugugugu

SEQ ID NO: 765522 - RNA, 18 nt, Human
ugugugugugugugugug

SEQ ID NO: 765523 - RNA, 18 nt, Human
ugugugugugugugugug

SEQ ID NO: 765524 - RNA, 18 nt, Human
ugugugugugugugugug

SEQ ID NO: 765525 - RNA, 18 nt, Human
ugugugugugugugugug

SEQ ID NO: 765526 - RNA, 18 nt, Human
ugugugugugugugugug

SEQ ID NO: 765527 - RNA, 18 nt, Human
ugugugugugugugugug

SEQ ID NO: 765528 - RNA, 18 nt, Human
ugugugugugugugugug

SEQ ID NO: 765529 - RNA, 18 nt, Human
ugugugugugugugugug

SEQ ID NO: 765530 - RNA, 18 nt, Human
ugugugugugugugugug

SEQ ID NO: 765531 - RNA, 18 nt, Human
ugugugugugugugugug

SEQ ID NO: 765532 - RNA, 18 nt, Human
ugugugugugugugugug

SEQ ID NO: 765533 - RNA, 18 nt, Human
ugugugugugugugugug

SEQ ID NO: 765534 - RNA, 18 nt, Human
ugugugugugugugugug

SEQ ID NO: 765535 - RNA, 18 nt, Human
ugugugugugugugugug

SEQ ID NO: 765536 - RNA, 18 nt, Human
ugugugugugugugugug

SEQ ID NO: 765537 - RNA, 21 nt, Human
ugugugugugugugugugugu

SEQ ID NO: 765538 - RNA, 21 nt, Human
ugugugugugugugugugugu

SEQ ID NO: 765539 - RNA, 21 nt, Human
ugugugugugugugugugugu

SEQ ID NO: 765540 - RNA, 21 nt, Human
ugugugugugugugugugugu

SEQ ID NO: 765541 - RNA, 21 nt, Human
ugugugugugugugugugugu

SEQ ID NO: 765542 - RNA, 21 nt, Human
ugugugugugugugugugugu

SEQ ID NO: 765543 - RNA, 21 nt, Human
ugugugugugugugugugugu

SEQ ID NO: 765544 - RNA, 21 nt, Human
ugugugugugugugugugugu

SEQ ID NO: 765545 - RNA, 21 nt, Human
ugugugugugugugugugugu

SEQ ID NO: 765546 - RNA, 21 nt, Human
ugugugugugugugugugugu

SEQ ID NO: 765547 - RNA, 21 nt, Human
ugugugugugugugugugugu

SEQ ID NO: 765548 - RNA, 21 nt, Human
ugugugugugugugugugugu

SEQ ID NO: 765549 - RNA, 21 nt, Human
ugugugugugugugugugugu

SEQ ID NO: 765550 - RNA, 21 nt, Human
ugugugugugugugugugugu

SEQ ID NO: 765551 - RNA, 21 nt, Human
ugugugugugugugugugugu

SEQ ID NO: 765552 - RNA, 21 nt, Human
ugugugugugugugugugugu

SEQ ID NO: 765553 - RNA, 21 nt, Human
ugugugugugugugugugugu

SEQ ID NO: 765554 - RNA, 21 nt, Human
ugugugugugugugugugugu

SEQ ID NO: 765555 - RNA, 21 nt, Human
ugugugugugugugugugugu

SEQ ID NO: 765556 - RNA, 21 nt, Human
ugugugugugugugugugugu

SEQ ID NO: 765557 - RNA, 21 nt, Human
ugugugugugugugugugugu

SEQ ID NO: 765558 - RNA, 21 nt, Human
ugugugugugugugugugugu

SEQ ID NO: 765559 - RNA, 21 nt, Human
ugugugugugugugugugugu

SEQ ID NO: 765560 - RNA, 21 nt, Human
ugugugugugugugugugugu

SEQ ID NO: 765561 - RNA, 21 nt, Human
ugugugugugugugugugugu

SEQ ID NO: 765562 - RNA, 21 nt, Human
ugugugugugugugugugugu

SEQ ID NO: 765563 - RNA, 21 nt, Human
ugugugugugugugugugugu

SEQ ID NO: 765564 - RNA, 21 nt, Human
ugugugugugugugugugugu

SEQ ID NO: 765565 - RNA, 22 nt, Human
ugugugugugugugugugugug

SEQ ID NO: 765566 - RNA, 22 nt, Human
ugugugugugugugugugugug

SEQ ID NO: 765567 - RNA, 22 nt, Human
ugugugugugugugugugugug

SEQ ID NO: 765568 - RNA, 22 nt, Human
ugugugugugugugugugugug

SEQ ID NO: 765569 - RNA, 22 nt, Human
ugugugugugugugugugugug

SEQ ID NO: 765570 - RNA, 22 nt, Human
ugugugugugugugugugugug

SEQ ID NO: 765571 - RNA, 22 nt, Human
ugugugugugugugugugugug

SEQ ID NO: 765572 - RNA, 22 nt, Human
ugugugugugugugugugugug

SEQ ID NO: 765573 - RNA, 22 nt, Human
ugugugugugugugugugugug

SEQ ID NO: 765574 - RNA, 22 nt, Human
ugugugugugugugugugugug

SEQ ID NO: 765575 - RNA, 22 nt, Human
ugugugugugugugugugugug

SEQ ID NO: 765576 - RNA, 22 nt, Human
ugugugugugugugugugugug

SEQ ID NO: 765577 - RNA, 22 nt, Human
ugugugugugugugugugugug

SEQ ID NO: 765578 - RNA, 26 nt, Human
uucaccuacauacguuugauccucag

SEQ ID NO: 765579 - RNA, 18 nt, Human
uucccugggaggggcccu

SEQ ID NO: 765580 - RNA, 22 nt, Human
uuccugaggcccaaggagcccu

SEQ ID NO: 765581 - RNA, 20 nt, Human
uuuccugccucuucccucca

SEQ ID NO: 765582 - RNA, 21 nt, Human
aagagcugucacaacuucucc

SEQ ID NO: 765583 - RNA, 19 nt, Human
aagcagaggugaggacagg

SEQ ID NO: 765584 - RNA, 22 nt, Human
aagcaguggcuugaugggcauu

SEQ ID NO: 765585 - RNA, 18 nt, Human
aaggagcugggacuauag

SEQ ID NO: 765586 - RNA, 24 nt, Human
aaggagcugggacuauaggcaugu

SEQ ID NO: 765587 - RNA, 21 nt, Human
aaucaccuaagagcaaacacc

SEQ ID NO: 765588 - RNA, 22 nt, Human
acagcugggacagggagggagc

SEQ ID NO: 765589 - RNA, 22 nt, Human
acaugcaaaggugcagcaugga

SEQ ID NO: 765590 - RNA, 22 nt, Human
acccagcagccguaccggggag

SEQ ID NO: 765591 - RNA, 21 nt, Human
acccugcagaggaccccacug

SEQ ID NO: 765592 - RNA, 23 nt, Human
acccugcagaggaccccacuguc

SEQ ID NO: 765593 - RNA, 22 nt, Human
accgaggggcugacucaggauu

SEQ ID NO: 765594 - RNA, 25 nt, Human
acuauguugcccaggcuggccuuga

SEQ ID NO: 765595 - RNA, 23 nt, Human
acugugagagggagcgagcuucg

SEQ ID NO: 765596 - RNA, 27 nt, Human
agaaacagugagaacgcacguggacaa

SEQ ID NO: 765597 - RNA, 21 nt, Human
agaaaggacagguccacgcaa

SEQ ID NO: 765598 - RNA, 21 nt, Human
agaaaugucagggcaguccuc

SEQ ID NO: 765599 - RNA, 25 nt, Human
agaggccagcaccgaggggcugacu

SEQ ID NO: 765600 - RNA, 18 nt, Human
agaggugaggacagggca

SEQ ID NO: 765601 - RNA, 21 nt, Human
agauagcuggaauaccagcug

SEQ ID NO: 765602 - RNA, 26 nt, Human
agaucucggguguucugggccccuuc

SEQ ID NO: 765603 - RNA, 21 nt, Human
agcagagucuaggaauuucca

SEQ ID NO: 765604 - RNA, 19 nt, Human
aggcccgggagagaaacga

SEQ ID NO: 765605 - RNA, 20 nt, Human
aggcggugccgagcgugggg

SEQ ID NO: 765606 - RNA, 20 nt, Human
agggcaucacuaggcucaga

SEQ ID NO: 765607 - RNA, 24 nt, Human
agggcucccacaccuccgggggcu

SEQ ID NO: 765608 - RNA, 22 nt, Human
aggggcugacucaggaugggga

SEQ ID NO: 765609 - RNA, 24 nt, Human
agggucucugucacccaggcugga

SEQ ID NO: 765610 - RNA, 20 nt, Human
agugaaguggcgcaaucucg

SEQ ID NO: 765611 - RNA, 24 nt, Human
agugaaguggcgcaaucucggcuc

SEQ ID NO: 765612 - RNA, 23 nt, Human
auacaaaacccaaaucaugacca

SEQ ID NO: 765613 - RNA, 22 nt, Human
auagcuacagaugguaaagaaa

SEQ ID NO: 765614 - RNA, 19 nt, Human
aucaccuaagagcaaacac

SEQ ID NO: 765615 - RNA, 22 nt, Human
augccagacagccucacccaca

SEQ ID NO: 765616 - RNA, 18 nt, Human
auggggcuucacuauguu

SEQ ID NO: 765617 - RNA, 24 nt, Human
caaaaaauccauacaaaacccaaa

SEQ ID NO: 765618 - RNA, 20 nt, Human
caagaagcuggugaggggcc

SEQ ID NO: 765619 - RNA, 21 nt, Human
caagcaagaccaagagggcac

SEQ ID NO: 765620 - RNA, 21 nt, Human
cacccacaauuccagggccuc

SEQ ID NO: 765621 - RNA, 20 nt, Human
caccgaggggcugacucagg

SEQ ID NO: 765622 - RNA, 20 nt, Human
caccuaagagcaaacaccac

SEQ ID NO: 765623 - RNA, 20 nt, Human
caccuaagagcaaacaccac

SEQ ID NO: 765624 - RNA, 21 nt, Human
caccucagccccccaaggagc

SEQ ID NO: 765625 - RNA, 24 nt, Human
caccucagccccccaaggagcugg

SEQ ID NO: 765626 - RNA, 18 nt, Human
caccugccucccugcggu

SEQ ID NO: 765627 - RNA, 19 nt, Human
caccuggacgggaggcucg

SEQ ID NO: 765628 - RNA, 19 nt, Human
cacuauguugcccaggcug

SEQ ID NO: 765629 - RNA, 24 nt, Human
cacuauguugcccaggcuggccuu

SEQ ID NO: 765630 - RNA, 26 nt, Human
cacuauguugcccaggcuggccuuga

SEQ ID NO: 765631 - RNA, 23 nt, Human
cacucacccuaugccagacagcc

SEQ ID NO: 765632 - RNA, 21 nt, Human
cagcaucugaacagagccugc

SEQ ID NO: 765633 - RNA, 19 nt, Human
cagccccccaaggagcugg

SEQ ID NO: 765634 - RNA, 21 nt, Human
cagccccccaaggagcuggga

SEQ ID NO: 765635 - RNA, 20 nt, Human
cagcccucacacucacccua

SEQ ID NO: 765636 - RNA, 21 nt, Human
caggacaggggccacuccaug

SEQ ID NO: 765637 - RNA, 20 nt, Human
caggcugcagaaggcaagga

SEQ ID NO: 765638 - RNA, 18 nt, Human
caggucaaaguggaggca

SEQ ID NO: 765639 - RNA, 24 nt, Human
cauacaaaacccaaaucaugacca

SEQ ID NO: 765640 - RNA, 22 nt, Human
caugcaaaggugcagcauggag

SEQ ID NO: 765641 - RNA, 19 nt, Human
ccacacucuuuuucucucu

SEQ ID NO: 765642 - RNA, 18 nt, Human
ccagacagccucacccac

SEQ ID NO: 765643 - RNA, 21 nt, Human
ccagacagccucacccacaau

SEQ ID NO: 765644 - RNA, 24 nt, Human
cccaaggagcugggacuauaggca

SEQ ID NO: 765645 - RNA, 20 nt, Human
cccaaguuccuuuagcuucc

SEQ ID NO: 765646 - RNA, 29 nt, Human
cccagcccacacucuuuuucucucuuuuc

SEQ ID NO: 765647 - RNA, 21 nt, Human
cccaggacaggggccacucca

SEQ ID NO: 765648 - RNA, 18 nt, Human
ccccagggcuucuguggg

SEQ ID NO: 765649 - RNA, 18 nt, Human
ccccguccgccugcccgc

SEQ ID NO: 765650 - RNA, 22 nt, Human
ccccguccgccugcccgccccc

SEQ ID NO: 765651 - RNA, 22 nt, Human
ccccugcauauuuccuuagcuc

SEQ ID NO: 765652 - RNA, 19 nt, Human
cccugagucucugugaggg

SEQ ID NO: 765653 - RNA, 23 nt, Human
ccgccugcccgcccccgcccgcc

SEQ ID NO: 765654 - RNA, 24 nt, Human
ccucugggccacggcacccagccc

SEQ ID NO: 765655 - RNA, 24 nt, Human
ccuggacucaagagaucugcccuc

SEQ ID NO: 765656 - RNA, 21 nt, Human
ccuggggguuucacuuccugc

SEQ ID NO: 765657 - RNA, 18 nt, Human
ccugugacuaccaagguc

SEQ ID NO: 765658 - RNA, 22 nt, Human
cgagcggcagcaccuugucagg

SEQ ID NO: 765659 - RNA, 24 nt, Human
cgaggcuggcgaggagugaggaga

SEQ ID NO: 765660 - RNA, 19 nt, Human
cgggggcagggggagggac

SEQ ID NO: 765661 - RNA, 25 nt, Human
cgggggguggggggcagaagcugca

SEQ ID NO: 765662 - RNA, 24 nt, Human
cggguguucugggccccuucgggg

SEQ ID NO: 765663 - RNA, 25 nt, Human
cguccgccugcccgcccccgcccgc

SEQ ID NO: 765664 - RNA, 22 nt, Human
cuaaucaccuaagagcaaacac

SEQ ID NO: 765665 - RNA, 24 nt, Human
cuacaaagccccauaggacugcag

SEQ ID NO: 765666 - RNA, 18 nt, Human
cuacagcaugacccaggg

SEQ ID NO: 765667 - RNA, 21 nt, Human
cuaggcucagacaggagcuaa

SEQ ID NO: 765668 - RNA, 25 nt, Human
cucacccuaugccagacagccucac

SEQ ID NO: 765669 - RNA, 24 nt, Human
cucagaugaucuucccaccucagc

SEQ ID NO: 765670 - RNA, 24 nt, Human
cuccagacccaccugccucccugc

SEQ ID NO: 765671 - RNA, 19 nt, Human
cuccaugcuccagacccac

SEQ ID NO: 765672 - RNA, 21 nt, Human
cuccccacaguccacagaaag

SEQ ID NO: 765673 - RNA, 19 nt, Human
cucugucacccaggcugga

SEQ ID NO: 765674 - RNA, 18 nt, Human
cugacucaggauggggag

SEQ ID NO: 765675 - RNA, 20 nt, Human
cugcagaggaccccacuguc

SEQ ID NO: 765676 - RNA, 18 nt, Human
gaagaggagaaaaaaagg

SEQ ID NO: 765677 - RNA, 19 nt, Human
gaagccccguccgccugcc

SEQ ID NO: 765678 - RNA, 23 nt, Human
gaagcugcagcuaggcggugccg

SEQ ID NO: 765679 - RNA, 21 nt, Human
gacagggagggagcuggggaa

SEQ ID NO: 765680 - RNA, 19 nt, Human
gacccagggaggacgacaa

SEQ ID NO: 765681 - RNA, 19 nt, Human
gacgggggguggggggcag

SEQ ID NO: 765682 - RNA, 24 nt, Human
gacuauaggcaugugccaccaugc

SEQ ID NO: 765683 - RNA, 20 nt, Human
gacugcgggggcagggggag

SEQ ID NO: 765684 - RNA, 18 nt, Human
gagaaaaaaagggagaga

SEQ ID NO: 765685 - RNA, 24 nt, Human
gagcagagucuaggaauuuccagg

SEQ ID NO: 765686 - RNA, 18 nt, Human
gagcggcagcggccaccc

SEQ ID NO: 765687 - RNA, 21 nt, Human
gagcugaccauuuugacccug

SEQ ID NO: 765688 - RNA, 26 nt, Human
gagcuggggugagagcuagucuaggg

SEQ ID NO: 765689 - RNA, 23 nt, Human
gaggagaaaaaaagggagagaga

SEQ ID NO: 765690 - RNA, 21 nt, Human
gaggugaggacagggcaucac

SEQ ID NO: 765691 - RNA, 19 nt, Human
gcagcauggagacagcauc

SEQ ID NO: 765692 - RNA, 22 nt, Human
gcaggcaggagaggccagcacc

SEQ ID NO: 765693 - RNA, 20 nt, Human
gcauggagacagcaucugaa

SEQ ID NO: 765694 - RNA, 21 nt, Human
gcucggccuccccacagucca

SEQ ID NO: 765695 - RNA, 19 nt, Human
gcuggccuugaacuccugg

SEQ ID NO: 765696 - RNA, 21 nt, Human
ggaaagccagaagcaccugga

SEQ ID NO: 765697 - RNA, 19 nt, Human
ggacagggagggagcuggg

SEQ ID NO: 765698 - RNA, 24 nt, Human
ggacuauaggcaugugccaccaug

SEQ ID NO: 765699 - RNA, 19 nt, Human
ggagaauagggugcggggg

SEQ ID NO: 765700 - RNA, 21 nt, Human
ggagacagcaucugaacagag

SEQ ID NO: 765701 - RNA, 18 nt, Human
ggagaggaacugaaggga

SEQ ID NO: 765702 - RNA, 20 nt, Human
ggcacaguggggacacuggg

SEQ ID NO: 765703 - RNA, 18 nt, Human
ggcagaagcugcagcuag

SEQ ID NO: 765704 - RNA, 18 nt, Human
ggcgaggcuggcgaggag

SEQ ID NO: 765705 - RNA, 23 nt, Human
ggcuaggucacauuucaguccug

SEQ ID NO: 765706 - RNA, 22 nt, Human
ggcuugucucgacaacacugcc

SEQ ID NO: 765707 - RNA, 23 nt, Human
gggaaaagaaacagugagaacgc

SEQ ID NO: 765708 - RNA, 22 nt, Human
gggacgggggguggggggcaga

SEQ ID NO: 765709 - RNA, 22 nt, Human
gggaggcucgccgucucccaug

SEQ ID NO: 765710 - RNA, 21 nt, Human
gggccggacauggggacgggg

SEQ ID NO: 765711 - RNA, 20 nt, Human
ggggacgggggguggggggc

SEQ ID NO: 765712 - RNA, 22 nt, Human
ggggacgggggguggggggcag

SEQ ID NO: 765713 - RNA, 24 nt, Human
ggggaugcuggccaggcccgggag

SEQ ID NO: 765714 - RNA, 22 nt, Human
ggggcuucacuauguugcccag

SEQ ID NO: 765715 - RNA, 23 nt, Human
ggggcuucacuauguugcccagg

SEQ ID NO: 765716 - RNA, 18 nt, Human
ggggguggggggcagaag

SEQ ID NO: 765717 - RNA, 24 nt, Human
ggggguggggggcagaagcugcag

SEQ ID NO: 765718 - RNA, 21 nt, Human
ggggguuucacuuccugccag

SEQ ID NO: 765719 - RNA, 19 nt, Human
gguccccaagggugcagag

SEQ ID NO: 765720 - RNA, 24 nt, Human
ggucucugucacccaggcuggagu

SEQ ID NO: 765721 - RNA, 26 nt, Human
ggugcagcauggagacagcaucugaa

SEQ ID NO: 765722 - RNA, 20 nt, Human
guauuuuuuugcagagaugg

SEQ ID NO: 765723 - RNA, 22 nt, Human
gucaaggaagaaguggggcuca

SEQ ID NO: 765724 - RNA, 20 nt, Human
gucacagcugggacagggag

SEQ ID NO: 765725 - RNA, 21 nt, Human
gucucugucacccaggcugga

SEQ ID NO: 765726 - RNA, 25 nt, Human
gugcagcauggagacagcaucugaa

SEQ ID NO: 765727 - RNA, 18 nt, Human
guggacccaagggcuagg

SEQ ID NO: 765728 - RNA, 20 nt, Human
uaagacccuuucccuacagc

SEQ ID NO: 765729 - RNA, 24 nt, Human
uacaaaacccaaaucaugaccagg

SEQ ID NO: 765730 - RNA, 19 nt, Human
uacaacagggaccuugaaa

SEQ ID NO: 765731 - RNA, 18 nt, Human
uagucuagggcucccaca

SEQ ID NO: 765732 - RNA, 18 nt, Human
uauggaccaaaggaacag

SEQ ID NO: 765733 - RNA, 19 nt, Human
uauguugcccaggcuggcc

SEQ ID NO: 765734 - RNA, 22 nt, Human
uauguugcccaggcuggccuug

SEQ ID NO: 765735 - RNA, 24 nt, Human
uauguugcccaggcuggccuugaa

SEQ ID NO: 765736 - RNA, 22 nt, Human
ucaaugccugucugcccagggg

SEQ ID NO: 765737 - RNA, 21 nt, Human
ucacaacuucuccaagcaaga

SEQ ID NO: 765738 - RNA, 21 nt, Human
ucacccaggcuggagugaagu

SEQ ID NO: 765739 - RNA, 20 nt, Human
ucagaugaucuucccaccuu

SEQ ID NO: 765740 - RNA, 18 nt, Human
ucagccccccaaggagcu

SEQ ID NO: 765741 - RNA, 18 nt, Human
ucagccccccaaggagcu

SEQ ID NO: 765742 - RNA, 20 nt, Human
ucagccccccaaggagcugg

SEQ ID NO: 765743 - RNA, 19 nt, Human
uccacagaaaggacagguc

SEQ ID NO: 765744 - RNA, 22 nt, Human
uccacagaaaggacagguccac

SEQ ID NO: 765745 - RNA, 24 nt, Human
ucccaccucagccccccaaggagc

SEQ ID NO: 765746 - RNA, 26 nt, Human
ucccucaucgcugccccugguuucug

SEQ ID NO: 765747 - RNA, 18 nt, Human
ucccugaaugcccaaguu

SEQ ID NO: 765748 - RNA, 22 nt, Human
ucccugcggugacagucagccu

SEQ ID NO: 765749 - RNA, 22 nt, Human
ucccuggggguuucacuuccug

SEQ ID NO: 765750 - RNA, 21 nt, Human
uccgccugcccgcccccgccc

SEQ ID NO: 765751 - RNA, 21 nt, Human
uccuaagacccuuucccuaca

SEQ ID NO: 765752 - RNA, 21 nt, Human
uccuggauaccagaggggccc

SEQ ID NO: 765753 - RNA, 22 nt, Human
ucggccuccccacaguccacag

SEQ ID NO: 765754 - RNA, 18 nt, Human
ucuccuucuccuaggcug

SEQ ID NO: 765755 - RNA, 21 nt, Human
ucucggcucacugcugccucg

SEQ ID NO: 765756 - RNA, 19 nt, Human
ucucggguguucugggccc

SEQ ID NO: 765757 - RNA, 22 nt, Human
ucucggguguucugggccccuu

SEQ ID NO: 765758 - RNA, 21 nt, Human
ucucugggcgcaggagggccc

SEQ ID NO: 765759 - RNA, 23 nt, Human
ucucugucacccaggcuggagug

SEQ ID NO: 765760 - RNA, 24 nt, Human
ucucugucacccaggcuggaguga

SEQ ID NO: 765761 - RNA, 22 nt, Human
ucuggcacaguggggacacugg

SEQ ID NO: 765762 - RNA, 25 nt, Human
ucuggcacaguggggacacuggaac

SEQ ID NO: 765763 - RNA, 22 nt, Human
ucugucacccaggcuggaguga

SEQ ID NO: 765764 - RNA, 22 nt, Human
ugaaggggugaggaauaacaca

SEQ ID NO: 765765 - RNA, 23 nt, Human
ugaaguggcgcaaucucggcuca

SEQ ID NO: 765766 - RNA, 22 nt, Human
ugacugcgggggcagggggagg

SEQ ID NO: 765767 - RNA, 19 nt, Human
ugagcugaggagaggcuug

SEQ ID NO: 765768 - RNA, 22 nt, Human
ugagcugaggagaggcuugucu

SEQ ID NO: 765769 - RNA, 24 nt, Human
ugaggacagggcaucacuaggcuc

SEQ ID NO: 765770 - RNA, 23 nt, Human
ugaucuucccaccucagcccccc

SEQ ID NO: 765771 - RNA, 24 nt, Human
ugcagagauggggcuucacuaugu

SEQ ID NO: 765772 - RNA, 21 nt, Human
ugcagccaggucaaaguggag

SEQ ID NO: 765773 - RNA, 22 nt, Human
ugcaugcagggccccagggccg

SEQ ID NO: 765774 - RNA, 19 nt, Human
ugccaccaugcccagcuau

SEQ ID NO: 765775 - RNA, 26 nt, Human
ugccagacagccucacccacaauucc

SEQ ID NO: 765776 - RNA, 24 nt, Human
ugcccagcuauuuuuuuguauuuu

SEQ ID NO: 765777 - RNA, 24 nt, Human
ugcccaggcuggccuugaacuccu

SEQ ID NO: 765778 - RNA, 18 nt, Human
ugccucagaaccuggcag

SEQ ID NO: 765779 - RNA, 22 nt, Human
ugccucagaaccuggcagaagc

SEQ ID NO: 765780 - RNA, 18 nt, Human
ugcuccagacccaccugc

SEQ ID NO: 765781 - RNA, 27 nt, Human
uggaacccuucuguggggccggacuca

SEQ ID NO: 765782 - RNA, 18 nt, Human
uggaagaccagugggucu

SEQ ID NO: 765783 - RNA, 18 nt, Human
uggaagcagaggugagga

SEQ ID NO: 765784 - RNA, 19 nt, Human
uggaagcagaggugaggac

SEQ ID NO: 765785 - RNA, 24 nt, Human
uggagugaaguggcgcaaucucgg

SEQ ID NO: 765786 - RNA, 21 nt, Human
uggauaccagaggggccccag

SEQ ID NO: 765787 - RNA, 23 nt, Human
uggcagcaggcuggcgaggcugg

SEQ ID NO: 765788 - RNA, 23 nt, Human
uggccaacaggcugaagcagugg

SEQ ID NO: 765789 - RNA, 19 nt, Human
uggcuugaugggcauuuuc

SEQ ID NO: 765790 - RNA, 23 nt, Human
ugggaagaggagaaaaaaaggga

SEQ ID NO: 765791 - RNA, 18 nt, Human
ugggacuauaggcaugug

SEQ ID NO: 765792 - RNA, 21 nt, Human
ugggacuauaggcaugugcca

SEQ ID NO: 765793 - RNA, 22 nt, Human
ugggacuauaggcaugugccac

SEQ ID NO: 765794 - RNA, 24 nt, Human
ugggacuauaggcaugugccacca

SEQ ID NO: 765795 - RNA, 23 nt, Human
uggggaagguggaagaccagugg

SEQ ID NO: 765796 - RNA, 24 nt, Human
uggggaagguggaagaccaguggg

SEQ ID NO: 765797 - RNA, 24 nt, Human
uggggcuucacuauguugcccagg

SEQ ID NO: 765798 - RNA, 21 nt, Human
ugguaaagaaaugucagggca

SEQ ID NO: 765799 - RNA, 21 nt, Human
ugucacccaggcuggagugaa

SEQ ID NO: 765800 - RNA, 19 nt, Human
ugugagggacucagaggcu

SEQ ID NO: 765801 - RNA, 19 nt, Human
uguggaggagucacagcug

SEQ ID NO: 765802 - RNA, 20 nt, Human
uguggggaacccagaagccg

SEQ ID NO: 765803 - RNA, 21 nt, Human
ugugugcccaggcacagggca

SEQ ID NO: 765804 - RNA, 21 nt, Human
uuccagggccucugggcugcu

SEQ ID NO: 765805 - RNA, 25 nt, Human
uucccaccucagccccccaaggagc

SEQ ID NO: 765806 - RNA, 26 nt, Human
uuucaaaaaauccauacaaaacccaa

SEQ ID NO: 765807 - RNA, 24 nt, Human
uuuuucucucuuuucaaaaaaucc

SEQ ID NO: 765808 - RNA, 22 nt, Human
uuuuuuguauuuuuuugcagag

SEQ ID NO: 765809 - RNA, 25 nt, Human
uuuuuuguauuuuuuugcagagaug

SEQ ID NO: 765810 - RNA, 22 nt, Human
aaacagcuccuggagcucccca

SEQ ID NO: 765811 - RNA, 25 nt, Human
aaagcaccuccaccucuccucacug

SEQ ID NO: 765812 - RNA, 24 nt, Human
aaaugcccccuaggugcugggggc

SEQ ID NO: 765813 - RNA, 21 nt, Human
aacagcuccuggagcucccca

SEQ ID NO: 765814 - RNA, 24 nt, Human
aacaguucuucucuccuggccuuc

SEQ ID NO: 765815 - RNA, 19 nt, Human
aagcagcucuuuaagccuc

SEQ ID NO: 765816 - RNA, 23 nt, Human
aagccccgucccuccccgcccag

SEQ ID NO: 765817 - RNA, 19 nt, Human
aaucccauccuccccccuc

SEQ ID NO: 765818 - RNA, 21 nt, Human
agagccguccccucggccccc

SEQ ID NO: 765819 - RNA, 19 nt, Human
agaggggagggaauggagu

SEQ ID NO: 765820 - RNA, 25 nt, Human
aggaagaagggauggagaaaccugg

SEQ ID NO: 765821 - RNA, 20 nt, Human
aggcaugcaccacugcaccc

SEQ ID NO: 765822 - RNA, 21 nt, Human
agggagaggcaaacucccaaa

SEQ ID NO: 765823 - RNA, 21 nt, Human
aguagcugggacuacaggcau

SEQ ID NO: 765824 - RNA, 24 nt, Human
agugcaguugugugaucacgacuc

SEQ ID NO: 765825 - RNA, 22 nt, Human
agugccgcucggccgaccgccc

SEQ ID NO: 765826 - RNA, 24 nt, Human
aucccauccuccccccucccccca

SEQ ID NO: 765827 - RNA, 26 nt, Human
aucccauccuccccccuccccccauu

SEQ ID NO: 765828 - RNA, 19 nt, Human
auccuggucccuccagucc

SEQ ID NO: 765829 - RNA, 19 nt, Human
augcaccacugcacccagc

SEQ ID NO: 765830 - RNA, 23 nt, Human
augggguuucgccauguuggcca

SEQ ID NO: 765831 - RNA, 24 nt, Human
augggguuucgccauguuggccag

SEQ ID NO: 765832 - RNA, 19 nt, Human
caaaacagcuuuugcaggc

SEQ ID NO: 765833 - RNA, 25 nt, Human
caaauucucuuuuguggugggaggc

SEQ ID NO: 765834 - RNA, 18 nt, Human
caagccccgucccucccc

SEQ ID NO: 765835 - RNA, 18 nt, Human
caaguuggggauguggcu

SEQ ID NO: 765836 - RNA, 24 nt, Human
cacacaggccuaagggaggggcac

SEQ ID NO: 765837 - RNA, 19 nt, Human
caccccguuuucauuucuc

SEQ ID NO: 765838 - RNA, 22 nt, Human
caccuagaggggcgcuccagag

SEQ ID NO: 765839 - RNA, 21 nt, Human
caccuggaaccuuggccaagu

SEQ ID NO: 765840 - RNA, 24 nt, Human
cacugcacccagcuaauuuuugua

SEQ ID NO: 765841 - RNA, 22 nt, Human
cagagaugggguuucgccaugu

SEQ ID NO: 765842 - RNA, 22 nt, Human
cagcaauagggagcugugucag

SEQ ID NO: 765843 - RNA, 19 nt, Human
cagcagaaaaaggcgugcc

SEQ ID NO: 765844 - RNA, 22 nt, Human
cagcagaaaaaggcgugccaua

SEQ ID NO: 765845 - RNA, 26 nt, Human
cagcagaaaaaggcgugccauacaca

SEQ ID NO: 765846 - RNA, 18 nt, Human
cagccucggucuccccaa

SEQ ID NO: 765847 - RNA, 20 nt, Human
cagcgcccuccgcgcaggga

SEQ ID NO: 765848 - RNA, 22 nt, Human
cagcuacucagcucaccccggu

SEQ ID NO: 765849 - RNA, 18 nt, Human
cagcucaaaaugcccccu

SEQ ID NO: 765850 - RNA, 21 nt, Human
cagcuccuggagcuccccaac

SEQ ID NO: 765851 - RNA, 20 nt, Human
cagucuccugaguagcuggg

SEQ ID NO: 765852 - RNA, 20 nt, Human
caugcaccacugcacccagc

SEQ ID NO: 765853 - RNA, 24 nt, Human
cauguuggccaggcuggucucaaa

SEQ ID NO: 765854 - RNA, 24 nt, Human
cauuggagaaagagcuuccagcug

SEQ ID NO: 765855 - RNA, 20 nt, Human
ccaaaugcugggauuauagu

SEQ ID NO: 765856 - RNA, 23 nt, Human
ccaaaugcugggauuauagucau

SEQ ID NO: 765857 - RNA, 18 nt, Human
ccaccaaggcgcaagccc

SEQ ID NO: 765858 - RNA, 18 nt, Human
ccacugcacccagcuaau

SEQ ID NO: 765859 - RNA, 22 nt, Human
ccagagagcccuaccccuugcc

SEQ ID NO: 765860 - RNA, 25 nt, Human
ccagagagcccuaccccuugcccag

SEQ ID NO: 765861 - RNA, 20 nt, Human
ccaggguucaaacaauucuc

SEQ ID NO: 765862 - RNA, 26 nt, Human
ccaucugagguauccuguggcuuggg

SEQ ID NO: 765863 - RNA, 20 nt, Human
ccauggagaucccaggagaa

SEQ ID NO: 765864 - RNA, 19 nt, Human
ccauguuggccaggcuggu

SEQ ID NO: 765865 - RNA, 22 nt, Human
ccauguuggccaggcuggucuc

SEQ ID NO: 765866 - RNA, 24 nt, Human
cccaaccccaaggcuccucacgau

SEQ ID NO: 765867 - RNA, 19 nt, Human
cccaccccuuggaggaggc

SEQ ID NO: 765868 - RNA, 23 nt, Human
ccccaaagcaccuccaccucucc

SEQ ID NO: 765869 - RNA, 20 nt, Human
ccccaaccccaaggcuccuc

SEQ ID NO: 765870 - RNA, 22 nt, Human
ccccaggaaaucgucagauucc

SEQ ID NO: 765871 - RNA, 18 nt, Human
ccccauggagaucccagg

SEQ ID NO: 765872 - RNA, 21 nt, Human
cccgaucucagcccacccuuc

SEQ ID NO: 765873 - RNA, 24 nt, Human
cccgccucagucuccugaguagcu

SEQ ID NO: 765874 - RNA, 20 nt, Human
cccuaagguccuaugugcac

SEQ ID NO: 765875 - RNA, 18 nt, Human
ccgcgcaggcgcagugcc

SEQ ID NO: 765876 - RNA, 21 nt, Human
ccucaaguuggggauguggcu

SEQ ID NO: 765877 - RNA, 22 nt, Human
ccuccaaccagcauccuggucc

SEQ ID NO: 765878 - RNA, 26 nt, Human
ccuccagaaacccagcuacucagcuc

SEQ ID NO: 765879 - RNA, 24 nt, Human
ccuccaggguucaaacaauucucc

SEQ ID NO: 765880 - RNA, 25 nt, Human
ccuccgcgcaggcgcagugccgcuc

SEQ ID NO: 765881 - RNA, 24 nt, Human
ccucggucuccccaaaugcuggga

SEQ ID NO: 765882 - RNA, 23 nt, Human
ccucucauucuucaccucggaaa

SEQ ID NO: 765883 - RNA, 23 nt, Human
ccugaguagcugggacuacaggc

SEQ ID NO: 765884 - RNA, 24 nt, Human
ccugaguagcugggacuacaggca

SEQ ID NO: 765885 - RNA, 25 nt, Human
ccuggaaccuuggccaagucucaag

SEQ ID NO: 765886 - RNA, 20 nt, Human
ccuugcccagggcccccccu

SEQ ID NO: 765887 - RNA, 24 nt, Human
cgccauguuggccaggcuggucuc

SEQ ID NO: 765888 - RNA, 23 nt, Human
cgccucagucuccugaguagcug

SEQ ID NO: 765889 - RNA, 24 nt, Human
cgccucagucuccugaguagcugg

SEQ ID NO: 765890 - RNA, 24 nt, Human
cgguaccagagccccgggaugugg

SEQ ID NO: 765891 - RNA, 25 nt, Human
cgugccauacacacauguggaaaag

SEQ ID NO: 765892 - RNA, 23 nt, Human
cuaauuuuuguauuuuuagcaga

SEQ ID NO: 765893 - RNA, 24 nt, Human
cuacaaccucugccuccaggguuc

SEQ ID NO: 765894 - RNA, 19 nt, Human
cucaaaaugcccccuaggu

SEQ ID NO: 765895 - RNA, 24 nt, Human
cucagucuccugaguagcugggac

SEQ ID NO: 765896 - RNA, 20 nt, Human
cuccagccgugccacccuuc

SEQ ID NO: 765897 - RNA, 20 nt, Human
cuccccaaccccaaggcucc

SEQ ID NO: 765898 - RNA, 23 nt, Human
cuccccaacuuaaaacagcuccc

SEQ ID NO: 765899 - RNA, 24 nt, Human
cuccccccauuuauuuuuugcaca

SEQ ID NO: 765900 - RNA, 20 nt, Human
cuccccgcccagcgcccucc

SEQ ID NO: 765901 - RNA, 20 nt, Human
cuguguuuguguuucucucu

SEQ ID NO: 765902 - RNA, 18 nt, Human
cuucugcagaucucccca

SEQ ID NO: 765903 - RNA, 23 nt, Human
cuucugcagaucuccccaacccc

SEQ ID NO: 765904 - RNA, 22 nt, Human
cuuggcaauuggucuggggucc

SEQ ID NO: 765905 - RNA, 24 nt, Human
gaccuuaagugaucugccagccuc

SEQ ID NO: 765906 - RNA, 23 nt, Human
gacuacaggcaugcaccacugca

SEQ ID NO: 765907 - RNA, 20 nt, Human
gagaugggguuucgccaugu

SEQ ID NO: 765908 - RNA, 24 nt, Human
gagaugggguuucgccauguuggc

SEQ ID NO: 765909 - RNA, 20 nt, Human
gaggggcacagaggguaugg

SEQ ID NO: 765910 - RNA, 20 nt, Human
gaguagcugggacuacaggc

SEQ ID NO: 765911 - RNA, 24 nt, Human
gaguagcugggacuacaggcaugc

SEQ ID NO: 765912 - RNA, 23 nt, Human
gcacagaggguauggcaccugga

SEQ ID NO: 765913 - RNA, 25 nt, Human
gccauguuggccaggcuggucucaa

SEQ ID NO: 765914 - RNA, 19 nt, Human
gcccaggcuggagugcagu

SEQ ID NO: 765915 - RNA, 21 nt, Human
gccccccgagccccgccccug

SEQ ID NO: 765916 - RNA, 24 nt, Human
gccucagucuccugaguagcuggg

SEQ ID NO: 765917 - RNA, 24 nt, Human
gccucggucuccccaaaugcuggg

SEQ ID NO: 765918 - RNA, 18 nt, Human
ggagggaauggaguauug

SEQ ID NO: 765919 - RNA, 21 nt, Human
ggaggggcacagaggguaugg

SEQ ID NO: 765920 - RNA, 21 nt, Human
ggcgugccauacacacaugug

SEQ ID NO: 765921 - RNA, 23 nt, Human
ggcuggucucaaacuccugaccu

SEQ ID NO: 765922 - RNA, 23 nt, Human
gggcaaagguccugcuuggcagc

SEQ ID NO: 765923 - RNA, 24 nt, Human
ggggcauccuccauuccuaauucc

SEQ ID NO: 765924 - RNA, 22 nt, Human
gggguuucgccauguuggccag

SEQ ID NO: 765925 - RNA, 23 nt, Human
ggguauggcaccuggaaccuugg

SEQ ID NO: 765926 - RNA, 22 nt, Human
ggguuucgccauguuggccagg

SEQ ID NO: 765927 - RNA, 18 nt, Human
gguagaggggagggaaug

SEQ ID NO: 765928 - RNA, 24 nt, Human
gucuuggccuggaauucccacccc

SEQ ID NO: 765929 - RNA, 24 nt, Human
gugaucugccagccucggucuccc

SEQ ID NO: 765930 - RNA, 21 nt, Human
guggccucccgagagggcggg

SEQ ID NO: 765931 - RNA, 18 nt, Human
uaaaacagcuccuggagc

SEQ ID NO: 765932 - RNA, 25 nt, Human
uaaaacagcuccuggagcuccccaa

SEQ ID NO: 765933 - RNA, 21 nt, Human
uaaaaguaaaacuccucagga

SEQ ID NO: 765934 - RNA, 24 nt, Human
uaauuuuuguauuuuuagcagaga

SEQ ID NO: 765935 - RNA, 24 nt, Human
uacaggcaugcaccacugcaccca

SEQ ID NO: 765936 - RNA, 24 nt, Human
uagcagagaugggguuucgccaug

SEQ ID NO: 765937 - RNA, 25 nt, Human
uagcagcaauagggagcugugucag

SEQ ID NO: 765938 - RNA, 24 nt, Human
uaggugucuuuucaacacagccuu

SEQ ID NO: 765939 - RNA, 23 nt, Human
uauuguucuguugcccaggcugg

SEQ ID NO: 765940 - RNA, 24 nt, Human
uauuguucuguugcccaggcugga

SEQ ID NO: 765941 - RNA, 23 nt, Human
uauuuggaaaauucuggaaaagg

SEQ ID NO: 765942 - RNA, 23 nt, Human
ucacuacaaccucugccuccagg

SEQ ID NO: 765943 - RNA, 24 nt, Human
ucacuacaaccucugccuccaggg

SEQ ID NO: 765944 - RNA, 25 nt, Human
ucacuacaaccucugccuccagggu

SEQ ID NO: 765945 - RNA, 26 nt, Human
ucacuacaaccucugccuccaggguu

SEQ ID NO: 765946 - RNA, 24 nt, Human
ucagaaucuuuccaagaauccauu

SEQ ID NO: 765947 - RNA, 22 nt, Human
ucagcccacccuuccauggggc

SEQ ID NO: 765948 - RNA, 23 nt, Human
ucagucuccugaguagcugggac

SEQ ID NO: 765949 - RNA, 22 nt, Human
ucaguuuugccaucugucaaau

SEQ ID NO: 765950 - RNA, 26 nt, Human
uccagccaggucacuguaacuuugcu

SEQ ID NO: 765951 - RNA, 19 nt, Human
uccccaaaugcugggauua

SEQ ID NO: 765952 - RNA, 18 nt, Human
uccccaaccccaaggcuc

SEQ ID NO: 765953 - RNA, 19 nt, Human
uccccaggccuggagcucu

SEQ ID NO: 765954 - RNA, 24 nt, Human
ucccccuugcuggcucagcuccag

SEQ ID NO: 765955 - RNA, 21 nt, Human
uccccgcccagcgcccuccgc

SEQ ID NO: 765956 - RNA, 24 nt, Human
uccugaguagcugggacuacaggc

SEQ ID NO: 765957 - RNA, 24 nt, Human
ucgcacgugcuguuccccaggccu

SEQ ID NO: 765958 - RNA, 22 nt, Human
ucgccauguuggccaggcuggu

SEQ ID NO: 765959 - RNA, 24 nt, Human
ucgccauguuggccaggcuggucu

SEQ ID NO: 765960 - RNA, 23 nt, Human
ucuaguaagugguucccucucau

SEQ ID NO: 765961 - RNA, 23 nt, Human
ucucaagcagcucuuuaagccuc

SEQ ID NO: 765962 - RNA, 24 nt, Human
ucugccuccaggguucaaacaauu

SEQ ID NO: 765963 - RNA, 23 nt, Human
ucuggucuccuucuguucuuucc

SEQ ID NO: 765964 - RNA, 18 nt, Human
ucuguugcccaggcugga

SEQ ID NO: 765965 - RNA, 19 nt, Human
ucuguugcccaggcuggag

SEQ ID NO: 765966 - RNA, 24 nt, Human
ucuuucucucauucucuuucuccc

SEQ ID NO: 765967 - RNA, 18 nt, Human
ugaccuuaagugaucugc

SEQ ID NO: 765968 - RNA, 24 nt, Human
ugaccuuaagugaucugccagccu

SEQ ID NO: 765969 - RNA, 23 nt, Human
ugaucacgacucacuacaaccuc

SEQ ID NO: 765970 - RNA, 24 nt, Human
ugaucugccagccucggucucccc

SEQ ID NO: 765971 - RNA, 18 nt, Human
ugcccaggcuggagugca

SEQ ID NO: 765972 - RNA, 20 nt, Human
ugcccaggcuggagugcagu

SEQ ID NO: 765973 - RNA, 24 nt, Human
ugcccaggcuggagugcaguugug

SEQ ID NO: 765974 - RNA, 18 nt, Human
ugcccagggcccccccuc

SEQ ID NO: 765975 - RNA, 19 nt, Human
uggaauccagucucucccc

SEQ ID NO: 765976 - RNA, 18 nt, Human
uggaggaggccgaggggg

SEQ ID NO: 765977 - RNA, 19 nt, Human
uggagugcaguugugugau

SEQ ID NO: 765978 - RNA, 19 nt, Human
uggagugcaguugugugau

SEQ ID NO: 765979 - RNA, 19 nt, Human
uggccaagucucaagcagc

SEQ ID NO: 765980 - RNA, 24 nt, Human
uggccaggcuggucucaaacuccu

SEQ ID NO: 765981 - RNA, 20 nt, Human
uggccuggaauucccacccc

SEQ ID NO: 765982 - RNA, 21 nt, Human
uggcguggagccccccgagcc

SEQ ID NO: 765983 - RNA, 23 nt, Human
ugggaccaggggaucccaaauuc

SEQ ID NO: 765984 - RNA, 21 nt, Human
ugggacuacaggcaugcacca

SEQ ID NO: 765985 - RNA, 24 nt, Human
ugggacuacaggcaugcaccacug

SEQ ID NO: 765986 - RNA, 24 nt, Human
ugggacuacaggcaugcaccacug

SEQ ID NO: 765987 - RNA, 19 nt, Human
uggggcacacaggccuaag

SEQ ID NO: 765988 - RNA, 21 nt, Human
uggggcacacaggccuaaggg

SEQ ID NO: 765989 - RNA, 18 nt, Human
ugggggcguggccucaag

SEQ ID NO: 765990 - RNA, 24 nt, Human
ugggguuucgccauguuggccagg

SEQ ID NO: 765991 - RNA, 21 nt, Human
uguauuuuuagcagagauggg

SEQ ID NO: 765992 - RNA, 23 nt, Human
ugucuuuucaacacagccuucag

SEQ ID NO: 765993 - RNA, 21 nt, Human
uguggcuuggguguuugaauc

SEQ ID NO: 765994 - RNA, 18 nt, Human
ugugucacuguguuugug

SEQ ID NO: 765995 - RNA, 19 nt, Human
uguguuuguguuucucucu

SEQ ID NO: 765996 - RNA, 21 nt, Human
uguugcccaggcuggagugca

SEQ ID NO: 765997 - RNA, 18 nt, Human
uuagcagagaugggguuu

SEQ ID NO: 765998 - RNA, 22 nt, Human
uuagcagagaugggguuucgcc

SEQ ID NO: 765999 - RNA, 24 nt, Human
uuagcagagaugggguuucgccau

SEQ ID NO: 766000 - RNA, 24 nt, Human
uucaaacaauucucccgccucagu

SEQ ID NO: 766001 - RNA, 26 nt, Human
uucaccucggaaagccuccccaucug

SEQ ID NO: 766002 - RNA, 28 nt, Human
uucaguguccccaaagcaccuccaccuc

SEQ ID NO: 766003 - RNA, 25 nt, Human
uucucuuucuccccccuagaguuuc

SEQ ID NO: 766004 - RNA, 24 nt, Human
uugaaaucccauccuccccccucc

SEQ ID NO: 766005 - RNA, 22 nt, Human
uugcccaggcuggagugcaguu

SEQ ID NO: 766006 - RNA, 24 nt, Human
uugcuggcucagcuccagccgugc

SEQ ID NO: 766007 - RNA, 23 nt, Human
uuguauuuuuagcagagaugggg

SEQ ID NO: 766008 - RNA, 21 nt, Human
uuguucuguugcccaggcugg

SEQ ID NO: 766009 - RNA, 22 nt, Human
uuguucuguugcccaggcugga

SEQ ID NO: 766010 - RNA, 24 nt, Human
uuguucuguugcccaggcuggagu

SEQ ID NO: 766011 - RNA, 24 nt, Human
uuucgccauguuggccaggcuggu

SEQ ID NO: 766012 - RNA, 25 nt, Human
uuucuggucuccuucuguucuuucc

SEQ ID NO: 766013 - RNA, 23 nt, Human
uuuuuagcagagaugggguuucg

SEQ ID NO: 766014 - RNA, 24 nt, Human
uuuuuagcagagaugggguuucgc

SEQ ID NO: 766015 - RNA, 20 nt, Human
uuuuuguauuuuuagcagag

SEQ ID NO: 766016 - RNA, 23 nt, Human
uuuuuguauuuuuagcagagaug

SEQ ID NO: 766017 - RNA, 22 nt, Human
aaagucuacccaaaccaucacu

SEQ ID NO: 766018 - RNA, 21 nt, Human
aacagcuugcugggcacaaaa

SEQ ID NO: 766019 - RNA, 18 nt, Human
aaccaaaauagaagugaa

SEQ ID NO: 766020 - RNA, 22 nt, Human
aacuguagguauccagggaguc

SEQ ID NO: 766021 - RNA, 19 nt, Human
aagaaaaacagagaaaaca

SEQ ID NO: 766022 - RNA, 19 nt, Human
aagaaaccugaguuuggau

SEQ ID NO: 766023 - RNA, 19 nt, Human
aagcaauguaaacuaguua

SEQ ID NO: 766024 - RNA, 21 nt, Human
aagucuacccaaaccaucacc

SEQ ID NO: 766025 - RNA, 21 nt, Human
aaguuuucugugaacuuaaaa

SEQ ID NO: 766026 - RNA, 19 nt, Human
accccacucaagugaggua

SEQ ID NO: 766027 - RNA, 19 nt, Human
accccggcgccucccacag

SEQ ID NO: 766028 - RNA, 19 nt, Human
agaagaaaaacagagaaaa

SEQ ID NO: 766029 - RNA, 21 nt, Human
agaagaaaaacagagaaaaca

SEQ ID NO: 766030 - RNA, 27 nt, Human
agacaaaugcaauagaaaaaaaucaag

SEQ ID NO: 766031 - RNA, 21 nt, Human
agcccuguugcucugcaguuu

SEQ ID NO: 766032 - RNA, 21 nt, Human
agcuggaaucaaagaauaaug

SEQ ID NO: 766033 - RNA, 21 nt, Human
aggaaaaauaauugucuguca

SEQ ID NO: 766034 - RNA, 19 nt, Human
aguaagugauguaucuugc

SEQ ID NO: 766035 - RNA, 24 nt, Human
auacugaagcccuguugcucugca

SEQ ID NO: 766036 - RNA, 23 nt, Human
augcaagaucauuaauauaaaca

SEQ ID NO: 766037 - RNA, 24 nt, Human
auuaaguuuucugugaacuuaaaa

SEQ ID NO: 766038 - RNA, 26 nt, Human
auuacaaauauuaaaugccuuuaauc

SEQ ID NO: 766039 - RNA, 19 nt, Human
auugggggaaaaggaaaac

SEQ ID NO: 766040 - RNA, 23 nt, Human
caaacagggcauuguacacccau

SEQ ID NO: 766041 - RNA, 22 nt, Human
caaagaucuaugcaaauacaaa

SEQ ID NO: 766042 - RNA, 21 nt, Human
caaauagaaacaucuuguacc

SEQ ID NO: 766043 - RNA, 21 nt, Human
caccauuuaaauucguuucca

SEQ ID NO: 766044 - RNA, 20 nt, Human
caccccggcgccucccacag

SEQ ID NO: 766045 - RNA, 19 nt, Human
cagagaaguuagagaagaa

SEQ ID NO: 766046 - RNA, 19 nt, Human
ccagagaugugacccagga

SEQ ID NO: 766047 - RNA, 19 nt, Human
cccacucaagugagguaac

SEQ ID NO: 766048 - RNA, 24 nt, Human
cccuaaccaguaaguacaaacagg

SEQ ID NO: 766049 - RNA, 26 nt, Human
ccggcgccucccacagacacagcccc

SEQ ID NO: 766050 - RNA, 22 nt, Human
ccucccacagacacagccccaa

SEQ ID NO: 766051 - RNA, 21 nt, Human
cuucaggcucauuccuuuugu

SEQ ID NO: 766052 - RNA, 23 nt, Human
gaacugacaauguuauggugagu

SEQ ID NO: 766053 - RNA, 21 nt, Human
gaagaaaaacagagaaaacaa

SEQ ID NO: 766054 - RNA, 21 nt, Human
gauucucuucuaguaacaauu

SEQ ID NO: 766055 - RNA, 22 nt, Human
gcagugacauuauuuugaccua

SEQ ID NO: 766056 - RNA, 25 nt, Human
gcuggcaaguuacccugacccuaac

SEQ ID NO: 766057 - RNA, 19 nt, Human
gggaaaaggaaaaccccac

SEQ ID NO: 766058 - RNA, 23 nt, Human
uaaaaaaaaagucuacccaaacc

SEQ ID NO: 766059 - RNA, 26 nt, Human
uaaaacaaacgcucacauuaauuuuu

SEQ ID NO: 766060 - RNA, 19 nt, Human
uacaguaugucugaaaaaa

SEQ ID NO: 766061 - RNA, 19 nt, Human
uagaacugacaauguuaug

SEQ ID NO: 766062 - RNA, 21 nt, Human
uaugaaaugacgaauuugaua

SEQ ID NO: 766063 - RNA, 26 nt, Human
uccaaagaaauguuuagcagacaaau

SEQ ID NO: 766064 - RNA, 23 nt, Human
uccacuggcaaaaguuuuaacaa

SEQ ID NO: 766065 - RNA, 25 nt, Human
uccaggcaaaaauccaauuuuaaaa

SEQ ID NO: 766066 - RNA, 22 nt, Human
ucuugggcuggcaaguuacccu

SEQ ID NO: 766067 - RNA, 19 nt, Human
ugaaaguagagccuuugga

SEQ ID NO: 766068 - RNA, 19 nt, Human
ugaauauacugaagcccug

SEQ ID NO: 766069 - RNA, 28 nt, Human
ugacccaggaaacaauucaucaauaggg

SEQ ID NO: 766070 - RNA, 22 nt, Human
ugaguuuggauguagaaauaau

SEQ ID NO: 766071 - RNA, 22 nt, Human
ugccuucaaccaaaauagaagu

SEQ ID NO: 766072 - RNA, 18 nt, Human
uggaaacagaaugaacuu

SEQ ID NO: 766073 - RNA, 23 nt, Human
ugggcacaaaauuuacucaaaau

SEQ ID NO: 766074 - RNA, 19 nt, Human
uguaaacuaguuauaaaau

SEQ ID NO: 766075 - RNA, 19 nt, Human
uguaaagguaucacuuuau

SEQ ID NO: 766076 - RNA, 19 nt, Human
uguagggauaaugaacaca

SEQ ID NO: 766077 - RNA, 19 nt, Human
ugucugucauuuucuucuc

SEQ ID NO: 766078 - RNA, 20 nt, Human
uucaaccaaaauagaaguga

SEQ ID NO: 766079 - RNA, 23 nt, Human
uucaaccaaaauagaagugaagc

SEQ ID NO: 766080 - RNA, 25 nt, Human
uucagagaaguuagagaagaaaaac

SEQ ID NO: 766081 - RNA, 20 nt, Human
uuguaaagguaucacuuuau

SEQ ID NO: 766082 - RNA, 27 nt, Human
uuuaaacuuuugucuucauuguaaagg

SEQ ID NO: 766083 - RNA, 21 nt, Human
aaaaaaaaaaaaucagggaca

SEQ ID NO: 766084 - RNA, 26 nt, Human
aaaaaaaaaaauccaaccauguggga

SEQ ID NO: 766085 - RNA, 25 nt, Human
aaaaaaaaaauccaaccauguggga

SEQ ID NO: 766086 - RNA, 21 nt, Human
aaaaaaacagcaacaacaaac

SEQ ID NO: 766087 - RNA, 25 nt, Human
aaaaaaacccaaaaacaaaaacaaa

SEQ ID NO: 766088 - RNA, 23 nt, Human
aaaaaacaaaaagacaaaaaaac

SEQ ID NO: 766089 - RNA, 21 nt, Human
aaaaaacccaaaaacaaaaac

SEQ ID NO: 766090 - RNA, 30 nt, Human
aaaaacaaaacagacauaaaaagacaaaaa

SEQ ID NO: 766091 - RNA, 21 nt, Human
aaaaagacaaaaaaacagcaa

SEQ ID NO: 766092 - RNA, 26 nt, Human
aaaaagccaaagcgacucacugugaa

SEQ ID NO: 766093 - RNA, 19 nt, Human
aaaacaaaaacaaaaaaca

SEQ ID NO: 766094 - RNA, 22 nt, Human
aaaacaaaaagacaaaaaaaca

SEQ ID NO: 766095 - RNA, 18 nt, Human
aaaacagacauaaaaaga

SEQ ID NO: 766096 - RNA, 18 nt, Human
aaaagacaaaaaaacagc

SEQ ID NO: 766097 - RNA, 26 nt, Human
aaaagacaaaaaaacagcaacaacaa

SEQ ID NO: 766098 - RNA, 26 nt, Human
aaacaaaaacaaaaaacaaacuaaca

SEQ ID NO: 766099 - RNA, 27 nt, Human
aaacaaaaacaaaaaacaaacuaacaa

SEQ ID NO: 766100 - RNA, 25 nt, Human
aaacaaaacagacauaaaaagacaa

SEQ ID NO: 766101 - RNA, 26 nt, Human
aaacaaaacagacauaaaaagacaaa

SEQ ID NO: 766102 - RNA, 27 nt, Human
aaacaaacuaacaaaaaaccggacccc

SEQ ID NO: 766103 - RNA, 24 nt, Human
aaacagacauaaaaagacaaaaau

SEQ ID NO: 766104 - RNA, 18 nt, Human
aaacagcaacaacaaaca

SEQ ID NO: 766105 - RNA, 26 nt, Human
aaacagcaacaacaaacaacuuuuaa

SEQ ID NO: 766106 - RNA, 18 nt, Human
aaacuccagagguuacug

SEQ ID NO: 766107 - RNA, 26 nt, Human
aaagaaauguccaaaaggguaagaaa

SEQ ID NO: 766108 - RNA, 22 nt, Human
aaagacaaaaauaaagccaaaa

SEQ ID NO: 766109 - RNA, 20 nt, Human
aaauaaagccaaaaaaaccc

SEQ ID NO: 766110 - RNA, 23 nt, Human
aaauaaagccaaaaaaacccaaa

SEQ ID NO: 766111 - RNA, 22 nt, Human
aacaaccaaaaaauucuaacag

SEQ ID NO: 766112 - RNA, 21 nt, Human
aaccaaaaaauucuaacagcc

SEQ ID NO: 766113 - RNA, 31 nt, Human
aacccaaaaacaaaaacaaaaaacaaacuag

SEQ ID NO: 766114 - RNA, 20 nt, Human
aacugggcagcaacuucuuu

SEQ ID NO: 766115 - RNA, 24 nt, Human
aagacaaaaauaaagccaaaaaaa

SEQ ID NO: 766116 - RNA, 23 nt, Human
aagaccacaggcuaaaaugccca

SEQ ID NO: 766117 - RNA, 23 nt, Human
aagauaccaaaugcggaugccau

SEQ ID NO: 766118 - RNA, 20 nt, Human
aagcagaaaucagaaauguc

SEQ ID NO: 766119 - RNA, 30 nt, Human
aagccaaaaaaacccaaaaacaaaaacaaa

SEQ ID NO: 766120 - RNA, 18 nt, Human
aagcccaaagugaagcag

SEQ ID NO: 766121 - RNA, 22 nt, Human
aaugcucaucccauuaaacauc

SEQ ID NO: 766122 - RNA, 18 nt, Human
aauggccaguuuaaagca

SEQ ID NO: 766123 - RNA, 21 nt, Human
aauuaaaaaauaaaaggcaag

SEQ ID NO: 766124 - RNA, 18 nt, Human
acagacauaaaaagacaa

SEQ ID NO: 766125 - RNA, 22 nt, Human
acagcaacaacaaacaacuuuu

SEQ ID NO: 766126 - RNA, 22 nt, Human
accccacccugagagcaggccg

SEQ ID NO: 766127 - RNA, 20 nt, Human
acccugagagcaggccgcag

SEQ ID NO: 766128 - RNA, 24 nt, Human
accgcaauaaaacacaauuuguuu

SEQ ID NO: 766129 - RNA, 21 nt, Human
acgaagaagaggaagcccaaa

SEQ ID NO: 766130 - RNA, 25 nt, Human
acucaaaaaaaaaaaaaaaauccaa

SEQ ID NO: 766131 - RNA, 19 nt, Human
agaaaucagaaaugucuuu

SEQ ID NO: 766132 - RNA, 28 nt, Human
agacaaaaauaaagccaaaaaaacccaa

SEQ ID NO: 766133 - RNA, 19 nt, Human
agaucagggacugaaaaug

SEQ ID NO: 766134 - RNA, 20 nt, Human
agauucacuuagaaccacug

SEQ ID NO: 766135 - RNA, 21 nt, Human
agccaaaaaaacccaaaaaca

SEQ ID NO: 766136 - RNA, 20 nt, Human
agcuuccuucauuuauuuca

SEQ ID NO: 766137 - RNA, 24 nt, Human
aggaagcagcaaccauggacuuuc

SEQ ID NO: 766138 - RNA, 26 nt, Human
auaaaaagacaaaaauaaagccaaaa

SEQ ID NO: 766139 - RNA, 23 nt, Human
auaaagccaaaaaaacccaaaaa

SEQ ID NO: 766140 - RNA, 20 nt, Human
auauacacacacacuuguag

SEQ ID NO: 766141 - RNA, 19 nt, Human
auauagagauauauacaua

SEQ ID NO: 766142 - RNA, 20 nt, Human
auugccuggagcugcacaac

SEQ ID NO: 766143 - RNA, 22 nt, Human
auuugagagggagccccuuuaa

SEQ ID NO: 766144 - RNA, 26 nt, Human
caaaaaaacccaaaaacaaaaacaaa

SEQ ID NO: 766145 - RNA, 24 nt, Human
caaaaaacaaacuaacaaaaaacu

SEQ ID NO: 766146 - RNA, 26 nt, Human
caaaaacaaaaacaaaaaacaaacua

SEQ ID NO: 766147 - RNA, 20 nt, Human
caaaaagccaaagcgacuca

SEQ ID NO: 766148 - RNA, 26 nt, Human
caaaaggguaagaaaaacaaaacaga

SEQ ID NO: 766149 - RNA, 22 nt, Human
caaagugaagcagaaaucagaa

SEQ ID NO: 766150 - RNA, 21 nt, Human
caacucaaaaaaaaaaaaaaa

SEQ ID NO: 766151 - RNA, 20 nt, Human
caagaggcacuacaagagaa

SEQ ID NO: 766152 - RNA, 19 nt, Human
caauuacuguaaguagaag

SEQ ID NO: 766153 - RNA, 24 nt, Human
cacaacucaaaaaaaaaaaaaaaa

SEQ ID NO: 766154 - RNA, 21 nt, Human
cagcuagaauuagcuuguauu

SEQ ID NO: 766155 - RNA, 21 nt, Human
cagugaaauuaaaaaauaaaa

SEQ ID NO: 766156 - RNA, 26 nt, Human
cauaaaaagacaaaaauaaagccaaa

SEQ ID NO: 766157 - RNA, 18 nt, Human
cauugugucuuuaagauu

SEQ ID NO: 766158 - RNA, 18 nt, Human
ccacccugagagcaggcc

SEQ ID NO: 766159 - RNA, 26 nt, Human
cccaaaaacaaaaacaaaaaacaaac

SEQ ID NO: 766160 - RNA, 21 nt, Human
cccaccggcaggucgcaauaa

SEQ ID NO: 766161 - RNA, 19 nt, Human
ccgcaguuuaucaaaaagc

SEQ ID NO: 766162 - RNA, 20 nt, Human
ccuuuuauaccuuucaaaua

SEQ ID NO: 766163 - RNA, 21 nt, Human
cguuuauuuuaacaaccaaaa

SEQ ID NO: 766164 - RNA, 23 nt, Human
cuaacaaaaaacuuuuaaagaaa

SEQ ID NO: 766165 - RNA, 18 nt, Human
cuccgacucggagacaaa

SEQ ID NO: 766166 - RNA, 18 nt, Human
gaaagcacaacucaaaaa

SEQ ID NO: 766167 - RNA, 19 nt, Human
gaaaucgcuucacauacuc

SEQ ID NO: 766168 - RNA, 24 nt, Human
gauauauacauauacauauacaca

SEQ ID NO: 766169 - RNA, 20 nt, Human
gcaacaaagaaauguccaaa

SEQ ID NO: 766170 - RNA, 21 nt, Human
gcaauaaaacgcacagggacc

SEQ ID NO: 766171 - RNA, 23 nt, Human
gcaguuuaucaaaaagccaaagc

SEQ ID NO: 766172 - RNA, 24 nt, Human
gccaaaaaaacccaaaaacaaaaa

SEQ ID NO: 766173 - RNA, 25 nt, Human
ggaaaaaagaacauuuacaauaugu

SEQ ID NO: 766174 - RNA, 19 nt, Human
ggaaggauggggccagggc

SEQ ID NO: 766175 - RNA, 20 nt, Human
ggaugccaucgauagaugaa

SEQ ID NO: 766176 - RNA, 18 nt, Human
guguacagagugaccuuc

SEQ ID NO: 766177 - RNA, 22 nt, Human
guucccaccggcaggucgcaau

SEQ ID NO: 766178 - RNA, 26 nt, Human
uaaaaaacaaaaagacaaaaaaacag

SEQ ID NO: 766179 - RNA, 18 nt, Human
uaaaaggcaagacuuagc

SEQ ID NO: 766180 - RNA, 18 nt, Human
uaaaaugcccacagauuc

SEQ ID NO: 766181 - RNA, 23 nt, Human
uaaagccaaaaaaacccaaaaac

SEQ ID NO: 766182 - RNA, 25 nt, Human
uaaagccaaaaaaacccaaaaacaa

SEQ ID NO: 766183 - RNA, 23 nt, Human
uaaauaaauuucacaacaaaaug

SEQ ID NO: 766184 - RNA, 26 nt, Human
uaacucggagaucaggaagcagcaag

SEQ ID NO: 766185 - RNA, 24 nt, Human
uaagaaaaacaaaacagacauaaa

SEQ ID NO: 766186 - RNA, 25 nt, Human
uaagaaaaacaaaacagacauaaaa

SEQ ID NO: 766187 - RNA, 26 nt, Human
uaagcugccagauaggaagccauagg

SEQ ID NO: 766188 - RNA, 23 nt, Human
uaaguagaaguggaaaguaaugc

SEQ ID NO: 766189 - RNA, 18 nt, Human
uaauuuucagauuugaag

SEQ ID NO: 766190 - RNA, 23 nt, Human
uacauaaacaagucuuuucuuua

SEQ ID NO: 766191 - RNA, 24 nt, Human
uacguucacuaggccaguccugaa

SEQ ID NO: 766192 - RNA, 21 nt, Human
uagaugaaccaccuuguaaga

SEQ ID NO: 766193 - RNA, 24 nt, Human
uaggaaggauggggccagggcuaa

SEQ ID NO: 766194 - RNA, 18 nt, Human
uagguaacugggauaaug

SEQ ID NO: 766195 - RNA, 20 nt, Human
uauacauauacauauacaca

SEQ ID NO: 766196 - RNA, 25 nt, Human
uauacauauacauauacacacacac

SEQ ID NO: 766197 - RNA, 19 nt, Human
uauauacauauacauauac

SEQ ID NO: 766198 - RNA, 22 nt, Human
uauauacauauacauauacaca

SEQ ID NO: 766199 - RNA, 18 nt, Human
ucacaaaaaaaaaaaaag

SEQ ID NO: 766200 - RNA, 22 nt, Human
ucacaacaaaauguggcucaua

SEQ ID NO: 766201 - RNA, 22 nt, Human
ucacuaggccaguccugaaugu

SEQ ID NO: 766202 - RNA, 23 nt, Human
ucaguuuuacuuauuuggaauuc

SEQ ID NO: 766203 - RNA, 18 nt, Human
uccacagaaaugcaucug

SEQ ID NO: 766204 - RNA, 23 nt, Human
uccacagaaaugcaucuguucac

SEQ ID NO: 766205 - RNA, 19 nt, Human
ucccuuuaaaaacuccaga

SEQ ID NO: 766206 - RNA, 19 nt, Human
ucggaaauacugaacuuau

SEQ ID NO: 766207 - RNA, 23 nt, Human
ucuggcaagaccacaggcuaaaa

SEQ ID NO: 766208 - RNA, 21 nt, Human
ugaaccaccuuguaagagcuu

SEQ ID NO: 766209 - RNA, 19 nt, Human
ugaacugcgaauccuccuc

SEQ ID NO: 766210 - RNA, 19 nt, Human
ugaaguguaaaagauacca

SEQ ID NO: 766211 - RNA, 28 nt, Human
ugcaaacaaccauccuuuugcaaaggua

SEQ ID NO: 766212 - RNA, 18 nt, Human
ugccuggagcugcacaac

SEQ ID NO: 766213 - RNA, 20 nt, Human
ugccuggagcugcacaacga

SEQ ID NO: 766214 - RNA, 24 nt, Human
uggaaaaaagaacauuuacaauau

SEQ ID NO: 766215 - RNA, 18 nt, Human
uggaauguguacgaagaa

SEQ ID NO: 766216 - RNA, 23 nt, Human
uguagguaacugggauaauguuu

SEQ ID NO: 766217 - RNA, 23 nt, Human
ugugcaacaaagaaauguccaaa

SEQ ID NO: 766218 - RNA, 21 nt, Human
uuaaagcugcagcauacuaca

SEQ ID NO: 766219 - RNA, 21 nt, Human
uuaauccuuauucacauuguu

SEQ ID NO: 766220 - RNA, 18 nt, Human
uuacuguaaguagaagug

SEQ ID NO: 766221 - RNA, 23 nt, Human
uucacaaaaaaaaaaaaaggcgg

SEQ ID NO: 766222 - RNA, 28 nt, Human
uugaaaaauaccuaauaaauuuuugguu

SEQ ID NO: 766223 - RNA, 18 nt, Human
uugcaacaugucuucucc

SEQ ID NO: 766224 - RNA, 18 nt, Human
uugcaacaugucuucucc

SEQ ID NO: 766225 - RNA, 21 nt, Human
uuuaauggccaguuuaaagca

SEQ ID NO: 766226 - RNA, 21 nt, Human
uuucaguuuuacuuauuugga

SEQ ID NO: 766227 - RNA, 22 nt, Human
uuucauaguucuuuucauccug

SEQ ID NO: 766228 - RNA, 23 nt, Human
uuuuaagugugcauugugucuuu

SEQ ID NO: 766229 - RNA, 25 nt, Human
aaacggaauaaagagaacacacccc

SEQ ID NO: 766230 - RNA, 23 nt, Human
aaacugaggccagacagcucgga

SEQ ID NO: 766231 - RNA, 22 nt, Human
aaagcagacaaucuggcaacac

SEQ ID NO: 766232 - RNA, 21 nt, Human
aacaugcccaggaggggagga

SEQ ID NO: 766233 - RNA, 26 nt, Human
aaccucacagccaggccagcccccag

SEQ ID NO: 766234 - RNA, 21 nt, Human
aaccugguccauuuuccacag

SEQ ID NO: 766235 - RNA, 18 nt, Human
aacucucccccacauccc

SEQ ID NO: 766236 - RNA, 21 nt, Human
aacuggcucacaagaggccuc

SEQ ID NO: 766237 - RNA, 21 nt, Human
aagagcugccagccuguggcg

SEQ ID NO: 766238 - RNA, 24 nt, Human
aagcacccccaucuaacugcgaga

SEQ ID NO: 766239 - RNA, 20 nt, Human
aagcacuggccuucccacca

SEQ ID NO: 766240 - RNA, 20 nt, Human
aagcaucccgccccaucacc

SEQ ID NO: 766241 - RNA, 25 nt, Human
aaggauccuaccccagcccagccca

SEQ ID NO: 766242 - RNA, 25 nt, Human
aaggauccugcaaguuggaaccucc

SEQ ID NO: 766243 - RNA, 22 nt, Human
aaggccccaaagucccugccuc

SEQ ID NO: 766244 - RNA, 20 nt, Human
aaucuggcaacacagggccg

SEQ ID NO: 766245 - RNA, 19 nt, Human
acacagcccuucaggccuc

SEQ ID NO: 766246 - RNA, 21 nt, Human
acacagcccuucaggccuccu

SEQ ID NO: 766247 - RNA, 22 nt, Human
acaccaucaucauguugggccc

SEQ ID NO: 766248 - RNA, 21 nt, Human
acacugcagccauccagagcu

SEQ ID NO: 766249 - RNA, 23 nt, Human
accacuauguccugugcuggucu

SEQ ID NO: 766250 - RNA, 22 nt, Human
acccaacucccagagagaagcc

SEQ ID NO: 766251 - RNA, 19 nt, Human
accccuccucugcccacac

SEQ ID NO: 766252 - RNA, 25 nt, Human
accuugaccccuccucagccagcag

SEQ ID NO: 766253 - RNA, 19 nt, Human
accuuucucagaaggacuc

SEQ ID NO: 766254 - RNA, 18 nt, Human
acucgaccagccagaaug

SEQ ID NO: 766255 - RNA, 24 nt, Human
acugagcaugaggagccaggcuuu

SEQ ID NO: 766256 - RNA, 28 nt, Human
agagacccaggcccaagcaucccgcccc

SEQ ID NO: 766257 - RNA, 20 nt, Human
agaggccucccacacaccgg

SEQ ID NO: 766258 - RNA, 23 nt, Human
agcagagccuguguaaacaugcc

SEQ ID NO: 766259 - RNA, 19 nt, Human
agcagcccccaccuccagg

SEQ ID NO: 766260 - RNA, 18 nt, Human
agccagcagcccccaccu

SEQ ID NO: 766261 - RNA, 19 nt, Human
agcgagcccagggacacag

SEQ ID NO: 766262 - RNA, 21 nt, Human
agcggagaaaagucggaggga

SEQ ID NO: 766263 - RNA, 21 nt, Human
agcugccagccuguggcgccu

SEQ ID NO: 766264 - RNA, 19 nt, Human
agcuuggggggcugagcug

SEQ ID NO: 766265 - RNA, 23 nt, Human
agcuuucuugaacucaccuugac

SEQ ID NO: 766266 - RNA, 22 nt, Human
aggccucuggucacucgaccag

SEQ ID NO: 766267 - RNA, 20 nt, Human
aggccuggggcagaagcauc

SEQ ID NO: 766268 - RNA, 27 nt, Human
aggccuuggaggaagaggacuggcagu

SEQ ID NO: 766269 - RNA, 23 nt, Human
agguagcuuucuugaacucaccu

SEQ ID NO: 766270 - RNA, 20 nt, Human
auaccuuaaacuucaguugu

SEQ ID NO: 766271 - RNA, 21 nt, Human
aucacaucccaaggccagagg

SEQ ID NO: 766272 - RNA, 18 nt, Human
aucccuuucucacuugca

SEQ ID NO: 766273 - RNA, 18 nt, Human
aucuccaccccaccccca

SEQ ID NO: 766274 - RNA, 22 nt, Human
aucuccaccccacccccacccc

SEQ ID NO: 766275 - RNA, 18 nt, Human
auggccagagugcaaggc

SEQ ID NO: 766276 - RNA, 21 nt, Human
auggccagagugcaaggcgcc

SEQ ID NO: 766277 - RNA, 18 nt, Human
augggauggugagucaag

SEQ ID NO: 766278 - RNA, 23 nt, Human
caaacccugucauucccgggaag

SEQ ID NO: 766279 - RNA, 24 nt, Human
caacaggcagagcugggacugagc

SEQ ID NO: 766280 - RNA, 20 nt, Human
caacucccagagagaagcca

SEQ ID NO: 766281 - RNA, 23 nt, Human
caacucccagagagaagccaggg

SEQ ID NO: 766282 - RNA, 25 nt, Human
caacuucuuggcucucucugcuccc

SEQ ID NO: 766283 - RNA, 19 nt, Human
caagaggccucccacacac

SEQ ID NO: 766284 - RNA, 21 nt, Human
caaggauccuaccccagccca

SEQ ID NO: 766285 - RNA, 24 nt, Human
caagggcuccuggcacugcuggcg

SEQ ID NO: 766286 - RNA, 23 nt, Human
caagucccagugggaagggcugg

SEQ ID NO: 766287 - RNA, 21 nt, Human
caaucacccccccaaccuggu

SEQ ID NO: 766288 - RNA, 22 nt, Human
cacacauucacacaggccucug

SEQ ID NO: 766289 - RNA, 18 nt, Human
cacacuacccccacuccc

SEQ ID NO: 766290 - RNA, 20 nt, Human
caccaccaggcccugugggc

SEQ ID NO: 766291 - RNA, 21 nt, Human
caccccacccccaccccccau

SEQ ID NO: 766292 - RNA, 21 nt, Human
cacccccaccccccaucacag

SEQ ID NO: 766293 - RNA, 18 nt, Human
caccccuccucugcccac

SEQ ID NO: 766294 - RNA, 21 nt, Human
caccccuccucugcccacaca

SEQ ID NO: 766295 - RNA, 19 nt, Human
cacccuuuaccugcaccuc

SEQ ID NO: 766296 - RNA, 19 nt, Human
cacugcuggcggagagacc

SEQ ID NO: 766297 - RNA, 20 nt, Human
cagaagcauccuagucuggu

SEQ ID NO: 766298 - RNA, 21 nt, Human
cagagccuguguaaacaugcc

SEQ ID NO: 766299 - RNA, 19 nt, Human
cagaggccuuggaggaaga

SEQ ID NO: 766300 - RNA, 23 nt, Human
cagcagaaccagcaguuucccuc

SEQ ID NO: 766301 - RNA, 24 nt, Human
cagcagaaccagcaguuucccuca

SEQ ID NO: 766302 - RNA, 22 nt, Human
cagcagguggauccuggccccc

SEQ ID NO: 766303 - RNA, 18 nt, Human
cagccaggcccugucccu

SEQ ID NO: 766304 - RNA, 19 nt, Human
cagccaggcccugucccuc

SEQ ID NO: 766305 - RNA, 24 nt, Human
cagcccuucugcagccuuacugac

SEQ ID NO: 766306 - RNA, 24 nt, Human
cagccucucaguaaaacaaaaccu

SEQ ID NO: 766307 - RNA, 18 nt, Human
cagccugaacaaagucua

SEQ ID NO: 766308 - RNA, 22 nt, Human
cagccuguggcgccuucccuga

SEQ ID NO: 766309 - RNA, 20 nt, Human
cagcuccuggacuggcaccc

SEQ ID NO: 766310 - RNA, 23 nt, Human
cagcugagcagcuguggccccuu

SEQ ID NO: 766311 - RNA, 22 nt, Human
cagcuguggccccuuuaacagg

SEQ ID NO: 766312 - RNA, 21 nt, Human
caggccagcccccagagcaga

SEQ ID NO: 766313 - RNA, 21 nt, Human
caggcuggggacaaccccagg

SEQ ID NO: 766314 - RNA, 24 nt, Human
caguuguagaguuaaaaacuccaa

SEQ ID NO: 766315 - RNA, 27 nt, Human
caucacaggccugguaaggcugggaga

SEQ ID NO: 766316 - RNA, 21 nt, Human
cauccagacccggaaaggacc

SEQ ID NO: 766317 - RNA, 21 nt, Human
cauccgucucccuggcaggcc

SEQ ID NO: 766318 - RNA, 22 nt, Human
cauggccagagugcaaggcgcc

SEQ ID NO: 766319 - RNA, 23 nt, Human
cauuccaggcaggaaaagcaggu

SEQ ID NO: 766320 - RNA, 20 nt, Human
ccaagcccagacccuccgca

SEQ ID NO: 766321 - RNA, 20 nt, Human
ccaccccacccccacccccc

SEQ ID NO: 766322 - RNA, 18 nt, Human
ccacuggguaucucaugc

SEQ ID NO: 766323 - RNA, 25 nt, Human
ccagaaccaggagcggcucccucuc

SEQ ID NO: 766324 - RNA, 22 nt, Human
ccagaaugagacggacuccuug

SEQ ID NO: 766325 - RNA, 22 nt, Human
ccagccaucauugcaaccccaa

SEQ ID NO: 766326 - RNA, 23 nt, Human
ccagcccccagagcagagccugu

SEQ ID NO: 766327 - RNA, 24 nt, Human
ccagcccccagagcagagccugug

SEQ ID NO: 766328 - RNA, 20 nt, Human
ccaggcccaagcaucccgcc

SEQ ID NO: 766329 - RNA, 20 nt, Human
ccaggggcaaaggagcugaa

SEQ ID NO: 766330 - RNA, 21 nt, Human
cccacacaccggcugcagaga

SEQ ID NO: 766331 - RNA, 18 nt, Human
cccagcugucccucagug

SEQ ID NO: 766332 - RNA, 19 nt, Human
cccaggguuugcucaacuc

SEQ ID NO: 766333 - RNA, 21 nt, Human
cccaucuuggcccugcuagaa

SEQ ID NO: 766334 - RNA, 21 nt, Human
ccccaaagucccugccucucu

SEQ ID NO: 766335 - RNA, 26 nt, Human
ccccagaaaccucacagccaggccag

SEQ ID NO: 766336 - RNA, 18 nt, Human
ccccagcccagcccagcu

SEQ ID NO: 766337 - RNA, 19 nt, Human
ccccagggggaacuugggg

SEQ ID NO: 766338 - RNA, 19 nt, Human
ccccaggugccuagguucu

SEQ ID NO: 766339 - RNA, 19 nt, Human
ccccaucaccccauguccg

SEQ ID NO: 766340 - RNA, 18 nt, Human
ccccaucuuggcccugcu

SEQ ID NO: 766341 - RNA, 19 nt, Human
ccccgaagucucagcucag

SEQ ID NO: 766342 - RNA, 21 nt, Human
ccccuccucagccagcagccc

SEQ ID NO: 766343 - RNA, 20 nt, Human
ccuaagacuccagaaccagg

SEQ ID NO: 766344 - RNA, 23 nt, Human
ccucaaacccugucauucccggg

SEQ ID NO: 766345 - RNA, 23 nt, Human
ccucaagggccugaaggcucucc

SEQ ID NO: 766346 - RNA, 23 nt, Human
ccuccagaaccuaccccuggcuu

SEQ ID NO: 766347 - RNA, 26 nt, Human
ccucccaaggugagccaucucuucuu

SEQ ID NO: 766348 - RNA, 25 nt, Human
ccucccacacaccggcugcagagau

SEQ ID NO: 766349 - RNA, 21 nt, Human
ccucccagggugccucuggcc

SEQ ID NO: 766350 - RNA, 22 nt, Human
ccucucacuuucccacugggua

SEQ ID NO: 766351 - RNA, 19 nt, Human
ccugaaagcugggauggga

SEQ ID NO: 766352 - RNA, 22 nt, Human
ccugcagccucuugcccugccu

SEQ ID NO: 766353 - RNA, 23 nt, Human
ccugcagccucuugcccugccuu

SEQ ID NO: 766354 - RNA, 23 nt, Human
ccugccacaagugacuggcccag

SEQ ID NO: 766355 - RNA, 21 nt, Human
ccugcuccugagcggcagcau

SEQ ID NO: 766356 - RNA, 19 nt, Human
ccugcuucccuuucccugg

SEQ ID NO: 766357 - RNA, 24 nt, Human
ccuggcacugagcaugaggagcca

SEQ ID NO: 766358 - RNA, 18 nt, Human
ccuucaggccuccuucuc

SEQ ID NO: 766359 - RNA, 23 nt, Human
ccuucccaccaucagcagaucca

SEQ ID NO: 766360 - RNA, 19 nt, Human
ccuuccccaugcauaaggc

SEQ ID NO: 766361 - RNA, 18 nt, Human
ccuucccuuccucuuugc

SEQ ID NO: 766362 - RNA, 19 nt, Human
ccuucccuuccucuuugcu

SEQ ID NO: 766363 - RNA, 18 nt, Human
cgagagcagcuugggggg

SEQ ID NO: 766364 - RNA, 23 nt, Human
cgaggggguggguugucuggggu

SEQ ID NO: 766365 - RNA, 20 nt, Human
cgccccugcuccugagcggc

SEQ ID NO: 766366 - RNA, 20 nt, Human
cgggaaaacaacuggcucag

SEQ ID NO: 766367 - RNA, 25 nt, Human
cgggcagcagugagggcuggcagag

SEQ ID NO: 766368 - RNA, 23 nt, Human
cuagagcaacaggcagagcuggg

SEQ ID NO: 766369 - RNA, 18 nt, Human
cuaguuucagccuggcac

SEQ ID NO: 766370 - RNA, 19 nt, Human
cucacagccaggccagccu

SEQ ID NO: 766371 - RNA, 19 nt, Human
cucacuugcaucccccagu

SEQ ID NO: 766372 - RNA, 21 nt, Human
cucauaucuacuccccucaaa

SEQ ID NO: 766373 - RNA, 19 nt, Human
cuccaaauaaaauacuaac

SEQ ID NO: 766374 - RNA, 21 nt, Human
cuccaaauaaaauacuaacgg

SEQ ID NO: 766375 - RNA, 22 nt, Human
cuccaccccacccccacccccc

SEQ ID NO: 766376 - RNA, 23 nt, Human
cuccagaaccuaccccuggcucu

SEQ ID NO: 766377 - RNA, 23 nt, Human
cuccccaguguucugccccuggc

SEQ ID NO: 766378 - RNA, 22 nt, Human
cuccgccaagcccagacccucc

SEQ ID NO: 766379 - RNA, 21 nt, Human
cuccucugcccacacagcacu

SEQ ID NO: 766380 - RNA, 18 nt, Human
cucuauaccuggcucccc

SEQ ID NO: 766381 - RNA, 19 nt, Human
cugaccagcuggccuccca

SEQ ID NO: 766382 - RNA, 20 nt, Human
cugccagggcccugaugccc

SEQ ID NO: 766383 - RNA, 20 nt, Human
cugccagggcccugaugccc

SEQ ID NO: 766384 - RNA, 20 nt, Human
cugcccaccuccccacuccu

SEQ ID NO: 766385 - RNA, 21 nt, Human
cugccccuggcacugagcaug

SEQ ID NO: 766386 - RNA, 22 nt, Human
cuggaacacacucuuccugcag

SEQ ID NO: 766387 - RNA, 19 nt, Human
cuggcccagccaucauugc

SEQ ID NO: 766388 - RNA, 25 nt, Human
cuggcccagccaucauugcaacccc

SEQ ID NO: 766389 - RNA, 25 nt, Human
cuucaaaggcaccauccgucucccu

SEQ ID NO: 766390 - RNA, 23 nt, Human
cuugagccuccagaaccuacccc

SEQ ID NO: 766391 - RNA, 21 nt, Human
cuuggaggaagaggacuggca

SEQ ID NO: 766392 - RNA, 19 nt, Human
cuugggacuccggaggacc

SEQ ID NO: 766393 - RNA, 19 nt, Human
cuugguggacuucucccca

SEQ ID NO: 766394 - RNA, 19 nt, Human
cuugucaccagccccgccu

SEQ ID NO: 766395 - RNA, 20 nt, Human
gaaaaacggaauaaagagaa

SEQ ID NO: 766396 - RNA, 21 nt, Human
gaacacacucuuccugcagcc

SEQ ID NO: 766397 - RNA, 23 nt, Human
gacccuccgcagggagccugugg

SEQ ID NO: 766398 - RNA, 19 nt, Human
gacucaguggcuuuuccuc

SEQ ID NO: 766399 - RNA, 19 nt, Human
gacuccuacccugcuuccc

SEQ ID NO: 766400 - RNA, 27 nt, Human
gagaacaaugacgggcagccgguaccc

SEQ ID NO: 766401 - RNA, 18 nt, Human
gagagacccaggcccaag

SEQ ID NO: 766402 - RNA, 18 nt, Human
gagcagagccuguguaaa

SEQ ID NO: 766403 - RNA, 19 nt, Human
gagccacgagcucaugcuc

SEQ ID NO: 766404 - RNA, 21 nt, Human
gagccuccagaaccuaccccu

SEQ ID NO: 766405 - RNA, 19 nt, Human
gagcugccagccuguggcg

SEQ ID NO: 766406 - RNA, 19 nt, Human
gagcugggaucacaucagc

SEQ ID NO: 766407 - RNA, 21 nt, Human
gagcugggaucacaucagcca

SEQ ID NO: 766408 - RNA, 23 nt, Human
gagcuuacaacccuaguucugcu

SEQ ID NO: 766409 - RNA, 24 nt, Human
gaugaaaaggaaacuugggacucc

SEQ ID NO: 766410 - RNA, 19 nt, Human
gcagcagugagggcuggca

SEQ ID NO: 766411 - RNA, 22 nt, Human
gccagagugcaaggcgccuuua

SEQ ID NO: 766412 - RNA, 22 nt, Human
gcccagagguccuucccugggc

SEQ ID NO: 766413 - RNA, 20 nt, Human
gcccugcauguauguuccug

SEQ ID NO: 766414 - RNA, 18 nt, Human
gccuccugacaaacagcc

SEQ ID NO: 766415 - RNA, 19 nt, Human
gccugugccaagcuccugg

SEQ ID NO: 766416 - RNA, 23 nt, Human
gccugugccaagcuccugguuaa

SEQ ID NO: 766417 - RNA, 23 nt, Human
gccuguguaaacaugcccaggag

SEQ ID NO: 766418 - RNA, 18 nt, Human
gcggagagacccaggccc

SEQ ID NO: 766419 - RNA, 22 nt, Human
gcuacauaugagaaacaguuaa

SEQ ID NO: 766420 - RNA, 18 nt, Human
gcuccuguacaauaaaau

SEQ ID NO: 766421 - RNA, 23 nt, Human
gcuguccccaucuuggcccugcu

SEQ ID NO: 766422 - RNA, 19 nt, Human
ggaaaacaacuggcucaca

SEQ ID NO: 766423 - RNA, 22 nt, Human
ggaaacuugggacuccggagga

SEQ ID NO: 766424 - RNA, 22 nt, Human
ggaaaggauccugcaaguugga

SEQ ID NO: 766425 - RNA, 21 nt, Human
ggaacuuggggaggcaaggga

SEQ ID NO: 766426 - RNA, 18 nt, Human
ggagcugaaagacagucc

SEQ ID NO: 766427 - RNA, 19 nt, Human
ggauggugacuaaggcccc

SEQ ID NO: 766428 - RNA, 21 nt, Human
ggcaauacugagaugagaaca

SEQ ID NO: 766429 - RNA, 18 nt, Human
ggcagcagugagggcugg

SEQ ID NO: 766430 - RNA, 22 nt, Human
ggcagccgucacaaagcacccc

SEQ ID NO: 766431 - RNA, 20 nt, Human
ggcauaguaggaacauggag

SEQ ID NO: 766432 - RNA, 22 nt, Human
ggccucaagggccugaaggcuc

SEQ ID NO: 766433 - RNA, 24 nt, Human
ggcggagagacccaggcccaagca

SEQ ID NO: 766434 - RNA, 20 nt, Human
ggcucagugggagcgagagc

SEQ ID NO: 766435 - RNA, 18 nt, Human
ggcugggagauuucccac

SEQ ID NO: 766436 - RNA, 21 nt, Human
gggcagacugcccaccucccc

SEQ ID NO: 766437 - RNA, 25 nt, Human
gggcaggcuggggacaaccccaggu

SEQ ID NO: 766438 - RNA, 19 nt, Human
ggggaacuuggggaggcaa

SEQ ID NO: 766439 - RNA, 27 nt, Human
ggggguggguugucugggggggauccc

SEQ ID NO: 766440 - RNA, 18 nt, Human
ggguaucucaugcugacg

SEQ ID NO: 766441 - RNA, 23 nt, Human
gguggcuggcaugaugggugagg

SEQ ID NO: 766442 - RNA, 23 nt, Human
gucccuggcagacuuacagccuc

SEQ ID NO: 766443 - RNA, 18 nt, Human
gugaaagugaaaggaagg

SEQ ID NO: 766444 - RNA, 21 nt, Human
guggaggcgggaaaacaacug

SEQ ID NO: 766445 - RNA, 23 nt, Human
guuaggcauccucccagggcuca

SEQ ID NO: 766446 - RNA, 23 nt, Human
guuccagcagguggauccuggcc

SEQ ID NO: 766447 - RNA, 24 nt, Human
uaaaaacuccaaauaaaauacuaa

SEQ ID NO: 766448 - RNA, 18 nt, Human
uaaggugaauuagggucc

SEQ ID NO: 766449 - RNA, 24 nt, Human
uaaggugaauuaggguccgagggg

SEQ ID NO: 766450 - RNA, 19 nt, Human
uaccccagcccagcccagc

SEQ ID NO: 766451 - RNA, 21 nt, Human
uacugacagcugucccuggca

SEQ ID NO: 766452 - RNA, 21 nt, Human
uagaagagggauagggguggc

SEQ ID NO: 766453 - RNA, 21 nt, Human
uagaagagggauagggguggc

SEQ ID NO: 766454 - RNA, 22 nt, Human
uagccccccagcccuucugcag

SEQ ID NO: 766455 - RNA, 20 nt, Human
uagggguggcuggcaugaug

SEQ ID NO: 766456 - RNA, 31 nt, Human
uaggguccgaggggguggguugucugggguu

SEQ ID NO: 766457 - RNA, 21 nt, Human
ucaagcagccugauccugaac

SEQ ID NO: 766458 - RNA, 19 nt, Human
ucaagggucaccaugcccc

SEQ ID NO: 766459 - RNA, 19 nt, Human
ucacaagaggccucccaca

SEQ ID NO: 766460 - RNA, 24 nt, Human
ucacaccaucaucauguugggccc

SEQ ID NO: 766461 - RNA, 24 nt, Human
ucauccauuuacccuuccacaauc

SEQ ID NO: 766462 - RNA, 20 nt, Human
ucauugcaaccccaagccaa

SEQ ID NO: 766463 - RNA, 21 nt, Human
ucauugcaaccccaagccaag

SEQ ID NO: 766464 - RNA, 26 nt, Human
uccaccccacccccaccccccaucac

SEQ ID NO: 766465 - RNA, 19 nt, Human
uccaccccacccccacccu

SEQ ID NO: 766466 - RNA, 18 nt, Human
uccagagcuugagggagc

SEQ ID NO: 766467 - RNA, 21 nt, Human
ucccaaggccagagggcugcu

SEQ ID NO: 766468 - RNA, 18 nt, Human
uccccaguguucugcccc

SEQ ID NO: 766469 - RNA, 24 nt, Human
ucccgccccaucaccccaugucca

SEQ ID NO: 766470 - RNA, 18 nt, Human
uccucagccagcagcccc

SEQ ID NO: 766471 - RNA, 21 nt, Human
uccucagccagcagcccccac

SEQ ID NO: 766472 - RNA, 23 nt, Human
uccugagccacgagcucaugcuc

SEQ ID NO: 766473 - RNA, 24 nt, Human
uccugcaaguuggaaccuccuaag

SEQ ID NO: 766474 - RNA, 20 nt, Human
uccuuguguagccccccagc

SEQ ID NO: 766475 - RNA, 24 nt, Human
uccuuguguagccccccagcccuu

SEQ ID NO: 766476 - RNA, 24 nt, Human
ucuccgcauccucucacuuuccca

SEQ ID NO: 766477 - RNA, 24 nt, Human
ucucugcuccccaaacccuggccc

SEQ ID NO: 766478 - RNA, 21 nt, Human
ucugggaggagacucaguggc

SEQ ID NO: 766479 - RNA, 18 nt, Human
ucuucgagggggguggug

SEQ ID NO: 766480 - RNA, 21 nt, Human
ugaaaaacggaauaaagagaa

SEQ ID NO: 766481 - RNA, 20 nt, Human
ugaacucucccccacauccc

SEQ ID NO: 766482 - RNA, 18 nt, Human
ugaacuggggggagcugg

SEQ ID NO: 766483 - RNA, 18 nt, Human
ugacaacaggaaugagau

SEQ ID NO: 766484 - RNA, 19 nt, Human
ugacaacaggaaugagaug

SEQ ID NO: 766485 - RNA, 20 nt, Human
ugacccagcaacugcaaagg

SEQ ID NO: 766486 - RNA, 20 nt, Human
ugacgggcagcagugagggg

SEQ ID NO: 766487 - RNA, 22 nt, Human
ugagaaacaguuaaaaauaaau

SEQ ID NO: 766488 - RNA, 19 nt, Human
ugagaugaggugauaccau

SEQ ID NO: 766489 - RNA, 24 nt, Human
ugagccacgagcucaugcucuugg

SEQ ID NO: 766490 - RNA, 26 nt, Human
ugagccacgagcucaugcucuugggg

SEQ ID NO: 766491 - RNA, 23 nt, Human
ugaggccagacagcucggaccag

SEQ ID NO: 766492 - RNA, 19 nt, Human
ugauccugaacucuccccc

SEQ ID NO: 766493 - RNA, 21 nt, Human
ugcacacauucacacaggccu

SEQ ID NO: 766494 - RNA, 21 nt, Human
ugcacccuuuaccugcaccuc

SEQ ID NO: 766495 - RNA, 19 nt, Human
ugcagcugagccagaaaac

SEQ ID NO: 766496 - RNA, 23 nt, Human
ugcccagagguccuucccugggc

SEQ ID NO: 766497 - RNA, 19 nt, Human
ugcccugccuugucaccag

SEQ ID NO: 766498 - RNA, 21 nt, Human
ugcugggggauuaucagcugg

SEQ ID NO: 766499 - RNA, 18 nt, Human
ugcuuuaucaucacaucc

SEQ ID NO: 766500 - RNA, 23 nt, Human
uggacuaaguuuuccccaaauac

SEQ ID NO: 766501 - RNA, 26 nt, Human
uggcagacuuacagccucucaguaaa

SEQ ID NO: 766502 - RNA, 18 nt, Human
uggcagagcggagaaaag

SEQ ID NO: 766503 - RNA, 20 nt, Human
uggcagagcggagaaaaguc

SEQ ID NO: 766504 - RNA, 29 nt, Human
uggcauccucuuuugccaguauuggguuu

SEQ ID NO: 766505 - RNA, 23 nt, Human
uggcuccccaguguucugccccu

SEQ ID NO: 766506 - RNA, 19 nt, Human
ugggaggagacucaguggc

SEQ ID NO: 766507 - RNA, 21 nt, Human
ugggaugggauggugagucaa

SEQ ID NO: 766508 - RNA, 20 nt, Human
ugggcucacagauguugcug

SEQ ID NO: 766509 - RNA, 23 nt, Human
uggggaggcaagggacugaccag

SEQ ID NO: 766510 - RNA, 18 nt, Human
uggggccuggggugcugg

SEQ ID NO: 766511 - RNA, 18 nt, Human
uggggggcugagcuggaa

SEQ ID NO: 766512 - RNA, 21 nt, Human
ugggugaggggaacaugagaa

SEQ ID NO: 766513 - RNA, 19 nt, Human
uguagccccccagcccuuc

SEQ ID NO: 766514 - RNA, 23 nt, Human
uguccagccacagcuccuggacu

SEQ ID NO: 766515 - RNA, 22 nt, Human
ugucuggggucagccuuggagg

SEQ ID NO: 766516 - RNA, 23 nt, Human
ugucuggggucagccuuggaggc

SEQ ID NO: 766517 - RNA, 22 nt, Human
uguguagccccccagcccuucu

SEQ ID NO: 766518 - RNA, 23 nt, Human
uguuaaagaauggaaggcaggcc

SEQ ID NO: 766519 - RNA, 22 nt, Human
uguugcuugagccuccagaacc

SEQ ID NO: 766520 - RNA, 22 nt, Human
uguuucuucucucuugucagau

SEQ ID NO: 766521 - RNA, 22 nt, Human
uucuggguccuccgccaagccc

SEQ ID NO: 766522 - RNA, 21 nt, Human
uuggaggaagaggacuggcag

SEQ ID NO: 766523 - RNA, 27 nt, Human
uuggggcagauguggccugugccaagc

SEQ ID NO: 766524 - RNA, 23 nt, Human
uuucucagaaggacuccuacccu

SEQ ID NO: 766525 - RNA, 18 nt, Human
uuugcaaucaccccccca

SEQ ID NO: 766526 - RNA, 19 nt, Human
uuugcaaucacccccccaa

SEQ ID NO: 766527 - RNA, 21 nt, Human
aaaacagaauccccugaccuc

SEQ ID NO: 766528 - RNA, 22 nt, Human
aaaacagaauccccugaccucc

SEQ ID NO: 766529 - RNA, 23 nt, Human
aaaaccuuuccugaagaccacag

SEQ ID NO: 766530 - RNA, 20 nt, Human
aacaggggaaaugaaaaaaa

SEQ ID NO: 766531 - RNA, 18 nt, Human
aaccaaaacagaaucccc

SEQ ID NO: 766532 - RNA, 24 nt, Human
aagacaaaccaaaacagaaucccc

SEQ ID NO: 766533 - RNA, 21 nt, Human
aagaggagaauggccguagug

SEQ ID NO: 766534 - RNA, 22 nt, Human
aagugcuggcauggaugggugg

SEQ ID NO: 766535 - RNA, 24 nt, Human
aagugcuggcauggaugggugggg

SEQ ID NO: 766536 - RNA, 20 nt, Human
aaucccacuccuccugcugc

SEQ ID NO: 766537 - RNA, 23 nt, Human
acgccaaacuaacaaacaaaaca

SEQ ID NO: 766538 - RNA, 19 nt, Human
acugcaccuggcccucaga

SEQ ID NO: 766539 - RNA, 22 nt, Human
agaauccccugaccuccugccc

SEQ ID NO: 766540 - RNA, 20 nt, Human
agaggagcgagggugcucca

SEQ ID NO: 766541 - RNA, 23 nt, Human
agccagcaaguuguagcaaccuc

SEQ ID NO: 766542 - RNA, 28 nt, Human
agccuccagagguggccagugagaguag

SEQ ID NO: 766543 - RNA, 25 nt, Human
aggagaugggggggggcauauggag

SEQ ID NO: 766544 - RNA, 19 nt, Human
aggagcgcccaagaggaga

SEQ ID NO: 766545 - RNA, 18 nt, Human
aggcagagccuccagagg

SEQ ID NO: 766546 - RNA, 20 nt, Human
aggcagagccuccagaggug

SEQ ID NO: 766547 - RNA, 22 nt, Human
aggcugaggagcgcccaagagg

SEQ ID NO: 766548 - RNA, 23 nt, Human
agguggccagugagaguaggugc

SEQ ID NO: 766549 - RNA, 19 nt, Human
aguggcaacaggccaaggc

SEQ ID NO: 766550 - RNA, 21 nt, Human
auccgguagcccauguugagc

SEQ ID NO: 766551 - RNA, 22 nt, Human
auccuuuuucaaaaccuuuccu

SEQ ID NO: 766552 - RNA, 19 nt, Human
augggaaggagggcagaaa

SEQ ID NO: 766553 - RNA, 22 nt, Human
caaaacagaauccccugaccuc

SEQ ID NO: 766554 - RNA, 22 nt, Human
caaaccaaaacagaauccccug

SEQ ID NO: 766555 - RNA, 23 nt, Human
caaaccaaaacagaauccccuga

SEQ ID NO: 766556 - RNA, 18 nt, Human
caaacuaacaaacaaaac

SEQ ID NO: 766557 - RNA, 21 nt, Human
caaccuccaccccuaacgcca

SEQ ID NO: 766558 - RNA, 23 nt, Human
caauugcgucacccucacucucc

SEQ ID NO: 766559 - RNA, 19 nt, Human
cacccucacucuccuggga

SEQ ID NO: 766560 - RNA, 19 nt, Human
caccugaggcagaaggggu

SEQ ID NO: 766561 - RNA, 21 nt, Human
cacugcucaggcccgugaucc

SEQ ID NO: 766562 - RNA, 20 nt, Human
cagaaaggucacagugaggc

SEQ ID NO: 766563 - RNA, 18 nt, Human
cagagcuaguagccagga

SEQ ID NO: 766564 - RNA, 21 nt, Human
cagcagaguaggccuggcugg

SEQ ID NO: 766565 - RNA, 20 nt, Human
caggaagcgccaccucagca

SEQ ID NO: 766566 - RNA, 18 nt, Human
caggacagucccugaaga

SEQ ID NO: 766567 - RNA, 24 nt, Human
caggagacccaccccucuccccuc

SEQ ID NO: 766568 - RNA, 22 nt, Human
cagggcccuugggaaaggcaga

SEQ ID NO: 766569 - RNA, 23 nt, Human
caguagcaggggcuggggaccag

SEQ ID NO: 766570 - RNA, 22 nt, Human
caucaccuccaacgggucugca

SEQ ID NO: 766571 - RNA, 22 nt, Human
cauccaguguaaagcuuggggc

SEQ ID NO: 766572 - RNA, 19 nt, Human
ccaccccucuccccucaga

SEQ ID NO: 766573 - RNA, 20 nt, Human
ccagggcucccauccuuccu

SEQ ID NO: 766574 - RNA, 19 nt, Human
cccaccccucuccccucag

SEQ ID NO: 766575 - RNA, 24 nt, Human
cccaccccucuccccucagagcag

SEQ ID NO: 766576 - RNA, 18 nt, Human
cccacccucugccagggc

SEQ ID NO: 766577 - RNA, 19 nt, Human
ccccggcacccccacugcu

SEQ ID NO: 766578 - RNA, 25 nt, Human
ccccggcacccccacugcucaggcc

SEQ ID NO: 766579 - RNA, 20 nt, Human
ccccucagagcagcagggga

SEQ ID NO: 766580 - RNA, 20 nt, Human
ccccugaccuccugcccagg

SEQ ID NO: 766581 - RNA, 19 nt, Human
cccucagagcuguccucau

SEQ ID NO: 766582 - RNA, 18 nt, Human
cccuugggaaaggcagag

SEQ ID NO: 766583 - RNA, 22 nt, Human
ccggcacugcaccuggcccuca

SEQ ID NO: 766584 - RNA, 21 nt, Human
ccucacucuccugggagcgga

SEQ ID NO: 766585 - RNA, 22 nt, Human
ccuccagggacaugaaagcagg

SEQ ID NO: 766586 - RNA, 27 nt, Human
ccuccugcucuuuuuuucagggcuggg

SEQ ID NO: 766587 - RNA, 20 nt, Human
cgccaaacuaacaaacaaaa

SEQ ID NO: 766588 - RNA, 22 nt, Human
cgccaaacuaacaaacaaaaca

SEQ ID NO: 766589 - RNA, 21 nt, Human
cuccagagguggccagugaga

SEQ ID NO: 766590 - RNA, 24 nt, Human
cuccagggcucccauccuuccuuu

SEQ ID NO: 766591 - RNA, 24 nt, Human
cuccugggagcggagcaacaaaaa

SEQ ID NO: 766592 - RNA, 24 nt, Human
cugggagcggagcaacaaaaaggc

SEQ ID NO: 766593 - RNA, 22 nt, Human
cuugcccacuccagggcuccca

SEQ ID NO: 766594 - RNA, 23 nt, Human
gaaaggucacagugaggcugagg

SEQ ID NO: 766595 - RNA, 21 nt, Human
gacagucccugaagacaguuc

SEQ ID NO: 766596 - RNA, 23 nt, Human
gacccauccuuuuucaaaaccuu

SEQ ID NO: 766597 - RNA, 20 nt, Human
gcaacaggccaaggcgagcc

SEQ ID NO: 766598 - RNA, 18 nt, Human
gcagaaagggcagagaag

SEQ ID NO: 766599 - RNA, 21 nt, Human
gccguagugcagaagugcugg

SEQ ID NO: 766600 - RNA, 20 nt, Human
gcuggcauggaugggugggg

SEQ ID NO: 766601 - RNA, 20 nt, Human
gcuggggaccagggcuggag

SEQ ID NO: 766602 - RNA, 19 nt, Human
ggagaggagcgagggugcu

SEQ ID NO: 766603 - RNA, 23 nt, Human
ggagcuagccuugcaggcuaggg

SEQ ID NO: 766604 - RNA, 20 nt, Human
ggaugggaaggagggcagaa

SEQ ID NO: 766605 - RNA, 25 nt, Human
ggaugggaaggagggcagaaagggc

SEQ ID NO: 766606 - RNA, 22 nt, Human
ggcucaggagacccaccccucu

SEQ ID NO: 766607 - RNA, 21 nt, Human
ggcuggggaccagggcuggag

SEQ ID NO: 766608 - RNA, 22 nt, Human
gggagcggagcaacaaaaaggc

SEQ ID NO: 766609 - RNA, 23 nt, Human
gggagcggagcaacaaaaaggcu

SEQ ID NO: 766610 - RNA, 22 nt, Human
gggcagaaagggcagagaaggg

SEQ ID NO: 766611 - RNA, 24 nt, Human
gggccagagcuaguagccaggaga

SEQ ID NO: 766612 - RNA, 20 nt, Human
guagcaaccuccaccccuaa

SEQ ID NO: 766613 - RNA, 21 nt, Human
gugcagugccccacccucugc

SEQ ID NO: 766614 - RNA, 23 nt, Human
gugcuggcauggauggguggggu

SEQ ID NO: 766615 - RNA, 19 nt, Human
guguccccuccugcucuuu

SEQ ID NO: 766616 - RNA, 24 nt, Human
uaacgccaaacuaacaaacaaaac

SEQ ID NO: 766617 - RNA, 21 nt, Human
ucagagcagcaggggacagag

SEQ ID NO: 766618 - RNA, 22 nt, Human
ucagcagguggccuggucuugc

SEQ ID NO: 766619 - RNA, 20 nt, Human
ucagcuuguuccuccccacc

SEQ ID NO: 766620 - RNA, 26 nt, Human
ucaggagacccaccccucuccccuca

SEQ ID NO: 766621 - RNA, 20 nt, Human
uccacagcgaccucagcagg

SEQ ID NO: 766622 - RNA, 19 nt, Human
uccaguguaaagcuugggg

SEQ ID NO: 766623 - RNA, 22 nt, Human
uccccugaccuccugcccaggg

SEQ ID NO: 766624 - RNA, 21 nt, Human
ucccugaagacaguucagcuu

SEQ ID NO: 766625 - RNA, 24 nt, Human
uccgaaagccagcaaguuguagca

SEQ ID NO: 766626 - RNA, 22 nt, Human
uccuccccaccugaggcagaag

SEQ ID NO: 766627 - RNA, 24 nt, Human
uccugcucuuuuuuucagggcugg

SEQ ID NO: 766628 - RNA, 23 nt, Human
ucuccccucagagcagcagggga

SEQ ID NO: 766629 - RNA, 19 nt, Human
ucuuuggucuuuguggcgg

SEQ ID NO: 766630 - RNA, 18 nt, Human
ugaaagcaggagaugggg

SEQ ID NO: 766631 - RNA, 24 nt, Human
ugaagacaguucagcuuguuccuc

SEQ ID NO: 766632 - RNA, 24 nt, Human
ugagcagcaucaccuccaacgggu

SEQ ID NO: 766633 - RNA, 21 nt, Human
uggagggucuagcugggccgg

SEQ ID NO: 766634 - RNA, 25 nt, Human
uggcagaaaggucacagugaggcug

SEQ ID NO: 766635 - RNA, 18 nt, Human
ugggaugggaaggagggc

SEQ ID NO: 766636 - RNA, 19 nt, Human
ugggaugggaaggagggca

SEQ ID NO: 766637 - RNA, 21 nt, Human
ugggaugggaaggagggcaga

SEQ ID NO: 766638 - RNA, 21 nt, Human
ugggcuccgcucuaacacugg

SEQ ID NO: 766639 - RNA, 18 nt, Human
uggggcugcuggggaggg

SEQ ID NO: 766640 - RNA, 19 nt, Human
ugggggggggcauauggag

SEQ ID NO: 766641 - RNA, 24 nt, Human
ugggguaaggugcagugccccacc

SEQ ID NO: 766642 - RNA, 18 nt, Human
ugguggggaagacaaacc

SEQ ID NO: 766643 - RNA, 26 nt, Human
uguaaagcuuggggcugcuggggagg

SEQ ID NO: 766644 - RNA, 20 nt, Human
uuggucuuuguggcggcuca

SEQ ID NO: 766645 - RNA, 21 nt, Human
uuguggcggcucagcaugugg

SEQ ID NO: 766646 - RNA, 21 nt, Human
aaaaacagacagacuucagug

SEQ ID NO: 766647 - RNA, 20 nt, Human
aaaaugccaaaccuaagugg

SEQ ID NO: 766648 - RNA, 20 nt, Human
aaaauggugaaaccccaucu

SEQ ID NO: 766649 - RNA, 22 nt, Human
aaacuguaauccacaauauucu

SEQ ID NO: 766650 - RNA, 21 nt, Human
aaagaaaugagguaugaugaa

SEQ ID NO: 766651 - RNA, 23 nt, Human
aaauauaaaauaugaaaagucuu

SEQ ID NO: 766652 - RNA, 22 nt, Human
aacaaaaucaguagaaauauaa

SEQ ID NO: 766653 - RNA, 20 nt, Human
aaccauauaauggaaaaaac

SEQ ID NO: 766654 - RNA, 27 nt, Human
aaccauauaauggaaaaaacaagaaac

SEQ ID NO: 766655 - RNA, 18 nt, Human
aacugcuugaacccggga

SEQ ID NO: 766656 - RNA, 23 nt, Human
aagaacagaccauuuuccuuuga

SEQ ID NO: 766657 - RNA, 19 nt, Human
aagaaccuauauuucaaag

SEQ ID NO: 766658 - RNA, 24 nt, Human
aagcagagguugcagugagccaag

SEQ ID NO: 766659 - RNA, 25 nt, Human
aagcagagguugcagugagccaaga

SEQ ID NO: 766660 - RNA, 23 nt, Human
aagcaggaaacugcuugaacccg

SEQ ID NO: 766661 - RNA, 27 nt, Human
aauaaaaauucccucuaauaauguaga

SEQ ID NO: 766662 - RNA, 25 nt, Human
aauaauaaaauagaaauucaguaau

SEQ ID NO: 766663 - RNA, 24 nt, Human
aauacacuaaaauaauacugagac

SEQ ID NO: 766664 - RNA, 21 nt, Human
aaugaccaccucauuaauaaa

SEQ ID NO: 766665 - RNA, 21 nt, Human
aauuauacuaccaagggggcc

SEQ ID NO: 766666 - RNA, 20 nt, Human
acacaaauguaauaaugacu

SEQ ID NO: 766667 - RNA, 23 nt, Human
acagagcgagacuccgucucaaa

SEQ ID NO: 766668 - RNA, 18 nt, Human
accccaucucuacuaaaa

SEQ ID NO: 766669 - RNA, 24 nt, Human
accugaggucaggaguucaagacu

SEQ ID NO: 766670 - RNA, 18 nt, Human
acucagaagaaaaauacu

SEQ ID NO: 766671 - RNA, 21 nt, Human
acuccgugacagcaaguucac

SEQ ID NO: 766672 - RNA, 24 nt, Human
acugcauuccagccugggugacag

SEQ ID NO: 766673 - RNA, 26 nt, Human
acugcauuccagccugggugacagag

SEQ ID NO: 766674 - RNA, 23 nt, Human
agaaagauguuagcuguuaagug

SEQ ID NO: 766675 - RNA, 18 nt, Human
agacagacuucaccuaca

SEQ ID NO: 766676 - RNA, 22 nt, Human
agacagccaauauaaaaaacag

SEQ ID NO: 766677 - RNA, 19 nt, Human
agacuucaccuacagcagu

SEQ ID NO: 766678 - RNA, 20 nt, Human
agagaucauuuuugucuaca

SEQ ID NO: 766679 - RNA, 24 nt, Human
agagguugcagugagccaagaucg

SEQ ID NO: 766680 - RNA, 23 nt, Human
agaucaccugaggucaggaguuc

SEQ ID NO: 766681 - RNA, 21 nt, Human
agccuggcaugguggcauguc

SEQ ID NO: 766682 - RNA, 24 nt, Human
agccugggugacagagcgagacuc

SEQ ID NO: 766683 - RNA, 26 nt, Human
aggcgggcagaucaccugaggucagg

SEQ ID NO: 766684 - RNA, 18 nt, Human
agguacuaagguacuaac

SEQ ID NO: 766685 - RNA, 24 nt, Human
aguggcucaggccuguaaugucag

SEQ ID NO: 766686 - RNA, 18 nt, Human
aguguucugccuuggcua

SEQ ID NO: 766687 - RNA, 22 nt, Human
auaaaacaggcacuggcaguga

SEQ ID NO: 766688 - RNA, 21 nt, Human
auaaauacaacccaggaacac

SEQ ID NO: 766689 - RNA, 24 nt, Human
aucgugccacugcauuccagccug

SEQ ID NO: 766690 - RNA, 20 nt, Human
augaagcacugauaugaaca

SEQ ID NO: 766691 - RNA, 24 nt, Human
augguggcaugucuguaaucccag

SEQ ID NO: 766692 - RNA, 19 nt, Human
caaaaccucacaggcaaga

SEQ ID NO: 766693 - RNA, 21 nt, Human
caaaaccuuaacacuaguuau

SEQ ID NO: 766694 - RNA, 23 nt, Human
caaauuuucucuucauauuagac

SEQ ID NO: 766695 - RNA, 22 nt, Human
caagaguugaaucgauaaccau

SEQ ID NO: 766696 - RNA, 24 nt, Human
caagaucgugccacugcauuccag

SEQ ID NO: 766697 - RNA, 24 nt, Human
caaggcgggcagaucaccugaggu

SEQ ID NO: 766698 - RNA, 26 nt, Human
caaggcgggcagaucaccugagguca

SEQ ID NO: 766699 - RNA, 21 nt, Human
cacaaauguaauaaugaccac

SEQ ID NO: 766700 - RNA, 22 nt, Human
cacaaauguaauaaugaccacc

SEQ ID NO: 766701 - RNA, 24 nt, Human
caccuacagcagucucuugaaaac

SEQ ID NO: 766702 - RNA, 23 nt, Human
caccugaggucaggaguucaaga

SEQ ID NO: 766703 - RNA, 19 nt, Human
cacugcauuccagccuggg

SEQ ID NO: 766704 - RNA, 19 nt, Human
cacugcauuccagccuggg

SEQ ID NO: 766705 - RNA, 22 nt, Human
cacugcauuccagccuggguga

SEQ ID NO: 766706 - RNA, 24 nt, Human
cacugcauuccagccugggugaca

SEQ ID NO: 766707 - RNA, 25 nt, Human
cacugcauuccagccugggugacag

SEQ ID NO: 766708 - RNA, 22 nt, Human
cagacagacuucagugaaagcu

SEQ ID NO: 766709 - RNA, 24 nt, Human
cagaucaccugaggucaggaguuc

SEQ ID NO: 766710 - RNA, 27 nt, Human
cagaucaccugaggucaggaguucaag

SEQ ID NO: 766711 - RNA, 24 nt, Human
cagcacuuugggaggccaaggcgg

SEQ ID NO: 766712 - RNA, 18 nt, Human
caggaguucaagacuaga

SEQ ID NO: 766713 - RNA, 24 nt, Human
caggccuguaaugucagcacuuug

SEQ ID NO: 766714 - RNA, 24 nt, Human
cagugacaaauguuguuaggggaa

SEQ ID NO: 766715 - RNA, 22 nt, Human
cauuccagccugggugacagag

SEQ ID NO: 766716 - RNA, 23 nt, Human
cauuccagccugggugacagagc

SEQ ID NO: 766717 - RNA, 23 nt, Human
cauuuuacagauaaugcaaauua

SEQ ID NO: 766718 - RNA, 20 nt, Human
ccacugcauuccagccuggg

SEQ ID NO: 766719 - RNA, 20 nt, Human
ccacugcauuccagccuggg

SEQ ID NO: 766720 - RNA, 21 nt, Human
ccacugcauuccagccugggu

SEQ ID NO: 766721 - RNA, 21 nt, Human
ccacugcauuccagccugggu

SEQ ID NO: 766722 - RNA, 23 nt, Human
ccacugcauuccagccuggguga

SEQ ID NO: 766723 - RNA, 24 nt, Human
ccacugcauuccagccugggugac

SEQ ID NO: 766724 - RNA, 22 nt, Human
ccauucuucucaugaaugacaa

SEQ ID NO: 766725 - RNA, 22 nt, Human
ccuauauuucaaagcuccaaaa

SEQ ID NO: 766726 - RNA, 20 nt, Human
ccugauaaagcaagcuuugg

SEQ ID NO: 766727 - RNA, 22 nt, Human
ccugggugacagagcgagacuc

SEQ ID NO: 766728 - RNA, 18 nt, Human
ccuuuguuaacaaaggcu

SEQ ID NO: 766729 - RNA, 23 nt, Human
ccuuuuguuuguuuuggaaccua

SEQ ID NO: 766730 - RNA, 24 nt, Human
cgggaagcagagguugcagugagc

SEQ ID NO: 766731 - RNA, 24 nt, Human
cgggcagaucaccugaggucagga

SEQ ID NO: 766732 - RNA, 24 nt, Human
cgucucaaaugaaaaaaaaaaaaa

SEQ ID NO: 766733 - RNA, 20 nt, Human
cucagaagaaaaauacugua

SEQ ID NO: 766734 - RNA, 24 nt, Human
cucaggccuguaaugucagcacuu

SEQ ID NO: 766735 - RNA, 18 nt, Human
cucuugaaaacuugguug

SEQ ID NO: 766736 - RNA, 24 nt, Human
cugaagcaggaaacugcuugaacc

SEQ ID NO: 766737 - RNA, 18 nt, Human
cugaauugaaauaucucu

SEQ ID NO: 766738 - RNA, 21 nt, Human
cugacugaauugaaauaucuc

SEQ ID NO: 766739 - RNA, 24 nt, Human
cugcuugaacccgggaagcagagg

SEQ ID NO: 766740 - RNA, 18 nt, Human
cuguaaucccagcuacuu

SEQ ID NO: 766741 - RNA, 20 nt, Human
cuguaaucccagcuacuugg

SEQ ID NO: 766742 - RNA, 23 nt, Human
cuuggagagcuguuuaaagaaau

SEQ ID NO: 766743 - RNA, 21 nt, Human
cuuggcuagacagacuucacc

SEQ ID NO: 766744 - RNA, 22 nt, Human
gaaaaucugaaaucaucuugcc

SEQ ID NO: 766745 - RNA, 19 nt, Human
gaagcacugauaugaacaa

SEQ ID NO: 766746 - RNA, 21 nt, Human
gaaguauuaaagacuuuuccc

SEQ ID NO: 766747 - RNA, 21 nt, Human
gacaaaggacauuuuuacuac

SEQ ID NO: 766748 - RNA, 19 nt, Human
gacaagggcaauguguucc

SEQ ID NO: 766749 - RNA, 21 nt, Human
gacagagcgagacuccgucuc

SEQ ID NO: 766750 - RNA, 18 nt, Human
gagcuuccuuuuugaauc

SEQ ID NO: 766751 - RNA, 18 nt, Human
gagguugcagugagccaa

SEQ ID NO: 766752 - RNA, 23 nt, Human
gaucaccugaggucaggaguuca

SEQ ID NO: 766753 - RNA, 24 nt, Human
gaucaccugaggucaggaguucaa

SEQ ID NO: 766754 - RNA, 24 nt, Human
gcauuccagccugggugacagagc

SEQ ID NO: 766755 - RNA, 24 nt, Human
gccaaaauggugaaaccccaucuc

SEQ ID NO: 766756 - RNA, 20 nt, Human
gccaaaccuaaguggaaauc

SEQ ID NO: 766757 - RNA, 20 nt, Human
gccaagaucgugccacugca

SEQ ID NO: 766758 - RNA, 19 nt, Human
gccacugcauuccagccug

SEQ ID NO: 766759 - RNA, 24 nt, Human
gccacugcauuccagccuggguga

SEQ ID NO: 766760 - RNA, 20 nt, Human
ggaagcagagguugcaguga

SEQ ID NO: 766761 - RNA, 25 nt, Human
ggcagaucaccugaggucaggaguu

SEQ ID NO: 766762 - RNA, 19 nt, Human
ggcaugucuguaaucccag

SEQ ID NO: 766763 - RNA, 20 nt, Human
ggccaaaauggugaaacccc

SEQ ID NO: 766764 - RNA, 23 nt, Human
ggcgcaguggcucaggccuguaa

SEQ ID NO: 766765 - RNA, 19 nt, Human
ggcugggcgcaguggcuca

SEQ ID NO: 766766 - RNA, 20 nt, Human
gggcaugguccugauaaagc

SEQ ID NO: 766767 - RNA, 19 nt, Human
guaugacaaaggacauuuu

SEQ ID NO: 766768 - RNA, 24 nt, Human
uaaaaaaauuuuucagauauagga

SEQ ID NO: 766769 - RNA, 18 nt, Human
uaaaaaacagacagacuu

SEQ ID NO: 766770 - RNA, 27 nt, Human
uaaaaaauacagugagcuaggucaaaa

SEQ ID NO: 766771 - RNA, 22 nt, Human
uaaaaugugaugcuuuauacaa

SEQ ID NO: 766772 - RNA, 26 nt, Human
uaaauaaaugcacuauuuuauacaga

SEQ ID NO: 766773 - RNA, 21 nt, Human
uaaauuaugaaaauuuaacuc

SEQ ID NO: 766774 - RNA, 24 nt, Human
uaaggaacauaccuggcugcuggc

SEQ ID NO: 766775 - RNA, 19 nt, Human
uaauagccucaaaacugua

SEQ ID NO: 766776 - RNA, 24 nt, Human
uaauccucaauuuaacacacccaa

SEQ ID NO: 766777 - RNA, 23 nt, Human
uaauuagcauuuuacuccgugac

SEQ ID NO: 766778 - RNA, 24 nt, Human
uaauuuauuaaagccuuacacugc

SEQ ID NO: 766779 - RNA, 18 nt, Human
uacuaacaagacaagggc

SEQ ID NO: 766780 - RNA, 21 nt, Human
uagaauuuaaaggaggccaac

SEQ ID NO: 766781 - RNA, 20 nt, Human
uagagcuuuaagcauuuaac

SEQ ID NO: 766782 - RNA, 20 nt, Human
uauaaagaaauacuaaagac

SEQ ID NO: 766783 - RNA, 24 nt, Human
uaugaacaaaaccucacaggcaag

SEQ ID NO: 766784 - RNA, 21 nt, Human
uauguuuauguuuugaacugu

SEQ ID NO: 766785 - RNA, 23 nt, Human
uauuggcugggcgcaguggcuca

SEQ ID NO: 766786 - RNA, 23 nt, Human
ucaccugaggucaggaguucaag

SEQ ID NO: 766787 - RNA, 22 nt, Human
ucauucaggagccuuuguugau

SEQ ID NO: 766788 - RNA, 21 nt, Human
uccagccugggugacagagcg

SEQ ID NO: 766789 - RNA, 23 nt, Human
uccagccugggugacagagcgag

SEQ ID NO: 766790 - RNA, 24 nt, Human
uccagccugggugacagagcgaga

SEQ ID NO: 766791 - RNA, 23 nt, Human
ucgugccacugcauuccagccug

SEQ ID NO: 766792 - RNA, 23 nt, Human
ucucaaaugaaaaaaaaaaaaaa

SEQ ID NO: 766793 - RNA, 22 nt, Human
ucuccaaaaauacacuuuucau

SEQ ID NO: 766794 - RNA, 20 nt, Human
ucucccuuggcagugguggu

SEQ ID NO: 766795 - RNA, 22 nt, Human
ucucuacuaaaaauauuaaaaa

SEQ ID NO: 766796 - RNA, 18 nt, Human
ucugaagcaggaaacugc

SEQ ID NO: 766797 - RNA, 23 nt, Human
ucugacugaauugaaauaucucu

SEQ ID NO: 766798 - RNA, 20 nt, Human
ucugcaguaagaaauguccu

SEQ ID NO: 766799 - RNA, 22 nt, Human
ucugcaguaagaaauguccuuc

SEQ ID NO: 766800 - RNA, 21 nt, Human
ucuguaaucccagcuacuugg

SEQ ID NO: 766801 - RNA, 19 nt, Human
ucuguauuuggggagaaaa

SEQ ID NO: 766802 - RNA, 24 nt, Human
ugaaaacuugguugcccaucugaa

SEQ ID NO: 766803 - RNA, 19 nt, Human
ugaaaccccaucucuacua

SEQ ID NO: 766804 - RNA, 18 nt, Human
ugaaagcaagugaaaagu

SEQ ID NO: 766805 - RNA, 20 nt, Human
ugaaagcaagugaaaagugg

SEQ ID NO: 766806 - RNA, 19 nt, Human
ugaaagcagaacuuaugaa

SEQ ID NO: 766807 - RNA, 23 nt, Human
ugaaagcagaacuuaugaaaugc

SEQ ID NO: 766808 - RNA, 23 nt, Human
ugaagcaggaaacugcuugaacc

SEQ ID NO: 766809 - RNA, 24 nt, Human
ugaagcaggaaacugcuugaaccc

SEQ ID NO: 766810 - RNA, 20 nt, Human
ugaagucauagugcuacaau

SEQ ID NO: 766811 - RNA, 20 nt, Human
ugaauaaaugcauagcaaua

SEQ ID NO: 766812 - RNA, 22 nt, Human
ugacagcaagugacgaugugag

SEQ ID NO: 766813 - RNA, 18 nt, Human
ugaccaccucauuaauaa

SEQ ID NO: 766814 - RNA, 20 nt, Human
ugacgaugugaggcuuaaaa

SEQ ID NO: 766815 - RNA, 22 nt, Human
ugagccaagaucgugccacugc

SEQ ID NO: 766816 - RNA, 18 nt, Human
ugagcuaggucaaaguca

SEQ ID NO: 766817 - RNA, 25 nt, Human
ugauaugaacaaaaccucacaggca

SEQ ID NO: 766818 - RNA, 18 nt, Human
ugcugaaagcagaacuua

SEQ ID NO: 766819 - RNA, 21 nt, Human
uggaaaaaacaagaaacaaga

SEQ ID NO: 766820 - RNA, 18 nt, Human
uggaauguuacaguacca

SEQ ID NO: 766821 - RNA, 20 nt, Human
uggcagugacagcaagugac

SEQ ID NO: 766822 - RNA, 25 nt, Human
uggcaguggugguagcauaggaaac

SEQ ID NO: 766823 - RNA, 26 nt, Human
uggcaguggugguagcauaggaaacu

SEQ ID NO: 766824 - RNA, 19 nt, Human
uggcaucgaauacuuucac

SEQ ID NO: 766825 - RNA, 20 nt, Human
uggcaugucuguaaucccag

SEQ ID NO: 766826 - RNA, 22 nt, Human
uggccaaaauggugaaacccca

SEQ ID NO: 766827 - RNA, 24 nt, Human
uggcucaggccuguaaugucagca

SEQ ID NO: 766828 - RNA, 24 nt, Human
ugggaggccaaggcgggcagauca

SEQ ID NO: 766829 - RNA, 21 nt, Human
ugguauuggcugggcgcagug

SEQ ID NO: 766830 - RNA, 18 nt, Human
uggucagauguuuaaugg

SEQ ID NO: 766831 - RNA, 22 nt, Human
ugguggcaugucuguaauccca

SEQ ID NO: 766832 - RNA, 19 nt, Human
ugguucauauaaauguaua

SEQ ID NO: 766833 - RNA, 21 nt, Human
uguaaucccagcuacuuggaa

SEQ ID NO: 766834 - RNA, 23 nt, Human
ugucuguaaucccagcuacuugg

SEQ ID NO: 766835 - RNA, 19 nt, Human
uguuucaaugcuuuaucag

SEQ ID NO: 766836 - RNA, 22 nt, Human
uuaaagccuuacacugcuguuc

SEQ ID NO: 766837 - RNA, 25 nt, Human
uuaagcauuuaacauuaucaauacu

SEQ ID NO: 766838 - RNA, 21 nt, Human
uuauccgccacauaugaaggc

SEQ ID NO: 766839 - RNA, 18 nt, Human
uucaaauauauuguagcc

SEQ ID NO: 766840 - RNA, 22 nt, Human
uucauugacacaaauguaauaa

SEQ ID NO: 766841 - RNA, 18 nt, Human
uuccaaggguggcacagu

SEQ ID NO: 766842 - RNA, 22 nt, Human
uugcagugagccaagaucgugc

SEQ ID NO: 766843 - RNA, 23 nt, Human
uugcaguuuuaugauuauucugg

SEQ ID NO: 766844 - RNA, 21 nt, Human
uuucucccuuggcaguggugg

SEQ ID NO: 766845 - RNA, 23 nt, Human
uuuugcaguuuuaugauuauucu

SEQ ID NO: 766846 - RNA, 23 nt, Human
aaaaaagaaaaaaauaauaauag

SEQ ID NO: 766847 - RNA, 20 nt, Human
aaaaacugccacaaaugcca

SEQ ID NO: 766848 - RNA, 19 nt, Human
aaaaagccaaugcauuuuc

SEQ ID NO: 766849 - RNA, 23 nt, Human
aaaaagccguccaaaucacacaa

SEQ ID NO: 766850 - RNA, 22 nt, Human
aaacaaaacaaacuaccaccac

SEQ ID NO: 766851 - RNA, 25 nt, Human
aaacaaaacaaacuaccaccacuaa

SEQ ID NO: 766852 - RNA, 21 nt, Human
aaacaaacuaccaccacuaaa

SEQ ID NO: 766853 - RNA, 19 nt, Human
aaacugacacaaauaugca

SEQ ID NO: 766854 - RNA, 19 nt, Human
aaacugccacaaaugccag

SEQ ID NO: 766855 - RNA, 18 nt, Human
aaaucacacaacaguuag

SEQ ID NO: 766856 - RNA, 19 nt, Human
aacacuccauuaaaacaca

SEQ ID NO: 766857 - RNA, 20 nt, Human
aacagggcaagacuccaucu

SEQ ID NO: 766858 - RNA, 27 nt, Human
aacaguuucaaaacagcuauuuuggug

SEQ ID NO: 766859 - RNA, 19 nt, Human
aacauggugaaaccccauc

SEQ ID NO: 766860 - RNA, 20 nt, Human
aacauggugaaaccccaucu

SEQ ID NO: 766861 - RNA, 21 nt, Human
aacauggugaaaccccaucuc

SEQ ID NO: 766862 - RNA, 21 nt, Human
aacauggugaaaccccaucuc

SEQ ID NO: 766863 - RNA, 31 nt, Human
aagcaauuaaaacaguuucaaaacagcuauu

SEQ ID NO: 766864 - RNA, 21 nt, Human
aagcagacauaaauacucuau

SEQ ID NO: 766865 - RNA, 21 nt, Human
aaguuuguuuucucaacugga

SEQ ID NO: 766866 - RNA, 24 nt, Human
aauugcuugaacccgggaggcgga

SEQ ID NO: 766867 - RNA, 19 nt, Human
acaaaacaaacuaccacca

SEQ ID NO: 766868 - RNA, 18 nt, Human
acaacagaaacagcaggc

SEQ ID NO: 766869 - RNA, 21 nt, Human
acaagacaacagaaacagcag

SEQ ID NO: 766870 - RNA, 21 nt, Human
acacagcacacacacacagaa

SEQ ID NO: 766871 - RNA, 19 nt, Human
acagaaacagcaggccaca

SEQ ID NO: 766872 - RNA, 24 nt, Human
acagggcaagacuccaucucaaaa

SEQ ID NO: 766873 - RNA, 20 nt, Human
acauacaagacaacagaaac

SEQ ID NO: 766874 - RNA, 23 nt, Human
accccaucucuacuaaaauacaa

SEQ ID NO: 766875 - RNA, 23 nt, Human
acuaaaauacaaaaaaucagcca

SEQ ID NO: 766876 - RNA, 24 nt, Human
acugcacuccagccugggcaacag

SEQ ID NO: 766877 - RNA, 24 nt, Human
acugcacuccagccugggcaacag

SEQ ID NO: 766878 - RNA, 19 nt, Human
acugcauuccaauauccaa

SEQ ID NO: 766879 - RNA, 18 nt, Human
agacaacagaaacagcag

SEQ ID NO: 766880 - RNA, 21 nt, Human
agacaacagaaacagcaggcc

SEQ ID NO: 766881 - RNA, 23 nt, Human
agacaacagaaacagcaggccac

SEQ ID NO: 766882 - RNA, 21 nt, Human
agacauaaauacucuaugauc

SEQ ID NO: 766883 - RNA, 18 nt, Human
agagugggaugggucugg

SEQ ID NO: 766884 - RNA, 21 nt, Human
agauauguacacaucacccuc

SEQ ID NO: 766885 - RNA, 19 nt, Human
agaugaguggggaaaccug

SEQ ID NO: 766886 - RNA, 27 nt, Human
agauguuuguuuaguucaaguagagau

SEQ ID NO: 766887 - RNA, 24 nt, Human
agcaagaaugccaagacagagaaa

SEQ ID NO: 766888 - RNA, 20 nt, Human
agcauccugcagaaaauagc

SEQ ID NO: 766889 - RNA, 18 nt, Human
agccaggcauggcggugu

SEQ ID NO: 766890 - RNA, 24 nt, Human
agcccaggcaacauggugaaaccc

SEQ ID NO: 766891 - RNA, 24 nt, Human
agccugggcaacagggcaagacuc

SEQ ID NO: 766892 - RNA, 21 nt, Human
aggcaacauggugaaacccca

SEQ ID NO: 766893 - RNA, 24 nt, Human
aggcaggagaauugcuugaacccg

SEQ ID NO: 766894 - RNA, 20 nt, Human
aggcaggcagacugccugag

SEQ ID NO: 766895 - RNA, 19 nt, Human
aggcauggcggugugcacc

SEQ ID NO: 766896 - RNA, 24 nt, Human
aggcgcaguggcucaugucuguaa

SEQ ID NO: 766897 - RNA, 21 nt, Human
aggcggagguugcagugagcc

SEQ ID NO: 766898 - RNA, 24 nt, Human
aggcggagguugcagugagccgag

SEQ ID NO: 766899 - RNA, 21 nt, Human
aggcugaggcaggagaauugc

SEQ ID NO: 766900 - RNA, 24 nt, Human
aggcugaggcaggagaauugcuug

SEQ ID NO: 766901 - RNA, 21 nt, Human
aggcugaggcaggcagacugc

SEQ ID NO: 766902 - RNA, 20 nt, Human
aggguccaaacaacagagaa

SEQ ID NO: 766903 - RNA, 22 nt, Human
agugauucauucaaggcaacac

SEQ ID NO: 766904 - RNA, 23 nt, Human
aguggcucaugucuguaauccca

SEQ ID NO: 766905 - RNA, 24 nt, Human
aguggcucaugucuguaaucccag

SEQ ID NO: 766906 - RNA, 18 nt, Human
auaaauauuaaaaugaca

SEQ ID NO: 766907 - RNA, 21 nt, Human
aucuugccucugauccuucua

SEQ ID NO: 766908 - RNA, 20 nt, Human
augaaacaaaacaaacuacc

SEQ ID NO: 766909 - RNA, 19 nt, Human
augucuguaaucccagcac

SEQ ID NO: 766910 - RNA, 26 nt, Human
caaaaagccguccaaaucacacaaca

SEQ ID NO: 766911 - RNA, 18 nt, Human
caaaauggccacuagagg

SEQ ID NO: 766912 - RNA, 23 nt, Human
caaacauguaguacuugcuuggg

SEQ ID NO: 766913 - RNA, 21 nt, Human
caacagaaacagcaggccaca

SEQ ID NO: 766914 - RNA, 23 nt, Human
caacagaaacagcaggccacaua

SEQ ID NO: 766915 - RNA, 25 nt, Human
caacaguuaggagcuacauagggcc

SEQ ID NO: 766916 - RNA, 22 nt, Human
caacauggugaaaccccaucuc

SEQ ID NO: 766917 - RNA, 24 nt, Human
caacauggugaaaccccaucucua

SEQ ID NO: 766918 - RNA, 24 nt, Human
caagacaacagaaacagcaggcca

SEQ ID NO: 766919 - RNA, 21 nt, Human
caagacuccaucucaaaaaaa

SEQ ID NO: 766920 - RNA, 23 nt, Human
caagacuccaucucaaaaaaaga

SEQ ID NO: 766921 - RNA, 22 nt, Human
caaggcaacacuccauuaaaac

SEQ ID NO: 766922 - RNA, 21 nt, Human
cacacacacacagaaacaaaa

SEQ ID NO: 766923 - RNA, 23 nt, Human
cacacacacacagaaacaaaaga

SEQ ID NO: 766924 - RNA, 25 nt, Human
cacagcacacacacacagaaacaaa

SEQ ID NO: 766925 - RNA, 23 nt, Human
cacagguacucaagagauauaug

SEQ ID NO: 766926 - RNA, 18 nt, Human
caccacuaaaaaacccgu

SEQ ID NO: 766927 - RNA, 23 nt, Human
caccacuaaaaaacccguaagag

SEQ ID NO: 766928 - RNA, 19 nt, Human
caccccucuuuuuucaagg

SEQ ID NO: 766929 - RNA, 21 nt, Human
cacccucugaaugaacaauau

SEQ ID NO: 766930 - RNA, 23 nt, Human
cacuccagccugggcaacagggc

SEQ ID NO: 766931 - RNA, 19 nt, Human
cacugcacuccagccuggg

SEQ ID NO: 766932 - RNA, 21 nt, Human
cacugcacuccagccugggca

SEQ ID NO: 766933 - RNA, 22 nt, Human
cacugcacuccagccugggcaa

SEQ ID NO: 766934 - RNA, 23 nt, Human
cacugcacuccagccugggcaac

SEQ ID NO: 766935 - RNA, 24 nt, Human
cacugcacuccagccugggcaaca

SEQ ID NO: 766936 - RNA, 27 nt, Human
cacugcacuccagccugggcaacaggg

SEQ ID NO: 766937 - RNA, 21 nt, Human
cagcaaaauaggcuccgucug

SEQ ID NO: 766938 - RNA, 21 nt, Human
cagcacucuaggaggcugagg

SEQ ID NO: 766939 - RNA, 24 nt, Human
cagcacucuaggaggcugaggcag

SEQ ID NO: 766940 - RNA, 19 nt, Human
cagcaggccacauaauauc

SEQ ID NO: 766941 - RNA, 24 nt, Human
cagcuacucgggaggcugaggcag

SEQ ID NO: 766942 - RNA, 19 nt, Human
cagcucaaaacucaggcaa

SEQ ID NO: 766943 - RNA, 20 nt, Human
caggcaacauggugaaaccc

SEQ ID NO: 766944 - RNA, 21 nt, Human
cauuagcaacuaccauacaaa

SEQ ID NO: 766945 - RNA, 18 nt, Human
cauuuucaucacauauau

SEQ ID NO: 766946 - RNA, 24 nt, Human
ccaagacagagaaaucuauucaca

SEQ ID NO: 766947 - RNA, 19 nt, Human
ccacagaaaaggccugucc

SEQ ID NO: 766948 - RNA, 18 nt, Human
ccacugcacuccagccug

SEQ ID NO: 766949 - RNA, 20 nt, Human
ccacugcacuccagccuggg

SEQ ID NO: 766950 - RNA, 21 nt, Human
ccacugcacuccagccugggc

SEQ ID NO: 766951 - RNA, 23 nt, Human
ccacugcacuccagccugggcaa

SEQ ID NO: 766952 - RNA, 24 nt, Human
ccacugcacuccagccugggcaac

SEQ ID NO: 766953 - RNA, 23 nt, Human
ccaggcaacauggugaaacccca

SEQ ID NO: 766954 - RNA, 26 nt, Human
cccaagcaauuaaaacaguuucaaaa

SEQ ID NO: 766955 - RNA, 23 nt, Human
ccuacaucaguuaaaagcauccu

SEQ ID NO: 766956 - RNA, 21 nt, Human
ccugcacucccagcuacucgg

SEQ ID NO: 766957 - RNA, 22 nt, Human
ccugggcaacagggcaagacuc

SEQ ID NO: 766958 - RNA, 24 nt, Human
cgagaucgugccacugcacuccag

SEQ ID NO: 766959 - RNA, 24 nt, Human
cgggaggcggagguugcagugagc

SEQ ID NO: 766960 - RNA, 20 nt, Human
cgugcaauagcaaaacugua

SEQ ID NO: 766961 - RNA, 23 nt, Human
cguucaucauagaggcaaaauau

SEQ ID NO: 766962 - RNA, 23 nt, Human
cucaugucuguaaucccagcacu

SEQ ID NO: 766963 - RNA, 18 nt, Human
cuccauuaaaacacacac

SEQ ID NO: 766964 - RNA, 22 nt, Human
cucucugcaccucaccagguaa

SEQ ID NO: 766965 - RNA, 18 nt, Human
cugacuguccaacagcag

SEQ ID NO: 766966 - RNA, 21 nt, Human
cugcacucccagcuacucggg

SEQ ID NO: 766967 - RNA, 20 nt, Human
cugcaggcugccaucucauc

SEQ ID NO: 766968 - RNA, 23 nt, Human
cuggaucacaggagagugggaug

SEQ ID NO: 766969 - RNA, 19 nt, Human
cuggccacaaagagaaucu

SEQ ID NO: 766970 - RNA, 20 nt, Human
cugucuugcuucuucaucug

SEQ ID NO: 766971 - RNA, 20 nt, Human
cuucacacaauuuauaaaau

SEQ ID NO: 766972 - RNA, 23 nt, Human
gaaaucgugcaauagcaaaacug

SEQ ID NO: 766973 - RNA, 20 nt, Human
gaaggauuaucuugugaaag

SEQ ID NO: 766974 - RNA, 19 nt, Human
gaauauuucuuuacagcac

SEQ ID NO: 766975 - RNA, 23 nt, Human
gagaauugcuugaacccgggagg

SEQ ID NO: 766976 - RNA, 23 nt, Human
gagguugcagugagccgagaucg

SEQ ID NO: 766977 - RNA, 19 nt, Human
gaguuugcaaccagcccag

SEQ ID NO: 766978 - RNA, 20 nt, Human
gauagagaaugacacaaugu

SEQ ID NO: 766979 - RNA, 19 nt, Human
gcaaaaagccguccaaauc

SEQ ID NO: 766980 - RNA, 21 nt, Human
gcaaaccauugaaaaucaccc

SEQ ID NO: 766981 - RNA, 24 nt, Human
gcaagggaaaaugaucucauacua

SEQ ID NO: 766982 - RNA, 24 nt, Human
gcacuccagccugggcaacagggc

SEQ ID NO: 766983 - RNA, 24 nt, Human
gcagcaaaauaggcuccgucugaa

SEQ ID NO: 766984 - RNA, 18 nt, Human
gccaaugcauuuucauca

SEQ ID NO: 766985 - RNA, 19 nt, Human
gccacaaaugccagucgga

SEQ ID NO: 766986 - RNA, 19 nt, Human
gccacugcacuccagccug

SEQ ID NO: 766987 - RNA, 22 nt, Human
gccacugcacuccagccugggc

SEQ ID NO: 766988 - RNA, 24 nt, Human
gccacugcacuccagccugggcaa

SEQ ID NO: 766989 - RNA, 18 nt, Human
gccccuuuggauuguugg

SEQ ID NO: 766990 - RNA, 20 nt, Human
gccgagaucgugccacugca

SEQ ID NO: 766991 - RNA, 19 nt, Human
gccuguccugggcuccugg

SEQ ID NO: 766992 - RNA, 24 nt, Human
gcgcgcacacucucacacacagca

SEQ ID NO: 766993 - RNA, 20 nt, Human
ggaauauauuuccccauuag

SEQ ID NO: 766994 - RNA, 21 nt, Human
ggagagugggaugggucuggg

SEQ ID NO: 766995 - RNA, 20 nt, Human
ggagguugcagugagccgag

SEQ ID NO: 766996 - RNA, 22 nt, Human
ggagguugcagugagccgagau

SEQ ID NO: 766997 - RNA, 24 nt, Human
ggagguugcagugagccgagaucg

SEQ ID NO: 766998 - RNA, 21 nt, Human
ggccaggcgcaguggcucaug

SEQ ID NO: 766999 - RNA, 20 nt, Human
gugcaccugcacucccagcu

SEQ ID NO: 767000 - RNA, 19 nt, Human
gugucaaauucugguuucc

SEQ ID NO: 767001 - RNA, 18 nt, Human
gugugucaaauucugguu

SEQ ID NO: 767002 - RNA, 24 nt, Human
guugcagugagccgagaucgugcc

SEQ ID NO: 767003 - RNA, 21 nt, Human
uaaaaaacccguaagaggggc

SEQ ID NO: 767004 - RNA, 24 nt, Human
uaaaacacugacuguccaacagcc

SEQ ID NO: 767005 - RNA, 24 nt, Human
uaaaagcaguaaguuauccagcua

SEQ ID NO: 767006 - RNA, 21 nt, Human
uaaagcucuuccuuucucccc

SEQ ID NO: 767007 - RNA, 19 nt, Human
uaaagugcacauugcuacc

SEQ ID NO: 767008 - RNA, 23 nt, Human
uaacaaggaauaaaaacugacaa

SEQ ID NO: 767009 - RNA, 20 nt, Human
uaagaggcgcaaguuggcug

SEQ ID NO: 767010 - RNA, 18 nt, Human
uaagcaaaccauugaaaa

SEQ ID NO: 767011 - RNA, 18 nt, Human
uacaagacaacagaaaca

SEQ ID NO: 767012 - RNA, 22 nt, Human
uacacaucacccucugaaugaa

SEQ ID NO: 767013 - RNA, 19 nt, Human
uaccaccacuaaaaaaccc

SEQ ID NO: 767014 - RNA, 19 nt, Human
uaccauggcuggcuuccca

SEQ ID NO: 767015 - RNA, 20 nt, Human
uaccauggcuggcuucccag

SEQ ID NO: 767016 - RNA, 22 nt, Human
uagaaaaaacugaagccuuuca

SEQ ID NO: 767017 - RNA, 23 nt, Human
uagaaacauuaaaacacugacug

SEQ ID NO: 767018 - RNA, 19 nt, Human
uagauauguacacaucacc

SEQ ID NO: 767019 - RNA, 19 nt, Human
uagcaacuaccauacaaaa

SEQ ID NO: 767020 - RNA, 25 nt, Human
uauauacaauauagauauguacaca

SEQ ID NO: 767021 - RNA, 26 nt, Human
uaucauaaaacuaagauaaucagucc

SEQ ID NO: 767022 - RNA, 22 nt, Human
uaugaucccccaagcaucaaaa

SEQ ID NO: 767023 - RNA, 19 nt, Human
uaugcaaaaagccguccaa

SEQ ID NO: 767024 - RNA, 21 nt, Human
ucaaagaaagggaccaaaugu

SEQ ID NO: 767025 - RNA, 24 nt, Human
ucaaucagcucaaaacucaggcaa

SEQ ID NO: 767026 - RNA, 19 nt, Human
ucagauaaaagcaguaagu

SEQ ID NO: 767027 - RNA, 20 nt, Human
ucagcaagaaugccaagaca

SEQ ID NO: 767028 - RNA, 19 nt, Human
ucagccaggcauggcggug

SEQ ID NO: 767029 - RNA, 22 nt, Human
ucaugucuguaaucccagcacu

SEQ ID NO: 767030 - RNA, 20 nt, Human
uccaaggggcuggaacugag

SEQ ID NO: 767031 - RNA, 23 nt, Human
uccaauuagaaaaaacugaagcc

SEQ ID NO: 767032 - RNA, 21 nt, Human
uccagaaaaauccgauuuaac

SEQ ID NO: 767033 - RNA, 23 nt, Human
uccaucucaaaaaaagaaaaaaa

SEQ ID NO: 767034 - RNA, 23 nt, Human
uccccggauugauucccucccac

SEQ ID NO: 767035 - RNA, 23 nt, Human
ucgggaggcugaggcaggagaau

SEQ ID NO: 767036 - RNA, 26 nt, Human
ucuagaaaacagugacuuaagcaaac

SEQ ID NO: 767037 - RNA, 22 nt, Human
ucucacacacagcacacacaca

SEQ ID NO: 767038 - RNA, 26 nt, Human
ucucacacacagcacacacacacaga

SEQ ID NO: 767039 - RNA, 19 nt, Human
ucuccugaacagagugucc

SEQ ID NO: 767040 - RNA, 20 nt, Human
ucuuuacagcacuaaacagu

SEQ ID NO: 767041 - RNA, 25 nt, Human
ugaaacaaaacaaacuaccaccacu

SEQ ID NO: 767042 - RNA, 19 nt, Human
ugaaaccccaucucuacua

SEQ ID NO: 767043 - RNA, 21 nt, Human
ugaauaaucaccuucaaauaa

SEQ ID NO: 767044 - RNA, 22 nt, Human
ugagccgagaucgugccacugc

SEQ ID NO: 767045 - RNA, 24 nt, Human
ugaggcaggagaauugcuugaacc

SEQ ID NO: 767046 - RNA, 25 nt, Human
ugaggcaggagaauugcuugaaccc

SEQ ID NO: 767047 - RNA, 20 nt, Human
ugaggcaggcagacugccug

SEQ ID NO: 767048 - RNA, 21 nt, Human
ugaggcaggcagacugccuga

SEQ ID NO: 767049 - RNA, 25 nt, Human
ugaggcaggcagacugccugagcuc

SEQ ID NO: 767050 - RNA, 23 nt, Human
ugagugucuuaucuguaaauucu

SEQ ID NO: 767051 - RNA, 20 nt, Human
ugaucccccaagcaucaaaa

SEQ ID NO: 767052 - RNA, 18 nt, Human
ugaugauagagaaugaca

SEQ ID NO: 767053 - RNA, 23 nt, Human
ugcaggcugccaucucaucuugc

SEQ ID NO: 767054 - RNA, 23 nt, Human
ugccaagacagagaaaucuauuc

SEQ ID NO: 767055 - RNA, 24 nt, Human
ugccacugcacuccagccugggca

SEQ ID NO: 767056 - RNA, 19 nt, Human
uggagugugucaaauucug

SEQ ID NO: 767057 - RNA, 19 nt, Human
uggccagggcccacagaaa

SEQ ID NO: 767058 - RNA, 23 nt, Human
uggccauucuugcuaaguuuaaa

SEQ ID NO: 767059 - RNA, 24 nt, Human
uggcucaugucuguaaucccagca

SEQ ID NO: 767060 - RNA, 18 nt, Human
ugggcuccuggaccaccu

SEQ ID NO: 767061 - RNA, 21 nt, Human
ugguuaacaucaaacugacac

SEQ ID NO: 767062 - RNA, 18 nt, Human
uguacauauauuuacaca

SEQ ID NO: 767063 - RNA, 27 nt, Human
uguacauauauuuacacauauguaucu

SEQ ID NO: 767064 - RNA, 19 nt, Human
ugucaaauucugguuuccu

SEQ ID NO: 767065 - RNA, 21 nt, Human
ugucaaauucugguuuccuug

SEQ ID NO: 767066 - RNA, 18 nt, Human
ugucuguaaucccagcac

SEQ ID NO: 767067 - RNA, 24 nt, Human
ugucuguaaucccagcacucuagg

SEQ ID NO: 767068 - RNA, 23 nt, Human
uucaaaaacugccacaaaugccu

SEQ ID NO: 767069 - RNA, 23 nt, Human
uucaagacaaccuagaugagugg

SEQ ID NO: 767070 - RNA, 21 nt, Human
uucaagacauaauaauccaau

SEQ ID NO: 767071 - RNA, 24 nt, Human
uugaacccgggaggcggagguugc

SEQ ID NO: 767072 - RNA, 19 nt, Human
uugauccaaggggcuggaa

SEQ ID NO: 767073 - RNA, 18 nt, Human
uugcagugagccgagauc

SEQ ID NO: 767074 - RNA, 22 nt, Human
uugcagugagccgagaucgugc

SEQ ID NO: 767075 - RNA, 24 nt, Human
uugcuugaacccgggaggcggagg

SEQ ID NO: 767076 - RNA, 24 nt, Human
uuggaaaaaaucuauuuccuuuca

SEQ ID NO: 767077 - RNA, 20 nt, Human
uugugaaagaaggcagacua

SEQ ID NO: 767078 - RNA, 23 nt, Human
uuuaaagugcacauugcuaccca

SEQ ID NO: 767079 - RNA, 22 nt, Human
uuuacuauucuuucccccuaaa

SEQ ID NO: 767080 - RNA, 28 nt, Human
uuuuuguacauauauuuacacauaugua

SEQ ID NO: 767081 - RNA, 18 nt, Human
aaaaagauauaaguuacu

SEQ ID NO: 767082 - RNA, 22 nt, Human
aaaauaaaacaaaucacacaga

SEQ ID NO: 767083 - RNA, 24 nt, Human
aaacaagaaggaaaagcauguggg

SEQ ID NO: 767084 - RNA, 21 nt, Human
aaagaaacgacuguccacuga

SEQ ID NO: 767085 - RNA, 24 nt, Human
aaauaauaaauaaaaguuuaaaac

SEQ ID NO: 767086 - RNA, 21 nt, Human
aaggacacaucuucugcugcc

SEQ ID NO: 767087 - RNA, 25 nt, Human
aaggagacaaaaggcuuuggaggga

SEQ ID NO: 767088 - RNA, 21 nt, Human
aaguauugcaaccucugaacu

SEQ ID NO: 767089 - RNA, 23 nt, Human
acaaaguuuccacacuuccucca

SEQ ID NO: 767090 - RNA, 23 nt, Human
acacagaacacagaggggcuggu

SEQ ID NO: 767091 - RNA, 18 nt, Human
acacagaggggcugcuga

SEQ ID NO: 767092 - RNA, 23 nt, Human
acagaacacagaggggcugcuga

SEQ ID NO: 767093 - RNA, 18 nt, Human
acagagaagggcagaggg

SEQ ID NO: 767094 - RNA, 19 nt, Human
acuucagagaacagagaga

SEQ ID NO: 767095 - RNA, 19 nt, Human
agaaaaaagcugcuaucuc

SEQ ID NO: 767096 - RNA, 21 nt, Human
agaaaaaagcugcuaucucau

SEQ ID NO: 767097 - RNA, 25 nt, Human
agaaaacauacacuaccaguaccau

SEQ ID NO: 767098 - RNA, 19 nt, Human
agagagccuccaugagagc

SEQ ID NO: 767099 - RNA, 24 nt, Human
agagagccuccaugagagcucagc

SEQ ID NO: 767100 - RNA, 18 nt, Human
agaggagaacgugggucu

SEQ ID NO: 767101 - RNA, 20 nt, Human
agaggggcugcugaacaacg

SEQ ID NO: 767102 - RNA, 25 nt, Human
agccccggcaguaccucgcacagcc

SEQ ID NO: 767103 - RNA, 21 nt, Human
agcugauuacaaaacacagga

SEQ ID NO: 767104 - RNA, 22 nt, Human
aggcuuuggagggaaagaaaau

SEQ ID NO: 767105 - RNA, 21 nt, Human
agggagggagugcacuguggg

SEQ ID NO: 767106 - RNA, 21 nt, Human
agggagggagugcacuguggg

SEQ ID NO: 767107 - RNA, 22 nt, Human
aggggaaggcaugaaaacaaaa

SEQ ID NO: 767108 - RNA, 18 nt, Human
aggggguggacagagaag

SEQ ID NO: 767109 - RNA, 18 nt, Human
aggggguggacagagaag

SEQ ID NO: 767110 - RNA, 22 nt, Human
agugcagcccucaaauuagaau

SEQ ID NO: 767111 - RNA, 24 nt, Human
auucuuuucacaagcaccuggauc

SEQ ID NO: 767112 - RNA, 22 nt, Human
caaaaggaaagaagaaaggacc

SEQ ID NO: 767113 - RNA, 27 nt, Human
caaaaggaaagaagaaaggaccccacu

SEQ ID NO: 767114 - RNA, 20 nt, Human
caacaggaccagccucccuu

SEQ ID NO: 767115 - RNA, 22 nt, Human
caaccucugaacugccaauuuu

SEQ ID NO: 767116 - RNA, 22 nt, Human
caaggagacaaaaggcuuugga

SEQ ID NO: 767117 - RNA, 19 nt, Human
caccucaaaaaagaaacga

SEQ ID NO: 767118 - RNA, 21 nt, Human
cacgucagcugcacguggcug

SEQ ID NO: 767119 - RNA, 20 nt, Human
cacuucagagaacagagaga

SEQ ID NO: 767120 - RNA, 22 nt, Human
cagaacacagaggggcugcuga

SEQ ID NO: 767121 - RNA, 24 nt, Human
cagagaauaaauagucugaaaccg

SEQ ID NO: 767122 - RNA, 21 nt, Human
cagugaaggucuugaagaagc

SEQ ID NO: 767123 - RNA, 21 nt, Human
ccagaaaaaagcugcuaucuc

SEQ ID NO: 767124 - RNA, 20 nt, Human
cccagaaaaaagcugcuauc

SEQ ID NO: 767125 - RNA, 24 nt, Human
cccagaaaaaagcugcuaucucau

SEQ ID NO: 767126 - RNA, 20 nt, Human
cccauaaaagaaaagcccuc

SEQ ID NO: 767127 - RNA, 18 nt, Human
cccucccgugccuuccuc

SEQ ID NO: 767128 - RNA, 23 nt, Human
ccuauuguuaaaggugucuuggg

SEQ ID NO: 767129 - RNA, 18 nt, Human
ccucccgugccuuccuca

SEQ ID NO: 767130 - RNA, 20 nt, Human
ccucgcacagccacccuccc

SEQ ID NO: 767131 - RNA, 19 nt, Human
ccucuagggcaaccggccc

SEQ ID NO: 767132 - RNA, 22 nt, Human
cuaaguauugcaaccucugaac

SEQ ID NO: 767133 - RNA, 23 nt, Human
cuaugacuggaacuggaaggaac

SEQ ID NO: 767134 - RNA, 22 nt, Human
cucaaaguauccuuuguggaca

SEQ ID NO: 767135 - RNA, 22 nt, Human
cuccucuagggcaaccggcccc

SEQ ID NO: 767136 - RNA, 21 nt, Human
cucugggucccagaaaaaagc

SEQ ID NO: 767137 - RNA, 18 nt, Human
cugaaacaagaaggaaaa

SEQ ID NO: 767138 - RNA, 19 nt, Human
cuggaacuggaaggaacga

SEQ ID NO: 767139 - RNA, 20 nt, Human
gaaaauaucuuguugugacc

SEQ ID NO: 767140 - RNA, 23 nt, Human
gaccccaccuucccccagguuag

SEQ ID NO: 767141 - RNA, 21 nt, Human
gagaauaaauagucugaaacc

SEQ ID NO: 767142 - RNA, 18 nt, Human
gagccuccaugagagcuc

SEQ ID NO: 767143 - RNA, 18 nt, Human
gcagagggagggagugca

SEQ ID NO: 767144 - RNA, 21 nt, Human
gcuguucugaaacaagaagga

SEQ ID NO: 767145 - RNA, 21 nt, Human
ggaagagagggaggugggagc

SEQ ID NO: 767146 - RNA, 23 nt, Human
ggagacaaaaggcuuuggaggga

SEQ ID NO: 767147 - RNA, 21 nt, Human
ggagcaagagaggagaacgug

SEQ ID NO: 767148 - RNA, 26 nt, Human
gggaaggcaugaaaacaaaaggucac

SEQ ID NO: 767149 - RNA, 18 nt, Human
gguccauucaguccaugg

SEQ ID NO: 767150 - RNA, 20 nt, Human
gugacagcacccuggccagc

SEQ ID NO: 767151 - RNA, 18 nt, Human
guggcugaggauggaggc

SEQ ID NO: 767152 - RNA, 22 nt, Human
uaaaacaaaucacacagaacac

SEQ ID NO: 767153 - RNA, 22 nt, Human
uaagaacacacuugggaguuuc

SEQ ID NO: 767154 - RNA, 21 nt, Human
uaagcuuuuucccuauccuuu

SEQ ID NO: 767155 - RNA, 21 nt, Human
uaagucacaugguuggacugg

SEQ ID NO: 767156 - RNA, 19 nt, Human
uaccaaagccuuguuuccc

SEQ ID NO: 767157 - RNA, 20 nt, Human
uagaauaaauaagucacaug

SEQ ID NO: 767158 - RNA, 22 nt, Human
uagaauaaauaagucacauggu

SEQ ID NO: 767159 - RNA, 21 nt, Human
uagggcaaccggccccccucc

SEQ ID NO: 767160 - RNA, 18 nt, Human
uaugacccgugccgcgug

SEQ ID NO: 767161 - RNA, 24 nt, Human
uauuaugccugguugugguucuuc

SEQ ID NO: 767162 - RNA, 19 nt, Human
uauuuaaaauacggcagac

SEQ ID NO: 767163 - RNA, 20 nt, Human
uccuaaggauaaaaagaggc

SEQ ID NO: 767164 - RNA, 23 nt, Human
ucuagggcaaccggccccccucc

SEQ ID NO: 767165 - RNA, 22 nt, Human
ucucauuagcggcuugguguga

SEQ ID NO: 767166 - RNA, 18 nt, Human
ugaagaagcugggccacc

SEQ ID NO: 767167 - RNA, 19 nt, Human
ugaaugcacacauacaaca

SEQ ID NO: 767168 - RNA, 22 nt, Human
ugacagugcaggggcacuuccu

SEQ ID NO: 767169 - RNA, 21 nt, Human
ugaugcauuacaacacacuuu

SEQ ID NO: 767170 - RNA, 18 nt, Human
ugcacacauacaacagca

SEQ ID NO: 767171 - RNA, 25 nt, Human
uggaacacggugucacaggacaaag

SEQ ID NO: 767172 - RNA, 18 nt, Human
uggaaccgguuugguauu

SEQ ID NO: 767173 - RNA, 19 nt, Human
uggaaugccacagacacac

SEQ ID NO: 767174 - RNA, 24 nt, Human
uggaaugccacagacacacuauga

SEQ ID NO: 767175 - RNA, 21 nt, Human
ugggagcaagagaggagaacg

SEQ ID NO: 767176 - RNA, 25 nt, Human
uggggggaagagagggaggugggag

SEQ ID NO: 767177 - RNA, 22 nt, Human
ugucacaggacaccaugguguc

SEQ ID NO: 767178 - RNA, 21 nt, Human
ugucuagcuuaggagggggug

SEQ ID NO: 767179 - RNA, 25 nt, Human
ugucuggaacacggugucacaggag

SEQ ID NO: 767180 - RNA, 18 nt, Human
uuagugaauaaaauugug

SEQ ID NO: 767181 - RNA, 18 nt, Human
uucacaagcaccuggauc

SEQ ID NO: 767182 - RNA, 18 nt, Human
uucagugcuucucaaaag

SEQ ID NO: 767183 - RNA, 22 nt, Human
uugguagugguugcacaauguu

SEQ ID NO: 767184 - RNA, 24 nt, Human
uuguuccuuaggggcuuucucaaa

SEQ ID NO: 767185 - RNA, 19 nt, Human
uuuauuuacuauacuaagu

SEQ ID NO: 767186 - RNA, 21 nt, Human
uuucccuauccuuuuuccuuu

SEQ ID NO: 767187 - RNA, 21 nt, Human
uuugucuagcuuaggaggggg

SEQ ID NO: 767188 - RNA, 19 nt, Human
aagcaaacgccaggccccc

SEQ ID NO: 767189 - RNA, 24 nt, Human
aauugcuacaauuuaauuacaaau

SEQ ID NO: 767190 - RNA, 23 nt, Human
acgccaggcccccaucugcaggc

SEQ ID NO: 767191 - RNA, 20 nt, Human
agggaagggcugaagcaaac

SEQ ID NO: 767192 - RNA, 19 nt, Human
agggugcugguggcugugg

SEQ ID NO: 767193 - RNA, 24 nt, Human
augacuauucaaaauuugacauuu

SEQ ID NO: 767194 - RNA, 20 nt, Human
auuggcauuuuaaaaaccau

SEQ ID NO: 767195 - RNA, 24 nt, Human
auuugcagagcagaguucagaaug

SEQ ID NO: 767196 - RNA, 20 nt, Human
caccccagaaccaugaucau

SEQ ID NO: 767197 - RNA, 22 nt, Human
cacccccaaccagcaaccgaaa

SEQ ID NO: 767198 - RNA, 24 nt, Human
caggugcccaugagcucugcacuc

SEQ ID NO: 767199 - RNA, 18 nt, Human
cauuuuuguacaaaaucc

SEQ ID NO: 767200 - RNA, 21 nt, Human
cauuuuuguacaaaauccugg

SEQ ID NO: 767201 - RNA, 19 nt, Human
ccaaaagacauuugcagag

SEQ ID NO: 767202 - RNA, 21 nt, Human
ccaaccagcaaccgaaagccu

SEQ ID NO: 767203 - RNA, 19 nt, Human
ccaggcccccaucugcagg

SEQ ID NO: 767204 - RNA, 22 nt, Human
ccaggcccccaucugcaggcug

SEQ ID NO: 767205 - RNA, 23 nt, Human
cccaucugcaggcugcucagagu

SEQ ID NO: 767206 - RNA, 23 nt, Human
cccccaaccagcaaccgaaagcc

SEQ ID NO: 767207 - RNA, 19 nt, Human
ccuccuguaccagccccac

SEQ ID NO: 767208 - RNA, 20 nt, Human
ccucuccccaccccagaacc

SEQ ID NO: 767209 - RNA, 20 nt, Human
cgccaggcccccaucugcag

SEQ ID NO: 767210 - RNA, 22 nt, Human
cgccaggcccccaucugcaggc

SEQ ID NO: 767211 - RNA, 27 nt, Human
cuccccuggcaagucacucagcucccc

SEQ ID NO: 767212 - RNA, 24 nt, Human
cugaagcaaacgccaggcccccau

SEQ ID NO: 767213 - RNA, 25 nt, Human
gacgugguggugccccucgccugca

SEQ ID NO: 767214 - RNA, 19 nt, Human
gagaagcagggaguucaaa

SEQ ID NO: 767215 - RNA, 24 nt, Human
gaucauuuuuguacaaaauccugg

SEQ ID NO: 767216 - RNA, 18 nt, Human
gcacucagggaagggcug

SEQ ID NO: 767217 - RNA, 20 nt, Human
uacacuaucaugagaccaaa

SEQ ID NO: 767218 - RNA, 18 nt, Human
uacugcauauauaccucu

SEQ ID NO: 767219 - RNA, 19 nt, Human
uauauaccucuuagcaaaa

SEQ ID NO: 767220 - RNA, 19 nt, Human
ucacaauugcauaguucua

SEQ ID NO: 767221 - RNA, 23 nt, Human
ucauaucaaagaugagaagcagg

SEQ ID NO: 767222 - RNA, 24 nt, Human
uccaugagccuccuguaccaggaa

SEQ ID NO: 767223 - RNA, 20 nt, Human
uccccuggcaagucacucag

SEQ ID NO: 767224 - RNA, 23 nt, Human
uccccuggcaagucacucagcuc

SEQ ID NO: 767225 - RNA, 18 nt, Human
ugagaagcagggaguuca

SEQ ID NO: 767226 - RNA, 18 nt, Human
ugagggugcugguggcug

SEQ ID NO: 767227 - RNA, 19 nt, Human
ugcauuguugcugagauau

SEQ ID NO: 767228 - RNA, 20 nt, Human
ugcucccuuuccucucccca

SEQ ID NO: 767229 - RNA, 27 nt, Human
uggcagccuuuggacgugguggugccc

SEQ ID NO: 767230 - RNA, 19 nt, Human
uggcccagaaaagccacca

SEQ ID NO: 767231 - RNA, 18 nt, Human
uggcuuuuggugaaugug

SEQ ID NO: 767232 - RNA, 25 nt, Human
uguacaaaauccuggugaagaauca

SEQ ID NO: 767233 - RNA, 25 nt, Human
ugugcucccuuuccucuccccaccc

SEQ ID NO: 767234 - RNA, 19 nt, Human
uguguauaaaagguacugc

SEQ ID NO: 767235 - RNA, 20 nt, Human
uuccuguagaauucaacuga

SEQ ID NO: 767236 - RNA, 24 nt, Human
uugcauaguucuaaaaugccugga

SEQ ID NO: 767237 - RNA, 23 nt, Human
uugcuacaauuuaauuacaaauc

SEQ ID NO: 767238 - RNA, 19 nt, Human
uuggcauuuuaaaaaccau

SEQ ID NO: 767239 - RNA, 19 nt, Human
uuuuuuuuuuuuuuugcuu

SEQ ID NO: 767240 - RNA, 23 nt, Human
uuuuuuuuuuuuuuugcuuauaa

SEQ ID NO: 767241 - RNA, 23 nt, Human
aaaugcccagucccacccuacac

SEQ ID NO: 767242 - RNA, 22 nt, Human
aagacuuuuggacucaggugac

SEQ ID NO: 767243 - RNA, 23 nt, Human
aagacuuuuggacucaggugacc

SEQ ID NO: 767244 - RNA, 18 nt, Human
aagcagccacucaagccg

SEQ ID NO: 767245 - RNA, 21 nt, Human
aauuucagagucacagugaug

SEQ ID NO: 767246 - RNA, 19 nt, Human
acaccgcgggccccgcgca

SEQ ID NO: 767247 - RNA, 24 nt, Human
acacugcaaagggagauucuggac

SEQ ID NO: 767248 - RNA, 18 nt, Human
acaggaggagacuacaca

SEQ ID NO: 767249 - RNA, 23 nt, Human
acaggaggagacuacacagggcu

SEQ ID NO: 767250 - RNA, 19 nt, Human
acagggcuuggggacguuc

SEQ ID NO: 767251 - RNA, 22 nt, Human
acagggcuuggggacguucccc

SEQ ID NO: 767252 - RNA, 25 nt, Human
accccaugagucucugugccagagg

SEQ ID NO: 767253 - RNA, 19 nt, Human
accgcgggccccgcgcagc

SEQ ID NO: 767254 - RNA, 20 nt, Human
acugugcccagccucagggg

SEQ ID NO: 767255 - RNA, 22 nt, Human
agaaaagacugaaacauuuucu

SEQ ID NO: 767256 - RNA, 21 nt, Human
agaaagaggcaauguccucau

SEQ ID NO: 767257 - RNA, 21 nt, Human
agaaaggcugguaucugcccu

SEQ ID NO: 767258 - RNA, 21 nt, Human
agaaaggcugguaucugcccu

SEQ ID NO: 767259 - RNA, 22 nt, Human
agaagccccuggccgcagcucc

SEQ ID NO: 767260 - RNA, 22 nt, Human
agaagccuagaacauggacccc

SEQ ID NO: 767261 - RNA, 20 nt, Human
agagguuggugggggaaggg

SEQ ID NO: 767262 - RNA, 21 nt, Human
agagugaggggacugcuccau

SEQ ID NO: 767263 - RNA, 19 nt, Human
agcagaaaaguaacagcag

SEQ ID NO: 767264 - RNA, 21 nt, Human
agcagccacucaagccgaguc

SEQ ID NO: 767265 - RNA, 20 nt, Human
agccccagguacuugggcug

SEQ ID NO: 767266 - RNA, 18 nt, Human
aggaaaggagggagagga

SEQ ID NO: 767267 - RNA, 19 nt, Human
aggagaaaaaugcuauuca

SEQ ID NO: 767268 - RNA, 18 nt, Human
aggagccugucuauaacc

SEQ ID NO: 767269 - RNA, 20 nt, Human
aggagguguccucuucccag

SEQ ID NO: 767270 - RNA, 26 nt, Human
aggcagcuucugcugaccuucccuuc

SEQ ID NO: 767271 - RNA, 19 nt, Human
aggcaggcaugcgagucug

SEQ ID NO: 767272 - RNA, 20 nt, Human
aggccuuccaugccaggccc

SEQ ID NO: 767273 - RNA, 24 nt, Human
aggcugggcucaggagaggaagcc

SEQ ID NO: 767274 - RNA, 19 nt, Human
agggaccagagcgcauugg

SEQ ID NO: 767275 - RNA, 20 nt, Human
agggaccagagcgcauugga

SEQ ID NO: 767276 - RNA, 19 nt, Human
agggccacacaucugucug

SEQ ID NO: 767277 - RNA, 19 nt, Human
aggggaauggugauuucag

SEQ ID NO: 767278 - RNA, 18 nt, Human
aggggcccagacagauau

SEQ ID NO: 767279 - RNA, 20 nt, Human
agggugacaucccauaggga

SEQ ID NO: 767280 - RNA, 18 nt, Human
agugguuuuguggccagg

SEQ ID NO: 767281 - RNA, 23 nt, Human
aguguugcucaaguguucucaga

SEQ ID NO: 767282 - RNA, 19 nt, Human
aguuaagacgcuggcagug

SEQ ID NO: 767283 - RNA, 25 nt, Human
auuaaaaaaaaaaaaaaaagaaaau

SEQ ID NO: 767284 - RNA, 20 nt, Human
auuugccaggagaguagguu

SEQ ID NO: 767285 - RNA, 18 nt, Human
caaaaggccuuccaugcc

SEQ ID NO: 767286 - RNA, 22 nt, Human
caaccccagcagcucaccaccc

SEQ ID NO: 767287 - RNA, 18 nt, Human
caccacccugcuuccagc

SEQ ID NO: 767288 - RNA, 23 nt, Human
caccauggcuaugaaaaggccug

SEQ ID NO: 767289 - RNA, 20 nt, Human
cacgcagaggagcaugcagc

SEQ ID NO: 767290 - RNA, 22 nt, Human
cacucugcuggucugaagggaa

SEQ ID NO: 767291 - RNA, 21 nt, Human
cagcccaaggccaguggcaca

SEQ ID NO: 767292 - RNA, 20 nt, Human
caggcccccuuggcccuagg

SEQ ID NO: 767293 - RNA, 25 nt, Human
caggcccccuuggcccuaggccaug

SEQ ID NO: 767294 - RNA, 22 nt, Human
cagggaacaagauggacuucca

SEQ ID NO: 767295 - RNA, 18 nt, Human
cagggagacagggcuugg

SEQ ID NO: 767296 - RNA, 24 nt, Human
cauaacacacggacugaagaauuu

SEQ ID NO: 767297 - RNA, 20 nt, Human
caucccauagggagcagcag

SEQ ID NO: 767298 - RNA, 18 nt, Human
ccaacucuccucacucac

SEQ ID NO: 767299 - RNA, 18 nt, Human
ccaaggagcagacuugga

SEQ ID NO: 767300 - RNA, 18 nt, Human
ccaagguugccaaaaaua

SEQ ID NO: 767301 - RNA, 23 nt, Human
ccacauccuccagcugccccuuc

SEQ ID NO: 767302 - RNA, 19 nt, Human
ccacugugcccagccucag

SEQ ID NO: 767303 - RNA, 22 nt, Human
ccacugugcccagccucagggc

SEQ ID NO: 767304 - RNA, 18 nt, Human
ccaggccuggcugcuuca

SEQ ID NO: 767305 - RNA, 21 nt, Human
ccauucaggcccccuuggccc

SEQ ID NO: 767306 - RNA, 21 nt, Human
cccagacagauauccugggca

SEQ ID NO: 767307 - RNA, 18 nt, Human
ccccaaggagguguccuc

SEQ ID NO: 767308 - RNA, 21 nt, Human
ccccaaggagguguccucuuc

SEQ ID NO: 767309 - RNA, 20 nt, Human
ccccagcagcucaccacccu

SEQ ID NO: 767310 - RNA, 20 nt, Human
cccccuuuccaugcucuggg

SEQ ID NO: 767311 - RNA, 20 nt, Human
cccucuuggcuuuugggcuu

SEQ ID NO: 767312 - RNA, 19 nt, Human
cccugcucagggcucugca

SEQ ID NO: 767313 - RNA, 22 nt, Human
cccugcuuccagcuaagguggg

SEQ ID NO: 767314 - RNA, 20 nt, Human
ccgcgggccccgcgcagccc

SEQ ID NO: 767315 - RNA, 20 nt, Human
ccugcaauggccgagguugu

SEQ ID NO: 767316 - RNA, 23 nt, Human
ccugccaguguguuugcuccauu

SEQ ID NO: 767317 - RNA, 18 nt, Human
cggcaggccugaccuggc

SEQ ID NO: 767318 - RNA, 19 nt, Human
cggcggacucuacacaccg

SEQ ID NO: 767319 - RNA, 21 nt, Human
cgggacgcggcuccggggcgg

SEQ ID NO: 767320 - RNA, 19 nt, Human
cucagugauagggagaagc

SEQ ID NO: 767321 - RNA, 22 nt, Human
cuccaggagcucuaggcaggca

SEQ ID NO: 767322 - RNA, 23 nt, Human
cucgccauugucuggguugcagc

SEQ ID NO: 767323 - RNA, 18 nt, Human
cucuacucaaaaugcccc

SEQ ID NO: 767324 - RNA, 19 nt, Human
cucuacucuuugcugaggg

SEQ ID NO: 767325 - RNA, 18 nt, Human
cucuccucuuccuccaga

SEQ ID NO: 767326 - RNA, 19 nt, Human
cugcuaaagacuuuuggac

SEQ ID NO: 767327 - RNA, 19 nt, Human
cugcucagcugacccucgg

SEQ ID NO: 767328 - RNA, 24 nt, Human
cuggcccagaccagagcugacccc

SEQ ID NO: 767329 - RNA, 21 nt, Human
cuggggccuugccaggcagcu

SEQ ID NO: 767330 - RNA, 21 nt, Human
cuguaaggcuuucccaggacc

SEQ ID NO: 767331 - RNA, 19 nt, Human
cuucacucugcuggucuga

SEQ ID NO: 767332 - RNA, 19 nt, Human
cuucccucuuggcuuuugg

SEQ ID NO: 767333 - RNA, 20 nt, Human
cuuggggacguuccccucag

SEQ ID NO: 767334 - RNA, 21 nt, Human
cuuugugucaccauggcuaug

SEQ ID NO: 767335 - RNA, 22 nt, Human
gaaaacgaaaugggcuucacug

SEQ ID NO: 767336 - RNA, 24 nt, Human
gaaaacgaaaugggcuucacuggg

SEQ ID NO: 767337 - RNA, 23 nt, Human
gaaaagacugaaacauuuucuca

SEQ ID NO: 767338 - RNA, 18 nt, Human
gagagguuccuagaaucc

SEQ ID NO: 767339 - RNA, 23 nt, Human
gagaguagguaagagccccugug

SEQ ID NO: 767340 - RNA, 20 nt, Human
gagcagacuuggagugguuu

SEQ ID NO: 767341 - RNA, 20 nt, Human
gagcagcaggaccagaaagg

SEQ ID NO: 767342 - RNA, 19 nt, Human
gagggcuggggcuuggagg

SEQ ID NO: 767343 - RNA, 19 nt, Human
gcaaaaccccaggccuggc

SEQ ID NO: 767344 - RNA, 21 nt, Human
gcacaccuacuaguaacagca

SEQ ID NO: 767345 - RNA, 21 nt, Human
gccgcagcuccuugcuuuccu

SEQ ID NO: 767346 - RNA, 20 nt, Human
gccucuucuuaagccccagc

SEQ ID NO: 767347 - RNA, 22 nt, Human
gccuggggccuugccaggcagc

SEQ ID NO: 767348 - RNA, 22 nt, Human
gcucaggagaggaagccaagga

SEQ ID NO: 767349 - RNA, 18 nt, Human
gcuccauucaggcccccu

SEQ ID NO: 767350 - RNA, 21 nt, Human
gcucuggggugggccuggcug

SEQ ID NO: 767351 - RNA, 22 nt, Human
gcuggggcuuggaggccaggcu

SEQ ID NO: 767352 - RNA, 20 nt, Human
ggaaacagaagccuagaaca

SEQ ID NO: 767353 - RNA, 21 nt, Human
ggaaggagggcuggggcuugg

SEQ ID NO: 767354 - RNA, 18 nt, Human
ggagaagaggcuggcugc

SEQ ID NO: 767355 - RNA, 20 nt, Human
ggagaggaugucacuguccu

SEQ ID NO: 767356 - RNA, 23 nt, Human
ggagauucuggacggggguuggg

SEQ ID NO: 767357 - RNA, 19 nt, Human
ggagugguuuuguggccag

SEQ ID NO: 767358 - RNA, 19 nt, Human
ggaugggaacucuacucuu

SEQ ID NO: 767359 - RNA, 19 nt, Human
ggcagggcgucugcaacuc

SEQ ID NO: 767360 - RNA, 21 nt, Human
ggccuggcuacuuauaacuug

SEQ ID NO: 767361 - RNA, 21 nt, Human
ggccuugccaggcagcuucug

SEQ ID NO: 767362 - RNA, 23 nt, Human
ggcuucagaggagccugucuaua

SEQ ID NO: 767363 - RNA, 21 nt, Human
gggaagggagaaaggaaagga

SEQ ID NO: 767364 - RNA, 27 nt, Human
gggcaggggcgguccaggagaggaugc

SEQ ID NO: 767365 - RNA, 21 nt, Human
gggccuggcuggccuggggcc

SEQ ID NO: 767366 - RNA, 18 nt, Human
ggggaagggagaaaggaa

SEQ ID NO: 767367 - RNA, 18 nt, Human
ggggaagggagaaaggaa

SEQ ID NO: 767368 - RNA, 21 nt, Human
ggggcucacucccccaaggag

SEQ ID NO: 767369 - RNA, 25 nt, Human
gucaaguuaccuucugcagaaaagc

SEQ ID NO: 767370 - RNA, 18 nt, Human
gugguuccuacaggagga

SEQ ID NO: 767371 - RNA, 18 nt, Human
guuccuacaggaggagac

SEQ ID NO: 767372 - RNA, 18 nt, Human
uaacagcagcugacugca

SEQ ID NO: 767373 - RNA, 18 nt, Human
uaauccaaccccagcagg

SEQ ID NO: 767374 - RNA, 24 nt, Human
uacuugggcugagggcagaaagag

SEQ ID NO: 767375 - RNA, 22 nt, Human
uagagccagcuaccaguucucc

SEQ ID NO: 767376 - RNA, 22 nt, Human
uagcagaaaaguaacagcagag

SEQ ID NO: 767377 - RNA, 24 nt, Human
uagcaggcccucacccaggaaguu

SEQ ID NO: 767378 - RNA, 20 nt, Human
uagguaagagccccugugcu

SEQ ID NO: 767379 - RNA, 24 nt, Human
uaguaacagcagcugacugcagaa

SEQ ID NO: 767380 - RNA, 20 nt, Human
ucaagaagccccuggccgca

SEQ ID NO: 767381 - RNA, 21 nt, Human
ucagagucacagugaugggag

SEQ ID NO: 767382 - RNA, 21 nt, Human
uccacugugcccagccucagg

SEQ ID NO: 767383 - RNA, 18 nt, Human
uccagucaggauucucca

SEQ ID NO: 767384 - RNA, 30 nt, Human
ucccaaauaauccaaccccagcagcucacc

SEQ ID NO: 767385 - RNA, 25 nt, Human
ucccaaguguugcucaaguguuccc

SEQ ID NO: 767386 - RNA, 18 nt, Human
ucccagggcuucuccuug

SEQ ID NO: 767387 - RNA, 26 nt, Human
ucccgagucccugggaagggcugccu

SEQ ID NO: 767388 - RNA, 20 nt, Human
ucccgucuaugauguggggc

SEQ ID NO: 767389 - RNA, 24 nt, Human
ucccugcagcuccaccacauccuc

SEQ ID NO: 767390 - RNA, 22 nt, Human
ucccugggaagggcugccuccc

SEQ ID NO: 767391 - RNA, 24 nt, Human
ucccugggaagggcugccuccccc

SEQ ID NO: 767392 - RNA, 23 nt, Human
uccuggguauaaccuuggggcuc

SEQ ID NO: 767393 - RNA, 19 nt, Human
uccuuucucaaccaaaaag

SEQ ID NO: 767394 - RNA, 20 nt, Human
ucucaaagcccagagcuugu

SEQ ID NO: 767395 - RNA, 22 nt, Human
ucucagagucccucucacaaac

SEQ ID NO: 767396 - RNA, 19 nt, Human
ucuccaggcuaguugccuu

SEQ ID NO: 767397 - RNA, 21 nt, Human
ucuccucacucacccguggag

SEQ ID NO: 767398 - RNA, 18 nt, Human
ucucgccauugucugggu

SEQ ID NO: 767399 - RNA, 22 nt, Human
ucucuuggcucuggggugggcc

SEQ ID NO: 767400 - RNA, 22 nt, Human
ucuugguagucagaucucgcua

SEQ ID NO: 767401 - RNA, 18 nt, Human
ugaccuucccucuuggcu

SEQ ID NO: 767402 - RNA, 19 nt, Human
ugagagguuccuagaaucc

SEQ ID NO: 767403 - RNA, 23 nt, Human
ugagaucgagcagcccaaggcca

SEQ ID NO: 767404 - RNA, 19 nt, Human
ugagcccagauuugucucc

SEQ ID NO: 767405 - RNA, 22 nt, Human
ugagcuggaaugaugaggaagc

SEQ ID NO: 767406 - RNA, 22 nt, Human
ugaggaagaggaaugcuaggug

SEQ ID NO: 767407 - RNA, 23 nt, Human
ugaggaagaggaaugcuagguga

SEQ ID NO: 767408 - RNA, 18 nt, Human
ugaggaagcagagccccg

SEQ ID NO: 767409 - RNA, 23 nt, Human
ugaggagaagcagccacucaagc

SEQ ID NO: 767410 - RNA, 18 nt, Human
ugaggcaggagaaaaaug

SEQ ID NO: 767411 - RNA, 21 nt, Human
ugagggaaguguccccuggga

SEQ ID NO: 767412 - RNA, 24 nt, Human
ugagggaccagagcgcauuggauu

SEQ ID NO: 767413 - RNA, 25 nt, Human
ugagggcagaaagaggcaauguccu

SEQ ID NO: 767414 - RNA, 20 nt, Human
ugcccugcuagccccaggua

SEQ ID NO: 767415 - RNA, 22 nt, Human
ugcuaaagacuuuuggacucag

SEQ ID NO: 767416 - RNA, 22 nt, Human
ugcuggggaaggacaugugaug

SEQ ID NO: 767417 - RNA, 23 nt, Human
ugcuuugggcuaugaguccuggg

SEQ ID NO: 767418 - RNA, 20 nt, Human
uggaccccacggccggccaa

SEQ ID NO: 767419 - RNA, 21 nt, Human
uggccagagacuuaucuauug

SEQ ID NO: 767420 - RNA, 18 nt, Human
uggcccagaccagagcug

SEQ ID NO: 767421 - RNA, 22 nt, Human
uggcccagaccagagcugaccc

SEQ ID NO: 767422 - RNA, 22 nt, Human
uggcucuggggugggccuggcu

SEQ ID NO: 767423 - RNA, 20 nt, Human
ugggcugagggcagaaagag

SEQ ID NO: 767424 - RNA, 22 nt, Human
uggggaaggacaugugaugagc

SEQ ID NO: 767425 - RNA, 19 nt, Human
uguaaggcuuucccaggac

SEQ ID NO: 767426 - RNA, 22 nt, Human
uguagguguccucaaaugaaga

SEQ ID NO: 767427 - RNA, 20 nt, Human
ugucaaguuaccuucugcag

SEQ ID NO: 767428 - RNA, 22 nt, Human
ugucuggguugcagccaggggc

SEQ ID NO: 767429 - RNA, 21 nt, Human
ugugaaaccugcaauggccga

SEQ ID NO: 767430 - RNA, 24 nt, Human
ugugaaggcugggccacgcagagg

SEQ ID NO: 767431 - RNA, 21 nt, Human
ugugcacauguauauaagugg

SEQ ID NO: 767432 - RNA, 21 nt, Human
ugugcacauguauauaagugu

SEQ ID NO: 767433 - RNA, 23 nt, Human
ugugcacauguauauaagugugg

SEQ ID NO: 767434 - RNA, 21 nt, Human
uguggaagaacucuggggcug

SEQ ID NO: 767435 - RNA, 19 nt, Human
ugugguggcaggucccguc

SEQ ID NO: 767436 - RNA, 22 nt, Human
uuaggcccaggaguccugcgcu

SEQ ID NO: 767437 - RNA, 21 nt, Human
uuagggccacacaucugucug

SEQ ID NO: 767438 - RNA, 20 nt, Human
uuccuguuguggaagaacuc

SEQ ID NO: 767439 - RNA, 22 nt, Human
uucugaaggcauggacagcugg

SEQ ID NO: 767440 - RNA, 22 nt, Human
uucuguaaccuguuuauuuucu

SEQ ID NO: 767441 - RNA, 24 nt, Human
uugcugagggaaguguccccuggg

SEQ ID NO: 767442 - RNA, 22 nt, Human
uugguuagaaacacugaucuca

SEQ ID NO: 767443 - RNA, 20 nt, Human
uuguggaagaacucuggggc

SEQ ID NO: 767444 - RNA, 21 nt, Human
uuucccaggaccuucucugca

SEQ ID NO: 767445 - RNA, 21 nt, Human
aaaaaagcgaaaccaaccuuc

SEQ ID NO: 767446 - RNA, 25 nt, Human
aaaaagccaaacacuaaaucuauaa

SEQ ID NO: 767447 - RNA, 20 nt, Human
aaaagaacuauauacaacau

SEQ ID NO: 767448 - RNA, 23 nt, Human
aaacaaaagaggagaaaagggac

SEQ ID NO: 767449 - RNA, 27 nt, Human
aaacagaacauagaaaaauaaacagga

SEQ ID NO: 767450 - RNA, 22 nt, Human
aaagcaccuaacacaaaaaaca

SEQ ID NO: 767451 - RNA, 23 nt, Human
aaagcaccuaacacaaaaaacag

SEQ ID NO: 767452 - RNA, 21 nt, Human
aacauugcuaagacacaguua

SEQ ID NO: 767453 - RNA, 22 nt, Human
aagaggcaaaaauaaauauugc

SEQ ID NO: 767454 - RNA, 23 nt, Human
aagaguacuccgaauguaaggau

SEQ ID NO: 767455 - RNA, 18 nt, Human
aagcaccuaacacaaaaa

SEQ ID NO: 767456 - RNA, 25 nt, Human
aagcauuuuaaaagacaacaguguu

SEQ ID NO: 767457 - RNA, 20 nt, Human
aagcgaaaccaaccuucaug

SEQ ID NO: 767458 - RNA, 19 nt, Human
aaggaaaaaaagcgaaacc

SEQ ID NO: 767459 - RNA, 20 nt, Human
aaggaaacaacacgcugcaa

SEQ ID NO: 767460 - RNA, 21 nt, Human
aagugaaagugauacacaacc

SEQ ID NO: 767461 - RNA, 27 nt, Human
aaucaaguucagccaaagcaccuaaca

SEQ ID NO: 767462 - RNA, 23 nt, Human
acaaacaauagcauuuagacaua

SEQ ID NO: 767463 - RNA, 21 nt, Human
acagcacagagguaaauaacc

SEQ ID NO: 767464 - RNA, 22 nt, Human
acuccugagaucaaacacauug

SEQ ID NO: 767465 - RNA, 21 nt, Human
acucugcaauucuaggagccc

SEQ ID NO: 767466 - RNA, 21 nt, Human
acuggcauccaaacauuccca

SEQ ID NO: 767467 - RNA, 20 nt, Human
agaaagaccucuuuuaaaaa

SEQ ID NO: 767468 - RNA, 22 nt, Human
agaauucuugguggaaacagcc

SEQ ID NO: 767469 - RNA, 27 nt, Human
agacaaaaaacaguuaaauaaacaaaa

SEQ ID NO: 767470 - RNA, 21 nt, Human
agacaaaauuuaauauaugca

SEQ ID NO: 767471 - RNA, 19 nt, Human
agaggagaaaaaagagagg

SEQ ID NO: 767472 - RNA, 24 nt, Human
agaguggauuuucacauugguaug

SEQ ID NO: 767473 - RNA, 23 nt, Human
agauucugaaugaagaaaacugg

SEQ ID NO: 767474 - RNA, 20 nt, Human
agcauuaagacaugcaccca

SEQ ID NO: 767475 - RNA, 26 nt, Human
agcauuuagacauaaaguaggaagca

SEQ ID NO: 767476 - RNA, 18 nt, Human
aggggggcuggggagagg

SEQ ID NO: 767477 - RNA, 22 nt, Human
agugcauuaguguuaaaguggc

SEQ ID NO: 767478 - RNA, 22 nt, Human
aguggauuuucacauugguaug

SEQ ID NO: 767479 - RNA, 18 nt, Human
aguuccaacugcgguuuu

SEQ ID NO: 767480 - RNA, 25 nt, Human
aucacaucuucacaugcucuuaaag

SEQ ID NO: 767481 - RNA, 19 nt, Human
aucauaauauggugaaguu

SEQ ID NO: 767482 - RNA, 19 nt, Human
augggaaacagaaagcaaa

SEQ ID NO: 767483 - RNA, 24 nt, Human
augugauuuucauuaaaaucaggu

SEQ ID NO: 767484 - RNA, 19 nt, Human
auuacacauggcaugcaaa

SEQ ID NO: 767485 - RNA, 20 nt, Human
auuccuuaacugagccaccg

SEQ ID NO: 767486 - RNA, 18 nt, Human
caaaaaaagaaagucacc

SEQ ID NO: 767487 - RNA, 23 nt, Human
caaaauccccuggacuaauacau

SEQ ID NO: 767488 - RNA, 19 nt, Human
caaaucagcaguuacacag

SEQ ID NO: 767489 - RNA, 24 nt, Human
caaauccuuccucugcaagaguuc

SEQ ID NO: 767490 - RNA, 21 nt, Human
caagcuauaaaauacaaagca

SEQ ID NO: 767491 - RNA, 18 nt, Human
caauggugcggggggggg

SEQ ID NO: 767492 - RNA, 18 nt, Human
cacuagaguggaccuugc

SEQ ID NO: 767493 - RNA, 22 nt, Human
cacugugugaccccaugcaggc

SEQ ID NO: 767494 - RNA, 21 nt, Human
cagaagcugagaucaaacccc

SEQ ID NO: 767495 - RNA, 24 nt, Human
cagagaacccagaaaacccaucug

SEQ ID NO: 767496 - RNA, 21 nt, Human
cagcauaaggcaaaauccccu

SEQ ID NO: 767497 - RNA, 23 nt, Human
cagcauuaagacaugcacccacc

SEQ ID NO: 767498 - RNA, 20 nt, Human
caggaauuaaccugcccccu

SEQ ID NO: 767499 - RNA, 21 nt, Human
caugcaaagagaaauuacuac

SEQ ID NO: 767500 - RNA, 19 nt, Human
cauguagggcauuuacucu

SEQ ID NO: 767501 - RNA, 22 nt, Human
cauguagggcauuuacucuuau

SEQ ID NO: 767502 - RNA, 19 nt, Human
cauugaacuuucaaaucug

SEQ ID NO: 767503 - RNA, 20 nt, Human
ccaacaucugaaaucaaacu

SEQ ID NO: 767504 - RNA, 21 nt, Human
ccauagguuaucagagaaccc

SEQ ID NO: 767505 - RNA, 21 nt, Human
ccccuugaacucauguccaaa

SEQ ID NO: 767506 - RNA, 23 nt, Human
cccucuucuaagauuuucuaaaa

SEQ ID NO: 767507 - RNA, 18 nt, Human
ccucuagaaaagaacuag

SEQ ID NO: 767508 - RNA, 22 nt, Human
ccuucagaaacauuccaccuaa

SEQ ID NO: 767509 - RNA, 19 nt, Human
cuagaggugagauauggga

SEQ ID NO: 767510 - RNA, 23 nt, Human
cuauaaaauacaaagcaaaacca

SEQ ID NO: 767511 - RNA, 20 nt, Human
cucacaaaauauuuagaauc

SEQ ID NO: 767512 - RNA, 22 nt, Human
cucauguccaaaaugucuuguc

SEQ ID NO: 767513 - RNA, 22 nt, Human
cugcccccuugaacucaugucc

SEQ ID NO: 767514 - RNA, 19 nt, Human
cuggaagaaaacagaaugu

SEQ ID NO: 767515 - RNA, 24 nt, Human
cugugugaccccaugcaggccagu

SEQ ID NO: 767516 - RNA, 28 nt, Human
cuuaaguaauuugcuuuacaaaaaaaga

SEQ ID NO: 767517 - RNA, 23 nt, Human
cuuauccuuaguuugaccucagc

SEQ ID NO: 767518 - RNA, 24 nt, Human
gaaaaaaagcgaaaccaaccuuca

SEQ ID NO: 767519 - RNA, 21 nt, Human
gaaaacaacucuagaaaccug

SEQ ID NO: 767520 - RNA, 19 nt, Human
gaacagagugcaacaugca

SEQ ID NO: 767521 - RNA, 21 nt, Human
gaagaaaacaacucuagaaac

SEQ ID NO: 767522 - RNA, 18 nt, Human
gaaugaagaaaacuggca

SEQ ID NO: 767523 - RNA, 21 nt, Human
gacaaggcagggucugagcuu

SEQ ID NO: 767524 - RNA, 26 nt, Human
gaguaggcaccaugauauuuacacca

SEQ ID NO: 767525 - RNA, 20 nt, Human
gauaugggaaacagaaagca

SEQ ID NO: 767526 - RNA, 21 nt, Human
gggcuggggagaggaaagagu

SEQ ID NO: 767527 - RNA, 24 nt, Human
gucacuugaucaacaaacagauuc

SEQ ID NO: 767528 - RNA, 21 nt, Human
gugaccccaugcaggccaguc

SEQ ID NO: 767529 - RNA, 20 nt, Human
gugcauuaguguuaaagugg

SEQ ID NO: 767530 - RNA, 25 nt, Human
uaaaaaccaaaauaugaagaaagua

SEQ ID NO: 767531 - RNA, 22 nt, Human
uaaaaccaaucugaaguccuca

SEQ ID NO: 767532 - RNA, 19 nt, Human
uaaaauacaaagcaaaacc

SEQ ID NO: 767533 - RNA, 24 nt, Human
uaaaguggcauuaaaaaaacuucu

SEQ ID NO: 767534 - RNA, 18 nt, Human
uaacaagcuauaaaauac

SEQ ID NO: 767535 - RNA, 22 nt, Human
uaacucacugugugaccccaug

SEQ ID NO: 767536 - RNA, 21 nt, Human
uaagacaugcacccaccccuc

SEQ ID NO: 767537 - RNA, 18 nt, Human
uaaggcuacaaaacagaa

SEQ ID NO: 767538 - RNA, 21 nt, Human
uacccuuaaguaaaagacaaa

SEQ ID NO: 767539 - RNA, 21 nt, Human
uagaaaagaacuagaagucac

SEQ ID NO: 767540 - RNA, 23 nt, Human
uagaaaccugucaagcuaaaaau

SEQ ID NO: 767541 - RNA, 18 nt, Human
uagaccucuaaucaggga

SEQ ID NO: 767542 - RNA, 23 nt, Human
uagaggugagauaugggaaacag

SEQ ID NO: 767543 - RNA, 19 nt, Human
uaggagauaguaucuccau

SEQ ID NO: 767544 - RNA, 18 nt, Human
uagggucaaaauaaguuu

SEQ ID NO: 767545 - RNA, 19 nt, Human
uagguuaucagagaaccca

SEQ ID NO: 767546 - RNA, 23 nt, Human
uauaaggaaaaaagccaaacacu

SEQ ID NO: 767547 - RNA, 22 nt, Human
uauaugcacacaguuuuauaua

SEQ ID NO: 767548 - RNA, 21 nt, Human
uaucugaaaauaacauauugg

SEQ ID NO: 767549 - RNA, 23 nt, Human
ucaagaaaaguuuuccacacaac

SEQ ID NO: 767550 - RNA, 19 nt, Human
ucaguaaacaguaugagga

SEQ ID NO: 767551 - RNA, 19 nt, Human
uccaucacugacuguuuag

SEQ ID NO: 767552 - RNA, 18 nt, Human
ucuaccacuaacucacug

SEQ ID NO: 767553 - RNA, 19 nt, Human
ucugcuaaaauucucuuuc

SEQ ID NO: 767554 - RNA, 23 nt, Human
ugaaauauuccaaauccuuccuc

SEQ ID NO: 767555 - RNA, 22 nt, Human
ugaagguaaggggggcugggga

SEQ ID NO: 767556 - RNA, 23 nt, Human
ugagaacagagugcaacaugcaa

SEQ ID NO: 767557 - RNA, 21 nt, Human
ugauaaagaauauaaaguacu

SEQ ID NO: 767558 - RNA, 19 nt, Human
ugauuuucauuaaaaucag

SEQ ID NO: 767559 - RNA, 21 nt, Human
ugcauuaguguuaaaguggca

SEQ ID NO: 767560 - RNA, 18 nt, Human
ugccaaggagacaugggg

SEQ ID NO: 767561 - RNA, 18 nt, Human
ugccaggacaaggcaggg

SEQ ID NO: 767562 - RNA, 18 nt, Human
ugcuaagacacaguuaau

SEQ ID NO: 767563 - RNA, 23 nt, Human
uggacuccugagaucaaacacau

SEQ ID NO: 767564 - RNA, 20 nt, Human
ugucuuguccaguaugggag

SEQ ID NO: 767565 - RNA, 18 nt, Human
uuaaaacuaucaaaaguc

SEQ ID NO: 767566 - RNA, 26 nt, Human
uuaaaagacaacaguguuuuaggcug

SEQ ID NO: 767567 - RNA, 20 nt, Human
uuaaauaaacaaaagaggag

SEQ ID NO: 767568 - RNA, 21 nt, Human
uuaacauuucuucucacaaaa

SEQ ID NO: 767569 - RNA, 21 nt, Human
uuacaaaaaaagaaagucacc

SEQ ID NO: 767570 - RNA, 24 nt, Human
uuaggcugagaauuguuugagccc

SEQ ID NO: 767571 - RNA, 24 nt, Human
uuaggucugccaugaaaaugaauu

SEQ ID NO: 767572 - RNA, 21 nt, Human
uucaguuugucaaauucaagu

SEQ ID NO: 767573 - RNA, 23 nt, Human
uucauaauuuccaacucaaaaau

SEQ ID NO: 767574 - RNA, 21 nt, Human
uucuaagauuuucuaaaacuu

SEQ ID NO: 767575 - RNA, 22 nt, Human
uucuaggagcccccaagaguac

SEQ ID NO: 767576 - RNA, 24 nt, Human
uucuuaaggcuacaaaacagaaca

SEQ ID NO: 767577 - RNA, 25 nt, Human
uugaaaaugaaauauuccaaauccu

SEQ ID NO: 767578 - RNA, 19 nt, Human
uugaagauuugagaggaaa

SEQ ID NO: 767579 - RNA, 20 nt, Human
uugaagauuugagaggaaau

SEQ ID NO: 767580 - RNA, 18 nt, Human
uugagaggaaaugaagag

SEQ ID NO: 767581 - RNA, 20 nt, Human
uuggaagcauuuuaaaagac

SEQ ID NO: 767582 - RNA, 23 nt, Human
uuggguggauaucaaucuacaag

SEQ ID NO: 767583 - RNA, 23 nt, Human
uuuaaagccuucagaaacauucc

SEQ ID NO: 767584 - RNA, 21 nt, Human
uuuagaaucugucagugcauu

SEQ ID NO: 767585 - RNA, 22 nt, Human
uuuguacucaguguaaggcuau

SEQ ID NO: 767586 - RNA, 21 nt, Human
accacgacgucuggagagagg

SEQ ID NO: 767587 - RNA, 20 nt, Human
agaaggaagcgcagaaacuc

SEQ ID NO: 767588 - RNA, 22 nt, Human
caggcaacuggccgacuccgac

SEQ ID NO: 767589 - RNA, 27 nt, Human
ccgaccaacagagaaaucgggaacuga

SEQ ID NO: 767590 - RNA, 21 nt, Human
cgacuccgaccaacagagaaa

SEQ ID NO: 767591 - RNA, 24 nt, Human
gacgucuggagagagggagaagga

SEQ ID NO: 767592 - RNA, 18 nt, Human
ggagaaacaguggaccag

SEQ ID NO: 767593 - RNA, 18 nt, Human
uggccgacuccgaccaac

SEQ ID NO: 767594 - RNA, 21 nt, Human
uuacauuuauaggagaaacag

SEQ ID NO: 767595 - RNA, 24 nt, Human
aaaaaaaaaacacauguuagaaca

SEQ ID NO: 767596 - RNA, 22 nt, Human
aaaaagaaagggucugaucuga

SEQ ID NO: 767597 - RNA, 23 nt, Human
aaaaauuaagagaagaaagacaa

SEQ ID NO: 767598 - RNA, 23 nt, Human
aaagacaaaaaagaaagggucug

SEQ ID NO: 767599 - RNA, 23 nt, Human
aacaacggaacaaacaucagaga

SEQ ID NO: 767600 - RNA, 22 nt, Human
aagagaagaaagacaaaaaaga

SEQ ID NO: 767601 - RNA, 19 nt, Human
aagggcucccggcccugau

SEQ ID NO: 767602 - RNA, 20 nt, Human
aagucaaagggggaaggagg

SEQ ID NO: 767603 - RNA, 22 nt, Human
acaaacaucagagagcaucccc

SEQ ID NO: 767604 - RNA, 21 nt, Human
acacaugcugggggucuuugu

SEQ ID NO: 767605 - RNA, 24 nt, Human
acagagcaagaccacguaucaaaa

SEQ ID NO: 767606 - RNA, 27 nt, Human
accacguaucaaaaaaaaaaaaaaaaa

SEQ ID NO: 767607 - RNA, 20 nt, Human
acccuccggcagggcucugg

SEQ ID NO: 767608 - RNA, 18 nt, Human
acugcacugcagccugag

SEQ ID NO: 767609 - RNA, 20 nt, Human
acugcacugcagccugagug

SEQ ID NO: 767610 - RNA, 21 nt, Human
acugcacugcagccugaguga

SEQ ID NO: 767611 - RNA, 24 nt, Human
acugcacugcagccugagugacag

SEQ ID NO: 767612 - RNA, 20 nt, Human
agaaaagacagauggaaaca

SEQ ID NO: 767613 - RNA, 22 nt, Human
agaaaagaggcauuuaaaaauu

SEQ ID NO: 767614 - RNA, 20 nt, Human
agaagaaagacaaaaaagaa

SEQ ID NO: 767615 - RNA, 21 nt, Human
agacaaaaaagaaagggucug

SEQ ID NO: 767616 - RNA, 27 nt, Human
agacaaaaaagaaagggucugaucuga

SEQ ID NO: 767617 - RNA, 27 nt, Human
agagaagaaagacaaaaaagaaagggu

SEQ ID NO: 767618 - RNA, 22 nt, Human
agagcauccccugcaaagcccc

SEQ ID NO: 767619 - RNA, 22 nt, Human
aggaaaacacagugccugcaga

SEQ ID NO: 767620 - RNA, 20 nt, Human
aggagccccagggagcagga

SEQ ID NO: 767621 - RNA, 19 nt, Human
aggaggucaaggccgcagc

SEQ ID NO: 767622 - RNA, 23 nt, Human
aggcagccguggaaucagggcag

SEQ ID NO: 767623 - RNA, 24 nt, Human
aucaugccacugcacugcagccug

SEQ ID NO: 767624 - RNA, 19 nt, Human
auggaagauagcacccaca

SEQ ID NO: 767625 - RNA, 21 nt, Human
caaacaucagagagcaucccc

SEQ ID NO: 767626 - RNA, 21 nt, Human
caaagcccccaccccagagcc

SEQ ID NO: 767627 - RNA, 27 nt, Human
caacccccuggucccugguggcuccuu

SEQ ID NO: 767628 - RNA, 24 nt, Human
caacggcagcaucuccaacugcac

SEQ ID NO: 767629 - RNA, 23 nt, Human
caacugcacaaagaccccuugcu

SEQ ID NO: 767630 - RNA, 18 nt, Human
caagagcucguacaaguc

SEQ ID NO: 767631 - RNA, 24 nt, Human
caaugcccaugaauauacccaaag

SEQ ID NO: 767632 - RNA, 23 nt, Human
cacacaaccuccuugggagcccc

SEQ ID NO: 767633 - RNA, 21 nt, Human
caccgcacgccaucagcuugc

SEQ ID NO: 767634 - RNA, 19 nt, Human
caccuguagucucaucuac

SEQ ID NO: 767635 - RNA, 21 nt, Human
caccuguagucucaucuacag

SEQ ID NO: 767636 - RNA, 22 nt, Human
cacucaacccccuggucccugg

SEQ ID NO: 767637 - RNA, 20 nt, Human
cacugcacugcagccugagu

SEQ ID NO: 767638 - RNA, 24 nt, Human
cacugcacugcagccugagugaca

SEQ ID NO: 767639 - RNA, 23 nt, Human
cacugcagccugagugacagagc

SEQ ID NO: 767640 - RNA, 23 nt, Human
cagagggacagcccccagcaccc

SEQ ID NO: 767641 - RNA, 25 nt, Human
cagagggacagcccccagcacccuc

SEQ ID NO: 767642 - RNA, 22 nt, Human
cagccaccgcacgccaucagcu

SEQ ID NO: 767643 - RNA, 23 nt, Human
ccaccgcacgccaucagcuugcc

SEQ ID NO: 767644 - RNA, 20 nt, Human
ccacugcacugcagccugag

SEQ ID NO: 767645 - RNA, 21 nt, Human
ccacugcacugcagccugagu

SEQ ID NO: 767646 - RNA, 24 nt, Human
ccacugcacugcagccugagugac

SEQ ID NO: 767647 - RNA, 21 nt, Human
ccaguccugagagggucaaaa

SEQ ID NO: 767648 - RNA, 22 nt, Human
ccauacacacaaccuccuuggg

SEQ ID NO: 767649 - RNA, 22 nt, Human
ccaugaauauacccaaaguguc

SEQ ID NO: 767650 - RNA, 18 nt, Human
cccaugaauauacccaaa

SEQ ID NO: 767651 - RNA, 24 nt, Human
cccccagcacccuccggcagggcu

SEQ ID NO: 767652 - RNA, 22 nt, Human
ccccgcagccaccgcacgccau

SEQ ID NO: 767653 - RNA, 24 nt, Human
ccccugcaaagcccccaccccaga

SEQ ID NO: 767654 - RNA, 23 nt, Human
cccugagccuccgaaggcagcuc

SEQ ID NO: 767655 - RNA, 19 nt, Human
ccugcaaagcccccacccc

SEQ ID NO: 767656 - RNA, 22 nt, Human
ccugcaaagcccccaccccaga

SEQ ID NO: 767657 - RNA, 20 nt, Human
ccugcaaagcccccaccccg

SEQ ID NO: 767658 - RNA, 20 nt, Human
ccugcugauggaagcggggc

SEQ ID NO: 767659 - RNA, 19 nt, Human
cggcagcaucuccaacugc

SEQ ID NO: 767660 - RNA, 19 nt, Human
cggcagggcucuggacagc

SEQ ID NO: 767661 - RNA, 21 nt, Human
cucaaacaccuguagucucau

SEQ ID NO: 767662 - RNA, 24 nt, Human
cucaagaaaagaggcauuuaaaaa

SEQ ID NO: 767663 - RNA, 25 nt, Human
cucccggcccugauaccccgcagcc

SEQ ID NO: 767664 - RNA, 21 nt, Human
cucccugagccuccgaaggca

SEQ ID NO: 767665 - RNA, 24 nt, Human
cuccugcaagucaaagggggaagg

SEQ ID NO: 767666 - RNA, 23 nt, Human
cucuggacagcuaagcccagucc

SEQ ID NO: 767667 - RNA, 21 nt, Human
cugcacaaagaccccuugcug

SEQ ID NO: 767668 - RNA, 24 nt, Human
cuugagcacaggaggucaaggccg

SEQ ID NO: 767669 - RNA, 21 nt, Human
gaaacaaccagcuccaaaggg

SEQ ID NO: 767670 - RNA, 24 nt, Human
gaacaaacaucagagagcaucccc

SEQ ID NO: 767671 - RNA, 20 nt, Human
gaagaaagacaaaaaagaaa

SEQ ID NO: 767672 - RNA, 22 nt, Human
gaagacaucacaagugucagga

SEQ ID NO: 767673 - RNA, 22 nt, Human
gacaagagcucguacaagucca

SEQ ID NO: 767674 - RNA, 20 nt, Human
gacagcccccagcacccucc

SEQ ID NO: 767675 - RNA, 24 nt, Human
gagagcauccccugcaaagccccc

SEQ ID NO: 767676 - RNA, 21 nt, Human
gagcacaggaggucaaggccg

SEQ ID NO: 767677 - RNA, 18 nt, Human
gaggacagccccugagga

SEQ ID NO: 767678 - RNA, 19 nt, Human
gaggagaggcugggcugcc

SEQ ID NO: 767679 - RNA, 18 nt, Human
gcaaaaaaaaaaacaaaa

SEQ ID NO: 767680 - RNA, 21 nt, Human
gcagcgagccaugaucaugcc

SEQ ID NO: 767681 - RNA, 21 nt, Human
gcagcuccucuaacgccuccc

SEQ ID NO: 767682 - RNA, 24 nt, Human
gccacaacggcagcaucuccaacu

SEQ ID NO: 767683 - RNA, 18 nt, Human
gccagggccgggcaccgg

SEQ ID NO: 767684 - RNA, 19 nt, Human
gccaugaucaugccacugc

SEQ ID NO: 767685 - RNA, 24 nt, Human
gcuccuugccugccugccugaggc

SEQ ID NO: 767686 - RNA, 18 nt, Human
gcugccccaagccccugc

SEQ ID NO: 767687 - RNA, 20 nt, Human
ggcaggcagcuccucaggca

SEQ ID NO: 767688 - RNA, 19 nt, Human
ggcccugauaccccgcagc

SEQ ID NO: 767689 - RNA, 18 nt, Human
ggccuccuggagaaguug

SEQ ID NO: 767690 - RNA, 20 nt, Human
gggaaggagggugcuuucuc

SEQ ID NO: 767691 - RNA, 19 nt, Human
gggucugaucugaggcuga

SEQ ID NO: 767692 - RNA, 19 nt, Human
gguggaggagaggcugggc

SEQ ID NO: 767693 - RNA, 23 nt, Human
gucccaggaggauaaaagccauc

SEQ ID NO: 767694 - RNA, 22 nt, Human
uaccccgcagccaccgcacgcc

SEQ ID NO: 767695 - RNA, 18 nt, Human
uagaaaagacagauggaa

SEQ ID NO: 767696 - RNA, 21 nt, Human
uagaaaagacagauggaaaca

SEQ ID NO: 767697 - RNA, 22 nt, Human
uauauacauuuacaucugcaua

SEQ ID NO: 767698 - RNA, 26 nt, Human
uauaugcauaaauauguagguauaua

SEQ ID NO: 767699 - RNA, 21 nt, Human
ucagcuugccaugucaaugac

SEQ ID NO: 767700 - RNA, 25 nt, Human
uccaaagggacucccugagccuccg

SEQ ID NO: 767701 - RNA, 22 nt, Human
uccacacauuuuagccugagau

SEQ ID NO: 767702 - RNA, 18 nt, Human
ucccaaagggcucccggc

SEQ ID NO: 767703 - RNA, 21 nt, Human
ucccaaagggcucccggcccu

SEQ ID NO: 767704 - RNA, 19 nt, Human
ucccaggguacacacaugc

SEQ ID NO: 767705 - RNA, 26 nt, Human
uccccugcaaagcccccaccccagag

SEQ ID NO: 767706 - RNA, 19 nt, Human
ucccugagccuccgaaggc

SEQ ID NO: 767707 - RNA, 19 nt, Human
ucuggguggaggagaggcu

SEQ ID NO: 767708 - RNA, 22 nt, Human
ugaauauacccaaaguguccca

SEQ ID NO: 767709 - RNA, 22 nt, Human
ugacaagagcucguacaagucc

SEQ ID NO: 767710 - RNA, 18 nt, Human
ugagccuccgaaggcagc

SEQ ID NO: 767711 - RNA, 22 nt, Human
ugagccuccgaaggcagcuccu

SEQ ID NO: 767712 - RNA, 19 nt, Human
ugaggcugagguauuggag

SEQ ID NO: 767713 - RNA, 24 nt, Human
ugauggaagcggggcugcaggacg

SEQ ID NO: 767714 - RNA, 18 nt, Human
ugcaaagcccccacccca

SEQ ID NO: 767715 - RNA, 23 nt, Human
ugcacaaagaccccuugcugcca

SEQ ID NO: 767716 - RNA, 22 nt, Human
ugcauauaugcauaaauaugua

SEQ ID NO: 767717 - RNA, 23 nt, Human
ugcauauaugcauaaauauguag

SEQ ID NO: 767718 - RNA, 20 nt, Human
ugccccaagccccugcucag

SEQ ID NO: 767719 - RNA, 23 nt, Human
ugccccaagccccugcucagggc

SEQ ID NO: 767720 - RNA, 21 nt, Human
ugccugccugccugaggcagc

SEQ ID NO: 767721 - RNA, 21 nt, Human
ugcugauggaagcggggcugc

SEQ ID NO: 767722 - RNA, 21 nt, Human
uggaagaaggcaggcagcucc

SEQ ID NO: 767723 - RNA, 21 nt, Human
uggaagauagcacccacagug

SEQ ID NO: 767724 - RNA, 21 nt, Human
uggcucccugaggagccccuc

SEQ ID NO: 767725 - RNA, 18 nt, Human
uggguggaggagaggcug

SEQ ID NO: 767726 - RNA, 24 nt, Human
ugugcauauaugcauaaauaugua

SEQ ID NO: 767727 - RNA, 22 nt, Human
uguguggcuuuacuguuccacu

SEQ ID NO: 767728 - RNA, 20 nt, Human
uuccucccaaagggcucccg

SEQ ID NO: 767729 - RNA, 21 nt, Human
agucgauuucacggccagcgc

SEQ ID NO: 767730 - RNA, 19 nt, Human
ccgcccacagagccagccg

SEQ ID NO: 767731 - RNA, 24 nt, Human
cucgucuucagcuucuagauggug

SEQ ID NO: 767732 - RNA, 19 nt, Human
gaaaaaaggcugcaaagua

SEQ ID NO: 767733 - RNA, 19 nt, Human
gaccagggggaaaaaaggc

SEQ ID NO: 767734 - RNA, 25 nt, Human
gccaccgcccacagagccagccguc

SEQ ID NO: 767735 - RNA, 21 nt, Human
ucucacaaaaucaaaacggga

SEQ ID NO: 767736 - RNA, 21 nt, Human
ugaccuacgcucucacaaaau

SEQ ID NO: 767737 - RNA, 22 nt, Human
uuucacggccagcgcggucacu

SEQ ID NO: 767738 - RNA, 18 nt, Human
aaaauuagcugggcgugg

SEQ ID NO: 767739 - RNA, 21 nt, Human
aaacaaaacaaaacaaacaaa

SEQ ID NO: 767740 - RNA, 23 nt, Human
aaacaggaaauaucacucuguua

SEQ ID NO: 767741 - RNA, 20 nt, Human
aaacauucugaaccacaugc

SEQ ID NO: 767742 - RNA, 20 nt, Human
aaagaagagguguaaaaagg

SEQ ID NO: 767743 - RNA, 22 nt, Human
aaagagccccacccagcccugu

SEQ ID NO: 767744 - RNA, 22 nt, Human
aaagaucccucuuaggccacca

SEQ ID NO: 767745 - RNA, 21 nt, Human
aaagucucugcuguguccuaa

SEQ ID NO: 767746 - RNA, 23 nt, Human
aaauauaggagcaaguggacuau

SEQ ID NO: 767747 - RNA, 19 nt, Human
aacaacuuccuacacucuu

SEQ ID NO: 767748 - RNA, 18 nt, Human
aacacggugaaaccccac

SEQ ID NO: 767749 - RNA, 20 nt, Human
aacacggugaaaccccaccu

SEQ ID NO: 767750 - RNA, 20 nt, Human
aacacggugaaaccccaccu

SEQ ID NO: 767751 - RNA, 21 nt, Human
aacacggugaaaccccaccuc

SEQ ID NO: 767752 - RNA, 20 nt, Human
aacagagugaaacuccaccu

SEQ ID NO: 767753 - RNA, 21 nt, Human
aaccagacuaaguuuggcacg

SEQ ID NO: 767754 - RNA, 18 nt, Human
aaccugaacucugauuug

SEQ ID NO: 767755 - RNA, 18 nt, Human
aagaucugggucccugua

SEQ ID NO: 767756 - RNA, 23 nt, Human
aaggagugggagugguaaaugga

SEQ ID NO: 767757 - RNA, 22 nt, Human
aaguaaacaggaaauaucacuc

SEQ ID NO: 767758 - RNA, 22 nt, Human
aagugagagaaaguuguuucuu

SEQ ID NO: 767759 - RNA, 24 nt, Human
aaucacuugaaccugggaggcgga

SEQ ID NO: 767760 - RNA, 21 nt, Human
aaucagggagagauagguggg

SEQ ID NO: 767761 - RNA, 19 nt, Human
aaucuggagcaagcuauac

SEQ ID NO: 767762 - RNA, 22 nt, Human
aaugaccccagcauuuagaaag

SEQ ID NO: 767763 - RNA, 19 nt, Human
acaaaaacugugagaaaca

SEQ ID NO: 767764 - RNA, 24 nt, Human
acaaacaaacaaccugugcaaaau

SEQ ID NO: 767765 - RNA, 23 nt, Human
acagagugaaacuccaccuaaaa

SEQ ID NO: 767766 - RNA, 22 nt, Human
accacugcacuccagccugggc

SEQ ID NO: 767767 - RNA, 19 nt, Human
acccccagggaaccacccu

SEQ ID NO: 767768 - RNA, 23 nt, Human
acccccagggaaccacccucuuc

SEQ ID NO: 767769 - RNA, 23 nt, Human
accugcucagguccccaaauguc

SEQ ID NO: 767770 - RNA, 24 nt, Human
acuccagccugggcaacagaguga

SEQ ID NO: 767771 - RNA, 21 nt, Human
acugagaagauucugugauaa

SEQ ID NO: 767772 - RNA, 24 nt, Human
acugcacuccagccugggcaacag

SEQ ID NO: 767773 - RNA, 24 nt, Human
acugcacuccagccugggcaacag

SEQ ID NO: 767774 - RNA, 24 nt, Human
acuugaggucaggaguucgagacc

SEQ ID NO: 767775 - RNA, 25 nt, Human
agaaaaacauacaggguacuuucuu

SEQ ID NO: 767776 - RNA, 21 nt, Human
agaaaaccuaacauacagccg

SEQ ID NO: 767777 - RNA, 22 nt, Human
agaaaagaucccucuuaggcca

SEQ ID NO: 767778 - RNA, 19 nt, Human
agaaacgcaggaaggaugg

SEQ ID NO: 767779 - RNA, 22 nt, Human
agagaagcuuuacuuaaaauac

SEQ ID NO: 767780 - RNA, 23 nt, Human
agagcagacuagucccaauccuu

SEQ ID NO: 767781 - RNA, 19 nt, Human
agaguggagagcagacuag

SEQ ID NO: 767782 - RNA, 20 nt, Human
agaguuucuguuuaauaucc

SEQ ID NO: 767783 - RNA, 22 nt, Human
agaugccaguugcguguuuagg

SEQ ID NO: 767784 - RNA, 22 nt, Human
agcaaaguacgagaacacagug

SEQ ID NO: 767785 - RNA, 18 nt, Human
agcauuuugggaggcuga

SEQ ID NO: 767786 - RNA, 24 nt, Human
agcauuuugggaggcugagguggg

SEQ ID NO: 767787 - RNA, 21 nt, Human
agccgauaugccccuuaacac

SEQ ID NO: 767788 - RNA, 23 nt, Human
agccgauaugccccuuaacacca

SEQ ID NO: 767789 - RNA, 22 nt, Human
agccugggcaacagagugaaac

SEQ ID NO: 767790 - RNA, 24 nt, Human
agccugggcaacagagugaaacuc

SEQ ID NO: 767791 - RNA, 24 nt, Human
agcuacuugggaggcugagguggg

SEQ ID NO: 767792 - RNA, 26 nt, Human
aggagugcaggcgggcugugauuuua

SEQ ID NO: 767793 - RNA, 21 nt, Human
aggcagggaagagugcacaaa

SEQ ID NO: 767794 - RNA, 18 nt, Human
aggcaggggggccucagg

SEQ ID NO: 767795 - RNA, 20 nt, Human
aggcaggggggccucagggg

SEQ ID NO: 767796 - RNA, 25 nt, Human
aggcggagguugcagugacaacggu

SEQ ID NO: 767797 - RNA, 19 nt, Human
aggcggagguugcagugag

SEQ ID NO: 767798 - RNA, 20 nt, Human
aggcggagguugcagugagc

SEQ ID NO: 767799 - RNA, 24 nt, Human
aggcggagguugcagugagcagag

SEQ ID NO: 767800 - RNA, 21 nt, Human
aggcggggcccuuuucuggcu

SEQ ID NO: 767801 - RNA, 24 nt, Human
aggcugaggugggagaaucacuug

SEQ ID NO: 767802 - RNA, 23 nt, Human
aggggagggggaggcaggggggc

SEQ ID NO: 767803 - RNA, 22 nt, Human
agguagucuaguuagcaaagug

SEQ ID NO: 767804 - RNA, 24 nt, Human
aggugggagaaucacuugaaccug

SEQ ID NO: 767805 - RNA, 24 nt, Human
aguggcucacgccuguaaucccag

SEQ ID NO: 767806 - RNA, 22 nt, Human
aguuuuugguucggguuuuccu

SEQ ID NO: 767807 - RNA, 18 nt, Human
auacagccgauaugcccc

SEQ ID NO: 767808 - RNA, 19 nt, Human
auagaaugugguacauaca

SEQ ID NO: 767809 - RNA, 24 nt, Human
aucacuugaggucaggaguucgag

SEQ ID NO: 767810 - RNA, 22 nt, Human
augccuauaauaaguaacaaga

SEQ ID NO: 767811 - RNA, 26 nt, Human
augcuggcagggcagacagcaugggg

SEQ ID NO: 767812 - RNA, 26 nt, Human
caaaguacgagaacacaguggguaug

SEQ ID NO: 767813 - RNA, 20 nt, Human
caacacggugaaaccccacc

SEQ ID NO: 767814 - RNA, 20 nt, Human
caaucucuagacuagagaca

SEQ ID NO: 767815 - RNA, 23 nt, Human
cacccagcccuguuuggugccac

SEQ ID NO: 767816 - RNA, 24 nt, Human
cacgccuguaaucccagcauuuug

SEQ ID NO: 767817 - RNA, 22 nt, Human
cacuccagccugggcaacagag

SEQ ID NO: 767818 - RNA, 22 nt, Human
cacuccagccugggcaacagag

SEQ ID NO: 767819 - RNA, 24 nt, Human
cacuccagccugggcaacagagug

SEQ ID NO: 767820 - RNA, 18 nt, Human
cacugcacuccagccugg

SEQ ID NO: 767821 - RNA, 19 nt, Human
cacugcacuccagccuggg

SEQ ID NO: 767822 - RNA, 21 nt, Human
cacugcacuccagccugggca

SEQ ID NO: 767823 - RNA, 23 nt, Human
cacugcacuccagccugggcaac

SEQ ID NO: 767824 - RNA, 24 nt, Human
cacugcacuccagccugggcaaca

SEQ ID NO: 767825 - RNA, 21 nt, Human
cacuugaaccugggaggcgga

SEQ ID NO: 767826 - RNA, 23 nt, Human
cacuugaggucaggaguucgaga

SEQ ID NO: 767827 - RNA, 19 nt, Human
cagcaaaguacgagaacac

SEQ ID NO: 767828 - RNA, 21 nt, Human
cagcauggggacugugcuuuc

SEQ ID NO: 767829 - RNA, 21 nt, Human
cagcauuuugggaggcugagg

SEQ ID NO: 767830 - RNA, 24 nt, Human
cagcauuuugggaggcugaggugg

SEQ ID NO: 767831 - RNA, 24 nt, Human
cagcuacuugggaggcugaggugg

SEQ ID NO: 767832 - RNA, 21 nt, Human
caggaugcugagaugcuggca

SEQ ID NO: 767833 - RNA, 19 nt, Human
caggggacacggauggcag

SEQ ID NO: 767834 - RNA, 18 nt, Human
cagugggccagcccuggg

SEQ ID NO: 767835 - RNA, 19 nt, Human
cagugguaucuuggacucu

SEQ ID NO: 767836 - RNA, 23 nt, Human
caugccacagucacagauacugu

SEQ ID NO: 767837 - RNA, 25 nt, Human
ccaccacugcacuccagccugggca

SEQ ID NO: 767838 - RNA, 20 nt, Human
ccacccagcccuguuuggug

SEQ ID NO: 767839 - RNA, 20 nt, Human
ccaccuaaaaaaaaaaaaaa

SEQ ID NO: 767840 - RNA, 20 nt, Human
ccacugcacuccagccuggg

SEQ ID NO: 767841 - RNA, 20 nt, Human
ccacugcacuccagccuggg

SEQ ID NO: 767842 - RNA, 21 nt, Human
ccacugcacuccagccugggc

SEQ ID NO: 767843 - RNA, 23 nt, Human
ccacugcacuccagccugggcaa

SEQ ID NO: 767844 - RNA, 24 nt, Human
ccacugcacuccagccugggcaac

SEQ ID NO: 767845 - RNA, 22 nt, Human
cccaccucuacuaaaagauaca

SEQ ID NO: 767846 - RNA, 18 nt, Human
cccagggcaggaggaaga

SEQ ID NO: 767847 - RNA, 19 nt, Human
ccccaaagagccccaccca

SEQ ID NO: 767848 - RNA, 20 nt, Human
ccccaaagagccccacccag

SEQ ID NO: 767849 - RNA, 21 nt, Human
ccccaaagagccccacccagc

SEQ ID NO: 767850 - RNA, 24 nt, Human
ccccaaagagccccacccagcccu

SEQ ID NO: 767851 - RNA, 19 nt, Human
cccuaugcugacccaaccc

SEQ ID NO: 767852 - RNA, 18 nt, Human
ccgacuuauauuuccugu

SEQ ID NO: 767853 - RNA, 24 nt, Human
ccgaucacuugaggucaggaguuc

SEQ ID NO: 767854 - RNA, 24 nt, Human
ccugaccaacacggugaaacccca

SEQ ID NO: 767855 - RNA, 24 nt, Human
ccuggacugcuuuggaaaugaccu

SEQ ID NO: 767856 - RNA, 19 nt, Human
ccugggaggcggagguugc

SEQ ID NO: 767857 - RNA, 24 nt, Human
ccugggcaacagagugaaacucca

SEQ ID NO: 767858 - RNA, 24 nt, Human
cgccuguaaucccagcauuuuggg

SEQ ID NO: 767859 - RNA, 20 nt, Human
cgggccaggugggguggggg

SEQ ID NO: 767860 - RNA, 22 nt, Human
cgggccagucccacagcaaaga

SEQ ID NO: 767861 - RNA, 21 nt, Human
cuaaaaaaaaaaaaaaugagu

SEQ ID NO: 767862 - RNA, 25 nt, Human
cuaaaagaccugcucagguccccaa

SEQ ID NO: 767863 - RNA, 21 nt, Human
cucacgccuguaaucccagca

SEQ ID NO: 767864 - RNA, 21 nt, Human
cucacgccuguaaucccagca

SEQ ID NO: 767865 - RNA, 21 nt, Human
cuccaccuaaaaaaaaaaaaa

SEQ ID NO: 767866 - RNA, 18 nt, Human
cugaagccuugagucagg

SEQ ID NO: 767867 - RNA, 21 nt, Human
cuggcgggccagucccacagc

SEQ ID NO: 767868 - RNA, 19 nt, Human
cuggucauuggcugcaagu

SEQ ID NO: 767869 - RNA, 22 nt, Human
cugugagaaacauauaguccac

SEQ ID NO: 767870 - RNA, 23 nt, Human
cuuuagugcaugaacagaucagg

SEQ ID NO: 767871 - RNA, 18 nt, Human
gaagaagaaaaacauaca

SEQ ID NO: 767872 - RNA, 23 nt, Human
gagaaucacuugaaccugggagg

SEQ ID NO: 767873 - RNA, 21 nt, Human
gagaauugacccagggcagga

SEQ ID NO: 767874 - RNA, 18 nt, Human
gagccugggggaagggga

SEQ ID NO: 767875 - RNA, 23 nt, Human
gaggugggccgaucacuugaggu

SEQ ID NO: 767876 - RNA, 21 nt, Human
gagugguaaauggaggcagaa

SEQ ID NO: 767877 - RNA, 22 nt, Human
gaucacuugaggucaggaguuc

SEQ ID NO: 767878 - RNA, 24 nt, Human
gaucacuugaggucaggaguucga

SEQ ID NO: 767879 - RNA, 19 nt, Human
gaucucuuaagguaucuug

SEQ ID NO: 767880 - RNA, 24 nt, Human
gcacuccagccugggcaacagagu

SEQ ID NO: 767881 - RNA, 18 nt, Human
gcaggggggccucagggg

SEQ ID NO: 767882 - RNA, 21 nt, Human
gccaguggcucacgccuguaa

SEQ ID NO: 767883 - RNA, 21 nt, Human
gccuugagucaggaaggagaa

SEQ ID NO: 767884 - RNA, 19 nt, Human
gcgggccaggugggguggg

SEQ ID NO: 767885 - RNA, 19 nt, Human
gcgggccagucccacagca

SEQ ID NO: 767886 - RNA, 18 nt, Human
gcuaaaucuggagcaagc

SEQ ID NO: 767887 - RNA, 19 nt, Human
gcugggugaugguaacugu

SEQ ID NO: 767888 - RNA, 20 nt, Human
gcuucuggucauuggcugca

SEQ ID NO: 767889 - RNA, 19 nt, Human
ggaaaacucugaagccuug

SEQ ID NO: 767890 - RNA, 22 nt, Human
ggaagaagaaaaacauacaggg

SEQ ID NO: 767891 - RNA, 18 nt, Human
ggagguugcagugagcag

SEQ ID NO: 767892 - RNA, 20 nt, Human
ggagguugcagugagcaggc

SEQ ID NO: 767893 - RNA, 19 nt, Human
ggagugguaaauggaggca

SEQ ID NO: 767894 - RNA, 20 nt, Human
ggccagucccacagcaaaga

SEQ ID NO: 767895 - RNA, 24 nt, Human
gggaaauuuuaguuagaaaaggug

SEQ ID NO: 767896 - RNA, 19 nt, Human
gggcccucaggagugcagg

SEQ ID NO: 767897 - RNA, 24 nt, Human
ggggaaggggagccugagaggcga

SEQ ID NO: 767898 - RNA, 21 nt, Human
guccuggcugaccucuuucuu

SEQ ID NO: 767899 - RNA, 22 nt, Human
guuacaguucuuuuuccucaca

SEQ ID NO: 767900 - RNA, 24 nt, Human
uaaaaaaaaaaaaaaugaguuuag

SEQ ID NO: 767901 - RNA, 23 nt, Human
uaaaaucacugaaaaacuguuuc

SEQ ID NO: 767902 - RNA, 21 nt, Human
uacagccgauaugccccuuuu

SEQ ID NO: 767903 - RNA, 21 nt, Human
uagagacagcgaugcccaugu

SEQ ID NO: 767904 - RNA, 19 nt, Human
uaggcgaaaugagaugcca

SEQ ID NO: 767905 - RNA, 24 nt, Human
uagguaacaaguaggccaagaacg

SEQ ID NO: 767906 - RNA, 20 nt, Human
ucacgccuguaaucccagca

SEQ ID NO: 767907 - RNA, 25 nt, Human
ucacucuguuagaaaaaaaaaaaaa

SEQ ID NO: 767908 - RNA, 24 nt, Human
ucacuugaaccugggaggcggagg

SEQ ID NO: 767909 - RNA, 25 nt, Human
ucacuugaaccugggaggcggaggu

SEQ ID NO: 767910 - RNA, 27 nt, Human
ucagagguuuaauugggcuuucugacc

SEQ ID NO: 767911 - RNA, 19 nt, Human
ucagcaaaguacgagaaca

SEQ ID NO: 767912 - RNA, 25 nt, Human
ucagcacaaaugcaauaaugugccg

SEQ ID NO: 767913 - RNA, 21 nt, Human
ucaggagugcaggcgggcugu

SEQ ID NO: 767914 - RNA, 18 nt, Human
ucagggagagauaggugg

SEQ ID NO: 767915 - RNA, 24 nt, Human
ucagugauuuuucuucuuccugcc

SEQ ID NO: 767916 - RNA, 19 nt, Human
ucauuaggaaggggagggg

SEQ ID NO: 767917 - RNA, 21 nt, Human
uccaagcccaggcagauucca

SEQ ID NO: 767918 - RNA, 24 nt, Human
uccaugcgggcuucccaaacaacu

SEQ ID NO: 767919 - RNA, 19 nt, Human
ucccacugcccccaacacc

SEQ ID NO: 767920 - RNA, 21 nt, Human
ucccacugcccccaacaccag

SEQ ID NO: 767921 - RNA, 19 nt, Human
ucuaaguaaacaggaaaua

SEQ ID NO: 767922 - RNA, 23 nt, Human
ucugaagccuauguauaauacuu

SEQ ID NO: 767923 - RNA, 19 nt, Human
ugaaaccccaccucuacua

SEQ ID NO: 767924 - RNA, 19 nt, Human
ugaacagagauacuaguca

SEQ ID NO: 767925 - RNA, 20 nt, Human
ugaacagagauacuagucag

SEQ ID NO: 767926 - RNA, 24 nt, Human
ugaaccugggaggcggagguugca

SEQ ID NO: 767927 - RNA, 23 nt, Human
ugagaacuagagauguucaacga

SEQ ID NO: 767928 - RNA, 19 nt, Human
ugagcagugggccagcccu

SEQ ID NO: 767929 - RNA, 20 nt, Human
ugaggugggagaaucacuug

SEQ ID NO: 767930 - RNA, 24 nt, Human
ugaggugggagaaucacuugaacc

SEQ ID NO: 767931 - RNA, 24 nt, Human
ugaggugggccgaucacuugaggu

SEQ ID NO: 767932 - RNA, 21 nt, Human
ugauaggaggcagaagugaga

SEQ ID NO: 767933 - RNA, 21 nt, Human
ugauggguugauggagaugca

SEQ ID NO: 767934 - RNA, 21 nt, Human
ugcaggggacacggauggcag

SEQ ID NO: 767935 - RNA, 23 nt, Human
ugcaggggacacggauggcaggu

SEQ ID NO: 767936 - RNA, 18 nt, Human
ugccaauauagguaaaau

SEQ ID NO: 767937 - RNA, 19 nt, Human
ugccacagucacagauacu

SEQ ID NO: 767938 - RNA, 21 nt, Human
ugcgggccagguggggugggg

SEQ ID NO: 767939 - RNA, 24 nt, Human
ugcguguggucccagcuacuuggg

SEQ ID NO: 767940 - RNA, 19 nt, Human
ugcuaauugcagagcuuuu

SEQ ID NO: 767941 - RNA, 19 nt, Human
ugcucugcagcuugggaga

SEQ ID NO: 767942 - RNA, 25 nt, Human
uggaaagagguaccauuuuguauuu

SEQ ID NO: 767943 - RNA, 22 nt, Human
uggaaagauaacaaugcauuca

SEQ ID NO: 767944 - RNA, 26 nt, Human
uggaaagauaacaaugcauucaaaca

SEQ ID NO: 767945 - RNA, 21 nt, Human
uggaagaagaaaaacauacag

SEQ ID NO: 767946 - RNA, 26 nt, Human
uggcaaggcggggcccuuuucuggcu

SEQ ID NO: 767947 - RNA, 18 nt, Human
uggcagaaucagguaggc

SEQ ID NO: 767948 - RNA, 22 nt, Human
uggcucacgccuguaaucccag

SEQ ID NO: 767949 - RNA, 24 nt, Human
uggcucacgccuguaaucccagca

SEQ ID NO: 767950 - RNA, 27 nt, Human
uggcucugggugugaauuucuuccuaa

SEQ ID NO: 767951 - RNA, 24 nt, Human
ugggagagguggugaccaagaagg

SEQ ID NO: 767952 - RNA, 24 nt, Human
ugggaggcggagguugcagugagc

SEQ ID NO: 767953 - RNA, 19 nt, Human
ugggaggcugaggugggag

SEQ ID NO: 767954 - RNA, 24 nt, Human
ugggaggcugaggugggagaauca

SEQ ID NO: 767955 - RNA, 18 nt, Human
ugggaggcugaggugggc

SEQ ID NO: 767956 - RNA, 20 nt, Human
ugggaggcugaggugggccg

SEQ ID NO: 767957 - RNA, 24 nt, Human
ugggaggcugaggugggccgauca

SEQ ID NO: 767958 - RNA, 18 nt, Human
uggguuguuugacugcug

SEQ ID NO: 767959 - RNA, 24 nt, Human
ugguggcgcaugcgugugguccca

SEQ ID NO: 767960 - RNA, 24 nt, Human
ugugcaaaaucacaaaggggcaag

SEQ ID NO: 767961 - RNA, 20 nt, Human
uguuucaagaaaauaaugga

SEQ ID NO: 767962 - RNA, 28 nt, Human
uguuucuuaaucuccagcuaaaucugga

SEQ ID NO: 767963 - RNA, 24 nt, Human
uuagaaaaaaaaaaaaaaagaauc

SEQ ID NO: 767964 - RNA, 18 nt, Human
uuagcugggcgugguggc

SEQ ID NO: 767965 - RNA, 24 nt, Human
uuagcugggcgugguggcgcaugc

SEQ ID NO: 767966 - RNA, 24 nt, Human
uucagugauuuuucuucuuccugc

SEQ ID NO: 767967 - RNA, 19 nt, Human
uucauuuuccuucuacugu

SEQ ID NO: 767968 - RNA, 24 nt, Human
uucccaccacugcacuccagccug

SEQ ID NO: 767969 - RNA, 24 nt, Human
uugaaccugggaggcggagguugc

SEQ ID NO: 767970 - RNA, 25 nt, Human
uugggaggcugaggugggagaauca

SEQ ID NO: 767971 - RNA, 22 nt, Human
uugggaggcugaggugggccga

SEQ ID NO: 767972 - RNA, 20 nt, Human
uuuagugcuuguaaaaauga

SEQ ID NO: 767973 - RNA, 24 nt, Human
uuucacuuagucugagcucugcga

SEQ ID NO: 767974 - RNA, 21 nt, Human
uuucuuggguuguuugacugc

SEQ ID NO: 767975 - RNA, 18 nt, Human
uuugcuggaaccuuauca

SEQ ID NO: 767976 - RNA, 22 nt, Human
uuuucauuuuuguacaaauuuu

SEQ ID NO: 767977 - RNA, 23 nt, Human
uuuuucuucuuccugccaccuuu

SEQ ID NO: 767978 - RNA, 18 nt, Human
cauugcaauucacccucc

SEQ ID NO: 767979 - RNA, 24 nt, Human
cccagaaauaccgaaagaugccaa

SEQ ID NO: 767980 - RNA, 22 nt, Human
ccuccuggagccucccucugaa

SEQ ID NO: 767981 - RNA, 24 nt, Human
cgaaagaugccaagugaacacugu

SEQ ID NO: 767982 - RNA, 21 nt, Human
cucagcucuuuggugguggug

SEQ ID NO: 767983 - RNA, 18 nt, Human
ucagcucuuugguggugg

SEQ ID NO: 767984 - RNA, 20 nt, Human
ucuuuggugguggugaucaa

SEQ ID NO: 767985 - RNA, 18 nt, Human
ugccaagugaacacuguu

SEQ ID NO: 767986 - RNA, 19 nt, Human
ugggagccucagcucuuug

SEQ ID NO: 767987 - RNA, 22 nt, Human
uugcaauucacccucccagaaa

SEQ ID NO: 767988 - RNA, 25 nt, Human
uuggugguggugaucauugcaauuc

SEQ ID NO: 767989 - RNA, 22 nt, Human
aaaaagaaacacccacacagaa

SEQ ID NO: 767990 - RNA, 24 nt, Human
aaaaagaaacacccacacagaaga

SEQ ID NO: 767991 - RNA, 21 nt, Human
aaagagcugggcaguagcugg

SEQ ID NO: 767992 - RNA, 24 nt, Human
aaagagcugggcaguagcugguug

SEQ ID NO: 767993 - RNA, 24 nt, Human
aaagugcugggauuacaggcguga

SEQ ID NO: 767994 - RNA, 20 nt, Human
aaccagaggcugggaauccc

SEQ ID NO: 767995 - RNA, 19 nt, Human
aagaagaggagauuaagga

SEQ ID NO: 767996 - RNA, 24 nt, Human
aagcagcugggauuacaggcgugu

SEQ ID NO: 767997 - RNA, 25 nt, Human
aagcagcugggauuacaggcgugug

SEQ ID NO: 767998 - RNA, 23 nt, Human
aagcaggacaagcagccagucaa

SEQ ID NO: 767999 - RNA, 22 nt, Human
aagccagcucauccucccucag

SEQ ID NO: 768000 - RNA, 21 nt, Human
aagugcugaacauguggaacu

SEQ ID NO: 768001 - RNA, 19 nt, Human
aagugcugggauuacaggc

SEQ ID NO: 768002 - RNA, 19 nt, Human
aagugcugggauuacaggc

SEQ ID NO: 768003 - RNA, 26 nt, Human
aagugcugggauuacaggcgugagcc

SEQ ID NO: 768004 - RNA, 21 nt, Human
aauaaacaccacagcuccccc

SEQ ID NO: 768005 - RNA, 20 nt, Human
acaauaaauguuacauauug

SEQ ID NO: 768006 - RNA, 29 nt, Human
acacagaagauagagggaaaagggacccc

SEQ ID NO: 768007 - RNA, 18 nt, Human
acaggguuuugccacauu

SEQ ID NO: 768008 - RNA, 20 nt, Human
acaggguuuugccacauugg

SEQ ID NO: 768009 - RNA, 24 nt, Human
acaggguuuugccacauuggccag

SEQ ID NO: 768010 - RNA, 19 nt, Human
acauuggccagguuggucu

SEQ ID NO: 768011 - RNA, 18 nt, Human
accacgcccagcuaauuu

SEQ ID NO: 768012 - RNA, 23 nt, Human
accacgcccagcuaauuuuugua

SEQ ID NO: 768013 - RNA, 23 nt, Human
acucaucuuggcuucccaaagug

SEQ ID NO: 768014 - RNA, 25 nt, Human
acucaucuuggcuucccaaagugcu

SEQ ID NO: 768015 - RNA, 20 nt, Human
agacggaaaaaaauaaauaa

SEQ ID NO: 768016 - RNA, 22 nt, Human
agaggcucccuugucccugccc

SEQ ID NO: 768017 - RNA, 21 nt, Human
agccaggcccccacuucagcu

SEQ ID NO: 768018 - RNA, 22 nt, Human
agcugggauuacaggcgugugc

SEQ ID NO: 768019 - RNA, 21 nt, Human
aggaagaaaagaugcugagga

SEQ ID NO: 768020 - RNA, 21 nt, Human
aggagugcugggggcucaugu

SEQ ID NO: 768021 - RNA, 20 nt, Human
aggccccaccaucaccugac

SEQ ID NO: 768022 - RNA, 25 nt, Human
aggccggagugcagugacgugaucu

SEQ ID NO: 768023 - RNA, 23 nt, Human
aggcucagggcguuuuguagggu

SEQ ID NO: 768024 - RNA, 19 nt, Human
aggcucccuugucccugcc

SEQ ID NO: 768025 - RNA, 19 nt, Human
agguaggaggacugggggg

SEQ ID NO: 768026 - RNA, 24 nt, Human
aguaugaaaagccaacaaaaagaa

SEQ ID NO: 768027 - RNA, 20 nt, Human
agugcagugacgugaucucg

SEQ ID NO: 768028 - RNA, 24 nt, Human
agugcagugacgugaucucggcuc

SEQ ID NO: 768029 - RNA, 28 nt, Human
augaaaagccaacaaaaagaaacaccca

SEQ ID NO: 768030 - RNA, 18 nt, Human
auguuacauauuguaguc

SEQ ID NO: 768031 - RNA, 25 nt, Human
auuuuuguauuuuuuaguggagaca

SEQ ID NO: 768032 - RNA, 24 nt, Human
caaaaagaaacacccacacagaag

SEQ ID NO: 768033 - RNA, 24 nt, Human
caaagcaugacaaaauuacgucug

SEQ ID NO: 768034 - RNA, 24 nt, Human
caaagugcugggauuacaggcgug

SEQ ID NO: 768035 - RNA, 18 nt, Human
caacaaaaagaaacaccc

SEQ ID NO: 768036 - RNA, 18 nt, Human
caacaaaaagaaacaccc

SEQ ID NO: 768037 - RNA, 23 nt, Human
caacaaaaagaaacacccacaca

SEQ ID NO: 768038 - RNA, 20 nt, Human
caaugcuauuuggcugcggc

SEQ ID NO: 768039 - RNA, 19 nt, Human
cacaggauggcaucucaaa

SEQ ID NO: 768040 - RNA, 20 nt, Human
cacaguccugagagcuggcu

SEQ ID NO: 768041 - RNA, 24 nt, Human
caccacagcucccccaguggccca

SEQ ID NO: 768042 - RNA, 20 nt, Human
caccggugucuugucuuucu

SEQ ID NO: 768043 - RNA, 22 nt, Human
caccucagcuggaagcagggac

SEQ ID NO: 768044 - RNA, 23 nt, Human
cacgcuuggccucucacuccuaa

SEQ ID NO: 768045 - RNA, 23 nt, Human
cagaccuacccagccugcaucca

SEQ ID NO: 768046 - RNA, 20 nt, Human
cagcacaauuccuuuauuca

SEQ ID NO: 768047 - RNA, 22 nt, Human
cagcacaauuccuuuauucauc

SEQ ID NO: 768048 - RNA, 18 nt, Human
cagccacaguccugagag

SEQ ID NO: 768049 - RNA, 20 nt, Human
cagccuccagccacaguccu

SEQ ID NO: 768050 - RNA, 24 nt, Human
caggguuuugccacauuggccagg

SEQ ID NO: 768051 - RNA, 24 nt, Human
caucagggaagggaggacauagga

SEQ ID NO: 768052 - RNA, 19 nt, Human
caucucaaaccagaggcug

SEQ ID NO: 768053 - RNA, 22 nt, Human
caucucccucugugcuugaccc

SEQ ID NO: 768054 - RNA, 22 nt, Human
ccaaagugcugggauuacaggc

SEQ ID NO: 768055 - RNA, 22 nt, Human
ccaaagugcugggauuacaggc

SEQ ID NO: 768056 - RNA, 24 nt, Human
ccaaagugcugggauuacaggcgu

SEQ ID NO: 768057 - RNA, 21 nt, Human
ccaacaaaaagaaacacccac

SEQ ID NO: 768058 - RNA, 22 nt, Human
ccaagcagcugggauuacaggc

SEQ ID NO: 768059 - RNA, 24 nt, Human
ccaagcagcugggauuacaggcgu

SEQ ID NO: 768060 - RNA, 18 nt, Human
ccacauuggccagguugg

SEQ ID NO: 768061 - RNA, 19 nt, Human
ccacauuggccagguuggu

SEQ ID NO: 768062 - RNA, 21 nt, Human
ccacauuggccagguuggucu

SEQ ID NO: 768063 - RNA, 20 nt, Human
ccaccucagcuggaagcagg

SEQ ID NO: 768064 - RNA, 25 nt, Human
ccagcauguacccccacucuuuccu

SEQ ID NO: 768065 - RNA, 23 nt, Human
ccaggccggagugcagugacgug

SEQ ID NO: 768066 - RNA, 19 nt, Human
ccagguucaagcaauucuc

SEQ ID NO: 768067 - RNA, 22 nt, Human
ccagguucaagcaauucuccug

SEQ ID NO: 768068 - RNA, 20 nt, Human
ccaguggcacaggccugugu

SEQ ID NO: 768069 - RNA, 18 nt, Human
ccaucaccugacugccag

SEQ ID NO: 768070 - RNA, 19 nt, Human
cccaagcagcugggauuac

SEQ ID NO: 768071 - RNA, 23 nt, Human
cccaagcagcugggauuacaggc

SEQ ID NO: 768072 - RNA, 24 nt, Human
cccacacagaagauagagggaaaa

SEQ ID NO: 768073 - RNA, 30 nt, Human
cccaccaucaccugacugccagaccuaccc

SEQ ID NO: 768074 - RNA, 21 nt, Human
cccagccuccagccacagucc

SEQ ID NO: 768075 - RNA, 19 nt, Human
cccagucuuugcugccugc

SEQ ID NO: 768076 - RNA, 19 nt, Human
ccccacuucagcucuuccc

SEQ ID NO: 768077 - RNA, 24 nt, Human
ccccaguggcccaggaaaauucug

SEQ ID NO: 768078 - RNA, 23 nt, Human
ccccucagaacacagagcugcca

SEQ ID NO: 768079 - RNA, 18 nt, Human
ccccuccuccucccuccc

SEQ ID NO: 768080 - RNA, 23 nt, Human
ccccuccuccucccucccuccag

SEQ ID NO: 768081 - RNA, 23 nt, Human
cccucagaacacagagcugccau

SEQ ID NO: 768082 - RNA, 23 nt, Human
cccucagccucccaagcagcugg

SEQ ID NO: 768083 - RNA, 22 nt, Human
cccucaggcucagcagcuccca

SEQ ID NO: 768084 - RNA, 24 nt, Human
cccucucagcacauucucagccac

SEQ ID NO: 768085 - RNA, 21 nt, Human
cccucuuccaccauccuggcc

SEQ ID NO: 768086 - RNA, 21 nt, Human
cccugcugggccagcucugcc

SEQ ID NO: 768087 - RNA, 19 nt, Human
ccgauguguugauuccucu

SEQ ID NO: 768088 - RNA, 27 nt, Human
ccgccuuccagguucaagcaauucuuu

SEQ ID NO: 768089 - RNA, 19 nt, Human
ccucagcuggaagcaggga

SEQ ID NO: 768090 - RNA, 27 nt, Human
ccucagcuggaagcagggacgggaguu

SEQ ID NO: 768091 - RNA, 23 nt, Human
ccuccagccacaguccugagagc

SEQ ID NO: 768092 - RNA, 18 nt, Human
ccucugugaaccaucacc

SEQ ID NO: 768093 - RNA, 23 nt, Human
ccucugugcuugacccugcuggg

SEQ ID NO: 768094 - RNA, 20 nt, Human
ccucuuccaccauccuggcc

SEQ ID NO: 768095 - RNA, 23 nt, Human
ccugaugccaggugaucuacuca

SEQ ID NO: 768096 - RNA, 21 nt, Human
ccugcccucagccucccaagc

SEQ ID NO: 768097 - RNA, 21 nt, Human
ccugcugggccagcucugccc

SEQ ID NO: 768098 - RNA, 21 nt, Human
ccuggggauuuagagauuugu

SEQ ID NO: 768099 - RNA, 20 nt, Human
ccugggugcugccuaggucu

SEQ ID NO: 768100 - RNA, 24 nt, Human
ccuuccagguucaagcaauucucc

SEQ ID NO: 768101 - RNA, 19 nt, Human
ccuuggauugggacaaagg

SEQ ID NO: 768102 - RNA, 21 nt, Human
ccuuucuccuccccuccuucc

SEQ ID NO: 768103 - RNA, 19 nt, Human
cggagugcagugacgugau

SEQ ID NO: 768104 - RNA, 23 nt, Human
cggagugcagugacgugaucucg

SEQ ID NO: 768105 - RNA, 24 nt, Human
cggagugcagugacgugaucucgg

SEQ ID NO: 768106 - RNA, 19 nt, Human
cggcggugagggaagugaa

SEQ ID NO: 768107 - RNA, 22 nt, Human
cgggagcaggaguuaggaagaa

SEQ ID NO: 768108 - RNA, 22 nt, Human
cucaaaccagaggcugggaauc

SEQ ID NO: 768109 - RNA, 23 nt, Human
cuccagccacaguccugagagcu

SEQ ID NO: 768110 - RNA, 19 nt, Human
cuccggggcgucagggacg

SEQ ID NO: 768111 - RNA, 19 nt, Human
cucuguaccuacugccccc

SEQ ID NO: 768112 - RNA, 18 nt, Human
cucugugcuugacccugc

SEQ ID NO: 768113 - RNA, 19 nt, Human
cucuucugaagcugaggau

SEQ ID NO: 768114 - RNA, 24 nt, Human
cugccagaccuacccagccugcau

SEQ ID NO: 768115 - RNA, 24 nt, Human
cugcccccgaaagugcugaacaug

SEQ ID NO: 768116 - RNA, 22 nt, Human
cuggcaccaguggcacaggccu

SEQ ID NO: 768117 - RNA, 19 nt, Human
cuuuauucaucuuucccuc

SEQ ID NO: 768118 - RNA, 20 nt, Human
cuuucuccuccccuccuucc

SEQ ID NO: 768119 - RNA, 19 nt, Human
cuuucuuuuuccuucuucu

SEQ ID NO: 768120 - RNA, 20 nt, Human
cuuugucuggcccucuucca

SEQ ID NO: 768121 - RNA, 18 nt, Human
gaacauguggaacuggau

SEQ ID NO: 768122 - RNA, 18 nt, Human
gagcaggaguuaggaaga

SEQ ID NO: 768123 - RNA, 23 nt, Human
gaggcugggaauccccucagaac

SEQ ID NO: 768124 - RNA, 24 nt, Human
gaugccaggugaucuacucaucuu

SEQ ID NO: 768125 - RNA, 18 nt, Human
gauuacaggcgugagcca

SEQ ID NO: 768126 - RNA, 21 nt, Human
gauuacaggcgugagccacca

SEQ ID NO: 768127 - RNA, 22 nt, Human
gauuacaggcgugagccaccac

SEQ ID NO: 768128 - RNA, 22 nt, Human
gcaaccuccgccuuccagguuc

SEQ ID NO: 768129 - RNA, 19 nt, Human
gcagacccagccuccagcc

SEQ ID NO: 768130 - RNA, 24 nt, Human
gcauuauagcagacccagccucca

SEQ ID NO: 768131 - RNA, 21 nt, Human
gccacacuuccagagggguga

SEQ ID NO: 768132 - RNA, 22 nt, Human
gcccagcuaauuuuuguauuuu

SEQ ID NO: 768133 - RNA, 19 nt, Human
gccggagugcagugacgug

SEQ ID NO: 768134 - RNA, 21 nt, Human
gccucccaagcagcugggauu

SEQ ID NO: 768135 - RNA, 25 nt, Human
gcucugucacccaggccggagugca

SEQ ID NO: 768136 - RNA, 21 nt, Human
ggacuggggggaagggaggga

SEQ ID NO: 768137 - RNA, 18 nt, Human
ggagacaggguuuugcca

SEQ ID NO: 768138 - RNA, 24 nt, Human
ggagaguaugaaaagccaacaaaa

SEQ ID NO: 768139 - RNA, 21 nt, Human
ggaggagugcugggggcucau

SEQ ID NO: 768140 - RNA, 19 nt, Human
ggauuacaggcgugagcca

SEQ ID NO: 768141 - RNA, 20 nt, Human
ggcaccaguggcacaggccu

SEQ ID NO: 768142 - RNA, 21 nt, Human
ggccagucuuguuuucugucu

SEQ ID NO: 768143 - RNA, 21 nt, Human
ggcccuaccugucugcucaga

SEQ ID NO: 768144 - RNA, 18 nt, Human
gggaagggagggaaaacu

SEQ ID NO: 768145 - RNA, 18 nt, Human
gggaggggagggggcggc

SEQ ID NO: 768146 - RNA, 21 nt, Human
gggcggaagugccuagccucu

SEQ ID NO: 768147 - RNA, 18 nt, Human
ggggagagucagcuuaaa

SEQ ID NO: 768148 - RNA, 18 nt, Human
ggggaggggagggggcgg

SEQ ID NO: 768149 - RNA, 23 nt, Human
ggggguuuccauugauucacccu

SEQ ID NO: 768150 - RNA, 18 nt, Human
ggguggcucagcuaaggg

SEQ ID NO: 768151 - RNA, 24 nt, Human
gguagacggaggagugcugggggc

SEQ ID NO: 768152 - RNA, 20 nt, Human
ggucugguuggcacugucuc

SEQ ID NO: 768153 - RNA, 20 nt, Human
ggugaggcugccagaggccc

SEQ ID NO: 768154 - RNA, 19 nt, Human
gguuguuugcuuuugccuu

SEQ ID NO: 768155 - RNA, 25 nt, Human
gucagcgugacagccaguaccacca

SEQ ID NO: 768156 - RNA, 24 nt, Human
guggcccaggaaaauucuggccca

SEQ ID NO: 768157 - RNA, 18 nt, Human
uaaagagguguggcauca

SEQ ID NO: 768158 - RNA, 21 nt, Human
uaaauaaauucacggcgguga

SEQ ID NO: 768159 - RNA, 25 nt, Human
uaauuuuuguauuuuuuaguggaga

SEQ ID NO: 768160 - RNA, 19 nt, Human
uacaggcgugagccaccac

SEQ ID NO: 768161 - RNA, 21 nt, Human
uacaggcgugagccaccacgc

SEQ ID NO: 768162 - RNA, 23 nt, Human
uacaggcgugagccaccacgcuu

SEQ ID NO: 768163 - RNA, 24 nt, Human
uagacggaggagugcugggggcuc

SEQ ID NO: 768164 - RNA, 19 nt, Human
uaguggagacaggguuuug

SEQ ID NO: 768165 - RNA, 23 nt, Human
uaguggagacaggguuuugccac

SEQ ID NO: 768166 - RNA, 24 nt, Human
uaguggagacaggguuuugccaca

SEQ ID NO: 768167 - RNA, 18 nt, Human
ucacugcaaccuccgccu

SEQ ID NO: 768168 - RNA, 19 nt, Human
ucacugcaaccuccgccuu

SEQ ID NO: 768169 - RNA, 24 nt, Human
ucacugcaaccuccgccuuccagg

SEQ ID NO: 768170 - RNA, 24 nt, Human
ucacugcaaccuccgccuuccagg

SEQ ID NO: 768171 - RNA, 27 nt, Human
ucacugcaaccuccgccuuccagguuc

SEQ ID NO: 768172 - RNA, 20 nt, Human
ucagaacacagagcugccau

SEQ ID NO: 768173 - RNA, 24 nt, Human
ucagcagcucccaccuuauuuucc

SEQ ID NO: 768174 - RNA, 18 nt, Human
ucagccucccaagcagcu

SEQ ID NO: 768175 - RNA, 19 nt, Human
ucagggguggguggcucag

SEQ ID NO: 768176 - RNA, 24 nt, Human
uccaccauccuggccucucugccu

SEQ ID NO: 768177 - RNA, 24 nt, Human
ucccaaagugcugggauuacaggc

SEQ ID NO: 768178 - RNA, 24 nt, Human
ucccaagcagcugggauuacaggc

SEQ ID NO: 768179 - RNA, 25 nt, Human
ucccaccuuauuuuccaucuuucuu

SEQ ID NO: 768180 - RNA, 23 nt, Human
uccccacuuucccuuggauuggg

SEQ ID NO: 768181 - RNA, 21 nt, Human
ucccccaguggcccaggaaaa

SEQ ID NO: 768182 - RNA, 22 nt, Human
ucccccaguggcccaggaaaau

SEQ ID NO: 768183 - RNA, 21 nt, Human
ucccucaggcucagcagcucc

SEQ ID NO: 768184 - RNA, 18 nt, Human
ucccuccuaucaucuccc

SEQ ID NO: 768185 - RNA, 18 nt, Human
ucccucugugcuugaccc

SEQ ID NO: 768186 - RNA, 22 nt, Human
uccuaaugugaauaaacaccac

SEQ ID NO: 768187 - RNA, 19 nt, Human
uccucuuuuuuccccuccu

SEQ ID NO: 768188 - RNA, 20 nt, Human
uccugggugcugccuagguc

SEQ ID NO: 768189 - RNA, 24 nt, Human
ucuccugcccucagccucccaagc

SEQ ID NO: 768190 - RNA, 18 nt, Human
ucucuggaagggccaguc

SEQ ID NO: 768191 - RNA, 23 nt, Human
ucugccucugugaaccaucaccu

SEQ ID NO: 768192 - RNA, 27 nt, Human
ucugccuuuucuuggugugucuuuccc

SEQ ID NO: 768193 - RNA, 24 nt, Human
ucuggaagaggucuguuggcgggg

SEQ ID NO: 768194 - RNA, 19 nt, Human
ucuggcucugucacccagg

SEQ ID NO: 768195 - RNA, 24 nt, Human
ucuggcucugucacccaggccgga

SEQ ID NO: 768196 - RNA, 24 nt, Human
ucugucacccaggccggagugcag

SEQ ID NO: 768197 - RNA, 23 nt, Human
ucuucugaagcugaggaugaaag

SEQ ID NO: 768198 - RNA, 20 nt, Human
ucuugaacuccugaugccag

SEQ ID NO: 768199 - RNA, 23 nt, Human
ugaaaagccaacaaaaagaaaca

SEQ ID NO: 768200 - RNA, 21 nt, Human
ugaaagaagaggagauuaagg

SEQ ID NO: 768201 - RNA, 20 nt, Human
ugaagaggaacuagccagau

SEQ ID NO: 768202 - RNA, 24 nt, Human
ugacagccaguaccaccucagcug

SEQ ID NO: 768203 - RNA, 18 nt, Human
ugagcagaucucaguaaa

SEQ ID NO: 768204 - RNA, 22 nt, Human
ugcagugacgugaucucggcuc

SEQ ID NO: 768205 - RNA, 20 nt, Human
ugccacauuggccagguugg

SEQ ID NO: 768206 - RNA, 22 nt, Human
ugccacauuggccagguugguc

SEQ ID NO: 768207 - RNA, 24 nt, Human
ugccagaccuacccagccugcauc

SEQ ID NO: 768208 - RNA, 21 nt, Human
ugccaggugaucuacucaucu

SEQ ID NO: 768209 - RNA, 19 nt, Human
ugccucaacucuccagcua

SEQ ID NO: 768210 - RNA, 24 nt, Human
ugcugggauuacaggcgugagcca

SEQ ID NO: 768211 - RNA, 19 nt, Human
ugcugggggcucaugucag

SEQ ID NO: 768212 - RNA, 20 nt, Human
uggaagggacuucuccgaug

SEQ ID NO: 768213 - RNA, 26 nt, Human
uggagagcugugaggcacaggauggc

SEQ ID NO: 768214 - RNA, 21 nt, Human
uggcaagggcugacuccgggu

SEQ ID NO: 768215 - RNA, 22 nt, Human
uggcaagggcugacuccggguc

SEQ ID NO: 768216 - RNA, 24 nt, Human
uggccagguuggucuugaacuccu

SEQ ID NO: 768217 - RNA, 23 nt, Human
ugggacaaaggccuagcuuaggc

SEQ ID NO: 768218 - RNA, 18 nt, Human
ugggauuacaggcgugag

SEQ ID NO: 768219 - RNA, 19 nt, Human
ugggauuacaggcgugagc

SEQ ID NO: 768220 - RNA, 22 nt, Human
ugggauuacaggcgugagccac

SEQ ID NO: 768221 - RNA, 23 nt, Human
ugggauuacaggcgugagccacc

SEQ ID NO: 768222 - RNA, 24 nt, Human
ugggauuacaggcgugagccacca

SEQ ID NO: 768223 - RNA, 18 nt, Human
ugggauuacaggcgugug

SEQ ID NO: 768224 - RNA, 19 nt, Human
ugggauuacaggcgugugc

SEQ ID NO: 768225 - RNA, 24 nt, Human
ugggauuacaggcgugugcaacca

SEQ ID NO: 768226 - RNA, 18 nt, Human
uguaaaggaaggggaucc

SEQ ID NO: 768227 - RNA, 21 nt, Human
uuagagauuuguggcacaaca

SEQ ID NO: 768228 - RNA, 18 nt, Human
uuaguggagacaggguuu

SEQ ID NO: 768229 - RNA, 21 nt, Human
uuaguggagacaggguuuugc

SEQ ID NO: 768230 - RNA, 25 nt, Human
uuaguggagacaggguuuugccaca

SEQ ID NO: 768231 - RNA, 25 nt, Human
uucaagcaauucuccugcccucagc

SEQ ID NO: 768232 - RNA, 18 nt, Human
uucccaguuaccccaauu

SEQ ID NO: 768233 - RNA, 22 nt, Human
uuccugggugcugccuaggucc

SEQ ID NO: 768234 - RNA, 21 nt, Human
uucucugugaaaugguuccau

SEQ ID NO: 768235 - RNA, 18 nt, Human
uugcacuccuucuuuguc

SEQ ID NO: 768236 - RNA, 24 nt, Human
uuuccccuccuccucccucccccc

SEQ ID NO: 768237 - RNA, 18 nt, Human
uuuccuucuucuuuuucc

SEQ ID NO: 768238 - RNA, 22 nt, Human
uuugccuuucuccuccccuccu

SEQ ID NO: 768239 - RNA, 21 nt, Human
uuuuuaguggagacaggguuu

SEQ ID NO: 768240 - RNA, 21 nt, Human
uuuuuguauuuuuuaguggag

SEQ ID NO: 768241 - RNA, 22 nt, Human
uuuuuuaguggagacaggguuu

SEQ ID NO: 768242 - RNA, 23 nt, Human
aaaguacaccaccauucaccaca

SEQ ID NO: 768243 - RNA, 22 nt, Human
aagagugucuaccacaccuuug

SEQ ID NO: 768244 - RNA, 23 nt, Human
aaggaaaugaauauaaaagcacu

SEQ ID NO: 768245 - RNA, 23 nt, Human
acaggaaaaaaaaaauauuuuca

SEQ ID NO: 768246 - RNA, 21 nt, Human
accaauuacauacuccaccau

SEQ ID NO: 768247 - RNA, 23 nt, Human
accaauuacauacuccaccauuu

SEQ ID NO: 768248 - RNA, 20 nt, Human
accugaacacucacgcugcc

SEQ ID NO: 768249 - RNA, 18 nt, Human
agauguaaucacacgacc

SEQ ID NO: 768250 - RNA, 23 nt, Human
aggaagaauaaaaucuaagucca

SEQ ID NO: 768251 - RNA, 20 nt, Human
aggagcacagcugccggagc

SEQ ID NO: 768252 - RNA, 24 nt, Human
auggugacagcuuuaaaguacacc

SEQ ID NO: 768253 - RNA, 24 nt, Human
caaaaggucccccaggcaucaaug

SEQ ID NO: 768254 - RNA, 27 nt, Human
cacacgaccgaagacgagcuggucauc

SEQ ID NO: 768255 - RNA, 22 nt, Human
cacacgggccaugagauguaau

SEQ ID NO: 768256 - RNA, 23 nt, Human
cacaggaaaaaaaaaauauuuuc

SEQ ID NO: 768257 - RNA, 23 nt, Human
cagcacaaauuuaucacaauuaa

SEQ ID NO: 768258 - RNA, 18 nt, Human
cagcugccggagcuccgc

SEQ ID NO: 768259 - RNA, 20 nt, Human
caguguauggcugucaggau

SEQ ID NO: 768260 - RNA, 22 nt, Human
cauaagggaagcaguguauggc

SEQ ID NO: 768261 - RNA, 18 nt, Human
ccaggacuguauuaacaa

SEQ ID NO: 768262 - RNA, 21 nt, Human
cccacacacgggccaugagau

SEQ ID NO: 768263 - RNA, 19 nt, Human
ccccgcccugccucuuccc

SEQ ID NO: 768264 - RNA, 19 nt, Human
cccugugcucggucucccc

SEQ ID NO: 768265 - RNA, 21 nt, Human
ccgcaagcuuccacaaauugc

SEQ ID NO: 768266 - RNA, 24 nt, Human
ccugaacacucacgcugcccugga

SEQ ID NO: 768267 - RNA, 18 nt, Human
cggccgaggagcacagcu

SEQ ID NO: 768268 - RNA, 20 nt, Human
cgucaaagaaggggaugacg

SEQ ID NO: 768269 - RNA, 21 nt, Human
cucagccucgaggcaaaaggu

SEQ ID NO: 768270 - RNA, 23 nt, Human
gaaauucuuaaaacuguuuauaa

SEQ ID NO: 768271 - RNA, 22 nt, Human
gaaugccaggacuguauuaaca

SEQ ID NO: 768272 - RNA, 23 nt, Human
gaguacaguuuaaggagucucug

SEQ ID NO: 768273 - RNA, 20 nt, Human
gaugggguucaggucagugu

SEQ ID NO: 768274 - RNA, 20 nt, Human
gcggauguugugggaucucu

SEQ ID NO: 768275 - RNA, 23 nt, Human
gcggcggauguugugggaucucu

SEQ ID NO: 768276 - RNA, 20 nt, Human
gcuuuggaaagcauccugag

SEQ ID NO: 768277 - RNA, 24 nt, Human
ggauguaugcauacuuagaaucca

SEQ ID NO: 768278 - RNA, 19 nt, Human
guaucaucuaagaaagcuc

SEQ ID NO: 768279 - RNA, 18 nt, Human
guccucccugugcucggu

SEQ ID NO: 768280 - RNA, 26 nt, Human
uaaaagaaaauauaacauggugaagg

SEQ ID NO: 768281 - RNA, 21 nt, Human
uaaaguacaccaccauucacc

SEQ ID NO: 768282 - RNA, 21 nt, Human
uaaaguacaccaccauucacc

SEQ ID NO: 768283 - RNA, 23 nt, Human
uaagacacaaugaaaacuuugaa

SEQ ID NO: 768284 - RNA, 19 nt, Human
uaagacgcucgucuucucc

SEQ ID NO: 768285 - RNA, 23 nt, Human
uauguacauaacaauauacugua

SEQ ID NO: 768286 - RNA, 24 nt, Human
uauugccagugagauuuaaaaaaa

SEQ ID NO: 768287 - RNA, 21 nt, Human
ucaaagaaggggaugacguga

SEQ ID NO: 768288 - RNA, 18 nt, Human
ucagaaagucugcaacug

SEQ ID NO: 768289 - RNA, 22 nt, Human
uccaccucggccgaggagcaca

SEQ ID NO: 768290 - RNA, 24 nt, Human
uccccagugauuggcuuuggaaag

SEQ ID NO: 768291 - RNA, 22 nt, Human
ucccccaggcaucaaugucagu

SEQ ID NO: 768292 - RNA, 18 nt, Human
uccccuugguccucccug

SEQ ID NO: 768293 - RNA, 22 nt, Human
ucccggucugcguaaauggcau

SEQ ID NO: 768294 - RNA, 19 nt, Human
ucccugccauguagauccc

SEQ ID NO: 768295 - RNA, 19 nt, Human
uccgccaccuucuuacuca

SEQ ID NO: 768296 - RNA, 18 nt, Human
uccuuaagcagcuucacu

SEQ ID NO: 768297 - RNA, 20 nt, Human
ucuccccuuccccuuggucc

SEQ ID NO: 768298 - RNA, 19 nt, Human
ucugcaacuggaacagcug

SEQ ID NO: 768299 - RNA, 19 nt, Human
ucuucaaagaaucccucca

SEQ ID NO: 768300 - RNA, 22 nt, Human
ugaaaacgcaagucagaaaguc

SEQ ID NO: 768301 - RNA, 18 nt, Human
ugagcugcaguuugauca

SEQ ID NO: 768302 - RNA, 19 nt, Human
ugaggacugcucaugcaug

SEQ ID NO: 768303 - RNA, 23 nt, Human
ugaguauuaaaaauguagaaaug

SEQ ID NO: 768304 - RNA, 18 nt, Human
ugaguuuggguuccuugu

SEQ ID NO: 768305 - RNA, 21 nt, Human
ugauauguacauaacaauaua

SEQ ID NO: 768306 - RNA, 24 nt, Human
ugcaaggaaaugaauauaaaagca

SEQ ID NO: 768307 - RNA, 19 nt, Human
ugccacaggaaaaaaaaaa

SEQ ID NO: 768308 - RNA, 23 nt, Human
ugcucggucuccccagugauugg

SEQ ID NO: 768309 - RNA, 20 nt, Human
uggcaaaaggaugaaauucu

SEQ ID NO: 768310 - RNA, 22 nt, Human
uggcaaaaggaugaaauucuua

SEQ ID NO: 768311 - RNA, 18 nt, Human
uggcaucucaaacaugaa

SEQ ID NO: 768312 - RNA, 20 nt, Human
ugguacaugacagggaugcg

SEQ ID NO: 768313 - RNA, 18 nt, Human
uguacauaacaauauacu

SEQ ID NO: 768314 - RNA, 25 nt, Human
uguagaaauguaauacauauaugua

SEQ ID NO: 768315 - RNA, 20 nt, Human
uguggugcugguacaugaca

SEQ ID NO: 768316 - RNA, 21 nt, Human
uguuggagucccacugauggc

SEQ ID NO: 768317 - RNA, 21 nt, Human
uucaaagaaucccuccacauc

SEQ ID NO: 768318 - RNA, 26 nt, Human
uucaaccugaaugugccacaggaaaa

SEQ ID NO: 768319 - RNA, 24 nt, Human
uucacuuuauugucaggauaucgc

SEQ ID NO: 768320 - RNA, 18 nt, Human
uucaggucaguguggugc

SEQ ID NO: 768321 - RNA, 18 nt, Human
uuccuuaagcagcuucac

SEQ ID NO: 768322 - RNA, 23 nt, Human
uucgguaagacgcucgucuucuc

SEQ ID NO: 768323 - RNA, 21 nt, Human
uugcacugcucuuccaccccg

SEQ ID NO: 768324 - RNA, 20 nt, Human
uuguaaauauacuccuuucc

SEQ ID NO: 768325 - RNA, 22 nt, Human
uuuaaucagacguucguuuacc

SEQ ID NO: 768326 - RNA, 21 nt, Human
uuuuccuuucuugcaacucuu

SEQ ID NO: 768327 - RNA, 19 nt, Human
uuuuucuguaggccaucua

SEQ ID NO: 768328 - RNA, 20 nt, Human
aaaaccccaaucuugguagc

SEQ ID NO: 768329 - RNA, 21 nt, Human
aaaggggugagaugggucauc

SEQ ID NO: 768330 - RNA, 24 nt, Human
acuccugauuauuuuaaaaggcca

SEQ ID NO: 768331 - RNA, 27 nt, Human
acugcauucuaggcuuucuggcuaacc

SEQ ID NO: 768332 - RNA, 28 nt, Human
agauauugaggcaggaaaaaaaaagggg

SEQ ID NO: 768333 - RNA, 19 nt, Human
agaucuggggcgggggaug

SEQ ID NO: 768334 - RNA, 19 nt, Human
agcuguguguguugagagu

SEQ ID NO: 768335 - RNA, 18 nt, Human
aggcaggaaaaaaaaagg

SEQ ID NO: 768336 - RNA, 21 nt, Human
aggcaggaaaaaaaaaggggu

SEQ ID NO: 768337 - RNA, 27 nt, Human
aggcaggaaaaaaaaaggggugagguc

SEQ ID NO: 768338 - RNA, 19 nt, Human
aggcaggagugaaaggagg

SEQ ID NO: 768339 - RNA, 25 nt, Human
agggagcaccccguggcggcggcgg

SEQ ID NO: 768340 - RNA, 22 nt, Human
agggagggagcaccccguggcg

SEQ ID NO: 768341 - RNA, 22 nt, Human
agggccaguauucucagaugac

SEQ ID NO: 768342 - RNA, 23 nt, Human
agguggccggacuugggcgggag

SEQ ID NO: 768343 - RNA, 22 nt, Human
agguggcuuggcagucaggcag

SEQ ID NO: 768344 - RNA, 19 nt, Human
aguggcuuuccaacugugu

SEQ ID NO: 768345 - RNA, 19 nt, Human
auacuaggaaacuugcaag

SEQ ID NO: 768346 - RNA, 24 nt, Human
auaucuuuuaaaauaaaaaacaga

SEQ ID NO: 768347 - RNA, 22 nt, Human
auuggugacuuugccuccuggg

SEQ ID NO: 768348 - RNA, 23 nt, Human
caaaaucuguuuugaaaagguau

SEQ ID NO: 768349 - RNA, 19 nt, Human
caacacagaaccgaguccu

SEQ ID NO: 768350 - RNA, 25 nt, Human
cacagguaggaaaacaaaaucuguu

SEQ ID NO: 768351 - RNA, 19 nt, Human
cacccccgagacucggccu

SEQ ID NO: 768352 - RNA, 19 nt, Human
cacuccgucagggcaaagu

SEQ ID NO: 768353 - RNA, 21 nt, Human
cacucggugugcagcuuggca

SEQ ID NO: 768354 - RNA, 19 nt, Human
cagcaaagggcagcuaugc

SEQ ID NO: 768355 - RNA, 21 nt, Human
caggaaaugcacucugaggac

SEQ ID NO: 768356 - RNA, 20 nt, Human
ccaggaaaugcacucugagg

SEQ ID NO: 768357 - RNA, 24 nt, Human
ccaguggcuuuccaacuguguccc

SEQ ID NO: 768358 - RNA, 18 nt, Human
cccccgagacucggccua

SEQ ID NO: 768359 - RNA, 18 nt, Human
ccccguggcggcggcggc

SEQ ID NO: 768360 - RNA, 20 nt, Human
ccccugacuccccacccacc

SEQ ID NO: 768361 - RNA, 19 nt, Human
cccugagccgccgcugccc

SEQ ID NO: 768362 - RNA, 18 nt, Human
ccgagacucggccuaagg

SEQ ID NO: 768363 - RNA, 22 nt, Human
ccgccgcugcccgcugcugugc

SEQ ID NO: 768364 - RNA, 23 nt, Human
ccgcugcugugccaccgccgccg

SEQ ID NO: 768365 - RNA, 18 nt, Human
ccguguggcuugcaaaau

SEQ ID NO: 768366 - RNA, 20 nt, Human
ccucccaccccugacucccc

SEQ ID NO: 768367 - RNA, 22 nt, Human
ccucccaccccugacuccccac

SEQ ID NO: 768368 - RNA, 18 nt, Human
ccuccucuuccuccuucu

SEQ ID NO: 768369 - RNA, 19 nt, Human
ccuccucuuccuccuucuc

SEQ ID NO: 768370 - RNA, 21 nt, Human
ccucugcuuccgggccacucc

SEQ ID NO: 768371 - RNA, 23 nt, Human
ccucugcuuccgggccacuccgu

SEQ ID NO: 768372 - RNA, 22 nt, Human
ccucuuccuccuucuccuccca

SEQ ID NO: 768373 - RNA, 26 nt, Human
ccugaaacccugaccuaggcuucagg

SEQ ID NO: 768374 - RNA, 22 nt, Human
ccugcauuggugacuuugccuc

SEQ ID NO: 768375 - RNA, 18 nt, Human
ccugcuucgauucaguug

SEQ ID NO: 768376 - RNA, 22 nt, Human
ccuggggcuggacuccugaaac

SEQ ID NO: 768377 - RNA, 20 nt, Human
ccuugaaagaguucauuccu

SEQ ID NO: 768378 - RNA, 21 nt, Human
cgccgaaauguguucucucug

SEQ ID NO: 768379 - RNA, 23 nt, Human
cgccgccgcggcugcccuauuuc

SEQ ID NO: 768380 - RNA, 20 nt, Human
cgggaccggagcccgugagg

SEQ ID NO: 768381 - RNA, 26 nt, Human
cguggcggcggcggcgaccccgcccc

SEQ ID NO: 768382 - RNA, 20 nt, Human
cucccaacccguguggcuug

SEQ ID NO: 768383 - RNA, 21 nt, Human
cugaccuaggcuucaggccug

SEQ ID NO: 768384 - RNA, 21 nt, Human
cugccgccgggaccggagccc

SEQ ID NO: 768385 - RNA, 23 nt, Human
cuggccccacucguguccuuggg

SEQ ID NO: 768386 - RNA, 22 nt, Human
cuucaggaacucaccuggcccc

SEQ ID NO: 768387 - RNA, 22 nt, Human
cuugcuacaggaggccccccug

SEQ ID NO: 768388 - RNA, 26 nt, Human
cuuggcacagaaaugaucccuuuaca

SEQ ID NO: 768389 - RNA, 19 nt, Human
cuuuugucuguaaaaaugu

SEQ ID NO: 768390 - RNA, 20 nt, Human
gagaaagggcaggccagucu

SEQ ID NO: 768391 - RNA, 21 nt, Human
gagaugggucauccaugcauc

SEQ ID NO: 768392 - RNA, 18 nt, Human
gaggcuguugaggcucca

SEQ ID NO: 768393 - RNA, 18 nt, Human
gaugcagguggcuuggca

SEQ ID NO: 768394 - RNA, 20 nt, Human
gauucaguugugucuggcau

SEQ ID NO: 768395 - RNA, 22 nt, Human
gcagcugcgagggagaagaugc

SEQ ID NO: 768396 - RNA, 19 nt, Human
gcaguaagggacaaugacu

SEQ ID NO: 768397 - RNA, 19 nt, Human
gcagugucaggacuagggg

SEQ ID NO: 768398 - RNA, 24 nt, Human
gccaccgccgccgcggcugcccuu

SEQ ID NO: 768399 - RNA, 19 nt, Human
gccuccuggggcuggacuc

SEQ ID NO: 768400 - RNA, 25 nt, Human
gcuggacuccugaaacccugaccua

SEQ ID NO: 768401 - RNA, 21 nt, Human
ggaacucaccuggccccacuc

SEQ ID NO: 768402 - RNA, 25 nt, Human
ggagaagcaggugcugcagaaguug

SEQ ID NO: 768403 - RNA, 24 nt, Human
ggaguggaugggccacagguagga

SEQ ID NO: 768404 - RNA, 24 nt, Human
ggccuaaggcagggaaggauauag

SEQ ID NO: 768405 - RNA, 21 nt, Human
ggcggcggcggcgaccccgcc

SEQ ID NO: 768406 - RNA, 19 nt, Human
ggguguuccuuggcccagg

SEQ ID NO: 768407 - RNA, 20 nt, Human
guggccggacuugggcggga

SEQ ID NO: 768408 - RNA, 21 nt, Human
gugugcagcuuggcacagaaa

SEQ ID NO: 768409 - RNA, 21 nt, Human
uaaaauaaaaaacagacguac

SEQ ID NO: 768410 - RNA, 26 nt, Human
uacaauggaaauuuuuccaaaaaaaa

SEQ ID NO: 768411 - RNA, 18 nt, Human
uacacagcagcauauguu

SEQ ID NO: 768412 - RNA, 22 nt, Human
ucaaaccaggacacauguaagu

SEQ ID NO: 768413 - RNA, 21 nt, Human
ucaggccugcuucgauucagu

SEQ ID NO: 768414 - RNA, 20 nt, Human
ucauaugugggagagggaag

SEQ ID NO: 768415 - RNA, 23 nt, Human
uccaggaaaugcacucugaggac

SEQ ID NO: 768416 - RNA, 21 nt, Human
ucccaccccugacuccccacc

SEQ ID NO: 768417 - RNA, 19 nt, Human
ucccaugaaccucugcugg

SEQ ID NO: 768418 - RNA, 18 nt, Human
ucccgggcucgcuggagg

SEQ ID NO: 768419 - RNA, 18 nt, Human
ucccugagccgccgcugc

SEQ ID NO: 768420 - RNA, 19 nt, Human
uccuuuuucugucaggggc

SEQ ID NO: 768421 - RNA, 23 nt, Human
ucuauugguuuuccugccaaaag

SEQ ID NO: 768422 - RNA, 18 nt, Human
ucucaugagaucuggggc

SEQ ID NO: 768423 - RNA, 23 nt, Human
ucucccaacccguguggcuugca

SEQ ID NO: 768424 - RNA, 19 nt, Human
ucuccucccaccccugacu

SEQ ID NO: 768425 - RNA, 19 nt, Human
ucuguucuggguucugcag

SEQ ID NO: 768426 - RNA, 22 nt, Human
ucuuccuccuucuccucccccc

SEQ ID NO: 768427 - RNA, 23 nt, Human
ugacuccccacccaaccaacucu

SEQ ID NO: 768428 - RNA, 24 nt, Human
ugacuuaggaauccugcugcccag

SEQ ID NO: 768429 - RNA, 22 nt, Human
ugagacacauaaggagaaugca

SEQ ID NO: 768430 - RNA, 21 nt, Human
ugagaccaccucucccaaccc

SEQ ID NO: 768431 - RNA, 22 nt, Human
ugaggacagcaaagggcagcua

SEQ ID NO: 768432 - RNA, 20 nt, Human
ugaggcaggaaaaaaaaagg

SEQ ID NO: 768433 - RNA, 18 nt, Human
ugagguggccuggucugc

SEQ ID NO: 768434 - RNA, 19 nt, Human
ugcaguguguguguauuga

SEQ ID NO: 768435 - RNA, 24 nt, Human
ugccaaaaggcauuuaccucccug

SEQ ID NO: 768436 - RNA, 24 nt, Human
ugccaggcaagcccagucugcccu

SEQ ID NO: 768437 - RNA, 19 nt, Human
ugcccagaggggcucgugu

SEQ ID NO: 768438 - RNA, 24 nt, Human
ugcccaugugagagucaccacagc

SEQ ID NO: 768439 - RNA, 22 nt, Human
ugccuccuggggcuggacuccu

SEQ ID NO: 768440 - RNA, 24 nt, Human
ugcggggaugggguaccagagagg

SEQ ID NO: 768441 - RNA, 18 nt, Human
uggagaagcaggguggca

SEQ ID NO: 768442 - RNA, 20 nt, Human
uggcaaaggaaaauccuggu

SEQ ID NO: 768443 - RNA, 20 nt, Human
uggccccacucguguccuug

SEQ ID NO: 768444 - RNA, 21 nt, Human
ugggaugugggguugugacca

SEQ ID NO: 768445 - RNA, 19 nt, Human
ugggguaccagagaggagu

SEQ ID NO: 768446 - RNA, 23 nt, Human
ugggguugugaccacccccgaga

SEQ ID NO: 768447 - RNA, 23 nt, Human
ugggguuucugcauugagccugg

SEQ ID NO: 768448 - RNA, 22 nt, Human
ugguaaaaaugggagauuggga

SEQ ID NO: 768449 - RNA, 19 nt, Human
ugugaaggcaacugacaga

SEQ ID NO: 768450 - RNA, 20 nt, Human
ugugcagcuuggcacagaaa

SEQ ID NO: 768451 - RNA, 24 nt, Human
uguugaggcuccagcucccugagc

SEQ ID NO: 768452 - RNA, 18 nt, Human
uuccuaacgaaaaaaccc

SEQ ID NO: 768453 - RNA, 22 nt, Human
uuccuccucuuccuccuucucc

SEQ ID NO: 768454 - RNA, 19 nt, Human
uuccucuccuugaaagagu

SEQ ID NO: 768455 - RNA, 27 nt, Human
uucuggguucugcaguguguguguauu

SEQ ID NO: 768456 - RNA, 24 nt, Human
uugcaaaaugaucauucaaaccag

SEQ ID NO: 768457 - RNA, 22 nt, Human
uugcugagucucugaucuaggc

SEQ ID NO: 768458 - RNA, 20 nt, Human
uuggagaagcaggguggcaa

SEQ ID NO: 768459 - RNA, 21 nt, Human
aaaacaacagcaagcagagag

SEQ ID NO: 768460 - RNA, 19 nt, Human
aaaaugacaagucuuucuc

SEQ ID NO: 768461 - RNA, 23 nt, Human
aaacaaaccacaaacuuacucuc

SEQ ID NO: 768462 - RNA, 21 nt, Human
aaaccagaaacaaaccacaaa

SEQ ID NO: 768463 - RNA, 18 nt, Human
aaaugacaagucuuucuc

SEQ ID NO: 768464 - RNA, 22 nt, Human
aacaagaaccaaagcaaggucg

SEQ ID NO: 768465 - RNA, 23 nt, Human
aacacagaauauaaaaucaggca

SEQ ID NO: 768466 - RNA, 27 nt, Human
aaccauacucccggcgaugggcaccca

SEQ ID NO: 768467 - RNA, 25 nt, Human
aacuuacucuccaagagagccccca

SEQ ID NO: 768468 - RNA, 20 nt, Human
aaggccugguucacccuuga

SEQ ID NO: 768469 - RNA, 19 nt, Human
acaacagcaagcagagagc

SEQ ID NO: 768470 - RNA, 21 nt, Human
acaacagcaagcagagagcag

SEQ ID NO: 768471 - RNA, 23 nt, Human
acaacagcaagcagagagcaggg

SEQ ID NO: 768472 - RNA, 24 nt, Human
acaacagcaagcagagagcagggg

SEQ ID NO: 768473 - RNA, 27 nt, Human
acagugccgguggcagcugaaccauac

SEQ ID NO: 768474 - RNA, 24 nt, Human
accccgcuuuccucggaccucagc

SEQ ID NO: 768475 - RNA, 22 nt, Human
acuccugcccacacuuugacac

SEQ ID NO: 768476 - RNA, 18 nt, Human
agaacgcgcaggaaaucc

SEQ ID NO: 768477 - RNA, 19 nt, Human
agaacgugcaaacagggcu

SEQ ID NO: 768478 - RNA, 22 nt, Human
agaagacuucccaggaaugcuu

SEQ ID NO: 768479 - RNA, 26 nt, Human
agaagacuucccaggaaugcuuucuu

SEQ ID NO: 768480 - RNA, 22 nt, Human
agacacacaccacaagaccucc

SEQ ID NO: 768481 - RNA, 20 nt, Human
agagaacagaauccccgcug

SEQ ID NO: 768482 - RNA, 23 nt, Human
agagaaucacccaccagacagcg

SEQ ID NO: 768483 - RNA, 19 nt, Human
agagagcaggggaggaaag

SEQ ID NO: 768484 - RNA, 24 nt, Human
agagccccugugaguacuuggaac

SEQ ID NO: 768485 - RNA, 20 nt, Human
agaggaugggaagaggggag

SEQ ID NO: 768486 - RNA, 21 nt, Human
agaggaugggaagaggggagu

SEQ ID NO: 768487 - RNA, 21 nt, Human
agcaagucccuggaaugcagg

SEQ ID NO: 768488 - RNA, 24 nt, Human
aggaccccucauagaugacaagaa

SEQ ID NO: 768489 - RNA, 24 nt, Human
aggcaggcaaagcacauuuauaag

SEQ ID NO: 768490 - RNA, 21 nt, Human
aggcugaggcaggcaaagcac

SEQ ID NO: 768491 - RNA, 22 nt, Human
aggggcuucaccagcucagugg

SEQ ID NO: 768492 - RNA, 20 nt, Human
agggugggggcugcaauggg

SEQ ID NO: 768493 - RNA, 18 nt, Human
aucaggcaaaacaaacac

SEQ ID NO: 768494 - RNA, 23 nt, Human
augcaaggucaggguggaaggcc

SEQ ID NO: 768495 - RNA, 19 nt, Human
augcugccugcaguggcug

SEQ ID NO: 768496 - RNA, 21 nt, Human
augcugccugcaguggcuggu

SEQ ID NO: 768497 - RNA, 19 nt, Human
caaaccaacaccaaggagc

SEQ ID NO: 768498 - RNA, 22 nt, Human
caaaccaacaccaaggagcugg

SEQ ID NO: 768499 - RNA, 20 nt, Human
caacuagaacgugcaaacag

SEQ ID NO: 768500 - RNA, 21 nt, Human
caagaagggcagccgaggaua

SEQ ID NO: 768501 - RNA, 21 nt, Human
caagagagcccccacaaccca

SEQ ID NO: 768502 - RNA, 22 nt, Human
caagagagcccccacaacccaa

SEQ ID NO: 768503 - RNA, 18 nt, Human
caaggaguuucccagagc

SEQ ID NO: 768504 - RNA, 23 nt, Human
cacagucagagaacagaaucccc

SEQ ID NO: 768505 - RNA, 24 nt, Human
caccaagcaccgcaguguggcacc

SEQ ID NO: 768506 - RNA, 18 nt, Human
caccacauagcagcuggc

SEQ ID NO: 768507 - RNA, 26 nt, Human
caccacauagcagcuggccccgcacc

SEQ ID NO: 768508 - RNA, 22 nt, Human
caccacuguaaaccagaaacaa

SEQ ID NO: 768509 - RNA, 19 nt, Human
caccccgcuuuccucggac

SEQ ID NO: 768510 - RNA, 20 nt, Human
caccgugcacccaaagagga

SEQ ID NO: 768511 - RNA, 21 nt, Human
caccuggcacagaggauggga

SEQ ID NO: 768512 - RNA, 22 nt, Human
caccuucacucagugucagcca

SEQ ID NO: 768513 - RNA, 24 nt, Human
cacgugcugcaggaugcccaaaag

SEQ ID NO: 768514 - RNA, 22 nt, Human
cacugcaucacuucuggaagac

SEQ ID NO: 768515 - RNA, 22 nt, Human
cagaaacaaaccacaaacuuac

SEQ ID NO: 768516 - RNA, 26 nt, Human
cagaagcccuucaaggucaaagcuuc

SEQ ID NO: 768517 - RNA, 24 nt, Human
cagaauagcgucaaaacaacagcc

SEQ ID NO: 768518 - RNA, 19 nt, Human
cagacaacaagacucucac

SEQ ID NO: 768519 - RNA, 20 nt, Human
cagagaaucacccaccagac

SEQ ID NO: 768520 - RNA, 21 nt, Human
cagaugcaaguggcuguuccu

SEQ ID NO: 768521 - RNA, 25 nt, Human
cagcaacaacuccacaucccaacca

SEQ ID NO: 768522 - RNA, 24 nt, Human
cagcucaguggcaaauaucagaca

SEQ ID NO: 768523 - RNA, 19 nt, Human
cagcugcagcagcugacac

SEQ ID NO: 768524 - RNA, 21 nt, Human
caggaaugcuuucuuacaagg

SEQ ID NO: 768525 - RNA, 20 nt, Human
cagggcagagaaucacccac

SEQ ID NO: 768526 - RNA, 25 nt, Human
caggggaggaaagacaugcugccug

SEQ ID NO: 768527 - RNA, 23 nt, Human
caguggcaaauaucagacaacaa

SEQ ID NO: 768528 - RNA, 22 nt, Human
cauggaagugaaugacucucaa

SEQ ID NO: 768529 - RNA, 22 nt, Human
ccaauuuauugcaaaccaacac

SEQ ID NO: 768530 - RNA, 28 nt, Human
ccacuguaaaccagaaacaaaccacaag

SEQ ID NO: 768531 - RNA, 26 nt, Human
ccaguccagggugguggcucagggca

SEQ ID NO: 768532 - RNA, 18 nt, Human
cccacaacccaaguaucc

SEQ ID NO: 768533 - RNA, 20 nt, Human
cccacaacccaaguauccau

SEQ ID NO: 768534 - RNA, 22 nt, Human
cccacaacccaaguauccauag

SEQ ID NO: 768535 - RNA, 22 nt, Human
cccacacuuugacaccgugcac

SEQ ID NO: 768536 - RNA, 19 nt, Human
ccccacaacccaaguaucc

SEQ ID NO: 768537 - RNA, 22 nt, Human
ccccaugcagaaauuccuccuc

SEQ ID NO: 768538 - RNA, 25 nt, Human
cccucaugcaagcacagagcuucac

SEQ ID NO: 768539 - RNA, 19 nt, Human
cccuggaaugcagggagcc

SEQ ID NO: 768540 - RNA, 20 nt, Human
ccgccucagcccacgcgucc

SEQ ID NO: 768541 - RNA, 20 nt, Human
ccgcugcaucuggaccugag

SEQ ID NO: 768542 - RNA, 18 nt, Human
ccucaaugggaagaacuc

SEQ ID NO: 768543 - RNA, 21 nt, Human
ccugcccacacuuugacaccg

SEQ ID NO: 768544 - RNA, 23 nt, Human
cgcaccuucucuggaacagucug

SEQ ID NO: 768545 - RNA, 21 nt, Human
cgccugagaguccagcaacaa

SEQ ID NO: 768546 - RNA, 24 nt, Human
cuaaaaagagaaaacaggcagggu

SEQ ID NO: 768547 - RNA, 19 nt, Human
cuccaagagagcccccaca

SEQ ID NO: 768548 - RNA, 22 nt, Human
cucuuccucuuccuuucuucug

SEQ ID NO: 768549 - RNA, 25 nt, Human
cugagcccagaaccuaggcuuucuc

SEQ ID NO: 768550 - RNA, 21 nt, Human
cugcugagcugauggacaugc

SEQ ID NO: 768551 - RNA, 23 nt, Human
cuguaaaccagaaacaaaccaca

SEQ ID NO: 768552 - RNA, 18 nt, Human
cuucagcuucgccugaga

SEQ ID NO: 768553 - RNA, 28 nt, Human
cuuggccucuuccucuuccuuucuucug

SEQ ID NO: 768554 - RNA, 25 nt, Human
gaacaacuagaacgugcaaacaggg

SEQ ID NO: 768555 - RNA, 20 nt, Human
gaacacaggccugaggaccu

SEQ ID NO: 768556 - RNA, 19 nt, Human
gacagugccgguggcagcu

SEQ ID NO: 768557 - RNA, 24 nt, Human
gaccagaugcaaguggcuguuccu

SEQ ID NO: 768558 - RNA, 20 nt, Human
gagaaaugcaacacagaaua

SEQ ID NO: 768559 - RNA, 21 nt, Human
gagcacagucuggcaccuggc

SEQ ID NO: 768560 - RNA, 23 nt, Human
gagcacagucuggcaccuggcac

SEQ ID NO: 768561 - RNA, 19 nt, Human
gaggaugggaagaggggag

SEQ ID NO: 768562 - RNA, 22 nt, Human
gaguuucccagagcagccucag

SEQ ID NO: 768563 - RNA, 24 nt, Human
gcaagcgauagaagucugucuugc

SEQ ID NO: 768564 - RNA, 18 nt, Human
gcaaggaguuucccagag

SEQ ID NO: 768565 - RNA, 29 nt, Human
gccccaugcagaaauuccuccucucccaa

SEQ ID NO: 768566 - RNA, 22 nt, Human
gccucccgcccuagguacgcuu

SEQ ID NO: 768567 - RNA, 18 nt, Human
ggaagaacuccaggaaaa

SEQ ID NO: 768568 - RNA, 22 nt, Human
ggaccugagcccagaaccuagg

SEQ ID NO: 768569 - RNA, 24 nt, Human
ggagacacacaccacaagaccucc

SEQ ID NO: 768570 - RNA, 20 nt, Human
ggaggcugcacuuucucuac

SEQ ID NO: 768571 - RNA, 28 nt, Human
ggcaaaacaaacacuagucaccauggaa

SEQ ID NO: 768572 - RNA, 22 nt, Human
ggccccgcaccuucucuggaac

SEQ ID NO: 768573 - RNA, 18 nt, Human
ggcuuauccaugcucuga

SEQ ID NO: 768574 - RNA, 18 nt, Human
gggcaucucacaccacug

SEQ ID NO: 768575 - RNA, 24 nt, Human
guccagcaacaacuccacauccca

SEQ ID NO: 768576 - RNA, 23 nt, Human
uaaaccagaaacaaaccacaaac

SEQ ID NO: 768577 - RNA, 25 nt, Human
uaaaccagaaacaaaccacaaacuu

SEQ ID NO: 768578 - RNA, 19 nt, Human
uaaagcagggcagggagug

SEQ ID NO: 768579 - RNA, 18 nt, Human
uacagcucggccgccccu

SEQ ID NO: 768580 - RNA, 24 nt, Human
uacucccggcgaugggcacccaga

SEQ ID NO: 768581 - RNA, 26 nt, Human
uagcaucugcgggccuugauucuugc

SEQ ID NO: 768582 - RNA, 18 nt, Human
uagcgucaaaacaacagc

SEQ ID NO: 768583 - RNA, 22 nt, Human
uaucagacaacaagacucucac

SEQ ID NO: 768584 - RNA, 21 nt, Human
ucaaugggaagaacuccagga

SEQ ID NO: 768585 - RNA, 21 nt, Human
ucacacacacagcgccgccuc

SEQ ID NO: 768586 - RNA, 22 nt, Human
ucacaccacugcaucacuucug

SEQ ID NO: 768587 - RNA, 22 nt, Human
ucacuucaacaagaaccaaagc

SEQ ID NO: 768588 - RNA, 18 nt, Human
uccacaaccacaccaagc

SEQ ID NO: 768589 - RNA, 21 nt, Human
uccacaaccacaccaagcacc

SEQ ID NO: 768590 - RNA, 19 nt, Human
uccacaucccaaccagaag

SEQ ID NO: 768591 - RNA, 22 nt, Human
uccacaucccaaccagaagaca

SEQ ID NO: 768592 - RNA, 18 nt, Human
uccaggaaaaaaaaugac

SEQ ID NO: 768593 - RNA, 18 nt, Human
uccccugacaauaggccc

SEQ ID NO: 768594 - RNA, 24 nt, Human
ucccuggagaacagguaagauugg

SEQ ID NO: 768595 - RNA, 18 nt, Human
ucucaggacuuguggcug

SEQ ID NO: 768596 - RNA, 26 nt, Human
ucucccagaagcccuucaaggucaaa

SEQ ID NO: 768597 - RNA, 24 nt, Human
ucucgucuuugcaccuuggcugga

SEQ ID NO: 768598 - RNA, 20 nt, Human
ugaaagaaaggauggcuagg

SEQ ID NO: 768599 - RNA, 20 nt, Human
ugaaagaaaggauggcuagg

SEQ ID NO: 768600 - RNA, 23 nt, Human
ugaaugacucucaaagucuccca

SEQ ID NO: 768601 - RNA, 23 nt, Human
ugacacagucuuggccucuuccu

SEQ ID NO: 768602 - RNA, 26 nt, Human
ugacuucagcuucgccugagaguccu

SEQ ID NO: 768603 - RNA, 21 nt, Human
ugagcaagaagaccacgugaa

SEQ ID NO: 768604 - RNA, 22 nt, Human
ugagcccagaaccuaggcuuuc

SEQ ID NO: 768605 - RNA, 21 nt, Human
ugcagggcaucucacaccacu

SEQ ID NO: 768606 - RNA, 24 nt, Human
ugcgguagaggaagccaaagagaa

SEQ ID NO: 768607 - RNA, 20 nt, Human
uggaacacaggccugaggac

SEQ ID NO: 768608 - RNA, 18 nt, Human
uggccucuuccucuuccu

SEQ ID NO: 768609 - RNA, 20 nt, Human
uggcucagggcauaggcuug

SEQ ID NO: 768610 - RNA, 18 nt, Human
uggcuguuccugccaugg

SEQ ID NO: 768611 - RNA, 18 nt, Human
ugggaagaacuccaggaa

SEQ ID NO: 768612 - RNA, 24 nt, Human
ugggaagaacuccaggaaaaaaaa

SEQ ID NO: 768613 - RNA, 19 nt, Human
ugggaagaggggagucuuc

SEQ ID NO: 768614 - RNA, 20 nt, Human
ugggacuggcuccuucucag

SEQ ID NO: 768615 - RNA, 21 nt, Human
ugggggcugcaaugggggccc

SEQ ID NO: 768616 - RNA, 19 nt, Human
ugguggccgggcuugguuc

SEQ ID NO: 768617 - RNA, 23 nt, Human
ugguucacccuugaaagaaagga

SEQ ID NO: 768618 - RNA, 24 nt, Human
uguaaaccagaaacaaaccacaaa

SEQ ID NO: 768619 - RNA, 22 nt, Human
ugucuaaaaagagaaaacaggc

SEQ ID NO: 768620 - RNA, 25 nt, Human
ugugaugaucggagcaacauguuug

SEQ ID NO: 768621 - RNA, 23 nt, Human
uguggucaaagguuuugaauacc

SEQ ID NO: 768622 - RNA, 20 nt, Human
uucaacaagaaccaaagcaa

SEQ ID NO: 768623 - RNA, 21 nt, Human
uuccaaaggggguaucuaggg

SEQ ID NO: 768624 - RNA, 22 nt, Human
uuccuuucuucugauuuucucu

SEQ ID NO: 768625 - RNA, 23 nt, Human
uucucagcugcagcagcugacac

SEQ ID NO: 768626 - RNA, 18 nt, Human
uugcgguagaggaagcca

SEQ ID NO: 768627 - RNA, 24 nt, Human
uuggacccacagaagacuucccag

SEQ ID NO: 768628 - RNA, 23 nt, Human
uuucccagagcagccucaggcac

SEQ ID NO: 768629 - RNA, 23 nt, Human
uuugcugggauauccucuccugc

SEQ ID NO: 768630 - RNA, 23 nt, Human
uuuuuuuuuuuuuuuuuuuuggg

SEQ ID NO: 768631 - RNA, 23 nt, Human
aaaacaaagagggacaucugaac

SEQ ID NO: 768632 - RNA, 21 nt, Human
aaaagaaaauaaauuucuggu

SEQ ID NO: 768633 - RNA, 19 nt, Human
aaaaggcaagguaacuagu

SEQ ID NO: 768634 - RNA, 22 nt, Human
aacaaagagggacaucugaaca

SEQ ID NO: 768635 - RNA, 23 nt, Human
aacacaugaagucaaagggagac

SEQ ID NO: 768636 - RNA, 21 nt, Human
aacccgagcugcugaggaguu

SEQ ID NO: 768637 - RNA, 18 nt, Human
aagacagccuucuuccuc

SEQ ID NO: 768638 - RNA, 18 nt, Human
aagacuuggauuuucccu

SEQ ID NO: 768639 - RNA, 21 nt, Human
aagaugcuuuucccuuccaca

SEQ ID NO: 768640 - RNA, 18 nt, Human
aagcuuccgaagcugcuc

SEQ ID NO: 768641 - RNA, 18 nt, Human
aaguaacaaauaaagguc

SEQ ID NO: 768642 - RNA, 21 nt, Human
aaucaggggaagaggcagggc

SEQ ID NO: 768643 - RNA, 20 nt, Human
aaucauuccaaagccaagga

SEQ ID NO: 768644 - RNA, 21 nt, Human
acaaaaaaaaaaaacaaagag

SEQ ID NO: 768645 - RNA, 25 nt, Human
acaaaagacagccuucuuccucaca

SEQ ID NO: 768646 - RNA, 18 nt, Human
acacaguaaaggacaucu

SEQ ID NO: 768647 - RNA, 20 nt, Human
acauuauaacccgagcugcu

SEQ ID NO: 768648 - RNA, 21 nt, Human
accuugaaaaccuuaagaaug

SEQ ID NO: 768649 - RNA, 21 nt, Human
agaugggagugcagguaguuu

SEQ ID NO: 768650 - RNA, 24 nt, Human
agcagcuauccauccccuuucaac

SEQ ID NO: 768651 - RNA, 19 nt, Human
agccgugcaugcccccucu

SEQ ID NO: 768652 - RNA, 18 nt, Human
aggaaggaagacuuggau

SEQ ID NO: 768653 - RNA, 20 nt, Human
aggcaauguccucugauguu

SEQ ID NO: 768654 - RNA, 18 nt, Human
aggcagggcugcagcucu

SEQ ID NO: 768655 - RNA, 21 nt, Human
agggguuuuccuggcaauugc

SEQ ID NO: 768656 - RNA, 23 nt, Human
agggguuuuccuggcaauugcuu

SEQ ID NO: 768657 - RNA, 22 nt, Human
agucugauggaagucccucauu

SEQ ID NO: 768658 - RNA, 19 nt, Human
augcccccucugggaugcc

SEQ ID NO: 768659 - RNA, 20 nt, Human
augcccccucugggaugccc

SEQ ID NO: 768660 - RNA, 20 nt, Human
caaaacagaauuaucugaac

SEQ ID NO: 768661 - RNA, 23 nt, Human
caaaggacacaagcuuccgaagc

SEQ ID NO: 768662 - RNA, 19 nt, Human
caacuuccugaccagugcc

SEQ ID NO: 768663 - RNA, 26 nt, Human
cacagguuguuagagaaagauuuucu

SEQ ID NO: 768664 - RNA, 21 nt, Human
cacccucacggccuauuccaa

SEQ ID NO: 768665 - RNA, 19 nt, Human
cacucugcucugacuucug

SEQ ID NO: 768666 - RNA, 23 nt, Human
cagcuguucuccugugacugaca

SEQ ID NO: 768667 - RNA, 20 nt, Human
caggaagaacaucauugcag

SEQ ID NO: 768668 - RNA, 30 nt, Human
cauacaaagccauuagcaaaaauauguaac

SEQ ID NO: 768669 - RNA, 21 nt, Human
cauccuaaaaggcaagguaac

SEQ ID NO: 768670 - RNA, 22 nt, Human
caucugaaucugagaaaugauu

SEQ ID NO: 768671 - RNA, 23 nt, Human
cauggagacgucugacaaagaaa

SEQ ID NO: 768672 - RNA, 21 nt, Human
caugucaguacuaaaauagag

SEQ ID NO: 768673 - RNA, 19 nt, Human
ccagggucaaaucagggga

SEQ ID NO: 768674 - RNA, 23 nt, Human
ccauuagcaaaaauauguaacaa

SEQ ID NO: 768675 - RNA, 20 nt, Human
cccagcuguucuccugugac

SEQ ID NO: 768676 - RNA, 22 nt, Human
ccccucugggaugccccggccu

SEQ ID NO: 768677 - RNA, 19 nt, Human
ccuauuaccuuccagguuc

SEQ ID NO: 768678 - RNA, 20 nt, Human
ccucugggaugccccggccu

SEQ ID NO: 768679 - RNA, 20 nt, Human
cggccuucaaggccaccccc

SEQ ID NO: 768680 - RNA, 19 nt, Human
cguugcauguuuggugguc

SEQ ID NO: 768681 - RNA, 23 nt, Human
cucacacccucacggccuauucc

SEQ ID NO: 768682 - RNA, 25 nt, Human
cuccugccccauugcugggguuugg

SEQ ID NO: 768683 - RNA, 23 nt, Human
cucuccuauauucacagguuguu

SEQ ID NO: 768684 - RNA, 23 nt, Human
cugcagaauugcaguugaaugua

SEQ ID NO: 768685 - RNA, 24 nt, Human
cugugacugacaugugggcaguag

SEQ ID NO: 768686 - RNA, 23 nt, Human
cuuucccuuuucuucugccaucu

SEQ ID NO: 768687 - RNA, 19 nt, Human
gaagagccgugcaugcccc

SEQ ID NO: 768688 - RNA, 24 nt, Human
gagccgugcaugcccccucuggga

SEQ ID NO: 768689 - RNA, 20 nt, Human
gcaggggugggugcugaggg

SEQ ID NO: 768690 - RNA, 22 nt, Human
gcggagggucucuuuacaguag

SEQ ID NO: 768691 - RNA, 20 nt, Human
gcuaucagcuccggagauga

SEQ ID NO: 768692 - RNA, 19 nt, Human
ggaaauuacacucuccugc

SEQ ID NO: 768693 - RNA, 18 nt, Human
gggagaaagaucauaaua

SEQ ID NO: 768694 - RNA, 19 nt, Human
gggugggauaagaacaucc

SEQ ID NO: 768695 - RNA, 23 nt, Human
guaaaggacaucuuggugaaaca

SEQ ID NO: 768696 - RNA, 18 nt, Human
guaaggaauucaucccuu

SEQ ID NO: 768697 - RNA, 19 nt, Human
guaggacuuuuugguaacc

SEQ ID NO: 768698 - RNA, 23 nt, Human
guccucaggauuacccuuuuccu

SEQ ID NO: 768699 - RNA, 18 nt, Human
gugcaugcccccucuggg

SEQ ID NO: 768700 - RNA, 21 nt, Human
guggagcagagcacuggagga

SEQ ID NO: 768701 - RNA, 20 nt, Human
uaaaaggcaagguaacuauu

SEQ ID NO: 768702 - RNA, 25 nt, Human
uaacuacaggaucgggagccaaaug

SEQ ID NO: 768703 - RNA, 18 nt, Human
uaagaaauacuuugaguu

SEQ ID NO: 768704 - RNA, 22 nt, Human
uaagaacauccuaaaaggcaag

SEQ ID NO: 768705 - RNA, 19 nt, Human
uaagaaccacuccugcccc

SEQ ID NO: 768706 - RNA, 24 nt, Human
uacaguuuacaacaacucaaggga

SEQ ID NO: 768707 - RNA, 18 nt, Human
uaccccuauuaccuucca

SEQ ID NO: 768708 - RNA, 20 nt, Human
uagagaugggagugcaggua

SEQ ID NO: 768709 - RNA, 21 nt, Human
uauuaugagaaaauauucugu

SEQ ID NO: 768710 - RNA, 22 nt, Human
uauuccaaaaagugggaagggc

SEQ ID NO: 768711 - RNA, 24 nt, Human
ucaacucaacaguuagagaguaaa

SEQ ID NO: 768712 - RNA, 26 nt, Human
ucacacccucacggccuauuccaaaa

SEQ ID NO: 768713 - RNA, 22 nt, Human
ucacagucacgcccuucuuguc

SEQ ID NO: 768714 - RNA, 19 nt, Human
ucagaaaauucaaaaguac

SEQ ID NO: 768715 - RNA, 21 nt, Human
uccacaaggcugcucucccca

SEQ ID NO: 768716 - RNA, 23 nt, Human
uccacaguuaggugaucuuucuu

SEQ ID NO: 768717 - RNA, 20 nt, Human
uccaggaagaacaucauugc

SEQ ID NO: 768718 - RNA, 23 nt, Human
uccaggcagguugcuuucuaagg

SEQ ID NO: 768719 - RNA, 19 nt, Human
uccuggcaauugcuugugg

SEQ ID NO: 768720 - RNA, 18 nt, Human
ucguugcauguuuggugg

SEQ ID NO: 768721 - RNA, 23 nt, Human
ucuaaggccgcugucuuggccuu

SEQ ID NO: 768722 - RNA, 19 nt, Human
ucuaauuaucuguucacuu

SEQ ID NO: 768723 - RNA, 23 nt, Human
ucuacagaauaccuugaaaaccu

SEQ ID NO: 768724 - RNA, 20 nt, Human
ucucaucaaacuggccaauc

SEQ ID NO: 768725 - RNA, 19 nt, Human
ucugcuuguuggcuuccug

SEQ ID NO: 768726 - RNA, 20 nt, Human
ucuucaguguuucccagucu

SEQ ID NO: 768727 - RNA, 26 nt, Human
ucuugugugggguuaacuacaggauc

SEQ ID NO: 768728 - RNA, 19 nt, Human
ugaaaaucauuccaaagcc

SEQ ID NO: 768729 - RNA, 21 nt, Human
ugaaaaucauuccaaagccaa

SEQ ID NO: 768730 - RNA, 22 nt, Human
ugaaacacacacacauuauaac

SEQ ID NO: 768731 - RNA, 24 nt, Human
ugaaacacacacacauuauaaccc

SEQ ID NO: 768732 - RNA, 21 nt, Human
ugaaagccguuguucgcaguc

SEQ ID NO: 768733 - RNA, 23 nt, Human
ugaacaaagagggaaacauagga

SEQ ID NO: 768734 - RNA, 20 nt, Human
ugaauucacagugaaaauaa

SEQ ID NO: 768735 - RNA, 21 nt, Human
ugacaaagaaaaggauguugc

SEQ ID NO: 768736 - RNA, 19 nt, Human
ugagaaacaacugugagag

SEQ ID NO: 768737 - RNA, 19 nt, Human
ugcccccucugggaugccc

SEQ ID NO: 768738 - RNA, 20 nt, Human
ugcccccucugggaugcccc

SEQ ID NO: 768739 - RNA, 18 nt, Human
ugcugcuuuggggagaga

SEQ ID NO: 768740 - RNA, 18 nt, Human
ugcuuggcucagucugca

SEQ ID NO: 768741 - RNA, 19 nt, Human
ugcuuggcucagucugcaa

SEQ ID NO: 768742 - RNA, 19 nt, Human
uggagcagagcacuggagg

SEQ ID NO: 768743 - RNA, 18 nt, Human
uggcuuccuguuucuccu

SEQ ID NO: 768744 - RNA, 22 nt, Human
ugggaagggcauggggagcagc

SEQ ID NO: 768745 - RNA, 22 nt, Human
ugggaucagcuauuacauccuc

SEQ ID NO: 768746 - RNA, 18 nt, Human
uggggcacacaggucugg

SEQ ID NO: 768747 - RNA, 23 nt, Human
ugguuugguuuuagagaugggag

SEQ ID NO: 768748 - RNA, 23 nt, Human
uguaacaaaacucuuacuaauac

SEQ ID NO: 768749 - RNA, 22 nt, Human
ugugccaacugcuuggguacag

SEQ ID NO: 768750 - RNA, 22 nt, Human
uguuaaagugacauugucaaua

SEQ ID NO: 768751 - RNA, 24 nt, Human
uuacccuuuuccuugauuuucaca

SEQ ID NO: 768752 - RNA, 22 nt, Human
uuauacuugcuuucccuuuucu

SEQ ID NO: 768753 - RNA, 24 nt, Human
uucacugcaggggugggugcugag

SEQ ID NO: 768754 - RNA, 19 nt, Human
uuccacaaggcugcucucc

SEQ ID NO: 768755 - RNA, 18 nt, Human
uuccuggucaaaggacac

SEQ ID NO: 768756 - RNA, 23 nt, Human
uucuaauuaucuguucacuugga

SEQ ID NO: 768757 - RNA, 23 nt, Human
uucugccaucuuuaucuucugcu

SEQ ID NO: 768758 - RNA, 24 nt, Human
uugaguuuuaaaggagaagcaagu

SEQ ID NO: 768759 - RNA, 20 nt, Human
uugcaguugaauguagguca

SEQ ID NO: 768760 - RNA, 21 nt, Human
uugcaguugaauguaggucaa

SEQ ID NO: 768761 - RNA, 24 nt, Human
uugcaucugaaucugagaaaugau

SEQ ID NO: 768762 - RNA, 26 nt, Human
uuuacaacaacucaagggagaaagau

SEQ ID NO: 768763 - RNA, 21 nt, Human
uuucacaccaugcagaucuug

SEQ ID NO: 768764 - RNA, 21 nt, Human
uuucagggacagaagggcgga

SEQ ID NO: 768765 - RNA, 23 nt, Human
uuucccuuuucuucugccaucuu

SEQ ID NO: 768766 - RNA, 21 nt, Human
uuuccuggcaauugcuugugg

SEQ ID NO: 768767 - RNA, 25 nt, Human
uuucuugucacuguagcucaaaagu

SEQ ID NO: 768768 - RNA, 22 nt, Human
uuuggggaaguuuucaauuugu

SEQ ID NO: 768769 - RNA, 19 nt, Human
agccccggcuggccgcagc

SEQ ID NO: 768770 - RNA, 22 nt, Human
caaaaugucacauaaacagccc

SEQ ID NO: 768771 - RNA, 23 nt, Human
cacauaaacagcccaguaauaaa

SEQ ID NO: 768772 - RNA, 20 nt, Human
ccggagcccaacauaacaag

SEQ ID NO: 768773 - RNA, 18 nt, Human
ccuccggguuaccaagca

SEQ ID NO: 768774 - RNA, 23 nt, Human
cgcgguuuccaaucucucccucc

SEQ ID NO: 768775 - RNA, 25 nt, Human
cuucagagacaccucaugucucucu

SEQ ID NO: 768776 - RNA, 20 nt, Human
aggcgggaagggggcagguc

SEQ ID NO: 768777 - RNA, 24 nt, Human
aggggggaggaugugggggaggcc

SEQ ID NO: 768778 - RNA, 25 nt, Human
aucuccuucggggcucaacugcugg

SEQ ID NO: 768779 - RNA, 22 nt, Human
caaaaauagacucucuuuuuuc

SEQ ID NO: 768780 - RNA, 21 nt, Human
caccccucacacacccaucuc

SEQ ID NO: 768781 - RNA, 21 nt, Human
caccccucucccaucccugcc

SEQ ID NO: 768782 - RNA, 20 nt, Human
caggccugaugcccacuccu

SEQ ID NO: 768783 - RNA, 19 nt, Human
ccccugggcggaggguagg

SEQ ID NO: 768784 - RNA, 20 nt, Human
ccccugggcggaggguaggc

SEQ ID NO: 768785 - RNA, 18 nt, Human
cccggcccuggaagugga

SEQ ID NO: 768786 - RNA, 24 nt, Human
ccugcagguggggcugccugaucu

SEQ ID NO: 768787 - RNA, 23 nt, Human
ccugccgugcuggcaccugcagc

SEQ ID NO: 768788 - RNA, 18 nt, Human
ccugcugggagugucagc

SEQ ID NO: 768789 - RNA, 23 nt, Human
cucaccccucacacacccaucuc

SEQ ID NO: 768790 - RNA, 20 nt, Human
cuccuggguccaggccaggg

SEQ ID NO: 768791 - RNA, 21 nt, Human
cucgcuccccaccccucuccc

SEQ ID NO: 768792 - RNA, 19 nt, Human
cucucccaucccugccgug

SEQ ID NO: 768793 - RNA, 24 nt, Human
cuggcggaggcagccgcuuccccu

SEQ ID NO: 768794 - RNA, 24 nt, Human
gaagggggcaggucgcugcuccag

SEQ ID NO: 768795 - RNA, 21 nt, Human
gacucgcuccccaccccucuc

SEQ ID NO: 768796 - RNA, 19 nt, Human
gacucgcuccccaccccuu

SEQ ID NO: 768797 - RNA, 18 nt, Human
gccugaacaaugcugggg

SEQ ID NO: 768798 - RNA, 19 nt, Human
gccuggcggaggcagccgc

SEQ ID NO: 768799 - RNA, 24 nt, Human
ggcaggggcugauccccuggaggg

SEQ ID NO: 768800 - RNA, 22 nt, Human
ggcaggucgcugcuccaggaag

SEQ ID NO: 768801 - RNA, 23 nt, Human
ggccaggggaugugagggcugug

SEQ ID NO: 768802 - RNA, 18 nt, Human
ggccuggcggaggcagcc

SEQ ID NO: 768803 - RNA, 20 nt, Human
ggcuggcuggggugcuggcc

SEQ ID NO: 768804 - RNA, 22 nt, Human
ggcuggggugcuggccccaggg

SEQ ID NO: 768805 - RNA, 23 nt, Human
ggcuguggggugcugggaggggg

SEQ ID NO: 768806 - RNA, 22 nt, Human
gggaaggagagcagugucccag

SEQ ID NO: 768807 - RNA, 22 nt, Human
gggcggggaaggagagcagugu

SEQ ID NO: 768808 - RNA, 21 nt, Human
ggggcugauccccuggagggc

SEQ ID NO: 768809 - RNA, 22 nt, Human
ggugcugggaggggggcagugu

SEQ ID NO: 768810 - RNA, 20 nt, Human
gugacucgcuccccaccccu

SEQ ID NO: 768811 - RNA, 18 nt, Human
gugcaggcgggaaggggg

SEQ ID NO: 768812 - RNA, 21 nt, Human
guggagggaagugcaggcggg

SEQ ID NO: 768813 - RNA, 18 nt, Human
uaagggagggugcuuucu

SEQ ID NO: 768814 - RNA, 23 nt, Human
uacccugcugggagugucagccu

SEQ ID NO: 768815 - RNA, 22 nt, Human
ucaccccucacacacccaucuc

SEQ ID NO: 768816 - RNA, 22 nt, Human
ucccaggccugaugcccacucc

SEQ ID NO: 768817 - RNA, 21 nt, Human
uccccaccccucucccauccc

SEQ ID NO: 768818 - RNA, 23 nt, Human
uccucaccccucacacacccauc

SEQ ID NO: 768819 - RNA, 18 nt, Human
uccuggaagcggccuggc

SEQ ID NO: 768820 - RNA, 20 nt, Human
ucgcuccccaccccucuccc

SEQ ID NO: 768821 - RNA, 19 nt, Human
ucuccugggucuccugggu

SEQ ID NO: 768822 - RNA, 25 nt, Human
ugacucgcuccccaccccucuccca

SEQ ID NO: 768823 - RNA, 24 nt, Human
ugaugcccacuccucauuccuaag

SEQ ID NO: 768824 - RNA, 20 nt, Human
ugcuuucuccugggucuccu

SEQ ID NO: 768825 - RNA, 22 nt, Human
uggaaguggagggaagugcagg

SEQ ID NO: 768826 - RNA, 24 nt, Human
uggagggaagugcaggcgggaagg

SEQ ID NO: 768827 - RNA, 22 nt, Human
uggcccggggcuuccuggaagc

SEQ ID NO: 768828 - RNA, 19 nt, Human
uggcggaggcagccgcuuc

SEQ ID NO: 768829 - RNA, 20 nt, Human
ugggaggggggcaguguuga

SEQ ID NO: 768830 - RNA, 18 nt, Human
ugucuggcuggugugagg

SEQ ID NO: 768831 - RNA, 20 nt, Human
ugugaggagaagcccggccc

SEQ ID NO: 768832 - RNA, 23 nt, Human
uuccuaagggagggugcuuucuc

SEQ ID NO: 768833 - RNA, 23 nt, Human
aaaaaaacaacaaaaaacacaca

SEQ ID NO: 768834 - RNA, 28 nt, Human
aaaaaacaacaaaaaacacacaacaaaa

SEQ ID NO: 768835 - RNA, 20 nt, Human
aaaaaacacacaacaaaacc

SEQ ID NO: 768836 - RNA, 24 nt, Human
aaaaaacacacaacaaaaccacca

SEQ ID NO: 768837 - RNA, 25 nt, Human
aaaaaacacacaacaaaaccaccaa

SEQ ID NO: 768838 - RNA, 26 nt, Human
aaaaaacacacaacaaaaccaccaac

SEQ ID NO: 768839 - RNA, 23 nt, Human
aaaaacacacaacaaaaccacca

SEQ ID NO: 768840 - RNA, 20 nt, Human
aaaauaaauaugcucuggcc

SEQ ID NO: 768841 - RNA, 20 nt, Human
aaaauagcagaaacccccaa

SEQ ID NO: 768842 - RNA, 20 nt, Human
aaacaacaaaaaacacacaa

SEQ ID NO: 768843 - RNA, 26 nt, Human
aaacaacaaaaaacacacaacaaaac

SEQ ID NO: 768844 - RNA, 23 nt, Human
aaacacacaacaaaaccaccaac

SEQ ID NO: 768845 - RNA, 24 nt, Human
aaacacacaacaaaaccaccaaca

SEQ ID NO: 768846 - RNA, 22 nt, Human
aaacagaaauccugaaaggggc

SEQ ID NO: 768847 - RNA, 21 nt, Human
aaaccaccaacaacaaaaaag

SEQ ID NO: 768848 - RNA, 20 nt, Human
aaagcaaaaaauagcagaaa

SEQ ID NO: 768849 - RNA, 20 nt, Human
aacacacaacaaaaccacca

SEQ ID NO: 768850 - RNA, 22 nt, Human
aaccaccaacaacaaaaaagag

SEQ ID NO: 768851 - RNA, 22 nt, Human
aagaaaaaaaaaagccauggga

SEQ ID NO: 768852 - RNA, 20 nt, Human
aagaggccgagggugauggu

SEQ ID NO: 768853 - RNA, 21 nt, Human
aagaggccgagggugauggug

SEQ ID NO: 768854 - RNA, 24 nt, Human
aagcaaaaaauagcagaagggacc

SEQ ID NO: 768855 - RNA, 18 nt, Human
aaggugaggccaggggga

SEQ ID NO: 768856 - RNA, 20 nt, Human
acaacaaaaaacacacaaca

SEQ ID NO: 768857 - RNA, 22 nt, Human
acaacggaaacacuucucuuca

SEQ ID NO: 768858 - RNA, 19 nt, Human
acacaacaaaaccaccaac

SEQ ID NO: 768859 - RNA, 21 nt, Human
acacaacaaaaccaccaacaa

SEQ ID NO: 768860 - RNA, 27 nt, Human
acacaacaaaaccaccaacaacaaaaa

SEQ ID NO: 768861 - RNA, 20 nt, Human
acacugaggccucugcagac

SEQ ID NO: 768862 - RNA, 19 nt, Human
acagagaagagagagaggg

SEQ ID NO: 768863 - RNA, 19 nt, Human
acagcaccugaaauggggg

SEQ ID NO: 768864 - RNA, 23 nt, Human
acccgccugcccuugggagcccu

SEQ ID NO: 768865 - RNA, 19 nt, Human
agagaagagacagagaaga

SEQ ID NO: 768866 - RNA, 26 nt, Human
agagacagagaagagagagaggggag

SEQ ID NO: 768867 - RNA, 21 nt, Human
agagagggccugggggaaagg

SEQ ID NO: 768868 - RNA, 20 nt, Human
agagaugggaagggggucaa

SEQ ID NO: 768869 - RNA, 23 nt, Human
agaggcuccggccgccugcgucc

SEQ ID NO: 768870 - RNA, 20 nt, Human
aggacagcaccugaaauggg

SEQ ID NO: 768871 - RNA, 20 nt, Human
aggcaagggucccuucccug

SEQ ID NO: 768872 - RNA, 18 nt, Human
aggccgugggggccucca

SEQ ID NO: 768873 - RNA, 21 nt, Human
aggccucuggggaaggaacag

SEQ ID NO: 768874 - RNA, 19 nt, Human
agggaggucuaguccccuu

SEQ ID NO: 768875 - RNA, 18 nt, Human
aggggaggagagacggag

SEQ ID NO: 768876 - RNA, 19 nt, Human
agggggagggagagaaagg

SEQ ID NO: 768877 - RNA, 22 nt, Human
aggggugaggcaagggucccuu

SEQ ID NO: 768878 - RNA, 23 nt, Human
agggucccuucccuggucuucuc

SEQ ID NO: 768879 - RNA, 23 nt, Human
agguggcagggaaagcccagagc

SEQ ID NO: 768880 - RNA, 19 nt, Human
agugaaggccagccgaggu

SEQ ID NO: 768881 - RNA, 21 nt, Human
aucugugucuuguugccacca

SEQ ID NO: 768882 - RNA, 19 nt, Human
aucuuugcagggggaggga

SEQ ID NO: 768883 - RNA, 21 nt, Human
caaaaaacacacaacaaaacc

SEQ ID NO: 768884 - RNA, 21 nt, Human
caaaaaaugccacacgcagac

SEQ ID NO: 768885 - RNA, 18 nt, Human
caaaaccaccaacaacaa

SEQ ID NO: 768886 - RNA, 22 nt, Human
caacaaaaaacacacaacaaaa

SEQ ID NO: 768887 - RNA, 24 nt, Human
caacaaaaaacacacaacaaaacc

SEQ ID NO: 768888 - RNA, 26 nt, Human
caacaaaaaacacacaacaaaaccac

SEQ ID NO: 768889 - RNA, 21 nt, Human
caacaaaaccaccaacaacaa

SEQ ID NO: 768890 - RNA, 23 nt, Human
caacaaaaccaccaacaacaaaa

SEQ ID NO: 768891 - RNA, 24 nt, Human
caacgaggaaaaaaauagagaaga

SEQ ID NO: 768892 - RNA, 20 nt, Human
caagcugagauaccagaggc

SEQ ID NO: 768893 - RNA, 28 nt, Human
cacaacaaaaccaccaacaacaaaaaag

SEQ ID NO: 768894 - RNA, 19 nt, Human
cacaacagucacuuuccag

SEQ ID NO: 768895 - RNA, 18 nt, Human
cacaauuaggcagaaaac

SEQ ID NO: 768896 - RNA, 21 nt, Human
caccgggucaguggugccccg

SEQ ID NO: 768897 - RNA, 21 nt, Human
cacgcacagccacacugaggc

SEQ ID NO: 768898 - RNA, 22 nt, Human
cacgccuccucugcuuucuggg

SEQ ID NO: 768899 - RNA, 20 nt, Human
cagaaacccccaacucuuga

SEQ ID NO: 768900 - RNA, 22 nt, Human
cagacccccgcggggccccucu

SEQ ID NO: 768901 - RNA, 18 nt, Human
cagagcggagaccccugc

SEQ ID NO: 768902 - RNA, 21 nt, Human
cagccgagguuaacacugggc

SEQ ID NO: 768903 - RNA, 23 nt, Human
cagggggaugugggguguggguu

SEQ ID NO: 768904 - RNA, 21 nt, Human
cagguccggguggcuuccagg

SEQ ID NO: 768905 - RNA, 22 nt, Human
ccacccagggcgaaggcaaggg

SEQ ID NO: 768906 - RNA, 19 nt, Human
ccacgcacagccacacuga

SEQ ID NO: 768907 - RNA, 22 nt, Human
ccaggcccugaauggccgcugg

SEQ ID NO: 768908 - RNA, 20 nt, Human
ccagguaccccaucuguguc

SEQ ID NO: 768909 - RNA, 19 nt, Human
ccaugggaauaaauucuga

SEQ ID NO: 768910 - RNA, 23 nt, Human
cccacagcaccuggcccugcguc

SEQ ID NO: 768911 - RNA, 18 nt, Human
ccccggggccaggggcuc

SEQ ID NO: 768912 - RNA, 18 nt, Human
cccgcggggccccucucu

SEQ ID NO: 768913 - RNA, 20 nt, Human
cccucucugauuccaccuuc

SEQ ID NO: 768914 - RNA, 20 nt, Human
ccucauccuccgaggaugag

SEQ ID NO: 768915 - RNA, 22 nt, Human
ccuccuccucuucuuccuccuc

SEQ ID NO: 768916 - RNA, 20 nt, Human
ccuccucuucuuccuccucu

SEQ ID NO: 768917 - RNA, 19 nt, Human
ccuuucccgcggaggggcc

SEQ ID NO: 768918 - RNA, 19 nt, Human
cgcacagccacacugaggc

SEQ ID NO: 768919 - RNA, 22 nt, Human
cggagccaggggcuccaggggg

SEQ ID NO: 768920 - RNA, 20 nt, Human
cgucaaggcuuagauuugug

SEQ ID NO: 768921 - RNA, 19 nt, Human
cuccggccgccugcguccg

SEQ ID NO: 768922 - RNA, 21 nt, Human
cuccgggucacaacagucacu

SEQ ID NO: 768923 - RNA, 22 nt, Human
cuccuccuccucuucuuccucc

SEQ ID NO: 768924 - RNA, 18 nt, Human
cugauuccaccuucacau

SEQ ID NO: 768925 - RNA, 18 nt, Human
cuggggaaggaacaggcu

SEQ ID NO: 768926 - RNA, 23 nt, Human
cuucaaaaaccuuuuuccccuuc

SEQ ID NO: 768927 - RNA, 23 nt, Human
cuucccgcauguuucuacaagaa

SEQ ID NO: 768928 - RNA, 25 nt, Human
cuugaucuugaaaccggcgggcaca

SEQ ID NO: 768929 - RNA, 22 nt, Human
cuuuugucuuuuuuuuccuuuu

SEQ ID NO: 768930 - RNA, 24 nt, Human
gaaaauaaauaugcucuggccuuc

SEQ ID NO: 768931 - RNA, 19 nt, Human
gaacaggcugcagcucggg

SEQ ID NO: 768932 - RNA, 24 nt, Human
gaauaaaaaaaaaacaacaaaaaa

SEQ ID NO: 768933 - RNA, 18 nt, Human
gacagcccuuuggaggcu

SEQ ID NO: 768934 - RNA, 22 nt, Human
gacauccuuugagucuggugcc

SEQ ID NO: 768935 - RNA, 18 nt, Human
gagcccugucccacccag

SEQ ID NO: 768936 - RNA, 20 nt, Human
gaggaaaaaaauagagaaga

SEQ ID NO: 768937 - RNA, 22 nt, Human
gaggacuccgggucacaacagu

SEQ ID NO: 768938 - RNA, 19 nt, Human
gcacaagaaaaaaaaaagc

SEQ ID NO: 768939 - RNA, 21 nt, Human
gcacaagaaaaaaaaaagcca

SEQ ID NO: 768940 - RNA, 24 nt, Human
gcagcucccucauggagcgcgcuc

SEQ ID NO: 768941 - RNA, 22 nt, Human
gccacacgcagacggucugaca

SEQ ID NO: 768942 - RNA, 19 nt, Human
gccagggggaggggugagg

SEQ ID NO: 768943 - RNA, 27 nt, Human
gccagggggaggggugaggcaaggguc

SEQ ID NO: 768944 - RNA, 19 nt, Human
gccggagccaggggcucca

SEQ ID NO: 768945 - RNA, 21 nt, Human
gcggggggccgggccccgggg

SEQ ID NO: 768946 - RNA, 21 nt, Human
ggacacgggccacgcacagcc

SEQ ID NO: 768947 - RNA, 20 nt, Human
ggagagagagaagcugaugc

SEQ ID NO: 768948 - RNA, 21 nt, Human
ggagcaaggugaggccagggg

SEQ ID NO: 768949 - RNA, 19 nt, Human
ggccaggggcuccacgcuc

SEQ ID NO: 768950 - RNA, 21 nt, Human
gggccggagccaggggcucca

SEQ ID NO: 768951 - RNA, 19 nt, Human
gggccuccgagaggcuccc

SEQ ID NO: 768952 - RNA, 20 nt, Human
ggggaggagagacggagagg

SEQ ID NO: 768953 - RNA, 21 nt, Human
ggggaggggugaggcaagggu

SEQ ID NO: 768954 - RNA, 18 nt, Human
ggggcgggcgcggggggc

SEQ ID NO: 768955 - RNA, 21 nt, Human
ggggcuggggcuccuggggag

SEQ ID NO: 768956 - RNA, 23 nt, Human
gggggaugugggguguggguugg

SEQ ID NO: 768957 - RNA, 22 nt, Human
gggucccuucccuggucuucuc

SEQ ID NO: 768958 - RNA, 22 nt, Human
ggugggagcagcucccucaugg

SEQ ID NO: 768959 - RNA, 22 nt, Human
guccagguccggguggcuucca

SEQ ID NO: 768960 - RNA, 19 nt, Human
gugaggcaagggucccuuc

SEQ ID NO: 768961 - RNA, 18 nt, Human
uaacuugaaucagccguc

SEQ ID NO: 768962 - RNA, 23 nt, Human
uacagaauuuacaugauaacaag

SEQ ID NO: 768963 - RNA, 25 nt, Human
uacaucaagacacacaacggaaaca

SEQ ID NO: 768964 - RNA, 24 nt, Human
uagagagggccugggggaaaggaa

SEQ ID NO: 768965 - RNA, 23 nt, Human
uagcagcauucacaggaagaggc

SEQ ID NO: 768966 - RNA, 21 nt, Human
uaggcagaaaaccgcaaacgg

SEQ ID NO: 768967 - RNA, 20 nt, Human
uagggggugcugggguguga

SEQ ID NO: 768968 - RNA, 23 nt, Human
uagguugaggggcugccggcagg

SEQ ID NO: 768969 - RNA, 25 nt, Human
uauacagaaguugguucugaacuuc

SEQ ID NO: 768970 - RNA, 20 nt, Human
uaugaacaaauauuuacauc

SEQ ID NO: 768971 - RNA, 23 nt, Human
uaugaacaaauauuuacaucaag

SEQ ID NO: 768972 - RNA, 23 nt, Human
ucaaaagggaaaaaaaaaccguc

SEQ ID NO: 768973 - RNA, 21 nt, Human
ucaagacacacaacggaaaca

SEQ ID NO: 768974 - RNA, 21 nt, Human
ucaguggugccccaggccucu

SEQ ID NO: 768975 - RNA, 23 nt, Human
uccacgcucgggagucccagggc

SEQ ID NO: 768976 - RNA, 23 nt, Human
ucccagggcuacggcugacaucc

SEQ ID NO: 768977 - RNA, 24 nt, Human
ucccagggcuacggcugacauccu

SEQ ID NO: 768978 - RNA, 21 nt, Human
uccuccgaggaugagggcgag

SEQ ID NO: 768979 - RNA, 18 nt, Human
uccuccucuucuuccucc

SEQ ID NO: 768980 - RNA, 18 nt, Human
uccuugaucuugaaaccu

SEQ ID NO: 768981 - RNA, 19 nt, Human
ucucugauuccaccuucac

SEQ ID NO: 768982 - RNA, 18 nt, Human
ucucugggagaaguaauc

SEQ ID NO: 768983 - RNA, 23 nt, Human
ucugaggucaaggccgugggggc

SEQ ID NO: 768984 - RNA, 21 nt, Human
ucuuccuccucuucccuggcc

SEQ ID NO: 768985 - RNA, 20 nt, Human
ucuuuguacagaauuuacau

SEQ ID NO: 768986 - RNA, 27 nt, Human
ugaaaagcagagauuuguucaaugaaa

SEQ ID NO: 768987 - RNA, 20 nt, Human
ugaaagaaaaaugacucgac

SEQ ID NO: 768988 - RNA, 23 nt, Human
ugaaagaaaaaugacucgacaca

SEQ ID NO: 768989 - RNA, 20 nt, Human
ugagauaccagaggcuccgg

SEQ ID NO: 768990 - RNA, 18 nt, Human
ugaggccagggggagggg

SEQ ID NO: 768991 - RNA, 18 nt, Human
ugagguggcagggaaagc

SEQ ID NO: 768992 - RNA, 24 nt, Human
ugagugggugaagcuuauaagcca

SEQ ID NO: 768993 - RNA, 20 nt, Human
ugaucuugaaaccggcgggc

SEQ ID NO: 768994 - RNA, 19 nt, Human
ugcacuggggccuccgaga

SEQ ID NO: 768995 - RNA, 22 nt, Human
ugcacuggggccuccgagaggc

SEQ ID NO: 768996 - RNA, 23 nt, Human
ugccaccaauuuccuugaucuug

SEQ ID NO: 768997 - RNA, 18 nt, Human
ugcuggggugugaggugg

SEQ ID NO: 768998 - RNA, 24 nt, Human
ugggagcagcucccucauggagcg

SEQ ID NO: 768999 - RNA, 25 nt, Human
ugggagcccugucccacccagggcg

SEQ ID NO: 769000 - RNA, 19 nt, Human
uggggaaaggugugggguc

SEQ ID NO: 769001 - RNA, 23 nt, Human
ugggggcgggcgcggggggccgg

SEQ ID NO: 769002 - RNA, 22 nt, Human
uggggucuccucacugugccca

SEQ ID NO: 769003 - RNA, 18 nt, Human
ugggguguggguuggggg

SEQ ID NO: 769004 - RNA, 22 nt, Human
uggguagaggacagcaccugaa

SEQ ID NO: 769005 - RNA, 18 nt, Human
uggguugggggugagugg

SEQ ID NO: 769006 - RNA, 24 nt, Human
uguggggucuccucacugugccca

SEQ ID NO: 769007 - RNA, 23 nt, Human
uucacaggaagaggccgagggug

SEQ ID NO: 769008 - RNA, 22 nt, Human
uuccagaaauuauuuacacgcc

SEQ ID NO: 769009 - RNA, 19 nt, Human
uucccuggccacuaccucc

SEQ ID NO: 769010 - RNA, 24 nt, Human
uucccuggucuucucgaacacccc

SEQ ID NO: 769011 - RNA, 20 nt, Human
uugaacccaagguuuagggg

SEQ ID NO: 769012 - RNA, 24 nt, Human
uugaucuugaaaccggcgggcaca

SEQ ID NO: 769013 - RNA, 26 nt, Human
uuuacacgccuccucugcuuucuggg

SEQ ID NO: 769014 - RNA, 22 nt, Human
uuugcuuuauaaaaguuacuau

SEQ ID NO: 769015 - RNA, 22 nt, Human
uuuuuuggaaguacaaagaaau

SEQ ID NO: 769016 - RNA, 23 nt, Human
aaaaaaucaaaaccaagccaacc

SEQ ID NO: 769017 - RNA, 25 nt, Human
aaaaaaucaaaaccaagccaaccca

SEQ ID NO: 769018 - RNA, 28 nt, Human
aaaacaaacaaacaagcaaaaaaucaaa

SEQ ID NO: 769019 - RNA, 20 nt, Human
aaaaucaaaaccaagccaac

SEQ ID NO: 769020 - RNA, 25 nt, Human
aaacaaacaaacaagcaaaaaauca

SEQ ID NO: 769021 - RNA, 25 nt, Human
aaacaagcaaaaaaucaaaaccaag

SEQ ID NO: 769022 - RNA, 19 nt, Human
aaacaauaugugauccaua

SEQ ID NO: 769023 - RNA, 26 nt, Human
aaacuagucauauuuuaucaacauuu

SEQ ID NO: 769024 - RNA, 23 nt, Human
aaagugcaaaaucaucuaacuga

SEQ ID NO: 769025 - RNA, 22 nt, Human
aaaucuucucuagagaaaaagc

SEQ ID NO: 769026 - RNA, 19 nt, Human
aacccaaauauccccagcc

SEQ ID NO: 769027 - RNA, 20 nt, Human
aagaguuuaccauaaacacu

SEQ ID NO: 769028 - RNA, 20 nt, Human
aagauuuucugcaauuauuc

SEQ ID NO: 769029 - RNA, 20 nt, Human
aagcaaaaaaucaaaaccaa

SEQ ID NO: 769030 - RNA, 21 nt, Human
aagcaaaaaaucaaaaccaag

SEQ ID NO: 769031 - RNA, 24 nt, Human
aagcacuugaauuaucuaaaaaua

SEQ ID NO: 769032 - RNA, 21 nt, Human
aagccaacccaaauaucccca

SEQ ID NO: 769033 - RNA, 24 nt, Human
acaaaacaaacaaacaagcaaaaa

SEQ ID NO: 769034 - RNA, 20 nt, Human
acaaugacagccaacaguga

SEQ ID NO: 769035 - RNA, 23 nt, Human
acccaggguagcuuggaauguug

SEQ ID NO: 769036 - RNA, 20 nt, Human
acuuugagcaguuugagucu

SEQ ID NO: 769037 - RNA, 24 nt, Human
agacugauaagccuguaaaaauaa

SEQ ID NO: 769038 - RNA, 20 nt, Human
agaugaugguggguggccgu

SEQ ID NO: 769039 - RNA, 23 nt, Human
agccuggggcugggcccgagcuc

SEQ ID NO: 769040 - RNA, 28 nt, Human
aggaggcagaggagcagagauaaggugg

SEQ ID NO: 769041 - RNA, 23 nt, Human
agggaggaggcagaggagcagag

SEQ ID NO: 769042 - RNA, 25 nt, Human
agguacccaggguagcuuggaaugu

SEQ ID NO: 769043 - RNA, 19 nt, Human
agucaugccaagaaaacca

SEQ ID NO: 769044 - RNA, 22 nt, Human
auccucgcugcccucgcuccug

SEQ ID NO: 769045 - RNA, 18 nt, Human
caaaagccgccuucaaaa

SEQ ID NO: 769046 - RNA, 18 nt, Human
caacagugagacugauaa

SEQ ID NO: 769047 - RNA, 23 nt, Human
caagaaaaccaaaaaagaugaaa

SEQ ID NO: 769048 - RNA, 23 nt, Human
cacaaugacagccaacagugaga

SEQ ID NO: 769049 - RNA, 21 nt, Human
cacagcgugcucagcagagac

SEQ ID NO: 769050 - RNA, 21 nt, Human
cacuagcuucuacugcacaaa

SEQ ID NO: 769051 - RNA, 21 nt, Human
cacuguguagcuccucuaggc

SEQ ID NO: 769052 - RNA, 24 nt, Human
cagaauuguucuauaaaaguauca

SEQ ID NO: 769053 - RNA, 21 nt, Human
cagcacaaaagccgccuucaa

SEQ ID NO: 769054 - RNA, 21 nt, Human
cagcgggacuuccuuccuccu

SEQ ID NO: 769055 - RNA, 25 nt, Human
caucccaccgaugauacacacauca

SEQ ID NO: 769056 - RNA, 20 nt, Human
caucuaacugaaaaugacgg

SEQ ID NO: 769057 - RNA, 22 nt, Human
caugccaagaaaaccaaaaaag

SEQ ID NO: 769058 - RNA, 20 nt, Human
cauucuagccaucuugauug

SEQ ID NO: 769059 - RNA, 23 nt, Human
ccaacccaaauauccccagccuu

SEQ ID NO: 769060 - RNA, 18 nt, Human
cccaaccuuaugccuugg

SEQ ID NO: 769061 - RNA, 28 nt, Human
cccgacaccggccccaagauucauuagc

SEQ ID NO: 769062 - RNA, 20 nt, Human
ccggcagccgggaaggccug

SEQ ID NO: 769063 - RNA, 18 nt, Human
ccucugauccucgcugcc

SEQ ID NO: 769064 - RNA, 18 nt, Human
ccugcgaaugggcugcag

SEQ ID NO: 769065 - RNA, 22 nt, Human
cgccggcagccgggaaggccug

SEQ ID NO: 769066 - RNA, 21 nt, Human
cgccugggguuuccuaguugc

SEQ ID NO: 769067 - RNA, 26 nt, Human
cggccccaagauucauuagcgacggg

SEQ ID NO: 769068 - RNA, 25 nt, Human
cuccgaggagcgccggcagccggga

SEQ ID NO: 769069 - RNA, 21 nt, Human
cugccuugaagaaccugcaug

SEQ ID NO: 769070 - RNA, 21 nt, Human
gaacagggaggaggcagagga

SEQ ID NO: 769071 - RNA, 20 nt, Human
gagacaaccaagaacccguc

SEQ ID NO: 769072 - RNA, 23 nt, Human
gaggcagaggagcagagauaagg

SEQ ID NO: 769073 - RNA, 24 nt, Human
gaguaugcuuccuaauaacuugaa

SEQ ID NO: 769074 - RNA, 21 nt, Human
gccucugcgccugggguuucc

SEQ ID NO: 769075 - RNA, 21 nt, Human
ggaaggccuggccucugaucc

SEQ ID NO: 769076 - RNA, 25 nt, Human
gggaacagggaggaggcagaggagc

SEQ ID NO: 769077 - RNA, 18 nt, Human
ggggcugggcccgagcuc

SEQ ID NO: 769078 - RNA, 19 nt, Human
guaaaacacaugcaacauu

SEQ ID NO: 769079 - RNA, 19 nt, Human
guggcagcgggacuuccuu

SEQ ID NO: 769080 - RNA, 22 nt, Human
gugugcacaccgcuugcucaca

SEQ ID NO: 769081 - RNA, 23 nt, Human
uaaaaaacagaguaugcuuccua

SEQ ID NO: 769082 - RNA, 21 nt, Human
uaaaaaccuaauacacaacaa

SEQ ID NO: 769083 - RNA, 21 nt, Human
uaaaacacaugcaacauuuuc

SEQ ID NO: 769084 - RNA, 25 nt, Human
uaaaguuaccaaaaagauucagcua

SEQ ID NO: 769085 - RNA, 20 nt, Human
uaagaagaaaaccucucuua

SEQ ID NO: 769086 - RNA, 18 nt, Human
uaagcaaaaacacaucau

SEQ ID NO: 769087 - RNA, 22 nt, Human
uacaaaacaaacaaacaagcaa

SEQ ID NO: 769088 - RNA, 24 nt, Human
uacaaaacaaacaaacaagcaaaa

SEQ ID NO: 769089 - RNA, 22 nt, Human
uaccaaaaagauucagcuauaa

SEQ ID NO: 769090 - RNA, 21 nt, Human
uagacuuuccugaagccagaa

SEQ ID NO: 769091 - RNA, 20 nt, Human
uagauguuuucauucacacu

SEQ ID NO: 769092 - RNA, 19 nt, Human
uagccaucuugauuggaua

SEQ ID NO: 769093 - RNA, 23 nt, Human
uagccaucuugauuggauaacau

SEQ ID NO: 769094 - RNA, 19 nt, Human
uagccaugccuuucugcua

SEQ ID NO: 769095 - RNA, 19 nt, Human
uauaaaaguaucauggaau

SEQ ID NO: 769096 - RNA, 25 nt, Human
uauguuuguucugucaucccaccga

SEQ ID NO: 769097 - RNA, 24 nt, Human
uauuuucaccaccaacauuauuag

SEQ ID NO: 769098 - RNA, 22 nt, Human
ucaaaaccaagccaacccaaau

SEQ ID NO: 769099 - RNA, 22 nt, Human
ucaaaaucuucucuagagaaaa

SEQ ID NO: 769100 - RNA, 26 nt, Human
ucaaucucuauucucagagguauuca

SEQ ID NO: 769101 - RNA, 18 nt, Human
ucagaacaucugcagaua

SEQ ID NO: 769102 - RNA, 20 nt, Human
ucagcagagacaaccaagaa

SEQ ID NO: 769103 - RNA, 18 nt, Human
uccuuuccaggaccacca

SEQ ID NO: 769104 - RNA, 21 nt, Human
ucgcuccuggccucugcgccu

SEQ ID NO: 769105 - RNA, 23 nt, Human
ucuaaucagaggagagugaagag

SEQ ID NO: 769106 - RNA, 23 nt, Human
ucuagcucugucaugccaucgcc

SEQ ID NO: 769107 - RNA, 22 nt, Human
ucucaaagugcaaaaucaucua

SEQ ID NO: 769108 - RNA, 18 nt, Human
ucuccgucuccugauuuc

SEQ ID NO: 769109 - RNA, 20 nt, Human
ucuccgugugcacaccgcuu

SEQ ID NO: 769110 - RNA, 18 nt, Human
ucucuagagaaaaagcuc

SEQ ID NO: 769111 - RNA, 22 nt, Human
ucuuaggguaagcaaaaacaca

SEQ ID NO: 769112 - RNA, 23 nt, Human
ucuuuagaucuuuuucuccuguu

SEQ ID NO: 769113 - RNA, 18 nt, Human
ucuuuuauugagaaguuc

SEQ ID NO: 769114 - RNA, 22 nt, Human
ugaaggucuuacaaauaaucau

SEQ ID NO: 769115 - RNA, 22 nt, Human
ugacacagcgugcucagcagag

SEQ ID NO: 769116 - RNA, 23 nt, Human
ugaugaacgcuuugaggcuaggc

SEQ ID NO: 769117 - RNA, 24 nt, Human
ugaugguggguggccgucagcaca

SEQ ID NO: 769118 - RNA, 21 nt, Human
ugauuaacuucuggaaugucg

SEQ ID NO: 769119 - RNA, 23 nt, Human
ugcaaauacucuaucuaaauccu

SEQ ID NO: 769120 - RNA, 19 nt, Human
ugcacaaagguacccaggg

SEQ ID NO: 769121 - RNA, 20 nt, Human
ugccuugggucuucaucuga

SEQ ID NO: 769122 - RNA, 24 nt, Human
ugcugugacuucuccuuuucguga

SEQ ID NO: 769123 - RNA, 23 nt, Human
uggccucugauccucgcugcccu

SEQ ID NO: 769124 - RNA, 25 nt, Human
ugguuaaaaaugaaucaaaacuuca

SEQ ID NO: 769125 - RNA, 23 nt, Human
ugugcacaccgcuugcucacaug

SEQ ID NO: 769126 - RNA, 23 nt, Human
uguguagcuccucuaggccuugc

SEQ ID NO: 769127 - RNA, 23 nt, Human
uguucagaauucaaaugauuaac

SEQ ID NO: 769128 - RNA, 18 nt, Human
uuaccaggggugucaagu

SEQ ID NO: 769129 - RNA, 21 nt, Human
uuaccaggggugucaaguuuu

SEQ ID NO: 769130 - RNA, 22 nt, Human
uuaucuaaaaauaagaagaaaa

SEQ ID NO: 769131 - RNA, 24 nt, Human
uucaugaucauaaauauguuuguu

SEQ ID NO: 769132 - RNA, 18 nt, Human
uuccagugguuaaaaaug

SEQ ID NO: 769133 - RNA, 24 nt, Human
uucgguguucugcgguggccaugg

SEQ ID NO: 769134 - RNA, 18 nt, Human
uugaagaaccugcauguc

SEQ ID NO: 769135 - RNA, 19 nt, Human
uuggucgguucaaaugcag

SEQ ID NO: 769136 - RNA, 20 nt, Human
uuuauuuucaccaccaacau

SEQ ID NO: 769137 - RNA, 22 nt, Human
aaaaaacaaaaaaccuguaagc

SEQ ID NO: 769138 - RNA, 21 nt, Human
aaaaaaccuguaagcaaugcu

SEQ ID NO: 769139 - RNA, 22 nt, Human
aaaaggauuaaaaugaagaaaa

SEQ ID NO: 769140 - RNA, 25 nt, Human
aaacagccaaauaaaacuguaacag

SEQ ID NO: 769141 - RNA, 20 nt, Human
aaacaguagaucacaaauag

SEQ ID NO: 769142 - RNA, 25 nt, Human
aaacuaguuuuaaucuaaacgugua

SEQ ID NO: 769143 - RNA, 24 nt, Human
aaagaaauauauccauauuccuuc

SEQ ID NO: 769144 - RNA, 22 nt, Human
aaagagauagaaagccuuuuuu

SEQ ID NO: 769145 - RNA, 24 nt, Human
aaagcugcaccauaauaaaaaaau

SEQ ID NO: 769146 - RNA, 23 nt, Human
aaauauaagaguuacauauccug

SEQ ID NO: 769147 - RNA, 22 nt, Human
aagcaggugaaccugauaacac

SEQ ID NO: 769148 - RNA, 22 nt, Human
aaucauucaagucuuuuccuga

SEQ ID NO: 769149 - RNA, 24 nt, Human
acaggcugcacugguaaccacgac

SEQ ID NO: 769150 - RNA, 18 nt, Human
acuaacccucugguauac

SEQ ID NO: 769151 - RNA, 23 nt, Human
acugaugccuaaaggccuuauaa

SEQ ID NO: 769152 - RNA, 18 nt, Human
agagaaauguauauauuu

SEQ ID NO: 769153 - RNA, 22 nt, Human
agagaauguuaauacuugagug

SEQ ID NO: 769154 - RNA, 21 nt, Human
agaguuacauauccuggucuc

SEQ ID NO: 769155 - RNA, 21 nt, Human
augacaacagagcuuaauguc

SEQ ID NO: 769156 - RNA, 23 nt, Human
auuaaaaaaaagcugcaccauaa

SEQ ID NO: 769157 - RNA, 24 nt, Human
caaauauacauaaauauaagaaca

SEQ ID NO: 769158 - RNA, 18 nt, Human
caagaacuaaaucuuucc

SEQ ID NO: 769159 - RNA, 23 nt, Human
caagaacuaaaucuuuccaaagc

SEQ ID NO: 769160 - RNA, 22 nt, Human
cacaacacugaaauauaacagg

SEQ ID NO: 769161 - RNA, 22 nt, Human
cacauaauuuguaaucuuaacc

SEQ ID NO: 769162 - RNA, 22 nt, Human
cacaugaaauaaaauacaaagg

SEQ ID NO: 769163 - RNA, 21 nt, Human
cacuccaaaauacugugguuu

SEQ ID NO: 769164 - RNA, 29 nt, Human
cagcaacuucucauaacauauucuugguu

SEQ ID NO: 769165 - RNA, 22 nt, Human
caggcugcacugguaaccacga

SEQ ID NO: 769166 - RNA, 25 nt, Human
cagguaagcacaccauacacuguac

SEQ ID NO: 769167 - RNA, 22 nt, Human
caguauuuuacagcacagcauc

SEQ ID NO: 769168 - RNA, 18 nt, Human
caucucauuccuauucuu

SEQ ID NO: 769169 - RNA, 19 nt, Human
caucucauuccuauucuuu

SEQ ID NO: 769170 - RNA, 22 nt, Human
caugaaagaaaacaaacuacgc

SEQ ID NO: 769171 - RNA, 20 nt, Human
caugugguuuaaagcgaacc

SEQ ID NO: 769172 - RNA, 18 nt, Human
ccaaagcugugucaaaua

SEQ ID NO: 769173 - RNA, 26 nt, Human
ccaacuaacccucugguauacacugu

SEQ ID NO: 769174 - RNA, 20 nt, Human
ccuguaagcaaugcucuaga

SEQ ID NO: 769175 - RNA, 20 nt, Human
cggaaaaaccaagaacuaaa

SEQ ID NO: 769176 - RNA, 18 nt, Human
cuacacauguaucuugca

SEQ ID NO: 769177 - RNA, 25 nt, Human
cuagcagcucuuuacaacaccuccu

SEQ ID NO: 769178 - RNA, 22 nt, Human
cucuuacaugcaaacaguagau

SEQ ID NO: 769179 - RNA, 19 nt, Human
cuuugaugagggaaauuua

SEQ ID NO: 769180 - RNA, 22 nt, Human
gaaaauguugauaacccagaug

SEQ ID NO: 769181 - RNA, 20 nt, Human
gaauaaacccccaggagaga

SEQ ID NO: 769182 - RNA, 20 nt, Human
gauugcuuugaugagggaaa

SEQ ID NO: 769183 - RNA, 21 nt, Human
gcacagcaucuuaaaaaacaa

SEQ ID NO: 769184 - RNA, 21 nt, Human
gcaucuuaaaaaacaaaaaac

SEQ ID NO: 769185 - RNA, 18 nt, Human
gcucuuuacaacaccucc

SEQ ID NO: 769186 - RNA, 21 nt, Human
ggacacacacaaauuuaagaa

SEQ ID NO: 769187 - RNA, 21 nt, Human
ggccuuauaauaauagaaaag

SEQ ID NO: 769188 - RNA, 19 nt, Human
guaaaaugugcaauucccc

SEQ ID NO: 769189 - RNA, 23 nt, Human
guauacacuguuaaagaacaaag

SEQ ID NO: 769190 - RNA, 20 nt, Human
uaaaaaaaagcaacaaauaa

SEQ ID NO: 769191 - RNA, 25 nt, Human
uaaaaaacaaaaaaccuguaagcaa

SEQ ID NO: 769192 - RNA, 21 nt, Human
uaaaacacauaauuuguaauc

SEQ ID NO: 769193 - RNA, 21 nt, Human
uaaagacuucuugagaacuug

SEQ ID NO: 769194 - RNA, 25 nt, Human
uacaaaacggaaaaaccaagaacua

SEQ ID NO: 769195 - RNA, 23 nt, Human
uagcaaaccaucugaagacaaga

SEQ ID NO: 769196 - RNA, 19 nt, Human
uagcagaauuugacaggcu

SEQ ID NO: 769197 - RNA, 21 nt, Human
uaucucuacuucccaugaaag

SEQ ID NO: 769198 - RNA, 20 nt, Human
uaugacaguauuuuacagca

SEQ ID NO: 769199 - RNA, 22 nt, Human
uaugauacaauacugucuuccc

SEQ ID NO: 769200 - RNA, 26 nt, Human
uauguuauauacacaauauguauaca

SEQ ID NO: 769201 - RNA, 22 nt, Human
uccauugucuugcauccaauuu

SEQ ID NO: 769202 - RNA, 20 nt, Human
ucuagaguggacagguaagc

SEQ ID NO: 769203 - RNA, 20 nt, Human
ucuuuacaacaccuccucuu

SEQ ID NO: 769204 - RNA, 18 nt, Human
ugaaagaaaacaaacuac

SEQ ID NO: 769205 - RNA, 21 nt, Human
ugaaagaaaacaaacuacgca

SEQ ID NO: 769206 - RNA, 20 nt, Human
ugaaauaaaauacaaaggua

SEQ ID NO: 769207 - RNA, 19 nt, Human
ugaaaugaacaaauuuagu

SEQ ID NO: 769208 - RNA, 23 nt, Human
ugaaaugaacaaauuuaguaacg

SEQ ID NO: 769209 - RNA, 19 nt, Human
ugaagaaaaacccaauaua

SEQ ID NO: 769210 - RNA, 21 nt, Human
ugagugaauaauaaauagagu

SEQ ID NO: 769211 - RNA, 23 nt, Human
ugcaaauuuaccaugaauguucu

SEQ ID NO: 769212 - RNA, 18 nt, Human
ugccaacuuauaaaguga

SEQ ID NO: 769213 - RNA, 23 nt, Human
ugguuuacauuccaguuguucau

SEQ ID NO: 769214 - RNA, 26 nt, Human
uguuauauacacaauauguauacacu

SEQ ID NO: 769215 - RNA, 20 nt, Human
uuaaaaaaaagcugcaccau

SEQ ID NO: 769216 - RNA, 23 nt, Human
uuaaacagccaaauaaaacuguc

SEQ ID NO: 769217 - RNA, 22 nt, Human
uucaggaagucuuacaucuuca

SEQ ID NO: 769218 - RNA, 19 nt, Human
uuggcaauuagaaagauuu

SEQ ID NO: 769219 - RNA, 19 nt, Human
uuuccccaacuaacccucu

SEQ ID NO: 769220 - RNA, 21 nt, Human
uuuugcaaaugcuguaacacc

SEQ ID NO: 769221 - RNA, 19 nt, Human
aacaccauccuucccgccc

SEQ ID NO: 769222 - RNA, 21 nt, Human
aacaccauccuucccgcccgc

SEQ ID NO: 769223 - RNA, 20 nt, Human
accucuggauucuuccuccc

SEQ ID NO: 769224 - RNA, 22 nt, Human
agaaacaccauccuucccgccc

SEQ ID NO: 769225 - RNA, 18 nt, Human
auccugccucccuccgcu

SEQ ID NO: 769226 - RNA, 22 nt, Human
caacgccagcagcccugcggag

SEQ ID NO: 769227 - RNA, 21 nt, Human
caccugggcucccgagggccc

SEQ ID NO: 769228 - RNA, 18 nt, Human
cagcuaagagccgucucc

SEQ ID NO: 769229 - RNA, 21 nt, Human
cagcuaagagccgucucccuc

SEQ ID NO: 769230 - RNA, 21 nt, Human
caggggagcagccucggaccc

SEQ ID NO: 769231 - RNA, 20 nt, Human
cagucgauccugccucccuc

SEQ ID NO: 769232 - RNA, 21 nt, Human
cccacggcgcggcuccggggc

SEQ ID NO: 769233 - RNA, 22 nt, Human
cccugcucgauguccgagucgg

SEQ ID NO: 769234 - RNA, 25 nt, Human
ccgcccgccugcgccgccgccgccg

SEQ ID NO: 769235 - RNA, 23 nt, Human
ccgccugcgccgccgccgccgcc

SEQ ID NO: 769236 - RNA, 18 nt, Human
ccgcgccgguugcucccg

SEQ ID NO: 769237 - RNA, 23 nt, Human
ccucccaaucucaugucagcaaa

SEQ ID NO: 769238 - RNA, 24 nt, Human
ccuccgcugccucaguggcacccg

SEQ ID NO: 769239 - RNA, 19 nt, Human
cgcccgucagucgauccug

SEQ ID NO: 769240 - RNA, 20 nt, Human
cgccgccgccgccucucaac

SEQ ID NO: 769241 - RNA, 20 nt, Human
cgccgccgccucucaacagc

SEQ ID NO: 769242 - RNA, 21 nt, Human
cgccggcuccuggacacggcc

SEQ ID NO: 769243 - RNA, 18 nt, Human
cgcugcucgggcugaggg

SEQ ID NO: 769244 - RNA, 20 nt, Human
cggccgcgggugcacggggc

SEQ ID NO: 769245 - RNA, 19 nt, Human
cggcucccgguccgcaccu

SEQ ID NO: 769246 - RNA, 19 nt, Human
cggcuccuggacacggccu

SEQ ID NO: 769247 - RNA, 23 nt, Human
cgguccggcucccgguccgcacc

SEQ ID NO: 769248 - RNA, 23 nt, Human
cucccgagcacacguugcuucug

SEQ ID NO: 769249 - RNA, 23 nt, Human
cucccgguccgcaccugccgcuc

SEQ ID NO: 769250 - RNA, 21 nt, Human
cuccgcugccucaguggcacc

SEQ ID NO: 769251 - RNA, 18 nt, Human
gauccugccucccuccgc

SEQ ID NO: 769252 - RNA, 20 nt, Human
gcagcccugcggagcggcgg

SEQ ID NO: 769253 - RNA, 19 nt, Human
gccuugaacgcagcuaaga

SEQ ID NO: 769254 - RNA, 19 nt, Human
ggagcagccucggacccga

SEQ ID NO: 769255 - RNA, 20 nt, Human
ucgauccugccucccuccgc

SEQ ID NO: 769256 - RNA, 21 nt, Human
ucgcccacggcgcggcuccgg

SEQ ID NO: 769257 - RNA, 19 nt, Human
ucgcugcucgggcugaggg

SEQ ID NO: 769258 - RNA, 19 nt, Human
ugagggacgccggcuccug

SEQ ID NO: 769259 - RNA, 21 nt, Human
ugccaaaccucgguccggcuc

SEQ ID NO: 769260 - RNA, 23 nt, Human
ugccucaguggcacccgcgccgg

SEQ ID NO: 769261 - RNA, 24 nt, Human
ugcucgggcugagggcgcaggggc

SEQ ID NO: 769262 - RNA, 21 nt, Human
uggauucuuccucccaaucuc

SEQ ID NO: 769263 - RNA, 22 nt, Human
uggcgaguggaugucgcugcuc

SEQ ID NO: 769264 - RNA, 20 nt, Human
ugucgcugcucgggcugagg

SEQ ID NO: 769265 - RNA, 23 nt, Human
uucuccgucuucgcugcuuccgc

SEQ ID NO: 769266 - RNA, 19 nt, Human
uuggcagccaccuaguccu

SEQ ID NO: 769267 - RNA, 23 nt, Human
uuggcagccaccuaguccuuuuc

SEQ ID NO: 769268 - RNA, 24 nt, Human
uuggcagccaccuaguccuuuucu

SEQ ID NO: 769269 - RNA, 23 nt, Human
aaaaaaaaagcaugagccacaaa

SEQ ID NO: 769270 - RNA, 24 nt, Human
aaaaaagacaucuuccaacacuga

SEQ ID NO: 769271 - RNA, 21 nt, Human
aaaaagacaucuuccaacacu

SEQ ID NO: 769272 - RNA, 22 nt, Human
aaaagaugcugcaacauaaaau

SEQ ID NO: 769273 - RNA, 21 nt, Human
aaaagcaugagccacaaagaa

SEQ ID NO: 769274 - RNA, 20 nt, Human
aaaaggaaacaaaacuguuu

SEQ ID NO: 769275 - RNA, 22 nt, Human
aaaaggaaacaaaacuguuuua

SEQ ID NO: 769276 - RNA, 22 nt, Human
aaaaguagccauguuacuaaac

SEQ ID NO: 769277 - RNA, 21 nt, Human
aaagcaugaauuauuauuacc

SEQ ID NO: 769278 - RNA, 20 nt, Human
aacucacucugcaacaacag

SEQ ID NO: 769279 - RNA, 20 nt, Human
aacuccuuuuguuucagaga

SEQ ID NO: 769280 - RNA, 18 nt, Human
aagcaaauguuaagcuga

SEQ ID NO: 769281 - RNA, 21 nt, Human
aagcaaauguuaagcugaaac

SEQ ID NO: 769282 - RNA, 26 nt, Human
acaaagaaaagaugcugcaacauaaa

SEQ ID NO: 769283 - RNA, 19 nt, Human
acaaagcaagcauggaagc

SEQ ID NO: 769284 - RNA, 20 nt, Human
acaguaucuagcucaagaca

SEQ ID NO: 769285 - RNA, 25 nt, Human
agagacugaggaucacagaggcaca

SEQ ID NO: 769286 - RNA, 22 nt, Human
aggcaggccaugccuuuuggcc

SEQ ID NO: 769287 - RNA, 20 nt, Human
agguggaggaaaagaggcau

SEQ ID NO: 769288 - RNA, 21 nt, Human
agugucuuucaaaucaauucc

SEQ ID NO: 769289 - RNA, 24 nt, Human
auaaaguacccauccagguauaag

SEQ ID NO: 769290 - RNA, 21 nt, Human
caaaagcucuguucucaguag

SEQ ID NO: 769291 - RNA, 20 nt, Human
caaagcaagcauggaagcuc

SEQ ID NO: 769292 - RNA, 21 nt, Human
caaccaugacaacuaagggca

SEQ ID NO: 769293 - RNA, 22 nt, Human
caacuguuuccaauggaaagaa

SEQ ID NO: 769294 - RNA, 20 nt, Human
cacaaagaaaagaugcugca

SEQ ID NO: 769295 - RNA, 22 nt, Human
cacaaagaaaagaugcugcaac

SEQ ID NO: 769296 - RNA, 23 nt, Human
cacaaagaaaagaugcugcaaca

SEQ ID NO: 769297 - RNA, 23 nt, Human
cacaguaucuagcucaagacagg

SEQ ID NO: 769298 - RNA, 24 nt, Human
caccuguauacaccgcauaaaagu

SEQ ID NO: 769299 - RNA, 19 nt, Human
cacuaagcugucuauuccc

SEQ ID NO: 769300 - RNA, 19 nt, Human
cacucugcaacaacagggc

SEQ ID NO: 769301 - RNA, 19 nt, Human
cagagcaggaagaacugug

SEQ ID NO: 769302 - RNA, 19 nt, Human
cagcaccuaacacaguauc

SEQ ID NO: 769303 - RNA, 19 nt, Human
cagguuacagggacaaagg

SEQ ID NO: 769304 - RNA, 22 nt, Human
cauccagguauaaguaugcagc

SEQ ID NO: 769305 - RNA, 19 nt, Human
cauggaagcucaugaaaaa

SEQ ID NO: 769306 - RNA, 22 nt, Human
ccaagcaaauguuaagcugaaa

SEQ ID NO: 769307 - RNA, 20 nt, Human
ccacaaagaaaagaugcugc

SEQ ID NO: 769308 - RNA, 21 nt, Human
ccacaaagaaaagaugcugca

SEQ ID NO: 769309 - RNA, 23 nt, Human
ccagcaccuaacacaguaucuag

SEQ ID NO: 769310 - RNA, 18 nt, Human
cccugaaaauaaccaacc

SEQ ID NO: 769311 - RNA, 25 nt, Human
ccgaaacgcaggagacauggaucca

SEQ ID NO: 769312 - RNA, 19 nt, Human
ccugaagggcagugaugcc

SEQ ID NO: 769313 - RNA, 19 nt, Human
cggucaggcggcggcugcu

SEQ ID NO: 769314 - RNA, 24 nt, Human
cuacaguggugucaaaaucaguuc

SEQ ID NO: 769315 - RNA, 24 nt, Human
cucccggcucuuuucccucuuuuc

SEQ ID NO: 769316 - RNA, 19 nt, Human
cucuuuucccucuuuuccc

SEQ ID NO: 769317 - RNA, 19 nt, Human
cugaaaauaaccaaccaug

SEQ ID NO: 769318 - RNA, 23 nt, Human
cugacaaccagauuucaaaauau

SEQ ID NO: 769319 - RNA, 21 nt, Human
cuugcccaccucucucccggc

SEQ ID NO: 769320 - RNA, 24 nt, Human
cuuuagcaaagucuguacuuuacc

SEQ ID NO: 769321 - RNA, 23 nt, Human
gaagaaagcuuagguagaacacc

SEQ ID NO: 769322 - RNA, 18 nt, Human
gacaucuguuugacauga

SEQ ID NO: 769323 - RNA, 19 nt, Human
gagccacaaagaaaagaug

SEQ ID NO: 769324 - RNA, 20 nt, Human
gcaugucuggguaaaaucuc

SEQ ID NO: 769325 - RNA, 24 nt, Human
gccacacuggagacauuuaaagua

SEQ ID NO: 769326 - RNA, 21 nt, Human
gcccucguccuugcccaccuc

SEQ ID NO: 769327 - RNA, 21 nt, Human
gcugaaccaaagcggcacagc

SEQ ID NO: 769328 - RNA, 22 nt, Human
gcuugcuuuucuggcuugcugg

SEQ ID NO: 769329 - RNA, 24 nt, Human
ggaaacaaaacuguuuuagcucag

SEQ ID NO: 769330 - RNA, 22 nt, Human
ggccaagcaaauguuaagcuga

SEQ ID NO: 769331 - RNA, 20 nt, Human
ggucaggcggcggcugcugc

SEQ ID NO: 769332 - RNA, 22 nt, Human
guacucccagcaccuaacacag

SEQ ID NO: 769333 - RNA, 21 nt, Human
guagaacaccuguauacaccg

SEQ ID NO: 769334 - RNA, 23 nt, Human
guagcuuuucuggcuugcuuuuc

SEQ ID NO: 769335 - RNA, 22 nt, Human
guccuugcccaccucucucccg

SEQ ID NO: 769336 - RNA, 24 nt, Human
gucuucuucacugaguuggauucc

SEQ ID NO: 769337 - RNA, 21 nt, Human
uaaaaaaaaagcaugagccac

SEQ ID NO: 769338 - RNA, 23 nt, Human
uaaaaauccaugcauguaacccu

SEQ ID NO: 769339 - RNA, 22 nt, Human
uaacuuuaauucuuagcaaauc

SEQ ID NO: 769340 - RNA, 23 nt, Human
uaauaacuacugccaagcagaac

SEQ ID NO: 769341 - RNA, 26 nt, Human
uaauauacacacuaaucauaauuaua

SEQ ID NO: 769342 - RNA, 20 nt, Human
uacaguccacaggcuauuca

SEQ ID NO: 769343 - RNA, 21 nt, Human
uacuucauccuuucauuaggg

SEQ ID NO: 769344 - RNA, 24 nt, Human
uagcacagaaugagagccugugcu

SEQ ID NO: 769345 - RNA, 23 nt, Human
uagguagaacaccuguauacacc

SEQ ID NO: 769346 - RNA, 20 nt, Human
uaucuaauauugaguuaaua

SEQ ID NO: 769347 - RNA, 19 nt, Human
uaucugaauggcagagacu

SEQ ID NO: 769348 - RNA, 20 nt, Human
uaugguaaaacauuucacuc

SEQ ID NO: 769349 - RNA, 20 nt, Human
uauuaccagaaacucgguug

SEQ ID NO: 769350 - RNA, 21 nt, Human
uauuuugccucuugaagucuc

SEQ ID NO: 769351 - RNA, 21 nt, Human
ucagacguuuuaaugucuccu

SEQ ID NO: 769352 - RNA, 18 nt, Human
ucaguaggucaacuggug

SEQ ID NO: 769353 - RNA, 19 nt, Human
ucccccgguuucccccucc

SEQ ID NO: 769354 - RNA, 21 nt, Human
ucccugaggauaaggaucugc

SEQ ID NO: 769355 - RNA, 26 nt, Human
uccucagaaacagagaucagauucac

SEQ ID NO: 769356 - RNA, 21 nt, Human
ucguucugucuucuucacuga

SEQ ID NO: 769357 - RNA, 19 nt, Human
ucuaaaagggaaagucacc

SEQ ID NO: 769358 - RNA, 23 nt, Human
ucuaauauucuuauuaccagaaa

SEQ ID NO: 769359 - RNA, 21 nt, Human
ucuacaaauuggaaaugcuag

SEQ ID NO: 769360 - RNA, 20 nt, Human
ucucaguaggucaacuggug

SEQ ID NO: 769361 - RNA, 23 nt, Human
ucugaauggcagagacugaggau

SEQ ID NO: 769362 - RNA, 22 nt, Human
ucuggcuugcuuuucuggcuug

SEQ ID NO: 769363 - RNA, 20 nt, Human
ugaaaaaggcagagcaggaa

SEQ ID NO: 769364 - RNA, 19 nt, Human
ugaaccaaagcggcacagc

SEQ ID NO: 769365 - RNA, 23 nt, Human
ugaagucucaguuuucucaucua

SEQ ID NO: 769366 - RNA, 21 nt, Human
ugagugacuugaucauauaaa

SEQ ID NO: 769367 - RNA, 22 nt, Human
ugcaaaaacagaugcuauauca

SEQ ID NO: 769368 - RNA, 23 nt, Human
ugccaagcagaacaaaauguccu

SEQ ID NO: 769369 - RNA, 21 nt, Human
ugccacuaagcugucuauucc

SEQ ID NO: 769370 - RNA, 19 nt, Human
ugcccuaagguaucugugc

SEQ ID NO: 769371 - RNA, 23 nt, Human
ugcccucgcccucguccuugccc

SEQ ID NO: 769372 - RNA, 20 nt, Human
uggaaaugcuagaaccucac

SEQ ID NO: 769373 - RNA, 24 nt, Human
uggccugacaaccagauuucaaaa

SEQ ID NO: 769374 - RNA, 20 nt, Human
ugggguauaauuuaaugaaa

SEQ ID NO: 769375 - RNA, 20 nt, Human
uggggugggggccuaccauc

SEQ ID NO: 769376 - RNA, 22 nt, Human
uggggugggggccuaccaucug

SEQ ID NO: 769377 - RNA, 21 nt, Human
uguaaaaaggaaacaaaacug

SEQ ID NO: 769378 - RNA, 18 nt, Human
uguaacccuaaaaaaaaa

SEQ ID NO: 769379 - RNA, 20 nt, Human
ugucucuuggcaggaagaaa

SEQ ID NO: 769380 - RNA, 20 nt, Human
ugucuuaucucccauaaaca

SEQ ID NO: 769381 - RNA, 18 nt, Human
ugugugucugugugugug

SEQ ID NO: 769382 - RNA, 25 nt, Human
uguuguagcuuuucuggcuugcuuu

SEQ ID NO: 769383 - RNA, 20 nt, Human
uguuucagagaguuuuacag

SEQ ID NO: 769384 - RNA, 18 nt, Human
uuaugguccaaucauauc

SEQ ID NO: 769385 - RNA, 18 nt, Human
uuccaauaaaaaacaagg

SEQ ID NO: 769386 - RNA, 21 nt, Human
uuccaauggaaagaauauugg

SEQ ID NO: 769387 - RNA, 28 nt, Human
uuggauuccugaagggcagugaugccuu

SEQ ID NO: 769388 - RNA, 18 nt, Human
uuggggugggggccuacc

SEQ ID NO: 769389 - RNA, 21 nt, Human
uuuucuggcuugcuuuucugg

SEQ ID NO: 769390 - RNA, 24 nt, Human
uuuuguuucagagaguuuuacagg

SEQ ID NO: 769391 - RNA, 23 nt, Human
accaccaccucuagguucuccau

SEQ ID NO: 769392 - RNA, 24 nt, Human
accacugcuacucucacuguugca

SEQ ID NO: 769393 - RNA, 22 nt, Human
acuguugcagucugugcugucc

SEQ ID NO: 769394 - RNA, 19 nt, Human
aucacuauucccaccugca

SEQ ID NO: 769395 - RNA, 19 nt, Human
caaaagcacuaaggucaua

SEQ ID NO: 769396 - RNA, 22 nt, Human
cacuauaugacaagaaauuuac

SEQ ID NO: 769397 - RNA, 21 nt, Human
cagguggauaggaaaucaauu

SEQ ID NO: 769398 - RNA, 18 nt, Human
ccaccugcaccaccaccu

SEQ ID NO: 769399 - RNA, 21 nt, Human
ccacugcuacucucacuguug

SEQ ID NO: 769400 - RNA, 21 nt, Human
cucuuggcuuuuaccaccacu

SEQ ID NO: 769401 - RNA, 19 nt, Human
gagaacauaaucagguggg

SEQ ID NO: 769402 - RNA, 23 nt, Human
ggucauaugaucuuaaguucaaa

SEQ ID NO: 769403 - RNA, 20 nt, Human
uaaaaaaaaauccccauggu

SEQ ID NO: 769404 - RNA, 20 nt, Human
uaaacuaaccagagaacaua

SEQ ID NO: 769405 - RNA, 23 nt, Human
uaccaccacugcuacucucacug

SEQ ID NO: 769406 - RNA, 22 nt, Human
uaggcacauuaaaaaaaaaucc

SEQ ID NO: 769407 - RNA, 22 nt, Human
ucccaccugcaccaccaccucu

SEQ ID NO: 769408 - RNA, 22 nt, Human
ucugugcuguccaaguuaucug

SEQ ID NO: 769409 - RNA, 21 nt, Human
ucuuggcuuuuaccaccacug

SEQ ID NO: 769410 - RNA, 21 nt, Human
ucuuuuuauugaauauucugg

SEQ ID NO: 769411 - RNA, 21 nt, Human
uggcuaaacuaaccagagaac

SEQ ID NO: 769412 - RNA, 20 nt, Human
uguaaacaauuauacaugua

SEQ ID NO: 769413 - RNA, 22 nt, Human
uuauacauguauuuaucacccu

SEQ ID NO: 769414 - RNA, 20 nt, Human
uucuuaaacaaggcuaaaga

SEQ ID NO: 769415 - RNA, 18 nt, Human
uuuuuuuuuuuuuuuuug

SEQ ID NO: 769416 - RNA, 22 nt, Human
aaaaccccuuccuguaccacga

SEQ ID NO: 769417 - RNA, 24 nt, Human
aaagugcugggauuaaaggcauga

SEQ ID NO: 769418 - RNA, 24 nt, Human
aaagugcugggauuacaggcguga

SEQ ID NO: 769419 - RNA, 24 nt, Human
aaagugcugggauuauagguguga

SEQ ID NO: 769420 - RNA, 22 nt, Human
aagaaaaaaaaacugaccaagc

SEQ ID NO: 769421 - RNA, 22 nt, Human
aagaugcccccgaguuuagaau

SEQ ID NO: 769422 - RNA, 18 nt, Human
aagcaacucagccuccca

SEQ ID NO: 769423 - RNA, 24 nt, Human
aagcgauccaccaagcuuggccuc

SEQ ID NO: 769424 - RNA, 19 nt, Human
aaggcacucagugguacag

SEQ ID NO: 769425 - RNA, 19 nt, Human
aaguagcugggacuacagg

SEQ ID NO: 769426 - RNA, 20 nt, Human
aaguagcugggacuacaggu

SEQ ID NO: 769427 - RNA, 26 nt, Human
aaguagcugggacuacaggugcacac

SEQ ID NO: 769428 - RNA, 19 nt, Human
aagugcugggauuaaaggc

SEQ ID NO: 769429 - RNA, 19 nt, Human
aagugcugggauuacaggc

SEQ ID NO: 769430 - RNA, 19 nt, Human
aagugcugggauuacaggc

SEQ ID NO: 769431 - RNA, 18 nt, Human
aagugcugggauuauagg

SEQ ID NO: 769432 - RNA, 26 nt, Human
aagugcugggauuauaggugugagcc

SEQ ID NO: 769433 - RNA, 18 nt, Human
acaggguuucaccauguu

SEQ ID NO: 769434 - RNA, 19 nt, Human
acaggguuucaccauguug

SEQ ID NO: 769435 - RNA, 24 nt, Human
acaggguuucaccauguugaccag

SEQ ID NO: 769436 - RNA, 25 nt, Human
accauauugcccagacugaucuuaa

SEQ ID NO: 769437 - RNA, 24 nt, Human
acggccucagccucccgaguagcu

SEQ ID NO: 769438 - RNA, 23 nt, Human
acggugcaaucacagcucacugc

SEQ ID NO: 769439 - RNA, 24 nt, Human
acugcuggccccccuggcuguggg

SEQ ID NO: 769440 - RNA, 21 nt, Human
agaaaaaaaaacugaccaagc

SEQ ID NO: 769441 - RNA, 20 nt, Human
agacagggucucgcucugua

SEQ ID NO: 769442 - RNA, 18 nt, Human
agacggcggccccucccc

SEQ ID NO: 769443 - RNA, 24 nt, Human
agagaaacaaaacugagccacugg

SEQ ID NO: 769444 - RNA, 22 nt, Human
agcucacugcccuccuggccuc

SEQ ID NO: 769445 - RNA, 22 nt, Human
agcugggacuacaggcuugggc

SEQ ID NO: 769446 - RNA, 24 nt, Human
aggcgaucugcccaccucggccuc

SEQ ID NO: 769447 - RNA, 19 nt, Human
aggcgugaaucaccgcgcc

SEQ ID NO: 769448 - RNA, 24 nt, Human
agggauccuacggccucagccucc

SEQ ID NO: 769449 - RNA, 18 nt, Human
agggcucggggcgggggg

SEQ ID NO: 769450 - RNA, 25 nt, Human
agguugggguggggacucagaaggg

SEQ ID NO: 769451 - RNA, 21 nt, Human
agguuugaacagguuggggug

SEQ ID NO: 769452 - RNA, 19 nt, Human
aguagcugggacuacaggc

SEQ ID NO: 769453 - RNA, 19 nt, Human
aguagcugggacuacaggc

SEQ ID NO: 769454 - RNA, 25 nt, Human
aguagcugggacuacaggcuugggc

SEQ ID NO: 769455 - RNA, 18 nt, Human
agugcugggauuacaggc

SEQ ID NO: 769456 - RNA, 20 nt, Human
auuggggacccccugccuca

SEQ ID NO: 769457 - RNA, 24 nt, Human
caaagugcugggauuaaaggcaug

SEQ ID NO: 769458 - RNA, 21 nt, Human
caaagugcugggauuacaggc

SEQ ID NO: 769459 - RNA, 24 nt, Human
caaagugcugggauuacaggcgug

SEQ ID NO: 769460 - RNA, 24 nt, Human
caaagugcugggauuauaggugug

SEQ ID NO: 769461 - RNA, 24 nt, Human
caacucagccucccaaagugcugg

SEQ ID NO: 769462 - RNA, 21 nt, Human
caagaugcccccgaguuuaga

SEQ ID NO: 769463 - RNA, 22 nt, Human
cacagugcccggucugaagcac

SEQ ID NO: 769464 - RNA, 21 nt, Human
cacauccaucagugccaggag

SEQ ID NO: 769465 - RNA, 27 nt, Human
caccauauugcccagacugaucuuaaa

SEQ ID NO: 769466 - RNA, 18 nt, Human
caccauguugaccaggcc

SEQ ID NO: 769467 - RNA, 21 nt, Human
caccauguugaccaggccggu

SEQ ID NO: 769468 - RNA, 24 nt, Human
caccauguugaccaggccggucuc

SEQ ID NO: 769469 - RNA, 27 nt, Human
caccauguugaccaggccggucucgaa

SEQ ID NO: 769470 - RNA, 24 nt, Human
cagccucgaacuccugggcucaag

SEQ ID NO: 769471 - RNA, 20 nt, Human
cagcuggccaaagaaaaaaa

SEQ ID NO: 769472 - RNA, 21 nt, Human
cagcuggccaaagaaaaaaaa

SEQ ID NO: 769473 - RNA, 21 nt, Human
cagggucucgcucuguaaccc

SEQ ID NO: 769474 - RNA, 24 nt, Human
caggguuucaccauguugaccagg

SEQ ID NO: 769475 - RNA, 20 nt, Human
caguagcgcaaucucggcuc

SEQ ID NO: 769476 - RNA, 24 nt, Human
cauauugcccagacugaucuuaaa

SEQ ID NO: 769477 - RNA, 24 nt, Human
caugccaagcugauuuuuaaaaau

SEQ ID NO: 769478 - RNA, 24 nt, Human
cauguugaccaggccggucucgaa

SEQ ID NO: 769479 - RNA, 24 nt, Human
ccaaagugcugggauuaaaggcau

SEQ ID NO: 769480 - RNA, 20 nt, Human
ccaaagugcugggauuauag

SEQ ID NO: 769481 - RNA, 21 nt, Human
ccaaagugcugggauuauagg

SEQ ID NO: 769482 - RNA, 24 nt, Human
ccaaagugcugggauuauaggugu

SEQ ID NO: 769483 - RNA, 20 nt, Human
ccacugggcagcuggccaaa

SEQ ID NO: 769484 - RNA, 18 nt, Human
ccagcacagcuguucccg

SEQ ID NO: 769485 - RNA, 21 nt, Human
ccaggagugcagggaugcaaa

SEQ ID NO: 769486 - RNA, 18 nt, Human
cccaaagguggacuuuuc

SEQ ID NO: 769487 - RNA, 23 nt, Human
cccaaguagcugggacuacaggu

SEQ ID NO: 769488 - RNA, 24 nt, Human
cccaaguagcugggacuacaggug

SEQ ID NO: 769489 - RNA, 20 nt, Human
cccacgugauuucaaaucca

SEQ ID NO: 769490 - RNA, 21 nt, Human
cccagaacagggccugcccac

SEQ ID NO: 769491 - RNA, 19 nt, Human
ccccagaacagggccugcc

SEQ ID NO: 769492 - RNA, 20 nt, Human
cccccaggcacgggucccgg

SEQ ID NO: 769493 - RNA, 19 nt, Human
cccccgaguuuagaaucug

SEQ ID NO: 769494 - RNA, 18 nt, Human
cccccugccucccaauuu

SEQ ID NO: 769495 - RNA, 24 nt, Human
cccgaguagcugggacuacaggcu

SEQ ID NO: 769496 - RNA, 22 nt, Human
cccgggcccugcuaccacaagg

SEQ ID NO: 769497 - RNA, 21 nt, Human
ccggucucgaacuccugaccu

SEQ ID NO: 769498 - RNA, 20 nt, Human
ccucaaggcuccggacucag

SEQ ID NO: 769499 - RNA, 24 nt, Human
ccucaucgcccgucggcgugucca

SEQ ID NO: 769500 - RNA, 24 nt, Human
ccuccuggccucaaggcuccggac

SEQ ID NO: 769501 - RNA, 19 nt, Human
ccucgaacuccugggcuca

SEQ ID NO: 769502 - RNA, 22 nt, Human
ccucgaacuccugggcucaagg

SEQ ID NO: 769503 - RNA, 24 nt, Human
ccugaccucaggcgaucugcccac

SEQ ID NO: 769504 - RNA, 18 nt, Human
ccuggcuguggagguggg

SEQ ID NO: 769505 - RNA, 19 nt, Human
ccuggcugugggggauggg

SEQ ID NO: 769506 - RNA, 19 nt, Human
ccugggcucaagggauccu

SEQ ID NO: 769507 - RNA, 25 nt, Human
ccuguaccacgaggugaguuuagag

SEQ ID NO: 769508 - RNA, 25 nt, Human
cgaacuccugggcucaagggauccu

SEQ ID NO: 769509 - RNA, 24 nt, Human
cgaucugcccaccucggccucuca

SEQ ID NO: 769510 - RNA, 21 nt, Human
cggccccuccccggguccccc

SEQ ID NO: 769511 - RNA, 25 nt, Human
cuacggccucagccucccgaguagc

SEQ ID NO: 769512 - RNA, 22 nt, Human
cucaagcaacucagccucccaa

SEQ ID NO: 769513 - RNA, 24 nt, Human
cucagccucccaaguagcugggac

SEQ ID NO: 769514 - RNA, 24 nt, Human
cucagccucccgaguagcugggac

SEQ ID NO: 769515 - RNA, 26 nt, Human
cucaggcccugcugacauccuggcug

SEQ ID NO: 769516 - RNA, 19 nt, Human
cuccccgggucccccaggc

SEQ ID NO: 769517 - RNA, 21 nt, Human
cucucaggcucaagcaacuca

SEQ ID NO: 769518 - RNA, 22 nt, Human
cugacuguccagcacagcuguu

SEQ ID NO: 769519 - RNA, 23 nt, Human
cugcagccucgaacuccugggcu

SEQ ID NO: 769520 - RNA, 25 nt, Human
cuggccaaagaaaaaaaaacugacc

SEQ ID NO: 769521 - RNA, 18 nt, Human
cuggccucaaggcuccgg

SEQ ID NO: 769522 - RNA, 20 nt, Human
cugggauuaaaggcaugagc

SEQ ID NO: 769523 - RNA, 21 nt, Human
cugggauuauaggugugagcc

SEQ ID NO: 769524 - RNA, 18 nt, Human
cuucuguugcccaggcug

SEQ ID NO: 769525 - RNA, 24 nt, Human
cuucuucuguugcccaggcuggag

SEQ ID NO: 769526 - RNA, 24 nt, Human
gaccucaggcgaucugcccaccuc

SEQ ID NO: 769527 - RNA, 20 nt, Human
gagacagggucucgcucugu

SEQ ID NO: 769528 - RNA, 19 nt, Human
gagaucacaucugcccaaa

SEQ ID NO: 769529 - RNA, 22 nt, Human
gauccuacggccucagccuccc

SEQ ID NO: 769530 - RNA, 18 nt, Human
gaugcaaaggcccgcagg

SEQ ID NO: 769531 - RNA, 18 nt, Human
gauuaaaggcaugagcca

SEQ ID NO: 769532 - RNA, 19 nt, Human
gauuaaaggcaugagccac

SEQ ID NO: 769533 - RNA, 19 nt, Human
gauuacaggcgugaaucac

SEQ ID NO: 769534 - RNA, 22 nt, Human
gauuacaggcgugaaucaccgc

SEQ ID NO: 769535 - RNA, 18 nt, Human
gauuauaggugugagcca

SEQ ID NO: 769536 - RNA, 21 nt, Human
gauuauaggugugagccacca

SEQ ID NO: 769537 - RNA, 24 nt, Human
gauuauaggugugagccaccaugc

SEQ ID NO: 769538 - RNA, 24 nt, Human
gcagcuggccaaagaaaaaaaaac

SEQ ID NO: 769539 - RNA, 21 nt, Human
gccaagcugauuuuuaaaaau

SEQ ID NO: 769540 - RNA, 19 nt, Human
gccaggauccucaucgccc

SEQ ID NO: 769541 - RNA, 21 nt, Human
gcccagacugaucuuaaaccg

SEQ ID NO: 769542 - RNA, 22 nt, Human
gcccaggcuggagugucacggu

SEQ ID NO: 769543 - RNA, 23 nt, Human
gccggucucgaacuccugaccuc

SEQ ID NO: 769544 - RNA, 24 nt, Human
gcgauccaccaagcuuggccuccc

SEQ ID NO: 769545 - RNA, 22 nt, Human
gcgaucugcccaccucggccuc

SEQ ID NO: 769546 - RNA, 24 nt, Human
gcgcagcccagaggaaggggaacc

SEQ ID NO: 769547 - RNA, 23 nt, Human
gcguggggaugccggcugggagc

SEQ ID NO: 769548 - RNA, 22 nt, Human
gcucuguaacccaggcuggagu

SEQ ID NO: 769549 - RNA, 19 nt, Human
ggacuacaggcuugggcca

SEQ ID NO: 769550 - RNA, 23 nt, Human
ggacucagccucccaaguagcug

SEQ ID NO: 769551 - RNA, 19 nt, Human
ggagguggguggggggucu

SEQ ID NO: 769552 - RNA, 24 nt, Human
ggauuauaggugugagccaccaug

SEQ ID NO: 769553 - RNA, 24 nt, Human
ggccggucucgaacuccugaccuc

SEQ ID NO: 769554 - RNA, 23 nt, Human
ggccucagccucccgaguagcug

SEQ ID NO: 769555 - RNA, 24 nt, Human
ggccucagccucccgaguagcugg

SEQ ID NO: 769556 - RNA, 21 nt, Human
ggcggggggugggugggggug

SEQ ID NO: 769557 - RNA, 19 nt, Human
gggaggcccagccaggauc

SEQ ID NO: 769558 - RNA, 21 nt, Human
gggcggggggugggugggggu

SEQ ID NO: 769559 - RNA, 22 nt, Human
gggcggggggugggugggggug

SEQ ID NO: 769560 - RNA, 24 nt, Human
gggcggggggugggugggggugcc

SEQ ID NO: 769561 - RNA, 22 nt, Human
gggcucggggcggggggugggu

SEQ ID NO: 769562 - RNA, 18 nt, Human
ggggauggggcccucgag

SEQ ID NO: 769563 - RNA, 21 nt, Human
ggggggucuguuuggagcagg

SEQ ID NO: 769564 - RNA, 23 nt, Human
gggggugggugggggugccucug

SEQ ID NO: 769565 - RNA, 20 nt, Human
gguggggccccagaacaggg

SEQ ID NO: 769566 - RNA, 21 nt, Human
gguuugaacagguuggggugg

SEQ ID NO: 769567 - RNA, 20 nt, Human
gucugggcuggccuugaacu

SEQ ID NO: 769568 - RNA, 22 nt, Human
gugaaaggcacucagugguaca

SEQ ID NO: 769569 - RNA, 21 nt, Human
uaagugacaaagucuucuucu

SEQ ID NO: 769570 - RNA, 23 nt, Human
uacagagcguuacucaaaaggaa

SEQ ID NO: 769571 - RNA, 27 nt, Human
uaccacgaggugaguuuagagccaacu

SEQ ID NO: 769572 - RNA, 24 nt, Human
uacuagagacaggguuucaccaug

SEQ ID NO: 769573 - RNA, 20 nt, Human
uagagacaggguuucaccau

SEQ ID NO: 769574 - RNA, 21 nt, Human
uagagacaggguuucaccaug

SEQ ID NO: 769575 - RNA, 22 nt, Human
uagagacaggguuucaccaugu

SEQ ID NO: 769576 - RNA, 22 nt, Human
ucaaagugcugggauuacaggc

SEQ ID NO: 769577 - RNA, 24 nt, Human
ucaaagugcugggauuacaggcgu

SEQ ID NO: 769578 - RNA, 23 nt, Human
ucaaauccaggccucagugacac

SEQ ID NO: 769579 - RNA, 22 nt, Human
ucaagcaacucagccucccaaa

SEQ ID NO: 769580 - RNA, 18 nt, Human
ucagccucccaaagugcu

SEQ ID NO: 769581 - RNA, 20 nt, Human
ucagccucccaaguagcugg

SEQ ID NO: 769582 - RNA, 23 nt, Human
ucagccucccgaguagcugggac

SEQ ID NO: 769583 - RNA, 21 nt, Human
ucaggcccugcugacauccug

SEQ ID NO: 769584 - RNA, 20 nt, Human
uccaccaagcuuggccuccc

SEQ ID NO: 769585 - RNA, 25 nt, Human
uccaugccgcagccgcauccaaaga

SEQ ID NO: 769586 - RNA, 24 nt, Human
ucccaaagugcugggauuaaaggc

SEQ ID NO: 769587 - RNA, 23 nt, Human
ucccaaagugcugggauuauagg

SEQ ID NO: 769588 - RNA, 24 nt, Human
ucccaaguagcugggacuacaggu

SEQ ID NO: 769589 - RNA, 18 nt, Human
ucccagggcuggauggug

SEQ ID NO: 769590 - RNA, 24 nt, Human
ucccgaguagcugggacuacaggc

SEQ ID NO: 769591 - RNA, 18 nt, Human
uccugggcucaagggauc

SEQ ID NO: 769592 - RNA, 20 nt, Human
uccugggcucaagggauccu

SEQ ID NO: 769593 - RNA, 24 nt, Human
ucgcugcagccucgaacuccuggg

SEQ ID NO: 769594 - RNA, 22 nt, Human
ucggcgcgcacacguccaggag

SEQ ID NO: 769595 - RNA, 24 nt, Human
ucuacaaagacauucagacagagc

SEQ ID NO: 769596 - RNA, 24 nt, Human
ucucaaagugcugggauuacaggc

SEQ ID NO: 769597 - RNA, 18 nt, Human
ucucacucuguugucugg

SEQ ID NO: 769598 - RNA, 23 nt, Human
ucucacucuguugucugggcugg

SEQ ID NO: 769599 - RNA, 18 nt, Human
ucucaggcucaagcaacu

SEQ ID NO: 769600 - RNA, 19 nt, Human
ucucaggcucaagcaacuc

SEQ ID NO: 769601 - RNA, 23 nt, Human
ucucgaacuccugaccucaggcg

SEQ ID NO: 769602 - RNA, 23 nt, Human
ucucgcucuguaacccaggcugg

SEQ ID NO: 769603 - RNA, 24 nt, Human
ucucgcucuguaacccaggcugga

SEQ ID NO: 769604 - RNA, 24 nt, Human
ucuguaacccaggcuggaguucag

SEQ ID NO: 769605 - RNA, 22 nt, Human
ucuucuguugcccaggcuggag

SEQ ID NO: 769606 - RNA, 23 nt, Human
ucuucuguugcccaggcuggagu

SEQ ID NO: 769607 - RNA, 24 nt, Human
ucuucuguugcccaggcuggagug

SEQ ID NO: 769608 - RNA, 23 nt, Human
ucuucuucuguugcccaggcugg

SEQ ID NO: 769609 - RNA, 24 nt, Human
ucuucuucuguugcccaggcugga

SEQ ID NO: 769610 - RNA, 19 nt, Human
ugacacauggcagaguggg

SEQ ID NO: 769611 - RNA, 18 nt, Human
ugacauccuggcugugga

SEQ ID NO: 769612 - RNA, 24 nt, Human
ugaccaggccggucucgaacuccu

SEQ ID NO: 769613 - RNA, 18 nt, Human
ugaccucaggcgaucugc

SEQ ID NO: 769614 - RNA, 20 nt, Human
ugaccucaggcgaucugccc

SEQ ID NO: 769615 - RNA, 21 nt, Human
ugaccucaggcgaucugccca

SEQ ID NO: 769616 - RNA, 22 nt, Human
ugcaaaggcccgcagguggggg

SEQ ID NO: 769617 - RNA, 24 nt, Human
ugcacaccaccacgccaggcuaau

SEQ ID NO: 769618 - RNA, 20 nt, Human
ugcccaggcuggagugucac

SEQ ID NO: 769619 - RNA, 24 nt, Human
ugcccaggcuggagugucacggug

SEQ ID NO: 769620 - RNA, 24 nt, Human
ugcccccgaguuuagaaucugcuu

SEQ ID NO: 769621 - RNA, 20 nt, Human
ugccucugggcuccgggucu

SEQ ID NO: 769622 - RNA, 23 nt, Human
ugcugggauuacaggcgugaauc

SEQ ID NO: 769623 - RNA, 21 nt, Human
uggagguggguggggggucug

SEQ ID NO: 769624 - RNA, 22 nt, Human
uggccaaagaaaaaaaaacuga

SEQ ID NO: 769625 - RNA, 27 nt, Human
uggccaaagaaaaaaaaacugaccaag

SEQ ID NO: 769626 - RNA, 20 nt, Human
uggcuguggagguggguggg

SEQ ID NO: 769627 - RNA, 22 nt, Human
ugggacuacaggcuugggccac

SEQ ID NO: 769628 - RNA, 24 nt, Human
ugggacuacaggcuugggccacca

SEQ ID NO: 769629 - RNA, 24 nt, Human
ugggacuacaggugcacaccacca

SEQ ID NO: 769630 - RNA, 22 nt, Human
ugggauuaaaggcaugagccac

SEQ ID NO: 769631 - RNA, 24 nt, Human
ugggauuaaaggcaugagccacag

SEQ ID NO: 769632 - RNA, 26 nt, Human
ugggauuaaaggcaugagccacagug

SEQ ID NO: 769633 - RNA, 18 nt, Human
ugggauuacaggcgugaa

SEQ ID NO: 769634 - RNA, 19 nt, Human
ugggauuacaggcgugaau

SEQ ID NO: 769635 - RNA, 21 nt, Human
ugggauuacaggcgugaauca

SEQ ID NO: 769636 - RNA, 22 nt, Human
ugggauuacaggcgugaaucac

SEQ ID NO: 769637 - RNA, 23 nt, Human
ugggauuacaggcgugaaucacc

SEQ ID NO: 769638 - RNA, 24 nt, Human
ugggauuacaggcgugaaucaccg

SEQ ID NO: 769639 - RNA, 18 nt, Human
ugggauuauaggugugag

SEQ ID NO: 769640 - RNA, 22 nt, Human
ugggauuauaggugugagccac

SEQ ID NO: 769641 - RNA, 23 nt, Human
ugggauuauaggugugagccacc

SEQ ID NO: 769642 - RNA, 24 nt, Human
ugggauuauaggugugagccacca

SEQ ID NO: 769643 - RNA, 25 nt, Human
ugggauuauaggugugagccaccau

SEQ ID NO: 769644 - RNA, 21 nt, Human
ugggcuuguccugcacaugug

SEQ ID NO: 769645 - RNA, 18 nt, Human
uggggacccccugccuca

SEQ ID NO: 769646 - RNA, 21 nt, Human
uggggacccccugccucaggg

SEQ ID NO: 769647 - RNA, 20 nt, Human
ugggggcguggggaugccgg

SEQ ID NO: 769648 - RNA, 22 nt, Human
uggggggucuguuuggagcagg

SEQ ID NO: 769649 - RNA, 18 nt, Human
ugggguggggacucagaa

SEQ ID NO: 769650 - RNA, 21 nt, Human
uggugucauuucuguaacaau

SEQ ID NO: 769651 - RNA, 23 nt, Human
ugugaaaggcacucagugguaca

SEQ ID NO: 769652 - RNA, 20 nt, Human
uguggcucuccccacagggg

SEQ ID NO: 769653 - RNA, 22 nt, Human
uguuuuaaaggaaaccuacaga

SEQ ID NO: 769654 - RNA, 24 nt, Human
uuacuagagacaggguuucaccau

SEQ ID NO: 769655 - RNA, 20 nt, Human
uuagagccagcaagaugccc

SEQ ID NO: 769656 - RNA, 20 nt, Human
uucaaacacagagaaacaaa

SEQ ID NO: 769657 - RNA, 19 nt, Human
uugcccaggcuggaguguc

SEQ ID NO: 769658 - RNA, 18 nt, Human
uuggagcaggcugggcug

SEQ ID NO: 769659 - RNA, 22 nt, Human
uuggagcaggcugggcuggggg

SEQ ID NO: 769660 - RNA, 18 nt, Human
uuggccucccaaagugcu

SEQ ID NO: 769661 - RNA, 24 nt, Human
uuggggacccccugccucagggcc

SEQ ID NO: 769662 - RNA, 24 nt, Human
uuguagagauggggugucaccaua

SEQ ID NO: 769663 - RNA, 24 nt, Human
uuucaccauguugaccaggccggu

SEQ ID NO: 769664 - RNA, 24 nt, Human
uuuguagagauggggugucaccau

SEQ ID NO: 769665 - RNA, 24 nt, Human
uuuuuacuagagacaggguuucac

SEQ ID NO: 769666 - RNA, 24 nt, Human
uuuuuuguagagauggggugucac

SEQ ID NO: 769667 - RNA, 18 nt, Human
aacaaagggaccccaccc

SEQ ID NO: 769668 - RNA, 23 nt, Human
aacaaagggaccccacccuccca

SEQ ID NO: 769669 - RNA, 19 nt, Human
aagcagaaguggggcaaug

SEQ ID NO: 769670 - RNA, 19 nt, Human
aagugaugcuuuagucuca

SEQ ID NO: 769671 - RNA, 20 nt, Human
acacaaagcagaaguggggc

SEQ ID NO: 769672 - RNA, 22 nt, Human
acagcaggggagcugaggcagg

SEQ ID NO: 769673 - RNA, 22 nt, Human
acaggccccugccacccaccac

SEQ ID NO: 769674 - RNA, 18 nt, Human
acuccaaaagccagcccc

SEQ ID NO: 769675 - RNA, 21 nt, Human
acuggggugggggcagcagag

SEQ ID NO: 769676 - RNA, 22 nt, Human
acuggggugggggcagcagagc

SEQ ID NO: 769677 - RNA, 20 nt, Human
agacugccugcagcccuagg

SEQ ID NO: 769678 - RNA, 19 nt, Human
agauaggaagggggguggu

SEQ ID NO: 769679 - RNA, 20 nt, Human
agauaggaagggggguggug

SEQ ID NO: 769680 - RNA, 18 nt, Human
agccggcuccugggcccu

SEQ ID NO: 769681 - RNA, 18 nt, Human
agggggcugaaaggagga

SEQ ID NO: 769682 - RNA, 21 nt, Human
agggggcugaaaggaggaugg

SEQ ID NO: 769683 - RNA, 19 nt, Human
agugaaaugcagguaccca

SEQ ID NO: 769684 - RNA, 22 nt, Human
caacaaagggaccccacccucc

SEQ ID NO: 769685 - RNA, 23 nt, Human
caacaaagggaccccacccuccc

SEQ ID NO: 769686 - RNA, 25 nt, Human
caacaaagggaccccacccucccag

SEQ ID NO: 769687 - RNA, 22 nt, Human
caagagcacaaagcacagcacc

SEQ ID NO: 769688 - RNA, 18 nt, Human
caccccaggauuucccag

SEQ ID NO: 769689 - RNA, 20 nt, Human
cacccccuuucuucucuucc

SEQ ID NO: 769690 - RNA, 24 nt, Human
caccccgagccccuagccugugcu

SEQ ID NO: 769691 - RNA, 20 nt, Human
caccucaacacuccaaaagc

SEQ ID NO: 769692 - RNA, 23 nt, Human
caccucaacacuccaaaagccag

SEQ ID NO: 769693 - RNA, 19 nt, Human
cagauauucaccucaacac

SEQ ID NO: 769694 - RNA, 21 nt, Human
cagcagagcugagacccucca

SEQ ID NO: 769695 - RNA, 22 nt, Human
cagcagagcugagacccuccac

SEQ ID NO: 769696 - RNA, 18 nt, Human
cagcagccaagagcacaa

SEQ ID NO: 769697 - RNA, 23 nt, Human
cagcagccaagagcacaaagcac

SEQ ID NO: 769698 - RNA, 25 nt, Human
cagcaggaggaggagcacacgaacc

SEQ ID NO: 769699 - RNA, 19 nt, Human
cagccaagagcacaaagca

SEQ ID NO: 769700 - RNA, 20 nt, Human
cagccucccacacacagccc

SEQ ID NO: 769701 - RNA, 22 nt, Human
cagcucccggucacaggccccu

SEQ ID NO: 769702 - RNA, 20 nt, Human
cagcucuucccccaagaccu

SEQ ID NO: 769703 - RNA, 25 nt, Human
caggggcccacaagacucuccuaau

SEQ ID NO: 769704 - RNA, 23 nt, Human
cagucucugccagcaacugggag

SEQ ID NO: 769705 - RNA, 19 nt, Human
ccaaccacccugcaucuug

SEQ ID NO: 769706 - RNA, 18 nt, Human
ccacuccaggccuugcuu

SEQ ID NO: 769707 - RNA, 21 nt, Human
ccacugcagggccuggggguc

SEQ ID NO: 769708 - RNA, 21 nt, Human
cccaaccacccugcaucuugg

SEQ ID NO: 769709 - RNA, 20 nt, Human
cccaccacuaccgccaacac

SEQ ID NO: 769710 - RNA, 23 nt, Human
cccccaagaccuagaggguccaa

SEQ ID NO: 769711 - RNA, 24 nt, Human
ccccucagagauccaagaacccau

SEQ ID NO: 769712 - RNA, 24 nt, Human
cccucagagauccaagaacccauu

SEQ ID NO: 769713 - RNA, 20 nt, Human
cccuguggcuggcuccagag

SEQ ID NO: 769714 - RNA, 24 nt, Human
ccggcuccugggcccucccugcag

SEQ ID NO: 769715 - RNA, 18 nt, Human
ccuaccaccugccccugg

SEQ ID NO: 769716 - RNA, 21 nt, Human
ccucccagccggcuccugggc

SEQ ID NO: 769717 - RNA, 19 nt, Human
ccugcagccucugagcagc

SEQ ID NO: 769718 - RNA, 19 nt, Human
ccugcucccugcccuggaa

SEQ ID NO: 769719 - RNA, 23 nt, Human
ccugggcccucccugcagccucu

SEQ ID NO: 769720 - RNA, 20 nt, Human
ccuguggcuggcuccagagc

SEQ ID NO: 769721 - RNA, 20 nt, Human
cgagccccuagccugugcua

SEQ ID NO: 769722 - RNA, 23 nt, Human
cggccccuugucuucagcccucc

SEQ ID NO: 769723 - RNA, 19 nt, Human
cggcuccugggcccucccu

SEQ ID NO: 769724 - RNA, 23 nt, Human
cuagguggggccugcucccugcc

SEQ ID NO: 769725 - RNA, 22 nt, Human
cuccaccccgagccccuagccc

SEQ ID NO: 769726 - RNA, 18 nt, Human
cuccagagcugccugguc

SEQ ID NO: 769727 - RNA, 21 nt, Human
cuccagagcugccuggucccc

SEQ ID NO: 769728 - RNA, 21 nt, Human
cucccagccggcuccugggcc

SEQ ID NO: 769729 - RNA, 25 nt, Human
cucccggucacaggccccugccuug

SEQ ID NO: 769730 - RNA, 25 nt, Human
cuccuggccccaaccacccugcauc

SEQ ID NO: 769731 - RNA, 19 nt, Human
cucuuggugcgccauucac

SEQ ID NO: 769732 - RNA, 19 nt, Human
cugcggaaggcaaaaggag

SEQ ID NO: 769733 - RNA, 18 nt, Human
cuguuccuuccccucaga

SEQ ID NO: 769734 - RNA, 18 nt, Human
gaccccacccucccagcc

SEQ ID NO: 769735 - RNA, 19 nt, Human
gacgggggccucugacuga

SEQ ID NO: 769736 - RNA, 25 nt, Human
gagacacaaagcagaaguggggcaa

SEQ ID NO: 769737 - RNA, 18 nt, Human
gagacccuccaccccgag

SEQ ID NO: 769738 - RNA, 25 nt, Human
gagacccuccaccccgagccccuag

SEQ ID NO: 769739 - RNA, 22 nt, Human
gagccccuagccugugcuaucc

SEQ ID NO: 769740 - RNA, 24 nt, Human
gcaacaaagggaccccacccuccc

SEQ ID NO: 769741 - RNA, 21 nt, Human
gcacccccuuucuucucuucc

SEQ ID NO: 769742 - RNA, 23 nt, Human
gccacagcuugggaagcuaggcu

SEQ ID NO: 769743 - RNA, 22 nt, Human
gcccugagcuauucaugauccc

SEQ ID NO: 769744 - RNA, 22 nt, Human
gccggccccuugucuucagccc

SEQ ID NO: 769745 - RNA, 22 nt, Human
gccugagggggaggagcugagg

SEQ ID NO: 769746 - RNA, 21 nt, Human
gcugagacccuccaccccgag

SEQ ID NO: 769747 - RNA, 23 nt, Human
ggaagcuaggcuaguacuggggu

SEQ ID NO: 769748 - RNA, 21 nt, Human
ggaaggcaaaaggagggacgg

SEQ ID NO: 769749 - RNA, 23 nt, Human
ggagacagcaggggagcugaggc

SEQ ID NO: 769750 - RNA, 18 nt, Human
ggcacaggccagacugcc

SEQ ID NO: 769751 - RNA, 18 nt, Human
ggccccaaccacccugca

SEQ ID NO: 769752 - RNA, 19 nt, Human
ggccucuuuugcuguuccu

SEQ ID NO: 769753 - RNA, 23 nt, Human
ggcugccagggagggcaggagag

SEQ ID NO: 769754 - RNA, 20 nt, Human
ggcuggugggcacaggagac

SEQ ID NO: 769755 - RNA, 20 nt, Human
gggcaggagagaucuggagu

SEQ ID NO: 769756 - RNA, 18 nt, Human
gggccucugacugagcag

SEQ ID NO: 769757 - RNA, 19 nt, Human
gggcuggugggcacaggag

SEQ ID NO: 769758 - RNA, 19 nt, Human
ggggagcugaggcaggaag

SEQ ID NO: 769759 - RNA, 21 nt, Human
ggggccugcucccugcccugg

SEQ ID NO: 769760 - RNA, 20 nt, Human
gguccuggcugccagggagg

SEQ ID NO: 769761 - RNA, 19 nt, Human
uaaagggggcugaaaggag

SEQ ID NO: 769762 - RNA, 23 nt, Human
uaagccacagcuugggaagcuag

SEQ ID NO: 769763 - RNA, 19 nt, Human
uacccagcucuucccccaa

SEQ ID NO: 769764 - RNA, 21 nt, Human
uagccugugcuauccucccag

SEQ ID NO: 769765 - RNA, 19 nt, Human
uaguacuggggugggggca

SEQ ID NO: 769766 - RNA, 23 nt, Human
uauuaagugaugcuuuagucuca

SEQ ID NO: 769767 - RNA, 22 nt, Human
ucccagccggcuccugggcccu

SEQ ID NO: 769768 - RNA, 21 nt, Human
ucccugcagccucugagcagc

SEQ ID NO: 769769 - RNA, 19 nt, Human
ucccugcccuggaagcuag

SEQ ID NO: 769770 - RNA, 20 nt, Human
uccggccguagccgcagccg

SEQ ID NO: 769771 - RNA, 18 nt, Human
uccuggccccaaccaccc

SEQ ID NO: 769772 - RNA, 23 nt, Human
uccugggcccucccugcagccuc

SEQ ID NO: 769773 - RNA, 18 nt, Human
uccuugaggaggggaagg

SEQ ID NO: 769774 - RNA, 19 nt, Human
uccuugaggaggggaaggg

SEQ ID NO: 769775 - RNA, 24 nt, Human
ucuccggccguagccgcagccgcc

SEQ ID NO: 769776 - RNA, 24 nt, Human
ucugccagcaacugggaguggggu

SEQ ID NO: 769777 - RNA, 23 nt, Human
ugagacccuccaccccgagcccc

SEQ ID NO: 769778 - RNA, 18 nt, Human
ugaggaagaagggccucu

SEQ ID NO: 769779 - RNA, 19 nt, Human
ugaggaagaagggccucuu

SEQ ID NO: 769780 - RNA, 25 nt, Human
ugaggaggggaagggucugcagaga

SEQ ID NO: 769781 - RNA, 21 nt, Human
ugaggcaauccuggcugcagc

SEQ ID NO: 769782 - RNA, 20 nt, Human
ugaggcaggaaggcuggccc

SEQ ID NO: 769783 - RNA, 28 nt, Human
ugaucucugcucccagauauucaccucc

SEQ ID NO: 769784 - RNA, 20 nt, Human
ugcagccccugcagcaggag

SEQ ID NO: 769785 - RNA, 19 nt, Human
ugcccggguccgggggcag

SEQ ID NO: 769786 - RNA, 20 nt, Human
ugcccggguccgggggcagc

SEQ ID NO: 769787 - RNA, 24 nt, Human
ugccugcagcccuagguggggccu

SEQ ID NO: 769788 - RNA, 19 nt, Human
ugcgugcaugagucugcgu

SEQ ID NO: 769789 - RNA, 20 nt, Human
ugcuucucuaacagccccug

SEQ ID NO: 769790 - RNA, 19 nt, Human
uggcacaggccagacugcc

SEQ ID NO: 769791 - RNA, 23 nt, Human
uggcuccagagcugccugguccc

SEQ ID NO: 769792 - RNA, 20 nt, Human
uggcuggcuccagagcugcc

SEQ ID NO: 769793 - RNA, 21 nt, Human
uggggugggggcagcagagcu

SEQ ID NO: 769794 - RNA, 22 nt, Human
uggggugggggcagcagagcug

SEQ ID NO: 769795 - RNA, 20 nt, Human
ugggugauccuugaggaggg

SEQ ID NO: 769796 - RNA, 24 nt, Human
ugguggggugacuacaggugcugg

SEQ ID NO: 769797 - RNA, 19 nt, Human
uguggcuggcuccagagcu

SEQ ID NO: 769798 - RNA, 23 nt, Human
ugugguggggugacuacaggugc

SEQ ID NO: 769799 - RNA, 25 nt, Human
ugugugcgugcaugagucugcgugu

SEQ ID NO: 769800 - RNA, 23 nt, Human
uguuccuuccccucagagaucca

SEQ ID NO: 769801 - RNA, 25 nt, Human
uucccccaagaccuagaggguccaa

SEQ ID NO: 769802 - RNA, 21 nt, Human
aaaaaagaaaaaagaaaagaa

SEQ ID NO: 769803 - RNA, 20 nt, Human
aaaaaagaaaauacguggga

SEQ ID NO: 769804 - RNA, 24 nt, Human
aaaaaagaaaauacuuaaaaacac

SEQ ID NO: 769805 - RNA, 25 nt, Human
aaaaaagaaaauacuuaaaaacaca

SEQ ID NO: 769806 - RNA, 18 nt, Human
aaaaacacacaauggcgg

SEQ ID NO: 769807 - RNA, 21 nt, Human
aaaaaccuguuaaaacaugcu

SEQ ID NO: 769808 - RNA, 18 nt, Human
aaaaagaaaaaagaaaag

SEQ ID NO: 769809 - RNA, 27 nt, Human
aaauaagcggcaccagccucgcucccu

SEQ ID NO: 769810 - RNA, 21 nt, Human
aagaaaaaccuguuaaaacau

SEQ ID NO: 769811 - RNA, 24 nt, Human
aagaaaauacuuaaaaacacacaa

SEQ ID NO: 769812 - RNA, 23 nt, Human
acagcccagaguuaucauggcca

SEQ ID NO: 769813 - RNA, 23 nt, Human
acugccucgcucuuucucaggcu

SEQ ID NO: 769814 - RNA, 22 nt, Human
agaaaaaagaaaagaaaaaccu

SEQ ID NO: 769815 - RNA, 27 nt, Human
agacaggaggugauagaggagggaccc

SEQ ID NO: 769816 - RNA, 20 nt, Human
agcacaccagcaucugaaac

SEQ ID NO: 769817 - RNA, 20 nt, Human
aggccgagacaaggccacac

SEQ ID NO: 769818 - RNA, 20 nt, Human
aguaguaagcuuccccaagu

SEQ ID NO: 769819 - RNA, 19 nt, Human
aucagcaaauaaacucuaa

SEQ ID NO: 769820 - RNA, 19 nt, Human
aucucuagcacauuccugg

SEQ ID NO: 769821 - RNA, 23 nt, Human
augaaagccaaauauccauaaua

SEQ ID NO: 769822 - RNA, 23 nt, Human
caaaauaagcggcaccagccucg

SEQ ID NO: 769823 - RNA, 21 nt, Human
caaacaauacugacaaaaaag

SEQ ID NO: 769824 - RNA, 18 nt, Human
caaggccgagacaaggcc

SEQ ID NO: 769825 - RNA, 20 nt, Human
cacucuccacagagcaacag

SEQ ID NO: 769826 - RNA, 18 nt, Human
cagaguuaucauggccaa

SEQ ID NO: 769827 - RNA, 24 nt, Human
cagugacaaaucggcagaaguucc

SEQ ID NO: 769828 - RNA, 20 nt, Human
cauggagccccccagcuucu

SEQ ID NO: 769829 - RNA, 22 nt, Human
ccaaacaauacugacaaaaaag

SEQ ID NO: 769830 - RNA, 23 nt, Human
ccaaacaauacugacaaaaaaga

SEQ ID NO: 769831 - RNA, 26 nt, Human
ccaaacaauacugacaaaaaagaaaa

SEQ ID NO: 769832 - RNA, 19 nt, Human
ccaacuaggauccgcucca

SEQ ID NO: 769833 - RNA, 21 nt, Human
ccaggaaaucccaaaugaaga

SEQ ID NO: 769834 - RNA, 22 nt, Human
ccaggcuuccaucauccaugcc

SEQ ID NO: 769835 - RNA, 21 nt, Human
cccccggcccuggcccggucc

SEQ ID NO: 769836 - RNA, 19 nt, Human
ccccgcaacccgggcgccc

SEQ ID NO: 769837 - RNA, 20 nt, Human
ccccgcaacccgggcgcccg

SEQ ID NO: 769838 - RNA, 27 nt, Human
ccccggcccuggcccgguccccucggc

SEQ ID NO: 769839 - RNA, 19 nt, Human
cccgcacgcagugcacagg

SEQ ID NO: 769840 - RNA, 25 nt, Human
cccgggcgcccgcccguccgcccuc

SEQ ID NO: 769841 - RNA, 22 nt, Human
cccucaggccgccccucccgcc

SEQ ID NO: 769842 - RNA, 19 nt, Human
ccgcaacccgggcgcccgc

SEQ ID NO: 769843 - RNA, 19 nt, Human
ccgccgcuaccgcggcucg

SEQ ID NO: 769844 - RNA, 26 nt, Human
ccucagggacuacuucauucuucucu

SEQ ID NO: 769845 - RNA, 18 nt, Human
ccucccgccgccgccgcu

SEQ ID NO: 769846 - RNA, 23 nt, Human
cgcccccggcccuggcccggucc

SEQ ID NO: 769847 - RNA, 21 nt, Human
cgccccgcaccgcauccugga

SEQ ID NO: 769848 - RNA, 21 nt, Human
cgcgcagcacaccugugugug

SEQ ID NO: 769849 - RNA, 20 nt, Human
cgcuccaggcuuccaucauc

SEQ ID NO: 769850 - RNA, 22 nt, Human
cucccgccgccgccgcuaccgc

SEQ ID NO: 769851 - RNA, 21 nt, Human
cugaaacuugccauccuugcc

SEQ ID NO: 769852 - RNA, 18 nt, Human
cugcugcuggcuggugcu

SEQ ID NO: 769853 - RNA, 19 nt, Human
cuggugcugggaggucaga

SEQ ID NO: 769854 - RNA, 23 nt, Human
gagcccccgcaacccgggcgccc

SEQ ID NO: 769855 - RNA, 18 nt, Human
gagggcaccagcuucaaa

SEQ ID NO: 769856 - RNA, 20 nt, Human
gaucagaaugugguacggga

SEQ ID NO: 769857 - RNA, 21 nt, Human
gaucaggauaguugugaagac

SEQ ID NO: 769858 - RNA, 18 nt, Human
gcagucagccagcagggc

SEQ ID NO: 769859 - RNA, 18 nt, Human
gcccaguguucagcuugg

SEQ ID NO: 769860 - RNA, 19 nt, Human
gcccgguccccucggccgc

SEQ ID NO: 769861 - RNA, 24 nt, Human
gcccucaggccgccccucccgccg

SEQ ID NO: 769862 - RNA, 23 nt, Human
gccggggccgagaccggccgggc

SEQ ID NO: 769863 - RNA, 25 nt, Human
gcgcagcacaccuguguguggccua

SEQ ID NO: 769864 - RNA, 20 nt, Human
gcucccucucccuaucacuc

SEQ ID NO: 769865 - RNA, 21 nt, Human
ggagggcaccagcuucaaaau

SEQ ID NO: 769866 - RNA, 21 nt, Human
ggcaccgagcccccgcaaccc

SEQ ID NO: 769867 - RNA, 19 nt, Human
gggcagucagccagcaggg

SEQ ID NO: 769868 - RNA, 20 nt, Human
gggccgagaccggccgggca

SEQ ID NO: 769869 - RNA, 19 nt, Human
ggucagaugucgaugcccu

SEQ ID NO: 769870 - RNA, 23 nt, Human
guccgcccucaggccgccccucc

SEQ ID NO: 769871 - RNA, 18 nt, Human
gucuccagcgugauguug

SEQ ID NO: 769872 - RNA, 18 nt, Human
uaaaaagcaaaucagcaa

SEQ ID NO: 769873 - RNA, 23 nt, Human
uaagcuuccccaaguucuggcac

SEQ ID NO: 769874 - RNA, 23 nt, Human
uagcacauuccugggaaucugca

SEQ ID NO: 769875 - RNA, 23 nt, Human
ucaaaauaagcggcaccagcccu

SEQ ID NO: 769876 - RNA, 26 nt, Human
ucacaaugccauugacugccuccccg

SEQ ID NO: 769877 - RNA, 19 nt, Human
ucaguccagggaggccuca

SEQ ID NO: 769878 - RNA, 23 nt, Human
ucagugccacauccucauacaug

SEQ ID NO: 769879 - RNA, 19 nt, Human
uccacagagcaacagcguc

SEQ ID NO: 769880 - RNA, 20 nt, Human
uccagugguguaggagguga

SEQ ID NO: 769881 - RNA, 24 nt, Human
ucccaaaugaagacauuuuugaag

SEQ ID NO: 769882 - RNA, 20 nt, Human
ucccgccgccgccgcuaccg

SEQ ID NO: 769883 - RNA, 23 nt, Human
ucccuuugauuggagcauggggc

SEQ ID NO: 769884 - RNA, 19 nt, Human
uccugcugcuggcuggugc

SEQ ID NO: 769885 - RNA, 20 nt, Human
uccugcugcuggcuggugcu

SEQ ID NO: 769886 - RNA, 18 nt, Human
uccuggaucugcccagug

SEQ ID NO: 769887 - RNA, 20 nt, Human
ucucauccaccucaggcugg

SEQ ID NO: 769888 - RNA, 21 nt, Human
ucugcccaguguucagcuugg

SEQ ID NO: 769889 - RNA, 22 nt, Human
ugaaagacaggaggugauagag

SEQ ID NO: 769890 - RNA, 20 nt, Human
ugaagacauuuuugaagagc

SEQ ID NO: 769891 - RNA, 22 nt, Human
ugacggggcgggggggcaccgg

SEQ ID NO: 769892 - RNA, 22 nt, Human
ugaucagugccacauccucaua

SEQ ID NO: 769893 - RNA, 25 nt, Human
ugccacauccucauacaugugugca

SEQ ID NO: 769894 - RNA, 21 nt, Human
ugccauccuugccgauguucc

SEQ ID NO: 769895 - RNA, 19 nt, Human
uggacuccuggaucugccc

SEQ ID NO: 769896 - RNA, 21 nt, Human
uggacuccuggaucugcccag

SEQ ID NO: 769897 - RNA, 22 nt, Human
uggcucccaagcacaccagcau

SEQ ID NO: 769898 - RNA, 20 nt, Human
ugggugagaugguaacaagc

SEQ ID NO: 769899 - RNA, 22 nt, Human
ugggugagaugguaacaagccu

SEQ ID NO: 769900 - RNA, 26 nt, Human
uguugauugcagugacaaaucggcag

SEQ ID NO: 769901 - RNA, 18 nt, Human
uuccagcauguggccacg

SEQ ID NO: 769902 - RNA, 21 nt, Human
uucccgcgcagcacaccugug

SEQ ID NO: 769903 - RNA, 19 nt, Human
uuccucagggacuacuuca

SEQ ID NO: 769904 - RNA, 18 nt, Human
uuccugggaaucugcaug

SEQ ID NO: 769905 - RNA, 18 nt, Human
uugaaagacaggagguga

SEQ ID NO: 769906 - RNA, 18 nt, Human
aaaaaaaacgaaaagguc

SEQ ID NO: 769907 - RNA, 21 nt, Human
aaaaaaggucacgaggucaga

SEQ ID NO: 769908 - RNA, 19 nt, Human
aggcauacaagguagaaau

SEQ ID NO: 769909 - RNA, 21 nt, Human
caaaaaaggucacgaggucag

SEQ ID NO: 769910 - RNA, 18 nt, Human
caaguugaaaaaaaaaac

SEQ ID NO: 769911 - RNA, 19 nt, Human
cucugucggccauuuuggc

SEQ ID NO: 769912 - RNA, 19 nt, Human
gaaaaaaaaaacgaaaagg

SEQ ID NO: 769913 - RNA, 22 nt, Human
uaaauccagcaaauugaggcau

SEQ ID NO: 769914 - RNA, 22 nt, Human
uaucuguuuuuuuguauuuuaa

SEQ ID NO: 769915 - RNA, 19 nt, Human
ucaaguuagugcugcugcu

SEQ ID NO: 769916 - RNA, 23 nt, Human
ucacgaggucagaguugaaaguu

SEQ ID NO: 769917 - RNA, 23 nt, Human
ucucucacacacucucccucuug

SEQ ID NO: 769918 - RNA, 22 nt, Human
ucuuuuugucuaucuguuuuuu

SEQ ID NO: 769919 - RNA, 22 nt, Human
uuuaaauauucagaaaccagca

SEQ ID NO: 769920 - RNA, 24 nt, Human
uuuuugucuaucuguuuuuuugua

SEQ ID NO: 769921 - RNA, 19 nt, Human
aacugaaaaaucaaaucug

SEQ ID NO: 769922 - RNA, 21 nt, Human
acuguucacccuccccauguc

SEQ ID NO: 769923 - RNA, 18 nt, Human
cacucugcagccuuccuc

SEQ ID NO: 769924 - RNA, 23 nt, Human
cagccccgucaagcagagggagg

SEQ ID NO: 769925 - RNA, 19 nt, Human
caggucacuucugcggccu

SEQ ID NO: 769926 - RNA, 20 nt, Human
caugucuguuuccuccguca

SEQ ID NO: 769927 - RNA, 23 nt, Human
ccaccccccacagccuccaaccu

SEQ ID NO: 769928 - RNA, 26 nt, Human
ccagcaaccuucucccuccguucucc

SEQ ID NO: 769929 - RNA, 19 nt, Human
ccccacagccuccaaccua

SEQ ID NO: 769930 - RNA, 19 nt, Human
cccccgcugccggcuccuc

SEQ ID NO: 769931 - RNA, 18 nt, Human
cccggccaccccccacag

SEQ ID NO: 769932 - RNA, 20 nt, Human
ccgcccccgcugccggcucc

SEQ ID NO: 769933 - RNA, 23 nt, Human
ccggccagcaaccuucucccucc

SEQ ID NO: 769934 - RNA, 28 nt, Human
ccucacaguuacagccgcccccgcugcc

SEQ ID NO: 769935 - RNA, 24 nt, Human
cgccacucugcagccuuccucaca

SEQ ID NO: 769936 - RNA, 21 nt, Human
cucccuccguucuccagcagc

SEQ ID NO: 769937 - RNA, 19 nt, Human
cugcagccuuccucacagu

SEQ ID NO: 769938 - RNA, 24 nt, Human
cugcagccuuccucacaguuacag

SEQ ID NO: 769939 - RNA, 19 nt, Human
gacuacggacgcccuagac

SEQ ID NO: 769940 - RNA, 19 nt, Human
gacuacggacgcccuagac

SEQ ID NO: 769941 - RNA, 24 nt, Human
gagcuggcgcccggccacccccca

SEQ ID NO: 769942 - RNA, 22 nt, Human
gggccucgccaucuuggcaccg

SEQ ID NO: 769943 - RNA, 19 nt, Human
gggcuucacggaggccggg

SEQ ID NO: 769944 - RNA, 19 nt, Human
ucaaaucugcuuuucacac

SEQ ID NO: 769945 - RNA, 18 nt, Human
ucacugcugcugcacugu

SEQ ID NO: 769946 - RNA, 19 nt, Human
uccuccgucacugcugcug

SEQ ID NO: 769947 - RNA, 20 nt, Human
uccuccgucacugcugcugc

SEQ ID NO: 769948 - RNA, 22 nt, Human
uccuccgucacugcugcugcac

SEQ ID NO: 769949 - RNA, 23 nt, Human
ucucuagaccuggggcuucacgg

SEQ ID NO: 769950 - RNA, 19 nt, Human
ucugcagccuuccucacag

SEQ ID NO: 769951 - RNA, 23 nt, Human
ucuguuuccuccgucacugcugc

SEQ ID NO: 769952 - RNA, 21 nt, Human
ugcggccugggagcuggcgcc

SEQ ID NO: 769953 - RNA, 19 nt, Human
uggcaccgccccgcggcaa

SEQ ID NO: 769954 - RNA, 18 nt, Human
uggcgcccggccaccccc

SEQ ID NO: 769955 - RNA, 21 nt, Human
ugucuguuuccuccgucacug

SEQ ID NO: 769956 - RNA, 28 nt, Human
uuccuccgucacugcugcugcacuguaa

SEQ ID NO: 769957 - RNA, 24 nt, Human
uugggccucgccaucuuggcaccg

SEQ ID NO: 769958 - RNA, 20 nt, Human
aaaauaggguuccauuaaaa

SEQ ID NO: 769959 - RNA, 24 nt, Human
aaauagaccuaugacacccagagu

SEQ ID NO: 769960 - RNA, 21 nt, Human
acaaaaacuugccgcauugaa

SEQ ID NO: 769961 - RNA, 20 nt, Human
acuauaaacaugaagaccgu

SEQ ID NO: 769962 - RNA, 23 nt, Human
agugguaguggucuccuuuaugu

SEQ ID NO: 769963 - RNA, 21 nt, Human
aguuguaggguuugcaaauuu

SEQ ID NO: 769964 - RNA, 22 nt, Human
auuccacaaaccgucuccaucc

SEQ ID NO: 769965 - RNA, 22 nt, Human
caaugggcugcaauauuugcaa

SEQ ID NO: 769966 - RNA, 18 nt, Human
cacuuuauguaaaagggu

SEQ ID NO: 769967 - RNA, 20 nt, Human
caggaauuucuaccccagug

SEQ ID NO: 769968 - RNA, 19 nt, Human
ccccacgaggcggcccaga

SEQ ID NO: 769969 - RNA, 18 nt, Human
ccccggggucgccgccgg

SEQ ID NO: 769970 - RNA, 19 nt, Human
ccccggggucgccgccggg

SEQ ID NO: 769971 - RNA, 21 nt, Human
ccccggggucgccgccgggcg

SEQ ID NO: 769972 - RNA, 22 nt, Human
ccgggcgcccccucccucccca

SEQ ID NO: 769973 - RNA, 24 nt, Human
ccuuuauguacauaaugcagaagu

SEQ ID NO: 769974 - RNA, 18 nt, Human
cgcccccucccuccccac

SEQ ID NO: 769975 - RNA, 20 nt, Human
cuuaaaauagaccuaugaca

SEQ ID NO: 769976 - RNA, 21 nt, Human
cuuaaaauuccacaaaccguc

SEQ ID NO: 769977 - RNA, 18 nt, Human
cuuaaccaggaaaauguu

SEQ ID NO: 769978 - RNA, 23 nt, Human
cuuaacggucacgcauaugaaac

SEQ ID NO: 769979 - RNA, 24 nt, Human
gcaaaaguuuacuacaaugagcac

SEQ ID NO: 769980 - RNA, 24 nt, Human
uaaaaggguacagguagaaaagua

SEQ ID NO: 769981 - RNA, 23 nt, Human
uaaacaugaagaccguacuuauc

SEQ ID NO: 769982 - RNA, 24 nt, Human
uaauaaaagaucuuucugaaauuu

SEQ ID NO: 769983 - RNA, 21 nt, Human
uaauuuauuuuaacuucauuu

SEQ ID NO: 769984 - RNA, 22 nt, Human
uaccuucaaaucuacaaagcaa

SEQ ID NO: 769985 - RNA, 22 nt, Human
uaggcaggaaaaaaagcguguu

SEQ ID NO: 769986 - RNA, 22 nt, Human
uauaaaauaggguuccauuaaa

SEQ ID NO: 769987 - RNA, 21 nt, Human
uauguacauaaugcagaagug

SEQ ID NO: 769988 - RNA, 21 nt, Human
uccacaaaccgucuccaucca

SEQ ID NO: 769989 - RNA, 22 nt, Human
ugcuauuugaaaaaagcucugu

SEQ ID NO: 769990 - RNA, 19 nt, Human
uggacuauaaacaugaaga

SEQ ID NO: 769991 - RNA, 18 nt, Human
uugcaaauuuggacuaua

SEQ ID NO: 769992 - RNA, 20 nt, Human
uuguguuuuaggcaggaaaa

SEQ ID NO: 769993 - RNA, 21 nt, Human
uuuaacuuuuuuauaugaaua

SEQ ID NO: 769994 - RNA, 23 nt, Human
aaaaaaagaaaaaaacccccaaa

SEQ ID NO: 769995 - RNA, 21 nt, Human
aaaaaacaaaaccccagaaaa

SEQ ID NO: 769996 - RNA, 21 nt, Human
aaaaaggcauuauuugagacu

SEQ ID NO: 769997 - RNA, 31 nt, Human
aaacauucuagaauaacaucauuaaaaacag

SEQ ID NO: 769998 - RNA, 23 nt, Human
aaaccuccugccacaccccuuaa

SEQ ID NO: 769999 - RNA, 18 nt, Human
aacacugcucacuuugau

SEQ ID NO: 770000 - RNA, 22 nt, Human
aacucaucgaguccaaaaccuc

SEQ ID NO: 770001 - RNA, 21 nt, Human
aagaaaaaaacccccaaauca

SEQ ID NO: 770002 - RNA, 22 nt, Human
aaggcuccucuauccagcacca

SEQ ID NO: 770003 - RNA, 21 nt, Human
aauauggcuguuaauuucugu

SEQ ID NO: 770004 - RNA, 24 nt, Human
acaaaaccccagaaaauugcaaag

SEQ ID NO: 770005 - RNA, 20 nt, Human
acaccccuuaaaaccccaga

SEQ ID NO: 770006 - RNA, 19 nt, Human
agaaccucugcucucugcu

SEQ ID NO: 770007 - RNA, 23 nt, Human
agaccacaaccaaaacacagcac

SEQ ID NO: 770008 - RNA, 25 nt, Human
agaccacaaccaaaacacagcacca

SEQ ID NO: 770009 - RNA, 19 nt, Human
agcaaaaaaaccgcaucug

SEQ ID NO: 770010 - RNA, 20 nt, Human
agcaaaaaaaccgcaucuga

SEQ ID NO: 770011 - RNA, 24 nt, Human
agcaccaguuaucuucaguucuuu

SEQ ID NO: 770012 - RNA, 19 nt, Human
aggagggucggucaguguu

SEQ ID NO: 770013 - RNA, 19 nt, Human
agggagcaaaaaaaccgca

SEQ ID NO: 770014 - RNA, 23 nt, Human
agguaaaaaacaaaaccccagaa

SEQ ID NO: 770015 - RNA, 26 nt, Human
aguggcacaguucuagguacucacug

SEQ ID NO: 770016 - RNA, 19 nt, Human
auauauguauauauauaua

SEQ ID NO: 770017 - RNA, 21 nt, Human
auaugcacucaaaaaaauggg

SEQ ID NO: 770018 - RNA, 19 nt, Human
auauguauauauauauaua

SEQ ID NO: 770019 - RNA, 20 nt, Human
auauguauauauauauauau

SEQ ID NO: 770020 - RNA, 18 nt, Human
auguauauauauauauau

SEQ ID NO: 770021 - RNA, 19 nt, Human
auguauauauauauauaua

SEQ ID NO: 770022 - RNA, 20 nt, Human
auguauauauauauauauaa

SEQ ID NO: 770023 - RNA, 25 nt, Human
auucaaauuauauauauauauguau

SEQ ID NO: 770024 - RNA, 23 nt, Human
caaaaccccagaaaauugcaaag

SEQ ID NO: 770025 - RNA, 25 nt, Human
caaaaccccagaaaauugcaaaggg

SEQ ID NO: 770026 - RNA, 21 nt, Human
caaaguugacagcacagcuaa

SEQ ID NO: 770027 - RNA, 20 nt, Human
caacacaguaaaccgggaua

SEQ ID NO: 770028 - RNA, 23 nt, Human
caaugccaacucaacacaguaaa

SEQ ID NO: 770029 - RNA, 21 nt, Human
cacacuccauuuaaaaaaaag

SEQ ID NO: 770030 - RNA, 21 nt, Human
cacagcaccauuucaaauaga

SEQ ID NO: 770031 - RNA, 20 nt, Human
cacaggccauuuugccccuu

SEQ ID NO: 770032 - RNA, 25 nt, Human
caccccuuaaaaccccaguccuuaa

SEQ ID NO: 770033 - RNA, 18 nt, Human
cacuacuacguaucauaa

SEQ ID NO: 770034 - RNA, 19 nt, Human
cagcacagcuaaaguuucc

SEQ ID NO: 770035 - RNA, 20 nt, Human
caguggcaggggcugacugg

SEQ ID NO: 770036 - RNA, 23 nt, Human
cauaagggagcaaaaaaaccgca

SEQ ID NO: 770037 - RNA, 18 nt, Human
caucacacuguucaggcu

SEQ ID NO: 770038 - RNA, 21 nt, Human
ccaaaaccuccugccacaccc

SEQ ID NO: 770039 - RNA, 25 nt, Human
ccacaaccaaaacacagcaccauuu

SEQ ID NO: 770040 - RNA, 18 nt, Human
ccagcauuaucugacuua

SEQ ID NO: 770041 - RNA, 24 nt, Human
ccagcauuaucugacuuaauucuc

SEQ ID NO: 770042 - RNA, 21 nt, Human
cccccaaaucaugggauucau

SEQ ID NO: 770043 - RNA, 23 nt, Human
cccuuaaaaccccaguccuuaag

SEQ ID NO: 770044 - RNA, 18 nt, Human
ccgccccccucccaaucc

SEQ ID NO: 770045 - RNA, 23 nt, Human
ccuccaagccuacaaaugccaua

SEQ ID NO: 770046 - RNA, 24 nt, Human
ccuccugccacaccccuuaaaacc

SEQ ID NO: 770047 - RNA, 18 nt, Human
ccuguacaaauggaaaaa

SEQ ID NO: 770048 - RNA, 23 nt, Human
cuccugccacaccccuuaaaacc

SEQ ID NO: 770049 - RNA, 23 nt, Human
cugguauaaaaaaaaaaagaaaa

SEQ ID NO: 770050 - RNA, 24 nt, Human
cugguauaaaaaaaaaaagaaaaa

SEQ ID NO: 770051 - RNA, 21 nt, Human
cuuaaaaccccaguccuuaag

SEQ ID NO: 770052 - RNA, 24 nt, Human
gaaaaaaacccccaaaucauggga

SEQ ID NO: 770053 - RNA, 18 nt, Human
gaagaaggggacaucagu

SEQ ID NO: 770054 - RNA, 22 nt, Human
gcaagcugccauaauaaaaaau

SEQ ID NO: 770055 - RNA, 18 nt, Human
gcacucaaaaaaaugggu

SEQ ID NO: 770056 - RNA, 20 nt, Human
ggcuuuucuucuacuuuuuc

SEQ ID NO: 770057 - RNA, 24 nt, Human
gggaaaaagguaaaaaacaaaacc

SEQ ID NO: 770058 - RNA, 20 nt, Human
gguaaaaaacaaaaccccag

SEQ ID NO: 770059 - RNA, 23 nt, Human
gguggaaacucaucgaguccaaa

SEQ ID NO: 770060 - RNA, 21 nt, Human
guauauauauauauauauuua

SEQ ID NO: 770061 - RNA, 24 nt, Human
guuugcucuguugcuguucagaga

SEQ ID NO: 770062 - RNA, 21 nt, Human
uaaacaccagcuaaaaacugg

SEQ ID NO: 770063 - RNA, 23 nt, Human
uaauaaaaaauaaggcuccucua

SEQ ID NO: 770064 - RNA, 20 nt, Human
uacaagcuugcaaagccucg

SEQ ID NO: 770065 - RNA, 18 nt, Human
uaccuccaagccuacaaa

SEQ ID NO: 770066 - RNA, 23 nt, Human
uagagaauacuuuauuaguuucu

SEQ ID NO: 770067 - RNA, 22 nt, Human
uagcaguauguuaugcaucaau

SEQ ID NO: 770068 - RNA, 22 nt, Human
uagccuuuaagauuuuguuucu

SEQ ID NO: 770069 - RNA, 21 nt, Human
uaguagcugggaccaucacac

SEQ ID NO: 770070 - RNA, 21 nt, Human
uaguagguacaagcuugcaaa

SEQ ID NO: 770071 - RNA, 23 nt, Human
uauaaaaaaaaaaagaaaaaaac

SEQ ID NO: 770072 - RNA, 19 nt, Human
uauaaaaagaccaauagca

SEQ ID NO: 770073 - RNA, 18 nt, Human
uauauauauauguauaua

SEQ ID NO: 770074 - RNA, 20 nt, Human
uauauauauguauauauaua

SEQ ID NO: 770075 - RNA, 23 nt, Human
uauauauauguauauauauauau

SEQ ID NO: 770076 - RNA, 18 nt, Human
uauauguauauauauaua

SEQ ID NO: 770077 - RNA, 18 nt, Human
uauccgaagaacauaagg

SEQ ID NO: 770078 - RNA, 19 nt, Human
uaucugacuuaauucucca

SEQ ID NO: 770079 - RNA, 18 nt, Human
uauguauauauauauaua

SEQ ID NO: 770080 - RNA, 19 nt, Human
uauguauauauauauauau

SEQ ID NO: 770081 - RNA, 24 nt, Human
uauguauauauauauauauauuua

SEQ ID NO: 770082 - RNA, 21 nt, Human
ucacugguacagcagcugugu

SEQ ID NO: 770083 - RNA, 22 nt, Human
uccaaaaccuccugccacaccc

SEQ ID NO: 770084 - RNA, 21 nt, Human
ucccgccccccucccaauccc

SEQ ID NO: 770085 - RNA, 19 nt, Human
ucgguggaaacucaucgag

SEQ ID NO: 770086 - RNA, 24 nt, Human
ucuauccagcaccaguuaucuuca

SEQ ID NO: 770087 - RNA, 22 nt, Human
ucuccauguuuucccgcccccc

SEQ ID NO: 770088 - RNA, 19 nt, Human
ucugauaaagcacggucac

SEQ ID NO: 770089 - RNA, 22 nt, Human
ucugauaaagcacggucacuac

SEQ ID NO: 770090 - RNA, 18 nt, Human
ugaaucaucaucuggaaa

SEQ ID NO: 770091 - RNA, 18 nt, Human
ugacuggaacugcuucug

SEQ ID NO: 770092 - RNA, 24 nt, Human
ugauaaagcacggucacuacuacg

SEQ ID NO: 770093 - RNA, 22 nt, Human
ugcacucaaaaaaaugggugca

SEQ ID NO: 770094 - RNA, 19 nt, Human
ugccacaccccuuaaaacc

SEQ ID NO: 770095 - RNA, 23 nt, Human
ugccuggggugcaaacuguguag

SEQ ID NO: 770096 - RNA, 22 nt, Human
ugggugcauacauuuauauaua

SEQ ID NO: 770097 - RNA, 18 nt, Human
uguauauauauauauaua

SEQ ID NO: 770098 - RNA, 20 nt, Human
uguuuucccgccccccuccc

SEQ ID NO: 770099 - RNA, 23 nt, Human
uuaaaaacagcucugauaaagca

SEQ ID NO: 770100 - RNA, 21 nt, Human
uuaucugacuuaauucuccau

SEQ ID NO: 770101 - RNA, 20 nt, Human
uucaaauuauauauauauau

SEQ ID NO: 770102 - RNA, 23 nt, Human
uucaaauuauauauauauaugua

SEQ ID NO: 770103 - RNA, 20 nt, Human
uucacagagguaugauacag

SEQ ID NO: 770104 - RNA, 21 nt, Human
uuccagguucugcagucaucu

SEQ ID NO: 770105 - RNA, 19 nt, Human
uugauucuacuuuuccagc

SEQ ID NO: 770106 - RNA, 20 nt, Human
uugcucuguugcuguucaga

SEQ ID NO: 770107 - RNA, 21 nt, Human
uugguggcuauggagggugca

SEQ ID NO: 770108 - RNA, 23 nt, Human
uuuccagguucugcagucaucug

SEQ ID NO: 770109 - RNA, 20 nt, Human
uuucuagaccaauauggcug

SEQ ID NO: 770110 - RNA, 23 nt, Human
uuuucccgccccccucccaaucc

SEQ ID NO: 770111 - RNA, 19 nt, Human
aaaccaaugugaaucccau

SEQ ID NO: 770112 - RNA, 23 nt, Human
aaauauccacauccccaaauccu

SEQ ID NO: 770113 - RNA, 19 nt, Human
aaccaaugugaaucccaug

SEQ ID NO: 770114 - RNA, 22 nt, Human
aaccaaugugaaucccauggaa

SEQ ID NO: 770115 - RNA, 20 nt, Human
aagacuuuggguucuccaug

SEQ ID NO: 770116 - RNA, 21 nt, Human
aaggcccccuggagauggggg

SEQ ID NO: 770117 - RNA, 19 nt, Human
aaggggcaggccugggcca

SEQ ID NO: 770118 - RNA, 20 nt, Human
aaugaaugaacaaaaacugc

SEQ ID NO: 770119 - RNA, 18 nt, Human
acaugggaaaaaugaggu

SEQ ID NO: 770120 - RNA, 22 nt, Human
accacaggaaaucauugguaac

SEQ ID NO: 770121 - RNA, 24 nt, Human
accagacucagcccucacagcagc

SEQ ID NO: 770122 - RNA, 22 nt, Human
acugggcagggggcgggggagg

SEQ ID NO: 770123 - RNA, 19 nt, Human
agaacacaggcgcugggcc

SEQ ID NO: 770124 - RNA, 19 nt, Human
agacccccaacccugcccc

SEQ ID NO: 770125 - RNA, 21 nt, Human
agacccccaacccugccccac

SEQ ID NO: 770126 - RNA, 19 nt, Human
agagggagaggagauuggg

SEQ ID NO: 770127 - RNA, 20 nt, Human
agcaggaaaaggagggaccu

SEQ ID NO: 770128 - RNA, 22 nt, Human
agcaggaaaaggagggaccuga

SEQ ID NO: 770129 - RNA, 19 nt, Human
agcggaccccuggcacuca

SEQ ID NO: 770130 - RNA, 21 nt, Human
aggaggggggauucagcccug

SEQ ID NO: 770131 - RNA, 25 nt, Human
aggcaggagcgaaggggcaggccug

SEQ ID NO: 770132 - RNA, 20 nt, Human
aggcccucagggagcgggag

SEQ ID NO: 770133 - RNA, 19 nt, Human
aggcgccaggggcugccug

SEQ ID NO: 770134 - RNA, 25 nt, Human
agggaccugagggugcacaggaggg

SEQ ID NO: 770135 - RNA, 23 nt, Human
agggggcgggggagggggggggu

SEQ ID NO: 770136 - RNA, 21 nt, Human
agugcauggcaguuaucagcu

SEQ ID NO: 770137 - RNA, 21 nt, Human
agugccagcaggaaaaggagg

SEQ ID NO: 770138 - RNA, 19 nt, Human
aucagcaacaauauuaaaa

SEQ ID NO: 770139 - RNA, 21 nt, Human
caaauccuacacgugauuuug

SEQ ID NO: 770140 - RNA, 24 nt, Human
caacccuuuggccgcccggccaca

SEQ ID NO: 770141 - RNA, 22 nt, Human
caaggucggcggaucacaaaca

SEQ ID NO: 770142 - RNA, 23 nt, Human
cacacgcaugcaugcaggccggc

SEQ ID NO: 770143 - RNA, 20 nt, Human
cacagccuuccuggucccca

SEQ ID NO: 770144 - RNA, 26 nt, Human
cacagccuuccugguccccauccucc

SEQ ID NO: 770145 - RNA, 18 nt, Human
caccgggaacacagggcu

SEQ ID NO: 770146 - RNA, 20 nt, Human
cacguugacuccuuuguucc

SEQ ID NO: 770147 - RNA, 19 nt, Human
cacugcuauaaauauagaa

SEQ ID NO: 770148 - RNA, 19 nt, Human
cagaacacaggcgcugggc

SEQ ID NO: 770149 - RNA, 19 nt, Human
cagaacuuggaggacaggg

SEQ ID NO: 770150 - RNA, 26 nt, Human
cagacccccaacccugccccacgacc

SEQ ID NO: 770151 - RNA, 20 nt, Human
cagcaggaaaaggagggacc

SEQ ID NO: 770152 - RNA, 22 nt, Human
cagcaugaccgugcucggcccc

SEQ ID NO: 770153 - RNA, 18 nt, Human
cagccaacacagagccag

SEQ ID NO: 770154 - RNA, 18 nt, Human
cagccagggcugggggaa

SEQ ID NO: 770155 - RNA, 24 nt, Human
cagcugccugaguucacuguucgg

SEQ ID NO: 770156 - RNA, 18 nt, Human
cagggccacugcgaggag

SEQ ID NO: 770157 - RNA, 22 nt, Human
cauccccaaauccuacacguga

SEQ ID NO: 770158 - RNA, 21 nt, Human
ccaaaauuacauauauuucua

SEQ ID NO: 770159 - RNA, 21 nt, Human
ccaacccugccccacgaccgc

SEQ ID NO: 770160 - RNA, 24 nt, Human
ccaaggaucuccaccggccccacu

SEQ ID NO: 770161 - RNA, 21 nt, Human
ccagacccuacagcggccucc

SEQ ID NO: 770162 - RNA, 23 nt, Human
ccagagcuucaggcaggguucuc

SEQ ID NO: 770163 - RNA, 21 nt, Human
ccaggggcugccugcuaggau

SEQ ID NO: 770164 - RNA, 19 nt, Human
ccauggaauggaaaaaacc

SEQ ID NO: 770165 - RNA, 26 nt, Human
cccaacccugccccacgaccgccggc

SEQ ID NO: 770166 - RNA, 23 nt, Human
cccacacgcaguucguucagggc

SEQ ID NO: 770167 - RNA, 23 nt, Human
cccacugagggagcggaccccug

SEQ ID NO: 770168 - RNA, 28 nt, Human
cccagcccggcacacgcaugcaugcagu

SEQ ID NO: 770169 - RNA, 20 nt, Human
cccauggaauggaaaaaacc

SEQ ID NO: 770170 - RNA, 18 nt, Human
ccccagcuggguauagga

SEQ ID NO: 770171 - RNA, 20 nt, Human
cccccggguccgggggcagc

SEQ ID NO: 770172 - RNA, 21 nt, Human
cccccuggagauggggguccc

SEQ ID NO: 770173 - RNA, 21 nt, Human
ccccggguccgggggcagccc

SEQ ID NO: 770174 - RNA, 23 nt, Human
ccccguauggcccaagccccuca

SEQ ID NO: 770175 - RNA, 24 nt, Human
ccccuagggaaccagacucagccc

SEQ ID NO: 770176 - RNA, 21 nt, Human
ccggccccacacgcaguucgu

SEQ ID NO: 770177 - RNA, 23 nt, Human
ccgggggcagcccggcuccuucc

SEQ ID NO: 770178 - RNA, 23 nt, Human
ccuacagcggccuccuccagaac

SEQ ID NO: 770179 - RNA, 22 nt, Human
ccucacagcagccaacacagag

SEQ ID NO: 770180 - RNA, 18 nt, Human
ccuccccacccccggguc

SEQ ID NO: 770181 - RNA, 19 nt, Human
ccuccccauccucccuggg

SEQ ID NO: 770182 - RNA, 23 nt, Human
ccugcuaggaugugccggcccca

SEQ ID NO: 770183 - RNA, 22 nt, Human
cggaacaaugugcuccccuccc

SEQ ID NO: 770184 - RNA, 23 nt, Human
cggcacacgcaugcaugcaggcc

SEQ ID NO: 770185 - RNA, 24 nt, Human
cgggaacacagggcucccucuccc

SEQ ID NO: 770186 - RNA, 23 nt, Human
cucacaacccuuuggccgcccgg

SEQ ID NO: 770187 - RNA, 23 nt, Human
cuccccuccccacccccgggucc

SEQ ID NO: 770188 - RNA, 19 nt, Human
cuccucgcugggcugaccc

SEQ ID NO: 770189 - RNA, 19 nt, Human
cuccugggacuuccuugga

SEQ ID NO: 770190 - RNA, 23 nt, Human
cucggcccaggcccucagggagc

SEQ ID NO: 770191 - RNA, 24 nt, Human
cugaaaucagcaacaauauuaaaa

SEQ ID NO: 770192 - RNA, 22 nt, Human
cuggcaccagcucuggaaaugc

SEQ ID NO: 770193 - RNA, 18 nt, Human
cuguuuccgccugcccca

SEQ ID NO: 770194 - RNA, 18 nt, Human
gaaccagacucagcccuc

SEQ ID NO: 770195 - RNA, 22 nt, Human
gacagggaucaggcugggaagg

SEQ ID NO: 770196 - RNA, 23 nt, Human
gacucacaacccuuuggccgccc

SEQ ID NO: 770197 - RNA, 22 nt, Human
gacucagcccucacagcagcca

SEQ ID NO: 770198 - RNA, 20 nt, Human
gcagcccggcuccuuccggg

SEQ ID NO: 770199 - RNA, 21 nt, Human
gcagcggaauguaacaaaccc

SEQ ID NO: 770200 - RNA, 24 nt, Human
gcagcuccguggcgggcgggcggg

SEQ ID NO: 770201 - RNA, 22 nt, Human
gcagggggcgggggaggggggg

SEQ ID NO: 770202 - RNA, 23 nt, Human
gcagggggcgggggagggggggg

SEQ ID NO: 770203 - RNA, 18 nt, Human
gcagggggguggaggggc

SEQ ID NO: 770204 - RNA, 18 nt, Human
gcaguucguucagggcag

SEQ ID NO: 770205 - RNA, 18 nt, Human
gccaccugggcagagggc

SEQ ID NO: 770206 - RNA, 22 nt, Human
gcccugaaaagcgucggguccc

SEQ ID NO: 770207 - RNA, 20 nt, Human
gcggaacaaugugcuccccu

SEQ ID NO: 770208 - RNA, 19 nt, Human
gcggaauguaacaaacccc

SEQ ID NO: 770209 - RNA, 18 nt, Human
gcucagccagacccuaca

SEQ ID NO: 770210 - RNA, 18 nt, Human
gcuccccuccccaccccc

SEQ ID NO: 770211 - RNA, 20 nt, Human
gcuccguggcgggcgggcgg

SEQ ID NO: 770212 - RNA, 22 nt, Human
gcugccugaguucacuguucgg

SEQ ID NO: 770213 - RNA, 19 nt, Human
ggaaccagacucagcccuc

SEQ ID NO: 770214 - RNA, 19 nt, Human
ggacaagaaaggauuggga

SEQ ID NO: 770215 - RNA, 20 nt, Human
ggacagggaucaggcuggga

SEQ ID NO: 770216 - RNA, 23 nt, Human
ggaccccuggcacucagugccag

SEQ ID NO: 770217 - RNA, 26 nt, Human
ggagaggagauugggcacgggucugg

SEQ ID NO: 770218 - RNA, 24 nt, Human
ggagccagggccacugcgaggaga

SEQ ID NO: 770219 - RNA, 23 nt, Human
ggagcgaaggggcaggccugggc

SEQ ID NO: 770220 - RNA, 18 nt, Human
ggcagcaaccccagcugg

SEQ ID NO: 770221 - RNA, 22 nt, Human
ggcagggggcgggggagggggg

SEQ ID NO: 770222 - RNA, 18 nt, Human
ggcaggguucucccgggc

SEQ ID NO: 770223 - RNA, 18 nt, Human
ggcccagccagggcuggg

SEQ ID NO: 770224 - RNA, 21 nt, Human
ggcgggaggugggagccaggg

SEQ ID NO: 770225 - RNA, 18 nt, Human
ggcgggcgggcaggcaga

SEQ ID NO: 770226 - RNA, 19 nt, Human
ggcgggcgggcaggcagac

SEQ ID NO: 770227 - RNA, 19 nt, Human
ggcgggcgggcgggcaggc

SEQ ID NO: 770228 - RNA, 18 nt, Human
ggcgggggaggggggggg

SEQ ID NO: 770229 - RNA, 20 nt, Human
gggcagcaaccccagcuggg

SEQ ID NO: 770230 - RNA, 20 nt, Human
gggcagggggguggaggggc

SEQ ID NO: 770231 - RNA, 23 nt, Human
gggcagggggguggaggggcugg

SEQ ID NO: 770232 - RNA, 19 nt, Human
gggcgggggaggggggggg

SEQ ID NO: 770233 - RNA, 19 nt, Human
ggggucgggaagggagggg

SEQ ID NO: 770234 - RNA, 22 nt, Human
ggggucgggaagggagggguug

SEQ ID NO: 770235 - RNA, 19 nt, Human
gugugcaguacagugcaug

SEQ ID NO: 770236 - RNA, 23 nt, Human
uaagagcucccgcccugcggaac

SEQ ID NO: 770237 - RNA, 24 nt, Human
uacauauauuucuacauauauaug

SEQ ID NO: 770238 - RNA, 23 nt, Human
uagcaaggucggcggaucacaaa

SEQ ID NO: 770239 - RNA, 20 nt, Human
uaggccagaaguugguaaau

SEQ ID NO: 770240 - RNA, 24 nt, Human
ucagccagacccuacagcggccuc

SEQ ID NO: 770241 - RNA, 25 nt, Human
ucagggacacucaggcagcuccgug

SEQ ID NO: 770242 - RNA, 22 nt, Human
ucagggcagcaaccccagcugg

SEQ ID NO: 770243 - RNA, 21 nt, Human
ucagucucucucggcccaggc

SEQ ID NO: 770244 - RNA, 18 nt, Human
ucaugccuaggccagaag

SEQ ID NO: 770245 - RNA, 19 nt, Human
uccagagcuucaggcaggg

SEQ ID NO: 770246 - RNA, 22 nt, Human
uccccaaauccuacacgugauu

SEQ ID NO: 770247 - RNA, 23 nt, Human
uccccauccucccugggccccac

SEQ ID NO: 770248 - RNA, 23 nt, Human
uccccguauggcccaagccccuc

SEQ ID NO: 770249 - RNA, 18 nt, Human
uccccuagggaaccagac

SEQ ID NO: 770250 - RNA, 23 nt, Human
ucccugggccccacccacaaguu

SEQ ID NO: 770251 - RNA, 28 nt, Human
ucccugggccccacccacaaguuuccag

SEQ ID NO: 770252 - RNA, 20 nt, Human
uccgccugccccaggaacug

SEQ ID NO: 770253 - RNA, 24 nt, Human
uccgggggcagcccggcuccuucc

SEQ ID NO: 770254 - RNA, 19 nt, Human
uccuccagaacuuggagga

SEQ ID NO: 770255 - RNA, 21 nt, Human
uccuggggccaaggaucucca

SEQ ID NO: 770256 - RNA, 21 nt, Human
uccugguccccauccuccugg

SEQ ID NO: 770257 - RNA, 21 nt, Human
ucgcugggcugacccuggcac

SEQ ID NO: 770258 - RNA, 20 nt, Human
ucggggucaaggagggggga

SEQ ID NO: 770259 - RNA, 23 nt, Human
ucggggucaaggaggggggauuc

SEQ ID NO: 770260 - RNA, 23 nt, Human
ucucucuuuguuguccgcccgac

SEQ ID NO: 770261 - RNA, 20 nt, Human
ucuggauccuuuaagagcuc

SEQ ID NO: 770262 - RNA, 23 nt, Human
ucuuaaauauccacauccccaaa

SEQ ID NO: 770263 - RNA, 22 nt, Human
ucuuuggagcuuggcaaaugca

SEQ ID NO: 770264 - RNA, 19 nt, Human
ugagcacagacccccaacc

SEQ ID NO: 770265 - RNA, 21 nt, Human
ugagcacagacccccaacccu

SEQ ID NO: 770266 - RNA, 22 nt, Human
ugaggcagcaggcgccaggggc

SEQ ID NO: 770267 - RNA, 21 nt, Human
ugaggguggggcuggaauguu

SEQ ID NO: 770268 - RNA, 21 nt, Human
ugaggguggggcuggaauguu

SEQ ID NO: 770269 - RNA, 18 nt, Human
ugcaaggaacagggcccc

SEQ ID NO: 770270 - RNA, 21 nt, Human
ugccagcaggaaaaggaggga

SEQ ID NO: 770271 - RNA, 18 nt, Human
ugccuaggccagaaguug

SEQ ID NO: 770272 - RNA, 19 nt, Human
uggagauggggguccacag

SEQ ID NO: 770273 - RNA, 24 nt, Human
uggagggagaaaugcccugaaaag

SEQ ID NO: 770274 - RNA, 25 nt, Human
uggcaagcccccaccacaggaaauc

SEQ ID NO: 770275 - RNA, 21 nt, Human
uggcacucagugccagcagga

SEQ ID NO: 770276 - RNA, 20 nt, Human
uggcgggcgggcgggcaggc

SEQ ID NO: 770277 - RNA, 22 nt, Human
uggcgggcgggcgggcaggcag

SEQ ID NO: 770278 - RNA, 18 nt, Human
ugggaccagggaaagugg

SEQ ID NO: 770279 - RNA, 23 nt, Human
ugggacgcccuccagccugaggg

SEQ ID NO: 770280 - RNA, 19 nt, Human
ugggagccagggccacugc

SEQ ID NO: 770281 - RNA, 21 nt, Human
ugggaguugggcccuggcugg

SEQ ID NO: 770282 - RNA, 18 nt, Human
ugggcagagggcacgcca

SEQ ID NO: 770283 - RNA, 23 nt, Human
ugggcagggggcgggggaggggg

SEQ ID NO: 770284 - RNA, 26 nt, Human
ugggcagggggcgggggagggggggg

SEQ ID NO: 770285 - RNA, 21 nt, Human
ugggcccagccagggcugggg

SEQ ID NO: 770286 - RNA, 18 nt, Human
ugggcugacccuggcacc

SEQ ID NO: 770287 - RNA, 20 nt, Human
uggggccaaggaucuccacc

SEQ ID NO: 770288 - RNA, 22 nt, Human
uggggcucaggaaauggcucgu

SEQ ID NO: 770289 - RNA, 22 nt, Human
uggggcuggaauguuguuccug

SEQ ID NO: 770290 - RNA, 20 nt, Human
ugggggugggaccaggcuga

SEQ ID NO: 770291 - RNA, 22 nt, Human
ugugcaaggaacagggccccca

SEQ ID NO: 770292 - RNA, 21 nt, Human
ugugcuccccuccccaccccc

SEQ ID NO: 770293 - RNA, 24 nt, Human
uguguuucccccccaauagcugcu

SEQ ID NO: 770294 - RNA, 18 nt, Human
uguuaaaaauuucaauca

SEQ ID NO: 770295 - RNA, 18 nt, Human
uuaaaaaaaguacaaauc

SEQ ID NO: 770296 - RNA, 23 nt, Human
uucagcccuggggcucaggaaau

SEQ ID NO: 770297 - RNA, 19 nt, Human
uucaugcaaaacaacagag

SEQ ID NO: 770298 - RNA, 20 nt, Human
uucaugcaaaacaacagagg

SEQ ID NO: 770299 - RNA, 19 nt, Human
uuccagagcuucaggcagg

SEQ ID NO: 770300 - RNA, 19 nt, Human
uugguaaauaagagaguaa

SEQ ID NO: 770301 - RNA, 21 nt, Human
uuuccagagcuucaggcaggg

SEQ ID NO: 770302 - RNA, 20 nt, Human
uuuggagcuuggcaaaugca

SEQ ID NO: 770303 - RNA, 26 nt, Human
aaaaaaaaaaaaccaaaacaauaaac

SEQ ID NO: 770304 - RNA, 21 nt, Human
aaaaaacaaaaaaccagccug

SEQ ID NO: 770305 - RNA, 21 nt, Human
aaaaacaucuacuugaccccc

SEQ ID NO: 770306 - RNA, 19 nt, Human
aaaaaccaaaacaauaaac

SEQ ID NO: 770307 - RNA, 22 nt, Human
aaaacaaaacagguuuauugca

SEQ ID NO: 770308 - RNA, 22 nt, Human
aaacaaauuauagcucagagau

SEQ ID NO: 770309 - RNA, 20 nt, Human
aaacaggaaaaacauaaaca

SEQ ID NO: 770310 - RNA, 23 nt, Human
aaaccaaaacaauaaacaggaaa

SEQ ID NO: 770311 - RNA, 20 nt, Human
aaagaacccaucuagcaugu

SEQ ID NO: 770312 - RNA, 27 nt, Human
aaaugcaaaaaaaaaaaaaaaaccaaa

SEQ ID NO: 770313 - RNA, 23 nt, Human
aaaugcugagaagccccugagcu

SEQ ID NO: 770314 - RNA, 20 nt, Human
aacaaaaaacaaaaaaccag

SEQ ID NO: 770315 - RNA, 27 nt, Human
aacaucuacuugacccccuuuuaugac

SEQ ID NO: 770316 - RNA, 20 nt, Human
acaaaaaaccagccuggaga

SEQ ID NO: 770317 - RNA, 26 nt, Human
acaaaaaaccagccuggagaucuaca

SEQ ID NO: 770318 - RNA, 20 nt, Human
acaagaguuccucucuaaac

SEQ ID NO: 770319 - RNA, 18 nt, Human
acagaccaggggcugacc

SEQ ID NO: 770320 - RNA, 22 nt, Human
acagcucauccaaaugacaaau

SEQ ID NO: 770321 - RNA, 23 nt, Human
acaggaaaaacauaaacacugug

SEQ ID NO: 770322 - RNA, 24 nt, Human
accuccaugagaagucuuggaaac

SEQ ID NO: 770323 - RNA, 23 nt, Human
acggugcaauaauuuauugguau

SEQ ID NO: 770324 - RNA, 22 nt, Human
agaaaauaaaccagcucuccac

SEQ ID NO: 770325 - RNA, 19 nt, Human
agaauaaauagucccccuu

SEQ ID NO: 770326 - RNA, 18 nt, Human
agcaggcaacagaggccu

SEQ ID NO: 770327 - RNA, 25 nt, Human
aggaaaaacauaaacacugugcuac

SEQ ID NO: 770328 - RNA, 21 nt, Human
aggcaacagaggccugauguc

SEQ ID NO: 770329 - RNA, 22 nt, Human
auaaacaggaaaaacauaaaca

SEQ ID NO: 770330 - RNA, 30 nt, Human
augcaaaaaaaaaaaaaaaaccaaaacaag

SEQ ID NO: 770331 - RNA, 23 nt, Human
augcaaaaaaaaaaaaaaaaccc

SEQ ID NO: 770332 - RNA, 26 nt, Human
caacaaaaaacaaaaaaccagccugg

SEQ ID NO: 770333 - RNA, 22 nt, Human
caacagcuuugcguuuucuaag

SEQ ID NO: 770334 - RNA, 22 nt, Human
caccuaaugaugaacuuaucuc

SEQ ID NO: 770335 - RNA, 21 nt, Human
cagaaaauaaaccagcucucc

SEQ ID NO: 770336 - RNA, 19 nt, Human
caggaaaaacauaaacacu

SEQ ID NO: 770337 - RNA, 22 nt, Human
caguggcugaggaaauuucugc

SEQ ID NO: 770338 - RNA, 24 nt, Human
caguugccaggggacacucucagu

SEQ ID NO: 770339 - RNA, 21 nt, Human
cauaacuuccaagguacacag

SEQ ID NO: 770340 - RNA, 18 nt, Human
caucaaucuauuaggagu

SEQ ID NO: 770341 - RNA, 24 nt, Human
cauguaauaaauaaucgcuagcca

SEQ ID NO: 770342 - RNA, 23 nt, Human
cauuacaaccccauauucuuuug

SEQ ID NO: 770343 - RNA, 18 nt, Human
ccacaagaguuccucucu

SEQ ID NO: 770344 - RNA, 18 nt, Human
cccccuuuccccagucuu

SEQ ID NO: 770345 - RNA, 23 nt, Human
ccccgcguccucucaagcgccgg

SEQ ID NO: 770346 - RNA, 23 nt, Human
ccucucaagcgccgggaugagga

SEQ ID NO: 770347 - RNA, 25 nt, Human
cucuccacaagaguuccucucuaaa

SEQ ID NO: 770348 - RNA, 26 nt, Human
cuguaaaacagcaaacaccuccauga

SEQ ID NO: 770349 - RNA, 21 nt, Human
cuugcugaucacagaccaggg

SEQ ID NO: 770350 - RNA, 21 nt, Human
gaagugggcagggcauaaucu

SEQ ID NO: 770351 - RNA, 25 nt, Human
gacuuuggaaaugaugacugaaaua

SEQ ID NO: 770352 - RNA, 19 nt, Human
gagaauggaggagaguagg

SEQ ID NO: 770353 - RNA, 20 nt, Human
gagaucuacauugugaugcu

SEQ ID NO: 770354 - RNA, 22 nt, Human
gaguagguauucauugaagugg

SEQ ID NO: 770355 - RNA, 22 nt, Human
gcaaaaaaaaaaaaaaaaccaa

SEQ ID NO: 770356 - RNA, 24 nt, Human
gcaaaaaaaaaaaaaaaaccaaaa

SEQ ID NO: 770357 - RNA, 22 nt, Human
gcagaauaaauagucccccuuu

SEQ ID NO: 770358 - RNA, 21 nt, Human
gccccugagcuugggauuuug

SEQ ID NO: 770359 - RNA, 23 nt, Human
gccccugagcuugggauuuuguu

SEQ ID NO: 770360 - RNA, 18 nt, Human
ggugagugauccggaagc

SEQ ID NO: 770361 - RNA, 27 nt, Human
guaaaacagcaaacaccuccaugagaa

SEQ ID NO: 770362 - RNA, 22 nt, Human
guaaaugcugagaagccccuga

SEQ ID NO: 770363 - RNA, 19 nt, Human
gucccccuuuccccagucu

SEQ ID NO: 770364 - RNA, 20 nt, Human
gucccccuuuccccagucuu

SEQ ID NO: 770365 - RNA, 24 nt, Human
guguauccauagucuacauucaca

SEQ ID NO: 770366 - RNA, 26 nt, Human
uaaaacagcaaacaccuccaugagaa

SEQ ID NO: 770367 - RNA, 18 nt, Human
uaaaaccuuuuuugagcu

SEQ ID NO: 770368 - RNA, 24 nt, Human
uaaaccagcucuccacaagaguuc

SEQ ID NO: 770369 - RNA, 19 nt, Human
uaaauagucccccuuuccc

SEQ ID NO: 770370 - RNA, 27 nt, Human
uaaggagaacuugccagcaagggugag

SEQ ID NO: 770371 - RNA, 23 nt, Human
uaaggcagaauaaauaguccccc

SEQ ID NO: 770372 - RNA, 28 nt, Human
uaauuccuagacauucuaaaacaaaaca

SEQ ID NO: 770373 - RNA, 22 nt, Human
uacacagaaucuaauacuaacg

SEQ ID NO: 770374 - RNA, 24 nt, Human
uaccuccaaagguaaguaacacaa

SEQ ID NO: 770375 - RNA, 23 nt, Human
uagacauucuaaaacaaaacagg

SEQ ID NO: 770376 - RNA, 23 nt, Human
uagcuaauucccaaagaagagaa

SEQ ID NO: 770377 - RNA, 23 nt, Human
uagcugauauugcaagguuuugc

SEQ ID NO: 770378 - RNA, 22 nt, Human
uagucccccuuuccccagucuu

SEQ ID NO: 770379 - RNA, 26 nt, Human
uauuugccauugauuuaaggcagaau

SEQ ID NO: 770380 - RNA, 22 nt, Human
uccaaagguaaguaacacaaau

SEQ ID NO: 770381 - RNA, 20 nt, Human
ucccaaagaagagaauaaca

SEQ ID NO: 770382 - RNA, 19 nt, Human
uccccagucuuaacaacaa

SEQ ID NO: 770383 - RNA, 24 nt, Human
uccccagucuuaacaacaaaaaac

SEQ ID NO: 770384 - RNA, 21 nt, Human
ucccggaguguaaaucuagcu

SEQ ID NO: 770385 - RNA, 23 nt, Human
ucuguaaacauaaaguguuuaau

SEQ ID NO: 770386 - RNA, 20 nt, Human
ugacuccuuucuuggccagc

SEQ ID NO: 770387 - RNA, 23 nt, Human
ugagcagugcucacaccuaauga

SEQ ID NO: 770388 - RNA, 19 nt, Human
ugauggagaauggaggaga

SEQ ID NO: 770389 - RNA, 22 nt, Human
ugauggagaauggaggagagua

SEQ ID NO: 770390 - RNA, 18 nt, Human
ugcaaaaaaaaaaaaaaa

SEQ ID NO: 770391 - RNA, 24 nt, Human
ugcaaaugcaaaaaaaaaaaaaaa

SEQ ID NO: 770392 - RNA, 26 nt, Human
ugcaaaugcaaaaaaaaaaaaaaaac

SEQ ID NO: 770393 - RNA, 21 nt, Human
ugcuuacauaacagaaaaaca

SEQ ID NO: 770394 - RNA, 23 nt, Human
ugcuuuauuugaugaaccagccu

SEQ ID NO: 770395 - RNA, 18 nt, Human
uggaaacuuggaagugac

SEQ ID NO: 770396 - RNA, 26 nt, Human
ugggauuuuguuaagcaguugccagg

SEQ ID NO: 770397 - RNA, 22 nt, Human
ugggcagggcauaaucugugcu

SEQ ID NO: 770398 - RNA, 19 nt, Human
uggugagugauccggaagc

SEQ ID NO: 770399 - RNA, 18 nt, Human
uguaaaacagcaaacacc

SEQ ID NO: 770400 - RNA, 25 nt, Human
uguaaaacagcaaacaccuccauga

SEQ ID NO: 770401 - RNA, 19 nt, Human
ugucuugcacuuucugcag

SEQ ID NO: 770402 - RNA, 22 nt, Human
ugugauguuuaguuucugaaau

SEQ ID NO: 770403 - RNA, 23 nt, Human
ugugcaaaugcaaaaaaaaaaaa

SEQ ID NO: 770404 - RNA, 19 nt, Human
uguuuaguuucugaaaugc

SEQ ID NO: 770405 - RNA, 19 nt, Human
uuaagcaguugccagggga

SEQ ID NO: 770406 - RNA, 21 nt, Human
uuagaagaccgugugucucaa

SEQ ID NO: 770407 - RNA, 18 nt, Human
uucagaagagccuuucag

SEQ ID NO: 770408 - RNA, 26 nt, Human
uugaagugggcagggcauaaucugug

SEQ ID NO: 770409 - RNA, 24 nt, Human
aaaaauaaaggaguggccgguacc

SEQ ID NO: 770410 - RNA, 22 nt, Human
aacaugcucaaaaacuuuagaa

SEQ ID NO: 770411 - RNA, 24 nt, Human
auuugauuuuuauaucaccagagu

SEQ ID NO: 770412 - RNA, 22 nt, Human
cuaauaauuagagaaaacaugc

SEQ ID NO: 770413 - RNA, 20 nt, Human
cuuauaagucuucuaauuuc

SEQ ID NO: 770414 - RNA, 23 nt, Human
uauaucaccagagucagaaacuu

SEQ ID NO: 770415 - RNA, 24 nt, Human
ucagcuaggaaaggaaaacugaag

SEQ ID NO: 770416 - RNA, 19 nt, Human
ucuuguuauuuccccucca

SEQ ID NO: 770417 - RNA, 21 nt, Human
ugaacaaaucaucagcuagga

SEQ ID NO: 770418 - RNA, 25 nt, Human
ugaacaaaucaucagcuaggaaagg

SEQ ID NO: 770419 - RNA, 23 nt, Human
ugaagcuaggguuuccuuauaag

SEQ ID NO: 770420 - RNA, 18 nt, Human
uggauuuucuguugauca

SEQ ID NO: 770421 - RNA, 25 nt, Human
uucuugaauaaugauuaagugaaca

SEQ ID NO: 770422 - RNA, 26 nt, Human
uucuuguuauuuccccuccaagauuu

SEQ ID NO: 770423 - RNA, 21 nt, Human
uugauuuuuauaucaccagag

SEQ ID NO: 770424 - RNA, 23 nt, Human
uuucuauaugugauauauuaaua

SEQ ID NO: 770425 - RNA, 20 nt, Human
aaaaaagaaaaagcaauuaa

SEQ ID NO: 770426 - RNA, 24 nt, Human
aaaacacuccaguguaauaaaaca

SEQ ID NO: 770427 - RNA, 18 nt, Human
aaaacagacacaaucaua

SEQ ID NO: 770428 - RNA, 21 nt, Human
aagcaauuaaugaccucccca

SEQ ID NO: 770429 - RNA, 22 nt, Human
aauaaaacagacacaaucauaa

SEQ ID NO: 770430 - RNA, 24 nt, Human
aauuuguucacagaucaaauuacu

SEQ ID NO: 770431 - RNA, 27 nt, Human
caaaaaaauucacaguuauucugcaga

SEQ ID NO: 770432 - RNA, 24 nt, Human
caacaagauuuuuuucuaaaaguu

SEQ ID NO: 770433 - RNA, 20 nt, Human
cacauuaucaucaacaagau

SEQ ID NO: 770434 - RNA, 22 nt, Human
cacuguacacagaaugauggaa

SEQ ID NO: 770435 - RNA, 20 nt, Human
ccagagaggaauaggcugcu

SEQ ID NO: 770436 - RNA, 25 nt, Human
ccccaaaaucacauuaucaucaaca

SEQ ID NO: 770437 - RNA, 18 nt, Human
gacacaaucauaauuugu

SEQ ID NO: 770438 - RNA, 19 nt, Human
gacacaaucauaauuuguu

SEQ ID NO: 770439 - RNA, 19 nt, Human
uacuucacuguacacagaa

SEQ ID NO: 770440 - RNA, 21 nt, Human
uacuucacuguacacagaaug

SEQ ID NO: 770441 - RNA, 24 nt, Human
uauauacaaacagguauuuauaua

SEQ ID NO: 770442 - RNA, 24 nt, Human
uccccaaaaucacauuaucaucaa

SEQ ID NO: 770443 - RNA, 18 nt, Human
ucuacauuuaaaaaagaa

SEQ ID NO: 770444 - RNA, 22 nt, Human
uuaaugaccuccccaaaaucac

SEQ ID NO: 770445 - RNA, 24 nt, Human
uuacucaagcuauauacaaacagg

SEQ ID NO: 770446 - RNA, 22 nt, Human
uuagugguauacaaucauauca

SEQ ID NO: 770447 - RNA, 22 nt, Human
uuccagagaggaauaggcugcu

SEQ ID NO: 770448 - RNA, 19 nt, Human
uuuuaaagaugcaggaauu

SEQ ID NO: 770449 - RNA, 21 nt, Human
aaagcccccuccucacuccuc

SEQ ID NO: 770450 - RNA, 18 nt, Human
aaagccgaaagugcuccc

SEQ ID NO: 770451 - RNA, 23 nt, Human
aagaggaggccucgccgggucug

SEQ ID NO: 770452 - RNA, 19 nt, Human
acacacacacaaaacgaaa

SEQ ID NO: 770453 - RNA, 20 nt, Human
acacacacacacacacaaaa

SEQ ID NO: 770454 - RNA, 18 nt, Human
acagcuccaccuccuccc

SEQ ID NO: 770455 - RNA, 20 nt, Human
accacacacacacacacaca

SEQ ID NO: 770456 - RNA, 21 nt, Human
accacacacacacacacacaa

SEQ ID NO: 770457 - RNA, 22 nt, Human
accucgcgaucccguggcccug

SEQ ID NO: 770458 - RNA, 20 nt, Human
accugcacauaggacagcag

SEQ ID NO: 770459 - RNA, 21 nt, Human
acucccauccccacagcucca

SEQ ID NO: 770460 - RNA, 22 nt, Human
acucccauccccacagcuccac

SEQ ID NO: 770461 - RNA, 25 nt, Human
agauacaugaccucgcgaucccgug

SEQ ID NO: 770462 - RNA, 18 nt, Human
agccccgguuuuucuugc

SEQ ID NO: 770463 - RNA, 20 nt, Human
aggaagcagaggcccuggga

SEQ ID NO: 770464 - RNA, 20 nt, Human
aggagggggaaggacauggu

SEQ ID NO: 770465 - RNA, 19 nt, Human
aggcggggcggggugggga

SEQ ID NO: 770466 - RNA, 21 nt, Human
aggcuugggggcggggguggc

SEQ ID NO: 770467 - RNA, 24 nt, Human
agggggugcagcugagaaagggaa

SEQ ID NO: 770468 - RNA, 19 nt, Human
aggguccagggacucuugg

SEQ ID NO: 770469 - RNA, 22 nt, Human
auaggacagcagugagcuacug

SEQ ID NO: 770470 - RNA, 21 nt, Human
augaccucgcgaucccguggc

SEQ ID NO: 770471 - RNA, 21 nt, Human
augguccaaugggggaaagug

SEQ ID NO: 770472 - RNA, 22 nt, Human
augguccaaugggggaaagugg

SEQ ID NO: 770473 - RNA, 21 nt, Human
caacccuccuccccucagugc

SEQ ID NO: 770474 - RNA, 22 nt, Human
caaguuacagaaacugggccga

SEQ ID NO: 770475 - RNA, 21 nt, Human
caauuuugaggguccagggac

SEQ ID NO: 770476 - RNA, 18 nt, Human
cacagcuccaccuccucc

SEQ ID NO: 770477 - RNA, 23 nt, Human
cacaggacuggagccuggccagg

SEQ ID NO: 770478 - RNA, 21 nt, Human
cacaggcuccaaguguugggg

SEQ ID NO: 770479 - RNA, 23 nt, Human
caccccauaaguauauuuagcuc

SEQ ID NO: 770480 - RNA, 19 nt, Human
caccccugcuggaaggggg

SEQ ID NO: 770481 - RNA, 23 nt, Human
cacuccucccaccugucccucca

SEQ ID NO: 770482 - RNA, 23 nt, Human
cacucugaaaggcaaugacugga

SEQ ID NO: 770483 - RNA, 19 nt, Human
cacugccggccggcccagc

SEQ ID NO: 770484 - RNA, 21 nt, Human
cacugccucucccaggaggcc

SEQ ID NO: 770485 - RNA, 29 nt, Human
cagaaaaagcccccuccucacuccuccca

SEQ ID NO: 770486 - RNA, 26 nt, Human
cagaaaacagaggagggccagggcag

SEQ ID NO: 770487 - RNA, 23 nt, Human
cagaaacugggccgacgaagaca

SEQ ID NO: 770488 - RNA, 19 nt, Human
cagcuccaccuccucccaa

SEQ ID NO: 770489 - RNA, 25 nt, Human
caggccccccaguggccagcccucc

SEQ ID NO: 770490 - RNA, 20 nt, Human
caugucaccuuugacucaug

SEQ ID NO: 770491 - RNA, 21 nt, Human
ccacacacacacacacacaaa

SEQ ID NO: 770492 - RNA, 22 nt, Human
ccagggcagcaaggacacagag

SEQ ID NO: 770493 - RNA, 23 nt, Human
ccaguggccagcccucccaggac

SEQ ID NO: 770494 - RNA, 21 nt, Human
cccacagcuccaccuccuccc

SEQ ID NO: 770495 - RNA, 21 nt, Human
cccaggacagcaggguggugg

SEQ ID NO: 770496 - RNA, 23 nt, Human
cccaucuugcugggcccugggag

SEQ ID NO: 770497 - RNA, 19 nt, Human
ccccacagcuccaccuccu

SEQ ID NO: 770498 - RNA, 18 nt, Human
ccccacggcccccacccc

SEQ ID NO: 770499 - RNA, 21 nt, Human
cccccuccucacuccucccac

SEQ ID NO: 770500 - RNA, 18 nt, Human
ccccucggccuccaggcc

SEQ ID NO: 770501 - RNA, 18 nt, Human
ccccuucccgccucccuu

SEQ ID NO: 770502 - RNA, 19 nt, Human
cccgccccucggccuccag

SEQ ID NO: 770503 - RNA, 20 nt, Human
cccgccccucggccuccagg

SEQ ID NO: 770504 - RNA, 21 nt, Human
cccucagugcagcuacagagg

SEQ ID NO: 770505 - RNA, 23 nt, Human
cccuuuuuccaggcuuuucuggg

SEQ ID NO: 770506 - RNA, 23 nt, Human
ccgccccucggccuccaggccug

SEQ ID NO: 770507 - RNA, 21 nt, Human
ccgccucccuuuuuccaggcu

SEQ ID NO: 770508 - RNA, 24 nt, Human
ccgcgcucuccggcgcccgccccu

SEQ ID NO: 770509 - RNA, 27 nt, Human
ccucacuccucccaccugucccuccag

SEQ ID NO: 770510 - RNA, 22 nt, Human
ccuccaggggugggaccaaccc

SEQ ID NO: 770511 - RNA, 22 nt, Human
ccuccucccaagucccugacuc

SEQ ID NO: 770512 - RNA, 18 nt, Human
ccuccuguccaggccuuc

SEQ ID NO: 770513 - RNA, 21 nt, Human
ccucgggcugagccccaucuc

SEQ ID NO: 770514 - RNA, 19 nt, Human
ccuggcgggucagggcugu

SEQ ID NO: 770515 - RNA, 20 nt, Human
ccuggcgggucagggcuguc

SEQ ID NO: 770516 - RNA, 19 nt, Human
ccuguccaggccuucacuu

SEQ ID NO: 770517 - RNA, 21 nt, Human
ccuuuuuccaggcuuuucugg

SEQ ID NO: 770518 - RNA, 19 nt, Human
cgaaagugcuccccuuccc

SEQ ID NO: 770519 - RNA, 22 nt, Human
cggaaggaauggccugguucuc

SEQ ID NO: 770520 - RNA, 18 nt, Human
cgucuggcuggggagggg

SEQ ID NO: 770521 - RNA, 19 nt, Human
cgugcacaugccggugcgu

SEQ ID NO: 770522 - RNA, 21 nt, Human
cuacuggcacaggacuggagc

SEQ ID NO: 770523 - RNA, 18 nt, Human
cuagaaccuucuaggagg

SEQ ID NO: 770524 - RNA, 24 nt, Human
cucaugcguguuugcgugcacaug

SEQ ID NO: 770525 - RNA, 22 nt, Human
cucaugcucacugccucuccca

SEQ ID NO: 770526 - RNA, 18 nt, Human
cuccaccuccucccaagu

SEQ ID NO: 770527 - RNA, 24 nt, Human
cuccaggggugggaccaacccucc

SEQ ID NO: 770528 - RNA, 22 nt, Human
cuccccuucccgccucccuuuu

SEQ ID NO: 770529 - RNA, 20 nt, Human
cuccuaccuggcccggcuac

SEQ ID NO: 770530 - RNA, 21 nt, Human
cuccucacuccucccaccugu

SEQ ID NO: 770531 - RNA, 21 nt, Human
cuccucccaccugucccucca

SEQ ID NO: 770532 - RNA, 18 nt, Human
cucgcgaucccguggccc

SEQ ID NO: 770533 - RNA, 20 nt, Human
cucuccggcgcccgccccuc

SEQ ID NO: 770534 - RNA, 18 nt, Human
cucugggguggcugccuc

SEQ ID NO: 770535 - RNA, 19 nt, Human
cucugggguggcugccucu

SEQ ID NO: 770536 - RNA, 20 nt, Human
cugauagggccugacugcgc

SEQ ID NO: 770537 - RNA, 18 nt, Human
cugcaggcggggcggggu

SEQ ID NO: 770538 - RNA, 22 nt, Human
cuuugacucaugcucacugccu

SEQ ID NO: 770539 - RNA, 21 nt, Human
gaccucgcgaucccguggccc

SEQ ID NO: 770540 - RNA, 21 nt, Human
gacuccuccuguccaggccuu

SEQ ID NO: 770541 - RNA, 22 nt, Human
gaggaagcagaggcccugggag

SEQ ID NO: 770542 - RNA, 21 nt, Human
gaggagggccagggcagcaag

SEQ ID NO: 770543 - RNA, 20 nt, Human
gcaaacccaggugccaggga

SEQ ID NO: 770544 - RNA, 23 nt, Human
gcacccaagucccuccuggaggc

SEQ ID NO: 770545 - RNA, 25 nt, Human
gcacccaagucccuccuggaggcca

SEQ ID NO: 770546 - RNA, 18 nt, Human
gcagaaaaagcccccucc

SEQ ID NO: 770547 - RNA, 22 nt, Human
gccaggguauggggagcagugg

SEQ ID NO: 770548 - RNA, 20 nt, Human
gcccaggccccccaguggcc

SEQ ID NO: 770549 - RNA, 24 nt, Human
gcccaggccccccaguggccagcc

SEQ ID NO: 770550 - RNA, 20 nt, Human
gcggggcgggguggggagau

SEQ ID NO: 770551 - RNA, 21 nt, Human
gcucguggggccaccuaaggc

SEQ ID NO: 770552 - RNA, 22 nt, Human
ggaaaugcacaugccucuggag

SEQ ID NO: 770553 - RNA, 26 nt, Human
ggaaaugcacaugccucuggagcccc

SEQ ID NO: 770554 - RNA, 19 nt, Human
ggaaggaauggccugguuc

SEQ ID NO: 770555 - RNA, 20 nt, Human
ggaggagggggaaggacaug

SEQ ID NO: 770556 - RNA, 19 nt, Human
ggaggucagcgagccccgc

SEQ ID NO: 770557 - RNA, 18 nt, Human
ggcccagccucaugcugc

SEQ ID NO: 770558 - RNA, 24 nt, Human
ggccgacgaagacagggccagaaa

SEQ ID NO: 770559 - RNA, 19 nt, Human
gggaggagggggaaggaca

SEQ ID NO: 770560 - RNA, 18 nt, Human
gggcagcaaggacacaga

SEQ ID NO: 770561 - RNA, 21 nt, Human
gggcagcaaggacacagaggg

SEQ ID NO: 770562 - RNA, 23 nt, Human
gggcagcaaggacacagaggggc

SEQ ID NO: 770563 - RNA, 21 nt, Human
gggcagcccaggccccccagu

SEQ ID NO: 770564 - RNA, 21 nt, Human
ggggacgggguccugccuguc

SEQ ID NO: 770565 - RNA, 18 nt, Human
ggguccugccuguccuug

SEQ ID NO: 770566 - RNA, 20 nt, Human
ggugaucagugaccaggaac

SEQ ID NO: 770567 - RNA, 21 nt, Human
gguggccaggggaagaggagg

SEQ ID NO: 770568 - RNA, 21 nt, Human
gugcaccccaucugucaucug

SEQ ID NO: 770569 - RNA, 19 nt, Human
guggccaggggaagaggag

SEQ ID NO: 770570 - RNA, 28 nt, Human
uacggcuccuguggucucugggguggcu

SEQ ID NO: 770571 - RNA, 20 nt, Human
ucacugccucucccaggagg

SEQ ID NO: 770572 - RNA, 18 nt, Human
ucaggcuugggggcgggg

SEQ ID NO: 770573 - RNA, 24 nt, Human
ucauucuauuuucagcuucccuca

SEQ ID NO: 770574 - RNA, 23 nt, Human
uccaggcuuuucuggagucuggg

SEQ ID NO: 770575 - RNA, 24 nt, Human
ucccaggacagcaggguggugggg

SEQ ID NO: 770576 - RNA, 22 nt, Human
ucccaucuugcugggcccuggg

SEQ ID NO: 770577 - RNA, 20 nt, Human
ucccccauaccucgcacucc

SEQ ID NO: 770578 - RNA, 24 nt, Human
ucccuggcccccacggcccccacc

SEQ ID NO: 770579 - RNA, 29 nt, Human
ucccuggggaccaagaaguagacuccugg

SEQ ID NO: 770580 - RNA, 20 nt, Human
uccuguggucucuggggugg

SEQ ID NO: 770581 - RNA, 18 nt, Human
ucgccgggucuggcugug

SEQ ID NO: 770582 - RNA, 20 nt, Human
ucucugggguggcugccucu

SEQ ID NO: 770583 - RNA, 18 nt, Human
ucugcacccaagucccuc

SEQ ID NO: 770584 - RNA, 20 nt, Human
ucugcugggcacauuccugc

SEQ ID NO: 770585 - RNA, 22 nt, Human
ugaccuauagaaagccgaaagu

SEQ ID NO: 770586 - RNA, 21 nt, Human
ugauuccuccacucccauccc

SEQ ID NO: 770587 - RNA, 23 nt, Human
ugcagagggggugcagcugagaa

SEQ ID NO: 770588 - RNA, 22 nt, Human
ugccagggauugggauucucuu

SEQ ID NO: 770589 - RNA, 18 nt, Human
ugccaggguauggggagc

SEQ ID NO: 770590 - RNA, 20 nt, Human
ugcugcugcccaaggcccga

SEQ ID NO: 770591 - RNA, 20 nt, Human
ugcuggaaggggggggucua

SEQ ID NO: 770592 - RNA, 19 nt, Human
ugcuuacaucugcacccaa

SEQ ID NO: 770593 - RNA, 20 nt, Human
uggaaccucugggagcaggg

SEQ ID NO: 770594 - RNA, 22 nt, Human
uggaaccucugggagcagggaa

SEQ ID NO: 770595 - RNA, 23 nt, Human
uggaaggggggggucuagaaccu

SEQ ID NO: 770596 - RNA, 18 nt, Human
uggaggggcagcccaggc

SEQ ID NO: 770597 - RNA, 18 nt, Human
uggagucugggcagcucc

SEQ ID NO: 770598 - RNA, 21 nt, Human
uggaugaggcaaacccaggug

SEQ ID NO: 770599 - RNA, 24 nt, Human
uggcagaaaaagcccccuccucaa

SEQ ID NO: 770600 - RNA, 22 nt, Human
uggcccccacggcccccacccc

SEQ ID NO: 770601 - RNA, 22 nt, Human
ugggaccaacccuccuccccuc

SEQ ID NO: 770602 - RNA, 19 nt, Human
ugggauucucuucccaaaa

SEQ ID NO: 770603 - RNA, 19 nt, Human
ugggcuggcagccacaggg

SEQ ID NO: 770604 - RNA, 21 nt, Human
uggggaggggcccuuccccag

SEQ ID NO: 770605 - RNA, 25 nt, Human
ugggggcggggguggcagaaaaagc

SEQ ID NO: 770606 - RNA, 18 nt, Human
uguagggcccugggagag

SEQ ID NO: 770607 - RNA, 18 nt, Human
ugucuagugcuccacugc

SEQ ID NO: 770608 - RNA, 19 nt, Human
ugucugaaugcgugcaccc

SEQ ID NO: 770609 - RNA, 20 nt, Human
ugucugggagagugucccug

SEQ ID NO: 770610 - RNA, 24 nt, Human
ugugucuucagaucugcagagggg

SEQ ID NO: 770611 - RNA, 21 nt, Human
uuaaccacaggcuccaagugu

SEQ ID NO: 770612 - RNA, 18 nt, Human
uucuggagucugggcagc

SEQ ID NO: 770613 - RNA, 24 nt, Human
uugcgugcacaugccggugcguac

SEQ ID NO: 770614 - RNA, 22 nt, Human
uugcugggcccugggaggucag

SEQ ID NO: 770615 - RNA, 23 nt, Human
uugcugggcccugggaggucagc

SEQ ID NO: 770616 - RNA, 23 nt, Human
uugguaagcuugaagagcugugu

SEQ ID NO: 770617 - RNA, 23 nt, Human
uugguaaguuugaagagcugugu

SEQ ID NO: 770618 - RNA, 24 nt, Human
uuucuggagucugggcagcuccug

SEQ ID NO: 770619 - RNA, 25 nt, Human
uuuuccaggcuuuucuggagucugg

SEQ ID NO: 770620 - RNA, 18 nt, Human
uuuucuugcuuacaucug

SEQ ID NO: 770621 - RNA, 19 nt, Human
uuuucuugcuuacaucugc

SEQ ID NO: 770622 - RNA, 27 nt, Human
aaacaaguggccucauguuguaaugac

SEQ ID NO: 770623 - RNA, 23 nt, Human
aaaccucucccauuuaccugcuc

SEQ ID NO: 770624 - RNA, 19 nt, Human
aaaggcccaggagugaaga

SEQ ID NO: 770625 - RNA, 22 nt, Human
aagcauuuggcaagagggggca

SEQ ID NO: 770626 - RNA, 22 nt, Human
aaggggaggaucggauggaugg

SEQ ID NO: 770627 - RNA, 25 nt, Human
agaaagaagcaugaaaaguucccga

SEQ ID NO: 770628 - RNA, 23 nt, Human
agacaaggcaggugacgggagug

SEQ ID NO: 770629 - RNA, 22 nt, Human
agacaauccacgaaggaaggac

SEQ ID NO: 770630 - RNA, 22 nt, Human
agccacagccacagccacagcc

SEQ ID NO: 770631 - RNA, 20 nt, Human
aggaaggacaggggaaggga

SEQ ID NO: 770632 - RNA, 20 nt, Human
aggaaggacaggggaagggg

SEQ ID NO: 770633 - RNA, 21 nt, Human
aggaaggacaggggaagggga

SEQ ID NO: 770634 - RNA, 19 nt, Human
aggacaggggaaggggagg

SEQ ID NO: 770635 - RNA, 20 nt, Human
aggacaggggaaggggagga

SEQ ID NO: 770636 - RNA, 19 nt, Human
aggcaaaucccuggagcuc

SEQ ID NO: 770637 - RNA, 18 nt, Human
aggcaaggcggugggagg

SEQ ID NO: 770638 - RNA, 23 nt, Human
aggcaaggcggugggaggugggg

SEQ ID NO: 770639 - RNA, 20 nt, Human
aggcaggugacgggaguggu

SEQ ID NO: 770640 - RNA, 20 nt, Human
aggcggugggaggugggggc

SEQ ID NO: 770641 - RNA, 19 nt, Human
aggcuccuucauaccucuc

SEQ ID NO: 770642 - RNA, 21 nt, Human
aggcuccuucauaccucuccu

SEQ ID NO: 770643 - RNA, 24 nt, Human
auggggcaaacagaauggguggag

SEQ ID NO: 770644 - RNA, 26 nt, Human
cacagccacagccacagccacgugga

SEQ ID NO: 770645 - RNA, 18 nt, Human
cacgaaggaaggacaggg

SEQ ID NO: 770646 - RNA, 20 nt, Human
cacuuggguagugccaaaug

SEQ ID NO: 770647 - RNA, 19 nt, Human
cagaaagugucaagcacug

SEQ ID NO: 770648 - RNA, 20 nt, Human
cagaaagugucaagcacugg

SEQ ID NO: 770649 - RNA, 21 nt, Human
cagaccaagaccucaggugga

SEQ ID NO: 770650 - RNA, 21 nt, Human
cagauaggauccaggagugcc

SEQ ID NO: 770651 - RNA, 21 nt, Human
cagccuucucccaugagcaag

SEQ ID NO: 770652 - RNA, 24 nt, Human
caggacaaugcaccucagcaccuu

SEQ ID NO: 770653 - RNA, 20 nt, Human
cagggcccagccacagccac

SEQ ID NO: 770654 - RNA, 24 nt, Human
caggggaaggggaggaucggaugg

SEQ ID NO: 770655 - RNA, 21 nt, Human
cauguguagccagcuaaaagu

SEQ ID NO: 770656 - RNA, 18 nt, Human
cauugggcaagcuggggu

SEQ ID NO: 770657 - RNA, 23 nt, Human
ccacagccacagccacguggaua

SEQ ID NO: 770658 - RNA, 23 nt, Human
ccacagccacguggauaauguuc

SEQ ID NO: 770659 - RNA, 23 nt, Human
ccagaagcauugggcaagcuggg

SEQ ID NO: 770660 - RNA, 22 nt, Human
ccagccacagccacagccacag

SEQ ID NO: 770661 - RNA, 19 nt, Human
ccagggcccagccacagcc

SEQ ID NO: 770662 - RNA, 23 nt, Human
ccaggguuaucugcgucauuggc

SEQ ID NO: 770663 - RNA, 24 nt, Human
cccacaguggggcaggaaggaggc

SEQ ID NO: 770664 - RNA, 20 nt, Human
cccagccacagccacagcca

SEQ ID NO: 770665 - RNA, 21 nt, Human
cccagccacagccacagccac

SEQ ID NO: 770666 - RNA, 20 nt, Human
ccucauccugccuuccagcu

SEQ ID NO: 770667 - RNA, 18 nt, Human
ccuccauaauguccaggc

SEQ ID NO: 770668 - RNA, 21 nt, Human
ccugccagggcccagccacag

SEQ ID NO: 770669 - RNA, 21 nt, Human
ccuggagcucacccuaaaaca

SEQ ID NO: 770670 - RNA, 19 nt, Human
cgauaggcugggcucuuuc

SEQ ID NO: 770671 - RNA, 22 nt, Human
cuagcgggggaugaagaauaaa

SEQ ID NO: 770672 - RNA, 24 nt, Human
cuagucagcuggaaaccucuccca

SEQ ID NO: 770673 - RNA, 20 nt, Human
cucagguggagaaagaagca

SEQ ID NO: 770674 - RNA, 22 nt, Human
cucucccauuuaccugcuccuc

SEQ ID NO: 770675 - RNA, 24 nt, Human
cucucccauuuaccugcuccucag

SEQ ID NO: 770676 - RNA, 19 nt, Human
cuuccuccaacaggcuaca

SEQ ID NO: 770677 - RNA, 23 nt, Human
gacaaggcaggugacgggagugg

SEQ ID NO: 770678 - RNA, 26 nt, Human
gacaauggagacaauccacgaaggaa

SEQ ID NO: 770679 - RNA, 20 nt, Human
gaggaucggauggauggucu

SEQ ID NO: 770680 - RNA, 19 nt, Human
gaugaagaauaaagaacag

SEQ ID NO: 770681 - RNA, 20 nt, Human
gccacuucuggaaauggccc

SEQ ID NO: 770682 - RNA, 20 nt, Human
ggaacuagaaggagucggug

SEQ ID NO: 770683 - RNA, 20 nt, Human
ggaggugggcaggcuucugg

SEQ ID NO: 770684 - RNA, 21 nt, Human
ggcccagccacagccacagcc

SEQ ID NO: 770685 - RNA, 20 nt, Human
ggcugugcucugugguauag

SEQ ID NO: 770686 - RNA, 24 nt, Human
gggaacuagaaggagucgguggag

SEQ ID NO: 770687 - RNA, 22 nt, Human
gggcaagcuggggugagguugg

SEQ ID NO: 770688 - RNA, 19 nt, Human
gggcagagaccacagccuu

SEQ ID NO: 770689 - RNA, 19 nt, Human
ggggaaggggaggaucgga

SEQ ID NO: 770690 - RNA, 18 nt, Human
ggggguaaaggggugagg

SEQ ID NO: 770691 - RNA, 22 nt, Human
ggguggaggugggcaggcuucu

SEQ ID NO: 770692 - RNA, 24 nt, Human
gugaaaguggggaagggaacuaga

SEQ ID NO: 770693 - RNA, 19 nt, Human
gugaguccugaggucuucu

SEQ ID NO: 770694 - RNA, 19 nt, Human
guggagggguccgugccuu

SEQ ID NO: 770695 - RNA, 26 nt, Human
uaaaacaaguggccucauguguagcc

SEQ ID NO: 770696 - RNA, 19 nt, Human
uaaagaacagacaaggcag

SEQ ID NO: 770697 - RNA, 18 nt, Human
uaagucccaagaaagcag

SEQ ID NO: 770698 - RNA, 22 nt, Human
uaagucccaagaaagcaggaca

SEQ ID NO: 770699 - RNA, 20 nt, Human
uaccuugacaagugauagga

SEQ ID NO: 770700 - RNA, 19 nt, Human
ucccauuuaccugcuccuc

SEQ ID NO: 770701 - RNA, 23 nt, Human
ucccuggagcucacccuaaaaca

SEQ ID NO: 770702 - RNA, 24 nt, Human
uccuucauaccucuccucauccug

SEQ ID NO: 770703 - RNA, 21 nt, Human
ucgauaggcugggcucuuucc

SEQ ID NO: 770704 - RNA, 24 nt, Human
ucucccaugagcaagucuggaggu

SEQ ID NO: 770705 - RNA, 19 nt, Human
ugaggggugggacacagga

SEQ ID NO: 770706 - RNA, 18 nt, Human
ugcguuguugguucuucc

SEQ ID NO: 770707 - RNA, 19 nt, Human
uggaaauggcccacagugg

SEQ ID NO: 770708 - RNA, 23 nt, Human
uggagaaggcaauggggguaaag

SEQ ID NO: 770709 - RNA, 21 nt, Human
uggaggugggcaggcuucugg

SEQ ID NO: 770710 - RNA, 20 nt, Human
uggagguggggggauguucc

SEQ ID NO: 770711 - RNA, 24 nt, Human
uggagugggugguacagguggaaa

SEQ ID NO: 770712 - RNA, 20 nt, Human
uggcaagagggggcagagac

SEQ ID NO: 770713 - RNA, 24 nt, Human
uggcaggugcuuucagguuucugg

SEQ ID NO: 770714 - RNA, 22 nt, Human
ugggaggugggggcacugucug

SEQ ID NO: 770715 - RNA, 22 nt, Human
ugggggcacugucuggacaaug

SEQ ID NO: 770716 - RNA, 19 nt, Human
uggggguaaaggggugagg

SEQ ID NO: 770717 - RNA, 25 nt, Human
uggguggaggugggcaggcuucugg

SEQ ID NO: 770718 - RNA, 23 nt, Human
uguguagccagcuaaaaguagcu

SEQ ID NO: 770719 - RNA, 23 nt, Human
uuggacgaguagaaaagaggguu

SEQ ID NO: 770720 - RNA, 18 nt, Human
aaaaggccgggugugggc

SEQ ID NO: 770721 - RNA, 20 nt, Human
aacauggcgaaacccugucu

SEQ ID NO: 770722 - RNA, 21 nt, Human
aacauggcgaaacccugucuc

SEQ ID NO: 770723 - RNA, 21 nt, Human
aacccugucucuaccaaaaau

SEQ ID NO: 770724 - RNA, 18 nt, Human
aacuuccaaccucaccuc

SEQ ID NO: 770725 - RNA, 23 nt, Human
aagcuccugcgcuucccaauccc

SEQ ID NO: 770726 - RNA, 21 nt, Human
accaggccuccuccacccugc

SEQ ID NO: 770727 - RNA, 20 nt, Human
acccgcccugcccccacccc

SEQ ID NO: 770728 - RNA, 23 nt, Human
acccgcccugcccccaccccggg

SEQ ID NO: 770729 - RNA, 18 nt, Human
acccugcuaacacccaac

SEQ ID NO: 770730 - RNA, 24 nt, Human
acccugucucuaccaaaaauacaa

SEQ ID NO: 770731 - RNA, 27 nt, Human
accucaccuccugccucccuccuccaa

SEQ ID NO: 770732 - RNA, 21 nt, Human
accuugggaccccuaacacca

SEQ ID NO: 770733 - RNA, 23 nt, Human
agaaguucaagaccagccugggc

SEQ ID NO: 770734 - RNA, 22 nt, Human
agagcugccccaccagcgugcc

SEQ ID NO: 770735 - RNA, 22 nt, Human
agccugggcaacauggcgaaac

SEQ ID NO: 770736 - RNA, 24 nt, Human
agccugggcaacauggcgaaaccc

SEQ ID NO: 770737 - RNA, 19 nt, Human
aggaggcaacgcuccaaaa

SEQ ID NO: 770738 - RNA, 25 nt, Human
aggcaagcacaggcgggugggggcu

SEQ ID NO: 770739 - RNA, 21 nt, Human
aggcaggcauaucacuugagg

SEQ ID NO: 770740 - RNA, 22 nt, Human
aggcaggcauaucacuugaggu

SEQ ID NO: 770741 - RNA, 26 nt, Human
aggcaggcauaucacuugaggucaga

SEQ ID NO: 770742 - RNA, 24 nt, Human
aggcgggugggggcucgggucgga

SEQ ID NO: 770743 - RNA, 21 nt, Human
aggcugaggcaggcauaucac

SEQ ID NO: 770744 - RNA, 24 nt, Human
aggcugaggcaggcauaucacuug

SEQ ID NO: 770745 - RNA, 21 nt, Human
agggcaucauugaucuggggc

SEQ ID NO: 770746 - RNA, 23 nt, Human
aucacuugaggucagaaguucaa

SEQ ID NO: 770747 - RNA, 23 nt, Human
aucuggggcacaucugaggucag

SEQ ID NO: 770748 - RNA, 20 nt, Human
augcugccccagcuccggcu

SEQ ID NO: 770749 - RNA, 24 nt, Human
auugaucuggggcacaucugaggu

SEQ ID NO: 770750 - RNA, 22 nt, Human
caacauggcgaaacccugucuc

SEQ ID NO: 770751 - RNA, 24 nt, Human
caacauggcgaaacccugucucua

SEQ ID NO: 770752 - RNA, 21 nt, Human
caacuuccaaccucaccuccu

SEQ ID NO: 770753 - RNA, 23 nt, Human
caagacaagagcugccccaccag

SEQ ID NO: 770754 - RNA, 21 nt, Human
cacccaaccaucccauccuag

SEQ ID NO: 770755 - RNA, 19 nt, Human
cacccacgcugggccgucc

SEQ ID NO: 770756 - RNA, 20 nt, Human
cacccugcuaacacccaacc

SEQ ID NO: 770757 - RNA, 25 nt, Human
cacccugcuaacacccaaccauccc

SEQ ID NO: 770758 - RNA, 19 nt, Human
cagaagggacucaucggca

SEQ ID NO: 770759 - RNA, 20 nt, Human
cagaaucucgcaggccacac

SEQ ID NO: 770760 - RNA, 21 nt, Human
cagccuccuggggguccagag

SEQ ID NO: 770761 - RNA, 21 nt, Human
cagcgugggacagcugggcac

SEQ ID NO: 770762 - RNA, 24 nt, Human
cauaucacuugaggucagaaguuc

SEQ ID NO: 770763 - RNA, 23 nt, Human
caucccauccuaggcuccuuacc

SEQ ID NO: 770764 - RNA, 22 nt, Human
ccacaccaggccuccuccaccc

SEQ ID NO: 770765 - RNA, 18 nt, Human
ccagcuccggcugacucc

SEQ ID NO: 770766 - RNA, 22 nt, Human
cccaagacaagcugguccugaa

SEQ ID NO: 770767 - RNA, 19 nt, Human
cccacgcugggccgucccc

SEQ ID NO: 770768 - RNA, 19 nt, Human
ccccacccacgcugggccg

SEQ ID NO: 770769 - RNA, 19 nt, Human
cccccaagacaagcugguc

SEQ ID NO: 770770 - RNA, 22 nt, Human
cccccaagacaagcugguccug

SEQ ID NO: 770771 - RNA, 18 nt, Human
ccccuaacaccagcuccc

SEQ ID NO: 770772 - RNA, 24 nt, Human
ccccuugggaggcugaggcaggca

SEQ ID NO: 770773 - RNA, 24 nt, Human
cccgcccugcccccaccccgggag

SEQ ID NO: 770774 - RNA, 24 nt, Human
ccuaacaccagcucccgcugggac

SEQ ID NO: 770775 - RNA, 19 nt, Human
ccucagacccucaaggccc

SEQ ID NO: 770776 - RNA, 22 nt, Human
ccuccugccucccuccuccaaa

SEQ ID NO: 770777 - RNA, 23 nt, Human
ccugcuaacacccaaccauccca

SEQ ID NO: 770778 - RNA, 22 nt, Human
ccugggcaacauggcgaaaccc

SEQ ID NO: 770779 - RNA, 24 nt, Human
ccugggcaacauggcgaaacccug

SEQ ID NO: 770780 - RNA, 20 nt, Human
ccuuaccacccccaagacaa

SEQ ID NO: 770781 - RNA, 24 nt, Human
cgguguccucacucucucucgcuc

SEQ ID NO: 770782 - RNA, 26 nt, Human
cuaacacucaucccuuuugccucuca

SEQ ID NO: 770783 - RNA, 22 nt, Human
cucaccuccugccucccuccuc

SEQ ID NO: 770784 - RNA, 19 nt, Human
cucagacccucaaggcccc

SEQ ID NO: 770785 - RNA, 22 nt, Human
cuccaaaacuucucuucucagu

SEQ ID NO: 770786 - RNA, 23 nt, Human
cuccaagacaagagcugccccac

SEQ ID NO: 770787 - RNA, 22 nt, Human
cucccuggcaccagccuccugg

SEQ ID NO: 770788 - RNA, 21 nt, Human
cuccuccaaacuuucacacgg

SEQ ID NO: 770789 - RNA, 21 nt, Human
cugggacggaacagggaaggc

SEQ ID NO: 770790 - RNA, 23 nt, Human
cuuccaaccucaccuccugccuc

SEQ ID NO: 770791 - RNA, 27 nt, Human
gaagcuccugcgcuucccaaucccaca

SEQ ID NO: 770792 - RNA, 24 nt, Human
gaaugugggggugucagggugaug

SEQ ID NO: 770793 - RNA, 19 nt, Human
gaggcugccggugcucugc

SEQ ID NO: 770794 - RNA, 18 nt, Human
gcaauaugaaauagaagc

SEQ ID NO: 770795 - RNA, 23 nt, Human
gcacgcacacucacaccagccug

SEQ ID NO: 770796 - RNA, 22 nt, Human
gcccacaccaggccuccuccac

SEQ ID NO: 770797 - RNA, 21 nt, Human
gcuccugcgcuucccaauccc

SEQ ID NO: 770798 - RNA, 21 nt, Human
ggaccccuaacaccagcuccc

SEQ ID NO: 770799 - RNA, 22 nt, Human
ggacucaucggcacccagggca

SEQ ID NO: 770800 - RNA, 19 nt, Human
ggaggagggagcuggggac

SEQ ID NO: 770801 - RNA, 21 nt, Human
ggccugguugaaagugcaggg

SEQ ID NO: 770802 - RNA, 21 nt, Human
ggccugucucccuggcaccag

SEQ ID NO: 770803 - RNA, 23 nt, Human
gggacccucuggcacccccaccc

SEQ ID NO: 770804 - RNA, 22 nt, Human
gggcaucauugaucuggggcac

SEQ ID NO: 770805 - RNA, 20 nt, Human
ggggcggcaaggcuccaccc

SEQ ID NO: 770806 - RNA, 24 nt, Human
ggggcuguugccggggaggccccu

SEQ ID NO: 770807 - RNA, 18 nt, Human
ggguugggccugucuccc

SEQ ID NO: 770808 - RNA, 19 nt, Human
ggguugggccugucucccu

SEQ ID NO: 770809 - RNA, 20 nt, Human
ggugaugagggcaauggggg

SEQ ID NO: 770810 - RNA, 21 nt, Human
gguggguugggccugucuccc

SEQ ID NO: 770811 - RNA, 24 nt, Human
guaccccuugggaggcugaggcag

SEQ ID NO: 770812 - RNA, 19 nt, Human
guggccgucugcgcugcag

SEQ ID NO: 770813 - RNA, 21 nt, Human
uaccaaaaauacaaaaauuag

SEQ ID NO: 770814 - RNA, 19 nt, Human
uaggcuccuuaccaccccc

SEQ ID NO: 770815 - RNA, 20 nt, Human
uauauaauauauaauauaug

SEQ ID NO: 770816 - RNA, 24 nt, Human
uaucacuugaggucagaaguucaa

SEQ ID NO: 770817 - RNA, 22 nt, Human
uaucuuuauucuaggaggcaac

SEQ ID NO: 770818 - RNA, 20 nt, Human
ucagggugaugagggcaaug

SEQ ID NO: 770819 - RNA, 19 nt, Human
uccaaaacuucucuucuca

SEQ ID NO: 770820 - RNA, 21 nt, Human
uccaagacaagagcugcccca

SEQ ID NO: 770821 - RNA, 25 nt, Human
uccaggaaggggaaagggcagagga

SEQ ID NO: 770822 - RNA, 23 nt, Human
ucccuggcaccagccuccugggg

SEQ ID NO: 770823 - RNA, 21 nt, Human
ucccuuuugccucucagcggc

SEQ ID NO: 770824 - RNA, 21 nt, Human
uccuggaaccuugcucaacuu

SEQ ID NO: 770825 - RNA, 19 nt, Human
ugaaagugcagggucuggg

SEQ ID NO: 770826 - RNA, 19 nt, Human
ugaagcuccugcgcuuccc

SEQ ID NO: 770827 - RNA, 18 nt, Human
ugacgcagaaacaagggc

SEQ ID NO: 770828 - RNA, 19 nt, Human
ugacggcuccaagacaagg

SEQ ID NO: 770829 - RNA, 20 nt, Human
ugacuccuggaaccuugcuc

SEQ ID NO: 770830 - RNA, 26 nt, Human
ugaggcaggcauaucacuugagguca

SEQ ID NO: 770831 - RNA, 21 nt, Human
ugaggcugccggugcucugca

SEQ ID NO: 770832 - RNA, 20 nt, Human
ugagggcaaugggggccauc

SEQ ID NO: 770833 - RNA, 18 nt, Human
ugccacucaaggcccuga

SEQ ID NO: 770834 - RNA, 18 nt, Human
ugccccagcuccggcuga

SEQ ID NO: 770835 - RNA, 21 nt, Human
ugccccagcuccggcugacuc

SEQ ID NO: 770836 - RNA, 22 nt, Human
ugccggugcucugcaggaagcc

SEQ ID NO: 770837 - RNA, 23 nt, Human
ugccucccuccuccaaacuuuca

SEQ ID NO: 770838 - RNA, 22 nt, Human
uggaccugagcuaaaaggccgg

SEQ ID NO: 770839 - RNA, 21 nt, Human
ugggaacugcagagaccccug

SEQ ID NO: 770840 - RNA, 21 nt, Human
ugggacggaacagggaaggcu

SEQ ID NO: 770841 - RNA, 18 nt, Human
ugggaggagggagcuggg

SEQ ID NO: 770842 - RNA, 19 nt, Human
ugggaggcugaggcaggca

SEQ ID NO: 770843 - RNA, 24 nt, Human
ugggaggcugaggcaggcauauca

SEQ ID NO: 770844 - RNA, 22 nt, Human
uggggcacaucugaggucagaa

SEQ ID NO: 770845 - RNA, 19 nt, Human
uggggcuguugccggggag

SEQ ID NO: 770846 - RNA, 20 nt, Human
ugggggccaucgugggaccc

SEQ ID NO: 770847 - RNA, 19 nt, Human
uggguugaggcugccggug

SEQ ID NO: 770848 - RNA, 22 nt, Human
uugaucuggggcacaucugagg

SEQ ID NO: 770849 - RNA, 24 nt, Human
aaacaaaauucacccaacauugaa

SEQ ID NO: 770850 - RNA, 24 nt, Human
aaacacuuacuuuggagaaacaga

SEQ ID NO: 770851 - RNA, 27 nt, Human
aaaucacaaacacuuacuuuggagaaa

SEQ ID NO: 770852 - RNA, 22 nt, Human
aacaaaauucacccaacauuga

SEQ ID NO: 770853 - RNA, 18 nt, Human
aagaaucuggggccaaca

SEQ ID NO: 770854 - RNA, 26 nt, Human
agacaaaagugaacaacuauggucca

SEQ ID NO: 770855 - RNA, 21 nt, Human
agauauaccaccacuugcuau

SEQ ID NO: 770856 - RNA, 23 nt, Human
agggggcgcuggcgggagagcgg

SEQ ID NO: 770857 - RNA, 21 nt, Human
cacugcaguaugaggaacaaa

SEQ ID NO: 770858 - RNA, 24 nt, Human
ccgagcccggcggcggaagaggcg

SEQ ID NO: 770859 - RNA, 20 nt, Human
ccgcgaggagggggcgcugg

SEQ ID NO: 770860 - RNA, 22 nt, Human
ccucggggcggaguggaagggc

SEQ ID NO: 770861 - RNA, 18 nt, Human
cgaggagggggcgcuggc

SEQ ID NO: 770862 - RNA, 23 nt, Human
cgggagagcgggccgcugcgacc

SEQ ID NO: 770863 - RNA, 18 nt, Human
cguggccgcgaggagggg

SEQ ID NO: 770864 - RNA, 22 nt, Human
cuaaaaacaaaauucacccaac

SEQ ID NO: 770865 - RNA, 18 nt, Human
cugcggaggccccgagcc

SEQ ID NO: 770866 - RNA, 19 nt, Human
cugcggaggccccgagccc

SEQ ID NO: 770867 - RNA, 21 nt, Human
cuggcagacaaaagugaacaa

SEQ ID NO: 770868 - RNA, 24 nt, Human
cuguauugugcuccucaaauaccu

SEQ ID NO: 770869 - RNA, 23 nt, Human
gaacaaaucacaaacacuuacuu

SEQ ID NO: 770870 - RNA, 20 nt, Human
gcgcuggcgggagagcgggc

SEQ ID NO: 770871 - RNA, 21 nt, Human
gcgcuggcgggagagcgggcc

SEQ ID NO: 770872 - RNA, 18 nt, Human
gcgcuggcggggaagggc

SEQ ID NO: 770873 - RNA, 19 nt, Human
ggaacaaaucacaaacacu

SEQ ID NO: 770874 - RNA, 19 nt, Human
ggagggggcgcuggcggga

SEQ ID NO: 770875 - RNA, 19 nt, Human
ggccgcugcgaccucgggg

SEQ ID NO: 770876 - RNA, 19 nt, Human
gggaagggcucccucagcg

SEQ ID NO: 770877 - RNA, 20 nt, Human
ggggagagcgagacgcgggc

SEQ ID NO: 770878 - RNA, 18 nt, Human
guggccgcgaggaggggg

SEQ ID NO: 770879 - RNA, 23 nt, Human
uaaaauucugcagcagccuaaag

SEQ ID NO: 770880 - RNA, 21 nt, Human
uauacaagucaguuguacaau

SEQ ID NO: 770881 - RNA, 24 nt, Human
uauuuuaagagaaaggugaacaug

SEQ ID NO: 770882 - RNA, 21 nt, Human
uccucaaauaccuagagccag

SEQ ID NO: 770883 - RNA, 27 nt, Human
ucuaaaaaauucuuucuuccauaggaa

SEQ ID NO: 770884 - RNA, 23 nt, Human
ucuaaaaacaaaauucacccaac

SEQ ID NO: 770885 - RNA, 23 nt, Human
ucuggggccaacauuuguauuuu

SEQ ID NO: 770886 - RNA, 22 nt, Human
ugaacaugaacaucagauuaac

SEQ ID NO: 770887 - RNA, 23 nt, Human
ugcaguaugaggaacaaaucaca

SEQ ID NO: 770888 - RNA, 20 nt, Human
uggaagggcacgcgcuggcg

SEQ ID NO: 770889 - RNA, 19 nt, Human
uguauuuuaucagaaaaaa

SEQ ID NO: 770890 - RNA, 24 nt, Human
uuaaaauucugcagcagccuaaag

SEQ ID NO: 770891 - RNA, 20 nt, Human
uuuuaagagaaaggugaaca

SEQ ID NO: 770892 - RNA, 24 nt, Human
aaaaaaggaaaaacuauacaacgc

SEQ ID NO: 770893 - RNA, 21 nt, Human
aaaaagagaaaaguugcacaa

SEQ ID NO: 770894 - RNA, 22 nt, Human
aaaaagagaaaaguugcacaaa

SEQ ID NO: 770895 - RNA, 19 nt, Human
aaagugcuaggauuacagg

SEQ ID NO: 770896 - RNA, 24 nt, Human
aaagugcuaggauuacagguguga

SEQ ID NO: 770897 - RNA, 21 nt, Human
aaccaagucugaaaccaaugg

SEQ ID NO: 770898 - RNA, 20 nt, Human
aaccaaucuuaauugaacca

SEQ ID NO: 770899 - RNA, 28 nt, Human
aacuaauuauaauacguuucccagccuc

SEQ ID NO: 770900 - RNA, 20 nt, Human
aagcagacucacaaguaagc

SEQ ID NO: 770901 - RNA, 22 nt, Human
aaggaacaccauucugauacca

SEQ ID NO: 770902 - RNA, 22 nt, Human
aaggaugcaugguccagccuuc

SEQ ID NO: 770903 - RNA, 26 nt, Human
aagugcuaggauuacaggugugagcu

SEQ ID NO: 770904 - RNA, 19 nt, Human
acagaguacuuccugaggg

SEQ ID NO: 770905 - RNA, 24 nt, Human
acuauguugccuaggcuggucuug

SEQ ID NO: 770906 - RNA, 21 nt, Human
acuugauucaggccacauuca

SEQ ID NO: 770907 - RNA, 20 nt, Human
agacaagcaguuacaccccc

SEQ ID NO: 770908 - RNA, 22 nt, Human
agaucucacuauguugccuagg

SEQ ID NO: 770909 - RNA, 24 nt, Human
aggugauccuucucccuuggccuc

SEQ ID NO: 770910 - RNA, 25 nt, Human
auacaaaaaaggaaaaacuauacaa

SEQ ID NO: 770911 - RNA, 22 nt, Human
auuuuauuauggaaaauuaaaa

SEQ ID NO: 770912 - RNA, 18 nt, Human
caaaacucagaugcccug

SEQ ID NO: 770913 - RNA, 24 nt, Human
caaagugcuaggauuacaggugug

SEQ ID NO: 770914 - RNA, 23 nt, Human
caaauaugaaaugcuugcacuua

SEQ ID NO: 770915 - RNA, 22 nt, Human
caacucaggacaauaaaaacaa

SEQ ID NO: 770916 - RNA, 25 nt, Human
cacagaguacuuccugagggagaga

SEQ ID NO: 770917 - RNA, 23 nt, Human
cacuaccgaugcugaaagacaag

SEQ ID NO: 770918 - RNA, 24 nt, Human
cacuauguugccuaggcuggucuu

SEQ ID NO: 770919 - RNA, 20 nt, Human
caguucacagaaauggcuga

SEQ ID NO: 770920 - RNA, 18 nt, Human
cauguguauauauauagc

SEQ ID NO: 770921 - RNA, 21 nt, Human
ccaaagugcuaggauuacagg

SEQ ID NO: 770922 - RNA, 24 nt, Human
ccaaagugcuaggauuacaggugu

SEQ ID NO: 770923 - RNA, 21 nt, Human
ccaacagaauuugugaaagac

SEQ ID NO: 770924 - RNA, 22 nt, Human
ccaacagaauuugugaaagaca

SEQ ID NO: 770925 - RNA, 24 nt, Human
cgagaucucacuauguugccuagg

SEQ ID NO: 770926 - RNA, 23 nt, Human
cuaaagccacaguucacagaaau

SEQ ID NO: 770927 - RNA, 21 nt, Human
cugagcucaggugauccuucu

SEQ ID NO: 770928 - RNA, 20 nt, Human
cuguuuuugugugugauaug

SEQ ID NO: 770929 - RNA, 20 nt, Human
cuugaacuccugagcucagg

SEQ ID NO: 770930 - RNA, 19 nt, Human
gaaagaaguuuuaauguaa

SEQ ID NO: 770931 - RNA, 20 nt, Human
gagggagagaauucagauaa

SEQ ID NO: 770932 - RNA, 19 nt, Human
gagguggagaugcucaugg

SEQ ID NO: 770933 - RNA, 19 nt, Human
gauuacaggugugagcuac

SEQ ID NO: 770934 - RNA, 23 nt, Human
gauuacaggugugagcuacugca

SEQ ID NO: 770935 - RNA, 22 nt, Human
gccacaguucacagaaauggcu

SEQ ID NO: 770936 - RNA, 23 nt, Human
gccuaggcuggucuugaacuccu

SEQ ID NO: 770937 - RNA, 21 nt, Human
ggagaaaaacuaauuauaaua

SEQ ID NO: 770938 - RNA, 22 nt, Human
ggauuacaggugugagcuacug

SEQ ID NO: 770939 - RNA, 24 nt, Human
ggcuggucuugaacuccugagcuc

SEQ ID NO: 770940 - RNA, 21 nt, Human
gguuaauaaggaaaagagaaa

SEQ ID NO: 770941 - RNA, 19 nt, Human
guuguccaucccucuucca

SEQ ID NO: 770942 - RNA, 21 nt, Human
uaacagguuaagcuucugaaa

SEQ ID NO: 770943 - RNA, 22 nt, Human
uacaggugugagcuacugcacc

SEQ ID NO: 770944 - RNA, 23 nt, Human
uacaggugugagcuacugcaccu

SEQ ID NO: 770945 - RNA, 18 nt, Human
uacauguguauauauaua

SEQ ID NO: 770946 - RNA, 26 nt, Human
uacccugaccuuggagaaagaaguuu

SEQ ID NO: 770947 - RNA, 18 nt, Human
uacuauaugacuaaugcc

SEQ ID NO: 770948 - RNA, 22 nt, Human
uagagacgagaucucacuaugu

SEQ ID NO: 770949 - RNA, 19 nt, Human
uaggauuacaggugugagc

SEQ ID NO: 770950 - RNA, 22 nt, Human
uaggauuacaggugugagcuac

SEQ ID NO: 770951 - RNA, 22 nt, Human
uaggauuacaggugugagcuac

SEQ ID NO: 770952 - RNA, 24 nt, Human
uaggauuacaggugugagcuacug

SEQ ID NO: 770953 - RNA, 25 nt, Human
uaggauuacaggugugagcuacugc

SEQ ID NO: 770954 - RNA, 20 nt, Human
uauauaaugggcuaccacuu

SEQ ID NO: 770955 - RNA, 20 nt, Human
uauguugccuaggcuggucu

SEQ ID NO: 770956 - RNA, 24 nt, Human
uauguugccuaggcuggucuugaa

SEQ ID NO: 770957 - RNA, 20 nt, Human
ucagagguaugaauaggggg

SEQ ID NO: 770958 - RNA, 23 nt, Human
ucccaaagugcuaggauuacagg

SEQ ID NO: 770959 - RNA, 23 nt, Human
ucccuuggccucccaaagugcua

SEQ ID NO: 770960 - RNA, 23 nt, Human
ucucacuauguugccuaggcugg

SEQ ID NO: 770961 - RNA, 24 nt, Human
ucucacuauguugccuaggcuggu

SEQ ID NO: 770962 - RNA, 21 nt, Human
ucucccuuggccucccaaagu

SEQ ID NO: 770963 - RNA, 24 nt, Human
ucugaaaccaauggaaaaaaaaaa

SEQ ID NO: 770964 - RNA, 23 nt, Human
ucuugaacuccugagcucaggug

SEQ ID NO: 770965 - RNA, 18 nt, Human
ugaaagacaauuggaggu

SEQ ID NO: 770966 - RNA, 22 nt, Human
ugaaaggaaguguaauagagua

SEQ ID NO: 770967 - RNA, 25 nt, Human
ugaacuccugagcucaggugauccu

SEQ ID NO: 770968 - RNA, 25 nt, Human
ugaagcaaaacucagaugcccuguc

SEQ ID NO: 770969 - RNA, 18 nt, Human
ugagcucaggugauccuu

SEQ ID NO: 770970 - RNA, 20 nt, Human
ugagcucaggugauccuucu

SEQ ID NO: 770971 - RNA, 22 nt, Human
ugauccuucucccuuggccucc

SEQ ID NO: 770972 - RNA, 23 nt, Human
ugcaccuggccccaacauuauuu

SEQ ID NO: 770973 - RNA, 24 nt, Human
ugccaguuuacacauucaccaaca

SEQ ID NO: 770974 - RNA, 20 nt, Human
ugcuaggauuacagguguga

SEQ ID NO: 770975 - RNA, 19 nt, Human
uggaaauauuuuuugccaa

SEQ ID NO: 770976 - RNA, 20 nt, Human
uggagguacuaaagccacag

SEQ ID NO: 770977 - RNA, 19 nt, Human
ugggagaaaaacuaauuau

SEQ ID NO: 770978 - RNA, 19 nt, Human
uggguaguguauauuuugc

SEQ ID NO: 770979 - RNA, 22 nt, Human
uggguaguguauauuuugcagg

SEQ ID NO: 770980 - RNA, 24 nt, Human
uggucuugaacuccugagcucagg

SEQ ID NO: 770981 - RNA, 22 nt, Human
uguaagcuaaauggaaccagca

SEQ ID NO: 770982 - RNA, 20 nt, Human
uguagagaaacaacauaaug

SEQ ID NO: 770983 - RNA, 24 nt, Human
uguggaaauauuuuuugccaaagg

SEQ ID NO: 770984 - RNA, 23 nt, Human
uguguacccagcuucaacagaag

SEQ ID NO: 770985 - RNA, 21 nt, Human
uuauaauacguuucccagccu

SEQ ID NO: 770986 - RNA, 24 nt, Human
uucaccaacagaauuugugaaaga

SEQ ID NO: 770987 - RNA, 19 nt, Human
uuccugagggagagaauuc

SEQ ID NO: 770988 - RNA, 20 nt, Human
uuguccaucccucuuccaua

SEQ ID NO: 770989 - RNA, 22 nt, Human
uuuaaacuugauucaggccaca

SEQ ID NO: 770990 - RNA, 19 nt, Human
uuuacauguguauauauau

SEQ ID NO: 770991 - RNA, 19 nt, Human
aaccagccuggcaccaccu

SEQ ID NO: 770992 - RNA, 21 nt, Human
accagucgcgcccaaaccucg

SEQ ID NO: 770993 - RNA, 22 nt, Human
accuggcgccccgccaccccca

SEQ ID NO: 770994 - RNA, 23 nt, Human
agcagcggcggcagcuagcaacc

SEQ ID NO: 770995 - RNA, 18 nt, Human
aggcagguccugcgcggg

SEQ ID NO: 770996 - RNA, 23 nt, Human
caaccagccuggcaccaccuccc

SEQ ID NO: 770997 - RNA, 25 nt, Human
cacccccaacacugccccgaggccc

SEQ ID NO: 770998 - RNA, 22 nt, Human
caucucaaccaccagccucugu

SEQ ID NO: 770999 - RNA, 22 nt, Human
ccacguccagccucuguccucu

SEQ ID NO: 771000 - RNA, 19 nt, Human
ccagccucuguggggggca

SEQ ID NO: 771001 - RNA, 21 nt, Human
ccccaacacugccccgaggcc

SEQ ID NO: 771002 - RNA, 23 nt, Human
cccccaacacugccccgaggccc

SEQ ID NO: 771003 - RNA, 22 nt, Human
ccccgaggcccggugacaauga

SEQ ID NO: 771004 - RNA, 25 nt, Human
ccccgccacccccaacacugccccg

SEQ ID NO: 771005 - RNA, 21 nt, Human
cccugugggccucugggccca

SEQ ID NO: 771006 - RNA, 24 nt, Human
ccgccacccccaacacugccccga

SEQ ID NO: 771007 - RNA, 23 nt, Human
ccggugacaaugaagcggccgga

SEQ ID NO: 771008 - RNA, 21 nt, Human
ccggugacaaugaagcggccu

SEQ ID NO: 771009 - RNA, 18 nt, Human
ccuggcaccaccucccca

SEQ ID NO: 771010 - RNA, 20 nt, Human
cgcccaaaccucgggucggc

SEQ ID NO: 771011 - RNA, 18 nt, Human
cgcgcggggccugcagau

SEQ ID NO: 771012 - RNA, 24 nt, Human
cggaaccagucgcgcccaaaccuc

SEQ ID NO: 771013 - RNA, 19 nt, Human
cggccggggugagcagcgg

SEQ ID NO: 771014 - RNA, 28 nt, Human
gccccgaggcccggugacaaugaagcgg

SEQ ID NO: 771015 - RNA, 19 nt, Human
ggccucugggcccacgucc

SEQ ID NO: 771016 - RNA, 20 nt, Human
ucuguccucugccuuccguu

SEQ ID NO: 771017 - RNA, 19 nt, Human
ugccccgaggcccggugac

SEQ ID NO: 771018 - RNA, 21 nt, Human
ugcggaaccagucgcgcccaa

SEQ ID NO: 771019 - RNA, 20 nt, Human
uggcaccaccuccccagccc

SEQ ID NO: 771020 - RNA, 23 nt, Human
ugggccucugggcccacguccag

SEQ ID NO: 771021 - RNA, 23 nt, Human
ugggcgucccugugggccucugg

SEQ ID NO: 771022 - RNA, 18 nt, Human
uguucccggcaucccugg

SEQ ID NO: 771023 - RNA, 20 nt, Human
uucuucgacaguguucccgg

SEQ ID NO: 771024 - RNA, 22 nt, Human
cagcaccgugagcacgaugcca

SEQ ID NO: 771025 - RNA, 22 nt, Human
caggaccaccacucccagcacc

SEQ ID NO: 771026 - RNA, 20 nt, Human
ccccucgguggcaucggcgc

SEQ ID NO: 771027 - RNA, 18 nt, Human
ccucgcuguccaccacgu

SEQ ID NO: 771028 - RNA, 20 nt, Human
uccugcuccucgcuguccac

SEQ ID NO: 771029 - RNA, 25 nt, Human
ucgcuguccaccacguccagcagau

SEQ ID NO: 771030 - RNA, 22 nt, Human
ugaaguccaggaccaccacucc

SEQ ID NO: 771031 - RNA, 22 nt, Human
aaaacacuggccagaacucugc

SEQ ID NO: 771032 - RNA, 21 nt, Human
aaacuggaggcgguaccaaag

SEQ ID NO: 771033 - RNA, 20 nt, Human
aaagacauuucccucagacu

SEQ ID NO: 771034 - RNA, 19 nt, Human
aaagagccugagggggggc

SEQ ID NO: 771035 - RNA, 19 nt, Human
aaagguagagaaaaguuga

SEQ ID NO: 771036 - RNA, 20 nt, Human
aacaaagccacacccaauag

SEQ ID NO: 771037 - RNA, 21 nt, Human
aacaugauuugggccuuuggc

SEQ ID NO: 771038 - RNA, 20 nt, Human
aacuacuggguaagauggaa

SEQ ID NO: 771039 - RNA, 19 nt, Human
aacucugcuuacagacuac

SEQ ID NO: 771040 - RNA, 23 nt, Human
aacuucuaaauaaaccaaaaacc

SEQ ID NO: 771041 - RNA, 21 nt, Human
aagacguguguaaagcuuucu

SEQ ID NO: 771042 - RNA, 19 nt, Human
aagcauaauuagguuugug

SEQ ID NO: 771043 - RNA, 24 nt, Human
aaucgcuugaacccgggaggcaga

SEQ ID NO: 771044 - RNA, 18 nt, Human
aauuagccaggcauggug

SEQ ID NO: 771045 - RNA, 23 nt, Human
acaaaacacuggccagaacucug

SEQ ID NO: 771046 - RNA, 18 nt, Human
acaaagccacacccaaua

SEQ ID NO: 771047 - RNA, 18 nt, Human
acaagugacccaaagcau

SEQ ID NO: 771048 - RNA, 24 nt, Human
acaauccccagaaugcaaauugcc

SEQ ID NO: 771049 - RNA, 24 nt, Human
acagaaaaaaacaaaaaacacaga

SEQ ID NO: 771050 - RNA, 18 nt, Human
acuccagcuuucucaaga

SEQ ID NO: 771051 - RNA, 21 nt, Human
acuguaacuaucuucauugau

SEQ ID NO: 771052 - RNA, 24 nt, Human
acuguaauccagccugggcaaugg

SEQ ID NO: 771053 - RNA, 26 nt, Human
acuguaauccagccugggcaauggag

SEQ ID NO: 771054 - RNA, 19 nt, Human
acuguacuugacucgggag

SEQ ID NO: 771055 - RNA, 24 nt, Human
acuugaggucaggaguucgagacc

SEQ ID NO: 771056 - RNA, 18 nt, Human
acuuuuuggccauaaucc

SEQ ID NO: 771057 - RNA, 20 nt, Human
agaaacaaauuggcagguga

SEQ ID NO: 771058 - RNA, 23 nt, Human
agaacauguaugcccacuuacaa

SEQ ID NO: 771059 - RNA, 18 nt, Human
agaagagauuguuuuuaa

SEQ ID NO: 771060 - RNA, 18 nt, Human
agaagcaauaaacacaga

SEQ ID NO: 771061 - RNA, 22 nt, Human
agaaguugcagugagccgagau

SEQ ID NO: 771062 - RNA, 24 nt, Human
agaaguugcagugagccgagauug

SEQ ID NO: 771063 - RNA, 22 nt, Human
agaaucgcuugaacccgggagg

SEQ ID NO: 771064 - RNA, 18 nt, Human
agacaagcaugauauucu

SEQ ID NO: 771065 - RNA, 23 nt, Human
agacugauuucuuccaacucucu

SEQ ID NO: 771066 - RNA, 19 nt, Human
agauggucucaguuauuag

SEQ ID NO: 771067 - RNA, 23 nt, Human
agccaggcaugguggcacaugcc

SEQ ID NO: 771068 - RNA, 24 nt, Human
agccugggcaauggagcaagacuc

SEQ ID NO: 771069 - RNA, 24 nt, Human
aggaaaaaauagagaaaaauggag

SEQ ID NO: 771070 - RNA, 21 nt, Human
aggcagaaguugcagugagcc

SEQ ID NO: 771071 - RNA, 24 nt, Human
aggcagaaguugcagugagccgag

SEQ ID NO: 771072 - RNA, 24 nt, Human
aggcaggagaaucgcuugaacccg

SEQ ID NO: 771073 - RNA, 21 nt, Human
aggccaacucguaaauaaugu

SEQ ID NO: 771074 - RNA, 19 nt, Human
aggcgguaccaaagaacuc

SEQ ID NO: 771075 - RNA, 20 nt, Human
aggcugaggcaggagaaucg

SEQ ID NO: 771076 - RNA, 24 nt, Human
aggcugaggcaggagaaucgcuug

SEQ ID NO: 771077 - RNA, 23 nt, Human
aggcuguaguacuugaggucugu

SEQ ID NO: 771078 - RNA, 23 nt, Human
agguggguggaucacuugagguc

SEQ ID NO: 771079 - RNA, 19 nt, Human
aguugggggcuguuuguuu

SEQ ID NO: 771080 - RNA, 22 nt, Human
auaaaccaaaaaccacuaaguc

SEQ ID NO: 771081 - RNA, 24 nt, Human
aucacuugaggucaggaguucgag

SEQ ID NO: 771082 - RNA, 21 nt, Human
augaaaacugcaggcaaauac

SEQ ID NO: 771083 - RNA, 24 nt, Human
auggagcaagacucugucucaaaa

SEQ ID NO: 771084 - RNA, 18 nt, Human
augguauauuuauacccc

SEQ ID NO: 771085 - RNA, 19 nt, Human
auggucucaguuauuagaa

SEQ ID NO: 771086 - RNA, 22 nt, Human
auguguguguauaugugugugu

SEQ ID NO: 771087 - RNA, 23 nt, Human
auugauaccacuagaacuaagac

SEQ ID NO: 771088 - RNA, 24 nt, Human
auugcgccacuguaauccagccug

SEQ ID NO: 771089 - RNA, 23 nt, Human
auuuaucagcauaagugcauuuu

SEQ ID NO: 771090 - RNA, 24 nt, Human
caaaaaacaaacagaaaaaaacaa

SEQ ID NO: 771091 - RNA, 20 nt, Human
caaaaauacaccauagacga

SEQ ID NO: 771092 - RNA, 23 nt, Human
caaacuaguagaagcuuccacaa

SEQ ID NO: 771093 - RNA, 23 nt, Human
caccucagugucuguaacaccau

SEQ ID NO: 771094 - RNA, 21 nt, Human
cacuguaauccagccugggca

SEQ ID NO: 771095 - RNA, 23 nt, Human
cacuugaggucaggaguucgaga

SEQ ID NO: 771096 - RNA, 20 nt, Human
cagaaaaaaacaaaaaacac

SEQ ID NO: 771097 - RNA, 21 nt, Human
cagaacucugcuuacagacua

SEQ ID NO: 771098 - RNA, 19 nt, Human
cagacaagcaugauauucu

SEQ ID NO: 771099 - RNA, 24 nt, Human
cagcuacucaggaggcugaggcag

SEQ ID NO: 771100 - RNA, 22 nt, Human
caggcaaauucuaauauacagu

SEQ ID NO: 771101 - RNA, 24 nt, Human
caucagaauuuaaaaaggaacaag

SEQ ID NO: 771102 - RNA, 20 nt, Human
caucucuacuaaaaauacaa

SEQ ID NO: 771103 - RNA, 23 nt, Human
ccaauaaacuccuuaggccaagc

SEQ ID NO: 771104 - RNA, 20 nt, Human
ccacuguaauccagccuggg

SEQ ID NO: 771105 - RNA, 20 nt, Human
ccacuguaauccagccuggg

SEQ ID NO: 771106 - RNA, 21 nt, Human
ccacuguaauccagccugggc

SEQ ID NO: 771107 - RNA, 24 nt, Human
ccacuguaauccagccugggcaau

SEQ ID NO: 771108 - RNA, 24 nt, Human
ccauuuggauucugcaugauuucu

SEQ ID NO: 771109 - RNA, 23 nt, Human
cccacuggcggagacugauuucu

SEQ ID NO: 771110 - RNA, 23 nt, Human
cccaguaacaaauacaaacauaa

SEQ ID NO: 771111 - RNA, 21 nt, Human
ccccagaaugcaaauugccau

SEQ ID NO: 771112 - RNA, 19 nt, Human
ccccagugcccuagagacc

SEQ ID NO: 771113 - RNA, 19 nt, Human
ccugaccaacaaggugaaa

SEQ ID NO: 771114 - RNA, 24 nt, Human
ccugaccaacaaggugaaaucuca

SEQ ID NO: 771115 - RNA, 22 nt, Human
ccuggaagcuuugaggcucuag

SEQ ID NO: 771116 - RNA, 22 nt, Human
ccugggcaauggagcaagacuc

SEQ ID NO: 771117 - RNA, 21 nt, Human
ccuguagucccagcuacucag

SEQ ID NO: 771118 - RNA, 21 nt, Human
cgagaccagccugaccaacaa

SEQ ID NO: 771119 - RNA, 25 nt, Human
cgagguggguggaucacuugagguu

SEQ ID NO: 771120 - RNA, 24 nt, Human
cgccacuguaauccagccugggca

SEQ ID NO: 771121 - RNA, 24 nt, Human
cgggaggcagaaguugcagugagc

SEQ ID NO: 771122 - RNA, 27 nt, Human
cuagcaccaacauauguuacaaaugaa

SEQ ID NO: 771123 - RNA, 21 nt, Human
cucaaaaaacaaacagaaaaa

SEQ ID NO: 771124 - RNA, 23 nt, Human
cucacuuccauuucagacuuaac

SEQ ID NO: 771125 - RNA, 22 nt, Human
cucugucucaaaaaacaaacag

SEQ ID NO: 771126 - RNA, 19 nt, Human
cugacaagugacccaaagc

SEQ ID NO: 771127 - RNA, 20 nt, Human
cugacguggagagggaugga

SEQ ID NO: 771128 - RNA, 21 nt, Human
cugaugcaugucuuggauuga

SEQ ID NO: 771129 - RNA, 24 nt, Human
cuuaagcaugcaaacauaaccacc

SEQ ID NO: 771130 - RNA, 24 nt, Human
cuugucuuggccuggaagcuuuga

SEQ ID NO: 771131 - RNA, 25 nt, Human
cuuuauuaguuuucccuggguguga

SEQ ID NO: 771132 - RNA, 25 nt, Human
gaaagagccugagggggggcggagc

SEQ ID NO: 771133 - RNA, 20 nt, Human
gaacauuuggaagugacagc

SEQ ID NO: 771134 - RNA, 21 nt, Human
gacaauaaagacauuucccuc

SEQ ID NO: 771135 - RNA, 18 nt, Human
gagagaaggagggagcag

SEQ ID NO: 771136 - RNA, 18 nt, Human
gagauaauuaugcucaaa

SEQ ID NO: 771137 - RNA, 23 nt, Human
gagauugcgccacuguaauccag

SEQ ID NO: 771138 - RNA, 20 nt, Human
gagcaagacucugucucaaa

SEQ ID NO: 771139 - RNA, 24 nt, Human
gagguggguggaucacuugagguu

SEQ ID NO: 771140 - RNA, 23 nt, Human
gauaucuucaaacagcaacaauu

SEQ ID NO: 771141 - RNA, 21 nt, Human
gaucacuugaggucaggaguu

SEQ ID NO: 771142 - RNA, 24 nt, Human
gaucacuugaggucaggaguucga

SEQ ID NO: 771143 - RNA, 19 nt, Human
gauugagcauucacugcgg

SEQ ID NO: 771144 - RNA, 19 nt, Human
gcagaauacccaccaggaa

SEQ ID NO: 771145 - RNA, 22 nt, Human
gccacuguaauccagccugggc

SEQ ID NO: 771146 - RNA, 24 nt, Human
gccacuguaauccagccugggcaa

SEQ ID NO: 771147 - RNA, 23 nt, Human
gccaucauccccaaggaaaaaca

SEQ ID NO: 771148 - RNA, 19 nt, Human
gcccugaugcaugucuugg

SEQ ID NO: 771149 - RNA, 24 nt, Human
gccugaccaacaaggugaaaucuc

SEQ ID NO: 771150 - RNA, 22 nt, Human
gccuggucuacuguacuugacu

SEQ ID NO: 771151 - RNA, 23 nt, Human
gccuugggaugcuugucuuggcc

SEQ ID NO: 771152 - RNA, 23 nt, Human
gcucauuuaaagugcaaaucuga

SEQ ID NO: 771153 - RNA, 19 nt, Human
gcugcagccuuauugaucu

SEQ ID NO: 771154 - RNA, 20 nt, Human
gcuguaguacuugaggucug

SEQ ID NO: 771155 - RNA, 22 nt, Human
ggaaaaauaaaacuuacauaga

SEQ ID NO: 771156 - RNA, 18 nt, Human
ggagcaagacucugucuc

SEQ ID NO: 771157 - RNA, 21 nt, Human
gguggaucacuugaggucagg

SEQ ID NO: 771158 - RNA, 24 nt, Human
guaauccagccugggcaauggagc

SEQ ID NO: 771159 - RNA, 21 nt, Human
guugcagugagccgagauugc

SEQ ID NO: 771160 - RNA, 18 nt, Human
uaaaaacacaaaaacuac

SEQ ID NO: 771161 - RNA, 23 nt, Human
uaaaaacacaaaaacuacugggu

SEQ ID NO: 771162 - RNA, 19 nt, Human
uaaagcagcugcaggugaa

SEQ ID NO: 771163 - RNA, 19 nt, Human
uaaauaaaccaaaaaccac

SEQ ID NO: 771164 - RNA, 24 nt, Human
uaacauuagcugacugacccuggc

SEQ ID NO: 771165 - RNA, 19 nt, Human
uaagaagcagacaagcaug

SEQ ID NO: 771166 - RNA, 18 nt, Human
uaaggcucuugagcauuu

SEQ ID NO: 771167 - RNA, 23 nt, Human
uaauccagccugggcaauggagc

SEQ ID NO: 771168 - RNA, 25 nt, Human
uaaucuccuuuauucaucacaaagc

SEQ ID NO: 771169 - RNA, 21 nt, Human
uacaaaacacuggccagaacu

SEQ ID NO: 771170 - RNA, 20 nt, Human
uacaaaacacuggccagaag

SEQ ID NO: 771171 - RNA, 18 nt, Human
uaccaaggagaaaguggg

SEQ ID NO: 771172 - RNA, 18 nt, Human
uaccaaggagaaaguggg

SEQ ID NO: 771173 - RNA, 19 nt, Human
uaccaaggagaaagugggu

SEQ ID NO: 771174 - RNA, 20 nt, Human
uacguuguggcuuuauuagu

SEQ ID NO: 771175 - RNA, 21 nt, Human
uacuguacuugacucgggagg

SEQ ID NO: 771176 - RNA, 23 nt, Human
uacuuuggcaacuuggaacccaa

SEQ ID NO: 771177 - RNA, 19 nt, Human
uagaacuaagacaauaaau

SEQ ID NO: 771178 - RNA, 20 nt, Human
uaugccaacauuuucaggag

SEQ ID NO: 771179 - RNA, 23 nt, Human
uaugucaugcaagcauccuagau

SEQ ID NO: 771180 - RNA, 21 nt, Human
uauguguguguauaugugugu

SEQ ID NO: 771181 - RNA, 18 nt, Human
uaugugugugugcaugca

SEQ ID NO: 771182 - RNA, 23 nt, Human
uauuucaacaaagccacacccaa

SEQ ID NO: 771183 - RNA, 22 nt, Human
ucaagccugaauuaccagcaaa

SEQ ID NO: 771184 - RNA, 24 nt, Human
uccacaagccuaaggguucaagcc

SEQ ID NO: 771185 - RNA, 18 nt, Human
uccauuaucaccauaucu

SEQ ID NO: 771186 - RNA, 21 nt, Human
uccccagaaugcaaauugcca

SEQ ID NO: 771187 - RNA, 18 nt, Human
uccgugggauccccugga

SEQ ID NO: 771188 - RNA, 18 nt, Human
ucgcuugaacccgggagg

SEQ ID NO: 771189 - RNA, 25 nt, Human
ucuaauauauauauaaauacaauga

SEQ ID NO: 771190 - RNA, 19 nt, Human
ucuacuaauuuccucuuuc

SEQ ID NO: 771191 - RNA, 24 nt, Human
ucucaaaaaacaaacagaaaaaaa

SEQ ID NO: 771192 - RNA, 22 nt, Human
ucucuacuaaaaauacaaaaaa

SEQ ID NO: 771193 - RNA, 25 nt, Human
ucugacaaccacaauaaauacagac

SEQ ID NO: 771194 - RNA, 19 nt, Human
ucugauuauuugcaagauu

SEQ ID NO: 771195 - RNA, 19 nt, Human
ucugucugcggugcggugg

SEQ ID NO: 771196 - RNA, 22 nt, Human
ugaaaaaggcugcucuuccaaa

SEQ ID NO: 771197 - RNA, 20 nt, Human
ugacaagugacccaaagcau

SEQ ID NO: 771198 - RNA, 21 nt, Human
ugacaugauuugggagaagag

SEQ ID NO: 771199 - RNA, 19 nt, Human
ugacaugcugggaauauau

SEQ ID NO: 771200 - RNA, 23 nt, Human
ugacuuaaaaucaaugggaaaaa

SEQ ID NO: 771201 - RNA, 18 nt, Human
ugagcauuuacaguaaug

SEQ ID NO: 771202 - RNA, 22 nt, Human
ugagccgagauugcgccacugu

SEQ ID NO: 771203 - RNA, 20 nt, Human
ugaggcaggagaaucgcuug

SEQ ID NO: 771204 - RNA, 24 nt, Human
ugaggcaggagaaucgcuugaacc

SEQ ID NO: 771205 - RNA, 25 nt, Human
ugaggcaggagaaucgcuugaaccc

SEQ ID NO: 771206 - RNA, 22 nt, Human
ugauagguaagggaauaauggg

SEQ ID NO: 771207 - RNA, 20 nt, Human
ugaugaaaaaggcugcucuu

SEQ ID NO: 771208 - RNA, 19 nt, Human
ugauuucaaaguacauccc

SEQ ID NO: 771209 - RNA, 18 nt, Human
ugauuucuuccaacucuc

SEQ ID NO: 771210 - RNA, 22 nt, Human
ugccaaaugauaaggcucuuga

SEQ ID NO: 771211 - RNA, 24 nt, Human
ugccuguagucccagcuacucagg

SEQ ID NO: 771212 - RNA, 23 nt, Human
ugcuuuuuagaauucauuuuaca

SEQ ID NO: 771213 - RNA, 20 nt, Human
uggaacccaaaaaugucuug

SEQ ID NO: 771214 - RNA, 26 nt, Human
uggagcaagacucugucucaaaaaac

SEQ ID NO: 771215 - RNA, 24 nt, Human
uggaucacuugaggucaggaguuc

SEQ ID NO: 771216 - RNA, 27 nt, Human
uggaucacuugaggucaggaguucgag

SEQ ID NO: 771217 - RNA, 19 nt, Human
uggauccacaagccuaagg

SEQ ID NO: 771218 - RNA, 19 nt, Human
uggccuugggaugcuuguc

SEQ ID NO: 771219 - RNA, 19 nt, Human
ugggaauauauuucuguga

SEQ ID NO: 771220 - RNA, 19 nt, Human
ugggagaagaggaaggcag

SEQ ID NO: 771221 - RNA, 23 nt, Human
ugggaugcuugucuuggccugga

SEQ ID NO: 771222 - RNA, 20 nt, Human
ugggucugggaaggcugcug

SEQ ID NO: 771223 - RNA, 27 nt, Human
ugguagcaaacacuucuuucaaauuuc

SEQ ID NO: 771224 - RNA, 24 nt, Human
ugguauguguguguauaugugugu

SEQ ID NO: 771225 - RNA, 24 nt, Human
ugguggcacaugccuguaguccca

SEQ ID NO: 771226 - RNA, 22 nt, Human
uguaacaccauuuaugcuacag

SEQ ID NO: 771227 - RNA, 24 nt, Human
ugugaaacuuaacaaaccccauaa

SEQ ID NO: 771228 - RNA, 18 nt, Human
ugugugcaugcacaugug

SEQ ID NO: 771229 - RNA, 23 nt, Human
uguguguauaugugugugugcau

SEQ ID NO: 771230 - RNA, 24 nt, Human
ugugugugcaugcacauguguuug

SEQ ID NO: 771231 - RNA, 19 nt, Human
uguguguguauaugugugu

SEQ ID NO: 771232 - RNA, 20 nt, Human
uguguguguauaugugugug

SEQ ID NO: 771233 - RNA, 22 nt, Human
uguguguguauaugugugugug

SEQ ID NO: 771234 - RNA, 21 nt, Human
uuaauggaaaagugacaugcu

SEQ ID NO: 771235 - RNA, 24 nt, Human
uuacagacuaccaucuuccauuau

SEQ ID NO: 771236 - RNA, 22 nt, Human
uuacuaagaagcagacaagcau

SEQ ID NO: 771237 - RNA, 25 nt, Human
uuaguuaaaauaguagccauauuca

SEQ ID NO: 771238 - RNA, 24 nt, Human
uuauuggugacuuuuuacaagugg

SEQ ID NO: 771239 - RNA, 19 nt, Human
uucaauggaaccuccacca

SEQ ID NO: 771240 - RNA, 24 nt, Human
uucacuuuucuuucuuuaggaugc

SEQ ID NO: 771241 - RNA, 26 nt, Human
uucagacuuaacauuuacuaagaagc

SEQ ID NO: 771242 - RNA, 20 nt, Human
uuccucuuuacauuuuuggu

SEQ ID NO: 771243 - RNA, 18 nt, Human
uucguuguguuaguggcc

SEQ ID NO: 771244 - RNA, 18 nt, Human
uugcagugagccgagauu

SEQ ID NO: 771245 - RNA, 19 nt, Human
uugcagugagccgagauug

SEQ ID NO: 771246 - RNA, 22 nt, Human
uugcagugagccgagauugcgc

SEQ ID NO: 771247 - RNA, 23 nt, Human
uugcgccacuguaauccagccug

SEQ ID NO: 771248 - RNA, 21 nt, Human
uuugaaagagccugagggggg

SEQ ID NO: 771249 - RNA, 19 nt, Human
uuuucaggagagacuuuac

SEQ ID NO: 771250 - RNA, 22 nt, Human
uuuuccucuuuacauuuuuggu

SEQ ID NO: 771251 - RNA, 21 nt, Human
aaaaccaugcaggccaaauca

SEQ ID NO: 771252 - RNA, 20 nt, Human
aaacccagcuagccuuggaa

SEQ ID NO: 771253 - RNA, 23 nt, Human
aaagaaaaagggguaggaggaaa

SEQ ID NO: 771254 - RNA, 24 nt, Human
aaagcacugggauuacaggcauga

SEQ ID NO: 771255 - RNA, 24 nt, Human
aaagugcugggauuacaggcauga

SEQ ID NO: 771256 - RNA, 21 nt, Human
aaccuccagcaaugcccagcu

SEQ ID NO: 771257 - RNA, 20 nt, Human
aagaagugguuuuauuccag

SEQ ID NO: 771258 - RNA, 18 nt, Human
aagcaaaaacagaacagg

SEQ ID NO: 771259 - RNA, 18 nt, Human
aagcaaaaacagaacagg

SEQ ID NO: 771260 - RNA, 18 nt, Human
aagcagaaguccccugug

SEQ ID NO: 771261 - RNA, 21 nt, Human
aagcagugcucacgugaggcu

SEQ ID NO: 771262 - RNA, 24 nt, Human
aagugauccaccugucuuggccuu

SEQ ID NO: 771263 - RNA, 19 nt, Human
aagugcugggauuacaggc

SEQ ID NO: 771264 - RNA, 21 nt, Human
aagugcugggauuacaggcau

SEQ ID NO: 771265 - RNA, 21 nt, Human
acaaagggggaaaugugugau

SEQ ID NO: 771266 - RNA, 19 nt, Human
acaaguggucccugccuuc

SEQ ID NO: 771267 - RNA, 20 nt, Human
acauuuuguuuguuugagac

SEQ ID NO: 771268 - RNA, 24 nt, Human
accauuuuggucaggcuggucucg

SEQ ID NO: 771269 - RNA, 20 nt, Human
acgggguuucaccauuuugg

SEQ ID NO: 771270 - RNA, 21 nt, Human
acgggguuucaccauuuuggu

SEQ ID NO: 771271 - RNA, 24 nt, Human
acgggguuucaccauuuuggucag

SEQ ID NO: 771272 - RNA, 18 nt, Human
acuaaagugcaaauuccc

SEQ ID NO: 771273 - RNA, 22 nt, Human
acuccaucacaccaggucugag

SEQ ID NO: 771274 - RNA, 19 nt, Human
agaagggaugagaggcaga

SEQ ID NO: 771275 - RNA, 24 nt, Human
agacaggaagggaguagcacagaa

SEQ ID NO: 771276 - RNA, 24 nt, Human
agacugagcuggggccugcugacu

SEQ ID NO: 771277 - RNA, 25 nt, Human
agagaugagcccacccagcugcagg

SEQ ID NO: 771278 - RNA, 21 nt, Human
agaggggcacaggcacccaga

SEQ ID NO: 771279 - RNA, 18 nt, Human
agcagcugaggggagaga

SEQ ID NO: 771280 - RNA, 21 nt, Human
agccucugggccuuggguccc

SEQ ID NO: 771281 - RNA, 21 nt, Human
aggaccagcaggggaccaaga

SEQ ID NO: 771282 - RNA, 20 nt, Human
aggagggugagcaggggaag

SEQ ID NO: 771283 - RNA, 24 nt, Human
aggagugcagugacacgaucucgg

SEQ ID NO: 771284 - RNA, 25 nt, Human
aggcaggagugcagugacacgaucu

SEQ ID NO: 771285 - RNA, 23 nt, Human
aggcauuggcagugggauagcug

SEQ ID NO: 771286 - RNA, 24 nt, Human
aggcauuggcagugggauagcugg

SEQ ID NO: 771287 - RNA, 21 nt, Human
agggaugaaguguggggccag

SEQ ID NO: 771288 - RNA, 19 nt, Human
agggcucugagggcaguug

SEQ ID NO: 771289 - RNA, 20 nt, Human
agggcuucugaggaggguga

SEQ ID NO: 771290 - RNA, 24 nt, Human
aggugcaggagacacugcaccagc

SEQ ID NO: 771291 - RNA, 22 nt, Human
aguagagacgggguuucaccau

SEQ ID NO: 771292 - RNA, 18 nt, Human
aguagcugggauuacaga

SEQ ID NO: 771293 - RNA, 24 nt, Human
agugcagugacacgaucucggcuc

SEQ ID NO: 771294 - RNA, 18 nt, Human
agugcugggauuacaggc

SEQ ID NO: 771295 - RNA, 21 nt, Human
aguggugacagugugggugag

SEQ ID NO: 771296 - RNA, 18 nt, Human
aguugcuggggcugagga

SEQ ID NO: 771297 - RNA, 19 nt, Human
aguugguggacagggagca

SEQ ID NO: 771298 - RNA, 19 nt, Human
aguuugcagaaguuccugu

SEQ ID NO: 771299 - RNA, 19 nt, Human
auccucaccccagggaguc

SEQ ID NO: 771300 - RNA, 24 nt, Human
augauccacccaucucagccuccc

SEQ ID NO: 771301 - RNA, 21 nt, Human
auuccagaaggcauuggcagu

SEQ ID NO: 771302 - RNA, 24 nt, Human
auuuuuguguuuuuaguagagacg

SEQ ID NO: 771303 - RNA, 21 nt, Human
caaaccuccagcaaugcccag

SEQ ID NO: 771304 - RNA, 24 nt, Human
caaagcacugggauuacaggcaug

SEQ ID NO: 771305 - RNA, 24 nt, Human
caaagugcugggauuacaggcaug

SEQ ID NO: 771306 - RNA, 21 nt, Human
caagaaauacuuauugaacau

SEQ ID NO: 771307 - RNA, 19 nt, Human
caagacaaguggucccugc

SEQ ID NO: 771308 - RNA, 22 nt, Human
caagcgauucuccugucucagc

SEQ ID NO: 771309 - RNA, 18 nt, Human
caagugacuccaccucuc

SEQ ID NO: 771310 - RNA, 22 nt, Human
caagugauccaccugucuuggc

SEQ ID NO: 771311 - RNA, 19 nt, Human
caaguggucccugccuuca

SEQ ID NO: 771312 - RNA, 21 nt, Human
caaugcccagcuggagagagu

SEQ ID NO: 771313 - RNA, 19 nt, Human
cacagcaaacugcuguuca

SEQ ID NO: 771314 - RNA, 20 nt, Human
cacagguccagcaagugggc

SEQ ID NO: 771315 - RNA, 23 nt, Human
caccacgcccggcuaauuuuugu

SEQ ID NO: 771316 - RNA, 19 nt, Human
caccauccaaaagcgcuua

SEQ ID NO: 771317 - RNA, 30 nt, Human
caccauccaaaagcgcuuaaagugucccag

SEQ ID NO: 771318 - RNA, 21 nt, Human
caccauuuuggucaggcuggu

SEQ ID NO: 771319 - RNA, 24 nt, Human
caccauuuuggucaggcuggucuc

SEQ ID NO: 771320 - RNA, 20 nt, Human
cacccacugucccaucuccu

SEQ ID NO: 771321 - RNA, 22 nt, Human
cacccaucucagccucccaaag

SEQ ID NO: 771322 - RNA, 23 nt, Human
cacccaucucagccucccaaagu

SEQ ID NO: 771323 - RNA, 22 nt, Human
cacccuccucacugcuugcacc

SEQ ID NO: 771324 - RNA, 24 nt, Human
caccucaagugauccaccugucuu

SEQ ID NO: 771325 - RNA, 18 nt, Human
caccugucuuggccuucc

SEQ ID NO: 771326 - RNA, 23 nt, Human
caccugucuuggccuuccaaagc

SEQ ID NO: 771327 - RNA, 26 nt, Human
cacugcaccagccccacugcagggcu

SEQ ID NO: 771328 - RNA, 23 nt, Human
cacugcuaccucugccucccggg

SEQ ID NO: 771329 - RNA, 23 nt, Human
cacugcuugcaccgacugaggca

SEQ ID NO: 771330 - RNA, 20 nt, Human
cacugggauuacaggcauga

SEQ ID NO: 771331 - RNA, 24 nt, Human
cacugugucuggagcucaguuucc

SEQ ID NO: 771332 - RNA, 20 nt, Human
cagagacccaggcacccucc

SEQ ID NO: 771333 - RNA, 22 nt, Human
cagagacugggucuugcuaugu

SEQ ID NO: 771334 - RNA, 19 nt, Human
cagagagccuaaaggucaa

SEQ ID NO: 771335 - RNA, 24 nt, Human
cagcaggggaccaagaaggacggc

SEQ ID NO: 771336 - RNA, 20 nt, Human
cagccuccugaguagcuggg

SEQ ID NO: 771337 - RNA, 19 nt, Human
cagcugaggggagagagau

SEQ ID NO: 771338 - RNA, 19 nt, Human
cagcuuuaagcccugcccu

SEQ ID NO: 771339 - RNA, 22 nt, Human
caggagacacugcaccagcccc

SEQ ID NO: 771340 - RNA, 19 nt, Human
caggagugcuugugaccau

SEQ ID NO: 771341 - RNA, 24 nt, Human
caggggaagugcuggagcagccuc

SEQ ID NO: 771342 - RNA, 20 nt, Human
cauccaaaagcgcuuaaagu

SEQ ID NO: 771343 - RNA, 24 nt, Human
caucucagccucccaaagugcugg

SEQ ID NO: 771344 - RNA, 24 nt, Human
caugauccacccaucucagccucc

SEQ ID NO: 771345 - RNA, 21 nt, Human
caugcuuuggucaagaagagg

SEQ ID NO: 771346 - RNA, 21 nt, Human
cauuacggaagugccugggug

SEQ ID NO: 771347 - RNA, 21 nt, Human
ccaaaccuccagcaaugccca

SEQ ID NO: 771348 - RNA, 22 nt, Human
ccaaagcacugggauuacaggc

SEQ ID NO: 771349 - RNA, 24 nt, Human
ccaaagcacugggauuacaggcau

SEQ ID NO: 771350 - RNA, 23 nt, Human
ccaaagugcugggauuacaggca

SEQ ID NO: 771351 - RNA, 24 nt, Human
ccaaagugcugggauuacaggcau

SEQ ID NO: 771352 - RNA, 20 nt, Human
ccaccacgcccggcuaauuu

SEQ ID NO: 771353 - RNA, 18 nt, Human
ccaccagcucccuguagg

SEQ ID NO: 771354 - RNA, 26 nt, Human
ccacccaucucagccucccaaagugc

SEQ ID NO: 771355 - RNA, 24 nt, Human
ccaccccuucucagcugugugauc

SEQ ID NO: 771356 - RNA, 22 nt, Human
ccagcuuuaagcccugcccuuc

SEQ ID NO: 771357 - RNA, 19 nt, Human
cccaaagaaguauuuccuc

SEQ ID NO: 771358 - RNA, 24 nt, Human
cccaaagugcugggauuacaggca

SEQ ID NO: 771359 - RNA, 21 nt, Human
cccacagauccucgcucugaa

SEQ ID NO: 771360 - RNA, 23 nt, Human
cccacagguccagcaagugggcu

SEQ ID NO: 771361 - RNA, 19 nt, Human
cccaccauccaaaagcgcu

SEQ ID NO: 771362 - RNA, 24 nt, Human
cccaccauccaaaagcgcuuaaag

SEQ ID NO: 771363 - RNA, 19 nt, Human
ccccagcuguuuguuuucg

SEQ ID NO: 771364 - RNA, 20 nt, Human
ccccauccugccucuaacac

SEQ ID NO: 771365 - RNA, 20 nt, Human
cccccgcagagagccuaaaa

SEQ ID NO: 771366 - RNA, 21 nt, Human
cccccuagugggaagcugccu

SEQ ID NO: 771367 - RNA, 18 nt, Human
cccccuccccacagaucc

SEQ ID NO: 771368 - RNA, 19 nt, Human
ccccucuuccaucuucucu

SEQ ID NO: 771369 - RNA, 20 nt, Human
ccccucuuccaucuucucuc

SEQ ID NO: 771370 - RNA, 20 nt, Human
cccggguucaagcgauucuc

SEQ ID NO: 771371 - RNA, 23 nt, Human
cccggguucaagcgauucuccug

SEQ ID NO: 771372 - RNA, 21 nt, Human
cccugccuucauggagcucac

SEQ ID NO: 771373 - RNA, 23 nt, Human
ccggggcgggggcgcucgcagcc

SEQ ID NO: 771374 - RNA, 22 nt, Human
ccucaaggacagcuaguggcac

SEQ ID NO: 771375 - RNA, 24 nt, Human
ccucccggguucaagcgauucucc

SEQ ID NO: 771376 - RNA, 19 nt, Human
ccucuaacaccagcuuuaa

SEQ ID NO: 771377 - RNA, 21 nt, Human
ccugaccucaugauccaccca

SEQ ID NO: 771378 - RNA, 19 nt, Human
ccugaguagcugggauuac

SEQ ID NO: 771379 - RNA, 20 nt, Human
ccuggguggaggauggagug

SEQ ID NO: 771380 - RNA, 23 nt, Human
ccuggguggugagggagcccucc

SEQ ID NO: 771381 - RNA, 18 nt, Human
ccuguuucuucaugcucu

SEQ ID NO: 771382 - RNA, 19 nt, Human
ccuucuuuguagggaugaa

SEQ ID NO: 771383 - RNA, 24 nt, Human
cgcucugucacccaggcaggagug

SEQ ID NO: 771384 - RNA, 23 nt, Human
cgugggcucaaggauuugcccuc

SEQ ID NO: 771385 - RNA, 19 nt, Human
cuaagcuucugaccuguga

SEQ ID NO: 771386 - RNA, 23 nt, Human
cuagaacccacgucacugggugg

SEQ ID NO: 771387 - RNA, 18 nt, Human
cucaagugauccaccugu

SEQ ID NO: 771388 - RNA, 24 nt, Human
cucaagugauccaccugucuuggc

SEQ ID NO: 771389 - RNA, 24 nt, Human
cucacugcuaccucugccucccgg

SEQ ID NO: 771390 - RNA, 18 nt, Human
cucacuucuuaucagugc

SEQ ID NO: 771391 - RNA, 24 nt, Human
cucagccuccugaguagcugggau

SEQ ID NO: 771392 - RNA, 19 nt, Human
cucccccuccccacagauc

SEQ ID NO: 771393 - RNA, 18 nt, Human
cucccuucuuucucuucc

SEQ ID NO: 771394 - RNA, 18 nt, Human
cuccugaccucaugaucc

SEQ ID NO: 771395 - RNA, 22 nt, Human
cucucggauacaggaaacccag

SEQ ID NO: 771396 - RNA, 24 nt, Human
cucugugcaucacuuucuuccuug

SEQ ID NO: 771397 - RNA, 22 nt, Human
cugcauccccccaccauccaaa

SEQ ID NO: 771398 - RNA, 19 nt, Human
cuggcuggauucuggaaau

SEQ ID NO: 771399 - RNA, 19 nt, Human
cugggcccacauggccccc

SEQ ID NO: 771400 - RNA, 24 nt, Human
cugggucuugcuauguugcccagg

SEQ ID NO: 771401 - RNA, 23 nt, Human
cugucucagccuccugaguagcu

SEQ ID NO: 771402 - RNA, 25 nt, Human
cuuaaagugucccacagguccagca

SEQ ID NO: 771403 - RNA, 21 nt, Human
cuugcuuuucuguaguuugca

SEQ ID NO: 771404 - RNA, 20 nt, Human
gaacccacgucacugggugg

SEQ ID NO: 771405 - RNA, 25 nt, Human
gaccaagaaggacggcccggauucc

SEQ ID NO: 771406 - RNA, 19 nt, Human
gacccagccucucugggcc

SEQ ID NO: 771407 - RNA, 22 nt, Human
gacccagccucucugggcccac

SEQ ID NO: 771408 - RNA, 22 nt, Human
gaccucaugauccacccaucuc

SEQ ID NO: 771409 - RNA, 24 nt, Human
gaccucaugauccacccaucucag

SEQ ID NO: 771410 - RNA, 21 nt, Human
gacuuugcucccccuccccac

SEQ ID NO: 771411 - RNA, 22 nt, Human
gagacccagccucucugggccc

SEQ ID NO: 771412 - RNA, 18 nt, Human
gagacgggguuucaccau

SEQ ID NO: 771413 - RNA, 24 nt, Human
gagacgggguuucaccauuuuggu

SEQ ID NO: 771414 - RNA, 24 nt, Human
gagaggcuguggcugcuuuccaga

SEQ ID NO: 771415 - RNA, 20 nt, Human
gaggauggaguguugcuugg

SEQ ID NO: 771416 - RNA, 24 nt, Human
gaguagcugggauuacagacgcgc

SEQ ID NO: 771417 - RNA, 18 nt, Human
gauuacagacgcgcgcca

SEQ ID NO: 771418 - RNA, 18 nt, Human
gauuacaggcaugagcca

SEQ ID NO: 771419 - RNA, 19 nt, Human
gauuacaggcaugagccac

SEQ ID NO: 771420 - RNA, 23 nt, Human
gauuacaggcaugagccacugca

SEQ ID NO: 771421 - RNA, 21 nt, Human
gauuacaggcaugagcuacca

SEQ ID NO: 771422 - RNA, 22 nt, Human
gauuacaggcaugagcuaccau

SEQ ID NO: 771423 - RNA, 21 nt, Human
gauucuccugucucagccucc

SEQ ID NO: 771424 - RNA, 22 nt, Human
gcacaggagccucucggauaca

SEQ ID NO: 771425 - RNA, 18 nt, Human
gccacugcacccagccgu

SEQ ID NO: 771426 - RNA, 24 nt, Human
gcgauucuccugucucagccuccu

SEQ ID NO: 771427 - RNA, 18 nt, Human
gcgccccaggugggggac

SEQ ID NO: 771428 - RNA, 20 nt, Human
gcuagccaguggcaggcaca

SEQ ID NO: 771429 - RNA, 19 nt, Human
gcuggagcagccucugggc

SEQ ID NO: 771430 - RNA, 23 nt, Human
gcuggucucgaacuccugaccuc

SEQ ID NO: 771431 - RNA, 21 nt, Human
ggaaaugugugauucagcccc

SEQ ID NO: 771432 - RNA, 18 nt, Human
ggaaggcaggggcggagc

SEQ ID NO: 771433 - RNA, 19 nt, Human
ggaagugcuggagcagccu

SEQ ID NO: 771434 - RNA, 20 nt, Human
ggagggcuucugaggagggu

SEQ ID NO: 771435 - RNA, 22 nt, Human
ggagggggagggaagacugagc

SEQ ID NO: 771436 - RNA, 18 nt, Human
ggauacaggaaacccagc

SEQ ID NO: 771437 - RNA, 22 nt, Human
ggauuacaggcaugagccacug

SEQ ID NO: 771438 - RNA, 24 nt, Human
ggauuacaggcaugagcuaccaug

SEQ ID NO: 771439 - RNA, 24 nt, Human
ggcagacgggcgccccaggugggg

SEQ ID NO: 771440 - RNA, 24 nt, Human
ggcuggucucgaacuccugaccuc

SEQ ID NO: 771441 - RNA, 18 nt, Human
gggagagagaugagccca

SEQ ID NO: 771442 - RNA, 20 nt, Human
gggagggggagggaagacug

SEQ ID NO: 771443 - RNA, 21 nt, Human
gggagggggugggcgugggcu

SEQ ID NO: 771444 - RNA, 19 nt, Human
gggcagggccgaggguggg

SEQ ID NO: 771445 - RNA, 18 nt, Human
ggggaagugcuggagcag

SEQ ID NO: 771446 - RNA, 22 nt, Human
gggggagggaagacugagcugg

SEQ ID NO: 771447 - RNA, 20 nt, Human
gggggucaaggaccaugucc

SEQ ID NO: 771448 - RNA, 23 nt, Human
gggguuucaccauuuuggucagg

SEQ ID NO: 771449 - RNA, 22 nt, Human
gggucuugcuauguugcccagg

SEQ ID NO: 771450 - RNA, 24 nt, Human
gggugagcaggggaagugcuggag

SEQ ID NO: 771451 - RNA, 20 nt, Human
ggguggugggagacuggagg

SEQ ID NO: 771452 - RNA, 22 nt, Human
ggguuucaccauuuuggucagg

SEQ ID NO: 771453 - RNA, 23 nt, Human
gguccagcaagugggcugggcac

SEQ ID NO: 771454 - RNA, 19 nt, Human
ggucucgaacuccugaccu

SEQ ID NO: 771455 - RNA, 20 nt, Human
ggugagcaggggaagugcug

SEQ ID NO: 771456 - RNA, 18 nt, Human
gguggugggagacuggag

SEQ ID NO: 771457 - RNA, 20 nt, Human
gguguguguuucauaaagac

SEQ ID NO: 771458 - RNA, 20 nt, Human
guagcugggauuacagacgc

SEQ ID NO: 771459 - RNA, 19 nt, Human
guccuccugggagaagagg

SEQ ID NO: 771460 - RNA, 21 nt, Human
gugauccaccugucuuggccu

SEQ ID NO: 771461 - RNA, 24 nt, Human
gugauccaccugucuuggccuucc

SEQ ID NO: 771462 - RNA, 19 nt, Human
gugcuugugaccaugugga

SEQ ID NO: 771463 - RNA, 19 nt, Human
guggucccugccuucaugg

SEQ ID NO: 771464 - RNA, 22 nt, Human
gugucuuacucccuucuuucuc

SEQ ID NO: 771465 - RNA, 19 nt, Human
uaagauaggucuaguuugg

SEQ ID NO: 771466 - RNA, 24 nt, Human
uaagaugaacgaaugacugaauca

SEQ ID NO: 771467 - RNA, 19 nt, Human
uaagcuucugaccugugag

SEQ ID NO: 771468 - RNA, 21 nt, Human
uaagugcagagacugggucuu

SEQ ID NO: 771469 - RNA, 24 nt, Human
uaauuuuuguguuuuuaguagaga

SEQ ID NO: 771470 - RNA, 23 nt, Human
uacagacgcgcgccaccacgccc

SEQ ID NO: 771471 - RNA, 24 nt, Human
uacaggcaugagccacugcaccca

SEQ ID NO: 771472 - RNA, 24 nt, Human
uacaggcaugagcuaccaugccca

SEQ ID NO: 771473 - RNA, 19 nt, Human
uaccaugcccagucaugcc

SEQ ID NO: 771474 - RNA, 20 nt, Human
uacucccuucuuucucuucc

SEQ ID NO: 771475 - RNA, 21 nt, Human
uagaagucacugaccuggguu

SEQ ID NO: 771476 - RNA, 24 nt, Human
uaguaagauaggucuaguuugggu

SEQ ID NO: 771477 - RNA, 23 nt, Human
uaguagagacgggguuucaccau

SEQ ID NO: 771478 - RNA, 20 nt, Human
uauguugcccaggcuggucu

SEQ ID NO: 771479 - RNA, 22 nt, Human
uauguugcccaggcuggucuag

SEQ ID NO: 771480 - RNA, 25 nt, Human
uauguugcccaggcuggucuagcua

SEQ ID NO: 771481 - RNA, 26 nt, Human
uauguugcccaggcuggucuagcuag

SEQ ID NO: 771482 - RNA, 22 nt, Human
ucacgugaggcuggucaugcca

SEQ ID NO: 771483 - RNA, 24 nt, Human
ucacugcuaccucugccucccggg

SEQ ID NO: 771484 - RNA, 18 nt, Human
ucacuggguggcugggag

SEQ ID NO: 771485 - RNA, 20 nt, Human
ucagccuccugaguagcugg

SEQ ID NO: 771486 - RNA, 18 nt, Human
ucaggagcuagggauaca

SEQ ID NO: 771487 - RNA, 24 nt, Human
uccaaagcacugggauuacaggca

SEQ ID NO: 771488 - RNA, 18 nt, Human
uccaagacaggaagggag

SEQ ID NO: 771489 - RNA, 19 nt, Human
uccaccucucugugcauca

SEQ ID NO: 771490 - RNA, 19 nt, Human
uccagaucagaggaggagg

SEQ ID NO: 771491 - RNA, 21 nt, Human
uccagcaagugggcugggcac

SEQ ID NO: 771492 - RNA, 20 nt, Human
uccaucuucucucauucacc

SEQ ID NO: 771493 - RNA, 24 nt, Human
ucccaaagugcugggauuacaggc

SEQ ID NO: 771494 - RNA, 20 nt, Human
ucccagcagggcucuugcuu

SEQ ID NO: 771495 - RNA, 21 nt, Human
ucccggguucaagcgauucuc

SEQ ID NO: 771496 - RNA, 24 nt, Human
ucccggguucaagcgauucuccug

SEQ ID NO: 771497 - RNA, 24 nt, Human
ucccuggguggugagggagcccuc

SEQ ID NO: 771498 - RNA, 18 nt, Human
uccugaguagcugggauu

SEQ ID NO: 771499 - RNA, 21 nt, Human
uccuugacccugaccugucuc

SEQ ID NO: 771500 - RNA, 19 nt, Human
uccuugugagguaagcagg

SEQ ID NO: 771501 - RNA, 23 nt, Human
ucucaccucaagugauccaccug

SEQ ID NO: 771502 - RNA, 20 nt, Human
ucucagccucccaaagugcu

SEQ ID NO: 771503 - RNA, 18 nt, Human
ucuccaggccacucaauu

SEQ ID NO: 771504 - RNA, 24 nt, Human
ucuccugucucagccuccugagua

SEQ ID NO: 771505 - RNA, 19 nt, Human
ucucgaacuccugaccuca

SEQ ID NO: 771506 - RNA, 19 nt, Human
ucucgcucugucacccagg

SEQ ID NO: 771507 - RNA, 24 nt, Human
ucucgcucugucacccaggcagga

SEQ ID NO: 771508 - RNA, 24 nt, Human
ucugucacccaggcaggagugcag

SEQ ID NO: 771509 - RNA, 18 nt, Human
ucuugcuauguugcccag

SEQ ID NO: 771510 - RNA, 19 nt, Human
ucuugcuauguugcccagg

SEQ ID NO: 771511 - RNA, 23 nt, Human
ucuugcuauguugcccaggcugg

SEQ ID NO: 771512 - RNA, 24 nt, Human
ucuugcuauguugcccaggcuggu

SEQ ID NO: 771513 - RNA, 20 nt, Human
ugaaucccagcuccaccccu

SEQ ID NO: 771514 - RNA, 21 nt, Human
ugacaagggggagaagaguug

SEQ ID NO: 771515 - RNA, 25 nt, Human
ugaccugucucccaggauuaguggg

SEQ ID NO: 771516 - RNA, 25 nt, Human
ugacugaaucacccaaucauuagga

SEQ ID NO: 771517 - RNA, 24 nt, Human
ugagaagggaugagaggcagagac

SEQ ID NO: 771518 - RNA, 22 nt, Human
ugagagugucggaucaauggaa

SEQ ID NO: 771519 - RNA, 25 nt, Human
ugagcaagugacuccaccucucugu

SEQ ID NO: 771520 - RNA, 22 nt, Human
ugaggagacugagugaagggag

SEQ ID NO: 771521 - RNA, 19 nt, Human
ugaggagggugagcagggg

SEQ ID NO: 771522 - RNA, 20 nt, Human
ugaggccaguaaucuacacc

SEQ ID NO: 771523 - RNA, 19 nt, Human
ugaggcuggucaugccagc

SEQ ID NO: 771524 - RNA, 22 nt, Human
ugagggcaguugguggacaggg

SEQ ID NO: 771525 - RNA, 24 nt, Human
ugagguaagcaggggagggagccc

SEQ ID NO: 771526 - RNA, 21 nt, Human
ugagucucgcucugucaccca

SEQ ID NO: 771527 - RNA, 24 nt, Human
ugaucuguacauucucuggcacaa

SEQ ID NO: 771528 - RNA, 18 nt, Human
ugcaccagccccacugca

SEQ ID NO: 771529 - RNA, 24 nt, Human
ugcagagacugggucuugcuaugu

SEQ ID NO: 771530 - RNA, 22 nt, Human
ugcagugacacgaucucggcuc

SEQ ID NO: 771531 - RNA, 22 nt, Human
ugcuauguugcccaggcugguc

SEQ ID NO: 771532 - RNA, 18 nt, Human
ugcucccccuccccacag

SEQ ID NO: 771533 - RNA, 19 nt, Human
uggaaaaagcagugcucac

SEQ ID NO: 771534 - RNA, 22 nt, Human
uggaaggcaggggcggagccug

SEQ ID NO: 771535 - RNA, 23 nt, Human
uggaaggcaggggcggagccugg

SEQ ID NO: 771536 - RNA, 26 nt, Human
uggaggaagcccagagggcucugagg

SEQ ID NO: 771537 - RNA, 18 nt, Human
uggccauccucaccccag

SEQ ID NO: 771538 - RNA, 22 nt, Human
uggcugcuuuccagaauggcac

SEQ ID NO: 771539 - RNA, 23 nt, Human
ugggaagcugccuucuuuguagg

SEQ ID NO: 771540 - RNA, 24 nt, Human
ugggagaagaggggcacaggcacc

SEQ ID NO: 771541 - RNA, 18 nt, Human
ugggagggggugggcgug

SEQ ID NO: 771542 - RNA, 18 nt, Human
ugggagggggugggcgug

SEQ ID NO: 771543 - RNA, 21 nt, Human
ugggagggggugggcgugggc

SEQ ID NO: 771544 - RNA, 22 nt, Human
ugggagggggugggcgugggcc

SEQ ID NO: 771545 - RNA, 21 nt, Human
ugggauuacagacgcgcgcca

SEQ ID NO: 771546 - RNA, 22 nt, Human
ugggauuacagacgcgcgccac

SEQ ID NO: 771547 - RNA, 24 nt, Human
ugggauuacagacgcgcgccacca

SEQ ID NO: 771548 - RNA, 18 nt, Human
ugggauuacaggcaugag

SEQ ID NO: 771549 - RNA, 19 nt, Human
ugggauuacaggcaugagc

SEQ ID NO: 771550 - RNA, 21 nt, Human
ugggauuacaggcaugagcca

SEQ ID NO: 771551 - RNA, 22 nt, Human
ugggauuacaggcaugagccac

SEQ ID NO: 771552 - RNA, 22 nt, Human
ugggauuacaggcaugagccac

SEQ ID NO: 771553 - RNA, 24 nt, Human
ugggauuacaggcaugagccacug

SEQ ID NO: 771554 - RNA, 26 nt, Human
ugggauuacaggcaugagccacugca

SEQ ID NO: 771555 - RNA, 22 nt, Human
ugggauuacaggcaugagcuac

SEQ ID NO: 771556 - RNA, 23 nt, Human
ugggauuacaggcaugagcuacc

SEQ ID NO: 771557 - RNA, 24 nt, Human
ugggauuacaggcaugagcuacca

SEQ ID NO: 771558 - RNA, 25 nt, Human
ugggauuacaggcaugagcuaccau

SEQ ID NO: 771559 - RNA, 23 nt, Human
ugggcgugggcucaaggauuugc

SEQ ID NO: 771560 - RNA, 20 nt, Human
ugggcucaaggauuugcccu

SEQ ID NO: 771561 - RNA, 22 nt, Human
ugggggacugggccggcgugcu

SEQ ID NO: 771562 - RNA, 21 nt, Human
uggguuaagacugugggccua

SEQ ID NO: 771563 - RNA, 25 nt, Human
uggguuucucuccuauuugccuccc

SEQ ID NO: 771564 - RNA, 24 nt, Human
uggucaggcuggucucgaacuccu

SEQ ID NO: 771565 - RNA, 21 nt, Human
uggucagugccuucaccuccu

SEQ ID NO: 771566 - RNA, 20 nt, Human
ugucacaucacccacugucc

SEQ ID NO: 771567 - RNA, 21 nt, Human
ugucacaucacccacuguccc

SEQ ID NO: 771568 - RNA, 24 nt, Human
ugucucagccuccugaguagcugg

SEQ ID NO: 771569 - RNA, 22 nt, Human
ugucugagaaacaaugucacau

SEQ ID NO: 771570 - RNA, 19 nt, Human
ugugauucagccccagagg

SEQ ID NO: 771571 - RNA, 20 nt, Human
uguggggccagcaggguggu

SEQ ID NO: 771572 - RNA, 23 nt, Human
uguggugguugucaggagcuagg

SEQ ID NO: 771573 - RNA, 21 nt, Human
uguguuuuuaguagagacggg

SEQ ID NO: 771574 - RNA, 19 nt, Human
uguugcccaggcuggucua

SEQ ID NO: 771575 - RNA, 20 nt, Human
uuaaaaaacgugcugaccca

SEQ ID NO: 771576 - RNA, 22 nt, Human
uuaguagagacgggguuucacc

SEQ ID NO: 771577 - RNA, 24 nt, Human
uuaguagagacgggguuucaccau

SEQ ID NO: 771578 - RNA, 23 nt, Human
uucaagcgauucuccugucucag

SEQ ID NO: 771579 - RNA, 18 nt, Human
uucuuacauggcaucagu

SEQ ID NO: 771580 - RNA, 19 nt, Human
uugcccucugccuuagaug

SEQ ID NO: 771581 - RNA, 19 nt, Human
uugcucccccuccccacag

SEQ ID NO: 771582 - RNA, 20 nt, Human
uuggaacauuuaugagaagg

SEQ ID NO: 771583 - RNA, 21 nt, Human
uugguggacagggagcagcug

SEQ ID NO: 771584 - RNA, 25 nt, Human
uuguagggaugaaguguggggccag

SEQ ID NO: 771585 - RNA, 24 nt, Human
uuucaccauuuuggucaggcuggu

SEQ ID NO: 771586 - RNA, 21 nt, Human
uuugcagaaguuccuguccag

SEQ ID NO: 771587 - RNA, 24 nt, Human
uuuguguuuuuaguagagacgggg

SEQ ID NO: 771588 - RNA, 19 nt, Human
uuuguuuucgcucgcgccu

SEQ ID NO: 771589 - RNA, 24 nt, Human
uuuuuaguagagacgggguuucac

SEQ ID NO: 771590 - RNA, 20 nt, Human
uuuuuguguuuuuaguagag

SEQ ID NO: 771591 - RNA, 23 nt, Human
aaacagggaucagugacagcaac

SEQ ID NO: 771592 - RNA, 22 nt, Human
aacacugaagaucugagaagcu

SEQ ID NO: 771593 - RNA, 22 nt, Human
acuauaaacauaauagaacuau

SEQ ID NO: 771594 - RNA, 24 nt, Human
acuauaaacauaauagaacuauga

SEQ ID NO: 771595 - RNA, 19 nt, Human
acucuggaaaacgucuugg

SEQ ID NO: 771596 - RNA, 22 nt, Human
agaauuguaaaaaaugauauac

SEQ ID NO: 771597 - RNA, 23 nt, Human
agcagcuaaaaaacuuauuccac

SEQ ID NO: 771598 - RNA, 21 nt, Human
agcuaaaaaacuuauuccaca

SEQ ID NO: 771599 - RNA, 20 nt, Human
aggcaucauuaaaaaggaaa

SEQ ID NO: 771600 - RNA, 27 nt, Human
aucaaagauucuuuuuuuuuuucuuuu

SEQ ID NO: 771601 - RNA, 22 nt, Human
auucuuuuuuuuuuucuuuuuu

SEQ ID NO: 771602 - RNA, 20 nt, Human
caaaacagggaucagugaca

SEQ ID NO: 771603 - RNA, 21 nt, Human
caaguagcuuaaaagccagca

SEQ ID NO: 771604 - RNA, 24 nt, Human
cacuagaauacucuugauagugca

SEQ ID NO: 771605 - RNA, 21 nt, Human
caggauuuuugaccaaguagc

SEQ ID NO: 771606 - RNA, 25 nt, Human
cuacacaaaaacgaucaaaauacuc

SEQ ID NO: 771607 - RNA, 19 nt, Human
cugcacacaaacacaagag

SEQ ID NO: 771608 - RNA, 23 nt, Human
ggaaauaaaaauauacucccacc

SEQ ID NO: 771609 - RNA, 18 nt, Human
gugcuauauacuugcugg

SEQ ID NO: 771610 - RNA, 18 nt, Human
uaaaagccagcaaaacag

SEQ ID NO: 771611 - RNA, 23 nt, Human
uaaaagccagcaaaacagggauc

SEQ ID NO: 771612 - RNA, 19 nt, Human
uaaugguggaaaaaaaggc

SEQ ID NO: 771613 - RNA, 21 nt, Human
uacacuguuagaaauuuacca

SEQ ID NO: 771614 - RNA, 19 nt, Human
uaccagugaacacugaaga

SEQ ID NO: 771615 - RNA, 20 nt, Human
uagaacuaugaacaaauguc

SEQ ID NO: 771616 - RNA, 20 nt, Human
uaggaaauaaaaauauacuc

SEQ ID NO: 771617 - RNA, 19 nt, Human
uaucuacacaaaaacgauc

SEQ ID NO: 771618 - RNA, 19 nt, Human
ucaccaggugcacguucca

SEQ ID NO: 771619 - RNA, 18 nt, Human
uccacauguucuuaaagc

SEQ ID NO: 771620 - RNA, 22 nt, Human
uggaaaaaaaggcaagugucau

SEQ ID NO: 771621 - RNA, 22 nt, Human
uggaaauuuuuuacuucaaacg

SEQ ID NO: 771622 - RNA, 21 nt, Human
uuaaagucucugaugucuccc

SEQ ID NO: 771623 - RNA, 23 nt, Human
uucucugcacacaaacacaagag

SEQ ID NO: 771624 - RNA, 20 nt, Human
uuggaaauuuuuuacuucaa

SEQ ID NO: 771625 - RNA, 25 nt, Human
aaaauaaccuccugacuuguaaauu

SEQ ID NO: 771626 - RNA, 28 nt, Human
aaaccgaccccaccaaccugaguaaugc

SEQ ID NO: 771627 - RNA, 22 nt, Human
aacagcccuauauccacccucu

SEQ ID NO: 771628 - RNA, 20 nt, Human
aaccacagccaaaacuaaaa

SEQ ID NO: 771629 - RNA, 18 nt, Human
aacccuggcuuaaaaaca

SEQ ID NO: 771630 - RNA, 18 nt, Human
aagcaaauacaagagaac

SEQ ID NO: 771631 - RNA, 20 nt, Human
aaguaggaaauacugaaaga

SEQ ID NO: 771632 - RNA, 21 nt, Human
aaguaggaaauacugaaagag

SEQ ID NO: 771633 - RNA, 26 nt, Human
aauaugcuuugggggcugcuuugcuu

SEQ ID NO: 771634 - RNA, 19 nt, Human
aauccgggguucccuccuu

SEQ ID NO: 771635 - RNA, 20 nt, Human
acccuagcauguccuccuug

SEQ ID NO: 771636 - RNA, 20 nt, Human
accuguguuuuuuuuugaaa

SEQ ID NO: 771637 - RNA, 26 nt, Human
agaaagacucuaggcacucucacuga

SEQ ID NO: 771638 - RNA, 21 nt, Human
agaauucuguuuuuaccuucc

SEQ ID NO: 771639 - RNA, 24 nt, Human
agagaucaguguggaaugcaauaa

SEQ ID NO: 771640 - RNA, 18 nt, Human
agcccuauauccacccuc

SEQ ID NO: 771641 - RNA, 19 nt, Human
aggaagagauaaaagaagg

SEQ ID NO: 771642 - RNA, 24 nt, Human
agucacaauauauaaaccacagcc

SEQ ID NO: 771643 - RNA, 21 nt, Human
auacuguauuuucaguacaca

SEQ ID NO: 771644 - RNA, 18 nt, Human
aucccuagagucuucccu

SEQ ID NO: 771645 - RNA, 18 nt, Human
aucugucauguuuuccuu

SEQ ID NO: 771646 - RNA, 19 nt, Human
augcagccugcacaugcau

SEQ ID NO: 771647 - RNA, 22 nt, Human
augcagccugcacaugcauuga

SEQ ID NO: 771648 - RNA, 19 nt, Human
augcugcaacacgucacaa

SEQ ID NO: 771649 - RNA, 29 nt, Human
caaaacaaguaacucaacuuguauaaaaa

SEQ ID NO: 771650 - RNA, 23 nt, Human
caaaccgaccccaccaaccugag

SEQ ID NO: 771651 - RNA, 23 nt, Human
caaggacaggaugcagccugcac

SEQ ID NO: 771652 - RNA, 19 nt, Human
caagggaaggacuuucuug

SEQ ID NO: 771653 - RNA, 21 nt, Human
cacaaaaauagaauuucuaua

SEQ ID NO: 771654 - RNA, 23 nt, Human
cacaauauauaaaccacagccaa

SEQ ID NO: 771655 - RNA, 25 nt, Human
cacaauauauaaaccacagccaaaa

SEQ ID NO: 771656 - RNA, 19 nt, Human
cacagauuaagugaagaca

SEQ ID NO: 771657 - RNA, 25 nt, Human
cagcaaaugggugaggaagauuugc

SEQ ID NO: 771658 - RNA, 24 nt, Human
caucucuagcaggaucaauccuga

SEQ ID NO: 771659 - RNA, 18 nt, Human
cccuccuuuuccucuucu

SEQ ID NO: 771660 - RNA, 18 nt, Human
cccuccuuuuccucuucu

SEQ ID NO: 771661 - RNA, 19 nt, Human
cccuccuuuuccucuucuu

SEQ ID NO: 771662 - RNA, 19 nt, Human
ccucuuugggauuugagcc

SEQ ID NO: 771663 - RNA, 20 nt, Human
ccugaagugcaauagaaagu

SEQ ID NO: 771664 - RNA, 22 nt, Human
cgagcaaguggcucacaauggc

SEQ ID NO: 771665 - RNA, 18 nt, Human
cguuguugcucuugcccc

SEQ ID NO: 771666 - RNA, 21 nt, Human
cuauaucuucucaaaccgacc

SEQ ID NO: 771667 - RNA, 19 nt, Human
cugcuuugcuuugcaaaug

SEQ ID NO: 771668 - RNA, 23 nt, Human
cugguccucuucuacccaugccu

SEQ ID NO: 771669 - RNA, 24 nt, Human
cugguccucuucuacccaugccuu

SEQ ID NO: 771670 - RNA, 20 nt, Human
cuuaggaucuucaaaguccc

SEQ ID NO: 771671 - RNA, 20 nt, Human
cuucucggucagcuacuuag

SEQ ID NO: 771672 - RNA, 22 nt, Human
cuugggagaaugaagauuccau

SEQ ID NO: 771673 - RNA, 20 nt, Human
gaacuuccaacccaguucac

SEQ ID NO: 771674 - RNA, 20 nt, Human
gacucuacgacucucgguug

SEQ ID NO: 771675 - RNA, 18 nt, Human
gauccuguuucuccaucu

SEQ ID NO: 771676 - RNA, 19 nt, Human
gcaacacgucacaacauaa

SEQ ID NO: 771677 - RNA, 19 nt, Human
gcagaaaccuaggaagcaa

SEQ ID NO: 771678 - RNA, 24 nt, Human
gcugcuuugcuuugcaaauggacc

SEQ ID NO: 771679 - RNA, 24 nt, Human
ggacaggaugcagccugcacaugg

SEQ ID NO: 771680 - RNA, 23 nt, Human
ggguguuuacagggagaaaaagg

SEQ ID NO: 771681 - RNA, 21 nt, Human
gguuauaaaaccucuuuggga

SEQ ID NO: 771682 - RNA, 19 nt, Human
guccucuucuacccaugcc

SEQ ID NO: 771683 - RNA, 19 nt, Human
gucuuauaccuuuucuuuc

SEQ ID NO: 771684 - RNA, 24 nt, Human
gucuuauaccuuuucuuucuuugc

SEQ ID NO: 771685 - RNA, 20 nt, Human
guguuuacagggagaaaaag

SEQ ID NO: 771686 - RNA, 20 nt, Human
uaaacaugcugaaauggaaa

SEQ ID NO: 771687 - RNA, 19 nt, Human
uaaaccacagccaaaacua

SEQ ID NO: 771688 - RNA, 23 nt, Human
uaacaauccaagauuaagauucu

SEQ ID NO: 771689 - RNA, 23 nt, Human
uaagauauaauuuggcaagucuu

SEQ ID NO: 771690 - RNA, 21 nt, Human
uacagggagaaaaagggaagu

SEQ ID NO: 771691 - RNA, 24 nt, Human
uaccaagggaaggacuuucuugac

SEQ ID NO: 771692 - RNA, 24 nt, Human
uacuuggguguuuacagggagaaa

SEQ ID NO: 771693 - RNA, 19 nt, Human
uagcaaauguuugcgaccu

SEQ ID NO: 771694 - RNA, 23 nt, Human
uagcauguccuccuugcugcuug

SEQ ID NO: 771695 - RNA, 21 nt, Human
uagcugcagauugcauaaaug

SEQ ID NO: 771696 - RNA, 24 nt, Human
uauaaacccuggcuuaaaaacaag

SEQ ID NO: 771697 - RNA, 19 nt, Human
uauacaauucuauuaagau

SEQ ID NO: 771698 - RNA, 19 nt, Human
uauauccacccucugaucc

SEQ ID NO: 771699 - RNA, 23 nt, Human
ucaaaccgaccccaccaaccuga

SEQ ID NO: 771700 - RNA, 21 nt, Human
ucacccuagcauguccuccuu

SEQ ID NO: 771701 - RNA, 21 nt, Human
ucacucuuagcuucuuccuuu

SEQ ID NO: 771702 - RNA, 19 nt, Human
ucagcuacuuagaauuuca

SEQ ID NO: 771703 - RNA, 20 nt, Human
ucagcuacuuagaauuucag

SEQ ID NO: 771704 - RNA, 22 nt, Human
ucauauccaauccgggguuccc

SEQ ID NO: 771705 - RNA, 21 nt, Human
uccacugaaaauacucucuaa

SEQ ID NO: 771706 - RNA, 18 nt, Human
ucccaagccagagaaagc

SEQ ID NO: 771707 - RNA, 19 nt, Human
ucccaagccagagaaagcu

SEQ ID NO: 771708 - RNA, 22 nt, Human
ucccaagccagagaaagcuuac

SEQ ID NO: 771709 - RNA, 19 nt, Human
ucccuccuuuuccucuucu

SEQ ID NO: 771710 - RNA, 22 nt, Human
uccuaacaagaagugcaaaaca

SEQ ID NO: 771711 - RNA, 21 nt, Human
uccuggguuuauaguacugcu

SEQ ID NO: 771712 - RNA, 23 nt, Human
uccuugauugacaaauccuccuu

SEQ ID NO: 771713 - RNA, 20 nt, Human
ucgguugcuaaaugcuagaa

SEQ ID NO: 771714 - RNA, 19 nt, Human
ucuccugguuuaccuggcu

SEQ ID NO: 771715 - RNA, 21 nt, Human
ugaaaggcaaacuuccugggu

SEQ ID NO: 771716 - RNA, 20 nt, Human
ugaaagugcuaucaggagcu

SEQ ID NO: 771717 - RNA, 23 nt, Human
ugaauagcugcagauugcauaaa

SEQ ID NO: 771718 - RNA, 23 nt, Human
ugacaaauccuccuugggaauau

SEQ ID NO: 771719 - RNA, 19 nt, Human
ugcaaaacaaguaacucaa

SEQ ID NO: 771720 - RNA, 23 nt, Human
ugcaaaacaaguaacucaacuug

SEQ ID NO: 771721 - RNA, 19 nt, Human
ugccccccugguccucuuc

SEQ ID NO: 771722 - RNA, 18 nt, Human
ugcugggaguguccuggc

SEQ ID NO: 771723 - RNA, 24 nt, Human
ugcuguagguuucagauaauaguu

SEQ ID NO: 771724 - RNA, 22 nt, Human
uggaaugaaggcguuaucuauc

SEQ ID NO: 771725 - RNA, 19 nt, Human
uggaaugcaauaagcuuua

SEQ ID NO: 771726 - RNA, 22 nt, Human
uggccaaauaagcaguugauac

SEQ ID NO: 771727 - RNA, 22 nt, Human
uggcuuaggaucuucaaagucc

SEQ ID NO: 771728 - RNA, 22 nt, Human
ugggauuugagcccagcaaguu

SEQ ID NO: 771729 - RNA, 24 nt, Human
uggguguuuacagggagaaaaagg

SEQ ID NO: 771730 - RNA, 20 nt, Human
ugguacgucuucugugucuc

SEQ ID NO: 771731 - RNA, 18 nt, Human
uguaaagacacaaaaaua

SEQ ID NO: 771732 - RNA, 18 nt, Human
ugucacauaauaccaaag

SEQ ID NO: 771733 - RNA, 18 nt, Human
uguccuggccaaauaagc

SEQ ID NO: 771734 - RNA, 19 nt, Human
ugugaaauaauagagucaa

SEQ ID NO: 771735 - RNA, 20 nt, Human
uguuuuauugcagagaaguu

SEQ ID NO: 771736 - RNA, 21 nt, Human
uguuuuuuuuugaaaggcaaa

SEQ ID NO: 771737 - RNA, 21 nt, Human
uuaccaagggaaggacuuucu

SEQ ID NO: 771738 - RNA, 24 nt, Human
uuacuccugaauaaaaaaaucacu

SEQ ID NO: 771739 - RNA, 27 nt, Human
uugacuuuaccucaccaucugucaugu

SEQ ID NO: 771740 - RNA, 23 nt, Human
uuuccagugcuugggagaaugaa

SEQ ID NO: 771741 - RNA, 19 nt, Human
uuugugcugggaguguccu

SEQ ID NO: 771742 - RNA, 27 nt, Human
aauacaaaauaaaaaaagacugucuca

SEQ ID NO: 771743 - RNA, 23 nt, Human
accccgcaggagggaaggcagca

SEQ ID NO: 771744 - RNA, 21 nt, Human
agaggcgggugggaggcgggc

SEQ ID NO: 771745 - RNA, 23 nt, Human
aggaccagcgggacggcaggaga

SEQ ID NO: 771746 - RNA, 18 nt, Human
aggaggacggggcucuag

SEQ ID NO: 771747 - RNA, 18 nt, Human
aggaggggcugcgggccg

SEQ ID NO: 771748 - RNA, 19 nt, Human
agggcuggggggcagaggg

SEQ ID NO: 771749 - RNA, 21 nt, Human
agggcuggggggcagagggug

SEQ ID NO: 771750 - RNA, 23 nt, Human
aggggcaggaggggcugcgggcc

SEQ ID NO: 771751 - RNA, 20 nt, Human
aggggccagcuggguucuca

SEQ ID NO: 771752 - RNA, 23 nt, Human
aggggccagcuggguucucagag

SEQ ID NO: 771753 - RNA, 23 nt, Human
aggggcugcgggccggguggggg

SEQ ID NO: 771754 - RNA, 21 nt, Human
aggugagggggaagggggucc

SEQ ID NO: 771755 - RNA, 18 nt, Human
cacccccaccccgcagga

SEQ ID NO: 771756 - RNA, 21 nt, Human
caccccgcaggagggaaggca

SEQ ID NO: 771757 - RNA, 20 nt, Human
cacccgggagggagggccug

SEQ ID NO: 771758 - RNA, 20 nt, Human
cagcaggcccgcucuucccu

SEQ ID NO: 771759 - RNA, 19 nt, Human
ccacccgggagggagggcc

SEQ ID NO: 771760 - RNA, 22 nt, Human
ccacuggggucugucccacccc

SEQ ID NO: 771761 - RNA, 20 nt, Human
cccacccccaccccgcagga

SEQ ID NO: 771762 - RNA, 21 nt, Human
cccccgaagaccggccagccc

SEQ ID NO: 771763 - RNA, 24 nt, Human
cccccgaagaccggccagccccug

SEQ ID NO: 771764 - RNA, 21 nt, Human
ccccuggagcacagaggcggg

SEQ ID NO: 771765 - RNA, 18 nt, Human
cccgcgacccacgugagg

SEQ ID NO: 771766 - RNA, 26 nt, Human
cccgcggcggggccccggcccggagc

SEQ ID NO: 771767 - RNA, 22 nt, Human
ccgcugcucugggcugccucgg

SEQ ID NO: 771768 - RNA, 22 nt, Human
ccucggccagguggacggguua

SEQ ID NO: 771769 - RNA, 20 nt, Human
cgccgcggucgccgccgccc

SEQ ID NO: 771770 - RNA, 22 nt, Human
cgcgacccacgugaggagcaga

SEQ ID NO: 771771 - RNA, 22 nt, Human
cggcagacccuggggcuaacug

SEQ ID NO: 771772 - RNA, 18 nt, Human
cggcccggagccgcccgg

SEQ ID NO: 771773 - RNA, 21 nt, Human
cgggaagacaguguccggagg

SEQ ID NO: 771774 - RNA, 18 nt, Human
cgggcucuguccuggucu

SEQ ID NO: 771775 - RNA, 21 nt, Human
cgggggugggcugggcugggc

SEQ ID NO: 771776 - RNA, 25 nt, Human
cggguccagcccacacugcgcugag

SEQ ID NO: 771777 - RNA, 20 nt, Human
gaccggccagccccuggagc

SEQ ID NO: 771778 - RNA, 19 nt, Human
gagcgggggugggcugggc

SEQ ID NO: 771779 - RNA, 19 nt, Human
gagggcuggggggcagagg

SEQ ID NO: 771780 - RNA, 20 nt, Human
gaggugccggccaccacccg

SEQ ID NO: 771781 - RNA, 19 nt, Human
gagugguggaagccggcgc

SEQ ID NO: 771782 - RNA, 20 nt, Human
gcaggaggggcaggaggggc

SEQ ID NO: 771783 - RNA, 18 nt, Human
gccucggccagguggacg

SEQ ID NO: 771784 - RNA, 21 nt, Human
gcgccgcggucgccgccgccc

SEQ ID NO: 771785 - RNA, 21 nt, Human
ggaagacaguguccggaggcc

SEQ ID NO: 771786 - RNA, 19 nt, Human
ggaggggcaggaggggcug

SEQ ID NO: 771787 - RNA, 18 nt, Human
ggcagaggguggggaccg

SEQ ID NO: 771788 - RNA, 26 nt, Human
ggcagaggguggggaccggcggaggg

SEQ ID NO: 771789 - RNA, 20 nt, Human
ggcaggaggggcugcgggcc

SEQ ID NO: 771790 - RNA, 20 nt, Human
ggcccggagccgcccgggcc

SEQ ID NO: 771791 - RNA, 20 nt, Human
ggcuggggggcagagggugg

SEQ ID NO: 771792 - RNA, 19 nt, Human
gggaagacaguguccggag

SEQ ID NO: 771793 - RNA, 21 nt, Human
gggcagaggguggggaccggc

SEQ ID NO: 771794 - RNA, 20 nt, Human
gggcaggaggggcugcgggc

SEQ ID NO: 771795 - RNA, 20 nt, Human
gggggugggcugggcugggc

SEQ ID NO: 771796 - RNA, 18 nt, Human
ggggugggcugggcuggg

SEQ ID NO: 771797 - RNA, 19 nt, Human
ggggugggcugggcugggc

SEQ ID NO: 771798 - RNA, 21 nt, Human
ggucuccaucagcagcaguuu

SEQ ID NO: 771799 - RNA, 20 nt, Human
ggucugucccacccccaccc

SEQ ID NO: 771800 - RNA, 23 nt, Human
gucccugccuggaggugaggggg

SEQ ID NO: 771801 - RNA, 20 nt, Human
guggggcggcgaguggugga

SEQ ID NO: 771802 - RNA, 23 nt, Human
uaacaauacaaaauaaaaaaaga

SEQ ID NO: 771803 - RNA, 26 nt, Human
uagagacgccagagggcuggggggca

SEQ ID NO: 771804 - RNA, 22 nt, Human
uagcgggaagacaguguccgga

SEQ ID NO: 771805 - RNA, 25 nt, Human
ucaaacaaaccugggacaagcccgc

SEQ ID NO: 771806 - RNA, 19 nt, Human
uccagcccacacugcgcug

SEQ ID NO: 771807 - RNA, 20 nt, Human
uccaucagcagcaguuucua

SEQ ID NO: 771808 - RNA, 22 nt, Human
uccaucagcagcaguuucuaga

SEQ ID NO: 771809 - RNA, 19 nt, Human
ucccgcugcucugggcugc

SEQ ID NO: 771810 - RNA, 18 nt, Human
ugagggggaagggggucc

SEQ ID NO: 771811 - RNA, 22 nt, Human
ugccucggccagguggacgggu

SEQ ID NO: 771812 - RNA, 20 nt, Human
ugcgggccgggugggggcgg

SEQ ID NO: 771813 - RNA, 18 nt, Human
uggaagaggcauggggcu

SEQ ID NO: 771814 - RNA, 22 nt, Human
uggaagaggcauggggcuaagg

SEQ ID NO: 771815 - RNA, 21 nt, Human
uggcaggaggggcaggagggg

SEQ ID NO: 771816 - RNA, 22 nt, Human
uggcaggaggggcaggaggggc

SEQ ID NO: 771817 - RNA, 20 nt, Human
ugggaaagaugcugugcaag

SEQ ID NO: 771818 - RNA, 23 nt, Human
ugggcugccucggccagguggaa

SEQ ID NO: 771819 - RNA, 18 nt, Human
ugucccacccccaccccg

SEQ ID NO: 771820 - RNA, 20 nt, Human
uguccuggucuccaucagca

SEQ ID NO: 771821 - RNA, 24 nt, Human
aaagauguauuucccugaggcccc

SEQ ID NO: 771822 - RNA, 21 nt, Human
agauguauuucccugaggccc

SEQ ID NO: 771823 - RNA, 25 nt, Human
agcagcaccagcagcucccagcgca

SEQ ID NO: 771824 - RNA, 21 nt, Human
agccccucccucccugcggcu

SEQ ID NO: 771825 - RNA, 24 nt, Human
augccacuguugccccacccugac

SEQ ID NO: 771826 - RNA, 21 nt, Human
cacccugacccacguucccug

SEQ ID NO: 771827 - RNA, 23 nt, Human
cagcagcagcagcaccagcagcu

SEQ ID NO: 771828 - RNA, 28 nt, Human
cagcagcagcagcaccagcagcucccag

SEQ ID NO: 771829 - RNA, 23 nt, Human
cagcagcagcagcagcagcacca

SEQ ID NO: 771830 - RNA, 19 nt, Human
cagccggggcccgggcggc

SEQ ID NO: 771831 - RNA, 21 nt, Human
cagcgcaccgcccggcgccuc

SEQ ID NO: 771832 - RNA, 20 nt, Human
caggagcaaccuccgccucu

SEQ ID NO: 771833 - RNA, 19 nt, Human
cccagcgcaccgcccggcg

SEQ ID NO: 771834 - RNA, 22 nt, Human
cccucuggccagccccucccuc

SEQ ID NO: 771835 - RNA, 18 nt, Human
cccugcugccucucccuc

SEQ ID NO: 771836 - RNA, 22 nt, Human
ccggcgccuccgggcugcggcu

SEQ ID NO: 771837 - RNA, 19 nt, Human
ccgggggcggcguccuggc

SEQ ID NO: 771838 - RNA, 20 nt, Human
ccugacccacguucccugcu

SEQ ID NO: 771839 - RNA, 21 nt, Human
cgcugccgccgccgccgccgc

SEQ ID NO: 771840 - RNA, 20 nt, Human
cgggcggcggagggugggca

SEQ ID NO: 771841 - RNA, 20 nt, Human
cugcugccucucccucuggc

SEQ ID NO: 771842 - RNA, 21 nt, Human
gcgcugccgccgccgccgccg

SEQ ID NO: 771843 - RNA, 21 nt, Human
ggccaagaaguggagacccgg

SEQ ID NO: 771844 - RNA, 21 nt, Human
ggcccgggcggcggagggugg

SEQ ID NO: 771845 - RNA, 18 nt, Human
ggcggcagcgggggcccg

SEQ ID NO: 771846 - RNA, 21 nt, Human
ggggcgcacucgcgggcgggg

SEQ ID NO: 771847 - RNA, 19 nt, Human
uacaggagcaaccuccgcc

SEQ ID NO: 771848 - RNA, 19 nt, Human
ucccugaggccccgcaccu

SEQ ID NO: 771849 - RNA, 18 nt, Human
ucgcgggcgcugucaugg

SEQ ID NO: 771850 - RNA, 18 nt, Human
ugccucucccucuggcca

SEQ ID NO: 771851 - RNA, 18 nt, Human
ugcuguagcagcuccugg

SEQ ID NO: 771852 - RNA, 19 nt, Human
ugcuguagcagcuccuggc

SEQ ID NO: 771853 - RNA, 26 nt, Human
uggagacccggccgggggcggcgucc

SEQ ID NO: 771854 - RNA, 18 nt, Human
uguagcagcuccuggcgc

SEQ ID NO: 771855 - RNA, 24 nt, Human
aaaaaguuaauucaaaaacuuuug

SEQ ID NO: 771856 - RNA, 18 nt, Human
aaaaugccaagaaccugg

SEQ ID NO: 771857 - RNA, 23 nt, Human
aaacaaaacaaaacaaacuuaaa

SEQ ID NO: 771858 - RNA, 24 nt, Human
aaaguguugggauuacaagcauga

SEQ ID NO: 771859 - RNA, 23 nt, Human
aaaugaggcaggagaauaggguc

SEQ ID NO: 771860 - RNA, 19 nt, Human
aacaaagugaaaccccguc

SEQ ID NO: 771861 - RNA, 20 nt, Human
aacaaagugaaaccccgucu

SEQ ID NO: 771862 - RNA, 21 nt, Human
aacaaagugaaaccccgucuc

SEQ ID NO: 771863 - RNA, 22 nt, Human
aaccccaccucuccauaccuaa

SEQ ID NO: 771864 - RNA, 18 nt, Human
aagaaaccugaccaaggc

SEQ ID NO: 771865 - RNA, 23 nt, Human
aagaaaccugaccaaggccuaau

SEQ ID NO: 771866 - RNA, 23 nt, Human
aagaauacucguaaugcaauguc

SEQ ID NO: 771867 - RNA, 18 nt, Human
aagacaccaccggccauc

SEQ ID NO: 771868 - RNA, 25 nt, Human
aagcaauucucccaccuuggcuucc

SEQ ID NO: 771869 - RNA, 21 nt, Human
aaguguugggauuacaagcau

SEQ ID NO: 771870 - RNA, 22 nt, Human
aauccauuuccuuuugccuaga

SEQ ID NO: 771871 - RNA, 18 nt, Human
acagaagaaagacccuca

SEQ ID NO: 771872 - RNA, 23 nt, Human
acagagcgagacucugucucaaa

SEQ ID NO: 771873 - RNA, 24 nt, Human
acagagcgagacucugucucaaaa

SEQ ID NO: 771874 - RNA, 20 nt, Human
acauagagguugggaaacag

SEQ ID NO: 771875 - RNA, 21 nt, Human
acauuaucaucucccccaccc

SEQ ID NO: 771876 - RNA, 24 nt, Human
accccgucucuauuaaaaauacaa

SEQ ID NO: 771877 - RNA, 21 nt, Human
accuuggcuucccaaaguguu

SEQ ID NO: 771878 - RNA, 21 nt, Human
acucuguugcccaggcuggag

SEQ ID NO: 771879 - RNA, 25 nt, Human
acugcaaccaccagacacaacggcu

SEQ ID NO: 771880 - RNA, 24 nt, Human
acugcacuccagccugggugacag

SEQ ID NO: 771881 - RNA, 26 nt, Human
acugcacuccagccugggugacagag

SEQ ID NO: 771882 - RNA, 22 nt, Human
agaacugaaucaaaaggaaaac

SEQ ID NO: 771883 - RNA, 19 nt, Human
agaagacaccaccggccau

SEQ ID NO: 771884 - RNA, 23 nt, Human
agacagaaauauuguaugucccu

SEQ ID NO: 771885 - RNA, 23 nt, Human
agacagggaaccuaaggcugauu

SEQ ID NO: 771886 - RNA, 18 nt, Human
agagugacauauuaggcu

SEQ ID NO: 771887 - RNA, 18 nt, Human
agaguucuaaaauucuga

SEQ ID NO: 771888 - RNA, 24 nt, Human
agcacuuugggaggccgaggcagg

SEQ ID NO: 771889 - RNA, 23 nt, Human
agcagcugggacuacaggugugu

SEQ ID NO: 771890 - RNA, 21 nt, Human
agccauccuccugcuuagccu

SEQ ID NO: 771891 - RNA, 24 nt, Human
agccugggugacagagcgagacuc

SEQ ID NO: 771892 - RNA, 22 nt, Human
agcugggacuacaggugugugu

SEQ ID NO: 771893 - RNA, 24 nt, Human
aggaaaaccccaccucuccauacc

SEQ ID NO: 771894 - RNA, 21 nt, Human
aggcaagagaauggugugaac

SEQ ID NO: 771895 - RNA, 27 nt, Human
aggcaagagaauggugugaacccagga

SEQ ID NO: 771896 - RNA, 24 nt, Human
aggcagguggaucaugaggucagg

SEQ ID NO: 771897 - RNA, 20 nt, Human
aggccgaggcagguggauca

SEQ ID NO: 771898 - RNA, 24 nt, Human
aggcgcgguggcuccugccuguaa

SEQ ID NO: 771899 - RNA, 24 nt, Human
aggcggagcuugcagugagcugag

SEQ ID NO: 771900 - RNA, 20 nt, Human
aggcuuccugaaguucaaga

SEQ ID NO: 771901 - RNA, 24 nt, Human
agguaggaaugggaguuagcggga

SEQ ID NO: 771902 - RNA, 25 nt, Human
agguggaucaugaggucaggagauu

SEQ ID NO: 771903 - RNA, 21 nt, Human
agugcaguggugcaaucauag

SEQ ID NO: 771904 - RNA, 23 nt, Human
agugcaguggugcaaucauagcu

SEQ ID NO: 771905 - RNA, 24 nt, Human
agugcaguggugcaaucauagcuc

SEQ ID NO: 771906 - RNA, 21 nt, Human
aucaucucccccacccaaagu

SEQ ID NO: 771907 - RNA, 24 nt, Human
aucgcgccacugcacuccagccug

SEQ ID NO: 771908 - RNA, 22 nt, Human
caaaaaaacaaaacaaaacaaa

SEQ ID NO: 771909 - RNA, 20 nt, Human
caaaacaaaacaaacuuaaa

SEQ ID NO: 771910 - RNA, 20 nt, Human
caaccaccagacacaacggc

SEQ ID NO: 771911 - RNA, 24 nt, Human
caacggcuaggaauaacagcagag

SEQ ID NO: 771912 - RNA, 21 nt, Human
caagaaccuggacacccucca

SEQ ID NO: 771913 - RNA, 23 nt, Human
caagauucccacacccagauacu

SEQ ID NO: 771914 - RNA, 20 nt, Human
caaucagacuggucauaggc

SEQ ID NO: 771915 - RNA, 24 nt, Human
caaugucaagugagaagcaggaca

SEQ ID NO: 771916 - RNA, 21 nt, Human
cacauggcugccuuccuuaug

SEQ ID NO: 771917 - RNA, 22 nt, Human
cacauuaucaucucccccaccc

SEQ ID NO: 771918 - RNA, 19 nt, Human
caccaguaacaguuugacc

SEQ ID NO: 771919 - RNA, 22 nt, Human
cacuccagccugggugacagag

SEQ ID NO: 771920 - RNA, 23 nt, Human
cacuccagccugggugacagagc

SEQ ID NO: 771921 - RNA, 24 nt, Human
cacuccagccugggugacagagcg

SEQ ID NO: 771922 - RNA, 19 nt, Human
cacugcacuccagccuggg

SEQ ID NO: 771923 - RNA, 21 nt, Human
cacugcacuccagccugggug

SEQ ID NO: 771924 - RNA, 22 nt, Human
cacugcacuccagccuggguga

SEQ ID NO: 771925 - RNA, 23 nt, Human
cacugcacuccagccugggugac

SEQ ID NO: 771926 - RNA, 24 nt, Human
cacugcacuccagccugggugaca

SEQ ID NO: 771927 - RNA, 25 nt, Human
cacugcacuccagccugggugacag

SEQ ID NO: 771928 - RNA, 20 nt, Human
cagaauggcuucaggauuaa

SEQ ID NO: 771929 - RNA, 20 nt, Human
cagacuuuaaagugcuuccc

SEQ ID NO: 771930 - RNA, 22 nt, Human
cagagcugagucucauggccac

SEQ ID NO: 771931 - RNA, 24 nt, Human
cagcacuuugggaggccgaggcag

SEQ ID NO: 771932 - RNA, 24 nt, Human
cagcacuuugggaggccgaggcag

SEQ ID NO: 771933 - RNA, 18 nt, Human
cagcugggacuacaggug

SEQ ID NO: 771934 - RNA, 25 nt, Human
caggugugugucgcuacaccuggcu

SEQ ID NO: 771935 - RNA, 24 nt, Human
caguggugaauaacacaaacuccc

SEQ ID NO: 771936 - RNA, 19 nt, Human
ccaaaguguugggauuaca

SEQ ID NO: 771937 - RNA, 24 nt, Human
ccaaaguguugggauuacaagcau

SEQ ID NO: 771938 - RNA, 23 nt, Human
ccaaggcacuaauugaaaggcug

SEQ ID NO: 771939 - RNA, 18 nt, Human
ccaaggcuuacuucuuug

SEQ ID NO: 771940 - RNA, 19 nt, Human
ccaagucuguccuuuugua

SEQ ID NO: 771941 - RNA, 21 nt, Human
ccaauggcaaaccucuagagg

SEQ ID NO: 771942 - RNA, 20 nt, Human
ccacugcacuccagccuggg

SEQ ID NO: 771943 - RNA, 20 nt, Human
ccacugcacuccagccuggg

SEQ ID NO: 771944 - RNA, 21 nt, Human
ccacugcacuccagccugggu

SEQ ID NO: 771945 - RNA, 21 nt, Human
ccacugcacuccagccugggu

SEQ ID NO: 771946 - RNA, 24 nt, Human
ccacugcacuccagccugggugac

SEQ ID NO: 771947 - RNA, 19 nt, Human
ccauccuccugcuuagccu

SEQ ID NO: 771948 - RNA, 22 nt, Human
ccauugugucuggccuggguga

SEQ ID NO: 771949 - RNA, 23 nt, Human
ccauugugucuggccugggugau

SEQ ID NO: 771950 - RNA, 21 nt, Human
cccacacccagauacuaagac

SEQ ID NO: 771951 - RNA, 20 nt, Human
cccugucuccccuagacaaa

SEQ ID NO: 771952 - RNA, 24 nt, Human
ccugagcagcugggacuacaggug

SEQ ID NO: 771953 - RNA, 23 nt, Human
ccuggcuaacaaagugaaacccc

SEQ ID NO: 771954 - RNA, 24 nt, Human
ccuggcuaacaaagugaaaccccg

SEQ ID NO: 771955 - RNA, 18 nt, Human
ccuggcuucaagcaauuc

SEQ ID NO: 771956 - RNA, 20 nt, Human
ccuggcuucaagcaauucuc

SEQ ID NO: 771957 - RNA, 20 nt, Human
ccugggcccaagccauccuc

SEQ ID NO: 771958 - RNA, 22 nt, Human
ccugggugacagagcgagacuc

SEQ ID NO: 771959 - RNA, 20 nt, Human
ccuguaaucccagcacuuug

SEQ ID NO: 771960 - RNA, 22 nt, Human
ccuguaaucccagcacuuuggg

SEQ ID NO: 771961 - RNA, 24 nt, Human
ccuuggccagcccauuauuaauga

SEQ ID NO: 771962 - RNA, 24 nt, Human
cgagacucugucucaaaaaaacaa

SEQ ID NO: 771963 - RNA, 26 nt, Human
cgccacugcacuccagccugggugac

SEQ ID NO: 771964 - RNA, 19 nt, Human
cggcuaggaauaacagcag

SEQ ID NO: 771965 - RNA, 21 nt, Human
cucacugcagcguugaacucc

SEQ ID NO: 771966 - RNA, 25 nt, Human
cucauccacacacaucaccuuucag

SEQ ID NO: 771967 - RNA, 24 nt, Human
cuccugccuguaaucccagcacuu

SEQ ID NO: 771968 - RNA, 20 nt, Human
cuccugggcccaagccaucu

SEQ ID NO: 771969 - RNA, 21 nt, Human
cuguagucccagauacuuggg

SEQ ID NO: 771970 - RNA, 21 nt, Human
cugucucaaaaaaacaaaaca

SEQ ID NO: 771971 - RNA, 24 nt, Human
cuuagccuccugagcagcugggac

SEQ ID NO: 771972 - RNA, 19 nt, Human
cuuauaaucagcuacaguc

SEQ ID NO: 771973 - RNA, 19 nt, Human
cuugcagugagcugagauc

SEQ ID NO: 771974 - RNA, 21 nt, Human
cuugcagugagcugagaucgc

SEQ ID NO: 771975 - RNA, 18 nt, Human
cuuggcaguggucgcuuu

SEQ ID NO: 771976 - RNA, 21 nt, Human
cuuuggagagugugccauugg

SEQ ID NO: 771977 - RNA, 18 nt, Human
cuuugucgcccaggcugg

SEQ ID NO: 771978 - RNA, 23 nt, Human
gacaaagaacauuugcaauacag

SEQ ID NO: 771979 - RNA, 23 nt, Human
gagaagacaccaccggccaucaa

SEQ ID NO: 771980 - RNA, 20 nt, Human
gagcagcugggacuacaggu

SEQ ID NO: 771981 - RNA, 23 nt, Human
gagcuugcagugagcugagaucg

SEQ ID NO: 771982 - RNA, 23 nt, Human
gaggcagguggaucaugagguca

SEQ ID NO: 771983 - RNA, 18 nt, Human
gagugcaguggugcaauc

SEQ ID NO: 771984 - RNA, 18 nt, Human
gauuacaagcaugagcca

SEQ ID NO: 771985 - RNA, 18 nt, Human
gauuacaagcaugagcca

SEQ ID NO: 771986 - RNA, 21 nt, Human
gauuacaagcaugagccauug

SEQ ID NO: 771987 - RNA, 22 nt, Human
gcaagagaauggugugaaccca

SEQ ID NO: 771988 - RNA, 24 nt, Human
gcacuccagccugggugacagagc

SEQ ID NO: 771989 - RNA, 24 nt, Human
gcauauaaaagaaaccugaccaag

SEQ ID NO: 771990 - RNA, 23 nt, Human
gccacauuugucaacugugucuu

SEQ ID NO: 771991 - RNA, 19 nt, Human
gccacugcacuccagccug

SEQ ID NO: 771992 - RNA, 24 nt, Human
gccacugcacuccagccuggguga

SEQ ID NO: 771993 - RNA, 19 nt, Human
gcccaggcuggagugcagu

SEQ ID NO: 771994 - RNA, 20 nt, Human
gcccaggcuggagugcagug

SEQ ID NO: 771995 - RNA, 21 nt, Human
gcccaggcugggcucagauuc

SEQ ID NO: 771996 - RNA, 20 nt, Human
gcugagaucgcgccacugca

SEQ ID NO: 771997 - RNA, 19 nt, Human
gcuuugucgcccaggcugg

SEQ ID NO: 771998 - RNA, 19 nt, Human
gcuuugucgcccaggcugg

SEQ ID NO: 771999 - RNA, 19 nt, Human
ggagaauagggucuggaga

SEQ ID NO: 772000 - RNA, 18 nt, Human
ggagcuugcagugagcug

SEQ ID NO: 772001 - RNA, 24 nt, Human
ggagcuugcagugagcugagaucg

SEQ ID NO: 772002 - RNA, 24 nt, Human
ggauuacaagcaugagccauugug

SEQ ID NO: 772003 - RNA, 23 nt, Human
ggcagguggaucaugaggucagg

SEQ ID NO: 772004 - RNA, 20 nt, Human
gggagguauuuuuaacaagg

SEQ ID NO: 772005 - RNA, 23 nt, Human
gggagguauuuuuaacaaggcac

SEQ ID NO: 772006 - RNA, 19 nt, Human
gggcccaagccauccuccu

SEQ ID NO: 772007 - RNA, 19 nt, Human
gguaggaaugggaguuagc

SEQ ID NO: 772008 - RNA, 23 nt, Human
gguggcuccugccuguaauccca

SEQ ID NO: 772009 - RNA, 24 nt, Human
gguggcuccugccuguaaucccag

SEQ ID NO: 772010 - RNA, 22 nt, Human
guagcuauuaaugucagguuuu

SEQ ID NO: 772011 - RNA, 19 nt, Human
gugaauaacacaaacucca

SEQ ID NO: 772012 - RNA, 24 nt, Human
gugacagagcgagacucugucuca

SEQ ID NO: 772013 - RNA, 21 nt, Human
gugauuugucuuugguggaag

SEQ ID NO: 772014 - RNA, 18 nt, Human
guggguaaucaggcccag

SEQ ID NO: 772015 - RNA, 20 nt, Human
uaaacaaaaacaaagagaaa

SEQ ID NO: 772016 - RNA, 22 nt, Human
uaaacaaaaacaaagagaauau

SEQ ID NO: 772017 - RNA, 18 nt, Human
uaacaaaaggaucagagg

SEQ ID NO: 772018 - RNA, 24 nt, Human
uaacaaaauguuaauacuagcuaa

SEQ ID NO: 772019 - RNA, 24 nt, Human
uaacaaagugaaaccccgucucua

SEQ ID NO: 772020 - RNA, 24 nt, Human
uaaccaauggcaaaccucuagagg

SEQ ID NO: 772021 - RNA, 19 nt, Human
uaagccacagaaauagcca

SEQ ID NO: 772022 - RNA, 20 nt, Human
uacacaggaguauaacuuug

SEQ ID NO: 772023 - RNA, 19 nt, Human
uacauggacugaaaugaac

SEQ ID NO: 772024 - RNA, 23 nt, Human
uagaagaagaaugcuguuuugau

SEQ ID NO: 772025 - RNA, 21 nt, Human
uagcucccaacaaccaauccc

SEQ ID NO: 772026 - RNA, 23 nt, Human
uagcuuccuuuggguuauacuga

SEQ ID NO: 772027 - RNA, 23 nt, Human
uaggagagucuauauggacaaug

SEQ ID NO: 772028 - RNA, 24 nt, Human
uaggagagucuauauggacaauga

SEQ ID NO: 772029 - RNA, 24 nt, Human
uagguacuuaaaacuuaaaaaaag

SEQ ID NO: 772030 - RNA, 22 nt, Human
uaugaccauacuaauggaaaaa

SEQ ID NO: 772031 - RNA, 23 nt, Human
uauugcuuugucgcccaggcugg

SEQ ID NO: 772032 - RNA, 24 nt, Human
uauugcuuugucgcccaggcuggg

SEQ ID NO: 772033 - RNA, 22 nt, Human
uauuuuuuauuuuuuguagaga

SEQ ID NO: 772034 - RNA, 23 nt, Human
uauuuuuuauuuuuuuugagaca

SEQ ID NO: 772035 - RNA, 22 nt, Human
ucaagaagcuacccugucuccc

SEQ ID NO: 772036 - RNA, 18 nt, Human
ucaagcaauucucccacc

SEQ ID NO: 772037 - RNA, 24 nt, Human
ucacugcagcguugaacuccuggg

SEQ ID NO: 772038 - RNA, 20 nt, Human
ucagacuggucauaggccaa

SEQ ID NO: 772039 - RNA, 20 nt, Human
ucagguuuuaucucugcacu

SEQ ID NO: 772040 - RNA, 24 nt, Human
ucaugaggucaggagauugagacc

SEQ ID NO: 772041 - RNA, 19 nt, Human
uccaaggauuuuauggaaa

SEQ ID NO: 772042 - RNA, 23 nt, Human
uccagccugggugacagagcgag

SEQ ID NO: 772043 - RNA, 24 nt, Human
uccagccugggugacagagcgaga

SEQ ID NO: 772044 - RNA, 18 nt, Human
ucccaaaguguugggauu

SEQ ID NO: 772045 - RNA, 24 nt, Human
ucccaaaguguugggauuacaagc

SEQ ID NO: 772046 - RNA, 24 nt, Human
ucccccacccaaaguggagcuauu

SEQ ID NO: 772047 - RNA, 18 nt, Human
ucccuuggccagcccauu

SEQ ID NO: 772048 - RNA, 24 nt, Human
uccugagcagcugggacuacaggu

SEQ ID NO: 772049 - RNA, 20 nt, Human
uccugggcccaagccauccu

SEQ ID NO: 772050 - RNA, 20 nt, Human
uccuucucaaaaaaaaaaag

SEQ ID NO: 772051 - RNA, 19 nt, Human
ucgcccaggcugggcucag

SEQ ID NO: 772052 - RNA, 21 nt, Human
ucgcccaggcugggcucagau

SEQ ID NO: 772053 - RNA, 23 nt, Human
ucgcgccacugcacuccagccug

SEQ ID NO: 772054 - RNA, 19 nt, Human
ucuaaaauaugacaacagc

SEQ ID NO: 772055 - RNA, 25 nt, Human
ucucuauuaaaaauacaaaaaaauu

SEQ ID NO: 772056 - RNA, 18 nt, Human
ucuguugcccaggcugga

SEQ ID NO: 772057 - RNA, 24 nt, Human
ucuguugcccaggcuggagugcag

SEQ ID NO: 772058 - RNA, 23 nt, Human
ucuuacucuguugcccaggcugg

SEQ ID NO: 772059 - RNA, 24 nt, Human
ucuuacucuguugcccaggcugga

SEQ ID NO: 772060 - RNA, 18 nt, Human
ucuuccuagcucauccac

SEQ ID NO: 772061 - RNA, 22 nt, Human
ugaaaaaugaaagugccucuga

SEQ ID NO: 772062 - RNA, 18 nt, Human
ugaaauauugcuacuucu

SEQ ID NO: 772063 - RNA, 20 nt, Human
ugaaauguucuagcaaagcc

SEQ ID NO: 772064 - RNA, 22 nt, Human
ugacuuauaaucagcuacaguc

SEQ ID NO: 772065 - RNA, 21 nt, Human
ugagaagcaggacaaagaaca

SEQ ID NO: 772066 - RNA, 28 nt, Human
ugagaagcaggacaaagaacauuugcaa

SEQ ID NO: 772067 - RNA, 24 nt, Human
ugagaccauccuggcuaacaaagu

SEQ ID NO: 772068 - RNA, 20 nt, Human
ugagaguuacgugaucucca

SEQ ID NO: 772069 - RNA, 24 nt, Human
ugagaucgcgccacugcacuccag

SEQ ID NO: 772070 - RNA, 22 nt, Human
ugagcugagaucgcgccacugc

SEQ ID NO: 772071 - RNA, 18 nt, Human
ugaggcaagagaauggug

SEQ ID NO: 772072 - RNA, 24 nt, Human
ugaggcaagagaauggugugaacc

SEQ ID NO: 772073 - RNA, 25 nt, Human
ugaggcaagagaauggugugaaccc

SEQ ID NO: 772074 - RNA, 20 nt, Human
ugaggcaggagaauaggguc

SEQ ID NO: 772075 - RNA, 18 nt, Human
ugcccaggcuggagugca

SEQ ID NO: 772076 - RNA, 21 nt, Human
ugcccaggcuggagugcagug

SEQ ID NO: 772077 - RNA, 24 nt, Human
ugcccaggcuggagugcaguggug

SEQ ID NO: 772078 - RNA, 23 nt, Human
ugccuguaaucccagcacuuugg

SEQ ID NO: 772079 - RNA, 23 nt, Human
ugccuguaaucccagcacuuugg

SEQ ID NO: 772080 - RNA, 20 nt, Human
ugccuugguuuuuggaccau

SEQ ID NO: 772081 - RNA, 22 nt, Human
ugcucugauccuucucaaaaaa

SEQ ID NO: 772082 - RNA, 19 nt, Human
ugcuuugucgcccaggcug

SEQ ID NO: 772083 - RNA, 18 nt, Human
uggagugcaguggugcaa

SEQ ID NO: 772084 - RNA, 19 nt, Human
uggagugcaguggugcaau

SEQ ID NO: 772085 - RNA, 23 nt, Human
uggcaguggucgcuuugcaaaau

SEQ ID NO: 772086 - RNA, 23 nt, Human
uggcucccucccuuggccagccc

SEQ ID NO: 772087 - RNA, 19 nt, Human
uggcuccugccuguaaucc

SEQ ID NO: 772088 - RNA, 20 nt, Human
uggcuccugccuguaauccc

SEQ ID NO: 772089 - RNA, 21 nt, Human
uggcuccugccuguaauccca

SEQ ID NO: 772090 - RNA, 24 nt, Human
uggcuccugccuguaaucccagca

SEQ ID NO: 772091 - RNA, 21 nt, Human
uggcuucaagcaauucuccca

SEQ ID NO: 772092 - RNA, 24 nt, Human
uggcuucaagcaauucucccaccu

SEQ ID NO: 772093 - RNA, 21 nt, Human
ugggacuacaggugugugucg

SEQ ID NO: 772094 - RNA, 22 nt, Human
ugggacuacaggugugugucgc

SEQ ID NO: 772095 - RNA, 24 nt, Human
ugggacuacaggugugugucgcua

SEQ ID NO: 772096 - RNA, 24 nt, Human
ugggaggccgaggcagguggauca

SEQ ID NO: 772097 - RNA, 20 nt, Human
ugggaggcugaggcaagaga

SEQ ID NO: 772098 - RNA, 19 nt, Human
ugggauuacaagcaugagc

SEQ ID NO: 772099 - RNA, 21 nt, Human
ugggauuacaagcaugagcca

SEQ ID NO: 772100 - RNA, 21 nt, Human
ugggauuacaagcaugagcca

SEQ ID NO: 772101 - RNA, 22 nt, Human
ugggauuacaagcaugagccau

SEQ ID NO: 772102 - RNA, 23 nt, Human
ugggauuacaagcaugagccauu

SEQ ID NO: 772103 - RNA, 24 nt, Human
ugggauuacaagcaugagccauug

SEQ ID NO: 772104 - RNA, 27 nt, Human
ugggauuacaagcaugagccauugugu

SEQ ID NO: 772105 - RNA, 20 nt, Human
uggguaaucaggcccaguau

SEQ ID NO: 772106 - RNA, 21 nt, Human
uggguuucauggcucccuccc

SEQ ID NO: 772107 - RNA, 20 nt, Human
ugguaacuuuggagaguguu

SEQ ID NO: 772108 - RNA, 22 nt, Human
uggugaauaacacaaacuccau

SEQ ID NO: 772109 - RNA, 24 nt, Human
uggugcaaucauagcucacugcag

SEQ ID NO: 772110 - RNA, 24 nt, Human
ugguggcgggcgacuguaguccca

SEQ ID NO: 772111 - RNA, 19 nt, Human
ugucaacugugucuuuaug

SEQ ID NO: 772112 - RNA, 19 nt, Human
uguccaaaaugccaagaac

SEQ ID NO: 772113 - RNA, 24 nt, Human
uguugggauuacaagcaugagcca

SEQ ID NO: 772114 - RNA, 24 nt, Human
uguuguaagccacagaaauagcca

SEQ ID NO: 772115 - RNA, 25 nt, Human
uuaauauauguuguaaugauuaugu

SEQ ID NO: 772116 - RNA, 22 nt, Human
uuacauauauauacaaccacaa

SEQ ID NO: 772117 - RNA, 24 nt, Human
uuacucuguugcccaggcuggagu

SEQ ID NO: 772118 - RNA, 18 nt, Human
uuagccgggcgugguggc

SEQ ID NO: 772119 - RNA, 23 nt, Human
uuauggaaagccuggauaacauu

SEQ ID NO: 772120 - RNA, 24 nt, Human
uucaagcaauucucccaccuuggc

SEQ ID NO: 772121 - RNA, 22 nt, Human
uucccacacccagauacuaaga

SEQ ID NO: 772122 - RNA, 20 nt, Human
uuccuagaacugaaucaaaa

SEQ ID NO: 772123 - RNA, 24 nt, Human
uucuuacucuguugcccaggcugg

SEQ ID NO: 772124 - RNA, 19 nt, Human
uucuuguugcacuuugugu

SEQ ID NO: 772125 - RNA, 19 nt, Human
uugaaauauugcuacuucu

SEQ ID NO: 772126 - RNA, 24 nt, Human
uugagacaguucuuacucuguugc

SEQ ID NO: 772127 - RNA, 18 nt, Human
uugcagugagcugagauc

SEQ ID NO: 772128 - RNA, 22 nt, Human
uugcagugagcugagaucgcgc

SEQ ID NO: 772129 - RNA, 20 nt, Human
uugcuuugucgcccaggcug

SEQ ID NO: 772130 - RNA, 21 nt, Human
uugcuuugucgcccaggcugg

SEQ ID NO: 772131 - RNA, 25 nt, Human
uugggaggccgaggcagguggauca

SEQ ID NO: 772132 - RNA, 20 nt, Human
uugggauuacaagcaugagc

SEQ ID NO: 772133 - RNA, 25 nt, Human
uuguaagccacagaaauagccacau

SEQ ID NO: 772134 - RNA, 23 nt, Human
uuuacacaggguguacgccaagu

SEQ ID NO: 772135 - RNA, 24 nt, Human
uuuacauauauauacaaccacaca

SEQ ID NO: 772136 - RNA, 22 nt, Human
uuucugcauugcagaugaaaaa

SEQ ID NO: 772137 - RNA, 19 nt, Human
uuugguggaagugguagac

SEQ ID NO: 772138 - RNA, 20 nt, Human
aaaaaaaaagcaagcuugaa

SEQ ID NO: 772139 - RNA, 25 nt, Human
aaaaaaaagcaagcuugagcugccu

SEQ ID NO: 772140 - RNA, 26 nt, Human
aaaaaacagccaggcaugguggcuug

SEQ ID NO: 772141 - RNA, 18 nt, Human
aaaacaaccauuagcaau

SEQ ID NO: 772142 - RNA, 23 nt, Human
aaaagaaaaaagauuugccaaaa

SEQ ID NO: 772143 - RNA, 24 nt, Human
aaacagcaccuaccauaugacuca

SEQ ID NO: 772144 - RNA, 19 nt, Human
aaacccaggagcagagcag

SEQ ID NO: 772145 - RNA, 19 nt, Human
aaagccccauucauaaauc

SEQ ID NO: 772146 - RNA, 24 nt, Human
aacauucucucugccucccugccu

SEQ ID NO: 772147 - RNA, 22 nt, Human
aaccacucaauuguacgcuuaa

SEQ ID NO: 772148 - RNA, 23 nt, Human
aagcaagcuugagcugccuaagu

SEQ ID NO: 772149 - RNA, 23 nt, Human
aagcacauuugcuaggcugagca

SEQ ID NO: 772150 - RNA, 19 nt, Human
aauccaaaauacuuuauca

SEQ ID NO: 772151 - RNA, 27 nt, Human
acaaucaagauuugccaaaaaacagcc

SEQ ID NO: 772152 - RNA, 25 nt, Human
acacagcaaacccaggagcagagca

SEQ ID NO: 772153 - RNA, 21 nt, Human
acagguggcaaccuuggcuca

SEQ ID NO: 772154 - RNA, 21 nt, Human
acaugaccaucauuuguuuuc

SEQ ID NO: 772155 - RNA, 22 nt, Human
accaaagauuucaugaaaugac

SEQ ID NO: 772156 - RNA, 22 nt, Human
acgcgguagaccagggggaguc

SEQ ID NO: 772157 - RNA, 18 nt, Human
agacagccaugagaucag

SEQ ID NO: 772158 - RNA, 20 nt, Human
agacagccaugagaucaggg

SEQ ID NO: 772159 - RNA, 18 nt, Human
agacuugaaagaucagug

SEQ ID NO: 772160 - RNA, 22 nt, Human
agagagaccucuuucuucagga

SEQ ID NO: 772161 - RNA, 20 nt, Human
agagucaaugaaaauaugaa

SEQ ID NO: 772162 - RNA, 19 nt, Human
agcagagcccugucucaaa

SEQ ID NO: 772163 - RNA, 20 nt, Human
agcagcacucaaucccuggu

SEQ ID NO: 772164 - RNA, 23 nt, Human
agccaggcaugguggcuugugcc

SEQ ID NO: 772165 - RNA, 24 nt, Human
agccaugagaucagggugggacug

SEQ ID NO: 772166 - RNA, 21 nt, Human
aggagcagagcaggaucggca

SEQ ID NO: 772167 - RNA, 20 nt, Human
aggcaggcaggcuagauauu

SEQ ID NO: 772168 - RNA, 20 nt, Human
aggcagugagcaagguaggg

SEQ ID NO: 772169 - RNA, 24 nt, Human
aggcugaggugggaggaucccuug

SEQ ID NO: 772170 - RNA, 19 nt, Human
agugagcaagguaggagag

SEQ ID NO: 772171 - RNA, 20 nt, Human
aguggugaugguugaacaag

SEQ ID NO: 772172 - RNA, 19 nt, Human
aguggugggacaaggggcu

SEQ ID NO: 772173 - RNA, 18 nt, Human
aucgaaauacaaaagcua

SEQ ID NO: 772174 - RNA, 20 nt, Human
auuuguuuucauuuccugag

SEQ ID NO: 772175 - RNA, 25 nt, Human
caaaaaagaaaaaagauuugccaaa

SEQ ID NO: 772176 - RNA, 18 nt, Human
caaaacacaaaccuucag

SEQ ID NO: 772177 - RNA, 18 nt, Human
caaaauaaauaugccagg

SEQ ID NO: 772178 - RNA, 21 nt, Human
caaaaucagguguugguugcc

SEQ ID NO: 772179 - RNA, 26 nt, Human
caaacagcaccuaccauaugacucag

SEQ ID NO: 772180 - RNA, 21 nt, Human
caacaugaccaucauuuguuu

SEQ ID NO: 772181 - RNA, 22 nt, Human
caagaggggcccacccaggccc

SEQ ID NO: 772182 - RNA, 28 nt, Human
cacaaucaagauuugccaaaaaacagcc

SEQ ID NO: 772183 - RNA, 23 nt, Human
cacacagcaaacccaggagcaga

SEQ ID NO: 772184 - RNA, 21 nt, Human
cacaguguuuaacacugccca

SEQ ID NO: 772185 - RNA, 20 nt, Human
caccaaagauuucaugaaau

SEQ ID NO: 772186 - RNA, 23 nt, Human
cacggaucacaggucugagaagu

SEQ ID NO: 772187 - RNA, 28 nt, Human
cacuaaucuagccaccauucagucacac

SEQ ID NO: 772188 - RNA, 18 nt, Human
cagcacucaaucccuggu

SEQ ID NO: 772189 - RNA, 20 nt, Human
caggaucaccaauuaugcca

SEQ ID NO: 772190 - RNA, 21 nt, Human
caggauuccaaauuaauguua

SEQ ID NO: 772191 - RNA, 18 nt, Human
cauuuguuuucauuuccu

SEQ ID NO: 772192 - RNA, 24 nt, Human
ccaaagauuucaugaaaugacauu

SEQ ID NO: 772193 - RNA, 23 nt, Human
ccacccaggccccagcuugauuu

SEQ ID NO: 772194 - RNA, 19 nt, Human
ccacuaaucuagccaccau

SEQ ID NO: 772195 - RNA, 24 nt, Human
cccacagguaaaggguaaugcugg

SEQ ID NO: 772196 - RNA, 20 nt, Human
cccaggccccagcuugauuu

SEQ ID NO: 772197 - RNA, 19 nt, Human
cccucccagagcccuucac

SEQ ID NO: 772198 - RNA, 23 nt, Human
ccucaaggguuagacaucucucc

SEQ ID NO: 772199 - RNA, 22 nt, Human
ccuccuuaucugucucccagac

SEQ ID NO: 772200 - RNA, 18 nt, Human
ccuucagaguagugcuca

SEQ ID NO: 772201 - RNA, 18 nt, Human
cggagugugcugcuuucc

SEQ ID NO: 772202 - RNA, 24 nt, Human
cggcugcuugggaggcugaggugg

SEQ ID NO: 772203 - RNA, 21 nt, Human
cuaagucccgcucacacacac

SEQ ID NO: 772204 - RNA, 19 nt, Human
cucaugcuuucagcguucc

SEQ ID NO: 772205 - RNA, 19 nt, Human
cugaaggcugggcauuugc

SEQ ID NO: 772206 - RNA, 22 nt, Human
cugaaucaugcauauccuugcu

SEQ ID NO: 772207 - RNA, 21 nt, Human
cugacugcuguggacacugag

SEQ ID NO: 772208 - RNA, 28 nt, Human
cugcucccacuaaucuagccaccauuca

SEQ ID NO: 772209 - RNA, 26 nt, Human
cuucaaggaaaaaacugcaacaugac

SEQ ID NO: 772210 - RNA, 24 nt, Human
cuuccucuuuguuauacacacaga

SEQ ID NO: 772211 - RNA, 24 nt, Human
gaaaacguacacucacaugccuuc

SEQ ID NO: 772212 - RNA, 22 nt, Human
gaaaguaucaucugggcugaag

SEQ ID NO: 772213 - RNA, 24 nt, Human
gacaaugaaaggagagacagccau

SEQ ID NO: 772214 - RNA, 23 nt, Human
gacuugaaagaucaguguauaca

SEQ ID NO: 772215 - RNA, 18 nt, Human
gagcugccuaagucccgc

SEQ ID NO: 772216 - RNA, 19 nt, Human
gaguuugcaaccagccuga

SEQ ID NO: 772217 - RNA, 20 nt, Human
gaucacaggucugagaagug

SEQ ID NO: 772218 - RNA, 23 nt, Human
gaucaccaauuaugccaaggaga

SEQ ID NO: 772219 - RNA, 20 nt, Human
gcaaacccaggagcagagca

SEQ ID NO: 772220 - RNA, 24 nt, Human
gcacaacauucucucugccucccu

SEQ ID NO: 772221 - RNA, 18 nt, Human
gcagagcccugucucaaa

SEQ ID NO: 772222 - RNA, 20 nt, Human
gcagagcccugucucaaaag

SEQ ID NO: 772223 - RNA, 23 nt, Human
gcugcuugggaggcugagguggg

SEQ ID NO: 772224 - RNA, 20 nt, Human
gcuugugccugcagucccgg

SEQ ID NO: 772225 - RNA, 21 nt, Human
ggacaaggggcucaacagcag

SEQ ID NO: 772226 - RNA, 18 nt, Human
ggcagcuagcucacccuc

SEQ ID NO: 772227 - RNA, 18 nt, Human
gggcaggaaaucggucug

SEQ ID NO: 772228 - RNA, 23 nt, Human
gugaauuuacuaaaaccacucaa

SEQ ID NO: 772229 - RNA, 21 nt, Human
uaaaaguuuccuucgagugua

SEQ ID NO: 772230 - RNA, 24 nt, Human
uaaacugcagagauuaaaaguuuc

SEQ ID NO: 772231 - RNA, 18 nt, Human
uaacaggugugugauaag

SEQ ID NO: 772232 - RNA, 27 nt, Human
uaagagacagguggcaaccuuggcuca

SEQ ID NO: 772233 - RNA, 18 nt, Human
uacacacagagacacaga

SEQ ID NO: 772234 - RNA, 26 nt, Human
uaccaagaggggcccacccaggcccc

SEQ ID NO: 772235 - RNA, 24 nt, Human
uaccaagggccacacagcaaaccc

SEQ ID NO: 772236 - RNA, 18 nt, Human
uaccacgcugggcugguc

SEQ ID NO: 772237 - RNA, 24 nt, Human
uacgcuuaaaaaaaaaagcaagcu

SEQ ID NO: 772238 - RNA, 19 nt, Human
uacuaaaaccacucaauug

SEQ ID NO: 772239 - RNA, 22 nt, Human
uagauccuacgguauguuagaa

SEQ ID NO: 772240 - RNA, 24 nt, Human
uauaggacucacagaaaacaacca

SEQ ID NO: 772241 - RNA, 24 nt, Human
uaugguccccuggagagaagcagg

SEQ ID NO: 772242 - RNA, 24 nt, Human
ucaagauuugccaaaaaacagcca

SEQ ID NO: 772243 - RNA, 18 nt, Human
ucacagucugaugaggga

SEQ ID NO: 772244 - RNA, 23 nt, Human
ucacuggggagaagauacacgga

SEQ ID NO: 772245 - RNA, 23 nt, Human
ucagcccacgcugagucugaugc

SEQ ID NO: 772246 - RNA, 24 nt, Human
ucagcccacgcugagucugaugcc

SEQ ID NO: 772247 - RNA, 21 nt, Human
ucauucacuguaaaauuuggu

SEQ ID NO: 772248 - RNA, 23 nt, Human
ucauuuguuuucauuuccugagu

SEQ ID NO: 772249 - RNA, 23 nt, Human
uccaaaauacuuuaucaccaaag

SEQ ID NO: 772250 - RNA, 24 nt, Human
uccaaaauacuuuaucaccaaaga

SEQ ID NO: 772251 - RNA, 18 nt, Human
uccaagugaaaacaaggu

SEQ ID NO: 772252 - RNA, 20 nt, Human
uccagguaggaggauuuaga

SEQ ID NO: 772253 - RNA, 18 nt, Human
ucuaaacuaacagcagca

SEQ ID NO: 772254 - RNA, 18 nt, Human
ucuaaacuaacagcagca

SEQ ID NO: 772255 - RNA, 18 nt, Human
ucucaaaaaagaaaaaag

SEQ ID NO: 772256 - RNA, 23 nt, Human
ucugacaaugaaaggagagacag

SEQ ID NO: 772257 - RNA, 20 nt, Human
ucuucauucccugaaucaug

SEQ ID NO: 772258 - RNA, 22 nt, Human
ucuuggacccucccagagcccu

SEQ ID NO: 772259 - RNA, 26 nt, Human
ugaaaacaagguuauuuggucgacug

SEQ ID NO: 772260 - RNA, 19 nt, Human
ugaaaacauuccugcacac

SEQ ID NO: 772261 - RNA, 22 nt, Human
ugaaagccccauucauaaaucc

SEQ ID NO: 772262 - RNA, 18 nt, Human
ugaagagaacaaacagug

SEQ ID NO: 772263 - RNA, 19 nt, Human
ugaagagaacaaacagugg

SEQ ID NO: 772264 - RNA, 26 nt, Human
ugaauccaaaauacuuuaucaccaaa

SEQ ID NO: 772265 - RNA, 24 nt, Human
ugccugcagucccggcugcuuggg

SEQ ID NO: 772266 - RNA, 18 nt, Human
ugccuggguaugagaagg

SEQ ID NO: 772267 - RNA, 18 nt, Human
ugccuuccugccugcagc

SEQ ID NO: 772268 - RNA, 20 nt, Human
ugcuguggacacugaguaca

SEQ ID NO: 772269 - RNA, 21 nt, Human
uggaagaaaacguacacucac

SEQ ID NO: 772270 - RNA, 18 nt, Human
uggcgggaguggugggac

SEQ ID NO: 772271 - RNA, 25 nt, Human
uggcgggaguggugggacaaggggc

SEQ ID NO: 772272 - RNA, 19 nt, Human
ugggaggcugaggugggag

SEQ ID NO: 772273 - RNA, 19 nt, Human
ugggcaggaaaucggucug

SEQ ID NO: 772274 - RNA, 24 nt, Human
uggucaggugggcaggaaaucggu

SEQ ID NO: 772275 - RNA, 23 nt, Human
ugguggcuugugccugcaguccc

SEQ ID NO: 772276 - RNA, 28 nt, Human
uguaauauuucuaaaaugucauuuaauc

SEQ ID NO: 772277 - RNA, 18 nt, Human
ugugccugcagucccggc

SEQ ID NO: 772278 - RNA, 22 nt, Human
ugugccugcagucccggcugcu

SEQ ID NO: 772279 - RNA, 23 nt, Human
ugugccugcagucccggcugcuu

SEQ ID NO: 772280 - RNA, 19 nt, Human
uguuggauaacaggugugu

SEQ ID NO: 772281 - RNA, 20 nt, Human
uuaaaguguaacaaaacccc

SEQ ID NO: 772282 - RNA, 25 nt, Human
uucacagauaccaagaggggcccac

SEQ ID NO: 772283 - RNA, 20 nt, Human
uuccaaacagcaccuaccau

SEQ ID NO: 772284 - RNA, 20 nt, Human
uugcacuuaauuugaauccg

SEQ ID NO: 772285 - RNA, 21 nt, Human
uugcagucccucacagaccug

SEQ ID NO: 772286 - RNA, 23 nt, Human
uuggaaagauucacagauaccaa

SEQ ID NO: 772287 - RNA, 19 nt, Human
uuguaauauuucuaaaaug

SEQ ID NO: 772288 - RNA, 18 nt, Human
uuguuuucauuuccugag

SEQ ID NO: 772289 - RNA, 24 nt, Human
uuguuuucauuuccugaguaagcu

SEQ ID NO: 772290 - RNA, 20 nt, Human
uuugcagucccucacagacc

SEQ ID NO: 772291 - RNA, 19 nt, Human
aaaaaaaaaaaaaaagagg

SEQ ID NO: 772292 - RNA, 25 nt, Human
aaaaaaagcaaaaacagcuuuauaa

SEQ ID NO: 772293 - RNA, 18 nt, Human
aaaaaagccagacccaag

SEQ ID NO: 772294 - RNA, 19 nt, Human
aaaaaagccagacccaagg

SEQ ID NO: 772295 - RNA, 19 nt, Human
aaaaacagcuuuauaaaca

SEQ ID NO: 772296 - RNA, 21 nt, Human
aaaaagccagacccaagggac

SEQ ID NO: 772297 - RNA, 24 nt, Human
aaaacaaaacaggaaacuccccaa

SEQ ID NO: 772298 - RNA, 21 nt, Human
aaaacaaaggaaaaaaaccca

SEQ ID NO: 772299 - RNA, 21 nt, Human
aaaacccaaaaaaacuguuuc

SEQ ID NO: 772300 - RNA, 22 nt, Human
aaaagaaaaaaaaaaaaaaaag

SEQ ID NO: 772301 - RNA, 21 nt, Human
aaacaaaacaggaaacucccc

SEQ ID NO: 772302 - RNA, 23 nt, Human
aaacaaaacaggaaacuccccaa

SEQ ID NO: 772303 - RNA, 18 nt, Human
aaacaacccagcugaaag

SEQ ID NO: 772304 - RNA, 24 nt, Human
aaagcucaguaaaugucacaaaag

SEQ ID NO: 772305 - RNA, 18 nt, Human
aaaggauucccugccucc

SEQ ID NO: 772306 - RNA, 19 nt, Human
aaccugggcuaaccagaag

SEQ ID NO: 772307 - RNA, 23 nt, Human
aaccuuaauuaaagagaccccag

SEQ ID NO: 772308 - RNA, 21 nt, Human
aagaaaaaaaaaaaaaaaaga

SEQ ID NO: 772309 - RNA, 22 nt, Human
aagaaaaaaaaaaaaaaaagag

SEQ ID NO: 772310 - RNA, 18 nt, Human
aagagcaugaaggaucuu

SEQ ID NO: 772311 - RNA, 22 nt, Human
aagauccagucucuacaaaaaa

SEQ ID NO: 772312 - RNA, 18 nt, Human
aagaucccagaaggucag

SEQ ID NO: 772313 - RNA, 21 nt, Human
aaggaucuuauugggagggau

SEQ ID NO: 772314 - RNA, 21 nt, Human
aaguucucuaagcuacucucc

SEQ ID NO: 772315 - RNA, 23 nt, Human
aaguuguuuuaagaaaaggauuc

SEQ ID NO: 772316 - RNA, 23 nt, Human
aaucaaagcaauaguaauaaaca

SEQ ID NO: 772317 - RNA, 21 nt, Human
aaucaacaggacagaauaacu

SEQ ID NO: 772318 - RNA, 22 nt, Human
aaucacugaaauguacacuuga

SEQ ID NO: 772319 - RNA, 24 nt, Human
aaucacuugagcacaacaauucaa

SEQ ID NO: 772320 - RNA, 22 nt, Human
acaagcuccuuucucucugcaa

SEQ ID NO: 772321 - RNA, 23 nt, Human
acaccaucaccacuucaccaucc

SEQ ID NO: 772322 - RNA, 22 nt, Human
acacccagccuauaaucccagc

SEQ ID NO: 772323 - RNA, 19 nt, Human
acacugccaucuacaucuc

SEQ ID NO: 772324 - RNA, 24 nt, Human
acagaauucuacucagcaauaaaa

SEQ ID NO: 772325 - RNA, 23 nt, Human
acagagugagacuaugucucaaa

SEQ ID NO: 772326 - RNA, 24 nt, Human
acagagugagacuaugucucaaaa

SEQ ID NO: 772327 - RNA, 20 nt, Human
acaggacaacaguaacuaaa

SEQ ID NO: 772328 - RNA, 26 nt, Human
acaggacaacaguaacuaaaugacuc

SEQ ID NO: 772329 - RNA, 24 nt, Human
accacacccagccuauaaucccag

SEQ ID NO: 772330 - RNA, 21 nt, Human
accaccaucacagcccuaccu

SEQ ID NO: 772331 - RNA, 19 nt, Human
accacugcacuccagccug

SEQ ID NO: 772332 - RNA, 24 nt, Human
accacugcacuccagccuggguga

SEQ ID NO: 772333 - RNA, 18 nt, Human
accauccacaacauccuc

SEQ ID NO: 772334 - RNA, 25 nt, Human
accauuuugugcauuacuaucccca

SEQ ID NO: 772335 - RNA, 19 nt, Human
accuaaacugagaaagauu

SEQ ID NO: 772336 - RNA, 22 nt, Human
accucaccuccuuacuucccag

SEQ ID NO: 772337 - RNA, 23 nt, Human
accucaccuccuuacuucccagc

SEQ ID NO: 772338 - RNA, 21 nt, Human
acuaugucucaaaaaaaaaga

SEQ ID NO: 772339 - RNA, 28 nt, Human
acuaugucucaaaaaaaaagaaaaaaaa

SEQ ID NO: 772340 - RNA, 23 nt, Human
acucaagugacaaccaccaucac

SEQ ID NO: 772341 - RNA, 24 nt, Human
acuccagccugggugacagaguga

SEQ ID NO: 772342 - RNA, 24 nt, Human
acugcacuccagccugggugacag

SEQ ID NO: 772343 - RNA, 26 nt, Human
acugcacuccagccugggugacagag

SEQ ID NO: 772344 - RNA, 21 nt, Human
acuucgcaaacuaaugacguc

SEQ ID NO: 772345 - RNA, 24 nt, Human
agaaaaaaaaaaaaaaaagaggga

SEQ ID NO: 772346 - RNA, 23 nt, Human
agaaagggcaaauuuauagagaa

SEQ ID NO: 772347 - RNA, 21 nt, Human
agaaauacucagaggcuuaga

SEQ ID NO: 772348 - RNA, 23 nt, Human
agaauuucuucagcuuuccauac

SEQ ID NO: 772349 - RNA, 22 nt, Human
agaggcugcagaggugcucugu

SEQ ID NO: 772350 - RNA, 18 nt, Human
agaugggagaaucacuug

SEQ ID NO: 772351 - RNA, 24 nt, Human
agcacuuugggaggcugagauggg

SEQ ID NO: 772352 - RNA, 22 nt, Human
agccaugguuagcauuauaacc

SEQ ID NO: 772353 - RNA, 22 nt, Human
agccugggugacagagugagac

SEQ ID NO: 772354 - RNA, 23 nt, Human
agcuauuuaaaaaaacaaaacag

SEQ ID NO: 772355 - RNA, 21 nt, Human
agcugcuuccuauaccuggag

SEQ ID NO: 772356 - RNA, 20 nt, Human
aggaaaagcagucccagaag

SEQ ID NO: 772357 - RNA, 25 nt, Human
aggaaagacaaagaaacacacccua

SEQ ID NO: 772358 - RNA, 19 nt, Human
aggagaauuucuucagcuu

SEQ ID NO: 772359 - RNA, 24 nt, Human
aggcuaagaugggaggauugcuug

SEQ ID NO: 772360 - RNA, 20 nt, Human
aggcucauaaucaacaggac

SEQ ID NO: 772361 - RNA, 24 nt, Human
aggcucccagccuuuccccaguga

SEQ ID NO: 772362 - RNA, 24 nt, Human
aggcugagaugggagaaucacuug

SEQ ID NO: 772363 - RNA, 22 nt, Human
aggcugcagaggugcucugucu

SEQ ID NO: 772364 - RNA, 24 nt, Human
aggcuggaaaaaaaaacuguccaa

SEQ ID NO: 772365 - RNA, 18 nt, Human
agggagagauuuccucua

SEQ ID NO: 772366 - RNA, 23 nt, Human
aguaacuaaaugacucaagugac

SEQ ID NO: 772367 - RNA, 24 nt, Human
agucuuccucaaagcuuucucggc

SEQ ID NO: 772368 - RNA, 20 nt, Human
auacagcagggugagagggg

SEQ ID NO: 772369 - RNA, 20 nt, Human
aucaaaaguuacuguaaacu

SEQ ID NO: 772370 - RNA, 25 nt, Human
aucacagcccuaccuucugauuuag

SEQ ID NO: 772371 - RNA, 21 nt, Human
augauuaggggaaaaaaagca

SEQ ID NO: 772372 - RNA, 20 nt, Human
auguucagugucugaagaag

SEQ ID NO: 772373 - RNA, 19 nt, Human
auguuucccuggguuggcu

SEQ ID NO: 772374 - RNA, 24 nt, Human
auucaccucaccuccuuacuuccc

SEQ ID NO: 772375 - RNA, 20 nt, Human
auuuuaucucauuuuuguca

SEQ ID NO: 772376 - RNA, 24 nt, Human
caaaaagucaacgagagcucauaa

SEQ ID NO: 772377 - RNA, 20 nt, Human
caaaacagaccagcacagca

SEQ ID NO: 772378 - RNA, 22 nt, Human
caaaacaggaaacuccccaaac

SEQ ID NO: 772379 - RNA, 22 nt, Human
caaaauagaaauacucagaggc

SEQ ID NO: 772380 - RNA, 21 nt, Human
caaacaaaagucagcagaaca

SEQ ID NO: 772381 - RNA, 23 nt, Human
caaaccucaaaaacauuagcuaa

SEQ ID NO: 772382 - RNA, 19 nt, Human
caaaggaaaaaaacccaaa

SEQ ID NO: 772383 - RNA, 18 nt, Human
caacaagacacacaugca

SEQ ID NO: 772384 - RNA, 22 nt, Human
caacagaauucuacucagcaau

SEQ ID NO: 772385 - RNA, 20 nt, Human
caaccaccaucacagcccua

SEQ ID NO: 772386 - RNA, 20 nt, Human
caaccucugucccacagccu

SEQ ID NO: 772387 - RNA, 19 nt, Human
caagaccuucugggcccag

SEQ ID NO: 772388 - RNA, 23 nt, Human
cacacagcacaguagcaaucaga

SEQ ID NO: 772389 - RNA, 19 nt, Human
cacacccagccuauaaucc

SEQ ID NO: 772390 - RNA, 30 nt, Human
cacacccagccuauaaucccagcacuuugg

SEQ ID NO: 772391 - RNA, 18 nt, Human
cacagccacauacugaau

SEQ ID NO: 772392 - RNA, 23 nt, Human
cacccgagaagcgccacuaccac

SEQ ID NO: 772393 - RNA, 23 nt, Human
caccucaccuccuuacuucccag

SEQ ID NO: 772394 - RNA, 19 nt, Human
cacucagacacaugcucau

SEQ ID NO: 772395 - RNA, 22 nt, Human
cacuccagccugggugacagag

SEQ ID NO: 772396 - RNA, 24 nt, Human
cacuccagccugggugacagagug

SEQ ID NO: 772397 - RNA, 20 nt, Human
cacuccuccgagagcuuaaa

SEQ ID NO: 772398 - RNA, 19 nt, Human
cacugcacuccagccuggg

SEQ ID NO: 772399 - RNA, 21 nt, Human
cacugcacuccagccugggug

SEQ ID NO: 772400 - RNA, 22 nt, Human
cacugcacuccagccuggguga

SEQ ID NO: 772401 - RNA, 23 nt, Human
cacugcacuccagccugggugac

SEQ ID NO: 772402 - RNA, 24 nt, Human
cacugcacuccagccugggugaca

SEQ ID NO: 772403 - RNA, 24 nt, Human
cacugcacuccagccugggugaca

SEQ ID NO: 772404 - RNA, 22 nt, Human
cacuucgcaaacuaaugacguc

SEQ ID NO: 772405 - RNA, 23 nt, Human
cagaauucuacucagcaauaaaa

SEQ ID NO: 772406 - RNA, 20 nt, Human
cagcacagcaggccuccccu

SEQ ID NO: 772407 - RNA, 20 nt, Human
cagcacaguagcaaucagaa

SEQ ID NO: 772408 - RNA, 18 nt, Human
cagcacccgagaagcgcc

SEQ ID NO: 772409 - RNA, 24 nt, Human
cagcacuuugggaggcugagaugg

SEQ ID NO: 772410 - RNA, 19 nt, Human
cagcaguaggggguuggcc

SEQ ID NO: 772411 - RNA, 21 nt, Human
cagcaguaggggguuggccag

SEQ ID NO: 772412 - RNA, 24 nt, Human
cagcaguaggggguuggccagugg

SEQ ID NO: 772413 - RNA, 23 nt, Human
cagcugccauuugguuuguauag

SEQ ID NO: 772414 - RNA, 20 nt, Human
cagcuuuguaaguggagcca

SEQ ID NO: 772415 - RNA, 20 nt, Human
caggaaacuccccaaacaaa

SEQ ID NO: 772416 - RNA, 19 nt, Human
cagggcucuccaauuccuc

SEQ ID NO: 772417 - RNA, 19 nt, Human
caguaggggguuggccagu

SEQ ID NO: 772418 - RNA, 19 nt, Human
caugcuaauugccagcaca

SEQ ID NO: 772419 - RNA, 23 nt, Human
cauuucuauacaaauucucaaac

SEQ ID NO: 772420 - RNA, 20 nt, Human
ccaaaccauccuucaagcau

SEQ ID NO: 772421 - RNA, 22 nt, Human
ccaaaucugccuaacaaaggca

SEQ ID NO: 772422 - RNA, 20 nt, Human
ccacugcacuccagccuggg

SEQ ID NO: 772423 - RNA, 20 nt, Human
ccacugcacuccagccuggg

SEQ ID NO: 772424 - RNA, 20 nt, Human
ccacugcacuccagccuggg

SEQ ID NO: 772425 - RNA, 21 nt, Human
ccacugcacuccagccugggu

SEQ ID NO: 772426 - RNA, 21 nt, Human
ccacugcacuccagccugggu

SEQ ID NO: 772427 - RNA, 24 nt, Human
ccacugcacuccagccugggugac

SEQ ID NO: 772428 - RNA, 19 nt, Human
ccagcugcugugacuuugg

SEQ ID NO: 772429 - RNA, 23 nt, Human
cccaaacaaaagucagcagaaca

SEQ ID NO: 772430 - RNA, 24 nt, Human
cccaaagaaggauuaauaacuacc

SEQ ID NO: 772431 - RNA, 21 nt, Human
cccacagccacauacugaauu

SEQ ID NO: 772432 - RNA, 23 nt, Human
cccaguggaggugcugggcugcu

SEQ ID NO: 772433 - RNA, 18 nt, Human
cccccucuucagcuccac

SEQ ID NO: 772434 - RNA, 20 nt, Human
cccccucuucagcuccacca

SEQ ID NO: 772435 - RNA, 20 nt, Human
ccccuauaaguccuacguuu

SEQ ID NO: 772436 - RNA, 23 nt, Human
ccccugggacuggggaaggugaa

SEQ ID NO: 772437 - RNA, 22 nt, Human
cccuaagaggucaaucuacaaa

SEQ ID NO: 772438 - RNA, 20 nt, Human
cccuguccagucugggggag

SEQ ID NO: 772439 - RNA, 30 nt, Human
ccuccuguucuccccacccacuucgcaaaa

SEQ ID NO: 772440 - RNA, 24 nt, Human
ccuccuucagaucguacucugcca

SEQ ID NO: 772441 - RNA, 22 nt, Human
ccugaugguucaggagccuggg

SEQ ID NO: 772442 - RNA, 22 nt, Human
ccuggcacccaguuuaguuccu

SEQ ID NO: 772443 - RNA, 20 nt, Human
ccugggugacagagugagac

SEQ ID NO: 772444 - RNA, 20 nt, Human
ccuguccccugggacugggg

SEQ ID NO: 772445 - RNA, 21 nt, Human
ccuguugucccagcuacucgg

SEQ ID NO: 772446 - RNA, 21 nt, Human
ccuuacuucccagcuucucca

SEQ ID NO: 772447 - RNA, 23 nt, Human
ccuuugguagcaguaucuuuucu

SEQ ID NO: 772448 - RNA, 18 nt, Human
cgccccaucccccucuuc

SEQ ID NO: 772449 - RNA, 21 nt, Human
cuaaguaaaaaagccagaccc

SEQ ID NO: 772450 - RNA, 24 nt, Human
cuaguguccugaaaaauauuuccu

SEQ ID NO: 772451 - RNA, 24 nt, Human
cucaaaaaaaaagaaaaaaaaaaa

SEQ ID NO: 772452 - RNA, 18 nt, Human
cucaccuccuuacuuccc

SEQ ID NO: 772453 - RNA, 25 nt, Human
cuccaaaucugccuaacaaaggcag

SEQ ID NO: 772454 - RNA, 20 nt, Human
cuccuguaccccacacugcc

SEQ ID NO: 772455 - RNA, 22 nt, Human
cucuauacacgaagguagcucc

SEQ ID NO: 772456 - RNA, 23 nt, Human
cucuccuaugacaugugaccuaa

SEQ ID NO: 772457 - RNA, 24 nt, Human
cugaauuuauaccaacuuuguuuc

SEQ ID NO: 772458 - RNA, 19 nt, Human
cugcagcaguucuggcucu

SEQ ID NO: 772459 - RNA, 19 nt, Human
cugcauuugcccaggccua

SEQ ID NO: 772460 - RNA, 18 nt, Human
cugcccccuccucacagu

SEQ ID NO: 772461 - RNA, 21 nt, Human
cugccucccaaaccauccuuc

SEQ ID NO: 772462 - RNA, 18 nt, Human
cuggggaaggugaaucuc

SEQ ID NO: 772463 - RNA, 23 nt, Human
cugucccucccccaaagaaggau

SEQ ID NO: 772464 - RNA, 22 nt, Human
cuucagaucguacucugccacu

SEQ ID NO: 772465 - RNA, 20 nt, Human
cuucccgcugugcaccccuc

SEQ ID NO: 772466 - RNA, 22 nt, Human
cuuguagagauuaguguaucca

SEQ ID NO: 772467 - RNA, 24 nt, Human
cuuugcuguugggccuccccucca

SEQ ID NO: 772468 - RNA, 20 nt, Human
gaaaagaucccagaagguca

SEQ ID NO: 772469 - RNA, 24 nt, Human
gaaaaggauucccugccucccaaa

SEQ ID NO: 772470 - RNA, 20 nt, Human
gaaacaacccagcugaaagc

SEQ ID NO: 772471 - RNA, 18 nt, Human
gaaauauccaaacuguga

SEQ ID NO: 772472 - RNA, 21 nt, Human
gaauucugagcuuggacaggc

SEQ ID NO: 772473 - RNA, 24 nt, Human
gacaccaucaccacuucaccaucc

SEQ ID NO: 772474 - RNA, 21 nt, Human
gaugggaggauugcuugagcc

SEQ ID NO: 772475 - RNA, 18 nt, Human
gaugguucaggagccugg

SEQ ID NO: 772476 - RNA, 19 nt, Human
gcaacaaaagaccccagca

SEQ ID NO: 772477 - RNA, 24 nt, Human
gcacuccagccugggugacagagu

SEQ ID NO: 772478 - RNA, 20 nt, Human
gcagaggugcucugucuacc

SEQ ID NO: 772479 - RNA, 21 nt, Human
gcaggugacuaaguggugugc

SEQ ID NO: 772480 - RNA, 25 nt, Human
gccccaucccccucuucagcuccac

SEQ ID NO: 772481 - RNA, 21 nt, Human
gcccccacuacacaccaaauu

SEQ ID NO: 772482 - RNA, 27 nt, Human
gcccccuccucacaguuggguagauuc

SEQ ID NO: 772483 - RNA, 20 nt, Human
gccccuaccucccaacauaa

SEQ ID NO: 772484 - RNA, 19 nt, Human
gcccgccccaucccccucu

SEQ ID NO: 772485 - RNA, 20 nt, Human
ggaaacucgcauguuucccu

SEQ ID NO: 772486 - RNA, 24 nt, Human
ggaaccugggcuaaccagaagccc

SEQ ID NO: 772487 - RNA, 19 nt, Human
ggacaaacaggcaagggcu

SEQ ID NO: 772488 - RNA, 22 nt, Human
ggacccuuauugacgaaggccu

SEQ ID NO: 772489 - RNA, 24 nt, Human
ggcagaaggacaucaaggccccca

SEQ ID NO: 772490 - RNA, 21 nt, Human
gggaggcuaagaugggaggau

SEQ ID NO: 772491 - RNA, 19 nt, Human
gggcagcugagccucaaau

SEQ ID NO: 772492 - RNA, 20 nt, Human
gggguggcucaccacaccca

SEQ ID NO: 772493 - RNA, 24 nt, Human
gguaagaacaggauuaacuguaaa

SEQ ID NO: 772494 - RNA, 18 nt, Human
gucaaucuacaaaacuug

SEQ ID NO: 772495 - RNA, 19 nt, Human
gucaguauguucagugucu

SEQ ID NO: 772496 - RNA, 24 nt, Human
gucauaccacugcacuccagccug

SEQ ID NO: 772497 - RNA, 23 nt, Human
gugaagcacagcacccgagaagc

SEQ ID NO: 772498 - RNA, 18 nt, Human
gugauucccaaaacucaa

SEQ ID NO: 772499 - RNA, 19 nt, Human
gugcaucugucccuuuaca

SEQ ID NO: 772500 - RNA, 20 nt, Human
gugcugggcugcuccgggac

SEQ ID NO: 772501 - RNA, 24 nt, Human
gugucugaagaagacuagaaaugc

SEQ ID NO: 772502 - RNA, 18 nt, Human
guuuuaagaaaaggauuc

SEQ ID NO: 772503 - RNA, 21 nt, Human
uaaaacaaaggaaaaaaaccc

SEQ ID NO: 772504 - RNA, 23 nt, Human
uaaacuaacauugggaccagcca

SEQ ID NO: 772505 - RNA, 18 nt, Human
uaacaaggaaggcaauuu

SEQ ID NO: 772506 - RNA, 21 nt, Human
uaacaguuucaauaccucaau

SEQ ID NO: 772507 - RNA, 23 nt, Human
uaaccaagucuguguaggaaauu

SEQ ID NO: 772508 - RNA, 20 nt, Human
uaagaacaggauuaacugua

SEQ ID NO: 772509 - RNA, 21 nt, Human
uaagacacaacagauucaagg

SEQ ID NO: 772510 - RNA, 24 nt, Human
uaagacacaacagauucaaggaug

SEQ ID NO: 772511 - RNA, 19 nt, Human
uaagacaccaggaagacca

SEQ ID NO: 772512 - RNA, 21 nt, Human
uaagacaccaggaagaccaag

SEQ ID NO: 772513 - RNA, 19 nt, Human
uaaguaaaaaagccagacc

SEQ ID NO: 772514 - RNA, 18 nt, Human
uacacaccaaauuagagu

SEQ ID NO: 772515 - RNA, 22 nt, Human
uaccacugcacuccagccuggg

SEQ ID NO: 772516 - RNA, 23 nt, Human
uaccuguugucccagcuacucgg

SEQ ID NO: 772517 - RNA, 24 nt, Human
uaccuguugucccagcuacucggg

SEQ ID NO: 772518 - RNA, 25 nt, Human
uagcaaacucuaacuagccuguguu

SEQ ID NO: 772519 - RNA, 20 nt, Human
uagcaacaaaagaccccagc

SEQ ID NO: 772520 - RNA, 18 nt, Human
uagcugaaaagaucccag

SEQ ID NO: 772521 - RNA, 20 nt, Human
uaggaagguaagauugggga

SEQ ID NO: 772522 - RNA, 18 nt, Human
uaggggguuggccaguga

SEQ ID NO: 772523 - RNA, 25 nt, Human
uaucacuguucaaaaagucaacgag

SEQ ID NO: 772524 - RNA, 20 nt, Human
ucaaacuucuaguugccaau

SEQ ID NO: 772525 - RNA, 21 nt, Human
ucacauggggaaauguggaca

SEQ ID NO: 772526 - RNA, 23 nt, Human
ucaccucaccuccuuacuuccca

SEQ ID NO: 772527 - RNA, 20 nt, Human
ucagaaagaagccacuauua

SEQ ID NO: 772528 - RNA, 20 nt, Human
ucagagucacaguauuguga

SEQ ID NO: 772529 - RNA, 21 nt, Human
ucagcuccaccauuuugugca

SEQ ID NO: 772530 - RNA, 22 nt, Human
ucagcuuuccauacccuagucc

SEQ ID NO: 772531 - RNA, 23 nt, Human
ucagggcucuccaauuccucauc

SEQ ID NO: 772532 - RNA, 18 nt, Human
ucaguauguucagugucu

SEQ ID NO: 772533 - RNA, 21 nt, Human
ucauaaggagaauuucuucag

SEQ ID NO: 772534 - RNA, 23 nt, Human
ucauaccacugcacuccagccug

SEQ ID NO: 772535 - RNA, 18 nt, Human
uccacaagcuccacuccc

SEQ ID NO: 772536 - RNA, 23 nt, Human
uccagaaagggcaaauuuauaga

SEQ ID NO: 772537 - RNA, 24 nt, Human
uccagaaagggcaaauuuauagag

SEQ ID NO: 772538 - RNA, 23 nt, Human
uccagccugggugacagagugag

SEQ ID NO: 772539 - RNA, 24 nt, Human
uccagccugggugacagagugaga

SEQ ID NO: 772540 - RNA, 30 nt, Human
uccaucaacagaauucuacucagcaauaaa

SEQ ID NO: 772541 - RNA, 21 nt, Human
uccaugcuaaacuggcaggaa

SEQ ID NO: 772542 - RNA, 25 nt, Human
ucccauccaacucaauagauuccac

SEQ ID NO: 772543 - RNA, 25 nt, Human
uccccuauaaguccuacguucggag

SEQ ID NO: 772544 - RNA, 24 nt, Human
uccccugggacuggggaaggugaa

SEQ ID NO: 772545 - RNA, 18 nt, Human
uccccugucccugucacc

SEQ ID NO: 772546 - RNA, 23 nt, Human
ucccugccucccaaaccauccuu

SEQ ID NO: 772547 - RNA, 18 nt, Human
ucccugggagaauggccu

SEQ ID NO: 772548 - RNA, 20 nt, Human
ucccugggagaauggccugg

SEQ ID NO: 772549 - RNA, 21 nt, Human
ucccuggguuggcuuccugcu

SEQ ID NO: 772550 - RNA, 19 nt, Human
uccuggguuccugaugguu

SEQ ID NO: 772551 - RNA, 20 nt, Human
uccuggguuccugaugguuc

SEQ ID NO: 772552 - RNA, 21 nt, Human
ucgaaagagcuauuuaaaaaa

SEQ ID NO: 772553 - RNA, 25 nt, Human
ucggaauucugagcuuggacaggcu

SEQ ID NO: 772554 - RNA, 19 nt, Human
ucggccuuuaguaccaaaa

SEQ ID NO: 772555 - RNA, 20 nt, Human
ucuccaauuccucauccccu

SEQ ID NO: 772556 - RNA, 20 nt, Human
ucuccaggugcucacugucc

SEQ ID NO: 772557 - RNA, 22 nt, Human
ucuccuguccccugggacuggg

SEQ ID NO: 772558 - RNA, 21 nt, Human
ucugcaaucccaacgcauuuc

SEQ ID NO: 772559 - RNA, 22 nt, Human
ucugucccuuuacagauuucuc

SEQ ID NO: 772560 - RNA, 19 nt, Human
ugaagcacagcacccgaga

SEQ ID NO: 772561 - RNA, 23 nt, Human
ugacauccaaaacagaccagcac

SEQ ID NO: 772562 - RNA, 26 nt, Human
ugagaaaagucacugacagccagagg

SEQ ID NO: 772563 - RNA, 20 nt, Human
ugagaugggagaaucacuug

SEQ ID NO: 772564 - RNA, 21 nt, Human
ugagaugggagaaucacuuga

SEQ ID NO: 772565 - RNA, 22 nt, Human
ugagauucucaacagcugccau

SEQ ID NO: 772566 - RNA, 21 nt, Human
ugaguaauaguuacagcuaca

SEQ ID NO: 772567 - RNA, 19 nt, Human
ugcaaagcuggguaugugg

SEQ ID NO: 772568 - RNA, 21 nt, Human
ugcaauuuccuuaacucgaaa

SEQ ID NO: 772569 - RNA, 22 nt, Human
ugcagaggugcucugucuaccg

SEQ ID NO: 772570 - RNA, 21 nt, Human
ugcaggagaccccgggggugg

SEQ ID NO: 772571 - RNA, 22 nt, Human
ugcagggugcaaugagucacau

SEQ ID NO: 772572 - RNA, 18 nt, Human
ugccagcacagcaggccu

SEQ ID NO: 772573 - RNA, 22 nt, Human
ugccaucuacaucucuauacac

SEQ ID NO: 772574 - RNA, 18 nt, Human
ugccuaacaaaggcagca

SEQ ID NO: 772575 - RNA, 18 nt, Human
ugccucccaaaccauccu

SEQ ID NO: 772576 - RNA, 21 nt, Human
ugccucuaaaaaccagacuga

SEQ ID NO: 772577 - RNA, 21 nt, Human
ugccugacaccuuguagagau

SEQ ID NO: 772578 - RNA, 20 nt, Human
uggaugguuucacuuucuug

SEQ ID NO: 772579 - RNA, 18 nt, Human
uggcaaaaagaguuggac

SEQ ID NO: 772580 - RNA, 23 nt, Human
uggcagaucaacccuagugcucu

SEQ ID NO: 772581 - RNA, 21 nt, Human
uggccagugagggcaggugac

SEQ ID NO: 772582 - RNA, 22 nt, Human
uggcuugcugguucuucuucug

SEQ ID NO: 772583 - RNA, 21 nt, Human
ugggaauuaaugugucugucu

SEQ ID NO: 772584 - RNA, 19 nt, Human
ugggaggcugagaugggag

SEQ ID NO: 772585 - RNA, 24 nt, Human
ugggaggcugagaugggagaauca

SEQ ID NO: 772586 - RNA, 20 nt, Human
uggguuccugaugguucagg

SEQ ID NO: 772587 - RNA, 23 nt, Human
uggugcaucugucccuuuacaga

SEQ ID NO: 772588 - RNA, 24 nt, Human
ugguggugcguaccuguuguccca

SEQ ID NO: 772589 - RNA, 19 nt, Human
ugguucaggagccugggcu

SEQ ID NO: 772590 - RNA, 22 nt, Human
ugguuucacuuucuuguccacu

SEQ ID NO: 772591 - RNA, 18 nt, Human
ugucauauuagccuaaaa

SEQ ID NO: 772592 - RNA, 22 nt, Human
ugucauggacaaaccucaaaaa

SEQ ID NO: 772593 - RNA, 24 nt, Human
ugugaaacagggguaaguguccga

SEQ ID NO: 772594 - RNA, 22 nt, Human
uguguugugagugacaauugug

SEQ ID NO: 772595 - RNA, 18 nt, Human
uguugggccuccccucca

SEQ ID NO: 772596 - RNA, 20 nt, Human
uuagcuggccgugguggugc

SEQ ID NO: 772597 - RNA, 20 nt, Human
uuagcuggccgugguggugc

SEQ ID NO: 772598 - RNA, 23 nt, Human
uucacacaacuuuccucucuaac

SEQ ID NO: 772599 - RNA, 22 nt, Human
uuccaaccucugucccacagcc

SEQ ID NO: 772600 - RNA, 19 nt, Human
uuccacaagcuccacuccc

SEQ ID NO: 772601 - RNA, 20 nt, Human
uucgcaaacuaaugacgucc

SEQ ID NO: 772602 - RNA, 21 nt, Human
uugaaagcugagauucccugu

SEQ ID NO: 772603 - RNA, 18 nt, Human
uugacgaaggccugcccc

SEQ ID NO: 772604 - RNA, 26 nt, Human
uuggcagccucuucacacaacuuucc

SEQ ID NO: 772605 - RNA, 25 nt, Human
uugggaggcugagaugggagaauca

SEQ ID NO: 772606 - RNA, 21 nt, Human
uuucuuguccacucagacaca

SEQ ID NO: 772607 - RNA, 23 nt, Human
uuugugcauuacuauccccagau

SEQ ID NO: 772608 - RNA, 25 nt, Human
uuugugcauuacuauccccagauga

SEQ ID NO: 772609 - RNA, 24 nt, Human
uuuuaugaaaauuauuuucuucag

SEQ ID NO: 772610 - RNA, 25 nt, Human
uuuucuuagucagcuuauuuuguuu

SEQ ID NO: 772611 - RNA, 23 nt, Human
uuuuucuuuugaaauaaagaugg

SEQ ID NO: 772612 - RNA, 23 nt, Human
uuuuugucauauuagccuaaaau

SEQ ID NO: 772613 - RNA, 18 nt, Human
aaaaaaaaaaaaucccug

SEQ ID NO: 772614 - RNA, 21 nt, Human
aaaaguaaacaccccaaaucc

SEQ ID NO: 772615 - RNA, 20 nt, Human
aaaaugccacagagcaugga

SEQ ID NO: 772616 - RNA, 28 nt, Human
aaacaaacacaaaauacuugugggagau

SEQ ID NO: 772617 - RNA, 20 nt, Human
aaacaaauaugagaacugga

SEQ ID NO: 772618 - RNA, 21 nt, Human
aaacaccccaaauccuccaaa

SEQ ID NO: 772619 - RNA, 19 nt, Human
aaacaguuuucauuuuggg

SEQ ID NO: 772620 - RNA, 23 nt, Human
aaagaagaaauggaaaccaaagg

SEQ ID NO: 772621 - RNA, 18 nt, Human
aaagugccccccgagggg

SEQ ID NO: 772622 - RNA, 22 nt, Human
aacaacacuugguagcagccuu

SEQ ID NO: 772623 - RNA, 22 nt, Human
aacaccccaaauccuccaaaaa

SEQ ID NO: 772624 - RNA, 24 nt, Human
aacagauucaaggaaugucaaaaa

SEQ ID NO: 772625 - RNA, 23 nt, Human
aagaaaacugggggcaaaacagg

SEQ ID NO: 772626 - RNA, 21 nt, Human
aagaagaaauggaaaccaaag

SEQ ID NO: 772627 - RNA, 22 nt, Human
aagaucuuuccacucaaggcac

SEQ ID NO: 772628 - RNA, 19 nt, Human
aagcagcagguagauaugg

SEQ ID NO: 772629 - RNA, 25 nt, Human
aagccaugaaacaugaauccaaaau

SEQ ID NO: 772630 - RNA, 24 nt, Human
aaggcgcagcgcggggcaugcagg

SEQ ID NO: 772631 - RNA, 23 nt, Human
aaggggggcggggggcagacggc

SEQ ID NO: 772632 - RNA, 19 nt, Human
aagugccccccgaggggcc

SEQ ID NO: 772633 - RNA, 22 nt, Human
acaaacaugugccacgucacca

SEQ ID NO: 772634 - RNA, 18 nt, Human
acaaaugaucuccaccau

SEQ ID NO: 772635 - RNA, 25 nt, Human
acaagccaugaaacaugaauccaaa

SEQ ID NO: 772636 - RNA, 23 nt, Human
acacaacaaagacccucugucau

SEQ ID NO: 772637 - RNA, 25 nt, Human
acagagaagaaaaaaagagaagggg

SEQ ID NO: 772638 - RNA, 21 nt, Human
acagcagaacacacccuccac

SEQ ID NO: 772639 - RNA, 21 nt, Human
acagucacaagccaugaaaca

SEQ ID NO: 772640 - RNA, 26 nt, Human
accacugccauaaaagaauagaaaca

SEQ ID NO: 772641 - RNA, 21 nt, Human
acuaagaucuuuccacucaag

SEQ ID NO: 772642 - RNA, 21 nt, Human
acuacagcacauuuacagccu

SEQ ID NO: 772643 - RNA, 18 nt, Human
acuaggaaaucaaaaggu

SEQ ID NO: 772644 - RNA, 20 nt, Human
acuccaucugacaaaagcca

SEQ ID NO: 772645 - RNA, 21 nt, Human
acugcugacacuggcuacagg

SEQ ID NO: 772646 - RNA, 20 nt, Human
acugugccugcugcugcugc

SEQ ID NO: 772647 - RNA, 19 nt, Human
acuuggccauuccucccag

SEQ ID NO: 772648 - RNA, 21 nt, Human
agaacacacccuccaccucuc

SEQ ID NO: 772649 - RNA, 21 nt, Human
agaacucugauccuuacacuu

SEQ ID NO: 772650 - RNA, 20 nt, Human
agaagaaauggaaaccaaag

SEQ ID NO: 772651 - RNA, 24 nt, Human
agaaggggggcggggggcagacgg

SEQ ID NO: 772652 - RNA, 19 nt, Human
agacaacagaggaacuacu

SEQ ID NO: 772653 - RNA, 19 nt, Human
agacaaccauaaagacuug

SEQ ID NO: 772654 - RNA, 22 nt, Human
agacugcaucacuuggaacuca

SEQ ID NO: 772655 - RNA, 20 nt, Human
agagaaggggggcggggggc

SEQ ID NO: 772656 - RNA, 20 nt, Human
agaggugggcuaugguguga

SEQ ID NO: 772657 - RNA, 20 nt, Human
agaggugggcuauggugugc

SEQ ID NO: 772658 - RNA, 24 nt, Human
agauaagcuggcagcuugacaggc

SEQ ID NO: 772659 - RNA, 24 nt, Human
agcaggaaagccuuucauuaaagu

SEQ ID NO: 772660 - RNA, 22 nt, Human
agcucucuagcaugcugggggg

SEQ ID NO: 772661 - RNA, 24 nt, Human
aggaaagcaaauaaaugaaagacg

SEQ ID NO: 772662 - RNA, 22 nt, Human
aggaauaaggcuuugguuauca

SEQ ID NO: 772663 - RNA, 18 nt, Human
aggaggggcuccaggccu

SEQ ID NO: 772664 - RNA, 18 nt, Human
aggaggguggucacagcu

SEQ ID NO: 772665 - RNA, 22 nt, Human
aggcaucccagcuuucuucccc

SEQ ID NO: 772666 - RNA, 23 nt, Human
aggccaacacuugcacaaacacc

SEQ ID NO: 772667 - RNA, 18 nt, Human
aggucccuuccccgcccu

SEQ ID NO: 772668 - RNA, 22 nt, Human
auaaauaugacauauauacccc

SEQ ID NO: 772669 - RNA, 22 nt, Human
auaugucguauauacauauaua

SEQ ID NO: 772670 - RNA, 23 nt, Human
aucacuuuuaggaucagcuucgu

SEQ ID NO: 772671 - RNA, 22 nt, Human
augaaagacgguggggacacag

SEQ ID NO: 772672 - RNA, 24 nt, Human
augcauaaccacagcagaacacac

SEQ ID NO: 772673 - RNA, 22 nt, Human
augcugccugggcugugugggc

SEQ ID NO: 772674 - RNA, 24 nt, Human
auggaauacuguggaaaauaacug

SEQ ID NO: 772675 - RNA, 23 nt, Human
caaaacacacaaaauagaucccc

SEQ ID NO: 772676 - RNA, 18 nt, Human
caaaaccaaagucugcuc

SEQ ID NO: 772677 - RNA, 22 nt, Human
caaaauagauccccuuuacuaa

SEQ ID NO: 772678 - RNA, 23 nt, Human
caaaaugccacagagcauggacg

SEQ ID NO: 772679 - RNA, 22 nt, Human
caaaaugguccccagaugagcc

SEQ ID NO: 772680 - RNA, 20 nt, Human
caacacuugcacaaacaccu

SEQ ID NO: 772681 - RNA, 18 nt, Human
caacagaggaacuacugg

SEQ ID NO: 772682 - RNA, 20 nt, Human
cacaagccaugaaacaugaa

SEQ ID NO: 772683 - RNA, 19 nt, Human
cacaccccucgagacaacc

SEQ ID NO: 772684 - RNA, 22 nt, Human
caccaccaucucccuguggcug

SEQ ID NO: 772685 - RNA, 22 nt, Human
cacccggcgagcucgcggagcc

SEQ ID NO: 772686 - RNA, 19 nt, Human
caccgcgcgcuccaggagc

SEQ ID NO: 772687 - RNA, 29 nt, Human
cacugccauaaaagaauagaaacagagag

SEQ ID NO: 772688 - RNA, 23 nt, Human
cacugugccugcugcugcugcuc

SEQ ID NO: 772689 - RNA, 24 nt, Human
cagaaaaaaaacaaagaaaacugg

SEQ ID NO: 772690 - RNA, 21 nt, Human
cagaugagccauggugaacca

SEQ ID NO: 772691 - RNA, 25 nt, Human
cagcagagaagcagcagguagauau

SEQ ID NO: 772692 - RNA, 18 nt, Human
cagcaggaagaagacuag

SEQ ID NO: 772693 - RNA, 24 nt, Human
cagcaggucccuuccccgcccccu

SEQ ID NO: 772694 - RNA, 18 nt, Human
caggaaacaaacacaaaa

SEQ ID NO: 772695 - RNA, 25 nt, Human
caggagcgcccaggcggcugcagcu

SEQ ID NO: 772696 - RNA, 19 nt, Human
caguagaaaacuacagcac

SEQ ID NO: 772697 - RNA, 24 nt, Human
cauaaaagaauagaaacagagaag

SEQ ID NO: 772698 - RNA, 24 nt, Human
cauagagggaccuugaggagcugg

SEQ ID NO: 772699 - RNA, 18 nt, Human
cauucacuguacuagggu

SEQ ID NO: 772700 - RNA, 19 nt, Human
ccaaagacggcagcucagg

SEQ ID NO: 772701 - RNA, 22 nt, Human
ccaaagucugcucagagaggug

SEQ ID NO: 772702 - RNA, 20 nt, Human
ccaacacuugcacaaacacc

SEQ ID NO: 772703 - RNA, 19 nt, Human
ccacacugcugucacaugc

SEQ ID NO: 772704 - RNA, 22 nt, Human
ccagaagcacuaacuuacugaa

SEQ ID NO: 772705 - RNA, 20 nt, Human
ccagcaaagagauuuagagc

SEQ ID NO: 772706 - RNA, 18 nt, Human
ccaggcggcugcagcugc

SEQ ID NO: 772707 - RNA, 19 nt, Human
cccaaagacggcagcucag

SEQ ID NO: 772708 - RNA, 21 nt, Human
ccccccgcuacacuuccgcaa

SEQ ID NO: 772709 - RNA, 20 nt, Human
cccccugcgcucggcuccgg

SEQ ID NO: 772710 - RNA, 21 nt, Human
ccccugaacacaaacuugacu

SEQ ID NO: 772711 - RNA, 23 nt, Human
cccugggucuccagaaaaaaaac

SEQ ID NO: 772712 - RNA, 21 nt, Human
ccgcgcgcuccaggagcgccc

SEQ ID NO: 772713 - RNA, 19 nt, Human
ccgcggcugcugccacggc

SEQ ID NO: 772714 - RNA, 23 nt, Human
ccgcgguggccgccgccuccccc

SEQ ID NO: 772715 - RNA, 23 nt, Human
ccucaagaacagcagauagguau

SEQ ID NO: 772716 - RNA, 23 nt, Human
ccucacuccaccacugccauaaa

SEQ ID NO: 772717 - RNA, 23 nt, Human
ccucccaauccccugggccauuu

SEQ ID NO: 772718 - RNA, 22 nt, Human
ccucccauccccugaacacaaa

SEQ ID NO: 772719 - RNA, 20 nt, Human
ccucgagacaaccauaaaga

SEQ ID NO: 772720 - RNA, 21 nt, Human
ccugaaaauggcugccccagc

SEQ ID NO: 772721 - RNA, 22 nt, Human
ccuggaagugaaugaauacuga

SEQ ID NO: 772722 - RNA, 25 nt, Human
ccuuugaaaaaucccaguguacaaa

SEQ ID NO: 772723 - RNA, 20 nt, Human
cgaaagagcaguccucugca

SEQ ID NO: 772724 - RNA, 19 nt, Human
cgcaacggagcugcaugga

SEQ ID NO: 772725 - RNA, 21 nt, Human
cgcgcgcggcucccagagccu

SEQ ID NO: 772726 - RNA, 23 nt, Human
cggcaaucccugaaauaaaccuc

SEQ ID NO: 772727 - RNA, 18 nt, Human
cguauauacauauauaua

SEQ ID NO: 772728 - RNA, 20 nt, Human
cuccaaaauggaauacugug

SEQ ID NO: 772729 - RNA, 18 nt, Human
cuccaagugucccagaag

SEQ ID NO: 772730 - RNA, 22 nt, Human
cuccagaaaaaaaacaaagaaa

SEQ ID NO: 772731 - RNA, 23 nt, Human
cugaaaauagaaucucaucaaag

SEQ ID NO: 772732 - RNA, 19 nt, Human
cugcaaccuuucucugcaa

SEQ ID NO: 772733 - RNA, 18 nt, Human
cugcagcaggucccuucc

SEQ ID NO: 772734 - RNA, 18 nt, Human
cugugugggcuggaggag

SEQ ID NO: 772735 - RNA, 19 nt, Human
cuugcccaccaccaucucc

SEQ ID NO: 772736 - RNA, 20 nt, Human
cuugcccaccaccaucuccc

SEQ ID NO: 772737 - RNA, 18 nt, Human
cuuugcguagacaaugac

SEQ ID NO: 772738 - RNA, 23 nt, Human
cuuuuggccaugaacuccccgcu

SEQ ID NO: 772739 - RNA, 24 nt, Human
gaaaauccagacucucacagagaa

SEQ ID NO: 772740 - RNA, 18 nt, Human
gaaacaaacacaaaauac

SEQ ID NO: 772741 - RNA, 18 nt, Human
gaaccauagagggaccuu

SEQ ID NO: 772742 - RNA, 20 nt, Human
gaagaaaaaaagagaagggg

SEQ ID NO: 772743 - RNA, 25 nt, Human
gaagacaacuccugacaaggccgaa

SEQ ID NO: 772744 - RNA, 20 nt, Human
gaagucccauucuucccagg

SEQ ID NO: 772745 - RNA, 20 nt, Human
gacaacuccagaaaugcagg

SEQ ID NO: 772746 - RNA, 24 nt, Human
gacacaggaaggaucccaaagacg

SEQ ID NO: 772747 - RNA, 18 nt, Human
gacacgguuacuguuuua

SEQ ID NO: 772748 - RNA, 18 nt, Human
gacagucacaagccauga

SEQ ID NO: 772749 - RNA, 22 nt, Human
gaccacacugcugucacaugcc

SEQ ID NO: 772750 - RNA, 21 nt, Human
gagacaaccauaaagacuuga

SEQ ID NO: 772751 - RNA, 19 nt, Human
gagcaguccucugcagacc

SEQ ID NO: 772752 - RNA, 21 nt, Human
gaggcccaggaaagcaaauaa

SEQ ID NO: 772753 - RNA, 20 nt, Human
gagguuaaguuguucaagaa

SEQ ID NO: 772754 - RNA, 19 nt, Human
gcaaggcgcagcgcggggc

SEQ ID NO: 772755 - RNA, 21 nt, Human
gcaugcacugugccugcugcu

SEQ ID NO: 772756 - RNA, 20 nt, Human
gccgcggcugcugccacggc

SEQ ID NO: 772757 - RNA, 18 nt, Human
gccgcgguggccgccgcc

SEQ ID NO: 772758 - RNA, 23 nt, Human
gccucacuccaccacugccauaa

SEQ ID NO: 772759 - RNA, 20 nt, Human
gcgcagcgcggggcaugcag

SEQ ID NO: 772760 - RNA, 22 nt, Human
gcgcgcuccaggagcgcccagg

SEQ ID NO: 772761 - RNA, 23 nt, Human
gcgcggcucccagagccuagugc

SEQ ID NO: 772762 - RNA, 23 nt, Human
gcgcugaacugagcccacccggc

SEQ ID NO: 772763 - RNA, 18 nt, Human
gcggagcugcugggucgc

SEQ ID NO: 772764 - RNA, 22 nt, Human
gcggcucccagagccuagugcu

SEQ ID NO: 772765 - RNA, 24 nt, Human
ggcuauggugugcaggcugcaacc

SEQ ID NO: 772766 - RNA, 18 nt, Human
gguaaaaaaauaaggcca

SEQ ID NO: 772767 - RNA, 21 nt, Human
ggucaucuugaagcauagucu

SEQ ID NO: 772768 - RNA, 24 nt, Human
guagauauggcaugcacugugccu

SEQ ID NO: 772769 - RNA, 23 nt, Human
gugccugcugcugcugcucuugu

SEQ ID NO: 772770 - RNA, 18 nt, Human
guguuuugcucuuguuga

SEQ ID NO: 772771 - RNA, 27 nt, Human
guuaaguuguucaagaauuuaaaaagu

SEQ ID NO: 772772 - RNA, 21 nt, Human
guugauuggcaggugaggaag

SEQ ID NO: 772773 - RNA, 19 nt, Human
uaaaaaaauaaggccaaaa

SEQ ID NO: 772774 - RNA, 18 nt, Human
uaaaaaguaaacacccca

SEQ ID NO: 772775 - RNA, 24 nt, Human
uaaaaaguaaacaccccaaauccu

SEQ ID NO: 772776 - RNA, 19 nt, Human
uaaaguagccacacacccc

SEQ ID NO: 772777 - RNA, 27 nt, Human
uaaaguagccacacaccccucgagacc

SEQ ID NO: 772778 - RNA, 21 nt, Human
uaagaucuuuccacucaaggg

SEQ ID NO: 772779 - RNA, 23 nt, Human
uagaaaacuacagcacauuuaca

SEQ ID NO: 772780 - RNA, 25 nt, Human
uagcaugcugggggggucacgucag

SEQ ID NO: 772781 - RNA, 24 nt, Human
uagccacacaccccucgagacaac

SEQ ID NO: 772782 - RNA, 22 nt, Human
uauuaaacaagacuuccucuga

SEQ ID NO: 772783 - RNA, 24 nt, Human
ucaaagcuuaacauauucacucug

SEQ ID NO: 772784 - RNA, 20 nt, Human
ucaaaguugucaaaauggug

SEQ ID NO: 772785 - RNA, 18 nt, Human
ucacucugaaaacagcgg

SEQ ID NO: 772786 - RNA, 24 nt, Human
ucagaaaaguagaggacacagguu

SEQ ID NO: 772787 - RNA, 18 nt, Human
ucagacucugccacgaag

SEQ ID NO: 772788 - RNA, 19 nt, Human
ucagagaggugggcuaugg

SEQ ID NO: 772789 - RNA, 22 nt, Human
ucauuuugggguuacaaaaaag

SEQ ID NO: 772790 - RNA, 18 nt, Human
uccaagugucccagaagc

SEQ ID NO: 772791 - RNA, 23 nt, Human
uccacagaaacacucaguuucau

SEQ ID NO: 772792 - RNA, 21 nt, Human
ucccagagccuagugcugcag

SEQ ID NO: 772793 - RNA, 25 nt, Human
ucccaggccaacacuugcacaaaca

SEQ ID NO: 772794 - RNA, 23 nt, Human
uccccgcccccugcgcucggcuc

SEQ ID NO: 772795 - RNA, 20 nt, Human
ucccugggucuccagaaaaa

SEQ ID NO: 772796 - RNA, 23 nt, Human
uccgcaacggagcugcauggagc

SEQ ID NO: 772797 - RNA, 25 nt, Human
uccucacauaaaauucugugcugug

SEQ ID NO: 772798 - RNA, 18 nt, Human
uccucuccucugggaaga

SEQ ID NO: 772799 - RNA, 20 nt, Human
ucuacacccaaauucuuacu

SEQ ID NO: 772800 - RNA, 25 nt, Human
ucugagugccagggcagaacaggga

SEQ ID NO: 772801 - RNA, 19 nt, Human
ucuuacucugguggcuuga

SEQ ID NO: 772802 - RNA, 20 nt, Human
ugaaaacagcggagcugcug

SEQ ID NO: 772803 - RNA, 21 nt, Human
ugaaaauagaaucucaucaaa

SEQ ID NO: 772804 - RNA, 22 nt, Human
ugaaaauggcugccccagcuac

SEQ ID NO: 772805 - RNA, 22 nt, Human
ugacaggcugaagaguccucug

SEQ ID NO: 772806 - RNA, 24 nt, Human
ugacaucuacacccaaauucuuac

SEQ ID NO: 772807 - RNA, 18 nt, Human
ugacuucacaaagccuca

SEQ ID NO: 772808 - RNA, 24 nt, Human
ugagaacacaguaagaggagggug

SEQ ID NO: 772809 - RNA, 20 nt, Human
ugaguacuuggccuggcccg

SEQ ID NO: 772810 - RNA, 20 nt, Human
ugaucuccaccaugggccuc

SEQ ID NO: 772811 - RNA, 18 nt, Human
ugcacaaagaugaugggg

SEQ ID NO: 772812 - RNA, 26 nt, Human
ugcacugugccugcugcugcugcucu

SEQ ID NO: 772813 - RNA, 22 nt, Human
ugcagaugaagacaacuccuga

SEQ ID NO: 772814 - RNA, 19 nt, Human
ugcauaaccacagcagaac

SEQ ID NO: 772815 - RNA, 20 nt, Human
ugccagggcagaacagggag

SEQ ID NO: 772816 - RNA, 22 nt, Human
ugccauaaaagaauagaaacag

SEQ ID NO: 772817 - RNA, 21 nt, Human
ugccugggcugugugggcugg

SEQ ID NO: 772818 - RNA, 20 nt, Human
ugcugggggggucacgucag

SEQ ID NO: 772819 - RNA, 18 nt, Human
uggaaccauagagggacc

SEQ ID NO: 772820 - RNA, 22 nt, Human
uggaaggaaaaccagugaccac

SEQ ID NO: 772821 - RNA, 23 nt, Human
uggaaggggaauaaaaaacagau

SEQ ID NO: 772822 - RNA, 22 nt, Human
uggagugggcuuggggacaguc

SEQ ID NO: 772823 - RNA, 23 nt, Human
uggcaauaccucaguagcucagc

SEQ ID NO: 772824 - RNA, 24 nt, Human
ugggcgccgggcgcacggcgaguc

SEQ ID NO: 772825 - RNA, 19 nt, Human
ugggcugggaagagacugc

SEQ ID NO: 772826 - RNA, 18 nt, Human
uggggagagcagaacugc

SEQ ID NO: 772827 - RNA, 19 nt, Human
uggggagagcagaacugcu

SEQ ID NO: 772828 - RNA, 26 nt, Human
uguacaaacaugugccacgucaccac

SEQ ID NO: 772829 - RNA, 21 nt, Human
ugucaaaaugguggcaauacc

SEQ ID NO: 772830 - RNA, 24 nt, Human
ugucccuaauguuuucauacuagu

SEQ ID NO: 772831 - RNA, 20 nt, Human
ugugccugcugcugcugcuc

SEQ ID NO: 772832 - RNA, 21 nt, Human
ugugugggcuggaggaggugg

SEQ ID NO: 772833 - RNA, 26 nt, Human
ugugugggcuggaggagguggggaca

SEQ ID NO: 772834 - RNA, 18 nt, Human
uuaucaucuagcaaaaug

SEQ ID NO: 772835 - RNA, 24 nt, Human
uucaaaacacacaaaauagauccc

SEQ ID NO: 772836 - RNA, 21 nt, Human
uucaaauucuuuuauuaaagu

SEQ ID NO: 772837 - RNA, 21 nt, Human
uuccuacuuuugauuucuuca

SEQ ID NO: 772838 - RNA, 22 nt, Human
uuuauagucuuccucccauccc

SEQ ID NO: 772839 - RNA, 24 nt, Human
uuuggagugggcuuggggacaguc

SEQ ID NO: 772840 - RNA, 21 nt, Human
uuuuccacaaacuucucucca

SEQ ID NO: 772841 - RNA, 19 nt, Human
uuuugcucuuguugaguug

SEQ ID NO: 772842 - RNA, 19 nt, Human
aaagugcugggguuacagg

SEQ ID NO: 772843 - RNA, 24 nt, Human
aaagugcugggguuacaggcguga

SEQ ID NO: 772844 - RNA, 21 nt, Human
aaccuaccaggaagaccaggg

SEQ ID NO: 772845 - RNA, 19 nt, Human
aagacagggaccggaacug

SEQ ID NO: 772846 - RNA, 20 nt, Human
aagcagcugggacuacaggu

SEQ ID NO: 772847 - RNA, 26 nt, Human
aagcagcugggacuacaggugcaugc

SEQ ID NO: 772848 - RNA, 25 nt, Human
aagugauucuccugccucagccucc

SEQ ID NO: 772849 - RNA, 19 nt, Human
aagugcugggguuacaggc

SEQ ID NO: 772850 - RNA, 26 nt, Human
aagugcugggguuacaggcgugagcc

SEQ ID NO: 772851 - RNA, 21 nt, Human
acaaaaccuaccaggaagacc

SEQ ID NO: 772852 - RNA, 18 nt, Human
acacaguagcaaaauaug

SEQ ID NO: 772853 - RNA, 18 nt, Human
accagccugugucugcag

SEQ ID NO: 772854 - RNA, 19 nt, Human
accagccugugucugcagc

SEQ ID NO: 772855 - RNA, 22 nt, Human
accuccaccucucggguucaag

SEQ ID NO: 772856 - RNA, 19 nt, Human
acuacaggugcaugccagu

SEQ ID NO: 772857 - RNA, 19 nt, Human
acuacccacagacacugau

SEQ ID NO: 772858 - RNA, 25 nt, Human
acucugucgccaggcuggagugcaa

SEQ ID NO: 772859 - RNA, 21 nt, Human
agaccccuacccuccggucaa

SEQ ID NO: 772860 - RNA, 24 nt, Human
agagggaaggaaggcugagaaugg

SEQ ID NO: 772861 - RNA, 21 nt, Human
agccugugucugcagcccugg

SEQ ID NO: 772862 - RNA, 18 nt, Human
aggagcccuugcagcacc

SEQ ID NO: 772863 - RNA, 24 nt, Human
aggcccagaagacgccgacgcuca

SEQ ID NO: 772864 - RNA, 24 nt, Human
agugcaauggcacgaucuuggcuc

SEQ ID NO: 772865 - RNA, 19 nt, Human
auccacacaguagcaaaau

SEQ ID NO: 772866 - RNA, 18 nt, Human
augggguuucaccauguu

SEQ ID NO: 772867 - RNA, 22 nt, Human
augggguuucaccauguuggcc

SEQ ID NO: 772868 - RNA, 23 nt, Human
augggguuucaccauguuggcca

SEQ ID NO: 772869 - RNA, 24 nt, Human
augggguuucaccauguuggccag

SEQ ID NO: 772870 - RNA, 18 nt, Human
auucuccugccucagccu

SEQ ID NO: 772871 - RNA, 24 nt, Human
caaagugcugggguuacaggcgug

SEQ ID NO: 772872 - RNA, 21 nt, Human
caaccuccaccucucggguuc

SEQ ID NO: 772873 - RNA, 18 nt, Human
caagaaacuccacaggcc

SEQ ID NO: 772874 - RNA, 24 nt, Human
caagucaaaauaagacacaggcag

SEQ ID NO: 772875 - RNA, 22 nt, Human
caagugauucuccugccucagc

SEQ ID NO: 772876 - RNA, 23 nt, Human
caauaaaaauaaauggauccaca

SEQ ID NO: 772877 - RNA, 18 nt, Human
caccauguuggccaggau

SEQ ID NO: 772878 - RNA, 22 nt, Human
caccauguuggccaggaugguc

SEQ ID NO: 772879 - RNA, 24 nt, Human
caccauguuggccaggauggucuc

SEQ ID NO: 772880 - RNA, 23 nt, Human
cacucugucgccaggcuggagug

SEQ ID NO: 772881 - RNA, 21 nt, Human
cacugggggauggaagaacuc

SEQ ID NO: 772882 - RNA, 20 nt, Human
cagaagacgccgacgcucac

SEQ ID NO: 772883 - RNA, 23 nt, Human
cagccucccaagcagcugggacu

SEQ ID NO: 772884 - RNA, 21 nt, Human
cagcugggacuacaggugcau

SEQ ID NO: 772885 - RNA, 22 nt, Human
caggagcccuugcagcaccagc

SEQ ID NO: 772886 - RNA, 22 nt, Human
caggauggucuccaucucuuga

SEQ ID NO: 772887 - RNA, 18 nt, Human
caggcccagaagacgccg

SEQ ID NO: 772888 - RNA, 19 nt, Human
caggcccagaagacgccga

SEQ ID NO: 772889 - RNA, 24 nt, Human
caugccaguacgcccagcuaauuu

SEQ ID NO: 772890 - RNA, 22 nt, Human
ccaaagugcugggguuacaggc

SEQ ID NO: 772891 - RNA, 22 nt, Human
ccaaagugcugggguuacaggc

SEQ ID NO: 772892 - RNA, 24 nt, Human
ccaaagugcugggguuacaggcgu

SEQ ID NO: 772893 - RNA, 23 nt, Human
ccaagaaacuccacaggcccaga

SEQ ID NO: 772894 - RNA, 23 nt, Human
ccacaauaaaaauaaauggaucc

SEQ ID NO: 772895 - RNA, 21 nt, Human
ccacaucaucucauuuuucaa

SEQ ID NO: 772896 - RNA, 22 nt, Human
cccaagcagcugggacuacagg

SEQ ID NO: 772897 - RNA, 21 nt, Human
ccccucaaaauggcagugcaa

SEQ ID NO: 772898 - RNA, 21 nt, Human
cccgcggccccuguccaagaa

SEQ ID NO: 772899 - RNA, 19 nt, Human
cccuggguccugagguacc

SEQ ID NO: 772900 - RNA, 22 nt, Human
cccuguccaagaaacuccacag

SEQ ID NO: 772901 - RNA, 24 nt, Human
ccucucggguucaagugauucucc

SEQ ID NO: 772902 - RNA, 22 nt, Human
ccugagguaccacugggggaug

SEQ ID NO: 772903 - RNA, 19 nt, Human
ccuggagccccgcggcccc

SEQ ID NO: 772904 - RNA, 22 nt, Human
cgaagcggacgcucacagaaac

SEQ ID NO: 772905 - RNA, 19 nt, Human
cggguucaagugauucucc

SEQ ID NO: 772906 - RNA, 21 nt, Human
cggguucaagugauucuccug

SEQ ID NO: 772907 - RNA, 18 nt, Human
cucacucugucgccaggc

SEQ ID NO: 772908 - RNA, 23 nt, Human
cucacucugucgccaggcuggag

SEQ ID NO: 772909 - RNA, 19 nt, Human
cuccaaggagagccccagc

SEQ ID NO: 772910 - RNA, 20 nt, Human
cucucggguucaagugauuc

SEQ ID NO: 772911 - RNA, 24 nt, Human
cucuugaccucgugacccgcccgc

SEQ ID NO: 772912 - RNA, 23 nt, Human
cugccucagccucccaagcagcu

SEQ ID NO: 772913 - RNA, 20 nt, Human
cugugucugcagcccugggu

SEQ ID NO: 772914 - RNA, 24 nt, Human
gacagagucucacucugucgccag

SEQ ID NO: 772915 - RNA, 22 nt, Human
gaccucgugacccgcccgccuc

SEQ ID NO: 772916 - RNA, 22 nt, Human
gacgaagcggacgcucacagaa

SEQ ID NO: 772917 - RNA, 21 nt, Human
gauucuccugccucagccucc

SEQ ID NO: 772918 - RNA, 19 nt, Human
gcagcugggacuacaggug

SEQ ID NO: 772919 - RNA, 23 nt, Human
gccaggauggucuccaucucuug

SEQ ID NO: 772920 - RNA, 24 nt, Human
gcccagcuaauuuuuuuguauuuu

SEQ ID NO: 772921 - RNA, 23 nt, Human
gccucggccucccaaagugcugg

SEQ ID NO: 772922 - RNA, 19 nt, Human
gcuggagugcaauggcacg

SEQ ID NO: 772923 - RNA, 24 nt, Human
ggaaacguaaaagacagggaccgg

SEQ ID NO: 772924 - RNA, 19 nt, Human
ggacagaccccuacccucc

SEQ ID NO: 772925 - RNA, 19 nt, Human
ggaccggaacugaauggga

SEQ ID NO: 772926 - RNA, 18 nt, Human
gggggauggaagaacucc

SEQ ID NO: 772927 - RNA, 22 nt, Human
gggguuucaccauguuggccag

SEQ ID NO: 772928 - RNA, 22 nt, Human
ggguucaagugauucuccugcc

SEQ ID NO: 772929 - RNA, 22 nt, Human
ggguuucaccauguuggccagg

SEQ ID NO: 772930 - RNA, 18 nt, Human
gguuacaggcgugagcca

SEQ ID NO: 772931 - RNA, 22 nt, Human
gguuacaggcgugagccacugc

SEQ ID NO: 772932 - RNA, 19 nt, Human
gguucaagugauucuccug

SEQ ID NO: 772933 - RNA, 24 nt, Human
guacaaaaccuaccaggaagacca

SEQ ID NO: 772934 - RNA, 24 nt, Human
gugacccgcccgccucggccuccc

SEQ ID NO: 772935 - RNA, 24 nt, Human
gugauucuccugccucagccuccc

SEQ ID NO: 772936 - RNA, 23 nt, Human
uaaaagacagggaccggaacuga

SEQ ID NO: 772937 - RNA, 24 nt, Human
uaaauggauccacacaguagcaaa

SEQ ID NO: 772938 - RNA, 22 nt, Human
uaagacacaggcagccaguucg

SEQ ID NO: 772939 - RNA, 20 nt, Human
uacacuccacaauaaaaaua

SEQ ID NO: 772940 - RNA, 22 nt, Human
uacaggcgugagccacugcgcc

SEQ ID NO: 772941 - RNA, 22 nt, Human
uacaggcgugagccacugcgcc

SEQ ID NO: 772942 - RNA, 23 nt, Human
uacaggcgugagccacugcgccu

SEQ ID NO: 772943 - RNA, 26 nt, Human
uaccaggaagaccagggacagacccc

SEQ ID NO: 772944 - RNA, 23 nt, Human
uagcaaaauauguguacaaaacc

SEQ ID NO: 772945 - RNA, 24 nt, Human
uaguagacaugggguuucaccaug

SEQ ID NO: 772946 - RNA, 22 nt, Human
ucaaaauaagacacaggcagcc

SEQ ID NO: 772947 - RNA, 19 nt, Human
ucaagugauucuccugccu

SEQ ID NO: 772948 - RNA, 24 nt, Human
ucaccauguuggccaggauggucu

SEQ ID NO: 772949 - RNA, 23 nt, Human
ucacuucaaccuccaccucucgg

SEQ ID NO: 772950 - RNA, 24 nt, Human
ucacuucaaccuccaccucucggg

SEQ ID NO: 772951 - RNA, 20 nt, Human
ucagccucccaagcagcugg

SEQ ID NO: 772952 - RNA, 21 nt, Human
uccacaggcccagaagacgcc

SEQ ID NO: 772953 - RNA, 23 nt, Human
uccacaggcccagaagacgccga

SEQ ID NO: 772954 - RNA, 24 nt, Human
ucccaaagugcugggguuacaggc

SEQ ID NO: 772955 - RNA, 23 nt, Human
ucccaagcagcugggacuacagg

SEQ ID NO: 772956 - RNA, 18 nt, Human
ucggccucccaaagugcu

SEQ ID NO: 772957 - RNA, 23 nt, Human
ucggccucccaaagugcuggggu

SEQ ID NO: 772958 - RNA, 21 nt, Human
ucucacucugucgccaggcug

SEQ ID NO: 772959 - RNA, 23 nt, Human
ucucacucugucgccaggcugga

SEQ ID NO: 772960 - RNA, 23 nt, Human
ucuccugccucagccucccaagc

SEQ ID NO: 772961 - RNA, 21 nt, Human
ucucggguucaagugauucuc

SEQ ID NO: 772962 - RNA, 24 nt, Human
ucucggguucaagugauucuccug

SEQ ID NO: 772963 - RNA, 21 nt, Human
ucugucgccaggcuggagugc

SEQ ID NO: 772964 - RNA, 23 nt, Human
ucugucgccaggcuggagugcaa

SEQ ID NO: 772965 - RNA, 21 nt, Human
ugaagauuccaacuacccaca

SEQ ID NO: 772966 - RNA, 24 nt, Human
ugccucagccucccaagcagcugg

SEQ ID NO: 772967 - RNA, 20 nt, Human
uggaagaacuccaaggagag

SEQ ID NO: 772968 - RNA, 23 nt, Human
uggagugcaauggcacgaucuug

SEQ ID NO: 772969 - RNA, 24 nt, Human
uggagugcaauggcacgaucuugg

SEQ ID NO: 772970 - RNA, 22 nt, Human
uggccacaucaucucauuuuuc

SEQ ID NO: 772971 - RNA, 24 nt, Human
uggccaggauggucuccaucucuu

SEQ ID NO: 772972 - RNA, 22 nt, Human
ugggacagagucucacucuguc

SEQ ID NO: 772973 - RNA, 21 nt, Human
ugggacuacaggugcaugcca

SEQ ID NO: 772974 - RNA, 18 nt, Human
ugggguuacaggcgugag

SEQ ID NO: 772975 - RNA, 19 nt, Human
ugggguuacaggcgugagc

SEQ ID NO: 772976 - RNA, 22 nt, Human
ugggguuacaggcgugagccac

SEQ ID NO: 772977 - RNA, 22 nt, Human
ugggguuacaggcgugagccac

SEQ ID NO: 772978 - RNA, 24 nt, Human
ugggguuacaggcgugagccacug

SEQ ID NO: 772979 - RNA, 24 nt, Human
ugggguuucaccauguuggccagg

SEQ ID NO: 772980 - RNA, 23 nt, Human
uggguccugagguaccacugggg

SEQ ID NO: 772981 - RNA, 21 nt, Human
uggucuccaucucuugaccuc

SEQ ID NO: 772982 - RNA, 21 nt, Human
uguauuuuuaguagacauggg

SEQ ID NO: 772983 - RNA, 23 nt, Human
uguguacaaaaccuaccaggaag

SEQ ID NO: 772984 - RNA, 20 nt, Human
ugugucugcagcccuggguc

SEQ ID NO: 772985 - RNA, 20 nt, Human
uuacaggcgugagccacugc

SEQ ID NO: 772986 - RNA, 18 nt, Human
uuaguagacaugggguuu

SEQ ID NO: 772987 - RNA, 22 nt, Human
uuaguagacaugggguuucacc

SEQ ID NO: 772988 - RNA, 24 nt, Human
uuaguagacaugggguuucaccau

SEQ ID NO: 772989 - RNA, 21 nt, Human
uucaagugauucuccugccuc

SEQ ID NO: 772990 - RNA, 23 nt, Human
uucaagugauucuccugccucag

SEQ ID NO: 772991 - RNA, 24 nt, Human
uucaagugauucuccugccucagc

SEQ ID NO: 772992 - RNA, 21 nt, Human
uuguauacacuccacaauaaa

SEQ ID NO: 772993 - RNA, 23 nt, Human
uuguauuuuuaguagacaugggg

SEQ ID NO: 772994 - RNA, 19 nt, Human
uuucaccauguuggccagg

SEQ ID NO: 772995 - RNA, 20 nt, Human
uuucaccauguuggccagga

SEQ ID NO: 772996 - RNA, 24 nt, Human
uuuuuaguagacaugggguuucac

SEQ ID NO: 772997 - RNA, 22 nt, Human
uuuuuuguauuuuuaguagaca

SEQ ID NO: 772998 - RNA, 28 nt, Human
uuuuuuuuuuuugugggacagagucuca

SEQ ID NO: 772999 - RNA, 19 nt, Human
uuuuuuuuuuuuuuuuugu

SEQ ID NO: 773000 - RNA, 22 nt, Human
uuuuuuuuuuuuuuuuuguggg

SEQ ID NO: 773001 - RNA, 19 nt, Human
aaaaaauacaaaaagccag

SEQ ID NO: 773002 - RNA, 19 nt, Human
aaaaagccaggcauaguga

SEQ ID NO: 773003 - RNA, 24 nt, Human
aaaaugcagccagucucuuugcua

SEQ ID NO: 773004 - RNA, 22 nt, Human
aaacaaggcaagucccuuccac

SEQ ID NO: 773005 - RNA, 19 nt, Human
aaacacacguucuaagugu

SEQ ID NO: 773006 - RNA, 24 nt, Human
aacacuuugggaggccaagguggg

SEQ ID NO: 773007 - RNA, 21 nt, Human
aacagcggugccacaagcgag

SEQ ID NO: 773008 - RNA, 19 nt, Human
aacaugguaaaccccaucu

SEQ ID NO: 773009 - RNA, 20 nt, Human
aacaugguaaaccccaucuc

SEQ ID NO: 773010 - RNA, 18 nt, Human
aaccucugccuguuaccc

SEQ ID NO: 773011 - RNA, 20 nt, Human
aaccucugccuguuacccag

SEQ ID NO: 773012 - RNA, 24 nt, Human
aaccugggugacagagcaagacuc

SEQ ID NO: 773013 - RNA, 21 nt, Human
aagaaaaagagguuuaaugaa

SEQ ID NO: 773014 - RNA, 20 nt, Human
aagaccuuccccugucuggg

SEQ ID NO: 773015 - RNA, 24 nt, Human
aagcaaaaggggaaaccccuuauu

SEQ ID NO: 773016 - RNA, 24 nt, Human
aagcaaaaggggaaaccucuuaua

SEQ ID NO: 773017 - RNA, 19 nt, Human
aagcgaggcccgcagggcg

SEQ ID NO: 773018 - RNA, 24 nt, Human
aauagacgucgcgcuccugcuugc

SEQ ID NO: 773019 - RNA, 22 nt, Human
aaucaucucccucgaguucaaa

SEQ ID NO: 773020 - RNA, 21 nt, Human
acacagagucgcgauccacca

SEQ ID NO: 773021 - RNA, 23 nt, Human
acagagcaagacuccaucuaagg

SEQ ID NO: 773022 - RNA, 25 nt, Human
accccaucucuacuaaaaaauacaa

SEQ ID NO: 773023 - RNA, 21 nt, Human
accgccugggaggaggcuggc

SEQ ID NO: 773024 - RNA, 23 nt, Human
accugggugacagagcaagacuc

SEQ ID NO: 773025 - RNA, 20 nt, Human
acgaaguggcuaaaggcccc

SEQ ID NO: 773026 - RNA, 22 nt, Human
acuaaaaaauacaaaaagccag

SEQ ID NO: 773027 - RNA, 18 nt, Human
acugcacuccaaccuggg

SEQ ID NO: 773028 - RNA, 24 nt, Human
acugcacuccaaccugggugacag

SEQ ID NO: 773029 - RNA, 22 nt, Human
acugcauggccggcauaaaggc

SEQ ID NO: 773030 - RNA, 29 nt, Human
agaagcacagaccaccagaguaagaacag

SEQ ID NO: 773031 - RNA, 23 nt, Human
agacaagagagaaugagagccaa

SEQ ID NO: 773032 - RNA, 25 nt, Human
agacaagagagaaugagaggggacc

SEQ ID NO: 773033 - RNA, 20 nt, Human
agaggugggagguuccuggg

SEQ ID NO: 773034 - RNA, 20 nt, Human
agcagcugguuccagcacau

SEQ ID NO: 773035 - RNA, 26 nt, Human
agccaaacaccuccccagcuggacug

SEQ ID NO: 773036 - RNA, 23 nt, Human
agccaggcauagugaugcaugcc

SEQ ID NO: 773037 - RNA, 25 nt, Human
agcccagcaugcugacggugagcac

SEQ ID NO: 773038 - RNA, 20 nt, Human
agccuggauuucaugucccg

SEQ ID NO: 773039 - RNA, 23 nt, Human
agccuggccaacaugguaaaccc

SEQ ID NO: 773040 - RNA, 21 nt, Human
agccuguaaaaucaaaggcua

SEQ ID NO: 773041 - RNA, 23 nt, Human
aggaagucccaaacuuucccaca

SEQ ID NO: 773042 - RNA, 18 nt, Human
aggagggguugcagugag

SEQ ID NO: 773043 - RNA, 23 nt, Human
aggcaagagagaaugagaacuaa

SEQ ID NO: 773044 - RNA, 26 nt, Human
aggcaagagagaaugagaagggaccc

SEQ ID NO: 773045 - RNA, 24 nt, Human
aggcauagugaugcaugccuguaa

SEQ ID NO: 773046 - RNA, 21 nt, Human
aggccaaggugggugcaucac

SEQ ID NO: 773047 - RNA, 21 nt, Human
aggcggccacuuccagccagc

SEQ ID NO: 773048 - RNA, 22 nt, Human
agggguugcagugagcugauug

SEQ ID NO: 773049 - RNA, 18 nt, Human
agugagcgcaaccccagg

SEQ ID NO: 773050 - RNA, 24 nt, Human
agugaugcaugccuguaaucucag

SEQ ID NO: 773051 - RNA, 21 nt, Human
agugcaguguuaggagucucu

SEQ ID NO: 773052 - RNA, 23 nt, Human
agugcccccucccuaggccccac

SEQ ID NO: 773053 - RNA, 21 nt, Human
aucaaucaugccuucccaaca

SEQ ID NO: 773054 - RNA, 21 nt, Human
aucacuaggucaggaguuuga

SEQ ID NO: 773055 - RNA, 23 nt, Human
aucacucccuucuaggccacacc

SEQ ID NO: 773056 - RNA, 22 nt, Human
aucccaacacuuugggaggcca

SEQ ID NO: 773057 - RNA, 23 nt, Human
augaguuuuagguggggacacag

SEQ ID NO: 773058 - RNA, 19 nt, Human
augccuguaaucccaacac

SEQ ID NO: 773059 - RNA, 21 nt, Human
auuggugugagugugggggug

SEQ ID NO: 773060 - RNA, 24 nt, Human
auugugccacugcacuccaaccug

SEQ ID NO: 773061 - RNA, 22 nt, Human
caaaacgaaguggcuaaaggcc

SEQ ID NO: 773062 - RNA, 23 nt, Human
caaaaguccauacuccaaagucu

SEQ ID NO: 773063 - RNA, 24 nt, Human
caaaaguccauacuccaaagucuc

SEQ ID NO: 773064 - RNA, 18 nt, Human
caaaguuccacaaaucuc

SEQ ID NO: 773065 - RNA, 23 nt, Human
caaauggguuagugcaguguuag

SEQ ID NO: 773066 - RNA, 21 nt, Human
caacacuuugggaggccaagg

SEQ ID NO: 773067 - RNA, 24 nt, Human
caacacuuugggaggccaaggugg

SEQ ID NO: 773068 - RNA, 19 nt, Human
caacaugguaaaccccauc

SEQ ID NO: 773069 - RNA, 24 nt, Human
caaggugggugcaucacuagguca

SEQ ID NO: 773070 - RNA, 24 nt, Human
caagucccuuccaccuaugagccu

SEQ ID NO: 773071 - RNA, 22 nt, Human
cacaacacauggcaauuauggg

SEQ ID NO: 773072 - RNA, 26 nt, Human
cacacagagucgcgauccaccaggcg

SEQ ID NO: 773073 - RNA, 21 nt, Human
cacaccccaggcacaugugca

SEQ ID NO: 773074 - RNA, 23 nt, Human
cacagaccaccagaguaagaaca

SEQ ID NO: 773075 - RNA, 23 nt, Human
cacagccaaaccauaucauucuc

SEQ ID NO: 773076 - RNA, 25 nt, Human
cacaguucaggugagugcuggggac

SEQ ID NO: 773077 - RNA, 25 nt, Human
cacaguuccauguggcugggaggcc

SEQ ID NO: 773078 - RNA, 19 nt, Human
caccagaacaguauggcgg

SEQ ID NO: 773079 - RNA, 18 nt, Human
caccauaucggguaggau

SEQ ID NO: 773080 - RNA, 23 nt, Human
cacuccaaccugggugacagagc

SEQ ID NO: 773081 - RNA, 23 nt, Human
cacugcacuccaaccugggugac

SEQ ID NO: 773082 - RNA, 24 nt, Human
cacugcacuccaaccugggugaca

SEQ ID NO: 773083 - RNA, 24 nt, Human
cagacucagcugcaaagucagaaa

SEQ ID NO: 773084 - RNA, 23 nt, Human
cagcacccaagucaccucaugaa

SEQ ID NO: 773085 - RNA, 19 nt, Human
cagcagggcaguuaaaucu

SEQ ID NO: 773086 - RNA, 20 nt, Human
cagcagggcaguuaaaucuu

SEQ ID NO: 773087 - RNA, 22 nt, Human
cagcagggcaguuaaaucuuaa

SEQ ID NO: 773088 - RNA, 18 nt, Human
cagcggugccacaagcga

SEQ ID NO: 773089 - RNA, 20 nt, Human
caggaagagagcugaccuuu

SEQ ID NO: 773090 - RNA, 19 nt, Human
caucacuaggucaggaguu

SEQ ID NO: 773091 - RNA, 24 nt, Human
caucacuaggucaggaguuugaga

SEQ ID NO: 773092 - RNA, 21 nt, Human
caucaggcugcaaauuuucca

SEQ ID NO: 773093 - RNA, 20 nt, Human
caugccacuuuucuccagac

SEQ ID NO: 773094 - RNA, 20 nt, Human
caugccuguaaucccaacac

SEQ ID NO: 773095 - RNA, 20 nt, Human
cauggucuugggcagcucca

SEQ ID NO: 773096 - RNA, 20 nt, Human
ccaaaccauaucauucucuu

SEQ ID NO: 773097 - RNA, 20 nt, Human
ccacacagagucgcgaucca

SEQ ID NO: 773098 - RNA, 20 nt, Human
ccacugcacuccaaccuggg

SEQ ID NO: 773099 - RNA, 24 nt, Human
ccacugcacuccaaccugggugac

SEQ ID NO: 773100 - RNA, 21 nt, Human
ccaggcauagugaugcaugcc

SEQ ID NO: 773101 - RNA, 21 nt, Human
ccaguccuccuguucccuggg

SEQ ID NO: 773102 - RNA, 25 nt, Human
cccaauaaggaacugcgagguaccc

SEQ ID NO: 773103 - RNA, 18 nt, Human
cccagggcugagcccaug

SEQ ID NO: 773104 - RNA, 24 nt, Human
cccauggucuugggcagcuccacc

SEQ ID NO: 773105 - RNA, 20 nt, Human
ccccaaagucuuaacucauu

SEQ ID NO: 773106 - RNA, 23 nt, Human
ccccagcuggacugggaccaaau

SEQ ID NO: 773107 - RNA, 20 nt, Human
cccgccagcucaagcaacag

SEQ ID NO: 773108 - RNA, 21 nt, Human
cccgccagcucaagcaacagc

SEQ ID NO: 773109 - RNA, 20 nt, Human
cccuaggccccaccuucagc

SEQ ID NO: 773110 - RNA, 21 nt, Human
cccucgaguucaaaguuccac

SEQ ID NO: 773111 - RNA, 19 nt, Human
cccugcaagucuguuccca

SEQ ID NO: 773112 - RNA, 19 nt, Human
ccgccagcucaagcaacag

SEQ ID NO: 773113 - RNA, 19 nt, Human
ccuacgcgcaccuccgcca

SEQ ID NO: 773114 - RNA, 19 nt, Human
ccuaggccccaccuucagc

SEQ ID NO: 773115 - RNA, 20 nt, Human
ccucccacaauuaugggagc

SEQ ID NO: 773116 - RNA, 19 nt, Human
ccugcauggcccugcaagu

SEQ ID NO: 773117 - RNA, 23 nt, Human
ccuggccaacaugguaaacccca

SEQ ID NO: 773118 - RNA, 20 nt, Human
ccuguaaucccaacacuuug

SEQ ID NO: 773119 - RNA, 22 nt, Human
ccuguaaucccaacacuuuggg

SEQ ID NO: 773120 - RNA, 19 nt, Human
ccuguaaucucagcuacuc

SEQ ID NO: 773121 - RNA, 19 nt, Human
ccuguucccugggagggga

SEQ ID NO: 773122 - RNA, 21 nt, Human
ccuucagcagcugguuccagc

SEQ ID NO: 773123 - RNA, 20 nt, Human
ccuucuaggccacaccccag

SEQ ID NO: 773124 - RNA, 19 nt, Human
cgaaaagcucacccuugua

SEQ ID NO: 773125 - RNA, 23 nt, Human
cuaaaggccccaugcaagucuga

SEQ ID NO: 773126 - RNA, 19 nt, Human
cuacuaaaaaauacaaaaa

SEQ ID NO: 773127 - RNA, 23 nt, Human
cuacuaaaaaauacaaaaagcca

SEQ ID NO: 773128 - RNA, 21 nt, Human
cucacacacacacacgcacac

SEQ ID NO: 773129 - RNA, 24 nt, Human
cucaugccuguaaucccaacacuu

SEQ ID NO: 773130 - RNA, 28 nt, Human
cuccagcaccggggccacaagguacccc

SEQ ID NO: 773131 - RNA, 21 nt, Human
cuccaugcccccuuccuccag

SEQ ID NO: 773132 - RNA, 25 nt, Human
cucccuaggccccaccuucagcagc

SEQ ID NO: 773133 - RNA, 21 nt, Human
cuccggcugagguugcucuuc

SEQ ID NO: 773134 - RNA, 19 nt, Human
cuccugcuugccuggcucc

SEQ ID NO: 773135 - RNA, 22 nt, Human
cucuacuaaaaaauacaaaaag

SEQ ID NO: 773136 - RNA, 22 nt, Human
cucuggcuuccaccccagggaa

SEQ ID NO: 773137 - RNA, 22 nt, Human
cucugugcuaagcccaguccuc

SEQ ID NO: 773138 - RNA, 21 nt, Human
cugcaaagucagaaaaaacuc

SEQ ID NO: 773139 - RNA, 19 nt, Human
cugcagggggcuugaauuu

SEQ ID NO: 773140 - RNA, 18 nt, Human
cuguaaaaucaaaggcua

SEQ ID NO: 773141 - RNA, 19 nt, Human
cugucucgucgccgggcgc

SEQ ID NO: 773142 - RNA, 18 nt, Human
cuguuccaaccucugccu

SEQ ID NO: 773143 - RNA, 20 nt, Human
cuuagaaagagaaaauggcu

SEQ ID NO: 773144 - RNA, 18 nt, Human
gaacaguauggcggaaac

SEQ ID NO: 773145 - RNA, 22 nt, Human
gaacaugaugauggcucugugc

SEQ ID NO: 773146 - RNA, 20 nt, Human
gaacugcauggccggcauaa

SEQ ID NO: 773147 - RNA, 18 nt, Human
gaagagaaaauggcugag

SEQ ID NO: 773148 - RNA, 24 nt, Human
gaccuuccccugucuguuuauugg

SEQ ID NO: 773149 - RNA, 20 nt, Human
gagggggagguuucucuuug

SEQ ID NO: 773150 - RNA, 25 nt, Human
gcaaccccaggucguagccccacac

SEQ ID NO: 773151 - RNA, 19 nt, Human
gcagacaagagagaaugag

SEQ ID NO: 773152 - RNA, 18 nt, Human
gcagauuggugugagugu

SEQ ID NO: 773153 - RNA, 21 nt, Human
gcaggagguggguucccaugg

SEQ ID NO: 773154 - RNA, 23 nt, Human
gcaucacuaggucaggaguuuga

SEQ ID NO: 773155 - RNA, 23 nt, Human
gccaacaugguaaaccccaucuc

SEQ ID NO: 773156 - RNA, 24 nt, Human
gccaagcaaaaggggaaaccccuu

SEQ ID NO: 773157 - RNA, 21 nt, Human
gccacaccccaggcacaugug

SEQ ID NO: 773158 - RNA, 21 nt, Human
gccacaguucaggugagugcu

SEQ ID NO: 773159 - RNA, 24 nt, Human
gccacugcacuccaaccuggguga

SEQ ID NO: 773160 - RNA, 21 nt, Human
gcccauguauguacacaaaug

SEQ ID NO: 773161 - RNA, 20 nt, Human
gcccgccagcucaagcaaca

SEQ ID NO: 773162 - RNA, 24 nt, Human
gccuggccaacaugguaaacccca

SEQ ID NO: 773163 - RNA, 20 nt, Human
gcgggugugacggaggguuc

SEQ ID NO: 773164 - RNA, 18 nt, Human
gcuaaauacacccauuuc

SEQ ID NO: 773165 - RNA, 23 nt, Human
gcucaagcaacagcggugccacc

SEQ ID NO: 773166 - RNA, 20 nt, Human
gcucagcaaucagagccuca

SEQ ID NO: 773167 - RNA, 18 nt, Human
gcuggcgugguggcucau

SEQ ID NO: 773168 - RNA, 22 nt, Human
gcuggggacucagggccuggcu

SEQ ID NO: 773169 - RNA, 18 nt, Human
ggagguggguucccaugg

SEQ ID NO: 773170 - RNA, 23 nt, Human
ggcgugguggcucaugccuguaa

SEQ ID NO: 773171 - RNA, 21 nt, Human
ggcuauuuauuuccuacgaga

SEQ ID NO: 773172 - RNA, 21 nt, Human
gggcuugaauuuauccucaga

SEQ ID NO: 773173 - RNA, 22 nt, Human
gggggaagagaaaauggcugag

SEQ ID NO: 773174 - RNA, 24 nt, Human
ggggggaagagaaaauggcugaga

SEQ ID NO: 773175 - RNA, 18 nt, Human
gggguugcagugagcuga

SEQ ID NO: 773176 - RNA, 21 nt, Human
gggguugcagugagcugauug

SEQ ID NO: 773177 - RNA, 24 nt, Human
gggugcaucacuaggucaggaguu

SEQ ID NO: 773178 - RNA, 23 nt, Human
gguggcucaugccuguaauccca

SEQ ID NO: 773179 - RNA, 21 nt, Human
gguuaccgggcccugggcugg

SEQ ID NO: 773180 - RNA, 18 nt, Human
gucuugggcagcuccacc

SEQ ID NO: 773181 - RNA, 22 nt, Human
guugcagugagcugauugugcc

SEQ ID NO: 773182 - RNA, 22 nt, Human
uaaaauauagcaagagucaccu

SEQ ID NO: 773183 - RNA, 18 nt, Human
uaaaaucaucagcucuca

SEQ ID NO: 773184 - RNA, 23 nt, Human
uaaaccccaucucuacuaaaaaa

SEQ ID NO: 773185 - RNA, 30 nt, Human
uaaaucaucucccucgaguucaaaguuccu

SEQ ID NO: 773186 - RNA, 25 nt, Human
uaagaaaacacacguucuaagugug

SEQ ID NO: 773187 - RNA, 18 nt, Human
uaagaucaaguccccacc

SEQ ID NO: 773188 - RNA, 21 nt, Human
uaagauggacaaagauggcca

SEQ ID NO: 773189 - RNA, 25 nt, Human
uaagauggacaaagauggccacgaa

SEQ ID NO: 773190 - RNA, 19 nt, Human
uaagcccaguccuccuguu

SEQ ID NO: 773191 - RNA, 24 nt, Human
uaaggugauauuuggauggggaca

SEQ ID NO: 773192 - RNA, 20 nt, Human
uaaucucagcuacucaaucg

SEQ ID NO: 773193 - RNA, 19 nt, Human
uagaaagagaaaauggcug

SEQ ID NO: 773194 - RNA, 23 nt, Human
uagaggugggagguuccugggag

SEQ ID NO: 773195 - RNA, 19 nt, Human
uagcccagcaugcugacgg

SEQ ID NO: 773196 - RNA, 23 nt, Human
uagccccacacagagucgcgauc

SEQ ID NO: 773197 - RNA, 23 nt, Human
uagccuggccaacaugguaaacc

SEQ ID NO: 773198 - RNA, 23 nt, Human
uaggaggagggguugcagugagc

SEQ ID NO: 773199 - RNA, 23 nt, Human
uaggccccaccuucagcagcugg

SEQ ID NO: 773200 - RNA, 20 nt, Human
uaggucaggaguuugagacu

SEQ ID NO: 773201 - RNA, 24 nt, Human
uagugaugcaugccuguaaucuca

SEQ ID NO: 773202 - RNA, 25 nt, Human
uaucagcauuuuggucaaagcugaa

SEQ ID NO: 773203 - RNA, 24 nt, Human
uauguacacaaauggguuagugca

SEQ ID NO: 773204 - RNA, 18 nt, Human
ucacauccaggucacacu

SEQ ID NO: 773205 - RNA, 23 nt, Human
ucacuaccaccagaacaguaugg

SEQ ID NO: 773206 - RNA, 24 nt, Human
ucacuaggucaggaguuugagacu

SEQ ID NO: 773207 - RNA, 23 nt, Human
ucagugcccccucccuaggcccc

SEQ ID NO: 773208 - RNA, 23 nt, Human
ucauguccucucauuuaaaaauc

SEQ ID NO: 773209 - RNA, 21 nt, Human
uccaaagucucaucugaaaca

SEQ ID NO: 773210 - RNA, 22 nt, Human
uccagcaccggggccacaagca

SEQ ID NO: 773211 - RNA, 18 nt, Human
ucccaccaggucccuccc

SEQ ID NO: 773212 - RNA, 19 nt, Human
ucccuggccccucccaaau

SEQ ID NO: 773213 - RNA, 20 nt, Human
ucgcuugaaccuaggaggag

SEQ ID NO: 773214 - RNA, 18 nt, Human
ucuaaguguggugggggc

SEQ ID NO: 773215 - RNA, 21 nt, Human
ucucauguccucucauuuaaa

SEQ ID NO: 773216 - RNA, 22 nt, Human
ucucuaggaagucccaaacuuu

SEQ ID NO: 773217 - RNA, 21 nt, Human
ucucucucucucucucucaca

SEQ ID NO: 773218 - RNA, 18 nt, Human
ugacuccaugucucacau

SEQ ID NO: 773219 - RNA, 22 nt, Human
ugacuccaugucucacauccag

SEQ ID NO: 773220 - RNA, 23 nt, Human
ugacuccaugucucacauccagg

SEQ ID NO: 773221 - RNA, 22 nt, Human
ugagaacuaagcaaaaggggaa

SEQ ID NO: 773222 - RNA, 20 nt, Human
ugagaccaacucagccugga

SEQ ID NO: 773223 - RNA, 23 nt, Human
ugagacuagccuggccaacaugg

SEQ ID NO: 773224 - RNA, 24 nt, Human
ugagacuagccuggccaacauggu

SEQ ID NO: 773225 - RNA, 24 nt, Human
ugagccuguaaaaucaaaggcuag

SEQ ID NO: 773226 - RNA, 22 nt, Human
ugauauuuggauggggacacag

SEQ ID NO: 773227 - RNA, 22 nt, Human
ugaugcaugccuguaaucucag

SEQ ID NO: 773228 - RNA, 21 nt, Human
ugcaucacuaggucaggaguu

SEQ ID NO: 773229 - RNA, 22 nt, Human
ugcaucacuaggucaggaguuu

SEQ ID NO: 773230 - RNA, 18 nt, Human
ugcauggccggcauaaag

SEQ ID NO: 773231 - RNA, 24 nt, Human
ugccagauacccuaaaucaucucc

SEQ ID NO: 773232 - RNA, 20 nt, Human
ugccggcgggcaaauagacg

SEQ ID NO: 773233 - RNA, 22 nt, Human
ugccuggcuccagcaccggggc

SEQ ID NO: 773234 - RNA, 23 nt, Human
ugccuguaaucccaacacuuugg

SEQ ID NO: 773235 - RNA, 19 nt, Human
ugccuguaaucucagcuac

SEQ ID NO: 773236 - RNA, 22 nt, Human
ugccuguaaucucagcuacuca

SEQ ID NO: 773237 - RNA, 19 nt, Human
ugcgcgauggccaccacuu

SEQ ID NO: 773238 - RNA, 24 nt, Human
uggcaugccacuuuucuccagacu

SEQ ID NO: 773239 - RNA, 19 nt, Human
uggcccagggcugagccca

SEQ ID NO: 773240 - RNA, 21 nt, Human
uggccugcauggcccugcaag

SEQ ID NO: 773241 - RNA, 19 nt, Human
uggcuaaauacacccauuu

SEQ ID NO: 773242 - RNA, 21 nt, Human
uggcucaugccuguaauccca

SEQ ID NO: 773243 - RNA, 24 nt, Human
uggcucaugccuguaaucccaaca

SEQ ID NO: 773244 - RNA, 23 nt, Human
uggcuggcgugguggcucaugcc

SEQ ID NO: 773245 - RNA, 21 nt, Human
ugggaccaaaucagccacagu

SEQ ID NO: 773246 - RNA, 19 nt, Human
ugggaggccaaggugggug

SEQ ID NO: 773247 - RNA, 21 nt, Human
ugggaggccaaggugggugca

SEQ ID NO: 773248 - RNA, 18 nt, Human
uggguucccauggucuug

SEQ ID NO: 773249 - RNA, 20 nt, Human
ugguauagaggugggagguu

SEQ ID NO: 773250 - RNA, 24 nt, Human
ugguggcucaugccuguaauccca

SEQ ID NO: 773251 - RNA, 18 nt, Human
uggugugagugugggggu

SEQ ID NO: 773252 - RNA, 20 nt, Human
ugucgaaaagcucacccuug

SEQ ID NO: 773253 - RNA, 24 nt, Human
ugugcuuuuaaaccccaaccaugu

SEQ ID NO: 773254 - RNA, 21 nt, Human
uguucagaagcacagaccacc

SEQ ID NO: 773255 - RNA, 20 nt, Human
uguuucccuuuuaaaacuga

SEQ ID NO: 773256 - RNA, 25 nt, Human
uguuucucucucucucucucucuca

SEQ ID NO: 773257 - RNA, 20 nt, Human
uuacauggcagcagacaaga

SEQ ID NO: 773258 - RNA, 21 nt, Human
uucagcagcugguuccagcac

SEQ ID NO: 773259 - RNA, 18 nt, Human
uucccaucaggcacauuu

SEQ ID NO: 773260 - RNA, 24 nt, Human
uuccuccagaucauccagccucag

SEQ ID NO: 773261 - RNA, 22 nt, Human
uucucucccuggccccucccaa

SEQ ID NO: 773262 - RNA, 20 nt, Human
uugcagugagcugauugugc

SEQ ID NO: 773263 - RNA, 23 nt, Human
uugugccacugcacuccaaccug

SEQ ID NO: 773264 - RNA, 21 nt, Human
uuuaaaacugaaugcuuuuaa

SEQ ID NO: 773265 - RNA, 19 nt, Human
uuucccuuuuaaaacugaa

SEQ ID NO: 773266 - RNA, 21 nt, Human
uuuccugucuucugaucccuc

SEQ ID NO: 773267 - RNA, 23 nt, Human
uuugcuccaugcccccuuccucc

SEQ ID NO: 773268 - RNA, 19 nt, Human
aaaccaacaucagagaaca

SEQ ID NO: 773269 - RNA, 21 nt, Human
aaacucaaggccaaacuagug

SEQ ID NO: 773270 - RNA, 23 nt, Human
aaccuuguccacacagaggagau

SEQ ID NO: 773271 - RNA, 18 nt, Human
aaggcaaccuuguccaca

SEQ ID NO: 773272 - RNA, 21 nt, Human
aaguauucugcaaccuuggau

SEQ ID NO: 773273 - RNA, 19 nt, Human
aaucuguucuuccccucac

SEQ ID NO: 773274 - RNA, 22 nt, Human
acaaccacaacugcaaagaccu

SEQ ID NO: 773275 - RNA, 23 nt, Human
acacaagugggaggaaugggguc

SEQ ID NO: 773276 - RNA, 22 nt, Human
acagggcaugcaguguagucaa

SEQ ID NO: 773277 - RNA, 20 nt, Human
accagguagcuccuuaccac

SEQ ID NO: 773278 - RNA, 20 nt, Human
acccucuccuggccccuuuc

SEQ ID NO: 773279 - RNA, 21 nt, Human
accugagcuugauaaggagac

SEQ ID NO: 773280 - RNA, 19 nt, Human
agaaaaaccaacaucagag

SEQ ID NO: 773281 - RNA, 19 nt, Human
agaaggccugcuucauuua

SEQ ID NO: 773282 - RNA, 23 nt, Human
agaaucagcuagguccagcugga

SEQ ID NO: 773283 - RNA, 21 nt, Human
agaccacccaauuccaacccu

SEQ ID NO: 773284 - RNA, 19 nt, Human
agcaaggcaaccuugucca

SEQ ID NO: 773285 - RNA, 21 nt, Human
agcagcccccacucuggccug

SEQ ID NO: 773286 - RNA, 21 nt, Human
agccuaucuggaauucacccc

SEQ ID NO: 773287 - RNA, 20 nt, Human
agccugggcagaaaagugau

SEQ ID NO: 773288 - RNA, 22 nt, Human
agccugggcagaaaagugauuc

SEQ ID NO: 773289 - RNA, 19 nt, Human
agcuggggccaggcuuucu

SEQ ID NO: 773290 - RNA, 23 nt, Human
aggcagcaggccaggcuccugca

SEQ ID NO: 773291 - RNA, 18 nt, Human
aggcauccauaaaagcuc

SEQ ID NO: 773292 - RNA, 24 nt, Human
aguauucugcaaccuuggauggaa

SEQ ID NO: 773293 - RNA, 19 nt, Human
agucuucacgggagguuuc

SEQ ID NO: 773294 - RNA, 25 nt, Human
aucgccaagccuacucuaagccagc

SEQ ID NO: 773295 - RNA, 18 nt, Human
aucugcuuugcucucccc

SEQ ID NO: 773296 - RNA, 19 nt, Human
aucugcuuugcucucccca

SEQ ID NO: 773297 - RNA, 22 nt, Human
augaaguucaggugguuguggc

SEQ ID NO: 773298 - RNA, 20 nt, Human
auggaggaaugggguggcag

SEQ ID NO: 773299 - RNA, 19 nt, Human
caaaauucucaggagucuc

SEQ ID NO: 773300 - RNA, 25 nt, Human
caacaucacaggugugggugggcaa

SEQ ID NO: 773301 - RNA, 23 nt, Human
caaccacaacugcaaagaccucu

SEQ ID NO: 773302 - RNA, 24 nt, Human
cacaacaucacagguguggguggg

SEQ ID NO: 773303 - RNA, 20 nt, Human
cacaaccacaacugcaaaga

SEQ ID NO: 773304 - RNA, 23 nt, Human
cacccacagguaaaugacaccuc

SEQ ID NO: 773305 - RNA, 24 nt, Human
caccucuucucccaaggccuucaa

SEQ ID NO: 773306 - RNA, 23 nt, Human
caccugaaaccacgggaagaaac

SEQ ID NO: 773307 - RNA, 21 nt, Human
cagaacagagacucaagccag

SEQ ID NO: 773308 - RNA, 19 nt, Human
cagagcagcauauuaggga

SEQ ID NO: 773309 - RNA, 21 nt, Human
cagauaccacaucccacauug

SEQ ID NO: 773310 - RNA, 19 nt, Human
cagauucacuguccuggug

SEQ ID NO: 773311 - RNA, 18 nt, Human
cagcagcagggagugcag

SEQ ID NO: 773312 - RNA, 22 nt, Human
cagcagcagggagugcaguugg

SEQ ID NO: 773313 - RNA, 18 nt, Human
cagcagcccccacucugg

SEQ ID NO: 773314 - RNA, 19 nt, Human
cagccagguacaucuacca

SEQ ID NO: 773315 - RNA, 21 nt, Human
cagcccucucuuccauccccu

SEQ ID NO: 773316 - RNA, 21 nt, Human
cagcccucucuuccauccccu

SEQ ID NO: 773317 - RNA, 19 nt, Human
cagcugguuggaggagagg

SEQ ID NO: 773318 - RNA, 19 nt, Human
caggcccuccaagccccuc

SEQ ID NO: 773319 - RNA, 24 nt, Human
cagggcaugcaguguagucaaagg

SEQ ID NO: 773320 - RNA, 19 nt, Human
cagguacaucuaccaggug

SEQ ID NO: 773321 - RNA, 19 nt, Human
caguguagucaaagggaaa

SEQ ID NO: 773322 - RNA, 18 nt, Human
cccaaggccuucaaccca

SEQ ID NO: 773323 - RNA, 18 nt, Human
ccccuuucuugggcccca

SEQ ID NO: 773324 - RNA, 22 nt, Human
cccuugggcagccagcccucuc

SEQ ID NO: 773325 - RNA, 23 nt, Human
ccucacccacagguaaaugacac

SEQ ID NO: 773326 - RNA, 21 nt, Human
ccuuaccaccucuucucccaa

SEQ ID NO: 773327 - RNA, 22 nt, Human
cgccaagccuacucuaagccag

SEQ ID NO: 773328 - RNA, 19 nt, Human
cgugcuggcaccuaugcug

SEQ ID NO: 773329 - RNA, 23 nt, Human
cuaccacacugagaauuggcagg

SEQ ID NO: 773330 - RNA, 18 nt, Human
cucaaacucaaggccaaa

SEQ ID NO: 773331 - RNA, 19 nt, Human
cucaaaguauucugcaacc

SEQ ID NO: 773332 - RNA, 24 nt, Human
cucacaaccacaacugcaaagacc

SEQ ID NO: 773333 - RNA, 20 nt, Human
cuccagggacaccugcuucc

SEQ ID NO: 773334 - RNA, 18 nt, Human
cucuccuggggcagaauc

SEQ ID NO: 773335 - RNA, 22 nt, Human
cucugcuucaggauugccugga

SEQ ID NO: 773336 - RNA, 20 nt, Human
cugaaaguuuaguacuacug

SEQ ID NO: 773337 - RNA, 19 nt, Human
cugcucaucccccgccaaa

SEQ ID NO: 773338 - RNA, 23 nt, Human
cugcuuugcucuccccagcuggg

SEQ ID NO: 773339 - RNA, 23 nt, Human
cuucaggggugcauuaccucucc

SEQ ID NO: 773340 - RNA, 21 nt, Human
cuuugcucuccccagcugggg

SEQ ID NO: 773341 - RNA, 25 nt, Human
gaagagacccuaagaaaaaccaaca

SEQ ID NO: 773342 - RNA, 20 nt, Human
gaagcucccccaacacacac

SEQ ID NO: 773343 - RNA, 23 nt, Human
gaauguugagcucauucuucuua

SEQ ID NO: 773344 - RNA, 19 nt, Human
gacucauuuuccaaagguu

SEQ ID NO: 773345 - RNA, 22 nt, Human
gagaauuggcagggcuuugggu

SEQ ID NO: 773346 - RNA, 28 nt, Human
gagugcaguugggucaggcgcguggggg

SEQ ID NO: 773347 - RNA, 24 nt, Human
gaucucucggccuuuucuuauacc

SEQ ID NO: 773348 - RNA, 19 nt, Human
gcacaucaggaaaaaggaa

SEQ ID NO: 773349 - RNA, 21 nt, Human
gcagccagcccucucuuccau

SEQ ID NO: 773350 - RNA, 24 nt, Human
gccagguacaucuaccaggugucu

SEQ ID NO: 773351 - RNA, 22 nt, Human
gcccagaggcuccaagauuugc

SEQ ID NO: 773352 - RNA, 27 nt, Human
gcccagaggcuccaagauuugccagcc

SEQ ID NO: 773353 - RNA, 20 nt, Human
gcccuccaagccccucaccc

SEQ ID NO: 773354 - RNA, 20 nt, Human
gcuccuuaccaccucuucuc

SEQ ID NO: 773355 - RNA, 18 nt, Human
ggaauccauucccuuggg

SEQ ID NO: 773356 - RNA, 22 nt, Human
ggagcuccaucacgaugcccuu

SEQ ID NO: 773357 - RNA, 21 nt, Human
ggccccuuucuugggccccau

SEQ ID NO: 773358 - RNA, 23 nt, Human
gggccaggcuuucuuggacuccu

SEQ ID NO: 773359 - RNA, 23 nt, Human
ggguaggguaagaggagguggug

SEQ ID NO: 773360 - RNA, 23 nt, Human
gggugaagcuucagggaguucag

SEQ ID NO: 773361 - RNA, 21 nt, Human
gguguagcauuugccugagga

SEQ ID NO: 773362 - RNA, 21 nt, Human
gguuucugaggaguccaaaga

SEQ ID NO: 773363 - RNA, 22 nt, Human
guagcgcagguuggguaccggg

SEQ ID NO: 773364 - RNA, 22 nt, Human
gucuuggacacgggaggccugc

SEQ ID NO: 773365 - RNA, 22 nt, Human
gugacugagguccaguagugcu

SEQ ID NO: 773366 - RNA, 21 nt, Human
gugcaugcauaccuauaagca

SEQ ID NO: 773367 - RNA, 21 nt, Human
guuguaccugggaccaauucc

SEQ ID NO: 773368 - RNA, 20 nt, Human
uaaacaaagaagauacuaca

SEQ ID NO: 773369 - RNA, 20 nt, Human
uaaauacaaaauaauaauaa

SEQ ID NO: 773370 - RNA, 26 nt, Human
uaagaaaaaccaacaucagagaacau

SEQ ID NO: 773371 - RNA, 18 nt, Human
uacaggaguguguauuug

SEQ ID NO: 773372 - RNA, 23 nt, Human
uacaucuaccaggugucucaaac

SEQ ID NO: 773373 - RNA, 21 nt, Human
uacauugagaaucagcuaggu

SEQ ID NO: 773374 - RNA, 21 nt, Human
uacccacaccuggcaguuuuc

SEQ ID NO: 773375 - RNA, 29 nt, Human
uagagcccugucauccucugucuccaggg

SEQ ID NO: 773376 - RNA, 24 nt, Human
uagccuaucuggaauucacccccc

SEQ ID NO: 773377 - RNA, 21 nt, Human
uaggaagcuuaauagucaggc

SEQ ID NO: 773378 - RNA, 24 nt, Human
uaggguaagaggagguggugaucu

SEQ ID NO: 773379 - RNA, 21 nt, Human
uagguguacacaagugggagg

SEQ ID NO: 773380 - RNA, 21 nt, Human
ucaagccagguuuaaugauca

SEQ ID NO: 773381 - RNA, 19 nt, Human
ucagagcccuagauggugc

SEQ ID NO: 773382 - RNA, 22 nt, Human
ucaggggugcauuaccucuccu

SEQ ID NO: 773383 - RNA, 19 nt, Human
ucaugcuauaacccucugu

SEQ ID NO: 773384 - RNA, 18 nt, Human
ucauuaauggggacuaca

SEQ ID NO: 773385 - RNA, 23 nt, Human
uccaaagguuuucaacuucccca

SEQ ID NO: 773386 - RNA, 21 nt, Human
uccacacagaggagauauaua

SEQ ID NO: 773387 - RNA, 21 nt, Human
ucccaaggccuucaacccaug

SEQ ID NO: 773388 - RNA, 27 nt, Human
ucccaaggccuucaacccaugguucuu

SEQ ID NO: 773389 - RNA, 22 nt, Human
ucccagauuuccugaugagucu

SEQ ID NO: 773390 - RNA, 24 nt, Human
uccccaaucauaauaggaagcuua

SEQ ID NO: 773391 - RNA, 21 nt, Human
ucccccaacacacacaacauc

SEQ ID NO: 773392 - RNA, 23 nt, Human
uccuaguuccuauagcuccagua

SEQ ID NO: 773393 - RNA, 19 nt, Human
ucgauggaggaauggggug

SEQ ID NO: 773394 - RNA, 21 nt, Human
ucgugcuggcaccuaugcugu

SEQ ID NO: 773395 - RNA, 21 nt, Human
ucuagaggaucuggagaacuu

SEQ ID NO: 773396 - RNA, 22 nt, Human
ucugugccauuggucccaggac

SEQ ID NO: 773397 - RNA, 21 nt, Human
ucuguucuuccccucacuccu

SEQ ID NO: 773398 - RNA, 21 nt, Human
ugaacaggaacucauccagug

SEQ ID NO: 773399 - RNA, 21 nt, Human
ugaagagauggcauacauuga

SEQ ID NO: 773400 - RNA, 21 nt, Human
ugacuugcuaaacaaagaaga

SEQ ID NO: 773401 - RNA, 21 nt, Human
ugagcuugauaaggagacugg

SEQ ID NO: 773402 - RNA, 22 nt, Human
ugagggaaaugcugcaccucuc

SEQ ID NO: 773403 - RNA, 20 nt, Human
ugauaaggagacuggaugaa

SEQ ID NO: 773404 - RNA, 20 nt, Human
ugaugagucugaggagggag

SEQ ID NO: 773405 - RNA, 25 nt, Human
ugcagcagaggugguaucucugaga

SEQ ID NO: 773406 - RNA, 18 nt, Human
ugccagccuagguguaca

SEQ ID NO: 773407 - RNA, 21 nt, Human
ugccauuggucccaggacaag

SEQ ID NO: 773408 - RNA, 18 nt, Human
ugccccagaaggccugcu

SEQ ID NO: 773409 - RNA, 23 nt, Human
ugcuguguaacugggcaaggaau

SEQ ID NO: 773410 - RNA, 19 nt, Human
uggaagcucccccaacaca

SEQ ID NO: 773411 - RNA, 21 nt, Human
uggaagucaaggugcuggugu

SEQ ID NO: 773412 - RNA, 22 nt, Human
uggaauggaauguugagcucau

SEQ ID NO: 773413 - RNA, 24 nt, Human
uggaauguugagcucauucuucuu

SEQ ID NO: 773414 - RNA, 22 nt, Human
uggaauucaccccccaucuaca

SEQ ID NO: 773415 - RNA, 20 nt, Human
uggaggaaugggguggcaga

SEQ ID NO: 773416 - RNA, 25 nt, Human
uggcagaacuccccuucugaaaguu

SEQ ID NO: 773417 - RNA, 20 nt, Human
uggcaggcauccauaaaagc

SEQ ID NO: 773418 - RNA, 21 nt, Human
uggcauggucacugucucucc

SEQ ID NO: 773419 - RNA, 20 nt, Human
uggcuccuguggaagcuccc

SEQ ID NO: 773420 - RNA, 21 nt, Human
ugggaggaauggggucuugga

SEQ ID NO: 773421 - RNA, 18 nt, Human
ugugcaugaaguugugca

SEQ ID NO: 773422 - RNA, 20 nt, Human
uguggcuccuguggaagcuc

SEQ ID NO: 773423 - RNA, 21 nt, Human
ugugggugggcagagauagaa

SEQ ID NO: 773424 - RNA, 26 nt, Human
uguugugacugagguccaguagugcu

SEQ ID NO: 773425 - RNA, 25 nt, Human
uucacuguccugguggaagucaagg

SEQ ID NO: 773426 - RNA, 27 nt, Human
uucccuugggcagccagcccucucuuc

SEQ ID NO: 773427 - RNA, 24 nt, Human
uucgugcuggcaccuaugcuguga

SEQ ID NO: 773428 - RNA, 19 nt, Human
uuggaggagagguccaggu

SEQ ID NO: 773429 - RNA, 19 nt, Human
uuggcagggcuuuggguac

SEQ ID NO: 773430 - RNA, 19 nt, Human
uuuaaugaucauugucuag

SEQ ID NO: 773431 - RNA, 20 nt, Human
uuuggggucuugcucucugu

SEQ ID NO: 773432 - RNA, 24 nt, Human
uuuucaccuucacccugcucaucc

SEQ ID NO: 773433 - RNA, 23 nt, Human
aaaaaaaacacucuccaagugga

SEQ ID NO: 773434 - RNA, 18 nt, Human
aaaaaaacacucuccaag

SEQ ID NO: 773435 - RNA, 19 nt, Human
aaaaaacacucuccaagug

SEQ ID NO: 773436 - RNA, 24 nt, Human
aaaauguugggauuacaggcguga

SEQ ID NO: 773437 - RNA, 24 nt, Human
aaaguacugggauuacaggcauga

SEQ ID NO: 773438 - RNA, 26 nt, Human
aaauguugggauuacaggcgugagcc

SEQ ID NO: 773439 - RNA, 21 nt, Human
aacuuguaacaugaaacucca

SEQ ID NO: 773440 - RNA, 26 nt, Human
aagaaauaacaaauuguguaacagaa

SEQ ID NO: 773441 - RNA, 21 nt, Human
aagaguguauugugugacuug

SEQ ID NO: 773442 - RNA, 19 nt, Human
aaguacugggauuacaggc

SEQ ID NO: 773443 - RNA, 21 nt, Human
aaguacugggauuacaggcau

SEQ ID NO: 773444 - RNA, 19 nt, Human
aaguagcugggaugacagg

SEQ ID NO: 773445 - RNA, 22 nt, Human
aaugacauaguugaaaaaaucc

SEQ ID NO: 773446 - RNA, 22 nt, Human
aauuucucaagguauacugguu

SEQ ID NO: 773447 - RNA, 19 nt, Human
acaggguuucaccaugcug

SEQ ID NO: 773448 - RNA, 20 nt, Human
acaggguuucaccaugcugg

SEQ ID NO: 773449 - RNA, 24 nt, Human
acaggguuucaccaugcuggccag

SEQ ID NO: 773450 - RNA, 18 nt, Human
acaggguuuugccauguu

SEQ ID NO: 773451 - RNA, 23 nt, Human
acaggguuuugccauguuggcca

SEQ ID NO: 773452 - RNA, 24 nt, Human
acaggguuuugccauguuggccag

SEQ ID NO: 773453 - RNA, 26 nt, Human
acaguaaucaaagcaaacauuuuauc

SEQ ID NO: 773454 - RNA, 21 nt, Human
acauuucaucuuuccccccac

SEQ ID NO: 773455 - RNA, 19 nt, Human
accacacacaaaaaaaaca

SEQ ID NO: 773456 - RNA, 24 nt, Human
accaugcuggccaggcuggucucg

SEQ ID NO: 773457 - RNA, 18 nt, Human
agacaggguuuugccaug

SEQ ID NO: 773458 - RNA, 22 nt, Human
agaccacacacaaaaaaaacac

SEQ ID NO: 773459 - RNA, 24 nt, Human
agaugauccgcccaccuuggccuc

SEQ ID NO: 773460 - RNA, 19 nt, Human
agcauccacugugcuuucc

SEQ ID NO: 773461 - RNA, 24 nt, Human
agcgauucuccugccucagccucc

SEQ ID NO: 773462 - RNA, 22 nt, Human
aggcacagacgguauugaucgg

SEQ ID NO: 773463 - RNA, 21 nt, Human
aggcacgcaccaccaugccag

SEQ ID NO: 773464 - RNA, 24 nt, Human
aggccaggagcaaaacauugagga

SEQ ID NO: 773465 - RNA, 24 nt, Human
aggugauccaccugccucggccuc

SEQ ID NO: 773466 - RNA, 22 nt, Human
aguagagacaggguuucaccau

SEQ ID NO: 773467 - RNA, 22 nt, Human
aguagagacaggguuuugccau

SEQ ID NO: 773468 - RNA, 18 nt, Human
aguagcugggacuacagg

SEQ ID NO: 773469 - RNA, 19 nt, Human
aguagcugggacuacaggc

SEQ ID NO: 773470 - RNA, 24 nt, Human
auauuuacaaagccuagcauccac

SEQ ID NO: 773471 - RNA, 22 nt, Human
aucugcuuuucuacauccccau

SEQ ID NO: 773472 - RNA, 22 nt, Human
augccaggcugauuuuuuguau

SEQ ID NO: 773473 - RNA, 18 nt, Human
augcuuuuuaaaauuucu

SEQ ID NO: 773474 - RNA, 22 nt, Human
auggcagcauuuucuuuggaac

SEQ ID NO: 773475 - RNA, 21 nt, Human
augugauacacagauuguccc

SEQ ID NO: 773476 - RNA, 24 nt, Human
auguguggccucauaauaaaguua

SEQ ID NO: 773477 - RNA, 24 nt, Human
auuauuguauuuuuaguagagaca

SEQ ID NO: 773478 - RNA, 18 nt, Human
auucuugguauaucaaag

SEQ ID NO: 773479 - RNA, 23 nt, Human
auuucagaaaugugcuuuuucau

SEQ ID NO: 773480 - RNA, 22 nt, Human
auuuuuuguauuuuuaguagag

SEQ ID NO: 773481 - RNA, 24 nt, Human
caaaauguugggauuacaggcgug

SEQ ID NO: 773482 - RNA, 21 nt, Human
caaaguaaauuccaggaaugu

SEQ ID NO: 773483 - RNA, 24 nt, Human
caaaguacugggauuacaggcaug

SEQ ID NO: 773484 - RNA, 20 nt, Human
caaauuaagaagauaguaac

SEQ ID NO: 773485 - RNA, 22 nt, Human
caagcaauucuccugccucagc

SEQ ID NO: 773486 - RNA, 22 nt, Human
caagcgauucuccugccucagc

SEQ ID NO: 773487 - RNA, 27 nt, Human
caagcgauucuccugccucagccuccc

SEQ ID NO: 773488 - RNA, 22 nt, Human
caagugcaguauuuuucaugaa

SEQ ID NO: 773489 - RNA, 23 nt, Human
caauagucuuucaaaauaacuaa

SEQ ID NO: 773490 - RNA, 18 nt, Human
cacaacuauuugcagcag

SEQ ID NO: 773491 - RNA, 21 nt, Human
caccaugcuggccaggcuggu

SEQ ID NO: 773492 - RNA, 24 nt, Human
caccaugcuggccaggcuggucuc

SEQ ID NO: 773493 - RNA, 27 nt, Human
caccaugcuggccaggcuggucucgaa

SEQ ID NO: 773494 - RNA, 25 nt, Human
cacccaggcuggagugcagcagggc

SEQ ID NO: 773495 - RNA, 22 nt, Human
caccccagaccacacacaaaaa

SEQ ID NO: 773496 - RNA, 24 nt, Human
caccccagaccacacacaaaaaaa

SEQ ID NO: 773497 - RNA, 26 nt, Human
caccccagaccacacacaaaaaaaac

SEQ ID NO: 773498 - RNA, 23 nt, Human
caccugccucggccucccaaagu

SEQ ID NO: 773499 - RNA, 20 nt, Human
cacgcaccaccaugccaggc

SEQ ID NO: 773500 - RNA, 19 nt, Human
cacugcaaccucugccugc

SEQ ID NO: 773501 - RNA, 23 nt, Human
cacugcaaccucugccugccggg

SEQ ID NO: 773502 - RNA, 23 nt, Human
cacugcaaucacugccuccuggg

SEQ ID NO: 773503 - RNA, 19 nt, Human
cagaaaugugcuuuuucau

SEQ ID NO: 773504 - RNA, 19 nt, Human
cagaccacacacaaaaaaa

SEQ ID NO: 773505 - RNA, 18 nt, Human
cagcaaggggcagggucc

SEQ ID NO: 773506 - RNA, 21 nt, Human
cagcagcaauagucuuucaaa

SEQ ID NO: 773507 - RNA, 22 nt, Human
cagcagcaauagucuuucaaaa

SEQ ID NO: 773508 - RNA, 18 nt, Human
cagcagggcgaucucggc

SEQ ID NO: 773509 - RNA, 24 nt, Human
caggguuucaccaugcuggccagg

SEQ ID NO: 773510 - RNA, 24 nt, Human
caggguuuugccauguuggccagg

SEQ ID NO: 773511 - RNA, 22 nt, Human
caggugauccaccugccucggc

SEQ ID NO: 773512 - RNA, 19 nt, Human
caggugcccgccaccaugc

SEQ ID NO: 773513 - RNA, 24 nt, Human
caguauggcagcauuuucuuugga

SEQ ID NO: 773514 - RNA, 24 nt, Human
caugcuggccaggcuggucucgaa

SEQ ID NO: 773515 - RNA, 24 nt, Human
cauguuggccaggcuggucucgaa

SEQ ID NO: 773516 - RNA, 20 nt, Human
cauuguuagaacagaagaua

SEQ ID NO: 773517 - RNA, 22 nt, Human
ccaaaauguugggauuacaggc

SEQ ID NO: 773518 - RNA, 22 nt, Human
ccaaaauguugggauuacaggc

SEQ ID NO: 773519 - RNA, 24 nt, Human
ccaaaauguugggauuacaggcgu

SEQ ID NO: 773520 - RNA, 24 nt, Human
ccaaaguacugggauuacaggcau

SEQ ID NO: 773521 - RNA, 23 nt, Human
ccacugcgcccggcccuuucaga

SEQ ID NO: 773522 - RNA, 19 nt, Human
ccacuggauccacuugaug

SEQ ID NO: 773523 - RNA, 19 nt, Human
ccagaccacacacaaaaaa

SEQ ID NO: 773524 - RNA, 19 nt, Human
ccaggccaggagcaaaaca

SEQ ID NO: 773525 - RNA, 19 nt, Human
ccauguuggccaggcuggu

SEQ ID NO: 773526 - RNA, 22 nt, Human
ccauguuggccaggcuggucuc

SEQ ID NO: 773527 - RNA, 23 nt, Human
ccauguuggccaggcuggucucg

SEQ ID NO: 773528 - RNA, 24 nt, Human
cccaaaguacugggauuacaggca

SEQ ID NO: 773529 - RNA, 18 nt, Human
cccaaguagcugggauga

SEQ ID NO: 773530 - RNA, 18 nt, Human
cccaggcuggagugcagc

SEQ ID NO: 773531 - RNA, 20 nt, Human
ccccugaaaaaacgaacaaa

SEQ ID NO: 773532 - RNA, 23 nt, Human
cccuauguuaaacccgugguuuc

SEQ ID NO: 773533 - RNA, 24 nt, Human
cccucugucacccaggcuggagug

SEQ ID NO: 773534 - RNA, 24 nt, Human
cccugaguagcugggacuacaggc

SEQ ID NO: 773535 - RNA, 19 nt, Human
ccggguucaagcaauucuc

SEQ ID NO: 773536 - RNA, 22 nt, Human
ccggguucaagcaauucuccug

SEQ ID NO: 773537 - RNA, 22 nt, Human
ccuagcauccacugugcuuucc

SEQ ID NO: 773538 - RNA, 19 nt, Human
ccucagcccugaguagcug

SEQ ID NO: 773539 - RNA, 24 nt, Human
ccuccuggguucaagcgauucucc

SEQ ID NO: 773540 - RNA, 20 nt, Human
ccuccuucagccaacagagu

SEQ ID NO: 773541 - RNA, 23 nt, Human
ccugaguagcugggacuacaggc

SEQ ID NO: 773542 - RNA, 24 nt, Human
ccugaguagcugggacuacaggca

SEQ ID NO: 773543 - RNA, 21 nt, Human
ccugaucucaggugauccacc

SEQ ID NO: 773544 - RNA, 24 nt, Human
ccugccggguucaagcaauucucc

SEQ ID NO: 773545 - RNA, 24 nt, Human
ccuggccucagaugauccgcccac

SEQ ID NO: 773546 - RNA, 23 nt, Human
ccuggguucaagcgauucuccug

SEQ ID NO: 773547 - RNA, 21 nt, Human
ccuuuccuccugugguuuugu

SEQ ID NO: 773548 - RNA, 22 nt, Human
cgcccaccuuggccucccaaaa

SEQ ID NO: 773549 - RNA, 24 nt, Human
cucacugcaaccucugccugccgg

SEQ ID NO: 773550 - RNA, 24 nt, Human
cucacugcaaucacugccuccugg

SEQ ID NO: 773551 - RNA, 24 nt, Human
cucagaugauccgcccaccuuggc

SEQ ID NO: 773552 - RNA, 22 nt, Human
cucagcccugaguagcugggac

SEQ ID NO: 773553 - RNA, 23 nt, Human
cucagccucccaaguagcuggga

SEQ ID NO: 773554 - RNA, 21 nt, Human
cucaggugauccaccugccuc

SEQ ID NO: 773555 - RNA, 19 nt, Human
cuccaaaauuccucaaaau

SEQ ID NO: 773556 - RNA, 24 nt, Human
cucccucugucacccaggcuggag

SEQ ID NO: 773557 - RNA, 21 nt, Human
cuccugccucagcccugagua

SEQ ID NO: 773558 - RNA, 21 nt, Human
cuccuggguucaagcgauucu

SEQ ID NO: 773559 - RNA, 23 nt, Human
cucugucacccaggcuggagugc

SEQ ID NO: 773560 - RNA, 19 nt, Human
cugaguucuuauaaacacu

SEQ ID NO: 773561 - RNA, 24 nt, Human
cugcaaccucugccugccggguuc

SEQ ID NO: 773562 - RNA, 21 nt, Human
cugccucagcccugaguagcu

SEQ ID NO: 773563 - RNA, 23 nt, Human
cugccucagccucccaaguagcu

SEQ ID NO: 773564 - RNA, 27 nt, Human
cugggugaugauggguguguucucuuc

SEQ ID NO: 773565 - RNA, 20 nt, Human
cuuaucugauagcagcacug

SEQ ID NO: 773566 - RNA, 18 nt, Human
cuucaagggcaggaaacc

SEQ ID NO: 773567 - RNA, 22 nt, Human
cuuguaacaugaaacuccagcu

SEQ ID NO: 773568 - RNA, 19 nt, Human
cuuucaaaauaacuaaaac

SEQ ID NO: 773569 - RNA, 18 nt, Human
gaaguuucaccuuccagg

SEQ ID NO: 773570 - RNA, 21 nt, Human
gaaugucacuaugacacaaaa

SEQ ID NO: 773571 - RNA, 19 nt, Human
gacaggguuuugccauguu

SEQ ID NO: 773572 - RNA, 24 nt, Human
gacuacaggcacgcaccaccaugc

SEQ ID NO: 773573 - RNA, 21 nt, Human
gagacggagucucgcucuauu

SEQ ID NO: 773574 - RNA, 24 nt, Human
gaguagcugggacuacaggcacgc

SEQ ID NO: 773575 - RNA, 24 nt, Human
gaugacaggugcccgccaccaugc

SEQ ID NO: 773576 - RNA, 19 nt, Human
gauggccagcaaggggcag

SEQ ID NO: 773577 - RNA, 21 nt, Human
gauuacaggcaugaucuaaau

SEQ ID NO: 773578 - RNA, 18 nt, Human
gauuacaggcgugagcca

SEQ ID NO: 773579 - RNA, 22 nt, Human
gauuacaggcgugagccacugc

SEQ ID NO: 773580 - RNA, 22 nt, Human
gauuacaggcgugagccacugc

SEQ ID NO: 773581 - RNA, 24 nt, Human
gauuuuuuguauuuuuaguagaga

SEQ ID NO: 773582 - RNA, 22 nt, Human
gcaaccucugccugccggguuc

SEQ ID NO: 773583 - RNA, 20 nt, Human
gcagcagcaauagucuuuca

SEQ ID NO: 773584 - RNA, 20 nt, Human
gccauguuggccaggcuggu

SEQ ID NO: 773585 - RNA, 20 nt, Human
gccucagccucccaaguagc

SEQ ID NO: 773586 - RNA, 24 nt, Human
gcgauucuccugccucagccuccc

SEQ ID NO: 773587 - RNA, 25 nt, Human
gcucuauugcccaggcuugcaugca

SEQ ID NO: 773588 - RNA, 23 nt, Human
gcuggucucgaacuccuggccuc

SEQ ID NO: 773589 - RNA, 24 nt, Human
ggccucagaugauccgcccaccuu

SEQ ID NO: 773590 - RNA, 24 nt, Human
ggcuggucucgaacuccugaucuc

SEQ ID NO: 773591 - RNA, 24 nt, Human
ggcuggucucgaacuccuggccuc

SEQ ID NO: 773592 - RNA, 22 nt, Human
ggguuuugccauguuggccagg

SEQ ID NO: 773593 - RNA, 23 nt, Human
gguuugaguuaccuccuucagcc

SEQ ID NO: 773594 - RNA, 21 nt, Human
guaacaaccguuccccugaaa

SEQ ID NO: 773595 - RNA, 23 nt, Human
guagagacaggguuuugccaugu

SEQ ID NO: 773596 - RNA, 21 nt, Human
gucccgggaaaaacaaacccu

SEQ ID NO: 773597 - RNA, 24 nt, Human
gugauccaccugccucggccuccc

SEQ ID NO: 773598 - RNA, 18 nt, Human
gugguuuuguuucucaag

SEQ ID NO: 773599 - RNA, 22 nt, Human
guuuuguuuccuuccagaggga

SEQ ID NO: 773600 - RNA, 19 nt, Human
uaaaauuucucaagguaua

SEQ ID NO: 773601 - RNA, 21 nt, Human
uaaauaaagguaaagcuguuu

SEQ ID NO: 773602 - RNA, 19 nt, Human
uaacuuuuugcuauuggaa

SEQ ID NO: 773603 - RNA, 23 nt, Human
uaauuauuguauuuuuaguagag

SEQ ID NO: 773604 - RNA, 24 nt, Human
uaauuauuguauuuuuaguagaga

SEQ ID NO: 773605 - RNA, 18 nt, Human
uacacagauugucccggg

SEQ ID NO: 773606 - RNA, 24 nt, Human
uacacagauugucccgggaagcgu

SEQ ID NO: 773607 - RNA, 23 nt, Human
uacagauucauccuauaacuggu

SEQ ID NO: 773608 - RNA, 19 nt, Human
uacaggcgugagccacugc

SEQ ID NO: 773609 - RNA, 23 nt, Human
uacaggcgugagccacugcgccc

SEQ ID NO: 773610 - RNA, 24 nt, Human
uaccauaggaaauuugaagaaaua

SEQ ID NO: 773611 - RNA, 27 nt, Human
uaccuaaaauguacauuccuaaauaaa

SEQ ID NO: 773612 - RNA, 21 nt, Human
uaccuaugauaaagacuccaa

SEQ ID NO: 773613 - RNA, 20 nt, Human
uacugggauuacaggcauga

SEQ ID NO: 773614 - RNA, 22 nt, Human
uagaaaaaggcugaauuaacac

SEQ ID NO: 773615 - RNA, 20 nt, Human
uagagacaggguuucaccau

SEQ ID NO: 773616 - RNA, 22 nt, Human
uagagacaggguuuugccaugu

SEQ ID NO: 773617 - RNA, 24 nt, Human
uaguagagacaggguuucaccaug

SEQ ID NO: 773618 - RNA, 26 nt, Human
uaguagagacaggguuucaccaugcu

SEQ ID NO: 773619 - RNA, 24 nt, Human
uaguagagacaggguuuugccaug

SEQ ID NO: 773620 - RNA, 22 nt, Human
uauaauuaugaaaaaauaugcc

SEQ ID NO: 773621 - RNA, 24 nt, Human
uauaauuaugaaaaaauaugccuc

SEQ ID NO: 773622 - RNA, 21 nt, Human
uaucacuacuaucugucccgg

SEQ ID NO: 773623 - RNA, 19 nt, Human
ucaagcgauucuccugccu

SEQ ID NO: 773624 - RNA, 18 nt, Human
ucacccaggcuggagugc

SEQ ID NO: 773625 - RNA, 21 nt, Human
ucaccccagaccacacacaaa

SEQ ID NO: 773626 - RNA, 18 nt, Human
ucacugcaaccucugccu

SEQ ID NO: 773627 - RNA, 19 nt, Human
ucacugcaaccucugccug

SEQ ID NO: 773628 - RNA, 24 nt, Human
ucacugcaaccucugccugccggg

SEQ ID NO: 773629 - RNA, 24 nt, Human
ucacugcaaucacugccuccuggg

SEQ ID NO: 773630 - RNA, 19 nt, Human
ucacugccuccuggguuca

SEQ ID NO: 773631 - RNA, 18 nt, Human
ucagccucccaaguagcu

SEQ ID NO: 773632 - RNA, 20 nt, Human
ucagccucccaaguagcugg

SEQ ID NO: 773633 - RNA, 21 nt, Human
ucaggugauccaccugccucg

SEQ ID NO: 773634 - RNA, 23 nt, Human
ucauucugggugaugauggggag

SEQ ID NO: 773635 - RNA, 21 nt, Human
uccaaacuauauauagaaaca

SEQ ID NO: 773636 - RNA, 27 nt, Human
uccaugaucaagauaauaccggggucc

SEQ ID NO: 773637 - RNA, 24 nt, Human
ucccaaaauguugggauuacaggc

SEQ ID NO: 773638 - RNA, 24 nt, Human
ucccaaaguacugggauuacaggc

SEQ ID NO: 773639 - RNA, 23 nt, Human
ucccaaguagcugggaugacagg

SEQ ID NO: 773640 - RNA, 20 nt, Human
ucccucugucacccaggcug

SEQ ID NO: 773641 - RNA, 24 nt, Human
ucccucugucacccaggcuggagu

SEQ ID NO: 773642 - RNA, 19 nt, Human
uccguucucauucugggug

SEQ ID NO: 773643 - RNA, 21 nt, Human
uccuggguucaagcgauucuc

SEQ ID NO: 773644 - RNA, 24 nt, Human
uccuggguucaagcgauucuccug

SEQ ID NO: 773645 - RNA, 22 nt, Human
ucucccucugucacccaggcug

SEQ ID NO: 773646 - RNA, 23 nt, Human
ucucccucugucacccaggcugg

SEQ ID NO: 773647 - RNA, 24 nt, Human
ucucccucugucacccaggcugga

SEQ ID NO: 773648 - RNA, 21 nt, Human
ucuccugccucagcccugagu

SEQ ID NO: 773649 - RNA, 26 nt, Human
ucuccugccucagccucccaaguagc

SEQ ID NO: 773650 - RNA, 19 nt, Human
ucucgaacuccugaucuca

SEQ ID NO: 773651 - RNA, 20 nt, Human
ucucgaacuccuggccucag

SEQ ID NO: 773652 - RNA, 19 nt, Human
ucucgcucuauugcccagg

SEQ ID NO: 773653 - RNA, 24 nt, Human
ucucgcucuauugcccaggcuugc

SEQ ID NO: 773654 - RNA, 25 nt, Human
ucucgcucuauugcccaggcuugca

SEQ ID NO: 773655 - RNA, 19 nt, Human
ucugauagcagcacugcug

SEQ ID NO: 773656 - RNA, 24 nt, Human
ucugucacccaggcuggagugcag

SEQ ID NO: 773657 - RNA, 25 nt, Human
ugaaaaaacgaacaaaauccauuag

SEQ ID NO: 773658 - RNA, 19 nt, Human
ugaaaaaauccagaccaca

SEQ ID NO: 773659 - RNA, 18 nt, Human
ugacccuggauuuuuccc

SEQ ID NO: 773660 - RNA, 19 nt, Human
ugacccuggauuuuucccu

SEQ ID NO: 773661 - RNA, 22 nt, Human
ugagacggagucucccucuguc

SEQ ID NO: 773662 - RNA, 20 nt, Human
ugaguuuuguuuuguuuugu

SEQ ID NO: 773663 - RNA, 24 nt, Human
ugauccgcccaccuuggccuccca

SEQ ID NO: 773664 - RNA, 24 nt, Human
ugaucucaggugauccaccugccu

SEQ ID NO: 773665 - RNA, 20 nt, Human
ugauuguaacuaaguaacaa

SEQ ID NO: 773666 - RNA, 23 nt, Human
ugcacuaucacuacuaucugucc

SEQ ID NO: 773667 - RNA, 22 nt, Human
ugcagcagggcgaucucggcuc

SEQ ID NO: 773668 - RNA, 22 nt, Human
ugcaguggugcuaucucagcuc

SEQ ID NO: 773669 - RNA, 24 nt, Human
ugccauguuggccaggcuggucuc

SEQ ID NO: 773670 - RNA, 27 nt, Human
ugccauguuggccaggcuggucucgaa

SEQ ID NO: 773671 - RNA, 24 nt, Human
ugcccaggcuugcaugcaguggug

SEQ ID NO: 773672 - RNA, 24 nt, Human
ugccggguucaagcaauucuccug

SEQ ID NO: 773673 - RNA, 19 nt, Human
ugccucagcccugaguagc

SEQ ID NO: 773674 - RNA, 22 nt, Human
ugccucagcccugaguagcugg

SEQ ID NO: 773675 - RNA, 24 nt, Human
ugccucagccucccaaguagcugg

SEQ ID NO: 773676 - RNA, 24 nt, Human
ugccucggccucccaaaguacugg

SEQ ID NO: 773677 - RNA, 18 nt, Human
ugcuggccaggcuggucu

SEQ ID NO: 773678 - RNA, 22 nt, Human
uggaaaagaaauacaaaucuuu

SEQ ID NO: 773679 - RNA, 24 nt, Human
uggagugcagcagggcgaucucgg

SEQ ID NO: 773680 - RNA, 24 nt, Human
uggccaggcuggucucgaacuccu

SEQ ID NO: 773681 - RNA, 24 nt, Human
uggccaggcuggucucgaacuccu

SEQ ID NO: 773682 - RNA, 18 nt, Human
uggccucagaugauccgc

SEQ ID NO: 773683 - RNA, 21 nt, Human
ugggacuacaggcacgcacca

SEQ ID NO: 773684 - RNA, 24 nt, Human
ugggacuacaggcacgcaccacca

SEQ ID NO: 773685 - RNA, 21 nt, Human
ugggaugacaggugcccgcca

SEQ ID NO: 773686 - RNA, 22 nt, Human
ugggaugacaggugcccgccac

SEQ ID NO: 773687 - RNA, 18 nt, Human
ugggauuacaggcaugau

SEQ ID NO: 773688 - RNA, 21 nt, Human
ugggauuacaggcaugaucua

SEQ ID NO: 773689 - RNA, 19 nt, Human
ugggauuacaggcgugagc

SEQ ID NO: 773690 - RNA, 21 nt, Human
ugggauuacaggcgugagcca

SEQ ID NO: 773691 - RNA, 22 nt, Human
ugggauuacaggcgugagccac

SEQ ID NO: 773692 - RNA, 22 nt, Human
ugggauuacaggcgugagccac

SEQ ID NO: 773693 - RNA, 24 nt, Human
ugggauuacaggcgugagccacug

SEQ ID NO: 773694 - RNA, 26 nt, Human
ugggauuacaggcgugagccacugcg

SEQ ID NO: 773695 - RNA, 23 nt, Human
uggguucaagcgauucuccugcc

SEQ ID NO: 773696 - RNA, 24 nt, Human
uggugcuaucucagcucacugcaa

SEQ ID NO: 773697 - RNA, 19 nt, Human
uuaaacccgugguuucuca

SEQ ID NO: 773698 - RNA, 24 nt, Human
uuaguagagacaggguuucaccau

SEQ ID NO: 773699 - RNA, 24 nt, Human
uuaguagagacaggguuuugccau

SEQ ID NO: 773700 - RNA, 21 nt, Human
uucaagcaauucuccugccuc

SEQ ID NO: 773701 - RNA, 24 nt, Human
uucaagcaauucuccugccucagc

SEQ ID NO: 773702 - RNA, 21 nt, Human
uucaagcgauucuccugccuc

SEQ ID NO: 773703 - RNA, 23 nt, Human
uucaagcgauucuccugccucag

SEQ ID NO: 773704 - RNA, 24 nt, Human
uucaagcgauucuccugccucagc

SEQ ID NO: 773705 - RNA, 18 nt, Human
uuccuaaauaaagguaaa

SEQ ID NO: 773706 - RNA, 19 nt, Human
uuccuauucuuuuguuuuu

SEQ ID NO: 773707 - RNA, 21 nt, Human
uuccuauucuuuuguuuuugu

SEQ ID NO: 773708 - RNA, 23 nt, Human
uuccuccugugguuuuguuucuc

SEQ ID NO: 773709 - RNA, 29 nt, Human
uucuuccuuuccuccugugguuuuguuuc

SEQ ID NO: 773710 - RNA, 26 nt, Human
uugaagaaauaacaaauuguguaaag

SEQ ID NO: 773711 - RNA, 24 nt, Human
uugccauguuggccaggcuggucu

SEQ ID NO: 773712 - RNA, 23 nt, Human
uuguuuuguuuuguuuccuucca

SEQ ID NO: 773713 - RNA, 22 nt, Human
uuucaaaauaacuaaaacaaac

SEQ ID NO: 773714 - RNA, 21 nt, Human
uuucaccaugcuggccaggcu

SEQ ID NO: 773715 - RNA, 26 nt, Human
uuucucaagacauauaggugguucca

SEQ ID NO: 773716 - RNA, 18 nt, Human
uuuguuuuguuuuguuuc

SEQ ID NO: 773717 - RNA, 23 nt, Human
uuuucuagcaaugaacaugacuu

SEQ ID NO: 773718 - RNA, 23 nt, Human
uuuugccauguuggccaggcugg

SEQ ID NO: 773719 - RNA, 21 nt, Human
uuuuuaguagagacaggguuu

SEQ ID NO: 773720 - RNA, 24 nt, Human
uuuuuaguagagacaggguuucac

SEQ ID NO: 773721 - RNA, 24 nt, Human
uuuuuaguagagacaggguuuugc

SEQ ID NO: 773722 - RNA, 27 nt, Human
uuuuucuuccuuuccuccugugguuuu

SEQ ID NO: 773723 - RNA, 21 nt, Human
uuuuuguauuuuuaguagaga

SEQ ID NO: 773724 - RNA, 24 nt, Human
uuuuuuguauuuuuaguagagaca

SEQ ID NO: 773725 - RNA, 23 nt, Human
aaaacacaacagcagcuguucaa

SEQ ID NO: 773726 - RNA, 18 nt, Human
aaaaccaaagauauaacc

SEQ ID NO: 773727 - RNA, 23 nt, Human
aaacaagcacauauaccauaaaa

SEQ ID NO: 773728 - RNA, 19 nt, Human
aaacagaugagacauaaaa

SEQ ID NO: 773729 - RNA, 18 nt, Human
aaaugggcacauaugcau

SEQ ID NO: 773730 - RNA, 18 nt, Human
aagagccagaaacuaaau

SEQ ID NO: 773731 - RNA, 18 nt, Human
aagggaacauuaaguuuc

SEQ ID NO: 773732 - RNA, 21 nt, Human
aaucucuuccugcaagaucuc

SEQ ID NO: 773733 - RNA, 20 nt, Human
agaaaacaagcacauauacc

SEQ ID NO: 773734 - RNA, 21 nt, Human
agaaaacaagcacauauacca

SEQ ID NO: 773735 - RNA, 22 nt, Human
agaaaacaagcacauauaccau

SEQ ID NO: 773736 - RNA, 18 nt, Human
agaugaucaagcaucccc

SEQ ID NO: 773737 - RNA, 20 nt, Human
agcaaaaaccacccugccau

SEQ ID NO: 773738 - RNA, 24 nt, Human
aggaaaaacagaugagacauaaaa

SEQ ID NO: 773739 - RNA, 21 nt, Human
agguaaaaaucugugaacaac

SEQ ID NO: 773740 - RNA, 18 nt, Human
aguaauauguauacuuga

SEQ ID NO: 773741 - RNA, 19 nt, Human
aguucaggauauguuuuuu

SEQ ID NO: 773742 - RNA, 18 nt, Human
auaaaugcuaaaauaaca

SEQ ID NO: 773743 - RNA, 22 nt, Human
auacaaauaacugagaaguuaa

SEQ ID NO: 773744 - RNA, 22 nt, Human
aucaaaaguaacauguauccau

SEQ ID NO: 773745 - RNA, 23 nt, Human
augauaaugaauggcacauuauc

SEQ ID NO: 773746 - RNA, 22 nt, Human
auguguguguguauauauaugu

SEQ ID NO: 773747 - RNA, 24 nt, Human
auuaguauuuuuuccauuaagcag

SEQ ID NO: 773748 - RNA, 18 nt, Human
auucugauuccccugcuu

SEQ ID NO: 773749 - RNA, 24 nt, Human
caaaaauguuuagauacccuaaca

SEQ ID NO: 773750 - RNA, 19 nt, Human
caaaauaggcuaaagauua

SEQ ID NO: 773751 - RNA, 18 nt, Human
caaagggcaguggagcua

SEQ ID NO: 773752 - RNA, 22 nt, Human
caagcacauauaccauaaaagc

SEQ ID NO: 773753 - RNA, 22 nt, Human
cacaaacacauuuccauaacuu

SEQ ID NO: 773754 - RNA, 21 nt, Human
cacacucaaaaauguuuagau

SEQ ID NO: 773755 - RNA, 21 nt, Human
cacacucucacuacacacaca

SEQ ID NO: 773756 - RNA, 18 nt, Human
cacccugccauucaauuu

SEQ ID NO: 773757 - RNA, 20 nt, Human
cacuauuaagcugagaaaac

SEQ ID NO: 773758 - RNA, 23 nt, Human
cacugcagguuucaauacaccuu

SEQ ID NO: 773759 - RNA, 27 nt, Human
cagaaaacaagcacauauaccauaaaa

SEQ ID NO: 773760 - RNA, 21 nt, Human
cccaugcuacugucuuacuuc

SEQ ID NO: 773761 - RNA, 19 nt, Human
cccgcagcggccgccgaga

SEQ ID NO: 773762 - RNA, 18 nt, Human
ccgcagggccccuuccgc

SEQ ID NO: 773763 - RNA, 23 nt, Human
ccggcuuccgagagagggagucu

SEQ ID NO: 773764 - RNA, 21 nt, Human
ccuaaaaaugcagcuucccau

SEQ ID NO: 773765 - RNA, 22 nt, Human
ccugcagccgcggucucccggc

SEQ ID NO: 773766 - RNA, 20 nt, Human
ccuuuuaaaagacaaacaca

SEQ ID NO: 773767 - RNA, 20 nt, Human
cgagaccuccgcguuggucg

SEQ ID NO: 773768 - RNA, 19 nt, Human
cgccgagaccuccgcguug

SEQ ID NO: 773769 - RNA, 18 nt, Human
cggagaagcuccggggcg

SEQ ID NO: 773770 - RNA, 22 nt, Human
cggccacccccgucgacgacgu

SEQ ID NO: 773771 - RNA, 24 nt, Human
cguuucuaaauauauauaugugug

SEQ ID NO: 773772 - RNA, 21 nt, Human
cuaagagccagaaacuaaauc

SEQ ID NO: 773773 - RNA, 23 nt, Human
cucaacucuuucaauuauaucaa

SEQ ID NO: 773774 - RNA, 25 nt, Human
cuggcuccugcccuuaccccaguuc

SEQ ID NO: 773775 - RNA, 20 nt, Human
gaaaaucccuaaaacuagua

SEQ ID NO: 773776 - RNA, 24 nt, Human
gaaagguuugucacauaaacaguu

SEQ ID NO: 773777 - RNA, 19 nt, Human
gacaaaacaaaaaauaggc

SEQ ID NO: 773778 - RNA, 21 nt, Human
gagucuucuccgugcucagcu

SEQ ID NO: 773779 - RNA, 18 nt, Human
gcaaaaaccacccugcca

SEQ ID NO: 773780 - RNA, 23 nt, Human
gcaaccccaaccuaauuucacaa

SEQ ID NO: 773781 - RNA, 19 nt, Human
gcaggauuuuauauaucug

SEQ ID NO: 773782 - RNA, 19 nt, Human
gccccuuccgccuccguuc

SEQ ID NO: 773783 - RNA, 18 nt, Human
gcuuguaagcaaaaacca

SEQ ID NO: 773784 - RNA, 21 nt, Human
ggaaaaacagaugagacauaa

SEQ ID NO: 773785 - RNA, 18 nt, Human
ggaaaagucaaaacaaaa

SEQ ID NO: 773786 - RNA, 22 nt, Human
guaagcaaaaaccacccugcca

SEQ ID NO: 773787 - RNA, 18 nt, Human
uaaaagacaaacacaaau

SEQ ID NO: 773788 - RNA, 20 nt, Human
uaaaagacaaacacaaauga

SEQ ID NO: 773789 - RNA, 22 nt, Human
uaaaagacaaacacaaaugaga

SEQ ID NO: 773790 - RNA, 21 nt, Human
uaaaagauguugcaaccccaa

SEQ ID NO: 773791 - RNA, 18 nt, Human
uaaaauacaugccagcau

SEQ ID NO: 773792 - RNA, 21 nt, Human
uaaacugaaugagacaaaaca

SEQ ID NO: 773793 - RNA, 23 nt, Human
uaaaugcuaaaauaacauuuaac

SEQ ID NO: 773794 - RNA, 18 nt, Human
uaagcugagaaaacagga

SEQ ID NO: 773795 - RNA, 24 nt, Human
uaagcugagaaaacaggaauaacc

SEQ ID NO: 773796 - RNA, 24 nt, Human
uaauauguauacuugaaccuuaca

SEQ ID NO: 773797 - RNA, 18 nt, Human
uacaggaagaguuuuccu

SEQ ID NO: 773798 - RNA, 19 nt, Human
uacauauacacauauauau

SEQ ID NO: 773799 - RNA, 21 nt, Human
uaccauaaaagcuaaaaugaa

SEQ ID NO: 773800 - RNA, 24 nt, Human
uacuggaaauaauauuguuuuagc

SEQ ID NO: 773801 - RNA, 21 nt, Human
uagaaaacacuguggcaauaa

SEQ ID NO: 773802 - RNA, 21 nt, Human
uagauacccuaacaagaguuu

SEQ ID NO: 773803 - RNA, 21 nt, Human
uagcuaagcuuccuaguaauu

SEQ ID NO: 773804 - RNA, 21 nt, Human
uaggagagguuuuacuggaaa

SEQ ID NO: 773805 - RNA, 21 nt, Human
uauaaagcauaauaaauuuua

SEQ ID NO: 773806 - RNA, 19 nt, Human
uauacauauacacauauau

SEQ ID NO: 773807 - RNA, 20 nt, Human
uauacauauacacauauaua

SEQ ID NO: 773808 - RNA, 22 nt, Human
uauauauauguguauacauaua

SEQ ID NO: 773809 - RNA, 24 nt, Human
uauauauauguguguguguauaua

SEQ ID NO: 773810 - RNA, 18 nt, Human
uauauauguguauacaua

SEQ ID NO: 773811 - RNA, 20 nt, Human
uauaucuuauagacucaaaa

SEQ ID NO: 773812 - RNA, 21 nt, Human
uauaucuuauagacucaaaau

SEQ ID NO: 773813 - RNA, 22 nt, Human
uauauguguauacauauacaca

SEQ ID NO: 773814 - RNA, 18 nt, Human
uauguguauacauauaca

SEQ ID NO: 773815 - RNA, 22 nt, Human
uauguguauacauauacacaua

SEQ ID NO: 773816 - RNA, 26 nt, Human
uauguguauacauauacacauauaua

SEQ ID NO: 773817 - RNA, 23 nt, Human
uauguguguguguauauauaugu

SEQ ID NO: 773818 - RNA, 21 nt, Human
uauugaaagaauaaaguacag

SEQ ID NO: 773819 - RNA, 22 nt, Human
uauuggccuuuuaaaagacaaa

SEQ ID NO: 773820 - RNA, 19 nt, Human
ucacagguucacacuucca

SEQ ID NO: 773821 - RNA, 21 nt, Human
ucagcucccacggccaccccc

SEQ ID NO: 773822 - RNA, 21 nt, Human
uccauauucagaaaacaagca

SEQ ID NO: 773823 - RNA, 19 nt, Human
ugaaagaauaaaguacagg

SEQ ID NO: 773824 - RNA, 21 nt, Human
ugaaauaguacauacuagaug

SEQ ID NO: 773825 - RNA, 24 nt, Human
ugaaauuuuuuuguauuaacuucc

SEQ ID NO: 773826 - RNA, 22 nt, Human
ugaauguaaauuaaauuccagu

SEQ ID NO: 773827 - RNA, 21 nt, Human
ugaggcacuauuaagcugaga

SEQ ID NO: 773828 - RNA, 23 nt, Human
ugagucuaagagccagaaacuaa

SEQ ID NO: 773829 - RNA, 22 nt, Human
ugcagcuucccaucugaaaauc

SEQ ID NO: 773830 - RNA, 26 nt, Human
ugcagcuucccaucugaaaaucccua

SEQ ID NO: 773831 - RNA, 19 nt, Human
ugccacaaacacauuucca

SEQ ID NO: 773832 - RNA, 19 nt, Human
uggcuccugcccuuacccc

SEQ ID NO: 773833 - RNA, 18 nt, Human
uguaagcaaaaaccaccc

SEQ ID NO: 773834 - RNA, 22 nt, Human
uguauacauauacacauauaua

SEQ ID NO: 773835 - RNA, 18 nt, Human
uguauauauauguguaua

SEQ ID NO: 773836 - RNA, 21 nt, Human
uguauauauauguguauacau

SEQ ID NO: 773837 - RNA, 24 nt, Human
uguauauauauguguauacauaua

SEQ ID NO: 773838 - RNA, 18 nt, Human
ugugcaaaacaaaugaaa

SEQ ID NO: 773839 - RNA, 19 nt, Human
ugugcaaaacaaaugaaau

SEQ ID NO: 773840 - RNA, 18 nt, Human
uguguauauauaugugua

SEQ ID NO: 773841 - RNA, 20 nt, Human
uguguauauauauguguaua

SEQ ID NO: 773842 - RNA, 22 nt, Human
uguguauauauauguguauaca

SEQ ID NO: 773843 - RNA, 24 nt, Human
uguguauauauauguguauacaua

SEQ ID NO: 773844 - RNA, 22 nt, Human
uguguguguauauauaugugua

SEQ ID NO: 773845 - RNA, 23 nt, Human
uguguguguauauauauguguau

SEQ ID NO: 773846 - RNA, 22 nt, Human
uguguguguguauauauaugug

SEQ ID NO: 773847 - RNA, 25 nt, Human
uguguguguguauauauauguguca

SEQ ID NO: 773848 - RNA, 20 nt, Human
uguuuuugccuuaaaauuca

SEQ ID NO: 773849 - RNA, 18 nt, Human
uuaaaagauaaaauacca

SEQ ID NO: 773850 - RNA, 22 nt, Human
uuacaaguuaauccuaaaguca

SEQ ID NO: 773851 - RNA, 19 nt, Human
uuagaaggcaugucuaaaa

SEQ ID NO: 773852 - RNA, 25 nt, Human
uuagcagguaaaaaucugugaacaa

SEQ ID NO: 773853 - RNA, 21 nt, Human
uucaagggguguaacacaggu

SEQ ID NO: 773854 - RNA, 22 nt, Human
uuccugcagccgcggucucccg

SEQ ID NO: 773855 - RNA, 23 nt, Human
uugaaaauaacauucugauuccc

SEQ ID NO: 773856 - RNA, 19 nt, Human
uuuccauaacuugaaaaug

SEQ ID NO: 773857 - RNA, 28 nt, Human
uuugcauaucucaguucaggauauguuu

SEQ ID NO: 773858 - RNA, 18 nt, Human
aaaacacagaaaccugug

SEQ ID NO: 773859 - RNA, 19 nt, Human
aaaacacagaaaccugugg

SEQ ID NO: 773860 - RNA, 19 nt, Human
aacacacaaaagcuaaaag

SEQ ID NO: 773861 - RNA, 23 nt, Human
aagcaaaacacagaaaccugugg

SEQ ID NO: 773862 - RNA, 25 nt, Human
aagcaaaacacagaaaccuguggca

SEQ ID NO: 773863 - RNA, 21 nt, Human
aaggaccugguaucggcuuua

SEQ ID NO: 773864 - RNA, 24 nt, Human
acacacaaaagcuaaaaggcaccc

SEQ ID NO: 773865 - RNA, 20 nt, Human
acagaaaccuguggcauggg

SEQ ID NO: 773866 - RNA, 21 nt, Human
acagacacugaaauaccaccc

SEQ ID NO: 773867 - RNA, 19 nt, Human
acagcuuuggacguggccg

SEQ ID NO: 773868 - RNA, 22 nt, Human
accuacuucugcaccaaccgcu

SEQ ID NO: 773869 - RNA, 22 nt, Human
acgcccauuucaacacacaaaa

SEQ ID NO: 773870 - RNA, 22 nt, Human
acuccagcccaggugacagagc

SEQ ID NO: 773871 - RNA, 24 nt, Human
acuggacuccagcccaggugacag

SEQ ID NO: 773872 - RNA, 23 nt, Human
agagaggaagaggacaaagccag

SEQ ID NO: 773873 - RNA, 20 nt, Human
agaucacaucccagggccca

SEQ ID NO: 773874 - RNA, 19 nt, Human
agcgaggagcugaggaggg

SEQ ID NO: 773875 - RNA, 21 nt, Human
aggcccccccaccucggggcc

SEQ ID NO: 773876 - RNA, 21 nt, Human
agggagcgucucucugugcug

SEQ ID NO: 773877 - RNA, 24 nt, Human
aggggcacaguucuauugccacca

SEQ ID NO: 773878 - RNA, 24 nt, Human
agggguuggaggcuacagugagcu

SEQ ID NO: 773879 - RNA, 25 nt, Human
agggguuggaggcuacagugagcua

SEQ ID NO: 773880 - RNA, 19 nt, Human
aguguaaucuguggccgcc

SEQ ID NO: 773881 - RNA, 23 nt, Human
aucacgccacuggacuccagccc

SEQ ID NO: 773882 - RNA, 21 nt, Human
caaaacacagaaaccuguggc

SEQ ID NO: 773883 - RNA, 24 nt, Human
caaaacacagaaaccuguggcaug

SEQ ID NO: 773884 - RNA, 19 nt, Human
caauaaaguucccucucug

SEQ ID NO: 773885 - RNA, 21 nt, Human
cacacaaaagcuaaaaggcac

SEQ ID NO: 773886 - RNA, 22 nt, Human
cacacaaaagcuaaaaggcacc

SEQ ID NO: 773887 - RNA, 23 nt, Human
caccaggcugugccccuggccgc

SEQ ID NO: 773888 - RNA, 18 nt, Human
caccuuuagaagcugucc

SEQ ID NO: 773889 - RNA, 24 nt, Human
cacuggacuccagcccaggugaca

SEQ ID NO: 773890 - RNA, 22 nt, Human
cagggcaaggugguuauaaacc

SEQ ID NO: 773891 - RNA, 21 nt, Human
cagggguuggaggcuacagug

SEQ ID NO: 773892 - RNA, 19 nt, Human
cagucgacuggauccaggu

SEQ ID NO: 773893 - RNA, 22 nt, Human
caucggccccacuuccugccuc

SEQ ID NO: 773894 - RNA, 22 nt, Human
cauuccacgaaguggucugggu

SEQ ID NO: 773895 - RNA, 24 nt, Human
ccaccaggcugugccccuggccgc

SEQ ID NO: 773896 - RNA, 19 nt, Human
ccaccucggggccuugacu

SEQ ID NO: 773897 - RNA, 20 nt, Human
ccacuggacuccagcccagg

SEQ ID NO: 773898 - RNA, 20 nt, Human
ccacuggacuccagcccagg

SEQ ID NO: 773899 - RNA, 21 nt, Human
ccacuggacuccagcccaggu

SEQ ID NO: 773900 - RNA, 24 nt, Human
ccacuggacuccagcccaggugac

SEQ ID NO: 773901 - RNA, 21 nt, Human
ccagcccacaugaggggcaag

SEQ ID NO: 773902 - RNA, 22 nt, Human
ccagcccaggugacagagccuc

SEQ ID NO: 773903 - RNA, 18 nt, Human
ccagugggugccacuugg

SEQ ID NO: 773904 - RNA, 19 nt, Human
cccacagagcucacagccu

SEQ ID NO: 773905 - RNA, 22 nt, Human
cccacuuccugccucaugcccc

SEQ ID NO: 773906 - RNA, 23 nt, Human
cccccaccucggggccuugacuc

SEQ ID NO: 773907 - RNA, 21 nt, Human
ccccggggugcugcuggcccc

SEQ ID NO: 773908 - RNA, 25 nt, Human
ccccuggccgccagugggugccacu

SEQ ID NO: 773909 - RNA, 23 nt, Human
ccgcacccccaccccucaccaaa

SEQ ID NO: 773910 - RNA, 24 nt, Human
ccggcacuggcuaacugagcucug

SEQ ID NO: 773911 - RNA, 23 nt, Human
ccuccagagaggaagaggacaaa

SEQ ID NO: 773912 - RNA, 21 nt, Human
ccuggggaggaagaagggccc

SEQ ID NO: 773913 - RNA, 23 nt, Human
cgccagugggugccacuugggug

SEQ ID NO: 773914 - RNA, 19 nt, Human
cgcucuggacagggccgag

SEQ ID NO: 773915 - RNA, 23 nt, Human
cgggggaaucacagugagucuca

SEQ ID NO: 773916 - RNA, 21 nt, Human
cuaaagcaaaacacagaaacc

SEQ ID NO: 773917 - RNA, 18 nt, Human
cuccccugggcagacccc

SEQ ID NO: 773918 - RNA, 18 nt, Human
cuccuacaggguaccaug

SEQ ID NO: 773919 - RNA, 24 nt, Human
cuccuguaguuccagcugcuuggg

SEQ ID NO: 773920 - RNA, 20 nt, Human
cugaggaggggcacaguucu

SEQ ID NO: 773921 - RNA, 18 nt, Human
cuggaauaggccccccca

SEQ ID NO: 773922 - RNA, 25 nt, Human
cuggccaaaaccagguccuuucuca

SEQ ID NO: 773923 - RNA, 20 nt, Human
cuggggaggaagaagggccc

SEQ ID NO: 773924 - RNA, 22 nt, Human
cugggggcugcugggcggcggg

SEQ ID NO: 773925 - RNA, 22 nt, Human
cuggugugagcagagccaggga

SEQ ID NO: 773926 - RNA, 24 nt, Human
cuugucugucuuuuuucuuccugu

SEQ ID NO: 773927 - RNA, 23 nt, Human
cuugugaagggccuucuggagcc

SEQ ID NO: 773928 - RNA, 21 nt, Human
cuuuuaguaaugugcuagaaa

SEQ ID NO: 773929 - RNA, 18 nt, Human
gaagcaguagcagugaca

SEQ ID NO: 773930 - RNA, 24 nt, Human
gacaaagccagucugacucccggg

SEQ ID NO: 773931 - RNA, 19 nt, Human
gaccugguggccgcacccc

SEQ ID NO: 773932 - RNA, 25 nt, Human
gaggaagaagggcccaggcgaggcc

SEQ ID NO: 773933 - RNA, 23 nt, Human
gaggcuacagugagcuaugauca

SEQ ID NO: 773934 - RNA, 24 nt, Human
gaucacuugagcccagggguugga

SEQ ID NO: 773935 - RNA, 22 nt, Human
gaugcucaggucagagacucac

SEQ ID NO: 773936 - RNA, 19 nt, Human
gcccaggugacagagccuc

SEQ ID NO: 773937 - RNA, 18 nt, Human
gccgcagggagagggggc

SEQ ID NO: 773938 - RNA, 19 nt, Human
gcggcugccugggggcugc

SEQ ID NO: 773939 - RNA, 22 nt, Human
gcugaguugucgcugcugcucu

SEQ ID NO: 773940 - RNA, 19 nt, Human
ggcccagaugcucagguca

SEQ ID NO: 773941 - RNA, 21 nt, Human
ggcccccccaccucggggccu

SEQ ID NO: 773942 - RNA, 23 nt, Human
ggccgcagggagagggggcggga

SEQ ID NO: 773943 - RNA, 19 nt, Human
ggccggggccacggggcug

SEQ ID NO: 773944 - RNA, 19 nt, Human
ggcugugccccuggccgcc

SEQ ID NO: 773945 - RNA, 23 nt, Human
gggaagcgaggagcugaggaggg

SEQ ID NO: 773946 - RNA, 22 nt, Human
gggaggaucacuugagcccagg

SEQ ID NO: 773947 - RNA, 19 nt, Human
gggccgagaucccacuccu

SEQ ID NO: 773948 - RNA, 21 nt, Human
gggccgcagggagagggggcg

SEQ ID NO: 773949 - RNA, 23 nt, Human
gggcugcugggcggcgggggcug

SEQ ID NO: 773950 - RNA, 20 nt, Human
ggggaggaucacuugagccc

SEQ ID NO: 773951 - RNA, 24 nt, Human
ggggcugcugggcggcgggggcug

SEQ ID NO: 773952 - RNA, 18 nt, Human
gggguuggaggcuacagu

SEQ ID NO: 773953 - RNA, 24 nt, Human
gggugggaggcuugcagagccaag

SEQ ID NO: 773954 - RNA, 23 nt, Human
gguaccauggugggaggaggggu

SEQ ID NO: 773955 - RNA, 18 nt, Human
gguauuugucagguccug

SEQ ID NO: 773956 - RNA, 22 nt, Human
ggugcugcuggccccuccacgu

SEQ ID NO: 773957 - RNA, 18 nt, Human
gguggcgacguuaacuga

SEQ ID NO: 773958 - RNA, 20 nt, Human
gucuggguugcagacaucgg

SEQ ID NO: 773959 - RNA, 21 nt, Human
gugcacacgugugaaggaccu

SEQ ID NO: 773960 - RNA, 25 nt, Human
guggcaugggccgcagggagagggg

SEQ ID NO: 773961 - RNA, 24 nt, Human
uaaaaggcacccaauugugcaaua

SEQ ID NO: 773962 - RNA, 18 nt, Human
uaaagcaaaacacagaaa

SEQ ID NO: 773963 - RNA, 22 nt, Human
uaaagcaaaacacagaaaccug

SEQ ID NO: 773964 - RNA, 25 nt, Human
uaaagcaaaacacagaaaccugugg

SEQ ID NO: 773965 - RNA, 19 nt, Human
uaaccucaaugacaagggc

SEQ ID NO: 773966 - RNA, 21 nt, Human
uaaccucaaugacaagggcac

SEQ ID NO: 773967 - RNA, 21 nt, Human
uagauccugggcacugguccc

SEQ ID NO: 773968 - RNA, 18 nt, Human
uaggaaacaaaccaccag

SEQ ID NO: 773969 - RNA, 22 nt, Human
uaggaagagcucagaccuggug

SEQ ID NO: 773970 - RNA, 23 nt, Human
uaucacagacacugaaauaccac

SEQ ID NO: 773971 - RNA, 21 nt, Human
uaugugcauauacgugaguau

SEQ ID NO: 773972 - RNA, 22 nt, Human
uaugugcauauacgugaguaug

SEQ ID NO: 773973 - RNA, 23 nt, Human
ucaacacacaaaagcuaaaaggc

SEQ ID NO: 773974 - RNA, 24 nt, Human
ucaauaauguguugcuuucccaaa

SEQ ID NO: 773975 - RNA, 27 nt, Human
ucacagacacugaaauaccacccugga

SEQ ID NO: 773976 - RNA, 22 nt, Human
ucagguccuggccaaaaccagg

SEQ ID NO: 773977 - RNA, 19 nt, Human
uccacaguaggaagagcuc

SEQ ID NO: 773978 - RNA, 20 nt, Human
ucccagggcccacagagcuc

SEQ ID NO: 773979 - RNA, 21 nt, Human
ucccuaaagcaaaacacagaa

SEQ ID NO: 773980 - RNA, 22 nt, Human
ucccuaaagcaaaacacagaaa

SEQ ID NO: 773981 - RNA, 22 nt, Human
uccuccggguucugggucccca

SEQ ID NO: 773982 - RNA, 22 nt, Human
uccuggaauaggcccccccacc

SEQ ID NO: 773983 - RNA, 24 nt, Human
ucgcugcugcucuugcucccuggc

SEQ ID NO: 773984 - RNA, 19 nt, Human
ucggccccacuuccugccu

SEQ ID NO: 773985 - RNA, 19 nt, Human
ucggccccacuuccugccu

SEQ ID NO: 773986 - RNA, 18 nt, Human
ucucugugaaagggaggg

SEQ ID NO: 773987 - RNA, 21 nt, Human
ucucugugaaagggagggggu

SEQ ID NO: 773988 - RNA, 21 nt, Human
ucucugugcuguucgcuccug

SEQ ID NO: 773989 - RNA, 18 nt, Human
ucuggacagggccgagau

SEQ ID NO: 773990 - RNA, 23 nt, Human
ucuggaguuaaggaagacagggc

SEQ ID NO: 773991 - RNA, 19 nt, Human
ucugucuuuuuucuuccug

SEQ ID NO: 773992 - RNA, 22 nt, Human
ugacaucaaggaugagagggca

SEQ ID NO: 773993 - RNA, 21 nt, Human
ugagcagagccagggagggug

SEQ ID NO: 773994 - RNA, 19 nt, Human
ugagcuagaucacauccca

SEQ ID NO: 773995 - RNA, 24 nt, Human
ugagcucuggccacaugggcccag

SEQ ID NO: 773996 - RNA, 18 nt, Human
ugcaccaaccgcuccugc

SEQ ID NO: 773997 - RNA, 19 nt, Human
ugccugggggcugcugggc

SEQ ID NO: 773998 - RNA, 24 nt, Human
ugcuauggaaaucucuggugugag

SEQ ID NO: 773999 - RNA, 21 nt, Human
ugcuccucauaccacuccugu

SEQ ID NO: 774000 - RNA, 20 nt, Human
ugcugcugaguugucgcugc

SEQ ID NO: 774001 - RNA, 18 nt, Human
ugcugcuggccccuccac

SEQ ID NO: 774002 - RNA, 19 nt, Human
ugcugggcggcgggggcug

SEQ ID NO: 774003 - RNA, 18 nt, Human
ugcuggguggggccaggc

SEQ ID NO: 774004 - RNA, 24 nt, Human
ugcuggguggggccaggcauaacc

SEQ ID NO: 774005 - RNA, 19 nt, Human
uggaauaggcccccccacc

SEQ ID NO: 774006 - RNA, 21 nt, Human
uggacagggccgagaucccac

SEQ ID NO: 774007 - RNA, 19 nt, Human
uggauccaggugagggguc

SEQ ID NO: 774008 - RNA, 19 nt, Human
uggcaugcuccucauacca

SEQ ID NO: 774009 - RNA, 21 nt, Human
uggcaugggccgcagggagag

SEQ ID NO: 774010 - RNA, 25 nt, Human
uggccaaaaccagguccuuucucag

SEQ ID NO: 774011 - RNA, 24 nt, Human
uggccccuccacguuuccaccccu

SEQ ID NO: 774012 - RNA, 19 nt, Human
uggccgcacccccaccccu

SEQ ID NO: 774013 - RNA, 26 nt, Human
uggccgcacccccaccccucaccaaa

SEQ ID NO: 774014 - RNA, 24 nt, Human
uggcuggacucccgucuguugaca

SEQ ID NO: 774015 - RNA, 25 nt, Human
ugggagcgcuggcggcugccugggg

SEQ ID NO: 774016 - RNA, 18 nt, Human
ugggaggggaagcgagga

SEQ ID NO: 774017 - RNA, 18 nt, Human
uggggaggaagaagggcc

SEQ ID NO: 774018 - RNA, 20 nt, Human
uggggccaggcauaaccugg

SEQ ID NO: 774019 - RNA, 21 nt, Human
uggucaagagcccauuccacg

SEQ ID NO: 774020 - RNA, 20 nt, Human
ugguggaguaaggcuggggc

SEQ ID NO: 774021 - RNA, 20 nt, Human
uggugugagcagagccaggg

SEQ ID NO: 774022 - RNA, 23 nt, Human
uggugugagcagagccagggagg

SEQ ID NO: 774023 - RNA, 22 nt, Human
ugugaagggccuucuggagccu

SEQ ID NO: 774024 - RNA, 20 nt, Human
ugugagccugaagcaguagc

SEQ ID NO: 774025 - RNA, 24 nt, Human
ugugcauauacgugaguaugugua

SEQ ID NO: 774026 - RNA, 21 nt, Human
ugugcuagaaauccagagaca

SEQ ID NO: 774027 - RNA, 27 nt, Human
uguguacacacaccgcaguuccguaca

SEQ ID NO: 774028 - RNA, 24 nt, Human
uuaaccaaaacguuguuuugcuug

SEQ ID NO: 774029 - RNA, 20 nt, Human
uucuggaguuaaggaagaca

SEQ ID NO: 774030 - RNA, 19 nt, Human
uugcucccuggcaugcucc

SEQ ID NO: 774031 - RNA, 26 nt, Human
uuggguaggcugaguggggaggauca

SEQ ID NO: 774032 - RNA, 24 nt, Human
uuucuuccuguauauaaauaugug

SEQ ID NO: 774033 - RNA, 22 nt, Human
uuuuuuuuuuuuacaaagcaga

SEQ ID NO: 774034 - RNA, 24 nt, Human
uuuuuuuuuuuuuuuuuuacaaag

SEQ ID NO: 774035 - RNA, 23 nt, Human
aaaaaaaaaaaaaaaaaaagcau

SEQ ID NO: 774036 - RNA, 21 nt, Human
aaaaaaaaaaaaaaaagcaua

SEQ ID NO: 774037 - RNA, 27 nt, Human
aaaaaaaaaaaaagcauaugauccuaa

SEQ ID NO: 774038 - RNA, 23 nt, Human
aaaaaaacacuuuacacaacaca

SEQ ID NO: 774039 - RNA, 24 nt, Human
aaaaaaugaauuagaugaaaagga

SEQ ID NO: 774040 - RNA, 18 nt, Human
aaaagagaaauauaaaga

SEQ ID NO: 774041 - RNA, 18 nt, Human
aaagaggcaaaauccaaa

SEQ ID NO: 774042 - RNA, 18 nt, Human
aaauguuaaagcuuagca

SEQ ID NO: 774043 - RNA, 22 nt, Human
aacacuuuacacaacacacuuu

SEQ ID NO: 774044 - RNA, 18 nt, Human
aacauggugaaacccugu

SEQ ID NO: 774045 - RNA, 20 nt, Human
aacauggugaaacccuguuu

SEQ ID NO: 774046 - RNA, 21 nt, Human
aacauggugaaacccuguuuc

SEQ ID NO: 774047 - RNA, 19 nt, Human
aagaagaaaacuuucuccc

SEQ ID NO: 774048 - RNA, 18 nt, Human
aagcaaauuuugacuaua

SEQ ID NO: 774049 - RNA, 23 nt, Human
aagcacaaagaggcaaaauccaa

SEQ ID NO: 774050 - RNA, 22 nt, Human
aagcaggaaaagguccuaccaa

SEQ ID NO: 774051 - RNA, 24 nt, Human
aagcaggaaaagguccuaccaaag

SEQ ID NO: 774052 - RNA, 24 nt, Human
aaucgcuugaacccgggaggcgga

SEQ ID NO: 774053 - RNA, 18 nt, Human
aauuagccaggcauggug

SEQ ID NO: 774054 - RNA, 20 nt, Human
acaagagcgaaacucugucu

SEQ ID NO: 774055 - RNA, 21 nt, Human
acaagagcgaaacucugucuc

SEQ ID NO: 774056 - RNA, 19 nt, Human
acagaaugaggaaaaaaac

SEQ ID NO: 774057 - RNA, 21 nt, Human
acauguauaguaaaaaagcuu

SEQ ID NO: 774058 - RNA, 24 nt, Human
acccuguuucuacuaaaaauacaa

SEQ ID NO: 774059 - RNA, 28 nt, Human
acucugucucaaaaaaaaaaaaaaaaaa

SEQ ID NO: 774060 - RNA, 20 nt, Human
acugggcacccaacugaccc

SEQ ID NO: 774061 - RNA, 20 nt, Human
agaaaaagaaaaaugguaag

SEQ ID NO: 774062 - RNA, 22 nt, Human
agaaucgcuugaacccgggagg

SEQ ID NO: 774063 - RNA, 18 nt, Human
agagcgaaacucugucuc

SEQ ID NO: 774064 - RNA, 22 nt, Human
agagcgaaacucugucucaaaa

SEQ ID NO: 774065 - RNA, 20 nt, Human
agcacccugggagguggagg

SEQ ID NO: 774066 - RNA, 23 nt, Human
agccaggcaugguggugcgugcc

SEQ ID NO: 774067 - RNA, 22 nt, Human
agccuggcuaacauggugaaac

SEQ ID NO: 774068 - RNA, 24 nt, Human
agccuggcuaacauggugaaaccc

SEQ ID NO: 774069 - RNA, 24 nt, Human
aggcaggagaaucgcuugaacccg

SEQ ID NO: 774070 - RNA, 24 nt, Human
aggcaugguggugcgugccuguaa

SEQ ID NO: 774071 - RNA, 24 nt, Human
aggcggagguugcagugagccgag

SEQ ID NO: 774072 - RNA, 22 nt, Human
aggcgggcggaucaccugaggu

SEQ ID NO: 774073 - RNA, 26 nt, Human
aggcgggcggaucaccugaggucagg

SEQ ID NO: 774074 - RNA, 20 nt, Human
aggcugaggcaggagaaucg

SEQ ID NO: 774075 - RNA, 24 nt, Human
aggcugaggcaggagaaucgcuug

SEQ ID NO: 774076 - RNA, 21 nt, Human
agguggaggcgggcggaucac

SEQ ID NO: 774077 - RNA, 20 nt, Human
agugcaguggcaugaucucg

SEQ ID NO: 774078 - RNA, 23 nt, Human
agugcaguggcaugaucucggcu

SEQ ID NO: 774079 - RNA, 24 nt, Human
agugcaguggcaugaucucggcuc

SEQ ID NO: 774080 - RNA, 24 nt, Human
aguggcaugaucucggcucacugc

SEQ ID NO: 774081 - RNA, 20 nt, Human
auaaagccuccuguaguuaa

SEQ ID NO: 774082 - RNA, 24 nt, Human
aucaccugaggucaggaguuugag

SEQ ID NO: 774083 - RNA, 24 nt, Human
aucgugccauugcacuccagcuug

SEQ ID NO: 774084 - RNA, 23 nt, Human
aucugcacugagaaguaaccuuc

SEQ ID NO: 774085 - RNA, 22 nt, Human
augaaaugugcaauacuuuuaa

SEQ ID NO: 774086 - RNA, 21 nt, Human
augauccuaacuaaaucagaa

SEQ ID NO: 774087 - RNA, 24 nt, Human
auggagugcaguggcaugaucucg

SEQ ID NO: 774088 - RNA, 24 nt, Human
augugcaauacuuuuaaguagaga

SEQ ID NO: 774089 - RNA, 18 nt, Human
auuccuaaccacauacau

SEQ ID NO: 774090 - RNA, 18 nt, Human
auugcacuccagcuuggg

SEQ ID NO: 774091 - RNA, 19 nt, Human
caaauuuccucuuuuagag

SEQ ID NO: 774092 - RNA, 23 nt, Human
caacaagagcgaaacucugucuc

SEQ ID NO: 774093 - RNA, 21 nt, Human
caaguggacauaccaucugaa

SEQ ID NO: 774094 - RNA, 24 nt, Human
cacaccuguaaucccagcacccug

SEQ ID NO: 774095 - RNA, 23 nt, Human
caccugaggucaggaguuugagg

SEQ ID NO: 774096 - RNA, 21 nt, Human
caccuguaaucccagcacccu

SEQ ID NO: 774097 - RNA, 23 nt, Human
caccuguaaucccagcacccugg

SEQ ID NO: 774098 - RNA, 24 nt, Human
caccuguaaucccagcacccuggg

SEQ ID NO: 774099 - RNA, 24 nt, Human
cacuccagcuugggcaacaagagc

SEQ ID NO: 774100 - RNA, 25 nt, Human
cacuccagcuugggcaacaagagcg

SEQ ID NO: 774101 - RNA, 24 nt, Human
cagcuccuugggaggcugaggcag

SEQ ID NO: 774102 - RNA, 21 nt, Human
cagugugagcaagaagaaaac

SEQ ID NO: 774103 - RNA, 24 nt, Human
cauaaaaaauucaguagugccuaa

SEQ ID NO: 774104 - RNA, 19 nt, Human
caugacacuuugaaacugc

SEQ ID NO: 774105 - RNA, 18 nt, Human
cauugcacuccagcuugg

SEQ ID NO: 774106 - RNA, 19 nt, Human
cauugcacuccagcuuggg

SEQ ID NO: 774107 - RNA, 21 nt, Human
cauugcacuccagcuugggca

SEQ ID NO: 774108 - RNA, 24 nt, Human
cauugcacuccagcuugggcaaca

SEQ ID NO: 774109 - RNA, 20 nt, Human
ccaaaagauuuccaaggcca

SEQ ID NO: 774110 - RNA, 25 nt, Human
ccaacugaccccagggcaaguugau

SEQ ID NO: 774111 - RNA, 19 nt, Human
ccacauacaugguuuauau

SEQ ID NO: 774112 - RNA, 20 nt, Human
ccauugcacuccagcuuggg

SEQ ID NO: 774113 - RNA, 21 nt, Human
ccauugcacuccagcuugggc

SEQ ID NO: 774114 - RNA, 23 nt, Human
ccauugcacuccagcuugggcaa

SEQ ID NO: 774115 - RNA, 24 nt, Human
ccauugcacuccagcuugggcaac

SEQ ID NO: 774116 - RNA, 18 nt, Human
cccccagaagagcccuga

SEQ ID NO: 774117 - RNA, 19 nt, Human
cccugggagguggaggcgg

SEQ ID NO: 774118 - RNA, 21 nt, Human
ccuaaguugggggagaggggc

SEQ ID NO: 774119 - RNA, 24 nt, Human
ccuaaguugggggagaggggcaac

SEQ ID NO: 774120 - RNA, 22 nt, Human
ccuggcuaacauggugaaaccc

SEQ ID NO: 774121 - RNA, 24 nt, Human
ccuggcuaacauggugaaacccug

SEQ ID NO: 774122 - RNA, 18 nt, Human
ccuguaaucccagcuccu

SEQ ID NO: 774123 - RNA, 19 nt, Human
ccuguaaucccagcuccuu

SEQ ID NO: 774124 - RNA, 21 nt, Human
ccuguaaucccagcuccuugg

SEQ ID NO: 774125 - RNA, 24 nt, Human
cgagaucgugccauugcacuccag

SEQ ID NO: 774126 - RNA, 24 nt, Human
cggaucaccugaggucaggaguuu

SEQ ID NO: 774127 - RNA, 24 nt, Human
cgggaggcggagguugcagugagc

SEQ ID NO: 774128 - RNA, 24 nt, Human
cgggcggaucaccugaggucagga

SEQ ID NO: 774129 - RNA, 24 nt, Human
cgugccuguaaucccagcuccuug

SEQ ID NO: 774130 - RNA, 21 nt, Human
cuaaaauaaucuuagagcuaa

SEQ ID NO: 774131 - RNA, 23 nt, Human
cucaaaaaaaaaaaaaaaaaaaa

SEQ ID NO: 774132 - RNA, 21 nt, Human
cucaaaucauauuaaaaucau

SEQ ID NO: 774133 - RNA, 19 nt, Human
cucacaccuguaaucccag

SEQ ID NO: 774134 - RNA, 24 nt, Human
cucacaccuguaaucccagcaccc

SEQ ID NO: 774135 - RNA, 19 nt, Human
cuccuugggaggcugaggc

SEQ ID NO: 774136 - RNA, 19 nt, Human
cucugucucaaaaaaaaaa

SEQ ID NO: 774137 - RNA, 22 nt, Human
cugcuggucagcggcuccccuc

SEQ ID NO: 774138 - RNA, 24 nt, Human
cuggcuaacauggugaaacccugu

SEQ ID NO: 774139 - RNA, 27 nt, Human
cuguagauuaauuuacaggaguugugc

SEQ ID NO: 774140 - RNA, 20 nt, Human
cuuaacauucuccaagaccu

SEQ ID NO: 774141 - RNA, 24 nt, Human
cuugcaccaucuuuaggcccaaga

SEQ ID NO: 774142 - RNA, 19 nt, Human
gaaacccuguuucuacuaa

SEQ ID NO: 774143 - RNA, 25 nt, Human
gaggcgggcggaucaccugagguca

SEQ ID NO: 774144 - RNA, 23 nt, Human
gagguugcagugagccgagaucg

SEQ ID NO: 774145 - RNA, 24 nt, Human
gaucaccugaggucaggaguuuga

SEQ ID NO: 774146 - RNA, 24 nt, Human
gaucacgaccacaaguggacauac

SEQ ID NO: 774147 - RNA, 22 nt, Human
gcacaaagaggcaaaauccaaa

SEQ ID NO: 774148 - RNA, 23 nt, Human
gcaggaaaagguccuaccaaaga

SEQ ID NO: 774149 - RNA, 22 nt, Human
gccauugcacuccagcuugggc

SEQ ID NO: 774150 - RNA, 24 nt, Human
gccauugcacuccagcuugggcaa

SEQ ID NO: 774151 - RNA, 24 nt, Human
gcccaagagcccccagaagagccc

SEQ ID NO: 774152 - RNA, 25 nt, Human
gcccaagagcccccagaagagcccu

SEQ ID NO: 774153 - RNA, 24 nt, Human
gcuaacauggugaaacccuguuuc

SEQ ID NO: 774154 - RNA, 19 nt, Human
gcucuuuaaaaauggcaga

SEQ ID NO: 774155 - RNA, 19 nt, Human
gcugggcaugguggcucac

SEQ ID NO: 774156 - RNA, 20 nt, Human
ggaggcgggcggaucaccug

SEQ ID NO: 774157 - RNA, 20 nt, Human
ggagguugcagugagccgag

SEQ ID NO: 774158 - RNA, 22 nt, Human
ggagguugcagugagccgagau

SEQ ID NO: 774159 - RNA, 24 nt, Human
ggagguugcagugagccgagaucg

SEQ ID NO: 774160 - RNA, 22 nt, Human
ggaucaccugaggucaggaguu

SEQ ID NO: 774161 - RNA, 22 nt, Human
ggaucaccugaggucaggaguu

SEQ ID NO: 774162 - RNA, 25 nt, Human
ggaucaccugaggucaggaguuuga

SEQ ID NO: 774163 - RNA, 23 nt, Human
ggcaugguggcucacaccuguaa

SEQ ID NO: 774164 - RNA, 21 nt, Human
ggcggaucaccugaggucagg

SEQ ID NO: 774165 - RNA, 24 nt, Human
gguggcucacaccuguaaucccag

SEQ ID NO: 774166 - RNA, 24 nt, Human
gguggugcgugccuguaaucccag

SEQ ID NO: 774167 - RNA, 22 nt, Human
guaaauaaauacaaaauguuaa

SEQ ID NO: 774168 - RNA, 30 nt, Human
guagauuaauuuacaggaguugugcucagg

SEQ ID NO: 774169 - RNA, 23 nt, Human
guagccaagacuaaagcaggaaa

SEQ ID NO: 774170 - RNA, 23 nt, Human
guggcucacaccuguaaucccag

SEQ ID NO: 774171 - RNA, 24 nt, Human
guggugcgugccuguaaucccagc

SEQ ID NO: 774172 - RNA, 19 nt, Human
guucuuguugcccaggaug

SEQ ID NO: 774173 - RNA, 24 nt, Human
guugcagugagccgagaucgugcc

SEQ ID NO: 774174 - RNA, 23 nt, Human
uaaaagagaaauauaaagaggcu

SEQ ID NO: 774175 - RNA, 19 nt, Human
uaacaugcaguauugaggg

SEQ ID NO: 774176 - RNA, 19 nt, Human
uaacauggugaaacccugu

SEQ ID NO: 774177 - RNA, 21 nt, Human
uaacauggugaaacccuguuu

SEQ ID NO: 774178 - RNA, 24 nt, Human
uaacauggugaaacccuguuucua

SEQ ID NO: 774179 - RNA, 19 nt, Human
uaaguugggggagaggggc

SEQ ID NO: 774180 - RNA, 18 nt, Human
uaaucaacacugcagaaa

SEQ ID NO: 774181 - RNA, 21 nt, Human
uaaucaccauuggagacuggu

SEQ ID NO: 774182 - RNA, 24 nt, Human
uacaaaauguuaaagcuuagcaua

SEQ ID NO: 774183 - RNA, 25 nt, Human
uacaaauuauuuuaaaaaguuucau

SEQ ID NO: 774184 - RNA, 23 nt, Human
uacacaaggaaauaauuuucaca

SEQ ID NO: 774185 - RNA, 23 nt, Human
uagcauacuucugugccucaaaa

SEQ ID NO: 774186 - RNA, 24 nt, Human
uagguaaaauuuacaaauuauuuu

SEQ ID NO: 774187 - RNA, 23 nt, Human
ucaaaaaaaaaaaaaaaaaaaaa

SEQ ID NO: 774188 - RNA, 21 nt, Human
ucacugcaacccauacauggg

SEQ ID NO: 774189 - RNA, 22 nt, Human
ucauuuaagaaaaacaugaaac

SEQ ID NO: 774190 - RNA, 19 nt, Human
uccagcuugggcaacaaga

SEQ ID NO: 774191 - RNA, 20 nt, Human
uccucuguaagucacuaaaa

SEQ ID NO: 774192 - RNA, 23 nt, Human
uccuuagagaggaccuaauuauu

SEQ ID NO: 774193 - RNA, 24 nt, Human
ucgcuugaacccgggaggcggagg

SEQ ID NO: 774194 - RNA, 24 nt, Human
ucuagaauugauccaccaaaagau

SEQ ID NO: 774195 - RNA, 23 nt, Human
ucugucucaaaaaaaaaaaaaaa

SEQ ID NO: 774196 - RNA, 27 nt, Human
ugaaauauucacaaauaaaaauccucc

SEQ ID NO: 774197 - RNA, 23 nt, Human
ugacgaggggcagaguaaauaag

SEQ ID NO: 774198 - RNA, 18 nt, Human
ugacuauaucacccagca

SEQ ID NO: 774199 - RNA, 21 nt, Human
ugacuauaucacccagcauaa

SEQ ID NO: 774200 - RNA, 23 nt, Human
ugagaaguaaccuucccuuagaa

SEQ ID NO: 774201 - RNA, 22 nt, Human
ugagccgagaucgugccauugc

SEQ ID NO: 774202 - RNA, 20 nt, Human
ugaggcaggagaaucgcuug

SEQ ID NO: 774203 - RNA, 24 nt, Human
ugaggcaggagaaucgcuugaacc

SEQ ID NO: 774204 - RNA, 25 nt, Human
ugaggcaggagaaucgcuugaaccc

SEQ ID NO: 774205 - RNA, 18 nt, Human
ugaggucaggaguuugag

SEQ ID NO: 774206 - RNA, 24 nt, Human
ugauccuaacuaaaucagaaacuu

SEQ ID NO: 774207 - RNA, 27 nt, Human
ugaugaaugccaugggucaaaugccau

SEQ ID NO: 774208 - RNA, 21 nt, Human
ugauuggaaacuaaucauuua

SEQ ID NO: 774209 - RNA, 19 nt, Human
ugcacuccagcuugggcaa

SEQ ID NO: 774210 - RNA, 22 nt, Human
ugcacuccagcuugggcaacaa

SEQ ID NO: 774211 - RNA, 22 nt, Human
ugcaguggcaugaucucggcuc

SEQ ID NO: 774212 - RNA, 19 nt, Human
ugccaugggucaaaugcca

SEQ ID NO: 774213 - RNA, 24 nt, Human
ugccuguaaucccagcuccuuggg

SEQ ID NO: 774214 - RNA, 20 nt, Human
ugcuaaaucuccacaugaca

SEQ ID NO: 774215 - RNA, 19 nt, Human
uggagugcaguggcaugau

SEQ ID NO: 774216 - RNA, 24 nt, Human
uggagugcaguggcaugaucucgg

SEQ ID NO: 774217 - RNA, 21 nt, Human
uggcucacaccuguaauccca

SEQ ID NO: 774218 - RNA, 22 nt, Human
uggcucacaccuguaaucccag

SEQ ID NO: 774219 - RNA, 24 nt, Human
uggcucacaccuguaaucccagca

SEQ ID NO: 774220 - RNA, 22 nt, Human
uggcugucaauaccugaaagcu

SEQ ID NO: 774221 - RNA, 19 nt, Human
ugggaggcugaggcaggag

SEQ ID NO: 774222 - RNA, 23 nt, Human
ugggaggcugaggcaggagaauc

SEQ ID NO: 774223 - RNA, 21 nt, Human
uggugcgugccuguaauccca

SEQ ID NO: 774224 - RNA, 22 nt, Human
uggugcgugccuguaaucccag

SEQ ID NO: 774225 - RNA, 24 nt, Human
uggugcgugccuguaaucccagcu

SEQ ID NO: 774226 - RNA, 24 nt, Human
ugguggcucacaccuguaauccca

SEQ ID NO: 774227 - RNA, 24 nt, Human
ugguggugcgugccuguaauccca

SEQ ID NO: 774228 - RNA, 18 nt, Human
uguauggacaggguaggc

SEQ ID NO: 774229 - RNA, 21 nt, Human
uguugcccaggauggagugca

SEQ ID NO: 774230 - RNA, 27 nt, Human
uuaaucaacacugcagaaaaagaaaaa

SEQ ID NO: 774231 - RNA, 24 nt, Human
uucguucuuguugcccaggaugga

SEQ ID NO: 774232 - RNA, 24 nt, Human
uugaacccgggaggcggagguugc

SEQ ID NO: 774233 - RNA, 18 nt, Human
uugcagugagccgagauc

SEQ ID NO: 774234 - RNA, 21 nt, Human
uugcagugagccgagaucgug

SEQ ID NO: 774235 - RNA, 22 nt, Human
uugcagugagccgagaucgugc

SEQ ID NO: 774236 - RNA, 18 nt, Human
uugcccaggauggagugc

SEQ ID NO: 774237 - RNA, 24 nt, Human
uugggaggcugaggcaggagaauc

SEQ ID NO: 774238 - RNA, 22 nt, Human
uuuccaaggccaacugggcacc

SEQ ID NO: 774239 - RNA, 20 nt, Human
uuucguucuuguugcccagg

SEQ ID NO: 774240 - RNA, 24 nt, Human
uuucguucuuguugcccaggaugg

SEQ ID NO: 774241 - RNA, 22 nt, Human
uuucuacuaaaaauacaaaaaa

SEQ ID NO: 774242 - RNA, 22 nt, Human
uuugaaacugcuagcaauaaac

SEQ ID NO: 774243 - RNA, 23 nt, Human
aaacgcagcccaggggagccuca

SEQ ID NO: 774244 - RNA, 23 nt, Human
aaauaaucaagaagaaauagaga

SEQ ID NO: 774245 - RNA, 22 nt, Human
aaauagagaacauuaacaaaau

SEQ ID NO: 774246 - RNA, 21 nt, Human
aaaucccacccuccuccuccc

SEQ ID NO: 774247 - RNA, 18 nt, Human
aaauccuccagcccccuu

SEQ ID NO: 774248 - RNA, 18 nt, Human
aagaagaaauagagaaca

SEQ ID NO: 774249 - RNA, 20 nt, Human
aagaagaaauagagaacauu

SEQ ID NO: 774250 - RNA, 22 nt, Human
aagcccccggaggccccucugg

SEQ ID NO: 774251 - RNA, 22 nt, Human
aaucccacccuccuccucccac

SEQ ID NO: 774252 - RNA, 26 nt, Human
aaucccacccuccuccucccacccag

SEQ ID NO: 774253 - RNA, 18 nt, Human
acaaaucccacccuccuc

SEQ ID NO: 774254 - RNA, 24 nt, Human
acagaaaacccugacacguggcca

SEQ ID NO: 774255 - RNA, 22 nt, Human
acaggcccacccuuagcugcac

SEQ ID NO: 774256 - RNA, 18 nt, Human
acauggggguuucaucug

SEQ ID NO: 774257 - RNA, 19 nt, Human
accacaagagggacagagg

SEQ ID NO: 774258 - RNA, 24 nt, Human
accagcagggggcaccacaggccc

SEQ ID NO: 774259 - RNA, 26 nt, Human
accauguuuaaugaacaccaaagcug

SEQ ID NO: 774260 - RNA, 25 nt, Human
acccagcagcucccaaacgcagccc

SEQ ID NO: 774261 - RNA, 18 nt, Human
accccagguagaggcagc

SEQ ID NO: 774262 - RNA, 19 nt, Human
accccaucccccugcgagc

SEQ ID NO: 774263 - RNA, 24 nt, Human
acgcagcccaggggagccucagag

SEQ ID NO: 774264 - RNA, 22 nt, Human
acucagcuuggagcccuggagu

SEQ ID NO: 774265 - RNA, 22 nt, Human
acuugggccucugugucucccu

SEQ ID NO: 774266 - RNA, 22 nt, Human
agaaacacaaggacaugugaca

SEQ ID NO: 774267 - RNA, 21 nt, Human
agacgaguugaaggaggucau

SEQ ID NO: 774268 - RNA, 21 nt, Human
agagaagcaguuggggcugca

SEQ ID NO: 774269 - RNA, 29 nt, Human
agagaagcaguuggggcugcacugagaug

SEQ ID NO: 774270 - RNA, 19 nt, Human
agaggcucacagaaaaccc

SEQ ID NO: 774271 - RNA, 18 nt, Human
agagggacagagggagga

SEQ ID NO: 774272 - RNA, 21 nt, Human
agcagcagguccaggcaacgc

SEQ ID NO: 774273 - RNA, 23 nt, Human
agcagggacgggggugggggcag

SEQ ID NO: 774274 - RNA, 20 nt, Human
agccccaugggaggagcagg

SEQ ID NO: 774275 - RNA, 21 nt, Human
aggcagggcaggggcccaggg

SEQ ID NO: 774276 - RNA, 23 nt, Human
aggcagggcaggggcccaggggc

SEQ ID NO: 774277 - RNA, 25 nt, Human
aggccagcagggacggggguggggg

SEQ ID NO: 774278 - RNA, 25 nt, Human
aggccugggcuggaagggaggggag

SEQ ID NO: 774279 - RNA, 23 nt, Human
agggggcaggcccaagggugcca

SEQ ID NO: 774280 - RNA, 24 nt, Human
agggggcaggcccaagggugccag

SEQ ID NO: 774281 - RNA, 22 nt, Human
aggguucccgguccuuccuccu

SEQ ID NO: 774282 - RNA, 23 nt, Human
aguggcuaaauccuccagccccc

SEQ ID NO: 774283 - RNA, 23 nt, Human
auagaaugugggugagcacuaca

SEQ ID NO: 774284 - RNA, 24 nt, Human
aucaugacccagcagcaauccguc

SEQ ID NO: 774285 - RNA, 20 nt, Human
caaaccccagguagaggcag

SEQ ID NO: 774286 - RNA, 22 nt, Human
caaacgcagcccaggggagccu

SEQ ID NO: 774287 - RNA, 21 nt, Human
caagacccagacacucccaag

SEQ ID NO: 774288 - RNA, 22 nt, Human
caagacgaguugaaggagguca

SEQ ID NO: 774289 - RNA, 24 nt, Human
caaggacaugugacaucccccucc

SEQ ID NO: 774290 - RNA, 20 nt, Human
cacagcaccacaagagggac

SEQ ID NO: 774291 - RNA, 23 nt, Human
cacagcaccacaagagggacaga

SEQ ID NO: 774292 - RNA, 18 nt, Human
cacaggguucccgguccu

SEQ ID NO: 774293 - RNA, 18 nt, Human
cacccuccuccucccacc

SEQ ID NO: 774294 - RNA, 19 nt, Human
cacccuccuccucccaccc

SEQ ID NO: 774295 - RNA, 22 nt, Human
cacugugcgcccagucagaggc

SEQ ID NO: 774296 - RNA, 26 nt, Human
cagagcagccacuuuugaccccuugg

SEQ ID NO: 774297 - RNA, 18 nt, Human
cagaugcagguggacugg

SEQ ID NO: 774298 - RNA, 23 nt, Human
cagcagcaauccgucuuccuggu

SEQ ID NO: 774299 - RNA, 22 nt, Human
cagcagggacgggggugggggc

SEQ ID NO: 774300 - RNA, 19 nt, Human
cagcagggcauggggacug

SEQ ID NO: 774301 - RNA, 20 nt, Human
cagcagggggcaccacaggc

SEQ ID NO: 774302 - RNA, 23 nt, Human
cagcccaggggagccucagaggc

SEQ ID NO: 774303 - RNA, 26 nt, Human
cagcccaggggagccucagaggcagg

SEQ ID NO: 774304 - RNA, 19 nt, Human
cagcucccaaacgcagccc

SEQ ID NO: 774305 - RNA, 21 nt, Human
cagggcaggggcccaggggcc

SEQ ID NO: 774306 - RNA, 21 nt, Human
caucccccuccagcucccacc

SEQ ID NO: 774307 - RNA, 18 nt, Human
caucugcucucugcugcc

SEQ ID NO: 774308 - RNA, 19 nt, Human
caugcacacaaaaaacaaa

SEQ ID NO: 774309 - RNA, 24 nt, Human
ccaacccugccuaccacauggggg

SEQ ID NO: 774310 - RNA, 20 nt, Human
ccacacaggguucccggucc

SEQ ID NO: 774311 - RNA, 20 nt, Human
ccaccgccccaccacggcuc

SEQ ID NO: 774312 - RNA, 21 nt, Human
ccacgcagaaccugcuggacu

SEQ ID NO: 774313 - RNA, 18 nt, Human
ccacggcucagucaccgu

SEQ ID NO: 774314 - RNA, 21 nt, Human
ccagcaaaagcuucaggcucu

SEQ ID NO: 774315 - RNA, 24 nt, Human
ccagcagcucccaaacgcagccca

SEQ ID NO: 774316 - RNA, 18 nt, Human
ccagccacagcaccacaa

SEQ ID NO: 774317 - RNA, 19 nt, Human
ccaggcuucucugggcaga

SEQ ID NO: 774318 - RNA, 22 nt, Human
cccaccgccccaccacggcuca

SEQ ID NO: 774319 - RNA, 20 nt, Human
cccagaggcaaggccucccc

SEQ ID NO: 774320 - RNA, 22 nt, Human
cccagcaaaagcuucaggcucu

SEQ ID NO: 774321 - RNA, 19 nt, Human
cccagccucggcccaccgc

SEQ ID NO: 774322 - RNA, 23 nt, Human
cccaggaagcccccggaggcccc

SEQ ID NO: 774323 - RNA, 24 nt, Human
ccccaggggcucaggcugccuaga

SEQ ID NO: 774324 - RNA, 18 nt, Human
ccccggaggccccucugg

SEQ ID NO: 774325 - RNA, 22 nt, Human
ccccuccagcucccacccuccc

SEQ ID NO: 774326 - RNA, 22 nt, Human
ccccucuggcugaagagaucag

SEQ ID NO: 774327 - RNA, 22 nt, Human
ccccuggguccaggcuucucug

SEQ ID NO: 774328 - RNA, 19 nt, Human
ccuccagcucccacccucc

SEQ ID NO: 774329 - RNA, 22 nt, Human
ccuccagcucccacccucccug

SEQ ID NO: 774330 - RNA, 19 nt, Human
ccuccucccacccagcagc

SEQ ID NO: 774331 - RNA, 26 nt, Human
ccugcaccacugugcgcccagucaga

SEQ ID NO: 774332 - RNA, 19 nt, Human
ccugccgucccccaacccu

SEQ ID NO: 774333 - RNA, 21 nt, Human
ccuggagggcugcggugggcu

SEQ ID NO: 774334 - RNA, 19 nt, Human
ccuugggcuauggaagccu

SEQ ID NO: 774335 - RNA, 26 nt, Human
cgaggcggcagcccagccucggccca

SEQ ID NO: 774336 - RNA, 22 nt, Human
cgccagaaaaaucaccacccag

SEQ ID NO: 774337 - RNA, 24 nt, Human
cuccuccucccacccagcagcucc

SEQ ID NO: 774338 - RNA, 18 nt, Human
cugcccccuauagugccc

SEQ ID NO: 774339 - RNA, 20 nt, Human
cuggacuuaacucgccagaa

SEQ ID NO: 774340 - RNA, 18 nt, Human
cuggaggccagcagggac

SEQ ID NO: 774341 - RNA, 24 nt, Human
cuggcgguacagaugagggccuca

SEQ ID NO: 774342 - RNA, 19 nt, Human
cugggcuggaagggagggg

SEQ ID NO: 774343 - RNA, 21 nt, Human
cuggguccaggcuucucuggg

SEQ ID NO: 774344 - RNA, 19 nt, Human
cuguguggccagggccagg

SEQ ID NO: 774345 - RNA, 20 nt, Human
gacaucccccuccagcuccc

SEQ ID NO: 774346 - RNA, 19 nt, Human
gacaugugacaucccccuc

SEQ ID NO: 774347 - RNA, 19 nt, Human
gacuucccucccauaccuc

SEQ ID NO: 774348 - RNA, 20 nt, Human
gaggagcaggcaauggugug

SEQ ID NO: 774349 - RNA, 23 nt, Human
gagggccucaggggcucaggcgg

SEQ ID NO: 774350 - RNA, 19 nt, Human
gaggguuuccugcaaaccu

SEQ ID NO: 774351 - RNA, 18 nt, Human
gauguggaaaucaugacc

SEQ ID NO: 774352 - RNA, 19 nt, Human
gcaaaagcuucaggcucug

SEQ ID NO: 774353 - RNA, 25 nt, Human
gcaccacugugcgcccagucagagg

SEQ ID NO: 774354 - RNA, 19 nt, Human
gcagguccaggcaacgcca

SEQ ID NO: 774355 - RNA, 21 nt, Human
gcccaggaagcccccggaggc

SEQ ID NO: 774356 - RNA, 19 nt, Human
gcucuggguggggcugggg

SEQ ID NO: 774357 - RNA, 20 nt, Human
gcugcacugagaugagcaug

SEQ ID NO: 774358 - RNA, 19 nt, Human
gcugcccgaggcggcagcc

SEQ ID NO: 774359 - RNA, 19 nt, Human
gcuucucugggcagacccc

SEQ ID NO: 774360 - RNA, 23 nt, Human
ggaaguuugcagagggaaggccc

SEQ ID NO: 774361 - RNA, 19 nt, Human
ggaggagcaggcaauggug

SEQ ID NO: 774362 - RNA, 20 nt, Human
ggcacuggcuggaggccagc

SEQ ID NO: 774363 - RNA, 21 nt, Human
ggcccaggggcccaaaggcug

SEQ ID NO: 774364 - RNA, 24 nt, Human
ggccugggcuggaagggaggggag

SEQ ID NO: 774365 - RNA, 22 nt, Human
ggcgcgaugcuaugcggcacca

SEQ ID NO: 774366 - RNA, 24 nt, Human
gggcacggggccuggugcagagaa

SEQ ID NO: 774367 - RNA, 21 nt, Human
gggcccaaaggcuguaaggug

SEQ ID NO: 774368 - RNA, 23 nt, Human
ggggcccaggggcccaaaggcug

SEQ ID NO: 774369 - RNA, 24 nt, Human
gggggccuggagggcugcgguggg

SEQ ID NO: 774370 - RNA, 21 nt, Human
gggggugggggcaggacugcu

SEQ ID NO: 774371 - RNA, 22 nt, Human
ggggugggguccgccagggggc

SEQ ID NO: 774372 - RNA, 21 nt, Human
gggugggguccgccagggggc

SEQ ID NO: 774373 - RNA, 21 nt, Human
ggucaggggaggcuaaagccc

SEQ ID NO: 774374 - RNA, 18 nt, Human
ggucugggucggucccug

SEQ ID NO: 774375 - RNA, 20 nt, Human
gguggccaaggaggugcugu

SEQ ID NO: 774376 - RNA, 20 nt, Human
ggugggggcaggacugcugg

SEQ ID NO: 774377 - RNA, 18 nt, Human
guggccaaggaggugcug

SEQ ID NO: 774378 - RNA, 22 nt, Human
guguggccagggccaggggagg

SEQ ID NO: 774379 - RNA, 25 nt, Human
uaacucgccagaaaaaucaccaccc

SEQ ID NO: 774380 - RNA, 27 nt, Human
uaacucgccagaaaaaucaccacccag

SEQ ID NO: 774381 - RNA, 24 nt, Human
uacaggagcucaaggaggccuggg

SEQ ID NO: 774382 - RNA, 23 nt, Human
ucaccccaucccccugcgagccu

SEQ ID NO: 774383 - RNA, 20 nt, Human
ucacuggaaggcccgggugg

SEQ ID NO: 774384 - RNA, 21 nt, Human
ucacuggaaggcccggguggg

SEQ ID NO: 774385 - RNA, 20 nt, Human
ucagaggcagccaagaaggg

SEQ ID NO: 774386 - RNA, 21 nt, Human
ucagaggcagccaagaagggu

SEQ ID NO: 774387 - RNA, 18 nt, Human
ucccacccagcagcuccc

SEQ ID NO: 774388 - RNA, 22 nt, Human
ucccacccagcagcucccaaac

SEQ ID NO: 774389 - RNA, 23 nt, Human
ucccacccagcagcucccaaacg

SEQ ID NO: 774390 - RNA, 19 nt, Human
ucccacccuccuccuccca

SEQ ID NO: 774391 - RNA, 22 nt, Human
ucccagaacagccacuugggcc

SEQ ID NO: 774392 - RNA, 22 nt, Human
ucccagaacagccacuugggcc

SEQ ID NO: 774393 - RNA, 18 nt, Human
ucccggggcuaccucuuc

SEQ ID NO: 774394 - RNA, 19 nt, Human
ucccuggggguggagccca

SEQ ID NO: 774395 - RNA, 20 nt, Human
ucccuggggguggagcccag

SEQ ID NO: 774396 - RNA, 18 nt, Human
uccguggugaccagaccc

SEQ ID NO: 774397 - RNA, 25 nt, Human
uccucccacccagcagcucccaaac

SEQ ID NO: 774398 - RNA, 19 nt, Human
ucucugggcagaccccugg

SEQ ID NO: 774399 - RNA, 20 nt, Human
ucugugucucccuucucccc

SEQ ID NO: 774400 - RNA, 23 nt, Human
ugaccagacccucaagacgaguu

SEQ ID NO: 774401 - RNA, 18 nt, Human
ugacccugggccccaggu

SEQ ID NO: 774402 - RNA, 19 nt, Human
ugagaugagcaugccacaa

SEQ ID NO: 774403 - RNA, 21 nt, Human
ugagaugagcaugccacaaag

SEQ ID NO: 774404 - RNA, 22 nt, Human
ugaggguuuccugcaaaccugu

SEQ ID NO: 774405 - RNA, 20 nt, Human
ugauaagaauaaaaaagaua

SEQ ID NO: 774406 - RNA, 23 nt, Human
ugcacacaaaaaacaaagaacuu

SEQ ID NO: 774407 - RNA, 21 nt, Human
ugcagcaagaccauguuuaau

SEQ ID NO: 774408 - RNA, 24 nt, Human
ugcagggcccugcucaggagggcg

SEQ ID NO: 774409 - RNA, 20 nt, Human
ugcaugcacacaaaaaacaa

SEQ ID NO: 774410 - RNA, 26 nt, Human
ugccagucuguucucgggaucuacgc

SEQ ID NO: 774411 - RNA, 24 nt, Human
ugcgucuggccagcgcagggcuca

SEQ ID NO: 774412 - RNA, 18 nt, Human
ugcuguguggccagggcc

SEQ ID NO: 774413 - RNA, 20 nt, Human
uggaaaguggcacggugcag

SEQ ID NO: 774414 - RNA, 20 nt, Human
uggccccauuucacagcugg

SEQ ID NO: 774415 - RNA, 20 nt, Human
ugggccccaggucauugcaa

SEQ ID NO: 774416 - RNA, 19 nt, Human
uggggcaaacgcccaggac

SEQ ID NO: 774417 - RNA, 20 nt, Human
uggggcaaacgcccaggacu

SEQ ID NO: 774418 - RNA, 21 nt, Human
uggggcugcacugagaugagc

SEQ ID NO: 774419 - RNA, 18 nt, Human
ugggggcaggacugcugg

SEQ ID NO: 774420 - RNA, 19 nt, Human
ugggggcaggacugcuggu

SEQ ID NO: 774421 - RNA, 18 nt, Human
uggguccaggcuucucug

SEQ ID NO: 774422 - RNA, 21 nt, Human
uggguggggcugggggcacag

SEQ ID NO: 774423 - RNA, 23 nt, Human
ugguccacggauaugacuucccu

SEQ ID NO: 774424 - RNA, 26 nt, Human
ugugagagguggcccaggaggccugg

SEQ ID NO: 774425 - RNA, 18 nt, Human
uucaucugcucucugcug

SEQ ID NO: 774426 - RNA, 21 nt, Human
uucccgguccuuccuccugca

SEQ ID NO: 774427 - RNA, 18 nt, Human
uugcccaaagccacacag

SEQ ID NO: 774428 - RNA, 24 nt, Human
uuuggcuaauuuuuaacauccaaa

SEQ ID NO: 774429 - RNA, 24 nt, Human
aaaaaaaaaaaaaaaaauagagag

SEQ ID NO: 774430 - RNA, 23 nt, Human
aaaguuacagcaaaaaggguaau

SEQ ID NO: 774431 - RNA, 19 nt, Human
aaguuacagcaaaaagggu

SEQ ID NO: 774432 - RNA, 22 nt, Human
acauuuucacaaauuccagucu

SEQ ID NO: 774433 - RNA, 27 nt, Human
acuuuuaaaaaguuacagcaaaaaggg

SEQ ID NO: 774434 - RNA, 18 nt, Human
aggaaaaggaggcggcgg

SEQ ID NO: 774435 - RNA, 23 nt, Human
auaauacagcaucuguacaccuc

SEQ ID NO: 774436 - RNA, 18 nt, Human
caaucaaauugcuuacag

SEQ ID NO: 774437 - RNA, 23 nt, Human
cacauuuucacaaauuccagucu

SEQ ID NO: 774438 - RNA, 18 nt, Human
caggaagaggcugcgccc

SEQ ID NO: 774439 - RNA, 18 nt, Human
caggaugaggaaaaggag

SEQ ID NO: 774440 - RNA, 20 nt, Human
ccccgcgcccucacgcacug

SEQ ID NO: 774441 - RNA, 18 nt, Human
ccucucucucccucucuc

SEQ ID NO: 774442 - RNA, 19 nt, Human
ccucucucucccucucucc

SEQ ID NO: 774443 - RNA, 19 nt, Human
ccugguggccggggggagg

SEQ ID NO: 774444 - RNA, 21 nt, Human
cgagcggcggaguccgaggcc

SEQ ID NO: 774445 - RNA, 18 nt, Human
cgaggcagaggcggagag

SEQ ID NO: 774446 - RNA, 23 nt, Human
cgccggucacauagaccucgcgc

SEQ ID NO: 774447 - RNA, 23 nt, Human
cgcugcggcggcggcugcuccgg

SEQ ID NO: 774448 - RNA, 18 nt, Human
cggccgaggcagaggcgg

SEQ ID NO: 774449 - RNA, 23 nt, Human
cggcgagcgggcgggccucucuc

SEQ ID NO: 774450 - RNA, 20 nt, Human
cggcugcgcucugcgucucg

SEQ ID NO: 774451 - RNA, 24 nt, Human
cggggcugcaguacagcgggagcg

SEQ ID NO: 774452 - RNA, 22 nt, Human
cucgcgccgcggcggagcgggg

SEQ ID NO: 774453 - RNA, 20 nt, Human
cucuacacuccaggaagugu

SEQ ID NO: 774454 - RNA, 19 nt, Human
cugcggcggcggcugcucc

SEQ ID NO: 774455 - RNA, 18 nt, Human
gagcggcggaguccgagg

SEQ ID NO: 774456 - RNA, 24 nt, Human
gagcggcggaguccgaggcccggg

SEQ ID NO: 774457 - RNA, 22 nt, Human
gaggcggagagguggcgggccc

SEQ ID NO: 774458 - RNA, 22 nt, Human
gcaggaagaggcugcgcccgaa

SEQ ID NO: 774459 - RNA, 18 nt, Human
gcggagagguggcgggcc

SEQ ID NO: 774460 - RNA, 21 nt, Human
gcggcggcggcugcuccgggc

SEQ ID NO: 774461 - RNA, 22 nt, Human
ggcaggaagaggcugcgcccga

SEQ ID NO: 774462 - RNA, 19 nt, Human
ggcugcaguacagcgggag

SEQ ID NO: 774463 - RNA, 22 nt, Human
ggcugggaaaccagccgggccu

SEQ ID NO: 774464 - RNA, 20 nt, Human
ggggaggcgacgagcggcgg

SEQ ID NO: 774465 - RNA, 21 nt, Human
gggggaggcgacgagcggcgg

SEQ ID NO: 774466 - RNA, 23 nt, Human
gggggaggcgacgagcggcggag

SEQ ID NO: 774467 - RNA, 20 nt, Human
ggucuucaacauguccguuu

SEQ ID NO: 774468 - RNA, 21 nt, Human
ggugguggcggcugcgcucug

SEQ ID NO: 774469 - RNA, 23 nt, Human
uauaauacagcaucuguacaccu

SEQ ID NO: 774470 - RNA, 21 nt, Human
ucgcgcugcggcggcggcugc

SEQ ID NO: 774471 - RNA, 19 nt, Human
ucuacacuccaggaagugu

SEQ ID NO: 774472 - RNA, 18 nt, Human
ucuguacaccucaagcuc

SEQ ID NO: 774473 - RNA, 22 nt, Human
ugcgcccgaagcggcgaggcgg

SEQ ID NO: 774474 - RNA, 22 nt, Human
ugucacauuuucacaaauucca

SEQ ID NO: 774475 - RNA, 21 nt, Human
uguccguuuggugguggcggc

SEQ ID NO: 774476 - RNA, 22 nt, Human
uguuuugaggagcuuucaccgu

SEQ ID NO: 774477 - RNA, 24 nt, Human
uuaaauuaaaaaaaaaaaaaaaaa

SEQ ID NO: 774478 - RNA, 22 nt, Human
uuggugguggcggcugcgcucu

SEQ ID NO: 774479 - RNA, 18 nt, Human
uuugaggagcuuucaccg

SEQ ID NO: 774480 - RNA, 26 nt, Human
acccucugccaaaaccgcuccugcca

SEQ ID NO: 774481 - RNA, 19 nt, Human
accggccccacccucugcc

SEQ ID NO: 774482 - RNA, 18 nt, Human
agagcccaucccucuacc

SEQ ID NO: 774483 - RNA, 20 nt, Human
agagcccaucccucuacccg

SEQ ID NO: 774484 - RNA, 18 nt, Human
aggccccaucuggcccaa

SEQ ID NO: 774485 - RNA, 18 nt, Human
auaccuuccagaggcacc

SEQ ID NO: 774486 - RNA, 21 nt, Human
ccccacucucucagcgcucug

SEQ ID NO: 774487 - RNA, 22 nt, Human
ccggccccacccucugccaaaa

SEQ ID NO: 774488 - RNA, 21 nt, Human
ccugccaaggcccccaugacc

SEQ ID NO: 774489 - RNA, 21 nt, Human
cggccccacccucugccaaaa

SEQ ID NO: 774490 - RNA, 21 nt, Human
cucagcgcucuguguauucag

SEQ ID NO: 774491 - RNA, 25 nt, Human
cucucagcgcucuguguauucagcc

SEQ ID NO: 774492 - RNA, 23 nt, Human
gacagggcuucauuuacaucuuc

SEQ ID NO: 774493 - RNA, 20 nt, Human
gccaaaaccgcuccugccaa

SEQ ID NO: 774494 - RNA, 21 nt, Human
gccaaaaccgcuccugccaag

SEQ ID NO: 774495 - RNA, 22 nt, Human
gccccacccucugccaaaaccg

SEQ ID NO: 774496 - RNA, 23 nt, Human
uagcugagcagagcccaucccuc

SEQ ID NO: 774497 - RNA, 25 nt, Human
ucucucagcgcucuguguauucagc

SEQ ID NO: 774498 - RNA, 22 nt, Human
ucugccaaaaccgcuccugcca

SEQ ID NO: 774499 - RNA, 22 nt, Human
ugaccuguguccgugaccacac

SEQ ID NO: 774500 - RNA, 25 nt, Human
ugccccacucucucagcgcucugug

SEQ ID NO: 774501 - RNA, 22 nt, Human
uggcccaagaauagcugagcag

SEQ ID NO: 774502 - RNA, 27 nt, Human
uuuuuuuuuguuuuuuuuuuuuuuuuu

SEQ ID NO: 774503 - RNA, 22 nt, Human
uuuuuuuuuuuuuuuuguuuuu

SEQ ID NO: 774504 - RNA, 18 nt, Human
uuuuuuuuuuuuuuuuug

SEQ ID NO: 774505 - RNA, 23 nt, Human
uuuuuuuuuuuuuuuuuuguugu

SEQ ID NO: 774506 - RNA, 22 nt, Human
aaaaagaaacacggggaaaaga

SEQ ID NO: 774507 - RNA, 22 nt, Human
aaaagggaaaggaugaagagga

SEQ ID NO: 774508 - RNA, 23 nt, Human
aaaauccuuccacuggacacucu

SEQ ID NO: 774509 - RNA, 22 nt, Human
aaacugacauccccuauguccu

SEQ ID NO: 774510 - RNA, 19 nt, Human
aaagggacuccuuccugua

SEQ ID NO: 774511 - RNA, 19 nt, Human
aaauggcagagacuugagc

SEQ ID NO: 774512 - RNA, 20 nt, Human
aacaucgagccauccucuac

SEQ ID NO: 774513 - RNA, 23 nt, Human
acacaacccccacucccugccac

SEQ ID NO: 774514 - RNA, 23 nt, Human
acacacccuuugggacacagcca

SEQ ID NO: 774515 - RNA, 22 nt, Human
accaucuuucguggaaggugcc

SEQ ID NO: 774516 - RNA, 23 nt, Human
accaucuuucguggaaggugccg

SEQ ID NO: 774517 - RNA, 24 nt, Human
acguguuggcaugugaccagcuga

SEQ ID NO: 774518 - RNA, 23 nt, Human
acuccuuccuguaacuggggaac

SEQ ID NO: 774519 - RNA, 20 nt, Human
acugcagaucccagcagagu

SEQ ID NO: 774520 - RNA, 24 nt, Human
agaaacacggggaaaagagguagc

SEQ ID NO: 774521 - RNA, 24 nt, Human
agaaaggggugggguaaagacuug

SEQ ID NO: 774522 - RNA, 18 nt, Human
agagguccacggacagga

SEQ ID NO: 774523 - RNA, 22 nt, Human
aggaacgaggagaagagaggaa

SEQ ID NO: 774524 - RNA, 19 nt, Human
aggagaagagaggaagagg

SEQ ID NO: 774525 - RNA, 21 nt, Human
aggaugaagaggagcagcagg

SEQ ID NO: 774526 - RNA, 19 nt, Human
agggccaaaggagacaggg

SEQ ID NO: 774527 - RNA, 24 nt, Human
augcauucugggauguuccccuga

SEQ ID NO: 774528 - RNA, 22 nt, Human
auggaaaacaggcguguggcuc

SEQ ID NO: 774529 - RNA, 24 nt, Human
auguuccccugagggaagagacug

SEQ ID NO: 774530 - RNA, 22 nt, Human
caaguggccaccgauaccagaa

SEQ ID NO: 774531 - RNA, 18 nt, Human
caagugggccacgauggc

SEQ ID NO: 774532 - RNA, 24 nt, Human
cacacacccuuugggacacagcca

SEQ ID NO: 774533 - RNA, 18 nt, Human
cacacauauucacacacc

SEQ ID NO: 774534 - RNA, 24 nt, Human
cacagcacacaggcugaggcacau

SEQ ID NO: 774535 - RNA, 18 nt, Human
cacagugucaagugggcc

SEQ ID NO: 774536 - RNA, 19 nt, Human
caggacaggccuggccugc

SEQ ID NO: 774537 - RNA, 23 nt, Human
caggccaggcgggccgcggcgcc

SEQ ID NO: 774538 - RNA, 22 nt, Human
cagggcacuggaggcaaggcug

SEQ ID NO: 774539 - RNA, 22 nt, Human
cauccucuacuuuccccccacu

SEQ ID NO: 774540 - RNA, 19 nt, Human
ccacacacccuuugggaca

SEQ ID NO: 774541 - RNA, 18 nt, Human
ccagcugauggaggagcc

SEQ ID NO: 774542 - RNA, 21 nt, Human
ccauccaaguggccaccgaua

SEQ ID NO: 774543 - RNA, 26 nt, Human
cccacacacccuuugggacacagcca

SEQ ID NO: 774544 - RNA, 22 nt, Human
cccacccugccccacccucuac

SEQ ID NO: 774545 - RNA, 19 nt, Human
ccccaagaucccuggacuc

SEQ ID NO: 774546 - RNA, 21 nt, Human
ccccaccccacccugccccac

SEQ ID NO: 774547 - RNA, 22 nt, Human
ccccacucccugccacugcaga

SEQ ID NO: 774548 - RNA, 19 nt, Human
ccccccugacacucgccac

SEQ ID NO: 774549 - RNA, 21 nt, Human
ccccccugacacucgccacuc

SEQ ID NO: 774550 - RNA, 26 nt, Human
ccccccugacacucgccacucgccac

SEQ ID NO: 774551 - RNA, 28 nt, Human
ccccccugacacucgccacucgccacuc

SEQ ID NO: 774552 - RNA, 24 nt, Human
ccccgcccccgccggccgcccccc

SEQ ID NO: 774553 - RNA, 25 nt, Human
ccccgcccccgccggccgccccccu

SEQ ID NO: 774554 - RNA, 20 nt, Human
cccugccccacccucuacag

SEQ ID NO: 774555 - RNA, 18 nt, Human
ccgauaccagaaauaacc

SEQ ID NO: 774556 - RNA, 21 nt, Human
ccgauaccagaaauaaccaaa

SEQ ID NO: 774557 - RNA, 18 nt, Human
ccgccccccugacacucg

SEQ ID NO: 774558 - RNA, 21 nt, Human
ccgcccccgccggccgccccc

SEQ ID NO: 774559 - RNA, 24 nt, Human
ccgccccgcccccgccggccgccc

SEQ ID NO: 774560 - RNA, 20 nt, Human
ccuggagcugccucaggggc

SEQ ID NO: 774561 - RNA, 20 nt, Human
ccuucagauuuugauuauaa

SEQ ID NO: 774562 - RNA, 18 nt, Human
ccuuugggcagccugguc

SEQ ID NO: 774563 - RNA, 21 nt, Human
cgaagccuggcugagagcuga

SEQ ID NO: 774564 - RNA, 22 nt, Human
cgccacucgccacucgccacuc

SEQ ID NO: 774565 - RNA, 20 nt, Human
cguguggcucucucccuggg

SEQ ID NO: 774566 - RNA, 25 nt, Human
cuccccuucauuacaaaaguaugca

SEQ ID NO: 774567 - RNA, 20 nt, Human
cucugcacccguagggaguc

SEQ ID NO: 774568 - RNA, 22 nt, Human
cucuggggcagguuggcugccc

SEQ ID NO: 774569 - RNA, 18 nt, Human
cuggaccauugcuccucc

SEQ ID NO: 774570 - RNA, 18 nt, Human
cuuccccuuuacacaacc

SEQ ID NO: 774571 - RNA, 21 nt, Human
cuucuuggaagaacaagaaag

SEQ ID NO: 774572 - RNA, 19 nt, Human
gaccauugcuccucccuuu

SEQ ID NO: 774573 - RNA, 25 nt, Human
gacuccccaccccuugccugacucu

SEQ ID NO: 774574 - RNA, 21 nt, Human
gagcagguggggcacccugga

SEQ ID NO: 774575 - RNA, 26 nt, Human
gagcccgcugccaacgccuccuccgg

SEQ ID NO: 774576 - RNA, 18 nt, Human
gccgggaagugacgcucc

SEQ ID NO: 774577 - RNA, 20 nt, Human
gcguguggcucucucccugg

SEQ ID NO: 774578 - RNA, 23 nt, Human
ggagcacagugucaagugggcca

SEQ ID NO: 774579 - RNA, 20 nt, Human
ggagcgcugcaggccaggcg

SEQ ID NO: 774580 - RNA, 24 nt, Human
ggaugaagaggagcagcaggguag

SEQ ID NO: 774581 - RNA, 22 nt, Human
ggcacacauauucacacaccaa

SEQ ID NO: 774582 - RNA, 19 nt, Human
ggcacuggaggcaaggcug

SEQ ID NO: 774583 - RNA, 24 nt, Human
ggcagguuggcugcccaggggagg

SEQ ID NO: 774584 - RNA, 21 nt, Human
ggccaggcgggccgcggcgcc

SEQ ID NO: 774585 - RNA, 25 nt, Human
ggccgcggcgccgcguggguccgag

SEQ ID NO: 774586 - RNA, 25 nt, Human
gggaaaagagguagcugcaaaacau

SEQ ID NO: 774587 - RNA, 26 nt, Human
gggaacagaauguaaaaaaauccauc

SEQ ID NO: 774588 - RNA, 20 nt, Human
gggcacuggaggcaaggcug

SEQ ID NO: 774589 - RNA, 21 nt, Human
gguaaagacuugaggccuggg

SEQ ID NO: 774590 - RNA, 22 nt, Human
ggugggguaaagacuugaggcc

SEQ ID NO: 774591 - RNA, 20 nt, Human
gugggagcgcugcaggccag

SEQ ID NO: 774592 - RNA, 23 nt, Human
uaaaaagaaacacggggaaaaga

SEQ ID NO: 774593 - RNA, 22 nt, Human
uaaccaaaugcauuuacacuca

SEQ ID NO: 774594 - RNA, 20 nt, Human
uaagaauaacgggucagagg

SEQ ID NO: 774595 - RNA, 20 nt, Human
uaagugcacaaaccaugucc

SEQ ID NO: 774596 - RNA, 19 nt, Human
uacaaauggcagagacuug

SEQ ID NO: 774597 - RNA, 23 nt, Human
uacacaacccccacucccugcca

SEQ ID NO: 774598 - RNA, 20 nt, Human
uagagaaacccaagugcucu

SEQ ID NO: 774599 - RNA, 23 nt, Human
uagagaaacccaagugcucugca

SEQ ID NO: 774600 - RNA, 19 nt, Human
uagugacaaaucauagggg

SEQ ID NO: 774601 - RNA, 25 nt, Human
uauguccucagaguuguuuuuuuuu

SEQ ID NO: 774602 - RNA, 20 nt, Human
ucaggacaaaagggaaagga

SEQ ID NO: 774603 - RNA, 19 nt, Human
uccacggacaggacaggcc

SEQ ID NO: 774604 - RNA, 23 nt, Human
uccacggacaggacaggccuggc

SEQ ID NO: 774605 - RNA, 23 nt, Human
uccagaagguagagguccacgga

SEQ ID NO: 774606 - RNA, 18 nt, Human
ucccaaagcugaaagccu

SEQ ID NO: 774607 - RNA, 24 nt, Human
uccccaagaucccuggacucccca

SEQ ID NO: 774608 - RNA, 25 nt, Human
uccccaagaucccuggacuccccac

SEQ ID NO: 774609 - RNA, 19 nt, Human
uccccaccccacccugccc

SEQ ID NO: 774610 - RNA, 20 nt, Human
uccccaccccacccugcccc

SEQ ID NO: 774611 - RNA, 21 nt, Human
uccccaccccuugccugacuc

SEQ ID NO: 774612 - RNA, 22 nt, Human
uccccuauguccucagaguugu

SEQ ID NO: 774613 - RNA, 23 nt, Human
ucuaguugaacccaacgaguggg

SEQ ID NO: 774614 - RNA, 21 nt, Human
ucuccaaucggagcuuagagc

SEQ ID NO: 774615 - RNA, 20 nt, Human
ucuccuaggaggggucccca

SEQ ID NO: 774616 - RNA, 20 nt, Human
ucucuaccgcugcugcugag

SEQ ID NO: 774617 - RNA, 25 nt, Human
ucuguucuuggggcuccccagggaa

SEQ ID NO: 774618 - RNA, 19 nt, Human
ugaagaggagcagcagggu

SEQ ID NO: 774619 - RNA, 21 nt, Human
ugagcaacugggcaucugcuu

SEQ ID NO: 774620 - RNA, 20 nt, Human
ugagggaagagacugcagcc

SEQ ID NO: 774621 - RNA, 20 nt, Human
ugcagcucuccuaggagggg

SEQ ID NO: 774622 - RNA, 26 nt, Human
ugccacacagcacacaggcugaggca

SEQ ID NO: 774623 - RNA, 22 nt, Human
ugccucuggggcagguuggcug

SEQ ID NO: 774624 - RNA, 24 nt, Human
uggaaaacaggcguguggcucucu

SEQ ID NO: 774625 - RNA, 18 nt, Human
uggaagaacaagaaaggg

SEQ ID NO: 774626 - RNA, 24 nt, Human
uggaaggugccggguguauaaagg

SEQ ID NO: 774627 - RNA, 30 nt, Human
uggaggagcacagugucaagugggccacgg

SEQ ID NO: 774628 - RNA, 26 nt, Human
uggcagugggaaccagaaugcugucg

SEQ ID NO: 774629 - RNA, 20 nt, Human
uggcaugugaccagcugaug

SEQ ID NO: 774630 - RNA, 28 nt, Human
ugggacacagccagauuugggaccaguc

SEQ ID NO: 774631 - RNA, 23 nt, Human
uggggcagguuggcugcccaggg

SEQ ID NO: 774632 - RNA, 20 nt, Human
uguaaaaaaauccauccaag

SEQ ID NO: 774633 - RNA, 24 nt, Human
uguagagaaacccaagugcucugc

SEQ ID NO: 774634 - RNA, 18 nt, Human
ugucaagugggccacgau

SEQ ID NO: 774635 - RNA, 19 nt, Human
ugucaagugggccacgaug

SEQ ID NO: 774636 - RNA, 21 nt, Human
ugucuaaaaagaaacacgggg

SEQ ID NO: 774637 - RNA, 20 nt, Human
ugugaccagcugauggagga

SEQ ID NO: 774638 - RNA, 22 nt, Human
uguguccaccuagugggggcug

SEQ ID NO: 774639 - RNA, 18 nt, Human
uuaaugccuggaccauug

SEQ ID NO: 774640 - RNA, 22 nt, Human
uuccacuggacacuccccuuca

SEQ ID NO: 774641 - RNA, 21 nt, Human
uuccccuuuacacaaccccca

SEQ ID NO: 774642 - RNA, 18 nt, Human
uucccuucagauuuugau

SEQ ID NO: 774643 - RNA, 26 nt, Human
uuggcagugggaaccagaaugcuguu

SEQ ID NO: 774644 - RNA, 19 nt, Human
uuggcaugugaccagcuga

SEQ ID NO: 774645 - RNA, 20 nt, Human
uuuccauccccaccccaccc

SEQ ID NO: 774646 - RNA, 24 nt, Human
aagcacaccuggggcccuccccac

SEQ ID NO: 774647 - RNA, 23 nt, Human
aagugucgcuguccaccggcucc

SEQ ID NO: 774648 - RNA, 23 nt, Human
acacacacacccccuccgggggc

SEQ ID NO: 774649 - RNA, 25 nt, Human
acaggcaacaccacaggcugcugug

SEQ ID NO: 774650 - RNA, 18 nt, Human
accgccuucuaucucuca

SEQ ID NO: 774651 - RNA, 22 nt, Human
agccugguccucaguggguggg

SEQ ID NO: 774652 - RNA, 22 nt, Human
aggcaugaaugaaggugggggg

SEQ ID NO: 774653 - RNA, 23 nt, Human
aggcgggcgggugcccugcgggg

SEQ ID NO: 774654 - RNA, 19 nt, Human
aggggaggggagggcgggg

SEQ ID NO: 774655 - RNA, 22 nt, Human
aggggaggggagggcgggggcc

SEQ ID NO: 774656 - RNA, 20 nt, Human
agguggggucccguggagac

SEQ ID NO: 774657 - RNA, 27 nt, Human
auuccuucccagggacaaguggggcag

SEQ ID NO: 774658 - RNA, 21 nt, Human
auugaacaccucugcaaauaa

SEQ ID NO: 774659 - RNA, 22 nt, Human
auugaacaccucugcaaauaau

SEQ ID NO: 774660 - RNA, 23 nt, Human
caacaccacaggcugcugugccc

SEQ ID NO: 774661 - RNA, 25 nt, Human
caagaaggcaugaaugaaggugggg

SEQ ID NO: 774662 - RNA, 20 nt, Human
caagcagaggggagcacccc

SEQ ID NO: 774663 - RNA, 21 nt, Human
cacacauugccccagggacaa

SEQ ID NO: 774664 - RNA, 27 nt, Human
cacacccaaacccuccuauuccuuccc

SEQ ID NO: 774665 - RNA, 20 nt, Human
cacagacccagggcccaguc

SEQ ID NO: 774666 - RNA, 21 nt, Human
caccacagacccagggcccag

SEQ ID NO: 774667 - RNA, 21 nt, Human
caccacaggcugcugugccca

SEQ ID NO: 774668 - RNA, 27 nt, Human
cacccaaacccuccuauuccuucccag

SEQ ID NO: 774669 - RNA, 18 nt, Human
cacccccuccgggggcaa

SEQ ID NO: 774670 - RNA, 24 nt, Human
cacugccagggaauggaaauuggg

SEQ ID NO: 774671 - RNA, 24 nt, Human
cacugcccaggugagccucugucc

SEQ ID NO: 774672 - RNA, 21 nt, Human
cacuucucuuuccuccuccca

SEQ ID NO: 774673 - RNA, 21 nt, Human
caggaagaggggaggggaggg

SEQ ID NO: 774674 - RNA, 24 nt, Human
caggccccgagagcgccacgaaga

SEQ ID NO: 774675 - RNA, 18 nt, Human
cagggacaaguggggcag

SEQ ID NO: 774676 - RNA, 23 nt, Human
cagggcagggcugggguuuccuc

SEQ ID NO: 774677 - RNA, 19 nt, Human
caggugagccucugucccu

SEQ ID NO: 774678 - RNA, 20 nt, Human
caggugagccucugucccuc

SEQ ID NO: 774679 - RNA, 20 nt, Human
cauaggacugggacagucug

SEQ ID NO: 774680 - RNA, 22 nt, Human
caucucuuccccuggcugggag

SEQ ID NO: 774681 - RNA, 24 nt, Human
ccacucagcccagaagaaccaaaa

SEQ ID NO: 774682 - RNA, 20 nt, Human
ccagccugguccucaguggg

SEQ ID NO: 774683 - RNA, 26 nt, Human
cccaaacccuccuauuccuucccagg

SEQ ID NO: 774684 - RNA, 21 nt, Human
cccacgcccugcagcaggucu

SEQ ID NO: 774685 - RNA, 21 nt, Human
cccacuuuccugcgagucgcu

SEQ ID NO: 774686 - RNA, 22 nt, Human
ccccaaauugaacaccucugca

SEQ ID NO: 774687 - RNA, 18 nt, Human
ccccacccacaggcaaca

SEQ ID NO: 774688 - RNA, 18 nt, Human
ccccccucccccuccucc

SEQ ID NO: 774689 - RNA, 21 nt, Human
ccccccucccccuccuccucc

SEQ ID NO: 774690 - RNA, 20 nt, Human
cccccggccugcgagggccc

SEQ ID NO: 774691 - RNA, 21 nt, Human
cccccuggcacgaugggcucc

SEQ ID NO: 774692 - RNA, 22 nt, Human
ccccgagagcgccacgaagagc

SEQ ID NO: 774693 - RNA, 19 nt, Human
ccccuccuccuccucuuuc

SEQ ID NO: 774694 - RNA, 24 nt, Human
cccgccuacucuggaaccuccagg

SEQ ID NO: 774695 - RNA, 23 nt, Human
cccggccugcgagggcccgagag

SEQ ID NO: 774696 - RNA, 22 nt, Human
cccucugcuccccccucccccc

SEQ ID NO: 774697 - RNA, 26 nt, Human
cccuggcugggagcuggggagcucau

SEQ ID NO: 774698 - RNA, 18 nt, Human
ccggccugcgagggcccg

SEQ ID NO: 774699 - RNA, 27 nt, Human
ccggcguccacacacacacccccuccg

SEQ ID NO: 774700 - RNA, 28 nt, Human
ccucccccuccuccuccucuuucccuuc

SEQ ID NO: 774701 - RNA, 21 nt, Human
ccuccucuuucccuucuccca

SEQ ID NO: 774702 - RNA, 21 nt, Human
ccucugcuccccccucccccu

SEQ ID NO: 774703 - RNA, 18 nt, Human
ccucuguuucuugguccc

SEQ ID NO: 774704 - RNA, 19 nt, Human
ccugcucgcagccugggcg

SEQ ID NO: 774705 - RNA, 20 nt, Human
ccugguccacuuggcgcguc

SEQ ID NO: 774706 - RNA, 18 nt, Human
ccuucggggccccucugg

SEQ ID NO: 774707 - RNA, 25 nt, Human
ccuuuccuccuccuccccuuccccc

SEQ ID NO: 774708 - RNA, 19 nt, Human
cgacgggucgguauaggcc

SEQ ID NO: 774709 - RNA, 21 nt, Human
cgcccacuucucuuuccuccu

SEQ ID NO: 774710 - RNA, 22 nt, Human
cgcccccggccugcgagggccc

SEQ ID NO: 774711 - RNA, 24 nt, Human
cggcccgggcgcgcugugaagcga

SEQ ID NO: 774712 - RNA, 20 nt, Human
cggcccugcgcugcugccuc

SEQ ID NO: 774713 - RNA, 25 nt, Human
cgggagaagcacaccuggggcccuc

SEQ ID NO: 774714 - RNA, 24 nt, Human
cuccaccacagacccagggcccag

SEQ ID NO: 774715 - RNA, 20 nt, Human
cucccccuccuccuccucuu

SEQ ID NO: 774716 - RNA, 18 nt, Human
cuccuccccuucccaacc

SEQ ID NO: 774717 - RNA, 19 nt, Human
cuccuccuccccuucccaa

SEQ ID NO: 774718 - RNA, 26 nt, Human
cugcagcaggucucagucagcuucua

SEQ ID NO: 774719 - RNA, 22 nt, Human
cugcggggccugcucgcagccu

SEQ ID NO: 774720 - RNA, 23 nt, Human
cugcuccccccucccccuccucc

SEQ ID NO: 774721 - RNA, 21 nt, Human
cuggucuggacugugagguca

SEQ ID NO: 774722 - RNA, 22 nt, Human
cuugggacagcagguugugaag

SEQ ID NO: 774723 - RNA, 19 nt, Human
cuugguccccacuuuccug

SEQ ID NO: 774724 - RNA, 22 nt, Human
cuuuccuuucuggaaucaucuc

SEQ ID NO: 774725 - RNA, 22 nt, Human
cuuuuaguaagggcugcaaggc

SEQ ID NO: 774726 - RNA, 19 nt, Human
gaagaggggaggggagggc

SEQ ID NO: 774727 - RNA, 18 nt, Human
gagccucugucccucaca

SEQ ID NO: 774728 - RNA, 22 nt, Human
gagcggugggucagcuccacug

SEQ ID NO: 774729 - RNA, 24 nt, Human
gagcggugggucagcuccacugga

SEQ ID NO: 774730 - RNA, 23 nt, Human
gagcuggggccuccccuggcuga

SEQ ID NO: 774731 - RNA, 21 nt, Human
gagggggcacccaggggagcc

SEQ ID NO: 774732 - RNA, 18 nt, Human
gcaaaacgcggcccgggc

SEQ ID NO: 774733 - RNA, 22 nt, Human
gcacagggagagaagccuagga

SEQ ID NO: 774734 - RNA, 19 nt, Human
gcaggagcugaagcauacg

SEQ ID NO: 774735 - RNA, 23 nt, Human
gcccacuucucuuuccuccuccc

SEQ ID NO: 774736 - RNA, 23 nt, Human
gcgcgcugugaagcgaggagauu

SEQ ID NO: 774737 - RNA, 18 nt, Human
gcgcugagcgguggguca

SEQ ID NO: 774738 - RNA, 22 nt, Human
gcgggugcccugcggggccugc

SEQ ID NO: 774739 - RNA, 24 nt, Human
gcuacgggagaagcacaccugggg

SEQ ID NO: 774740 - RNA, 22 nt, Human
gcucagccgggguugcaggagc

SEQ ID NO: 774741 - RNA, 20 nt, Human
ggaagaggggaggggagggc

SEQ ID NO: 774742 - RNA, 19 nt, Human
ggacaggaagaggggaggg

SEQ ID NO: 774743 - RNA, 23 nt, Human
ggacaggaagaggggaggggagg

SEQ ID NO: 774744 - RNA, 24 nt, Human
ggacaggaagaggggaggggaggg

SEQ ID NO: 774745 - RNA, 23 nt, Human
ggagaagcacaccuggggcccuc

SEQ ID NO: 774746 - RNA, 27 nt, Human
ggaggacaggaagaggggaggggaggg

SEQ ID NO: 774747 - RNA, 19 nt, Human
ggaggggagggcgggggcc

SEQ ID NO: 774748 - RNA, 20 nt, Human
ggcagguggccuuggccugg

SEQ ID NO: 774749 - RNA, 18 nt, Human
gggcacagggagagaagc

SEQ ID NO: 774750 - RNA, 20 nt, Human
gggcagggcccccuggcacg

SEQ ID NO: 774751 - RNA, 19 nt, Human
gggcccagggguccgacgg

SEQ ID NO: 774752 - RNA, 20 nt, Human
gggcccccaauccuggucca

SEQ ID NO: 774753 - RNA, 22 nt, Human
gggcgggggccacaggcgggcg

SEQ ID NO: 774754 - RNA, 18 nt, Human
ggggaggggagggcgggg

SEQ ID NO: 774755 - RNA, 20 nt, Human
ggggaggggagggcgggggc

SEQ ID NO: 774756 - RNA, 21 nt, Human
ggggccacaggcgggcgggug

SEQ ID NO: 774757 - RNA, 26 nt, Human
gggucacuguccagggacagccuccc

SEQ ID NO: 774758 - RNA, 24 nt, Human
ggugacacagggcacagggagaga

SEQ ID NO: 774759 - RNA, 23 nt, Human
gucagcuucuacaucuggguguc

SEQ ID NO: 774760 - RNA, 22 nt, Human
uaagugaauuaccccaaauuga

SEQ ID NO: 774761 - RNA, 19 nt, Human
uacacccagccugguccuc

SEQ ID NO: 774762 - RNA, 20 nt, Human
uacucuggaaccuccagggc

SEQ ID NO: 774763 - RNA, 26 nt, Human
ucacuuuacuggaggauccaggugac

SEQ ID NO: 774764 - RNA, 24 nt, Human
ucagcuccacuggagagggggcac

SEQ ID NO: 774765 - RNA, 21 nt, Human
ucaggauuauccaacuccucu

SEQ ID NO: 774766 - RNA, 21 nt, Human
uccacacacacacccccuccg

SEQ ID NO: 774767 - RNA, 21 nt, Human
ucccaaccgccuucuaucucc

SEQ ID NO: 774768 - RNA, 21 nt, Human
ucccaaccgccuucuaucucu

SEQ ID NO: 774769 - RNA, 25 nt, Human
uccccacccacaggcaacaccacag

SEQ ID NO: 774770 - RNA, 18 nt, Human
uccccaggucauuucauc

SEQ ID NO: 774771 - RNA, 19 nt, Human
uccccccucccccuccucc

SEQ ID NO: 774772 - RNA, 20 nt, Human
uccccccucccccuccuccu

SEQ ID NO: 774773 - RNA, 18 nt, Human
uccccuggcugggagcug

SEQ ID NO: 774774 - RNA, 25 nt, Human
uccuucccagggacaaguggggcag

SEQ ID NO: 774775 - RNA, 22 nt, Human
ucuacaucugggugucccugac

SEQ ID NO: 774776 - RNA, 20 nt, Human
ucucucacagccagcagggc

SEQ ID NO: 774777 - RNA, 22 nt, Human
ucucucacagccagcagggcug

SEQ ID NO: 774778 - RNA, 20 nt, Human
ucucuuuccuccucccaucc

SEQ ID NO: 774779 - RNA, 18 nt, Human
ucuggccuuuaauucacu

SEQ ID NO: 774780 - RNA, 23 nt, Human
ugacugagccuccaccacagacc

SEQ ID NO: 774781 - RNA, 22 nt, Human
ugagccuccaccacagacccag

SEQ ID NO: 774782 - RNA, 20 nt, Human
ugagccucugucccucacag

SEQ ID NO: 774783 - RNA, 18 nt, Human
ugagcggugggucagcuc

SEQ ID NO: 774784 - RNA, 19 nt, Human
ugaggucacacccaaaccc

SEQ ID NO: 774785 - RNA, 22 nt, Human
ugcaggagcugaagcauacggc

SEQ ID NO: 774786 - RNA, 23 nt, Human
ugccaggcgcaggccccgagagc

SEQ ID NO: 774787 - RNA, 18 nt, Human
ugcccaggugagccucug

SEQ ID NO: 774788 - RNA, 18 nt, Human
ugcggaggacaggaagag

SEQ ID NO: 774789 - RNA, 19 nt, Human
uggccuggggcugguuccu

SEQ ID NO: 774790 - RNA, 22 nt, Human
uggccuggggcugguuccuuug

SEQ ID NO: 774791 - RNA, 23 nt, Human
ugggagcuggggccuccccuggc

SEQ ID NO: 774792 - RNA, 19 nt, Human
uggggcagggcccccuggc

SEQ ID NO: 774793 - RNA, 23 nt, Human
uggucaggggcagguggccuugg

SEQ ID NO: 774794 - RNA, 21 nt, Human
uggucuggacugugagguccu

SEQ ID NO: 774795 - RNA, 24 nt, Human
uguuaucaggggcgccccaguagg

SEQ ID NO: 774796 - RNA, 24 nt, Human
uuccuccuccuccccuucccaacc

SEQ ID NO: 774797 - RNA, 18 nt, Human
uucuacaucugggugucc

SEQ ID NO: 774798 - RNA, 20 nt, Human
uuuccuccuccuccccuucc

SEQ ID NO: 774799 - RNA, 21 nt, Human
aaagaagaaaagggcugcgga

SEQ ID NO: 774800 - RNA, 23 nt, Human
acaaggcaggaggagcaggggaa

SEQ ID NO: 774801 - RNA, 23 nt, Human
acacaggaaaagagggcuccugg

SEQ ID NO: 774802 - RNA, 18 nt, Human
acucuaacuagucuggug

SEQ ID NO: 774803 - RNA, 21 nt, Human
acugugugcuaggcaccgugc

SEQ ID NO: 774804 - RNA, 20 nt, Human
agagcccccuccugccagcc

SEQ ID NO: 774805 - RNA, 18 nt, Human
agaggccagaucaugagg

SEQ ID NO: 774806 - RNA, 18 nt, Human
agaggcuguggcuagaga

SEQ ID NO: 774807 - RNA, 18 nt, Human
agaucaugaggggaaacu

SEQ ID NO: 774808 - RNA, 18 nt, Human
aggagcagcagagcugga

SEQ ID NO: 774809 - RNA, 26 nt, Human
aggagggggccuuugaggggaucgug

SEQ ID NO: 774810 - RNA, 20 nt, Human
aggcugugggaagagggcag

SEQ ID NO: 774811 - RNA, 23 nt, Human
agggguugccuuccuggaggagg

SEQ ID NO: 774812 - RNA, 19 nt, Human
agguggugguguuagcgau

SEQ ID NO: 774813 - RNA, 22 nt, Human
agugcagagguagccuggaggg

SEQ ID NO: 774814 - RNA, 18 nt, Human
auacagagaugcauaaga

SEQ ID NO: 774815 - RNA, 20 nt, Human
augaugcccgcuugggugcc

SEQ ID NO: 774816 - RNA, 25 nt, Human
augcggggagugggcugggcugggg

SEQ ID NO: 774817 - RNA, 19 nt, Human
auggagguggugguguuag

SEQ ID NO: 774818 - RNA, 22 nt, Human
caaucaggacccuccuucuucc

SEQ ID NO: 774819 - RNA, 19 nt, Human
cacagaggcaugaaacugc

SEQ ID NO: 774820 - RNA, 19 nt, Human
caccagaggugagcagagc

SEQ ID NO: 774821 - RNA, 21 nt, Human
cagagcccccuccugccagcc

SEQ ID NO: 774822 - RNA, 22 nt, Human
cagagcuggaggugaagcagag

SEQ ID NO: 774823 - RNA, 18 nt, Human
cagccucgcgcugcgggg

SEQ ID NO: 774824 - RNA, 22 nt, Human
caggcuuugacacaggaaaaga

SEQ ID NO: 774825 - RNA, 19 nt, Human
cagggcagaggcagaggcc

SEQ ID NO: 774826 - RNA, 23 nt, Human
cagugagaugaggccuccugacg

SEQ ID NO: 774827 - RNA, 23 nt, Human
caugcggggagugggcugggcug

SEQ ID NO: 774828 - RNA, 27 nt, Human
cauguaaacaaguaaaauacaguguga

SEQ ID NO: 774829 - RNA, 20 nt, Human
ccaagaguagaggagcagcg

SEQ ID NO: 774830 - RNA, 27 nt, Human
ccaggccagaugugcaaggagagcaug

SEQ ID NO: 774831 - RNA, 20 nt, Human
ccauguccuugcugccgucc

SEQ ID NO: 774832 - RNA, 21 nt, Human
ccccugagcagugugggggga

SEQ ID NO: 774833 - RNA, 18 nt, Human
cccuccuuuccucuugcc

SEQ ID NO: 774834 - RNA, 20 nt, Human
cccuggcaaggaggggcccu

SEQ ID NO: 774835 - RNA, 18 nt, Human
ccucacagucucaucgcc

SEQ ID NO: 774836 - RNA, 18 nt, Human
ccuucuuccaggcuguag

SEQ ID NO: 774837 - RNA, 24 nt, Human
cggagaagcuaacagcagccccca

SEQ ID NO: 774838 - RNA, 22 nt, Human
cgggccuaagaacaagggccaa

SEQ ID NO: 774839 - RNA, 18 nt, Human
cucaaagaagaaaagggc

SEQ ID NO: 774840 - RNA, 24 nt, Human
cucacagucucaucgccugauccc

SEQ ID NO: 774841 - RNA, 24 nt, Human
cugaggaccacaggguuccucgcu

SEQ ID NO: 774842 - RNA, 20 nt, Human
cuguggcuagagaagggggc

SEQ ID NO: 774843 - RNA, 21 nt, Human
gaacaagggccaaaaugagaa

SEQ ID NO: 774844 - RNA, 23 nt, Human
gaaggcacagaggcaugaaacug

SEQ ID NO: 774845 - RNA, 22 nt, Human
gacaaagugcagagguagccug

SEQ ID NO: 774846 - RNA, 20 nt, Human
gaccugcaagacuguggggc

SEQ ID NO: 774847 - RNA, 23 nt, Human
gaggagggggccuuugaggggau

SEQ ID NO: 774848 - RNA, 20 nt, Human
gagguguuggugguggcggc

SEQ ID NO: 774849 - RNA, 23 nt, Human
gaugaggccuccugacggagaag

SEQ ID NO: 774850 - RNA, 20 nt, Human
gaugagguguuggugguggc

SEQ ID NO: 774851 - RNA, 21 nt, Human
gaugagguguuggugguggcg

SEQ ID NO: 774852 - RNA, 23 nt, Human
gcagagcuggaggugaagcagag

SEQ ID NO: 774853 - RNA, 24 nt, Human
gcagagcuggaggugaagcagagg

SEQ ID NO: 774854 - RNA, 19 nt, Human
gccaggucugggacccaga

SEQ ID NO: 774855 - RNA, 22 nt, Human
gcccgcuugggugccgauggag

SEQ ID NO: 774856 - RNA, 18 nt, Human
gccuccaacaggcccgcu

SEQ ID NO: 774857 - RNA, 19 nt, Human
gcugugggaagagggcaga

SEQ ID NO: 774858 - RNA, 23 nt, Human
ggaacucuaacuagucugguggu

SEQ ID NO: 774859 - RNA, 18 nt, Human
ggaagaaacagcaugagc

SEQ ID NO: 774860 - RNA, 21 nt, Human
ggagagcaugugaccugcaag

SEQ ID NO: 774861 - RNA, 20 nt, Human
ggagaugucccgagaccccu

SEQ ID NO: 774862 - RNA, 19 nt, Human
ggaggccacugaggcagag

SEQ ID NO: 774863 - RNA, 20 nt, Human
ggaguagggaaggaggaggg

SEQ ID NO: 774864 - RNA, 21 nt, Human
ggagugggcugggcugggggc

SEQ ID NO: 774865 - RNA, 18 nt, Human
ggcagggaggcuguggga

SEQ ID NO: 774866 - RNA, 20 nt, Human
ggcaggggcaucuuggaggg

SEQ ID NO: 774867 - RNA, 24 nt, Human
ggccaggucugggacccagagcug

SEQ ID NO: 774868 - RNA, 19 nt, Human
ggcugggcugggggcgcug

SEQ ID NO: 774869 - RNA, 18 nt, Human
gggagugggcugggcugg

SEQ ID NO: 774870 - RNA, 19 nt, Human
gggcagaggcagaggccag

SEQ ID NO: 774871 - RNA, 25 nt, Human
gggcagaggccagaucaugagggga

SEQ ID NO: 774872 - RNA, 24 nt, Human
gggcagggaggcugugggaagagg

SEQ ID NO: 774873 - RNA, 19 nt, Human
ggggcuccacacuccagac

SEQ ID NO: 774874 - RNA, 22 nt, Human
gggggaugaugcccgcuugggu

SEQ ID NO: 774875 - RNA, 28 nt, Human
ggugaagcagaggggucgggccaggaaa

SEQ ID NO: 774876 - RNA, 21 nt, Human
guagaggagcagcagagcugg

SEQ ID NO: 774877 - RNA, 23 nt, Human
guggugguguuagcgaugagaag

SEQ ID NO: 774878 - RNA, 18 nt, Human
uaagauacaguccaugcc

SEQ ID NO: 774879 - RNA, 18 nt, Human
uacagcaucggccaaaga

SEQ ID NO: 774880 - RNA, 24 nt, Human
ucaggacaccagaguccagcugcc

SEQ ID NO: 774881 - RNA, 21 nt, Human
ucauucauucaacauuuauug

SEQ ID NO: 774882 - RNA, 18 nt, Human
ucccaaccauggaugggg

SEQ ID NO: 774883 - RNA, 20 nt, Human
ucccagccuccaacaggccc

SEQ ID NO: 774884 - RNA, 22 nt, Human
ucccagccuccaacaggcccgc

SEQ ID NO: 774885 - RNA, 18 nt, Human
ucccaggaguagggaagg

SEQ ID NO: 774886 - RNA, 18 nt, Human
uccucuugccguugauga

SEQ ID NO: 774887 - RNA, 21 nt, Human
uccuugcugccgucccaggag

SEQ ID NO: 774888 - RNA, 23 nt, Human
ucgccugaucccuccccuccccu

SEQ ID NO: 774889 - RNA, 20 nt, Human
ucucuccccuggcaaggagg

SEQ ID NO: 774890 - RNA, 23 nt, Human
ucuuuuggccucacagucucauc

SEQ ID NO: 774891 - RNA, 20 nt, Human
ugagaaggaugaugaggugu

SEQ ID NO: 774892 - RNA, 20 nt, Human
ugagaauacagcaucggcca

SEQ ID NO: 774893 - RNA, 18 nt, Human
ugagcaguguggggggau

SEQ ID NO: 774894 - RNA, 20 nt, Human
ugagcgaaggcacagaggca

SEQ ID NO: 774895 - RNA, 21 nt, Human
ugaggcagagaguggccagcc

SEQ ID NO: 774896 - RNA, 23 nt, Human
ugagggcaggggcaucuuggagg

SEQ ID NO: 774897 - RNA, 24 nt, Human
ugagguguuggugguggcggccuc

SEQ ID NO: 774898 - RNA, 24 nt, Human
ugaugagguguuggugguggcggc

SEQ ID NO: 774899 - RNA, 22 nt, Human
ugcaagacuguggggcuccaca

SEQ ID NO: 774900 - RNA, 23 nt, Human
ugcagagguagccuggaggggag

SEQ ID NO: 774901 - RNA, 23 nt, Human
ugccacaagagaagcauugacaa

SEQ ID NO: 774902 - RNA, 22 nt, Human
ugccgauggagguggugguguu

SEQ ID NO: 774903 - RNA, 21 nt, Human
uggacccuggguuccagggcu

SEQ ID NO: 774904 - RNA, 24 nt, Human
uggcaaggaggggcccuuuuggcc

SEQ ID NO: 774905 - RNA, 19 nt, Human
uggcaaucaggacccuccu

SEQ ID NO: 774906 - RNA, 19 nt, Human
uggcccagggcagaggcag

SEQ ID NO: 774907 - RNA, 18 nt, Human
ugggacccagagcugcca

SEQ ID NO: 774908 - RNA, 21 nt, Human
ugggcugggggcgcugggggc

SEQ ID NO: 774909 - RNA, 21 nt, Human
ugggggccuggauccaguggg

SEQ ID NO: 774910 - RNA, 18 nt, Human
uguaaacaaguaaaauac

SEQ ID NO: 774911 - RNA, 26 nt, Human
ugucugaaaaauggcuuugcagggau

SEQ ID NO: 774912 - RNA, 25 nt, Human
ugucugaaaaauggcuuugcagggg

SEQ ID NO: 774913 - RNA, 20 nt, Human
uguggcuccaaagggaucuc

SEQ ID NO: 774914 - RNA, 19 nt, Human
ugugugcuaggcaccgugc

SEQ ID NO: 774915 - RNA, 23 nt, Human
ugugugcuaggcaccgugcuagg

SEQ ID NO: 774916 - RNA, 22 nt, Human
uguuggugguggcggccucccc

SEQ ID NO: 774917 - RNA, 18 nt, Human
uugacacaggaaaagagg

SEQ ID NO: 774918 - RNA, 19 nt, Human
uuggcaaucaggacccucc

SEQ ID NO: 774919 - RNA, 23 nt, Human
uuggugguggcggccuccccaug

SEQ ID NO: 774920 - RNA, 22 nt, Human
uuuuuugauuaaaucauucauu

SEQ ID NO: 774921 - RNA, 27 nt, Human
uuuuuuuuuuuuuuuuuuuuuuugggg

SEQ ID NO: 774922 - RNA, 24 nt, Human
aaaaaaaaaaccaacaaaaaaacu

SEQ ID NO: 774923 - RNA, 20 nt, Human
aaaaacagaacaacgaauac

SEQ ID NO: 774924 - RNA, 21 nt, Human
aaaauggugaaaccccgucuc

SEQ ID NO: 774925 - RNA, 21 nt, Human
aacauuuugaacaguuaauuc

SEQ ID NO: 774926 - RNA, 24 nt, Human
aaucgcuugaacccaggagacaca

SEQ ID NO: 774927 - RNA, 20 nt, Human
acaaggccaacgacgagagc

SEQ ID NO: 774928 - RNA, 23 nt, Human
acagaacaacgaauacauacauc

SEQ ID NO: 774929 - RNA, 24 nt, Human
acagagcgagacuccaucucaaaa

SEQ ID NO: 774930 - RNA, 19 nt, Human
acagcacuguacuuuucuc

SEQ ID NO: 774931 - RNA, 23 nt, Human
acagcucacgccuguaaucccag

SEQ ID NO: 774932 - RNA, 24 nt, Human
acccaggagacacaggcugcagug

SEQ ID NO: 774933 - RNA, 24 nt, Human
accccgucucuacuaaaaauacaa

SEQ ID NO: 774934 - RNA, 23 nt, Human
accuguagucccagcuacuuggg

SEQ ID NO: 774935 - RNA, 18 nt, Human
acgccacugcacuccagc

SEQ ID NO: 774936 - RNA, 22 nt, Human
acgccacugcacuccagccugg

SEQ ID NO: 774937 - RNA, 21 nt, Human
acucgagaucacgccacugca

SEQ ID NO: 774938 - RNA, 23 nt, Human
acugcacuccagccuggcgacag

SEQ ID NO: 774939 - RNA, 25 nt, Human
acugcacuccagccuggcgacagag

SEQ ID NO: 774940 - RNA, 22 nt, Human
agaaucgcuugaacccaggaga

SEQ ID NO: 774941 - RNA, 20 nt, Human
agcacuuugaggggcagagg

SEQ ID NO: 774942 - RNA, 24 nt, Human
agcacuuugggaggcugaggcggg

SEQ ID NO: 774943 - RNA, 21 nt, Human
agccuggcgacagagcgagac

SEQ ID NO: 774944 - RNA, 23 nt, Human
agccuggcgacagagcgagacuc

SEQ ID NO: 774945 - RNA, 19 nt, Human
aggauuccaaacacacugc

SEQ ID NO: 774946 - RNA, 23 nt, Human
aggcaggagaaucgcuugaaccc

SEQ ID NO: 774947 - RNA, 24 nt, Human
aggcaggagaaucgcuugaaccca

SEQ ID NO: 774948 - RNA, 19 nt, Human
aggccaacgacgagagccc

SEQ ID NO: 774949 - RNA, 19 nt, Human
aggcggguggaucacguaa

SEQ ID NO: 774950 - RNA, 20 nt, Human
aggcugaggcaggagaaucg

SEQ ID NO: 774951 - RNA, 24 nt, Human
aggcugaggcaggagaaucgcuug

SEQ ID NO: 774952 - RNA, 21 nt, Human
aggcugaggcggguggaucac

SEQ ID NO: 774953 - RNA, 22 nt, Human
aggcugaggcggguggaucacg

SEQ ID NO: 774954 - RNA, 20 nt, Human
auagaaaccuccgcaaaacc

SEQ ID NO: 774955 - RNA, 24 nt, Human
aucacgccacugcacuccagccug

SEQ ID NO: 774956 - RNA, 21 nt, Human
auccuggucaaaauggugaaa

SEQ ID NO: 774957 - RNA, 23 nt, Human
caaaaaaaaaaaccaacaaaaaa

SEQ ID NO: 774958 - RNA, 21 nt, Human
caaaaccggccaaacaaacgc

SEQ ID NO: 774959 - RNA, 22 nt, Human
caaaauggugaaaccccgucuc

SEQ ID NO: 774960 - RNA, 24 nt, Human
caaaauggugaaaccccgucucua

SEQ ID NO: 774961 - RNA, 19 nt, Human
caaacaaacgcggacaggc

SEQ ID NO: 774962 - RNA, 21 nt, Human
caacaaaaaaacuggggugaa

SEQ ID NO: 774963 - RNA, 24 nt, Human
caagaccauccuggucaaaauggu

SEQ ID NO: 774964 - RNA, 24 nt, Human
cacaccuguagucccagcuacuug

SEQ ID NO: 774965 - RNA, 21 nt, Human
cacagcucacgccuguaaucc

SEQ ID NO: 774966 - RNA, 24 nt, Human
cacagcucacgccuguaaucccag

SEQ ID NO: 774967 - RNA, 22 nt, Human
caccagaagggagggcccgucc

SEQ ID NO: 774968 - RNA, 23 nt, Human
caccuguagucccagcuacuugg

SEQ ID NO: 774969 - RNA, 24 nt, Human
caccuguagucccagcuacuuggg

SEQ ID NO: 774970 - RNA, 25 nt, Human
caccuucaggcucccuuccagaucc

SEQ ID NO: 774971 - RNA, 26 nt, Human
caccuucaggcucccuuccagaucca

SEQ ID NO: 774972 - RNA, 24 nt, Human
cacgccuguaaucccagcacuuug

SEQ ID NO: 774973 - RNA, 22 nt, Human
cacuccagccuggcgacagagc

SEQ ID NO: 774974 - RNA, 23 nt, Human
cacuccagccuggcgacagagcg

SEQ ID NO: 774975 - RNA, 18 nt, Human
cacugcacuccagccugg

SEQ ID NO: 774976 - RNA, 18 nt, Human
cacugcacuccagccugg

SEQ ID NO: 774977 - RNA, 22 nt, Human
cacugcacuccagccuggcgac

SEQ ID NO: 774978 - RNA, 23 nt, Human
cacugcacuccagccuggcgaca

SEQ ID NO: 774979 - RNA, 23 nt, Human
cacugcacuccagccuggcgaca

SEQ ID NO: 774980 - RNA, 18 nt, Human
cagcacuuugaggggcag

SEQ ID NO: 774981 - RNA, 22 nt, Human
cagcacuuugaggggcagaggu

SEQ ID NO: 774982 - RNA, 24 nt, Human
cagcacuuugaggggcagaggugg

SEQ ID NO: 774983 - RNA, 24 nt, Human
cagcacuuugggaggcugaggcgg

SEQ ID NO: 774984 - RNA, 24 nt, Human
cagcuacuugggaggcugaggcag

SEQ ID NO: 774985 - RNA, 24 nt, Human
cagcucacgccuguaaucccagca

SEQ ID NO: 774986 - RNA, 22 nt, Human
ccaccaccagaagggagggccc

SEQ ID NO: 774987 - RNA, 20 nt, Human
ccaccacccggaccugcucc

SEQ ID NO: 774988 - RNA, 19 nt, Human
ccacugcacuccagccugg

SEQ ID NO: 774989 - RNA, 19 nt, Human
ccacugcacuccagccugg

SEQ ID NO: 774990 - RNA, 20 nt, Human
ccacugcacuccagccuggc

SEQ ID NO: 774991 - RNA, 23 nt, Human
ccacugcacuccagccuggcgac

SEQ ID NO: 774992 - RNA, 18 nt, Human
ccagagacugcaucggcu

SEQ ID NO: 774993 - RNA, 22 nt, Human
ccauguaucuacaugauucaga

SEQ ID NO: 774994 - RNA, 23 nt, Human
ccgcauagaaaccuccgcaaaac

SEQ ID NO: 774995 - RNA, 21 nt, Human
ccuggcgacagagcgagacuc

SEQ ID NO: 774996 - RNA, 22 nt, Human
ccuggucaaaauggugaaaccc

SEQ ID NO: 774997 - RNA, 23 nt, Human
ccuggucaaaauggugaaacccc

SEQ ID NO: 774998 - RNA, 24 nt, Human
ccuggucaaaauggugaaaccccg

SEQ ID NO: 774999 - RNA, 22 nt, Human
ccuguaaucccagcacuuuggg

SEQ ID NO: 775000 - RNA, 21 nt, Human
ccuguagucccagcuacuugg

SEQ ID NO: 775001 - RNA, 21 nt, Human
cgacgagagcccagaccagga

SEQ ID NO: 775002 - RNA, 23 nt, Human
cgagaauauuguggauccgcugu

SEQ ID NO: 775003 - RNA, 23 nt, Human
cgagacuccaucucaaaaaaaaa

SEQ ID NO: 775004 - RNA, 25 nt, Human
cgccacugcacuccagccuggcgac

SEQ ID NO: 775005 - RNA, 23 nt, Human
cgccuguaaucccagcacuuugg

SEQ ID NO: 775006 - RNA, 22 nt, Human
cggguacaccaccuucaggcuc

SEQ ID NO: 775007 - RNA, 20 nt, Human
cucaaaaaaaaaaaccaaca

SEQ ID NO: 775008 - RNA, 22 nt, Human
cucacgccuguaaucccagcac

SEQ ID NO: 775009 - RNA, 24 nt, Human
cucacgccuguaaucccagcacuu

SEQ ID NO: 775010 - RNA, 24 nt, Human
cuccagccuggcgacagagcgaga

SEQ ID NO: 775011 - RNA, 19 nt, Human
cuccaucucaaaaaaaaaa

SEQ ID NO: 775012 - RNA, 23 nt, Human
cugaacaucacucacuuccccua

SEQ ID NO: 775013 - RNA, 19 nt, Human
cuuccagauccaccacccg

SEQ ID NO: 775014 - RNA, 18 nt, Human
gacagaucaugaggucaa

SEQ ID NO: 775015 - RNA, 23 nt, Human
gagaucacgccacugcacuccag

SEQ ID NO: 775016 - RNA, 23 nt, Human
gagguggacagaucaugagguca

SEQ ID NO: 775017 - RNA, 23 nt, Human
gcacuccagccuggcgacagagc

SEQ ID NO: 775018 - RNA, 22 nt, Human
gcaggagaaucgcuugaaccca

SEQ ID NO: 775019 - RNA, 24 nt, Human
ggaucacguaaucccagcacuuug

SEQ ID NO: 775020 - RNA, 20 nt, Human
gggaggggcaguggccaggu

SEQ ID NO: 775021 - RNA, 19 nt, Human
ggggugggccaggcacagc

SEQ ID NO: 775022 - RNA, 18 nt, Human
gucaagagaucaagacca

SEQ ID NO: 775023 - RNA, 18 nt, Human
guggaucacguaauccca

SEQ ID NO: 775024 - RNA, 30 nt, Human
uaccugccauguaucuacaugauucagaac

SEQ ID NO: 775025 - RNA, 23 nt, Human
uacgacagaaucaucuggaaaaa

SEQ ID NO: 775026 - RNA, 21 nt, Human
uagaaaccuccgcaaaaccgg

SEQ ID NO: 775027 - RNA, 23 nt, Human
uaguggcacacaccuguaguccc

SEQ ID NO: 775028 - RNA, 24 nt, Human
uaguggcacacaccuguaguccca

SEQ ID NO: 775029 - RNA, 20 nt, Human
ucaaaaaccguaaaaucacu

SEQ ID NO: 775030 - RNA, 23 nt, Human
ucacgccacugcacuccagccug

SEQ ID NO: 775031 - RNA, 18 nt, Human
ucacguaaucccagcacu

SEQ ID NO: 775032 - RNA, 25 nt, Human
ucagcgcacgacagucacgugggga

SEQ ID NO: 775033 - RNA, 24 nt, Human
ucaugaggucaagagaucaagacc

SEQ ID NO: 775034 - RNA, 19 nt, Human
uccaccacccggaccugcu

SEQ ID NO: 775035 - RNA, 22 nt, Human
uccaccacccggaccugcucca

SEQ ID NO: 775036 - RNA, 22 nt, Human
uccagccuggcgacagagcgag

SEQ ID NO: 775037 - RNA, 24 nt, Human
uccaucucaaaaaaaaaaaccaac

SEQ ID NO: 775038 - RNA, 25 nt, Human
ucccaucaaaaaccguaaaaucacu

SEQ ID NO: 775039 - RNA, 20 nt, Human
uccgcaaaaccggccaaaca

SEQ ID NO: 775040 - RNA, 19 nt, Human
ucuaaaguguacuuuuuca

SEQ ID NO: 775041 - RNA, 21 nt, Human
ucucuacuaaaaauacaaaaa

SEQ ID NO: 775042 - RNA, 22 nt, Human
ugaacaucacucacuuccccua

SEQ ID NO: 775043 - RNA, 24 nt, Human
ugaggcaggagaaucgcuugaacc

SEQ ID NO: 775044 - RNA, 25 nt, Human
ugaggcaggagaaucgcuugaaccc

SEQ ID NO: 775045 - RNA, 18 nt, Human
ugaggcggguggaucacg

SEQ ID NO: 775046 - RNA, 19 nt, Human
ugaggcggguggaucacgu

SEQ ID NO: 775047 - RNA, 25 nt, Human
ugaggcggguggaucacguaauccc

SEQ ID NO: 775048 - RNA, 20 nt, Human
ugaggggcagagguggacag

SEQ ID NO: 775049 - RNA, 18 nt, Human
ugcuggggugggccaggc

SEQ ID NO: 775050 - RNA, 24 nt, Human
uggacggguacaccaccuucaggc

SEQ ID NO: 775051 - RNA, 19 nt, Human
uggaucacguaaucccagc

SEQ ID NO: 775052 - RNA, 22 nt, Human
uggcacacaccuguagucccag

SEQ ID NO: 775053 - RNA, 19 nt, Human
ugggaggcugaggcaggag

SEQ ID NO: 775054 - RNA, 23 nt, Human
ugggaggcugaggcaggagaauc

SEQ ID NO: 775055 - RNA, 20 nt, Human
ugggaggcugaggcgggugg

SEQ ID NO: 775056 - RNA, 23 nt, Human
ugggaggcugaggcggguggauc

SEQ ID NO: 775057 - RNA, 24 nt, Human
ugggaggcugaggcggguggauca

SEQ ID NO: 775058 - RNA, 22 nt, Human
ugggccaggcacagcucacgcc

SEQ ID NO: 775059 - RNA, 19 nt, Human
uguaacgacaacauagcau

SEQ ID NO: 775060 - RNA, 24 nt, Human
ugucagguaaguguccgucacuga

SEQ ID NO: 775061 - RNA, 23 nt, Human
uuccagauccaccacccggaccu

SEQ ID NO: 775062 - RNA, 25 nt, Human
uuccagauccaccacccggaccugc

SEQ ID NO: 775063 - RNA, 24 nt, Human
uugggaggcugaggcaggagaauc

SEQ ID NO: 775064 - RNA, 25 nt, Human
uugggaggcugaggcggguggauca

SEQ ID NO: 775065 - RNA, 20 nt, Human
aaaaagaaagaaacaaaggg

SEQ ID NO: 775066 - RNA, 20 nt, Human
aaaagaaaacagcuugucca

SEQ ID NO: 775067 - RNA, 18 nt, Human
aaagcuuuuugauuugag

SEQ ID NO: 775068 - RNA, 20 nt, Human
aaccauaggucacccaccuc

SEQ ID NO: 775069 - RNA, 21 nt, Human
aaccuagaaaagaaaacagcu

SEQ ID NO: 775070 - RNA, 22 nt, Human
aagaaagaaacaaaggguugaa

SEQ ID NO: 775071 - RNA, 22 nt, Human
aagauaccaaaagaaauaccag

SEQ ID NO: 775072 - RNA, 24 nt, Human
aagcaugaaaugaaaaauugugga

SEQ ID NO: 775073 - RNA, 23 nt, Human
aauggccaaccaucaccauuaug

SEQ ID NO: 775074 - RNA, 22 nt, Human
aauuguccuauugcaucaaucu

SEQ ID NO: 775075 - RNA, 22 nt, Human
acaggaagaaagauaccaaaag

SEQ ID NO: 775076 - RNA, 20 nt, Human
accaaucuucuagccccucc

SEQ ID NO: 775077 - RNA, 23 nt, Human
accaaugccaaagaauaguuuca

SEQ ID NO: 775078 - RNA, 22 nt, Human
accagacuuuccaucacuccaa

SEQ ID NO: 775079 - RNA, 18 nt, Human
acccuggggcaauagaau

SEQ ID NO: 775080 - RNA, 25 nt, Human
agaaaagaaaacagcuuguccaugu

SEQ ID NO: 775081 - RNA, 20 nt, Human
agaaguugucauuagaauau

SEQ ID NO: 775082 - RNA, 23 nt, Human
agagaaaaugugguaauagagag

SEQ ID NO: 775083 - RNA, 25 nt, Human
agagccagcaagccuacugaugaga

SEQ ID NO: 775084 - RNA, 20 nt, Human
agauguuuccuuggaccaga

SEQ ID NO: 775085 - RNA, 20 nt, Human
agcaagccuacugaugagag

SEQ ID NO: 775086 - RNA, 18 nt, Human
agcacagagcuaagagga

SEQ ID NO: 775087 - RNA, 22 nt, Human
agccacagaaauaaaacuaucc

SEQ ID NO: 775088 - RNA, 22 nt, Human
aggaagaaagauaccaaaagaa

SEQ ID NO: 775089 - RNA, 25 nt, Human
aggaagaaagauaccaaaagaaaua

SEQ ID NO: 775090 - RNA, 18 nt, Human
agguuacaaagacucaaa

SEQ ID NO: 775091 - RNA, 21 nt, Human
aguuucuauuuaucuagcaac

SEQ ID NO: 775092 - RNA, 23 nt, Human
auauuagagucccuuaagaggua

SEQ ID NO: 775093 - RNA, 22 nt, Human
augaacaugaagcauuuaccaa

SEQ ID NO: 775094 - RNA, 20 nt, Human
auuaauucucccucuucccu

SEQ ID NO: 775095 - RNA, 24 nt, Human
caaaagaaauaccagaaucauuuc

SEQ ID NO: 775096 - RNA, 23 nt, Human
caaauaguccccucaaauagucu

SEQ ID NO: 775097 - RNA, 18 nt, Human
cacaauggguuuaauuca

SEQ ID NO: 775098 - RNA, 19 nt, Human
cacagaugaagcuaagcgc

SEQ ID NO: 775099 - RNA, 20 nt, Human
caccucccuccaagugauaa

SEQ ID NO: 775100 - RNA, 20 nt, Human
cagaaauaaaacuauccaac

SEQ ID NO: 775101 - RNA, 18 nt, Human
cagaauuauccugacuga

SEQ ID NO: 775102 - RNA, 19 nt, Human
cagagaaauagagcuauua

SEQ ID NO: 775103 - RNA, 21 nt, Human
cagcacagaugaagcuaagcg

SEQ ID NO: 775104 - RNA, 20 nt, Human
caugcaaucugaaucagacc

SEQ ID NO: 775105 - RNA, 25 nt, Human
cauuagaauaugugggauuuaucac

SEQ ID NO: 775106 - RNA, 19 nt, Human
ccagaguccuuaccacccc

SEQ ID NO: 775107 - RNA, 21 nt, Human
ccauggacaccaaugccaaag

SEQ ID NO: 775108 - RNA, 21 nt, Human
ccucccuccaagugauaacuc

SEQ ID NO: 775109 - RNA, 21 nt, Human
cuagcaacagaggaaaacaaa

SEQ ID NO: 775110 - RNA, 21 nt, Human
cucaaaauacaggcucuugau

SEQ ID NO: 775111 - RNA, 23 nt, Human
cucuaguucuacaggaauccauc

SEQ ID NO: 775112 - RNA, 23 nt, Human
cuguauuacauucagacaauaag

SEQ ID NO: 775113 - RNA, 19 nt, Human
cuuguaaacaacuaaauaa

SEQ ID NO: 775114 - RNA, 22 nt, Human
gaaaaugugguaauagagaggg

SEQ ID NO: 775115 - RNA, 21 nt, Human
gcccaccaaucuucuagcccc

SEQ ID NO: 775116 - RNA, 19 nt, Human
gcuacauuuauagccgaau

SEQ ID NO: 775117 - RNA, 21 nt, Human
gcuuucaacucuguggcuuuc

SEQ ID NO: 775118 - RNA, 21 nt, Human
gcuuucaacucuguggcuuuc

SEQ ID NO: 775119 - RNA, 20 nt, Human
ggaccagagaucccacaggg

SEQ ID NO: 775120 - RNA, 18 nt, Human
gggggagagagagauggu

SEQ ID NO: 775121 - RNA, 24 nt, Human
guagguagggggagagagagaugg

SEQ ID NO: 775122 - RNA, 19 nt, Human
guaggugcuguuguuaucu

SEQ ID NO: 775123 - RNA, 19 nt, Human
uaaaagauaaaugcccaag

SEQ ID NO: 775124 - RNA, 22 nt, Human
uaaaauaguuucuguugacuaa

SEQ ID NO: 775125 - RNA, 20 nt, Human
uacuguuaauaagagaaaau

SEQ ID NO: 775126 - RNA, 21 nt, Human
uagagcuauuauuaguuucua

SEQ ID NO: 775127 - RNA, 22 nt, Human
uagcaaacagaauuauccugac

SEQ ID NO: 775128 - RNA, 21 nt, Human
uagcaacagaggaaaacaaaa

SEQ ID NO: 775129 - RNA, 25 nt, Human
uagcaacagaggaaaacaaaaaauc

SEQ ID NO: 775130 - RNA, 22 nt, Human
uagggccauggacaccaaugcc

SEQ ID NO: 775131 - RNA, 18 nt, Human
uagguuacaaagacucaa

SEQ ID NO: 775132 - RNA, 19 nt, Human
uauagaaugaggguaacag

SEQ ID NO: 775133 - RNA, 23 nt, Human
uaucagacugaauuuuuaucuag

SEQ ID NO: 775134 - RNA, 24 nt, Human
uaucuccauuuuauagacuagaaa

SEQ ID NO: 775135 - RNA, 23 nt, Human
uauggaagcaugaaaugaaaaau

SEQ ID NO: 775136 - RNA, 22 nt, Human
uauguuaaaaaucccccaugca

SEQ ID NO: 775137 - RNA, 24 nt, Human
uauuuaaauuguggauaguuuggu

SEQ ID NO: 775138 - RNA, 18 nt, Human
ucacagagccagcaagcc

SEQ ID NO: 775139 - RNA, 19 nt, Human
ucacagagccagcaagccu

SEQ ID NO: 775140 - RNA, 19 nt, Human
ucagagcucucccacuaaa

SEQ ID NO: 775141 - RNA, 24 nt, Human
ucagagcucucccacuaaaaauac

SEQ ID NO: 775142 - RNA, 19 nt, Human
uccacaaguacaauuuuaa

SEQ ID NO: 775143 - RNA, 22 nt, Human
uccauagguuguauagaaugag

SEQ ID NO: 775144 - RNA, 25 nt, Human
ucccacagggguucggcauuagcac

SEQ ID NO: 775145 - RNA, 22 nt, Human
ucccccaggggacugacugcuu

SEQ ID NO: 775146 - RNA, 19 nt, Human
uccuagguuacaaagacuc

SEQ ID NO: 775147 - RNA, 18 nt, Human
ucucuguagaugccaagg

SEQ ID NO: 775148 - RNA, 19 nt, Human
ugaagugcagagagauuaa

SEQ ID NO: 775149 - RNA, 22 nt, Human
ugacccggaaggauuaaagaag

SEQ ID NO: 775150 - RNA, 22 nt, Human
ugacugacaauugcucaucucc

SEQ ID NO: 775151 - RNA, 22 nt, Human
ugacuuuaacugugcuagacaa

SEQ ID NO: 775152 - RNA, 23 nt, Human
ugagagaagauucagugaauggu

SEQ ID NO: 775153 - RNA, 24 nt, Human
ugagagcacagagcuaagaggacc

SEQ ID NO: 775154 - RNA, 18 nt, Human
ugauagauaacacaauac

SEQ ID NO: 775155 - RNA, 19 nt, Human
uggacaccaaugccaaaga

SEQ ID NO: 775156 - RNA, 19 nt, Human
ugggcugagguccaguaaa

SEQ ID NO: 775157 - RNA, 21 nt, Human
ugggcugagguccaguaaauu

SEQ ID NO: 775158 - RNA, 23 nt, Human
uggguuuaauucaguuugaaagc

SEQ ID NO: 775159 - RNA, 26 nt, Human
uggugauaauagaaaaggcacagaau

SEQ ID NO: 775160 - RNA, 19 nt, Human
uguaagauggcgguauagg

SEQ ID NO: 775161 - RNA, 20 nt, Human
uguacaggaagaaagauacc

SEQ ID NO: 775162 - RNA, 26 nt, Human
uuauucuacagugaaaaagagaguca

SEQ ID NO: 775163 - RNA, 23 nt, Human
uucacaaaaugaaaaagaaagaa

SEQ ID NO: 775164 - RNA, 22 nt, Human
uugaaucacaaaagcucaagua

SEQ ID NO: 775165 - RNA, 24 nt, Human
uugccagagucugcaaaaucaagu

SEQ ID NO: 775166 - RNA, 23 nt, Human
aaaauguccccagcucccugccc

SEQ ID NO: 775167 - RNA, 21 nt, Human
aaacccaugucccaggacagg

SEQ ID NO: 775168 - RNA, 27 nt, Human
aaagagcuuaacuaggaaacauguagc

SEQ ID NO: 775169 - RNA, 22 nt, Human
aaagcuaguaaaacaggaaccc

SEQ ID NO: 775170 - RNA, 22 nt, Human
aacacacaccugggcauggcca

SEQ ID NO: 775171 - RNA, 19 nt, Human
aacuucuccccaaacccuc

SEQ ID NO: 775172 - RNA, 21 nt, Human
aacuucuccccaaacccucca

SEQ ID NO: 775173 - RNA, 24 nt, Human
aagcaggagccuggaguccccagc

SEQ ID NO: 775174 - RNA, 19 nt, Human
aagccucuucccacuccag

SEQ ID NO: 775175 - RNA, 21 nt, Human
aaggagucacagaaagggggg

SEQ ID NO: 775176 - RNA, 24 nt, Human
aaggagucacagaaagggggggca

SEQ ID NO: 775177 - RNA, 18 nt, Human
aaugacaacaaaaaaggg

SEQ ID NO: 775178 - RNA, 27 nt, Human
acacagugaagcacuggucugcagucu

SEQ ID NO: 775179 - RNA, 18 nt, Human
accagcugucaagcuguc

SEQ ID NO: 775180 - RNA, 20 nt, Human
acccaccggugcacaggccc

SEQ ID NO: 775181 - RNA, 22 nt, Human
acccagguccagucucaggccc

SEQ ID NO: 775182 - RNA, 22 nt, Human
acccugaggacaucacggaagc

SEQ ID NO: 775183 - RNA, 23 nt, Human
accggcagugcuaugggcgcccc

SEQ ID NO: 775184 - RNA, 23 nt, Human
accucgccacccuccacccccca

SEQ ID NO: 775185 - RNA, 19 nt, Human
accuugaaacccuaccagc

SEQ ID NO: 775186 - RNA, 23 nt, Human
accuugaaacccuaccagcacug

SEQ ID NO: 775187 - RNA, 19 nt, Human
acucugcccccaaagcugg

SEQ ID NO: 775188 - RNA, 21 nt, Human
acuggucugcagucuccgcac

SEQ ID NO: 775189 - RNA, 24 nt, Human
agaaagggggggcacuugggagug

SEQ ID NO: 775190 - RNA, 18 nt, Human
agaccagagagccccaag

SEQ ID NO: 775191 - RNA, 20 nt, Human
agacccagacuccaggccug

SEQ ID NO: 775192 - RNA, 18 nt, Human
agcaacagggaggggggg

SEQ ID NO: 775193 - RNA, 20 nt, Human
agccgcccugccccugcccc

SEQ ID NO: 775194 - RNA, 20 nt, Human
agccggggagggggcagacc

SEQ ID NO: 775195 - RNA, 19 nt, Human
agccuggaguccccagccu

SEQ ID NO: 775196 - RNA, 21 nt, Human
agcgggccuuugggggagcag

SEQ ID NO: 775197 - RNA, 18 nt, Human
agcuacaguaaagcagga

SEQ ID NO: 775198 - RNA, 23 nt, Human
agcuacaguaaagcaggagccug

SEQ ID NO: 775199 - RNA, 25 nt, Human
agcuggccugagaccagagagcccc

SEQ ID NO: 775200 - RNA, 23 nt, Human
aggaacuggggugcucugugagc

SEQ ID NO: 775201 - RNA, 23 nt, Human
aggacaucacggaagcccaaaga

SEQ ID NO: 775202 - RNA, 23 nt, Human
aggacucugcccccaaagcuggu

SEQ ID NO: 775203 - RNA, 21 nt, Human
aggcaggaauaaagacauuaa

SEQ ID NO: 775204 - RNA, 21 nt, Human
aggcagugggucccuccugga

SEQ ID NO: 775205 - RNA, 22 nt, Human
aggcuccuauccccaguggggc

SEQ ID NO: 775206 - RNA, 21 nt, Human
aggcugcugaggcugacccag

SEQ ID NO: 775207 - RNA, 23 nt, Human
aggcugcugaggcugacccaggc

SEQ ID NO: 775208 - RNA, 21 nt, Human
agggaggauaaggccuagagc

SEQ ID NO: 775209 - RNA, 21 nt, Human
agggggcagacccagacucca

SEQ ID NO: 775210 - RNA, 22 nt, Human
aggguugaaggcucccagaacu

SEQ ID NO: 775211 - RNA, 23 nt, Human
aggguuucauugccagcucccca

SEQ ID NO: 775212 - RNA, 18 nt, Human
aguaaagcaggagccugg

SEQ ID NO: 775213 - RNA, 22 nt, Human
aguagcuggugaggaacugggg

SEQ ID NO: 775214 - RNA, 23 nt, Human
auccugcgucccccuucccccag

SEQ ID NO: 775215 - RNA, 27 nt, Human
auccugcgucccccuucccccagcccu

SEQ ID NO: 775216 - RNA, 19 nt, Human
caaacaaaacuguauaaac

SEQ ID NO: 775217 - RNA, 21 nt, Human
caacuucuccccaaacccucc

SEQ ID NO: 775218 - RNA, 23 nt, Human
caagaacaugaaacccauguccc

SEQ ID NO: 775219 - RNA, 19 nt, Human
cacacagugaagcacuggu

SEQ ID NO: 775220 - RNA, 18 nt, Human
cacacuuguuccuucugg

SEQ ID NO: 775221 - RNA, 21 nt, Human
cacagugaagcacuggucugc

SEQ ID NO: 775222 - RNA, 18 nt, Human
caccccccacgcucaccc

SEQ ID NO: 775223 - RNA, 18 nt, Human
caccccccacgcucaccc

SEQ ID NO: 775224 - RNA, 19 nt, Human
cacccuccaccccccacgc

SEQ ID NO: 775225 - RNA, 19 nt, Human
caccucgccacccuccacc

SEQ ID NO: 775226 - RNA, 21 nt, Human
caccucgccacccuccacccc

SEQ ID NO: 775227 - RNA, 19 nt, Human
caccugcugcccaggcccc

SEQ ID NO: 775228 - RNA, 23 nt, Human
cacuggucugcagucuccgcacc

SEQ ID NO: 775229 - RNA, 19 nt, Human
cacuguacccuccaagccc

SEQ ID NO: 775230 - RNA, 20 nt, Human
cagacccccagcaccccccu

SEQ ID NO: 775231 - RNA, 22 nt, Human
cagaguggguggggaaggcaag

SEQ ID NO: 775232 - RNA, 20 nt, Human
cagcccacugggagagauca

SEQ ID NO: 775233 - RNA, 23 nt, Human
cagccucccccuccucccccucc

SEQ ID NO: 775234 - RNA, 19 nt, Human
cagccugcauaccccuccu

SEQ ID NO: 775235 - RNA, 24 nt, Human
cagcuucuggggacaucuccagga

SEQ ID NO: 775236 - RNA, 19 nt, Human
caggacccuuggugccacc

SEQ ID NO: 775237 - RNA, 24 nt, Human
caggacccuuggugccaccuggug

SEQ ID NO: 775238 - RNA, 19 nt, Human
caggcuccaacuggccaac

SEQ ID NO: 775239 - RNA, 23 nt, Human
caguauggccugacaggucucag

SEQ ID NO: 775240 - RNA, 21 nt, Human
cagucccccuaaccauucccc

SEQ ID NO: 775241 - RNA, 28 nt, Human
ccaaaaaaaaaaaaaaguaaaggcuucc

SEQ ID NO: 775242 - RNA, 22 nt, Human
ccaagcccagagaacaaccagg

SEQ ID NO: 775243 - RNA, 19 nt, Human
ccaccaacaauggcccaag

SEQ ID NO: 775244 - RNA, 19 nt, Human
ccagaagccuucuuccucg

SEQ ID NO: 775245 - RNA, 23 nt, Human
ccaggacagcaggagcgccugag

SEQ ID NO: 775246 - RNA, 19 nt, Human
ccaggcccgcacuacugug

SEQ ID NO: 775247 - RNA, 21 nt, Human
ccaggcccgcacuacugugcu

SEQ ID NO: 775248 - RNA, 22 nt, Human
ccaggccugaguucuagccaaa

SEQ ID NO: 775249 - RNA, 21 nt, Human
ccaucgccagcuggccugaga

SEQ ID NO: 775250 - RNA, 22 nt, Human
ccauggaggacccugccuacag

SEQ ID NO: 775251 - RNA, 20 nt, Human
cccacuaauagcaccuugaa

SEQ ID NO: 775252 - RNA, 19 nt, Human
cccaggccccuuucuuucu

SEQ ID NO: 775253 - RNA, 20 nt, Human
cccagugccaugggccucau

SEQ ID NO: 775254 - RNA, 23 nt, Human
cccaucgccagcuggccugagac

SEQ ID NO: 775255 - RNA, 23 nt, Human
ccccacuccacacagugaagcac

SEQ ID NO: 775256 - RNA, 18 nt, Human
ccccagcaccccccucac

SEQ ID NO: 775257 - RNA, 19 nt, Human
ccccagcaccccccucacc

SEQ ID NO: 775258 - RNA, 18 nt, Human
ccccaggacagcaggagc

SEQ ID NO: 775259 - RNA, 21 nt, Human
cccccagcaccccccucaccu

SEQ ID NO: 775260 - RNA, 22 nt, Human
cccccagccucccccuccuccc

SEQ ID NO: 775261 - RNA, 20 nt, Human
cccccuccucccccuccucc

SEQ ID NO: 775262 - RNA, 19 nt, Human
ccccuccucccccuccucc

SEQ ID NO: 775263 - RNA, 20 nt, Human
ccccuccuccuccucagagc

SEQ ID NO: 775264 - RNA, 23 nt, Human
ccccuccuccuccucagagcucu

SEQ ID NO: 775265 - RNA, 18 nt, Human
ccccucuggcacaggccu

SEQ ID NO: 775266 - RNA, 19 nt, Human
ccccugccugccccacucc

SEQ ID NO: 775267 - RNA, 22 nt, Human
ccccugcuugcccccagccucc

SEQ ID NO: 775268 - RNA, 28 nt, Human
ccccuucauccucucacucgcaugccug

SEQ ID NO: 775269 - RNA, 26 nt, Human
cccugcuugcccccagccucccccuc

SEQ ID NO: 775270 - RNA, 25 nt, Human
cccuuggugccaccuggugcagguc

SEQ ID NO: 775271 - RNA, 20 nt, Human
ccgcccugccccugccccac

SEQ ID NO: 775272 - RNA, 20 nt, Human
ccuaggacucugcccccaaa

SEQ ID NO: 775273 - RNA, 18 nt, Human
ccuccaagcccagagaac

SEQ ID NO: 775274 - RNA, 23 nt, Human
ccuccaagcccagagaacaacca

SEQ ID NO: 775275 - RNA, 18 nt, Human
ccuccaccccccacgcuc

SEQ ID NO: 775276 - RNA, 21 nt, Human
ccucgccacccuccacccccc

SEQ ID NO: 775277 - RNA, 22 nt, Human
ccucuucccacuccagccaugc

SEQ ID NO: 775278 - RNA, 20 nt, Human
ccugacuccaggccccagcc

SEQ ID NO: 775279 - RNA, 18 nt, Human
ccugagaccagagagccc

SEQ ID NO: 775280 - RNA, 19 nt, Human
ccugccccacuaauagcac

SEQ ID NO: 775281 - RNA, 24 nt, Human
ccugccccacuccacacagugaag

SEQ ID NO: 775282 - RNA, 21 nt, Human
ccuggaaagugaguauggugg

SEQ ID NO: 775283 - RNA, 19 nt, Human
ccuugaaacccuaccagca

SEQ ID NO: 775284 - RNA, 19 nt, Human
cgcaugccugcugugcccc

SEQ ID NO: 775285 - RNA, 20 nt, Human
cgucccccuucccccagccc

SEQ ID NO: 775286 - RNA, 27 nt, Human
cuaaccauucccccggggcccaagccu

SEQ ID NO: 775287 - RNA, 27 nt, Human
cucacagcgcugugaggcacagcagcu

SEQ ID NO: 775288 - RNA, 18 nt, Human
cucaugggggcaagcaau

SEQ ID NO: 775289 - RNA, 22 nt, Human
cucgcaugccugcugugcccca

SEQ ID NO: 775290 - RNA, 27 nt, Human
cugcgccuccccaguccccccaauccc

SEQ ID NO: 775291 - RNA, 19 nt, Human
cuggagugggcccugacuc

SEQ ID NO: 775292 - RNA, 20 nt, Human
cuggggcuguggggugccug

SEQ ID NO: 775293 - RNA, 21 nt, Human
cuggggcuguggggugccugu

SEQ ID NO: 775294 - RNA, 23 nt, Human
cugugcuccccgggaaggcagug

SEQ ID NO: 775295 - RNA, 20 nt, Human
cuuauggaaccuuccucccc

SEQ ID NO: 775296 - RNA, 21 nt, Human
gaaacccuaccagcacugccc

SEQ ID NO: 775297 - RNA, 20 nt, Human
gaagggcaccguggagacua

SEQ ID NO: 775298 - RNA, 26 nt, Human
gacaggguuucauugccagcucccca

SEQ ID NO: 775299 - RNA, 19 nt, Human
gacccccagcaccccccuc

SEQ ID NO: 775300 - RNA, 24 nt, Human
gaggaacuggggugcucugugagc

SEQ ID NO: 775301 - RNA, 20 nt, Human
gagggacuggccacaccugc

SEQ ID NO: 775302 - RNA, 24 nt, Human
gcaacagggagggggggacccuga

SEQ ID NO: 775303 - RNA, 24 nt, Human
gcaagcaauugggucuaggcugcg

SEQ ID NO: 775304 - RNA, 24 nt, Human
gcacaggcccaggagggacgagga

SEQ ID NO: 775305 - RNA, 20 nt, Human
gcagcagaguggguggggaa

SEQ ID NO: 775306 - RNA, 19 nt, Human
gccagccugcauaccccuc

SEQ ID NO: 775307 - RNA, 22 nt, Human
gccagcuccccaccagugucuc

SEQ ID NO: 775308 - RNA, 23 nt, Human
gccagcuccccaccagugucucu

SEQ ID NO: 775309 - RNA, 21 nt, Human
gcccgcacuacugugcucccc

SEQ ID NO: 775310 - RNA, 19 nt, Human
gcccugacuccaggcccca

SEQ ID NO: 775311 - RNA, 21 nt, Human
gccggggagggggcagaccca

SEQ ID NO: 775312 - RNA, 18 nt, Human
gcuacaguaaagcaggag

SEQ ID NO: 775313 - RNA, 21 nt, Human
gcucuggggcuguggggugcc

SEQ ID NO: 775314 - RNA, 24 nt, Human
gcugacccaggcuccaacuggcca

SEQ ID NO: 775315 - RNA, 18 nt, Human
gcugugccccaugcucug

SEQ ID NO: 775316 - RNA, 24 nt, Human
gcugugccccaugcucuggggcug

SEQ ID NO: 775317 - RNA, 19 nt, Human
gcuuccccguggccccugc

SEQ ID NO: 775318 - RNA, 26 nt, Human
ggaaacauguagcuuauggaaccuuc

SEQ ID NO: 775319 - RNA, 20 nt, Human
ggacacaggcuccuaucccc

SEQ ID NO: 775320 - RNA, 20 nt, Human
ggacauggggauaggcugcu

SEQ ID NO: 775321 - RNA, 23 nt, Human
ggagauccuggugccagugaugg

SEQ ID NO: 775322 - RNA, 21 nt, Human
ggaggacccugccuacagccc

SEQ ID NO: 775323 - RNA, 18 nt, Human
ggagggacgaggacgcug

SEQ ID NO: 775324 - RNA, 24 nt, Human
ggagggggcagacccagacuccag

SEQ ID NO: 775325 - RNA, 22 nt, Human
gggaaggcaauagugucgggga

SEQ ID NO: 775326 - RNA, 21 nt, Human
gggacaucuccaggacucagg

SEQ ID NO: 775327 - RNA, 20 nt, Human
gggaggauaaggccuagagc

SEQ ID NO: 775328 - RNA, 21 nt, Human
gggagugguggggguuuaagg

SEQ ID NO: 775329 - RNA, 21 nt, Human
gggcaggggccucccaggaga

SEQ ID NO: 775330 - RNA, 21 nt, Human
gggggacccugaggacaucac

SEQ ID NO: 775331 - RNA, 20 nt, Human
ggggguuuaaggugcaaaga

SEQ ID NO: 775332 - RNA, 18 nt, Human
gguggcacgccaacuucu

SEQ ID NO: 775333 - RNA, 21 nt, Human
ggugugggauauauggccaga

SEQ ID NO: 775334 - RNA, 23 nt, Human
gucacagaaagggggggcacuug

SEQ ID NO: 775335 - RNA, 21 nt, Human
gugccuguacacgagcaguug

SEQ ID NO: 775336 - RNA, 21 nt, Human
gugcugccagucagccugucu

SEQ ID NO: 775337 - RNA, 19 nt, Human
uaaaaagauguaaaagcua

SEQ ID NO: 775338 - RNA, 20 nt, Human
uaaaaauagcaacagggagg

SEQ ID NO: 775339 - RNA, 19 nt, Human
uaaaauguccccagcuccc

SEQ ID NO: 775340 - RNA, 22 nt, Human
uaaaauguccccagcucccugc

SEQ ID NO: 775341 - RNA, 21 nt, Human
uaaagcaggagccuggagucc

SEQ ID NO: 775342 - RNA, 25 nt, Human
uaccaagcccucugugaagggcacc

SEQ ID NO: 775343 - RNA, 18 nt, Human
uagcaacagggagggggg

SEQ ID NO: 775344 - RNA, 20 nt, Human
uagcaccuugaaacccuacc

SEQ ID NO: 775345 - RNA, 19 nt, Human
uagcuggugaggaacuggg

SEQ ID NO: 775346 - RNA, 19 nt, Human
uaggaaagagcuuaacuag

SEQ ID NO: 775347 - RNA, 19 nt, Human
uauggaaccuuccucccca

SEQ ID NO: 775348 - RNA, 18 nt, Human
ucacccagguccagucuc

SEQ ID NO: 775349 - RNA, 22 nt, Human
ucacuuccaaaaaaaaaaaaaa

SEQ ID NO: 775350 - RNA, 22 nt, Human
uccaagcccagagaacaaccag

SEQ ID NO: 775351 - RNA, 21 nt, Human
uccccaaacccuccaagauga

SEQ ID NO: 775352 - RNA, 24 nt, Human
uccccagccuuggggugggggucc

SEQ ID NO: 775353 - RNA, 20 nt, Human
uccccagcucccugccccag

SEQ ID NO: 775354 - RNA, 18 nt, Human
ucccccggggcccaagcc

SEQ ID NO: 775355 - RNA, 18 nt, Human
ucccccuaaccauucccc

SEQ ID NO: 775356 - RNA, 21 nt, Human
ucccccuucccccagcccugg

SEQ ID NO: 775357 - RNA, 18 nt, Human
uccgcaccucgccacccu

SEQ ID NO: 775358 - RNA, 18 nt, Human
ucgccacccuccaccccc

SEQ ID NO: 775359 - RNA, 19 nt, Human
ucggcuuccccguggcccc

SEQ ID NO: 775360 - RNA, 22 nt, Human
ucuccgcaccucgccacccucc

SEQ ID NO: 775361 - RNA, 19 nt, Human
ucugcagucuccgcaccuc

SEQ ID NO: 775362 - RNA, 21 nt, Human
ucuggaccccucaccugaucc

SEQ ID NO: 775363 - RNA, 20 nt, Human
ucuggggacaucuccaggac

SEQ ID NO: 775364 - RNA, 21 nt, Human
ugacuguggggaggggggucu

SEQ ID NO: 775365 - RNA, 21 nt, Human
ugagcagccgcccugccccug

SEQ ID NO: 775366 - RNA, 20 nt, Human
ugaggaagcaaauuaggggc

SEQ ID NO: 775367 - RNA, 26 nt, Human
ugaggacaucacggaagcccaaagau

SEQ ID NO: 775368 - RNA, 18 nt, Human
ugaggugccauuauugcu

SEQ ID NO: 775369 - RNA, 23 nt, Human
ugaguauggugcccuagucgccu

SEQ ID NO: 775370 - RNA, 18 nt, Human
ugaugacaccaccagugc

SEQ ID NO: 775371 - RNA, 22 nt, Human
ugcaaagaguauaacaaacaaa

SEQ ID NO: 775372 - RNA, 18 nt, Human
ugcacgggugcagcucgg

SEQ ID NO: 775373 - RNA, 21 nt, Human
ugccaccuggugcaggucagg

SEQ ID NO: 775374 - RNA, 18 nt, Human
ugcgccuccccagucccc

SEQ ID NO: 775375 - RNA, 20 nt, Human
ugcggcucucagacuggguc

SEQ ID NO: 775376 - RNA, 20 nt, Human
ugcucuggggcuguggggug

SEQ ID NO: 775377 - RNA, 24 nt, Human
ugcucuggggcuguggggugccug

SEQ ID NO: 775378 - RNA, 22 nt, Human
ugcuucggcuuccccguggccc

SEQ ID NO: 775379 - RNA, 22 nt, Human
uggacacagccacacuuguucc

SEQ ID NO: 775380 - RNA, 22 nt, Human
uggaccccucaccugaucccag

SEQ ID NO: 775381 - RNA, 23 nt, Human
uggagcagggcccaggcccgcac

SEQ ID NO: 775382 - RNA, 21 nt, Human
uggagccagccagggacaggu

SEQ ID NO: 775383 - RNA, 21 nt, Human
uggcacaggccuuggcagagg

SEQ ID NO: 775384 - RNA, 18 nt, Human
uggcagagggacuggcca

SEQ ID NO: 775385 - RNA, 27 nt, Human
ugggaaaaugugagccagcuccaaaga

SEQ ID NO: 775386 - RNA, 22 nt, Human
ugggagagaucaacuuuuuuug

SEQ ID NO: 775387 - RNA, 19 nt, Human
ugggaggggaugauccugc

SEQ ID NO: 775388 - RNA, 19 nt, Human
ugggcauggccauucugcc

SEQ ID NO: 775389 - RNA, 21 nt, Human
uggggacaucuccaggacuca

SEQ ID NO: 775390 - RNA, 22 nt, Human
uggggguggcacgccaacuucu

SEQ ID NO: 775391 - RNA, 21 nt, Human
uggggguuuaaggugcaaaga

SEQ ID NO: 775392 - RNA, 20 nt, Human
uggucugcagucuccgcacc

SEQ ID NO: 775393 - RNA, 20 nt, Human
ugucggggaguggugggggu

SEQ ID NO: 775394 - RNA, 23 nt, Human
ugucggggagugguggggguuua

SEQ ID NO: 775395 - RNA, 24 nt, Human
ugucugcccaaggagggucuggcu

SEQ ID NO: 775396 - RNA, 21 nt, Human
ugugggagauccuggugccag

SEQ ID NO: 775397 - RNA, 18 nt, Human
uuagugcuagccucaugg

SEQ ID NO: 775398 - RNA, 21 nt, Human
uuccccguggccccugcuugc

SEQ ID NO: 775399 - RNA, 25 nt, Human
uucuccccaaacccuccaagaugag

SEQ ID NO: 775400 - RNA, 18 nt, Human
uucuggagguggagcagg

SEQ ID NO: 775401 - RNA, 22 nt, Human
uucuuuuuccuucacuuccaaa

SEQ ID NO: 775402 - RNA, 21 nt, Human
uugcuucuggccuuguggucu

SEQ ID NO: 775403 - RNA, 24 nt, Human
uugggcaaggaagcugcuggcacu

SEQ ID NO: 775404 - RNA, 22 nt, Human
uuguguuguuuuguuuuaaaua

SEQ ID NO: 775405 - RNA, 20 nt, Human
aaaaagcagggggacucaag

SEQ ID NO: 775406 - RNA, 26 nt, Human
aaacauucuuuaccuaguaagcagug

SEQ ID NO: 775407 - RNA, 19 nt, Human
aaagguuccgagggcccac

SEQ ID NO: 775408 - RNA, 24 nt, Human
aaagugcugggauuacaggcguga

SEQ ID NO: 775409 - RNA, 20 nt, Human
aagaagccuggguuuuggaa

SEQ ID NO: 775410 - RNA, 19 nt, Human
aagaggccccacaugaaga

SEQ ID NO: 775411 - RNA, 27 nt, Human
aagcagguauuugagacaguguucaag

SEQ ID NO: 775412 - RNA, 23 nt, Human
aaguagcaaagcuucccaggaag

SEQ ID NO: 775413 - RNA, 19 nt, Human
aaguagcugggacuacagg

SEQ ID NO: 775414 - RNA, 20 nt, Human
aaguagcugggacuacaggc

SEQ ID NO: 775415 - RNA, 25 nt, Human
aaguagcugggacuacaggcgccca

SEQ ID NO: 775416 - RNA, 19 nt, Human
aagugcugggauuacaggc

SEQ ID NO: 775417 - RNA, 19 nt, Human
aagugcugggauuacaggc

SEQ ID NO: 775418 - RNA, 26 nt, Human
aagugcugggauuacaggcgugagcc

SEQ ID NO: 775419 - RNA, 20 nt, Human
aaugagguccccauacaccc

SEQ ID NO: 775420 - RNA, 21 nt, Human
acagugaaaugaugugaugac

SEQ ID NO: 775421 - RNA, 20 nt, Human
accacuggcuucacaugaac

SEQ ID NO: 775422 - RNA, 24 nt, Human
accauguuggccaggcuggucuug

SEQ ID NO: 775423 - RNA, 20 nt, Human
acccaagccauugugagagc

SEQ ID NO: 775424 - RNA, 18 nt, Human
acgggguuucaccauguu

SEQ ID NO: 775425 - RNA, 23 nt, Human
acgggguuucaccauguuggcca

SEQ ID NO: 775426 - RNA, 24 nt, Human
acgggguuucaccauguuggccag

SEQ ID NO: 775427 - RNA, 18 nt, Human
agaaaguaguaaggauuu

SEQ ID NO: 775428 - RNA, 24 nt, Human
agaaauaaaaagguggccgguacc

SEQ ID NO: 775429 - RNA, 19 nt, Human
agaaucccuggaaagaggg

SEQ ID NO: 775430 - RNA, 22 nt, Human
agacagugauccauuaggucug

SEQ ID NO: 775431 - RNA, 18 nt, Human
agagguucugugauccuc

SEQ ID NO: 775432 - RNA, 18 nt, Human
aggaagaguccauccaga

SEQ ID NO: 775433 - RNA, 18 nt, Human
aggcccugaccugaacaa

SEQ ID NO: 775434 - RNA, 21 nt, Human
aggcccugaccugaacaagga

SEQ ID NO: 775435 - RNA, 20 nt, Human
aggcgcccaccaccacgccc

SEQ ID NO: 775436 - RNA, 18 nt, Human
aggcuggagcacagcacc

SEQ ID NO: 775437 - RNA, 20 nt, Human
aggcuggagcacagcaccag

SEQ ID NO: 775438 - RNA, 21 nt, Human
agguauccaccuaccuuggcc

SEQ ID NO: 775439 - RNA, 23 nt, Human
agguauccaccuaccuuggccuc

SEQ ID NO: 775440 - RNA, 22 nt, Human
aguagagacgggguuucaccau

SEQ ID NO: 775441 - RNA, 18 nt, Human
agugcugggauuacaggc

SEQ ID NO: 775442 - RNA, 24 nt, Human
auuuuuguauuuuuaguagagacg

SEQ ID NO: 775443 - RNA, 23 nt, Human
caaaccuuggguccccuaacuga

SEQ ID NO: 775444 - RNA, 19 nt, Human
caaaguagcaaagcuuccc

SEQ ID NO: 775445 - RNA, 24 nt, Human
caaagugcugggauuacaggcgug

SEQ ID NO: 775446 - RNA, 20 nt, Human
caacagggccaaagucgucu

SEQ ID NO: 775447 - RNA, 22 nt, Human
caagaaaccaccuuuaccagaa

SEQ ID NO: 775448 - RNA, 26 nt, Human
caagacagugauccauuaggucugcc

SEQ ID NO: 775449 - RNA, 22 nt, Human
caagccauugugagagcggcgg

SEQ ID NO: 775450 - RNA, 23 nt, Human
caagguacuauccaaaacaaaaa

SEQ ID NO: 775451 - RNA, 20 nt, Human
cacaacaagggcaagcuuua

SEQ ID NO: 775452 - RNA, 21 nt, Human
cacagugaagagaaauaaaaa

SEQ ID NO: 775453 - RNA, 24 nt, Human
caccacgcccagcuaauuuuugua

SEQ ID NO: 775454 - RNA, 19 nt, Human
caccagucaucaacagggc

SEQ ID NO: 775455 - RNA, 21 nt, Human
caccauguuggccaggcuggu

SEQ ID NO: 775456 - RNA, 24 nt, Human
caccauguuggccaggcuggucuu

SEQ ID NO: 775457 - RNA, 27 nt, Human
caccauguuggccaggcuggucuugaa

SEQ ID NO: 775458 - RNA, 23 nt, Human
caccuaccuuggccucccaaagu

SEQ ID NO: 775459 - RNA, 22 nt, Human
cagcuaaauuaaucucacuuua

SEQ ID NO: 775460 - RNA, 19 nt, Human
caggcccugaccugaacaa

SEQ ID NO: 775461 - RNA, 22 nt, Human
caggcgauucuccugccucagc

SEQ ID NO: 775462 - RNA, 21 nt, Human
caggcgcccaccaccacgccc

SEQ ID NO: 775463 - RNA, 21 nt, Human
cagggccaaagucgucuuagc

SEQ ID NO: 775464 - RNA, 22 nt, Human
caggucccaaacaaaccuuggg

SEQ ID NO: 775465 - RNA, 22 nt, Human
cauagaaagaggagcaugccuc

SEQ ID NO: 775466 - RNA, 24 nt, Human
caucuccagcucuagccucaauuu

SEQ ID NO: 775467 - RNA, 24 nt, Human
cauguuggccaggcuggucuugaa

SEQ ID NO: 775468 - RNA, 22 nt, Human
ccaaagugcugggauuacaggc

SEQ ID NO: 775469 - RNA, 22 nt, Human
ccaaagugcugggauuacaggc

SEQ ID NO: 775470 - RNA, 24 nt, Human
ccaaagugcugggauuacaggcgu

SEQ ID NO: 775471 - RNA, 19 nt, Human
ccacaugaagaacuagcug

SEQ ID NO: 775472 - RNA, 23 nt, Human
cccaaguagcugggacuacaggc

SEQ ID NO: 775473 - RNA, 23 nt, Human
cccaaguagcugggacuacaggc

SEQ ID NO: 775474 - RNA, 21 nt, Human
cccaccaccacgcccagcuaa

SEQ ID NO: 775475 - RNA, 23 nt, Human
cccaggcuggaguguaauggcau

SEQ ID NO: 775476 - RNA, 21 nt, Human
cccaggucccaaacaaaccuu

SEQ ID NO: 775477 - RNA, 22 nt, Human
cccggaguccggcacuaaaaag

SEQ ID NO: 775478 - RNA, 24 nt, Human
ccucagguauccaccuaccuuggc

SEQ ID NO: 775479 - RNA, 23 nt, Human
ccugccucagccucccaaguagc

SEQ ID NO: 775480 - RNA, 19 nt, Human
cgaagguccccaagaccca

SEQ ID NO: 775481 - RNA, 21 nt, Human
cgcacaggcguuccaggcccu

SEQ ID NO: 775482 - RNA, 24 nt, Human
cgggguuucaccauguuggccagg

SEQ ID NO: 775483 - RNA, 24 nt, Human
cguucugucgcccaggcuggagug

SEQ ID NO: 775484 - RNA, 24 nt, Human
cucagccucccaaguagcugggac

SEQ ID NO: 775485 - RNA, 24 nt, Human
cucguucugucgcccaggcuggag

SEQ ID NO: 775486 - RNA, 23 nt, Human
cucuagccucaauuuaauagguu

SEQ ID NO: 775487 - RNA, 23 nt, Human
cugccucagccucccaaguagcu

SEQ ID NO: 775488 - RNA, 24 nt, Human
cuggaguguaauggcaugaucuca

SEQ ID NO: 775489 - RNA, 23 nt, Human
gaacuuguacacagugaagagaa

SEQ ID NO: 775490 - RNA, 23 nt, Human
gaccucagguauccaccuaccuu

SEQ ID NO: 775491 - RNA, 24 nt, Human
gagacgggguuucaccauguuggc

SEQ ID NO: 775492 - RNA, 20 nt, Human
gaggcucauuuuggugaaaa

SEQ ID NO: 775493 - RNA, 18 nt, Human
gauuacaggcgugagcca

SEQ ID NO: 775494 - RNA, 21 nt, Human
gauuacaggcgugagccacca

SEQ ID NO: 775495 - RNA, 22 nt, Human
gauuacaggcgugagccaccac

SEQ ID NO: 775496 - RNA, 21 nt, Human
gauucuccugccucagccucc

SEQ ID NO: 775497 - RNA, 18 nt, Human
gcauagaaagaggagcau

SEQ ID NO: 775498 - RNA, 22 nt, Human
gcccagcuaauuuuuguauuuu

SEQ ID NO: 775499 - RNA, 23 nt, Human
gcccaggcuggaguguaauggca

SEQ ID NO: 775500 - RNA, 24 nt, Human
gcgauucuccugccucagccuccc

SEQ ID NO: 775501 - RNA, 23 nt, Human
gcuggucuugaacuccugaccuc

SEQ ID NO: 775502 - RNA, 19 nt, Human
ggauuacaggcgugagcca

SEQ ID NO: 775503 - RNA, 18 nt, Human
ggcaugaucucagcucgg

SEQ ID NO: 775504 - RNA, 24 nt, Human
ggcuggucuugaacuccugaccuc

SEQ ID NO: 775505 - RNA, 23 nt, Human
gggguuucaccauguuggccagg

SEQ ID NO: 775506 - RNA, 18 nt, Human
gguaaaugaugaaaaaaa

SEQ ID NO: 775507 - RNA, 21 nt, Human
gguccccuaacugauaaggcu

SEQ ID NO: 775508 - RNA, 19 nt, Human
ggucuugaacuccugaccu

SEQ ID NO: 775509 - RNA, 23 nt, Human
guagagacgggguuucaccaugu

SEQ ID NO: 775510 - RNA, 24 nt, Human
uaauuuuuguauuuuuaguagaga

SEQ ID NO: 775511 - RNA, 22 nt, Human
uacacagugaagagaaauaaaa

SEQ ID NO: 775512 - RNA, 24 nt, Human
uacaggcgugagccaccacgccca

SEQ ID NO: 775513 - RNA, 22 nt, Human
uagagacgggguuucaccaugu

SEQ ID NO: 775514 - RNA, 24 nt, Human
uaguagagacgggguuucaccaug

SEQ ID NO: 775515 - RNA, 25 nt, Human
uaguagagacgggguuucaccaugu

SEQ ID NO: 775516 - RNA, 24 nt, Human
uauuucccucccucaguaagguua

SEQ ID NO: 775517 - RNA, 20 nt, Human
ucagccucccaaguagcugg

SEQ ID NO: 775518 - RNA, 19 nt, Human
ucaggcgauucuccugccu

SEQ ID NO: 775519 - RNA, 20 nt, Human
ucaguagacuuaauuuucuc

SEQ ID NO: 775520 - RNA, 21 nt, Human
uccaccuaccuuggccuccca

SEQ ID NO: 775521 - RNA, 24 nt, Human
ucccaaagugcugggauuacaggc

SEQ ID NO: 775522 - RNA, 24 nt, Human
ucccaaguagcugggacuacaggc

SEQ ID NO: 775523 - RNA, 23 nt, Human
uccccaagacccacuagguagca

SEQ ID NO: 775524 - RNA, 21 nt, Human
ucccgagaggcuguggcgcag

SEQ ID NO: 775525 - RNA, 23 nt, Human
ucccugccaccacagugaaauga

SEQ ID NO: 775526 - RNA, 20 nt, Human
uccugcugccgcgggacugc

SEQ ID NO: 775527 - RNA, 19 nt, Human
uccuggguucaggcgauuc

SEQ ID NO: 775528 - RNA, 20 nt, Human
uccuggguucaggcgauucu

SEQ ID NO: 775529 - RNA, 21 nt, Human
uccuggguucaggcgauucuc

SEQ ID NO: 775530 - RNA, 22 nt, Human
uccuggguucaggcgauucucc

SEQ ID NO: 775531 - RNA, 24 nt, Human
uccuggguucaggcgauucuccug

SEQ ID NO: 775532 - RNA, 18 nt, Human
ucgcccaggcuggagugu

SEQ ID NO: 775533 - RNA, 24 nt, Human
ucguucugucgcccaggcuggagu

SEQ ID NO: 775534 - RNA, 26 nt, Human
ucuccugccucagccucccaaguagc

SEQ ID NO: 775535 - RNA, 23 nt, Human
ucucguucugucgcccaggcugg

SEQ ID NO: 775536 - RNA, 24 nt, Human
ucucguucugucgcccaggcugga

SEQ ID NO: 775537 - RNA, 24 nt, Human
ucugucgcccaggcuggaguguaa

SEQ ID NO: 775538 - RNA, 22 nt, Human
ucuguggcauagaaagaggagc

SEQ ID NO: 775539 - RNA, 23 nt, Human
ucuugaacuccugaccucaggua

SEQ ID NO: 775540 - RNA, 18 nt, Human
ugaaagacugggauccag

SEQ ID NO: 775541 - RNA, 22 nt, Human
ugaaaugaugugaugacuaagc

SEQ ID NO: 775542 - RNA, 24 nt, Human
ugaacuuguacacagugaagagaa

SEQ ID NO: 775543 - RNA, 18 nt, Human
ugaccucagguauccacc

SEQ ID NO: 775544 - RNA, 19 nt, Human
ugaccucagguauccaccu

SEQ ID NO: 775545 - RNA, 20 nt, Human
ugagcaccucuaagccauga

SEQ ID NO: 775546 - RNA, 24 nt, Human
ugccucagccucccaaguagcugg

SEQ ID NO: 775547 - RNA, 24 nt, Human
ugcugggauuacaggcgugagcca

SEQ ID NO: 775548 - RNA, 24 nt, Human
uggaguguaauggcaugaucucag

SEQ ID NO: 775549 - RNA, 24 nt, Human
uggcaugaucucagcucgguacaa

SEQ ID NO: 775550 - RNA, 24 nt, Human
uggccaggcuggucuugaacuccu

SEQ ID NO: 775551 - RNA, 21 nt, Human
uggcgcagucuggacccaagc

SEQ ID NO: 775552 - RNA, 24 nt, Human
uggcgucucguucugucgcccagg

SEQ ID NO: 775553 - RNA, 21 nt, Human
uggcuuccguauuucccuccc

SEQ ID NO: 775554 - RNA, 21 nt, Human
ugggacuacaggcgcccacca

SEQ ID NO: 775555 - RNA, 24 nt, Human
ugggacuacaggcgcccaccacca

SEQ ID NO: 775556 - RNA, 18 nt, Human
ugggauuacaggcgugag

SEQ ID NO: 775557 - RNA, 19 nt, Human
ugggauuacaggcgugagc

SEQ ID NO: 775558 - RNA, 22 nt, Human
ugggauuacaggcgugagccac

SEQ ID NO: 775559 - RNA, 23 nt, Human
ugggauuacaggcgugagccacc

SEQ ID NO: 775560 - RNA, 24 nt, Human
ugggauuacaggcgugagccacca

SEQ ID NO: 775561 - RNA, 24 nt, Human
uggguucaggcgauucuccugccu

SEQ ID NO: 775562 - RNA, 22 nt, Human
ugguaaaggaauaaagaagccu

SEQ ID NO: 775563 - RNA, 21 nt, Human
uguauuuuuaguagagacggg

SEQ ID NO: 775564 - RNA, 20 nt, Human
ugucgcccaggcuggagugu

SEQ ID NO: 775565 - RNA, 21 nt, Human
uuaaagcaguacaaaauggcu

SEQ ID NO: 775566 - RNA, 18 nt, Human
uuaguagagacgggguuu

SEQ ID NO: 775567 - RNA, 22 nt, Human
uuaguagagacgggguuucacc

SEQ ID NO: 775568 - RNA, 24 nt, Human
uuaguagagacgggguuucaccau

SEQ ID NO: 775569 - RNA, 27 nt, Human
uuauacagacaagguacuauccaaaac

SEQ ID NO: 775570 - RNA, 18 nt, Human
uucaggcgauucuccugc

SEQ ID NO: 775571 - RNA, 21 nt, Human
uucaggcgauucuccugccuc

SEQ ID NO: 775572 - RNA, 23 nt, Human
uucaggcgauucuccugccucag

SEQ ID NO: 775573 - RNA, 21 nt, Human
uuccaggcccugaccugaaca

SEQ ID NO: 775574 - RNA, 19 nt, Human
uuccguauuucccucccuc

SEQ ID NO: 775575 - RNA, 18 nt, Human
uuggccucccaaagugcu

SEQ ID NO: 775576 - RNA, 23 nt, Human
uuguauuuuuaguagagacgggg

SEQ ID NO: 775577 - RNA, 24 nt, Human
uuucaccauguuggccaggcuggu

SEQ ID NO: 775578 - RNA, 24 nt, Human
uuuuuaguagagacgggguuucac

SEQ ID NO: 775579 - RNA, 20 nt, Human
uuuuuguauuuuuaguagag

SEQ ID NO: 775580 - RNA, 33 nt, Human
uuuuuuacuuuacuuuauuuauuuauuuauuuu

SEQ ID NO: 775581 - RNA, 18 nt, Human
uuuuuuuuuuuuuuuuug

SEQ ID NO: 775582 - RNA, 25 nt, Human
aaaaaaaaaagcaaaacaaaacaaa

SEQ ID NO: 775583 - RNA, 19 nt, Human
aaaaaaaccaagagaggac

SEQ ID NO: 775584 - RNA, 22 nt, Human
aaacagaaacagaaacgaacga

SEQ ID NO: 775585 - RNA, 24 nt, Human
aaacagaaacagaaacgaacgaga

SEQ ID NO: 775586 - RNA, 26 nt, Human
aaagcaaaacaaaacaaaaaaacaau

SEQ ID NO: 775587 - RNA, 26 nt, Human
aaagcacauccucaucaauacaccaa

SEQ ID NO: 775588 - RNA, 26 nt, Human
aaagcacauccucgucaauacaccaa

SEQ ID NO: 775589 - RNA, 20 nt, Human
aacaauacguagcccaccac

SEQ ID NO: 775590 - RNA, 30 nt, Human
aacccaaccagccugcaccgucccugcagg

SEQ ID NO: 775591 - RNA, 22 nt, Human
aaccucugcccucugugcccuc

SEQ ID NO: 775592 - RNA, 24 nt, Human
aagaggccggacgacacccggggc

SEQ ID NO: 775593 - RNA, 19 nt, Human
aagcaaaacaaaacaaaaa

SEQ ID NO: 775594 - RNA, 23 nt, Human
aagcaaaacaaaacaaaaaaaca

SEQ ID NO: 775595 - RNA, 24 nt, Human
aagcaaaacaaaacaaaaaaacaa

SEQ ID NO: 775596 - RNA, 26 nt, Human
aagcagaaggaggugcuaccccaagg

SEQ ID NO: 775597 - RNA, 24 nt, Human
aagggggguucaaggcaguuauca

SEQ ID NO: 775598 - RNA, 19 nt, Human
accaagagaggacugaaga

SEQ ID NO: 775599 - RNA, 19 nt, Human
acccaggccucuguccucu

SEQ ID NO: 775600 - RNA, 19 nt, Human
acccagguugccgaguggc

SEQ ID NO: 775601 - RNA, 20 nt, Human
accccaaggcccggggggug

SEQ ID NO: 775602 - RNA, 24 nt, Human
acucaggaggcggagguugcagug

SEQ ID NO: 775603 - RNA, 23 nt, Human
acugcacuccagccuggcgacag

SEQ ID NO: 775604 - RNA, 20 nt, Human
agaaggaagaccugcagggc

SEQ ID NO: 775605 - RNA, 23 nt, Human
agaaggaagaccugcagggcugg

SEQ ID NO: 775606 - RNA, 24 nt, Human
agcacuuugggaggccgaggcggg

SEQ ID NO: 775607 - RNA, 20 nt, Human
agcagcugcccacgaccccc

SEQ ID NO: 775608 - RNA, 23 nt, Human
agccaagcagggagcugagggcg

SEQ ID NO: 775609 - RNA, 23 nt, Human
agccuggcgacagugugagaccc

SEQ ID NO: 775610 - RNA, 23 nt, Human
aggaaaaaaaccaagagaggacu

SEQ ID NO: 775611 - RNA, 19 nt, Human
aggaagaccugcagggcug

SEQ ID NO: 775612 - RNA, 18 nt, Human
aggaagacugacagaggc

SEQ ID NO: 775613 - RNA, 26 nt, Human
aggcagcggcccggacccggguggca

SEQ ID NO: 775614 - RNA, 21 nt, Human
aggcaggagaaucgcgugaac

SEQ ID NO: 775615 - RNA, 23 nt, Human
aggcaggagaaucgcgugaacuc

SEQ ID NO: 775616 - RNA, 20 nt, Human
aggcaggagaccacgcgagg

SEQ ID NO: 775617 - RNA, 23 nt, Human
aggcagguggggguguaaagugc

SEQ ID NO: 775618 - RNA, 20 nt, Human
aggccgaggcgggagaacac

SEQ ID NO: 775619 - RNA, 24 nt, Human
aggcggagguugcagugagccgag

SEQ ID NO: 775620 - RNA, 23 nt, Human
aggcgggagaacacaaggucaag

SEQ ID NO: 775621 - RNA, 21 nt, Human
aggcgggcccagcggcagcgc

SEQ ID NO: 775622 - RNA, 20 nt, Human
aggcugaggcaggagaaucg

SEQ ID NO: 775623 - RNA, 20 nt, Human
aggcugaggcaggagaaucg

SEQ ID NO: 775624 - RNA, 19 nt, Human
agggcuggggcagcccgcg

SEQ ID NO: 775625 - RNA, 26 nt, Human
agguggggguguaaagugcggcuuuu

SEQ ID NO: 775626 - RNA, 23 nt, Human
auaugcaacccaaccagccugca

SEQ ID NO: 775627 - RNA, 19 nt, Human
aucacuucuaggaggcugc

SEQ ID NO: 775628 - RNA, 18 nt, Human
auccucaucaauacacca

SEQ ID NO: 775629 - RNA, 18 nt, Human
auccucgucaauacacca

SEQ ID NO: 775630 - RNA, 24 nt, Human
aucgcaccacugcacuccagccug

SEQ ID NO: 775631 - RNA, 23 nt, Human
augucucacgccuguaaucccag

SEQ ID NO: 775632 - RNA, 25 nt, Human
caaaaaaacaaugcagaccuaaagu

SEQ ID NO: 775633 - RNA, 23 nt, Human
caaagcacacccucaucagacac

SEQ ID NO: 775634 - RNA, 23 nt, Human
caaagcacacccucaucagacac

SEQ ID NO: 775635 - RNA, 23 nt, Human
caaagcacacccucaucagacac

SEQ ID NO: 775636 - RNA, 23 nt, Human
caaagcacacccucaucagacac

SEQ ID NO: 775637 - RNA, 24 nt, Human
caaagcacauccucaucaauacac

SEQ ID NO: 775638 - RNA, 21 nt, Human
caaagcacauccucaucagac

SEQ ID NO: 775639 - RNA, 21 nt, Human
caaagcacauccucaucagac

SEQ ID NO: 775640 - RNA, 21 nt, Human
caaagcacauccucaucagac

SEQ ID NO: 775641 - RNA, 21 nt, Human
caaagcacauccucaucagac

SEQ ID NO: 775642 - RNA, 21 nt, Human
caaagcacauccucaucagac

SEQ ID NO: 775643 - RNA, 21 nt, Human
caaagcacauccucaucagac

SEQ ID NO: 775644 - RNA, 21 nt, Human
caaagcacauccucaucagac

SEQ ID NO: 775645 - RNA, 21 nt, Human
caaagcacauccucaucagac

SEQ ID NO: 775646 - RNA, 21 nt, Human
caaagcacauccucaucagac

SEQ ID NO: 775647 - RNA, 21 nt, Human
caaagcacauccucaucagac

SEQ ID NO: 775648 - RNA, 21 nt, Human
caaagcacauccucaucagac

SEQ ID NO: 775649 - RNA, 21 nt, Human
caaagcacauccucaucagac

SEQ ID NO: 775650 - RNA, 21 nt, Human
caaagcacauccucaucagac

SEQ ID NO: 775651 - RNA, 21 nt, Human
caaagcacauccucaucagac

SEQ ID NO: 775652 - RNA, 21 nt, Human
caaagcacauccucaucagac

SEQ ID NO: 775653 - RNA, 21 nt, Human
caaagcacauccucaucagac

SEQ ID NO: 775654 - RNA, 21 nt, Human
caaagcacauccucaucagac

SEQ ID NO: 775655 - RNA, 21 nt, Human
caaagcacauccucaucagac

SEQ ID NO: 775656 - RNA, 21 nt, Human
caaagcacauccucaucagac

SEQ ID NO: 775657 - RNA, 21 nt, Human
caaagcacauccucaucagac

SEQ ID NO: 775658 - RNA, 21 nt, Human
caaagcacauccucaucagac

SEQ ID NO: 775659 - RNA, 21 nt, Human
caaagcacauccucaucagac

SEQ ID NO: 775660 - RNA, 21 nt, Human
caaagcacauccucaucagac

SEQ ID NO: 775661 - RNA, 21 nt, Human
caaagcacauccucaucagac

SEQ ID NO: 775662 - RNA, 21 nt, Human
caaagcacauccucaucagac

SEQ ID NO: 775663 - RNA, 21 nt, Human
caaagcacauccucaucagac

SEQ ID NO: 775664 - RNA, 21 nt, Human
caaagcacauccucaucagac

SEQ ID NO: 775665 - RNA, 23 nt, Human
caaagcacauccucaucagacac

SEQ ID NO: 775666 - RNA, 23 nt, Human
caaagcacauccucaucagacac

SEQ ID NO: 775667 - RNA, 23 nt, Human
caaagcacauccucaucagacac

SEQ ID NO: 775668 - RNA, 23 nt, Human
caaagcacauccucaucagacac

SEQ ID NO: 775669 - RNA, 23 nt, Human
caaagcacauccucaucagacac

SEQ ID NO: 775670 - RNA, 23 nt, Human
caaagcacauccucaucagacac

SEQ ID NO: 775671 - RNA, 23 nt, Human
caaagcacauccucaucagacac

SEQ ID NO: 775672 - RNA, 23 nt, Human
caaagcacauccucaucagacac

SEQ ID NO: 775673 - RNA, 21 nt, Human
caaagcacauccucaucggac

SEQ ID NO: 775674 - RNA, 24 nt, Human
caaagcacauccucgucaauacac

SEQ ID NO: 775675 - RNA, 21 nt, Human
caaagcacauucucaucagac

SEQ ID NO: 775676 - RNA, 21 nt, Human
caaagcacauucucaucagac

SEQ ID NO: 775677 - RNA, 21 nt, Human
caaagcacauucucaucagac

SEQ ID NO: 775678 - RNA, 21 nt, Human
caaagcacauucucaucagac

SEQ ID NO: 775679 - RNA, 21 nt, Human
caaagcacauucucaucagac

SEQ ID NO: 775680 - RNA, 23 nt, Human
caaagcacauucucaucagacac

SEQ ID NO: 775681 - RNA, 23 nt, Human
caaagcacauucucaucagacac

SEQ ID NO: 775682 - RNA, 23 nt, Human
caaagcacauucucaucagacac

SEQ ID NO: 775683 - RNA, 23 nt, Human
caaagcacauucucaucagacac

SEQ ID NO: 775684 - RNA, 23 nt, Human
caaagcacauucucaucagacac

SEQ ID NO: 775685 - RNA, 23 nt, Human
caaagcacauucucaucagacac

SEQ ID NO: 775686 - RNA, 23 nt, Human
caaagcacauucucaucagacac

SEQ ID NO: 775687 - RNA, 23 nt, Human
caaagcacauucucaucagacac

SEQ ID NO: 775688 - RNA, 23 nt, Human
caaagcacauucucaucagucac

SEQ ID NO: 775689 - RNA, 26 nt, Human
caacguguaaacagaaacagaaacga

SEQ ID NO: 775690 - RNA, 22 nt, Human
caagaccccugacucucccaca

SEQ ID NO: 775691 - RNA, 21 nt, Human
caauagucccugaggccaagc

SEQ ID NO: 775692 - RNA, 18 nt, Human
caaugcagaccucagccg

SEQ ID NO: 775693 - RNA, 22 nt, Human
caccaauagucccugaggccaa

SEQ ID NO: 775694 - RNA, 23 nt, Human
caccacagcacauccucuucaga

SEQ ID NO: 775695 - RNA, 27 nt, Human
caccacagcacauccucuucagacuca

SEQ ID NO: 775696 - RNA, 25 nt, Human
caccacugcacuccagccuggcgac

SEQ ID NO: 775697 - RNA, 26 nt, Human
caccacugcuguugucugcaagcccg

SEQ ID NO: 775698 - RNA, 21 nt, Human
cacccggggcagggcgcgccg

SEQ ID NO: 775699 - RNA, 20 nt, Human
caccugucuccucaaaccca

SEQ ID NO: 775700 - RNA, 24 nt, Human
cacgccuguaaucccagcacuuug

SEQ ID NO: 775701 - RNA, 20 nt, Human
cacuccagccuggcgacagu

SEQ ID NO: 775702 - RNA, 18 nt, Human
cacugcacuccagccugg

SEQ ID NO: 775703 - RNA, 18 nt, Human
cacugcacuccagccugg

SEQ ID NO: 775704 - RNA, 22 nt, Human
cacugcacuccagccuggcgac

SEQ ID NO: 775705 - RNA, 23 nt, Human
cacugcacuccagccuggcgaca

SEQ ID NO: 775706 - RNA, 23 nt, Human
cacugcacuccagccuggcgaca

SEQ ID NO: 775707 - RNA, 20 nt, Human
cacugcuguugucugcaagc

SEQ ID NO: 775708 - RNA, 18 nt, Human
cagcaaagggggguucaa

SEQ ID NO: 775709 - RNA, 22 nt, Human
cagcacuuugggaggccgaggc

SEQ ID NO: 775710 - RNA, 24 nt, Human
cagcacuuugggaggccgaggcgg

SEQ ID NO: 775711 - RNA, 22 nt, Human
cagccaccucaccccaguccug

SEQ ID NO: 775712 - RNA, 19 nt, Human
cagcggcagcgcuaagucc

SEQ ID NO: 775713 - RNA, 24 nt, Human
cagcuacucgggaggcugaggcag

SEQ ID NO: 775714 - RNA, 19 nt, Human
cagcuccuggcacaggcuc

SEQ ID NO: 775715 - RNA, 21 nt, Human
cagcugcccacgacccccagg

SEQ ID NO: 775716 - RNA, 19 nt, Human
caucaugcaagugguccug

SEQ ID NO: 775717 - RNA, 25 nt, Human
caugcaggcccccaagugagaugac

SEQ ID NO: 775718 - RNA, 26 nt, Human
ccaaagcacacccucaucagacaccu

SEQ ID NO: 775719 - RNA, 26 nt, Human
ccaaagcacacccucaucagacaccu

SEQ ID NO: 775720 - RNA, 26 nt, Human
ccaaagcacacccucaucagacaccu

SEQ ID NO: 775721 - RNA, 26 nt, Human
ccaaagcacacccucaucagacaccu

SEQ ID NO: 775722 - RNA, 21 nt, Human
ccaaagcacauccucaucaga

SEQ ID NO: 775723 - RNA, 21 nt, Human
ccaaagcacauccucaucaga

SEQ ID NO: 775724 - RNA, 21 nt, Human
ccaaagcacauccucaucaga

SEQ ID NO: 775725 - RNA, 21 nt, Human
ccaaagcacauccucaucaga

SEQ ID NO: 775726 - RNA, 21 nt, Human
ccaaagcacauccucaucaga

SEQ ID NO: 775727 - RNA, 21 nt, Human
ccaaagcacauccucaucaga

SEQ ID NO: 775728 - RNA, 21 nt, Human
ccaaagcacauccucaucaga

SEQ ID NO: 775729 - RNA, 22 nt, Human
ccaaagcacauccucaucagac

SEQ ID NO: 775730 - RNA, 22 nt, Human
ccaaagcacauccucaucagac

SEQ ID NO: 775731 - RNA, 22 nt, Human
ccaaagcacauccucaucagac

SEQ ID NO: 775732 - RNA, 22 nt, Human
ccaaagcacauccucaucagac

SEQ ID NO: 775733 - RNA, 22 nt, Human
ccaaagcacauccucaucagac

SEQ ID NO: 775734 - RNA, 22 nt, Human
ccaaagcacauccucaucagac

SEQ ID NO: 775735 - RNA, 22 nt, Human
ccaaagcacauccucaucagac

SEQ ID NO: 775736 - RNA, 22 nt, Human
ccaaagcacauccucaucagac

SEQ ID NO: 775737 - RNA, 22 nt, Human
ccaaagcacauccucaucagac

SEQ ID NO: 775738 - RNA, 26 nt, Human
ccaaagcacauccucaucagacaccu

SEQ ID NO: 775739 - RNA, 26 nt, Human
ccaaagcacauccucaucagacaccu

SEQ ID NO: 775740 - RNA, 26 nt, Human
ccaaagcacauccucaucagacaccu

SEQ ID NO: 775741 - RNA, 26 nt, Human
ccaaagcacauccucaucagacaccu

SEQ ID NO: 775742 - RNA, 26 nt, Human
ccaaagcacauccucaucagacaccu

SEQ ID NO: 775743 - RNA, 26 nt, Human
ccaaagcacauccucaucagacaccu

SEQ ID NO: 775744 - RNA, 26 nt, Human
ccaaagcacauccucaucagacaccu

SEQ ID NO: 775745 - RNA, 26 nt, Human
ccaaagcacauccucaucagacaccu

SEQ ID NO: 775746 - RNA, 25 nt, Human
ccaaagcacauccucaucagacucc

SEQ ID NO: 775747 - RNA, 25 nt, Human
ccaaagcacauccucaucagacucc

SEQ ID NO: 775748 - RNA, 25 nt, Human
ccaaagcacauccucaucagacucc

SEQ ID NO: 775749 - RNA, 25 nt, Human
ccaaagcacauccucaucagacucc

SEQ ID NO: 775750 - RNA, 25 nt, Human
ccaaagcacauccucaucagacucc

SEQ ID NO: 775751 - RNA, 25 nt, Human
ccaaagcacauccucaucagacucc

SEQ ID NO: 775752 - RNA, 25 nt, Human
ccaaagcacauccucaucagacucc

SEQ ID NO: 775753 - RNA, 25 nt, Human
ccaaagcacauccucaucagacucc

SEQ ID NO: 775754 - RNA, 25 nt, Human
ccaaagcacauccucaucagacucc

SEQ ID NO: 775755 - RNA, 25 nt, Human
ccaaagcacauccucaucagacucc

SEQ ID NO: 775756 - RNA, 25 nt, Human
ccaaagcacauccucaucagacucc

SEQ ID NO: 775757 - RNA, 23 nt, Human
ccaaagcacauccucaucggacu

SEQ ID NO: 775758 - RNA, 21 nt, Human
ccaaagcacauucucaucaga

SEQ ID NO: 775759 - RNA, 22 nt, Human
ccaaagcacauucucaucagac

SEQ ID NO: 775760 - RNA, 22 nt, Human
ccaaagcacauucucaucagac

SEQ ID NO: 775761 - RNA, 22 nt, Human
ccaaagcacauucucaucagac

SEQ ID NO: 775762 - RNA, 26 nt, Human
ccaaagcacauucucaucagacaccu

SEQ ID NO: 775763 - RNA, 26 nt, Human
ccaaagcacauucucaucagacaccu

SEQ ID NO: 775764 - RNA, 26 nt, Human
ccaaagcacauucucaucagacaccu

SEQ ID NO: 775765 - RNA, 26 nt, Human
ccaaagcacauucucaucagacaccu

SEQ ID NO: 775766 - RNA, 26 nt, Human
ccaaagcacauucucaucagacaccu

SEQ ID NO: 775767 - RNA, 26 nt, Human
ccaaagcacauucucaucagacaccu

SEQ ID NO: 775768 - RNA, 26 nt, Human
ccaaagcacauucucaucagacaccu

SEQ ID NO: 775769 - RNA, 26 nt, Human
ccaaagcacauucucaucagacaccu

SEQ ID NO: 775770 - RNA, 25 nt, Human
ccaaagcacauucucaucagacucc

SEQ ID NO: 775771 - RNA, 26 nt, Human
ccaaagcacauucucaucagucaccu

SEQ ID NO: 775772 - RNA, 19 nt, Human
ccacacccaucaugcaagu

SEQ ID NO: 775773 - RNA, 18 nt, Human
ccacagaaggaagaccug

SEQ ID NO: 775774 - RNA, 18 nt, Human
ccacccgauccaccacaa

SEQ ID NO: 775775 - RNA, 22 nt, Human
ccacgcgaggacucugccuccc

SEQ ID NO: 775776 - RNA, 19 nt, Human
ccacugcacuccagccugg

SEQ ID NO: 775777 - RNA, 19 nt, Human
ccacugcacuccagccugg

SEQ ID NO: 775778 - RNA, 20 nt, Human
ccacugcacuccagccuggc

SEQ ID NO: 775779 - RNA, 23 nt, Human
ccacugcacuccagccuggcgac

SEQ ID NO: 775780 - RNA, 18 nt, Human
ccaggacuccaagccauc

SEQ ID NO: 775781 - RNA, 25 nt, Human
ccaucaccaugcaugcccacauuuc

SEQ ID NO: 775782 - RNA, 20 nt, Human
cccaccacgucaugcccccg

SEQ ID NO: 775783 - RNA, 22 nt, Human
ccccaaacacccagguugccga

SEQ ID NO: 775784 - RNA, 28 nt, Human
ccccaccccgcccaaccucugcccucuu

SEQ ID NO: 775785 - RNA, 18 nt, Human
ccccagcccccacccgau

SEQ ID NO: 775786 - RNA, 20 nt, Human
ccccggcggaggcugcuggu

SEQ ID NO: 775787 - RNA, 21 nt, Human
ccccggcggaggcugcuggug

SEQ ID NO: 775788 - RNA, 21 nt, Human
cccgaccaccucuacccagac

SEQ ID NO: 775789 - RNA, 19 nt, Human
cccgucuccccgccggggc

SEQ ID NO: 775790 - RNA, 24 nt, Human
ccgaggcgggagaacacaagguca

SEQ ID NO: 775791 - RNA, 22 nt, Human
ccgcauacgccgcccgcggcca

SEQ ID NO: 775792 - RNA, 18 nt, Human
ccuacuguccccaccccg

SEQ ID NO: 775793 - RNA, 23 nt, Human
ccuacuguccccaccccgcccaa

SEQ ID NO: 775794 - RNA, 21 nt, Human
ccucaucagacaccucaauac

SEQ ID NO: 775795 - RNA, 21 nt, Human
ccucaucagacaccucaauac

SEQ ID NO: 775796 - RNA, 21 nt, Human
ccucaucagacaccucaauac

SEQ ID NO: 775797 - RNA, 21 nt, Human
ccucaucagacaccucaauac

SEQ ID NO: 775798 - RNA, 21 nt, Human
ccucaucagacaccucaauac

SEQ ID NO: 775799 - RNA, 21 nt, Human
ccucaucagacaccucaauac

SEQ ID NO: 775800 - RNA, 21 nt, Human
ccucaucagacaccucaauac

SEQ ID NO: 775801 - RNA, 21 nt, Human
ccucaucagacaccucaauac

SEQ ID NO: 775802 - RNA, 21 nt, Human
ccucaucagacaccucaauac

SEQ ID NO: 775803 - RNA, 21 nt, Human
ccucaucagacaccucaauac

SEQ ID NO: 775804 - RNA, 21 nt, Human
ccucaucagacaccucaauac

SEQ ID NO: 775805 - RNA, 21 nt, Human
ccucaucagacaccucaauac

SEQ ID NO: 775806 - RNA, 21 nt, Human
ccucaucagacaccucaauac

SEQ ID NO: 775807 - RNA, 21 nt, Human
ccucaucagacaccucaguac

SEQ ID NO: 775808 - RNA, 19 nt, Human
ccucccagcugggggccgg

SEQ ID NO: 775809 - RNA, 22 nt, Human
ccucccagcugggggccggccc

SEQ ID NO: 775810 - RNA, 22 nt, Human
ccugaggccaagccacagucac

SEQ ID NO: 775811 - RNA, 20 nt, Human
ccugccgccccagcccccac

SEQ ID NO: 775812 - RNA, 22 nt, Human
ccugccgccccagcccccaccc

SEQ ID NO: 775813 - RNA, 24 nt, Human
ccugggcaauaaggagaaacccca

SEQ ID NO: 775814 - RNA, 19 nt, Human
ccuguaaucccagcuacuc

SEQ ID NO: 775815 - RNA, 21 nt, Human
ccuguaaucccagcuacucgg

SEQ ID NO: 775816 - RNA, 21 nt, Human
cgagagggccagggaggaggg

SEQ ID NO: 775817 - RNA, 24 nt, Human
cgagaucgcaccacugcacuccag

SEQ ID NO: 775818 - RNA, 18 nt, Human
cgaggcaggagaccacgc

SEQ ID NO: 775819 - RNA, 21 nt, Human
cgaggcuggggugggggccgg

SEQ ID NO: 775820 - RNA, 21 nt, Human
cgagguauauggcucugugcc

SEQ ID NO: 775821 - RNA, 21 nt, Human
cgcaccacugcacuccagccu

SEQ ID NO: 775822 - RNA, 23 nt, Human
cgcccguaaucccagguggcggg

SEQ ID NO: 775823 - RNA, 24 nt, Human
cgccuguaaucccagcacuuuggg

SEQ ID NO: 775824 - RNA, 24 nt, Human
cgccuguaaucccagcuacucggg

SEQ ID NO: 775825 - RNA, 24 nt, Human
cgccuucccucgccucugcuggcu

SEQ ID NO: 775826 - RNA, 21 nt, Human
cgcuggguggggccguggguc

SEQ ID NO: 775827 - RNA, 23 nt, Human
cggaucccacgugcaggcagcgg

SEQ ID NO: 775828 - RNA, 21 nt, Human
cggcccggacccggguggcag

SEQ ID NO: 775829 - RNA, 19 nt, Human
cgggcccagcggcagcgcu

SEQ ID NO: 775830 - RNA, 20 nt, Human
cguccugcccgucuccccgc

SEQ ID NO: 775831 - RNA, 28 nt, Human
cuaaaaaaaaaaagcaaaacaaaacaaa

SEQ ID NO: 775832 - RNA, 24 nt, Human
cuaaguccagucugggccgcauac

SEQ ID NO: 775833 - RNA, 19 nt, Human
cuaugcccauccccaaaca

SEQ ID NO: 775834 - RNA, 26 nt, Human
cucaaaaccagugguacugaaaaauc

SEQ ID NO: 775835 - RNA, 19 nt, Human
cucacagcuccuggcacag

SEQ ID NO: 775836 - RNA, 22 nt, Human
cucacagcuccuggcacaggcu

SEQ ID NO: 775837 - RNA, 20 nt, Human
cucaccagcaagaccccuga

SEQ ID NO: 775838 - RNA, 21 nt, Human
cucacgacuuauccuggaccc

SEQ ID NO: 775839 - RNA, 22 nt, Human
cucacgccuguaaucccagcac

SEQ ID NO: 775840 - RNA, 24 nt, Human
cucacgccuguaaucccagcacuu

SEQ ID NO: 775841 - RNA, 22 nt, Human
cucaugaccuacuguccccacc

SEQ ID NO: 775842 - RNA, 20 nt, Human
cucccacacccaucaugcaa

SEQ ID NO: 775843 - RNA, 19 nt, Human
cuccucaauacaccaaagc

SEQ ID NO: 775844 - RNA, 19 nt, Human
cuccucaauacaccaaagc

SEQ ID NO: 775845 - RNA, 19 nt, Human
cuccucaauacaccaaagc

SEQ ID NO: 775846 - RNA, 19 nt, Human
cuccucaauacaccaaagc

SEQ ID NO: 775847 - RNA, 19 nt, Human
cuccucaauacaccaaagc

SEQ ID NO: 775848 - RNA, 19 nt, Human
cuccucaauacaccaaagc

SEQ ID NO: 775849 - RNA, 19 nt, Human
cuccucaauacaccaaagc

SEQ ID NO: 775850 - RNA, 19 nt, Human
cuccucaauacaccaaagc

SEQ ID NO: 775851 - RNA, 19 nt, Human
cuccucaauacaccaaagc

SEQ ID NO: 775852 - RNA, 19 nt, Human
cuccucaauacaccaaagc

SEQ ID NO: 775853 - RNA, 19 nt, Human
cuccucaauacaccaaagc

SEQ ID NO: 775854 - RNA, 19 nt, Human
cuccucaauacaccaaagc

SEQ ID NO: 775855 - RNA, 19 nt, Human
cuccucuaugcccaucccc

SEQ ID NO: 775856 - RNA, 23 nt, Human
cuccucuaugcccauccccaaac

SEQ ID NO: 775857 - RNA, 25 nt, Human
cucgaggcaggagaccacgcgagga

SEQ ID NO: 775858 - RNA, 20 nt, Human
cucucccacacccaucaugc

SEQ ID NO: 775859 - RNA, 20 nt, Human
cugcaagcccggcuccccug

SEQ ID NO: 775860 - RNA, 22 nt, Human
cugcguggccagcagggccggc

SEQ ID NO: 775861 - RNA, 18 nt, Human
cuggaggcagggcaagcu

SEQ ID NO: 775862 - RNA, 23 nt, Human
cuggccccugcguggccagcagg

SEQ ID NO: 775863 - RNA, 20 nt, Human
gaaguggagacgauggggug

SEQ ID NO: 775864 - RNA, 22 nt, Human
gacaccugccgccccagccccc

SEQ ID NO: 775865 - RNA, 19 nt, Human
gacagugugagacccuguc

SEQ ID NO: 775866 - RNA, 19 nt, Human
gaggcugcuggugcggggc

SEQ ID NO: 775867 - RNA, 23 nt, Human
gagguugcagugagccgagaucg

SEQ ID NO: 775868 - RNA, 24 nt, Human
gaugucucacgccuguaaucccag

SEQ ID NO: 775869 - RNA, 20 nt, Human
gauguggacaauaugcaacc

SEQ ID NO: 775870 - RNA, 20 nt, Human
gcaccacugcacuccagccu

SEQ ID NO: 775871 - RNA, 19 nt, Human
gcagggcgcgccgccgccc

SEQ ID NO: 775872 - RNA, 21 nt, Human
gcccugguucucacagcuccu

SEQ ID NO: 775873 - RNA, 26 nt, Human
gcccugguucucacagcuccuggcac

SEQ ID NO: 775874 - RNA, 20 nt, Human
gccgagaucgcaccacugca

SEQ ID NO: 775875 - RNA, 19 nt, Human
gccgccccagcccccaccc

SEQ ID NO: 775876 - RNA, 23 nt, Human
gccuguaaucccagcuacucggg

SEQ ID NO: 775877 - RNA, 20 nt, Human
gcgggcgccuguaaucccag

SEQ ID NO: 775878 - RNA, 20 nt, Human
ggaagaggcaggugggggug

SEQ ID NO: 775879 - RNA, 22 nt, Human
ggacuagguggccggcucugcc

SEQ ID NO: 775880 - RNA, 22 nt, Human
ggaggcggagguugcagugagc

SEQ ID NO: 775881 - RNA, 20 nt, Human
ggagguugcagugagccgag

SEQ ID NO: 775882 - RNA, 22 nt, Human
ggagguugcagugagccgagau

SEQ ID NO: 775883 - RNA, 24 nt, Human
ggagguugcagugagccgagaucg

SEQ ID NO: 775884 - RNA, 22 nt, Human
ggcagggcguccugcccgucuc

SEQ ID NO: 775885 - RNA, 20 nt, Human
ggcaugguggcgggcgcccg

SEQ ID NO: 775886 - RNA, 24 nt, Human
ggcccgggggguggggaagggguc

SEQ ID NO: 775887 - RNA, 23 nt, Human
ggcccugguucucacagcuccug

SEQ ID NO: 775888 - RNA, 27 nt, Human
ggcccugguucucacagcuccuggcac

SEQ ID NO: 775889 - RNA, 18 nt, Human
ggcuggggugggggccgg

SEQ ID NO: 775890 - RNA, 19 nt, Human
ggcuuccacaccaagaaca

SEQ ID NO: 775891 - RNA, 24 nt, Human
gggcgcgaugucucacgccuguaa

SEQ ID NO: 775892 - RNA, 18 nt, Human
ggggauguaaaucaccug

SEQ ID NO: 775893 - RNA, 23 nt, Human
gguggcgggcgccuguaauccca

SEQ ID NO: 775894 - RNA, 24 nt, Human
gguggcgggcgccuguaaucccag

SEQ ID NO: 775895 - RNA, 18 nt, Human
guagcugggcaugguggc

SEQ ID NO: 775896 - RNA, 21 nt, Human
guccucugcaucugcugucac

SEQ ID NO: 775897 - RNA, 21 nt, Human
gucugcaagcccggcuccccu

SEQ ID NO: 775898 - RNA, 24 nt, Human
gugaacucaggaggcggagguugc

SEQ ID NO: 775899 - RNA, 19 nt, Human
guugcagugagccgagauc

SEQ ID NO: 775900 - RNA, 21 nt, Human
uaaacagaaacagaaacgaac

SEQ ID NO: 775901 - RNA, 25 nt, Human
uaaggagaaaccccaucucuacaaa

SEQ ID NO: 775902 - RNA, 20 nt, Human
uauaaaaaguagcugggcau

SEQ ID NO: 775903 - RNA, 19 nt, Human
ucaagagauagagaccauc

SEQ ID NO: 775904 - RNA, 24 nt, Human
ucaauacaccaaagcacacccuca

SEQ ID NO: 775905 - RNA, 24 nt, Human
ucaauacaccaaagcacacccuca

SEQ ID NO: 775906 - RNA, 24 nt, Human
ucaauacaccaaagcacacccuca

SEQ ID NO: 775907 - RNA, 24 nt, Human
ucaauacaccaaagcacacccuca

SEQ ID NO: 775908 - RNA, 24 nt, Human
ucaauacaccaaagcacauccuca

SEQ ID NO: 775909 - RNA, 24 nt, Human
ucaauacaccaaagcacauccuca

SEQ ID NO: 775910 - RNA, 24 nt, Human
ucaauacaccaaagcacauccuca

SEQ ID NO: 775911 - RNA, 24 nt, Human
ucaauacaccaaagcacauccuca

SEQ ID NO: 775912 - RNA, 24 nt, Human
ucaauacaccaaagcacauccuca

SEQ ID NO: 775913 - RNA, 24 nt, Human
ucaauacaccaaagcacauccuca

SEQ ID NO: 775914 - RNA, 24 nt, Human
ucaauacaccaaagcacauccuca

SEQ ID NO: 775915 - RNA, 24 nt, Human
ucaauacaccaaagcacauccuca

SEQ ID NO: 775916 - RNA, 24 nt, Human
ucaauacaccaaagcacauccuca

SEQ ID NO: 775917 - RNA, 24 nt, Human
ucaauacaccaaagcacauccuca

SEQ ID NO: 775918 - RNA, 24 nt, Human
ucaauacaccaaagcacauccuca

SEQ ID NO: 775919 - RNA, 24 nt, Human
ucaauacaccaaagcacauccuca

SEQ ID NO: 775920 - RNA, 24 nt, Human
ucaauacaccaaagcacauccuca

SEQ ID NO: 775921 - RNA, 24 nt, Human
ucaauacaccaaagcacauccuca

SEQ ID NO: 775922 - RNA, 24 nt, Human
ucaauacaccaaagcacauccuca

SEQ ID NO: 775923 - RNA, 24 nt, Human
ucaauacaccaaagcacauccuca

SEQ ID NO: 775924 - RNA, 24 nt, Human
ucaauacaccaaagcacauccuca

SEQ ID NO: 775925 - RNA, 24 nt, Human
ucaauacaccaaagcacauccuca

SEQ ID NO: 775926 - RNA, 24 nt, Human
ucaauacaccaaagcacauccuca

SEQ ID NO: 775927 - RNA, 24 nt, Human
ucaauacaccaaagcacauccuca

SEQ ID NO: 775928 - RNA, 24 nt, Human
ucaauacaccaaagcacauccuca

SEQ ID NO: 775929 - RNA, 24 nt, Human
ucaauacaccaaagcacauccuca

SEQ ID NO: 775930 - RNA, 24 nt, Human
ucaauacaccaaagcacauccuca

SEQ ID NO: 775931 - RNA, 24 nt, Human
ucaauacaccaaagcacauccuca

SEQ ID NO: 775932 - RNA, 24 nt, Human
ucaauacaccaaagcacauccuca

SEQ ID NO: 775933 - RNA, 24 nt, Human
ucaauacaccaaagcacauccuca

SEQ ID NO: 775934 - RNA, 24 nt, Human
ucaauacaccaaagcacauccuca

SEQ ID NO: 775935 - RNA, 24 nt, Human
ucaauacaccaaagcacauccuca

SEQ ID NO: 775936 - RNA, 24 nt, Human
ucaauacaccaaagcacauccuca

SEQ ID NO: 775937 - RNA, 24 nt, Human
ucaauacaccaaagcacauccuca

SEQ ID NO: 775938 - RNA, 24 nt, Human
ucaauacaccaaagcacauccuca

SEQ ID NO: 775939 - RNA, 24 nt, Human
ucaauacaccaaagcacauccuca

SEQ ID NO: 775940 - RNA, 24 nt, Human
ucaauacaccaaagcacauccuca

SEQ ID NO: 775941 - RNA, 24 nt, Human
ucaauacaccaaagcacauccuca

SEQ ID NO: 775942 - RNA, 24 nt, Human
ucaauacaccaaagcacauccuca

SEQ ID NO: 775943 - RNA, 24 nt, Human
ucaauacaccaaagcacauccucg

SEQ ID NO: 775944 - RNA, 24 nt, Human
ucaauacaccaaagcacauucuca

SEQ ID NO: 775945 - RNA, 24 nt, Human
ucaauacaccaaagcacauucuca

SEQ ID NO: 775946 - RNA, 24 nt, Human
ucaauacaccaaagcacauucuca

SEQ ID NO: 775947 - RNA, 24 nt, Human
ucaauacaccaaagcacauucuca

SEQ ID NO: 775948 - RNA, 24 nt, Human
ucaauacaccaaagcacauucuca

SEQ ID NO: 775949 - RNA, 24 nt, Human
ucaauacaccaaagcacauucuca

SEQ ID NO: 775950 - RNA, 24 nt, Human
ucaauacaccaaagcacauucuca

SEQ ID NO: 775951 - RNA, 24 nt, Human
ucaauacaccaaagcacauucuca

SEQ ID NO: 775952 - RNA, 24 nt, Human
ucaauacaccaaagcacauucuca

SEQ ID NO: 775953 - RNA, 24 nt, Human
ucaauacaccaaagcacauucuca

SEQ ID NO: 775954 - RNA, 24 nt, Human
ucaauacaccaaagcacauucuca

SEQ ID NO: 775955 - RNA, 24 nt, Human
ucaauacaccaaagcacauucuca

SEQ ID NO: 775956 - RNA, 24 nt, Human
ucaauacaccaaagcacauucuca

SEQ ID NO: 775957 - RNA, 24 nt, Human
ucaauacaccaaagcacauucuca

SEQ ID NO: 775958 - RNA, 24 nt, Human
ucaauacaccaaaguacauccuca

SEQ ID NO: 775959 - RNA, 24 nt, Human
ucaauacaccaaaguacauccuca

SEQ ID NO: 775960 - RNA, 23 nt, Human
ucagccgggcgcgaugucucacg

SEQ ID NO: 775961 - RNA, 22 nt, Human
ucaggaggcggagguugcagug

SEQ ID NO: 775962 - RNA, 24 nt, Human
ucaguacaccaaagcacauccuca

SEQ ID NO: 775963 - RNA, 18 nt, Human
ucaugcaagugguccugg

SEQ ID NO: 775964 - RNA, 23 nt, Human
uccccaaacacccagguugccga

SEQ ID NO: 775965 - RNA, 20 nt, Human
ucccugccuugguaccgggg

SEQ ID NO: 775966 - RNA, 23 nt, Human
uccuggagacccaggccucuguc

SEQ ID NO: 775967 - RNA, 23 nt, Human
uccuucaccaauagucccugagg

SEQ ID NO: 775968 - RNA, 23 nt, Human
ucgcaccacugcacuccagccug

SEQ ID NO: 775969 - RNA, 20 nt, Human
ucgcgugaacucaggaggcg

SEQ ID NO: 775970 - RNA, 24 nt, Human
ucgggaggcugaggcaggagaauc

SEQ ID NO: 775971 - RNA, 21 nt, Human
ucuguccucugcaucugcugu

SEQ ID NO: 775972 - RNA, 18 nt, Human
ugaaguggagacgauggg

SEQ ID NO: 775973 - RNA, 23 nt, Human
ugaaguggagacgaugggguggg

SEQ ID NO: 775974 - RNA, 22 nt, Human
ugacgugaacaauacguagccc

SEQ ID NO: 775975 - RNA, 22 nt, Human
ugagccgagaucgcaccacugc

SEQ ID NO: 775976 - RNA, 20 nt, Human
ugaggcaggagaaucgcgug

SEQ ID NO: 775977 - RNA, 22 nt, Human
ugaggcaggagaaucgcgugaa

SEQ ID NO: 775978 - RNA, 23 nt, Human
ugaggcaggagaaucgcgugaac

SEQ ID NO: 775979 - RNA, 23 nt, Human
ugaggcaggagaaucgcgugaac

SEQ ID NO: 775980 - RNA, 22 nt, Human
ugauguggacaauaugcaaccc

SEQ ID NO: 775981 - RNA, 20 nt, Human
ugcaugcccacauuucccuc

SEQ ID NO: 775982 - RNA, 20 nt, Human
ugccgaguggcuggcccugg

SEQ ID NO: 775983 - RNA, 19 nt, Human
ugcugagggaccccacccc

SEQ ID NO: 775984 - RNA, 21 nt, Human
uggagggggaagaggcaggug

SEQ ID NO: 775985 - RNA, 24 nt, Human
uggagggggaagaggcaggugggg

SEQ ID NO: 775986 - RNA, 18 nt, Human
uggcacugaguagcagcu

SEQ ID NO: 775987 - RNA, 22 nt, Human
uggcgggcgccuguaaucccag

SEQ ID NO: 775988 - RNA, 19 nt, Human
uggcucugugccccacggg

SEQ ID NO: 775989 - RNA, 19 nt, Human
ugggaggccgaggcgggag

SEQ ID NO: 775990 - RNA, 22 nt, Human
ugggcaauaaggagaaacccca

SEQ ID NO: 775991 - RNA, 23 nt, Human
uggggaaggggucaggaagacug

SEQ ID NO: 775992 - RNA, 18 nt, Human
uggggugggaaggcgagg

SEQ ID NO: 775993 - RNA, 18 nt, Human
ugguggggugagggaugg

SEQ ID NO: 775994 - RNA, 22 nt, Human
uguccccaccccgcccaaccuc

SEQ ID NO: 775995 - RNA, 21 nt, Human
ugucucacgccuguaauccca

SEQ ID NO: 775996 - RNA, 24 nt, Human
ugucucacgccuguaaucccagca

SEQ ID NO: 775997 - RNA, 23 nt, Human
uguguggacaggggcaagggcuc

SEQ ID NO: 775998 - RNA, 23 nt, Human
uucacagugugguccuugguggg

SEQ ID NO: 775999 - RNA, 22 nt, Human
uucaccaauagucccugaggcc

SEQ ID NO: 776000 - RNA, 22 nt, Human
uucagacucaauacaccaaagc

SEQ ID NO: 776001 - RNA, 18 nt, Human
uucccucacugaugugga

SEQ ID NO: 776002 - RNA, 18 nt, Human
uugcagugagccgagauc

SEQ ID NO: 776003 - RNA, 20 nt, Human
uugcagugagccgagaucgc

SEQ ID NO: 776004 - RNA, 22 nt, Human
uugcagugagccgagaucgcac

SEQ ID NO: 776005 - RNA, 24 nt, Human
uugcuaggaagcuucccacagaag

SEQ ID NO: 776006 - RNA, 23 nt, Human
uuuaauaaauaaaacagcaaagg

SEQ ID NO: 776007 - RNA, 19 nt, Human
cagcgccgccaccgccgcc

SEQ ID NO: 776008 - RNA, 18 nt, Human
cagucccgcccgcugcug

SEQ ID NO: 776009 - RNA, 23 nt, Human
ccccgacgggccgccacuacgcc

SEQ ID NO: 776010 - RNA, 19 nt, Human
ccccggccucgcccuccuc

SEQ ID NO: 776011 - RNA, 18 nt, Human
cccgccgcugccuucgcc

SEQ ID NO: 776012 - RNA, 21 nt, Human
cccgccgcugccuucgccucc

SEQ ID NO: 776013 - RNA, 22 nt, Human
ccgccacuacgcccucccgccc

SEQ ID NO: 776014 - RNA, 18 nt, Human
ccgccgccgcuccucugc

SEQ ID NO: 776015 - RNA, 22 nt, Human
ccgccgccgcuccucugccgcc

SEQ ID NO: 776016 - RNA, 22 nt, Human
ccgccgccgcuccucugccgcc

SEQ ID NO: 776017 - RNA, 23 nt, Human
ccgccgccgcuccucugccgccu

SEQ ID NO: 776018 - RNA, 19 nt, Human
ccgccgcugccgccuccuc

SEQ ID NO: 776019 - RNA, 21 nt, Human
ccgccgcugccuucgccuccg

SEQ ID NO: 776020 - RNA, 19 nt, Human
ccuccgagagccacugcuu

SEQ ID NO: 776021 - RNA, 21 nt, Human
ccuccgcgccgccgucgccgc

SEQ ID NO: 776022 - RNA, 23 nt, Human
ccucgcugcgcccgccgcugccu

SEQ ID NO: 776023 - RNA, 24 nt, Human
ccucugccgccuuagucgcugcuc

SEQ ID NO: 776024 - RNA, 23 nt, Human
ccuuagucgcugcucuuuguucc

SEQ ID NO: 776025 - RNA, 22 nt, Human
ccuuccuccgccgcugccgcua

SEQ ID NO: 776026 - RNA, 19 nt, Human
cgcugcgcccgccgcugcc

SEQ ID NO: 776027 - RNA, 19 nt, Human
cgcugcgcccgccgcugcc

SEQ ID NO: 776028 - RNA, 22 nt, Human
cggcccccggccucgcccuccu

SEQ ID NO: 776029 - RNA, 20 nt, Human
cggggugcgccgccuuccuc

SEQ ID NO: 776030 - RNA, 21 nt, Human
cucugccgccuuagucgcugc

SEQ ID NO: 776031 - RNA, 22 nt, Human
cucuuuguucccccuccgagag

SEQ ID NO: 776032 - RNA, 25 nt, Human
cugcagcgccgccaccgccgccgcu

SEQ ID NO: 776033 - RNA, 21 nt, Human
cuuccuccgccgcugccgccu

SEQ ID NO: 776034 - RNA, 20 nt, Human
gcagcgccgccaccgccgcc

SEQ ID NO: 776035 - RNA, 18 nt, Human
gcccccggccucgcccuc

SEQ ID NO: 776036 - RNA, 19 nt, Human
gccgccuuagucgcugcuc

SEQ ID NO: 776037 - RNA, 20 nt, Human
ggcccccggccucgcccucc

SEQ ID NO: 776038 - RNA, 20 nt, Human
ggccucgcccuccucgcugc

SEQ ID NO: 776039 - RNA, 26 nt, Human
uaaacaaauaaccacuuacuucuuuu

SEQ ID NO: 776040 - RNA, 18 nt, Human
ucccgcccucucggcccc

SEQ ID NO: 776041 - RNA, 23 nt, Human
uccuccgccgcugccgccuccuc

SEQ ID NO: 776042 - RNA, 26 nt, Human
ucgccuccgcgccgccgucgccgccg

SEQ ID NO: 776043 - RNA, 23 nt, Human
uuccuccgccgcugccgccuccu

SEQ ID NO: 776044 - RNA, 21 nt, Human
aaaaaacccaaaccaagaaac

SEQ ID NO: 776045 - RNA, 23 nt, Human
aaaaaacccaaaccaagaaaccc

SEQ ID NO: 776046 - RNA, 26 nt, Human
aaaaaacccaaaccaagaaacccaaa

SEQ ID NO: 776047 - RNA, 21 nt, Human
aaaaacccaaaccaagaaacc

SEQ ID NO: 776048 - RNA, 21 nt, Human
aaaugaccacacaaccagaaa

SEQ ID NO: 776049 - RNA, 21 nt, Human
aaccacaggucaccagggaug

SEQ ID NO: 776050 - RNA, 24 nt, Human
aaccacaggucaccagggaugccu

SEQ ID NO: 776051 - RNA, 20 nt, Human
aagaaacccaaagcacggga

SEQ ID NO: 776052 - RNA, 21 nt, Human
aagaaacccaaagcacgggac

SEQ ID NO: 776053 - RNA, 19 nt, Human
aagaccccagacacauucc

SEQ ID NO: 776054 - RNA, 19 nt, Human
aaggggaccaagugggugg

SEQ ID NO: 776055 - RNA, 21 nt, Human
acaggaaggaaugccuccccc

SEQ ID NO: 776056 - RNA, 23 nt, Human
acagugauggcccguccccacgc

SEQ ID NO: 776057 - RNA, 19 nt, Human
accacacaaccagaaacaa

SEQ ID NO: 776058 - RNA, 23 nt, Human
accagacccucuucucuucuccc

SEQ ID NO: 776059 - RNA, 23 nt, Human
accaggcaggagggccaacgguc

SEQ ID NO: 776060 - RNA, 22 nt, Human
accagggcgcggggcggggacg

SEQ ID NO: 776061 - RNA, 30 nt, Human
accccacccuccaccuccggcuccuccagg

SEQ ID NO: 776062 - RNA, 20 nt, Human
acccuggacucccugccuga

SEQ ID NO: 776063 - RNA, 21 nt, Human
acccuggacucccugccugac

SEQ ID NO: 776064 - RNA, 18 nt, Human
accuaggcccccgcccag

SEQ ID NO: 776065 - RNA, 21 nt, Human
acgcugggucacgcccaucuc

SEQ ID NO: 776066 - RNA, 22 nt, Human
acuccacgaggcugcuccaacc

SEQ ID NO: 776067 - RNA, 18 nt, Human
acugagggcuccuggagg

SEQ ID NO: 776068 - RNA, 18 nt, Human
agaagcaaggggaccaag

SEQ ID NO: 776069 - RNA, 26 nt, Human
agacagaaggcugccuuucccccagu

SEQ ID NO: 776070 - RNA, 22 nt, Human
agacaggaaguguucugcaacc

SEQ ID NO: 776071 - RNA, 20 nt, Human
agagcuuggccacugggccu

SEQ ID NO: 776072 - RNA, 22 nt, Human
agagggagggcagaaaggaggg

SEQ ID NO: 776073 - RNA, 22 nt, Human
agaucugcagaaagggccccga

SEQ ID NO: 776074 - RNA, 21 nt, Human
agcaagaccccagggcccgaa

SEQ ID NO: 776075 - RNA, 22 nt, Human
agccaggccagcucugcccagc

SEQ ID NO: 776076 - RNA, 25 nt, Human
agccagggaagggacccggcagggc

SEQ ID NO: 776077 - RNA, 18 nt, Human
agcccucagcccacuccc

SEQ ID NO: 776078 - RNA, 23 nt, Human
aggcugccccagcagcagcugcc

SEQ ID NO: 776079 - RNA, 21 nt, Human
agggagggagccacaggcugu

SEQ ID NO: 776080 - RNA, 21 nt, Human
agggguggggguagugggcag

SEQ ID NO: 776081 - RNA, 21 nt, Human
agguagaaaacagaagcaagg

SEQ ID NO: 776082 - RNA, 20 nt, Human
aggugcccucaccagcccag

SEQ ID NO: 776083 - RNA, 19 nt, Human
aguacugccucccugagca

SEQ ID NO: 776084 - RNA, 21 nt, Human
aguacugccucccugagcagc

SEQ ID NO: 776085 - RNA, 20 nt, Human
auauauguauauauauaugg

SEQ ID NO: 776086 - RNA, 24 nt, Human
augccuaugggccccagcaagacc

SEQ ID NO: 776087 - RNA, 26 nt, Human
auucucaucguccagggucagugggg

SEQ ID NO: 776088 - RNA, 20 nt, Human
caaaaccccucccuugcccc

SEQ ID NO: 776089 - RNA, 21 nt, Human
caaaccaagaaacccaaagca

SEQ ID NO: 776090 - RNA, 22 nt, Human
caaaccaagaaacccaaagcac

SEQ ID NO: 776091 - RNA, 18 nt, Human
caaccccaguccccaaag

SEQ ID NO: 776092 - RNA, 22 nt, Human
caacccuccuggcuauugcacu

SEQ ID NO: 776093 - RNA, 19 nt, Human
caagaagcaaaaccccucc

SEQ ID NO: 776094 - RNA, 23 nt, Human
caagggaccccaaccccagagac

SEQ ID NO: 776095 - RNA, 24 nt, Human
caagggaccccaaccccagagacc

SEQ ID NO: 776096 - RNA, 24 nt, Human
caaguaccugagaggcuggggcag

SEQ ID NO: 776097 - RNA, 24 nt, Human
caagugauagcuggaaccucuuuc

SEQ ID NO: 776098 - RNA, 23 nt, Human
cacacccccagggcuggcagcug

SEQ ID NO: 776099 - RNA, 23 nt, Human
caccaagaccccagacacauucc

SEQ ID NO: 776100 - RNA, 23 nt, Human
caccaggaaacccuuagcaccaa

SEQ ID NO: 776101 - RNA, 22 nt, Human
cacccccagcaaaaaccagacc

SEQ ID NO: 776102 - RNA, 19 nt, Human
cacccucaccugccuuugc

SEQ ID NO: 776103 - RNA, 20 nt, Human
caccgucugcaccaggaaac

SEQ ID NO: 776104 - RNA, 21 nt, Human
caccuuggggagccccaaccc

SEQ ID NO: 776105 - RNA, 22 nt, Human
cacugggccuacccagauuggc

SEQ ID NO: 776106 - RNA, 20 nt, Human
cagacaggccuggggggcag

SEQ ID NO: 776107 - RNA, 21 nt, Human
cagagacccacgcccuggucc

SEQ ID NO: 776108 - RNA, 21 nt, Human
cagcaagggaccccaacccca

SEQ ID NO: 776109 - RNA, 25 nt, Human
cagcagcugccagaccccacccucc

SEQ ID NO: 776110 - RNA, 19 nt, Human
cagcccagcccccaggccc

SEQ ID NO: 776111 - RNA, 23 nt, Human
cagcccuuccgggcccuuuccug

SEQ ID NO: 776112 - RNA, 19 nt, Human
cagcugccagaccccaccc

SEQ ID NO: 776113 - RNA, 25 nt, Human
cagcugccagaccccacccuccacc

SEQ ID NO: 776114 - RNA, 20 nt, Human
caggaggcacccucaccugc

SEQ ID NO: 776115 - RNA, 20 nt, Human
caggcacccuggacucccug

SEQ ID NO: 776116 - RNA, 24 nt, Human
caggccgaggugugcguggguggg

SEQ ID NO: 776117 - RNA, 22 nt, Human
cagggaugccugagccuugggg

SEQ ID NO: 776118 - RNA, 22 nt, Human
cagggguggggguagugggcag

SEQ ID NO: 776119 - RNA, 22 nt, Human
caguagcccccacgccuaccuu

SEQ ID NO: 776120 - RNA, 23 nt, Human
caucaaccugcugugacuuuggc

SEQ ID NO: 776121 - RNA, 18 nt, Human
caucaagcuucugcugcc

SEQ ID NO: 776122 - RNA, 20 nt, Human
ccaaaccuacccccucugag

SEQ ID NO: 776123 - RNA, 20 nt, Human
ccaaguggguggccaagggc

SEQ ID NO: 776124 - RNA, 19 nt, Human
ccacaaaggggcaaagaca

SEQ ID NO: 776125 - RNA, 20 nt, Human
ccacccagggccccaccccu

SEQ ID NO: 776126 - RNA, 22 nt, Human
ccagaaggcugaacacuggagg

SEQ ID NO: 776127 - RNA, 23 nt, Human
ccagacccgggccugggggagcc

SEQ ID NO: 776128 - RNA, 18 nt, Human
ccagcccagaaccacagg

SEQ ID NO: 776129 - RNA, 25 nt, Human
ccagggcuggcagcuguguugaagg

SEQ ID NO: 776130 - RNA, 21 nt, Human
cccaaccccagagacccacgc

SEQ ID NO: 776131 - RNA, 24 nt, Human
cccaccacacucugggggucagcu

SEQ ID NO: 776132 - RNA, 21 nt, Human
cccaccccuugggaggagggc

SEQ ID NO: 776133 - RNA, 23 nt, Human
cccacucccacccacccuggaaa

SEQ ID NO: 776134 - RNA, 22 nt, Human
cccagaaccacaggucaccagg

SEQ ID NO: 776135 - RNA, 22 nt, Human
cccagauuggcagacagaaggc

SEQ ID NO: 776136 - RNA, 25 nt, Human
cccaguggggccccuucucccuggg

SEQ ID NO: 776137 - RNA, 22 nt, Human
cccaucucugccccagccucca

SEQ ID NO: 776138 - RNA, 18 nt, Human
ccccaaagugcuccugga

SEQ ID NO: 776139 - RNA, 18 nt, Human
ccccaaccccagagaccc

SEQ ID NO: 776140 - RNA, 21 nt, Human
ccccacgccacucgggaccag

SEQ ID NO: 776141 - RNA, 19 nt, Human
ccccagcaaaaaccagacc

SEQ ID NO: 776142 - RNA, 24 nt, Human
ccccagcaaaaaccagacccucuu

SEQ ID NO: 776143 - RNA, 22 nt, Human
ccccagcaagaccccagggccc

SEQ ID NO: 776144 - RNA, 27 nt, Human
ccccagccuccauccucucaucaggcc

SEQ ID NO: 776145 - RNA, 22 nt, Human
ccccaggcccaccgucugcacc

SEQ ID NO: 776146 - RNA, 19 nt, Human
ccccagggcuggcagcugu

SEQ ID NO: 776147 - RNA, 20 nt, Human
ccccaguccccaaagugcuc

SEQ ID NO: 776148 - RNA, 19 nt, Human
ccccaguggccacucagag

SEQ ID NO: 776149 - RNA, 23 nt, Human
cccccaggcccaccgucugcacc

SEQ ID NO: 776150 - RNA, 22 nt, Human
ccccgcccagugccugcucccc

SEQ ID NO: 776151 - RNA, 19 nt, Human
ccccuccccuccccucccc

SEQ ID NO: 776152 - RNA, 19 nt, Human
ccccuccccuccccucccc

SEQ ID NO: 776153 - RNA, 22 nt, Human
cccucagcccacucccacccac

SEQ ID NO: 776154 - RNA, 20 nt, Human
cccuccaccuccggcuccuc

SEQ ID NO: 776155 - RNA, 21 nt, Human
cccuggaaaauggccucccuc

SEQ ID NO: 776156 - RNA, 22 nt, Human
cccuggacucccugccugaccc

SEQ ID NO: 776157 - RNA, 23 nt, Human
cccuggacucccugccugacccc

SEQ ID NO: 776158 - RNA, 18 nt, Human
cccuugggaggagggcuc

SEQ ID NO: 776159 - RNA, 23 nt, Human
ccgucccuacuccacgaggcugc

SEQ ID NO: 776160 - RNA, 20 nt, Human
ccuaugggccccagcaagac

SEQ ID NO: 776161 - RNA, 22 nt, Human
ccucaccagcccagaaccacag

SEQ ID NO: 776162 - RNA, 22 nt, Human
ccucaccugccuuugcaccagc

SEQ ID NO: 776163 - RNA, 21 nt, Human
ccugcagguguucagguccac

SEQ ID NO: 776164 - RNA, 18 nt, Human
ccugcugagcuccaccca

SEQ ID NO: 776165 - RNA, 21 nt, Human
ccuggaaaauggccucccucc

SEQ ID NO: 776166 - RNA, 18 nt, Human
ccugggagguagcugggg

SEQ ID NO: 776167 - RNA, 19 nt, Human
ccuggggccccagacccgg

SEQ ID NO: 776168 - RNA, 22 nt, Human
ccuguggcaccaagaccccaga

SEQ ID NO: 776169 - RNA, 19 nt, Human
cgaggcaggggaaagccug

SEQ ID NO: 776170 - RNA, 22 nt, Human
cgcacacgggcaaacaucaaga

SEQ ID NO: 776171 - RNA, 21 nt, Human
cggagcuggcccugccuugaa

SEQ ID NO: 776172 - RNA, 21 nt, Human
cgggggugggggauggagaac

SEQ ID NO: 776173 - RNA, 20 nt, Human
cuacugcaggccaagcccag

SEQ ID NO: 776174 - RNA, 24 nt, Human
cuccaggggccccacacccccagg

SEQ ID NO: 776175 - RNA, 22 nt, Human
cuccuggcuauugcacuucugc

SEQ ID NO: 776176 - RNA, 18 nt, Human
cucugcgcugcagccccc

SEQ ID NO: 776177 - RNA, 20 nt, Human
cugaccccugcccuaccuau

SEQ ID NO: 776178 - RNA, 24 nt, Human
cugcaaccccaguccccaaagugc

SEQ ID NO: 776179 - RNA, 21 nt, Human
cugccagaccccacccuccac

SEQ ID NO: 776180 - RNA, 23 nt, Human
cugccagaccccacccuccaccu

SEQ ID NO: 776181 - RNA, 22 nt, Human
cugcuccccuccccuccccucc

SEQ ID NO: 776182 - RNA, 21 nt, Human
cugcugagcuccacccagggc

SEQ ID NO: 776183 - RNA, 20 nt, Human
cuggggggcagggccugagc

SEQ ID NO: 776184 - RNA, 19 nt, Human
cuggucccucucacugagg

SEQ ID NO: 776185 - RNA, 21 nt, Human
cuuccgggcccuuuccuguuc

SEQ ID NO: 776186 - RNA, 20 nt, Human
cuugccccaagcugggagaa

SEQ ID NO: 776187 - RNA, 22 nt, Human
cuuucaaaaugcacuuauguac

SEQ ID NO: 776188 - RNA, 20 nt, Human
cuuuggccaagccccucccc

SEQ ID NO: 776189 - RNA, 21 nt, Human
gaacacuggaggagagcacac

SEQ ID NO: 776190 - RNA, 19 nt, Human
gaagcaaaaccccucccuu

SEQ ID NO: 776191 - RNA, 24 nt, Human
gaaggaaugccucccccgacccuc

SEQ ID NO: 776192 - RNA, 19 nt, Human
gaagggacccggcagggcc

SEQ ID NO: 776193 - RNA, 18 nt, Human
gacacaggaaggaaugcc

SEQ ID NO: 776194 - RNA, 19 nt, Human
gacccagccguccucaggg

SEQ ID NO: 776195 - RNA, 25 nt, Human
gagcacacuccaggggccccacacc

SEQ ID NO: 776196 - RNA, 18 nt, Human
gagcugccaucaaccugc

SEQ ID NO: 776197 - RNA, 19 nt, Human
gaggaagcggagccggggg

SEQ ID NO: 776198 - RNA, 18 nt, Human
gaggagcagggguggggg

SEQ ID NO: 776199 - RNA, 22 nt, Human
gagggcuccuggaggccuaugu

SEQ ID NO: 776200 - RNA, 19 nt, Human
gcacacuccaggggcccca

SEQ ID NO: 776201 - RNA, 19 nt, Human
gccccagcaagaccccagg

SEQ ID NO: 776202 - RNA, 19 nt, Human
gccccagccuccauccucu

SEQ ID NO: 776203 - RNA, 18 nt, Human
gcccugguccagcccagc

SEQ ID NO: 776204 - RNA, 21 nt, Human
gccugggggagccgccugggg

SEQ ID NO: 776205 - RNA, 24 nt, Human
gccuugaacagagggcgguguggc

SEQ ID NO: 776206 - RNA, 18 nt, Human
gcgcggggcggggacgag

SEQ ID NO: 776207 - RNA, 18 nt, Human
gcucacuggcuccuuccc

SEQ ID NO: 776208 - RNA, 21 nt, Human
gcucaggugcccucaccagcc

SEQ ID NO: 776209 - RNA, 18 nt, Human
gcugcugaggguuggagc

SEQ ID NO: 776210 - RNA, 22 nt, Human
gcuguguugaagggcaucaagc

SEQ ID NO: 776211 - RNA, 24 nt, Human
gcuuugggagugucccggaaacuc

SEQ ID NO: 776212 - RNA, 23 nt, Human
ggaaugggggagggugggugcuu

SEQ ID NO: 776213 - RNA, 19 nt, Human
ggagguagcugggggugcu

SEQ ID NO: 776214 - RNA, 23 nt, Human
ggcagaaaggagggggucagacc

SEQ ID NO: 776215 - RNA, 21 nt, Human
ggccaagcccaguggggcccc

SEQ ID NO: 776216 - RNA, 22 nt, Human
ggcccaaggaugaagccagaga

SEQ ID NO: 776217 - RNA, 20 nt, Human
ggcccgaacucaccguugaa

SEQ ID NO: 776218 - RNA, 22 nt, Human
ggcccugccuugaacagagggc

SEQ ID NO: 776219 - RNA, 21 nt, Human
ggccugggggagccgccuggg

SEQ ID NO: 776220 - RNA, 21 nt, Human
gggagggggcucccaugagag

SEQ ID NO: 776221 - RNA, 21 nt, Human
gggcagacccugcugagcucc

SEQ ID NO: 776222 - RNA, 19 nt, Human
gggcagaggcagugcccag

SEQ ID NO: 776223 - RNA, 18 nt, Human
gggcagggccugagcaca

SEQ ID NO: 776224 - RNA, 18 nt, Human
gggcccgaacucaccguu

SEQ ID NO: 776225 - RNA, 19 nt, Human
ggggagggugggugcuggg

SEQ ID NO: 776226 - RNA, 20 nt, Human
ggggucaggcucacuggcuc

SEQ ID NO: 776227 - RNA, 20 nt, Human
ggguggggguagugggcagg

SEQ ID NO: 776228 - RNA, 18 nt, Human
ggugcuggaguuccagug

SEQ ID NO: 776229 - RNA, 24 nt, Human
gguggcugcccgugccagguugcu

SEQ ID NO: 776230 - RNA, 18 nt, Human
guagaaaacagaagcaag

SEQ ID NO: 776231 - RNA, 21 nt, Human
guccagcccagcccccaggcc

SEQ ID NO: 776232 - RNA, 18 nt, Human
gucccggagcuggcccug

SEQ ID NO: 776233 - RNA, 20 nt, Human
gucuguccugggagguagcu

SEQ ID NO: 776234 - RNA, 20 nt, Human
gugcuggaguuccaguguug

SEQ ID NO: 776235 - RNA, 22 nt, Human
guggcugcccgugccagguugc

SEQ ID NO: 776236 - RNA, 21 nt, Human
gugggggauggagaacuggag

SEQ ID NO: 776237 - RNA, 20 nt, Human
guguuggguggaggugaggc

SEQ ID NO: 776238 - RNA, 18 nt, Human
uaaaaaacccaaaccaag

SEQ ID NO: 776239 - RNA, 19 nt, Human
uacaagugauagcuggaac

SEQ ID NO: 776240 - RNA, 21 nt, Human
uacaagugauagcuggaaccu

SEQ ID NO: 776241 - RNA, 18 nt, Human
uacagugauggcccgucc

SEQ ID NO: 776242 - RNA, 24 nt, Human
uagaaaacagaagcaaggggacca

SEQ ID NO: 776243 - RNA, 25 nt, Human
uagaucugcagaaagggccccgacu

SEQ ID NO: 776244 - RNA, 18 nt, Human
uauauauguauauauaua

SEQ ID NO: 776245 - RNA, 19 nt, Human
uauauauguauauauauau

SEQ ID NO: 776246 - RNA, 21 nt, Human
uauauguauauauauaugguc

SEQ ID NO: 776247 - RNA, 18 nt, Human
uaucaaaugaccacacaa

SEQ ID NO: 776248 - RNA, 22 nt, Human
uauguauauauauaugguuaca

SEQ ID NO: 776249 - RNA, 20 nt, Human
uauugcacuucugcugggca

SEQ ID NO: 776250 - RNA, 23 nt, Human
ucaccugccuuugcaccagcaaa

SEQ ID NO: 776251 - RNA, 21 nt, Human
ucagcccacucccacccaccc

SEQ ID NO: 776252 - RNA, 23 nt, Human
uccaggacuccucuucccacacc

SEQ ID NO: 776253 - RNA, 20 nt, Human
uccccaagggccaaguaccu

SEQ ID NO: 776254 - RNA, 20 nt, Human
ucccgccauugguggcaagg

SEQ ID NO: 776255 - RNA, 21 nt, Human
ucccggaaacucacccccagc

SEQ ID NO: 776256 - RNA, 21 nt, Human
ucccuccaaaccuacccccuc

SEQ ID NO: 776257 - RNA, 22 nt, Human
uccgggucuccacacccacucc

SEQ ID NO: 776258 - RNA, 18 nt, Human
uccucagggccacaaagg

SEQ ID NO: 776259 - RNA, 20 nt, Human
ugacuuuggccaagccccuc

SEQ ID NO: 776260 - RNA, 18 nt, Human
ugagaggcuggggcaggc

SEQ ID NO: 776261 - RNA, 19 nt, Human
ugagaggcuggggcaggca

SEQ ID NO: 776262 - RNA, 20 nt, Human
ugagaggcuggggcaggcac

SEQ ID NO: 776263 - RNA, 21 nt, Human
ugagaggcuggggcaggcacc

SEQ ID NO: 776264 - RNA, 18 nt, Human
ugagcagcaagggacccc

SEQ ID NO: 776265 - RNA, 27 nt, Human
ugagcuccacccagggccccaccccuu

SEQ ID NO: 776266 - RNA, 21 nt, Human
ugagggcuccuggaggccuau

SEQ ID NO: 776267 - RNA, 21 nt, Human
ugcaccaggaaacccuuagca

SEQ ID NO: 776268 - RNA, 21 nt, Human
ugcaccuaggcccccgcccag

SEQ ID NO: 776269 - RNA, 22 nt, Human
ugccagguugcucaggugcccu

SEQ ID NO: 776270 - RNA, 18 nt, Human
ugccaucaaccugcugug

SEQ ID NO: 776271 - RNA, 26 nt, Human
ugccccacaugccuaugggccccagc

SEQ ID NO: 776272 - RNA, 18 nt, Human
ugcccgugccagguugcu

SEQ ID NO: 776273 - RNA, 21 nt, Human
ugcccuaccuauagacccagc

SEQ ID NO: 776274 - RNA, 18 nt, Human
ugcccucaccagcccaga

SEQ ID NO: 776275 - RNA, 20 nt, Human
ugcccuguggcagccuuaac

SEQ ID NO: 776276 - RNA, 19 nt, Human
ugccuacucugcgcugcag

SEQ ID NO: 776277 - RNA, 20 nt, Human
ugcucaggugcccucaccag

SEQ ID NO: 776278 - RNA, 19 nt, Human
ugcuccaaccuaggccugc

SEQ ID NO: 776279 - RNA, 22 nt, Human
ugcugaggguuggagccuucug

SEQ ID NO: 776280 - RNA, 18 nt, Human
ugcugggggcagaggcag

SEQ ID NO: 776281 - RNA, 19 nt, Human
uggaaaauggccucccucc

SEQ ID NO: 776282 - RNA, 21 nt, Human
uggaggagagcacacuccagg

SEQ ID NO: 776283 - RNA, 21 nt, Human
uggaggugaggccaggauggu

SEQ ID NO: 776284 - RNA, 20 nt, Human
uggcaaggacaaagugcacc

SEQ ID NO: 776285 - RNA, 20 nt, Human
uggcaagggcugcugagggu

SEQ ID NO: 776286 - RNA, 21 nt, Human
uggcaagggcugcugaggguu

SEQ ID NO: 776287 - RNA, 21 nt, Human
uggcagacagaaggcugccuu

SEQ ID NO: 776288 - RNA, 19 nt, Human
uggcagagggagggcagaa

SEQ ID NO: 776289 - RNA, 24 nt, Human
uggcagcuguguugaagggcaucc

SEQ ID NO: 776290 - RNA, 20 nt, Human
uggcauuaaaaaacccaaac

SEQ ID NO: 776291 - RNA, 22 nt, Human
uggccaagccccuccccuggcu

SEQ ID NO: 776292 - RNA, 18 nt, Human
uggccacugggccuaccc

SEQ ID NO: 776293 - RNA, 23 nt, Human
uggcccaaggaugaagccagaga

SEQ ID NO: 776294 - RNA, 23 nt, Human
uggcuauugcacuucugcugggc

SEQ ID NO: 776295 - RNA, 20 nt, Human
ugggccccagcaagacccca

SEQ ID NO: 776296 - RNA, 20 nt, Human
ugggggagccgccuggggcc

SEQ ID NO: 776297 - RNA, 20 nt, Human
ugggggcagaggcagugccc

SEQ ID NO: 776298 - RNA, 21 nt, Human
uggguggaggugaggccagga

SEQ ID NO: 776299 - RNA, 23 nt, Human
uggguggaggugaggccaggaug

SEQ ID NO: 776300 - RNA, 19 nt, Human
uggguggggggaguccggg

SEQ ID NO: 776301 - RNA, 18 nt, Human
uggucagacaggggucug

SEQ ID NO: 776302 - RNA, 24 nt, Human
uguauauauauaugguuacaagug

SEQ ID NO: 776303 - RNA, 23 nt, Human
ugucccggaaacucacccccagc

SEQ ID NO: 776304 - RNA, 20 nt, Human
uguggcggcugcaugggggc

SEQ ID NO: 776305 - RNA, 24 nt, Human
uguguugaagggcaucaagcuucu

SEQ ID NO: 776306 - RNA, 24 nt, Human
uguucugcaaccccaguccccaaa

SEQ ID NO: 776307 - RNA, 18 nt, Human
uguuuguauaaaaaacaa

SEQ ID NO: 776308 - RNA, 21 nt, Human
uuaaaaaaaaaaguggggagg

SEQ ID NO: 776309 - RNA, 25 nt, Human
uuaaaaaaaaaaguggggagggggc

SEQ ID NO: 776310 - RNA, 23 nt, Human
uucagggaagggagaguggcugg

SEQ ID NO: 776311 - RNA, 23 nt, Human
uuuaauacauacagugauggccc

SEQ ID NO: 776312 - RNA, 20 nt, Human
aaaaaaacaacaaacaaaca

SEQ ID NO: 776313 - RNA, 19 nt, Human
aaaaaacaaaccccacaaa

SEQ ID NO: 776314 - RNA, 22 nt, Human
aaaaaacaaaccccacaaaaga

SEQ ID NO: 776315 - RNA, 24 nt, Human
aaaaaacuagcucgguaugguggc

SEQ ID NO: 776316 - RNA, 18 nt, Human
aaaauuagcugggcaugg

SEQ ID NO: 776317 - RNA, 27 nt, Human
aaacaaaaacaaaaaacaaaccccaca

SEQ ID NO: 776318 - RNA, 24 nt, Human
aaacaaacaaaauaaccagccagg

SEQ ID NO: 776319 - RNA, 22 nt, Human
aaacaggagaauugcuugaacc

SEQ ID NO: 776320 - RNA, 24 nt, Human
aaacaggagaauugcuugaaccug

SEQ ID NO: 776321 - RNA, 23 nt, Human
aaacccacagguguaacagccca

SEQ ID NO: 776322 - RNA, 23 nt, Human
aaauauauauacacacagcccuc

SEQ ID NO: 776323 - RNA, 20 nt, Human
aacacacugacuugcuaaga

SEQ ID NO: 776324 - RNA, 19 nt, Human
aacacggugaaaccccguc

SEQ ID NO: 776325 - RNA, 20 nt, Human
aacacggugaaaccccgucu

SEQ ID NO: 776326 - RNA, 21 nt, Human
aacacggugaaaccccgucuc

SEQ ID NO: 776327 - RNA, 19 nt, Human
aacauggagaaaccccauc

SEQ ID NO: 776328 - RNA, 20 nt, Human
aacauggagaaaccccaucu

SEQ ID NO: 776329 - RNA, 21 nt, Human
aacauggagaaaccccaucuc

SEQ ID NO: 776330 - RNA, 20 nt, Human
aacauggugaaacacugucu

SEQ ID NO: 776331 - RNA, 21 nt, Human
aacauggugaaacacugucuc

SEQ ID NO: 776332 - RNA, 19 nt, Human
aacauggugaaaccccauc

SEQ ID NO: 776333 - RNA, 20 nt, Human
aacauggugaaaccccaucu

SEQ ID NO: 776334 - RNA, 21 nt, Human
aacauggugaaaccccaucuc

SEQ ID NO: 776335 - RNA, 21 nt, Human
aacauggugaaaccccaucuc

SEQ ID NO: 776336 - RNA, 19 nt, Human
aacauggugaaaccccguc

SEQ ID NO: 776337 - RNA, 19 nt, Human
aacauggugaaaccccguc

SEQ ID NO: 776338 - RNA, 20 nt, Human
aacauggugaaaccccgucu

SEQ ID NO: 776339 - RNA, 20 nt, Human
aacauggugaaaccccgucu

SEQ ID NO: 776340 - RNA, 21 nt, Human
aacauggugaaaccccgucuc

SEQ ID NO: 776341 - RNA, 21 nt, Human
aacauggugaaaccccgucuc

SEQ ID NO: 776342 - RNA, 23 nt, Human
aagaugcgaaccuuugucuuaga

SEQ ID NO: 776343 - RNA, 25 nt, Human
aagguggguggaucauuugagguca

SEQ ID NO: 776344 - RNA, 22 nt, Human
aagugaaggcuuuccuacacuc

SEQ ID NO: 776345 - RNA, 19 nt, Human
aaguggagguugcagugag

SEQ ID NO: 776346 - RNA, 24 nt, Human
aaguggagguugcagugagccaag

SEQ ID NO: 776347 - RNA, 22 nt, Human
aauaccuaucacaaaagauggc

SEQ ID NO: 776348 - RNA, 21 nt, Human
aauuacaucucaacaaaaaca

SEQ ID NO: 776349 - RNA, 19 nt, Human
aauugcuugaacccagagg

SEQ ID NO: 776350 - RNA, 24 nt, Human
aauugcuugaaccugagaagugga

SEQ ID NO: 776351 - RNA, 18 nt, Human
aauugcuugaaccuggga

SEQ ID NO: 776352 - RNA, 24 nt, Human
aauugcuugaaccugggaggcaga

SEQ ID NO: 776353 - RNA, 24 nt, Human
aauugcuugaauccgggaggcgga

SEQ ID NO: 776354 - RNA, 18 nt, Human
acaaaaaacaaaccccac

SEQ ID NO: 776355 - RNA, 21 nt, Human
acaaaaaacaaaccccacaaa

SEQ ID NO: 776356 - RNA, 22 nt, Human
acaaaaacaaaaaacaaacccc

SEQ ID NO: 776357 - RNA, 19 nt, Human
acaaaauaaccagccaggc

SEQ ID NO: 776358 - RNA, 25 nt, Human
acaaacccacagguguaacagccca

SEQ ID NO: 776359 - RNA, 20 nt, Human
acaccacugcacuccagccu

SEQ ID NO: 776360 - RNA, 25 nt, Human
acaccacugcacuccagccuggggc

SEQ ID NO: 776361 - RNA, 24 nt, Human
acagagcgagacugugucucaaaa

SEQ ID NO: 776362 - RNA, 24 nt, Human
acagaguaagacuccagcucaaaa

SEQ ID NO: 776363 - RNA, 19 nt, Human
acagagugagacaccaucu

SEQ ID NO: 776364 - RNA, 18 nt, Human
acauacagguggacagac

SEQ ID NO: 776365 - RNA, 22 nt, Human
accacugcacuccagccugggc

SEQ ID NO: 776366 - RNA, 21 nt, Human
accagcaccucccauacacaa

SEQ ID NO: 776367 - RNA, 23 nt, Human
accagguccuccacugcaucucc

SEQ ID NO: 776368 - RNA, 24 nt, Human
accccaucucuacuaaaaauacaa

SEQ ID NO: 776369 - RNA, 24 nt, Human
accccaucucuacuaaaauuacaa

SEQ ID NO: 776370 - RNA, 24 nt, Human
accccgucuccacuaaaaauacaa

SEQ ID NO: 776371 - RNA, 18 nt, Human
accccgucucuacuaaaa

SEQ ID NO: 776372 - RNA, 18 nt, Human
accccgucucuacuaaaa

SEQ ID NO: 776373 - RNA, 24 nt, Human
accugaggucaggaguucaagacc

SEQ ID NO: 776374 - RNA, 24 nt, Human
accugaggucaggaguuugagacc

SEQ ID NO: 776375 - RNA, 19 nt, Human
acucacacagacacauaca

SEQ ID NO: 776376 - RNA, 18 nt, Human
acucaggaggcugaaaca

SEQ ID NO: 776377 - RNA, 25 nt, Human
acuccagccuggggcaacagaguga

SEQ ID NO: 776378 - RNA, 23 nt, Human
acugcacuccagccuggcaacag

SEQ ID NO: 776379 - RNA, 18 nt, Human
acugcacuccagccuggg

SEQ ID NO: 776380 - RNA, 18 nt, Human
acugcacuccagccuggg

SEQ ID NO: 776381 - RNA, 18 nt, Human
acugcacuccagccuggg

SEQ ID NO: 776382 - RNA, 18 nt, Human
acugcacuccagccuggg

SEQ ID NO: 776383 - RNA, 21 nt, Human
acugcacuccagccugggcaa

SEQ ID NO: 776384 - RNA, 21 nt, Human
acugcacuccagccugggcaa

SEQ ID NO: 776385 - RNA, 25 nt, Human
acugcacuccagccugggcaacaag

SEQ ID NO: 776386 - RNA, 22 nt, Human
acugcacuccagccugggcaag

SEQ ID NO: 776387 - RNA, 25 nt, Human
acugcacuccagccuggggcaacag

SEQ ID NO: 776388 - RNA, 23 nt, Human
acugcaguccagcuuggugacag

SEQ ID NO: 776389 - RNA, 23 nt, Human
acuuucacuccagccuaggcaac

SEQ ID NO: 776390 - RNA, 22 nt, Human
agaaaacagggaaagcaaguua

SEQ ID NO: 776391 - RNA, 21 nt, Human
agaaugugaaaggaccugaaa

SEQ ID NO: 776392 - RNA, 22 nt, Human
agaauugcuugaaccugagaag

SEQ ID NO: 776393 - RNA, 22 nt, Human
agaauugcuugaauccgggagg

SEQ ID NO: 776394 - RNA, 19 nt, Human
agacaaauauacaaaaauc

SEQ ID NO: 776395 - RNA, 21 nt, Human
agaccgagguggguggaucac

SEQ ID NO: 776396 - RNA, 18 nt, Human
agagaagcgaaggugugc

SEQ ID NO: 776397 - RNA, 23 nt, Human
agagauugcagugagccgagauc

SEQ ID NO: 776398 - RNA, 19 nt, Human
agaggguguuuccuaacuu

SEQ ID NO: 776399 - RNA, 18 nt, Human
agagguuacagugagcca

SEQ ID NO: 776400 - RNA, 22 nt, Human
agaucaccugaggucaggaguu

SEQ ID NO: 776401 - RNA, 20 nt, Human
agaugggaaauggagcugga

SEQ ID NO: 776402 - RNA, 24 nt, Human
agcacuuugggaggccgaggaggg

SEQ ID NO: 776403 - RNA, 24 nt, Human
agcacuuugggaggccgaggcagg

SEQ ID NO: 776404 - RNA, 25 nt, Human
agcacuuuggggagaccgagguggg

SEQ ID NO: 776405 - RNA, 21 nt, Human
agccaagauugugccacugca

SEQ ID NO: 776406 - RNA, 23 nt, Human
agccaggcgugguggcgcaugcc

SEQ ID NO: 776407 - RNA, 24 nt, Human
agccuaggcaacagaguaagacuc

SEQ ID NO: 776408 - RNA, 22 nt, Human
agccuggcaacagugagaaucc

SEQ ID NO: 776409 - RNA, 22 nt, Human
agccuggccaacauggugaaac

SEQ ID NO: 776410 - RNA, 24 nt, Human
agccuggccaacauggugaaaccc

SEQ ID NO: 776411 - RNA, 22 nt, Human
agccuggucaacauggugaaac

SEQ ID NO: 776412 - RNA, 23 nt, Human
agcucgguaugguggcacgcgcc

SEQ ID NO: 776413 - RNA, 20 nt, Human
agcugggcaugguggugggc

SEQ ID NO: 776414 - RNA, 23 nt, Human
agcugguugugguggcacgcgcc

SEQ ID NO: 776415 - RNA, 24 nt, Human
aggagggcggaucacgaggucagg

SEQ ID NO: 776416 - RNA, 20 nt, Human
aggaguuugagaccagccug

SEQ ID NO: 776417 - RNA, 20 nt, Human
aggaugugcauaggcagauc

SEQ ID NO: 776418 - RNA, 23 nt, Human
aggcagaagaauugcuugaaccc

SEQ ID NO: 776419 - RNA, 21 nt, Human
aggcagagauugcagugagcc

SEQ ID NO: 776420 - RNA, 24 nt, Human
aggcagagauugcagugagccgag

SEQ ID NO: 776421 - RNA, 24 nt, Human
aggcagaguggcucacgccuguaa

SEQ ID NO: 776422 - RNA, 22 nt, Human
aggcagaucacaaggucaggag

SEQ ID NO: 776423 - RNA, 26 nt, Human
aggcagaucaccugaggucaggaguu

SEQ ID NO: 776424 - RNA, 20 nt, Human
aggcagaucccacuugggga

SEQ ID NO: 776425 - RNA, 21 nt, Human
aggcaggagaauggcgugaac

SEQ ID NO: 776426 - RNA, 27 nt, Human
aggcaggagaauggcgugaacccagga

SEQ ID NO: 776427 - RNA, 22 nt, Human
aggcaggagaauugcuugaacc

SEQ ID NO: 776428 - RNA, 24 nt, Human
aggcaggagaauugcuugaaccug

SEQ ID NO: 776429 - RNA, 24 nt, Human
aggcaggcagaucacaaggucagg

SEQ ID NO: 776430 - RNA, 26 nt, Human
aggcaggcagaucacaaggucaggag

SEQ ID NO: 776431 - RNA, 22 nt, Human
aggcaggcagaucaccugaggu

SEQ ID NO: 776432 - RNA, 26 nt, Human
aggcaggcagaucaccugaggucagg

SEQ ID NO: 776433 - RNA, 22 nt, Human
aggcagguggauuaccugaggu

SEQ ID NO: 776434 - RNA, 26 nt, Human
aggcagguggauuaccugaggucagg

SEQ ID NO: 776435 - RNA, 20 nt, Human
aggccaagguggguggauca

SEQ ID NO: 776436 - RNA, 21 nt, Human
aggccgaggagggcggaucac

SEQ ID NO: 776437 - RNA, 24 nt, Human
aggcggagcuugcagugagcugag

SEQ ID NO: 776438 - RNA, 19 nt, Human
aggcggagguugcggugag

SEQ ID NO: 776439 - RNA, 22 nt, Human
aggcggagguugcggugagccg

SEQ ID NO: 776440 - RNA, 24 nt, Human
aggcgugguggcgcaugccuguaa

SEQ ID NO: 776441 - RNA, 24 nt, Human
aggcugaggcagaagaauugcuug

SEQ ID NO: 776442 - RNA, 19 nt, Human
aggcugaggcaggagaaug

SEQ ID NO: 776443 - RNA, 21 nt, Human
aggcugaggcaggagaauugc

SEQ ID NO: 776444 - RNA, 24 nt, Human
aggcugaggcaggagaauugcuug

SEQ ID NO: 776445 - RNA, 24 nt, Human
aggcugcggcaggagaauugcuug

SEQ ID NO: 776446 - RNA, 22 nt, Human
agggaaagcaaguuaggggagg

SEQ ID NO: 776447 - RNA, 22 nt, Human
agggagacuguuguuacgaggg

SEQ ID NO: 776448 - RNA, 22 nt, Human
agguggauuaccugaggucagg

SEQ ID NO: 776449 - RNA, 24 nt, Human
agguggguggaucacaaggucagg

SEQ ID NO: 776450 - RNA, 24 nt, Human
aguggcucacgccuguaaucccag

SEQ ID NO: 776451 - RNA, 23 nt, Human
aguugggcgugguggcaugugcc

SEQ ID NO: 776452 - RNA, 24 nt, Human
aucacaccacugcacuccagccug

SEQ ID NO: 776453 - RNA, 24 nt, Human
aucaccugaggucaggaguuugag

SEQ ID NO: 776454 - RNA, 24 nt, Human
aucaugccacugcaguccagcuug

SEQ ID NO: 776455 - RNA, 24 nt, Human
aucgcaccacugcacuccagccug

SEQ ID NO: 776456 - RNA, 24 nt, Human
aucgcgccacugcacuccagccug

SEQ ID NO: 776457 - RNA, 24 nt, Human
auuaccugaggucaggaguucaag

SEQ ID NO: 776458 - RNA, 24 nt, Human
auugcagugagccgagaucaugcc

SEQ ID NO: 776459 - RNA, 23 nt, Human
auugcuuugaccugggaggcaga

SEQ ID NO: 776460 - RNA, 24 nt, Human
auugugccacugcacuccagccug

SEQ ID NO: 776461 - RNA, 18 nt, Human
caaaaaacaaaccccaca

SEQ ID NO: 776462 - RNA, 20 nt, Human
caaaaacaaaaaacaaaccc

SEQ ID NO: 776463 - RNA, 21 nt, Human
caaaaacaaaaaacaaacccc

SEQ ID NO: 776464 - RNA, 23 nt, Human
caaaaacaaaaaacaaaccccac

SEQ ID NO: 776465 - RNA, 24 nt, Human
caaaaacaaaaacaaaaaacaaac

SEQ ID NO: 776466 - RNA, 21 nt, Human
caaaaacaucaucauagaccc

SEQ ID NO: 776467 - RNA, 19 nt, Human
caaaacagcccuggaauaa

SEQ ID NO: 776468 - RNA, 21 nt, Human
caaaauaaccagccaggcaga

SEQ ID NO: 776469 - RNA, 27 nt, Human
caaaauaaccagccaggcagaguggcc

SEQ ID NO: 776470 - RNA, 23 nt, Human
caaacaaacaaaauaaccagcca

SEQ ID NO: 776471 - RNA, 19 nt, Human
caaaggacagacccgaccc

SEQ ID NO: 776472 - RNA, 23 nt, Human
caacaaaaacaaaaacaaaaaac

SEQ ID NO: 776473 - RNA, 25 nt, Human
caacaaaaacaaaaacaaaaaacaa

SEQ ID NO: 776474 - RNA, 28 nt, Human
caacaaaaacaaaaacaaaaaacaaaag

SEQ ID NO: 776475 - RNA, 28 nt, Human
caacaaaaacaaaaacaaaaaacaaacc

SEQ ID NO: 776476 - RNA, 24 nt, Human
caacaaaggacagacccgaccccu

SEQ ID NO: 776477 - RNA, 21 nt, Human
caacaagagcaaaauuacauc

SEQ ID NO: 776478 - RNA, 20 nt, Human
caacauggugaaacacuguc

SEQ ID NO: 776479 - RNA, 22 nt, Human
caacauggugaaacacugucuc

SEQ ID NO: 776480 - RNA, 24 nt, Human
caacauggugaaacacugucucua

SEQ ID NO: 776481 - RNA, 20 nt, Human
caacauggugaaaccccauc

SEQ ID NO: 776482 - RNA, 22 nt, Human
caacauggugaaaccccaucuc

SEQ ID NO: 776483 - RNA, 24 nt, Human
caacauggugaaaccccaucucua

SEQ ID NO: 776484 - RNA, 24 nt, Human
caacauggugaaaccccgucucua

SEQ ID NO: 776485 - RNA, 24 nt, Human
caacauggugaaaccccgucucua

SEQ ID NO: 776486 - RNA, 24 nt, Human
caagaccagccuggccaacauggu

SEQ ID NO: 776487 - RNA, 24 nt, Human
caagacuauccuggcuaacacggu

SEQ ID NO: 776488 - RNA, 24 nt, Human
caagauugugccacugcacuccag

SEQ ID NO: 776489 - RNA, 24 nt, Human
caagccucuaaucccagcacuuug

SEQ ID NO: 776490 - RNA, 24 nt, Human
caaggcagguggauuaccugaggu

SEQ ID NO: 776491 - RNA, 26 nt, Human
caaggcagguggauuaccugagguca

SEQ ID NO: 776492 - RNA, 24 nt, Human
caagguggguggaucauuugaggu

SEQ ID NO: 776493 - RNA, 26 nt, Human
cacaaacccacagguguaacagcccu

SEQ ID NO: 776494 - RNA, 20 nt, Human
cacacagacacauacacaaa

SEQ ID NO: 776495 - RNA, 21 nt, Human
cacaccacugcacuccagccu

SEQ ID NO: 776496 - RNA, 24 nt, Human
cacaccuguaaucccagcacuuug

SEQ ID NO: 776497 - RNA, 21 nt, Human
cacagucugacccgaggacac

SEQ ID NO: 776498 - RNA, 25 nt, Human
caccacugcacuccagccuggggca

SEQ ID NO: 776499 - RNA, 21 nt, Human
caccucagagccaccugcggu

SEQ ID NO: 776500 - RNA, 23 nt, Human
caccucagagccaccugcgguug

SEQ ID NO: 776501 - RNA, 22 nt, Human
caccucccauacacaacagagc

SEQ ID NO: 776502 - RNA, 23 nt, Human
caccugaggucaggaguuugaga

SEQ ID NO: 776503 - RNA, 23 nt, Human
caccuguaaucccagcacuuugg

SEQ ID NO: 776504 - RNA, 24 nt, Human
caccuguaaucccagcacuuuggg

SEQ ID NO: 776505 - RNA, 24 nt, Human
cacgccuauaaucccagcacuuug

SEQ ID NO: 776506 - RNA, 24 nt, Human
cacgccuguaaucccagcacuuug

SEQ ID NO: 776507 - RNA, 24 nt, Human
cacgccuguaaucccagcacuuug

SEQ ID NO: 776508 - RNA, 19 nt, Human
cacuccagccuaggcaaca

SEQ ID NO: 776509 - RNA, 23 nt, Human
cacuccagccuaggcaacagagu

SEQ ID NO: 776510 - RNA, 24 nt, Human
cacuccagccugggcaacaagagc

SEQ ID NO: 776511 - RNA, 23 nt, Human
cacuccagccuggggcaacagag

SEQ ID NO: 776512 - RNA, 24 nt, Human
cacuccagccuggggcaacagagu

SEQ ID NO: 776513 - RNA, 25 nt, Human
cacuccagccuggggcaacagagug

SEQ ID NO: 776514 - RNA, 24 nt, Human
cacugaggccucaucugccagcaa

SEQ ID NO: 776515 - RNA, 18 nt, Human
cacugcacuccagccugg

SEQ ID NO: 776516 - RNA, 18 nt, Human
cacugcacuccagccugg

SEQ ID NO: 776517 - RNA, 18 nt, Human
cacugcacuccagccugg

SEQ ID NO: 776518 - RNA, 20 nt, Human
cacugcacuccagccuggca

SEQ ID NO: 776519 - RNA, 23 nt, Human
cacugcacuccagccuggcaaca

SEQ ID NO: 776520 - RNA, 24 nt, Human
cacugcacuccagccuggcaacag

SEQ ID NO: 776521 - RNA, 19 nt, Human
cacugcacuccagccuggg

SEQ ID NO: 776522 - RNA, 19 nt, Human
cacugcacuccagccuggg

SEQ ID NO: 776523 - RNA, 19 nt, Human
cacugcacuccagccuggg

SEQ ID NO: 776524 - RNA, 21 nt, Human
cacugcacuccagccugggca

SEQ ID NO: 776525 - RNA, 21 nt, Human
cacugcacuccagccugggca

SEQ ID NO: 776526 - RNA, 22 nt, Human
cacugcacuccagccugggcaa

SEQ ID NO: 776527 - RNA, 23 nt, Human
cacugcacuccagccugggcaac

SEQ ID NO: 776528 - RNA, 24 nt, Human
cacugcacuccagccugggcaaca

SEQ ID NO: 776529 - RNA, 25 nt, Human
cacugcacuccagccugggcaacaa

SEQ ID NO: 776530 - RNA, 23 nt, Human
cacugcacuccagccugggcaag

SEQ ID NO: 776531 - RNA, 25 nt, Human
cacugcacuccagccugggcaagga

SEQ ID NO: 776532 - RNA, 23 nt, Human
cacugcacuccagccuggggcaa

SEQ ID NO: 776533 - RNA, 24 nt, Human
cacugcacuccagccuggggcaac

SEQ ID NO: 776534 - RNA, 24 nt, Human
cacugcaguccagcuuggugacag

SEQ ID NO: 776535 - RNA, 23 nt, Human
cacuuguaaucccagcuacuugg

SEQ ID NO: 776536 - RNA, 24 nt, Human
cagaucaccugaggucaggaguuu

SEQ ID NO: 776537 - RNA, 27 nt, Human
cagaucaccugaggucaggaguuugag

SEQ ID NO: 776538 - RNA, 24 nt, Human
cagcacuuugagaggccgaggcag

SEQ ID NO: 776539 - RNA, 25 nt, Human
cagcacuuugagaggccgaggcagg

SEQ ID NO: 776540 - RNA, 24 nt, Human
cagcacuuugggaggccaaggcag

SEQ ID NO: 776541 - RNA, 25 nt, Human
cagcacuuugggaggccaaggcagg

SEQ ID NO: 776542 - RNA, 23 nt, Human
cagcacuuugggaggccgaggag

SEQ ID NO: 776543 - RNA, 28 nt, Human
cagcacuuugggaggccgaggagggcgg

SEQ ID NO: 776544 - RNA, 24 nt, Human
cagcacuuugggaggccgaggcag

SEQ ID NO: 776545 - RNA, 25 nt, Human
cagcacuuugggaggccgaggcagg

SEQ ID NO: 776546 - RNA, 25 nt, Human
cagcacuuuggggagaccgaggugg

SEQ ID NO: 776547 - RNA, 24 nt, Human
cagccugaccaacauggagaaacc

SEQ ID NO: 776548 - RNA, 19 nt, Human
cagcguaaguacucucaua

SEQ ID NO: 776549 - RNA, 24 nt, Human
cagcuacucaggaggcugaggcag

SEQ ID NO: 776550 - RNA, 24 nt, Human
cagcuacucgggaggcugaggcag

SEQ ID NO: 776551 - RNA, 24 nt, Human
cagcuacuuggaaggcugaggcag

SEQ ID NO: 776552 - RNA, 18 nt, Human
caggauugcuuugaccug

SEQ ID NO: 776553 - RNA, 22 nt, Human
caggcagaucacaaggucagga

SEQ ID NO: 776554 - RNA, 24 nt, Human
caggcagaucaccugaggucagga

SEQ ID NO: 776555 - RNA, 20 nt, Human
cagguccuccacugcaucuc

SEQ ID NO: 776556 - RNA, 24 nt, Human
cagguggauuaccugaggucagga

SEQ ID NO: 776557 - RNA, 22 nt, Human
caguccagcuuggugacagagc

SEQ ID NO: 776558 - RNA, 21 nt, Human
cauacagguggacagacacaa

SEQ ID NO: 776559 - RNA, 28 nt, Human
caucucaacaaaaacaaaaacaaaaaac

SEQ ID NO: 776560 - RNA, 20 nt, Human
caucuccacaguagccguca

SEQ ID NO: 776561 - RNA, 24 nt, Human
caugccuguaaucccagcuucuug

SEQ ID NO: 776562 - RNA, 24 nt, Human
ccaacaaaggacagacccgacccc

SEQ ID NO: 776563 - RNA, 22 nt, Human
ccacagucugacccgaggacac

SEQ ID NO: 776564 - RNA, 19 nt, Human
ccacugcacuccagccugg

SEQ ID NO: 776565 - RNA, 19 nt, Human
ccacugcacuccagccugg

SEQ ID NO: 776566 - RNA, 20 nt, Human
ccacugcacuccagccuggc

SEQ ID NO: 776567 - RNA, 23 nt, Human
ccacugcacuccagccuggcaac

SEQ ID NO: 776568 - RNA, 20 nt, Human
ccacugcacuccagccuggg

SEQ ID NO: 776569 - RNA, 20 nt, Human
ccacugcacuccagccuggg

SEQ ID NO: 776570 - RNA, 20 nt, Human
ccacugcacuccagccuggg

SEQ ID NO: 776571 - RNA, 20 nt, Human
ccacugcacuccagccuggg

SEQ ID NO: 776572 - RNA, 21 nt, Human
ccacugcacuccagccugggc

SEQ ID NO: 776573 - RNA, 21 nt, Human
ccacugcacuccagccugggc

SEQ ID NO: 776574 - RNA, 22 nt, Human
ccacugcacuccagccugggca

SEQ ID NO: 776575 - RNA, 23 nt, Human
ccacugcacuccagccugggcaa

SEQ ID NO: 776576 - RNA, 24 nt, Human
ccacugcacuccagccugggcaac

SEQ ID NO: 776577 - RNA, 24 nt, Human
ccacugcacuccagccugggcaag

SEQ ID NO: 776578 - RNA, 21 nt, Human
ccacugcacuccagccugggg

SEQ ID NO: 776579 - RNA, 25 nt, Human
ccacugcacuccagccuggggcaac

SEQ ID NO: 776580 - RNA, 26 nt, Human
ccacugcacuccagccuggggcaaca

SEQ ID NO: 776581 - RNA, 19 nt, Human
ccacugcaguccagcuugg

SEQ ID NO: 776582 - RNA, 19 nt, Human
ccacugcaguccagcuugg

SEQ ID NO: 776583 - RNA, 20 nt, Human
ccacugcaguccagcuuggu

SEQ ID NO: 776584 - RNA, 23 nt, Human
ccacugcaguccagcuuggugac

SEQ ID NO: 776585 - RNA, 21 nt, Human
ccacugcaucuccacaguagc

SEQ ID NO: 776586 - RNA, 23 nt, Human
ccacuuucacuccagccuaggca

SEQ ID NO: 776587 - RNA, 21 nt, Human
ccagaaacacugcaggaagac

SEQ ID NO: 776588 - RNA, 23 nt, Human
ccagccaggcagaguggcucacg

SEQ ID NO: 776589 - RNA, 23 nt, Human
cccaaguccuucuuccccauucc

SEQ ID NO: 776590 - RNA, 25 nt, Human
cccuagaggguguuuccuaacuucu

SEQ ID NO: 776591 - RNA, 21 nt, Human
cccucaaugcugccaccuccc

SEQ ID NO: 776592 - RNA, 21 nt, Human
cccuguccccgcauccagaaa

SEQ ID NO: 776593 - RNA, 21 nt, Human
ccuauagucccagcuacucag

SEQ ID NO: 776594 - RNA, 24 nt, Human
ccugaccaacauggagaaacccca

SEQ ID NO: 776595 - RNA, 21 nt, Human
ccugagaaguggagguugcag

SEQ ID NO: 776596 - RNA, 22 nt, Human
ccuggccaacauggugaaaccc

SEQ ID NO: 776597 - RNA, 23 nt, Human
ccuggccaacauggugaaacccc

SEQ ID NO: 776598 - RNA, 23 nt, Human
ccuggccaacauggugaaacccc

SEQ ID NO: 776599 - RNA, 24 nt, Human
ccuggccaacauggugaaaccccg

SEQ ID NO: 776600 - RNA, 24 nt, Human
ccuggccaacauggugaaaccccg

SEQ ID NO: 776601 - RNA, 23 nt, Human
ccuggcuaacacggugaaacccc

SEQ ID NO: 776602 - RNA, 24 nt, Human
ccuggcuaacacggugaaaccccg

SEQ ID NO: 776603 - RNA, 20 nt, Human
ccuggucaacauggugaaac

SEQ ID NO: 776604 - RNA, 24 nt, Human
ccuggucaacauggugaaacacug

SEQ ID NO: 776605 - RNA, 22 nt, Human
ccuggucaacauggugaaaccc

SEQ ID NO: 776606 - RNA, 23 nt, Human
ccuggucaacauggugaaacccc

SEQ ID NO: 776607 - RNA, 24 nt, Human
ccuggucaacauggugaaacccca

SEQ ID NO: 776608 - RNA, 22 nt, Human
ccuguaaucccagcacuuuggg

SEQ ID NO: 776609 - RNA, 21 nt, Human
ccuguaaucccagcuacucag

SEQ ID NO: 776610 - RNA, 21 nt, Human
ccuguaaucccagcuucuugg

SEQ ID NO: 776611 - RNA, 22 nt, Human
ccuguaaucccagcuucuuggg

SEQ ID NO: 776612 - RNA, 22 nt, Human
ccuguaaugccagcuacuaggg

SEQ ID NO: 776613 - RNA, 21 nt, Human
ccuguagucccagcuacucgg

SEQ ID NO: 776614 - RNA, 19 nt, Human
ccuguccccgcauccagaa

SEQ ID NO: 776615 - RNA, 20 nt, Human
cgacccgagauccggaacaa

SEQ ID NO: 776616 - RNA, 24 nt, Human
cgagaccauccuggccaacauggu

SEQ ID NO: 776617 - RNA, 26 nt, Human
cgaggcaggcagaucacaaggucagg

SEQ ID NO: 776618 - RNA, 20 nt, Human
cgaggcaggcagaucaccug

SEQ ID NO: 776619 - RNA, 26 nt, Human
cgaggcaggcagaucaccugagguca

SEQ ID NO: 776620 - RNA, 21 nt, Human
cgcaccacugcacuccagccu

SEQ ID NO: 776621 - RNA, 19 nt, Human
cgcaggagaguggaugcug

SEQ ID NO: 776622 - RNA, 24 nt, Human
cgccacugcacuccagccugggca

SEQ ID NO: 776623 - RNA, 23 nt, Human
cgccuauaaucccagcacuuugg

SEQ ID NO: 776624 - RNA, 24 nt, Human
cgccuauaaucccagcacuuuggg

SEQ ID NO: 776625 - RNA, 24 nt, Human
cgccuauagucccagcuacucagg

SEQ ID NO: 776626 - RNA, 23 nt, Human
cgccuguaaucccagcacuuugg

SEQ ID NO: 776627 - RNA, 24 nt, Human
cgccuguaaucccagcacuuuggg

SEQ ID NO: 776628 - RNA, 24 nt, Human
cgccuguaaucccagcuacucagg

SEQ ID NO: 776629 - RNA, 23 nt, Human
cgccuguagucccagcuacucgg

SEQ ID NO: 776630 - RNA, 24 nt, Human
cgccuguagucccagcuacucggg

SEQ ID NO: 776631 - RNA, 24 nt, Human
cgggaggcggagguugcggugagc

SEQ ID NO: 776632 - RNA, 18 nt, Human
cgggccugguggcucaag

SEQ ID NO: 776633 - RNA, 26 nt, Human
cucaaaaaaaaaaaaaaaaaaaaaaa

SEQ ID NO: 776634 - RNA, 19 nt, Human
cucaaaaaaacaacaaaca

SEQ ID NO: 776635 - RNA, 24 nt, Human
cucaagccucuaaucccagcacuu

SEQ ID NO: 776636 - RNA, 22 nt, Human
cucacaccuguaaucccagcac

SEQ ID NO: 776637 - RNA, 24 nt, Human
cucacaccuguaaucccagcacuu

SEQ ID NO: 776638 - RNA, 22 nt, Human
cucacgccuauaaucccagcac

SEQ ID NO: 776639 - RNA, 24 nt, Human
cucacgccuauaaucccagcacuu

SEQ ID NO: 776640 - RNA, 22 nt, Human
cucacgccuguaaucccagcac

SEQ ID NO: 776641 - RNA, 22 nt, Human
cucacgccuguaaucccagcac

SEQ ID NO: 776642 - RNA, 24 nt, Human
cucacgccuguaaucccagcacuu

SEQ ID NO: 776643 - RNA, 24 nt, Human
cucacgccuguaaucccagcacuu

SEQ ID NO: 776644 - RNA, 19 nt, Human
cuccagcucaaaaaaaaaa

SEQ ID NO: 776645 - RNA, 24 nt, Human
cuccagcucaaaaaaaaaaaaaaa

SEQ ID NO: 776646 - RNA, 18 nt, Human
cucccaaauagaaggacc

SEQ ID NO: 776647 - RNA, 19 nt, Human
cucccaaauagaaggaccc

SEQ ID NO: 776648 - RNA, 21 nt, Human
cucccauacacaacagagcug

SEQ ID NO: 776649 - RNA, 19 nt, Human
cuccgucucaaaaaaaaaa

SEQ ID NO: 776650 - RNA, 19 nt, Human
cuccucgggaauaaccacc

SEQ ID NO: 776651 - RNA, 19 nt, Human
cugggggccggguguggug

SEQ ID NO: 776652 - RNA, 23 nt, Human
cuggucaacauggugaaacccca

SEQ ID NO: 776653 - RNA, 19 nt, Human
cuugcagugagcugagauc

SEQ ID NO: 776654 - RNA, 21 nt, Human
cuugcagugagcugagaucgc

SEQ ID NO: 776655 - RNA, 21 nt, Human
cuuguaaucccagcuacuugg

SEQ ID NO: 776656 - RNA, 24 nt, Human
gaaaaacuguaagaugcgaaccuu

SEQ ID NO: 776657 - RNA, 24 nt, Human
gaacaauuugggaggccaaggugg

SEQ ID NO: 776658 - RNA, 22 nt, Human
gaacuggaggccgggcgcggug

SEQ ID NO: 776659 - RNA, 22 nt, Human
gaacugggggccggguguggug

SEQ ID NO: 776660 - RNA, 20 nt, Human
gaaguacagcauucccacag

SEQ ID NO: 776661 - RNA, 18 nt, Human
gaaguggagguugcagug

SEQ ID NO: 776662 - RNA, 19 nt, Human
gacacaaauucacaaaccc

SEQ ID NO: 776663 - RNA, 26 nt, Human
gaccugguuucccucaaugcugccac

SEQ ID NO: 776664 - RNA, 23 nt, Human
gagaauugcuugaaccugggagg

SEQ ID NO: 776665 - RNA, 23 nt, Human
gagaucaugccacugcaguccag

SEQ ID NO: 776666 - RNA, 23 nt, Human
gagaucgcgccacugcacuccag

SEQ ID NO: 776667 - RNA, 23 nt, Human
gagcuugcagugagcugagaucg

SEQ ID NO: 776668 - RNA, 23 nt, Human
gaggagggcggaucacgagguca

SEQ ID NO: 776669 - RNA, 22 nt, Human
gagguggguggaucacaagguc

SEQ ID NO: 776670 - RNA, 24 nt, Human
gagguggguggaucacaaggucag

SEQ ID NO: 776671 - RNA, 18 nt, Human
gagguugcagugagccaa

SEQ ID NO: 776672 - RNA, 23 nt, Human
gagguugcagugagccaagauug

SEQ ID NO: 776673 - RNA, 24 nt, Human
gagguugcgccacuuucacuccag

SEQ ID NO: 776674 - RNA, 19 nt, Human
gaguugaguucaccuugcc

SEQ ID NO: 776675 - RNA, 24 nt, Human
gaucaccugaggucaggaguuuga

SEQ ID NO: 776676 - RNA, 23 nt, Human
gaucauuugaggucaagaguuua

SEQ ID NO: 776677 - RNA, 24 nt, Human
gaucauuugaggucaagaguuuaa

SEQ ID NO: 776678 - RNA, 18 nt, Human
gaugggaaauggagcugg

SEQ ID NO: 776679 - RNA, 23 nt, Human
gauuaccugaggucaggaguuca

SEQ ID NO: 776680 - RNA, 24 nt, Human
gauuaccugaggucaggaguucaa

SEQ ID NO: 776681 - RNA, 18 nt, Human
gauugcuuugaccuggga

SEQ ID NO: 776682 - RNA, 20 nt, Human
gcaccacugcacuccagccu

SEQ ID NO: 776683 - RNA, 25 nt, Human
gcacuccagccuggggcaacagagu

SEQ ID NO: 776684 - RNA, 22 nt, Human
gcagaagaauugcuugaaccca

SEQ ID NO: 776685 - RNA, 18 nt, Human
gcagagugugucugugac

SEQ ID NO: 776686 - RNA, 22 nt, Human
gcaggagaauggcgugaaccca

SEQ ID NO: 776687 - RNA, 24 nt, Human
gccaacauggugaaaccccgucuc

SEQ ID NO: 776688 - RNA, 24 nt, Human
gccaacauggugaaaccccgucuc

SEQ ID NO: 776689 - RNA, 22 nt, Human
gccacugcacuccagccugggc

SEQ ID NO: 776690 - RNA, 24 nt, Human
gccacugcacuccagccugggcaa

SEQ ID NO: 776691 - RNA, 19 nt, Human
gccaggaucacaccacugc

SEQ ID NO: 776692 - RNA, 23 nt, Human
gcccuggaauaaugcaaugcuga

SEQ ID NO: 776693 - RNA, 20 nt, Human
gccgagaucaugccacugca

SEQ ID NO: 776694 - RNA, 24 nt, Human
gcggcaggagaauugcuugaaucc

SEQ ID NO: 776695 - RNA, 20 nt, Human
gcggcggggaaaaaaagguu

SEQ ID NO: 776696 - RNA, 24 nt, Human
gcuaacacggugaaaccccgucuc

SEQ ID NO: 776697 - RNA, 20 nt, Human
gcugagaucgcgccacugca

SEQ ID NO: 776698 - RNA, 22 nt, Human
gcugaggcaggagaauggcgug

SEQ ID NO: 776699 - RNA, 20 nt, Human
gcuggggcccaaguccuucu

SEQ ID NO: 776700 - RNA, 20 nt, Human
gcuguggcucacaccuguaa

SEQ ID NO: 776701 - RNA, 22 nt, Human
ggaacaauuucugcuucaacac

SEQ ID NO: 776702 - RNA, 26 nt, Human
ggacagacacaaauucacaaacccac

SEQ ID NO: 776703 - RNA, 18 nt, Human
ggagcuugcagugagcug

SEQ ID NO: 776704 - RNA, 24 nt, Human
ggagcuugcagugagcugagaucg

SEQ ID NO: 776705 - RNA, 24 nt, Human
ggaggccgggcgcgguggcucacg

SEQ ID NO: 776706 - RNA, 20 nt, Human
ggagguugcagugagccaag

SEQ ID NO: 776707 - RNA, 22 nt, Human
ggagguugcagugagccaagau

SEQ ID NO: 776708 - RNA, 24 nt, Human
ggagguugcagugagccaagauug

SEQ ID NO: 776709 - RNA, 24 nt, Human
ggagguugcggugagccgcgaucg

SEQ ID NO: 776710 - RNA, 22 nt, Human
ggauuaccugaggucaggaguu

SEQ ID NO: 776711 - RNA, 21 nt, Human
ggcacgcgccuauagucccag

SEQ ID NO: 776712 - RNA, 24 nt, Human
ggcacuuguaaucccagcuacuug

SEQ ID NO: 776713 - RNA, 22 nt, Human
ggcaggagaauugcuugaaucc

SEQ ID NO: 776714 - RNA, 23 nt, Human
ggcaggagaauugcuugaauccg

SEQ ID NO: 776715 - RNA, 18 nt, Human
ggccagaggccuaaagag

SEQ ID NO: 776716 - RNA, 18 nt, Human
ggccgaggagggcggauc

SEQ ID NO: 776717 - RNA, 21 nt, Human
ggccgggugugguggcucacg

SEQ ID NO: 776718 - RNA, 21 nt, Human
ggccucaucugccagcaaacc

SEQ ID NO: 776719 - RNA, 20 nt, Human
ggccugaggcaggauugcuu

SEQ ID NO: 776720 - RNA, 22 nt, Human
ggcggggaaaaaaagguugggu

SEQ ID NO: 776721 - RNA, 18 nt, Human
ggcgugguggcgggcgcc

SEQ ID NO: 776722 - RNA, 21 nt, Human
ggcucacgccuguaaucccag

SEQ ID NO: 776723 - RNA, 23 nt, Human
gggagaccgagguggguggauca

SEQ ID NO: 776724 - RNA, 28 nt, Human
gggcaacagagugagacaccaucuuggg

SEQ ID NO: 776725 - RNA, 24 nt, Human
gggcgcgguggcucacgccuauaa

SEQ ID NO: 776726 - RNA, 24 nt, Human
gggcggaucacgaggucaggagau

SEQ ID NO: 776727 - RNA, 24 nt, Human
gggcgugguggcaugugccuguaa

SEQ ID NO: 776728 - RNA, 24 nt, Human
gggcgugguggcgggcgccuguag

SEQ ID NO: 776729 - RNA, 21 nt, Human
ggggccgggugugguggcuca

SEQ ID NO: 776730 - RNA, 23 nt, Human
ggggugcucccagggaaaucagg

SEQ ID NO: 776731 - RNA, 24 nt, Human
gggugugguggcucacgccuguaa

SEQ ID NO: 776732 - RNA, 23 nt, Human
gguaugguggcacgcgccuguaa

SEQ ID NO: 776733 - RNA, 19 nt, Human
ggucaggaguuugagacca

SEQ ID NO: 776734 - RNA, 21 nt, Human
gguggaucacaaggucaggag

SEQ ID NO: 776735 - RNA, 24 nt, Human
gguggcacgcgccuguaaucccag

SEQ ID NO: 776736 - RNA, 24 nt, Human
gguggcaugugccuguaaugccag

SEQ ID NO: 776737 - RNA, 24 nt, Human
gguggcgcaugccuguaaucccag

SEQ ID NO: 776738 - RNA, 24 nt, Human
gguggcgggcgccuguagucccag

SEQ ID NO: 776739 - RNA, 24 nt, Human
gguggcucaagccucuaaucccag

SEQ ID NO: 776740 - RNA, 24 nt, Human
gguggcucacgccuauaaucccag

SEQ ID NO: 776741 - RNA, 24 nt, Human
guccagcuuggugacagagcgaga

SEQ ID NO: 776742 - RNA, 25 nt, Human
gugcagggcugguaaccuggagccg

SEQ ID NO: 776743 - RNA, 20 nt, Human
gugcucccagggaaaucagg

SEQ ID NO: 776744 - RNA, 22 nt, Human
guggcucacaccuguaauccca

SEQ ID NO: 776745 - RNA, 23 nt, Human
guggcucacgccuguaaucccag

SEQ ID NO: 776746 - RNA, 23 nt, Human
guggugggcacuuguaaucccag

SEQ ID NO: 776747 - RNA, 19 nt, Human
guuuccuaacuucugacug

SEQ ID NO: 776748 - RNA, 19 nt, Human
uaaaaauaaaaaaacuagc

SEQ ID NO: 776749 - RNA, 20 nt, Human
uaaaaauaaaaaaacuagcu

SEQ ID NO: 776750 - RNA, 22 nt, Human
uaaaacacacugacuugcuaag

SEQ ID NO: 776751 - RNA, 22 nt, Human
uaaaacgaacaauuugggaggc

SEQ ID NO: 776752 - RNA, 19 nt, Human
uaaaaugaacuggaggccg

SEQ ID NO: 776753 - RNA, 23 nt, Human
uaaaaugaacuggaggccgggcg

SEQ ID NO: 776754 - RNA, 20 nt, Human
uaaaauuacaaaauuagcca

SEQ ID NO: 776755 - RNA, 18 nt, Human
uaacacggugaaaccccg

SEQ ID NO: 776756 - RNA, 22 nt, Human
uaacacggugaaaccccgucuc

SEQ ID NO: 776757 - RNA, 19 nt, Human
uaaccaccacagugccuua

SEQ ID NO: 776758 - RNA, 18 nt, Human
uaagaauucugagugucc

SEQ ID NO: 776759 - RNA, 21 nt, Human
uaagacuccagcucaaaaaaa

SEQ ID NO: 776760 - RNA, 20 nt, Human
uacagcauucccacagucug

SEQ ID NO: 776761 - RNA, 25 nt, Human
uacaucucaacaaaaacaaaaacaa

SEQ ID NO: 776762 - RNA, 23 nt, Human
uaccugaggucaggaguucaaga

SEQ ID NO: 776763 - RNA, 23 nt, Human
uacuaaaauuacaaaauuagcca

SEQ ID NO: 776764 - RNA, 24 nt, Human
uagaaggaccccagguguucugau

SEQ ID NO: 776765 - RNA, 19 nt, Human
uagaaugugccagaaaaca

SEQ ID NO: 776766 - RNA, 20 nt, Human
uagcugguugugguggcacg

SEQ ID NO: 776767 - RNA, 22 nt, Human
uaguugggcgugguggcaugug

SEQ ID NO: 776768 - RNA, 20 nt, Human
uauauaaauauauauacaca

SEQ ID NO: 776769 - RNA, 22 nt, Human
uauauacacacagcccucuaga

SEQ ID NO: 776770 - RNA, 21 nt, Human
uaugcaauucagaaaacggag

SEQ ID NO: 776771 - RNA, 20 nt, Human
uauuaggacucacacagaca

SEQ ID NO: 776772 - RNA, 22 nt, Human
ucaaaaaaaaaaaaaaagaacu

SEQ ID NO: 776773 - RNA, 18 nt, Human
ucaacacaauuguccacg

SEQ ID NO: 776774 - RNA, 21 nt, Human
ucaaggggugugugucccaug

SEQ ID NO: 776775 - RNA, 24 nt, Human
ucacaaggucaggagauugagacc

SEQ ID NO: 776776 - RNA, 24 nt, Human
ucacaaggucaggagggcgagacc

SEQ ID NO: 776777 - RNA, 21 nt, Human
ucacacagacacauacacaaa

SEQ ID NO: 776778 - RNA, 23 nt, Human
ucacaccacugcacuccagccug

SEQ ID NO: 776779 - RNA, 20 nt, Human
ucaccgugguuuuggaugcu

SEQ ID NO: 776780 - RNA, 18 nt, Human
ucacgaggucaggagauc

SEQ ID NO: 776781 - RNA, 23 nt, Human
ucacgaggucaggagaucaagac

SEQ ID NO: 776782 - RNA, 24 nt, Human
ucacgaggucaggagaucaagacu

SEQ ID NO: 776783 - RNA, 23 nt, Human
ucacgucuucaaagggaauuagg

SEQ ID NO: 776784 - RNA, 20 nt, Human
ucaugccacugcaguccagc

SEQ ID NO: 776785 - RNA, 23 nt, Human
ucauuugaggucaagaguuuaag

SEQ ID NO: 776786 - RNA, 18 nt, Human
uccaaaaggaacuaauac

SEQ ID NO: 776787 - RNA, 23 nt, Human
uccacggagggcaccaguuccgu

SEQ ID NO: 776788 - RNA, 22 nt, Human
uccacugaggccucaucugcca

SEQ ID NO: 776789 - RNA, 24 nt, Human
uccagccuggggcaacagagugag

SEQ ID NO: 776790 - RNA, 25 nt, Human
uccagccuggggcaacagagugaga

SEQ ID NO: 776791 - RNA, 22 nt, Human
uccagcuuggugacagagcgag

SEQ ID NO: 776792 - RNA, 23 nt, Human
uccagcuuggugacagagcgaga

SEQ ID NO: 776793 - RNA, 19 nt, Human
ucccacagucugacccgag

SEQ ID NO: 776794 - RNA, 26 nt, Human
uccccauuccuuuaauucuuccuacg

SEQ ID NO: 776795 - RNA, 19 nt, Human
uccgggaggcggagguugc

SEQ ID NO: 776796 - RNA, 23 nt, Human
uccgucucaaaaaaaaaaaaaaa

SEQ ID NO: 776797 - RNA, 23 nt, Human
ucgcaccacugcacuccagccug

SEQ ID NO: 776798 - RNA, 23 nt, Human
ucgcgccacugcacuccagccug

SEQ ID NO: 776799 - RNA, 18 nt, Human
ucucaaaaaaaaaaaaaa

SEQ ID NO: 776800 - RNA, 19 nt, Human
ucucccaaauagaaggacc

SEQ ID NO: 776801 - RNA, 23 nt, Human
ucucuacuaaaaauaaaaaaacu

SEQ ID NO: 776802 - RNA, 22 nt, Human
ucucuacuaaaaauacaaaaaa

SEQ ID NO: 776803 - RNA, 21 nt, Human
ucucuacuaaaaauauaaaaa

SEQ ID NO: 776804 - RNA, 21 nt, Human
ucucuacuaaaaauauaaaaa

SEQ ID NO: 776805 - RNA, 22 nt, Human
ucucuacuaaaauuacaaaauu

SEQ ID NO: 776806 - RNA, 19 nt, Human
ucuuggggugcggcgggga

SEQ ID NO: 776807 - RNA, 24 nt, Human
ugaaacaggagaauugcuugaacc

SEQ ID NO: 776808 - RNA, 24 nt, Human
ugaaacaggagaauugcuugaacc

SEQ ID NO: 776809 - RNA, 19 nt, Human
ugaaaccccaucucuacua

SEQ ID NO: 776810 - RNA, 22 nt, Human
ugaaaccccgucuccacuaaaa

SEQ ID NO: 776811 - RNA, 18 nt, Human
ugaauguucucacuccca

SEQ ID NO: 776812 - RNA, 23 nt, Human
ugaccugggaggcagagguugcg

SEQ ID NO: 776813 - RNA, 23 nt, Human
ugacuguggugguuggugcaggg

SEQ ID NO: 776814 - RNA, 24 nt, Human
ugacuugcuaagaaaaggggggac

SEQ ID NO: 776815 - RNA, 24 nt, Human
ugagaaguggagguugcagugagc

SEQ ID NO: 776816 - RNA, 24 nt, Human
ugagaccagccugaccaacaugga

SEQ ID NO: 776817 - RNA, 24 nt, Human
ugagaccauccuggucaacauggu

SEQ ID NO: 776818 - RNA, 18 nt, Human
ugagaggccgaggcaggc

SEQ ID NO: 776819 - RNA, 20 nt, Human
ugagaggccgaggcaggcag

SEQ ID NO: 776820 - RNA, 24 nt, Human
ugagaggccgaggcaggcagauca

SEQ ID NO: 776821 - RNA, 19 nt, Human
ugagaugggaaauggagcu

SEQ ID NO: 776822 - RNA, 19 nt, Human
ugagaugggaaauggagcu

SEQ ID NO: 776823 - RNA, 22 nt, Human
ugagaugggaaauggagcugga

SEQ ID NO: 776824 - RNA, 21 nt, Human
ugagauuauucugacuguggu

SEQ ID NO: 776825 - RNA, 22 nt, Human
ugagccaagauugugccacugc

SEQ ID NO: 776826 - RNA, 22 nt, Human
ugagccgagaucaugccacugc

SEQ ID NO: 776827 - RNA, 22 nt, Human
ugagcugagaucgcgccacugc

SEQ ID NO: 776828 - RNA, 24 nt, Human
ugaggcagaagaauugcuugaacc

SEQ ID NO: 776829 - RNA, 25 nt, Human
ugaggcagaagaauugcuugaaccc

SEQ ID NO: 776830 - RNA, 24 nt, Human
ugaggcaggagaauggcgugaacc

SEQ ID NO: 776831 - RNA, 25 nt, Human
ugaggcaggagaauggcgugaaccc

SEQ ID NO: 776832 - RNA, 24 nt, Human
ugaggcaggagaauugcuugaacc

SEQ ID NO: 776833 - RNA, 25 nt, Human
ugaggcaggagaauugcuugaaccu

SEQ ID NO: 776834 - RNA, 18 nt, Human
ugaggucaggaguuugag

SEQ ID NO: 776835 - RNA, 23 nt, Human
ugauacaggcucugcuucuucag

SEQ ID NO: 776836 - RNA, 24 nt, Human
ugcagaugucauugaagauguucc

SEQ ID NO: 776837 - RNA, 19 nt, Human
ugccagcaaaccuugcucc

SEQ ID NO: 776838 - RNA, 20 nt, Human
ugccuguaaucccagcuucu

SEQ ID NO: 776839 - RNA, 23 nt, Human
ugccuguaaucccagcuucuugg

SEQ ID NO: 776840 - RNA, 24 nt, Human
ugccuguaaucccagcuucuuggg

SEQ ID NO: 776841 - RNA, 23 nt, Human
ugccuguaaugccagcuacuagg

SEQ ID NO: 776842 - RNA, 22 nt, Human
ugcggugagccgcgaucgcacc

SEQ ID NO: 776843 - RNA, 21 nt, Human
ugcuucaacacaauuguccac

SEQ ID NO: 776844 - RNA, 18 nt, Human
ugcuugaauccgggaggc

SEQ ID NO: 776845 - RNA, 20 nt, Human
uggaaggcugaggcagaaga

SEQ ID NO: 776846 - RNA, 27 nt, Human
uggaaggcugaggcagaagaauugcuu

SEQ ID NO: 776847 - RNA, 23 nt, Human
uggaucauuugaggucaagaguu

SEQ ID NO: 776848 - RNA, 24 nt, Human
uggaucauuugaggucaagaguuu

SEQ ID NO: 776849 - RNA, 24 nt, Human
uggauuaccugaggucaggaguuc

SEQ ID NO: 776850 - RNA, 21 nt, Human
uggcacgcgccuguaauccca

SEQ ID NO: 776851 - RNA, 22 nt, Human
uggcacgcgccuguaaucccag

SEQ ID NO: 776852 - RNA, 24 nt, Human
uggcaugugccuguaaugccagcu

SEQ ID NO: 776853 - RNA, 24 nt, Human
uggccaacauggugaaaccccguc

SEQ ID NO: 776854 - RNA, 24 nt, Human
uggccaacauggugaaaccccguc

SEQ ID NO: 776855 - RNA, 21 nt, Human
uggcgcaugccuguaauccca

SEQ ID NO: 776856 - RNA, 24 nt, Human
uggcucaagccucuaaucccagca

SEQ ID NO: 776857 - RNA, 21 nt, Human
uggcucacaccuguaauccca

SEQ ID NO: 776858 - RNA, 24 nt, Human
uggcucacaccuguaaucccagca

SEQ ID NO: 776859 - RNA, 21 nt, Human
uggcucacgccuauaauccca

SEQ ID NO: 776860 - RNA, 24 nt, Human
uggcucacgccuauaaucccagca

SEQ ID NO: 776861 - RNA, 22 nt, Human
uggcucacgccuguaaucccag

SEQ ID NO: 776862 - RNA, 24 nt, Human
uggcucacgccuguaaucccagca

SEQ ID NO: 776863 - RNA, 24 nt, Human
uggcucacgccuguaaucccagca

SEQ ID NO: 776864 - RNA, 20 nt, Human
uggcuccuugagcccauucu

SEQ ID NO: 776865 - RNA, 18 nt, Human
ugggacccacccagggag

SEQ ID NO: 776866 - RNA, 23 nt, Human
ugggaggcagagauugcaguggc

SEQ ID NO: 776867 - RNA, 23 nt, Human
ugggaggccaagguggguggauc

SEQ ID NO: 776868 - RNA, 24 nt, Human
ugggaggccaagguggguggauca

SEQ ID NO: 776869 - RNA, 19 nt, Human
ugggaggccgaggagggcg

SEQ ID NO: 776870 - RNA, 24 nt, Human
ugggaggccgaggagggcggauca

SEQ ID NO: 776871 - RNA, 20 nt, Human
ugggaggccgaggcaggcag

SEQ ID NO: 776872 - RNA, 24 nt, Human
ugggaggccgaggcaggcagauca

SEQ ID NO: 776873 - RNA, 22 nt, Human
ugggcaaggacuccgucucaaa

SEQ ID NO: 776874 - RNA, 19 nt, Human
ugggggccggguguggugg

SEQ ID NO: 776875 - RNA, 23 nt, Human
ugggggccgggugugguggcuca

SEQ ID NO: 776876 - RNA, 24 nt, Human
uggguggaucauuugaggucaaga

SEQ ID NO: 776877 - RNA, 24 nt, Human
ugguggcacgcgccuguaauccca

SEQ ID NO: 776878 - RNA, 24 nt, Human
ugguggcaugugccuguaaugcca

SEQ ID NO: 776879 - RNA, 24 nt, Human
ugguggcgcaugccuguaauccca

SEQ ID NO: 776880 - RNA, 24 nt, Human
ugguggcgggcgccuguaguccca

SEQ ID NO: 776881 - RNA, 24 nt, Human
ugguggcucaagccucuaauccca

SEQ ID NO: 776882 - RNA, 24 nt, Human
ugguggcucacgccuguaauccca

SEQ ID NO: 776883 - RNA, 22 nt, Human
uggugggcacuuguaaucccag

SEQ ID NO: 776884 - RNA, 24 nt, Human
ugguggugggcacuuguaauccca

SEQ ID NO: 776885 - RNA, 19 nt, Human
uggugguuggugcagggcu

SEQ ID NO: 776886 - RNA, 22 nt, Human
uguaacagcccagauacuaaaa

SEQ ID NO: 776887 - RNA, 23 nt, Human
ugugccagaaaacagggaaagca

SEQ ID NO: 776888 - RNA, 24 nt, Human
uguggcucacaccuguaaucccag

SEQ ID NO: 776889 - RNA, 19 nt, Human
uuaaaagauuacgugaagu

SEQ ID NO: 776890 - RNA, 18 nt, Human
uuagcugggcaugguggu

SEQ ID NO: 776891 - RNA, 18 nt, Human
uuagcugguugugguggc

SEQ ID NO: 776892 - RNA, 22 nt, Human
uuagcugguugugguggcacgc

SEQ ID NO: 776893 - RNA, 22 nt, Human
uuaguugggcgugguggcaugu

SEQ ID NO: 776894 - RNA, 24 nt, Human
uuaguugggcgugguggcaugugc

SEQ ID NO: 776895 - RNA, 23 nt, Human
uuccccaauaccuaucacaaaag

SEQ ID NO: 776896 - RNA, 23 nt, Human
uucggaggcuccagcaagcaguu

SEQ ID NO: 776897 - RNA, 24 nt, Human
uugaaccugagaaguggagguugc

SEQ ID NO: 776898 - RNA, 24 nt, Human
uugaauccgggaggcggagguugc

SEQ ID NO: 776899 - RNA, 22 nt, Human
uugcagugagccaagauugugc

SEQ ID NO: 776900 - RNA, 18 nt, Human
uugcagugagccgagauc

SEQ ID NO: 776901 - RNA, 19 nt, Human
uugcagugagccgagauca

SEQ ID NO: 776902 - RNA, 20 nt, Human
uugcagugagccgagaucau

SEQ ID NO: 776903 - RNA, 18 nt, Human
uugcagugagcugagauc

SEQ ID NO: 776904 - RNA, 19 nt, Human
uugcagugagcugagaucg

SEQ ID NO: 776905 - RNA, 22 nt, Human
uugcagugagcugagaucgcgc

SEQ ID NO: 776906 - RNA, 22 nt, Human
uugcggugagccgcgaucgcac

SEQ ID NO: 776907 - RNA, 24 nt, Human
uugcuugaaccugagaaguggagg

SEQ ID NO: 776908 - RNA, 18 nt, Human
uugcuugaaccugggagg

SEQ ID NO: 776909 - RNA, 24 nt, Human
uugcuugaauccgggaggcggagg

SEQ ID NO: 776910 - RNA, 24 nt, Human
uugcuuugaccugggaggcagagg

SEQ ID NO: 776911 - RNA, 23 nt, Human
uuggaaggcugaggcagaagaau

SEQ ID NO: 776912 - RNA, 24 nt, Human
uuggaaggcugaggcagaagaauu

SEQ ID NO: 776913 - RNA, 25 nt, Human
uugggaggccgaggagggcggauca

SEQ ID NO: 776914 - RNA, 25 nt, Human
uugggaggccgaggcaggcagauca

SEQ ID NO: 776915 - RNA, 23 nt, Human
uugugccacugcacuccagccug

SEQ ID NO: 776916 - RNA, 18 nt, Human
uuugaccugggaggcaga

SEQ ID NO: 776917 - RNA, 21 nt, Human
uuugaccugggaggcagaggu

SEQ ID NO: 776918 - RNA, 23 nt, Human
uuugaggucaagaguuuaagauc

SEQ ID NO: 776919 - RNA, 20 nt, Human
uuuggggagaccgagguggg

SEQ ID NO: 776920 - RNA, 24 nt, Human
uuugucuuagaaguacagcauucc

SEQ ID NO: 776921 - RNA, 21 nt, Human
uuuuggaugcugccaccugac

SEQ ID NO: 776922 - RNA, 24 nt, Human
aaaaaagacaagcauuucagagga

SEQ ID NO: 776923 - RNA, 19 nt, Human
aaaaagacaagcauuucag

SEQ ID NO: 776924 - RNA, 24 nt, Human
aaaaugcccccagccuucauuccu

SEQ ID NO: 776925 - RNA, 25 nt, Human
aaaaugcccccagccuucauuccug

SEQ ID NO: 776926 - RNA, 29 nt, Human
aaagacaagcauuucagaggagcguugcu

SEQ ID NO: 776927 - RNA, 22 nt, Human
aagacaagcauuucagaggagc

SEQ ID NO: 776928 - RNA, 22 nt, Human
aagcagccauaucuuuaaaagc

SEQ ID NO: 776929 - RNA, 23 nt, Human
accacagauagaguucucccucu

SEQ ID NO: 776930 - RNA, 26 nt, Human
agaaaaaagacaagcauuucagagga

SEQ ID NO: 776931 - RNA, 19 nt, Human
agaaauaacaaggaggaca

SEQ ID NO: 776932 - RNA, 18 nt, Human
agacacccaagaucagcc

SEQ ID NO: 776933 - RNA, 19 nt, Human
agacauucaacauuccugg

SEQ ID NO: 776934 - RNA, 21 nt, Human
agacccagggagacucuggug

SEQ ID NO: 776935 - RNA, 19 nt, Human
agacccuggccgcgcucag

SEQ ID NO: 776936 - RNA, 22 nt, Human
agacccuggccgcgcucagccc

SEQ ID NO: 776937 - RNA, 18 nt, Human
agagcugcagagacagga

SEQ ID NO: 776938 - RNA, 20 nt, Human
agcacaacccaggucuccug

SEQ ID NO: 776939 - RNA, 20 nt, Human
aggaaagaguuugugguugg

SEQ ID NO: 776940 - RNA, 23 nt, Human
aggcagcugcuggcaggggcugg

SEQ ID NO: 776941 - RNA, 22 nt, Human
aggcugccucaucuccccccag

SEQ ID NO: 776942 - RNA, 19 nt, Human
caaaaugcccccagccuuc

SEQ ID NO: 776943 - RNA, 21 nt, Human
caaaguggaucuuugcuguca

SEQ ID NO: 776944 - RNA, 23 nt, Human
caacagaaaaaagacaagcauuu

SEQ ID NO: 776945 - RNA, 19 nt, Human
caagaaauguuuacauaca

SEQ ID NO: 776946 - RNA, 18 nt, Human
caccaaggggagggcggg

SEQ ID NO: 776947 - RNA, 19 nt, Human
caccaaggggagggcgggu

SEQ ID NO: 776948 - RNA, 21 nt, Human
caccaaggggagggcggguuu

SEQ ID NO: 776949 - RNA, 20 nt, Human
caccaauggggaguugcagc

SEQ ID NO: 776950 - RNA, 18 nt, Human
caccgccccaggggcucc

SEQ ID NO: 776951 - RNA, 21 nt, Human
cacucuauacaucuaacuccc

SEQ ID NO: 776952 - RNA, 20 nt, Human
cagaccccucaagcuaggca

SEQ ID NO: 776953 - RNA, 22 nt, Human
cagagcccuauggucaccuccc

SEQ ID NO: 776954 - RNA, 21 nt, Human
cagcaagggcuaggguggggc

SEQ ID NO: 776955 - RNA, 20 nt, Human
cagcagcugaaagggacugg

SEQ ID NO: 776956 - RNA, 21 nt, Human
cagcugaaagauguuuggugg

SEQ ID NO: 776957 - RNA, 20 nt, Human
cagcugcuggcaggggcugg

SEQ ID NO: 776958 - RNA, 21 nt, Human
cagcugcuggcaggggcuggg

SEQ ID NO: 776959 - RNA, 23 nt, Human
cagcugcuggcaggggcuggggg

SEQ ID NO: 776960 - RNA, 23 nt, Human
caggcccucccuuagcugugugg

SEQ ID NO: 776961 - RNA, 19 nt, Human
caggggcuccagguagaca

SEQ ID NO: 776962 - RNA, 21 nt, Human
caucuagggucuccuggaggc

SEQ ID NO: 776963 - RNA, 23 nt, Human
caucuagggucuccuggaggccc

SEQ ID NO: 776964 - RNA, 22 nt, Human
caucuccccccagcaaaaugcc

SEQ ID NO: 776965 - RNA, 21 nt, Human
ccaaacccccacugaagaggc

SEQ ID NO: 776966 - RNA, 23 nt, Human
ccaaacccccacugaagaggcac

SEQ ID NO: 776967 - RNA, 21 nt, Human
ccaaauuggcucaccagaaac

SEQ ID NO: 776968 - RNA, 19 nt, Human
ccacacuucuccaucauga

SEQ ID NO: 776969 - RNA, 21 nt, Human
ccagcccuccagacuaccucc

SEQ ID NO: 776970 - RNA, 24 nt, Human
cccaagaggcugcaggaaagugaa

SEQ ID NO: 776971 - RNA, 24 nt, Human
cccagcaucauggauaucagugga

SEQ ID NO: 776972 - RNA, 23 nt, Human
cccagccaucccccacuggucug

SEQ ID NO: 776973 - RNA, 20 nt, Human
cccccagccuucauuccugu

SEQ ID NO: 776974 - RNA, 19 nt, Human
cccucugcugggccucacc

SEQ ID NO: 776975 - RNA, 20 nt, Human
cccuggccgcgcucagcccc

SEQ ID NO: 776976 - RNA, 23 nt, Human
ccgccaggcgccgcgagcucccg

SEQ ID NO: 776977 - RNA, 20 nt, Human
ccucaucuccccccagcaaa

SEQ ID NO: 776978 - RNA, 22 nt, Human
ccucccugacaguuggcuccca

SEQ ID NO: 776979 - RNA, 25 nt, Human
ccucugcugggccucaccuguagag

SEQ ID NO: 776980 - RNA, 23 nt, Human
ccucugugcucauaagcagcaaa

SEQ ID NO: 776981 - RNA, 21 nt, Human
ccucuuugaaggaaagaguuu

SEQ ID NO: 776982 - RNA, 23 nt, Human
ccugauaugguccccaaaccccc

SEQ ID NO: 776983 - RNA, 18 nt, Human
ccugccacucaaagucuc

SEQ ID NO: 776984 - RNA, 18 nt, Human
ccuggccaccugaaagug

SEQ ID NO: 776985 - RNA, 19 nt, Human
cgaggggacuuguccccau

SEQ ID NO: 776986 - RNA, 22 nt, Human
cgaggggacuuguccccauuuc

SEQ ID NO: 776987 - RNA, 20 nt, Human
cgccucgcgggccaggagcu

SEQ ID NO: 776988 - RNA, 21 nt, Human
cgcgcucagccccgcuggcuc

SEQ ID NO: 776989 - RNA, 18 nt, Human
cggcagggagggcugaau

SEQ ID NO: 776990 - RNA, 23 nt, Human
cuaccaagaaaaugccuagauau

SEQ ID NO: 776991 - RNA, 20 nt, Human
cuacucccucugcugggccu

SEQ ID NO: 776992 - RNA, 21 nt, Human
cuacucccucugcugggccuc

SEQ ID NO: 776993 - RNA, 23 nt, Human
cuagggucuccuggaggcccccu

SEQ ID NO: 776994 - RNA, 21 nt, Human
cuauaaggugggccagggaga

SEQ ID NO: 776995 - RNA, 20 nt, Human
cuauacaucuaacucccgaa

SEQ ID NO: 776996 - RNA, 21 nt, Human
cuccagacuaccuccuagcug

SEQ ID NO: 776997 - RNA, 20 nt, Human
cucccgaaaaaggaccagcu

SEQ ID NO: 776998 - RNA, 21 nt, Human
cucuccaucccgugugcgcug

SEQ ID NO: 776999 - RNA, 21 nt, Human
cucugaccacacuucuccauc

SEQ ID NO: 777000 - RNA, 21 nt, Human
cugaaacacggccuucccagg

SEQ ID NO: 777001 - RNA, 18 nt, Human
cugcugaagaccaugggg

SEQ ID NO: 777002 - RNA, 23 nt, Human
cuguagccgagacagugucacgc

SEQ ID NO: 777003 - RNA, 22 nt, Human
cuucccaggcagcugcuggcag

SEQ ID NO: 777004 - RNA, 22 nt, Human
cuuccugagccuccccucugaa

SEQ ID NO: 777005 - RNA, 19 nt, Human
gaaguccuuccugugacuc

SEQ ID NO: 777006 - RNA, 23 nt, Human
gaaguccuuccugugacucuggc

SEQ ID NO: 777007 - RNA, 19 nt, Human
gacacccaagaucagccaa

SEQ ID NO: 777008 - RNA, 20 nt, Human
gaggcaaugugguguggcag

SEQ ID NO: 777009 - RNA, 20 nt, Human
gaggcugccucaucuccccc

SEQ ID NO: 777010 - RNA, 23 nt, Human
gagucaucuaguccaaguccaaa

SEQ ID NO: 777011 - RNA, 19 nt, Human
gcaaaaugcccccagccuu

SEQ ID NO: 777012 - RNA, 22 nt, Human
gcaccgccccaggggcuccagg

SEQ ID NO: 777013 - RNA, 24 nt, Human
gcagggcuugccucuuccccaagg

SEQ ID NO: 777014 - RNA, 24 nt, Human
gccagagagacgugagcaaagggc

SEQ ID NO: 777015 - RNA, 24 nt, Human
gccccaggggcuccagguagacac

SEQ ID NO: 777016 - RNA, 18 nt, Human
gccugggcacucuggggc

SEQ ID NO: 777017 - RNA, 22 nt, Human
ggaaagaaacuuuuauguacag

SEQ ID NO: 777018 - RNA, 22 nt, Human
ggaaaucuggguucagacccug

SEQ ID NO: 777019 - RNA, 24 nt, Human
ggauagccaguucuaccccagcuc

SEQ ID NO: 777020 - RNA, 22 nt, Human
ggcggguuugugugcgcuggga

SEQ ID NO: 777021 - RNA, 26 nt, Human
ggcugcaggaaagugaauguuuccag

SEQ ID NO: 777022 - RNA, 19 nt, Human
ggcugggggacccagccau

SEQ ID NO: 777023 - RNA, 22 nt, Human
gggcacccagcaucauggauau

SEQ ID NO: 777024 - RNA, 23 nt, Human
gggcuaggguggggcuccccagg

SEQ ID NO: 777025 - RNA, 23 nt, Human
ggggaucugugaaugaccagccc

SEQ ID NO: 777026 - RNA, 23 nt, Human
guaaagauuuccuuaaggccaag

SEQ ID NO: 777027 - RNA, 18 nt, Human
gucagggcuccugccaaa

SEQ ID NO: 777028 - RNA, 18 nt, Human
gugagcaaagggcgaccc

SEQ ID NO: 777029 - RNA, 23 nt, Human
gugcucccucugggucuguagcc

SEQ ID NO: 777030 - RNA, 23 nt, Human
guggauauccaugaacuguuggg

SEQ ID NO: 777031 - RNA, 21 nt, Human
gugguucuuucccaucuuggg

SEQ ID NO: 777032 - RNA, 24 nt, Human
uaacaaggaggacaauuuucuaag

SEQ ID NO: 777033 - RNA, 22 nt, Human
uaagcaagaagccuuccugagc

SEQ ID NO: 777034 - RNA, 28 nt, Human
uaagcagcagcugaaagggacuggggug

SEQ ID NO: 777035 - RNA, 21 nt, Human
uaaggcaggagcucacuucug

SEQ ID NO: 777036 - RNA, 18 nt, Human
uacaucuaacucccgaaa

SEQ ID NO: 777037 - RNA, 21 nt, Human
uaccaagaaaaugccuagaua

SEQ ID NO: 777038 - RNA, 21 nt, Human
uaccccagcuccuaauccugu

SEQ ID NO: 777039 - RNA, 19 nt, Human
uacugugaaacauauguac

SEQ ID NO: 777040 - RNA, 22 nt, Human
uaggguggggcuccccaggccc

SEQ ID NO: 777041 - RNA, 23 nt, Human
ucagacacccaagaucagccaaa

SEQ ID NO: 777042 - RNA, 20 nt, Human
ucagcaggcagcggcaggga

SEQ ID NO: 777043 - RNA, 21 nt, Human
uccaaaccugccacucaaagu

SEQ ID NO: 777044 - RNA, 23 nt, Human
uccagaggcugccucaucucccc

SEQ ID NO: 777045 - RNA, 19 nt, Human
uccaugaacuguuggguuc

SEQ ID NO: 777046 - RNA, 20 nt, Human
uccccaggcccucccuuagc

SEQ ID NO: 777047 - RNA, 24 nt, Human
uccccccagcaaaaugcccccagc

SEQ ID NO: 777048 - RNA, 20 nt, Human
ucccugacaguuggcuccca

SEQ ID NO: 777049 - RNA, 18 nt, Human
ucccugagccauuccaga

SEQ ID NO: 777050 - RNA, 21 nt, Human
ucccugagccauuccagaggc

SEQ ID NO: 777051 - RNA, 22 nt, Human
ucccuggaagaaguccuuccug

SEQ ID NO: 777052 - RNA, 24 nt, Human
ucccuggaagaaguccuuccugug

SEQ ID NO: 777053 - RNA, 20 nt, Human
ucggcaacagaaaaaagaca

SEQ ID NO: 777054 - RNA, 22 nt, Human
ucuccugauaugguccccaaac

SEQ ID NO: 777055 - RNA, 19 nt, Human
ucucugauagccuucccuu

SEQ ID NO: 777056 - RNA, 24 nt, Human
ucucugauagccuucccuuggccc

SEQ ID NO: 777057 - RNA, 21 nt, Human
ucuggccuuugaagcagccau

SEQ ID NO: 777058 - RNA, 22 nt, Human
ucuguagccgagacagugucac

SEQ ID NO: 777059 - RNA, 23 nt, Human
ucugugauuucuccaccuggcau

SEQ ID NO: 777060 - RNA, 20 nt, Human
ugaaaugcagcagauuucug

SEQ ID NO: 777061 - RNA, 24 nt, Human
ugaagcagccauaucuuuaaaagc

SEQ ID NO: 777062 - RNA, 25 nt, Human
ugaaggaaagaguuugugguugggg

SEQ ID NO: 777063 - RNA, 18 nt, Human
ugacuucuugaagugcac

SEQ ID NO: 777064 - RNA, 18 nt, Human
ugagagucaucuagucca

SEQ ID NO: 777065 - RNA, 26 nt, Human
ugcagugcacauggaccuuggaaggc

SEQ ID NO: 777066 - RNA, 22 nt, Human
ugcccccagccuucauuccugu

SEQ ID NO: 777067 - RNA, 18 nt, Human
ugccugggcacucugggg

SEQ ID NO: 777068 - RNA, 19 nt, Human
uggcagcaagggcuagggu

SEQ ID NO: 777069 - RNA, 21 nt, Human
uggcagcaagggcuagggugg

SEQ ID NO: 777070 - RNA, 24 nt, Human
uggcagcaagggcuaggguggggc

SEQ ID NO: 777071 - RNA, 22 nt, Human
uggccagcaccgccccaggggc

SEQ ID NO: 777072 - RNA, 23 nt, Human
uggggcaggaaaggggauaaaug

SEQ ID NO: 777073 - RNA, 22 nt, Human
ugggguggacccaauagcuguu

SEQ ID NO: 777074 - RNA, 19 nt, Human
ugguccccaaacccccacu

SEQ ID NO: 777075 - RNA, 18 nt, Human
ugguguggcagcaagggc

SEQ ID NO: 777076 - RNA, 19 nt, Human
ugguguggcagcaagggcu

SEQ ID NO: 777077 - RNA, 19 nt, Human
uguccccauuuccagaagc

SEQ ID NO: 777078 - RNA, 24 nt, Human
ugugaaaugcagcagauuucugga

SEQ ID NO: 777079 - RNA, 21 nt, Human
ugugcacccaggcugggcuga

SEQ ID NO: 777080 - RNA, 18 nt, Human
ugugguguggcagcaagg

SEQ ID NO: 777081 - RNA, 19 nt, Human
ugugguguggcagcaagga

SEQ ID NO: 777082 - RNA, 23 nt, Human
uguuuggugggaaagaccucccu

SEQ ID NO: 777083 - RNA, 22 nt, Human
uucacagugugagacccuugca

SEQ ID NO: 777084 - RNA, 23 nt, Human
uuccagcucugaaaucccaggcc

SEQ ID NO: 777085 - RNA, 22 nt, Human
uuuaacucuccucuccaucacc

SEQ ID NO: 777086 - RNA, 19 nt, Human
uuucagaggagcguugcuu

SEQ ID NO: 777087 - RNA, 22 nt, Human
uuucagaggagcguugcuuucc

SEQ ID NO: 777088 - RNA, 24 nt, Human
uuuccagcauuggccagcaccgcc

SEQ ID NO: 777089 - RNA, 25 nt, Human
aaaacuucaaguauaaauaagacca

SEQ ID NO: 777090 - RNA, 21 nt, Human
aaaagaggcagaaacuuggau

SEQ ID NO: 777091 - RNA, 19 nt, Human
aaaggcuucacagagacua

SEQ ID NO: 777092 - RNA, 24 nt, Human
aaauggcuguaaaacuacuugccu

SEQ ID NO: 777093 - RNA, 19 nt, Human
aacauggugaaaccccguc

SEQ ID NO: 777094 - RNA, 20 nt, Human
aacauggugaaaccccgucu

SEQ ID NO: 777095 - RNA, 21 nt, Human
aacauggugaaaccccgucuc

SEQ ID NO: 777096 - RNA, 20 nt, Human
aagaagaaggaaacaaauga

SEQ ID NO: 777097 - RNA, 18 nt, Human
aagaguagccgggggcug

SEQ ID NO: 777098 - RNA, 21 nt, Human
aaggaaacaaaugauggccca

SEQ ID NO: 777099 - RNA, 26 nt, Human
aaggcaaaagaugaaagaagggaccc

SEQ ID NO: 777100 - RNA, 22 nt, Human
aaguacauuuaaaagaggcaga

SEQ ID NO: 777101 - RNA, 26 nt, Human
aagugggcagaucaccugaggucagg

SEQ ID NO: 777102 - RNA, 21 nt, Human
aauucccagcagaaguuugcc

SEQ ID NO: 777103 - RNA, 19 nt, Human
aauugcuugaacccugugg

SEQ ID NO: 777104 - RNA, 28 nt, Human
acacauuucacagaacaagaguagcccc

SEQ ID NO: 777105 - RNA, 20 nt, Human
acaccuguaaucccagccac

SEQ ID NO: 777106 - RNA, 18 nt, Human
acagcagcaaaaagcaga

SEQ ID NO: 777107 - RNA, 24 nt, Human
accccgucucuacuaaaaauacaa

SEQ ID NO: 777108 - RNA, 24 nt, Human
accugaggucaggaguucgagacc

SEQ ID NO: 777109 - RNA, 21 nt, Human
accuugcgucgcucucgccgg

SEQ ID NO: 777110 - RNA, 19 nt, Human
acugugucccccgcccccc

SEQ ID NO: 777111 - RNA, 18 nt, Human
acuuggaugugcuucuuu

SEQ ID NO: 777112 - RNA, 23 nt, Human
agaaagaaaauuagcuuccuuga

SEQ ID NO: 777113 - RNA, 18 nt, Human
agacccgucacaguagua

SEQ ID NO: 777114 - RNA, 27 nt, Human
agacugccccagaaggggcuguaccaa

SEQ ID NO: 777115 - RNA, 20 nt, Human
agagggugggggaaauagau

SEQ ID NO: 777116 - RNA, 21 nt, Human
agauauuauaaaaccagagcu

SEQ ID NO: 777117 - RNA, 23 nt, Human
agaucaccugaggucaggaguuc

SEQ ID NO: 777118 - RNA, 25 nt, Human
agaucaccugaggucaggaguucga

SEQ ID NO: 777119 - RNA, 27 nt, Human
agauguuggaaaaucagaguaugaacu

SEQ ID NO: 777120 - RNA, 20 nt, Human
agcaccuuucccauuuggga

SEQ ID NO: 777121 - RNA, 24 nt, Human
agcacuuugggaggccaaaguggg

SEQ ID NO: 777122 - RNA, 22 nt, Human
agccuggccaacauggugaaac

SEQ ID NO: 777123 - RNA, 24 nt, Human
agccuggccaacauggugaaaccc

SEQ ID NO: 777124 - RNA, 19 nt, Human
aggagaagcuuacagcagc

SEQ ID NO: 777125 - RNA, 26 nt, Human
aggaugagacaaaaggccagacagaa

SEQ ID NO: 777126 - RNA, 19 nt, Human
aggcagaaacuuggaugug

SEQ ID NO: 777127 - RNA, 23 nt, Human
aggcaggagaauugcuugaaccc

SEQ ID NO: 777128 - RNA, 25 nt, Human
aggcaggagaauugcuugaacccug

SEQ ID NO: 777129 - RNA, 21 nt, Human
aggcugaggcaggagaauugc

SEQ ID NO: 777130 - RNA, 24 nt, Human
aggcugaggcaggagaauugcuug

SEQ ID NO: 777131 - RNA, 21 nt, Human
aggguuggggaggagagaggg

SEQ ID NO: 777132 - RNA, 20 nt, Human
aguagccgggggcuguuaga

SEQ ID NO: 777133 - RNA, 22 nt, Human
agugaacacagccuucaccgag

SEQ ID NO: 777134 - RNA, 22 nt, Human
aucccagcacuuugggaggcca

SEQ ID NO: 777135 - RNA, 19 nt, Human
auccuguuuagcgacguuc

SEQ ID NO: 777136 - RNA, 23 nt, Human
augagacaaaaggccagacagaa

SEQ ID NO: 777137 - RNA, 19 nt, Human
augccuguaaucccagcac

SEQ ID NO: 777138 - RNA, 23 nt, Human
auggcucaugccuguaaucccag

SEQ ID NO: 777139 - RNA, 20 nt, Human
auguacccucacccucaaac

SEQ ID NO: 777140 - RNA, 21 nt, Human
auguuauccugcaaagacugc

SEQ ID NO: 777141 - RNA, 24 nt, Human
caaacuaauucccagcagaaguuu

SEQ ID NO: 777142 - RNA, 24 nt, Human
caaagugggcagaucaccugaggu

SEQ ID NO: 777143 - RNA, 26 nt, Human
caaagugggcagaucaccugagguca

SEQ ID NO: 777144 - RNA, 24 nt, Human
caacauggugaaaccccgucucua

SEQ ID NO: 777145 - RNA, 21 nt, Human
caagauauuauaaaaccagag

SEQ ID NO: 777146 - RNA, 18 nt, Human
caaggagcauauccaggc

SEQ ID NO: 777147 - RNA, 19 nt, Human
cacaccuguaaucccagcc

SEQ ID NO: 777148 - RNA, 21 nt, Human
cacaccuguaaucccagccac

SEQ ID NO: 777149 - RNA, 22 nt, Human
cacauuucacagaacaagagua

SEQ ID NO: 777150 - RNA, 23 nt, Human
caccugaggucaggaguucgaga

SEQ ID NO: 777151 - RNA, 19 nt, Human
caccuguaaucccagccac

SEQ ID NO: 777152 - RNA, 24 nt, Human
caccuguaaucccagccacuccga

SEQ ID NO: 777153 - RNA, 22 nt, Human
cacugggcacacgggcgcccuc

SEQ ID NO: 777154 - RNA, 22 nt, Human
cacugugucccccgcccccccc

SEQ ID NO: 777155 - RNA, 24 nt, Human
cagaucaccugaggucaggaguuc

SEQ ID NO: 777156 - RNA, 19 nt, Human
cagcaaaaagcagagugca

SEQ ID NO: 777157 - RNA, 21 nt, Human
cagcacuuugggaggccaaag

SEQ ID NO: 777158 - RNA, 24 nt, Human
cagcacuuugggaggccaaagugg

SEQ ID NO: 777159 - RNA, 19 nt, Human
cagcagcaaaaagcagagg

SEQ ID NO: 777160 - RNA, 24 nt, Human
caugccuguaaucccagcacuuug

SEQ ID NO: 777161 - RNA, 20 nt, Human
ccaaugccuacauaccaaua

SEQ ID NO: 777162 - RNA, 22 nt, Human
ccccagaaagaaaauuagcuuc

SEQ ID NO: 777163 - RNA, 21 nt, Human
cccccgccccccccagaaaga

SEQ ID NO: 777164 - RNA, 22 nt, Human
cccgccccccccagaaagaaaa

SEQ ID NO: 777165 - RNA, 24 nt, Human
cccgucacaguaguaucauacccu

SEQ ID NO: 777166 - RNA, 18 nt, Human
cccucaaacuaauuccca

SEQ ID NO: 777167 - RNA, 21 nt, Human
ccuagagaguaaaggcuucac

SEQ ID NO: 777168 - RNA, 23 nt, Human
ccucugcacucaaucagaagguc

SEQ ID NO: 777169 - RNA, 22 nt, Human
ccugaggucaggaguucgagac

SEQ ID NO: 777170 - RNA, 20 nt, Human
ccugcaaagacugccccaga

SEQ ID NO: 777171 - RNA, 23 nt, Human
ccuggccaacauggugaaacccc

SEQ ID NO: 777172 - RNA, 24 nt, Human
ccuggccaacauggugaaaccccg

SEQ ID NO: 777173 - RNA, 23 nt, Human
ccuguaaucccagccacuccgaa

SEQ ID NO: 777174 - RNA, 19 nt, Human
ccuucaccgagcgcugucc

SEQ ID NO: 777175 - RNA, 24 nt, Human
cgagaccagccuggccaacauggu

SEQ ID NO: 777176 - RNA, 19 nt, Human
cgggccgccgccgcagccg

SEQ ID NO: 777177 - RNA, 24 nt, Human
cucaugccuguaaucccagcacuu

SEQ ID NO: 777178 - RNA, 20 nt, Human
cucucauguuaacaaagaau

SEQ ID NO: 777179 - RNA, 18 nt, Human
cugugucccccgcccccc

SEQ ID NO: 777180 - RNA, 20 nt, Human
cuucaccgagcgcuguccag

SEQ ID NO: 777181 - RNA, 18 nt, Human
gagcccuccagcgagcuc

SEQ ID NO: 777182 - RNA, 18 nt, Human
gaggagacugucuagucu

SEQ ID NO: 777183 - RNA, 24 nt, Human
gaucaccugaggucaggaguucga

SEQ ID NO: 777184 - RNA, 23 nt, Human
gauggcucaugccuguaauccca

SEQ ID NO: 777185 - RNA, 24 nt, Human
gauggcucaugccuguaaucccag

SEQ ID NO: 777186 - RNA, 24 nt, Human
gccaacauggugaaaccccgucuc

SEQ ID NO: 777187 - RNA, 24 nt, Human
gcccaguuuagugaguucuaggcu

SEQ ID NO: 777188 - RNA, 22 nt, Human
gccccccccagaaagaaaauua

SEQ ID NO: 777189 - RNA, 18 nt, Human
ggaggagagagggugggg

SEQ ID NO: 777190 - RNA, 21 nt, Human
ggcugggcgauggcucaugcc

SEQ ID NO: 777191 - RNA, 26 nt, Human
gggcagaucaccugaggucaggaguu

SEQ ID NO: 777192 - RNA, 24 nt, Human
gggcaugguggcgcacaccuguaa

SEQ ID NO: 777193 - RNA, 20 nt, Human
ggguuggggaggagagaggg

SEQ ID NO: 777194 - RNA, 24 nt, Human
gguggcgcacaccuguaaucccag

SEQ ID NO: 777195 - RNA, 21 nt, Human
gguguuggggaaucggguagg

SEQ ID NO: 777196 - RNA, 21 nt, Human
gugcuucuuuuuucaucaugc

SEQ ID NO: 777197 - RNA, 25 nt, Human
guuuacucuuccuuuggacuccuac

SEQ ID NO: 777198 - RNA, 18 nt, Human
guuuuguuuuuguuaggg

SEQ ID NO: 777199 - RNA, 25 nt, Human
uaaaagaggcagaaacuuggaugug

SEQ ID NO: 777200 - RNA, 23 nt, Human
uaacuuauagcacugaugcccuc

SEQ ID NO: 777201 - RNA, 20 nt, Human
uaaggcaaaagaugaaagaa

SEQ ID NO: 777202 - RNA, 22 nt, Human
uaaggcaccuagagaguaaagg

SEQ ID NO: 777203 - RNA, 20 nt, Human
uagcugcuuuuuauugacaa

SEQ ID NO: 777204 - RNA, 20 nt, Human
uagcuucugggcugggcgau

SEQ ID NO: 777205 - RNA, 20 nt, Human
uauguacccucacccucaaa

SEQ ID NO: 777206 - RNA, 21 nt, Human
ucacauauguacccucacccu

SEQ ID NO: 777207 - RNA, 20 nt, Human
ucaccugaggucaggaguuc

SEQ ID NO: 777208 - RNA, 22 nt, Human
ucaugccuguaaucccagcacu

SEQ ID NO: 777209 - RNA, 19 nt, Human
uccagcgagcucgcggccg

SEQ ID NO: 777210 - RNA, 19 nt, Human
ucccccgccccccccagaa

SEQ ID NO: 777211 - RNA, 23 nt, Human
ucccccgccccccccagaaagaa

SEQ ID NO: 777212 - RNA, 21 nt, Human
ucucuacuaaaaauacaaaaa

SEQ ID NO: 777213 - RNA, 18 nt, Human
ucuucuguguuucugacu

SEQ ID NO: 777214 - RNA, 19 nt, Human
ugaacacagccuucaccga

SEQ ID NO: 777215 - RNA, 21 nt, Human
ugaggaaaacagcuugaaucu

SEQ ID NO: 777216 - RNA, 24 nt, Human
ugaggcaggagaauugcuugaacc

SEQ ID NO: 777217 - RNA, 25 nt, Human
ugaggcaggagaauugcuugaaccc

SEQ ID NO: 777218 - RNA, 18 nt, Human
ugccaagaaggaugagac

SEQ ID NO: 777219 - RNA, 20 nt, Human
ugccaagaaggaugagacaa

SEQ ID NO: 777220 - RNA, 23 nt, Human
ugccuguaaucccagcacuuugg

SEQ ID NO: 777221 - RNA, 23 nt, Human
ugccuguaaucccagcacuuugg

SEQ ID NO: 777222 - RNA, 24 nt, Human
ugccuguaaucccagcacuuuggg

SEQ ID NO: 777223 - RNA, 21 nt, Human
ugcuucuuuuuucaucaugcu

SEQ ID NO: 777224 - RNA, 18 nt, Human
uggacugggugacauagu

SEQ ID NO: 777225 - RNA, 24 nt, Human
uggccaacauggugaaaccccguc

SEQ ID NO: 777226 - RNA, 22 nt, Human
uggcgcacaccuguaaucccag

SEQ ID NO: 777227 - RNA, 24 nt, Human
uggcucaugccuguaaucccagca

SEQ ID NO: 777228 - RNA, 20 nt, Human
ugggaggccaaagugggcag

SEQ ID NO: 777229 - RNA, 24 nt, Human
ugggaggccaaagugggcagauca

SEQ ID NO: 777230 - RNA, 18 nt, Human
ugggcagaucaccugagg

SEQ ID NO: 777231 - RNA, 24 nt, Human
ugggcagaucaccugaggucagga

SEQ ID NO: 777232 - RNA, 23 nt, Human
ugggcgauggcucaugccuguaa

SEQ ID NO: 777233 - RNA, 22 nt, Human
uggggaggagagaggguggggg

SEQ ID NO: 777234 - RNA, 24 nt, Human
ugguggcgcacaccuguaauccca

SEQ ID NO: 777235 - RNA, 19 nt, Human
uuacagcagcaaaaagcag

SEQ ID NO: 777236 - RNA, 21 nt, Human
uuacagcagcaaaaagcagag

SEQ ID NO: 777237 - RNA, 18 nt, Human
uuagccgggcaugguggc

SEQ ID NO: 777238 - RNA, 18 nt, Human
uuauccugcaaagacugc

SEQ ID NO: 777239 - RNA, 21 nt, Human
uucgagguagaaaugucucag

SEQ ID NO: 777240 - RNA, 19 nt, Human
uucugggcugggcgauggc

SEQ ID NO: 777241 - RNA, 20 nt, Human
uucugggcugggcgauggcu

SEQ ID NO: 777242 - RNA, 19 nt, Human
uucuguguuucugacucau

SEQ ID NO: 777243 - RNA, 24 nt, Human
uuggucuuuuacaagaagaaggaa

SEQ ID NO: 777244 - RNA, 24 nt, Human
uuuucuccaacucugucagcaccu

SEQ ID NO: 777245 - RNA, 18 nt, Human
uuuugcugugcaaaagau

SEQ ID NO: 777246 - RNA, 19 nt, Human
aaaccuacaucuagaaguc

SEQ ID NO: 777247 - RNA, 20 nt, Human
aaacugcuaauugcuaucua

SEQ ID NO: 777248 - RNA, 19 nt, Human
aaagugcugggauuucagg

SEQ ID NO: 777249 - RNA, 24 nt, Human
aaagugcugggauuucaggcguga

SEQ ID NO: 777250 - RNA, 26 nt, Human
aagaaaaaaauaaucaaaacauaaaa

SEQ ID NO: 777251 - RNA, 23 nt, Human
aagaacccccucccccaauaaug

SEQ ID NO: 777252 - RNA, 25 nt, Human
aagcagaaugaaggcacuuccuugg

SEQ ID NO: 777253 - RNA, 19 nt, Human
aagugcugggauuucaggc

SEQ ID NO: 777254 - RNA, 18 nt, Human
acaaagaagauugaaagc

SEQ ID NO: 777255 - RNA, 22 nt, Human
acaaagcagaaugaaggcacuu

SEQ ID NO: 777256 - RNA, 23 nt, Human
acccccucccccaauaaugaaac

SEQ ID NO: 777257 - RNA, 25 nt, Human
acucuguugcccaggauggagugca

SEQ ID NO: 777258 - RNA, 21 nt, Human
agaaacugcuaacaaagaaga

SEQ ID NO: 777259 - RNA, 19 nt, Human
agagauaggguuucaccgu

SEQ ID NO: 777260 - RNA, 20 nt, Human
agagggcuggaacaaacugc

SEQ ID NO: 777261 - RNA, 23 nt, Human
aggguuucaccguguuagccagg

SEQ ID NO: 777262 - RNA, 20 nt, Human
aguagagauaggguuucacc

SEQ ID NO: 777263 - RNA, 18 nt, Human
aguagcugggacuacugg

SEQ ID NO: 777264 - RNA, 19 nt, Human
agugcagugguguggucuc

SEQ ID NO: 777265 - RNA, 23 nt, Human
agugcagugguguggucucagcu

SEQ ID NO: 777266 - RNA, 24 nt, Human
agugcagugguguggucucagcuc

SEQ ID NO: 777267 - RNA, 24 nt, Human
agugguguggucucagcucacugc

SEQ ID NO: 777268 - RNA, 21 nt, Human
auaacaauaagaacccccucc

SEQ ID NO: 777269 - RNA, 18 nt, Human
auaggguuucaccguguu

SEQ ID NO: 777270 - RNA, 19 nt, Human
auaggguuucaccguguua

SEQ ID NO: 777271 - RNA, 20 nt, Human
auaggguuucaccguguuag

SEQ ID NO: 777272 - RNA, 24 nt, Human
auaggguuucaccguguuagccag

SEQ ID NO: 777273 - RNA, 21 nt, Human
auucuccugccucagccuccc

SEQ ID NO: 777274 - RNA, 20 nt, Human
auugcuaucuacuugcugag

SEQ ID NO: 777275 - RNA, 24 nt, Human
caaagugcugggauuucaggcgug

SEQ ID NO: 777276 - RNA, 22 nt, Human
caacacgagaagagcaagaaua

SEQ ID NO: 777277 - RNA, 22 nt, Human
caagcaauucuccugccucagc

SEQ ID NO: 777278 - RNA, 26 nt, Human
caauaagaacccccucccccaauaau

SEQ ID NO: 777279 - RNA, 18 nt, Human
caccguguuagccaggau

SEQ ID NO: 777280 - RNA, 23 nt, Human
caccguguuagccaggauggucu

SEQ ID NO: 777281 - RNA, 24 nt, Human
caccguguuagccaggauggucuu

SEQ ID NO: 777282 - RNA, 23 nt, Human
caccugccucggccucccaaagu

SEQ ID NO: 777283 - RNA, 24 nt, Human
caccugcgguaacccccagcaaug

SEQ ID NO: 777284 - RNA, 24 nt, Human
cacucuguugcccaggauggagug

SEQ ID NO: 777285 - RNA, 23 nt, Human
cagaaugaaggcacuuccuuggu

SEQ ID NO: 777286 - RNA, 26 nt, Human
cagcucccuuggguagaagcuugugg

SEQ ID NO: 777287 - RNA, 24 nt, Human
caggcagguaguugugagcaacac

SEQ ID NO: 777288 - RNA, 21 nt, Human
caggcgugagccaccaugccc

SEQ ID NO: 777289 - RNA, 22 nt, Human
ccaaagugcugggauuucaggc

SEQ ID NO: 777290 - RNA, 24 nt, Human
ccaaagugcugggauuucaggcgu

SEQ ID NO: 777291 - RNA, 20 nt, Human
ccaccacaccuggcuaauuu

SEQ ID NO: 777292 - RNA, 23 nt, Human
ccaccaugcccggccggaacugu

SEQ ID NO: 777293 - RNA, 19 nt, Human
ccagguucaagcaauucuc

SEQ ID NO: 777294 - RNA, 22 nt, Human
ccagguucaagcaauucuccug

SEQ ID NO: 777295 - RNA, 22 nt, Human
cccaauaaugaaaccuacaucu

SEQ ID NO: 777296 - RNA, 26 nt, Human
cccagcaauguaaaggaaagaugaaa

SEQ ID NO: 777297 - RNA, 27 nt, Human
cccccaauaaugaaaccuacaucuaga

SEQ ID NO: 777298 - RNA, 20 nt, Human
cccgaguagcugggacuacu

SEQ ID NO: 777299 - RNA, 22 nt, Human
cccucccccaauaaugaaaccu

SEQ ID NO: 777300 - RNA, 18 nt, Human
ccucaaggcagccagcuc

SEQ ID NO: 777301 - RNA, 19 nt, Human
ccugaccucgugauccacc

SEQ ID NO: 777302 - RNA, 21 nt, Human
ccugaccucgugauccaccug

SEQ ID NO: 777303 - RNA, 22 nt, Human
ccugcaaagcuugggugaggcc

SEQ ID NO: 777304 - RNA, 23 nt, Human
ccugccucagccucccgaguagc

SEQ ID NO: 777305 - RNA, 24 nt, Human
ccuuccagguucaagcaauucucc

SEQ ID NO: 777306 - RNA, 18 nt, Human
ccuugcugcagcucccuu

SEQ ID NO: 777307 - RNA, 23 nt, Human
cuaauuuuuuguauuuuuaguag

SEQ ID NO: 777308 - RNA, 24 nt, Human
cucacugcaaucucugccuuccag

SEQ ID NO: 777309 - RNA, 24 nt, Human
cucagccucccgaguagcugggac

SEQ ID NO: 777310 - RNA, 26 nt, Human
cuccaacuucccucuucucgccuuau

SEQ ID NO: 777311 - RNA, 24 nt, Human
cuccugaccucgugauccaccugc

SEQ ID NO: 777312 - RNA, 24 nt, Human
cugagaaacugcuaacaaagaaga

SEQ ID NO: 777313 - RNA, 24 nt, Human
cugcaaucucugccuuccagguuc

SEQ ID NO: 777314 - RNA, 23 nt, Human
cugccucagccucccgaguagcu

SEQ ID NO: 777315 - RNA, 23 nt, Human
cugccucggccucccaaagugcu

SEQ ID NO: 777316 - RNA, 25 nt, Human
gaaacaagaggugguaggaccaaag

SEQ ID NO: 777317 - RNA, 21 nt, Human
gaaauggcuggccacaagccc

SEQ ID NO: 777318 - RNA, 22 nt, Human
gaccucgugauccaccugccuc

SEQ ID NO: 777319 - RNA, 22 nt, Human
gaccucgugauccaccugccuc

SEQ ID NO: 777320 - RNA, 24 nt, Human
gaccucgugauccaccugccucgg

SEQ ID NO: 777321 - RNA, 22 nt, Human
gagaaacugcuaacaaagaaga

SEQ ID NO: 777322 - RNA, 22 nt, Human
gaguagcugggacuacuggugc

SEQ ID NO: 777323 - RNA, 18 nt, Human
gauuucaggcgugagcca

SEQ ID NO: 777324 - RNA, 21 nt, Human
gauuucaggcgugagccacca

SEQ ID NO: 777325 - RNA, 24 nt, Human
gauuucaggcgugagccaccaugc

SEQ ID NO: 777326 - RNA, 22 nt, Human
gcaaucucugccuuccagguuc

SEQ ID NO: 777327 - RNA, 19 nt, Human
gcgugagccaccaugcccg

SEQ ID NO: 777328 - RNA, 23 nt, Human
ggaaggagagugugguucuaaga

SEQ ID NO: 777329 - RNA, 23 nt, Human
ggacaggaagagggucacacuag

SEQ ID NO: 777330 - RNA, 24 nt, Human
ggauggucuugaucuccugaccuc

SEQ ID NO: 777331 - RNA, 24 nt, Human
ggauuucaggcgugagccaccaug

SEQ ID NO: 777332 - RNA, 24 nt, Human
gggaaggagagugugguucuaaga

SEQ ID NO: 777333 - RNA, 27 nt, Human
ggguagaagcuuguggcuuccccaggg

SEQ ID NO: 777334 - RNA, 21 nt, Human
ggguuucaccguguuagccag

SEQ ID NO: 777335 - RNA, 22 nt, Human
ggguuucaccguguuagccagg

SEQ ID NO: 777336 - RNA, 21 nt, Human
ggugaggcccugaaacuggug

SEQ ID NO: 777337 - RNA, 23 nt, Human
guacaaagcagaaugaaggcacu

SEQ ID NO: 777338 - RNA, 24 nt, Human
gugaagcccugggguaggcaccug

SEQ ID NO: 777339 - RNA, 24 nt, Human
gugauccaccugccucggccuccc

SEQ ID NO: 777340 - RNA, 20 nt, Human
gugcagugguguggucucag

SEQ ID NO: 777341 - RNA, 19 nt, Human
guuuucuuucuuucuuucu

SEQ ID NO: 777342 - RNA, 26 nt, Human
uaaaaauaaauaaaaucaaaaggcca

SEQ ID NO: 777343 - RNA, 23 nt, Human
uaaaauauaacaauaagaacccc

SEQ ID NO: 777344 - RNA, 22 nt, Human
uaacaaagaagauugaaagcac

SEQ ID NO: 777345 - RNA, 23 nt, Human
uaacaauaagaacccccuccccc

SEQ ID NO: 777346 - RNA, 24 nt, Human
uaacaauaagaacccccuccccca

SEQ ID NO: 777347 - RNA, 25 nt, Human
uaacaauaagaacccccucccccaa

SEQ ID NO: 777348 - RNA, 24 nt, Human
uaauuuuuuguauuuuuaguagag

SEQ ID NO: 777349 - RNA, 25 nt, Human
uaauuuuuuguauuuuuaguagaga

SEQ ID NO: 777350 - RNA, 24 nt, Human
uacuggugcgugccaccacaccug

SEQ ID NO: 777351 - RNA, 21 nt, Human
uacuugcccuuggcaacugug

SEQ ID NO: 777352 - RNA, 23 nt, Human
uagaagcuuguggcuuccccagg

SEQ ID NO: 777353 - RNA, 21 nt, Human
uagaggcuguugaugauaugg

SEQ ID NO: 777354 - RNA, 23 nt, Human
uagcugggacuacuggugcgugc

SEQ ID NO: 777355 - RNA, 20 nt, Human
uagcugguuaggaccacugc

SEQ ID NO: 777356 - RNA, 21 nt, Human
uaguagagauaggguuucacc

SEQ ID NO: 777357 - RNA, 24 nt, Human
uaguagagauaggguuucaccgug

SEQ ID NO: 777358 - RNA, 26 nt, Human
uaguagagauaggguuucaccguguu

SEQ ID NO: 777359 - RNA, 18 nt, Human
ucaaaacauaaaaauaaa

SEQ ID NO: 777360 - RNA, 24 nt, Human
ucaccguguuagccaggauggucu

SEQ ID NO: 777361 - RNA, 18 nt, Human
ucacugcaaucucugccu

SEQ ID NO: 777362 - RNA, 24 nt, Human
ucacugcaaucucugccuuccagg

SEQ ID NO: 777363 - RNA, 23 nt, Human
ucagccucccgaguagcugggac

SEQ ID NO: 777364 - RNA, 24 nt, Human
ucccaaagugcugggauuucaggc

SEQ ID NO: 777365 - RNA, 22 nt, Human
ucccacauggcugggcagggau

SEQ ID NO: 777366 - RNA, 21 nt, Human
uccccugaacuugcugcuggg

SEQ ID NO: 777367 - RNA, 23 nt, Human
ucccgaguagcugggacuacugg

SEQ ID NO: 777368 - RNA, 24 nt, Human
ucccgaguagcugggacuacuggu

SEQ ID NO: 777369 - RNA, 18 nt, Human
ucggccucccaaagugcu

SEQ ID NO: 777370 - RNA, 19 nt, Human
ucucacucuguugcccagg

SEQ ID NO: 777371 - RNA, 20 nt, Human
ucucacucuguugcccagga

SEQ ID NO: 777372 - RNA, 23 nt, Human
ucucacucuguugcccaggaugg

SEQ ID NO: 777373 - RNA, 24 nt, Human
ucucacucuguugcccaggaugga

SEQ ID NO: 777374 - RNA, 24 nt, Human
ucuccugccucagccucccgagua

SEQ ID NO: 777375 - RNA, 24 nt, Human
ucucugugcagcaaguacuugccc

SEQ ID NO: 777376 - RNA, 24 nt, Human
ucuguugcccaggauggagugcag

SEQ ID NO: 777377 - RNA, 18 nt, Human
ucuuucuuucuuucuuuc

SEQ ID NO: 777378 - RNA, 18 nt, Human
ucuuucuuucuuucuuuc

SEQ ID NO: 777379 - RNA, 22 nt, Human
ucuuucuuucuuucuuucuuuc

SEQ ID NO: 777380 - RNA, 25 nt, Human
ucuuucuuucuuucuuucuuucuuu

SEQ ID NO: 777381 - RNA, 25 nt, Human
ucuuucuuucuuucuuucuuucuuu

SEQ ID NO: 777382 - RNA, 25 nt, Human
ucuuucuuucuuucuuucuuucuuu

SEQ ID NO: 777383 - RNA, 25 nt, Human
ucuuucuuucuuucuuucuuucuuu

SEQ ID NO: 777384 - RNA, 24 nt, Human
ucuuucuuucuuucuuuucuuucc

SEQ ID NO: 777385 - RNA, 22 nt, Human
ucuuucuuuuugagacaaaguc

SEQ ID NO: 777386 - RNA, 22 nt, Human
ugaagcccugggguaggcaccu

SEQ ID NO: 777387 - RNA, 23 nt, Human
ugaagcccugggguaggcaccug

SEQ ID NO: 777388 - RNA, 19 nt, Human
ugagaaauggcuggccaca

SEQ ID NO: 777389 - RNA, 18 nt, Human
ugagacaaagucucacuc

SEQ ID NO: 777390 - RNA, 22 nt, Human
ugagacaaagucucacucuguu

SEQ ID NO: 777391 - RNA, 24 nt, Human
ugaggcccugaaacugggaccaag

SEQ ID NO: 777392 - RNA, 24 nt, Human
ugaucugcagaaaaugcuuuccuu

SEQ ID NO: 777393 - RNA, 18 nt, Human
ugcaaagcuugggugagg

SEQ ID NO: 777394 - RNA, 23 nt, Human
ugcaaucucugccuuccagguuc

SEQ ID NO: 777395 - RNA, 18 nt, Human
ugcagcaaguacuugccc

SEQ ID NO: 777396 - RNA, 18 nt, Human
ugcagcucccuuggguag

SEQ ID NO: 777397 - RNA, 22 nt, Human
ugcagugguguggucucagcuc

SEQ ID NO: 777398 - RNA, 24 nt, Human
ugcccaggauggagugcaguggug

SEQ ID NO: 777399 - RNA, 25 nt, Human
ugccuagccacgguggauucaggcu

SEQ ID NO: 777400 - RNA, 24 nt, Human
ugccucagccucccgaguagcugg

SEQ ID NO: 777401 - RNA, 21 nt, Human
ugccucggccucccaaagugc

SEQ ID NO: 777402 - RNA, 24 nt, Human
ugccucggccucccaaagugcugg

SEQ ID NO: 777403 - RNA, 19 nt, Human
ugcuaacaaagaagauuga

SEQ ID NO: 777404 - RNA, 20 nt, Human
uggagugcaguggugugguc

SEQ ID NO: 777405 - RNA, 23 nt, Human
uggagugcagugguguggucuca

SEQ ID NO: 777406 - RNA, 24 nt, Human
uggagugcagugguguggucucag

SEQ ID NO: 777407 - RNA, 19 nt, Human
uggcccauauggugaagcc

SEQ ID NO: 777408 - RNA, 23 nt, Human
uggcugggcagggaugcuguggc

SEQ ID NO: 777409 - RNA, 19 nt, Human
ugggaaggagagugugguu

SEQ ID NO: 777410 - RNA, 24 nt, Human
ugggacuacuggugcgugccacca

SEQ ID NO: 777411 - RNA, 18 nt, Human
ugggauuucaggcgugag

SEQ ID NO: 777412 - RNA, 24 nt, Human
ugggauuucaggcgugagccacca

SEQ ID NO: 777413 - RNA, 25 nt, Human
ugggauuucaggcgugagccaccau

SEQ ID NO: 777414 - RNA, 21 nt, Human
uggugcgugccaccacaccug

SEQ ID NO: 777415 - RNA, 24 nt, Human
ugguguggucucagcucacugcaa

SEQ ID NO: 777416 - RNA, 23 nt, Human
uuaggacaggaagagggucacaa

SEQ ID NO: 777417 - RNA, 18 nt, Human
uuaguagagauaggguuu

SEQ ID NO: 777418 - RNA, 22 nt, Human
uuaguagagauaggguuucacc

SEQ ID NO: 777419 - RNA, 24 nt, Human
uuaguagagauaggguuucaccgu

SEQ ID NO: 777420 - RNA, 27 nt, Human
uuaguuaaaaaagaaaaaaauaaucaa

SEQ ID NO: 777421 - RNA, 21 nt, Human
uucaagcaauucuccugccuc

SEQ ID NO: 777422 - RNA, 24 nt, Human
uucaagcaauucuccugccucagc

SEQ ID NO: 777423 - RNA, 19 nt, Human
uucaggcgugagccaccau

SEQ ID NO: 777424 - RNA, 24 nt, Human
uuccagguucaagcaauucuccug

SEQ ID NO: 777425 - RNA, 22 nt, Human
uuccccagggucuccuagcugg

SEQ ID NO: 777426 - RNA, 22 nt, Human
uucucgccuuauuaguuaaaaa

SEQ ID NO: 777427 - RNA, 24 nt, Human
uuuaaaauauaacaauaagaaccc

SEQ ID NO: 777428 - RNA, 19 nt, Human
uuucaccguguuagccagg

SEQ ID NO: 777429 - RNA, 25 nt, Human
uuuccuaaauucauccaggcaggua

SEQ ID NO: 777430 - RNA, 24 nt, Human
uuuuuaguagagauaggguuucac

SEQ ID NO: 777431 - RNA, 21 nt, Human
uuuuuguauuuuuaguagaga

SEQ ID NO: 777432 - RNA, 24 nt, Human
uuuuuuguauuuuuaguagagaua

SEQ ID NO: 777433 - RNA, 25 nt, Human
aaaaaaaaaaaaaaaaagaaaagaa

SEQ ID NO: 777434 - RNA, 23 nt, Human
aaaaaaaaaagaaaagcuaaaaa

SEQ ID NO: 777435 - RNA, 23 nt, Human
aaaaaaagaaaagaaagaaagaa

SEQ ID NO: 777436 - RNA, 18 nt, Human
aaaaaugcaacaccugac

SEQ ID NO: 777437 - RNA, 25 nt, Human
aaaagaaaaaaaaaguagugcagaa

SEQ ID NO: 777438 - RNA, 21 nt, Human
aaaccaacaccaaguccccaa

SEQ ID NO: 777439 - RNA, 26 nt, Human
aaaccaacaccaaguccccaacccua

SEQ ID NO: 777440 - RNA, 23 nt, Human
aaccaacaccaaguccccaaccc

SEQ ID NO: 777441 - RNA, 21 nt, Human
aacgucugaugccccucuaug

SEQ ID NO: 777442 - RNA, 21 nt, Human
aagaaaaaaaaaguagugcag

SEQ ID NO: 777443 - RNA, 23 nt, Human
aagaauaaaacuuuaaaaagcaa

SEQ ID NO: 777444 - RNA, 21 nt, Human
aaggcagcccuaacagagacu

SEQ ID NO: 777445 - RNA, 19 nt, Human
aaguggucuccagacuugc

SEQ ID NO: 777446 - RNA, 22 nt, Human
aauuaaaaaaaaaaaaaaaaag

SEQ ID NO: 777447 - RNA, 23 nt, Human
acaaaacaaaagcacaggaggcc

SEQ ID NO: 777448 - RNA, 27 nt, Human
acacacacgcauacacucacacacaca

SEQ ID NO: 777449 - RNA, 24 nt, Human
acagcaucgaaggcagccaguugc

SEQ ID NO: 777450 - RNA, 25 nt, Human
acagcaucgaaggcagccaguugcc

SEQ ID NO: 777451 - RNA, 21 nt, Human
acagcgagugaagaagugagu

SEQ ID NO: 777452 - RNA, 24 nt, Human
acauggcaccuuccucuuuaaucc

SEQ ID NO: 777453 - RNA, 24 nt, Human
accaacaccaaguccccaacccua

SEQ ID NO: 777454 - RNA, 21 nt, Human
acccaguuuagaaucuagaag

SEQ ID NO: 777455 - RNA, 19 nt, Human
acuacagugcaaaauucca

SEQ ID NO: 777456 - RNA, 19 nt, Human
acucacacacacacacaca

SEQ ID NO: 777457 - RNA, 18 nt, Human
acuguugcuauuuuuuuc

SEQ ID NO: 777458 - RNA, 23 nt, Human
acuugcauacuauuucaaaaauc

SEQ ID NO: 777459 - RNA, 18 nt, Human
acuugcucaagagaacca

SEQ ID NO: 777460 - RNA, 20 nt, Human
acuuugcuuaucugugaggu

SEQ ID NO: 777461 - RNA, 19 nt, Human
agaaaaacgagagcggugg

SEQ ID NO: 777462 - RNA, 18 nt, Human
agaacaaagaagaaauaa

SEQ ID NO: 777463 - RNA, 24 nt, Human
agacaggaucugaagugcauaugg

SEQ ID NO: 777464 - RNA, 18 nt, Human
agagacugacagacagga

SEQ ID NO: 777465 - RNA, 19 nt, Human
agaucccauggaaaaccaa

SEQ ID NO: 777466 - RNA, 21 nt, Human
agcaaacaaacauuacagaua

SEQ ID NO: 777467 - RNA, 21 nt, Human
agcuuuucugguucacagguu

SEQ ID NO: 777468 - RNA, 18 nt, Human
aggacuaaacuccaugac

SEQ ID NO: 777469 - RNA, 24 nt, Human
aggaggcuuuggugggagggcagg

SEQ ID NO: 777470 - RNA, 23 nt, Human
aggcaacuucuuuccucuccaag

SEQ ID NO: 777471 - RNA, 23 nt, Human
aggcuuuggugggagggcagggg

SEQ ID NO: 777472 - RNA, 18 nt, Human
aguaacuacuuucccaca

SEQ ID NO: 777473 - RNA, 26 nt, Human
auauacuuugcuuaucugugagguuu

SEQ ID NO: 777474 - RNA, 25 nt, Human
augaaauguaacgucugaugccccc

SEQ ID NO: 777475 - RNA, 20 nt, Human
augacacagucacccacaug

SEQ ID NO: 777476 - RNA, 24 nt, Human
augagaucuaccuacuaaacaaaa

SEQ ID NO: 777477 - RNA, 21 nt, Human
auuacagauacaacauuacug

SEQ ID NO: 777478 - RNA, 23 nt, Human
caaaaaaguacaaaacaaaagca

SEQ ID NO: 777479 - RNA, 21 nt, Human
caaaacccucauauccaaaga

SEQ ID NO: 777480 - RNA, 23 nt, Human
caaaucccugaagcuuucaguuu

SEQ ID NO: 777481 - RNA, 19 nt, Human
caacgagaaacccaggccu

SEQ ID NO: 777482 - RNA, 22 nt, Human
caagggucuaaaauuccagcua

SEQ ID NO: 777483 - RNA, 25 nt, Human
caaguaacuacuuucccacaagaua

SEQ ID NO: 777484 - RNA, 24 nt, Human
cacaaauacucccacauccguucc

SEQ ID NO: 777485 - RNA, 23 nt, Human
cacacaacgcuucaacauaccac

SEQ ID NO: 777486 - RNA, 25 nt, Human
cacacacacacacagucgggcacgu

SEQ ID NO: 777487 - RNA, 24 nt, Human
cacacacacagucgggcacgugac

SEQ ID NO: 777488 - RNA, 19 nt, Human
cacacacagcaauacugaa

SEQ ID NO: 777489 - RNA, 20 nt, Human
cacacagucgggcacgugac

SEQ ID NO: 777490 - RNA, 19 nt, Human
cacaccacaaauacuccca

SEQ ID NO: 777491 - RNA, 21 nt, Human
cacagucacccacauggcacc

SEQ ID NO: 777492 - RNA, 19 nt, Human
caccaaaaucugaacagua

SEQ ID NO: 777493 - RNA, 27 nt, Human
cacuuccuaggaccuaucccaagaguc

SEQ ID NO: 777494 - RNA, 19 nt, Human
cacuucgauugcagaaaua

SEQ ID NO: 777495 - RNA, 23 nt, Human
cacuugaucacacaacgcuucaa

SEQ ID NO: 777496 - RNA, 21 nt, Human
cagaaggaacagacuugcuca

SEQ ID NO: 777497 - RNA, 21 nt, Human
cagaaggcaacuucuuuccuc

SEQ ID NO: 777498 - RNA, 18 nt, Human
cagcccuaacagagacug

SEQ ID NO: 777499 - RNA, 21 nt, Human
cagcuacagcaaaucccugaa

SEQ ID NO: 777500 - RNA, 19 nt, Human
caggacagcgagugaagaa

SEQ ID NO: 777501 - RNA, 20 nt, Human
caggacgagaaaauacaaaa

SEQ ID NO: 777502 - RNA, 21 nt, Human
caggaggcuuuggugggaggg

SEQ ID NO: 777503 - RNA, 20 nt, Human
cauccuagacuagcugagua

SEQ ID NO: 777504 - RNA, 19 nt, Human
ccaaacuuucgggccaaau

SEQ ID NO: 777505 - RNA, 20 nt, Human
ccaacaccaaguccccaacc

SEQ ID NO: 777506 - RNA, 19 nt, Human
ccaacuauggaaauaaaau

SEQ ID NO: 777507 - RNA, 19 nt, Human
ccaagagauauucuugggg

SEQ ID NO: 777508 - RNA, 18 nt, Human
ccaccaaaaucugaacag

SEQ ID NO: 777509 - RNA, 24 nt, Human
ccagaucccauggaaaaccaaagg

SEQ ID NO: 777510 - RNA, 23 nt, Human
cccaacccuaccaaugaacuaaa

SEQ ID NO: 777511 - RNA, 20 nt, Human
cccaccaaaaucugaacagg

SEQ ID NO: 777512 - RNA, 24 nt, Human
ccccaacccuaccaaugaacuaaa

SEQ ID NO: 777513 - RNA, 27 nt, Human
cccuaaaggcugccacucuuggucccu

SEQ ID NO: 777514 - RNA, 20 nt, Human
cccucuaugugaaauaaagc

SEQ ID NO: 777515 - RNA, 19 nt, Human
cgagaaacccaggccuauc

SEQ ID NO: 777516 - RNA, 25 nt, Human
cgcauacacucacacacacacacac

SEQ ID NO: 777517 - RNA, 19 nt, Human
cgcuucaacauaccaccau

SEQ ID NO: 777518 - RNA, 20 nt, Human
cggaauccacgugaucucuu

SEQ ID NO: 777519 - RNA, 21 nt, Human
cggccagauggaacacacucc

SEQ ID NO: 777520 - RNA, 22 nt, Human
cuaaaucuuaaauacugccaag

SEQ ID NO: 777521 - RNA, 19 nt, Human
cuccuuuguaagaaaugca

SEQ ID NO: 777522 - RNA, 24 nt, Human
cucucuugacauuuaaaaaaaaaa

SEQ ID NO: 777523 - RNA, 24 nt, Human
cucugugcucaaagaaggcccucc

SEQ ID NO: 777524 - RNA, 19 nt, Human
cuuccuaggaccuauccca

SEQ ID NO: 777525 - RNA, 19 nt, Human
gaaaggcagcccuaacaga

SEQ ID NO: 777526 - RNA, 20 nt, Human
gaaugacaauguuccccuca

SEQ ID NO: 777527 - RNA, 21 nt, Human
gaccuugaaaaagcuugcaaa

SEQ ID NO: 777528 - RNA, 21 nt, Human
gagaaaauacaaaacggaugg

SEQ ID NO: 777529 - RNA, 22 nt, Human
gagaaacccaggccuaucaucc

SEQ ID NO: 777530 - RNA, 19 nt, Human
gagcccacagacacagggc

SEQ ID NO: 777531 - RNA, 19 nt, Human
gaugggaaauggucuaaga

SEQ ID NO: 777532 - RNA, 23 nt, Human
gauuuguagaaacguuuuuccuu

SEQ ID NO: 777533 - RNA, 21 nt, Human
gcaaaucccugaagcuuucag

SEQ ID NO: 777534 - RNA, 20 nt, Human
gcaacuucuuuccucuccaa

SEQ ID NO: 777535 - RNA, 22 nt, Human
gccaaauaaccuuuccuguggc

SEQ ID NO: 777536 - RNA, 21 nt, Human
gccgcagauguacugagcaga

SEQ ID NO: 777537 - RNA, 19 nt, Human
gcuccuuccuccuucuacg

SEQ ID NO: 777538 - RNA, 18 nt, Human
gcuugaugggcugugcuc

SEQ ID NO: 777539 - RNA, 23 nt, Human
ggcagaauaaggcgacgcuuuga

SEQ ID NO: 777540 - RNA, 19 nt, Human
ggcugugaugugcugggcu

SEQ ID NO: 777541 - RNA, 20 nt, Human
guaaaaccaggacagcgagu

SEQ ID NO: 777542 - RNA, 18 nt, Human
gugcaauggauguuuaca

SEQ ID NO: 777543 - RNA, 24 nt, Human
guggaaaauccauuccuagauaac

SEQ ID NO: 777544 - RNA, 19 nt, Human
gugguaacuuucacaaggc

SEQ ID NO: 777545 - RNA, 21 nt, Human
guuguaguuaauucacacaca

SEQ ID NO: 777546 - RNA, 19 nt, Human
uaaaaaaaaaagaaaagcu

SEQ ID NO: 777547 - RNA, 20 nt, Human
uaaaaaccuuugucuaauca

SEQ ID NO: 777548 - RNA, 21 nt, Human
uaaaaagcaaacaaacauuac

SEQ ID NO: 777549 - RNA, 25 nt, Human
uaaaaagcaaacaaacauuacagau

SEQ ID NO: 777550 - RNA, 26 nt, Human
uaaaaccaggacagcgagugaagaag

SEQ ID NO: 777551 - RNA, 26 nt, Human
uaaaauagcuucaugaugucuagaca

SEQ ID NO: 777552 - RNA, 22 nt, Human
uaaacaaaaaugagagguuuga

SEQ ID NO: 777553 - RNA, 23 nt, Human
uaaauaaacaucuuuacagauaa

SEQ ID NO: 777554 - RNA, 18 nt, Human
uaaaugagcuuuguucac

SEQ ID NO: 777555 - RNA, 19 nt, Human
uacagcaaaucccugaagc

SEQ ID NO: 777556 - RNA, 24 nt, Human
uacaguuuauagacacugacauuu

SEQ ID NO: 777557 - RNA, 18 nt, Human
uacuaaaaacuuuuccca

SEQ ID NO: 777558 - RNA, 20 nt, Human
uacucccacauccguuccca

SEQ ID NO: 777559 - RNA, 23 nt, Human
uacucccacauccguucccacug

SEQ ID NO: 777560 - RNA, 20 nt, Human
uacugagcagaugagagugg

SEQ ID NO: 777561 - RNA, 22 nt, Human
uacuggugugcaaccauccuag

SEQ ID NO: 777562 - RNA, 18 nt, Human
uagcagcaaaauaaaguu

SEQ ID NO: 777563 - RNA, 22 nt, Human
uaggagaagacagucuaugaua

SEQ ID NO: 777564 - RNA, 24 nt, Human
ucaaaaaaguacaaaacaaaagca

SEQ ID NO: 777565 - RNA, 22 nt, Human
ucaaaugagaucuaccuacuaa

SEQ ID NO: 777566 - RNA, 18 nt, Human
uccaacccagaaacacua

SEQ ID NO: 777567 - RNA, 19 nt, Human
uccacaguaaggacaaguc

SEQ ID NO: 777568 - RNA, 23 nt, Human
uccacaguaaggacaaguccugc

SEQ ID NO: 777569 - RNA, 21 nt, Human
uccccugcuuugcugcuguua

SEQ ID NO: 777570 - RNA, 19 nt, Human
uccucagcuacagcaaauc

SEQ ID NO: 777571 - RNA, 18 nt, Human
ucuccuuuguaagaaaug

SEQ ID NO: 777572 - RNA, 19 nt, Human
ucugaagugcauauguaac

SEQ ID NO: 777573 - RNA, 23 nt, Human
ugacgaaaaacgcuaauauuuaa

SEQ ID NO: 777574 - RNA, 20 nt, Human
ugagcagaugagaguggucg

SEQ ID NO: 777575 - RNA, 20 nt, Human
ugagcccacagacacagggc

SEQ ID NO: 777576 - RNA, 22 nt, Human
ugagugcaauggacaacaggcu

SEQ ID NO: 777577 - RNA, 24 nt, Human
ugagugcaauggacaacaggcuca

SEQ ID NO: 777578 - RNA, 21 nt, Human
ugauacuuccugauuuuuucu

SEQ ID NO: 777579 - RNA, 19 nt, Human
ugauggggcugugaugugc

SEQ ID NO: 777580 - RNA, 25 nt, Human
ugauggggcugugaugugcugggcu

SEQ ID NO: 777581 - RNA, 18 nt, Human
ugcaccaaggguucaaga

SEQ ID NO: 777582 - RNA, 19 nt, Human
uggauguuuacaagaaauc

SEQ ID NO: 777583 - RNA, 18 nt, Human
uggcaaagugacaaaugc

SEQ ID NO: 777584 - RNA, 18 nt, Human
uggcagaauaaggcgacg

SEQ ID NO: 777585 - RNA, 23 nt, Human
ugggaaaauuaaaaaaaaaaaaa

SEQ ID NO: 777586 - RNA, 22 nt, Human
ugguacugcuuugagaacccac

SEQ ID NO: 777587 - RNA, 18 nt, Human
uggugggagggcaggggu

SEQ ID NO: 777588 - RNA, 23 nt, Human
uguccagucuuucacccaguuua

SEQ ID NO: 777589 - RNA, 24 nt, Human
ugugaaauaaagcacgcuuauuuc

SEQ ID NO: 777590 - RNA, 20 nt, Human
ugugcuuaugacuugcauac

SEQ ID NO: 777591 - RNA, 19 nt, Human
uguggcaguaggagaaaug

SEQ ID NO: 777592 - RNA, 22 nt, Human
uuaaccccaaagcacauacacg

SEQ ID NO: 777593 - RNA, 19 nt, Human
uuccaguuagcuugguguc

SEQ ID NO: 777594 - RNA, 20 nt, Human
uugagaacccaccaaaaucu

SEQ ID NO: 777595 - RNA, 24 nt, Human
uugcucaagagaaccacaagccuu

SEQ ID NO: 777596 - RNA, 21 nt, Human
uuggaaacaaucacuucggcu

SEQ ID NO: 777597 - RNA, 21 nt, Human
uuucccacaagauacuuccca

SEQ ID NO: 777598 - RNA, 20 nt, Human
uuucccaggagaacugucac

SEQ ID NO: 777599 - RNA, 18 nt, Human
uuuccucuccaagcuaca

SEQ ID NO: 777600 - RNA, 20 nt, Human
uuuugugccuaccaggagau

SEQ ID NO: 777601 - RNA, 20 nt, Human
aaaaggcugaagaaagagaa

SEQ ID NO: 777602 - RNA, 24 nt, Human
aaaguguugggauuacagauguga

SEQ ID NO: 777603 - RNA, 18 nt, Human
aacuuccagaugaaucac

SEQ ID NO: 777604 - RNA, 20 nt, Human
aagaaagagaagucagaggc

SEQ ID NO: 777605 - RNA, 24 nt, Human
aagcauaaagaggaggccuucuaa

SEQ ID NO: 777606 - RNA, 22 nt, Human
aagcucuccccaccccuuacua

SEQ ID NO: 777607 - RNA, 24 nt, Human
aagcuggcccuguaauaacuucca

SEQ ID NO: 777608 - RNA, 19 nt, Human
aaguguugggauuacagau

SEQ ID NO: 777609 - RNA, 21 nt, Human
aaguguugggauuacagaugu

SEQ ID NO: 777610 - RNA, 22 nt, Human
acccaucucagccucccaaagu

SEQ ID NO: 777611 - RNA, 31 nt, Human
agaagucagaggccacaauaggcccaaacuu

SEQ ID NO: 777612 - RNA, 23 nt, Human
agacaccagcaggugaaccgaaa

SEQ ID NO: 777613 - RNA, 20 nt, Human
agaggaaaggagaaaggaag

SEQ ID NO: 777614 - RNA, 24 nt, Human
agaguugaagagcaaguuugagug

SEQ ID NO: 777615 - RNA, 22 nt, Human
agaugccuucacuucacaauug

SEQ ID NO: 777616 - RNA, 22 nt, Human
agauggaagaacuugggcuggg

SEQ ID NO: 777617 - RNA, 19 nt, Human
agcaauccacccaucucag

SEQ ID NO: 777618 - RNA, 22 nt, Human
aggcugccccuccgucucugcc

SEQ ID NO: 777619 - RNA, 24 nt, Human
auggggucucgcuguguugcccag

SEQ ID NO: 777620 - RNA, 18 nt, Human
auuccauccucuccccuu

SEQ ID NO: 777621 - RNA, 23 nt, Human
auuccauccucuccccuuaccua

SEQ ID NO: 777622 - RNA, 24 nt, Human
caaaguguugggauuacagaugug

SEQ ID NO: 777623 - RNA, 18 nt, Human
caaauuacuaaaagccag

SEQ ID NO: 777624 - RNA, 18 nt, Human
caagcucuccccaccccu

SEQ ID NO: 777625 - RNA, 19 nt, Human
caagcucuccccaccccuu

SEQ ID NO: 777626 - RNA, 22 nt, Human
caauaggcccaaacuugauaac

SEQ ID NO: 777627 - RNA, 24 nt, Human
caauccacccaucucagccuccca

SEQ ID NO: 777628 - RNA, 22 nt, Human
cacccaucucagccucccaaag

SEQ ID NO: 777629 - RNA, 23 nt, Human
cacccaucucagccucccaaagu

SEQ ID NO: 777630 - RNA, 21 nt, Human
caccccuuacuaagugccccg

SEQ ID NO: 777631 - RNA, 18 nt, Human
cacuuggaguccuaggga

SEQ ID NO: 777632 - RNA, 21 nt, Human
cauccugucgcugcugcccgc

SEQ ID NO: 777633 - RNA, 24 nt, Human
caucucagccucccaaaguguugg

SEQ ID NO: 777634 - RNA, 24 nt, Human
cauggaccccgcgggccgcgggcc

SEQ ID NO: 777635 - RNA, 23 nt, Human
cauuaugguaauccucagcccag

SEQ ID NO: 777636 - RNA, 22 nt, Human
cauuccauccucuccccuuacc

SEQ ID NO: 777637 - RNA, 21 nt, Human
ccaaaguguugggauuacaga

SEQ ID NO: 777638 - RNA, 22 nt, Human
ccaaaguguugggauuacagau

SEQ ID NO: 777639 - RNA, 24 nt, Human
ccaaaguguugggauuacagaugu

SEQ ID NO: 777640 - RNA, 25 nt, Human
ccaauagcaacauuuugagguuuga

SEQ ID NO: 777641 - RNA, 19 nt, Human
ccacccaucucagccuccc

SEQ ID NO: 777642 - RNA, 20 nt, Human
cccaaagaggcugccccucc

SEQ ID NO: 777643 - RNA, 26 nt, Human
cccaauagcaacauuuugagguuuga

SEQ ID NO: 777644 - RNA, 22 nt, Human
cccaccccuuacuaagugcccc

SEQ ID NO: 777645 - RNA, 20 nt, Human
cccgcgccgcuccggggccg

SEQ ID NO: 777646 - RNA, 20 nt, Human
cccuccgucucugccgcccc

SEQ ID NO: 777647 - RNA, 22 nt, Human
cccuccgucucugccgccccuc

SEQ ID NO: 777648 - RNA, 24 nt, Human
cccugcgcauggaccccgcgggcc

SEQ ID NO: 777649 - RNA, 19 nt, Human
cccugcguagcuacuggau

SEQ ID NO: 777650 - RNA, 18 nt, Human
ccgccccucugcuuggca

SEQ ID NO: 777651 - RNA, 20 nt, Human
ccgugcagacuggcagccgc

SEQ ID NO: 777652 - RNA, 19 nt, Human
ccucccuucauccucuccu

SEQ ID NO: 777653 - RNA, 19 nt, Human
ccuccuggagcuccucccu

SEQ ID NO: 777654 - RNA, 24 nt, Human
ccugcuagggcucuucccucgccu

SEQ ID NO: 777655 - RNA, 23 nt, Human
ccugggcucaagcaauccaccca

SEQ ID NO: 777656 - RNA, 22 nt, Human
ccuguaauaacuuccagaugaa

SEQ ID NO: 777657 - RNA, 20 nt, Human
ccuguauugcugggcccagc

SEQ ID NO: 777658 - RNA, 21 nt, Human
cgaggagacugcccagggggc

SEQ ID NO: 777659 - RNA, 24 nt, Human
cgguuuuuuucagacaccagcagg

SEQ ID NO: 777660 - RNA, 20 nt, Human
cuaaaagaacacguuugaaa

SEQ ID NO: 777661 - RNA, 18 nt, Human
cuaaccccaauagcaaca

SEQ ID NO: 777662 - RNA, 21 nt, Human
cucaagcaauccacccaucuc

SEQ ID NO: 777663 - RNA, 25 nt, Human
cucagcccagccuccacccugcgua

SEQ ID NO: 777664 - RNA, 24 nt, Human
cuccagggauuccagggaaagagc

SEQ ID NO: 777665 - RNA, 21 nt, Human
cucccgggcuagaucaccggc

SEQ ID NO: 777666 - RNA, 20 nt, Human
cuccgucucugccgccccuc

SEQ ID NO: 777667 - RNA, 19 nt, Human
cuggucuugaacuccuggg

SEQ ID NO: 777668 - RNA, 19 nt, Human
cuucacaauugcauaccua

SEQ ID NO: 777669 - RNA, 25 nt, Human
gaaagagcauuaaaaagcauaaaga

SEQ ID NO: 777670 - RNA, 20 nt, Human
gaagaaagagaagucagagg

SEQ ID NO: 777671 - RNA, 20 nt, Human
gaagaacuugggcugggggc

SEQ ID NO: 777672 - RNA, 20 nt, Human
gaauauuuucugcuggugcc

SEQ ID NO: 777673 - RNA, 20 nt, Human
gaugaggggaauuauggaag

SEQ ID NO: 777674 - RNA, 23 nt, Human
gaugaggggaauuauggaaggga

SEQ ID NO: 777675 - RNA, 18 nt, Human
gauuacagaugugaggca

SEQ ID NO: 777676 - RNA, 18 nt, Human
gcccagccuccacccugc

SEQ ID NO: 777677 - RNA, 22 nt, Human
gcccugcgcauggaccccgcgg

SEQ ID NO: 777678 - RNA, 21 nt, Human
gcccugggcccgcugucucgc

SEQ ID NO: 777679 - RNA, 23 nt, Human
gcccuguaauaacuuccagauga

SEQ ID NO: 777680 - RNA, 22 nt, Human
gcucaagcaauccacccaucuc

SEQ ID NO: 777681 - RNA, 18 nt, Human
ggaaaggagaaaggaagg

SEQ ID NO: 777682 - RNA, 18 nt, Human
ggccgcaucggaagaugg

SEQ ID NO: 777683 - RNA, 20 nt, Human
ggccuucuaaccccaauagc

SEQ ID NO: 777684 - RNA, 19 nt, Human
ggcucaagcaauccaccca

SEQ ID NO: 777685 - RNA, 18 nt, Human
ggcuggucuugaacuccu

SEQ ID NO: 777686 - RNA, 22 nt, Human
gggucucgcuguguugcccagg

SEQ ID NO: 777687 - RNA, 22 nt, Human
gucucagaguuugcucuugauu

SEQ ID NO: 777688 - RNA, 24 nt, Human
uaaaagaacacguuugaaagagca

SEQ ID NO: 777689 - RNA, 20 nt, Human
uaaagaaagcagaugccuuc

SEQ ID NO: 777690 - RNA, 21 nt, Human
uaagaagggcaacucucagug

SEQ ID NO: 777691 - RNA, 20 nt, Human
uaagaugggcucccgggcua

SEQ ID NO: 777692 - RNA, 18 nt, Human
uacuaagugccccggaga

SEQ ID NO: 777693 - RNA, 26 nt, Human
uagggcucuucccucgccuccuggag

SEQ ID NO: 777694 - RNA, 22 nt, Human
uauuuuuuaagagauggggucu

SEQ ID NO: 777695 - RNA, 18 nt, Human
ucacgccuuccuuuuuuu

SEQ ID NO: 777696 - RNA, 21 nt, Human
ucagacaccagcaggugaacc

SEQ ID NO: 777697 - RNA, 21 nt, Human
uccacccaucucagccuccca

SEQ ID NO: 777698 - RNA, 31 nt, Human
ucccaaagaggcugccccuccgucucugccc

SEQ ID NO: 777699 - RNA, 18 nt, Human
ucccaaaguguugggauu

SEQ ID NO: 777700 - RNA, 23 nt, Human
ucccaaaguguugggauuacaga

SEQ ID NO: 777701 - RNA, 20 nt, Human
ucccaaauuacuaaaagcca

SEQ ID NO: 777702 - RNA, 22 nt, Human
ucccuucauccucuccuguauu

SEQ ID NO: 777703 - RNA, 20 nt, Human
ucccuugaccacucuucuag

SEQ ID NO: 777704 - RNA, 18 nt, Human
uccuggagcuccucccuu

SEQ ID NO: 777705 - RNA, 18 nt, Human
uccugggcucaagcaauc

SEQ ID NO: 777706 - RNA, 19 nt, Human
uccugggcucaagcaaucc

SEQ ID NO: 777707 - RNA, 18 nt, Human
uccugucgcugcugcccg

SEQ ID NO: 777708 - RNA, 24 nt, Human
ucuauggugacauccuguucuugg

SEQ ID NO: 777709 - RNA, 19 nt, Human
ucucgcuguguugcccagg

SEQ ID NO: 777710 - RNA, 23 nt, Human
ucucgcuguguugcccaggcugg

SEQ ID NO: 777711 - RNA, 24 nt, Human
ucucgcuguguugcccaggcuggu

SEQ ID NO: 777712 - RNA, 26 nt, Human
ucucgcuguguugcccaggcuggucu

SEQ ID NO: 777713 - RNA, 27 nt, Human
ucucgcuguguugcccaggcuggucuu

SEQ ID NO: 777714 - RNA, 19 nt, Human
ucuugaacuccugggcuca

SEQ ID NO: 777715 - RNA, 23 nt, Human
ucuugaacuccugggcucaagca

SEQ ID NO: 777716 - RNA, 18 nt, Human
ucuuggacucugauacug

SEQ ID NO: 777717 - RNA, 24 nt, Human
ugaacuccugggcucaagcaaucc

SEQ ID NO: 777718 - RNA, 19 nt, Human
ugaggcaccgcaccuggcc

SEQ ID NO: 777719 - RNA, 24 nt, Human
ugcccaggcuggucuugaacuccu

SEQ ID NO: 777720 - RNA, 28 nt, Human
ugcccaggcuggucuugaacuccugggc

SEQ ID NO: 777721 - RNA, 21 nt, Human
uggaagaacuugggcuggggg

SEQ ID NO: 777722 - RNA, 19 nt, Human
uggaagggagagggguucc

SEQ ID NO: 777723 - RNA, 22 nt, Human
uggaagggagagggguuccuca

SEQ ID NO: 777724 - RNA, 22 nt, Human
uggagugggcgguggaugaggg

SEQ ID NO: 777725 - RNA, 19 nt, Human
uggauugugccagucucag

SEQ ID NO: 777726 - RNA, 21 nt, Human
uggcagccgcgggccggcucg

SEQ ID NO: 777727 - RNA, 18 nt, Human
ugggauuacagaugugag

SEQ ID NO: 777728 - RNA, 18 nt, Human
ugggauuacagaugugag

SEQ ID NO: 777729 - RNA, 19 nt, Human
ugggauuacagaugugagg

SEQ ID NO: 777730 - RNA, 20 nt, Human
ugggauuacagaugugaggc

SEQ ID NO: 777731 - RNA, 21 nt, Human
ugggauuacagaugugaggca

SEQ ID NO: 777732 - RNA, 23 nt, Human
ugggauuacagaugugaggcacc

SEQ ID NO: 777733 - RNA, 24 nt, Human
ugggauuacagaugugaggcaccg

SEQ ID NO: 777734 - RNA, 25 nt, Human
ugggggcccugcgcaugggggacac

SEQ ID NO: 777735 - RNA, 24 nt, Human
uggggucucgcuguguugcccagg

SEQ ID NO: 777736 - RNA, 21 nt, Human
uguggaagaagaguaaagcug

SEQ ID NO: 777737 - RNA, 24 nt, Human
uguguugcccaggcuggucuugaa

SEQ ID NO: 777738 - RNA, 18 nt, Human
uguugcccaggcuggucu

SEQ ID NO: 777739 - RNA, 18 nt, Human
uguugcccaggcuggucu

SEQ ID NO: 777740 - RNA, 18 nt, Human
uguugcccaggcuggucu

SEQ ID NO: 777741 - RNA, 22 nt, Human
uguugcccaggcuggucuugaa

SEQ ID NO: 777742 - RNA, 22 nt, Human
uguugggauuacagaugugagg

SEQ ID NO: 777743 - RNA, 18 nt, Human
uugaccacucuucuagca

SEQ ID NO: 777744 - RNA, 24 nt, Human
uugugccagucucagaguuugcuc

SEQ ID NO: 777745 - RNA, 20 nt, Human
uuuaagagauggggucucgc

SEQ ID NO: 777746 - RNA, 21 nt, Human
uuugguagagcgaaaaacaag

SEQ ID NO: 777747 - RNA, 19 nt, Human
aagccaccccacccccccc

SEQ ID NO: 777748 - RNA, 21 nt, Human
aagccaccccaccccccccag

SEQ ID NO: 777749 - RNA, 18 nt, Human
aagcccaagaaagagcaa

SEQ ID NO: 777750 - RNA, 22 nt, Human
aagcccaagaaagagcaagaga

SEQ ID NO: 777751 - RNA, 21 nt, Human
acccuucuccccccuccaccu

SEQ ID NO: 777752 - RNA, 19 nt, Human
accuccccaagccccugcc

SEQ ID NO: 777753 - RNA, 25 nt, Human
acgccaaaugcccugcggagggaau

SEQ ID NO: 777754 - RNA, 26 nt, Human
agaaagagcaagagacaaaggguagu

SEQ ID NO: 777755 - RNA, 24 nt, Human
agacaaaggguagugggagcaggg

SEQ ID NO: 777756 - RNA, 23 nt, Human
agagaggggacccuucucccccc

SEQ ID NO: 777757 - RNA, 22 nt, Human
agcaaagaucuuggccugcagg

SEQ ID NO: 777758 - RNA, 18 nt, Human
agcaggggguggggcggg

SEQ ID NO: 777759 - RNA, 19 nt, Human
agcaggggguggggcgggg

SEQ ID NO: 777760 - RNA, 19 nt, Human
aggacacgguucuguccca

SEQ ID NO: 777761 - RNA, 23 nt, Human
aggagaccgauaaaaaauagaac

SEQ ID NO: 777762 - RNA, 27 nt, Human
aggggacccuucuccccccuccaccuc

SEQ ID NO: 777763 - RNA, 22 nt, Human
augggcagugggugggggccag

SEQ ID NO: 777764 - RNA, 26 nt, Human
augggggaugggcagugggugggggc

SEQ ID NO: 777765 - RNA, 19 nt, Human
caagagacaaaggguagug

SEQ ID NO: 777766 - RNA, 25 nt, Human
cacgguucugucccaauucucgguu

SEQ ID NO: 777767 - RNA, 22 nt, Human
cagcacagacacacccugaccc

SEQ ID NO: 777768 - RNA, 23 nt, Human
cagccauacauagacuuuuccua

SEQ ID NO: 777769 - RNA, 22 nt, Human
cauccagacaacaaugggggau

SEQ ID NO: 777770 - RNA, 19 nt, Human
ccaagccccugccccaggu

SEQ ID NO: 777771 - RNA, 20 nt, Human
cccaagaaagagcaagagac

SEQ ID NO: 777772 - RNA, 21 nt, Human
cccaagaaagagcaagagaca

SEQ ID NO: 777773 - RNA, 23 nt, Human
cccccagcucucugaagccaccc

SEQ ID NO: 777774 - RNA, 21 nt, Human
ccccccuccaccuccccaagc

SEQ ID NO: 777775 - RNA, 23 nt, Human
ccccccuccaccuccccaagccc

SEQ ID NO: 777776 - RNA, 22 nt, Human
ccccucacaagcuggggcgggg

SEQ ID NO: 777777 - RNA, 22 nt, Human
ccccugccccagguauguacaa

SEQ ID NO: 777778 - RNA, 22 nt, Human
cccggcgauggagcccaggugu

SEQ ID NO: 777779 - RNA, 21 nt, Human
cccuccaccuccccaagcccc

SEQ ID NO: 777780 - RNA, 23 nt, Human
cccuucuccccccuccaccuccc

SEQ ID NO: 777781 - RNA, 19 nt, Human
ccucacaagcuggggcggg

SEQ ID NO: 777782 - RNA, 27 nt, Human
ccugacccaugacccccuuuccccggc

SEQ ID NO: 777783 - RNA, 22 nt, Human
ccugcaggggggacuugggggg

SEQ ID NO: 777784 - RNA, 18 nt, Human
cuccaccuccccaagccc

SEQ ID NO: 777785 - RNA, 19 nt, Human
cuccccaagccccugcccc

SEQ ID NO: 777786 - RNA, 22 nt, Human
cucugaagccaccccacccccc

SEQ ID NO: 777787 - RNA, 22 nt, Human
cugaagccaccccacccccccc

SEQ ID NO: 777788 - RNA, 23 nt, Human
cugaagccaccccacccccccca

SEQ ID NO: 777789 - RNA, 23 nt, Human
gacacgguucugucccaauucuc

SEQ ID NO: 777790 - RNA, 20 nt, Human
gacccaugacccccuuuccc

SEQ ID NO: 777791 - RNA, 19 nt, Human
gacccuucuccccccucca

SEQ ID NO: 777792 - RNA, 18 nt, Human
gagaacggggaggagggg

SEQ ID NO: 777793 - RNA, 19 nt, Human
gagggggcgggggcugugg

SEQ ID NO: 777794 - RNA, 19 nt, Human
gcagcacagacacacccug

SEQ ID NO: 777795 - RNA, 18 nt, Human
gccccccucacaagcugg

SEQ ID NO: 777796 - RNA, 19 nt, Human
gcgagaacggggaggaggg

SEQ ID NO: 777797 - RNA, 22 nt, Human
ggaauggggagggaguggaggg

SEQ ID NO: 777798 - RNA, 23 nt, Human
ggacccuucuccccccuccaccu

SEQ ID NO: 777799 - RNA, 25 nt, Human
ggacccuucuccccccuccaccucc

SEQ ID NO: 777800 - RNA, 20 nt, Human
ggagggggcgggggcugugg

SEQ ID NO: 777801 - RNA, 20 nt, Human
ggcuguggagggggggucgg

SEQ ID NO: 777802 - RNA, 24 nt, Human
ggcuugggagagggggggagucgg

SEQ ID NO: 777803 - RNA, 25 nt, Human
gggaaggggucccccagcucucuga

SEQ ID NO: 777804 - RNA, 22 nt, Human
gggacuuggggggaaggggucc

SEQ ID NO: 777805 - RNA, 23 nt, Human
gggagcaggggguggggcggggg

SEQ ID NO: 777806 - RNA, 22 nt, Human
gggagggaguggagggggcuug

SEQ ID NO: 777807 - RNA, 24 nt, Human
gggagggaguggagggggcuuggg

SEQ ID NO: 777808 - RNA, 18 nt, Human
gggaugggcagugggugg

SEQ ID NO: 777809 - RNA, 22 nt, Human
gggcgagaacggggaggagggg

SEQ ID NO: 777810 - RNA, 23 nt, Human
gggcgggggcuguggcuguggaa

SEQ ID NO: 777811 - RNA, 22 nt, Human
gggcuugggagagggggggagu

SEQ ID NO: 777812 - RNA, 19 nt, Human
ggggaugggcagugggugg

SEQ ID NO: 777813 - RNA, 22 nt, Human
ggggaugggcaguggguggggg

SEQ ID NO: 777814 - RNA, 21 nt, Human
ggggcgggggcuguggcugug

SEQ ID NO: 777815 - RNA, 20 nt, Human
gggggaugggcagugggugg

SEQ ID NO: 777816 - RNA, 23 nt, Human
gggggcgagaacggggaggaggg

SEQ ID NO: 777817 - RNA, 19 nt, Human
gggggcuguggcuguggag

SEQ ID NO: 777818 - RNA, 23 nt, Human
ggggggaaggggucccccagcuc

SEQ ID NO: 777819 - RNA, 20 nt, Human
gggggucggggcaaggggag

SEQ ID NO: 777820 - RNA, 19 nt, Human
ggguagugggagcaggggg

SEQ ID NO: 777821 - RNA, 19 nt, Human
gguuguguguacacagugu

SEQ ID NO: 777822 - RNA, 23 nt, Human
guagugggagcaggggguggggc

SEQ ID NO: 777823 - RNA, 23 nt, Human
uaaaaaauagaaccacauccaga

SEQ ID NO: 777824 - RNA, 23 nt, Human
uagaaaaggagugggaggggcag

SEQ ID NO: 777825 - RNA, 22 nt, Human
uagacauuuauacauauauaua

SEQ ID NO: 777826 - RNA, 25 nt, Human
ucgccguagaaaaggagugggaggg

SEQ ID NO: 777827 - RNA, 18 nt, Human
ugaagccaccccaccccc

SEQ ID NO: 777828 - RNA, 22 nt, Human
ugaagccaccccacccccccca

SEQ ID NO: 777829 - RNA, 22 nt, Human
ugacccaugacccccuuucccc

SEQ ID NO: 777830 - RNA, 23 nt, Human
ugcccuggagggggcagcacaga

SEQ ID NO: 777831 - RNA, 24 nt, Human
uggagggggcuugggagagggggg

SEQ ID NO: 777832 - RNA, 20 nt, Human
uggccugcaggggggacuug

SEQ ID NO: 777833 - RNA, 22 nt, Human
ugggagcaggggguggggcggg

SEQ ID NO: 777834 - RNA, 21 nt, Human
ugggcagugggugggggccag

SEQ ID NO: 777835 - RNA, 20 nt, Human
uggggagggaguggaggggg

SEQ ID NO: 777836 - RNA, 22 nt, Human
uggggagggaguggagggggcu

SEQ ID NO: 777837 - RNA, 24 nt, Human
ugggggaugggcaguggguggggg

SEQ ID NO: 777838 - RNA, 22 nt, Human
uguggcuguggagggggggucg

SEQ ID NO: 777839 - RNA, 18 nt, Human
uguguguacacaguguau

SEQ ID NO: 777840 - RNA, 24 nt, Human
uucauggaggaggcgccccccucu

SEQ ID NO: 777841 - RNA, 24 nt, Human
uugggagagggggggagucggacu

SEQ ID NO: 777842 - RNA, 21 nt, Human
aaaaaaaauugaaccuucagu

SEQ ID NO: 777843 - RNA, 21 nt, Human
aaaaaaacuuucuugugguac

SEQ ID NO: 777844 - RNA, 21 nt, Human
aaaaaacuuucuugugguacu

SEQ ID NO: 777845 - RNA, 20 nt, Human
aaaaacauacuuucuuggcc

SEQ ID NO: 777846 - RNA, 22 nt, Human
aaaaagucuccuugcugccuuu

SEQ ID NO: 777847 - RNA, 19 nt, Human
aaaaauacaaacaugauua

SEQ ID NO: 777848 - RNA, 23 nt, Human
aaaacaaacaaacaaaaaaacca

SEQ ID NO: 777849 - RNA, 23 nt, Human
aaaacaaacuguuuuaaacaaaa

SEQ ID NO: 777850 - RNA, 22 nt, Human
aaaaccaaccaaacaaaaaaac

SEQ ID NO: 777851 - RNA, 21 nt, Human
aaacaaaaaaaccaaccaaac

SEQ ID NO: 777852 - RNA, 22 nt, Human
aaacaaacaaaaaaaccaacca

SEQ ID NO: 777853 - RNA, 21 nt, Human
aaacaaacaaacaaaaaaacc

SEQ ID NO: 777854 - RNA, 21 nt, Human
aaacaggcacacaaaaugguc

SEQ ID NO: 777855 - RNA, 26 nt, Human
aaacaugauuauauauauauacacac

SEQ ID NO: 777856 - RNA, 26 nt, Human
aaauaaacacaauaaagaaggaaugu

SEQ ID NO: 777857 - RNA, 23 nt, Human
aacaaaaaaaccaaccaaacaaa

SEQ ID NO: 777858 - RNA, 23 nt, Human
aacaaacaaaaaaaccaaccaaa

SEQ ID NO: 777859 - RNA, 20 nt, Human
aacaugaugaaaccccgccu

SEQ ID NO: 777860 - RNA, 19 nt, Human
aaccuaaagccauguagac

SEQ ID NO: 777861 - RNA, 24 nt, Human
aacuugggcaacagggagagacuc

SEQ ID NO: 777862 - RNA, 21 nt, Human
aagaaaaaaacaaacaaacaa

SEQ ID NO: 777863 - RNA, 24 nt, Human
aagcgaaaaugcgaaacagcuuuc

SEQ ID NO: 777864 - RNA, 21 nt, Human
acaaaaacccuaaaaugggca

SEQ ID NO: 777865 - RNA, 25 nt, Human
acaauaaagaaggaauguucccaga

SEQ ID NO: 777866 - RNA, 23 nt, Human
acauccccaccccaccucuaaaa

SEQ ID NO: 777867 - RNA, 24 nt, Human
acauccccaccccaccucuaaaac

SEQ ID NO: 777868 - RNA, 19 nt, Human
accgcuugagaaagcauuc

SEQ ID NO: 777869 - RNA, 24 nt, Human
accggggagguggaggcugcagug

SEQ ID NO: 777870 - RNA, 18 nt, Human
accugaaaacaacgaaaa

SEQ ID NO: 777871 - RNA, 19 nt, Human
acgaaaaaaaggcucccau

SEQ ID NO: 777872 - RNA, 19 nt, Human
acucaggcuuaagcacauc

SEQ ID NO: 777873 - RNA, 22 nt, Human
acuuucuuggccgggcgcagug

SEQ ID NO: 777874 - RNA, 22 nt, Human
agaaaaaaacaaacaaacaaaa

SEQ ID NO: 777875 - RNA, 24 nt, Human
agaaaaaaacaaacaaacaaaaaa

SEQ ID NO: 777876 - RNA, 27 nt, Human
agaaaaagaggcauaggacuuaacaaa

SEQ ID NO: 777877 - RNA, 23 nt, Human
agaaacaggcacacaaaaugguc

SEQ ID NO: 777878 - RNA, 22 nt, Human
agaaucgcuggaaccggggagg

SEQ ID NO: 777879 - RNA, 24 nt, Human
agacggaucaugagaucaggaguu

SEQ ID NO: 777880 - RNA, 18 nt, Human
agaucaggaguucgagac

SEQ ID NO: 777881 - RNA, 24 nt, Human
agccuggccaacaugaugaaaccc

SEQ ID NO: 777882 - RNA, 21 nt, Human
aggaaaaaaauacaaacauga

SEQ ID NO: 777883 - RNA, 24 nt, Human
aggcagacggaucaugagaucagg

SEQ ID NO: 777884 - RNA, 22 nt, Human
aggcaggagaaucgcuggaacc

SEQ ID NO: 777885 - RNA, 23 nt, Human
aggcaggagaaucgcuggaaccg

SEQ ID NO: 777886 - RNA, 20 nt, Human
aggccgaggcagacggauca

SEQ ID NO: 777887 - RNA, 25 nt, Human
aggccgaggcagacggaucaugaga

SEQ ID NO: 777888 - RNA, 20 nt, Human
aggcugaggcaggagaaucg

SEQ ID NO: 777889 - RNA, 22 nt, Human
aggcugaggcaggagaaucgcu

SEQ ID NO: 777890 - RNA, 19 nt, Human
agguggaggcugcagugag

SEQ ID NO: 777891 - RNA, 24 nt, Human
agguggaggcugcagugagccaag

SEQ ID NO: 777892 - RNA, 24 nt, Human
aggugugguggcgggcgccuguaa

SEQ ID NO: 777893 - RNA, 23 nt, Human
aguggcucaugccuguaauccca

SEQ ID NO: 777894 - RNA, 24 nt, Human
aguggcucaugccuguaaucccag

SEQ ID NO: 777895 - RNA, 22 nt, Human
auagguaauacaaaugcacuua

SEQ ID NO: 777896 - RNA, 21 nt, Human
augaaaccccgccucuacuaa

SEQ ID NO: 777897 - RNA, 19 nt, Human
augccuguaaucccagcac

SEQ ID NO: 777898 - RNA, 20 nt, Human
auguacaccugauuaaaaug

SEQ ID NO: 777899 - RNA, 23 nt, Human
auugcacuccaacuugggcaaca

SEQ ID NO: 777900 - RNA, 24 nt, Human
auugcacuccaacuugggcaacag

SEQ ID NO: 777901 - RNA, 21 nt, Human
caaaaacccuaaaaugggcac

SEQ ID NO: 777902 - RNA, 23 nt, Human
caaaaagcgaaaaugcgaaacag

SEQ ID NO: 777903 - RNA, 22 nt, Human
caaaaugugagauauaagcaua

SEQ ID NO: 777904 - RNA, 23 nt, Human
caaacaaacaaaaaaaccaacca

SEQ ID NO: 777905 - RNA, 23 nt, Human
cacaaaaacccuaaaaugggcac

SEQ ID NO: 777906 - RNA, 24 nt, Human
cacaaaaacccuaaaaugggcacc

SEQ ID NO: 777907 - RNA, 25 nt, Human
cacaaauauaaccaaaaugugagau

SEQ ID NO: 777908 - RNA, 25 nt, Human
cacaucgucugccuucagcugaugc

SEQ ID NO: 777909 - RNA, 23 nt, Human
caccuaguaaccaaagauuucau

SEQ ID NO: 777910 - RNA, 19 nt, Human
cagaaucccaaacucagga

SEQ ID NO: 777911 - RNA, 18 nt, Human
cagcacucugggaggccg

SEQ ID NO: 777912 - RNA, 24 nt, Human
cagcacucugggaggccgaggcag

SEQ ID NO: 777913 - RNA, 24 nt, Human
cagcuauucaagaggcugaggcag

SEQ ID NO: 777914 - RNA, 19 nt, Human
cagggagagacucagucuc

SEQ ID NO: 777915 - RNA, 21 nt, Human
cagggccaggaucaaguuggu

SEQ ID NO: 777916 - RNA, 21 nt, Human
cauccccaccccaccucuaaa

SEQ ID NO: 777917 - RNA, 19 nt, Human
caugaagacacucagcaug

SEQ ID NO: 777918 - RNA, 20 nt, Human
caugccuguaaucccagcac

SEQ ID NO: 777919 - RNA, 21 nt, Human
cauguagaccuuuuauacagu

SEQ ID NO: 777920 - RNA, 23 nt, Human
caugugcuacaguacaauccggg

SEQ ID NO: 777921 - RNA, 25 nt, Human
ccugcagccaaugacuccucagggc

SEQ ID NO: 777922 - RNA, 23 nt, Human
ccuggccaacaugaugaaacccc

SEQ ID NO: 777923 - RNA, 24 nt, Human
ccuggccaacaugaugaaaccccg

SEQ ID NO: 777924 - RNA, 20 nt, Human
ccuguaaucccagcacucug

SEQ ID NO: 777925 - RNA, 22 nt, Human
ccuguaaucccagcacucuggg

SEQ ID NO: 777926 - RNA, 21 nt, Human
cgagaccagccuggccaacau

SEQ ID NO: 777927 - RNA, 24 nt, Human
cgaggcagacggaucaugagauca

SEQ ID NO: 777928 - RNA, 22 nt, Human
cgccuguaaucccagcuauuca

SEQ ID NO: 777929 - RNA, 22 nt, Human
cggaucaugagaucaggaguuc

SEQ ID NO: 777930 - RNA, 23 nt, Human
cggaucaugagaucaggaguucg

SEQ ID NO: 777931 - RNA, 23 nt, Human
cucaugccuguaaucccagcacu

SEQ ID NO: 777932 - RNA, 22 nt, Human
cugcagugagccaagauugcac

SEQ ID NO: 777933 - RNA, 24 nt, Human
cuuggccgggcgcaguggcucaug

SEQ ID NO: 777934 - RNA, 22 nt, Human
gaaaaaaacaaacaaacaaaaa

SEQ ID NO: 777935 - RNA, 18 nt, Human
gaaacuaguaagaacuug

SEQ ID NO: 777936 - RNA, 19 nt, Human
gaaacuaguaagaacuuga

SEQ ID NO: 777937 - RNA, 18 nt, Human
gagaagcaagaaacuugg

SEQ ID NO: 777938 - RNA, 23 nt, Human
gaggcugcagugagccaagauug

SEQ ID NO: 777939 - RNA, 19 nt, Human
gagggcaggaacgccuggc

SEQ ID NO: 777940 - RNA, 21 nt, Human
gagguggaggcugcagugagc

SEQ ID NO: 777941 - RNA, 22 nt, Human
gaucaugagaucaggaguucga

SEQ ID NO: 777942 - RNA, 24 nt, Human
gaucaugagaucaggaguucgaga

SEQ ID NO: 777943 - RNA, 23 nt, Human
gauugcacuccaacuugggcaac

SEQ ID NO: 777944 - RNA, 24 nt, Human
gauugcacuccaacuugggcaaca

SEQ ID NO: 777945 - RNA, 22 nt, Human
gcaucgucagccauuuccaaaa

SEQ ID NO: 777946 - RNA, 24 nt, Human
gccaacaugaugaaaccccgccuc

SEQ ID NO: 777947 - RNA, 20 nt, Human
ggagaagcaagaaacuuggg

SEQ ID NO: 777948 - RNA, 22 nt, Human
ggaggcugcagugagccaagau

SEQ ID NO: 777949 - RNA, 24 nt, Human
ggaggcugcagugagccaagauug

SEQ ID NO: 777950 - RNA, 24 nt, Human
ggccgaggcagacggaucaugaga

SEQ ID NO: 777951 - RNA, 24 nt, Human
ggccuucuggauaacaggaaagga

SEQ ID NO: 777952 - RNA, 24 nt, Human
gggcgcaguggcucaugccuguaa

SEQ ID NO: 777953 - RNA, 24 nt, Human
gguggcgggcgccuguaaucccag

SEQ ID NO: 777954 - RNA, 24 nt, Human
guaauuucugagagucagacagaa

SEQ ID NO: 777955 - RNA, 21 nt, Human
guacauauaacuuuuccucgu

SEQ ID NO: 777956 - RNA, 19 nt, Human
gucagccauuuccaaaagu

SEQ ID NO: 777957 - RNA, 23 nt, Human
guggcgggcgccuguaaucccag

SEQ ID NO: 777958 - RNA, 22 nt, Human
guuaaaagucuaaaaacuuuca

SEQ ID NO: 777959 - RNA, 22 nt, Human
uaaaacaaacuguuuuaaacaa

SEQ ID NO: 777960 - RNA, 21 nt, Human
uaaaaugagaauacaaaggcc

SEQ ID NO: 777961 - RNA, 22 nt, Human
uaaaaugagaauacaaaggcca

SEQ ID NO: 777962 - RNA, 21 nt, Human
uaagaaguugauucaagcagu

SEQ ID NO: 777963 - RNA, 27 nt, Human
uaauacaaaugcacuuacacacaccuc

SEQ ID NO: 777964 - RNA, 25 nt, Human
uaauuucugagagucagacagaaca

SEQ ID NO: 777965 - RNA, 23 nt, Human
uacaguaucacaaugaaauguga

SEQ ID NO: 777966 - RNA, 25 nt, Human
uacaugaaacaugaagacacucagc

SEQ ID NO: 777967 - RNA, 21 nt, Human
uagcacaaaaacccuaaaaug

SEQ ID NO: 777968 - RNA, 22 nt, Human
uauauuagaaacaugaugagca

SEQ ID NO: 777969 - RNA, 22 nt, Human
uauauuauuguaucuuuuaaaa

SEQ ID NO: 777970 - RNA, 24 nt, Human
uaugagaagaauacuuuggagaag

SEQ ID NO: 777971 - RNA, 24 nt, Human
uauugaccuugguuuucucuaagc

SEQ ID NO: 777972 - RNA, 19 nt, Human
ucaaaaugacauaaaagaa

SEQ ID NO: 777973 - RNA, 24 nt, Human
ucagacagaacaauaauaugaacc

SEQ ID NO: 777974 - RNA, 26 nt, Human
ucaggaaaaaaauacaaacaugauua

SEQ ID NO: 777975 - RNA, 18 nt, Human
ucauaaggaguuagauca

SEQ ID NO: 777976 - RNA, 20 nt, Human
ucaugagaucaggaguucga

SEQ ID NO: 777977 - RNA, 24 nt, Human
ucaugagaucaggaguucgagacc

SEQ ID NO: 777978 - RNA, 22 nt, Human
ucaugccuguaaucccagcacu

SEQ ID NO: 777979 - RNA, 22 nt, Human
uccaaaaguugugcuguaaaag

SEQ ID NO: 777980 - RNA, 18 nt, Human
ucccagaccaugcuauuc

SEQ ID NO: 777981 - RNA, 22 nt, Human
ucguuauauacauccccacccc

SEQ ID NO: 777982 - RNA, 18 nt, Human
ucuaggccuuguccagga

SEQ ID NO: 777983 - RNA, 21 nt, Human
ucucuaagccaguaaggaaau

SEQ ID NO: 777984 - RNA, 19 nt, Human
ucugcguacagaaaauggg

SEQ ID NO: 777985 - RNA, 21 nt, Human
ucuuugauuuugcuuuuuauu

SEQ ID NO: 777986 - RNA, 18 nt, Human
ugaaaacaacgaaaaaaa

SEQ ID NO: 777987 - RNA, 21 nt, Human
ugaaaacaacgaaaaaaaggc

SEQ ID NO: 777988 - RNA, 24 nt, Human
ugaaaacaacgaaaaaaaggcucc

SEQ ID NO: 777989 - RNA, 23 nt, Human
ugaagacacucagcaugagaaaa

SEQ ID NO: 777990 - RNA, 22 nt, Human
ugaccuugguuuucucuaagcc

SEQ ID NO: 777991 - RNA, 18 nt, Human
ugagaagaauacuuugga

SEQ ID NO: 777992 - RNA, 19 nt, Human
ugagaagaauacuuuggag

SEQ ID NO: 777993 - RNA, 22 nt, Human
ugagauauaagcauaauucuuu

SEQ ID NO: 777994 - RNA, 19 nt, Human
ugaggcaggagaaucgcug

SEQ ID NO: 777995 - RNA, 24 nt, Human
ugaggcaggagaaucgcuggaacc

SEQ ID NO: 777996 - RNA, 26 nt, Human
ugaugagcagcucguucucuaggccg

SEQ ID NO: 777997 - RNA, 22 nt, Human
ugauuuugcuuuuuauucaaug

SEQ ID NO: 777998 - RNA, 23 nt, Human
ugcaacaagacacuggcgugaag

SEQ ID NO: 777999 - RNA, 22 nt, Human
ugcacuccaacuugggcaacag

SEQ ID NO: 778000 - RNA, 22 nt, Human
ugcacuccaacuugggcaacag

SEQ ID NO: 778001 - RNA, 19 nt, Human
ugcaucgucagccauuucc

SEQ ID NO: 778002 - RNA, 23 nt, Human
ugccuguaaucccagcacucugg

SEQ ID NO: 778003 - RNA, 23 nt, Human
ugccuguaaucccagcacucugg

SEQ ID NO: 778004 - RNA, 24 nt, Human
ugcgaaacagcuuuccugggacaa

SEQ ID NO: 778005 - RNA, 24 nt, Human
ugcuagucugugcagcgccuuccg

SEQ ID NO: 778006 - RNA, 22 nt, Human
uggaaaggauaaauuuaaagug

SEQ ID NO: 778007 - RNA, 24 nt, Human
uggccgggcgcaguggcucaugcc

SEQ ID NO: 778008 - RNA, 22 nt, Human
uggcucaugccuguaaucccag

SEQ ID NO: 778009 - RNA, 24 nt, Human
uggcucaugccuguaaucccagca

SEQ ID NO: 778010 - RNA, 20 nt, Human
ugggaggccgaggcagacgg

SEQ ID NO: 778011 - RNA, 24 nt, Human
ugggaggccgaggcagacggauca

SEQ ID NO: 778012 - RNA, 24 nt, Human
ugguggcgggcgccuguaauccca

SEQ ID NO: 778013 - RNA, 23 nt, Human
uguaaaagaaaguauauuuuaca

SEQ ID NO: 778014 - RNA, 21 nt, Human
ugugaaaaagucuccuugcug

SEQ ID NO: 778015 - RNA, 19 nt, Human
ugugguggcgggcgccugu

SEQ ID NO: 778016 - RNA, 25 nt, Human
uucaggaaaaaaauacaaacaugau

SEQ ID NO: 778017 - RNA, 23 nt, Human
uugauucaagcaguuauuaugaa

SEQ ID NO: 778018 - RNA, 24 nt, Human
uugggauguggaacuuugguuaca

SEQ ID NO: 778019 - RNA, 18 nt, Human
uuugguuacagcugaugg

SEQ ID NO: 778020 - RNA, 23 nt, Human
aaaauacgaaaacaaaauuagcc

SEQ ID NO: 778021 - RNA, 23 nt, Human
aaaauagcauuaucaaaauggca

SEQ ID NO: 778022 - RNA, 18 nt, Human
aaagcagcacaguguaac

SEQ ID NO: 778023 - RNA, 19 nt, Human
aaaggacaagaagcuacau

SEQ ID NO: 778024 - RNA, 19 nt, Human
aacauggugaaaccccguc

SEQ ID NO: 778025 - RNA, 20 nt, Human
aacauggugaaaccccgucu

SEQ ID NO: 778026 - RNA, 21 nt, Human
aacauggugaaaccccgucuc

SEQ ID NO: 778027 - RNA, 21 nt, Human
aacuaacuucuagugaaccua

SEQ ID NO: 778028 - RNA, 21 nt, Human
aagagaaagacagagaaagga

SEQ ID NO: 778029 - RNA, 24 nt, Human
aauaaaugcugaugcuccacacaa

SEQ ID NO: 778030 - RNA, 18 nt, Human
acacagugauaacuacuc

SEQ ID NO: 778031 - RNA, 25 nt, Human
acagaacuuuguuguuaacugugga

SEQ ID NO: 778032 - RNA, 21 nt, Human
acagagcgagacucugucuca

SEQ ID NO: 778033 - RNA, 23 nt, Human
acagagcgagacucugucucaaa

SEQ ID NO: 778034 - RNA, 24 nt, Human
acagagcgagacucugucucaaaa

SEQ ID NO: 778035 - RNA, 30 nt, Human
acagguucacugugaaaaaaaggaagggaa

SEQ ID NO: 778036 - RNA, 24 nt, Human
acaguaaaaagaucacuacauaga

SEQ ID NO: 778037 - RNA, 21 nt, Human
acccaaggagaaagcaucagg

SEQ ID NO: 778038 - RNA, 22 nt, Human
accccgucucuacuaaaaauac

SEQ ID NO: 778039 - RNA, 28 nt, Human
acucugucucaaaaaaaaaaaaaaaaaa

SEQ ID NO: 778040 - RNA, 18 nt, Human
acugcacuccaaucuggg

SEQ ID NO: 778041 - RNA, 24 nt, Human
acugcacuccaaucuggguaacag

SEQ ID NO: 778042 - RNA, 23 nt, Human
acuuauuuugcuuaauacaagug

SEQ ID NO: 778043 - RNA, 19 nt, Human
agaggaaaugcuggguuuc

SEQ ID NO: 778044 - RNA, 22 nt, Human
agcggaaaguucauuucucugu

SEQ ID NO: 778045 - RNA, 23 nt, Human
agcucugacaccucacuaccucu

SEQ ID NO: 778046 - RNA, 23 nt, Human
agcuuuugggaggcugaggcggg

SEQ ID NO: 778047 - RNA, 23 nt, Human
aggcauuuaaaaagaacuuaauc

SEQ ID NO: 778048 - RNA, 24 nt, Human
aggcggagcuugcagugagcggag

SEQ ID NO: 778049 - RNA, 24 nt, Human
aggcgggagaguggcgugaacccg

SEQ ID NO: 778050 - RNA, 24 nt, Human
aggcgggcggaucacgaggucagg

SEQ ID NO: 778051 - RNA, 21 nt, Human
aggcugaggcgggcggaucac

SEQ ID NO: 778052 - RNA, 22 nt, Human
aggcugaggcgggcggaucacg

SEQ ID NO: 778053 - RNA, 21 nt, Human
agggagcuuuguguaagugcu

SEQ ID NO: 778054 - RNA, 18 nt, Human
agucccagcuagucggga

SEQ ID NO: 778055 - RNA, 22 nt, Human
aucaacaaaacccagcaccaag

SEQ ID NO: 778056 - RNA, 19 nt, Human
aucccucucauccucuuuc

SEQ ID NO: 778057 - RNA, 21 nt, Human
auccuggccaacauggugaaa

SEQ ID NO: 778058 - RNA, 24 nt, Human
aucgcgccacugcacuccaaucug

SEQ ID NO: 778059 - RNA, 21 nt, Human
augcaaaauuuagcauguaau

SEQ ID NO: 778060 - RNA, 23 nt, Human
augcuggguuucugggugcuggc

SEQ ID NO: 778061 - RNA, 18 nt, Human
auuaaggaacuggcucug

SEQ ID NO: 778062 - RNA, 20 nt, Human
auugcacucuugcuuugggc

SEQ ID NO: 778063 - RNA, 24 nt, Human
auuuagcauguaauuguacugugu

SEQ ID NO: 778064 - RNA, 22 nt, Human
caaaagaaaaagaccguguggc

SEQ ID NO: 778065 - RNA, 18 nt, Human
caaaauggcaaaggcaca

SEQ ID NO: 778066 - RNA, 25 nt, Human
caaagcagcacaguguaacagaggc

SEQ ID NO: 778067 - RNA, 24 nt, Human
caacauggugaaaccccgucucua

SEQ ID NO: 778068 - RNA, 24 nt, Human
caagaccauccuggccaacauggu

SEQ ID NO: 778069 - RNA, 18 nt, Human
cacagcugaccaucccuc

SEQ ID NO: 778070 - RNA, 21 nt, Human
cacaguaguauugggacaaga

SEQ ID NO: 778071 - RNA, 23 nt, Human
cacgccuguaaucccagcuuuug

SEQ ID NO: 778072 - RNA, 23 nt, Human
cacuccaaucuggguaacagagc

SEQ ID NO: 778073 - RNA, 23 nt, Human
cacugcacuccaaucuggguaac

SEQ ID NO: 778074 - RNA, 24 nt, Human
cacugcacuccaaucuggguaaca

SEQ ID NO: 778075 - RNA, 19 nt, Human
cagcaucaacaaaacccag

SEQ ID NO: 778076 - RNA, 21 nt, Human
cagcaucaacaaaacccagca

SEQ ID NO: 778077 - RNA, 22 nt, Human
cagcaucaacaaaacccagcac

SEQ ID NO: 778078 - RNA, 21 nt, Human
cagcuaaucuaccaggaguac

SEQ ID NO: 778079 - RNA, 21 nt, Human
cagcuuuugggaggcugaggc

SEQ ID NO: 778080 - RNA, 20 nt, Human
ccacugcacuccaaucuggg

SEQ ID NO: 778081 - RNA, 24 nt, Human
ccacugcacuccaaucuggguaac

SEQ ID NO: 778082 - RNA, 18 nt, Human
ccagaggaguaagauaau

SEQ ID NO: 778083 - RNA, 23 nt, Human
ccagcaccaaguguuuugguggc

SEQ ID NO: 778084 - RNA, 20 nt, Human
ccagcaucaacaaaacccag

SEQ ID NO: 778085 - RNA, 24 nt, Human
ccagcaucaacaaaacccagcacc

SEQ ID NO: 778086 - RNA, 24 nt, Human
ccagcuuuugggaggcugaggcgg

SEQ ID NO: 778087 - RNA, 18 nt, Human
ccagggacacagggaaga

SEQ ID NO: 778088 - RNA, 24 nt, Human
ccaucccucucauccucuuucuca

SEQ ID NO: 778089 - RNA, 23 nt, Human
ccccugagggguagugguuucug

SEQ ID NO: 778090 - RNA, 19 nt, Human
ccucucauccucuuucuca

SEQ ID NO: 778091 - RNA, 22 nt, Human
ccuggccaacauggugaaaccc

SEQ ID NO: 778092 - RNA, 23 nt, Human
ccuggccaacauggugaaacccc

SEQ ID NO: 778093 - RNA, 24 nt, Human
ccuggccaacauggugaaaccccg

SEQ ID NO: 778094 - RNA, 21 nt, Human
ccuguaaucccagcuuuuggg

SEQ ID NO: 778095 - RNA, 19 nt, Human
ccuguagucccagcuaguc

SEQ ID NO: 778096 - RNA, 21 nt, Human
ccuguagucccagcuagucgg

SEQ ID NO: 778097 - RNA, 21 nt, Human
cgaaaacaaaauuagccgggc

SEQ ID NO: 778098 - RNA, 22 nt, Human
cgccuguaaucccagcuuuugg

SEQ ID NO: 778099 - RNA, 24 nt, Human
cgccuguagucccagcuagucggg

SEQ ID NO: 778100 - RNA, 21 nt, Human
cuacaaaagaaaaagaccgug

SEQ ID NO: 778101 - RNA, 23 nt, Human
cucaaaaaaaaaaaaaaaaaaaa

SEQ ID NO: 778102 - RNA, 20 nt, Human
cucacgccuguaaucccagc

SEQ ID NO: 778103 - RNA, 20 nt, Human
cucacgccuguaaucccagc

SEQ ID NO: 778104 - RNA, 20 nt, Human
cuccaccuuaaugcuggaac

SEQ ID NO: 778105 - RNA, 19 nt, Human
cucugucucaaaaaaaaaa

SEQ ID NO: 778106 - RNA, 25 nt, Human
cugaggcgggagaguggcgugaacc

SEQ ID NO: 778107 - RNA, 19 nt, Human
cugaugcuuggccgggcgc

SEQ ID NO: 778108 - RNA, 23 nt, Human
cugauuuacucacuuaaagcuuc

SEQ ID NO: 778109 - RNA, 21 nt, Human
cuggguaacagagcgagacuc

SEQ ID NO: 778110 - RNA, 25 nt, Human
cugugaaaaaaaggaagggaggugu

SEQ ID NO: 778111 - RNA, 21 nt, Human
cuguuuaagcaaagcagcaca

SEQ ID NO: 778112 - RNA, 18 nt, Human
cuuaauaaauucuuaguu

SEQ ID NO: 778113 - RNA, 21 nt, Human
cuugcagugagcggagaucgc

SEQ ID NO: 778114 - RNA, 24 nt, Human
cuuggccgggcgcgguggcucacg

SEQ ID NO: 778115 - RNA, 19 nt, Human
cuuuguguaagugcucugc

SEQ ID NO: 778116 - RNA, 21 nt, Human
gagaaaaugcaaaauuuagca

SEQ ID NO: 778117 - RNA, 24 nt, Human
gauggcgggcgccuguagucccag

SEQ ID NO: 778118 - RNA, 20 nt, Human
gcaaagacagcugaggggaa

SEQ ID NO: 778119 - RNA, 24 nt, Human
gcaaagcagcacaguguaacagag

SEQ ID NO: 778120 - RNA, 24 nt, Human
gccaacauggugaaaccccgucuc

SEQ ID NO: 778121 - RNA, 21 nt, Human
gccacugcacuccaaucuggg

SEQ ID NO: 778122 - RNA, 20 nt, Human
gcggagaucgcgccacugca

SEQ ID NO: 778123 - RNA, 23 nt, Human
gcugugcagaaauuuucuuggag

SEQ ID NO: 778124 - RNA, 24 nt, Human
gcuuugggcuaaaaccuugugaag

SEQ ID NO: 778125 - RNA, 25 nt, Human
gcuuuuggcaucuguagaacucuaa

SEQ ID NO: 778126 - RNA, 20 nt, Human
ggaaaggacaagaagcuaca

SEQ ID NO: 778127 - RNA, 23 nt, Human
ggagaucgcgccacugcacucca

SEQ ID NO: 778128 - RNA, 18 nt, Human
ggagcuugcagugagcgg

SEQ ID NO: 778129 - RNA, 24 nt, Human
ggagcuugcagugagcggagaucg

SEQ ID NO: 778130 - RNA, 20 nt, Human
ggaguucuccaccuuaaugc

SEQ ID NO: 778131 - RNA, 23 nt, Human
ggcgcgguggcucacgccuguaa

SEQ ID NO: 778132 - RNA, 18 nt, Human
ggcgugauggcgggcgcc

SEQ ID NO: 778133 - RNA, 22 nt, Human
ggcgugauggcgggcgccugua

SEQ ID NO: 778134 - RNA, 20 nt, Human
gggacaagaagcaaaacauu

SEQ ID NO: 778135 - RNA, 19 nt, Human
gggcagcaccccacucaga

SEQ ID NO: 778136 - RNA, 24 nt, Human
gggcggaucacgaggucaggagau

SEQ ID NO: 778137 - RNA, 23 nt, Human
gguggcucacgccuguaauccca

SEQ ID NO: 778138 - RNA, 24 nt, Human
gguggcucacgccuguaaucccag

SEQ ID NO: 778139 - RNA, 20 nt, Human
gugcucgcuacagccaggcc

SEQ ID NO: 778140 - RNA, 23 nt, Human
guggcucacgccuguaaucccag

SEQ ID NO: 778141 - RNA, 18 nt, Human
uaaaaaagggaagggagg

SEQ ID NO: 778142 - RNA, 26 nt, Human
uaaaaauacgaaaacaaaauuagccg

SEQ ID NO: 778143 - RNA, 20 nt, Human
uaaaauaaaugcugaugcuc

SEQ ID NO: 778144 - RNA, 22 nt, Human
uaaagaaguagaaaaguuguca

SEQ ID NO: 778145 - RNA, 25 nt, Human
uaacuaacuucuagugaaccuagau

SEQ ID NO: 778146 - RNA, 19 nt, Human
uaauuugcauuucuaaggc

SEQ ID NO: 778147 - RNA, 26 nt, Human
uacaaaagaaaaagaccguguggcaa

SEQ ID NO: 778148 - RNA, 21 nt, Human
uagaaaaaugagcuagguuua

SEQ ID NO: 778149 - RNA, 22 nt, Human
uagaaaaaugagcuagguuuac

SEQ ID NO: 778150 - RNA, 23 nt, Human
uagaggaaaugcuggguuucugg

SEQ ID NO: 778151 - RNA, 23 nt, Human
uauauagagaaaaugcaaaauuu

SEQ ID NO: 778152 - RNA, 20 nt, Human
uauguccaaagagggagcuu

SEQ ID NO: 778153 - RNA, 24 nt, Human
uauuucauucaaauaauuauguuu

SEQ ID NO: 778154 - RNA, 23 nt, Human
ucaaaaaaaaaaaaaaaaaaaaa

SEQ ID NO: 778155 - RNA, 20 nt, Human
ucaagaccauccuggccaac

SEQ ID NO: 778156 - RNA, 20 nt, Human
ucaagaccauccuggccaac

SEQ ID NO: 778157 - RNA, 18 nt, Human
ucacgaggucaggagauc

SEQ ID NO: 778158 - RNA, 24 nt, Human
ucacgaggucaggagaucaagacc

SEQ ID NO: 778159 - RNA, 22 nt, Human
ucagaauauaaaggcacaguca

SEQ ID NO: 778160 - RNA, 23 nt, Human
ucgacgugggguauguccaaaga

SEQ ID NO: 778161 - RNA, 23 nt, Human
ucgcgccacugcacuccaaucug

SEQ ID NO: 778162 - RNA, 18 nt, Human
ucuaccaggaguacccag

SEQ ID NO: 778163 - RNA, 19 nt, Human
ucucacucucccuuuuugg

SEQ ID NO: 778164 - RNA, 24 nt, Human
ucuccuagaaaaaugagcuagguu

SEQ ID NO: 778165 - RNA, 22 nt, Human
ucucuacuaaaaauacgaaaac

SEQ ID NO: 778166 - RNA, 18 nt, Human
ucuggguaacagagcgag

SEQ ID NO: 778167 - RNA, 23 nt, Human
ucugucucaaaaaaaaaaaaaaa

SEQ ID NO: 778168 - RNA, 22 nt, Human
ugaaaaaaaggaagggaggugu

SEQ ID NO: 778169 - RNA, 19 nt, Human
ugaagcaaagacagcugag

SEQ ID NO: 778170 - RNA, 20 nt, Human
ugagaggggaaaagcugauu

SEQ ID NO: 778171 - RNA, 22 nt, Human
ugagcggagaucgcgccacugc

SEQ ID NO: 778172 - RNA, 24 nt, Human
ugaggcgggcggaucacgagguca

SEQ ID NO: 778173 - RNA, 18 nt, Human
ugauggaaaguacagcuu

SEQ ID NO: 778174 - RNA, 21 nt, Human
ugauggaaaguacagcuuuug

SEQ ID NO: 778175 - RNA, 18 nt, Human
ugauggacuaacccucca

SEQ ID NO: 778176 - RNA, 24 nt, Human
ugauggcgggcgccuguaguccca

SEQ ID NO: 778177 - RNA, 18 nt, Human
ugcagaaauuuucuugga

SEQ ID NO: 778178 - RNA, 18 nt, Human
ugcucgcuacagccaggc

SEQ ID NO: 778179 - RNA, 20 nt, Human
ugcuuugcauauaucuuaaa

SEQ ID NO: 778180 - RNA, 19 nt, Human
uggaaaguacagcuuuugg

SEQ ID NO: 778181 - RNA, 21 nt, Human
uggaaccagagaggaaggagc

SEQ ID NO: 778182 - RNA, 25 nt, Human
uggaaccagagaggaaggagcucca

SEQ ID NO: 778183 - RNA, 19 nt, Human
uggacuaacccuccagagg

SEQ ID NO: 778184 - RNA, 25 nt, Human
uggcaucuguagaacucuaauuuca

SEQ ID NO: 778185 - RNA, 24 nt, Human
uggccaacauggugaaaccccguc

SEQ ID NO: 778186 - RNA, 21 nt, Human
uggcucacgccuguaauccca

SEQ ID NO: 778187 - RNA, 22 nt, Human
uggcucacgccuguaaucccag

SEQ ID NO: 778188 - RNA, 18 nt, Human
ugggacaagaagcaaaac

SEQ ID NO: 778189 - RNA, 19 nt, Human
ugggaggcugaggcgggcg

SEQ ID NO: 778190 - RNA, 24 nt, Human
ugggaggcugaggcgggcggauca

SEQ ID NO: 778191 - RNA, 24 nt, Human
uggggguaaaggugccuacaucuu

SEQ ID NO: 778192 - RNA, 20 nt, Human
ugguugagggaaaugacaau

SEQ ID NO: 778193 - RNA, 18 nt, Human
ugugaagcaaagacagcu

SEQ ID NO: 778194 - RNA, 18 nt, Human
uucucuguggcuuuggga

SEQ ID NO: 778195 - RNA, 19 nt, Human
uugcagugagcggagaucg

SEQ ID NO: 778196 - RNA, 22 nt, Human
uugcagugagcggagaucgcgc

SEQ ID NO: 778197 - RNA, 25 nt, Human
uugggaggcugaggcgggcggauca

SEQ ID NO: 778198 - RNA, 18 nt, Human
uuuaauagaggaaaugcu

SEQ ID NO: 778199 - RNA, 21 nt, Human
uuuaucugaaagcaaccccug

SEQ ID NO: 778200 - RNA, 21 nt, Human
uuuuggucuucccucuucucc

SEQ ID NO: 778201 - RNA, 23 nt, Human
aaaaaaccauuaccaaagguugg

SEQ ID NO: 778202 - RNA, 25 nt, Human
aaaaaaccauuaccaaagguuggca

SEQ ID NO: 778203 - RNA, 18 nt, Human
aaaaaggccacuuaaaac

SEQ ID NO: 778204 - RNA, 23 nt, Human
aaaaaggccacuuaaaacucaga

SEQ ID NO: 778205 - RNA, 22 nt, Human
aaaaagucaauucagaagaauu

SEQ ID NO: 778206 - RNA, 24 nt, Human
aaaaauaaauaaauaaaaagggca

SEQ ID NO: 778207 - RNA, 20 nt, Human
aaagaccaaagggaauuuuc

SEQ ID NO: 778208 - RNA, 20 nt, Human
aaagacuuugauggaaaaau

SEQ ID NO: 778209 - RNA, 24 nt, Human
aaagauucccauuaaaaaguguua

SEQ ID NO: 778210 - RNA, 18 nt, Human
aacaaaugccuacauaua

SEQ ID NO: 778211 - RNA, 29 nt, Human
aacacuaugaaauauaagguuagcaccaa

SEQ ID NO: 778212 - RNA, 22 nt, Human
aagaaaaagucaauucagaaga

SEQ ID NO: 778213 - RNA, 22 nt, Human
aagaacuacugcccuagaugga

SEQ ID NO: 778214 - RNA, 23 nt, Human
aagaacuacugcccuagauggag

SEQ ID NO: 778215 - RNA, 20 nt, Human
agaauacauauuccuggccc

SEQ ID NO: 778216 - RNA, 24 nt, Human
agaauuccccauaguuuguugcuc

SEQ ID NO: 778217 - RNA, 20 nt, Human
agcauuaucauuccagggcu

SEQ ID NO: 778218 - RNA, 21 nt, Human
agccaauacaaaguugacaca

SEQ ID NO: 778219 - RNA, 24 nt, Human
agcucuucccaucccucagccucc

SEQ ID NO: 778220 - RNA, 20 nt, Human
aggagccaauaacuggcagu

SEQ ID NO: 778221 - RNA, 20 nt, Human
aggaugaaagaaaaagucaa

SEQ ID NO: 778222 - RNA, 20 nt, Human
agguuaaucaucuauaaccc

SEQ ID NO: 778223 - RNA, 18 nt, Human
aguauggaagacgugcag

SEQ ID NO: 778224 - RNA, 20 nt, Human
auaagaacuacugcccuaga

SEQ ID NO: 778225 - RNA, 21 nt, Human
auggaaaaauuuuaacugagg

SEQ ID NO: 778226 - RNA, 22 nt, Human
auguucccugggagccaacugg

SEQ ID NO: 778227 - RNA, 21 nt, Human
caaaaaaccauuaccaaaggu

SEQ ID NO: 778228 - RNA, 22 nt, Human
caaaugccuacauauaagauuu

SEQ ID NO: 778229 - RNA, 19 nt, Human
caagaagagacaauacaua

SEQ ID NO: 778230 - RNA, 19 nt, Human
caaugaacaccaccaguuc

SEQ ID NO: 778231 - RNA, 24 nt, Human
cacaagaagagacaauacauacua

SEQ ID NO: 778232 - RNA, 18 nt, Human
caccuccgccuccugcug

SEQ ID NO: 778233 - RNA, 24 nt, Human
caccuccgccuccugcuguuccag

SEQ ID NO: 778234 - RNA, 18 nt, Human
cacugcauucaggagaau

SEQ ID NO: 778235 - RNA, 18 nt, Human
cacuugaccacacaugcc

SEQ ID NO: 778236 - RNA, 20 nt, Human
cacuugaccacacaugccag

SEQ ID NO: 778237 - RNA, 23 nt, Human
cagaauacauauuccuggcccag

SEQ ID NO: 778238 - RNA, 26 nt, Human
cagaauuccccauaguuuguugcucc

SEQ ID NO: 778239 - RNA, 20 nt, Human
cagaguggggaaaacucaug

SEQ ID NO: 778240 - RNA, 21 nt, Human
cagccaauacaaaguugacac

SEQ ID NO: 778241 - RNA, 19 nt, Human
caugaaaacuaagaugggc

SEQ ID NO: 778242 - RNA, 21 nt, Human
caugaaaacuaagaugggcac

SEQ ID NO: 778243 - RNA, 20 nt, Human
caugguagaauaacagcaca

SEQ ID NO: 778244 - RNA, 18 nt, Human
ccagcucuucccaucccu

SEQ ID NO: 778245 - RNA, 25 nt, Human
ccauaauugggauauuguccaaagc

SEQ ID NO: 778246 - RNA, 18 nt, Human
ccccagauccuccuccuc

SEQ ID NO: 778247 - RNA, 22 nt, Human
cccccagauccuccuccuccgc

SEQ ID NO: 778248 - RNA, 19 nt, Human
ccccugcaccuccgccucc

SEQ ID NO: 778249 - RNA, 23 nt, Human
ccccuucgaagucugaaaaauua

SEQ ID NO: 778250 - RNA, 19 nt, Human
ccccuucuucucucuuuuc

SEQ ID NO: 778251 - RNA, 18 nt, Human
cccucugcacagagcaaa

SEQ ID NO: 778252 - RNA, 25 nt, Human
ccuccugccaccgcagcuccuccac

SEQ ID NO: 778253 - RNA, 24 nt, Human
ccugccaccgcagcuccuccaccu

SEQ ID NO: 778254 - RNA, 22 nt, Human
ccugcuguuccagcucuuccca

SEQ ID NO: 778255 - RNA, 22 nt, Human
cgcggcuuccaccggccccucu

SEQ ID NO: 778256 - RNA, 19 nt, Human
cgggcggccccugcaccuc

SEQ ID NO: 778257 - RNA, 19 nt, Human
cucacaguucuuaaccuuu

SEQ ID NO: 778258 - RNA, 20 nt, Human
cucagagacagaaagugaac

SEQ ID NO: 778259 - RNA, 18 nt, Human
cuccuccuccucuucccc

SEQ ID NO: 778260 - RNA, 21 nt, Human
cucguccaccuccugccaccg

SEQ ID NO: 778261 - RNA, 19 nt, Human
cugcaccuccgccuccugc

SEQ ID NO: 778262 - RNA, 24 nt, Human
cugcaccuccgccuccugcuguuc

SEQ ID NO: 778263 - RNA, 23 nt, Human
cuugauuucuuuaccccauauaa

SEQ ID NO: 778264 - RNA, 19 nt, Human
cuugcaagaguacaacuau

SEQ ID NO: 778265 - RNA, 19 nt, Human
cuuuguaugcacaugugua

SEQ ID NO: 778266 - RNA, 20 nt, Human
gaaagaaaaagucaauucag

SEQ ID NO: 778267 - RNA, 20 nt, Human
gaggcugcgcggcuuccacc

SEQ ID NO: 778268 - RNA, 24 nt, Human
gccccgccggcccuccccagucuc

SEQ ID NO: 778269 - RNA, 23 nt, Human
gccggcccuccccagucuccucc

SEQ ID NO: 778270 - RNA, 20 nt, Human
ggaaaacucaugaaaacuaa

SEQ ID NO: 778271 - RNA, 22 nt, Human
ggccaaaugcuucacauguccu

SEQ ID NO: 778272 - RNA, 23 nt, Human
ggccaaaugcuucacauguccuu

SEQ ID NO: 778273 - RNA, 22 nt, Human
ggccccugcaccuccgccuccu

SEQ ID NO: 778274 - RNA, 23 nt, Human
ggcccuccuccuccucuuccccc

SEQ ID NO: 778275 - RNA, 24 nt, Human
gggaauuuucaaacauguaauguc

SEQ ID NO: 778276 - RNA, 21 nt, Human
gggcacagugauaucccagcc

SEQ ID NO: 778277 - RNA, 18 nt, Human
guaaauguuuuggacaaa

SEQ ID NO: 778278 - RNA, 19 nt, Human
guagaguaaauguuuugga

SEQ ID NO: 778279 - RNA, 21 nt, Human
guccaccuccugccaccgcag

SEQ ID NO: 778280 - RNA, 20 nt, Human
gugugugggugggugugugu

SEQ ID NO: 778281 - RNA, 22 nt, Human
guuguuuuauuauuuuuccugu

SEQ ID NO: 778282 - RNA, 19 nt, Human
uaaaaaaaaagucuugaac

SEQ ID NO: 778283 - RNA, 30 nt, Human
uaaaaaauaaauaaauaaaaagggcaaaac

SEQ ID NO: 778284 - RNA, 19 nt, Human
uaaaaaggccacuuaaaac

SEQ ID NO: 778285 - RNA, 24 nt, Human
uaaaaagggcaagagaggagccaa

SEQ ID NO: 778286 - RNA, 23 nt, Human
uaaaacucagauguuuuuuaaag

SEQ ID NO: 778287 - RNA, 22 nt, Human
uaaaauguucccugggagccaa

SEQ ID NO: 778288 - RNA, 20 nt, Human
uaaauggcuggcuugggggg

SEQ ID NO: 778289 - RNA, 18 nt, Human
uaacuggcaguagggaug

SEQ ID NO: 778290 - RNA, 19 nt, Human
uacaacuuuuuguaacuga

SEQ ID NO: 778291 - RNA, 18 nt, Human
uacagcuucagagugggg

SEQ ID NO: 778292 - RNA, 18 nt, Human
uacagugaggcugagcua

SEQ ID NO: 778293 - RNA, 25 nt, Human
uagaaaggauaaacauucccagaca

SEQ ID NO: 778294 - RNA, 19 nt, Human
uagaauaacagcacauugc

SEQ ID NO: 778295 - RNA, 23 nt, Human
uagcauuaucauuccagggcugu

SEQ ID NO: 778296 - RNA, 18 nt, Human
uaggcccuaggagggagc

SEQ ID NO: 778297 - RNA, 21 nt, Human
uaguaaagaaaagacuuucug

SEQ ID NO: 778298 - RNA, 23 nt, Human
uagugcauagaaucaaaaaacca

SEQ ID NO: 778299 - RNA, 25 nt, Human
uaugucuguuucauguaaauuuagg

SEQ ID NO: 778300 - RNA, 24 nt, Human
uauuacaaaggcuccaaaucuugg

SEQ ID NO: 778301 - RNA, 18 nt, Human
ucacugcauucaggagaa

SEQ ID NO: 778302 - RNA, 25 nt, Human
ucacugcauucaggagaaugggugu

SEQ ID NO: 778303 - RNA, 24 nt, Human
uccacucuuuacaaugaacaccac

SEQ ID NO: 778304 - RNA, 20 nt, Human
uccagcucuucccaucccuc

SEQ ID NO: 778305 - RNA, 23 nt, Human
uccccagucuccuccaacgccuc

SEQ ID NO: 778306 - RNA, 18 nt, Human
uccccauaguuuguugcu

SEQ ID NO: 778307 - RNA, 19 nt, Human
ucccuaaagaccaaaggga

SEQ ID NO: 778308 - RNA, 18 nt, Human
ucccugggagccaacugg

SEQ ID NO: 778309 - RNA, 23 nt, Human
ucccugggagccaacugggccaa

SEQ ID NO: 778310 - RNA, 26 nt, Human
uccuggcccaguccccacaggcucug

SEQ ID NO: 778311 - RNA, 19 nt, Human
uccuguggacggaauuuuc

SEQ ID NO: 778312 - RNA, 20 nt, Human
uccuguggacggaauuuucu

SEQ ID NO: 778313 - RNA, 18 nt, Human
ucucguccaccuccugcc

SEQ ID NO: 778314 - RNA, 24 nt, Human
ucugaucuagaauugucuuucuuc

SEQ ID NO: 778315 - RNA, 20 nt, Human
ucugucucucguccaccucc

SEQ ID NO: 778316 - RNA, 23 nt, Human
ucugucucucguccaccuccugc

SEQ ID NO: 778317 - RNA, 19 nt, Human
ugagugaaugagccucccc

SEQ ID NO: 778318 - RNA, 24 nt, Human
ugcacagagcaaaggauguguacc

SEQ ID NO: 778319 - RNA, 20 nt, Human
ugccuucuggguuacagcuu

SEQ ID NO: 778320 - RNA, 21 nt, Human
ugcuuuuagcuagauaugauc

SEQ ID NO: 778321 - RNA, 19 nt, Human
uggaaagauucccauuaaa

SEQ ID NO: 778322 - RNA, 21 nt, Human
uggcaguagggaugggugaga

SEQ ID NO: 778323 - RNA, 20 nt, Human
ugggcacagugauaucccag

SEQ ID NO: 778324 - RNA, 24 nt, Human
ugggugggugugugugcaaggcca

SEQ ID NO: 778325 - RNA, 19 nt, Human
uggugugugggugggugug

SEQ ID NO: 778326 - RNA, 23 nt, Human
uggugugugggugggugugugug

SEQ ID NO: 778327 - RNA, 18 nt, Human
uguaaugucaauaaccug

SEQ ID NO: 778328 - RNA, 19 nt, Human
uguaggagaggaaaaagga

SEQ ID NO: 778329 - RNA, 24 nt, Human
uuaaauaaaaaaaaaaaaaaguua

SEQ ID NO: 778330 - RNA, 27 nt, Human
uuacauugauuuuuaacagucugaagg

SEQ ID NO: 778331 - RNA, 18 nt, Human
uuagugaggaaaucauug

SEQ ID NO: 778332 - RNA, 19 nt, Human
uuauaguaaagaaaagacu

SEQ ID NO: 778333 - RNA, 22 nt, Human
uucaagggcggcggcuucuuuc

SEQ ID NO: 778334 - RNA, 24 nt, Human
uucauugguauuuagugcaaauuu

SEQ ID NO: 778335 - RNA, 20 nt, Human
uucccccagauccuccuccu

SEQ ID NO: 778336 - RNA, 22 nt, Human
uucuucucucuuuuccucgggc

SEQ ID NO: 778337 - RNA, 22 nt, Human
uuuaacagucugaagguccagu

SEQ ID NO: 778338 - RNA, 20 nt, Human
uuuccugucucacuguugcu

SEQ ID NO: 778339 - RNA, 23 nt, Human
uuuccugucucacuguugcuuuu

SEQ ID NO: 778340 - RNA, 19 nt, Human
uuuuaaacugccaaguccc

SEQ ID NO: 778341 - RNA, 18 nt, Human
acucuguuucuuuugugc

SEQ ID NO: 778342 - RNA, 22 nt, Human
acucuguuucuuuugugcugcu

SEQ ID NO: 778343 - RNA, 23 nt, Human
acucuguuucuuuugugcugcuc

SEQ ID NO: 778344 - RNA, 19 nt, Human
agauuccccucccugcccu

SEQ ID NO: 778345 - RNA, 19 nt, Human
caaggcggguccucuggcu

SEQ ID NO: 778346 - RNA, 22 nt, Human
caaggcggguccucuggcuuua

SEQ ID NO: 778347 - RNA, 26 nt, Human
cacucuguuucuuuugugcugcuuua

SEQ ID NO: 778348 - RNA, 24 nt, Human
cagaaucucucugugccucaguuu

SEQ ID NO: 778349 - RNA, 23 nt, Human
cccacagcagccacuaauaacgg

SEQ ID NO: 778350 - RNA, 18 nt, Human
cccagugaugucaugguu

SEQ ID NO: 778351 - RNA, 18 nt, Human
ccucccugcccagugaug

SEQ ID NO: 778352 - RNA, 20 nt, Human
ccugggauuggaggcuggag

SEQ ID NO: 778353 - RNA, 20 nt, Human
cucaaaagauaaaacugacc

SEQ ID NO: 778354 - RNA, 20 nt, Human
cuggagacacuggagaggga

SEQ ID NO: 778355 - RNA, 20 nt, Human
cuggcagagugauggccgcu

SEQ ID NO: 778356 - RNA, 23 nt, Human
cugugccucaguuuacucaucug

SEQ ID NO: 778357 - RNA, 23 nt, Human
cugugugcuguuugcugcuggag

SEQ ID NO: 778358 - RNA, 18 nt, Human
cuuugugcuuggccuguc

SEQ ID NO: 778359 - RNA, 21 nt, Human
gggcguuuugaauggcuuuga

SEQ ID NO: 778360 - RNA, 22 nt, Human
gguaaguagauugucuuugggc

SEQ ID NO: 778361 - RNA, 21 nt, Human
guacuagugauguccugggau

SEQ ID NO: 778362 - RNA, 19 nt, Human
guagauuccccucccugcc

SEQ ID NO: 778363 - RNA, 21 nt, Human
uaaacugacuacaggaacugg

SEQ ID NO: 778364 - RNA, 26 nt, Human
uaacugcacucacugcacuggggugu

SEQ ID NO: 778365 - RNA, 19 nt, Human
uaaugacaauguucucaga

SEQ ID NO: 778366 - RNA, 19 nt, Human
uagguuaggaauuuucucu

SEQ ID NO: 778367 - RNA, 21 nt, Human
ucagaaucucucugugccuca

SEQ ID NO: 778368 - RNA, 18 nt, Human
ucccacagacugucgugg

SEQ ID NO: 778369 - RNA, 26 nt, Human
uccucuggcuuuaagaaacaugguuc

SEQ ID NO: 778370 - RNA, 19 nt, Human
uccuuugugcuuggccugu

SEQ ID NO: 778371 - RNA, 20 nt, Human
ugagacaggcuuuuguuuuc

SEQ ID NO: 778372 - RNA, 18 nt, Human
ugggauuggaggcuggag

SEQ ID NO: 778373 - RNA, 19 nt, Human
ugggauuggaggcuggaga

SEQ ID NO: 778374 - RNA, 24 nt, Human
ugugugcuguuugcugcuggaggu

SEQ ID NO: 778375 - RNA, 22 nt, Human
uuaggaauuuucucuaaacuga

SEQ ID NO: 778376 - RNA, 23 nt, Human
uugaaccgugucuucucucccac

SEQ ID NO: 778377 - RNA, 23 nt, Human
uuggcaucaaguagauuccccuc

SEQ ID NO: 778378 - RNA, 24 nt, Human
uuucgcaggaaagacugugugcug

SEQ ID NO: 778379 - RNA, 22 nt, Human
aaaacagaccaucugacuccaa

SEQ ID NO: 778380 - RNA, 21 nt, Human
aaaagcucccuccugcaacuu

SEQ ID NO: 778381 - RNA, 20 nt, Human
aaacagaugguuguagcucu

SEQ ID NO: 778382 - RNA, 22 nt, Human
aaacaugaacagguuauggcaa

SEQ ID NO: 778383 - RNA, 19 nt, Human
aaagcucccuccugcaacu

SEQ ID NO: 778384 - RNA, 19 nt, Human
aaaguuauuaaaccucauc

SEQ ID NO: 778385 - RNA, 21 nt, Human
aacaagguaaaagcccuccuc

SEQ ID NO: 778386 - RNA, 19 nt, Human
aacagauauagcaacugaa

SEQ ID NO: 778387 - RNA, 26 nt, Human
aaccaccaaaacaucaaaccaaacag

SEQ ID NO: 778388 - RNA, 24 nt, Human
aacccaccguuugauuccacaucg

SEQ ID NO: 778389 - RNA, 23 nt, Human
aagaagaccuacaacugaguaga

SEQ ID NO: 778390 - RNA, 18 nt, Human
aagaaguacaucugcauc

SEQ ID NO: 778391 - RNA, 19 nt, Human
aagagcccauuuuccccuc

SEQ ID NO: 778392 - RNA, 21 nt, Human
aagcguucuucccacucccuc

SEQ ID NO: 778393 - RNA, 24 nt, Human
aaguauuuacugggcgccuacuau

SEQ ID NO: 778394 - RNA, 23 nt, Human
aaucuuuaaaacagaccaucuga

SEQ ID NO: 778395 - RNA, 25 nt, Human
acaauaauggagagagugggguauc

SEQ ID NO: 778396 - RNA, 20 nt, Human
acccaacagauauagcaacu

SEQ ID NO: 778397 - RNA, 21 nt, Human
accucaucuucuuccugugaa

SEQ ID NO: 778398 - RNA, 19 nt, Human
acuaaagaagaaagcacau

SEQ ID NO: 778399 - RNA, 18 nt, Human
acuuguauucaucaauga

SEQ ID NO: 778400 - RNA, 18 nt, Human
agaaagaggagguuaucu

SEQ ID NO: 778401 - RNA, 24 nt, Human
agccauuucuaacaguagccaccc

SEQ ID NO: 778402 - RNA, 25 nt, Human
agcuggaugacaagaagaccuacaa

SEQ ID NO: 778403 - RNA, 19 nt, Human
aggacaaggccaugcucca

SEQ ID NO: 778404 - RNA, 21 nt, Human
agugauuuguuuuuauuuuua

SEQ ID NO: 778405 - RNA, 21 nt, Human
agugccagaaauauuuacaga

SEQ ID NO: 778406 - RNA, 21 nt, Human
augacaacagccauuucuaac

SEQ ID NO: 778407 - RNA, 21 nt, Human
caaaaugcacauuucuggaau

SEQ ID NO: 778408 - RNA, 21 nt, Human
caaaguccagaaaacaugaca

SEQ ID NO: 778409 - RNA, 20 nt, Human
cacacugaagaaguacaucu

SEQ ID NO: 778410 - RNA, 19 nt, Human
caccaaaacaucaaaccaa

SEQ ID NO: 778411 - RNA, 23 nt, Human
caccaaaacaucaaaccaaacag

SEQ ID NO: 778412 - RNA, 26 nt, Human
cacucauccacccccggcauacccaa

SEQ ID NO: 778413 - RNA, 21 nt, Human
cagaaaacaugacaacagcca

SEQ ID NO: 778414 - RNA, 22 nt, Human
cagagucugacaaaugcuuccc

SEQ ID NO: 778415 - RNA, 22 nt, Human
cauaaaagccuuucuccucaaa

SEQ ID NO: 778416 - RNA, 21 nt, Human
cauacaaacuguauauaugau

SEQ ID NO: 778417 - RNA, 21 nt, Human
ccaacccucauacacacacac

SEQ ID NO: 778418 - RNA, 18 nt, Human
ccaaucucuccaacucag

SEQ ID NO: 778419 - RNA, 23 nt, Human
ccacaaaacacaucuuugagcaa

SEQ ID NO: 778420 - RNA, 20 nt, Human
ccagaagaaaugaauacucu

SEQ ID NO: 778421 - RNA, 27 nt, Human
cccacaaacuuuauuugcauccccauu

SEQ ID NO: 778422 - RNA, 23 nt, Human
ccccagaggcuagaacauaugcu

SEQ ID NO: 778423 - RNA, 23 nt, Human
ccccucaaaaugucaaucuagaa

SEQ ID NO: 778424 - RNA, 18 nt, Human
cccuccugcaacuuaaga

SEQ ID NO: 778425 - RNA, 19 nt, Human
ccuacaacugaguagaagg

SEQ ID NO: 778426 - RNA, 21 nt, Human
ccucacuguccucagugcucc

SEQ ID NO: 778427 - RNA, 25 nt, Human
ccuccuaaaaagugagguaaaaaac

SEQ ID NO: 778428 - RNA, 20 nt, Human
ccuguaagauucugagauuu

SEQ ID NO: 778429 - RNA, 22 nt, Human
ccuucagaggagaaagaugucu

SEQ ID NO: 778430 - RNA, 18 nt, Human
ccuuucuccucaaaaggc

SEQ ID NO: 778431 - RNA, 23 nt, Human
cggaaugccacacucauccaccc

SEQ ID NO: 778432 - RNA, 25 nt, Human
cguaaguaaaccaccaaaacaucaa

SEQ ID NO: 778433 - RNA, 21 nt, Human
cuacugcaguuugcugcuugg

SEQ ID NO: 778434 - RNA, 29 nt, Human
cuacugcaguuugcugcuugggggcccuc

SEQ ID NO: 778435 - RNA, 23 nt, Human
cuccuaaaaagugagguaaaaaa

SEQ ID NO: 778436 - RNA, 24 nt, Human
cucugcucacuucaacuagaacaa

SEQ ID NO: 778437 - RNA, 20 nt, Human
cugaaggaucagcaagacca

SEQ ID NO: 778438 - RNA, 19 nt, Human
cugagaaacacacuagaag

SEQ ID NO: 778439 - RNA, 19 nt, Human
cuucaggggcugcacaucc

SEQ ID NO: 778440 - RNA, 22 nt, Human
cuucuauauugcaaauuuguug

SEQ ID NO: 778441 - RNA, 20 nt, Human
gaaaaaaauaugacaucuuu

SEQ ID NO: 778442 - RNA, 22 nt, Human
gaauaauacuauaaccugaaug

SEQ ID NO: 778443 - RNA, 26 nt, Human
ggaaaucuuuaaaacagaccaucuga

SEQ ID NO: 778444 - RNA, 20 nt, Human
ggaauaagagacauuugcac

SEQ ID NO: 778445 - RNA, 18 nt, Human
ggaguugccagaauuuag

SEQ ID NO: 778446 - RNA, 20 nt, Human
ggaguuucaugccuucaggg

SEQ ID NO: 778447 - RNA, 18 nt, Human
ggguaaagcuccaccuuc

SEQ ID NO: 778448 - RNA, 20 nt, Human
ggucacucagaaacugaggc

SEQ ID NO: 778449 - RNA, 30 nt, Human
guaugcgagugugugugugugugugugugg

SEQ ID NO: 778450 - RNA, 18 nt, Human
gucaaauuaccuccaaua

SEQ ID NO: 778451 - RNA, 21 nt, Human
gugauuuuuaacaaaggcagg

SEQ ID NO: 778452 - RNA, 20 nt, Human
gugugugugugugugugugu

SEQ ID NO: 778453 - RNA, 21 nt, Human
gugugugugugugugugugug

SEQ ID NO: 778454 - RNA, 19 nt, Human
guugauacuaccaaugcac

SEQ ID NO: 778455 - RNA, 20 nt, Human
uaaaaagugagguaaaaaaa

SEQ ID NO: 778456 - RNA, 26 nt, Human
uaaaacagaccaucugacuccaaugu

SEQ ID NO: 778457 - RNA, 24 nt, Human
uaaaagcccuccucacuguccuca

SEQ ID NO: 778458 - RNA, 20 nt, Human
uaaaauguauaucaucauua

SEQ ID NO: 778459 - RNA, 18 nt, Human
uaaauauguuccuccagu

SEQ ID NO: 778460 - RNA, 24 nt, Human
uaaguaaaccaccaaaacaucaaa

SEQ ID NO: 778461 - RNA, 28 nt, Human
uaaguaaaccaccaaaacaucaaaccaa

SEQ ID NO: 778462 - RNA, 19 nt, Human
uacacagaaccugcagcag

SEQ ID NO: 778463 - RNA, 20 nt, Human
uacagcacauuuuucugaaa

SEQ ID NO: 778464 - RNA, 21 nt, Human
uaccugagcuuaaaacaaaca

SEQ ID NO: 778465 - RNA, 19 nt, Human
uagaaagaggagguuaucu

SEQ ID NO: 778466 - RNA, 22 nt, Human
uagaacaagagcccauuuuccc

SEQ ID NO: 778467 - RNA, 18 nt, Human
uagaaguacauggcuucu

SEQ ID NO: 778468 - RNA, 21 nt, Human
uauaaccugaauggaaacugg

SEQ ID NO: 778469 - RNA, 18 nt, Human
uauaugcaaggcacugug

SEQ ID NO: 778470 - RNA, 23 nt, Human
uaugcgagugugugugugugugu

SEQ ID NO: 778471 - RNA, 20 nt, Human
ucaaaccaaacagaugguug

SEQ ID NO: 778472 - RNA, 18 nt, Human
ucaaacuguucugcugug

SEQ ID NO: 778473 - RNA, 23 nt, Human
ucaaaggcccaauggauggaaga

SEQ ID NO: 778474 - RNA, 23 nt, Human
ucaacagucuuagaaauucagug

SEQ ID NO: 778475 - RNA, 21 nt, Human
ucacuagauagcccaaagucu

SEQ ID NO: 778476 - RNA, 24 nt, Human
ucacucauguuugucaauuaugag

SEQ ID NO: 778477 - RNA, 18 nt, Human
uccagaagaaaugaauac

SEQ ID NO: 778478 - RNA, 18 nt, Human
uccauuucugaucuguuc

SEQ ID NO: 778479 - RNA, 24 nt, Human
uccgcucacauucaagaacuguuc

SEQ ID NO: 778480 - RNA, 24 nt, Human
ucuaacaguagccacccaaagagg

SEQ ID NO: 778481 - RNA, 23 nt, Human
ucugggagcccauuucacuagau

SEQ ID NO: 778482 - RNA, 18 nt, Human
ugaaauaaaggaucugga

SEQ ID NO: 778483 - RNA, 21 nt, Human
ugaagaaguacaucugcauca

SEQ ID NO: 778484 - RNA, 23 nt, Human
ugaauccagaggaaaaugggcug

SEQ ID NO: 778485 - RNA, 24 nt, Human
ugacaagaagaccuacaacugagu

SEQ ID NO: 778486 - RNA, 22 nt, Human
ugagaaacacacuagaaguaca

SEQ ID NO: 778487 - RNA, 21 nt, Human
ugaggacuugggaaacuuggu

SEQ ID NO: 778488 - RNA, 18 nt, Human
ugaguagaaggcugugac

SEQ ID NO: 778489 - RNA, 19 nt, Human
ugaguagaaggcugugacu

SEQ ID NO: 778490 - RNA, 25 nt, Human
ugaguaugcgagugugugugugugu

SEQ ID NO: 778491 - RNA, 32 nt, Human
ugaguaugcgaguguguguguguguguguggu

SEQ ID NO: 778492 - RNA, 24 nt, Human
ugaugagaaggacaacuuuuugaa

SEQ ID NO: 778493 - RNA, 18 nt, Human
ugauuuguuuuuauuuuu

SEQ ID NO: 778494 - RNA, 20 nt, Human
ugcauaaaagccuuucuccu

SEQ ID NO: 778495 - RNA, 19 nt, Human
ugcccucucccauguuacc

SEQ ID NO: 778496 - RNA, 21 nt, Human
ugcuaugcccauauuucuugc

SEQ ID NO: 778497 - RNA, 21 nt, Human
uggaauuacaaggaguugcca

SEQ ID NO: 778498 - RNA, 23 nt, Human
uggacuacuaaauauuaauauua

SEQ ID NO: 778499 - RNA, 23 nt, Human
uggagagagugggguaucacugc

SEQ ID NO: 778500 - RNA, 24 nt, Human
uggagagagugggguaucacugcu

SEQ ID NO: 778501 - RNA, 21 nt, Human
uggagucauagaaagaggagg

SEQ ID NO: 778502 - RNA, 24 nt, Human
uggauguucugggucuggccaccc

SEQ ID NO: 778503 - RNA, 21 nt, Human
uggcagggaucuguuggcugg

SEQ ID NO: 778504 - RNA, 25 nt, Human
uggcuaaaauguauaucaucauuau

SEQ ID NO: 778505 - RNA, 19 nt, Human
ugggguaucacugcugucu

SEQ ID NO: 778506 - RNA, 24 nt, Human
uggguaaagcuccaccuuccagaa

SEQ ID NO: 778507 - RNA, 23 nt, Human
ugugagcagaaggaaccagcgcc

SEQ ID NO: 778508 - RNA, 28 nt, Human
ugugugugugugugucugauuaguccuu

SEQ ID NO: 778509 - RNA, 20 nt, Human
ugugugugugugugugucug

SEQ ID NO: 778510 - RNA, 18 nt, Human
ugugugugugugugugug

SEQ ID NO: 778511 - RNA, 18 nt, Human
ugugugugugugugugug

SEQ ID NO: 778512 - RNA, 18 nt, Human
ugugugugugugugugug

SEQ ID NO: 778513 - RNA, 18 nt, Human
ugugugugugugugugug

SEQ ID NO: 778514 - RNA, 18 nt, Human
ugugugugugugugugug

SEQ ID NO: 778515 - RNA, 18 nt, Human
ugugugugugugugugug

SEQ ID NO: 778516 - RNA, 18 nt, Human
ugugugugugugugugug

SEQ ID NO: 778517 - RNA, 18 nt, Human
ugugugugugugugugug

SEQ ID NO: 778518 - RNA, 22 nt, Human
ugugugugugugugugugucug

SEQ ID NO: 778519 - RNA, 21 nt, Human
ugugugugugugugugugugu

SEQ ID NO: 778520 - RNA, 21 nt, Human
ugugugugugugugugugugu

SEQ ID NO: 778521 - RNA, 21 nt, Human
ugugugugugugugugugugu

SEQ ID NO: 778522 - RNA, 21 nt, Human
ugugugugugugugugugugu

SEQ ID NO: 778523 - RNA, 21 nt, Human
ugugugugugugugugugugu

SEQ ID NO: 778524 - RNA, 21 nt, Human
ugugugugugugugugugugu

SEQ ID NO: 778525 - RNA, 21 nt, Human
ugugugugugugugugugugu

SEQ ID NO: 778526 - RNA, 21 nt, Human
ugugugugugugugugugugu

SEQ ID NO: 778527 - RNA, 21 nt, Human
ugugugugugugugugugugu

SEQ ID NO: 778528 - RNA, 21 nt, Human
ugugugugugugugugugugu

SEQ ID NO: 778529 - RNA, 21 nt, Human
ugugugugugugugugugugu

SEQ ID NO: 778530 - RNA, 21 nt, Human
ugugugugugugugugugugu

SEQ ID NO: 778531 - RNA, 21 nt, Human
ugugugugugugugugugugu

SEQ ID NO: 778532 - RNA, 21 nt, Human
ugugugugugugugugugugu

SEQ ID NO: 778533 - RNA, 22 nt, Human
ugugugugugugugugugugug

SEQ ID NO: 778534 - RNA, 22 nt, Human
ugugugugugugugugugugug

SEQ ID NO: 778535 - RNA, 22 nt, Human
ugugugugugugugugugugug

SEQ ID NO: 778536 - RNA, 22 nt, Human
ugugugugugugugugugugug

SEQ ID NO: 778537 - RNA, 22 nt, Human
ugugugugugugugugugugug

SEQ ID NO: 778538 - RNA, 19 nt, Human
uuacaguucagugccagaa

SEQ ID NO: 778539 - RNA, 21 nt, Human
uuacuaaagaagaaagcacau

SEQ ID NO: 778540 - RNA, 20 nt, Human
uuauuuauuuauuuauuuuu

SEQ ID NO: 778541 - RNA, 19 nt, Human
uucaacuagaacaagagcc

SEQ ID NO: 778542 - RNA, 22 nt, Human
uucacaaacuacugcaguuugc

SEQ ID NO: 778543 - RNA, 18 nt, Human
uucaugaaggccucauac

SEQ ID NO: 778544 - RNA, 22 nt, Human
uuccaaaaccuggcagggaucu

SEQ ID NO: 778545 - RNA, 21 nt, Human
uugcugcuugguccugucauu

SEQ ID NO: 778546 - RNA, 30 nt, Human
uuucuuuuuuuauuauuuauuuauuuauuu

SEQ ID NO: 778547 - RNA, 28 nt, Human
uuuuuuuauuauuuauuuauuuauuuau

SEQ ID NO: 778548 - RNA, 26 nt, Human
aaaaagaaaaaaaaauaaauacaagg

SEQ ID NO: 778549 - RNA, 21 nt, Human
aaaacuuuuacaaugugaaau

SEQ ID NO: 778550 - RNA, 22 nt, Human
aaacaggaaagaguaugaggau

SEQ ID NO: 778551 - RNA, 24 nt, Human
aaagaaaaaaaaauaaauacaagg

SEQ ID NO: 778552 - RNA, 21 nt, Human
aaagaagaaaacaggaaagag

SEQ ID NO: 778553 - RNA, 23 nt, Human
aaauacaaggaacacugccuuuu

SEQ ID NO: 778554 - RNA, 24 nt, Human
aagaaaaaaaaauaaauacaagga

SEQ ID NO: 778555 - RNA, 20 nt, Human
aagaaacaggccauacacua

SEQ ID NO: 778556 - RNA, 23 nt, Human
aagaaccacuccaucacaauguc

SEQ ID NO: 778557 - RNA, 19 nt, Human
aagaagaaaacaggaaaga

SEQ ID NO: 778558 - RNA, 21 nt, Human
aagaagaaaacaggaaagagu

SEQ ID NO: 778559 - RNA, 25 nt, Human
aagaagaaaacaggaaagaguauga

SEQ ID NO: 778560 - RNA, 22 nt, Human
acaaagaagaaaacaggaaaga

SEQ ID NO: 778561 - RNA, 21 nt, Human
acaaggaacacugccuuuuca

SEQ ID NO: 778562 - RNA, 20 nt, Human
acccuggcauccagcccucc

SEQ ID NO: 778563 - RNA, 21 nt, Human
acuugaaacauucacauuuga

SEQ ID NO: 778564 - RNA, 19 nt, Human
agaaaaguauuuacuucug

SEQ ID NO: 778565 - RNA, 18 nt, Human
agaagaaaacaggaaaga

SEQ ID NO: 778566 - RNA, 23 nt, Human
agacaggugcauuucucucugca

SEQ ID NO: 778567 - RNA, 24 nt, Human
agagaucacauucuucauuuuuuu

SEQ ID NO: 778568 - RNA, 19 nt, Human
agagucccauuaauuuuau

SEQ ID NO: 778569 - RNA, 20 nt, Human
agcaaauucaguacaauauc

SEQ ID NO: 778570 - RNA, 20 nt, Human
aggacuuuguucugccuaca

SEQ ID NO: 778571 - RNA, 21 nt, Human
aggguucucuuucuaaagaaa

SEQ ID NO: 778572 - RNA, 19 nt, Human
agguguagugaacauagaa

SEQ ID NO: 778573 - RNA, 20 nt, Human
auccaucacuauuaaguaac

SEQ ID NO: 778574 - RNA, 22 nt, Human
auggagcagaagccauuuucau

SEQ ID NO: 778575 - RNA, 18 nt, Human
auucaguacaauauccuc

SEQ ID NO: 778576 - RNA, 18 nt, Human
caaaaaucuacccuuaga

SEQ ID NO: 778577 - RNA, 23 nt, Human
caaauauuugcauagccaaaaca

SEQ ID NO: 778578 - RNA, 22 nt, Human
caagaaaagccuuacaauaaga

SEQ ID NO: 778579 - RNA, 24 nt, Human
caagaaacaggccauacacuacaa

SEQ ID NO: 778580 - RNA, 23 nt, Human
cacaugcacauuuuuuaucacaa

SEQ ID NO: 778581 - RNA, 23 nt, Human
cauaccucaaaccaagggaaaaa

SEQ ID NO: 778582 - RNA, 25 nt, Human
caucacaaugucuucuguuucacag

SEQ ID NO: 778583 - RNA, 20 nt, Human
caugccucaggaaugauagu

SEQ ID NO: 778584 - RNA, 20 nt, Human
cccagcggaugaaauaggac

SEQ ID NO: 778585 - RNA, 25 nt, Human
cucaaagucauuuauguucuauucc

SEQ ID NO: 778586 - RNA, 18 nt, Human
cuccaucacaaugucuuc

SEQ ID NO: 778587 - RNA, 21 nt, Human
cuccccaugcugcugcucuca

SEQ ID NO: 778588 - RNA, 23 nt, Human
cuccccaugcugcugcucucaaa

SEQ ID NO: 778589 - RNA, 20 nt, Human
cucguaguccucacuaugac

SEQ ID NO: 778590 - RNA, 23 nt, Human
cucucuuaacccuggcauccagc

SEQ ID NO: 778591 - RNA, 20 nt, Human
cuuaacccuggcauccagcc

SEQ ID NO: 778592 - RNA, 24 nt, Human
gaaacaaauaagcaaggcagggca

SEQ ID NO: 778593 - RNA, 25 nt, Human
gaggauagaaaagugcaaauccauc

SEQ ID NO: 778594 - RNA, 22 nt, Human
gauuuaagaguaaggagacuaa

SEQ ID NO: 778595 - RNA, 20 nt, Human
ggacauauucuaaagauuuu

SEQ ID NO: 778596 - RNA, 25 nt, Human
guaacaauaaaaaguacacaugugc

SEQ ID NO: 778597 - RNA, 21 nt, Human
gucauuuuuccuuccaaaacc

SEQ ID NO: 778598 - RNA, 20 nt, Human
uaaaaagaaagcauuuguuu

SEQ ID NO: 778599 - RNA, 21 nt, Human
uaaaagcaagaaaagccuuac

SEQ ID NO: 778600 - RNA, 20 nt, Human
uaaacgacccaucuaagcua

SEQ ID NO: 778601 - RNA, 20 nt, Human
uaaacuacuuaaagcagcuc

SEQ ID NO: 778602 - RNA, 18 nt, Human
uaaagcagcucccuaaac

SEQ ID NO: 778603 - RNA, 20 nt, Human
uaaggagacuaaggcugugg

SEQ ID NO: 778604 - RNA, 19 nt, Human
uaagguaacuguacugcag

SEQ ID NO: 778605 - RNA, 23 nt, Human
uaaguaucaaacuauuuuuggug

SEQ ID NO: 778606 - RNA, 20 nt, Human
uacaauauccucguguccuc

SEQ ID NO: 778607 - RNA, 24 nt, Human
uacaaugcaaugugacugaaacag

SEQ ID NO: 778608 - RNA, 22 nt, Human
uacuugaaacauucacauuuga

SEQ ID NO: 778609 - RNA, 21 nt, Human
uagaaaaugauuuuuauccaa

SEQ ID NO: 778610 - RNA, 23 nt, Human
uagccaggaggaagaggucaguu

SEQ ID NO: 778611 - RNA, 23 nt, Human
uagcugaagaaccacuccaucac

SEQ ID NO: 778612 - RNA, 19 nt, Human
uauaguauggauaugaaaa

SEQ ID NO: 778613 - RNA, 22 nt, Human
uauuaaggaguuuuauauuugg

SEQ ID NO: 778614 - RNA, 20 nt, Human
uccacaaccuuggcuucuaa

SEQ ID NO: 778615 - RNA, 18 nt, Human
uccuccccaugcugcugc

SEQ ID NO: 778616 - RNA, 23 nt, Human
ucuagaaguagcaaugguuuugu

SEQ ID NO: 778617 - RNA, 24 nt, Human
ucuccagcacccauccuaucaucc

SEQ ID NO: 778618 - RNA, 19 nt, Human
ugaagaaccacuccaucac

SEQ ID NO: 778619 - RNA, 21 nt, Human
ugaagaaccacuccaucacaa

SEQ ID NO: 778620 - RNA, 20 nt, Human
ugauuuaagaguaaggagaa

SEQ ID NO: 778621 - RNA, 22 nt, Human
ugcacacacaugugacugaggc

SEQ ID NO: 778622 - RNA, 23 nt, Human
ugcaugcaauuguacaaagaaga

SEQ ID NO: 778623 - RNA, 21 nt, Human
ugcugcuaucaaagcaguucu

SEQ ID NO: 778624 - RNA, 22 nt, Human
ugcugcuaucaaagcaguucua

SEQ ID NO: 778625 - RNA, 22 nt, Human
ugcugcugcuaucaaagcaguu

SEQ ID NO: 778626 - RNA, 24 nt, Human
uguaaaaacaauaaaauuaaauaa

SEQ ID NO: 778627 - RNA, 25 nt, Human
ugugacugaggcauggccggggucc

SEQ ID NO: 778628 - RNA, 22 nt, Human
uguucauauuuauuaauagacu

SEQ ID NO: 778629 - RNA, 20 nt, Human
uuaaaaagugcuuauuccug

SEQ ID NO: 778630 - RNA, 21 nt, Human
uuauuaauauugccaugucac

SEQ ID NO: 778631 - RNA, 18 nt, Human
uucagcaaaucaacaggc

SEQ ID NO: 778632 - RNA, 23 nt, Human
uucaggguucucuuucccuaagg

SEQ ID NO: 778633 - RNA, 25 nt, Human
uugcauagccaaaacaauauugaga

SEQ ID NO: 778634 - RNA, 18 nt, Human
uuucacagaauaggaaac

SEQ ID NO: 778635 - RNA, 19 nt, Human
uuucaggguucucuuucua

SEQ ID NO: 778636 - RNA, 22 nt, Human
uuucaggucauuuuuccuucca

SEQ ID NO: 778637 - RNA, 22 nt, Human
uuugcugacuuuaaaaaauaaa

SEQ ID NO: 778638 - RNA, 21 nt, Human
uuugucccugagaauuuucau

SEQ ID NO: 778639 - RNA, 23 nt, Human
aaaaggaauucuuaccgugcaga

SEQ ID NO: 778640 - RNA, 20 nt, Human
aaacaaggccauaauaaagc

SEQ ID NO: 778641 - RNA, 22 nt, Human
aaacaaggccauaauaaagcac

SEQ ID NO: 778642 - RNA, 24 nt, Human
aaagugcugggauuacaggcguga

SEQ ID NO: 778643 - RNA, 21 nt, Human
aaauacaugcacugucacgug

SEQ ID NO: 778644 - RNA, 21 nt, Human
aagaugggguuucuccauguu

SEQ ID NO: 778645 - RNA, 24 nt, Human
aagaugggguuucuccauguuggc

SEQ ID NO: 778646 - RNA, 19 nt, Human
aagugcugggauuacaggc

SEQ ID NO: 778647 - RNA, 19 nt, Human
aagugcugggauuacaggc

SEQ ID NO: 778648 - RNA, 21 nt, Human
aauaaagcacagacacauccg

SEQ ID NO: 778649 - RNA, 22 nt, Human
aaugcaauauccugucuacuca

SEQ ID NO: 778650 - RNA, 18 nt, Human
aauguuaauauuuugaau

SEQ ID NO: 778651 - RNA, 21 nt, Human
acauccgacuccuacggacac

SEQ ID NO: 778652 - RNA, 19 nt, Human
accacagaaaaaacacaca

SEQ ID NO: 778653 - RNA, 19 nt, Human
accauaguuaaauguuuug

SEQ ID NO: 778654 - RNA, 20 nt, Human
acuccacugccucagggcag

SEQ ID NO: 778655 - RNA, 21 nt, Human
acuccugaccucaggucaucc

SEQ ID NO: 778656 - RNA, 25 nt, Human
acucuguugcccaggcuggagugca

SEQ ID NO: 778657 - RNA, 22 nt, Human
agaacucagauguaugggaugu

SEQ ID NO: 778658 - RNA, 22 nt, Human
agcagcgccagcgcgcggcaca

SEQ ID NO: 778659 - RNA, 28 nt, Human
agccaccagccuuguuuauaaauucaaa

SEQ ID NO: 778660 - RNA, 21 nt, Human
agccccagguagcccagcgcg

SEQ ID NO: 778661 - RNA, 19 nt, Human
aggaaaaguacaagguguc

SEQ ID NO: 778662 - RNA, 22 nt, Human
aggacaacguguaccuuccuuu

SEQ ID NO: 778663 - RNA, 20 nt, Human
aggcacggugcugcucuacc

SEQ ID NO: 778664 - RNA, 20 nt, Human
aggcacuuugguuuguuugg

SEQ ID NO: 778665 - RNA, 21 nt, Human
aggcagcuacuggaggccaag

SEQ ID NO: 778666 - RNA, 21 nt, Human
aggccaagcaccuccaggcac

SEQ ID NO: 778667 - RNA, 23 nt, Human
aggccgcggcugcggcgacacca

SEQ ID NO: 778668 - RNA, 25 nt, Human
aggcuggagugcaguggugcgaucu

SEQ ID NO: 778669 - RNA, 18 nt, Human
aggucauccgcccgccuc

SEQ ID NO: 778670 - RNA, 19 nt, Human
aguagcugggacuacaggc

SEQ ID NO: 778671 - RNA, 19 nt, Human
aguagcugggacuacaggc

SEQ ID NO: 778672 - RNA, 23 nt, Human
agugcaguggugcgaucuuggcu

SEQ ID NO: 778673 - RNA, 24 nt, Human
agugcaguggugcgaucuuggcuc

SEQ ID NO: 778674 - RNA, 21 nt, Human
agugcugcugcuuuauagauu

SEQ ID NO: 778675 - RNA, 18 nt, Human
agugcugggauuacaggc

SEQ ID NO: 778676 - RNA, 24 nt, Human
auaaagcacagacacauccgacuc

SEQ ID NO: 778677 - RNA, 31 nt, Human
auaacuaaauccaugaaauuauaaaaauaaa

SEQ ID NO: 778678 - RNA, 23 nt, Human
augaaacaagcuaaaagcuccaa

SEQ ID NO: 778679 - RNA, 18 nt, Human
augggguuucuccauguu

SEQ ID NO: 778680 - RNA, 20 nt, Human
augggguuucuccauguugg

SEQ ID NO: 778681 - RNA, 24 nt, Human
augggguuucuccauguuggccag

SEQ ID NO: 778682 - RNA, 22 nt, Human
auguaagaaauuucagauuagc

SEQ ID NO: 778683 - RNA, 24 nt, Human
caaagugcugggauuacaggcgug

SEQ ID NO: 778684 - RNA, 22 nt, Human
caaauaauccuauauacuaaca

SEQ ID NO: 778685 - RNA, 19 nt, Human
caagagcuaccgccgcccu

SEQ ID NO: 778686 - RNA, 22 nt, Human
caagcaauucuccugccucagc

SEQ ID NO: 778687 - RNA, 19 nt, Human
cacacagccuacgacacug

SEQ ID NO: 778688 - RNA, 22 nt, Human
cacacagcuacacacaggccug

SEQ ID NO: 778689 - RNA, 24 nt, Human
cacacgaauuuaauaaguuuuaga

SEQ ID NO: 778690 - RNA, 24 nt, Human
cacagaaaaaacacacagcuacac

SEQ ID NO: 778691 - RNA, 24 nt, Human
caccacgcccggcuaauuuuugua

SEQ ID NO: 778692 - RNA, 24 nt, Human
cacucuguugcccaggcuggagug

SEQ ID NO: 778693 - RNA, 21 nt, Human
cacugcaaccuccgccuccug

SEQ ID NO: 778694 - RNA, 23 nt, Human
cacugcaaccuccgccuccuggg

SEQ ID NO: 778695 - RNA, 19 nt, Human
cacuucagugccucagaau

SEQ ID NO: 778696 - RNA, 18 nt, Human
cagcagcagcgcgaagcu

SEQ ID NO: 778697 - RNA, 20 nt, Human
cagcagcgccagcgcgcggc

SEQ ID NO: 778698 - RNA, 18 nt, Human
cagcgcgagcgcgaggag

SEQ ID NO: 778699 - RNA, 19 nt, Human
caguggugcgaucuuggcu

SEQ ID NO: 778700 - RNA, 20 nt, Human
cauguacgagcuaacagagc

SEQ ID NO: 778701 - RNA, 24 nt, Human
cauguuggccaggcuggucuugaa

SEQ ID NO: 778702 - RNA, 23 nt, Human
cauucugcucuuucagugucugg

SEQ ID NO: 778703 - RNA, 22 nt, Human
ccaaagugcugggauuacaggc

SEQ ID NO: 778704 - RNA, 22 nt, Human
ccaaagugcugggauuacaggc

SEQ ID NO: 778705 - RNA, 24 nt, Human
ccaaagugcugggauuacaggcgu

SEQ ID NO: 778706 - RNA, 21 nt, Human
ccaugaaauuauaaaaauaac

SEQ ID NO: 778707 - RNA, 19 nt, Human
ccauguuggccaggcuggu

SEQ ID NO: 778708 - RNA, 21 nt, Human
ccauguuggccaggcuggucu

SEQ ID NO: 778709 - RNA, 21 nt, Human
ccauguuggccaggcuggucu

SEQ ID NO: 778710 - RNA, 24 nt, Human
cccacauguacgagcuaacagagc

SEQ ID NO: 778711 - RNA, 22 nt, Human
cccccgggguucucaggcccuc

SEQ ID NO: 778712 - RNA, 23 nt, Human
cccgaguagcugggacuacaggc

SEQ ID NO: 778713 - RNA, 24 nt, Human
cccgaguagcugggacuacaggcg

SEQ ID NO: 778714 - RNA, 21 nt, Human
cccuuuucuuagauaaacuga

SEQ ID NO: 778715 - RNA, 26 nt, Human
ccgccuccuggguucaagcaauucuu

SEQ ID NO: 778716 - RNA, 18 nt, Human
ccuacuuuaaggcacagg

SEQ ID NO: 778717 - RNA, 19 nt, Human
ccuccgccuccuggguuca

SEQ ID NO: 778718 - RNA, 24 nt, Human
ccuccuggguucaagcaauucucc

SEQ ID NO: 778719 - RNA, 24 nt, Human
ccugccucagccucccgaguagcu

SEQ ID NO: 778720 - RNA, 23 nt, Human
ccuggguucaagcaauucuccug

SEQ ID NO: 778721 - RNA, 24 nt, Human
ccuucauuggcuuggcucaaggua

SEQ ID NO: 778722 - RNA, 21 nt, Human
cgacacugcaacagagccuca

SEQ ID NO: 778723 - RNA, 20 nt, Human
cgacuccuacggacacagcu

SEQ ID NO: 778724 - RNA, 22 nt, Human
cgaggagaacccagcugaagcu

SEQ ID NO: 778725 - RNA, 24 nt, Human
cgccucggccucccaaagugcugg

SEQ ID NO: 778726 - RNA, 25 nt, Human
cgcguacacgggcagcagcagcgcg

SEQ ID NO: 778727 - RNA, 24 nt, Human
cggagucucacucuguugcccagg

SEQ ID NO: 778728 - RNA, 18 nt, Human
cggcacaggcgcagggcc

SEQ ID NO: 778729 - RNA, 24 nt, Human
cggcacaggcgcagggccuugagg

SEQ ID NO: 778730 - RNA, 23 nt, Human
cggcgacaccaggcgagcagcgc

SEQ ID NO: 778731 - RNA, 19 nt, Human
cgggcagcagcagcgcgaa

SEQ ID NO: 778732 - RNA, 19 nt, Human
cucaagguagaaaaguuaa

SEQ ID NO: 778733 - RNA, 24 nt, Human
cucacucuguugcccaggcuggag

SEQ ID NO: 778734 - RNA, 24 nt, Human
cucacugcaaccuccgccuccugg

SEQ ID NO: 778735 - RNA, 24 nt, Human
cucagccucccgaguagcugggac

SEQ ID NO: 778736 - RNA, 21 nt, Human
cuccacgcucagcacgccccc

SEQ ID NO: 778737 - RNA, 26 nt, Human
cuccugaccucaggucauccgcccgc

SEQ ID NO: 778738 - RNA, 21 nt, Human
cuccuggguucaagcaauucu

SEQ ID NO: 778739 - RNA, 23 nt, Human
cugcaaccuccgccuccuggguu

SEQ ID NO: 778740 - RNA, 19 nt, Human
cuguugcccaggcuggagu

SEQ ID NO: 778741 - RNA, 19 nt, Human
cuuauaagcccuucaacuu

SEQ ID NO: 778742 - RNA, 25 nt, Human
gaaaaaacacacagcuacacacagg

SEQ ID NO: 778743 - RNA, 24 nt, Human
gaacagcaggggccgggcucgcag

SEQ ID NO: 778744 - RNA, 24 nt, Human
gaccucaggucauccgcccgccuc

SEQ ID NO: 778745 - RNA, 23 nt, Human
gaggcagccugggaaguggcugc

SEQ ID NO: 778746 - RNA, 24 nt, Human
gaguagcugggacuacaggcgugc

SEQ ID NO: 778747 - RNA, 18 nt, Human
gauuacaggcgugagcca

SEQ ID NO: 778748 - RNA, 22 nt, Human
gauuacaggcgugagccaccgc

SEQ ID NO: 778749 - RNA, 23 nt, Human
gauuacaggcgugagccaccgca

SEQ ID NO: 778750 - RNA, 22 nt, Human
gcaacagagccucaccucacag

SEQ ID NO: 778751 - RNA, 22 nt, Human
gcaaccuccgccuccuggguuc

SEQ ID NO: 778752 - RNA, 25 nt, Human
gcagcagcagcgcgaagcuccgcgc

SEQ ID NO: 778753 - RNA, 21 nt, Human
gcagugggggguccagcugga

SEQ ID NO: 778754 - RNA, 18 nt, Human
gcccccaacccugguggu

SEQ ID NO: 778755 - RNA, 22 nt, Human
gcccggcuaauuuuuguauuuu

SEQ ID NO: 778756 - RNA, 20 nt, Human
gccucagccucccgaguagc

SEQ ID NO: 778757 - RNA, 19 nt, Human
gcgcggcacaggcgcaggg

SEQ ID NO: 778758 - RNA, 18 nt, Human
gcuagaagggaggguggg

SEQ ID NO: 778759 - RNA, 18 nt, Human
gcuagaagggaggguggg

SEQ ID NO: 778760 - RNA, 23 nt, Human
gcucgcagcuguggcgcccccaa

SEQ ID NO: 778761 - RNA, 23 nt, Human
gcuggucuugaacuccugaccuc

SEQ ID NO: 778762 - RNA, 20 nt, Human
gcuuggcucaagguagaaaa

SEQ ID NO: 778763 - RNA, 18 nt, Human
ggaaaugguuuauaaaga

SEQ ID NO: 778764 - RNA, 21 nt, Human
ggaaaugguuuauaaagaggc

SEQ ID NO: 778765 - RNA, 21 nt, Human
ggagguggaauaaaugcggca

SEQ ID NO: 778766 - RNA, 23 nt, Human
ggagucucacucuguugcccagg

SEQ ID NO: 778767 - RNA, 21 nt, Human
ggcacucaaggcccuggggac

SEQ ID NO: 778768 - RNA, 20 nt, Human
ggcagaaacauacuagcauu

SEQ ID NO: 778769 - RNA, 20 nt, Human
ggccgaggcgggcugggugc

SEQ ID NO: 778770 - RNA, 24 nt, Human
ggcuggucuugaacuccugaccuc

SEQ ID NO: 778771 - RNA, 18 nt, Human
gggcagcagcagcgcgaa

SEQ ID NO: 778772 - RNA, 22 nt, Human
gggguuucuccauguuggccag

SEQ ID NO: 778773 - RNA, 19 nt, Human
ggucuugaacuccugaccu

SEQ ID NO: 778774 - RNA, 24 nt, Human
gucauccgcccgccucggccuccc

SEQ ID NO: 778775 - RNA, 23 nt, Human
uaaaaggacaacguguaccuucc

SEQ ID NO: 778776 - RNA, 23 nt, Human
uaaaauaaacauaagacacuuca

SEQ ID NO: 778777 - RNA, 21 nt, Human
uaaaauucccuuuucuuagau

SEQ ID NO: 778778 - RNA, 24 nt, Human
uaaauacaugcacugucacgugaa

SEQ ID NO: 778779 - RNA, 24 nt, Human
uaacaauaucccaauauuaagguc

SEQ ID NO: 778780 - RNA, 23 nt, Human
uaacauugaaagucugcucuuac

SEQ ID NO: 778781 - RNA, 24 nt, Human
uaacauugaaagucugcucuuacu

SEQ ID NO: 778782 - RNA, 23 nt, Human
uaacccccaucccccaccgcugu

SEQ ID NO: 778783 - RNA, 18 nt, Human
uaagauguucucauggcu

SEQ ID NO: 778784 - RNA, 24 nt, Human
uaaguuacaacagcaauuaaaaua

SEQ ID NO: 778785 - RNA, 24 nt, Human
uaauuuuuguauuuuuaguaaaga

SEQ ID NO: 778786 - RNA, 21 nt, Human
uacacacuggacugcagaacu

SEQ ID NO: 778787 - RNA, 23 nt, Human
uacaggcgugagccaccgcaccc

SEQ ID NO: 778788 - RNA, 23 nt, Human
uacaggcgugcgcuccaccacca

SEQ ID NO: 778789 - RNA, 18 nt, Human
uacauguucguauuuguc

SEQ ID NO: 778790 - RNA, 23 nt, Human
uacccacaaguuguauaguucca

SEQ ID NO: 778791 - RNA, 18 nt, Human
uaccuuuaauugugucua

SEQ ID NO: 778792 - RNA, 21 nt, Human
uacgacacugcaacagagccu

SEQ ID NO: 778793 - RNA, 21 nt, Human
uacgcuucccaaauaauccua

SEQ ID NO: 778794 - RNA, 22 nt, Human
uacuuuuuaacccccauccccc

SEQ ID NO: 778795 - RNA, 23 nt, Human
uagcccagcgcguacacgggcag

SEQ ID NO: 778796 - RNA, 24 nt, Human
uaguaaagaugggguuucuccaug

SEQ ID NO: 778797 - RNA, 22 nt, Human
uaguuccaugaaacaagcuaaa

SEQ ID NO: 778798 - RNA, 18 nt, Human
uauccugucuacucacuc

SEQ ID NO: 778799 - RNA, 19 nt, Human
uauccugucuacucacucc

SEQ ID NO: 778800 - RNA, 22 nt, Human
uaugugccugaaaaagaagggc

SEQ ID NO: 778801 - RNA, 20 nt, Human
uauuuacauggcauaguaua

SEQ ID NO: 778802 - RNA, 24 nt, Human
uauuuauuuuuugagacggagucu

SEQ ID NO: 778803 - RNA, 21 nt, Human
ucaagagugucugacaucgcu

SEQ ID NO: 778804 - RNA, 22 nt, Human
ucaagagugucugacaucgcug

SEQ ID NO: 778805 - RNA, 19 nt, Human
ucaagcaauucuccugccu

SEQ ID NO: 778806 - RNA, 21 nt, Human
ucaaugauaauauuggccaaa

SEQ ID NO: 778807 - RNA, 20 nt, Human
ucacgugaaauuaguugaac

SEQ ID NO: 778808 - RNA, 23 nt, Human
ucacugcaaccuccgccuccugg

SEQ ID NO: 778809 - RNA, 24 nt, Human
ucacugcaaccuccgccuccuggg

SEQ ID NO: 778810 - RNA, 25 nt, Human
ucacugcaaccuccgccuccugggu

SEQ ID NO: 778811 - RNA, 26 nt, Human
ucacugcaaccuccgccuccuggguu

SEQ ID NO: 778812 - RNA, 19 nt, Human
ucagauguaugggauguug

SEQ ID NO: 778813 - RNA, 23 nt, Human
ucagccucccgaguagcugggac

SEQ ID NO: 778814 - RNA, 20 nt, Human
ucagggcaggcacggugcug

SEQ ID NO: 778815 - RNA, 23 nt, Human
uccacagacacaagagcuaccgc

SEQ ID NO: 778816 - RNA, 24 nt, Human
uccacgcucagcacgcccccgggg

SEQ ID NO: 778817 - RNA, 24 nt, Human
uccauaaauaccauaguuaaaugu

SEQ ID NO: 778818 - RNA, 19 nt, Human
uccaugaaacaagcuaaaa

SEQ ID NO: 778819 - RNA, 24 nt, Human
ucccaaagugcugggauuacaggc

SEQ ID NO: 778820 - RNA, 24 nt, Human
ucccaauauuaaggucagucaugg

SEQ ID NO: 778821 - RNA, 24 nt, Human
ucccgaguagcugggacuacaggc

SEQ ID NO: 778822 - RNA, 18 nt, Human
ucccgggcggcucagccc

SEQ ID NO: 778823 - RNA, 24 nt, Human
uccgccuccuggguucaagcaauu

SEQ ID NO: 778824 - RNA, 19 nt, Human
uccuacuuuaaggcacagg

SEQ ID NO: 778825 - RNA, 21 nt, Human
uccuggagugcugaguguggc

SEQ ID NO: 778826 - RNA, 21 nt, Human
uccuggguucaagcaauucuc

SEQ ID NO: 778827 - RNA, 24 nt, Human
uccuggguucaagcaauucuccug

SEQ ID NO: 778828 - RNA, 20 nt, Human
ucgaugguggcuucacuccg

SEQ ID NO: 778829 - RNA, 18 nt, Human
ucggccucccaaagugcu

SEQ ID NO: 778830 - RNA, 23 nt, Human
ucucacucuguugcccaggcugg

SEQ ID NO: 778831 - RNA, 24 nt, Human
ucucacucuguugcccaggcugga

SEQ ID NO: 778832 - RNA, 26 nt, Human
ucucacucuguugcccaggcuggagu

SEQ ID NO: 778833 - RNA, 24 nt, Human
ucuccugccucagccucccgagua

SEQ ID NO: 778834 - RNA, 18 nt, Human
ucuguugcccaggcugga

SEQ ID NO: 778835 - RNA, 24 nt, Human
ucuguugcccaggcuggagugcag

SEQ ID NO: 778836 - RNA, 23 nt, Human
ucuugaacuccugaccucagguc

SEQ ID NO: 778837 - RNA, 24 nt, Human
ugacagaagacuuucaacagaccu

SEQ ID NO: 778838 - RNA, 18 nt, Human
ugaccucaggucauccgc

SEQ ID NO: 778839 - RNA, 20 nt, Human
ugaccucaggucauccgccc

SEQ ID NO: 778840 - RNA, 24 nt, Human
ugaccucaggucauccgcccgccu

SEQ ID NO: 778841 - RNA, 20 nt, Human
ugagaacuuuuugcugccaa

SEQ ID NO: 778842 - RNA, 19 nt, Human
ugagaggguguguuccggg

SEQ ID NO: 778843 - RNA, 24 nt, Human
ugagcagaguccacagacacaaga

SEQ ID NO: 778844 - RNA, 19 nt, Human
ugagccccagguagcccag

SEQ ID NO: 778845 - RNA, 19 nt, Human
ugaggaaaaguacaaggug

SEQ ID NO: 778846 - RNA, 24 nt, Human
ugagugcugcugcuuuauagauua

SEQ ID NO: 778847 - RNA, 23 nt, Human
ugcaacagagccucaccucacag

SEQ ID NO: 778848 - RNA, 25 nt, Human
ugcaauauccugucuacucacucca

SEQ ID NO: 778849 - RNA, 21 nt, Human
ugccaagaugaaaaugauuau

SEQ ID NO: 778850 - RNA, 18 nt, Human
ugcccaggcuggagugca

SEQ ID NO: 778851 - RNA, 21 nt, Human
ugcccaggcuggagugcagug

SEQ ID NO: 778852 - RNA, 24 nt, Human
ugcccaggcuggagugcaguggug

SEQ ID NO: 778853 - RNA, 24 nt, Human
ugccucagccucccgaguagcugg

SEQ ID NO: 778854 - RNA, 19 nt, Human
ugccucagggcaggcacgg

SEQ ID NO: 778855 - RNA, 25 nt, Human
ugccugaaaaagaagggccgaccuc

SEQ ID NO: 778856 - RNA, 23 nt, Human
ugcggcaaccacagaaaaaacac

SEQ ID NO: 778857 - RNA, 24 nt, Human
ugcugggauuacaggcgugagcca

SEQ ID NO: 778858 - RNA, 18 nt, Human
uggaaaaugaacccaggc

SEQ ID NO: 778859 - RNA, 23 nt, Human
uggaaaugguuuauaaagaggcu

SEQ ID NO: 778860 - RNA, 24 nt, Human
uggagagcuacgcugaagaggacg

SEQ ID NO: 778861 - RNA, 23 nt, Human
uggagugcaguggugcgaucuug

SEQ ID NO: 778862 - RNA, 24 nt, Human
uggagugcaguggugcgaucuugg

SEQ ID NO: 778863 - RNA, 21 nt, Human
uggagugcugaguguggccuc

SEQ ID NO: 778864 - RNA, 24 nt, Human
uggccaggcuggucuugaacuccu

SEQ ID NO: 778865 - RNA, 19 nt, Human
uggcugcugagaacagcag

SEQ ID NO: 778866 - RNA, 18 nt, Human
uggcuuggcucaagguag

SEQ ID NO: 778867 - RNA, 23 nt, Human
uggcuuggcucaagguagaaaag

SEQ ID NO: 778868 - RNA, 18 nt, Human
ugggaaaacauugaaaau

SEQ ID NO: 778869 - RNA, 18 nt, Human
ugggacuacaggcgugcg

SEQ ID NO: 778870 - RNA, 26 nt, Human
ugggacuacaggcgugcgcuccacca

SEQ ID NO: 778871 - RNA, 28 nt, Human
ugggacuacaggcgugcgcuccaccacc

SEQ ID NO: 778872 - RNA, 29 nt, Human
ugggacuacaggcgugcgcuccaccacca

SEQ ID NO: 778873 - RNA, 19 nt, Human
ugggauuacaggcgugagc

SEQ ID NO: 778874 - RNA, 21 nt, Human
ugggauuacaggcgugagcca

SEQ ID NO: 778875 - RNA, 22 nt, Human
ugggauuacaggcgugagccac

SEQ ID NO: 778876 - RNA, 23 nt, Human
ugggauuacaggcgugagccacc

SEQ ID NO: 778877 - RNA, 24 nt, Human
ugggauuacaggcgugagccaccg

SEQ ID NO: 778878 - RNA, 24 nt, Human
ugggguuucuccauguuggccagg

SEQ ID NO: 778879 - RNA, 25 nt, Human
uggguagacagccaccagccuuguu

SEQ ID NO: 778880 - RNA, 24 nt, Human
uggguagacgccacccgccccguc

SEQ ID NO: 778881 - RNA, 21 nt, Human
uggguucaagcaauucuccug

SEQ ID NO: 778882 - RNA, 23 nt, Human
uggguucaagcaauucuccugcc

SEQ ID NO: 778883 - RNA, 21 nt, Human
uggugguggccagugcacauc

SEQ ID NO: 778884 - RNA, 21 nt, Human
uguauuuuuaguaaagauggg

SEQ ID NO: 778885 - RNA, 24 nt, Human
ugugaagcuacagacuccauuaua

SEQ ID NO: 778886 - RNA, 21 nt, Human
ugugagaggguguguuccggg

SEQ ID NO: 778887 - RNA, 20 nt, Human
ugugugcauacauguucgua

SEQ ID NO: 778888 - RNA, 23 nt, Human
uuaaaauaaacauaagacacuuc

SEQ ID NO: 778889 - RNA, 21 nt, Human
uuacacacuggacugcagaac

SEQ ID NO: 778890 - RNA, 18 nt, Human
uuaguaaagaugggguuu

SEQ ID NO: 778891 - RNA, 24 nt, Human
uuaguaaagaugggguuucuccau

SEQ ID NO: 778892 - RNA, 21 nt, Human
uuauaaauugaaacaaaauca

SEQ ID NO: 778893 - RNA, 21 nt, Human
uucaagcaauucuccugccuc

SEQ ID NO: 778894 - RNA, 24 nt, Human
uucaagcaauucuccugccucagc

SEQ ID NO: 778895 - RNA, 19 nt, Human
uuccuuauaagcccuucaa

SEQ ID NO: 778896 - RNA, 24 nt, Human
uugcccaggcuggagugcaguggu

SEQ ID NO: 778897 - RNA, 23 nt, Human
uuguauuuuuaguaaagaugggg

SEQ ID NO: 778898 - RNA, 20 nt, Human
uuuacagacacacacagccu

SEQ ID NO: 778899 - RNA, 21 nt, Human
uuucuccauguuggccaggcu

SEQ ID NO: 778900 - RNA, 20 nt, Human
uuuucuuuucaaaaagaaac

SEQ ID NO: 778901 - RNA, 22 nt, Human
uuuuuaguaaagaugggguuuc

SEQ ID NO: 778902 - RNA, 20 nt, Human
uuuuuguauuuuuaguaaag

SEQ ID NO: 778903 - RNA, 23 nt, Human
uuuuuguauuuuuaguaaagaug

SEQ ID NO: 778904 - RNA, 19 nt, Human
aaaaagggucagaggcgcc

SEQ ID NO: 778905 - RNA, 21 nt, Human
aaaaguuuagaaauaaaugga

SEQ ID NO: 778906 - RNA, 25 nt, Human
aaauacugcccacuuaacugucccc

SEQ ID NO: 778907 - RNA, 18 nt, Human
aauauacauucauuuagc

SEQ ID NO: 778908 - RNA, 19 nt, Human
acaccauuuauuaaauagg

SEQ ID NO: 778909 - RNA, 24 nt, Human
accaggcgaauuccuagaccugcu

SEQ ID NO: 778910 - RNA, 19 nt, Human
acuaauuuacacucccacc

SEQ ID NO: 778911 - RNA, 19 nt, Human
acuacaguggguagacuag

SEQ ID NO: 778912 - RNA, 24 nt, Human
agaaaauacaaaaaggccugcagg

SEQ ID NO: 778913 - RNA, 20 nt, Human
agagguccuucacauuccuu

SEQ ID NO: 778914 - RNA, 24 nt, Human
agauucuggauauuggcccuuugu

SEQ ID NO: 778915 - RNA, 24 nt, Human
agcaauaauagcauucauuccaaa

SEQ ID NO: 778916 - RNA, 21 nt, Human
agggagcgggacgcagggggc

SEQ ID NO: 778917 - RNA, 24 nt, Human
agguauuuuauucucuuuguggca

SEQ ID NO: 778918 - RNA, 26 nt, Human
auccuauuucuccacauccucuccag

SEQ ID NO: 778919 - RNA, 21 nt, Human
auggaauguuuuccauuuguu

SEQ ID NO: 778920 - RNA, 26 nt, Human
auggcaauaaaaucaaauugugcaug

SEQ ID NO: 778921 - RNA, 21 nt, Human
auggcugcauaguauuccaug

SEQ ID NO: 778922 - RNA, 21 nt, Human
augguauugccuagguuuuuc

SEQ ID NO: 778923 - RNA, 24 nt, Human
augguauuucugguucuagauccu

SEQ ID NO: 778924 - RNA, 23 nt, Human
caaaaaucauuuaacucuugaau

SEQ ID NO: 778925 - RNA, 24 nt, Human
caaauaucaucuagccuccaauua

SEQ ID NO: 778926 - RNA, 18 nt, Human
caacaguguaaaagcauc

SEQ ID NO: 778927 - RNA, 19 nt, Human
caauucaaauggggcugaa

SEQ ID NO: 778928 - RNA, 24 nt, Human
cacucugaugauaguuucuuuugc

SEQ ID NO: 778929 - RNA, 19 nt, Human
cacuugggaauuaaaaaaa

SEQ ID NO: 778930 - RNA, 19 nt, Human
cagauaagcaauaauagca

SEQ ID NO: 778931 - RNA, 22 nt, Human
cagaucuguacauccauucugc

SEQ ID NO: 778932 - RNA, 19 nt, Human
cagcaucuguuguuuccug

SEQ ID NO: 778933 - RNA, 24 nt, Human
cagcgacuucuccacauaaggccc

SEQ ID NO: 778934 - RNA, 21 nt, Human
caguuucaguuuucugcauau

SEQ ID NO: 778935 - RNA, 23 nt, Human
cauaucagguguucaaugacacc

SEQ ID NO: 778936 - RNA, 22 nt, Human
caucaacccgucaucuacauua

SEQ ID NO: 778937 - RNA, 21 nt, Human
caucuguuguuuccugucuuu

SEQ ID NO: 778938 - RNA, 27 nt, Human
ccaacaccauuuauuaaauagggaauc

SEQ ID NO: 778939 - RNA, 18 nt, Human
ccacauuuucuuuauuca

SEQ ID NO: 778940 - RNA, 20 nt, Human
cccagcucaggaaaugaggc

SEQ ID NO: 778941 - RNA, 21 nt, Human
ccccacgcccugacaggcccu

SEQ ID NO: 778942 - RNA, 18 nt, Human
cccuggaaggcauaaaac

SEQ ID NO: 778943 - RNA, 24 nt, Human
cgucgccgcgauauaaaaaaaggg

SEQ ID NO: 778944 - RNA, 19 nt, Human
cuagauagaaaagagagaa

SEQ ID NO: 778945 - RNA, 21 nt, Human
cucuccagcaucuguuguuuc

SEQ ID NO: 778946 - RNA, 24 nt, Human
cugcaauggaaaccguggcaaucc

SEQ ID NO: 778947 - RNA, 18 nt, Human
cugcagguaagcagggca

SEQ ID NO: 778948 - RNA, 18 nt, Human
cuuaaaaguugauagaau

SEQ ID NO: 778949 - RNA, 24 nt, Human
cuuccgcagugguugaacuaauuu

SEQ ID NO: 778950 - RNA, 20 nt, Human
cuugauggggauagcacuga

SEQ ID NO: 778951 - RNA, 18 nt, Human
cuuuccccauuucuuguu

SEQ ID NO: 778952 - RNA, 21 nt, Human
cuuugcacacuuuuugauggg

SEQ ID NO: 778953 - RNA, 18 nt, Human
gacauuucaggcuucccg

SEQ ID NO: 778954 - RNA, 19 nt, Human
gaugauaguuucuuuugcu

SEQ ID NO: 778955 - RNA, 21 nt, Human
gauucuggauauuggcccuuu

SEQ ID NO: 778956 - RNA, 21 nt, Human
gcacacuuuuugaugggguuu

SEQ ID NO: 778957 - RNA, 23 nt, Human
gcagggcacugugggagacacca

SEQ ID NO: 778958 - RNA, 19 nt, Human
gcccugacaggcccuggug

SEQ ID NO: 778959 - RNA, 18 nt, Human
gcgauauaaaaaaagggu

SEQ ID NO: 778960 - RNA, 24 nt, Human
ggaauccuuuccccauuucuuguu

SEQ ID NO: 778961 - RNA, 21 nt, Human
ggacaugaacucauccuuuuu

SEQ ID NO: 778962 - RNA, 19 nt, Human
ggcugcauaguauuccaug

SEQ ID NO: 778963 - RNA, 19 nt, Human
ggucagaggcgccacggcu

SEQ ID NO: 778964 - RNA, 21 nt, Human
ggucagaggcgccacggcugc

SEQ ID NO: 778965 - RNA, 25 nt, Human
ggugugacaugguaucucacuguag

SEQ ID NO: 778966 - RNA, 18 nt, Human
gguuacuguagccuugua

SEQ ID NO: 778967 - RNA, 23 nt, Human
guaguauaguuugaagucaggua

SEQ ID NO: 778968 - RNA, 24 nt, Human
guaguuuugauuugcauuucucug

SEQ ID NO: 778969 - RNA, 18 nt, Human
gugugcaugugucucuau

SEQ ID NO: 778970 - RNA, 20 nt, Human
gugugcaugugucucuauag

SEQ ID NO: 778971 - RNA, 20 nt, Human
guuccuguucacucugauga

SEQ ID NO: 778972 - RNA, 18 nt, Human
uaaaaaaagggucagagg

SEQ ID NO: 778973 - RNA, 22 nt, Human
uaaaaucaaauugugcaugcca

SEQ ID NO: 778974 - RNA, 22 nt, Human
uaaauaauucuuaauacucuca

SEQ ID NO: 778975 - RNA, 21 nt, Human
uaaaugucuucucuugagaag

SEQ ID NO: 778976 - RNA, 19 nt, Human
uaaugugaacauuuucuua

SEQ ID NO: 778977 - RNA, 22 nt, Human
uacaaaaaggccugcagguaag

SEQ ID NO: 778978 - RNA, 21 nt, Human
uacauguacagaacguacagg

SEQ ID NO: 778979 - RNA, 21 nt, Human
uagauucuggauauuggcccu

SEQ ID NO: 778980 - RNA, 19 nt, Human
uagcagcaugauuuauagu

SEQ ID NO: 778981 - RNA, 19 nt, Human
uaggaaggaaggcaaggga

SEQ ID NO: 778982 - RNA, 25 nt, Human
uaggguagaauauaaaaugucaaug

SEQ ID NO: 778983 - RNA, 21 nt, Human
uauaauauacauucauuuagc

SEQ ID NO: 778984 - RNA, 26 nt, Human
uaucagaaagucaaauggugaguuaa

SEQ ID NO: 778985 - RNA, 19 nt, Human
uaucagguuuaacaaaaca

SEQ ID NO: 778986 - RNA, 19 nt, Human
uaucccuccccuagccccc

SEQ ID NO: 778987 - RNA, 24 nt, Human
uauugugaauagugccacaauaaa

SEQ ID NO: 778988 - RNA, 21 nt, Human
ucaaauggugaguuaaaaaaa

SEQ ID NO: 778989 - RNA, 21 nt, Human
ucacauuccuuguaauuugga

SEQ ID NO: 778990 - RNA, 22 nt, Human
uccaguuucaguuuucugccac

SEQ ID NO: 778991 - RNA, 22 nt, Human
uccccauuucuuguuuuucuca

SEQ ID NO: 778992 - RNA, 20 nt, Human
ucccugcaaaggacaugaac

SEQ ID NO: 778993 - RNA, 24 nt, Human
uccgcagugguugaacuaauuuac

SEQ ID NO: 778994 - RNA, 22 nt, Human
uccuaaguaggugaguucacug

SEQ ID NO: 778995 - RNA, 20 nt, Human
uccuuaagcagugguuugua

SEQ ID NO: 778996 - RNA, 24 nt, Human
ucuaauguuaucccuccccuagcc

SEQ ID NO: 778997 - RNA, 25 nt, Human
ucucugaaugaccagugaugagcuu

SEQ ID NO: 778998 - RNA, 19 nt, Human
ucuucauauuacacugguu

SEQ ID NO: 778999 - RNA, 23 nt, Human
ucuuugcuauugugaauagugcc

SEQ ID NO: 779000 - RNA, 18 nt, Human
ucuuuuuaaugaucacca

SEQ ID NO: 779001 - RNA, 19 nt, Human
ugaaguauucguccaugcc

SEQ ID NO: 779002 - RNA, 22 nt, Human
ugaagucagguagcgugaugcc

SEQ ID NO: 779003 - RNA, 20 nt, Human
ugacaugguaucucacugua

SEQ ID NO: 779004 - RNA, 24 nt, Human
ugacaugguaucucacuguaguuu

SEQ ID NO: 779005 - RNA, 24 nt, Human
ugaccagugaugagcuuuuuuuca

SEQ ID NO: 779006 - RNA, 24 nt, Human
ugagaaugaugguuuccagcuuca

SEQ ID NO: 779007 - RNA, 24 nt, Human
ugagugagaacaugcgguguuugg

SEQ ID NO: 779008 - RNA, 20 nt, Human
ugaguuaaaaaaaaguuuaa

SEQ ID NO: 779009 - RNA, 22 nt, Human
ugaguucacugacaaugcuuua

SEQ ID NO: 779010 - RNA, 22 nt, Human
ugauaguuucuuuugcugugca

SEQ ID NO: 779011 - RNA, 23 nt, Human
uggaaaccguggcaauccuucuu

SEQ ID NO: 779012 - RNA, 20 nt, Human
uggaaggcauaaaacacaca

SEQ ID NO: 779013 - RNA, 21 nt, Human
uggaaggcauaaaacacacaa

SEQ ID NO: 779014 - RNA, 27 nt, Human
uggacagaaaauacaaaaaggccugca

SEQ ID NO: 779015 - RNA, 19 nt, Human
uggcaauaaaaucaaauug

SEQ ID NO: 779016 - RNA, 19 nt, Human
uggcuagccaguuuuccca

SEQ ID NO: 779017 - RNA, 24 nt, Human
uggcuccaagucuuugcuauugug

SEQ ID NO: 779018 - RNA, 19 nt, Human
ugguguaugugccacauuu

SEQ ID NO: 779019 - RNA, 20 nt, Human
uggugugugauguucccugc

SEQ ID NO: 779020 - RNA, 22 nt, Human
uguaaggaagggauccaguuuc

SEQ ID NO: 779021 - RNA, 23 nt, Human
uguacauccauucugcaccaccc

SEQ ID NO: 779022 - RNA, 20 nt, Human
uguaugugccacauuuucuu

SEQ ID NO: 779023 - RNA, 20 nt, Human
ugucuugguuaugugagcuc

SEQ ID NO: 779024 - RNA, 20 nt, Human
ugugaagaaagucaauggua

SEQ ID NO: 779025 - RNA, 22 nt, Human
uguucaaugacaccugauaccu

SEQ ID NO: 779026 - RNA, 24 nt, Human
uguuugguuuucuguucuuguguu

SEQ ID NO: 779027 - RNA, 21 nt, Human
uuacauagguauacacguggu

SEQ ID NO: 779028 - RNA, 24 nt, Human
uuaugagugagaacaugcgguguu

SEQ ID NO: 779029 - RNA, 23 nt, Human
uucacugacaaugcuuuagauaa

SEQ ID NO: 779030 - RNA, 18 nt, Human
uuccaugguguaugugcc

SEQ ID NO: 779031 - RNA, 20 nt, Human
uuccugauguugugcuuucu

SEQ ID NO: 779032 - RNA, 24 nt, Human
uucuuuguagauucuggauauugg

SEQ ID NO: 779033 - RNA, 18 nt, Human
uugaugggguuuuuuuuc

SEQ ID NO: 779034 - RNA, 21 nt, Human
uugccuagguuuuccucuagg

SEQ ID NO: 779035 - RNA, 24 nt, Human
uuggacagaaaauacaaaaaggcc

SEQ ID NO: 779036 - RNA, 23 nt, Human
uuuacacucccaccaacagugua

SEQ ID NO: 779037 - RNA, 21 nt, Human
uuuacauccuucauaucaggu

SEQ ID NO: 779038 - RNA, 19 nt, Human
uuuccagcuucauccaugu

SEQ ID NO: 779039 - RNA, 23 nt, Human
uuucuaauguuaucccuccccua

SEQ ID NO: 779040 - RNA, 20 nt, Human
uuucugguucuagauccuug

SEQ ID NO: 779041 - RNA, 19 nt, Human
uuucuuguuuuucucaggu

SEQ ID NO: 779042 - RNA, 18 nt, Human
uuugcacacuuuuugaug

SEQ ID NO: 779043 - RNA, 20 nt, Human
uuuggcaccaguaccaugcu

SEQ ID NO: 779044 - RNA, 22 nt, Human
uuuuccauuuguuuguguccuc

SEQ ID NO: 779045 - RNA, 24 nt, Human
aaacucagcaagcuuguccacaga

SEQ ID NO: 779046 - RNA, 19 nt, Human
aacuaaugggcuggugugu

SEQ ID NO: 779047 - RNA, 18 nt, Human
aacucacuucagcaacaa

SEQ ID NO: 779048 - RNA, 21 nt, Human
aacuguugaaaaccugcaacu

SEQ ID NO: 779049 - RNA, 20 nt, Human
aagaugccaugcuuccauga

SEQ ID NO: 779050 - RNA, 24 nt, Human
aaggaucaugaaacagaaacauua

SEQ ID NO: 779051 - RNA, 18 nt, Human
aaucaccaaacccuccac

SEQ ID NO: 779052 - RNA, 20 nt, Human
aauccuaaaacugaaacuaa

SEQ ID NO: 779053 - RNA, 22 nt, Human
acaacaaugaaaguacaauagc

SEQ ID NO: 779054 - RNA, 23 nt, Human
acaacucuagccuuaaccuuaac

SEQ ID NO: 779055 - RNA, 20 nt, Human
acagacacauccaaagccaa

SEQ ID NO: 779056 - RNA, 19 nt, Human
acagcagcaucaugacccc

SEQ ID NO: 779057 - RNA, 25 nt, Human
acaggggaaagaccccauaaccaaa

SEQ ID NO: 779058 - RNA, 20 nt, Human
acauccaaagccaaaaugca

SEQ ID NO: 779059 - RNA, 24 nt, Human
acccuuaaagacaacucuagccuu

SEQ ID NO: 779060 - RNA, 21 nt, Human
acccuuacccuuuuccucaaa

SEQ ID NO: 779061 - RNA, 23 nt, Human
agaaagcucugaauauacuacga

SEQ ID NO: 779062 - RNA, 21 nt, Human
agaacuuacaauuuaaugcua

SEQ ID NO: 779063 - RNA, 18 nt, Human
agacacauccaaagccaa

SEQ ID NO: 779064 - RNA, 19 nt, Human
aggaagucauggguugcug

SEQ ID NO: 779065 - RNA, 19 nt, Human
agugcaguggcaugcaugc

SEQ ID NO: 779066 - RNA, 23 nt, Human
auaaauuucuguaguuguauaaa

SEQ ID NO: 779067 - RNA, 23 nt, Human
auccauucccaaucaccaaaccc

SEQ ID NO: 779068 - RNA, 19 nt, Human
augaaacagaaacauuaac

SEQ ID NO: 779069 - RNA, 24 nt, Human
auggguguucuaaaagcaaggaca

SEQ ID NO: 779070 - RNA, 22 nt, Human
caaaccuaaccuccauccugac

SEQ ID NO: 779071 - RNA, 23 nt, Human
caacaccucgugcggaauccggc

SEQ ID NO: 779072 - RNA, 19 nt, Human
caacgcuuacuccaaaccu

SEQ ID NO: 779073 - RNA, 19 nt, Human
cacagacacauccaaagcc

SEQ ID NO: 779074 - RNA, 23 nt, Human
cacagacacauccaaagccaaaa

SEQ ID NO: 779075 - RNA, 18 nt, Human
caccagcacuggccccaa

SEQ ID NO: 779076 - RNA, 18 nt, Human
caccaggaccuuccccga

SEQ ID NO: 779077 - RNA, 22 nt, Human
cagaacuuacaauuuaaugcua

SEQ ID NO: 779078 - RNA, 19 nt, Human
cagaagccgcccgucaaca

SEQ ID NO: 779079 - RNA, 20 nt, Human
cagcgacauggggaaaagag

SEQ ID NO: 779080 - RNA, 20 nt, Human
caguggcaugcaugcuauag

SEQ ID NO: 779081 - RNA, 19 nt, Human
caucuaaagacacaacuuu

SEQ ID NO: 779082 - RNA, 24 nt, Human
ccaacaucuuaacaacuacuggcc

SEQ ID NO: 779083 - RNA, 26 nt, Human
ccaacccugaccuaaccugguccuaa

SEQ ID NO: 779084 - RNA, 19 nt, Human
ccacagacacauccaaagc

SEQ ID NO: 779085 - RNA, 19 nt, Human
cccaauccaacccugaccu

SEQ ID NO: 779086 - RNA, 25 nt, Human
cccauaaccaaaucagcuucagaac

SEQ ID NO: 779087 - RNA, 20 nt, Human
ccccggggccgcgcgggcuc

SEQ ID NO: 779088 - RNA, 20 nt, Human
cccgacgccggccuccagcc

SEQ ID NO: 779089 - RNA, 21 nt, Human
cccgcggcgccgcagucgccg

SEQ ID NO: 779090 - RNA, 24 nt, Human
cccuccacauacaguagugcucaa

SEQ ID NO: 779091 - RNA, 19 nt, Human
ccgggucucaguuguagcc

SEQ ID NO: 779092 - RNA, 23 nt, Human
ccuaacccuaacccuuaaagaca

SEQ ID NO: 779093 - RNA, 19 nt, Human
ccuccagcccgcggcgccg

SEQ ID NO: 779094 - RNA, 22 nt, Human
ccuccauccugacacuaucacu

SEQ ID NO: 779095 - RNA, 21 nt, Human
ccugaacucacuucagcaaca

SEQ ID NO: 779096 - RNA, 28 nt, Human
ccugaccuaaccugguccuaacccuaac

SEQ ID NO: 779097 - RNA, 26 nt, Human
ccugguccuaacccuaacccuuaaag

SEQ ID NO: 779098 - RNA, 23 nt, Human
cgccgcagucgccgccgccgccg

SEQ ID NO: 779099 - RNA, 20 nt, Human
cuaaaacugaaacuaacccu

SEQ ID NO: 779100 - RNA, 22 nt, Human
cuaaacccaauccaacccugac

SEQ ID NO: 779101 - RNA, 18 nt, Human
cuaaagacacaacuggua

SEQ ID NO: 779102 - RNA, 19 nt, Human
cuaacaccagcacuggccc

SEQ ID NO: 779103 - RNA, 23 nt, Human
cuaauccuaaaacugaaacuaac

SEQ ID NO: 779104 - RNA, 22 nt, Human
cuaaugggcugguguguccucc

SEQ ID NO: 779105 - RNA, 24 nt, Human
cucacugucccccauccauuccca

SEQ ID NO: 779106 - RNA, 22 nt, Human
cuccucacugucccccauccau

SEQ ID NO: 779107 - RNA, 18 nt, Human
cugaacucacuucagcaa

SEQ ID NO: 779108 - RNA, 22 nt, Human
cugaacucacuucagcaacaac

SEQ ID NO: 779109 - RNA, 22 nt, Human
cugguccuaacccuaacccuua

SEQ ID NO: 779110 - RNA, 20 nt, Human
cuuucccucuucuuugacuu

SEQ ID NO: 779111 - RNA, 20 nt, Human
gacacauccaaagccaaaaa

SEQ ID NO: 779112 - RNA, 27 nt, Human
gauuacuuucuuauaaauuuuccaaaa

SEQ ID NO: 779113 - RNA, 18 nt, Human
gccccggggccgcgcggg

SEQ ID NO: 779114 - RNA, 24 nt, Human
gcuauaguauuuuguucauccuug

SEQ ID NO: 779115 - RNA, 27 nt, Human
gguagagaaacucagcaagcuugucca

SEQ ID NO: 779116 - RNA, 19 nt, Human
gucauggguugcuguguuu

SEQ ID NO: 779117 - RNA, 22 nt, Human
guccacagacacauccaaagcc

SEQ ID NO: 779118 - RNA, 27 nt, Human
uaaacuaaauucugauuccaaccccug

SEQ ID NO: 779119 - RNA, 19 nt, Human
uaaagacaacucuagccuu

SEQ ID NO: 779120 - RNA, 22 nt, Human
uaacccuaacccuuaaagacaa

SEQ ID NO: 779121 - RNA, 18 nt, Human
uaaccuccauccugacac

SEQ ID NO: 779122 - RNA, 21 nt, Human
uaaccuccauccugacacuau

SEQ ID NO: 779123 - RNA, 24 nt, Human
uaaggaucaugaaacagaaacauu

SEQ ID NO: 779124 - RNA, 20 nt, Human
uaaugccaacaucuuaacaa

SEQ ID NO: 779125 - RNA, 18 nt, Human
uaccacucugugcuaguc

SEQ ID NO: 779126 - RNA, 22 nt, Human
uacccuuuuccucaaaucuuaa

SEQ ID NO: 779127 - RNA, 22 nt, Human
uacucuguguuuucuuccaugg

SEQ ID NO: 779128 - RNA, 21 nt, Human
uaggauguaccacucugugcu

SEQ ID NO: 779129 - RNA, 24 nt, Human
uauacaggggaaagaccccauaac

SEQ ID NO: 779130 - RNA, 22 nt, Human
uaucacuaacaccagcacuggc

SEQ ID NO: 779131 - RNA, 18 nt, Human
ucauggguugcuguguuu

SEQ ID NO: 779132 - RNA, 23 nt, Human
uccacagacacauccaaagccaa

SEQ ID NO: 779133 - RNA, 19 nt, Human
uccauagaaucuagucuuu

SEQ ID NO: 779134 - RNA, 18 nt, Human
uccccgacgccggccucc

SEQ ID NO: 779135 - RNA, 23 nt, Human
uccccgacgccggccuccagccc

SEQ ID NO: 779136 - RNA, 20 nt, Human
ucgccgccgccgccgcgaag

SEQ ID NO: 779137 - RNA, 23 nt, Human
ucuguguuuucuuccaugggugu

SEQ ID NO: 779138 - RNA, 19 nt, Human
ugaaaaaucagcccaaaac

SEQ ID NO: 779139 - RNA, 19 nt, Human
ugaaacagaaacauuaacu

SEQ ID NO: 779140 - RNA, 20 nt, Human
ugacaacaaugaaaguacaa

SEQ ID NO: 779141 - RNA, 22 nt, Human
ugaccaggaacuaggcucagca

SEQ ID NO: 779142 - RNA, 18 nt, Human
ugauugaugauuaacaac

SEQ ID NO: 779143 - RNA, 20 nt, Human
ugcaaauaccuuauaaaacu

SEQ ID NO: 779144 - RNA, 21 nt, Human
ugcacuguucaguuauuacug

SEQ ID NO: 779145 - RNA, 20 nt, Human
ugccacugaauaaucaaagu

SEQ ID NO: 779146 - RNA, 19 nt, Human
ugccaugcuuccaugaacc

SEQ ID NO: 779147 - RNA, 25 nt, Human
ugcuuccaugaacccuuaggucagu

SEQ ID NO: 779148 - RNA, 20 nt, Human
uggccccaaucuaaacccaa

SEQ ID NO: 779149 - RNA, 24 nt, Human
ugguguuuuugcaucaaccucugu

SEQ ID NO: 779150 - RNA, 18 nt, Human
uguacaggcagcugagac

SEQ ID NO: 779151 - RNA, 20 nt, Human
uguauaaaugacagcaauau

SEQ ID NO: 779152 - RNA, 20 nt, Human
uguccuccucacuguccccc

SEQ ID NO: 779153 - RNA, 22 nt, Human
uguugccaagaagauguagggg

SEQ ID NO: 779154 - RNA, 23 nt, Human
uuauuacugaccaggaacuaggc

SEQ ID NO: 779155 - RNA, 20 nt, Human
uucacagacuaaaccaagga

SEQ ID NO: 779156 - RNA, 20 nt, Human
uucagaacuuacaauuuaau

SEQ ID NO: 779157 - RNA, 21 nt, Human
uucagcaacaacgcuuacucc

SEQ ID NO: 779158 - RNA, 24 nt, Human
uucagcaacaacgcuuacuccaaa

SEQ ID NO: 779159 - RNA, 22 nt, Human
uuccccgacgccggccuccagc

SEQ ID NO: 779160 - RNA, 20 nt, Human
uucccucuucuuugacuucc

SEQ ID NO: 779161 - RNA, 24 nt, Human
uugaaugacaacaaugaaaguaca

SEQ ID NO: 779162 - RNA, 24 nt, Human
uuggugauuucucgauucaacuga

SEQ ID NO: 779163 - RNA, 20 nt, Human
uuuacaccuuaacaguggug

SEQ ID NO: 779164 - RNA, 19 nt, Human
aaaaaguuauuucuucagc

SEQ ID NO: 779165 - RNA, 22 nt, Human
aaaacacucuuaauccacucca

SEQ ID NO: 779166 - RNA, 27 nt, Human
aaacagauccaaaaggaaaccucccac

SEQ ID NO: 779167 - RNA, 22 nt, Human
aacagauccaaaaggaaaccuc

SEQ ID NO: 779168 - RNA, 18 nt, Human
aacagcuuugagugguug

SEQ ID NO: 779169 - RNA, 23 nt, Human
aaccggaagucuucaguucuccc

SEQ ID NO: 779170 - RNA, 24 nt, Human
aaccugccuauucagcccaucccu

SEQ ID NO: 779171 - RNA, 25 nt, Human
aagaagcauuguuggaacucacagg

SEQ ID NO: 779172 - RNA, 21 nt, Human
aagaagccuagucugugggcc

SEQ ID NO: 779173 - RNA, 21 nt, Human
aagccaguauuuugcugcaaa

SEQ ID NO: 779174 - RNA, 21 nt, Human
aauggcaauaagacccucugg

SEQ ID NO: 779175 - RNA, 21 nt, Human
acagucucaaaacagauccaa

SEQ ID NO: 779176 - RNA, 21 nt, Human
acauccaccugucuccuccac

SEQ ID NO: 779177 - RNA, 22 nt, Human
acaugugucaccuugacuuaaa

SEQ ID NO: 779178 - RNA, 22 nt, Human
accaggucccugcacugaaguc

SEQ ID NO: 779179 - RNA, 23 nt, Human
accuugacuuaaaaaacacauug

SEQ ID NO: 779180 - RNA, 21 nt, Human
acuaaaaugcaccuccccuga

SEQ ID NO: 779181 - RNA, 22 nt, Human
acuucagugguacgcucauccu

SEQ ID NO: 779182 - RNA, 23 nt, Human
agacaugcuuuacucaugucccc

SEQ ID NO: 779183 - RNA, 18 nt, Human
agauccaaaaggaaaccu

SEQ ID NO: 779184 - RNA, 24 nt, Human
agauucuggguacaaagugcugca

SEQ ID NO: 779185 - RNA, 21 nt, Human
agcccuuucucucuugcccuu

SEQ ID NO: 779186 - RNA, 22 nt, Human
agccgaauaaacagcuuugagu

SEQ ID NO: 779187 - RNA, 20 nt, Human
agcuaggaaccccgugcagg

SEQ ID NO: 779188 - RNA, 19 nt, Human
agcugaagucuucuggcuc

SEQ ID NO: 779189 - RNA, 19 nt, Human
agcugcaggagcucagaac

SEQ ID NO: 779190 - RNA, 19 nt, Human
agcugggggagucaggcgg

SEQ ID NO: 779191 - RNA, 23 nt, Human
aggaagccuucuuucuggaacag

SEQ ID NO: 779192 - RNA, 22 nt, Human
aggaauccacacagcuucccaa

SEQ ID NO: 779193 - RNA, 20 nt, Human
aggcauaauaaauaagauga

SEQ ID NO: 779194 - RNA, 18 nt, Human
aggggugugccaggacag

SEQ ID NO: 779195 - RNA, 23 nt, Human
agguuguuugugagacagaaagu

SEQ ID NO: 779196 - RNA, 18 nt, Human
agguuucuguaccugaga

SEQ ID NO: 779197 - RNA, 22 nt, Human
auaagacccucuggagcuuaaa

SEQ ID NO: 779198 - RNA, 18 nt, Human
auccaccugucuccucca

SEQ ID NO: 779199 - RNA, 24 nt, Human
auccacuccauacggaagaaaccc

SEQ ID NO: 779200 - RNA, 18 nt, Human
caaaaggaaaccucccac

SEQ ID NO: 779201 - RNA, 21 nt, Human
caaauccugggcgcagccucc

SEQ ID NO: 779202 - RNA, 23 nt, Human
caauuuaacuacuaaaaugcacc

SEQ ID NO: 779203 - RNA, 20 nt, Human
cacacaccccaggugcaggg

SEQ ID NO: 779204 - RNA, 23 nt, Human
cacacagaugccccugcgcccgg

SEQ ID NO: 779205 - RNA, 19 nt, Human
cacacagcuucccaaagca

SEQ ID NO: 779206 - RNA, 20 nt, Human
cacacagcuucccaaagcac

SEQ ID NO: 779207 - RNA, 19 nt, Human
cacagcugcggguucuggg

SEQ ID NO: 779208 - RNA, 21 nt, Human
cacccccaaacgccuccugga

SEQ ID NO: 779209 - RNA, 21 nt, Human
cacgugaaucacacaccccag

SEQ ID NO: 779210 - RNA, 19 nt, Human
cagaggucccaggugacug

SEQ ID NO: 779211 - RNA, 21 nt, Human
caggacagggguagaagauga

SEQ ID NO: 779212 - RNA, 20 nt, Human
caggacccacaucacaggca

SEQ ID NO: 779213 - RNA, 23 nt, Human
cagggccaaggauuauguaagaa

SEQ ID NO: 779214 - RNA, 22 nt, Human
caggugcaggggcugacaugga

SEQ ID NO: 779215 - RNA, 24 nt, Human
cauccgccuaaagaaacagacucc

SEQ ID NO: 779216 - RNA, 20 nt, Human
ccaaaaggaaaccucccacc

SEQ ID NO: 779217 - RNA, 23 nt, Human
ccaaaaggaaaccucccacccaa

SEQ ID NO: 779218 - RNA, 19 nt, Human
ccacuguggucacgccccg

SEQ ID NO: 779219 - RNA, 22 nt, Human
ccagccacccuucccugcugca

SEQ ID NO: 779220 - RNA, 21 nt, Human
ccaggacaguaaggcaggggg

SEQ ID NO: 779221 - RNA, 19 nt, Human
cccaagauuucaaaaaggc

SEQ ID NO: 779222 - RNA, 22 nt, Human
cccacagcugcggguucugggg

SEQ ID NO: 779223 - RNA, 22 nt, Human
cccacaucacaggcauaauaaa

SEQ ID NO: 779224 - RNA, 18 nt, Human
cccacauucacguucaca

SEQ ID NO: 779225 - RNA, 23 nt, Human
cccacccaauuuacuaaagugca

SEQ ID NO: 779226 - RNA, 23 nt, Human
cccacccccaaacgccuccugga

SEQ ID NO: 779227 - RNA, 25 nt, Human
ccccacccccaaacgccuccuggaa

SEQ ID NO: 779228 - RNA, 23 nt, Human
ccccuuccucucaccuuccccca

SEQ ID NO: 779229 - RNA, 18 nt, Human
cccugcgcccggcuccuc

SEQ ID NO: 779230 - RNA, 21 nt, Human
ccgaauaaacagcuuugagug

SEQ ID NO: 779231 - RNA, 23 nt, Human
ccuacauggcucuucccacagcu

SEQ ID NO: 779232 - RNA, 18 nt, Human
ccuccuuuuuuucucagu

SEQ ID NO: 779233 - RNA, 20 nt, Human
ccuuagagccucaugcucug

SEQ ID NO: 779234 - RNA, 23 nt, Human
ccuugcccagagccuggucaugg

SEQ ID NO: 779235 - RNA, 18 nt, Human
cgaagggaaaaccagguc

SEQ ID NO: 779236 - RNA, 20 nt, Human
cgcagcugccucuggccucc

SEQ ID NO: 779237 - RNA, 19 nt, Human
cggugccucacacauuucc

SEQ ID NO: 779238 - RNA, 19 nt, Human
cuaaccacauccagcugca

SEQ ID NO: 779239 - RNA, 21 nt, Human
cucaaaacagauccaaaagga

SEQ ID NO: 779240 - RNA, 19 nt, Human
cucaaccuugugggugccu

SEQ ID NO: 779241 - RNA, 21 nt, Human
cucuggagcuuaaaccaaacc

SEQ ID NO: 779242 - RNA, 21 nt, Human
cuggcucaaggggcagaggaa

SEQ ID NO: 779243 - RNA, 18 nt, Human
cuugaagaaacaaccaug

SEQ ID NO: 779244 - RNA, 24 nt, Human
gaaaaagugagauuuaacugcaaa

SEQ ID NO: 779245 - RNA, 21 nt, Human
gaagaaacaaccaugcccggg

SEQ ID NO: 779246 - RNA, 24 nt, Human
gaaguauaaccacguuucuggagg

SEQ ID NO: 779247 - RNA, 18 nt, Human
gaccaugggacacaggag

SEQ ID NO: 779248 - RNA, 18 nt, Human
gacugugugaccucaacc

SEQ ID NO: 779249 - RNA, 20 nt, Human
gagccuccagcuaaaaccaa

SEQ ID NO: 779250 - RNA, 21 nt, Human
gagccuggucaugguaggagc

SEQ ID NO: 779251 - RNA, 18 nt, Human
gagcucagaacucuccag

SEQ ID NO: 779252 - RNA, 24 nt, Human
gaggagccuugcccagagccuggu

SEQ ID NO: 779253 - RNA, 20 nt, Human
gaugcaggaaaucuaaccug

SEQ ID NO: 779254 - RNA, 20 nt, Human
gauggugaggggugugccag

SEQ ID NO: 779255 - RNA, 25 nt, Human
gcaaagagauuuuaaaaaaaaaucu

SEQ ID NO: 779256 - RNA, 19 nt, Human
gccugcugagccuccagcu

SEQ ID NO: 779257 - RNA, 21 nt, Human
gcucagagcaaugagucccuc

SEQ ID NO: 779258 - RNA, 20 nt, Human
gcugcggaaggagccaagaa

SEQ ID NO: 779259 - RNA, 18 nt, Human
gcugggggagucaggcgg

SEQ ID NO: 779260 - RNA, 18 nt, Human
gcuuguuugaaaaaguga

SEQ ID NO: 779261 - RNA, 22 nt, Human
ggacagggguagaagaugacug

SEQ ID NO: 779262 - RNA, 19 nt, Human
ggauuauauuuagaggacc

SEQ ID NO: 779263 - RNA, 19 nt, Human
ggcuacagugggcagagua

SEQ ID NO: 779264 - RNA, 24 nt, Human
gggcuacagugggcagaguagcug

SEQ ID NO: 779265 - RNA, 21 nt, Human
gguccucugagcagagguccc

SEQ ID NO: 779266 - RNA, 23 nt, Human
ggugugcauccaggccucuucug

SEQ ID NO: 779267 - RNA, 23 nt, Human
gucccaggccccaggcugggccc

SEQ ID NO: 779268 - RNA, 26 nt, Human
gugacgggacacacagaugccccugc

SEQ ID NO: 779269 - RNA, 20 nt, Human
guggaacuuccuucccgaag

SEQ ID NO: 779270 - RNA, 19 nt, Human
guuugacauuucuccucca

SEQ ID NO: 779271 - RNA, 25 nt, Human
uaaaaaaauaacuuaucuuuaaagc

SEQ ID NO: 779272 - RNA, 20 nt, Human
uaacuacuaaaaugcaccuc

SEQ ID NO: 779273 - RNA, 18 nt, Human
uacuggaugucucccugg

SEQ ID NO: 779274 - RNA, 23 nt, Human
uacuggcccacauucacguucac

SEQ ID NO: 779275 - RNA, 23 nt, Human
uauucagcccaucccucuaacca

SEQ ID NO: 779276 - RNA, 21 nt, Human
ucacuaauuugguuacuucuu

SEQ ID NO: 779277 - RNA, 19 nt, Human
ucacugggucacagacaug

SEQ ID NO: 779278 - RNA, 25 nt, Human
ucagcccaucccucuaaccacaucc

SEQ ID NO: 779279 - RNA, 21 nt, Human
ucaggcggacaaggguuucag

SEQ ID NO: 779280 - RNA, 24 nt, Human
ucaguuagaacaacaaaauaaaac

SEQ ID NO: 779281 - RNA, 19 nt, Human
uccaaaaccaggaugcccc

SEQ ID NO: 779282 - RNA, 20 nt, Human
uccaaaaggaaaccucccac

SEQ ID NO: 779283 - RNA, 23 nt, Human
uccacauccaccugucuccucca

SEQ ID NO: 779284 - RNA, 22 nt, Human
uccacuccauacggaagaaacc

SEQ ID NO: 779285 - RNA, 23 nt, Human
uccacugauaaaaacaguucucc

SEQ ID NO: 779286 - RNA, 21 nt, Human
uccagaaaugugaagcgggac

SEQ ID NO: 779287 - RNA, 21 nt, Human
ucccaggccccaggcugggcc

SEQ ID NO: 779288 - RNA, 23 nt, Human
ucccaggccccaggcugggcccu

SEQ ID NO: 779289 - RNA, 20 nt, Human
uccccacccccaaacgccuc

SEQ ID NO: 779290 - RNA, 18 nt, Human
uccccuuagagccucaug

SEQ ID NO: 779291 - RNA, 21 nt, Human
ucccucuaaccacauccagcu

SEQ ID NO: 779292 - RNA, 24 nt, Human
ucccugcugcagugugugacggga

SEQ ID NO: 779293 - RNA, 22 nt, Human
ucggcucccuguucuuccucag

SEQ ID NO: 779294 - RNA, 26 nt, Human
ucucaguuagaacaacaaaauaaaac

SEQ ID NO: 779295 - RNA, 19 nt, Human
ucuccaguuaggugcgagg

SEQ ID NO: 779296 - RNA, 18 nt, Human
ucucggcucccuguucuu

SEQ ID NO: 779297 - RNA, 21 nt, Human
ucucgggaaaggaagccuucu

SEQ ID NO: 779298 - RNA, 21 nt, Human
ugaaaugaagucacaggaguc

SEQ ID NO: 779299 - RNA, 19 nt, Human
ugaagaaacaaccaugccc

SEQ ID NO: 779300 - RNA, 19 nt, Human
ugagcagaggucccaggug

SEQ ID NO: 779301 - RNA, 21 nt, Human
ugaggggugugccaggacagu

SEQ ID NO: 779302 - RNA, 19 nt, Human
ugagugguggagaccaugg

SEQ ID NO: 779303 - RNA, 20 nt, Human
ugauggugagugguggagac

SEQ ID NO: 779304 - RNA, 24 nt, Human
ugcaggggcucaacaagcugcuuu

SEQ ID NO: 779305 - RNA, 20 nt, Human
ugcccugggcaggacagggg

SEQ ID NO: 779306 - RNA, 21 nt, Human
ugcccugggcaggacaggggu

SEQ ID NO: 779307 - RNA, 19 nt, Human
ugcucuggaggugccuucc

SEQ ID NO: 779308 - RNA, 21 nt, Human
uggagacugugugaccucaac

SEQ ID NO: 779309 - RNA, 22 nt, Human
uggauaagugcaauuuaacuac

SEQ ID NO: 779310 - RNA, 18 nt, Human
uggaugaaaagugccccc

SEQ ID NO: 779311 - RNA, 23 nt, Human
uggcgacaucuucagacuucagu

SEQ ID NO: 779312 - RNA, 18 nt, Human
ugggcagaguagcugggg

SEQ ID NO: 779313 - RNA, 22 nt, Human
ugguacgcucauccucaucugu

SEQ ID NO: 779314 - RNA, 24 nt, Human
uggugaggggugugccaggacagu

SEQ ID NO: 779315 - RNA, 24 nt, Human
uggugcaggauuguggcaucugug

SEQ ID NO: 779316 - RNA, 18 nt, Human
uguugaugucugaaauga

SEQ ID NO: 779317 - RNA, 22 nt, Human
uucaaaaaggcgacacuuugaa

SEQ ID NO: 779318 - RNA, 18 nt, Human
uuuaagcaucucuugagc

SEQ ID NO: 779319 - RNA, 25 nt, Human
aaaaaaaaaaaaaaaagcaacauua

SEQ ID NO: 779320 - RNA, 24 nt, Human
aaaaaagacuaaaacacuaacaaa

SEQ ID NO: 779321 - RNA, 23 nt, Human
aaaaacauccaacccacccccaa

SEQ ID NO: 779322 - RNA, 19 nt, Human
aaaaagcaacauuaacaga

SEQ ID NO: 779323 - RNA, 23 nt, Human
aaaaggccuaaaaaagcaucuac

SEQ ID NO: 779324 - RNA, 19 nt, Human
aaaaugcauagccagaagc

SEQ ID NO: 779325 - RNA, 19 nt, Human
aaacaaaaacauccaaccc

SEQ ID NO: 779326 - RNA, 26 nt, Human
aaacaaaaagcaaaacacagggaccc

SEQ ID NO: 779327 - RNA, 28 nt, Human
aaacaaaaggaaaaaaacaaagggaccc

SEQ ID NO: 779328 - RNA, 20 nt, Human
aaagagccccucaagauuuc

SEQ ID NO: 779329 - RNA, 27 nt, Human
aaaguccaguuuucaucaugggugaca

SEQ ID NO: 779330 - RNA, 18 nt, Human
aaaugcccaacuaccaaa

SEQ ID NO: 779331 - RNA, 24 nt, Human
aacaaaaacauccaacccaccccc

SEQ ID NO: 779332 - RNA, 18 nt, Human
aacuaauuucacauauuu

SEQ ID NO: 779333 - RNA, 19 nt, Human
aagauuucauaaacuacaa

SEQ ID NO: 779334 - RNA, 18 nt, Human
aagccccacaagccccaa

SEQ ID NO: 779335 - RNA, 21 nt, Human
aagugggggaaggagaggagg

SEQ ID NO: 779336 - RNA, 24 nt, Human
aauaaguccccaaacaaaaacauc

SEQ ID NO: 779337 - RNA, 24 nt, Human
aauuaagcaguucuuucuuccuca

SEQ ID NO: 779338 - RNA, 21 nt, Human
acacaaacaugaacuacauac

SEQ ID NO: 779339 - RNA, 25 nt, Human
acacaugcaugcgugcacacacaua

SEQ ID NO: 779340 - RNA, 24 nt, Human
acauauacucccucguaaaaugug

SEQ ID NO: 779341 - RNA, 23 nt, Human
accgggagccgccuccuuucucc

SEQ ID NO: 779342 - RNA, 24 nt, Human
acuacuaaauaaguccccaaacaa

SEQ ID NO: 779343 - RNA, 22 nt, Human
agcaguucuuucuuccucauuu

SEQ ID NO: 779344 - RNA, 20 nt, Human
agcaucuacucacccuaugu

SEQ ID NO: 779345 - RNA, 21 nt, Human
agccccacaagccccaaacug

SEQ ID NO: 779346 - RNA, 21 nt, Human
aggaaauguuagacuagcaug

SEQ ID NO: 779347 - RNA, 21 nt, Human
aggagaggagggggagggggu

SEQ ID NO: 779348 - RNA, 22 nt, Human
aggagggggagggggucgggau

SEQ ID NO: 779349 - RNA, 18 nt, Human
aggauuuguaaaugaaag

SEQ ID NO: 779350 - RNA, 22 nt, Human
agggaccaugaaaaaaaaaaag

SEQ ID NO: 779351 - RNA, 23 nt, Human
agggggagggggucgggauaccc

SEQ ID NO: 779352 - RNA, 23 nt, Human
agguccaucugaaggaaaauagc

SEQ ID NO: 779353 - RNA, 20 nt, Human
auaccauccaaacccaucaa

SEQ ID NO: 779354 - RNA, 18 nt, Human
auagaaaagaagaaagaa

SEQ ID NO: 779355 - RNA, 22 nt, Human
aucuaucucccacucucuccaa

SEQ ID NO: 779356 - RNA, 22 nt, Human
auuuguaaaugaaaguaacauc

SEQ ID NO: 779357 - RNA, 22 nt, Human
caaaaacaaaagcaagggacca

SEQ ID NO: 779358 - RNA, 21 nt, Human
caaaaacauccaacccacccc

SEQ ID NO: 779359 - RNA, 22 nt, Human
caaaaacauccaacccaccccc

SEQ ID NO: 779360 - RNA, 23 nt, Human
caaaaacauccaacccaccccca

SEQ ID NO: 779361 - RNA, 21 nt, Human
caaacaaaaacauccaaccca

SEQ ID NO: 779362 - RNA, 27 nt, Human
caaauacaagugaaugcacauauuuua

SEQ ID NO: 779363 - RNA, 21 nt, Human
caacccacccccaaucccaaa

SEQ ID NO: 779364 - RNA, 22 nt, Human
caacccacccccaaucccaaau

SEQ ID NO: 779365 - RNA, 25 nt, Human
caauuugaccucccaccaaauuaag

SEQ ID NO: 779366 - RNA, 22 nt, Human
caccaaaaaagaaaaaaacuau

SEQ ID NO: 779367 - RNA, 18 nt, Human
cacccccaaucccaaauc

SEQ ID NO: 779368 - RNA, 18 nt, Human
cagagcacaucuuucaaa

SEQ ID NO: 779369 - RNA, 22 nt, Human
cagcgaaagaaguaccaaguau

SEQ ID NO: 779370 - RNA, 24 nt, Human
cagcuucucccucaccccacuccc

SEQ ID NO: 779371 - RNA, 21 nt, Human
cagcuuuauacuuagaacuca

SEQ ID NO: 779372 - RNA, 24 nt, Human
caggcuagaaacaaaaggaaaaaa

SEQ ID NO: 779373 - RNA, 22 nt, Human
caguaaaagagccccucaagau

SEQ ID NO: 779374 - RNA, 19 nt, Human
cauagagcaggaaauguua

SEQ ID NO: 779375 - RNA, 24 nt, Human
cauccaacccacccccaaucccaa

SEQ ID NO: 779376 - RNA, 23 nt, Human
caugugaaugcauaauagugaau

SEQ ID NO: 779377 - RNA, 18 nt, Human
cauuacacauauuugaua

SEQ ID NO: 779378 - RNA, 25 nt, Human
ccaaacaaaaacauccaacccaccc

SEQ ID NO: 779379 - RNA, 22 nt, Human
ccaaguauuucuuucuguuaau

SEQ ID NO: 779380 - RNA, 23 nt, Human
ccacucccacacacucucacucc

SEQ ID NO: 779381 - RNA, 24 nt, Human
ccagccaaauagcccauaaaccuu

SEQ ID NO: 779382 - RNA, 18 nt, Human
cccgcaggcuggccgggc

SEQ ID NO: 779383 - RNA, 22 nt, Human
cccgucagcuucucccucaccc

SEQ ID NO: 779384 - RNA, 18 nt, Human
ccgacugagccgggcugg

SEQ ID NO: 779385 - RNA, 22 nt, Human
ccugggucggggggcuccuccc

SEQ ID NO: 779386 - RNA, 21 nt, Human
ccuugccuggauuauuuccuc

SEQ ID NO: 779387 - RNA, 23 nt, Human
ccuugccuggauuauuuccucuu

SEQ ID NO: 779388 - RNA, 18 nt, Human
cuaagccccacaagcccc

SEQ ID NO: 779389 - RNA, 20 nt, Human
cucaccccacucccacacac

SEQ ID NO: 779390 - RNA, 23 nt, Human
cucacugaugacaaaucuuccaa

SEQ ID NO: 779391 - RNA, 19 nt, Human
cucccucaccccacuccca

SEQ ID NO: 779392 - RNA, 19 nt, Human
cuccgccgacugcggcucc

SEQ ID NO: 779393 - RNA, 19 nt, Human
cucuaagccccacaagccc

SEQ ID NO: 779394 - RNA, 20 nt, Human
cucuccaacuaauccuacua

SEQ ID NO: 779395 - RNA, 18 nt, Human
cugagcaccuacauuuuc

SEQ ID NO: 779396 - RNA, 18 nt, Human
cuuccugagcauccucca

SEQ ID NO: 779397 - RNA, 18 nt, Human
cuuuuauaaauucugcaa

SEQ ID NO: 779398 - RNA, 20 nt, Human
gaaaauagcacuggagaggc

SEQ ID NO: 779399 - RNA, 23 nt, Human
gaacaaacaaacaaauaaaaaca

SEQ ID NO: 779400 - RNA, 21 nt, Human
gaaggagaggagggggagggg

SEQ ID NO: 779401 - RNA, 18 nt, Human
gagaggagggggaggggg

SEQ ID NO: 779402 - RNA, 21 nt, Human
gaggagggggagggggucggg

SEQ ID NO: 779403 - RNA, 25 nt, Human
gcauguauuaaaaaaaaaaaaaaaa

SEQ ID NO: 779404 - RNA, 18 nt, Human
gcccauaaaccuucucaa

SEQ ID NO: 779405 - RNA, 18 nt, Human
gcggcuggaaguggggga

SEQ ID NO: 779406 - RNA, 19 nt, Human
gcucugcagcaucuccauu

SEQ ID NO: 779407 - RNA, 23 nt, Human
ggaaaaaacaaaaaaauaagaaa

SEQ ID NO: 779408 - RNA, 19 nt, Human
ggaaggagaggagggggag

SEQ ID NO: 779409 - RNA, 19 nt, Human
gggcuggggccuucgagga

SEQ ID NO: 779410 - RNA, 23 nt, Human
ggggaaggagaggagggggaggg

SEQ ID NO: 779411 - RNA, 18 nt, Human
gggggaaggagaggaggg

SEQ ID NO: 779412 - RNA, 24 nt, Human
gggggaaggagaggagggggaggg

SEQ ID NO: 779413 - RNA, 22 nt, Human
gggucgggauaccgggagccgc

SEQ ID NO: 779414 - RNA, 21 nt, Human
gucccgucagcuucucccuca

SEQ ID NO: 779415 - RNA, 22 nt, Human
guguaugugucauaauacacau

SEQ ID NO: 779416 - RNA, 20 nt, Human
uaaaaacaguagcagcagug

SEQ ID NO: 779417 - RNA, 24 nt, Human
uaaagcuaaugaacuaauuucaca

SEQ ID NO: 779418 - RNA, 18 nt, Human
uaacuauucaaaguguau

SEQ ID NO: 779419 - RNA, 19 nt, Human
uaagaaaagacuaacuaca

SEQ ID NO: 779420 - RNA, 25 nt, Human
uaagcaugaucaaaccucuguuaua

SEQ ID NO: 779421 - RNA, 20 nt, Human
uaaggaaauggcagaauuuu

SEQ ID NO: 779422 - RNA, 20 nt, Human
uaaggugaauaccucuaccc

SEQ ID NO: 779423 - RNA, 23 nt, Human
uaaguccccaaacaaaaacaucc

SEQ ID NO: 779424 - RNA, 25 nt, Human
uaaguccccaaacaaaaacauccaa

SEQ ID NO: 779425 - RNA, 18 nt, Human
uaaguuaagaaaagacua

SEQ ID NO: 779426 - RNA, 23 nt, Human
uaauuuaugcagauguuuuccuc

SEQ ID NO: 779427 - RNA, 23 nt, Human
uacacugaacaggcuagaaacaa

SEQ ID NO: 779428 - RNA, 18 nt, Human
uacaggaagauuucaaug

SEQ ID NO: 779429 - RNA, 25 nt, Human
uacuacuaaauaaguccccaaacaa

SEQ ID NO: 779430 - RNA, 20 nt, Human
uagaauauccuaagauaaau

SEQ ID NO: 779431 - RNA, 25 nt, Human
uagcacuggagaggcaagaaagggc

SEQ ID NO: 779432 - RNA, 24 nt, Human
uagcagaggucucaucuaucuccc

SEQ ID NO: 779433 - RNA, 24 nt, Human
uauacacaaaaaggccuaaaaaag

SEQ ID NO: 779434 - RNA, 21 nt, Human
uauguaacuauucaaagugua

SEQ ID NO: 779435 - RNA, 26 nt, Human
uauucaucaacaaucaaccuuucacu

SEQ ID NO: 779436 - RNA, 20 nt, Human
ucaaaaaagacuaaaacacu

SEQ ID NO: 779437 - RNA, 24 nt, Human
ucaaaaaagacuaaaacacuaaca

SEQ ID NO: 779438 - RNA, 27 nt, Human
ucaauuauaggcaccaaaaaagaaaaa

SEQ ID NO: 779439 - RNA, 21 nt, Human
ucauuaagaagccuuuauugg

SEQ ID NO: 779440 - RNA, 20 nt, Human
uccaaacccaucaaugggau

SEQ ID NO: 779441 - RNA, 19 nt, Human
uccaugaacagcauugcaa

SEQ ID NO: 779442 - RNA, 19 nt, Human
ucccaguaaaagagccccu

SEQ ID NO: 779443 - RNA, 20 nt, Human
uccccaaacaaaaacaucca

SEQ ID NO: 779444 - RNA, 21 nt, Human
uccccaaacaaaaacauccaa

SEQ ID NO: 779445 - RNA, 23 nt, Human
uccccaaacaaaaacauccaacc

SEQ ID NO: 779446 - RNA, 22 nt, Human
ucccgucagcuucucccucacc

SEQ ID NO: 779447 - RNA, 21 nt, Human
ucgcccaguuucucacagccu

SEQ ID NO: 779448 - RNA, 25 nt, Human
ucuauucaucaacaaucaaccuuuc

SEQ ID NO: 779449 - RNA, 23 nt, Human
ucucugaggugaaaugagacacu

SEQ ID NO: 779450 - RNA, 19 nt, Human
ugaaaacaacucaucuguu

SEQ ID NO: 779451 - RNA, 19 nt, Human
ugaaggaauucaagaagau

SEQ ID NO: 779452 - RNA, 21 nt, Human
ugagaaaaagagaugauuuuc

SEQ ID NO: 779453 - RNA, 22 nt, Human
ugagucccccauuuacccugcg

SEQ ID NO: 779454 - RNA, 25 nt, Human
ugaguguacguuuuaauaucaugug

SEQ ID NO: 779455 - RNA, 21 nt, Human
ugauauauacauucucucuca

SEQ ID NO: 779456 - RNA, 23 nt, Human
ugauauauacauucucucucaua

SEQ ID NO: 779457 - RNA, 21 nt, Human
ugauauguaacuauucaaagu

SEQ ID NO: 779458 - RNA, 19 nt, Human
ugcaugcgugcacacacau

SEQ ID NO: 779459 - RNA, 20 nt, Human
uggccgggcguccucgcaca

SEQ ID NO: 779460 - RNA, 24 nt, Human
ugggggaaggagaggagggggagg

SEQ ID NO: 779461 - RNA, 18 nt, Human
uggguaaaagcuucagag

SEQ ID NO: 779462 - RNA, 22 nt, Human
uguacaaguaagcaugaucaaa

SEQ ID NO: 779463 - RNA, 25 nt, Human
uuaaaaaaaaaaaaaaaagcaacau

SEQ ID NO: 779464 - RNA, 18 nt, Human
uuaaaaggguaacuauga

SEQ ID NO: 779465 - RNA, 23 nt, Human
uuaaaugcccaacuaccaaaaca

SEQ ID NO: 779466 - RNA, 24 nt, Human
uuacaauuuuaacaauauacaaaa

SEQ ID NO: 779467 - RNA, 18 nt, Human
uuagacuagcauguauua

SEQ ID NO: 779468 - RNA, 21 nt, Human
uuagacuagcauguauuaaaa

SEQ ID NO: 779469 - RNA, 22 nt, Human
uucaucaugcaaacaugccaau

SEQ ID NO: 779470 - RNA, 19 nt, Human
uucucccucaccccacucc

SEQ ID NO: 779471 - RNA, 20 nt, Human
uugaauaaacuguacacuga

SEQ ID NO: 779472 - RNA, 23 nt, Human
uuggccauuguuaaagaugcagg

SEQ ID NO: 779473 - RNA, 26 nt, Human
uuguacaaaaacaaaagcaagggacc

SEQ ID NO: 779474 - RNA, 22 nt, Human
uuguaggauuuguaaaugaaag

SEQ ID NO: 779475 - RNA, 20 nt, Human
uuucuuccucauuuauuucu

SEQ ID NO: 779476 - RNA, 24 nt, Human
uuugaaauacaauuuagaauuaca

SEQ ID NO: 779477 - RNA, 22 nt, Human
aaaacuaaacucaaccaaaagu

SEQ ID NO: 779478 - RNA, 23 nt, Human
aaagaccacacccaagacuaacc

SEQ ID NO: 779479 - RNA, 22 nt, Human
aacacacugaugaaguuaaaga

SEQ ID NO: 779480 - RNA, 23 nt, Human
aacugcuuuccaagaggaaauac

SEQ ID NO: 779481 - RNA, 19 nt, Human
aagaggaaauacaauugac

SEQ ID NO: 779482 - RNA, 24 nt, Human
aagaggaaauacaauugaccugga

SEQ ID NO: 779483 - RNA, 25 nt, Human
aaucauuugaagucaagcagcucuu

SEQ ID NO: 779484 - RNA, 23 nt, Human
aaucuucuuuacacccagcacaa

SEQ ID NO: 779485 - RNA, 18 nt, Human
acaaacaaggacaauaaa

SEQ ID NO: 779486 - RNA, 27 nt, Human
acaacacacugaugaaguuaaagaccu

SEQ ID NO: 779487 - RNA, 18 nt, Human
acacuuugacaaaaagac

SEQ ID NO: 779488 - RNA, 22 nt, Human
acacuuugacaaaaagaccaca

SEQ ID NO: 779489 - RNA, 18 nt, Human
acuaaacucaaccaaaag

SEQ ID NO: 779490 - RNA, 19 nt, Human
acugaaaaacaucuuucac

SEQ ID NO: 779491 - RNA, 25 nt, Human
agcuaauuuaaaaacuuuuagccuc

SEQ ID NO: 779492 - RNA, 23 nt, Human
agcuaucaguugcaaacaaguua

SEQ ID NO: 779493 - RNA, 22 nt, Human
aggcauuuaauucuuagaaaug

SEQ ID NO: 779494 - RNA, 18 nt, Human
auaaaacacuggaauucc

SEQ ID NO: 779495 - RNA, 23 nt, Human
auggaaauggacagguguuuuga

SEQ ID NO: 779496 - RNA, 19 nt, Human
auucuggauacacuuugac

SEQ ID NO: 779497 - RNA, 21 nt, Human
caaaaagaccacacccaagac

SEQ ID NO: 779498 - RNA, 23 nt, Human
caaaaagaccacacccaagacua

SEQ ID NO: 779499 - RNA, 25 nt, Human
cacaaauaugcauuucaaaaagaug

SEQ ID NO: 779500 - RNA, 23 nt, Human
cacagcuucugcuuugaaaugga

SEQ ID NO: 779501 - RNA, 23 nt, Human
caccacacagcuaauuuaaaaac

SEQ ID NO: 779502 - RNA, 22 nt, Human
cacuucacaaaaacaacacacu

SEQ ID NO: 779503 - RNA, 27 nt, Human
cacuuugacaaaaagaccacacccaag

SEQ ID NO: 779504 - RNA, 18 nt, Human
cagcagcugguguuugag

SEQ ID NO: 779505 - RNA, 21 nt, Human
caucaguaucucagagauggc

SEQ ID NO: 779506 - RNA, 18 nt, Human
cauguugagaaagcuugc

SEQ ID NO: 779507 - RNA, 19 nt, Human
gaccacacccaagacuaac

SEQ ID NO: 779508 - RNA, 23 nt, Human
gaccagauuuguaaugcccuucc

SEQ ID NO: 779509 - RNA, 21 nt, Human
gaccguucacugcagacuagg

SEQ ID NO: 779510 - RNA, 21 nt, Human
gccuagagcaaaucaauuccu

SEQ ID NO: 779511 - RNA, 21 nt, Human
gcuuucuaugaagacuaacug

SEQ ID NO: 779512 - RNA, 19 nt, Human
ggaagaaagaacaaucauc

SEQ ID NO: 779513 - RNA, 22 nt, Human
guagcuaaaccauaaguaacau

SEQ ID NO: 779514 - RNA, 21 nt, Human
guucacauaaaucugcuggcc

SEQ ID NO: 779515 - RNA, 21 nt, Human
uaaagacugacucuccauguu

SEQ ID NO: 779516 - RNA, 23 nt, Human
uaacuaaauguaacauuuaugaa

SEQ ID NO: 779517 - RNA, 22 nt, Human
uaagaaaacuaaacucaaccaa

SEQ ID NO: 779518 - RNA, 19 nt, Human
uaaguaacauacugaaaaa

SEQ ID NO: 779519 - RNA, 23 nt, Human
uaauacauacacaagacuguaua

SEQ ID NO: 779520 - RNA, 19 nt, Human
uaaugacaggaaugagaau

SEQ ID NO: 779521 - RNA, 22 nt, Human
uacagaaacccucgcaugcaau

SEQ ID NO: 779522 - RNA, 26 nt, Human
uacauguuaaacugcuuuccaagagg

SEQ ID NO: 779523 - RNA, 22 nt, Human
uacugcuucccaaugucccuau

SEQ ID NO: 779524 - RNA, 20 nt, Human
uagaacuaauucccauccaa

SEQ ID NO: 779525 - RNA, 20 nt, Human
uagcaucaauaaucaugaug

SEQ ID NO: 779526 - RNA, 26 nt, Human
uaguagcuaaaccauaaguaacauac

SEQ ID NO: 779527 - RNA, 20 nt, Human
uaucccagaguauuugguca

SEQ ID NO: 779528 - RNA, 19 nt, Human
ucaauaaucaugauguugc

SEQ ID NO: 779529 - RNA, 23 nt, Human
uccaagaggaaauacaauugacc

SEQ ID NO: 779530 - RNA, 20 nt, Human
ucuccauguucaguagcccc

SEQ ID NO: 779531 - RNA, 20 nt, Human
ucucucaucuuaaccagugg

SEQ ID NO: 779532 - RNA, 20 nt, Human
ucucucaucuuaaccagugg

SEQ ID NO: 779533 - RNA, 18 nt, Human
ucucugggcuaccaccuc

SEQ ID NO: 779534 - RNA, 24 nt, Human
ucugcauuuuacacaggaaagaga

SEQ ID NO: 779535 - RNA, 24 nt, Human
ucuucaugauuucagcugauuuuu

SEQ ID NO: 779536 - RNA, 19 nt, Human
ugaaauggauaggacuaua

SEQ ID NO: 779537 - RNA, 24 nt, Human
ugaaauggauaggacuauaaaagg

SEQ ID NO: 779538 - RNA, 18 nt, Human
ugaccagauuuguaaugc

SEQ ID NO: 779539 - RNA, 19 nt, Human
ugaccuggauucucuaugg

SEQ ID NO: 779540 - RNA, 22 nt, Human
ugccuaaagagcucaaaagcau

SEQ ID NO: 779541 - RNA, 18 nt, Human
ugccucaccacacagcua

SEQ ID NO: 779542 - RNA, 19 nt, Human
uggaagaaagaacaaucau

SEQ ID NO: 779543 - RNA, 28 nt, Human
uggaucacauauuucugcuuagcuggaa

SEQ ID NO: 779544 - RNA, 21 nt, Human
uguaaagagagauuaaggcug

SEQ ID NO: 779545 - RNA, 21 nt, Human
uguggauaccuuuugaaaagu

SEQ ID NO: 779546 - RNA, 20 nt, Human
uguguugccuaaagagcuca

SEQ ID NO: 779547 - RNA, 22 nt, Human
uguucaguagcccuaugauagu

SEQ ID NO: 779548 - RNA, 18 nt, Human
uucuaugaagacuaacug

SEQ ID NO: 779549 - RNA, 21 nt, Human
uugaacgcuuacauguuaaac

SEQ ID NO: 779550 - RNA, 23 nt, Human
uuuugcacuucacaaaaacaaca

SEQ ID NO: 779551 - RNA, 24 nt, Human
aaaaaaacaaacaaacaaaagcaa

SEQ ID NO: 779552 - RNA, 19 nt, Human
aaaaauugauaaagcauuu

SEQ ID NO: 779553 - RNA, 20 nt, Human
aaaacaaacaaacaaaagca

SEQ ID NO: 779554 - RNA, 19 nt, Human
aaaacacaauuaacuccac

SEQ ID NO: 779555 - RNA, 18 nt, Human
aaaaucuccaagcugugg

SEQ ID NO: 779556 - RNA, 20 nt, Human
aaacaaacaaaagcaacuug

SEQ ID NO: 779557 - RNA, 18 nt, Human
aaacaaacaaacaaaagc

SEQ ID NO: 779558 - RNA, 18 nt, Human
aagaaaaaauggccacua

SEQ ID NO: 779559 - RNA, 19 nt, Human
aagcugcuuuaaacuauag

SEQ ID NO: 779560 - RNA, 23 nt, Human
aaguagacauacaugacugaaac

SEQ ID NO: 779561 - RNA, 23 nt, Human
aauaaauacuaaagaaagcauga

SEQ ID NO: 779562 - RNA, 18 nt, Human
aaucaaaaaagggaagaa

SEQ ID NO: 779563 - RNA, 20 nt, Human
acaaaaagcugagguagcuc

SEQ ID NO: 779564 - RNA, 18 nt, Human
acaaacccaaaauagacc

SEQ ID NO: 779565 - RNA, 24 nt, Human
acacaccugcagcuaacggcuaca

SEQ ID NO: 779566 - RNA, 20 nt, Human
acacuacaaagagccaaaga

SEQ ID NO: 779567 - RNA, 18 nt, Human
acagaaacuucacagacu

SEQ ID NO: 779568 - RNA, 19 nt, Human
acagcccauccuuuuagcc

SEQ ID NO: 779569 - RNA, 27 nt, Human
acauuacgguuaaaaaaacaaacaaac

SEQ ID NO: 779570 - RNA, 20 nt, Human
accauagcugaaccaacuua

SEQ ID NO: 779571 - RNA, 24 nt, Human
acuaaaauacaaaaagcugaggua

SEQ ID NO: 779572 - RNA, 25 nt, Human
acuacaaacccaaaauagaccauag

SEQ ID NO: 779573 - RNA, 22 nt, Human
agaaagcaugaaaauccuccca

SEQ ID NO: 779574 - RNA, 21 nt, Human
agaauuagaaggcguuagaug

SEQ ID NO: 779575 - RNA, 19 nt, Human
agacaauagcaccaaauuc

SEQ ID NO: 779576 - RNA, 19 nt, Human
agauacauacaauucacag

SEQ ID NO: 779577 - RNA, 22 nt, Human
agcaaaaaugaaaaacuuacag

SEQ ID NO: 779578 - RNA, 23 nt, Human
agcaaaaaugaaaaacuuacaga

SEQ ID NO: 779579 - RNA, 19 nt, Human
agcaccaaaaucuccaagc

SEQ ID NO: 779580 - RNA, 20 nt, Human
agccaaagacaaggagacaa

SEQ ID NO: 779581 - RNA, 21 nt, Human
aguggcaguuccuauacugag

SEQ ID NO: 779582 - RNA, 19 nt, Human
aguuccuauacugagguug

SEQ ID NO: 779583 - RNA, 21 nt, Human
auagugcagcaagaaccugag

SEQ ID NO: 779584 - RNA, 22 nt, Human
aucuguaaaauaagcaaaacug

SEQ ID NO: 779585 - RNA, 23 nt, Human
auguuucugaaguucuguuuggu

SEQ ID NO: 779586 - RNA, 19 nt, Human
caaaaaagggaagaaauua

SEQ ID NO: 779587 - RNA, 21 nt, Human
caaaaagcccccagggucccc

SEQ ID NO: 779588 - RNA, 22 nt, Human
caaaauacaaaaugcuaaugua

SEQ ID NO: 779589 - RNA, 25 nt, Human
caaagacaaggagacaaguaccuua

SEQ ID NO: 779590 - RNA, 21 nt, Human
caaaucuuuaaauucuguaac

SEQ ID NO: 779591 - RNA, 20 nt, Human
caaauuacaguaaauguuca

SEQ ID NO: 779592 - RNA, 24 nt, Human
caaauuuaguaaccuacuaagaaa

SEQ ID NO: 779593 - RNA, 21 nt, Human
caacuuaaucaaaaaagggaa

SEQ ID NO: 779594 - RNA, 22 nt, Human
caagaccauucgcccuaauuaa

SEQ ID NO: 779595 - RNA, 18 nt, Human
cacagaaaucacucaaca

SEQ ID NO: 779596 - RNA, 22 nt, Human
cacagaaaucacucaacaagau

SEQ ID NO: 779597 - RNA, 22 nt, Human
caccaaaaucuccaagcugugg

SEQ ID NO: 779598 - RNA, 22 nt, Human
caccagaacagaccauagccaa

SEQ ID NO: 779599 - RNA, 23 nt, Human
caccagaacagaccauagccaac

SEQ ID NO: 779600 - RNA, 19 nt, Human
caccauagcugaaccaacu

SEQ ID NO: 779601 - RNA, 19 nt, Human
cacuacaaagagccaaaga

SEQ ID NO: 779602 - RNA, 24 nt, Human
cagaauacaaaagaugcagguaca

SEQ ID NO: 779603 - RNA, 20 nt, Human
cagaugaugacuguuucuuu

SEQ ID NO: 779604 - RNA, 21 nt, Human
cagguacaagcccaaauucaa

SEQ ID NO: 779605 - RNA, 21 nt, Human
caguaggcuauggccaaagua

SEQ ID NO: 779606 - RNA, 21 nt, Human
caguaguccaagaccauucgc

SEQ ID NO: 779607 - RNA, 19 nt, Human
caguuucaacccuagugcg

SEQ ID NO: 779608 - RNA, 25 nt, Human
ccaaaacagaccuuacaagaaaacu

SEQ ID NO: 779609 - RNA, 19 nt, Human
ccagagcucguuugcaauu

SEQ ID NO: 779610 - RNA, 21 nt, Human
ccauagccaacucuaaaacag

SEQ ID NO: 779611 - RNA, 24 nt, Human
cccacucccuaaaaauaaaaucca

SEQ ID NO: 779612 - RNA, 21 nt, Human
ccugagacuugcaaaaaaccc

SEQ ID NO: 779613 - RNA, 18 nt, Human
ccugagugacaauugguc

SEQ ID NO: 779614 - RNA, 25 nt, Human
cgaaaacacaauuaacuccacagcc

SEQ ID NO: 779615 - RNA, 25 nt, Human
cuccaaaagagagugcacaaaaaga

SEQ ID NO: 779616 - RNA, 22 nt, Human
cucccuaagagaggagucucca

SEQ ID NO: 779617 - RNA, 22 nt, Human
cugaaaccaaauuggacuccca

SEQ ID NO: 779618 - RNA, 21 nt, Human
cuguugguaacuaaaauacaa

SEQ ID NO: 779619 - RNA, 21 nt, Human
cuugucaucuuuauucaagua

SEQ ID NO: 779620 - RNA, 20 nt, Human
gaaaauccucccaauaauca

SEQ ID NO: 779621 - RNA, 19 nt, Human
gagggaaggagggccagag

SEQ ID NO: 779622 - RNA, 20 nt, Human
gagugagagagcacuuuaca

SEQ ID NO: 779623 - RNA, 25 nt, Human
gcucugcacauaauuggggucucua

SEQ ID NO: 779624 - RNA, 20 nt, Human
ggcuacaaugaaugaagaua

SEQ ID NO: 779625 - RNA, 18 nt, Human
gggaaggagggccagagg

SEQ ID NO: 779626 - RNA, 24 nt, Human
gggaaggagggccagaggaguugg

SEQ ID NO: 779627 - RNA, 23 nt, Human
gggggaaaaauaugauuaaagaa

SEQ ID NO: 779628 - RNA, 18 nt, Human
guaacaauuuccaucaaa

SEQ ID NO: 779629 - RNA, 20 nt, Human
gucuccaaauuuguagaaag

SEQ ID NO: 779630 - RNA, 21 nt, Human
gugugcaguuuuguuuuuugu

SEQ ID NO: 779631 - RNA, 18 nt, Human
guugguacaauuucagcu

SEQ ID NO: 779632 - RNA, 21 nt, Human
uaaaaaggcacguuaaaggca

SEQ ID NO: 779633 - RNA, 24 nt, Human
uaaaacuacaaacccaaaauagac

SEQ ID NO: 779634 - RNA, 26 nt, Human
uaaaacuacaaacccaaaauagacca

SEQ ID NO: 779635 - RNA, 22 nt, Human
uaacuaaaauacaaaaagcuga

SEQ ID NO: 779636 - RNA, 26 nt, Human
uaagacaggcauuucauacccaaacc

SEQ ID NO: 779637 - RNA, 19 nt, Human
uaagagaggagucuccaaa

SEQ ID NO: 779638 - RNA, 20 nt, Human
uaagagaggagucuccaaaa

SEQ ID NO: 779639 - RNA, 20 nt, Human
uaagcaaaacugguaagugu

SEQ ID NO: 779640 - RNA, 24 nt, Human
uacaaugaaugaagauaccaagcc

SEQ ID NO: 779641 - RNA, 25 nt, Human
uacaaugaaugaagauaccaagcca

SEQ ID NO: 779642 - RNA, 22 nt, Human
uaccagaaacuugcuacaaaaa

SEQ ID NO: 779643 - RNA, 21 nt, Human
uacccacucccuaaaaauaaa

SEQ ID NO: 779644 - RNA, 18 nt, Human
uagcaccauagcugaacc

SEQ ID NO: 779645 - RNA, 23 nt, Human
uagccaacucuaaaacagguuuc

SEQ ID NO: 779646 - RNA, 19 nt, Human
uagcuucaggauguaaacg

SEQ ID NO: 779647 - RNA, 19 nt, Human
uauacagcaaaaaugaaaa

SEQ ID NO: 779648 - RNA, 20 nt, Human
uauacagcaaaaaugaaaaa

SEQ ID NO: 779649 - RNA, 21 nt, Human
uauacagcaaaaaugaaaaac

SEQ ID NO: 779650 - RNA, 24 nt, Human
uauagaaccaccagauaucuguaa

SEQ ID NO: 779651 - RNA, 23 nt, Human
uauuacaaauuacaguaaauguu

SEQ ID NO: 779652 - RNA, 22 nt, Human
ucaaaaagcccccagggucccc

SEQ ID NO: 779653 - RNA, 20 nt, Human
ucaaaauacaaaaugcuaau

SEQ ID NO: 779654 - RNA, 19 nt, Human
ucacugcauccuuugccuc

SEQ ID NO: 779655 - RNA, 23 nt, Human
ucacugcauccuuugccucauug

SEQ ID NO: 779656 - RNA, 20 nt, Human
ucagcuucccaccagaacag

SEQ ID NO: 779657 - RNA, 24 nt, Human
ucagcuucccaccagaacaggacu

SEQ ID NO: 779658 - RNA, 23 nt, Human
uccaucaaaauacaaaaugcuaa

SEQ ID NO: 779659 - RNA, 19 nt, Human
ucccuaaaaauaaaaucca

SEQ ID NO: 779660 - RNA, 19 nt, Human
ucccuaaaaauaaaaucca

SEQ ID NO: 779661 - RNA, 26 nt, Human
ucccuaaaaauaaaauccaguaaacc

SEQ ID NO: 779662 - RNA, 21 nt, Human
uccuauacugagguugccucc

SEQ ID NO: 779663 - RNA, 24 nt, Human
uccuauacugagguugccuccaau

SEQ ID NO: 779664 - RNA, 23 nt, Human
uccucaaaugaauaaaaaggcac

SEQ ID NO: 779665 - RNA, 22 nt, Human
uccucuaaaauuaaaguuucua

SEQ ID NO: 779666 - RNA, 21 nt, Human
uccuuucacaagugcugcugu

SEQ ID NO: 779667 - RNA, 21 nt, Human
ucgcccuaauuaaaacccaaa

SEQ ID NO: 779668 - RNA, 22 nt, Human
ucuccaaaagagagugcacaaa

SEQ ID NO: 779669 - RNA, 19 nt, Human
ucugauaaaaaaagucacu

SEQ ID NO: 779670 - RNA, 19 nt, Human
ucugggaacucaaacauga

SEQ ID NO: 779671 - RNA, 23 nt, Human
ugaaaaacuuacagaaagguaaa

SEQ ID NO: 779672 - RNA, 19 nt, Human
ugaaaagaaugcuucugaa

SEQ ID NO: 779673 - RNA, 21 nt, Human
ugaaaagaaugcuucugaauu

SEQ ID NO: 779674 - RNA, 24 nt, Human
ugaagauaccaagccaacuugcug

SEQ ID NO: 779675 - RNA, 24 nt, Human
ugaagauaccuacugaauagcacc

SEQ ID NO: 779676 - RNA, 23 nt, Human
ugacagaagaaaaaauggccacu

SEQ ID NO: 779677 - RNA, 21 nt, Human
ugaccaaagaaauauuucuaa

SEQ ID NO: 779678 - RNA, 23 nt, Human
ugagggaaggagggccagaggag

SEQ ID NO: 779679 - RNA, 24 nt, Human
ugagugacaauuggucucaaaaau

SEQ ID NO: 779680 - RNA, 18 nt, Human
ugcacaaaaagaggagca

SEQ ID NO: 779681 - RNA, 18 nt, Human
uggaaagacacaccugca

SEQ ID NO: 779682 - RNA, 21 nt, Human
uggcaaaauuuucuuuuuguu

SEQ ID NO: 779683 - RNA, 18 nt, Human
ugggaacucaaacaugaa

SEQ ID NO: 779684 - RNA, 22 nt, Human
ugguacaauuucagcucauugu

SEQ ID NO: 779685 - RNA, 23 nt, Human
ugguacaauuucagcucauuguu

SEQ ID NO: 779686 - RNA, 21 nt, Human
uguaaaacuaguaacccauaa

SEQ ID NO: 779687 - RNA, 21 nt, Human
uguggcuuacugggugucuug

SEQ ID NO: 779688 - RNA, 25 nt, Human
uguuugguucuuguaggcugguugg

SEQ ID NO: 779689 - RNA, 22 nt, Human
uuaaaaaaaaaaaaucacaggu

SEQ ID NO: 779690 - RNA, 23 nt, Human
uucaaaaagcccccagggucccc

SEQ ID NO: 779691 - RNA, 25 nt, Human
uucaaacucacugauggcuaaaauc

SEQ ID NO: 779692 - RNA, 20 nt, Human
uucaacuaaugucaaaugaa

SEQ ID NO: 779693 - RNA, 23 nt, Human
uucagauacauacaauucacaga

SEQ ID NO: 779694 - RNA, 24 nt, Human
uugagggaaggagggccagaggag

SEQ ID NO: 779695 - RNA, 24 nt, Human
uuggaagcauuuuaaugcugaaaa

SEQ ID NO: 779696 - RNA, 21 nt, Human
uuggucucaaaaauugauaaa

SEQ ID NO: 779697 - RNA, 22 nt, Human
uuugcaauuaagcauacagaaa

SEQ ID NO: 779698 - RNA, 19 nt, Human
uuuuuguuuuuuugugugu

SEQ ID NO: 779699 - RNA, 18 nt, Human
uuuuuuuuccuuucacaa

SEQ ID NO: 779700 - RNA, 23 nt, Human
aaaaaaacgacacagguuucuga

SEQ ID NO: 779701 - RNA, 23 nt, Human
aaaaaacuuuguauuacuacuga

SEQ ID NO: 779702 - RNA, 19 nt, Human
aaaaacuguggccaagaac

SEQ ID NO: 779703 - RNA, 21 nt, Human
aaaaaggaaauuuaaauaaga

SEQ ID NO: 779704 - RNA, 25 nt, Human
aaaagaaaacuaauuucuacauaga

SEQ ID NO: 779705 - RNA, 25 nt, Human
aaacaaacacaauaguaucuaagca

SEQ ID NO: 779706 - RNA, 21 nt, Human
aaacacaauaguaucuaagca

SEQ ID NO: 779707 - RNA, 22 nt, Human
aaacacgcaccugcucauugcc

SEQ ID NO: 779708 - RNA, 26 nt, Human
aaacacuagaacgugaaccacuaaca

SEQ ID NO: 779709 - RNA, 20 nt, Human
aaacacuauagaugugauga

SEQ ID NO: 779710 - RNA, 19 nt, Human
aaacagcaaauacaaaggc

SEQ ID NO: 779711 - RNA, 20 nt, Human
aaaccaacaaaacaacucua

SEQ ID NO: 779712 - RNA, 25 nt, Human
aaacuguagaaauucacuacugaac

SEQ ID NO: 779713 - RNA, 25 nt, Human
aaauagccuggcccuggagacaggc

SEQ ID NO: 779714 - RNA, 18 nt, Human
aacauuucccgaucagcu

SEQ ID NO: 779715 - RNA, 20 nt, Human
aacccagaagguugcuaaua

SEQ ID NO: 779716 - RNA, 19 nt, Human
aaccuggaacauguagugg

SEQ ID NO: 779717 - RNA, 19 nt, Human
aagcaauaaagggacccga

SEQ ID NO: 779718 - RNA, 22 nt, Human
aauauccacccuuccucauugc

SEQ ID NO: 779719 - RNA, 22 nt, Human
aauucagaauacaucuauguac

SEQ ID NO: 779720 - RNA, 20 nt, Human
aauuuuguggccucuagggc

SEQ ID NO: 779721 - RNA, 21 nt, Human
acaaaauagguagugcgcccc

SEQ ID NO: 779722 - RNA, 22 nt, Human
acaacaacaacaaccagucuuu

SEQ ID NO: 779723 - RNA, 22 nt, Human
acaagccuguaaaaugauaacc

SEQ ID NO: 779724 - RNA, 28 nt, Human
acacaaaaaugcaaaauugcugagauau

SEQ ID NO: 779725 - RNA, 20 nt, Human
acaccaaaaaaacgacacaa

SEQ ID NO: 779726 - RNA, 25 nt, Human
acaccaaaaaaacgacacagguuuc

SEQ ID NO: 779727 - RNA, 20 nt, Human
acaccacuguauucacuggc

SEQ ID NO: 779728 - RNA, 21 nt, Human
acacugagcacaguggccucu

SEQ ID NO: 779729 - RNA, 18 nt, Human
acauuucucuaaaaaguc

SEQ ID NO: 779730 - RNA, 24 nt, Human
accacugcuuaaaccacacacguc

SEQ ID NO: 779731 - RNA, 21 nt, Human
acccaggggaaccaaccugac

SEQ ID NO: 779732 - RNA, 23 nt, Human
acccgugguuugggaucuuugca

SEQ ID NO: 779733 - RNA, 19 nt, Human
accuggacuucugacagua

SEQ ID NO: 779734 - RNA, 23 nt, Human
accuuccauucuucuaacucgcc

SEQ ID NO: 779735 - RNA, 20 nt, Human
acuguguuuugagaacaugu

SEQ ID NO: 779736 - RNA, 21 nt, Human
acuugaggucaaguacuuuug

SEQ ID NO: 779737 - RNA, 23 nt, Human
agaaaagaaaacuaauuucuaca

SEQ ID NO: 779738 - RNA, 19 nt, Human
agaauccuaacgucacugu

SEQ ID NO: 779739 - RNA, 20 nt, Human
agacagacagggaguaccug

SEQ ID NO: 779740 - RNA, 18 nt, Human
agagugcuggacgacaaa

SEQ ID NO: 779741 - RNA, 20 nt, Human
agcucuuaggcaaaacacaa

SEQ ID NO: 779742 - RNA, 24 nt, Human
aggaagccugagucagcucuggug

SEQ ID NO: 779743 - RNA, 24 nt, Human
aggagcugcaggccgugggggagg

SEQ ID NO: 779744 - RNA, 21 nt, Human
aggagugaguccugaagagga

SEQ ID NO: 779745 - RNA, 21 nt, Human
aggcaaaacacaaacccagaa

SEQ ID NO: 779746 - RNA, 24 nt, Human
aggcagcaccacccugccuuugcc

SEQ ID NO: 779747 - RNA, 19 nt, Human
agguagugcgccccugagc

SEQ ID NO: 779748 - RNA, 23 nt, Human
aguuauugaagguuugaaccagg

SEQ ID NO: 779749 - RNA, 19 nt, Human
auagaaccaaaagucuuca

SEQ ID NO: 779750 - RNA, 20 nt, Human
auggaggguaagagcucuuc

SEQ ID NO: 779751 - RNA, 21 nt, Human
auggguauucucuugucagua

SEQ ID NO: 779752 - RNA, 22 nt, Human
augguccagcauaccugaguga

SEQ ID NO: 779753 - RNA, 21 nt, Human
auuccaaaaaaucacaaaaua

SEQ ID NO: 779754 - RNA, 18 nt, Human
auuucaggaaaaacacua

SEQ ID NO: 779755 - RNA, 22 nt, Human
auuuugugacccaggggaacca

SEQ ID NO: 779756 - RNA, 24 nt, Human
caaaaaaacgacacagguuucuga

SEQ ID NO: 779757 - RNA, 19 nt, Human
caaaacacaaacccagaaa

SEQ ID NO: 779758 - RNA, 19 nt, Human
caaaacacaaacccagaaa

SEQ ID NO: 779759 - RNA, 20 nt, Human
caaaauagguagugcgcccc

SEQ ID NO: 779760 - RNA, 24 nt, Human
caaaauugcugagauaucaaacau

SEQ ID NO: 779761 - RNA, 20 nt, Human
caaaugucuaauauauacag

SEQ ID NO: 779762 - RNA, 23 nt, Human
caaccacuccauguuguccaagu

SEQ ID NO: 779763 - RNA, 24 nt, Human
caacuggcgacuuugacuugugcu

SEQ ID NO: 779764 - RNA, 24 nt, Human
caagaaaagaaaacuaauuucuac

SEQ ID NO: 779765 - RNA, 19 nt, Human
caagaugaccaccuacucc

SEQ ID NO: 779766 - RNA, 20 nt, Human
caagccaggagagaggaggg

SEQ ID NO: 779767 - RNA, 20 nt, Human
cacaaaucagaaauaagauu

SEQ ID NO: 779768 - RNA, 18 nt, Human
cacauauaaaaauacagu

SEQ ID NO: 779769 - RNA, 21 nt, Human
cacauuucaggaaaaacacua

SEQ ID NO: 779770 - RNA, 18 nt, Human
caccaaaaaaacgacaca

SEQ ID NO: 779771 - RNA, 18 nt, Human
caccucccucacaucagc

SEQ ID NO: 779772 - RNA, 19 nt, Human
cacugccuuugaccucugc

SEQ ID NO: 779773 - RNA, 21 nt, Human
cagacagaaacccucagcaaa

SEQ ID NO: 779774 - RNA, 18 nt, Human
cagacuacacugagcaca

SEQ ID NO: 779775 - RNA, 20 nt, Human
cagcaaaaaaacuguggcca

SEQ ID NO: 779776 - RNA, 21 nt, Human
cagcaaaaaaacuguggccaa

SEQ ID NO: 779777 - RNA, 19 nt, Human
cagcagaaagguaaggcug

SEQ ID NO: 779778 - RNA, 18 nt, Human
cagcggcaccaugagcuc

SEQ ID NO: 779779 - RNA, 24 nt, Human
cagcggcaccaugagcuccccacc

SEQ ID NO: 779780 - RNA, 18 nt, Human
cagugaccucucaccucc

SEQ ID NO: 779781 - RNA, 21 nt, Human
cagugaccucucaccucccuc

SEQ ID NO: 779782 - RNA, 21 nt, Human
cauccaagaaagcuucuaguu

SEQ ID NO: 779783 - RNA, 18 nt, Human
ccaaaaaaacgacacagg

SEQ ID NO: 779784 - RNA, 19 nt, Human
ccaaggcucuccacugccu

SEQ ID NO: 779785 - RNA, 24 nt, Human
ccagugagcagagggcuccagugu

SEQ ID NO: 779786 - RNA, 21 nt, Human
ccucccucacaucagccuuag

SEQ ID NO: 779787 - RNA, 19 nt, Human
ccuuccauaggcagcagcu

SEQ ID NO: 779788 - RNA, 24 nt, Human
cgagagcuagaaaacuaucuacac

SEQ ID NO: 779789 - RNA, 18 nt, Human
cgccccugagccaucacu

SEQ ID NO: 779790 - RNA, 21 nt, Human
cuaaacaacaacaacaaccag

SEQ ID NO: 779791 - RNA, 25 nt, Human
cuaaccaacccagaagguugcuaau

SEQ ID NO: 779792 - RNA, 24 nt, Human
cuagaaaacuaucuacacaauuca

SEQ ID NO: 779793 - RNA, 18 nt, Human
cuauugcaagcaagaaaa

SEQ ID NO: 779794 - RNA, 20 nt, Human
cucauugcacucaccaucac

SEQ ID NO: 779795 - RNA, 22 nt, Human
cugaacacuuaaacuauucauc

SEQ ID NO: 779796 - RNA, 21 nt, Human
cugagcacaguggccucugcc

SEQ ID NO: 779797 - RNA, 21 nt, Human
cugagcacaguggccucugcc

SEQ ID NO: 779798 - RNA, 19 nt, Human
cugaggacacaguguuugu

SEQ ID NO: 779799 - RNA, 19 nt, Human
cuggacucccaaauagaga

SEQ ID NO: 779800 - RNA, 19 nt, Human
cuuguagauccgagauugc

SEQ ID NO: 779801 - RNA, 24 nt, Human
gaaagcuaugcugccuggaaugau

SEQ ID NO: 779802 - RNA, 25 nt, Human
gacaaaauagguagugcgccccuga

SEQ ID NO: 779803 - RNA, 27 nt, Human
gacacuaaccuaaacaacaacaacaac

SEQ ID NO: 779804 - RNA, 22 nt, Human
gacagcaccuuguagauccgag

SEQ ID NO: 779805 - RNA, 18 nt, Human
gacgacaaauugcugggg

SEQ ID NO: 779806 - RNA, 21 nt, Human
gacuuggggugguggccggga

SEQ ID NO: 779807 - RNA, 26 nt, Human
gagaucucuccacucuuaaggcacuc

SEQ ID NO: 779808 - RNA, 24 nt, Human
gagcuccccaccugagugacagcc

SEQ ID NO: 779809 - RNA, 28 nt, Human
gagguuuccuaguggaugcuuugcugaa

SEQ ID NO: 779810 - RNA, 18 nt, Human
gaguaccugcagcaaacu

SEQ ID NO: 779811 - RNA, 20 nt, Human
gaucugcaguuggaggaguu

SEQ ID NO: 779812 - RNA, 25 nt, Human
gcaauaaagggacccgagagcuaga

SEQ ID NO: 779813 - RNA, 18 nt, Human
gcacuguguauuuuugga

SEQ ID NO: 779814 - RNA, 22 nt, Human
gcagcuugcaggcagcaccacc

SEQ ID NO: 779815 - RNA, 21 nt, Human
gcaggcagcaccacccugccu

SEQ ID NO: 779816 - RNA, 22 nt, Human
gccaagaacuguaagaaaaaua

SEQ ID NO: 779817 - RNA, 22 nt, Human
gccacuguuucuaaacagcacu

SEQ ID NO: 779818 - RNA, 22 nt, Human
gccuugaaccgucuggaaggca

SEQ ID NO: 779819 - RNA, 25 nt, Human
gccuuugaccucugcugugucuugg

SEQ ID NO: 779820 - RNA, 21 nt, Human
gcgcguccucacuccaaccug

SEQ ID NO: 779821 - RNA, 22 nt, Human
ggaaaucucuggcagaggggcc

SEQ ID NO: 779822 - RNA, 19 nt, Human
ggcacaugagcacuguuag

SEQ ID NO: 779823 - RNA, 21 nt, Human
ggcuggugacccaagccagga

SEQ ID NO: 779824 - RNA, 18 nt, Human
gggaggacaggagcugca

SEQ ID NO: 779825 - RNA, 20 nt, Human
gggcagggacguggaggccc

SEQ ID NO: 779826 - RNA, 19 nt, Human
gggcaugguaauguccaac

SEQ ID NO: 779827 - RNA, 21 nt, Human
ggggugguggccgggacacca

SEQ ID NO: 779828 - RNA, 22 nt, Human
ggguccaggaagccugagucag

SEQ ID NO: 779829 - RNA, 19 nt, Human
gguaaggcugguacuacug

SEQ ID NO: 779830 - RNA, 25 nt, Human
gguaaggcugguacuacuguguuuu

SEQ ID NO: 779831 - RNA, 21 nt, Human
guaaaguuccauccaagaaag

SEQ ID NO: 779832 - RNA, 21 nt, Human
gugccuccuuuuggcaaauac

SEQ ID NO: 779833 - RNA, 20 nt, Human
gugguaaacucuuguagggc

SEQ ID NO: 779834 - RNA, 22 nt, Human
gugugguaaacucuuguagggc

SEQ ID NO: 779835 - RNA, 24 nt, Human
guguucugguuaacagagaguuau

SEQ ID NO: 779836 - RNA, 21 nt, Human
uaaaaaacaacauaaaggcaa

SEQ ID NO: 779837 - RNA, 22 nt, Human
uaaaaaacaacauaaaggcaau

SEQ ID NO: 779838 - RNA, 22 nt, Human
uaaaaacacuaauaaagccucc

SEQ ID NO: 779839 - RNA, 23 nt, Human
uaaaaacacuaauaaagccucca

SEQ ID NO: 779840 - RNA, 18 nt, Human
uaaaaagcaauaaaggga

SEQ ID NO: 779841 - RNA, 22 nt, Human
uaaaaagcaauaaagggacccg

SEQ ID NO: 779842 - RNA, 21 nt, Human
uaaaaucaaucuaaccaaccc

SEQ ID NO: 779843 - RNA, 21 nt, Human
uaaaaucaaucuaaccaaccc

SEQ ID NO: 779844 - RNA, 22 nt, Human
uaaacagcacugaaagccaaaa

SEQ ID NO: 779845 - RNA, 21 nt, Human
uaaaccacacacacacaaauc

SEQ ID NO: 779846 - RNA, 21 nt, Human
uaaauaaaaagugccuccuuu

SEQ ID NO: 779847 - RNA, 24 nt, Human
uaaaugugcacacauauaaaaaua

SEQ ID NO: 779848 - RNA, 18 nt, Human
uaaccuuaaauggauaau

SEQ ID NO: 779849 - RNA, 18 nt, Human
uaagaaaaauacuuuccc

SEQ ID NO: 779850 - RNA, 24 nt, Human
uacaaaucacaaugucagagcaua

SEQ ID NO: 779851 - RNA, 25 nt, Human
uacaacaccaaaaaaacgacacagg

SEQ ID NO: 779852 - RNA, 19 nt, Human
uacaacaguaccacugcuu

SEQ ID NO: 779853 - RNA, 24 nt, Human
uacaacaguaccacugcuuaaacc

SEQ ID NO: 779854 - RNA, 26 nt, Human
uacaagaugaccaccuacuccuagac

SEQ ID NO: 779855 - RNA, 23 nt, Human
uacacaauucaggauuauggaaa

SEQ ID NO: 779856 - RNA, 19 nt, Human
uacacugagcacaguggcc

SEQ ID NO: 779857 - RNA, 23 nt, Human
uacagguggugccauuuggacuu

SEQ ID NO: 779858 - RNA, 22 nt, Human
uacauagaaaaaaaacuuugua

SEQ ID NO: 779859 - RNA, 23 nt, Human
uacauuucucuaaaaagucccca

SEQ ID NO: 779860 - RNA, 18 nt, Human
uacgguguuugucauuug

SEQ ID NO: 779861 - RNA, 23 nt, Human
uacuugaggucaaguacuuuugg

SEQ ID NO: 779862 - RNA, 23 nt, Human
uagaucuaucucuaaaaacugac

SEQ ID NO: 779863 - RNA, 24 nt, Human
uagauugcacauuucaggaaaaac

SEQ ID NO: 779864 - RNA, 19 nt, Human
uagauugguaucuuucucc

SEQ ID NO: 779865 - RNA, 26 nt, Human
uaggagaagguucuucuuuuaugggg

SEQ ID NO: 779866 - RNA, 18 nt, Human
uaggcccagacagaaacc

SEQ ID NO: 779867 - RNA, 18 nt, Human
uaguuguuuuccaguuuu

SEQ ID NO: 779868 - RNA, 25 nt, Human
uauaaaaacacuaauaaagccucca

SEQ ID NO: 779869 - RNA, 20 nt, Human
uauccaguuacaagccugua

SEQ ID NO: 779870 - RNA, 21 nt, Human
uaucuacaucuuagugaaaau

SEQ ID NO: 779871 - RNA, 28 nt, Human
uauguacaguacaugugcaaaauguaug

SEQ ID NO: 779872 - RNA, 23 nt, Human
uauguugaaagaucuugcauuua

SEQ ID NO: 779873 - RNA, 24 nt, Human
uauucaucacagacuacacugagc

SEQ ID NO: 779874 - RNA, 19 nt, Human
ucacuggucucauuuugga

SEQ ID NO: 779875 - RNA, 20 nt, Human
ucagaaauaagaucagcucu

SEQ ID NO: 779876 - RNA, 21 nt, Human
ucaguauggaacauuuaccau

SEQ ID NO: 779877 - RNA, 21 nt, Human
uccacaaauucagaauacauc

SEQ ID NO: 779878 - RNA, 23 nt, Human
uccaccuauucuuucugugacaa

SEQ ID NO: 779879 - RNA, 22 nt, Human
ucccaaguaaauagccuggccc

SEQ ID NO: 779880 - RNA, 26 nt, Human
uccuaaaugcuuccucuuccuaccaa

SEQ ID NO: 779881 - RNA, 21 nt, Human
uccucgaucagagagaagggc

SEQ ID NO: 779882 - RNA, 23 nt, Human
uccugaagaggaguugggcaugg

SEQ ID NO: 779883 - RNA, 22 nt, Human
uccuggguagaugacagaccuu

SEQ ID NO: 779884 - RNA, 22 nt, Human
ucuccacugccuuugaccucug

SEQ ID NO: 779885 - RNA, 27 nt, Human
ucuccacugccuuugaccucugcugug

SEQ ID NO: 779886 - RNA, 22 nt, Human
ucuuaaaccaacaaaacaacuc

SEQ ID NO: 779887 - RNA, 19 nt, Human
ucuugguucuuugagaugg

SEQ ID NO: 779888 - RNA, 19 nt, Human
ugaaauguuuucaaacuug

SEQ ID NO: 779889 - RNA, 19 nt, Human
ugaaccacuaacacugucc

SEQ ID NO: 779890 - RNA, 19 nt, Human
ugaaccgucuggaaggcac

SEQ ID NO: 779891 - RNA, 18 nt, Human
ugaagaaagcuaugcugc

SEQ ID NO: 779892 - RNA, 22 nt, Human
ugaaugaagaagaugcucaggg

SEQ ID NO: 779893 - RNA, 22 nt, Human
ugaaugguccagcauaccugag

SEQ ID NO: 779894 - RNA, 21 nt, Human
ugacacuaaccuaaacaacaa

SEQ ID NO: 779895 - RNA, 19 nt, Human
ugacagaccuuccccuuac

SEQ ID NO: 779896 - RNA, 19 nt, Human
ugacagccaggacuucugu

SEQ ID NO: 779897 - RNA, 18 nt, Human
ugaccuuccaguuuaugu

SEQ ID NO: 779898 - RNA, 21 nt, Human
ugagacacaaaaaugcaaaac

SEQ ID NO: 779899 - RNA, 18 nt, Human
ugagaugcuaagacauaa

SEQ ID NO: 779900 - RNA, 19 nt, Human
ugagcacuguuagugccuu

SEQ ID NO: 779901 - RNA, 24 nt, Human
ugagugacagccaggacuucugug

SEQ ID NO: 779902 - RNA, 23 nt, Human
ugagugacucagcagaucauucu

SEQ ID NO: 779903 - RNA, 21 nt, Human
ugauaggcccagacagaaacc

SEQ ID NO: 779904 - RNA, 24 nt, Human
ugauuucaggggugcaaacagcaa

SEQ ID NO: 779905 - RNA, 23 nt, Human
ugcaaacagcaaauacaaaggca

SEQ ID NO: 779906 - RNA, 21 nt, Human
ugcagugaccucucaccuccc

SEQ ID NO: 779907 - RNA, 19 nt, Human
ugcauggaggguaagagcu

SEQ ID NO: 779908 - RNA, 23 nt, Human
ugcugaaauguacaagaugacca

SEQ ID NO: 779909 - RNA, 23 nt, Human
ugcuggaaaagcagacuguuguu

SEQ ID NO: 779910 - RNA, 19 nt, Human
uggacuuggggugguggcc

SEQ ID NO: 779911 - RNA, 24 nt, Human
uggauucuugggauggcuuugcuu

SEQ ID NO: 779912 - RNA, 18 nt, Human
uggauugaagaacacugu

SEQ ID NO: 779913 - RNA, 20 nt, Human
uggcacagucugaccuguac

SEQ ID NO: 779914 - RNA, 20 nt, Human
uggcccuggagacaggcccc

SEQ ID NO: 779915 - RNA, 20 nt, Human
ugggaauucugaaaggacug

SEQ ID NO: 779916 - RNA, 18 nt, Human
ugggauggcuuugcuuca

SEQ ID NO: 779917 - RNA, 21 nt, Human
ugggcaugguaauguccaacc

SEQ ID NO: 779918 - RNA, 19 nt, Human
ugggcuaauuuuguggccu

SEQ ID NO: 779919 - RNA, 23 nt, Human
uggggaggacaggagcugcaggc

SEQ ID NO: 779920 - RNA, 19 nt, Human
ugggggaggcugaucugca

SEQ ID NO: 779921 - RNA, 18 nt, Human
ugguuacuugaggucaag

SEQ ID NO: 779922 - RNA, 21 nt, Human
uguaaacaugugcagcuuuuc

SEQ ID NO: 779923 - RNA, 22 nt, Human
uguagguaucuucuguuuaugu

SEQ ID NO: 779924 - RNA, 23 nt, Human
ugucacaaagcugugacaccaca

SEQ ID NO: 779925 - RNA, 26 nt, Human
ugucacaaagcugugacaccacagag

SEQ ID NO: 779926 - RNA, 23 nt, Human
uguccaaguuugagucugacagg

SEQ ID NO: 779927 - RNA, 21 nt, Human
ugugacaccacagagcaaagu

SEQ ID NO: 779928 - RNA, 19 nt, Human
ugugcagcuuuucgaauug

SEQ ID NO: 779929 - RNA, 22 nt, Human
uguggcauguuucaaacccuau

SEQ ID NO: 779930 - RNA, 22 nt, Human
uguggggaggacaggagcugca

SEQ ID NO: 779931 - RNA, 21 nt, Human
uguguuagguccauuuugcag

SEQ ID NO: 779932 - RNA, 22 nt, Human
uguguugguuuaccaauuucug

SEQ ID NO: 779933 - RNA, 20 nt, Human
uguucgguuaccuucuacag

SEQ ID NO: 779934 - RNA, 20 nt, Human
uguuuguggggaggacaggg

SEQ ID NO: 779935 - RNA, 22 nt, Human
uuacucuuaaaccaacaaaaca

SEQ ID NO: 779936 - RNA, 18 nt, Human
uucacuggcauuguggug

SEQ ID NO: 779937 - RNA, 19 nt, Human
uucagccagaagcugucac

SEQ ID NO: 779938 - RNA, 25 nt, Human
uucccgacagcaccuuguagauccg

SEQ ID NO: 779939 - RNA, 24 nt, Human
uugaaccaggaaaaaaaaauuacu

SEQ ID NO: 779940 - RNA, 22 nt, Human
uugaagaacacuguucugugcg

SEQ ID NO: 779941 - RNA, 21 nt, Human
uugaagaacacuguucugugg

SEQ ID NO: 779942 - RNA, 24 nt, Human
uugcaagcaagaaaagaaaacuaa

SEQ ID NO: 779943 - RNA, 19 nt, Human
uugcugggguggcgggggu

SEQ ID NO: 779944 - RNA, 22 nt, Human
uuggugguacuuuaacuucuuu

SEQ ID NO: 779945 - RNA, 20 nt, Human
uugguuacuugaggucaagu

SEQ ID NO: 779946 - RNA, 26 nt, Human
uuuaccauuuugugacccaggggaaa

SEQ ID NO: 779947 - RNA, 18 nt, Human
uuuagggucuuaaaguga

SEQ ID NO: 779948 - RNA, 23 nt, Human
uuucaaacuuggguuccaggcuc

SEQ ID NO: 779949 - RNA, 18 nt, Human
uuuggcaaauacuuggca

SEQ ID NO: 779950 - RNA, 20 nt, Human
uuuguaguggaggaauuuca

SEQ ID NO: 779951 - RNA, 18 nt, Human
uuuuaaauucaucccacc

SEQ ID NO: 779952 - RNA, 20 nt, Human
aaaaacugaaggcaaacaga

SEQ ID NO: 779953 - RNA, 20 nt, Human
aaacaaacaccacaagaaca

SEQ ID NO: 779954 - RNA, 18 nt, Human
aaacugaaggcaaacaga

SEQ ID NO: 779955 - RNA, 21 nt, Human
aaagaaacaaagcaacugugg

SEQ ID NO: 779956 - RNA, 23 nt, Human
aaagaagucagaacacugccuuc

SEQ ID NO: 779957 - RNA, 18 nt, Human
aaauaccccuuuaaaucc

SEQ ID NO: 779958 - RNA, 19 nt, Human
aacaaaggacuaaggcacc

SEQ ID NO: 779959 - RNA, 22 nt, Human
aagaaacaaagcaacuguggug

SEQ ID NO: 779960 - RNA, 19 nt, Human
aaguagcugggauuacagg

SEQ ID NO: 779961 - RNA, 18 nt, Human
aagugcugggauuacagg

SEQ ID NO: 779962 - RNA, 19 nt, Human
aagugcugggauuacaggc

SEQ ID NO: 779963 - RNA, 19 nt, Human
aagugcugggauuacaggc

SEQ ID NO: 779964 - RNA, 23 nt, Human
aagugcugggauuacaggcguga

SEQ ID NO: 779965 - RNA, 26 nt, Human
aagugcugggauuacaggcgugagcc

SEQ ID NO: 779966 - RNA, 22 nt, Human
aaguuuacaaauaccccuuuaa

SEQ ID NO: 779967 - RNA, 22 nt, Human
acaacacuguaagcaaaagcac

SEQ ID NO: 779968 - RNA, 23 nt, Human
accacaccuggcuaauuuuugua

SEQ ID NO: 779969 - RNA, 20 nt, Human
accuuauguucagacaauug

SEQ ID NO: 779970 - RNA, 18 nt, Human
acgagguuucaccauguu

SEQ ID NO: 779971 - RNA, 19 nt, Human
acgagguuucaccauguug

SEQ ID NO: 779972 - RNA, 24 nt, Human
acgagguuucaccauguuguccag

SEQ ID NO: 779973 - RNA, 19 nt, Human
acguaccagccacuuucac

SEQ ID NO: 779974 - RNA, 23 nt, Human
acugaagccuuuucccccaguaa

SEQ ID NO: 779975 - RNA, 20 nt, Human
agaaauaaagguacaacaca

SEQ ID NO: 779976 - RNA, 18 nt, Human
agccacagacuucaaacc

SEQ ID NO: 779977 - RNA, 20 nt, Human
agcgauucuccugucucggc

SEQ ID NO: 779978 - RNA, 20 nt, Human
agguacaacacaguaccuua

SEQ ID NO: 779979 - RNA, 24 nt, Human
agguuaucugcccaccuuggccuc

SEQ ID NO: 779980 - RNA, 23 nt, Human
agugcaauggugcaaucuuggcu

SEQ ID NO: 779981 - RNA, 24 nt, Human
agugcaauggugcaaucuuggcuc

SEQ ID NO: 779982 - RNA, 18 nt, Human
agugcugggauuacaggc

SEQ ID NO: 779983 - RNA, 18 nt, Human
aguuccauauuucucaag

SEQ ID NO: 779984 - RNA, 18 nt, Human
aucagugguuggaaaggc

SEQ ID NO: 779985 - RNA, 23 nt, Human
aucuacguaccagccacuuucac

SEQ ID NO: 779986 - RNA, 24 nt, Human
augaaaaguugcuauguauaaaua

SEQ ID NO: 779987 - RNA, 19 nt, Human
auuacaggugcauccuacc

SEQ ID NO: 779988 - RNA, 24 nt, Human
auuuuuguauuuuuaguagagacg

SEQ ID NO: 779989 - RNA, 21 nt, Human
caaacaccacaagaacagcca

SEQ ID NO: 779990 - RNA, 25 nt, Human
caacacuguaagcaaaagcacuggg

SEQ ID NO: 779991 - RNA, 21 nt, Human
cacaaagaagaacugaaccuc

SEQ ID NO: 779992 - RNA, 24 nt, Human
caccauguuguccagccuggucuc

SEQ ID NO: 779993 - RNA, 21 nt, Human
cacugcaacguccgccuccug

SEQ ID NO: 779994 - RNA, 23 nt, Human
cacugcaacguccgccuccuggg

SEQ ID NO: 779995 - RNA, 18 nt, Human
cacuguaagcaaaagcac

SEQ ID NO: 779996 - RNA, 21 nt, Human
cagacaauuguggggcaugga

SEQ ID NO: 779997 - RNA, 20 nt, Human
cagcuugacuuaccagcaga

SEQ ID NO: 779998 - RNA, 20 nt, Human
cauccuaccacaccuggcua

SEQ ID NO: 779999 - RNA, 24 nt, Human
cauguuguccagccuggucucaaa

SEQ ID NO: 780000 - RNA, 28 nt, Human
ccaaaguaagugcugggauuacaggcgu

SEQ ID NO: 780001 - RNA, 21 nt, Human
ccaccugaaauauuggucuga

SEQ ID NO: 780002 - RNA, 22 nt, Human
ccagccagacccauaaccauaa

SEQ ID NO: 780003 - RNA, 22 nt, Human
ccagccggaccagcucggcugc

SEQ ID NO: 780004 - RNA, 21 nt, Human
ccgcagguuaucugcccaccu

SEQ ID NO: 780005 - RNA, 26 nt, Human
ccgcagguuaucugcccaccuuggcc

SEQ ID NO: 780006 - RNA, 24 nt, Human
ccgccuccuggguucgagcgauuc

SEQ ID NO: 780007 - RNA, 22 nt, Human
ccuaaguagcugggauuacagg

SEQ ID NO: 780008 - RNA, 23 nt, Human
ccuaaguagcugggauuacaggu

SEQ ID NO: 780009 - RNA, 24 nt, Human
ccuaaguagcugggauuacaggug

SEQ ID NO: 780010 - RNA, 24 nt, Human
ccuccuggguucgagcgauucucc

SEQ ID NO: 780011 - RNA, 24 nt, Human
ccugucucggccuccuaaguagcu

SEQ ID NO: 780012 - RNA, 22 nt, Human
cgagcgauucuccugucucggc

SEQ ID NO: 780013 - RNA, 18 nt, Human
cgagguuucaccauguug

SEQ ID NO: 780014 - RNA, 18 nt, Human
cguaccagccacuuucac

SEQ ID NO: 780015 - RNA, 21 nt, Human
cuaaguagcugggauuacagg

SEQ ID NO: 780016 - RNA, 23 nt, Human
cuaaguagcugggauuacaggug

SEQ ID NO: 780017 - RNA, 23 nt, Human
cuaauuuuuguauuuuuaguaga

SEQ ID NO: 780018 - RNA, 24 nt, Human
cuaccacaccuggcuaauuuuugu

SEQ ID NO: 780019 - RNA, 24 nt, Human
cucaaggagggcaaaguuuacaaa

SEQ ID NO: 780020 - RNA, 24 nt, Human
cucacugcaacguccgccuccugg

SEQ ID NO: 780021 - RNA, 21 nt, Human
cuccuggguucgagcgauucu

SEQ ID NO: 780022 - RNA, 24 nt, Human
cucggccuccuaaguagcugggau

SEQ ID NO: 780023 - RNA, 23 nt, Human
cugcaacguccgccuccuggguu

SEQ ID NO: 780024 - RNA, 20 nt, Human
cugcccaccuuggccuccca

SEQ ID NO: 780025 - RNA, 21 nt, Human
cuucuuuuagaaauacagaaa

SEQ ID NO: 780026 - RNA, 22 nt, Human
cuuuccuuuccuuuccuuguuu

SEQ ID NO: 780027 - RNA, 21 nt, Human
cuuuucuucuuuccuuuccuu

SEQ ID NO: 780028 - RNA, 19 nt, Human
gacaacacuguaagcaaaa

SEQ ID NO: 780029 - RNA, 24 nt, Human
gacccauaaccauaaaucuuccuc

SEQ ID NO: 780030 - RNA, 18 nt, Human
gaguguuuaucagcuuga

SEQ ID NO: 780031 - RNA, 18 nt, Human
gauuacaggcgugagcca

SEQ ID NO: 780032 - RNA, 21 nt, Human
gauuacaggcgugagccaccg

SEQ ID NO: 780033 - RNA, 24 nt, Human
gauuacaggcgugagccaccgugc

SEQ ID NO: 780034 - RNA, 23 nt, Human
gcagguuaucugcccaccuuggc

SEQ ID NO: 780035 - RNA, 23 nt, Human
ggaaagaacuuucuucuuuuaga

SEQ ID NO: 780036 - RNA, 23 nt, Human
ggaguuucacucuugucacccag

SEQ ID NO: 780037 - RNA, 22 nt, Human
ggggcuagugguggggaaaaug

SEQ ID NO: 780038 - RNA, 23 nt, Human
ggucugaaugcaaagacaucaaa

SEQ ID NO: 780039 - RNA, 24 nt, Human
guaacugacaccauaauuuugcaa

SEQ ID NO: 780040 - RNA, 27 nt, Human
guaccagccacuuucacuggguacucu

SEQ ID NO: 780041 - RNA, 22 nt, Human
gugaguaaaaacugaaggcaaa

SEQ ID NO: 780042 - RNA, 20 nt, Human
uaaaaagaaacaaagcaacu

SEQ ID NO: 780043 - RNA, 19 nt, Human
uaaccucuaagguaguucc

SEQ ID NO: 780044 - RNA, 24 nt, Human
uaagcuauaaaaagaaacaaagca

SEQ ID NO: 780045 - RNA, 24 nt, Human
uaagugcugggauuacaggcguga

SEQ ID NO: 780046 - RNA, 24 nt, Human
uaauuuuuguauuuuuaguagaga

SEQ ID NO: 780047 - RNA, 21 nt, Human
uacaacacaguaccuuacaug

SEQ ID NO: 780048 - RNA, 24 nt, Human
uacaggcgugagccaccgugccca

SEQ ID NO: 780049 - RNA, 22 nt, Human
uacaggugcauccuaccacacc

SEQ ID NO: 780050 - RNA, 21 nt, Human
uaccagccacuuucacugggu

SEQ ID NO: 780051 - RNA, 24 nt, Human
uaccuuauguucagacaauugugg

SEQ ID NO: 780052 - RNA, 19 nt, Human
uacucugugucacaggcug

SEQ ID NO: 780053 - RNA, 22 nt, Human
uacuguaauucuagccucugcu

SEQ ID NO: 780054 - RNA, 23 nt, Human
uagaaauacagaaauaaagguac

SEQ ID NO: 780055 - RNA, 22 nt, Human
uagagacgagguuucaccaugu

SEQ ID NO: 780056 - RNA, 24 nt, Human
uaguagagacgagguuucaccaug

SEQ ID NO: 780057 - RNA, 26 nt, Human
uaguagagacgagguuucaccauguu

SEQ ID NO: 780058 - RNA, 18 nt, Human
uaguuccauauuucucaa

SEQ ID NO: 780059 - RNA, 21 nt, Human
uaguugucuucuucccagcca

SEQ ID NO: 780060 - RNA, 22 nt, Human
uauaaaaugaguugcgucuuaa

SEQ ID NO: 780061 - RNA, 23 nt, Human
uauuggucugaaugcaaagacau

SEQ ID NO: 780062 - RNA, 23 nt, Human
ucaaacuccugaccgcagguuau

SEQ ID NO: 780063 - RNA, 20 nt, Human
ucacaaagaagaacugaacc

SEQ ID NO: 780064 - RNA, 23 nt, Human
ucacugcaacguccgccuccugg

SEQ ID NO: 780065 - RNA, 24 nt, Human
ucacugcaacguccgccuccuggg

SEQ ID NO: 780066 - RNA, 26 nt, Human
ucacugcaacguccgccuccuggguu

SEQ ID NO: 780067 - RNA, 27 nt, Human
ucagugguuggaaaggcuuuuuacauu

SEQ ID NO: 780068 - RNA, 22 nt, Human
uccacagaccccaccagccgga

SEQ ID NO: 780069 - RNA, 24 nt, Human
uccacagaccccaccagccggacc

SEQ ID NO: 780070 - RNA, 26 nt, Human
uccacagaccccaccagccggaccag

SEQ ID NO: 780071 - RNA, 28 nt, Human
ucccaaaguaagugcugggauuacaggc

SEQ ID NO: 780072 - RNA, 18 nt, Human
ucccaacaauucauugcc

SEQ ID NO: 780073 - RNA, 24 nt, Human
uccuaaguagcugggauuacaggu

SEQ ID NO: 780074 - RNA, 21 nt, Human
uccuggguucgagcgauucuc

SEQ ID NO: 780075 - RNA, 24 nt, Human
uccuggguucgagcgauucuccug

SEQ ID NO: 780076 - RNA, 21 nt, Human
ucugcccaccuuggccuccca

SEQ ID NO: 780077 - RNA, 25 nt, Human
ucuguggugaucucuagaugguaca

SEQ ID NO: 780078 - RNA, 23 nt, Human
ucuucccagccagacccauaacc

SEQ ID NO: 780079 - RNA, 19 nt, Human
ugaaaaugacccauuuggg

SEQ ID NO: 780080 - RNA, 21 nt, Human
ugacuuauucauuaugaaugg

SEQ ID NO: 780081 - RNA, 25 nt, Human
ugagacuagagcuuguguaacugac

SEQ ID NO: 780082 - RNA, 24 nt, Human
ugaguaauccuugaaaaugaccca

SEQ ID NO: 780083 - RNA, 24 nt, Human
ugcugggauuacaggcgugagcca

SEQ ID NO: 780084 - RNA, 23 nt, Human
uggaaacaaacaccacaagaaca

SEQ ID NO: 780085 - RNA, 18 nt, Human
uggaaaggcuuuuuacau

SEQ ID NO: 780086 - RNA, 20 nt, Human
uggaacugggaaaaaaaugg

SEQ ID NO: 780087 - RNA, 18 nt, Human
uggaguacucacagguuc

SEQ ID NO: 780088 - RNA, 23 nt, Human
uggagugcaauggugcaaucuug

SEQ ID NO: 780089 - RNA, 24 nt, Human
uggagugcaauggugcaaucuugg

SEQ ID NO: 780090 - RNA, 20 nt, Human
uggcucacugcaacguccgc

SEQ ID NO: 780091 - RNA, 18 nt, Human
ugggauuacaggcgugag

SEQ ID NO: 780092 - RNA, 21 nt, Human
ugggauuacaggcgugagcca

SEQ ID NO: 780093 - RNA, 22 nt, Human
ugggauuacaggcgugagccac

SEQ ID NO: 780094 - RNA, 23 nt, Human
ugggauuacaggcgugagccacc

SEQ ID NO: 780095 - RNA, 23 nt, Human
ugggauuacaggcgugagccacc

SEQ ID NO: 780096 - RNA, 24 nt, Human
ugggauuacaggcgugagccaccg

SEQ ID NO: 780097 - RNA, 22 nt, Human
ugggauuacaggugcauccuac

SEQ ID NO: 780098 - RNA, 24 nt, Human
ugggauuacaggugcauccuacca

SEQ ID NO: 780099 - RNA, 24 nt, Human
uggguucgagcgauucuccugucu

SEQ ID NO: 780100 - RNA, 20 nt, Human
uggugggagaguagaacagg

SEQ ID NO: 780101 - RNA, 20 nt, Human
ugguggggaaaaugcaacag

SEQ ID NO: 780102 - RNA, 18 nt, Human
ugucuuucuccauuacuu

SEQ ID NO: 780103 - RNA, 21 nt, Human
uuaaaaaaagcaguuauccaa

SEQ ID NO: 780104 - RNA, 23 nt, Human
uuacaaauaccccuuuaaauccu

SEQ ID NO: 780105 - RNA, 24 nt, Human
uuaguagagacgagguuucaccau

SEQ ID NO: 780106 - RNA, 20 nt, Human
uuccuuuccuuguuugccuu

SEQ ID NO: 780107 - RNA, 23 nt, Human
uucgagcgauucuccugucucgg

SEQ ID NO: 780108 - RNA, 18 nt, Human
uucuugauuaugacaccc

SEQ ID NO: 780109 - RNA, 23 nt, Human
uugucacccagucuggagugcaa

SEQ ID NO: 780110 - RNA, 26 nt, Human
uuuacaaauaccccuuuaaauccuua

SEQ ID NO: 780111 - RNA, 21 nt, Human
uuuacugaagccuuuuccccc

SEQ ID NO: 780112 - RNA, 22 nt, Human
uuuacugaagccuuuuccccca

SEQ ID NO: 780113 - RNA, 21 nt, Human
uuucaccauguuguccagccu

SEQ ID NO: 780114 - RNA, 22 nt, Human
uuucaccauguuguccagccug

SEQ ID NO: 780115 - RNA, 24 nt, Human
uuuuuaguagagacgagguuucac

SEQ ID NO: 780116 - RNA, 20 nt, Human
uuuuuguauuuuuaguagag

SEQ ID NO: 780117 - RNA, 18 nt, Human
aaacccuccggcggcucc

SEQ ID NO: 780118 - RNA, 25 nt, Human
aaacuccacaaacacuugccaguga

SEQ ID NO: 780119 - RNA, 21 nt, Human
aacuuguucucuucucuucca

SEQ ID NO: 780120 - RNA, 28 nt, Human
aagaaaaauaauaauaauaaucccuccc

SEQ ID NO: 780121 - RNA, 21 nt, Human
aagaagaaggggggaaaagca

SEQ ID NO: 780122 - RNA, 24 nt, Human
aagaagaaggggggaaaagcacaa

SEQ ID NO: 780123 - RNA, 23 nt, Human
accccggccgggugguggggagg

SEQ ID NO: 780124 - RNA, 18 nt, Human
agaagaaggggggaaaag

SEQ ID NO: 780125 - RNA, 24 nt, Human
agcaucuacccccggcuggguggc

SEQ ID NO: 780126 - RNA, 23 nt, Human
agcuaaacccuccggcggcuccg

SEQ ID NO: 780127 - RNA, 20 nt, Human
aggcagcaucuacccccggc

SEQ ID NO: 780128 - RNA, 24 nt, Human
aggcuacauuugugauuaacaggg

SEQ ID NO: 780129 - RNA, 18 nt, Human
agggcucaguccggcauu

SEQ ID NO: 780130 - RNA, 26 nt, Human
aggugauguggguguugcgggguagg

SEQ ID NO: 780131 - RNA, 20 nt, Human
auggaaacuccacaaacacu

SEQ ID NO: 780132 - RNA, 20 nt, Human
caaacacucagggcucaguc

SEQ ID NO: 780133 - RNA, 22 nt, Human
caaguucagacgagccugccgg

SEQ ID NO: 780134 - RNA, 18 nt, Human
cagcgagagggagccagg

SEQ ID NO: 780135 - RNA, 21 nt, Human
cagugagauucuuuccccuuc

SEQ ID NO: 780136 - RNA, 23 nt, Human
caucaccauggaaacuccacaaa

SEQ ID NO: 780137 - RNA, 18 nt, Human
cauggaaacuccacaaac

SEQ ID NO: 780138 - RNA, 19 nt, Human
cauggaaacuccacaaaca

SEQ ID NO: 780139 - RNA, 18 nt, Human
ccauggaaacuccacaaa

SEQ ID NO: 780140 - RNA, 19 nt, Human
cccacccugcgcacaggaa

SEQ ID NO: 780141 - RNA, 24 nt, Human
cccccggcuggguggcaccgaggc

SEQ ID NO: 780142 - RNA, 23 nt, Human
ccccggcucggccacgcauccuu

SEQ ID NO: 780143 - RNA, 23 nt, Human
cgagcuaaacccuccggcggcuc

SEQ ID NO: 780144 - RNA, 18 nt, Human
cgcccgggcuccccggcu

SEQ ID NO: 780145 - RNA, 21 nt, Human
cggcuggguggcaccgaggcc

SEQ ID NO: 780146 - RNA, 21 nt, Human
cgggguagggggggacacgag

SEQ ID NO: 780147 - RNA, 24 nt, Human
cucuucucuuccagauuaaagaaa

SEQ ID NO: 780148 - RNA, 20 nt, Human
cugggcgaggcagcaucuac

SEQ ID NO: 780149 - RNA, 18 nt, Human
gaggaugccgguaggauu

SEQ ID NO: 780150 - RNA, 20 nt, Human
ggcagaugguggccucggac

SEQ ID NO: 780151 - RNA, 19 nt, Human
gggcaucuuggaauguggg

SEQ ID NO: 780152 - RNA, 21 nt, Human
ggggacacgaggccauugaca

SEQ ID NO: 780153 - RNA, 25 nt, Human
guaaacaucaccauggaaacuccac

SEQ ID NO: 780154 - RNA, 18 nt, Human
guaggauuuuccggaucg

SEQ ID NO: 780155 - RNA, 21 nt, Human
gucuucaaguucagacgagcc

SEQ ID NO: 780156 - RNA, 20 nt, Human
uaauaauaauaaucccuccc

SEQ ID NO: 780157 - RNA, 20 nt, Human
uaugugugaguguaugugug

SEQ ID NO: 780158 - RNA, 18 nt, Human
ucagggcucaguccggca

SEQ ID NO: 780159 - RNA, 18 nt, Human
uccacgcggggaaagccc

SEQ ID NO: 780160 - RNA, 18 nt, Human
uccagauuaaagaaaaau

SEQ ID NO: 780161 - RNA, 22 nt, Human
ucccugagcacaccccggccgg

SEQ ID NO: 780162 - RNA, 21 nt, Human
ugacagggagacgaaacuguc

SEQ ID NO: 780163 - RNA, 22 nt, Human
uggggaggugauguggguguug

SEQ ID NO: 780164 - RNA, 25 nt, Human
uggggaggugauguggguguugcgg

SEQ ID NO: 780165 - RNA, 19 nt, Human
ugguggggaggugaugugg

SEQ ID NO: 780166 - RNA, 24 nt, Human
ugguggggaggugauguggguguu

SEQ ID NO: 780167 - RNA, 19 nt, Human
uguaugugugaguguaugu

SEQ ID NO: 780168 - RNA, 19 nt, Human
ugugugaguguaugugugu

SEQ ID NO: 780169 - RNA, 20 nt, Human
uucuuuccccuucucccacc

SEQ ID NO: 780170 - RNA, 21 nt, Human
uucuuuccccuucucccaccc

SEQ ID NO: 780171 - RNA, 23 nt, Human
uuuuccggaucgaagaaccccag

SEQ ID NO: 780172 - RNA, 19 nt, Human
aaaaaaacagacacaccaa

SEQ ID NO: 780173 - RNA, 20 nt, Human
aaaaaaacagacacaccaaa

SEQ ID NO: 780174 - RNA, 21 nt, Human
aaaaaaacagacacaccaaaa

SEQ ID NO: 780175 - RNA, 23 nt, Human
aaaaaaacagacacaccaaaaaa

SEQ ID NO: 780176 - RNA, 22 nt, Human
aaaaaacagacacaccaaaaaa

SEQ ID NO: 780177 - RNA, 24 nt, Human
aaacagacacaccaaaaaacuccc

SEQ ID NO: 780178 - RNA, 18 nt, Human
aaagcaaaagcaggggca

SEQ ID NO: 780179 - RNA, 20 nt, Human
aacacacaaaccagggggca

SEQ ID NO: 780180 - RNA, 21 nt, Human
aacgacgugaaucugccucuu

SEQ ID NO: 780181 - RNA, 22 nt, Human
aagcaggggcaaaaauggacuu

SEQ ID NO: 780182 - RNA, 26 nt, Human
aagcaggggcaaaaauggagggaccc

SEQ ID NO: 780183 - RNA, 20 nt, Human
aagccuauuucaaauaaugg

SEQ ID NO: 780184 - RNA, 23 nt, Human
aauaaugguaacaguuucugaga

SEQ ID NO: 780185 - RNA, 23 nt, Human
aaucacccacaugguuuuucauu

SEQ ID NO: 780186 - RNA, 18 nt, Human
acaaaccaaaagaauaag

SEQ ID NO: 780187 - RNA, 21 nt, Human
acaggaacagaaauguccaca

SEQ ID NO: 780188 - RNA, 25 nt, Human
acgcagagcuggggucccggcggcu

SEQ ID NO: 780189 - RNA, 18 nt, Human
agaaauguccacaacugc

SEQ ID NO: 780190 - RNA, 23 nt, Human
agaaauguccacaacugcgaggg

SEQ ID NO: 780191 - RNA, 26 nt, Human
agcuggaaacgagggagggaagcgag

SEQ ID NO: 780192 - RNA, 21 nt, Human
aggccuccuggccaagacccu

SEQ ID NO: 780193 - RNA, 18 nt, Human
agggaagcgagccagagc

SEQ ID NO: 780194 - RNA, 18 nt, Human
agggaguugcuagggagc

SEQ ID NO: 780195 - RNA, 20 nt, Human
aguaccuuaaaaaaaaaaca

SEQ ID NO: 780196 - RNA, 18 nt, Human
agugaacgcagagcuggg

SEQ ID NO: 780197 - RNA, 19 nt, Human
aguugaaaucugucaacua

SEQ ID NO: 780198 - RNA, 21 nt, Human
auccaaagcaaaagcaggggc

SEQ ID NO: 780199 - RNA, 18 nt, Human
aucccuguuggguuaagg

SEQ ID NO: 780200 - RNA, 23 nt, Human
auugauuaauacuuuuuuaaaaa

SEQ ID NO: 780201 - RNA, 22 nt, Human
caaaagaauaagaggauuuaga

SEQ ID NO: 780202 - RNA, 18 nt, Human
caaagcaaaagcaggggc

SEQ ID NO: 780203 - RNA, 23 nt, Human
caaagcaaaagcaggggcaaaaa

SEQ ID NO: 780204 - RNA, 21 nt, Human
cacacucucgcuccugcucgc

SEQ ID NO: 780205 - RNA, 26 nt, Human
cacggccccggccccggccccgaagu

SEQ ID NO: 780206 - RNA, 22 nt, Human
cacucacucgacacacucucgc

SEQ ID NO: 780207 - RNA, 22 nt, Human
cacuguaugacaauacuuaaac

SEQ ID NO: 780208 - RNA, 22 nt, Human
cagcuggugagguauaauccaa

SEQ ID NO: 780209 - RNA, 21 nt, Human
cagucaggugaugccucuaug

SEQ ID NO: 780210 - RNA, 25 nt, Human
cauaacaaagaaauacuaggagaaa

SEQ ID NO: 780211 - RNA, 23 nt, Human
cauuuucuuccaaaaagauguug

SEQ ID NO: 780212 - RNA, 19 nt, Human
cauuuugugcagcugguga

SEQ ID NO: 780213 - RNA, 24 nt, Human
ccaaagcaaaagcaggggcaaaaa

SEQ ID NO: 780214 - RNA, 20 nt, Human
ccagaaucugucauguugac

SEQ ID NO: 780215 - RNA, 19 nt, Human
cccaggagcuggaaacgag

SEQ ID NO: 780216 - RNA, 22 nt, Human
ccccggccccgaaguccagcuc

SEQ ID NO: 780217 - RNA, 26 nt, Human
ccccggccccggccccgaaguccagc

SEQ ID NO: 780218 - RNA, 26 nt, Human
ccccggcgcacggccccggccccggc

SEQ ID NO: 780219 - RNA, 21 nt, Human
cccgcagcucaaucgcagggc

SEQ ID NO: 780220 - RNA, 22 nt, Human
cccggcccugccuguccccggc

SEQ ID NO: 780221 - RNA, 21 nt, Human
cccggccgggcgcuccccucg

SEQ ID NO: 780222 - RNA, 23 nt, Human
cccggcgccgagcgcgcacccuc

SEQ ID NO: 780223 - RNA, 19 nt, Human
cccucgucccucuucacuc

SEQ ID NO: 780224 - RNA, 23 nt, Human
cccucuucacucgcagaucuccg

SEQ ID NO: 780225 - RNA, 18 nt, Human
cccuugggagaaauuucc

SEQ ID NO: 780226 - RNA, 18 nt, Human
ccgagcgcgcacccucgc

SEQ ID NO: 780227 - RNA, 18 nt, Human
ccggccgcgacccgcagc

SEQ ID NO: 780228 - RNA, 19 nt, Human
ccuccagccacacacauuu

SEQ ID NO: 780229 - RNA, 18 nt, Human
ccucuccacguugccucu

SEQ ID NO: 780230 - RNA, 18 nt, Human
ccugaaguuaucucugcu

SEQ ID NO: 780231 - RNA, 26 nt, Human
ccugcugguuauccuccagaaucugu

SEQ ID NO: 780232 - RNA, 25 nt, Human
ccuguccccggcgcacggccccggc

SEQ ID NO: 780233 - RNA, 23 nt, Human
cgacugccuuugccgaaagccuc

SEQ ID NO: 780234 - RNA, 22 nt, Human
cgcacacucacucgacacacuc

SEQ ID NO: 780235 - RNA, 18 nt, Human
cgccuccagccacacaca

SEQ ID NO: 780236 - RNA, 21 nt, Human
cguuuauugacaccaccacuc

SEQ ID NO: 780237 - RNA, 23 nt, Human
cucccggcgccgagcgcgcaccc

SEQ ID NO: 780238 - RNA, 19 nt, Human
cuuuugggaugcgggaguc

SEQ ID NO: 780239 - RNA, 19 nt, Human
gaaauguccacaacugcga

SEQ ID NO: 780240 - RNA, 27 nt, Human
gacugcuuuuccccuauuaucuuuagg

SEQ ID NO: 780241 - RNA, 22 nt, Human
gagcguuuauugacaccaccac

SEQ ID NO: 780242 - RNA, 27 nt, Human
gagcuggaaacgagggagggaagcgag

SEQ ID NO: 780243 - RNA, 24 nt, Human
gcccaggagcuggaaacgagggag

SEQ ID NO: 780244 - RNA, 23 nt, Human
gccccgaaguccagcuccggacg

SEQ ID NO: 780245 - RNA, 23 nt, Human
gccccggccccgaaguccagcuc

SEQ ID NO: 780246 - RNA, 21 nt, Human
gcccucggcggagaguugaaa

SEQ ID NO: 780247 - RNA, 24 nt, Human
ggcagugaacgcagagcugggguc

SEQ ID NO: 780248 - RNA, 18 nt, Human
ggcuuuguuucuuuuccc

SEQ ID NO: 780249 - RNA, 20 nt, Human
gggagaaauuuccaaggaaa

SEQ ID NO: 780250 - RNA, 20 nt, Human
ggggcagugaacgcagagaa

SEQ ID NO: 780251 - RNA, 21 nt, Human
guccccggcgcacggccccgg

SEQ ID NO: 780252 - RNA, 22 nt, Human
gugagcuucugggggagggucg

SEQ ID NO: 780253 - RNA, 22 nt, Human
gugauaaauucaggagggccau

SEQ ID NO: 780254 - RNA, 18 nt, Human
guugaaacagauguggga

SEQ ID NO: 780255 - RNA, 25 nt, Human
uaaaaaaaaaacaucaguucuggga

SEQ ID NO: 780256 - RNA, 19 nt, Human
uaaaaaaacagacacacca

SEQ ID NO: 780257 - RNA, 20 nt, Human
uaaaaaaacagacacaccaa

SEQ ID NO: 780258 - RNA, 24 nt, Human
uaaaaaaacagacacaccaaaaaa

SEQ ID NO: 780259 - RNA, 21 nt, Human
uaaaaaacgccacuagggagu

SEQ ID NO: 780260 - RNA, 24 nt, Human
uaaaaaaugaaguaccaaagcugg

SEQ ID NO: 780261 - RNA, 21 nt, Human
uaacaaagaaauacuaggaga

SEQ ID NO: 780262 - RNA, 18 nt, Human
uacauguaaauagucaca

SEQ ID NO: 780263 - RNA, 19 nt, Human
uaccacaggucugcuggaa

SEQ ID NO: 780264 - RNA, 18 nt, Human
uaccuuaaaaaaaaaaca

SEQ ID NO: 780265 - RNA, 26 nt, Human
uacuuuaaaaaaacagacacaccaaa

SEQ ID NO: 780266 - RNA, 18 nt, Human
uagguaaaugucaucucu

SEQ ID NO: 780267 - RNA, 20 nt, Human
ucaaucgcagggcaaaccga

SEQ ID NO: 780268 - RNA, 19 nt, Human
ucauuucuuuucaguaccc

SEQ ID NO: 780269 - RNA, 22 nt, Human
uccaaagcaaaagcaggggcaa

SEQ ID NO: 780270 - RNA, 23 nt, Human
uccccgagaaauuaacuucggcu

SEQ ID NO: 780271 - RNA, 24 nt, Human
uccccggcgcacggccccggcccu

SEQ ID NO: 780272 - RNA, 18 nt, Human
ucccggcggcucucgacc

SEQ ID NO: 780273 - RNA, 20 nt, Human
ucccucgucccucuucacuc

SEQ ID NO: 780274 - RNA, 18 nt, Human
uccgcuuucuucuucucc

SEQ ID NO: 780275 - RNA, 22 nt, Human
ucuacaaccaucuacuccccuu

SEQ ID NO: 780276 - RNA, 19 nt, Human
ucucucucgcucgcucucu

SEQ ID NO: 780277 - RNA, 19 nt, Human
ucugcaaacacucgacugc

SEQ ID NO: 780278 - RNA, 20 nt, Human
ucugccucuuuuccgcuuuc

SEQ ID NO: 780279 - RNA, 24 nt, Human
ucugccucuuuuccgcuuucuucu

SEQ ID NO: 780280 - RNA, 18 nt, Human
ucugcuggaaaucaccca

SEQ ID NO: 780281 - RNA, 20 nt, Human
ucuucagaggcaaccagggu

SEQ ID NO: 780282 - RNA, 24 nt, Human
ugaaguaccaaagcugguauacua

SEQ ID NO: 780283 - RNA, 22 nt, Human
ugagguauaauccaaagcaaaa

SEQ ID NO: 780284 - RNA, 26 nt, Human
ugccucuguccugcuucuuaguuccu

SEQ ID NO: 780285 - RNA, 25 nt, Human
ugccucuguccugcuucuuaguucu

SEQ ID NO: 780286 - RNA, 21 nt, Human
ugccuguccccggcgcacggc

SEQ ID NO: 780287 - RNA, 21 nt, Human
ugccugugcgcgcccgagaac

SEQ ID NO: 780288 - RNA, 23 nt, Human
uggcuuuguuucuuuucccucgu

SEQ ID NO: 780289 - RNA, 22 nt, Human
uggggcauugaaacaaaugugg

SEQ ID NO: 780290 - RNA, 19 nt, Human
uggucauuggcugggguuu

SEQ ID NO: 780291 - RNA, 26 nt, Human
uguaaauagucacauauauacaauga

SEQ ID NO: 780292 - RNA, 21 nt, Human
ugucaaacgucucugcacugu

SEQ ID NO: 780293 - RNA, 19 nt, Human
ugugcacgugugugugcgu

SEQ ID NO: 780294 - RNA, 20 nt, Human
ugugcacgugugugugcgua

SEQ ID NO: 780295 - RNA, 20 nt, Human
ugugugcacgugugugugcg

SEQ ID NO: 780296 - RNA, 22 nt, Human
ugugugcacgugugugugcgua

SEQ ID NO: 780297 - RNA, 28 nt, Human
uguuuggggcauugaaacaaaugugggu

SEQ ID NO: 780298 - RNA, 24 nt, Human
uuaaaaaaacagacacaccaaaaa

SEQ ID NO: 780299 - RNA, 20 nt, Human
uuccccuaaaaguucccaug

SEQ ID NO: 780300 - RNA, 20 nt, Human
uugccugugcagucagguga

SEQ ID NO: 780301 - RNA, 23 nt, Human
uuucucaggccuccuggccaaua

SEQ ID NO: 780302 - RNA, 25 nt, Human
uuuuaaaaaaugaaguaccaaagcu

SEQ ID NO: 780303 - RNA, 23 nt, Human
uuuucagccucuccacguugccu

SEQ ID NO: 780304 - RNA, 21 nt, Human
aaagugcugggauuacaaggg

SEQ ID NO: 780305 - RNA, 24 nt, Human
aaagugcugggauuacaaggguga

SEQ ID NO: 780306 - RNA, 20 nt, Human
aaccucugccuccugggcuc

SEQ ID NO: 780307 - RNA, 21 nt, Human
aagagcagcggauacagacaa

SEQ ID NO: 780308 - RNA, 20 nt, Human
aagauuuuucagacaacugg

SEQ ID NO: 780309 - RNA, 19 nt, Human
aagcaaaaacauacacaac

SEQ ID NO: 780310 - RNA, 25 nt, Human
aagcaauccucccaccucagccucc

SEQ ID NO: 780311 - RNA, 23 nt, Human
aagcaguaaaaucuaauucaugc

SEQ ID NO: 780312 - RNA, 20 nt, Human
aagcuucauuagacacuagu

SEQ ID NO: 780313 - RNA, 18 nt, Human
aagugcugggauuacaag

SEQ ID NO: 780314 - RNA, 21 nt, Human
aagugcugggauuacaagggu

SEQ ID NO: 780315 - RNA, 26 nt, Human
aagugcugggauuacaagggugagcu

SEQ ID NO: 780316 - RNA, 18 nt, Human
acaggguuucaccauguu

SEQ ID NO: 780317 - RNA, 19 nt, Human
acaggguuucaccauguug

SEQ ID NO: 780318 - RNA, 24 nt, Human
acaggguuucaccauguugcccag

SEQ ID NO: 780319 - RNA, 22 nt, Human
accauguugcccaggcuggucu

SEQ ID NO: 780320 - RNA, 25 nt, Human
accauguugcccaggcuggucuuga

SEQ ID NO: 780321 - RNA, 20 nt, Human
accgacaccuccauccauaa

SEQ ID NO: 780322 - RNA, 24 nt, Human
accgacaccuccauccauaaccua

SEQ ID NO: 780323 - RNA, 19 nt, Human
accuguuuaugggucaugc

SEQ ID NO: 780324 - RNA, 25 nt, Human
acucuguugcccaggcuagagugca

SEQ ID NO: 780325 - RNA, 23 nt, Human
agaaugcuauuauuggccaacuu

SEQ ID NO: 780326 - RNA, 24 nt, Human
agcccaauaauggccacuuuuacu

SEQ ID NO: 780327 - RNA, 22 nt, Human
agcuucuuucucgccuuuccga

SEQ ID NO: 780328 - RNA, 20 nt, Human
aggaguuuauucuaaaacaa

SEQ ID NO: 780329 - RNA, 23 nt, Human
agguuggggaauuaagcugaauu

SEQ ID NO: 780330 - RNA, 19 nt, Human
aguaaucuacccaccucag

SEQ ID NO: 780331 - RNA, 20 nt, Human
agucuguauuucagugucuu

SEQ ID NO: 780332 - RNA, 20 nt, Human
agugcagugacgugaccuug

SEQ ID NO: 780333 - RNA, 24 nt, Human
agugcagugacgugaccuuggcuc

SEQ ID NO: 780334 - RNA, 19 nt, Human
auaagguuggggaauuaag

SEQ ID NO: 780335 - RNA, 21 nt, Human
auagaaacaggguuucaccau

SEQ ID NO: 780336 - RNA, 21 nt, Human
caaacacuuccuucuaaccca

SEQ ID NO: 780337 - RNA, 24 nt, Human
caaagugcugggauuacaagggug

SEQ ID NO: 780338 - RNA, 19 nt, Human
caaauaacuaaacucucau

SEQ ID NO: 780339 - RNA, 23 nt, Human
caacacaucaaauauuucaaaag

SEQ ID NO: 780340 - RNA, 23 nt, Human
caaccucugccuccugggcucaa

SEQ ID NO: 780341 - RNA, 20 nt, Human
caacgucacaagagcagcgg

SEQ ID NO: 780342 - RNA, 27 nt, Human
caagcaauccucccaccucagccuccu

SEQ ID NO: 780343 - RNA, 19 nt, Human
caaguaaucuacccaccuc

SEQ ID NO: 780344 - RNA, 24 nt, Human
caccauguugcccaggcuggucuu

SEQ ID NO: 780345 - RNA, 27 nt, Human
caccauguugcccaggcuggucuugaa

SEQ ID NO: 780346 - RNA, 24 nt, Human
caccucagccucccaaagugcugg

SEQ ID NO: 780347 - RNA, 24 nt, Human
caccucagccuccucaguagcugg

SEQ ID NO: 780348 - RNA, 21 nt, Human
cacugcaaccucugccuccug

SEQ ID NO: 780349 - RNA, 23 nt, Human
cacugcaaccucugccuccuggg

SEQ ID NO: 780350 - RNA, 21 nt, Human
cacuggagaaguuacauggga

SEQ ID NO: 780351 - RNA, 19 nt, Human
cacuuuguuggcaaaggcc

SEQ ID NO: 780352 - RNA, 24 nt, Human
caggguuucaccauguugcccagg

SEQ ID NO: 780353 - RNA, 24 nt, Human
caguagcugggaccacaggcauau

SEQ ID NO: 780354 - RNA, 19 nt, Human
caucaaauauuucaaaagg

SEQ ID NO: 780355 - RNA, 18 nt, Human
caugcuggacaccagcaa

SEQ ID NO: 780356 - RNA, 19 nt, Human
cauguugcccaggcugguc

SEQ ID NO: 780357 - RNA, 20 nt, Human
cauguugcccaggcuggucu

SEQ ID NO: 780358 - RNA, 24 nt, Human
cauguugcccaggcuggucuugaa

SEQ ID NO: 780359 - RNA, 19 nt, Human
ccaaagugcugggauuaca

SEQ ID NO: 780360 - RNA, 21 nt, Human
ccaaagugcugggauuacaag

SEQ ID NO: 780361 - RNA, 24 nt, Human
ccaaagugcugggauuacaagggu

SEQ ID NO: 780362 - RNA, 22 nt, Human
ccaccucagccuccucaguagc

SEQ ID NO: 780363 - RNA, 19 nt, Human
ccacuaaacacucccuacc

SEQ ID NO: 780364 - RNA, 21 nt, Human
ccaggcaacacaucaaauauu

SEQ ID NO: 780365 - RNA, 22 nt, Human
cccaggcuagagugcagugacg

SEQ ID NO: 780366 - RNA, 25 nt, Human
ccgacaccuccauccauaaccuaca

SEQ ID NO: 780367 - RNA, 23 nt, Human
ccucccaccucagccuccucagu

SEQ ID NO: 780368 - RNA, 19 nt, Human
ccucugccuccugggcuca

SEQ ID NO: 780369 - RNA, 20 nt, Human
ccugggcucaagcaauccuc

SEQ ID NO: 780370 - RNA, 18 nt, Human
ccugggcucaaguaaucu

SEQ ID NO: 780371 - RNA, 24 nt, Human
ccugggcucaaguaaucuacccac

SEQ ID NO: 780372 - RNA, 21 nt, Human
ccuucuaacccaugauuaucc

SEQ ID NO: 780373 - RNA, 24 nt, Human
cucaagcaauccucccaccucagc

SEQ ID NO: 780374 - RNA, 24 nt, Human
cucaaguaaucuacccaccucagc

SEQ ID NO: 780375 - RNA, 24 nt, Human
cucacugcaaccucugccuccugg

SEQ ID NO: 780376 - RNA, 24 nt, Human
cucagccuccucaguagcugggac

SEQ ID NO: 780377 - RNA, 24 nt, Human
cuccucaguagcugggaccacagg

SEQ ID NO: 780378 - RNA, 23 nt, Human
cugcaaccucugccuccugggcu

SEQ ID NO: 780379 - RNA, 24 nt, Human
cugcaaccucugccuccugggcuc

SEQ ID NO: 780380 - RNA, 21 nt, Human
cuggacaccagcaauccacau

SEQ ID NO: 780381 - RNA, 20 nt, Human
cuugaauuccugggcucaag

SEQ ID NO: 780382 - RNA, 21 nt, Human
cuuucaugcuagaagucucac

SEQ ID NO: 780383 - RNA, 20 nt, Human
gacaccuccauccauaaccu

SEQ ID NO: 780384 - RNA, 19 nt, Human
gaccuuggcucacugcaac

SEQ ID NO: 780385 - RNA, 19 nt, Human
gcuagagugcagugacgug

SEQ ID NO: 780386 - RNA, 21 nt, Human
gcucacugcaaccucugccuc

SEQ ID NO: 780387 - RNA, 19 nt, Human
ggauacagacaagauggag

SEQ ID NO: 780388 - RNA, 18 nt, Human
gggcucaaguaaucuacc

SEQ ID NO: 780389 - RNA, 24 nt, Human
gggcucaaguaaucuacccaccuc

SEQ ID NO: 780390 - RNA, 24 nt, Human
guaaucuacccaccucagccuccc

SEQ ID NO: 780391 - RNA, 19 nt, Human
guggaauacaaugucuaca

SEQ ID NO: 780392 - RNA, 19 nt, Human
uaaaacacagccauucaaa

SEQ ID NO: 780393 - RNA, 24 nt, Human
uaaaaucuaauucaugccagaaca

SEQ ID NO: 780394 - RNA, 23 nt, Human
uaacaaaaugacaagcaguaaaa

SEQ ID NO: 780395 - RNA, 26 nt, Human
uaacuaaacucucauacugcuugauu

SEQ ID NO: 780396 - RNA, 25 nt, Human
uaagaaaauaacaaaaugacaagca

SEQ ID NO: 780397 - RNA, 19 nt, Human
uaagguuggggaauuaagc

SEQ ID NO: 780398 - RNA, 24 nt, Human
uaaucuacccaccucagccuccca

SEQ ID NO: 780399 - RNA, 20 nt, Human
uaaugcuugcuaaaacagcu

SEQ ID NO: 780400 - RNA, 20 nt, Human
uacaaauaacuaaacucuca

SEQ ID NO: 780401 - RNA, 22 nt, Human
uacaagggugagcuaccgugcu

SEQ ID NO: 780402 - RNA, 22 nt, Human
uacccaccucagccucccaaag

SEQ ID NO: 780403 - RNA, 23 nt, Human
uacccaccucagccucccaaagu

SEQ ID NO: 780404 - RNA, 24 nt, Human
uacucuguugcccaggcuagagug

SEQ ID NO: 780405 - RNA, 22 nt, Human
uagaaacaggguuucaccaugu

SEQ ID NO: 780406 - RNA, 27 nt, Human
uagugacacauacaaauaacuaaacuc

SEQ ID NO: 780407 - RNA, 23 nt, Human
uauagaaacaggguuucaccaug

SEQ ID NO: 780408 - RNA, 18 nt, Human
uauagagcagagaauaag

SEQ ID NO: 780409 - RNA, 21 nt, Human
uauuauuggccaacuugaaau

SEQ ID NO: 780410 - RNA, 18 nt, Human
uauucuaaaacauuccau

SEQ ID NO: 780411 - RNA, 19 nt, Human
ucaaagugacuuucaaaca

SEQ ID NO: 780412 - RNA, 24 nt, Human
ucacugcaaccucugccuccuggg

SEQ ID NO: 780413 - RNA, 25 nt, Human
ucacugcaaccucugccuccugggc

SEQ ID NO: 780414 - RNA, 26 nt, Human
ucacugcaaccucugccuccugggcu

SEQ ID NO: 780415 - RNA, 21 nt, Human
ucacuuuguuggcaaaggcca

SEQ ID NO: 780416 - RNA, 21 nt, Human
ucagaguuccaaacauuucca

SEQ ID NO: 780417 - RNA, 18 nt, Human
ucagccucccaaagugcu

SEQ ID NO: 780418 - RNA, 20 nt, Human
ucaguagcugggaccacagg

SEQ ID NO: 780419 - RNA, 21 nt, Human
ucaguagcugggaccacaggc

SEQ ID NO: 780420 - RNA, 23 nt, Human
ucccaaagugcugggauuacaag

SEQ ID NO: 780421 - RNA, 25 nt, Human
ucccaaagugcugggauuacaaggg

SEQ ID NO: 780422 - RNA, 18 nt, Human
uccugggcucaagcaauc

SEQ ID NO: 780423 - RNA, 22 nt, Human
uccugggcucaagcaauccucc

SEQ ID NO: 780424 - RNA, 24 nt, Human
uccugggcucaagcaauccuccca

SEQ ID NO: 780425 - RNA, 19 nt, Human
ucuacacacagaauaaggu

SEQ ID NO: 780426 - RNA, 21 nt, Human
ucuacccaccucagccuccca

SEQ ID NO: 780427 - RNA, 24 nt, Human
ucugccuccugggcucaagcaauc

SEQ ID NO: 780428 - RNA, 21 nt, Human
ucuguauuucagugucuucau

SEQ ID NO: 780429 - RNA, 18 nt, Human
ucuguugcccaggcuaga

SEQ ID NO: 780430 - RNA, 24 nt, Human
ucuguugcccaggcuagagugcag

SEQ ID NO: 780431 - RNA, 19 nt, Human
ucuuacucuguugcccagg

SEQ ID NO: 780432 - RNA, 23 nt, Human
ucuuacucuguugcccaggcuag

SEQ ID NO: 780433 - RNA, 24 nt, Human
ucuuacucuguugcccaggcuaga

SEQ ID NO: 780434 - RNA, 20 nt, Human
ugacaagcaguaaaaucuaa

SEQ ID NO: 780435 - RNA, 24 nt, Human
ugacacauacaaauaacuaaacuc

SEQ ID NO: 780436 - RNA, 20 nt, Human
ugcagugacgugaccuuggc

SEQ ID NO: 780437 - RNA, 23 nt, Human
ugcccaggcuagagugcagugac

SEQ ID NO: 780438 - RNA, 24 nt, Human
ugcccaggcuggucuugaauuccu

SEQ ID NO: 780439 - RNA, 24 nt, Human
ugccuccugggcucaagcaauccu

SEQ ID NO: 780440 - RNA, 20 nt, Human
ugcugggauuacaaggguga

SEQ ID NO: 780441 - RNA, 20 nt, Human
uggcauuuaagugacuuguu

SEQ ID NO: 780442 - RNA, 21 nt, Human
uggcccaaaacuaacuuucaa

SEQ ID NO: 780443 - RNA, 19 nt, Human
ugggaccacaggcauaugc

SEQ ID NO: 780444 - RNA, 21 nt, Human
ugggaccacaggcauaugcua

SEQ ID NO: 780445 - RNA, 23 nt, Human
ugggaccacaggcauaugcuaca

SEQ ID NO: 780446 - RNA, 22 nt, Human
ugggauuacaagggugagcuac

SEQ ID NO: 780447 - RNA, 23 nt, Human
ugggauuacaagggugagcuacc

SEQ ID NO: 780448 - RNA, 24 nt, Human
ugggauuacaagggugagcuaccg

SEQ ID NO: 780449 - RNA, 20 nt, Human
ugguaagaaaauaacaaaau

SEQ ID NO: 780450 - RNA, 23 nt, Human
uuauagaaacaggguuucaccau

SEQ ID NO: 780451 - RNA, 24 nt, Human
uuauagaaacaggguuucaccaug

SEQ ID NO: 780452 - RNA, 21 nt, Human
uucaaacacuuccuucuaacc

SEQ ID NO: 780453 - RNA, 22 nt, Human
uucauuuuuuuaaaugagagaa

SEQ ID NO: 780454 - RNA, 19 nt, Human
uugcaguauccugccaggc

SEQ ID NO: 780455 - RNA, 18 nt, Human
uugcccaggcuagagugc

SEQ ID NO: 780456 - RNA, 21 nt, Human
uuucaaagugacuuucaaaca

SEQ ID NO: 780457 - RNA, 22 nt, Human
uuucaccauguugcccaggcug

SEQ ID NO: 780458 - RNA, 23 nt, Human
uuucaccauguugcccaggcugg

SEQ ID NO: 780459 - RNA, 24 nt, Human
uuucaccauguugcccaggcuggu

SEQ ID NO: 780460 - RNA, 23 nt, Human
uuuuuauagaaacaggguuucac

SEQ ID NO: 780461 - RNA, 22 nt, Human
aaaaaaaauucaacgaagcuaa

SEQ ID NO: 780462 - RNA, 20 nt, Human
aaaauacaacagugaugcug

SEQ ID NO: 780463 - RNA, 18 nt, Human
aaacaaagcaaaacaaaa

SEQ ID NO: 780464 - RNA, 24 nt, Human
aaacacucaaaagauaacaaagaa

SEQ ID NO: 780465 - RNA, 24 nt, Human
aaaggccaccucacucaagaagcc

SEQ ID NO: 780466 - RNA, 29 nt, Human
aaaucauaaaaaugcuauccaaucuacaa

SEQ ID NO: 780467 - RNA, 19 nt, Human
aacauggugaaaccccauc

SEQ ID NO: 780468 - RNA, 20 nt, Human
aacauggugaaaccccaucu

SEQ ID NO: 780469 - RNA, 20 nt, Human
aacauggugaaaccccaucu

SEQ ID NO: 780470 - RNA, 21 nt, Human
aacauggugaaaccccaucuc

SEQ ID NO: 780471 - RNA, 22 nt, Human
aagaaaacaagucagcaagcuc

SEQ ID NO: 780472 - RNA, 29 nt, Human
aagaaaugugacaauaaaauaaugagauu

SEQ ID NO: 780473 - RNA, 24 nt, Human
aagaacuaccacucccgaagugga

SEQ ID NO: 780474 - RNA, 25 nt, Human
aagaacuaccacucccgaaguggag

SEQ ID NO: 780475 - RNA, 20 nt, Human
aagaagccuuuccaaacacc

SEQ ID NO: 780476 - RNA, 27 nt, Human
aagaaggaaaaagaaauucaugcauag

SEQ ID NO: 780477 - RNA, 21 nt, Human
aaguaucccuaagauaaggau

SEQ ID NO: 780478 - RNA, 20 nt, Human
aagucucaacuuuuucuuac

SEQ ID NO: 780479 - RNA, 20 nt, Human
aaucaccugaacccaggaga

SEQ ID NO: 780480 - RNA, 24 nt, Human
aaucaccugaacccaggagacaga

SEQ ID NO: 780481 - RNA, 26 nt, Human
aaucauaaaaaugcuauccaaucuag

SEQ ID NO: 780482 - RNA, 18 nt, Human
aaucuuaucccacccgcc

SEQ ID NO: 780483 - RNA, 18 nt, Human
aaugaaaagaaacaaacu

SEQ ID NO: 780484 - RNA, 22 nt, Human
aauuacccuugccccaaaccuu

SEQ ID NO: 780485 - RNA, 18 nt, Human
acaaagcaaaacaaaagu

SEQ ID NO: 780486 - RNA, 23 nt, Human
acagcucgggcgccaaugacgcc

SEQ ID NO: 780487 - RNA, 24 nt, Human
acauuauacaaagcauaaauuuuu

SEQ ID NO: 780488 - RNA, 24 nt, Human
acccaggagacagagguugcagug

SEQ ID NO: 780489 - RNA, 18 nt, Human
accccaucucuacuaaaa

SEQ ID NO: 780490 - RNA, 18 nt, Human
accuacaccgcuuuccuu

SEQ ID NO: 780491 - RNA, 19 nt, Human
accuguggucaacuguggu

SEQ ID NO: 780492 - RNA, 23 nt, Human
acuacccacccauuaaucaccua

SEQ ID NO: 780493 - RNA, 18 nt, Human
acuacuauccaacaagau

SEQ ID NO: 780494 - RNA, 23 nt, Human
acuaguauagucccaguuuagau

SEQ ID NO: 780495 - RNA, 20 nt, Human
acugcacuccagccuggcug

SEQ ID NO: 780496 - RNA, 22 nt, Human
acugccaacuaacccucuccac

SEQ ID NO: 780497 - RNA, 21 nt, Human
acuuagaaacaaaagaaaaga

SEQ ID NO: 780498 - RNA, 23 nt, Human
acuuugggagguagacaugugug

SEQ ID NO: 780499 - RNA, 29 nt, Human
agacaagaagugaguguaagagggacccc

SEQ ID NO: 780500 - RNA, 24 nt, Human
agacaccagaaucagucucauuau

SEQ ID NO: 780501 - RNA, 20 nt, Human
agacagagguugcagugagc

SEQ ID NO: 780502 - RNA, 24 nt, Human
agacagagguugcagugagcugag

SEQ ID NO: 780503 - RNA, 22 nt, Human
agagguugcagugagcugagau

SEQ ID NO: 780504 - RNA, 24 nt, Human
agagguugcagugagcugagaucg

SEQ ID NO: 780505 - RNA, 22 nt, Human
agcacuuugggagguagacaug

SEQ ID NO: 780506 - RNA, 30 nt, Human
agcauaaaauggggcccuucauggucugcc

SEQ ID NO: 780507 - RNA, 23 nt, Human
agccgggugugguggcacgugcc

SEQ ID NO: 780508 - RNA, 22 nt, Human
agccuggccaacauggugaaac

SEQ ID NO: 780509 - RNA, 24 nt, Human
agccuggccaacauggugaaaccc

SEQ ID NO: 780510 - RNA, 20 nt, Human
aggagaaucaccugaaccca

SEQ ID NO: 780511 - RNA, 22 nt, Human
aggcgggguacaguggcucacg

SEQ ID NO: 780512 - RNA, 18 nt, Human
agggaggagaaucaccug

SEQ ID NO: 780513 - RNA, 20 nt, Human
agucccaccguauccacggc

SEQ ID NO: 780514 - RNA, 24 nt, Human
aguggcucacgacuguaaucccag

SEQ ID NO: 780515 - RNA, 21 nt, Human
aguucaguucaaaggccaccu

SEQ ID NO: 780516 - RNA, 19 nt, Human
auaaaaacaaccugcucgc

SEQ ID NO: 780517 - RNA, 21 nt, Human
auacacaucucucacaaacaa

SEQ ID NO: 780518 - RNA, 22 nt, Human
auccccuggccgcccaguuucc

SEQ ID NO: 780519 - RNA, 24 nt, Human
aucgugucacugcacuccagccug

SEQ ID NO: 780520 - RNA, 25 nt, Human
aucuauguuagaguucaauguauuu

SEQ ID NO: 780521 - RNA, 20 nt, Human
augacccaacccagaaaucu

SEQ ID NO: 780522 - RNA, 21 nt, Human
auuauauuuauucagaaagau

SEQ ID NO: 780523 - RNA, 23 nt, Human
caaaaaaaauucaacgaagcuaa

SEQ ID NO: 780524 - RNA, 25 nt, Human
caaaagagaugaccauagaacuaac

SEQ ID NO: 780525 - RNA, 22 nt, Human
caaaagcucacaacaccuacac

SEQ ID NO: 780526 - RNA, 21 nt, Human
caaagcaaaacaaaagucuca

SEQ ID NO: 780527 - RNA, 18 nt, Human
caacaagaugacccaacc

SEQ ID NO: 780528 - RNA, 22 nt, Human
caacaagaugacccaacccaga

SEQ ID NO: 780529 - RNA, 24 nt, Human
caacauggugaaaccccaucucua

SEQ ID NO: 780530 - RNA, 20 nt, Human
caacccagaaaucuagaagu

SEQ ID NO: 780531 - RNA, 18 nt, Human
caagaacagccuggccaa

SEQ ID NO: 780532 - RNA, 24 nt, Human
caagaacagccuggccaacauggu

SEQ ID NO: 780533 - RNA, 21 nt, Human
caagaagccuuuccaaacacc

SEQ ID NO: 780534 - RNA, 22 nt, Human
caagaugacccaacccagaaau

SEQ ID NO: 780535 - RNA, 18 nt, Human
caaguaucccuaagauaa

SEQ ID NO: 780536 - RNA, 23 nt, Human
caauccuaguauauccauauaaa

SEQ ID NO: 780537 - RNA, 21 nt, Human
cacaaacaaagcaaaacaaaa

SEQ ID NO: 780538 - RNA, 24 nt, Human
cacagcucgggcgccaaugacgcc

SEQ ID NO: 780539 - RNA, 22 nt, Human
cacaguguuuguguucaaguau

SEQ ID NO: 780540 - RNA, 20 nt, Human
cacaucucucacaaacaaag

SEQ ID NO: 780541 - RNA, 24 nt, Human
cacgacuguaaucccagcacuuug

SEQ ID NO: 780542 - RNA, 23 nt, Human
cacuccagccuggcugacaaagc

SEQ ID NO: 780543 - RNA, 18 nt, Human
cacugcacuccagccugg

SEQ ID NO: 780544 - RNA, 18 nt, Human
cacugcacuccagccugg

SEQ ID NO: 780545 - RNA, 21 nt, Human
cacugcacuccagccuggcug

SEQ ID NO: 780546 - RNA, 23 nt, Human
cacugcacuccagccuggcugac

SEQ ID NO: 780547 - RNA, 24 nt, Human
cacugcacuccagccuggcugaca

SEQ ID NO: 780548 - RNA, 25 nt, Human
cacugcacuccagccuggcugacaa

SEQ ID NO: 780549 - RNA, 18 nt, Human
cagcacuuugggagguag

SEQ ID NO: 780550 - RNA, 19 nt, Human
cagcuucaccuuuguucau

SEQ ID NO: 780551 - RNA, 21 nt, Human
cauagcaaauccucauuucuc

SEQ ID NO: 780552 - RNA, 20 nt, Human
caucuccaaaugaccuuccu

SEQ ID NO: 780553 - RNA, 18 nt, Human
caugcacaaaaucuguug

SEQ ID NO: 780554 - RNA, 24 nt, Human
ccaaacacaauucucaucuccaau

SEQ ID NO: 780555 - RNA, 24 nt, Human
ccaacaagaugacccaacccagaa

SEQ ID NO: 780556 - RNA, 21 nt, Human
ccacucccgaaguggagcgca

SEQ ID NO: 780557 - RNA, 20 nt, Human
ccauagaacuaacugccaac

SEQ ID NO: 780558 - RNA, 19 nt, Human
cccaaaauacaacagugau

SEQ ID NO: 780559 - RNA, 18 nt, Human
ccuauagucccagcuacu

SEQ ID NO: 780560 - RNA, 21 nt, Human
ccuauagucccagcuacuugg

SEQ ID NO: 780561 - RNA, 20 nt, Human
ccuccagacagccugaggcc

SEQ ID NO: 780562 - RNA, 21 nt, Human
ccuccagcucuacccugcuuc

SEQ ID NO: 780563 - RNA, 23 nt, Human
ccuggccaacauggugaaacccc

SEQ ID NO: 780564 - RNA, 24 nt, Human
ccuggccaacauggugaaacccca

SEQ ID NO: 780565 - RNA, 22 nt, Human
ccuguccuuagccuucccuaca

SEQ ID NO: 780566 - RNA, 23 nt, Human
cgacuguaaucccagcacuuugg

SEQ ID NO: 780567 - RNA, 23 nt, Human
cgcagugcaugccgugacgcgua

SEQ ID NO: 780568 - RNA, 20 nt, Human
cgcguagucccgccugcgcc

SEQ ID NO: 780569 - RNA, 21 nt, Human
cggcaggcggugaccggcugg

SEQ ID NO: 780570 - RNA, 22 nt, Human
cguagucccgccugcgccuccu

SEQ ID NO: 780571 - RNA, 24 nt, Human
cuagggaggagaaucaccugaacc

SEQ ID NO: 780572 - RNA, 19 nt, Human
cuauaguaagaacaaaccc

SEQ ID NO: 780573 - RNA, 19 nt, Human
cucacaacaccuacaccgc

SEQ ID NO: 780574 - RNA, 24 nt, Human
cucacgacuguaaucccagcacuu

SEQ ID NO: 780575 - RNA, 18 nt, Human
cuccagacagccugaggc

SEQ ID NO: 780576 - RNA, 24 nt, Human
cuccagacagccugaggccaccau

SEQ ID NO: 780577 - RNA, 22 nt, Human
cucugcugcaaauuuaacacaa

SEQ ID NO: 780578 - RNA, 22 nt, Human
cugcaaauuuaacacaaacauc

SEQ ID NO: 780579 - RNA, 23 nt, Human
cuggccaacauggugaaacccca

SEQ ID NO: 780580 - RNA, 21 nt, Human
cuguaaucccagcacuuuggg

SEQ ID NO: 780581 - RNA, 21 nt, Human
cuguggcugaaggugcuucug

SEQ ID NO: 780582 - RNA, 24 nt, Human
cuguggcugaaggugcuucugcuc

SEQ ID NO: 780583 - RNA, 24 nt, Human
cuuucuacuucuccuucacaagaa

SEQ ID NO: 780584 - RNA, 21 nt, Human
gaaaagaaacaaacuuggcca

SEQ ID NO: 780585 - RNA, 23 nt, Human
gaacauauauccugaagauaagg

SEQ ID NO: 780586 - RNA, 27 nt, Human
gaacauuuccagugucaaaaaaaauuc

SEQ ID NO: 780587 - RNA, 19 nt, Human
gaagccuuuccaaacaccu

SEQ ID NO: 780588 - RNA, 19 nt, Human
gaaguucuccauguccuac

SEQ ID NO: 780589 - RNA, 23 nt, Human
gacauguguggaucacuugaggu

SEQ ID NO: 780590 - RNA, 21 nt, Human
gagacagagguugcagugagc

SEQ ID NO: 780591 - RNA, 23 nt, Human
gagaucgugucacugcacuccag

SEQ ID NO: 780592 - RNA, 18 nt, Human
gaucacuugaggucagga

SEQ ID NO: 780593 - RNA, 22 nt, Human
gaucacuugaggucaggauuuc

SEQ ID NO: 780594 - RNA, 24 nt, Human
gaucacuugaggucaggauuucaa

SEQ ID NO: 780595 - RNA, 21 nt, Human
gaugaccauagaacuaacugc

SEQ ID NO: 780596 - RNA, 19 nt, Human
gauuguaaagaaggaaaaa

SEQ ID NO: 780597 - RNA, 23 nt, Human
gcagcggugaagagaagaacuac

SEQ ID NO: 780598 - RNA, 24 nt, Human
gccaacauggugaaaccccaucuc

SEQ ID NO: 780599 - RNA, 22 nt, Human
gccauuugucuuccauuagugc

SEQ ID NO: 780600 - RNA, 20 nt, Human
gccucuuauaaaaacaaccu

SEQ ID NO: 780601 - RNA, 21 nt, Human
gcugcaaauuuaacacaaaca

SEQ ID NO: 780602 - RNA, 27 nt, Human
gcuuccgucacuacuucacuggaaguc

SEQ ID NO: 780603 - RNA, 18 nt, Human
ggcgggguacaguggcuc

SEQ ID NO: 780604 - RNA, 18 nt, Human
ggcugccccaguggcggc

SEQ ID NO: 780605 - RNA, 23 nt, Human
gguacaguggcucacgacuguaa

SEQ ID NO: 780606 - RNA, 24 nt, Human
gguggcacgugccuauagucccag

SEQ ID NO: 780607 - RNA, 20 nt, Human
guagcagucuguuaaucaga

SEQ ID NO: 780608 - RNA, 21 nt, Human
guaguuuuauuguuucuucca

SEQ ID NO: 780609 - RNA, 24 nt, Human
gucaacuguggucugaaaauguua

SEQ ID NO: 780610 - RNA, 24 nt, Human
guugcagugagcugagaucguguc

SEQ ID NO: 780611 - RNA, 21 nt, Human
guugcucauuccuagcuucca

SEQ ID NO: 780612 - RNA, 23 nt, Human
uaaaaaaugaagcuaacauuuga

SEQ ID NO: 780613 - RNA, 21 nt, Human
uaaaaaugcuauccaaucuac

SEQ ID NO: 780614 - RNA, 19 nt, Human
uaaagacaccagaaucagu

SEQ ID NO: 780615 - RNA, 18 nt, Human
uaaagcacaacucuuaga

SEQ ID NO: 780616 - RNA, 27 nt, Human
uaagugaaauucccuucccugucugca

SEQ ID NO: 780617 - RNA, 20 nt, Human
uaccacucccgaaguggagc

SEQ ID NO: 780618 - RNA, 19 nt, Human
uacccugcuuccuuaaagc

SEQ ID NO: 780619 - RNA, 18 nt, Human
uacugucauccccuggcc

SEQ ID NO: 780620 - RNA, 25 nt, Human
uagacauguguggaucacuugaggu

SEQ ID NO: 780621 - RNA, 18 nt, Human
uagauaccagcuuaauga

SEQ ID NO: 780622 - RNA, 22 nt, Human
uagccgggugugguggcacgug

SEQ ID NO: 780623 - RNA, 19 nt, Human
uagggaggagaaucaccug

SEQ ID NO: 780624 - RNA, 24 nt, Human
uagucccaccguauccacggcuuu

SEQ ID NO: 780625 - RNA, 19 nt, Human
uauaaggcuguggcugaag

SEQ ID NO: 780626 - RNA, 21 nt, Human
ucaagaagccuuuccaaacac

SEQ ID NO: 780627 - RNA, 28 nt, Human
ucacucaagaagccuuuccaaacaccuc

SEQ ID NO: 780628 - RNA, 19 nt, Human
ucacugcacuccagccugg

SEQ ID NO: 780629 - RNA, 20 nt, Human
ucacugcacuccagccuggc

SEQ ID NO: 780630 - RNA, 24 nt, Human
ucacugcacuccagccuggcugac

SEQ ID NO: 780631 - RNA, 21 nt, Human
ucagaaauaauucaucaguuu

SEQ ID NO: 780632 - RNA, 20 nt, Human
ucauaccuuucccaucaauc

SEQ ID NO: 780633 - RNA, 20 nt, Human
uccagugucaaaaaaaauuc

SEQ ID NO: 780634 - RNA, 23 nt, Human
uccagugucaaaaaaaauucaac

SEQ ID NO: 780635 - RNA, 18 nt, Human
uccccuggccgcccaguu

SEQ ID NO: 780636 - RNA, 23 nt, Human
ucgugucacugcacuccagccug

SEQ ID NO: 780637 - RNA, 24 nt, Human
ucuauaguaagaacaaaccggggc

SEQ ID NO: 780638 - RNA, 21 nt, Human
ucucuacuaaaaauaugaaaa

SEQ ID NO: 780639 - RNA, 23 nt, Human
ucucucaguggccauaaagcaca

SEQ ID NO: 780640 - RNA, 22 nt, Human
ucuucagaaguucuccaugucc

SEQ ID NO: 780641 - RNA, 24 nt, Human
ugaaaagaaacaaacuuggccaaa

SEQ ID NO: 780642 - RNA, 27 nt, Human
ugaaaagaaacaaacuuggccaaagua

SEQ ID NO: 780643 - RNA, 22 nt, Human
ugaaaauuagccggguguggug

SEQ ID NO: 780644 - RNA, 19 nt, Human
ugaaaccccaucucuacua

SEQ ID NO: 780645 - RNA, 21 nt, Human
ugaaggggcagcgccaccucc

SEQ ID NO: 780646 - RNA, 26 nt, Human
ugacccaacccagaaaucuagaaguc

SEQ ID NO: 780647 - RNA, 23 nt, Human
ugagauggcuuuuggauuuucaa

SEQ ID NO: 780648 - RNA, 22 nt, Human
ugagcugagaucgugucacugc

SEQ ID NO: 780649 - RNA, 23 nt, Human
ugaguaauguaaugaaauaaugc

SEQ ID NO: 780650 - RNA, 19 nt, Human
ugccgugacgcguaguccc

SEQ ID NO: 780651 - RNA, 24 nt, Human
ugccuauagucccagcuacuuggg

SEQ ID NO: 780652 - RNA, 23 nt, Human
ugccuggaguuuucaauauuuac

SEQ ID NO: 780653 - RNA, 25 nt, Human
uggaauggacaagugaaaauaggug

SEQ ID NO: 780654 - RNA, 20 nt, Human
uggaucacuugaggucagga

SEQ ID NO: 780655 - RNA, 23 nt, Human
uggaucacuugaggucaggauuu

SEQ ID NO: 780656 - RNA, 21 nt, Human
uggcaaaaaagggaaacacuc

SEQ ID NO: 780657 - RNA, 24 nt, Human
uggcaaaaaagggaaacacucaaa

SEQ ID NO: 780658 - RNA, 24 nt, Human
uggccaacauggugaaaccccauc

SEQ ID NO: 780659 - RNA, 18 nt, Human
uggcggcggucacagcuc

SEQ ID NO: 780660 - RNA, 24 nt, Human
uggcucacgacuguaaucccagca

SEQ ID NO: 780661 - RNA, 18 nt, Human
uggcugaaggugcuucug

SEQ ID NO: 780662 - RNA, 22 nt, Human
uggcuuuuggauuuucaaggua

SEQ ID NO: 780663 - RNA, 24 nt, Human
ugggagguagacauguguggauca

SEQ ID NO: 780664 - RNA, 24 nt, Human
ugguggcacgugccuauaguccca

SEQ ID NO: 780665 - RNA, 20 nt, Human
uguauuuacacuacccaccc

SEQ ID NO: 780666 - RNA, 20 nt, Human
ugucaaaaaaaauucaacga

SEQ ID NO: 780667 - RNA, 27 nt, Human
uguggucaacuguggucugaaaauguu

SEQ ID NO: 780668 - RNA, 24 nt, Human
uguguggaucacuugaggucagga

SEQ ID NO: 780669 - RNA, 21 nt, Human
uuacuuagcuugugagcuccu

SEQ ID NO: 780670 - RNA, 23 nt, Human
uuacuuucuacuucuccuucaca

SEQ ID NO: 780671 - RNA, 20 nt, Human
uuagccgggugugguggcac

SEQ ID NO: 780672 - RNA, 20 nt, Human
uuagccgggugugguggcac

SEQ ID NO: 780673 - RNA, 24 nt, Human
uuagccgggugugguggcacgugc

SEQ ID NO: 780674 - RNA, 20 nt, Human
uucaaagguaaaaaaugaag

SEQ ID NO: 780675 - RNA, 21 nt, Human
uucaacgaagcuaaacuacag

SEQ ID NO: 780676 - RNA, 21 nt, Human
uucacaagaaaacaagucagc

SEQ ID NO: 780677 - RNA, 24 nt, Human
uucauuuauuuacuuagcuuguga

SEQ ID NO: 780678 - RNA, 23 nt, Human
uucccuacaaccccauggauguu

SEQ ID NO: 780679 - RNA, 19 nt, Human
uucugugauugagguuucc

SEQ ID NO: 780680 - RNA, 22 nt, Human
uugaacauuuccagugucaaaa

SEQ ID NO: 780681 - RNA, 18 nt, Human
uugcagugagcugagauc

SEQ ID NO: 780682 - RNA, 21 nt, Human
uugcagugagcugagaucgug

SEQ ID NO: 780683 - RNA, 22 nt, Human
uugcagugagcugagaucgugu

SEQ ID NO: 780684 - RNA, 22 nt, Human
uuuaagcucuuacacugaaagg

SEQ ID NO: 780685 - RNA, 26 nt, Human
uuuauuguuucuuccacgauauucag

SEQ ID NO: 780686 - RNA, 18 nt, Human
uuugcucaagucaaagug

SEQ ID NO: 780687 - RNA, 18 nt, Human
uuuuaaauguuuucucca

SEQ ID NO: 780688 - RNA, 22 nt, Human
aaaacacugugcagaaaagucc

SEQ ID NO: 780689 - RNA, 22 nt, Human
aaaagacuucagggcaagagga

SEQ ID NO: 780690 - RNA, 19 nt, Human
aaacaggacucaauguucu

SEQ ID NO: 780691 - RNA, 21 nt, Human
aaagaaaaaaagacuucaggg

SEQ ID NO: 780692 - RNA, 22 nt, Human
aacacauauuguucaucucaga

SEQ ID NO: 780693 - RNA, 20 nt, Human
aaccaagcuaccuaagcccu

SEQ ID NO: 780694 - RNA, 25 nt, Human
aagcaugccuagucccagccagggc

SEQ ID NO: 780695 - RNA, 19 nt, Human
aagccaauggaaaacagga

SEQ ID NO: 780696 - RNA, 23 nt, Human
aagccaauggaaaacaggacuca

SEQ ID NO: 780697 - RNA, 19 nt, Human
aaggacauaggaccugccg

SEQ ID NO: 780698 - RNA, 23 nt, Human
aaguccacagccacuuacccuag

SEQ ID NO: 780699 - RNA, 21 nt, Human
aagucuguggaaagaggcuuu

SEQ ID NO: 780700 - RNA, 23 nt, Human
aaucauauggaaucauuugaaau

SEQ ID NO: 780701 - RNA, 21 nt, Human
aaucaugauucucuuacuuuc

SEQ ID NO: 780702 - RNA, 20 nt, Human
acaaagaacaggcuguugca

SEQ ID NO: 780703 - RNA, 20 nt, Human
acacuauccagaaaagaaug

SEQ ID NO: 780704 - RNA, 18 nt, Human
acaugccucacauggcca

SEQ ID NO: 780705 - RNA, 19 nt, Human
acccuagaguaaagccagc

SEQ ID NO: 780706 - RNA, 22 nt, Human
accgcaauacagaggacacacu

SEQ ID NO: 780707 - RNA, 21 nt, Human
acuccaguuuaucagcucauu

SEQ ID NO: 780708 - RNA, 19 nt, Human
agaaaagaaugaacaaaga

SEQ ID NO: 780709 - RNA, 18 nt, Human
agaacaggcuguugcaaa

SEQ ID NO: 780710 - RNA, 22 nt, Human
agaacagguauccauguaccaa

SEQ ID NO: 780711 - RNA, 22 nt, Human
agaagcauuugugucaaggaca

SEQ ID NO: 780712 - RNA, 21 nt, Human
agacaggacgcagcaagacga

SEQ ID NO: 780713 - RNA, 18 nt, Human
agcaagaagcauuugugu

SEQ ID NO: 780714 - RNA, 24 nt, Human
agcuacacagaacugggaccaaca

SEQ ID NO: 780715 - RNA, 19 nt, Human
agcugcacuccugacaccu

SEQ ID NO: 780716 - RNA, 18 nt, Human
agggagagcacgggaagg

SEQ ID NO: 780717 - RNA, 22 nt, Human
agggaggauuucagcaagaagc

SEQ ID NO: 780718 - RNA, 21 nt, Human
augaucuuaagauucugagug

SEQ ID NO: 780719 - RNA, 22 nt, Human
auggccaaauguuugccaagac

SEQ ID NO: 780720 - RNA, 21 nt, Human
caaagaacaggcuguugcaaa

SEQ ID NO: 780721 - RNA, 23 nt, Human
caaagcugaucauuagaaucacu

SEQ ID NO: 780722 - RNA, 23 nt, Human
caacaaguucuggcagccucauc

SEQ ID NO: 780723 - RNA, 22 nt, Human
cacacacugacaaucauaugga

SEQ ID NO: 780724 - RNA, 21 nt, Human
cacacuauccagaaaagaaug

SEQ ID NO: 780725 - RNA, 18 nt, Human
caccaagcuacuggaagg

SEQ ID NO: 780726 - RNA, 21 nt, Human
cacuccugacaccucaguagc

SEQ ID NO: 780727 - RNA, 23 nt, Human
cacuccugacaccucaguagcau

SEQ ID NO: 780728 - RNA, 21 nt, Human
cagaacugggaccaacagcac

SEQ ID NO: 780729 - RNA, 25 nt, Human
cagcacacaagccagagacuuccaa

SEQ ID NO: 780730 - RNA, 20 nt, Human
cagccugcugagugcagccc

SEQ ID NO: 780731 - RNA, 19 nt, Human
cagcuuccuacgcugagag

SEQ ID NO: 780732 - RNA, 25 nt, Human
caggacgcagcaagacgagagaaug

SEQ ID NO: 780733 - RNA, 24 nt, Human
cagggcauguuggagucagcuccc

SEQ ID NO: 780734 - RNA, 20 nt, Human
cagggcccuuggcugguggc

SEQ ID NO: 780735 - RNA, 18 nt, Human
cauggccaaauguuugcc

SEQ ID NO: 780736 - RNA, 23 nt, Human
cauggccaaauguuugccaagac

SEQ ID NO: 780737 - RNA, 22 nt, Human
ccacaugccucacauggccaaa

SEQ ID NO: 780738 - RNA, 20 nt, Human
cccccucucaucacuuggcc

SEQ ID NO: 780739 - RNA, 21 nt, Human
cccuuggggcugaagccuugg

SEQ ID NO: 780740 - RNA, 24 nt, Human
ccuauauccacauggaugcgcccu

SEQ ID NO: 780741 - RNA, 23 nt, Human
ccucauccagcacacaagccaga

SEQ ID NO: 780742 - RNA, 18 nt, Human
ccugacaccucaguagca

SEQ ID NO: 780743 - RNA, 21 nt, Human
ccuggacucaggcuuagaagc

SEQ ID NO: 780744 - RNA, 24 nt, Human
cgcccugaagccaauggaaaacag

SEQ ID NO: 780745 - RNA, 22 nt, Human
cguaaaaagaaaaaaagacuuc

SEQ ID NO: 780746 - RNA, 22 nt, Human
cuacacagaacugggaccaaca

SEQ ID NO: 780747 - RNA, 23 nt, Human
cuacacagaacugggaccaacag

SEQ ID NO: 780748 - RNA, 23 nt, Human
cugaagccaauggaaaacaggac

SEQ ID NO: 780749 - RNA, 24 nt, Human
cugacacacacacugacaaucaua

SEQ ID NO: 780750 - RNA, 18 nt, Human
cugaggcuggagaugccc

SEQ ID NO: 780751 - RNA, 19 nt, Human
cuggguggggucaggcugg

SEQ ID NO: 780752 - RNA, 22 nt, Human
gcaucacuagggaggauuucag

SEQ ID NO: 780753 - RNA, 22 nt, Human
gccuuggugacucccccucuca

SEQ ID NO: 780754 - RNA, 23 nt, Human
gcugguggcccuucauggggcag

SEQ ID NO: 780755 - RNA, 21 nt, Human
ggaagacuucaugaaugcucu

SEQ ID NO: 780756 - RNA, 22 nt, Human
ggccucacccuugacucaucuc

SEQ ID NO: 780757 - RNA, 22 nt, Human
ggccugaggcuggagaugcccu

SEQ ID NO: 780758 - RNA, 23 nt, Human
gggcccuuggcugguggcccuuc

SEQ ID NO: 780759 - RNA, 21 nt, Human
guaaaaagaaaaaaagacuuc

SEQ ID NO: 780760 - RNA, 18 nt, Human
guacgcaaguguugacag

SEQ ID NO: 780761 - RNA, 19 nt, Human
guagaguuuuuccuuggag

SEQ ID NO: 780762 - RNA, 18 nt, Human
guuuuuccuuggagauuc

SEQ ID NO: 780763 - RNA, 25 nt, Human
uaauagaaaauggaaacugaccaca

SEQ ID NO: 780764 - RNA, 23 nt, Human
uaccaaccacuucaauucauauc

SEQ ID NO: 780765 - RNA, 20 nt, Human
uacuggaaggggaaaugguu

SEQ ID NO: 780766 - RNA, 21 nt, Human
uagaaaauggaaacugaccac

SEQ ID NO: 780767 - RNA, 21 nt, Human
uagaaacuggccaaaccuuca

SEQ ID NO: 780768 - RNA, 19 nt, Human
uagcaugaacacuguaaag

SEQ ID NO: 780769 - RNA, 25 nt, Human
uauaacacauauuguucaucucaga

SEQ ID NO: 780770 - RNA, 21 nt, Human
uauccauguaccaaccacuuc

SEQ ID NO: 780771 - RNA, 25 nt, Human
ucaaaagaaaaguuuaacaccucac

SEQ ID NO: 780772 - RNA, 23 nt, Human
ucaccgacaaugcagcucuauaa

SEQ ID NO: 780773 - RNA, 21 nt, Human
uccacagccacuuacccuaga

SEQ ID NO: 780774 - RNA, 19 nt, Human
uccagcacacaagccagag

SEQ ID NO: 780775 - RNA, 21 nt, Human
ugaaaacacugugcagaaaag

SEQ ID NO: 780776 - RNA, 20 nt, Human
ugaaaucgaucacagucuga

SEQ ID NO: 780777 - RNA, 19 nt, Human
ugaccaaggacguggccug

SEQ ID NO: 780778 - RNA, 21 nt, Human
ugacugaggacuccacagaca

SEQ ID NO: 780779 - RNA, 18 nt, Human
ugagcagagcagcugcug

SEQ ID NO: 780780 - RNA, 23 nt, Human
ugagcugagguccagucaaagcu

SEQ ID NO: 780781 - RNA, 23 nt, Human
ugcagaaaaguccacagccacuu

SEQ ID NO: 780782 - RNA, 19 nt, Human
ugcagggaugugugagggu

SEQ ID NO: 780783 - RNA, 19 nt, Human
ugcucuacucauucagaag

SEQ ID NO: 780784 - RNA, 19 nt, Human
ugcucuguagaguuuuucc

SEQ ID NO: 780785 - RNA, 21 nt, Human
ugcucuguagaguuuuuccuu

SEQ ID NO: 780786 - RNA, 22 nt, Human
uggaaggggaaaugguuuucca

SEQ ID NO: 780787 - RNA, 23 nt, Human
uggagucagcucccacucaagca

SEQ ID NO: 780788 - RNA, 23 nt, Human
uggcagccucauccagcacacaa

SEQ ID NO: 780789 - RNA, 24 nt, Human
uggccaaaccuucaaaagaaaagu

SEQ ID NO: 780790 - RNA, 23 nt, Human
uggcugguggcccuucauggggc

SEQ ID NO: 780791 - RNA, 20 nt, Human
ugggaccaacagcacucgca

SEQ ID NO: 780792 - RNA, 21 nt, Human
ugggaucuaucacaccauggu

SEQ ID NO: 780793 - RNA, 19 nt, Human
ugguaugguagggcauggg

SEQ ID NO: 780794 - RNA, 19 nt, Human
ugguggcccuucauggggc

SEQ ID NO: 780795 - RNA, 24 nt, Human
uguauaaaucuaccgcaauacaga

SEQ ID NO: 780796 - RNA, 18 nt, Human
uguaugaaucucuugcuc

SEQ ID NO: 780797 - RNA, 18 nt, Human
ugugcacaagcuuauauu

SEQ ID NO: 780798 - RNA, 25 nt, Human
uuaaugcaaaaaaauguagugguua

SEQ ID NO: 780799 - RNA, 18 nt, Human
uuagaaacuggccaaacc

SEQ ID NO: 780800 - RNA, 18 nt, Human
uuaugaaaacacugugca

SEQ ID NO: 780801 - RNA, 22 nt, Human
uucaaaagaaaaguuuaacacc

SEQ ID NO: 780802 - RNA, 18 nt, Human
uucaccuuuuuaaaaggg

SEQ ID NO: 780803 - RNA, 20 nt, Human
uucagggcaagaggauccua

SEQ ID NO: 780804 - RNA, 20 nt, Human
uuccaaaguaagguggcgca

SEQ ID NO: 780805 - RNA, 18 nt, Human
uuccuaagucuguggaaa

SEQ ID NO: 780806 - RNA, 24 nt, Human
uugaaaugggaucuaucacaccau

SEQ ID NO: 780807 - RNA, 18 nt, Human
uuugccaagacuagcaga

SEQ ID NO: 780808 - RNA, 23 nt, Human
aaaaaaaaaaaaaagacuacuca

SEQ ID NO: 780809 - RNA, 20 nt, Human
aaaaaaaaaaaaagugcaaa

SEQ ID NO: 780810 - RNA, 21 nt, Human
aaaaauacaaaaucagccgga

SEQ ID NO: 780811 - RNA, 26 nt, Human
aaaacaaauaaacaaaaaaaaucacc

SEQ ID NO: 780812 - RNA, 23 nt, Human
aaaagaaaaaaaaagggggggag

SEQ ID NO: 780813 - RNA, 20 nt, Human
aaaaugccuccacacacagc

SEQ ID NO: 780814 - RNA, 22 nt, Human
aaaaugccuccacacacagcca

SEQ ID NO: 780815 - RNA, 18 nt, Human
aaacaaaaaaaaucaccu

SEQ ID NO: 780816 - RNA, 19 nt, Human
aaagacgggguuucaccgu

SEQ ID NO: 780817 - RNA, 21 nt, Human
aaagcaaaauaauuaaauccc

SEQ ID NO: 780818 - RNA, 24 nt, Human
aaaguguagggauuacaggcguga

SEQ ID NO: 780819 - RNA, 22 nt, Human
aaauggagaaaccucgucucua

SEQ ID NO: 780820 - RNA, 18 nt, Human
aacaaacacaaugaugac

SEQ ID NO: 780821 - RNA, 20 nt, Human
aagacaaucacgaggucagg

SEQ ID NO: 780822 - RNA, 23 nt, Human
aagcaacauaauuuuaccaaaau

SEQ ID NO: 780823 - RNA, 22 nt, Human
aagcaggagaauugcuuaaacc

SEQ ID NO: 780824 - RNA, 24 nt, Human
aagcaggagaauugcuuaaaccug

SEQ ID NO: 780825 - RNA, 18 nt, Human
aagcaggaggauuacuug

SEQ ID NO: 780826 - RNA, 24 nt, Human
aagccaauuccccugaguuuccug

SEQ ID NO: 780827 - RNA, 21 nt, Human
aagggaauguuugugcuccuc

SEQ ID NO: 780828 - RNA, 19 nt, Human
aaguagcugggacuacagg

SEQ ID NO: 780829 - RNA, 20 nt, Human
aaguagcugggacuacaggu

SEQ ID NO: 780830 - RNA, 18 nt, Human
aagugccugcacccagag

SEQ ID NO: 780831 - RNA, 24 nt, Human
aaucacgaggucaggaguucaaga

SEQ ID NO: 780832 - RNA, 24 nt, Human
aaucgcuugaacccgggaggcgga

SEQ ID NO: 780833 - RNA, 24 nt, Human
acaagcccccugaguuaagagccc

SEQ ID NO: 780834 - RNA, 20 nt, Human
acagagcaagacuccaucuc

SEQ ID NO: 780835 - RNA, 21 nt, Human
acaguggcacggucuuggcuc

SEQ ID NO: 780836 - RNA, 23 nt, Human
accaaaaauacaaaaucagccgg

SEQ ID NO: 780837 - RNA, 25 nt, Human
accaaaauggagaaaccucgucucu

SEQ ID NO: 780838 - RNA, 22 nt, Human
accagcauccaaaccaguucug

SEQ ID NO: 780839 - RNA, 24 nt, Human
accucgucucuaccaaaaauacaa

SEQ ID NO: 780840 - RNA, 20 nt, Human
acggggcagguuauagagag

SEQ ID NO: 780841 - RNA, 18 nt, Human
acgggguuucaccguguu

SEQ ID NO: 780842 - RNA, 19 nt, Human
acgggguuucaccguguua

SEQ ID NO: 780843 - RNA, 20 nt, Human
acgggguuucaccguguuag

SEQ ID NO: 780844 - RNA, 24 nt, Human
acgggguuucaccguguuagccag

SEQ ID NO: 780845 - RNA, 23 nt, Human
acuccagccugggcaacaagagc

SEQ ID NO: 780846 - RNA, 19 nt, Human
acugaauugacaccaaccc

SEQ ID NO: 780847 - RNA, 23 nt, Human
acugaauugacaccaacccaaga

SEQ ID NO: 780848 - RNA, 21 nt, Human
acugcaaacugccaaaugcgg

SEQ ID NO: 780849 - RNA, 24 nt, Human
acugcacuccagccugggcgacag

SEQ ID NO: 780850 - RNA, 26 nt, Human
acugcacuccagccugggcgacagag

SEQ ID NO: 780851 - RNA, 21 nt, Human
agaaggaauccccauugcaaa

SEQ ID NO: 780852 - RNA, 19 nt, Human
agacaaucacgaggucagg

SEQ ID NO: 780853 - RNA, 23 nt, Human
agacaaucacgaggucaggaguu

SEQ ID NO: 780854 - RNA, 24 nt, Human
agacauacaccagaacagaauucc

SEQ ID NO: 780855 - RNA, 24 nt, Human
agagagcaagacccuaucucaaaa

SEQ ID NO: 780856 - RNA, 24 nt, Human
agaggcuguagugagccgagaucg

SEQ ID NO: 780857 - RNA, 24 nt, Human
agcacuuugggaggcugaggcagg

SEQ ID NO: 780858 - RNA, 18 nt, Human
agccaccacacccagccc

SEQ ID NO: 780859 - RNA, 23 nt, Human
agccaggugugguggugugcacc

SEQ ID NO: 780860 - RNA, 23 nt, Human
agccggacgugguagcgcaugcc

SEQ ID NO: 780861 - RNA, 23 nt, Human
agccuggcaugguggcaugcgcc

SEQ ID NO: 780862 - RNA, 24 nt, Human
agccuggccaaaauugugaaaccc

SEQ ID NO: 780863 - RNA, 23 nt, Human
agccugggcaacauagcaagacc

SEQ ID NO: 780864 - RNA, 24 nt, Human
agccugggcaacauagcaagaccu

SEQ ID NO: 780865 - RNA, 24 nt, Human
agccugggcgacagagcaagacuc

SEQ ID NO: 780866 - RNA, 21 nt, Human
agcucacgccuguaaucccag

SEQ ID NO: 780867 - RNA, 20 nt, Human
aggaguuugagaccagccug

SEQ ID NO: 780868 - RNA, 18 nt, Human
aggaucauggguuccucc

SEQ ID NO: 780869 - RNA, 24 nt, Human
aggauuacuugugaccaggaguuu

SEQ ID NO: 780870 - RNA, 19 nt, Human
aggcaggauugaccugggu

SEQ ID NO: 780871 - RNA, 19 nt, Human
aggcaggauugaccugggu

SEQ ID NO: 780872 - RNA, 18 nt, Human
aggcaggcggaucaccug

SEQ ID NO: 780873 - RNA, 22 nt, Human
aggcaggcggaucaccugaagg

SEQ ID NO: 780874 - RNA, 26 nt, Human
aggcaggcggaucaccugaagucggg

SEQ ID NO: 780875 - RNA, 22 nt, Human
aggcagguggaucacugucagg

SEQ ID NO: 780876 - RNA, 21 nt, Human
aggccgaggcaggcggaucac

SEQ ID NO: 780877 - RNA, 20 nt, Human
aggcggagguugcggugagc

SEQ ID NO: 780878 - RNA, 24 nt, Human
aggcugaagcaggaggauuacuug

SEQ ID NO: 780879 - RNA, 21 nt, Human
aggcugaggcagguggaucac

SEQ ID NO: 780880 - RNA, 23 nt, Human
aggcugaggcagguggaucacug

SEQ ID NO: 780881 - RNA, 18 nt, Human
agggauuacaggcgugag

SEQ ID NO: 780882 - RNA, 22 nt, Human
agggauuacaggcgugagccac

SEQ ID NO: 780883 - RNA, 23 nt, Human
agggauuacaggcgugagccacc

SEQ ID NO: 780884 - RNA, 24 nt, Human
agggauuacaggcgugagccacca

SEQ ID NO: 780885 - RNA, 19 nt, Human
aggggaccauguccuggcu

SEQ ID NO: 780886 - RNA, 23 nt, Human
agggggggaguucaccccauauu

SEQ ID NO: 780887 - RNA, 23 nt, Human
agguggaucacugucaggccucu

SEQ ID NO: 780888 - RNA, 24 nt, Human
aggugugguggugugcaccuguag

SEQ ID NO: 780889 - RNA, 24 nt, Human
agguucuuuauaaucucccccacc

SEQ ID NO: 780890 - RNA, 20 nt, Human
agguugaagcaggagaauug

SEQ ID NO: 780891 - RNA, 24 nt, Human
aguacaguggcacggucuuggcuc

SEQ ID NO: 780892 - RNA, 19 nt, Human
agucccgggccaggugugc

SEQ ID NO: 780893 - RNA, 19 nt, Human
agucgggaguuugagacca

SEQ ID NO: 780894 - RNA, 22 nt, Human
aucacgaggucaggaguucaag

SEQ ID NO: 780895 - RNA, 24 nt, Human
aucgcgccacugcacuccagccug

SEQ ID NO: 780896 - RNA, 24 nt, Human
aucgcgccauuguacuccagccug

SEQ ID NO: 780897 - RNA, 19 nt, Human
aucucaaaaaaaaaaaaag

SEQ ID NO: 780898 - RNA, 18 nt, Human
augcaggagaaucgcuug

SEQ ID NO: 780899 - RNA, 22 nt, Human
augcggcagcucaugccuguaa

SEQ ID NO: 780900 - RNA, 24 nt, Human
auuguacuccagccugggcaacaa

SEQ ID NO: 780901 - RNA, 23 nt, Human
caaaaauaauuaugcugggcuua

SEQ ID NO: 780902 - RNA, 23 nt, Human
caaaaauacaaaaucagccggac

SEQ ID NO: 780903 - RNA, 24 nt, Human
caaacugaauugacaccaacccaa

SEQ ID NO: 780904 - RNA, 28 nt, Human
caaacugaauugacaccaacccaagagc

SEQ ID NO: 780905 - RNA, 22 nt, Human
caacauagcaagaccuugucuc

SEQ ID NO: 780906 - RNA, 24 nt, Human
caacauagcaagaccuugucucua

SEQ ID NO: 780907 - RNA, 22 nt, Human
caagcuaagccaucauaucccc

SEQ ID NO: 780908 - RNA, 23 nt, Human
caaucacgaggucaggaguucaa

SEQ ID NO: 780909 - RNA, 21 nt, Human
cacaaagccuguuuggucucu

SEQ ID NO: 780910 - RNA, 24 nt, Human
cacacauggccucaggacagcugc

SEQ ID NO: 780911 - RNA, 21 nt, Human
cacagccaccaccacaccaca

SEQ ID NO: 780912 - RNA, 21 nt, Human
caccacaccacagguuggcug

SEQ ID NO: 780913 - RNA, 18 nt, Human
caccacacccagcccaga

SEQ ID NO: 780914 - RNA, 20 nt, Human
caccacacccagcccagaau

SEQ ID NO: 780915 - RNA, 20 nt, Human
caccacagccaccaccacac

SEQ ID NO: 780916 - RNA, 19 nt, Human
caccagaacagaauuccag

SEQ ID NO: 780917 - RNA, 18 nt, Human
cacccccugcccccaaaa

SEQ ID NO: 780918 - RNA, 18 nt, Human
cacccuuugcugacucuc

SEQ ID NO: 780919 - RNA, 22 nt, Human
caccguguuagccaggcuguuc

SEQ ID NO: 780920 - RNA, 24 nt, Human
caccguguuagccaggcuguucuc

SEQ ID NO: 780921 - RNA, 26 nt, Human
caccugggcgaagagaccggggguuc

SEQ ID NO: 780922 - RNA, 22 nt, Human
caccuguagucuuagcuaugcg

SEQ ID NO: 780923 - RNA, 24 nt, Human
caccuguagucuuagcuaugcggg

SEQ ID NO: 780924 - RNA, 22 nt, Human
cacgccauucuccugccucagc

SEQ ID NO: 780925 - RNA, 24 nt, Human
cacgccuauaaucccagcaguuug

SEQ ID NO: 780926 - RNA, 24 nt, Human
cacgccuguaaucccagcacuuug

SEQ ID NO: 780927 - RNA, 23 nt, Human
cacuccagccugggcgacagagc

SEQ ID NO: 780928 - RNA, 18 nt, Human
cacuccagccugggugag

SEQ ID NO: 780929 - RNA, 23 nt, Human
cacuccagccugggugagagagc

SEQ ID NO: 780930 - RNA, 19 nt, Human
cacugcacuccagccuggg

SEQ ID NO: 780931 - RNA, 21 nt, Human
cacugcacuccagccugggcg

SEQ ID NO: 780932 - RNA, 22 nt, Human
cacugcacuccagccugggcga

SEQ ID NO: 780933 - RNA, 23 nt, Human
cacugcacuccagccugggcgac

SEQ ID NO: 780934 - RNA, 24 nt, Human
cacugcacuccagccugggcgaca

SEQ ID NO: 780935 - RNA, 26 nt, Human
cacugcacuccagccugggcgacaga

SEQ ID NO: 780936 - RNA, 24 nt, Human
cacuguugccucucaagagguucu

SEQ ID NO: 780937 - RNA, 20 nt, Human
cacuuacacuccagccuggg

SEQ ID NO: 780938 - RNA, 23 nt, Human
cacuuacacuccagccuggguga

SEQ ID NO: 780939 - RNA, 24 nt, Human
cagagucuugcucugcugcccagg

SEQ ID NO: 780940 - RNA, 24 nt, Human
cagcacuuugggaggcugaggcag

SEQ ID NO: 780941 - RNA, 24 nt, Human
cagcacuuugggaggcugaggcag

SEQ ID NO: 780942 - RNA, 24 nt, Human
cagcaguuuggcaggccgaggcag

SEQ ID NO: 780943 - RNA, 19 nt, Human
cagcucagaaaagaccaac

SEQ ID NO: 780944 - RNA, 21 nt, Human
caggaaggcuaaugcaggaga

SEQ ID NO: 780945 - RNA, 21 nt, Human
cagggagacauacaccagaac

SEQ ID NO: 780946 - RNA, 20 nt, Human
caggugaaauaaacagccuu

SEQ ID NO: 780947 - RNA, 25 nt, Human
cauagcaagaccuugucucuacaga

SEQ ID NO: 780948 - RNA, 18 nt, Human
cauccagauggccugaag

SEQ ID NO: 780949 - RNA, 19 nt, Human
cauugcucuuaacuccacu

SEQ ID NO: 780950 - RNA, 19 nt, Human
cauuguacuccagccuggg

SEQ ID NO: 780951 - RNA, 21 nt, Human
cauuguacuccagccugggca

SEQ ID NO: 780952 - RNA, 22 nt, Human
cauuguacuccagccugggcaa

SEQ ID NO: 780953 - RNA, 24 nt, Human
cauuguacuccagccugggcaaca

SEQ ID NO: 780954 - RNA, 22 nt, Human
ccaaaaugccuccacacacagc

SEQ ID NO: 780955 - RNA, 20 nt, Human
ccaaaguguagggauuacag

SEQ ID NO: 780956 - RNA, 22 nt, Human
ccaaaguguagggauuacaggc

SEQ ID NO: 780957 - RNA, 24 nt, Human
ccaaaguguagggauuacaggcgu

SEQ ID NO: 780958 - RNA, 23 nt, Human
ccacagccaccaccacaccacag

SEQ ID NO: 780959 - RNA, 19 nt, Human
ccaccacagccaccaccac

SEQ ID NO: 780960 - RNA, 23 nt, Human
ccaccacagccaccaccacacca

SEQ ID NO: 780961 - RNA, 22 nt, Human
ccaccaccacaccacagguugg

SEQ ID NO: 780962 - RNA, 21 nt, Human
ccacccuaacuaucaauguac

SEQ ID NO: 780963 - RNA, 20 nt, Human
ccacugcacuccagccuggg

SEQ ID NO: 780964 - RNA, 20 nt, Human
ccacugcacuccagccuggg

SEQ ID NO: 780965 - RNA, 21 nt, Human
ccacugcacuccagccugggc

SEQ ID NO: 780966 - RNA, 21 nt, Human
ccacugcacuccagccugggc

SEQ ID NO: 780967 - RNA, 23 nt, Human
ccacugcacuccagccugggcga

SEQ ID NO: 780968 - RNA, 23 nt, Human
ccacugcacuccagccugggcga

SEQ ID NO: 780969 - RNA, 24 nt, Human
ccacugcacuccagccugggcgac

SEQ ID NO: 780970 - RNA, 29 nt, Human
ccagcaguuuggcaggccgaggcaggcgg

SEQ ID NO: 780971 - RNA, 21 nt, Human
ccagccugaccaaaauggaga

SEQ ID NO: 780972 - RNA, 25 nt, Human
ccagucccaaacaugcgcuaauguc

SEQ ID NO: 780973 - RNA, 25 nt, Human
ccaugaucaaaguguuuuggucacc

SEQ ID NO: 780974 - RNA, 20 nt, Human
ccauuguacuccagccuggg

SEQ ID NO: 780975 - RNA, 21 nt, Human
ccauuguacuccagccugggc

SEQ ID NO: 780976 - RNA, 23 nt, Human
ccauuguacuccagccugggcaa

SEQ ID NO: 780977 - RNA, 24 nt, Human
ccauuguacuccagccugggcaac

SEQ ID NO: 780978 - RNA, 23 nt, Human
cccaaguagcugggacuacaggu

SEQ ID NO: 780979 - RNA, 24 nt, Human
cccaaguagcugggacuacaggug

SEQ ID NO: 780980 - RNA, 19 nt, Human
cccaggcuggaguacagug

SEQ ID NO: 780981 - RNA, 23 nt, Human
cccccaaaacauugcucuuaacu

SEQ ID NO: 780982 - RNA, 18 nt, Human
ccccugaguuaagagccc

SEQ ID NO: 780983 - RNA, 21 nt, Human
cccguaccggauccacagcca

SEQ ID NO: 780984 - RNA, 19 nt, Human
cccuaucucaaaaaaaaaa

SEQ ID NO: 780985 - RNA, 21 nt, Human
ccgggccaggugugcacagcc

SEQ ID NO: 780986 - RNA, 19 nt, Human
ccuccaacagccaguccca

SEQ ID NO: 780987 - RNA, 19 nt, Human
ccucccaaaguguagggau

SEQ ID NO: 780988 - RNA, 20 nt, Human
ccugaccucgugauccaccc

SEQ ID NO: 780989 - RNA, 19 nt, Human
ccuggccaaaauugugaaa

SEQ ID NO: 780990 - RNA, 24 nt, Human
ccuggccaaaauugugaaacccca

SEQ ID NO: 780991 - RNA, 21 nt, Human
ccugggcaacauagcaagacc

SEQ ID NO: 780992 - RNA, 22 nt, Human
ccugggcgacagagcaagacuc

SEQ ID NO: 780993 - RNA, 22 nt, Human
ccuguaaucccagcuacucuag

SEQ ID NO: 780994 - RNA, 23 nt, Human
ccuguaaucccagcuacucuaga

SEQ ID NO: 780995 - RNA, 20 nt, Human
ccuguaauucuagaacucug

SEQ ID NO: 780996 - RNA, 25 nt, Human
ccuuggguuuaaaggauuaagaaag

SEQ ID NO: 780997 - RNA, 18 nt, Human
cgaaaaaaaaaaaagaga

SEQ ID NO: 780998 - RNA, 20 nt, Human
cgaggcaggcggaucaccug

SEQ ID NO: 780999 - RNA, 24 nt, Human
cgccauuguacuccagccugggca

SEQ ID NO: 781000 - RNA, 24 nt, Human
cgccuguaaucccagcacuuuggg

SEQ ID NO: 781001 - RNA, 23 nt, Human
cgccuguaaucccagcuacucua

SEQ ID NO: 781002 - RNA, 21 nt, Human
cgcugggcggcagcggggagu

SEQ ID NO: 781003 - RNA, 24 nt, Human
cggaucaccugaagucgggaguuu

SEQ ID NO: 781004 - RNA, 23 nt, Human
cggcaacucccguaccggaucca

SEQ ID NO: 781005 - RNA, 24 nt, Human
cgggaggcggagguugcggugagc

SEQ ID NO: 781006 - RNA, 24 nt, Human
cgggguuucaccguguuagccagg

SEQ ID NO: 781007 - RNA, 21 nt, Human
cuaaaaagaaaaaaaaagggg

SEQ ID NO: 781008 - RNA, 22 nt, Human
cucaaaaaaaaaaaaagugcaa

SEQ ID NO: 781009 - RNA, 21 nt, Human
cucacgccuauaaucccagca

SEQ ID NO: 781010 - RNA, 26 nt, Human
cucacgccuauaaucccagcaguuug

SEQ ID NO: 781011 - RNA, 22 nt, Human
cucacgccuguaaucccagcac

SEQ ID NO: 781012 - RNA, 24 nt, Human
cucacgccuguaaucccagcacuu

SEQ ID NO: 781013 - RNA, 24 nt, Human
cucacugcuagcuacgccuccugg

SEQ ID NO: 781014 - RNA, 24 nt, Human
cucagccucccaaguagcugggac

SEQ ID NO: 781015 - RNA, 24 nt, Human
cuccacaccugcacccccuggguc

SEQ ID NO: 781016 - RNA, 18 nt, Human
cuccacacugcugacagu

SEQ ID NO: 781017 - RNA, 19 nt, Human
cuccgucucaaaaaaaaaa

SEQ ID NO: 781018 - RNA, 24 nt, Human
cuccugaccucgugauccacccgc

SEQ ID NO: 781019 - RNA, 21 nt, Human
cuccuggguucacgccauucu

SEQ ID NO: 781020 - RNA, 20 nt, Human
cucugaaaguuuacucucug

SEQ ID NO: 781021 - RNA, 25 nt, Human
cugcccccaaaacauugcucuuaac

SEQ ID NO: 781022 - RNA, 23 nt, Human
cugccucagccucccaaguagcu

SEQ ID NO: 781023 - RNA, 23 nt, Human
cuggccaaaauugugaaacccca

SEQ ID NO: 781024 - RNA, 21 nt, Human
cugggccuuuguuucccccug

SEQ ID NO: 781025 - RNA, 20 nt, Human
cuguagugagccgagaucgc

SEQ ID NO: 781026 - RNA, 22 nt, Human
cuguagugagccgagaucgcgc

SEQ ID NO: 781027 - RNA, 18 nt, Human
cuuacacuccagccuggg

SEQ ID NO: 781028 - RNA, 19 nt, Human
cuucauucugcuggaaaca

SEQ ID NO: 781029 - RNA, 22 nt, Human
gaccucgugauccacccgccuc

SEQ ID NO: 781030 - RNA, 22 nt, Human
gaccucgugauccacccgccuc

SEQ ID NO: 781031 - RNA, 24 nt, Human
gaccucgugauccacccgccucgg

SEQ ID NO: 781032 - RNA, 19 nt, Human
gagaaaccucgucucuacc

SEQ ID NO: 781033 - RNA, 23 nt, Human
gagaaucgcuugaacccgggagg

SEQ ID NO: 781034 - RNA, 23 nt, Human
gagaucgcgccacugcacuccag

SEQ ID NO: 781035 - RNA, 24 nt, Human
gagcuggguucaaguccaggcuuc

SEQ ID NO: 781036 - RNA, 23 nt, Human
gagguugcggugagcugagaucg

SEQ ID NO: 781037 - RNA, 18 nt, Human
gauaaccaccacagccac

SEQ ID NO: 781038 - RNA, 24 nt, Human
gaucaccugaagucgggaguuuga

SEQ ID NO: 781039 - RNA, 18 nt, Human
gauuacaggcgugagcca

SEQ ID NO: 781040 - RNA, 21 nt, Human
gauuacaggcgugagccacca

SEQ ID NO: 781041 - RNA, 22 nt, Human
gauuacaggcgugagccaccac

SEQ ID NO: 781042 - RNA, 22 nt, Human
gauuacuugugaccaggaguuu

SEQ ID NO: 781043 - RNA, 24 nt, Human
gauuacuugugaccaggaguuuga

SEQ ID NO: 781044 - RNA, 24 nt, Human
gcacuccagccugggcgacagagc

SEQ ID NO: 781045 - RNA, 22 nt, Human
gcaggagaaucgcuugaacccg

SEQ ID NO: 781046 - RNA, 24 nt, Human
gccaaaauugugaaaccccaucuc

SEQ ID NO: 781047 - RNA, 18 nt, Human
gccaagucgcucacauuc

SEQ ID NO: 781048 - RNA, 22 nt, Human
gccacugcacuccagccugggc

SEQ ID NO: 781049 - RNA, 24 nt, Human
gccacugcacuccagccugggcga

SEQ ID NO: 781050 - RNA, 22 nt, Human
gccauuguacuccagccugggc

SEQ ID NO: 781051 - RNA, 23 nt, Human
gccauuguacuccagccugggca

SEQ ID NO: 781052 - RNA, 24 nt, Human
gccauuguacuccagccugggcaa

SEQ ID NO: 781053 - RNA, 19 nt, Human
gcccacacacauggccuca

SEQ ID NO: 781054 - RNA, 19 nt, Human
gcccaggcuggaguacagu

SEQ ID NO: 781055 - RNA, 21 nt, Human
gcccccugaguuaagagcccu

SEQ ID NO: 781056 - RNA, 20 nt, Human
gccgagaucgcgccacugca

SEQ ID NO: 781057 - RNA, 20 nt, Human
gcgguagcucacgccuguaa

SEQ ID NO: 781058 - RNA, 22 nt, Human
ggagagggcgcacaagacacgu

SEQ ID NO: 781059 - RNA, 25 nt, Human
ggagcggcccacacacauggccuca

SEQ ID NO: 781060 - RNA, 22 nt, Human
ggagguugcggugagcugagau

SEQ ID NO: 781061 - RNA, 24 nt, Human
ggagguugcggugagcugagaucg

SEQ ID NO: 781062 - RNA, 19 nt, Human
ggagugagcuaugaucaug

SEQ ID NO: 781063 - RNA, 19 nt, Human
ggaguuugagaccagccug

SEQ ID NO: 781064 - RNA, 22 nt, Human
ggaucaccugaagucgggaguu

SEQ ID NO: 781065 - RNA, 23 nt, Human
ggaucaccugaagucgggaguuu

SEQ ID NO: 781066 - RNA, 19 nt, Human
ggauuacaggcgugagcca

SEQ ID NO: 781067 - RNA, 22 nt, Human
ggauuacuugugaccaggaguu

SEQ ID NO: 781068 - RNA, 20 nt, Human
ggcagaggcuguagugagcc

SEQ ID NO: 781069 - RNA, 23 nt, Human
ggcagaggcuguagugagccgag

SEQ ID NO: 781070 - RNA, 19 nt, Human
ggcagcucaugccuguaau

SEQ ID NO: 781071 - RNA, 24 nt, Human
ggcagcucaugccuguaauucuag

SEQ ID NO: 781072 - RNA, 21 nt, Human
ggccaaaauugugaaacccca

SEQ ID NO: 781073 - RNA, 20 nt, Human
ggccacugagcuguguggga

SEQ ID NO: 781074 - RNA, 19 nt, Human
ggcuggagcgugggguggg

SEQ ID NO: 781075 - RNA, 23 nt, Human
gggauagacaccaccuuccuugg

SEQ ID NO: 781076 - RNA, 18 nt, Human
gggauuacaggcgugagc

SEQ ID NO: 781077 - RNA, 23 nt, Human
gggauuacaggcgugagccacca

SEQ ID NO: 781078 - RNA, 18 nt, Human
gggcggcagcggggaguu

SEQ ID NO: 781079 - RNA, 23 nt, Human
gggguuucaccguguuagccagg

SEQ ID NO: 781080 - RNA, 23 nt, Human
gguacgguggcucacgccuauaa

SEQ ID NO: 781081 - RNA, 24 nt, Human
gguagcucacgccuguaaucccag

SEQ ID NO: 781082 - RNA, 24 nt, Human
gguggcaugcgccuguaaucccag

SEQ ID NO: 781083 - RNA, 24 nt, Human
gguggcucacgccuauaaucccag

SEQ ID NO: 781084 - RNA, 24 nt, Human
gguggugugcaccuguagucuuag

SEQ ID NO: 781085 - RNA, 25 nt, Human
guacuccagccugggcaacaagagc

SEQ ID NO: 781086 - RNA, 20 nt, Human
gucucaaaaaaaaaaaaaag

SEQ ID NO: 781087 - RNA, 24 nt, Human
gucuugcucugcugcccaggcugg

SEQ ID NO: 781088 - RNA, 24 nt, Human
gugauccacccgccucggccuccc

SEQ ID NO: 781089 - RNA, 19 nt, Human
uaaaaagaaaaaaaaaggg

SEQ ID NO: 781090 - RNA, 19 nt, Human
uaaaacaagucccgggcca

SEQ ID NO: 781091 - RNA, 19 nt, Human
uaaaauaagagcucauucc

SEQ ID NO: 781092 - RNA, 25 nt, Human
uaacaguaucuuacuagaugccagu

SEQ ID NO: 781093 - RNA, 18 nt, Human
uaaccaccacagccacca

SEQ ID NO: 781094 - RNA, 18 nt, Human
uaacuccacugccuaucc

SEQ ID NO: 781095 - RNA, 19 nt, Human
uaaggaaaaaacaaaacaa

SEQ ID NO: 781096 - RNA, 22 nt, Human
uaagggaauguuugugcuccuc

SEQ ID NO: 781097 - RNA, 24 nt, Human
uaaugcaggagaaucgcuugaacc

SEQ ID NO: 781098 - RNA, 19 nt, Human
uaauuuuuuguauuguuag

SEQ ID NO: 781099 - RNA, 22 nt, Human
uacacuccagccugggugagag

SEQ ID NO: 781100 - RNA, 24 nt, Human
uacagaaaauaaaaaaaauagcca

SEQ ID NO: 781101 - RNA, 22 nt, Human
uacagcauuguacaugacgggg

SEQ ID NO: 781102 - RNA, 24 nt, Human
uacaggcgugagccaccacaccca

SEQ ID NO: 781103 - RNA, 20 nt, Human
uaccaaaaauacaaaaucag

SEQ ID NO: 781104 - RNA, 22 nt, Human
uacuuugugagauccacccccu

SEQ ID NO: 781105 - RNA, 19 nt, Human
uagagucuccaaggcucaa

SEQ ID NO: 781106 - RNA, 22 nt, Human
uagcucacgccuguaaucccag

SEQ ID NO: 781107 - RNA, 24 nt, Human
uagcucacgccuguaaucccagca

SEQ ID NO: 781108 - RNA, 21 nt, Human
uaguaaagacgggguuucacc

SEQ ID NO: 781109 - RNA, 24 nt, Human
uaguaaagacgggguuucaccgug

SEQ ID NO: 781110 - RNA, 19 nt, Human
uaucuuacuagaugccagu

SEQ ID NO: 781111 - RNA, 24 nt, Human
ucaaacugaauugacaccaaccca

SEQ ID NO: 781112 - RNA, 24 nt, Human
ucaaucaucaaaacauauugauau

SEQ ID NO: 781113 - RNA, 19 nt, Human
ucaccguguuagccaggcu

SEQ ID NO: 781114 - RNA, 24 nt, Human
ucacgaggucaggaguucaagacc

SEQ ID NO: 781115 - RNA, 24 nt, Human
ucacugcuagcuacgccuccuggg

SEQ ID NO: 781116 - RNA, 18 nt, Human
ucagaaaagaccaacgca

SEQ ID NO: 781117 - RNA, 19 nt, Human
ucagacucagccugccugc

SEQ ID NO: 781118 - RNA, 22 nt, Human
ucagacucagccugccugcacc

SEQ ID NO: 781119 - RNA, 20 nt, Human
ucagccucccaaguagcugg

SEQ ID NO: 781120 - RNA, 24 nt, Human
ucaugucacuuacacuccagccug

SEQ ID NO: 781121 - RNA, 22 nt, Human
uccacacacagccaaguguccc

SEQ ID NO: 781122 - RNA, 19 nt, Human
uccacccccugcccccaaa

SEQ ID NO: 781123 - RNA, 24 nt, Human
uccagccugggcgacagagcaaga

SEQ ID NO: 781124 - RNA, 18 nt, Human
uccagccugggugagaga

SEQ ID NO: 781125 - RNA, 19 nt, Human
uccagccugggugagagag

SEQ ID NO: 781126 - RNA, 24 nt, Human
ucccaaaguguagggauuacaggc

SEQ ID NO: 781127 - RNA, 23 nt, Human
ucccaaguagcugggacuacagg

SEQ ID NO: 781128 - RNA, 22 nt, Human
ucccaugguacgcucccccagg

SEQ ID NO: 781129 - RNA, 23 nt, Human
uccccagcagacacaagcccccu

SEQ ID NO: 781130 - RNA, 21 nt, Human
uccccauugcaaaaauaaaaa

SEQ ID NO: 781131 - RNA, 21 nt, Human
uccccugaguuuccugaggug

SEQ ID NO: 781132 - RNA, 22 nt, Human
uccgucucaaaaaaaaaaaaaa

SEQ ID NO: 781133 - RNA, 18 nt, Human
uccuggcuucauucugcu

SEQ ID NO: 781134 - RNA, 24 nt, Human
uccuggguucacgccauucuccug

SEQ ID NO: 781135 - RNA, 24 nt, Human
uccuugggacuguaggacgaagga

SEQ ID NO: 781136 - RNA, 23 nt, Human
ucgcgccacugcacuccagccug

SEQ ID NO: 781137 - RNA, 24 nt, Human
ucgcuugaacccgggaggcggagg

SEQ ID NO: 781138 - RNA, 18 nt, Human
ucucgaaaaaaaaaaaag

SEQ ID NO: 781139 - RNA, 20 nt, Human
ucucugucacuguugccucu

SEQ ID NO: 781140 - RNA, 23 nt, Human
ucuugcucugcugcccaggcugg

SEQ ID NO: 781141 - RNA, 24 nt, Human
ucuugcucugcugcccaggcugga

SEQ ID NO: 781142 - RNA, 21 nt, Human
ucuuugaguucuuuuccucac

SEQ ID NO: 781143 - RNA, 20 nt, Human
ugaaccccugcacuguacag

SEQ ID NO: 781144 - RNA, 24 nt, Human
ugaagcaggagaauugcuuaaacc

SEQ ID NO: 781145 - RNA, 21 nt, Human
ugacaccaacccaagagcgcg

SEQ ID NO: 781146 - RNA, 23 nt, Human
ugacggggcagguuauagagagg

SEQ ID NO: 781147 - RNA, 24 nt, Human
ugagaccagccugaccaaaaugga

SEQ ID NO: 781148 - RNA, 18 nt, Human
ugagagagcaagacccua

SEQ ID NO: 781149 - RNA, 21 nt, Human
ugagaggagcguccgccggug

SEQ ID NO: 781150 - RNA, 22 nt, Human
ugagaggcugaagcaggaggau

SEQ ID NO: 781151 - RNA, 24 nt, Human
ugagaggcugaagcaggaggauua

SEQ ID NO: 781152 - RNA, 22 nt, Human
ugagccgagaucgcgccacugc

SEQ ID NO: 781153 - RNA, 22 nt, Human
ugagcugagaucgcgccauugu

SEQ ID NO: 781154 - RNA, 22 nt, Human
ugaggcagguggaucacuguca

SEQ ID NO: 781155 - RNA, 19 nt, Human
ugagguaggaguaaucacc

SEQ ID NO: 781156 - RNA, 20 nt, Human
ugaucaggaaggacaagcug

SEQ ID NO: 781157 - RNA, 23 nt, Human
ugcagagcgcacugcuggccgcc

SEQ ID NO: 781158 - RNA, 21 nt, Human
ugcccaggcuggaguacagug

SEQ ID NO: 781159 - RNA, 24 nt, Human
ugcccaggcuggaguacaguggca

SEQ ID NO: 781160 - RNA, 19 nt, Human
ugccccacccuaacuauca

SEQ ID NO: 781161 - RNA, 24 nt, Human
ugccucagccucccaaguagcugg

SEQ ID NO: 781162 - RNA, 20 nt, Human
ugccuccacaccugcacccc

SEQ ID NO: 781163 - RNA, 23 nt, Human
ugccuccacaccugcacccccug

SEQ ID NO: 781164 - RNA, 23 nt, Human
ugccuguaauucuagaacucuga

SEQ ID NO: 781165 - RNA, 24 nt, Human
ugccuguauucccaacuacucagg

SEQ ID NO: 781166 - RNA, 20 nt, Human
ugcgcugggcggcagcgggg

SEQ ID NO: 781167 - RNA, 22 nt, Human
ugcucugcugcccaggcuggag

SEQ ID NO: 781168 - RNA, 21 nt, Human
uggaggcaggauugaccuggg

SEQ ID NO: 781169 - RNA, 18 nt, Human
uggaguacaguggcacgg

SEQ ID NO: 781170 - RNA, 24 nt, Human
uggaguacaguggcacggucuugg

SEQ ID NO: 781171 - RNA, 18 nt, Human
uggcaaaaaaacgaacaa

SEQ ID NO: 781172 - RNA, 19 nt, Human
uggcacggucuuggcucac

SEQ ID NO: 781173 - RNA, 19 nt, Human
uggcagaggcgggaggcuu

SEQ ID NO: 781174 - RNA, 24 nt, Human
uggcaggccgaggcaggcggauca

SEQ ID NO: 781175 - RNA, 21 nt, Human
uggcaugcgccuguaauccca

SEQ ID NO: 781176 - RNA, 24 nt, Human
uggcaugguggcaugcgccuguaa

SEQ ID NO: 781177 - RNA, 21 nt, Human
uggcucacgccuauaauccca

SEQ ID NO: 781178 - RNA, 24 nt, Human
uggcucacgccuauaaucccagca

SEQ ID NO: 781179 - RNA, 18 nt, Human
ugggacuacaggugcccg

SEQ ID NO: 781180 - RNA, 20 nt, Human
ugggacuacaggugcccgac

SEQ ID NO: 781181 - RNA, 18 nt, Human
ugggaggcugaggcaggu

SEQ ID NO: 781182 - RNA, 24 nt, Human
ugggaggcugaggcagguggauca

SEQ ID NO: 781183 - RNA, 22 nt, Human
ugggggaaaugaggcccagagu

SEQ ID NO: 781184 - RNA, 22 nt, Human
ugggguaagacccucugaaagu

SEQ ID NO: 781185 - RNA, 20 nt, Human
uggguucacgccauucuccu

SEQ ID NO: 781186 - RNA, 19 nt, Human
ugguaacuaugauaaccac

SEQ ID NO: 781187 - RNA, 22 nt, Human
uggucugagaaguaagugaugu

SEQ ID NO: 781188 - RNA, 24 nt, Human
ugguggcaugcgccuguaauccca

SEQ ID NO: 781189 - RNA, 21 nt, Human
ugguggugugcaccuguaguc

SEQ ID NO: 781190 - RNA, 18 nt, Human
uggugugcaccuguaguc

SEQ ID NO: 781191 - RNA, 24 nt, Human
uguaaucccagcuacucuagaggu

SEQ ID NO: 781192 - RNA, 19 nt, Human
uguacuccagccugggcaa

SEQ ID NO: 781193 - RNA, 22 nt, Human
uguacuccagccugggcaacaa

SEQ ID NO: 781194 - RNA, 19 nt, Human
uguauaaaguccaguucau

SEQ ID NO: 781195 - RNA, 25 nt, Human
uguggaacugaacuggaggcucuga

SEQ ID NO: 781196 - RNA, 21 nt, Human
uguugccucucaagagguucu

SEQ ID NO: 781197 - RNA, 18 nt, Human
uuacacuccagccugggu

SEQ ID NO: 781198 - RNA, 20 nt, Human
uuacacuccagccuggguga

SEQ ID NO: 781199 - RNA, 20 nt, Human
uuacacuccagccuggguga

SEQ ID NO: 781200 - RNA, 22 nt, Human
uuaguaaagacgggguuucacc

SEQ ID NO: 781201 - RNA, 24 nt, Human
uuaguaaagacgggguuucaccgu

SEQ ID NO: 781202 - RNA, 24 nt, Human
uugaacccgggaggcggagguugc

SEQ ID NO: 781203 - RNA, 24 nt, Human
uugcucugcugcccaggcuggagu

SEQ ID NO: 781204 - RNA, 18 nt, Human
uugcuuaaaccugggggg

SEQ ID NO: 781205 - RNA, 20 nt, Human
uuggaaucaaacagagcugg

SEQ ID NO: 781206 - RNA, 25 nt, Human
uugggaggcugaggcagguggauca

SEQ ID NO: 781207 - RNA, 24 nt, Human
uuggucaccaaaguucuccuuccg

SEQ ID NO: 781208 - RNA, 24 nt, Human
uuguuucugccccacccuaacuau

SEQ ID NO: 781209 - RNA, 22 nt, Human
uuuaaaacugcaaacugccaaa

SEQ ID NO: 781210 - RNA, 21 nt, Human
uuucaccguguuagccaggcu

SEQ ID NO: 781211 - RNA, 18 nt, Human
uuugaaauugaagaugau

SEQ ID NO: 781212 - RNA, 24 nt, Human
aaaugauuccccuauacccccuac

SEQ ID NO: 781213 - RNA, 20 nt, Human
aagagaaaaggcuuggcauu

SEQ ID NO: 781214 - RNA, 18 nt, Human
auacccccuacuccaaaa

SEQ ID NO: 781215 - RNA, 19 nt, Human
augauuccccuauaccccc

SEQ ID NO: 781216 - RNA, 19 nt, Human
caccugcggagacuuugca

SEQ ID NO: 781217 - RNA, 30 nt, Human
cccccuacuccaaaaaaguuuuaaaaaucc

SEQ ID NO: 781218 - RNA, 23 nt, Human
cccggagguaccugcuccaccag

SEQ ID NO: 781219 - RNA, 20 nt, Human
cccucuucaccucacuccug

SEQ ID NO: 781220 - RNA, 22 nt, Human
ccgcccggagguaccugcucca

SEQ ID NO: 781221 - RNA, 19 nt, Human
ccucugucucuacuggagg

SEQ ID NO: 781222 - RNA, 20 nt, Human
ccuugcaaacacugccccuc

SEQ ID NO: 781223 - RNA, 19 nt, Human
cuauacccccuacuccaaa

SEQ ID NO: 781224 - RNA, 19 nt, Human
cucacuccauuuuauuuaa

SEQ ID NO: 781225 - RNA, 19 nt, Human
cugcccccucucuccgccc

SEQ ID NO: 781226 - RNA, 19 nt, Human
cugcccccucucuccgccc

SEQ ID NO: 781227 - RNA, 24 nt, Human
gcccucuucaccucacuccugcug

SEQ ID NO: 781228 - RNA, 20 nt, Human
gcucaggcuggccgggcugg

SEQ ID NO: 781229 - RNA, 20 nt, Human
gcugauccaugcccuguggc

SEQ ID NO: 781230 - RNA, 23 nt, Human
ggagggcagcaagcucaggcugg

SEQ ID NO: 781231 - RNA, 22 nt, Human
ggccggugccgagccugccccc

SEQ ID NO: 781232 - RNA, 23 nt, Human
uacccccuacuccaaaaaaguuu

SEQ ID NO: 781233 - RNA, 19 nt, Human
uacuggagggcagcaagcu

SEQ ID NO: 781234 - RNA, 20 nt, Human
ucagaggcuugcccgcccgg

SEQ ID NO: 781235 - RNA, 21 nt, Human
uccauuuuauuuaagauuuuu

SEQ ID NO: 781236 - RNA, 23 nt, Human
uccccuauacccccuacuccaaa

SEQ ID NO: 781237 - RNA, 23 nt, Human
ucccuugcaaacacugccccucu

SEQ ID NO: 781238 - RNA, 23 nt, Human
uccugcugucccuuccucucuca

SEQ ID NO: 781239 - RNA, 19 nt, Human
ucucucagugcaauauaga

SEQ ID NO: 781240 - RNA, 21 nt, Human
ugagaugcaguggggcugauc

SEQ ID NO: 781241 - RNA, 24 nt, Human
ugagcaucuaaagggggucugugu

SEQ ID NO: 781242 - RNA, 20 nt, Human
uggcauuuuucugauucccu

SEQ ID NO: 781243 - RNA, 21 nt, Human
uggccgggcugggagggccgg

SEQ ID NO: 781244 - RNA, 18 nt, Human
ugucaggcuugccccgug

SEQ ID NO: 781245 - RNA, 24 nt, Human
ugugucucucuuuauacauaugua

SEQ ID NO: 781246 - RNA, 23 nt, Human
uuccccuauacccccuacuccaa

SEQ ID NO: 781247 - RNA, 24 nt, Human
uuuuuuuuuuuuaaaauuaucuca

SEQ ID NO: 781248 - RNA, 21 nt, Human
aaaaaaugacaagcuguugga

SEQ ID NO: 781249 - RNA, 21 nt, Human
aaagacacaugucuuccuucc

SEQ ID NO: 781250 - RNA, 24 nt, Human
aagaaaagccucuuuuguugggga

SEQ ID NO: 781251 - RNA, 19 nt, Human
aagcaacucuuccuaaaca

SEQ ID NO: 781252 - RNA, 23 nt, Human
aagcaauaggauuugggggugac

SEQ ID NO: 781253 - RNA, 25 nt, Human
aagcaauaggauuugggggugacuu

SEQ ID NO: 781254 - RNA, 19 nt, Human
aagcugugaucauccaaca

SEQ ID NO: 781255 - RNA, 21 nt, Human
aagggccagagcuacagaacg

SEQ ID NO: 781256 - RNA, 27 nt, Human
aauauucaccguuuggugaccggauac

SEQ ID NO: 781257 - RNA, 20 nt, Human
acacaaauccacaaaaagug

SEQ ID NO: 781258 - RNA, 18 nt, Human
acaccucuuugcacagaa

SEQ ID NO: 781259 - RNA, 22 nt, Human
acagaaccguacagauuucgcu

SEQ ID NO: 781260 - RNA, 18 nt, Human
acagacgaaaccaacaug

SEQ ID NO: 781261 - RNA, 23 nt, Human
acagagcacaaugaaaagcacaa

SEQ ID NO: 781262 - RNA, 25 nt, Human
acagagcacaaugaaaagcacaacc

SEQ ID NO: 781263 - RNA, 25 nt, Human
acauuacagacagacgaaaccaaca

SEQ ID NO: 781264 - RNA, 21 nt, Human
acccacaauggagccgaggaa

SEQ ID NO: 781265 - RNA, 21 nt, Human
acugauauaucacuauaguuu

SEQ ID NO: 781266 - RNA, 23 nt, Human
agaaauguguacuucucacauuu

SEQ ID NO: 781267 - RNA, 18 nt, Human
agacaaagcccagaggcg

SEQ ID NO: 781268 - RNA, 19 nt, Human
agagagauagggcuuucca

SEQ ID NO: 781269 - RNA, 20 nt, Human
agagccauccauuguguggc

SEQ ID NO: 781270 - RNA, 20 nt, Human
agcccauugcaaggaggcag

SEQ ID NO: 781271 - RNA, 26 nt, Human
agccgaggaacaugaucuucaaauau

SEQ ID NO: 781272 - RNA, 21 nt, Human
agcggagagauuuaagacugg

SEQ ID NO: 781273 - RNA, 20 nt, Human
agcuaagcugagcagguacu

SEQ ID NO: 781274 - RNA, 23 nt, Human
aggagacaacuggaaauacuaaa

SEQ ID NO: 781275 - RNA, 24 nt, Human
aggcaagcuuucuucuuuuuuugg

SEQ ID NO: 781276 - RNA, 22 nt, Human
aggcagccgucauuucaucuuc

SEQ ID NO: 781277 - RNA, 21 nt, Human
aucacucucaaauuuaaccca

SEQ ID NO: 781278 - RNA, 24 nt, Human
auccgaggcccggagaugaaggag

SEQ ID NO: 781279 - RNA, 25 nt, Human
augacuaaugugugugugugugugg

SEQ ID NO: 781280 - RNA, 19 nt, Human
augacugccuuuuugcauu

SEQ ID NO: 781281 - RNA, 21 nt, Human
caagauaagcaauaggauuug

SEQ ID NO: 781282 - RNA, 22 nt, Human
caaggagacaaagcccagaggc

SEQ ID NO: 781283 - RNA, 21 nt, Human
caccaaaggcaagcuuucuuc

SEQ ID NO: 781284 - RNA, 20 nt, Human
caccuuauaacacucaaaac

SEQ ID NO: 781285 - RNA, 24 nt, Human
cacuccacuuuggggacccaucuc

SEQ ID NO: 781286 - RNA, 20 nt, Human
cagagagauagggcuuucca

SEQ ID NO: 781287 - RNA, 22 nt, Human
cagcgcgccuggaucguucccu

SEQ ID NO: 781288 - RNA, 20 nt, Human
cagggcccugaaaugggaag

SEQ ID NO: 781289 - RNA, 18 nt, Human
cauagccccaccaaaggc

SEQ ID NO: 781290 - RNA, 21 nt, Human
cauagccccaccaaaggcaag

SEQ ID NO: 781291 - RNA, 23 nt, Human
caucggccaaacccucccgcagc

SEQ ID NO: 781292 - RNA, 24 nt, Human
ccaagccaggucuaaucaaucacg

SEQ ID NO: 781293 - RNA, 20 nt, Human
ccacacagaccgucuggguc

SEQ ID NO: 781294 - RNA, 18 nt, Human
ccagagcuacagaacggg

SEQ ID NO: 781295 - RNA, 18 nt, Human
ccagugauguggcuccaa

SEQ ID NO: 781296 - RNA, 21 nt, Human
ccaugugcugggcaaaaucuc

SEQ ID NO: 781297 - RNA, 19 nt, Human
cccacaauggagccgagga

SEQ ID NO: 781298 - RNA, 21 nt, Human
cccacaauggagccgaggaac

SEQ ID NO: 781299 - RNA, 21 nt, Human
cccuaggucaccaauuuaaaa

SEQ ID NO: 781300 - RNA, 18 nt, Human
ccuccuacaaaugagaau

SEQ ID NO: 781301 - RNA, 18 nt, Human
ccuucucucuuuccuucc

SEQ ID NO: 781302 - RNA, 22 nt, Human
ccuugcuaaaagcucuuucaaa

SEQ ID NO: 781303 - RNA, 19 nt, Human
ccuuucuucccccauucuu

SEQ ID NO: 781304 - RNA, 21 nt, Human
cggccaaacccucccgcagcu

SEQ ID NO: 781305 - RNA, 24 nt, Human
cggggccuugaaauggugaugucc

SEQ ID NO: 781306 - RNA, 24 nt, Human
cgggggaaauaggccacacagacc

SEQ ID NO: 781307 - RNA, 20 nt, Human
cuccaugugcugggcaaaau

SEQ ID NO: 781308 - RNA, 23 nt, Human
cuuaugaaaacuccaaggcagcc

SEQ ID NO: 781309 - RNA, 21 nt, Human
cuucuuuuuuuggcagggccc

SEQ ID NO: 781310 - RNA, 22 nt, Human
cuuuccuucccucuucuauguu

SEQ ID NO: 781311 - RNA, 20 nt, Human
cuuuccuucucucuuuccuu

SEQ ID NO: 781312 - RNA, 26 nt, Human
cuuucuucuuuuuuuggcagggcccu

SEQ ID NO: 781313 - RNA, 23 nt, Human
cuuuguaguuucacagagagccu

SEQ ID NO: 781314 - RNA, 24 nt, Human
gagcacaaugaaaagcacaaccuu

SEQ ID NO: 781315 - RNA, 19 nt, Human
gaggucacucucaaacacu

SEQ ID NO: 781316 - RNA, 24 nt, Human
gcaaaacaccucuuugcacagaac

SEQ ID NO: 781317 - RNA, 19 nt, Human
gcaaugcuccaaggaagcu

SEQ ID NO: 781318 - RNA, 19 nt, Human
gccuggaucguucccuagc

SEQ ID NO: 781319 - RNA, 20 nt, Human
gcuggacaauuuuuaugggg

SEQ ID NO: 781320 - RNA, 22 nt, Human
ggaaaacaccaacgauaagggu

SEQ ID NO: 781321 - RNA, 24 nt, Human
ggaaaacaccaacgauaagggucu

SEQ ID NO: 781322 - RNA, 19 nt, Human
ggagaugaaggagggaaaa

SEQ ID NO: 781323 - RNA, 19 nt, Human
ggaggaaacagaggugaua

SEQ ID NO: 781324 - RNA, 19 nt, Human
ggcuccaaggagacaaagc

SEQ ID NO: 781325 - RNA, 24 nt, Human
ggcuccaaggagacaaagcccaga

SEQ ID NO: 781326 - RNA, 21 nt, Human
gggacaauuucuuaugaaaac

SEQ ID NO: 781327 - RNA, 21 nt, Human
gggcuuuccagggagcaguag

SEQ ID NO: 781328 - RNA, 18 nt, Human
gucagcugcuuccaugac

SEQ ID NO: 781329 - RNA, 26 nt, Human
gucuuaagucagugggacaaaaacau

SEQ ID NO: 781330 - RNA, 20 nt, Human
gugaaaacaccaauaaaagg

SEQ ID NO: 781331 - RNA, 22 nt, Human
gugguugcucagguggggucau

SEQ ID NO: 781332 - RNA, 24 nt, Human
uaaaagcucuuucaaagugaaaac

SEQ ID NO: 781333 - RNA, 23 nt, Human
uaacacguacaagucaaaaguuu

SEQ ID NO: 781334 - RNA, 22 nt, Human
uaacccacaauggagccgagga

SEQ ID NO: 781335 - RNA, 23 nt, Human
uaagaacaagcacagccguuuuc

SEQ ID NO: 781336 - RNA, 24 nt, Human
uaaggagagccauccauugugugg

SEQ ID NO: 781337 - RNA, 20 nt, Human
uaaugugugugugugugugu

SEQ ID NO: 781338 - RNA, 22 nt, Human
uaauguguguguguguguguau

SEQ ID NO: 781339 - RNA, 21 nt, Human
uacagacagacgaaaccaaca

SEQ ID NO: 781340 - RNA, 23 nt, Human
uacuggaauucacauuacagaca

SEQ ID NO: 781341 - RNA, 25 nt, Human
uagaauaacccacaauggagccgaa

SEQ ID NO: 781342 - RNA, 25 nt, Human
uagcggagagauuuaagacuggauu

SEQ ID NO: 781343 - RNA, 20 nt, Human
uagcucuaugaaacaaugaa

SEQ ID NO: 781344 - RNA, 19 nt, Human
uaggaagggaaauagggca

SEQ ID NO: 781345 - RNA, 23 nt, Human
uauauacauuuuucuuuuuuaca

SEQ ID NO: 781346 - RNA, 21 nt, Human
uauauauauauauuuauauac

SEQ ID NO: 781347 - RNA, 19 nt, Human
uauccgaggcccggagaug

SEQ ID NO: 781348 - RNA, 24 nt, Human
uaugaaacaaugaauucggaauga

SEQ ID NO: 781349 - RNA, 27 nt, Human
uaugacuaaugugugugugugugugua

SEQ ID NO: 781350 - RNA, 22 nt, Human
uauguugcugagcggguagggc

SEQ ID NO: 781351 - RNA, 21 nt, Human
uauucuauccuuucuuccccc

SEQ ID NO: 781352 - RNA, 22 nt, Human
ucaaagugaaaacaccaauaaa

SEQ ID NO: 781353 - RNA, 21 nt, Human
ucacagggucagaaguugauc

SEQ ID NO: 781354 - RNA, 24 nt, Human
ucacauuacagacagacgaaacca

SEQ ID NO: 781355 - RNA, 19 nt, Human
ucaccaauuuaaaaugggu

SEQ ID NO: 781356 - RNA, 21 nt, Human
ucacucucaaacacugauaua

SEQ ID NO: 781357 - RNA, 21 nt, Human
uccaaggggcauagccccacc

SEQ ID NO: 781358 - RNA, 21 nt, Human
uccaccuuauaacacucaaaa

SEQ ID NO: 781359 - RNA, 21 nt, Human
uccuaauuucccagaaaaccc

SEQ ID NO: 781360 - RNA, 24 nt, Human
uccuccuacaaaugagaaucucau

SEQ ID NO: 781361 - RNA, 22 nt, Human
ucggccaaacccucccgcagcu

SEQ ID NO: 781362 - RNA, 18 nt, Human
ucuaaaaacacuuuucuu

SEQ ID NO: 781363 - RNA, 19 nt, Human
ucuacguuuccuucucucu

SEQ ID NO: 781364 - RNA, 25 nt, Human
ucucuguaggaaagaaauguugcuu

SEQ ID NO: 781365 - RNA, 19 nt, Human
ucucuuuccuucccucuuc

SEQ ID NO: 781366 - RNA, 26 nt, Human
ucugcauccacauccacagcuguccc

SEQ ID NO: 781367 - RNA, 22 nt, Human
ucuguacugcaauuucaugaag

SEQ ID NO: 781368 - RNA, 24 nt, Human
ucugugggacaucacauccuccua

SEQ ID NO: 781369 - RNA, 20 nt, Human
ucuuuccuucucucuuuccu

SEQ ID NO: 781370 - RNA, 19 nt, Human
ucuuucucucucucuuucc

SEQ ID NO: 781371 - RNA, 20 nt, Human
ugaaaaaugagaagagaaau

SEQ ID NO: 781372 - RNA, 27 nt, Human
ugaaaacaccaauaaaagcuggagacc

SEQ ID NO: 781373 - RNA, 21 nt, Human
ugaaaacuccaaggcagccgu

SEQ ID NO: 781374 - RNA, 23 nt, Human
ugaaaacuccaaggcagccguca

SEQ ID NO: 781375 - RNA, 21 nt, Human
ugaaaagcacaaccuugcuaa

SEQ ID NO: 781376 - RNA, 23 nt, Human
ugaaaagcacaaccuugcuaaaa

SEQ ID NO: 781377 - RNA, 24 nt, Human
ugaaaagcacaaccuugcuaaaag

SEQ ID NO: 781378 - RNA, 23 nt, Human
ugaaaucuuaccaugacaccucu

SEQ ID NO: 781379 - RNA, 23 nt, Human
ugaaguuauccuaauuucccaga

SEQ ID NO: 781380 - RNA, 20 nt, Human
ugacuaaugugugugugugu

SEQ ID NO: 781381 - RNA, 22 nt, Human
ugagaagagaaaugaaaaaaug

SEQ ID NO: 781382 - RNA, 25 nt, Human
ugauaugacuaaugugugugugugu

SEQ ID NO: 781383 - RNA, 24 nt, Human
ugaucuucaaauaucuuuggcuac

SEQ ID NO: 781384 - RNA, 23 nt, Human
ugcaauaauuuuucaaaaaagua

SEQ ID NO: 781385 - RNA, 23 nt, Human
ugcucagguggggucauacauug

SEQ ID NO: 781386 - RNA, 23 nt, Human
uggaaagacaaaucucugauuaa

SEQ ID NO: 781387 - RNA, 21 nt, Human
uggauuucuagaauaacccac

SEQ ID NO: 781388 - RNA, 23 nt, Human
uggcaaaacaccucuuugcacag

SEQ ID NO: 781389 - RNA, 21 nt, Human
uggcagcccauugcaaggagg

SEQ ID NO: 781390 - RNA, 19 nt, Human
ugggacaucacauccuccu

SEQ ID NO: 781391 - RNA, 19 nt, Human
uguacuaaaaucacuuuug

SEQ ID NO: 781392 - RNA, 21 nt, Human
uguagaaauaagauaucauuu

SEQ ID NO: 781393 - RNA, 22 nt, Human
uguaggaaagaaauguugcuuc

SEQ ID NO: 781394 - RNA, 24 nt, Human
uguauauauauauauauuuauaua

SEQ ID NO: 781395 - RNA, 18 nt, Human
uguguauauauauauaua

SEQ ID NO: 781396 - RNA, 19 nt, Human
uguguauauauauauauau

SEQ ID NO: 781397 - RNA, 19 nt, Human
uguguauauauauauauau

SEQ ID NO: 781398 - RNA, 24 nt, Human
uguguauauauauauauauuuaua

SEQ ID NO: 781399 - RNA, 18 nt, Human
uguguguguauauauaua

SEQ ID NO: 781400 - RNA, 18 nt, Human
uguguguguauauauaua

SEQ ID NO: 781401 - RNA, 24 nt, Human
uguguguguauauauauauauauu

SEQ ID NO: 781402 - RNA, 23 nt, Human
uguguguguguauauauauauau

SEQ ID NO: 781403 - RNA, 23 nt, Human
uguguguguguguauauauauau

SEQ ID NO: 781404 - RNA, 20 nt, Human
uguguguguguguguauaaa

SEQ ID NO: 781405 - RNA, 21 nt, Human
uguguguguguguguauauaa

SEQ ID NO: 781406 - RNA, 22 nt, Human
uguguguguguguguguauaua

SEQ ID NO: 781407 - RNA, 20 nt, Human
uuccugaaaaaugagaagag

SEQ ID NO: 781408 - RNA, 20 nt, Human
uuccuucucucuuuccuucc

SEQ ID NO: 781409 - RNA, 21 nt, Human
uucucacauuucacaggguca

SEQ ID NO: 781410 - RNA, 28 nt, Human
uucucauagaacucuaugaagauucuau

SEQ ID NO: 781411 - RNA, 22 nt, Human
uugcaaggaggcagcccucccu

SEQ ID NO: 781412 - RNA, 22 nt, Human
uuggggaggaaacagaggugau

SEQ ID NO: 781413 - RNA, 23 nt, Human
uuucacauauuuauauacagaga

SEQ ID NO: 781414 - RNA, 22 nt, Human
uuucagaagugucagcugcuuc

SEQ ID NO: 781415 - RNA, 20 nt, Human
uuuccauguagaaauaagau

SEQ ID NO: 781416 - RNA, 21 nt, Human
uuucuucuuuuuuuggcaggg

SEQ ID NO: 781417 - RNA, 19 nt, Human
uuuguuggggaggaaacag

SEQ ID NO: 781418 - RNA, 21 nt, Human
uuuuauggggaauguccacuu

SEQ ID NO: 781419 - RNA, 19 nt, Human
uuuuuuggcagggcccuga

SEQ ID NO: 781420 - RNA, 22 nt, Human
aaaaaacaaaacagaaagaaca

SEQ ID NO: 781421 - RNA, 23 nt, Human
aaaaaacaaaacagaaagaacac

SEQ ID NO: 781422 - RNA, 25 nt, Human
aaaaaacaaaacagaaagaacaccc

SEQ ID NO: 781423 - RNA, 23 nt, Human
aaaacaaaacagaaagaacaccc

SEQ ID NO: 781424 - RNA, 24 nt, Human
aaacaaaaguuuagauauuuuagc

SEQ ID NO: 781425 - RNA, 24 nt, Human
aaacacacaaaaaaugucucccca

SEQ ID NO: 781426 - RNA, 18 nt, Human
aaacagaaagaacacccc

SEQ ID NO: 781427 - RNA, 19 nt, Human
aaacagaaagcuacaugca

SEQ ID NO: 781428 - RNA, 18 nt, Human
aaagaacaccccaacacc

SEQ ID NO: 781429 - RNA, 25 nt, Human
aaagauuuguaagaaucuagcaaau

SEQ ID NO: 781430 - RNA, 25 nt, Human
aaaggaauguuggagccaaaagaaa

SEQ ID NO: 781431 - RNA, 23 nt, Human
aaaguaaaaaacaaaacagaaag

SEQ ID NO: 781432 - RNA, 20 nt, Human
aaaugucuccccaaaguccc

SEQ ID NO: 781433 - RNA, 20 nt, Human
aacaaagcuagcugcacaua

SEQ ID NO: 781434 - RNA, 20 nt, Human
aacaccuaagcucccuugcu

SEQ ID NO: 781435 - RNA, 23 nt, Human
aacuucuuuauauacuucagcau

SEQ ID NO: 781436 - RNA, 18 nt, Human
aagaacaccccaacacca

SEQ ID NO: 781437 - RNA, 23 nt, Human
aagauagauuguuacagcagcua

SEQ ID NO: 781438 - RNA, 24 nt, Human
aaggaacagaugcaaagcugcaug

SEQ ID NO: 781439 - RNA, 24 nt, Human
aauacaaagaaccauuaugaaucu

SEQ ID NO: 781440 - RNA, 19 nt, Human
aaucacauuuaagccacug

SEQ ID NO: 781441 - RNA, 19 nt, Human
aaugugcauacaguacaag

SEQ ID NO: 781442 - RNA, 20 nt, Human
acaaaacagaaagaacaccc

SEQ ID NO: 781443 - RNA, 23 nt, Human
acaaaacagaaagaacaccccaa

SEQ ID NO: 781444 - RNA, 23 nt, Human
acacaaaaaaugucuccccaaag

SEQ ID NO: 781445 - RNA, 18 nt, Human
acaccccaacaccaagua

SEQ ID NO: 781446 - RNA, 25 nt, Human
acuaagcaccagccucuugugguua

SEQ ID NO: 781447 - RNA, 23 nt, Human
acugacuuuccuuugagcaaugu

SEQ ID NO: 781448 - RNA, 24 nt, Human
agcaagaaucaccuugcaggacca

SEQ ID NO: 781449 - RNA, 21 nt, Human
agcauaaucaaucaaucacag

SEQ ID NO: 781450 - RNA, 23 nt, Human
aggaaagaagaguacuaaaugaa

SEQ ID NO: 781451 - RNA, 21 nt, Human
aggaggaaagaagaguacuaa

SEQ ID NO: 781452 - RNA, 20 nt, Human
auaaagguucuaaaaugaag

SEQ ID NO: 781453 - RNA, 20 nt, Human
auacaguuuaccuggcauaa

SEQ ID NO: 781454 - RNA, 21 nt, Human
auauauuugaacaauaagaua

SEQ ID NO: 781455 - RNA, 27 nt, Human
caaaacaaaauuaaaguaaaaaacaaa

SEQ ID NO: 781456 - RNA, 24 nt, Human
caaaacagaaagaacaccccaaca

SEQ ID NO: 781457 - RNA, 25 nt, Human
caaaacagaaagaacaccccaacac

SEQ ID NO: 781458 - RNA, 24 nt, Human
caaacugguaaagcaaugugaaca

SEQ ID NO: 781459 - RNA, 22 nt, Human
caagaauaagggcuuuucccaa

SEQ ID NO: 781460 - RNA, 26 nt, Human
caagcuaaaaggaauguuggagccaa

SEQ ID NO: 781461 - RNA, 21 nt, Human
cacaaaaaaugucuccccaaa

SEQ ID NO: 781462 - RNA, 24 nt, Human
cacauaguucaaauacaguuuacc

SEQ ID NO: 781463 - RNA, 18 nt, Human
caccacaugaauauaugu

SEQ ID NO: 781464 - RNA, 22 nt, Human
cauuacagacaugguaaacuuc

SEQ ID NO: 781465 - RNA, 27 nt, Human
cauuaugaaucuuucauuaaacugaag

SEQ ID NO: 781466 - RNA, 23 nt, Human
ccaaacccucaccuacccccgcc

SEQ ID NO: 781467 - RNA, 23 nt, Human
ccaagcagauuaaaacaaagcua

SEQ ID NO: 781468 - RNA, 23 nt, Human
ccaaugcuaaauucauacucuaa

SEQ ID NO: 781469 - RNA, 23 nt, Human
ccauuuuugagagaauauaaaac

SEQ ID NO: 781470 - RNA, 22 nt, Human
ccccgccaaaaaaaaaaaaaaa

SEQ ID NO: 781471 - RNA, 22 nt, Human
cccgccaaaaaaaaaaaaaaaa

SEQ ID NO: 781472 - RNA, 20 nt, Human
ccuacccccgccaaaaaaaa

SEQ ID NO: 781473 - RNA, 31 nt, Human
ccuacccccgccaaaaaaaaaaaaaaaaaaa

SEQ ID NO: 781474 - RNA, 19 nt, Human
cgccaaaaaaaaaaaaaaa

SEQ ID NO: 781475 - RNA, 24 nt, Human
cgccaaaaaaaaaaaaaaaaaauc

SEQ ID NO: 781476 - RNA, 22 nt, Human
cguggguauaaaaacccaaaag

SEQ ID NO: 781477 - RNA, 24 nt, Human
cuagauagauagauaucuaaauca

SEQ ID NO: 781478 - RNA, 25 nt, Human
cucacacaaacauacaaucacaaau

SEQ ID NO: 781479 - RNA, 19 nt, Human
cucaccuacccccgccaaa

SEQ ID NO: 781480 - RNA, 21 nt, Human
cugaagcucacacaaacauac

SEQ ID NO: 781481 - RNA, 20 nt, Human
cugagcuuuccucuaguucc

SEQ ID NO: 781482 - RNA, 22 nt, Human
gaaaaaaaaaaaacagcauuug

SEQ ID NO: 781483 - RNA, 20 nt, Human
gaacagaugcaaagcugcau

SEQ ID NO: 781484 - RNA, 18 nt, Human
gaccauguggcauaggau

SEQ ID NO: 781485 - RNA, 20 nt, Human
gcaccuaaaagacuaauccc

SEQ ID NO: 781486 - RNA, 27 nt, Human
gccaaaaaaaaaaaaaaaaaaucaaaa

SEQ ID NO: 781487 - RNA, 22 nt, Human
gcuggaaugcagaauccuaccg

SEQ ID NO: 781488 - RNA, 23 nt, Human
ggaaaaucaacuauuuaaaccac

SEQ ID NO: 781489 - RNA, 18 nt, Human
ggagucccauauucuccu

SEQ ID NO: 781490 - RNA, 27 nt, Human
uaaaaaacaaaacagaaagaacacccc

SEQ ID NO: 781491 - RNA, 21 nt, Human
uaaaaaaugauucaguuaaaa

SEQ ID NO: 781492 - RNA, 28 nt, Human
uaaaauaggaaaaucaacuauuuaaacc

SEQ ID NO: 781493 - RNA, 21 nt, Human
uaaaguaaaaaacaaaacaga

SEQ ID NO: 781494 - RNA, 20 nt, Human
uaagcaccagccucuugugg

SEQ ID NO: 781495 - RNA, 23 nt, Human
uaagcauaaucaaucaaucacag

SEQ ID NO: 781496 - RNA, 27 nt, Human
uaauaauacaaagaaccauuaugaauc

SEQ ID NO: 781497 - RNA, 19 nt, Human
uaauucagugcccaaugcu

SEQ ID NO: 781498 - RNA, 18 nt, Human
uagcaagaaucaccuugc

SEQ ID NO: 781499 - RNA, 21 nt, Human
uagcaagaaucaccuugcagg

SEQ ID NO: 781500 - RNA, 23 nt, Human
uauaaaaacccaaaagugaacua

SEQ ID NO: 781501 - RNA, 20 nt, Human
uauauaccaaaauucauaug

SEQ ID NO: 781502 - RNA, 23 nt, Human
ucaaucaggcauuuauuuuaaaa

SEQ ID NO: 781503 - RNA, 18 nt, Human
ucagcauaaccuacuugc

SEQ ID NO: 781504 - RNA, 22 nt, Human
ucaggcaccaacagcauaucuu

SEQ ID NO: 781505 - RNA, 20 nt, Human
ucaguuaaaacaaaacaaaa

SEQ ID NO: 781506 - RNA, 21 nt, Human
ucguaaucaacagugauuacu

SEQ ID NO: 781507 - RNA, 18 nt, Human
ucuccucucuuuaucaca

SEQ ID NO: 781508 - RNA, 21 nt, Human
ugaaaaaaaaaaaacagcauu

SEQ ID NO: 781509 - RNA, 21 nt, Human
ugacacaccacuguugacaau

SEQ ID NO: 781510 - RNA, 18 nt, Human
ugaccuccaacaaacaca

SEQ ID NO: 781511 - RNA, 19 nt, Human
ugacuuguuuguuuguuaa

SEQ ID NO: 781512 - RNA, 18 nt, Human
ugaggacuguccuaauuc

SEQ ID NO: 781513 - RNA, 22 nt, Human
ugauugauauauaccaaaauuc

SEQ ID NO: 781514 - RNA, 19 nt, Human
ugcauagccacagaaguuu

SEQ ID NO: 781515 - RNA, 19 nt, Human
ugccaagcagauuaaaaca

SEQ ID NO: 781516 - RNA, 25 nt, Human
uggaaaaaauucacacugcaucuag

SEQ ID NO: 781517 - RNA, 22 nt, Human
uggaaugcagaauccuaccgug

SEQ ID NO: 781518 - RNA, 22 nt, Human
uggcuugcacuucucacaaauc

SEQ ID NO: 781519 - RNA, 19 nt, Human
ugugaaaagucuuaaucaa

SEQ ID NO: 781520 - RNA, 21 nt, Human
uuaaaacaaaacaaaaguuua

SEQ ID NO: 781521 - RNA, 21 nt, Human
uucaguaguuuaggcugcagg

SEQ ID NO: 781522 - RNA, 21 nt, Human
uucuaaauugacacuucaugu

SEQ ID NO: 781523 - RNA, 22 nt, Human
uucucguaaucaacagugauua

SEQ ID NO: 781524 - RNA, 21 nt, Human
uuggcacaagaugaucaagug

SEQ ID NO: 781525 - RNA, 24 nt, Human
aaacacaguucucucacuccacac

SEQ ID NO: 781526 - RNA, 22 nt, Human
aaacacccacggggcagcuccu

SEQ ID NO: 781527 - RNA, 19 nt, Human
aaaccgcccuccaccucac

SEQ ID NO: 781528 - RNA, 20 nt, Human
aaagccguuuccucucuagg

SEQ ID NO: 781529 - RNA, 24 nt, Human
aacagaaucuccaaacacccacgg

SEQ ID NO: 781530 - RNA, 19 nt, Human
aaccccugccugccaccuc

SEQ ID NO: 781531 - RNA, 18 nt, Human
aacccucucagcaccaaa

SEQ ID NO: 781532 - RNA, 23 nt, Human
aaccuuccggcgacacccuccag

SEQ ID NO: 781533 - RNA, 22 nt, Human
aaggggccggccuggagccugc

SEQ ID NO: 781534 - RNA, 18 nt, Human
aaucauuuccccuucugg

SEQ ID NO: 781535 - RNA, 18 nt, Human
acaagauguugggcugga

SEQ ID NO: 781536 - RNA, 23 nt, Human
acaagcugcgcuuuucccaaagc

SEQ ID NO: 781537 - RNA, 18 nt, Human
acacagcacgcucucucu

SEQ ID NO: 781538 - RNA, 21 nt, Human
acagagucugucugcuuaaaa

SEQ ID NO: 781539 - RNA, 25 nt, Human
accaaaugcuucugacacaggcccc

SEQ ID NO: 781540 - RNA, 19 nt, Human
acccugugccugcaaacag

SEQ ID NO: 781541 - RNA, 19 nt, Human
accuccaccccucucacca

SEQ ID NO: 781542 - RNA, 25 nt, Human
accucuggguugccccucacucccu

SEQ ID NO: 781543 - RNA, 22 nt, Human
acggggcagcuccuccaccucc

SEQ ID NO: 781544 - RNA, 25 nt, Human
acuccacaccucuaggccaaacaga

SEQ ID NO: 781545 - RNA, 19 nt, Human
agaaagaugccauggcccu

SEQ ID NO: 781546 - RNA, 26 nt, Human
agaaccccugccugccaccuccaccc

SEQ ID NO: 781547 - RNA, 20 nt, Human
agaagggaggagguggaggg

SEQ ID NO: 781548 - RNA, 22 nt, Human
agacagacaauccacacugugg

SEQ ID NO: 781549 - RNA, 18 nt, Human
agacagguccacagugug

SEQ ID NO: 781550 - RNA, 24 nt, Human
agagagaaagugaaagggugaggg

SEQ ID NO: 781551 - RNA, 24 nt, Human
agaggaacaggagggguggacaga

SEQ ID NO: 781552 - RNA, 20 nt, Human
agcagggacaccauggcccc

SEQ ID NO: 781553 - RNA, 22 nt, Human
agccuguguccucaccccaggg

SEQ ID NO: 781554 - RNA, 20 nt, Human
agcgccccaagccaagaccc

SEQ ID NO: 781555 - RNA, 19 nt, Human
agcuugcagcagccccacu

SEQ ID NO: 781556 - RNA, 24 nt, Human
aggacacagacaucuacagcauca

SEQ ID NO: 781557 - RNA, 22 nt, Human
aggagggguggacagaaaacuu

SEQ ID NO: 781558 - RNA, 19 nt, Human
aggcaccugcaggacucug

SEQ ID NO: 781559 - RNA, 21 nt, Human
aggcgaugacugagccagagg

SEQ ID NO: 781560 - RNA, 23 nt, Human
agggaggagguggagggggggac

SEQ ID NO: 781561 - RNA, 23 nt, Human
agggcgcugcagaagggaggagg

SEQ ID NO: 781562 - RNA, 21 nt, Human
aggguggcagcggcucugagc

SEQ ID NO: 781563 - RNA, 21 nt, Human
aguggcaggggacugacccgg

SEQ ID NO: 781564 - RNA, 25 nt, Human
auaaaggcuucccccucccucccca

SEQ ID NO: 781565 - RNA, 21 nt, Human
aucccaugcucgcccuugcag

SEQ ID NO: 781566 - RNA, 24 nt, Human
augcuuccaacggcaaaggcacag

SEQ ID NO: 781567 - RNA, 22 nt, Human
auguuucugacaagaaucaugg

SEQ ID NO: 781568 - RNA, 19 nt, Human
caaaggcacagacuagagg

SEQ ID NO: 781569 - RNA, 20 nt, Human
caaaggcacagacuagaggc

SEQ ID NO: 781570 - RNA, 20 nt, Human
caacggcaaaggcacagacu

SEQ ID NO: 781571 - RNA, 21 nt, Human
caagaguggguggugguggag

SEQ ID NO: 781572 - RNA, 22 nt, Human
caagauguugggcuggaggggu

SEQ ID NO: 781573 - RNA, 23 nt, Human
cacagccccaccugcuugcccuc

SEQ ID NO: 781574 - RNA, 22 nt, Human
cacagcuacucagcacagcuga

SEQ ID NO: 781575 - RNA, 20 nt, Human
caccacuuaguagggguuca

SEQ ID NO: 781576 - RNA, 25 nt, Human
caccauggccccagaaagggagcgg

SEQ ID NO: 781577 - RNA, 20 nt, Human
cacccucagcgccccaagcc

SEQ ID NO: 781578 - RNA, 25 nt, Human
caccgagugcacugaggagcucacu

SEQ ID NO: 781579 - RNA, 18 nt, Human
cacgaagagcccaagcca

SEQ ID NO: 781580 - RNA, 22 nt, Human
cacuccacaccucuaggccaaa

SEQ ID NO: 781581 - RNA, 19 nt, Human
cagaagccuaagaugagaa

SEQ ID NO: 781582 - RNA, 18 nt, Human
cagaaucuccaaacaccc

SEQ ID NO: 781583 - RNA, 20 nt, Human
cagagucugucugcuuaaaa

SEQ ID NO: 781584 - RNA, 19 nt, Human
cagcaggacagugcagcaa

SEQ ID NO: 781585 - RNA, 19 nt, Human
cagccccaccugcuugccc

SEQ ID NO: 781586 - RNA, 19 nt, Human
cagcuccaagagugggugg

SEQ ID NO: 781587 - RNA, 22 nt, Human
cagcugccagcacaaguagcac

SEQ ID NO: 781588 - RNA, 21 nt, Human
cagcugguuuggcugcaaggg

SEQ ID NO: 781589 - RNA, 22 nt, Human
caggcagcagggugccuuccuc

SEQ ID NO: 781590 - RNA, 22 nt, Human
caguggccuuggccccaggcuc

SEQ ID NO: 781591 - RNA, 24 nt, Human
caguuucucuccaaccacaaaaca

SEQ ID NO: 781592 - RNA, 19 nt, Human
ccaaaggaaaacagggaca

SEQ ID NO: 781593 - RNA, 18 nt, Human
ccaacggcaaaggcacag

SEQ ID NO: 781594 - RNA, 22 nt, Human
ccacacagacucauacccacaa

SEQ ID NO: 781595 - RNA, 23 nt, Human
ccacacagacucauacccacaaa

SEQ ID NO: 781596 - RNA, 19 nt, Human
ccacccucagcgccccaag

SEQ ID NO: 781597 - RNA, 24 nt, Human
ccacguugccacuugcagucuugu

SEQ ID NO: 781598 - RNA, 22 nt, Human
ccagaaagggagcggguggcug

SEQ ID NO: 781599 - RNA, 23 nt, Human
ccagccagucucaggaugggggc

SEQ ID NO: 781600 - RNA, 20 nt, Human
ccaggcucagacaugacacc

SEQ ID NO: 781601 - RNA, 19 nt, Human
ccauggaugcacgcagagg

SEQ ID NO: 781602 - RNA, 22 nt, Human
ccaugugcucacugaaccacag

SEQ ID NO: 781603 - RNA, 22 nt, Human
cccaaaaggcagagaaaaugaa

SEQ ID NO: 781604 - RNA, 22 nt, Human
cccacccucagcgccccaagcc

SEQ ID NO: 781605 - RNA, 21 nt, Human
cccagccagucucaggauggg

SEQ ID NO: 781606 - RNA, 24 nt, Human
cccaggucuuugcugaagggaccc

SEQ ID NO: 781607 - RNA, 20 nt, Human
ccccaaagccguuuccucuc

SEQ ID NO: 781608 - RNA, 21 nt, Human
ccccaaagccguuuccucucu

SEQ ID NO: 781609 - RNA, 19 nt, Human
ccccaagccaagacccagc

SEQ ID NO: 781610 - RNA, 23 nt, Human
ccccaggggcaugucugcugggg

SEQ ID NO: 781611 - RNA, 22 nt, Human
cccccauuucaaaaaaacaagg

SEQ ID NO: 781612 - RNA, 27 nt, Human
ccccccuguggcugcccuaguaggcaa

SEQ ID NO: 781613 - RNA, 19 nt, Human
cccccucucucugccuggg

SEQ ID NO: 781614 - RNA, 19 nt, Human
ccccucccuccccaaagcc

SEQ ID NO: 781615 - RNA, 19 nt, Human
ccccucccuccccaaagcc

SEQ ID NO: 781616 - RNA, 18 nt, Human
cccucagcgccccaagcc

SEQ ID NO: 781617 - RNA, 21 nt, Human
cccucagcgccccaagccaag

SEQ ID NO: 781618 - RNA, 19 nt, Human
cccuggugcccagccaguc

SEQ ID NO: 781619 - RNA, 20 nt, Human
ccuccaccccucucaccaaa

SEQ ID NO: 781620 - RNA, 20 nt, Human
ccugcaggcucuagggccaa

SEQ ID NO: 781621 - RNA, 19 nt, Human
ccugccugccaccuccacc

SEQ ID NO: 781622 - RNA, 22 nt, Human
ccugcuugcccucagcccccug

SEQ ID NO: 781623 - RNA, 19 nt, Human
ccugugccugcaaacagag

SEQ ID NO: 781624 - RNA, 21 nt, Human
cgccagggacuuaggacagcg

SEQ ID NO: 781625 - RNA, 19 nt, Human
cgcccuugcagaagccuaa

SEQ ID NO: 781626 - RNA, 23 nt, Human
cuccagcccccaccagacagguc

SEQ ID NO: 781627 - RNA, 20 nt, Human
cucccaaaaggcagagaaaa

SEQ ID NO: 781628 - RNA, 23 nt, Human
cuccuaggaugacuggacuacag

SEQ ID NO: 781629 - RNA, 20 nt, Human
cuccuccucagaaaagaagc

SEQ ID NO: 781630 - RNA, 25 nt, Human
cuccuuacagacagacaauccacac

SEQ ID NO: 781631 - RNA, 22 nt, Human
cucuggguuagcuucccuggca

SEQ ID NO: 781632 - RNA, 19 nt, Human
cugagagauggaaacuggg

SEQ ID NO: 781633 - RNA, 21 nt, Human
cugccugccaccuccaccccu

SEQ ID NO: 781634 - RNA, 18 nt, Human
cugcggaaacacucauga

SEQ ID NO: 781635 - RNA, 18 nt, Human
cuggagcugucugugacc

SEQ ID NO: 781636 - RNA, 20 nt, Human
cuggaggggugggggucaug

SEQ ID NO: 781637 - RNA, 19 nt, Human
cuggaugaaaacccccacu

SEQ ID NO: 781638 - RNA, 18 nt, Human
cuuggaggaguaggaggg

SEQ ID NO: 781639 - RNA, 22 nt, Human
cuuggccccaggcucuggugac

SEQ ID NO: 781640 - RNA, 25 nt, Human
gaaacccucucagcaccaaaugcuu

SEQ ID NO: 781641 - RNA, 21 nt, Human
gaagccuaagaugagaaccaa

SEQ ID NO: 781642 - RNA, 18 nt, Human
gacaauaaauccagagca

SEQ ID NO: 781643 - RNA, 21 nt, Human
gagacaucccaugcucgcccu

SEQ ID NO: 781644 - RNA, 20 nt, Human
gaggcuccagcccccaccag

SEQ ID NO: 781645 - RNA, 23 nt, Human
gaguugccagccucacaucugcu

SEQ ID NO: 781646 - RNA, 28 nt, Human
gcacagcuccaagaguggggggaacgcc

SEQ ID NO: 781647 - RNA, 21 nt, Human
gcagagccgggcagaacacca

SEQ ID NO: 781648 - RNA, 27 nt, Human
gcagaggaacaggagggguggacagaa

SEQ ID NO: 781649 - RNA, 21 nt, Human
gcagcugcuuccaacuggguu

SEQ ID NO: 781650 - RNA, 20 nt, Human
gccaccuccaccccucucac

SEQ ID NO: 781651 - RNA, 24 nt, Human
gccaggaagauuccgggugcuucc

SEQ ID NO: 781652 - RNA, 22 nt, Human
gccccaccugcuugcccucagc

SEQ ID NO: 781653 - RNA, 21 nt, Human
gcgccccaagccaagacccag

SEQ ID NO: 781654 - RNA, 18 nt, Human
gcucccagggcagcugcu

SEQ ID NO: 781655 - RNA, 23 nt, Human
gcucuggguuagcuucccuggca

SEQ ID NO: 781656 - RNA, 22 nt, Human
ggaaacacucaugagcacaggu

SEQ ID NO: 781657 - RNA, 26 nt, Human
ggaacgugcacucccacaguuccuuc

SEQ ID NO: 781658 - RNA, 20 nt, Human
ggaauggugaggaggggcug

SEQ ID NO: 781659 - RNA, 22 nt, Human
ggagggguggacagaaaacugg

SEQ ID NO: 781660 - RNA, 19 nt, Human
ggauucugucagaacgagg

SEQ ID NO: 781661 - RNA, 24 nt, Human
ggcacggcugugaacaucagcagg

SEQ ID NO: 781662 - RNA, 21 nt, Human
gggaaacacgaagagcccaag

SEQ ID NO: 781663 - RNA, 22 nt, Human
gggaaccccccuguggcugccc

SEQ ID NO: 781664 - RNA, 18 nt, Human
gggaauggugaggagggg

SEQ ID NO: 781665 - RNA, 19 nt, Human
gggcaggcugaaaccuucc

SEQ ID NO: 781666 - RNA, 19 nt, Human
gggcaggggaguugccagc

SEQ ID NO: 781667 - RNA, 19 nt, Human
ggggcccccucucucugcc

SEQ ID NO: 781668 - RNA, 22 nt, Human
gguccacaguguggcagguccc

SEQ ID NO: 781669 - RNA, 18 nt, Human
gguugccccucacucccc

SEQ ID NO: 781670 - RNA, 20 nt, Human
gguuucacuacugugaggca

SEQ ID NO: 781671 - RNA, 21 nt, Human
gucccuggggaaccccccugu

SEQ ID NO: 781672 - RNA, 19 nt, Human
gugcaggcagcagggugcc

SEQ ID NO: 781673 - RNA, 19 nt, Human
uaaaacagaaucuccaaac

SEQ ID NO: 781674 - RNA, 23 nt, Human
uaaaagcauacuacuuuugcuuc

SEQ ID NO: 781675 - RNA, 22 nt, Human
uaaacaaaucucuggaugaaaa

SEQ ID NO: 781676 - RNA, 23 nt, Human
uaagaugagaaccaacuccuccu

SEQ ID NO: 781677 - RNA, 22 nt, Human
uaauucuguuccuuggaggagu

SEQ ID NO: 781678 - RNA, 27 nt, Human
uacagaaccacgagcuuuacuuacaag

SEQ ID NO: 781679 - RNA, 20 nt, Human
uaccaaguuaccucgugcuu

SEQ ID NO: 781680 - RNA, 22 nt, Human
uaccaaguuaccucgugcuucc

SEQ ID NO: 781681 - RNA, 22 nt, Human
uaucgagaaaaagcugagugac

SEQ ID NO: 781682 - RNA, 20 nt, Human
ucacagugauacacacgcuu

SEQ ID NO: 781683 - RNA, 21 nt, Human
ucagcaggacagugcagcaag

SEQ ID NO: 781684 - RNA, 21 nt, Human
uccaaguacgacaauaaaucc

SEQ ID NO: 781685 - RNA, 22 nt, Human
uccacacguggagacacaggau

SEQ ID NO: 781686 - RNA, 20 nt, Human
ucccaggcucccagggcagc

SEQ ID NO: 781687 - RNA, 20 nt, Human
ucccaugcucgcccuugcag

SEQ ID NO: 781688 - RNA, 19 nt, Human
ucccccucccuccccaaag

SEQ ID NO: 781689 - RNA, 25 nt, Human
ucucacuccacaccucuaggccaaa

SEQ ID NO: 781690 - RNA, 19 nt, Human
ucuccaaccacaaaacaca

SEQ ID NO: 781691 - RNA, 19 nt, Human
ucugcaaaaccgcccucca

SEQ ID NO: 781692 - RNA, 22 nt, Human
ucugcaaaaccgcccuccaccu

SEQ ID NO: 781693 - RNA, 22 nt, Human
ucugccaagcggagcucagccu

SEQ ID NO: 781694 - RNA, 23 nt, Human
ucugcuuaaaaugaaacuagguc

SEQ ID NO: 781695 - RNA, 23 nt, Human
ucugugaccaagcagagccgggc

SEQ ID NO: 781696 - RNA, 18 nt, Human
ucuucuauccuucuuauu

SEQ ID NO: 781697 - RNA, 23 nt, Human
ugaaaacccccacuugaaaucca

SEQ ID NO: 781698 - RNA, 25 nt, Human
ugacaugccacugacacacagcagg

SEQ ID NO: 781699 - RNA, 23 nt, Human
ugacgguaacagcaaggacaggg

SEQ ID NO: 781700 - RNA, 21 nt, Human
ugacuccugucuccaaaucuc

SEQ ID NO: 781701 - RNA, 21 nt, Human
ugagccagagggggagauagc

SEQ ID NO: 781702 - RNA, 23 nt, Human
ugaggagaaccccugccugccac

SEQ ID NO: 781703 - RNA, 20 nt, Human
ugccucucagcuuuucuugu

SEQ ID NO: 781704 - RNA, 21 nt, Human
ugccugggggauucugucaga

SEQ ID NO: 781705 - RNA, 21 nt, Human
ugcgcagacagucucugcacg

SEQ ID NO: 781706 - RNA, 23 nt, Human
ugcucacugaaccacagugacau

SEQ ID NO: 781707 - RNA, 22 nt, Human
ugcugcugauccacacguggag

SEQ ID NO: 781708 - RNA, 20 nt, Human
ugcuggguggggcgcagggc

SEQ ID NO: 781709 - RNA, 20 nt, Human
ugcuuccacguugccacuug

SEQ ID NO: 781710 - RNA, 22 nt, Human
uggaaacugggcugugcacaag

SEQ ID NO: 781711 - RNA, 18 nt, Human
uggaggccaagaggaggg

SEQ ID NO: 781712 - RNA, 20 nt, Human
uggaggccaagaggagggga

SEQ ID NO: 781713 - RNA, 21 nt, Human
uggaggccaagaggaggggag

SEQ ID NO: 781714 - RNA, 21 nt, Human
uggcaggggacugacccggug

SEQ ID NO: 781715 - RNA, 28 nt, Human
uggccacacagacucauacccacaaaca

SEQ ID NO: 781716 - RNA, 21 nt, Human
uggccccagaaagggagcggg

SEQ ID NO: 781717 - RNA, 22 nt, Human
uggcugggagaucagacuccag

SEQ ID NO: 781718 - RNA, 18 nt, Human
ugggcuggaggggugggg

SEQ ID NO: 781719 - RNA, 20 nt, Human
ugggcuggaggggugggggu

SEQ ID NO: 781720 - RNA, 26 nt, Human
ugggugggcccugagagauggaaacu

SEQ ID NO: 781721 - RNA, 20 nt, Human
uuccagaaucugcagucacc

SEQ ID NO: 781722 - RNA, 21 nt, Human
uuccagaaucugcagucacca

SEQ ID NO: 781723 - RNA, 19 nt, Human
uuccuauccuugcagcugc

SEQ ID NO: 781724 - RNA, 19 nt, Human
uugaaccucauaaacacug

SEQ ID NO: 781725 - RNA, 20 nt, Human
uugcuggagcugucugugac

SEQ ID NO: 781726 - RNA, 26 nt, Human
uugcuguuguuguuccccaccucugg

SEQ ID NO: 781727 - RNA, 20 nt, Human
aaacgagacucggguacccc

SEQ ID NO: 781728 - RNA, 19 nt, Human
aaagcugugaggcaggagg

SEQ ID NO: 781729 - RNA, 22 nt, Human
aaagcugugaggcaggaggguc

SEQ ID NO: 781730 - RNA, 24 nt, Human
aaagugcugggauuacaggcguga

SEQ ID NO: 781731 - RNA, 18 nt, Human
aacagugggugagcuugg

SEQ ID NO: 781732 - RNA, 19 nt, Human
aacccauaaggauaccccc

SEQ ID NO: 781733 - RNA, 20 nt, Human
aaccuggcugcugggagugg

SEQ ID NO: 781734 - RNA, 18 nt, Human
aacggaacagaugggugg

SEQ ID NO: 781735 - RNA, 20 nt, Human
aagacgacaggugcaccacc

SEQ ID NO: 781736 - RNA, 19 nt, Human
aagauugguggugggggau

SEQ ID NO: 781737 - RNA, 20 nt, Human
aagauugguggugggggaug

SEQ ID NO: 781738 - RNA, 19 nt, Human
aagccaaggacggggaccc

SEQ ID NO: 781739 - RNA, 24 nt, Human
aagcuucugggcucaagugauccu

SEQ ID NO: 781740 - RNA, 20 nt, Human
aaggauacccccaauccacc

SEQ ID NO: 781741 - RNA, 24 nt, Human
aaggcacaagauaaaguaaggggc

SEQ ID NO: 781742 - RNA, 25 nt, Human
aagugauccucccaccucagccucc

SEQ ID NO: 781743 - RNA, 19 nt, Human
aagugcugggauuacaggc

SEQ ID NO: 781744 - RNA, 19 nt, Human
aagugcugggauuacaggc

SEQ ID NO: 781745 - RNA, 26 nt, Human
aagugcugggauuacaggcgugagcc

SEQ ID NO: 781746 - RNA, 19 nt, Human
aauagcugggauuacagac

SEQ ID NO: 781747 - RNA, 23 nt, Human
acaggagaggcauucccaagcac

SEQ ID NO: 781748 - RNA, 23 nt, Human
acaggucuuccucaggccugaca

SEQ ID NO: 781749 - RNA, 19 nt, Human
acaggugcaccaccacgcc

SEQ ID NO: 781750 - RNA, 21 nt, Human
acagugagcccagccccugau

SEQ ID NO: 781751 - RNA, 20 nt, Human
acauauauccaacccuuggu

SEQ ID NO: 781752 - RNA, 18 nt, Human
accacucugucgcccagg

SEQ ID NO: 781753 - RNA, 19 nt, Human
acccacacaaggcaccgug

SEQ ID NO: 781754 - RNA, 24 nt, Human
acccuguuggccaggcuggucuug

SEQ ID NO: 781755 - RNA, 25 nt, Human
acccuguuggccaggcuggucuuga

SEQ ID NO: 781756 - RNA, 20 nt, Human
accucagccucccaaguagc

SEQ ID NO: 781757 - RNA, 18 nt, Human
acgggguuucacccuguu

SEQ ID NO: 781758 - RNA, 20 nt, Human
acgggguuucacccuguugg

SEQ ID NO: 781759 - RNA, 24 nt, Human
acgggguuucacccuguuggccag

SEQ ID NO: 781760 - RNA, 19 nt, Human
acucugucgcccaggcugg

SEQ ID NO: 781761 - RNA, 25 nt, Human
acucugucgcccaggcuggagcgca

SEQ ID NO: 781762 - RNA, 21 nt, Human
acugcaggaacggaacagaug

SEQ ID NO: 781763 - RNA, 23 nt, Human
acuguccacguggagaagcaaga

SEQ ID NO: 781764 - RNA, 19 nt, Human
agacagauaaaucccuugc

SEQ ID NO: 781765 - RNA, 22 nt, Human
agacagauaaaucccuugccca

SEQ ID NO: 781766 - RNA, 22 nt, Human
agaccagaagucugacaucugc

SEQ ID NO: 781767 - RNA, 20 nt, Human
agacgacaggugcaccacca

SEQ ID NO: 781768 - RNA, 21 nt, Human
agaggggagggaaagaggagg

SEQ ID NO: 781769 - RNA, 21 nt, Human
agcacugggggcagcccagga

SEQ ID NO: 781770 - RNA, 20 nt, Human
agcaggggagggggcccagu

SEQ ID NO: 781771 - RNA, 23 nt, Human
agccacugcgcucggcccauguu

SEQ ID NO: 781772 - RNA, 18 nt, Human
agccuccugaauagcugg

SEQ ID NO: 781773 - RNA, 24 nt, Human
agcgcaguggcacaaucucggcuc

SEQ ID NO: 781774 - RNA, 26 nt, Human
aggaaccuccagaccuucccaggauu

SEQ ID NO: 781775 - RNA, 27 nt, Human
aggcacaagauaaaguaagggggaccc

SEQ ID NO: 781776 - RNA, 21 nt, Human
aggcaggagggucugagucug

SEQ ID NO: 781777 - RNA, 18 nt, Human
aggcagguugggacgcag

SEQ ID NO: 781778 - RNA, 25 nt, Human
aggcagguugggacgcaggccuagg

SEQ ID NO: 781779 - RNA, 22 nt, Human
aggccugcagucccuuaacucc

SEQ ID NO: 781780 - RNA, 24 nt, Human
aggcgaucugcccaccuuggccuc

SEQ ID NO: 781781 - RNA, 21 nt, Human
aggcugccugugcugcagagc

SEQ ID NO: 781782 - RNA, 23 nt, Human
agggaaagaggaggcuggagagg

SEQ ID NO: 781783 - RNA, 19 nt, Human
aggguagggggacagaggg

SEQ ID NO: 781784 - RNA, 19 nt, Human
agguuggagugcaguggca

SEQ ID NO: 781785 - RNA, 21 nt, Human
agugcaguggcacgauccuag

SEQ ID NO: 781786 - RNA, 23 nt, Human
agugcaguggcacgauccuagcu

SEQ ID NO: 781787 - RNA, 18 nt, Human
agugcugggauuacaggc

SEQ ID NO: 781788 - RNA, 20 nt, Human
aguggggcaggaacucaagg

SEQ ID NO: 781789 - RNA, 20 nt, Human
auagcugggauuacagacgu

SEQ ID NO: 781790 - RNA, 24 nt, Human
caaagugcugggauuacaggcgug

SEQ ID NO: 781791 - RNA, 21 nt, Human
caacaggagaggcauucccaa

SEQ ID NO: 781792 - RNA, 27 nt, Human
caagaccagaagucugacaucugccaa

SEQ ID NO: 781793 - RNA, 27 nt, Human
caagugauccucccaccucagccuccc

SEQ ID NO: 781794 - RNA, 27 nt, Human
caagugauccucccaccucagccuccc

SEQ ID NO: 781795 - RNA, 24 nt, Human
cacaauccccaagaaagggacaag

SEQ ID NO: 781796 - RNA, 20 nt, Human
cacacaccacauaccugccc

SEQ ID NO: 781797 - RNA, 22 nt, Human
cacagagcuggugagaggcagg

SEQ ID NO: 781798 - RNA, 27 nt, Human
cacagccccggaagugagggagcugaa

SEQ ID NO: 781799 - RNA, 25 nt, Human
cacaggaaccuccagaccuucccag

SEQ ID NO: 781800 - RNA, 22 nt, Human
caccaccacgccuggcuaauuu

SEQ ID NO: 781801 - RNA, 23 nt, Human
caccaggugucuccuccccagcc

SEQ ID NO: 781802 - RNA, 21 nt, Human
cacccugccgcuccugccugc

SEQ ID NO: 781803 - RNA, 21 nt, Human
cacccuguuggccaggcuggu

SEQ ID NO: 781804 - RNA, 23 nt, Human
cacccuguuggccaggcuggucu

SEQ ID NO: 781805 - RNA, 24 nt, Human
cacccuguuggccaggcuggucuu

SEQ ID NO: 781806 - RNA, 24 nt, Human
caccucagccucccaaguagcuaa

SEQ ID NO: 781807 - RNA, 24 nt, Human
caccugggccaacagggcugaggc

SEQ ID NO: 781808 - RNA, 20 nt, Human
cacucugccucucaugcccu

SEQ ID NO: 781809 - RNA, 24 nt, Human
cacucugucgcccaggcuggagcg

SEQ ID NO: 781810 - RNA, 23 nt, Human
cacugcaaccuccgcauccuggg

SEQ ID NO: 781811 - RNA, 18 nt, Human
cacugggggcagcccagg

SEQ ID NO: 781812 - RNA, 24 nt, Human
cagaagucugacaucugccaaagc

SEQ ID NO: 781813 - RNA, 25 nt, Human
cagccaaggcauguccugcugccaa

SEQ ID NO: 781814 - RNA, 23 nt, Human
cagcccaggacccagaaagccaa

SEQ ID NO: 781815 - RNA, 19 nt, Human
caggcacuuggcaaacacc

SEQ ID NO: 781816 - RNA, 24 nt, Human
caggcacuuggcaaacaccuguag

SEQ ID NO: 781817 - RNA, 21 nt, Human
caggucuuccucaggccugac

SEQ ID NO: 781818 - RNA, 22 nt, Human
cagugaagaaugagccagauac

SEQ ID NO: 781819 - RNA, 23 nt, Human
cauccuaagaccuacaucgauaa

SEQ ID NO: 781820 - RNA, 22 nt, Human
ccaaagugcugggauuacaggc

SEQ ID NO: 781821 - RNA, 22 nt, Human
ccaaagugcugggauuacaggc

SEQ ID NO: 781822 - RNA, 24 nt, Human
ccaaagugcugggauuacaggcgu

SEQ ID NO: 781823 - RNA, 27 nt, Human
ccacaggaaccuccagaccuucccagg

SEQ ID NO: 781824 - RNA, 21 nt, Human
ccacagugagcccagccccug

SEQ ID NO: 781825 - RNA, 22 nt, Human
ccaccaggugucuccuccccag

SEQ ID NO: 781826 - RNA, 22 nt, Human
ccacccugccgcuccugccugc

SEQ ID NO: 781827 - RNA, 22 nt, Human
ccacucugucgcccaggcugga

SEQ ID NO: 781828 - RNA, 22 nt, Human
ccagccuccacaauccccaaga

SEQ ID NO: 781829 - RNA, 23 nt, Human
ccagggugcagguugcuggacuu

SEQ ID NO: 781830 - RNA, 22 nt, Human
cccacacaaggcaccgugggga

SEQ ID NO: 781831 - RNA, 23 nt, Human
cccacacaccacauaccugcccu

SEQ ID NO: 781832 - RNA, 22 nt, Human
cccaccaggugucuccucccca

SEQ ID NO: 781833 - RNA, 20 nt, Human
cccauaaggauacccccaau

SEQ ID NO: 781834 - RNA, 25 nt, Human
ccccaagaaagggacaaggggcuuc

SEQ ID NO: 781835 - RNA, 25 nt, Human
cccccggcccugagaccuggcgacc

SEQ ID NO: 781836 - RNA, 26 nt, Human
ccccucugacccagccuccacaaucc

SEQ ID NO: 781837 - RNA, 18 nt, Human
ccccugauggcucuaguu

SEQ ID NO: 781838 - RNA, 21 nt, Human
cccuguugcccagcaugccug

SEQ ID NO: 781839 - RNA, 18 nt, Human
cccuugguaaaugccagg

SEQ ID NO: 781840 - RNA, 18 nt, Human
ccgcuccugccugccuca

SEQ ID NO: 781841 - RNA, 20 nt, Human
ccggaagugagggagcugaa

SEQ ID NO: 781842 - RNA, 23 nt, Human
ccucccaccucagccucccaagu

SEQ ID NO: 781843 - RNA, 19 nt, Human
ccuccgcauccuggguuca

SEQ ID NO: 781844 - RNA, 18 nt, Human
ccuccugcuccaccuggg

SEQ ID NO: 781845 - RNA, 19 nt, Human
ccugaauagcugggauuac

SEQ ID NO: 781846 - RNA, 21 nt, Human
ccugccgcuccugccugccuc

SEQ ID NO: 781847 - RNA, 20 nt, Human
ccugugccuuguccagcaau

SEQ ID NO: 781848 - RNA, 23 nt, Human
ccuugcccaaggucacagagcug

SEQ ID NO: 781849 - RNA, 24 nt, Human
cgaucugcccaccuuggccuccca

SEQ ID NO: 781850 - RNA, 18 nt, Human
cgcccggggcccaggacc

SEQ ID NO: 781851 - RNA, 24 nt, Human
cgcucucucacccagguuggagug

SEQ ID NO: 781852 - RNA, 23 nt, Human
cucaaggcacaagauaaaguaag

SEQ ID NO: 781853 - RNA, 24 nt, Human
cucaagugauccucccaccucagc

SEQ ID NO: 781854 - RNA, 24 nt, Human
cucacugcaaccuccgcauccugg

SEQ ID NO: 781855 - RNA, 24 nt, Human
cucacugcagcuucaagcuucugg

SEQ ID NO: 781856 - RNA, 19 nt, Human
cucagaagaacccagugaa

SEQ ID NO: 781857 - RNA, 24 nt, Human
cucaggcgaucugcccaccuuggc

SEQ ID NO: 781858 - RNA, 23 nt, Human
cuccugaauagcugggauuacag

SEQ ID NO: 781859 - RNA, 25 nt, Human
cucgugccucagccuccugaauagc

SEQ ID NO: 781860 - RNA, 19 nt, Human
cucugccugagcucugccc

SEQ ID NO: 781861 - RNA, 22 nt, Human
cugaaaagaacccauaaggaua

SEQ ID NO: 781862 - RNA, 21 nt, Human
cugaggccuggaggaggaagc

SEQ ID NO: 781863 - RNA, 23 nt, Human
cugcaaccuccgcauccuggguu

SEQ ID NO: 781864 - RNA, 20 nt, Human
cugcagucccuuaacucccc

SEQ ID NO: 781865 - RNA, 18 nt, Human
cuggagcacugggggcag

SEQ ID NO: 781866 - RNA, 22 nt, Human
cuggaggcugacggcuuggggu

SEQ ID NO: 781867 - RNA, 18 nt, Human
cuggugagaggcagguug

SEQ ID NO: 781868 - RNA, 23 nt, Human
cuguuggccaggcuggucuugaa

SEQ ID NO: 781869 - RNA, 23 nt, Human
cuucugggcucaagugauccucc

SEQ ID NO: 781870 - RNA, 25 nt, Human
cuucugggcucaagugauccuccca

SEQ ID NO: 781871 - RNA, 26 nt, Human
gaauagcugggauuacagacgucugc

SEQ ID NO: 781872 - RNA, 22 nt, Human
gaauucucgugccucagccucc

SEQ ID NO: 781873 - RNA, 21 nt, Human
gacagauaaaucccuugccca

SEQ ID NO: 781874 - RNA, 23 nt, Human
gaccucaggcgaucugcccaccu

SEQ ID NO: 781875 - RNA, 24 nt, Human
gacggcuugggguggggccacagu

SEQ ID NO: 781876 - RNA, 21 nt, Human
gagaauggagaccagagggga

SEQ ID NO: 781877 - RNA, 25 nt, Human
gagaauggagaccagaggggaggga

SEQ ID NO: 781878 - RNA, 24 nt, Human
gagacgggguuucacccuguuggc

SEQ ID NO: 781879 - RNA, 21 nt, Human
gagcugaagagaauggagacc

SEQ ID NO: 781880 - RNA, 21 nt, Human
gaggagcuccacaggucuucc

SEQ ID NO: 781881 - RNA, 23 nt, Human
gagugaaaaagcuguagcagccc

SEQ ID NO: 781882 - RNA, 18 nt, Human
gauuacaggcgugagcca

SEQ ID NO: 781883 - RNA, 22 nt, Human
gauuacaggcgugagccacugc

SEQ ID NO: 781884 - RNA, 22 nt, Human
gauuacaggcgugagccacugc

SEQ ID NO: 781885 - RNA, 19 nt, Human
gauucuggagagagggcuc

SEQ ID NO: 781886 - RNA, 22 nt, Human
gcaaccuccgcauccuggguuc

SEQ ID NO: 781887 - RNA, 21 nt, Human
gcaguggcacaaucucggcuc

SEQ ID NO: 781888 - RNA, 23 nt, Human
gcccaaggucacagagcugguga

SEQ ID NO: 781889 - RNA, 24 nt, Human
gcccaaggucacagagcuggugag

SEQ ID NO: 781890 - RNA, 19 nt, Human
gcccaggacccagaaagcc

SEQ ID NO: 781891 - RNA, 23 nt, Human
gcccaggcuggagcgcaguggca

SEQ ID NO: 781892 - RNA, 19 nt, Human
gcccauguugccuuuuuga

SEQ ID NO: 781893 - RNA, 22 nt, Human
gcccggggcccaggacccuucc

SEQ ID NO: 781894 - RNA, 22 nt, Human
gcccugagaccuggcgaccgcc

SEQ ID NO: 781895 - RNA, 18 nt, Human
gcucaagugauccuccca

SEQ ID NO: 781896 - RNA, 21 nt, Human
gcuccuggagagcagccaccc

SEQ ID NO: 781897 - RNA, 19 nt, Human
gcugccugugcugcagagc

SEQ ID NO: 781898 - RNA, 19 nt, Human
gcuggagcgcaguggcaca

SEQ ID NO: 781899 - RNA, 22 nt, Human
ggaaagaggaggcuggagagga

SEQ ID NO: 781900 - RNA, 21 nt, Human
ggacugagaggaaacgagacu

SEQ ID NO: 781901 - RNA, 19 nt, Human
ggaggacauggaugauaac

SEQ ID NO: 781902 - RNA, 22 nt, Human
ggagggaaagaggaggcuggag

SEQ ID NO: 781903 - RNA, 21 nt, Human
ggagucgcccacacaccacau

SEQ ID NO: 781904 - RNA, 25 nt, Human
ggcacaagauaaaguaaggggcaaa

SEQ ID NO: 781905 - RNA, 18 nt, Human
ggcaggagagagauggga

SEQ ID NO: 781906 - RNA, 19 nt, Human
ggccuggaggaggaagcuc

SEQ ID NO: 781907 - RNA, 24 nt, Human
ggcgaccgccgcccggggcccagg

SEQ ID NO: 781908 - RNA, 22 nt, Human
ggcuggagaggagcuccacagg

SEQ ID NO: 781909 - RNA, 24 nt, Human
ggcuggucuugaacuccagaccuc

SEQ ID NO: 781910 - RNA, 21 nt, Human
ggcuucggagaggggccaggu

SEQ ID NO: 781911 - RNA, 22 nt, Human
ggcuugggguggggccacagug

SEQ ID NO: 781912 - RNA, 23 nt, Human
gggaaagaggaggcuggagagga

SEQ ID NO: 781913 - RNA, 19 nt, Human
gggaccaaugcaacaggag

SEQ ID NO: 781914 - RNA, 21 nt, Human
gggagggaaagaggaggcugg

SEQ ID NO: 781915 - RNA, 22 nt, Human
gggcagcccaggacccagaaag

SEQ ID NO: 781916 - RNA, 22 nt, Human
gggcucaagugauccucccacc

SEQ ID NO: 781917 - RNA, 24 nt, Human
gggcugccaggaugggaggcaggu

SEQ ID NO: 781918 - RNA, 18 nt, Human
gggcuucggagaggggcc

SEQ ID NO: 781919 - RNA, 19 nt, Human
ggggcagcccaggacccag

SEQ ID NO: 781920 - RNA, 21 nt, Human
gggggcagcccaggacccaga

SEQ ID NO: 781921 - RNA, 23 nt, Human
gggguuucacccuguuggccagg

SEQ ID NO: 781922 - RNA, 22 nt, Human
ggguuucacccuguuggccagg

SEQ ID NO: 781923 - RNA, 19 nt, Human
gguggggccacagugagcc

SEQ ID NO: 781924 - RNA, 20 nt, Human
gguggugggaagagcccagg

SEQ ID NO: 781925 - RNA, 23 nt, Human
gguggugggaagagcccagggcu

SEQ ID NO: 781926 - RNA, 18 nt, Human
guccacaggaaccuccag

SEQ ID NO: 781927 - RNA, 24 nt, Human
gugauccucccaccucagccuccc

SEQ ID NO: 781928 - RNA, 22 nt, Human
gugccucagccuccugaauagc

SEQ ID NO: 781929 - RNA, 24 nt, Human
guggagaagcaagaccagaagucu

SEQ ID NO: 781930 - RNA, 18 nt, Human
guggggccacagugagcc

SEQ ID NO: 781931 - RNA, 23 nt, Human
uaaagcugugaggcaggaggguc

SEQ ID NO: 781932 - RNA, 23 nt, Human
uaaaucccuugcccaaggucaca

SEQ ID NO: 781933 - RNA, 19 nt, Human
uaaccuggauugccagugg

SEQ ID NO: 781934 - RNA, 24 nt, Human
uaacugggguuuaggguaggggga

SEQ ID NO: 781935 - RNA, 21 nt, Human
uaagacgacaggugcaccacc

SEQ ID NO: 781936 - RNA, 18 nt, Human
uaaggauacccccaaucc

SEQ ID NO: 781937 - RNA, 19 nt, Human
uacaaagauaaagcuguga

SEQ ID NO: 781938 - RNA, 22 nt, Human
uacaggcgugagccacugcgcu

SEQ ID NO: 781939 - RNA, 24 nt, Human
uaccacucugucgcccaggcugga

SEQ ID NO: 781940 - RNA, 20 nt, Human
uacccccggcccugagaccu

SEQ ID NO: 781941 - RNA, 21 nt, Human
uacccuggaacgguaauacaa

SEQ ID NO: 781942 - RNA, 22 nt, Human
uagcucacugcagcuucaagcu

SEQ ID NO: 781943 - RNA, 21 nt, Human
uaggguagggggacagagggc

SEQ ID NO: 781944 - RNA, 19 nt, Human
ucacccagguuggagugca

SEQ ID NO: 781945 - RNA, 24 nt, Human
ucacccagguuggagugcaguggc

SEQ ID NO: 781946 - RNA, 18 nt, Human
ucacugcaaccuccgcau

SEQ ID NO: 781947 - RNA, 24 nt, Human
ucacugcaaccuccgcauccuggg

SEQ ID NO: 781948 - RNA, 18 nt, Human
ucacugcagcuucaagcu

SEQ ID NO: 781949 - RNA, 24 nt, Human
ucacugcagcuucaagcuucuggg

SEQ ID NO: 781950 - RNA, 21 nt, Human
ucagccucccaaguagcuaag

SEQ ID NO: 781951 - RNA, 19 nt, Human
uccaaaccucugccugagc

SEQ ID NO: 781952 - RNA, 25 nt, Human
uccacaggaaccuccagaccuuccc

SEQ ID NO: 781953 - RNA, 20 nt, Human
uccacaggucuuccucaggg

SEQ ID NO: 781954 - RNA, 20 nt, Human
uccaccugggccaacagggc

SEQ ID NO: 781955 - RNA, 21 nt, Human
uccagcaaugguucccugaaa

SEQ ID NO: 781956 - RNA, 24 nt, Human
ucccaaagugcugggauuacaggc

SEQ ID NO: 781957 - RNA, 24 nt, Human
ucccaagcaccacauguuccagug

SEQ ID NO: 781958 - RNA, 20 nt, Human
ucccugagguccacaggaac

SEQ ID NO: 781959 - RNA, 22 nt, Human
ucccugagguccacaggaaccu

SEQ ID NO: 781960 - RNA, 19 nt, Human
ucccuggaggcugacggcu

SEQ ID NO: 781961 - RNA, 18 nt, Human
uccuccauccuguacagc

SEQ ID NO: 781962 - RNA, 22 nt, Human
uccuccauccuguacagcugcc

SEQ ID NO: 781963 - RNA, 27 nt, Human
uccucccaccucagccucccaaguagc

SEQ ID NO: 781964 - RNA, 20 nt, Human
uccuggguucauggaauucu

SEQ ID NO: 781965 - RNA, 21 nt, Human
uccuggguucauggaauucuc

SEQ ID NO: 781966 - RNA, 18 nt, Human
ucgcccaggcuggagcgc

SEQ ID NO: 781967 - RNA, 24 nt, Human
ucgcucucucacccagguuggagu

SEQ ID NO: 781968 - RNA, 23 nt, Human
ucuccccaacagugggugagcuu

SEQ ID NO: 781969 - RNA, 23 nt, Human
ucucgcucucucacccagguugg

SEQ ID NO: 781970 - RNA, 24 nt, Human
ucucgcucucucacccagguugga

SEQ ID NO: 781971 - RNA, 22 nt, Human
ucucugcauuuuucuuuuucuu

SEQ ID NO: 781972 - RNA, 27 nt, Human
ucuggagcacugggggcagcccaggac

SEQ ID NO: 781973 - RNA, 22 nt, Human
ucugggcucaagugauccuccc

SEQ ID NO: 781974 - RNA, 18 nt, Human
ucugucgcccaggcugga

SEQ ID NO: 781975 - RNA, 18 nt, Human
ucuuuuucuugagacagg

SEQ ID NO: 781976 - RNA, 21 nt, Human
ugaagagaauggagaccagag

SEQ ID NO: 781977 - RNA, 23 nt, Human
ugaagagaauggagaccagaggg

SEQ ID NO: 781978 - RNA, 22 nt, Human
ugacccagccuccacaaucccc

SEQ ID NO: 781979 - RNA, 19 nt, Human
ugagaaaacuaagggacag

SEQ ID NO: 781980 - RNA, 23 nt, Human
ugagaggaaacgagacucgggua

SEQ ID NO: 781981 - RNA, 22 nt, Human
ugagaggcagguugggacgcag

SEQ ID NO: 781982 - RNA, 22 nt, Human
ugagauacuuuuuucaaagcua

SEQ ID NO: 781983 - RNA, 18 nt, Human
ugagccagauacucacug

SEQ ID NO: 781984 - RNA, 21 nt, Human
ugagccagauacucacugucc

SEQ ID NO: 781985 - RNA, 25 nt, Human
ugagccagauacucacuguccacgu

SEQ ID NO: 781986 - RNA, 20 nt, Human
ugaggcaggagggucugagu

SEQ ID NO: 781987 - RNA, 21 nt, Human
ugagguccacaggaaccucca

SEQ ID NO: 781988 - RNA, 19 nt, Human
ugcagagcucagaaaugga

SEQ ID NO: 781989 - RNA, 18 nt, Human
ugccaggccugcaguccc

SEQ ID NO: 781990 - RNA, 22 nt, Human
ugccaguggggaaggucuggag

SEQ ID NO: 781991 - RNA, 22 nt, Human
ugccucagccuccugaauagcu

SEQ ID NO: 781992 - RNA, 27 nt, Human
ugccucagccuccugaauagcugggau

SEQ ID NO: 781993 - RNA, 23 nt, Human
ugccuggacccucaacacuuaau

SEQ ID NO: 781994 - RNA, 21 nt, Human
ugccugugcugcagagcugca

SEQ ID NO: 781995 - RNA, 23 nt, Human
ugcgcucggcccauguugccuuu

SEQ ID NO: 781996 - RNA, 24 nt, Human
ugcugggauuacaggcgugagcca

SEQ ID NO: 781997 - RNA, 20 nt, Human
uggaaacgcccuauauccuc

SEQ ID NO: 781998 - RNA, 21 nt, Human
uggaaacgcccuauauccucc

SEQ ID NO: 781999 - RNA, 24 nt, Human
uggagcgcaguggcacaaucucgg

SEQ ID NO: 782000 - RNA, 19 nt, Human
uggagugcaguggcacgau

SEQ ID NO: 782001 - RNA, 18 nt, Human
uggaugauaaccuggauu

SEQ ID NO: 782002 - RNA, 24 nt, Human
uggcacaaucucggcucacugcaa

SEQ ID NO: 782003 - RNA, 23 nt, Human
uggcacgauccuagcucacugca

SEQ ID NO: 782004 - RNA, 23 nt, Human
uggccaggcuggucuugaacucc

SEQ ID NO: 782005 - RNA, 20 nt, Human
uggcgaccgccgcccggggc

SEQ ID NO: 782006 - RNA, 19 nt, Human
uggcuccugugccuugucc

SEQ ID NO: 782007 - RNA, 20 nt, Human
ugggagaagcaguggccacu

SEQ ID NO: 782008 - RNA, 18 nt, Human
ugggauuacagacgucug

SEQ ID NO: 782009 - RNA, 19 nt, Human
ugggauuacagacgucugc

SEQ ID NO: 782010 - RNA, 21 nt, Human
ugggauuacagacgucugcca

SEQ ID NO: 782011 - RNA, 24 nt, Human
ugggauuacagacgucugccacua

SEQ ID NO: 782012 - RNA, 18 nt, Human
ugggauuacaggcgugag

SEQ ID NO: 782013 - RNA, 19 nt, Human
ugggauuacaggcgugagc

SEQ ID NO: 782014 - RNA, 21 nt, Human
ugggauuacaggcgugagcca

SEQ ID NO: 782015 - RNA, 22 nt, Human
ugggauuacaggcgugagccac

SEQ ID NO: 782016 - RNA, 22 nt, Human
ugggauuacaggcgugagccac

SEQ ID NO: 782017 - RNA, 24 nt, Human
ugggauuacaggcgugagccacug

SEQ ID NO: 782018 - RNA, 24 nt, Human
ugggauuacaggcgugagccacug

SEQ ID NO: 782019 - RNA, 24 nt, Human
ugggccaggcacuuggcaaacacc

SEQ ID NO: 782020 - RNA, 24 nt, Human
ugggcucaagugauccucccaccu

SEQ ID NO: 782021 - RNA, 21 nt, Human
ugggggauggggauuaauaca

SEQ ID NO: 782022 - RNA, 22 nt, Human
ugggguggggccacagugagcc

SEQ ID NO: 782023 - RNA, 19 nt, Human
ugggguuuaggguaggggg

SEQ ID NO: 782024 - RNA, 25 nt, Human
uggugggggauggggauuaauacag

SEQ ID NO: 782025 - RNA, 19 nt, Human
ugguggugggggaugggga

SEQ ID NO: 782026 - RNA, 24 nt, Human
uguagagacgggguuucacccugu

SEQ ID NO: 782027 - RNA, 19 nt, Human
uguagagauggggucccug

SEQ ID NO: 782028 - RNA, 19 nt, Human
uguccagcaaugguucccu

SEQ ID NO: 782029 - RNA, 24 nt, Human
ugugaggcaggagggucugaggag

SEQ ID NO: 782030 - RNA, 19 nt, Human
uguucagagauagagauca

SEQ ID NO: 782031 - RNA, 20 nt, Human
uguucagagauagagaucau

SEQ ID NO: 782032 - RNA, 21 nt, Human
uguucagagauagagaucauu

SEQ ID NO: 782033 - RNA, 21 nt, Human
uguuccaguggucccuccugc

SEQ ID NO: 782034 - RNA, 24 nt, Human
uuaaacuuuuuuguagagauggga

SEQ ID NO: 782035 - RNA, 27 nt, Human
uucugguguuauuguagauaaucuccc

SEQ ID NO: 782036 - RNA, 22 nt, Human
uucuugucccuugcagagcuca

SEQ ID NO: 782037 - RNA, 21 nt, Human
uuggagcaugggaugaagaga

SEQ ID NO: 782038 - RNA, 22 nt, Human
uugggcaggagagagaugggag

SEQ ID NO: 782039 - RNA, 24 nt, Human
uuguagagacgggguuucacccug

SEQ ID NO: 782040 - RNA, 26 nt, Human
uuguagagacgggguuucacccuguu

SEQ ID NO: 782041 - RNA, 22 nt, Human
uuucacccuguuggccaggcug

SEQ ID NO: 782042 - RNA, 24 nt, Human
uuucacccuguuggccaggcuggu

SEQ ID NO: 782043 - RNA, 25 nt, Human
uuuguagagacgggguuucacccug

SEQ ID NO: 782044 - RNA, 25 nt, Human
uuuguagagacgggguuucacccug

SEQ ID NO: 782045 - RNA, 21 nt, Human
uuuguagagauggggucccug

SEQ ID NO: 782046 - RNA, 25 nt, Human
uuuuaagauugguggugggggaugg

SEQ ID NO: 782047 - RNA, 23 nt, Human
uuuuuguagagacgggguuucac

SEQ ID NO: 782048 - RNA, 19 nt, Human
uuuuuuguagagauggggu

SEQ ID NO: 782049 - RNA, 21 nt, Human
aaaagcuuugugugacaagaa

SEQ ID NO: 782050 - RNA, 21 nt, Human
aaagaccccggggaaagccaa

SEQ ID NO: 782051 - RNA, 20 nt, Human
aagaccccggggaaagccaa

SEQ ID NO: 782052 - RNA, 24 nt, Human
acaacugagguaaaacuucuccug

SEQ ID NO: 782053 - RNA, 22 nt, Human
acaagaaacauuucugaggccu

SEQ ID NO: 782054 - RNA, 20 nt, Human
accauaaauccuaacauaaa

SEQ ID NO: 782055 - RNA, 22 nt, Human
agaagcaagcugcccucugccc

SEQ ID NO: 782056 - RNA, 25 nt, Human
agaagcaagcugcccucugcccccu

SEQ ID NO: 782057 - RNA, 22 nt, Human
agcagccacaccagugcccacg

SEQ ID NO: 782058 - RNA, 23 nt, Human
agccacaccagugcccacguguc

SEQ ID NO: 782059 - RNA, 23 nt, Human
agguaccaugugggaaaacacug

SEQ ID NO: 782060 - RNA, 21 nt, Human
aucacugucaugaccugaagc

SEQ ID NO: 782061 - RNA, 24 nt, Human
aucccucgcuuggaaucggcuacc

SEQ ID NO: 782062 - RNA, 21 nt, Human
aucugagacacgguaguggga

SEQ ID NO: 782063 - RNA, 23 nt, Human
caaaagaccccggggaaagccaa

SEQ ID NO: 782064 - RNA, 20 nt, Human
caagcugcccucugcccccu

SEQ ID NO: 782065 - RNA, 19 nt, Human
cacagcaccaccaccaaca

SEQ ID NO: 782066 - RNA, 21 nt, Human
caguggguucaucucugguuu

SEQ ID NO: 782067 - RNA, 24 nt, Human
ccucucugggcaacagacaggagc

SEQ ID NO: 782068 - RNA, 20 nt, Human
ccugaagccggcaugcgccu

SEQ ID NO: 782069 - RNA, 22 nt, Human
ccugcugucaucugcccagagc

SEQ ID NO: 782070 - RNA, 24 nt, Human
cggggaaagccaauuuccaugaug

SEQ ID NO: 782071 - RNA, 21 nt, Human
cuccgugggcccaccaccauc

SEQ ID NO: 782072 - RNA, 24 nt, Human
cugagacacgguagugggauucac

SEQ ID NO: 782073 - RNA, 20 nt, Human
cugcacagcaccaccaccaa

SEQ ID NO: 782074 - RNA, 22 nt, Human
cuucuuuggaaguccaagguuu

SEQ ID NO: 782075 - RNA, 20 nt, Human
gacacuuccuguccugcagg

SEQ ID NO: 782076 - RNA, 19 nt, Human
gacccuguauuucuggaau

SEQ ID NO: 782077 - RNA, 25 nt, Human
gagaagaaacaacuuggggugcaga

SEQ ID NO: 782078 - RNA, 19 nt, Human
gaggagagccucugcuuag

SEQ ID NO: 782079 - RNA, 20 nt, Human
gagucccaucugagacacgg

SEQ ID NO: 782080 - RNA, 23 nt, Human
gcaucacugucaugaccugaagc

SEQ ID NO: 782081 - RNA, 18 nt, Human
gcugcuguuagaauggcu

SEQ ID NO: 782082 - RNA, 23 nt, Human
ggugaggagagccucugcuuagu

SEQ ID NO: 782083 - RNA, 18 nt, Human
gucagguaccauguggga

SEQ ID NO: 782084 - RNA, 22 nt, Human
gugaggcuuuuggaggcacaag

SEQ ID NO: 782085 - RNA, 24 nt, Human
uaaaccauaaauccuaacauaaaa

SEQ ID NO: 782086 - RNA, 19 nt, Human
uaaaucccucgcuuggaau

SEQ ID NO: 782087 - RNA, 23 nt, Human
uaauaagccuuccuuggagccaa

SEQ ID NO: 782088 - RNA, 21 nt, Human
uauuucuggaaucuucugagu

SEQ ID NO: 782089 - RNA, 19 nt, Human
ucaucucugguuuuuggug

SEQ ID NO: 782090 - RNA, 24 nt, Human
ucaucugcccagagcagccacacc

SEQ ID NO: 782091 - RNA, 23 nt, Human
uccaugaugaugaaauuuuugag

SEQ ID NO: 782092 - RNA, 22 nt, Human
ucuccugggcaaaagaccccgg

SEQ ID NO: 782093 - RNA, 21 nt, Human
ucuuuuccugcugucaucugc

SEQ ID NO: 782094 - RNA, 18 nt, Human
ugagaagaaacaacuugg

SEQ ID NO: 782095 - RNA, 19 nt, Human
ugagaagaaacaacuuggg

SEQ ID NO: 782096 - RNA, 26 nt, Human
ugagaagaaacaacuuggggugcaga

SEQ ID NO: 782097 - RNA, 20 nt, Human
ugaggagagccucugcuuag

SEQ ID NO: 782098 - RNA, 18 nt, Human
ugcccagagcagccacac

SEQ ID NO: 782099 - RNA, 19 nt, Human
ugcccagagcagccacacc

SEQ ID NO: 782100 - RNA, 18 nt, Human
ugcguggugaggagagcc

SEQ ID NO: 782101 - RNA, 24 nt, Human
ugggaaaacacuggacaacugagg

SEQ ID NO: 782102 - RNA, 25 nt, Human
ugggcaacagacaggagcagcaaag

SEQ ID NO: 782103 - RNA, 21 nt, Human
uggguucaucucugguuuuug

SEQ ID NO: 782104 - RNA, 18 nt, Human
ugugagguuucaggacaa

SEQ ID NO: 782105 - RNA, 23 nt, Human
ugugggaaaacacuggacaacug

SEQ ID NO: 782106 - RNA, 19 nt, Human
uucuuuggaaguccaaggu

SEQ ID NO: 782107 - RNA, 22 nt, Human
uugggacacuuccuguccugca

SEQ ID NO: 782108 - RNA, 24 nt, Human
uuuccugcugucaucugcccagag

SEQ ID NO: 782109 - RNA, 21 nt, Human
aaaaaaaaaaaaaaucacaaa

SEQ ID NO: 782110 - RNA, 25 nt, Human
aaaaaaaaaaaaaaucacaaaugaa

SEQ ID NO: 782111 - RNA, 18 nt, Human
aaaccugaaaagguagug

SEQ ID NO: 782112 - RNA, 21 nt, Human
aaacugaggcagagaggugau

SEQ ID NO: 782113 - RNA, 22 nt, Human
aaaguucuuucuaaaaaggcuc

SEQ ID NO: 782114 - RNA, 19 nt, Human
aacacuguccccuccaccc

SEQ ID NO: 782115 - RNA, 22 nt, Human
aagucagagccaaccaugagaa

SEQ ID NO: 782116 - RNA, 23 nt, Human
aagucagagccaaccaugagaac

SEQ ID NO: 782117 - RNA, 19 nt, Human
aaugaauccucacaacacc

SEQ ID NO: 782118 - RNA, 18 nt, Human
acaaaugaauccucacaa

SEQ ID NO: 782119 - RNA, 22 nt, Human
acauccuuuuuuuuuuuuccug

SEQ ID NO: 782120 - RNA, 21 nt, Human
acauggcacuucucugccacc

SEQ ID NO: 782121 - RNA, 20 nt, Human
acugggugaagcugccuuuc

SEQ ID NO: 782122 - RNA, 21 nt, Human
agaacacuguccccuccaccc

SEQ ID NO: 782123 - RNA, 18 nt, Human
agagaggggagaagagga

SEQ ID NO: 782124 - RNA, 22 nt, Human
agagauccacaguguuuggcaa

SEQ ID NO: 782125 - RNA, 20 nt, Human
agaggacagagagauccaca

SEQ ID NO: 782126 - RNA, 27 nt, Human
agaugcucagcaaggauggccuggaac

SEQ ID NO: 782127 - RNA, 23 nt, Human
agcagccucaggaccccagaccu

SEQ ID NO: 782128 - RNA, 20 nt, Human
agccucaggaccccagaccu

SEQ ID NO: 782129 - RNA, 23 nt, Human
aggcagagaggugaugugaucag

SEQ ID NO: 782130 - RNA, 21 nt, Human
aggcucaaagaugcucagcaa

SEQ ID NO: 782131 - RNA, 24 nt, Human
aggggagaagaggacagagagauc

SEQ ID NO: 782132 - RNA, 18 nt, Human
agguggcuccggaggugg

SEQ ID NO: 782133 - RNA, 19 nt, Human
auccgugcuccugcggccg

SEQ ID NO: 782134 - RNA, 18 nt, Human
auccuuuuuuuuuuuucc

SEQ ID NO: 782135 - RNA, 20 nt, Human
auggggaaacugaggcagag

SEQ ID NO: 782136 - RNA, 19 nt, Human
caacgcaaacauggcacuu

SEQ ID NO: 782137 - RNA, 22 nt, Human
cacaacaccccugugagguagg

SEQ ID NO: 782138 - RNA, 21 nt, Human
cacacaguaguucugcaaaag

SEQ ID NO: 782139 - RNA, 18 nt, Human
cacaccucacuguccaug

SEQ ID NO: 782140 - RNA, 24 nt, Human
caccacccucagugcacccuugcc

SEQ ID NO: 782141 - RNA, 20 nt, Human
caccccagcaaccacccuca

SEQ ID NO: 782142 - RNA, 21 nt, Human
caccccucagggccgcuccca

SEQ ID NO: 782143 - RNA, 19 nt, Human
caccucagacaccccaggc

SEQ ID NO: 782144 - RNA, 19 nt, Human
caccucagacaccccaggc

SEQ ID NO: 782145 - RNA, 19 nt, Human
cacgagccuaaccaaagac

SEQ ID NO: 782146 - RNA, 22 nt, Human
cacgagccuaaccaaagacagg

SEQ ID NO: 782147 - RNA, 24 nt, Human
cagagccaaccaugagaacacaaa

SEQ ID NO: 782148 - RNA, 21 nt, Human
cagcuccaggccuuggcuucc

SEQ ID NO: 782149 - RNA, 21 nt, Human
cagcucgcuccucccaacuuc

SEQ ID NO: 782150 - RNA, 22 nt, Human
caggaccccagaccugccagcc

SEQ ID NO: 782151 - RNA, 24 nt, Human
caggccugcguggggcccuguggg

SEQ ID NO: 782152 - RNA, 21 nt, Human
caguccccagcuggaagagcu

SEQ ID NO: 782153 - RNA, 22 nt, Human
cagugugcaccuugugagcacu

SEQ ID NO: 782154 - RNA, 18 nt, Human
cauccugccagccccacc

SEQ ID NO: 782155 - RNA, 22 nt, Human
cauccugccagccccaccaggc

SEQ ID NO: 782156 - RNA, 23 nt, Human
caugcaaaaauaaaaacaauaaa

SEQ ID NO: 782157 - RNA, 25 nt, Human
caugcaaaaauaaaaacaauaaacc

SEQ ID NO: 782158 - RNA, 23 nt, Human
cauucagucccaucucugacucc

SEQ ID NO: 782159 - RNA, 21 nt, Human
ccaaagacaggcuuuccuggu

SEQ ID NO: 782160 - RNA, 23 nt, Human
ccacccaccucaggcugccagac

SEQ ID NO: 782161 - RNA, 23 nt, Human
ccagccaagagcaccucagacac

SEQ ID NO: 782162 - RNA, 20 nt, Human
ccagccaagagcaccucagg

SEQ ID NO: 782163 - RNA, 18 nt, Human
cccagacaaguggagcag

SEQ ID NO: 782164 - RNA, 18 nt, Human
cccagaccugccagcccg

SEQ ID NO: 782165 - RNA, 19 nt, Human
cccaggucggagauggggg

SEQ ID NO: 782166 - RNA, 22 nt, Human
ccccaggccugcguggggcccu

SEQ ID NO: 782167 - RNA, 22 nt, Human
ccccuggaagcucuuuccuccc

SEQ ID NO: 782168 - RNA, 23 nt, Human
ccucaggaccccagaccugccag

SEQ ID NO: 782169 - RNA, 20 nt, Human
ccucccaccacccucagugc

SEQ ID NO: 782170 - RNA, 23 nt, Human
ccugcagcuccaggccuuggcuu

SEQ ID NO: 782171 - RNA, 18 nt, Human
cgagucaggcagcgacgg

SEQ ID NO: 782172 - RNA, 21 nt, Human
cgcggcuccggggggcauccg

SEQ ID NO: 782173 - RNA, 21 nt, Human
cgcucuggcuccagcucgcuc

SEQ ID NO: 782174 - RNA, 22 nt, Human
cgggcgccgagucaggcagcga

SEQ ID NO: 782175 - RNA, 21 nt, Human
cguggggcccugugggugggg

SEQ ID NO: 782176 - RNA, 22 nt, Human
cucacuguccaugaggaccacc

SEQ ID NO: 782177 - RNA, 22 nt, Human
cucaggaccccagaccugccag

SEQ ID NO: 782178 - RNA, 24 nt, Human
cucccaccggaaggcaggcucaaa

SEQ ID NO: 782179 - RNA, 19 nt, Human
cucccagccaagagcaccu

SEQ ID NO: 782180 - RNA, 22 nt, Human
cucugacuccgcaucuagaccu

SEQ ID NO: 782181 - RNA, 22 nt, Human
cucuguacaaaaaaaaaaaaaa

SEQ ID NO: 782182 - RNA, 21 nt, Human
cucugugcugcguucgccccc

SEQ ID NO: 782183 - RNA, 24 nt, Human
cuggaacccaggugauccccuccc

SEQ ID NO: 782184 - RNA, 20 nt, Human
cuggccuuuucugcucccac

SEQ ID NO: 782185 - RNA, 18 nt, Human
cugugccuccugcccagg

SEQ ID NO: 782186 - RNA, 22 nt, Human
gaaaccuccaccauccugccag

SEQ ID NO: 782187 - RNA, 24 nt, Human
gaggacagagagauccacaguguu

SEQ ID NO: 782188 - RNA, 22 nt, Human
gaggaccaccccagcaaccacc

SEQ ID NO: 782189 - RNA, 24 nt, Human
gcaaaaauaaaaacaauaaaccug

SEQ ID NO: 782190 - RNA, 20 nt, Human
gcagagguggcuccggaggu

SEQ ID NO: 782191 - RNA, 22 nt, Human
gccaagcaagguggacagccuc

SEQ ID NO: 782192 - RNA, 24 nt, Human
gcccuguggguggggggggguccc

SEQ ID NO: 782193 - RNA, 23 nt, Human
gccgggacagagagagaugccgg

SEQ ID NO: 782194 - RNA, 23 nt, Human
gccuccugcccagguucccagac

SEQ ID NO: 782195 - RNA, 23 nt, Human
gccuuggcuuccucugugccucc

SEQ ID NO: 782196 - RNA, 22 nt, Human
gcgcccggcgcgcgcucuggcu

SEQ ID NO: 782197 - RNA, 19 nt, Human
gcucaccggcgacgggacc

SEQ ID NO: 782198 - RNA, 23 nt, Human
gcucccugaagucuccagcuccu

SEQ ID NO: 782199 - RNA, 23 nt, Human
gcuccggggggcauccgugcucc

SEQ ID NO: 782200 - RNA, 26 nt, Human
gcucuggcuccagcucgcuccuccca

SEQ ID NO: 782201 - RNA, 23 nt, Human
ggaccugcagcuccaggccuugg

SEQ ID NO: 782202 - RNA, 20 nt, Human
gggggagugagccccuugga

SEQ ID NO: 782203 - RNA, 18 nt, Human
gguuucagcaagcaccag

SEQ ID NO: 782204 - RNA, 19 nt, Human
guccaugaggaccacccca

SEQ ID NO: 782205 - RNA, 20 nt, Human
gucccaucucugacuccgca

SEQ ID NO: 782206 - RNA, 25 nt, Human
gugaacagacacacaguaguucugc

SEQ ID NO: 782207 - RNA, 19 nt, Human
gugccuccugcccagguuc

SEQ ID NO: 782208 - RNA, 21 nt, Human
uacacgagccuaaccaaagac

SEQ ID NO: 782209 - RNA, 24 nt, Human
uacagauggggaaacugaggcaga

SEQ ID NO: 782210 - RNA, 24 nt, Human
uagaccuugucugcaaagaaauua

SEQ ID NO: 782211 - RNA, 20 nt, Human
uagcacuccuuggggcuccu

SEQ ID NO: 782212 - RNA, 21 nt, Human
ucaaauaucaugaccaaugac

SEQ ID NO: 782213 - RNA, 24 nt, Human
ucagccaguggucccaacacagcu

SEQ ID NO: 782214 - RNA, 21 nt, Human
ucaggcagcgacggggcgcgc

SEQ ID NO: 782215 - RNA, 19 nt, Human
ucagucccaucucugacuc

SEQ ID NO: 782216 - RNA, 19 nt, Human
uccacaguguuuggcaacu

SEQ ID NO: 782217 - RNA, 24 nt, Human
uccacaguguuuggcaacuggggg

SEQ ID NO: 782218 - RNA, 21 nt, Human
uccacccaccucaggcugcca

SEQ ID NO: 782219 - RNA, 24 nt, Human
ucccaacuccgcucagucucucca

SEQ ID NO: 782220 - RNA, 23 nt, Human
ucccagacaaguggagcaggccu

SEQ ID NO: 782221 - RNA, 25 nt, Human
uccccagcuggaagagcugcaaggc

SEQ ID NO: 782222 - RNA, 20 nt, Human
uccccaugagaggggcuccc

SEQ ID NO: 782223 - RNA, 25 nt, Human
uccccucccaccacccucagugcac

SEQ ID NO: 782224 - RNA, 18 nt, Human
uccgugcuccugcggccg

SEQ ID NO: 782225 - RNA, 19 nt, Human
uccugcugcagcagguggg

SEQ ID NO: 782226 - RNA, 23 nt, Human
ucucccauuuuacagauggggaa

SEQ ID NO: 782227 - RNA, 21 nt, Human
ucuguacaaaaaaaaaaaaaa

SEQ ID NO: 782228 - RNA, 19 nt, Human
ucugugccuccugcccagg

SEQ ID NO: 782229 - RNA, 23 nt, Human
ucugugccuccugcccagguucc

SEQ ID NO: 782230 - RNA, 20 nt, Human
ucugugcugcguucgccccc

SEQ ID NO: 782231 - RNA, 23 nt, Human
ugaaaagguagugaacagacaca

SEQ ID NO: 782232 - RNA, 24 nt, Human
ugaacagacacacaguaguucugc

SEQ ID NO: 782233 - RNA, 27 nt, Human
ugaacagacacacaguaguucugcaaa

SEQ ID NO: 782234 - RNA, 18 nt, Human
ugaauccucacaacaccc

SEQ ID NO: 782235 - RNA, 22 nt, Human
ugagaacacaaaggaucccucc

SEQ ID NO: 782236 - RNA, 18 nt, Human
ugagagaggggagaagag

SEQ ID NO: 782237 - RNA, 19 nt, Human
ugauccccucccaccaccc

SEQ ID NO: 782238 - RNA, 20 nt, Human
ugauccccucccaccacccu

SEQ ID NO: 782239 - RNA, 26 nt, Human
ugcaaaagaauucagccaaggggguc

SEQ ID NO: 782240 - RNA, 24 nt, Human
ugccagcccgcggcuccggggggc

SEQ ID NO: 782241 - RNA, 23 nt, Human
ugccaggggcugccaggccaauc

SEQ ID NO: 782242 - RNA, 24 nt, Human
ugccgggacagagagagaugccgg

SEQ ID NO: 782243 - RNA, 20 nt, Human
ugccuccugcccagguuccc

SEQ ID NO: 782244 - RNA, 21 nt, Human
ugcguggggcccugugggugg

SEQ ID NO: 782245 - RNA, 19 nt, Human
uggaagagcugcaaggcuc

SEQ ID NO: 782246 - RNA, 24 nt, Human
uggcagagcagcaggaguaaggaa

SEQ ID NO: 782247 - RNA, 21 nt, Human
uggccgggucugcucugugcc

SEQ ID NO: 782248 - RNA, 19 nt, Human
uggggaaacugaggcagag

SEQ ID NO: 782249 - RNA, 19 nt, Human
uggggcccugugggugggg

SEQ ID NO: 782250 - RNA, 23 nt, Human
uggguuucagcaagcaccagucc

SEQ ID NO: 782251 - RNA, 19 nt, Human
uguccccuccacccaccuc

SEQ ID NO: 782252 - RNA, 23 nt, Human
uguucagcuccuggguuucagca

SEQ ID NO: 782253 - RNA, 18 nt, Human
uguuuggcaacuggggga

SEQ ID NO: 782254 - RNA, 23 nt, Human
uucccagcagccuucccgcugug

SEQ ID NO: 782255 - RNA, 24 nt, Human
uuccucugugcugcguucgccccc

SEQ ID NO: 782256 - RNA, 18 nt, Human
aaacaaaugcacaaaaug

SEQ ID NO: 782257 - RNA, 19 nt, Human
aaacaaaugcacaaaaugg

SEQ ID NO: 782258 - RNA, 23 nt, Human
aaagaacuggcacaaacagauga

SEQ ID NO: 782259 - RNA, 26 nt, Human
aacuagaaaccacgcccuggcuucua

SEQ ID NO: 782260 - RNA, 20 nt, Human
aagcaaauucaugaugugaa

SEQ ID NO: 782261 - RNA, 19 nt, Human
aaugcacaaaaugggaaag

SEQ ID NO: 782262 - RNA, 21 nt, Human
agaaagugcagcaagaucaga

SEQ ID NO: 782263 - RNA, 22 nt, Human
auagaaagugcagcaagaucag

SEQ ID NO: 782264 - RNA, 19 nt, Human
aucuaacugaugaggaaac

SEQ ID NO: 782265 - RNA, 27 nt, Human
aucugcacaacauacccccuuagccac

SEQ ID NO: 782266 - RNA, 22 nt, Human
augacaauaguuaaaguauguc

SEQ ID NO: 782267 - RNA, 19 nt, Human
augaggaaacaggcucaga

SEQ ID NO: 782268 - RNA, 22 nt, Human
caaaugcacaaaaugggaaaga

SEQ ID NO: 782269 - RNA, 22 nt, Human
cagcaagaucagacgacugaca

SEQ ID NO: 782270 - RNA, 22 nt, Human
cauacccccuuagccacugguc

SEQ ID NO: 782271 - RNA, 18 nt, Human
cccccuuagccacugccc

SEQ ID NO: 782272 - RNA, 24 nt, Human
gaaagacaaaugguuauuaguugg

SEQ ID NO: 782273 - RNA, 19 nt, Human
gaucacaucuucucuggcc

SEQ ID NO: 782274 - RNA, 19 nt, Human
gggcucaaaaaaucaacag

SEQ ID NO: 782275 - RNA, 18 nt, Human
uaaaguaugucuuauuuu

SEQ ID NO: 782276 - RNA, 29 nt, Human
uaaaucgcauacugggcucaaaaaaucag

SEQ ID NO: 782277 - RNA, 19 nt, Human
uccagcacauaaagcaaau

SEQ ID NO: 782278 - RNA, 21 nt, Human
ucgcauacugggcucaaaaaa

SEQ ID NO: 782279 - RNA, 21 nt, Human
ugaaagaggcaaaugacaaua

SEQ ID NO: 782280 - RNA, 19 nt, Human
ugaggaaacaggcucagau

SEQ ID NO: 782281 - RNA, 22 nt, Human
ugaggaaacaggcucagauggg

SEQ ID NO: 782282 - RNA, 23 nt, Human
ugaggaaacaggcucagaugggu

SEQ ID NO: 782283 - RNA, 24 nt, Human
uguaaagaacuggcacaaacagau

SEQ ID NO: 782284 - RNA, 23 nt, Human
uguucacauuauuuccugaaauc

SEQ ID NO: 782285 - RNA, 18 nt, Human
uuagagguccaggcccug

SEQ ID NO: 782286 - RNA, 28 nt, Human
uucacauuauuuccugaaaucaucuuag

SEQ ID NO: 782287 - RNA, 22 nt, Human
uuugcuaauuuuguuccccagc

SEQ ID NO: 782288 - RNA, 21 nt, Human
aaaacgcgcccagcacucaga

SEQ ID NO: 782289 - RNA, 24 nt, Human
aaagugaugggauuacaggcguga

SEQ ID NO: 782290 - RNA, 18 nt, Human
aacagccagcuucucccc

SEQ ID NO: 782291 - RNA, 24 nt, Human
aagcaguccaucugccucagccuc

SEQ ID NO: 782292 - RNA, 25 nt, Human
aagcaguccaucugccucagccucc

SEQ ID NO: 782293 - RNA, 24 nt, Human
aaguaccugggaccacaggcacac

SEQ ID NO: 782294 - RNA, 22 nt, Human
aaguauccucugugauguaucc

SEQ ID NO: 782295 - RNA, 23 nt, Human
aagugauccucccgccucagucc

SEQ ID NO: 782296 - RNA, 26 nt, Human
aagugauccucccgccucaguccccc

SEQ ID NO: 782297 - RNA, 19 nt, Human
acagccagcuucuccccaa

SEQ ID NO: 782298 - RNA, 21 nt, Human
accugaauccucuccuucagc

SEQ ID NO: 782299 - RNA, 21 nt, Human
accugggaccacaggcacacg

SEQ ID NO: 782300 - RNA, 24 nt, Human
acucaagcaguccaucugccucag

SEQ ID NO: 782301 - RNA, 23 nt, Human
agaacaguaugaaguguuaacgc

SEQ ID NO: 782302 - RNA, 23 nt, Human
agccggcccugcgggguagccuc

SEQ ID NO: 782303 - RNA, 23 nt, Human
agcuccuccuggugcgcuucccg

SEQ ID NO: 782304 - RNA, 19 nt, Human
agcuuccggaccugagccu

SEQ ID NO: 782305 - RNA, 20 nt, Human
agggcucuccuggggcagcc

SEQ ID NO: 782306 - RNA, 21 nt, Human
agguucaagugauccucccgc

SEQ ID NO: 782307 - RNA, 24 nt, Human
augggguuucaccauauuggccag

SEQ ID NO: 782308 - RNA, 24 nt, Human
caaagugaugggauuacaggcgug

SEQ ID NO: 782309 - RNA, 24 nt, Human
caaauuccuggacucaagcagucc

SEQ ID NO: 782310 - RNA, 27 nt, Human
caagugauccucccgccucaguccccc

SEQ ID NO: 782311 - RNA, 22 nt, Human
cacaggcacacgccaccaugcc

SEQ ID NO: 782312 - RNA, 21 nt, Human
caccauauuggccaggcuggu

SEQ ID NO: 782313 - RNA, 24 nt, Human
caccauauuggccaggcuggucuc

SEQ ID NO: 782314 - RNA, 24 nt, Human
caccaugccuggcuaauuuuugua

SEQ ID NO: 782315 - RNA, 20 nt, Human
caccgucggcuuuggagccc

SEQ ID NO: 782316 - RNA, 20 nt, Human
cacucgcagccgcugcaccu

SEQ ID NO: 782317 - RNA, 18 nt, Human
cacugcaaccucugccuc

SEQ ID NO: 782318 - RNA, 21 nt, Human
cacugcaaccucugccuccua

SEQ ID NO: 782319 - RNA, 18 nt, Human
cagaagccaucgcuaaaa

SEQ ID NO: 782320 - RNA, 22 nt, Human
cagccagcuucuccccaaguuu

SEQ ID NO: 782321 - RNA, 23 nt, Human
cagccucuuuugcagcuccaggg

SEQ ID NO: 782322 - RNA, 24 nt, Human
cagccuugagcuccagcauuuccc

SEQ ID NO: 782323 - RNA, 18 nt, Human
cagcuccucggccuugcg

SEQ ID NO: 782324 - RNA, 22 nt, Human
cagcucucucuccuucgucucc

SEQ ID NO: 782325 - RNA, 24 nt, Human
cauauuggccaggcuggucucaaa

SEQ ID NO: 782326 - RNA, 22 nt, Human
ccaaagugaugggauuacaggc

SEQ ID NO: 782327 - RNA, 24 nt, Human
ccaaagugaugggauuacaggcgu

SEQ ID NO: 782328 - RNA, 23 nt, Human
ccagcauuucccuggagagcgug

SEQ ID NO: 782329 - RNA, 19 nt, Human
ccaggcugguuggaaugca

SEQ ID NO: 782330 - RNA, 26 nt, Human
ccagggccuggaugcgcuguagaagg

SEQ ID NO: 782331 - RNA, 23 nt, Human
ccgggcccuggccuggcuccgac

SEQ ID NO: 782332 - RNA, 22 nt, Human
ccuagguucaagugauccuccc

SEQ ID NO: 782333 - RNA, 24 nt, Human
ccucccgccucagucccccaagua

SEQ ID NO: 782334 - RNA, 24 nt, Human
ccuccuagguucaagugauccucc

SEQ ID NO: 782335 - RNA, 21 nt, Human
ccucucguagucagccuugag

SEQ ID NO: 782336 - RNA, 18 nt, Human
ccugcagcuccucggccu

SEQ ID NO: 782337 - RNA, 18 nt, Human
ccugcaggagccuggccu

SEQ ID NO: 782338 - RNA, 22 nt, Human
ccuggaccuggaaguucuugcc

SEQ ID NO: 782339 - RNA, 20 nt, Human
cgcuaaaacgcgcccagcac

SEQ ID NO: 782340 - RNA, 25 nt, Human
cggcccugcgggguagccucguggc

SEQ ID NO: 782341 - RNA, 24 nt, Human
cggccucugugcuccaggucuccu

SEQ ID NO: 782342 - RNA, 24 nt, Human
cucacugcaaccucugccuccuag

SEQ ID NO: 782343 - RNA, 21 nt, Human
cuccaugcuggccucagccuc

SEQ ID NO: 782344 - RNA, 24 nt, Human
cucccgccucagucccccaaguac

SEQ ID NO: 782345 - RNA, 22 nt, Human
cucugucacccaggcugguugg

SEQ ID NO: 782346 - RNA, 19 nt, Human
cugcaaccucugccuccua

SEQ ID NO: 782347 - RNA, 23 nt, Human
cugcaaccucugccuccuagguu

SEQ ID NO: 782348 - RNA, 24 nt, Human
cugcaaccucugccuccuagguuc

SEQ ID NO: 782349 - RNA, 21 nt, Human
cugcagggcugacuccuggac

SEQ ID NO: 782350 - RNA, 20 nt, Human
cugccaccgcauucuggagc

SEQ ID NO: 782351 - RNA, 18 nt, Human
cugcgcagcccuguuccu

SEQ ID NO: 782352 - RNA, 21 nt, Human
cuggcuccgacuugguuucag

SEQ ID NO: 782353 - RNA, 23 nt, Human
gacucaagcaguccaucugccuc

SEQ ID NO: 782354 - RNA, 20 nt, Human
gagacagggucucccucugu

SEQ ID NO: 782355 - RNA, 21 nt, Human
gagacagggucucccucuguc

SEQ ID NO: 782356 - RNA, 23 nt, Human
gagaugggguuucaccauauugg

SEQ ID NO: 782357 - RNA, 24 nt, Human
gagaugggguuucaccauauuggc

SEQ ID NO: 782358 - RNA, 23 nt, Human
gagguccgacuccuucuccugcc

SEQ ID NO: 782359 - RNA, 18 nt, Human
gauuacaggcgugagcug

SEQ ID NO: 782360 - RNA, 21 nt, Human
gauuacaggcgugagcugcug

SEQ ID NO: 782361 - RNA, 24 nt, Human
gauuacaggcgugagcugcugugc

SEQ ID NO: 782362 - RNA, 18 nt, Human
gcaguccaucugccucag

SEQ ID NO: 782363 - RNA, 24 nt, Human
gcaguccaucugccucagccuccc

SEQ ID NO: 782364 - RNA, 18 nt, Human
gccacugccacagggccu

SEQ ID NO: 782365 - RNA, 21 nt, Human
gccaggcuggucucaaauucc

SEQ ID NO: 782366 - RNA, 20 nt, Human
gccgcugcaccucuagcagg

SEQ ID NO: 782367 - RNA, 23 nt, Human
gccucagucccccaaguaccugg

SEQ ID NO: 782368 - RNA, 21 nt, Human
gcucacugcaaccucugccuc

SEQ ID NO: 782369 - RNA, 23 nt, Human
gcuggccucagccucauccuggc

SEQ ID NO: 782370 - RNA, 21 nt, Human
ggagcuccuccuggugcgcuu

SEQ ID NO: 782371 - RNA, 18 nt, Human
gggguuucaccauauugg

SEQ ID NO: 782372 - RNA, 22 nt, Human
gggguuucaccauauuggccag

SEQ ID NO: 782373 - RNA, 19 nt, Human
guagagaugggguuucacc

SEQ ID NO: 782374 - RNA, 21 nt, Human
guagagaugggguuucaccau

SEQ ID NO: 782375 - RNA, 23 nt, Human
gugcuccaggucuccuuccagcu

SEQ ID NO: 782376 - RNA, 23 nt, Human
gugcuggagccuccucucguagu

SEQ ID NO: 782377 - RNA, 24 nt, Human
uaauuuuuguauauuuuguagaga

SEQ ID NO: 782378 - RNA, 24 nt, Human
uagguucaagugauccucccgccu

SEQ ID NO: 782379 - RNA, 24 nt, Human
uauuuuguagagaugggguuucac

SEQ ID NO: 782380 - RNA, 26 nt, Human
ucaacucugaauucuccugucgagcc

SEQ ID NO: 782381 - RNA, 19 nt, Human
ucaagugauccucccgccu

SEQ ID NO: 782382 - RNA, 19 nt, Human
ucacugcaaccucugccuc

SEQ ID NO: 782383 - RNA, 24 nt, Human
ucacugcaaccucugccuccuagg

SEQ ID NO: 782384 - RNA, 25 nt, Human
ucacugcaaccucugccuccuaggu

SEQ ID NO: 782385 - RNA, 27 nt, Human
ucacugcaaccucugccuccuagguuc

SEQ ID NO: 782386 - RNA, 24 nt, Human
ucagccucuuuugcagcuccaggg

SEQ ID NO: 782387 - RNA, 21 nt, Human
uccauucuccagccggcgcca

SEQ ID NO: 782388 - RNA, 24 nt, Human
ucccaaagugaugggauuacaggc

SEQ ID NO: 782389 - RNA, 20 nt, Human
ucccucugucacccaggcug

SEQ ID NO: 782390 - RNA, 18 nt, Human
ucccuggagagcgugagg

SEQ ID NO: 782391 - RNA, 21 nt, Human
uccuagguucaagugauccuc

SEQ ID NO: 782392 - RNA, 24 nt, Human
uccuagguucaagugauccucccg

SEQ ID NO: 782393 - RNA, 19 nt, Human
uccuggacucaagcagucc

SEQ ID NO: 782394 - RNA, 24 nt, Human
uccuucagcuucugggcguacuuc

SEQ ID NO: 782395 - RNA, 24 nt, Human
ucucaaauuccuggacucaagcag

SEQ ID NO: 782396 - RNA, 23 nt, Human
ucucccucugucacccaggcugg

SEQ ID NO: 782397 - RNA, 26 nt, Human
ucucccucugucacccaggcugguug

SEQ ID NO: 782398 - RNA, 19 nt, Human
ucuccgggcccuggccugg

SEQ ID NO: 782399 - RNA, 22 nt, Human
ucuccgggcccuggccuggcuc

SEQ ID NO: 782400 - RNA, 21 nt, Human
ucugucacccaggcugguugg

SEQ ID NO: 782401 - RNA, 28 nt, Human
ucugucacccaggcugguuggaaugcag

SEQ ID NO: 782402 - RNA, 21 nt, Human
ucuugcggccucugugcucca

SEQ ID NO: 782403 - RNA, 24 nt, Human
ucuugcggccucugugcuccaggu

SEQ ID NO: 782404 - RNA, 19 nt, Human
ucuuuugcagcuccagggc

SEQ ID NO: 782405 - RNA, 20 nt, Human
ugagccugcagggcugacuc

SEQ ID NO: 782406 - RNA, 23 nt, Human
ugagcuccagcauuucccuggag

SEQ ID NO: 782407 - RNA, 18 nt, Human
ugcagcuccagggcgcuc

SEQ ID NO: 782408 - RNA, 24 nt, Human
ugcagcuccagggcgcucuccagg

SEQ ID NO: 782409 - RNA, 24 nt, Human
ugccucagccucccaaagugaugg

SEQ ID NO: 782410 - RNA, 20 nt, Human
ugccuccacccucagcucuc

SEQ ID NO: 782411 - RNA, 24 nt, Human
ugccuccuagguucaagugauccu

SEQ ID NO: 782412 - RNA, 18 nt, Human
ugcucugccuccacccuc

SEQ ID NO: 782413 - RNA, 22 nt, Human
uggaaugcaggaguucgaacuu

SEQ ID NO: 782414 - RNA, 19 nt, Human
uggagcccuggcaagugcc

SEQ ID NO: 782415 - RNA, 20 nt, Human
uggcaagugccgggcggguu

SEQ ID NO: 782416 - RNA, 24 nt, Human
uggccaggcuggucucaaauuccu

SEQ ID NO: 782417 - RNA, 21 nt, Human
ugggaccacaggcacacgcca

SEQ ID NO: 782418 - RNA, 24 nt, Human
ugggaccacaggcacacgccacca

SEQ ID NO: 782419 - RNA, 18 nt, Human
ugggauuacaggcgugag

SEQ ID NO: 782420 - RNA, 19 nt, Human
ugggauuacaggcgugagc

SEQ ID NO: 782421 - RNA, 19 nt, Human
ugggauuacaggcgugagc

SEQ ID NO: 782422 - RNA, 19 nt, Human
ugggauuacaggcgugagc

SEQ ID NO: 782423 - RNA, 20 nt, Human
ugggauuacaggcgugagcu

SEQ ID NO: 782424 - RNA, 22 nt, Human
ugggauuacaggcgugagcugc

SEQ ID NO: 782425 - RNA, 22 nt, Human
ugggauuacaggcgugagcugc

SEQ ID NO: 782426 - RNA, 24 nt, Human
ugggauuacaggcgugagcugcug

SEQ ID NO: 782427 - RNA, 24 nt, Human
ugggguuucaccauauuggccagg

SEQ ID NO: 782428 - RNA, 22 nt, Human
uguagagaugggguuucaccau

SEQ ID NO: 782429 - RNA, 23 nt, Human
uuaacgccaaaauuuguuuuagc

SEQ ID NO: 782430 - RNA, 19 nt, Human
uuaguucauuccuucaauc

SEQ ID NO: 782431 - RNA, 23 nt, Human
uucaagugauccucccgccucag

SEQ ID NO: 782432 - RNA, 24 nt, Human
uucaagugauccucccgccucagu

SEQ ID NO: 782433 - RNA, 18 nt, Human
uucagggcauaaaucacc

SEQ ID NO: 782434 - RNA, 22 nt, Human
uuccagcuuccggaccugagcc

SEQ ID NO: 782435 - RNA, 18 nt, Human
uucccuggagagcgugag

SEQ ID NO: 782436 - RNA, 21 nt, Human
uugguguuaguucauuccuuc

SEQ ID NO: 782437 - RNA, 23 nt, Human
uuguagagaugggguuucaccau

SEQ ID NO: 782438 - RNA, 24 nt, Human
uuguagagaugggguuucaccaua

SEQ ID NO: 782439 - RNA, 22 nt, Human
uuuaccugaauccucuccuuca

SEQ ID NO: 782440 - RNA, 24 nt, Human
uuucaccauauuggccaggcuggu

SEQ ID NO: 782441 - RNA, 24 nt, Human
uuuguagagaugggguuucaccau

SEQ ID NO: 782442 - RNA, 23 nt, Human
aaaaaaaaaaacccaaccaccaa

SEQ ID NO: 782443 - RNA, 24 nt, Human
aaaaaaaaaaacccaaccaccaaa

SEQ ID NO: 782444 - RNA, 23 nt, Human
aaaaaaaaaacccaaccaccaaa

SEQ ID NO: 782445 - RNA, 26 nt, Human
aaaaaacccaaccaccaaaacaaccc

SEQ ID NO: 782446 - RNA, 23 nt, Human
aaaaacccaaccaccaaaacaac

SEQ ID NO: 782447 - RNA, 19 nt, Human
aaaagguccccccgccccc

SEQ ID NO: 782448 - RNA, 23 nt, Human
aaacccaaccaccaaaacaaccc

SEQ ID NO: 782449 - RNA, 24 nt, Human
aaagugcugggauuauaggcauga

SEQ ID NO: 782450 - RNA, 26 nt, Human
aagaagagucagguccauuugggaaa

SEQ ID NO: 782451 - RNA, 19 nt, Human
aagguccccccgcccccca

SEQ ID NO: 782452 - RNA, 21 nt, Human
aagguccccccgccccccacc

SEQ ID NO: 782453 - RNA, 19 nt, Human
aagugcugggauuauaggc

SEQ ID NO: 782454 - RNA, 21 nt, Human
aagugcugggauuauaggcau

SEQ ID NO: 782455 - RNA, 18 nt, Human
acaccaaagccuggguag

SEQ ID NO: 782456 - RNA, 18 nt, Human
acagcucuuaggucgccc

SEQ ID NO: 782457 - RNA, 21 nt, Human
acccagccuuucagaaaggcc

SEQ ID NO: 782458 - RNA, 18 nt, Human
accugccugccuuggccu

SEQ ID NO: 782459 - RNA, 19 nt, Human
acggggucaaaguuguggc

SEQ ID NO: 782460 - RNA, 18 nt, Human
acugcaaccuucuccucc

SEQ ID NO: 782461 - RNA, 22 nt, Human
agauacauauauuccugagccc

SEQ ID NO: 782462 - RNA, 20 nt, Human
aggcacgcaccacgaugccc

SEQ ID NO: 782463 - RNA, 23 nt, Human
aggcagucaagaagagucagguc

SEQ ID NO: 782464 - RNA, 20 nt, Human
aggcaugagccauugcgccc

SEQ ID NO: 782465 - RNA, 25 nt, Human
aggcuggagugcaguggcaugaucu

SEQ ID NO: 782466 - RNA, 24 nt, Human
agguaguugggauuacaggcacgc

SEQ ID NO: 782467 - RNA, 19 nt, Human
agguccccccgccccccac

SEQ ID NO: 782468 - RNA, 21 nt, Human
agucaagaagagucaggucca

SEQ ID NO: 782469 - RNA, 20 nt, Human
agugcaguggcaugaucucg

SEQ ID NO: 782470 - RNA, 23 nt, Human
agugcaguggcaugaucucggcu

SEQ ID NO: 782471 - RNA, 24 nt, Human
agugcaguggcaugaucucggcuc

SEQ ID NO: 782472 - RNA, 24 nt, Human
aguggcaugaucucggcucacugc

SEQ ID NO: 782473 - RNA, 23 nt, Human
augggguuuugccauguuggcca

SEQ ID NO: 782474 - RNA, 24 nt, Human
augggguuuugccauguuggccag

SEQ ID NO: 782475 - RNA, 23 nt, Human
caaagugcugggauuauaggcau

SEQ ID NO: 782476 - RNA, 24 nt, Human
caaagugcugggauuauaggcaug

SEQ ID NO: 782477 - RNA, 18 nt, Human
caaccaccaaaacaaccc

SEQ ID NO: 782478 - RNA, 18 nt, Human
caaccuucuccuccccag

SEQ ID NO: 782479 - RNA, 22 nt, Human
caagcgauucuucugccucagc

SEQ ID NO: 782480 - RNA, 22 nt, Human
cacacggcucaugacgccgccc

SEQ ID NO: 782481 - RNA, 22 nt, Human
caccacuccucuuagcuccauu

SEQ ID NO: 782482 - RNA, 24 nt, Human
cacccacacacacccagccagagu

SEQ ID NO: 782483 - RNA, 20 nt, Human
caccgugacaaccugggacc

SEQ ID NO: 782484 - RNA, 22 nt, Human
caccgugacaaccugggaccca

SEQ ID NO: 782485 - RNA, 27 nt, Human
caccugccugccuuggccucucaaagu

SEQ ID NO: 782486 - RNA, 22 nt, Human
caccugguaguggcccugaggc

SEQ ID NO: 782487 - RNA, 21 nt, Human
cacuaggaggccucacucccu

SEQ ID NO: 782488 - RNA, 25 nt, Human
caggacagcucuuaggucgcccuga

SEQ ID NO: 782489 - RNA, 24 nt, Human
cauguuggccaggcugaucuugaa

SEQ ID NO: 782490 - RNA, 22 nt, Human
cauucaggcaucccccuagucc

SEQ ID NO: 782491 - RNA, 27 nt, Human
ccaaccaccaaaacaacccauuugcau

SEQ ID NO: 782492 - RNA, 28 nt, Human
ccacacccucccugcuucugguccagaa

SEQ ID NO: 782493 - RNA, 22 nt, Human
ccagguaguugggauuacaggc

SEQ ID NO: 782494 - RNA, 23 nt, Human
ccagguaguugggauuacaggca

SEQ ID NO: 782495 - RNA, 19 nt, Human
ccauguuggccaggcugau

SEQ ID NO: 782496 - RNA, 23 nt, Human
cccacccacacacacccagccag

SEQ ID NO: 782497 - RNA, 23 nt, Human
ccccacuguccccgcugcaggac

SEQ ID NO: 782498 - RNA, 25 nt, Human
ccccccgccccccaccguguacagg

SEQ ID NO: 782499 - RNA, 21 nt, Human
cccccuaguccccacccacac

SEQ ID NO: 782500 - RNA, 23 nt, Human
ccccgcugucccugcugucccca

SEQ ID NO: 782501 - RNA, 25 nt, Human
ccccugccaggcaguauggccccuc

SEQ ID NO: 782502 - RNA, 19 nt, Human
cccgccccccaccguguac

SEQ ID NO: 782503 - RNA, 19 nt, Human
cccggcuaaguuuuucuug

SEQ ID NO: 782504 - RNA, 18 nt, Human
cccuaaagguugagaacc

SEQ ID NO: 782505 - RNA, 24 nt, Human
cccucccugcuucugguccagaaa

SEQ ID NO: 782506 - RNA, 23 nt, Human
cccugaacccgaggcaccggcuc

SEQ ID NO: 782507 - RNA, 23 nt, Human
cccugcuguccccacuguccccg

SEQ ID NO: 782508 - RNA, 19 nt, Human
cccuggaaugagaugggaa

SEQ ID NO: 782509 - RNA, 24 nt, Human
ccgcaaaagguccccccgcccccc

SEQ ID NO: 782510 - RNA, 24 nt, Human
ccuccccaguucaagcgauucuuc

SEQ ID NO: 782511 - RNA, 21 nt, Human
ccugaccucaggugauccacc

SEQ ID NO: 782512 - RNA, 23 nt, Human
ccugaccucaggugauccaccug

SEQ ID NO: 782513 - RNA, 23 nt, Human
ccugaccucaggugauccaccug

SEQ ID NO: 782514 - RNA, 20 nt, Human
ccugagcccacacacaaacu

SEQ ID NO: 782515 - RNA, 21 nt, Human
ccugaggcuugcucugagaac

SEQ ID NO: 782516 - RNA, 19 nt, Human
ccugccuccccgcuguccc

SEQ ID NO: 782517 - RNA, 22 nt, Human
ccugccuuggccucucaaagug

SEQ ID NO: 782518 - RNA, 24 nt, Human
ccuuccagguaguugggauuacag

SEQ ID NO: 782519 - RNA, 19 nt, Human
ccuucuccacacccucccu

SEQ ID NO: 782520 - RNA, 24 nt, Human
cgcaagcugccucucuggcugcac

SEQ ID NO: 782521 - RNA, 19 nt, Human
cgcuggugagagcugaggg

SEQ ID NO: 782522 - RNA, 19 nt, Human
cguguacaggcagugcaca

SEQ ID NO: 782523 - RNA, 24 nt, Human
cucacugcaaccuucuccucccca

SEQ ID NO: 782524 - RNA, 20 nt, Human
cucccuagccuccacucuag

SEQ ID NO: 782525 - RNA, 22 nt, Human
cucccugaacccgaggcaccgg

SEQ ID NO: 782526 - RNA, 24 nt, Human
cuccgccuccuccccucacagucc

SEQ ID NO: 782527 - RNA, 25 nt, Human
cucuagggcaagggcccagccuuuc

SEQ ID NO: 782528 - RNA, 20 nt, Human
cucucuggcugcacacggcu

SEQ ID NO: 782529 - RNA, 21 nt, Human
cugccucagccuuccagguag

SEQ ID NO: 782530 - RNA, 18 nt, Human
cugccuccccgcuguccc

SEQ ID NO: 782531 - RNA, 23 nt, Human
cuggggcuguccucccaggcggc

SEQ ID NO: 782532 - RNA, 22 nt, Human
cugguaguggcccugaggcuug

SEQ ID NO: 782533 - RNA, 23 nt, Human
cuguccccgcugcaggacagcuc

SEQ ID NO: 782534 - RNA, 24 nt, Human
cuguccccgcugcaggacagcucu

SEQ ID NO: 782535 - RNA, 24 nt, Human
cuuggccucucaaagugcugggau

SEQ ID NO: 782536 - RNA, 26 nt, Human
gaccucaggugauccaccugccugcc

SEQ ID NO: 782537 - RNA, 20 nt, Human
gagugcaguggcaugaucuc

SEQ ID NO: 782538 - RNA, 18 nt, Human
gaugggacgaacgagggg

SEQ ID NO: 782539 - RNA, 22 nt, Human
gauuauaggcaugagccauugc

SEQ ID NO: 782540 - RNA, 22 nt, Human
gauuauaggcaugagccauugc

SEQ ID NO: 782541 - RNA, 19 nt, Human
gauucuucugccucagccu

SEQ ID NO: 782542 - RNA, 23 nt, Human
gcaaaagguccccccgcccccca

SEQ ID NO: 782543 - RNA, 20 nt, Human
gcaccacgaugcccggcuaa

SEQ ID NO: 782544 - RNA, 19 nt, Human
gcagcgugucugggaagcc

SEQ ID NO: 782545 - RNA, 19 nt, Human
gcaucacugucccuucugg

SEQ ID NO: 782546 - RNA, 21 nt, Human
gcaucccccuaguccccaccc

SEQ ID NO: 782547 - RNA, 24 nt, Human
gccauguuggccaggcugaucuug

SEQ ID NO: 782548 - RNA, 20 nt, Human
gcccaucaccacuccucuua

SEQ ID NO: 782549 - RNA, 22 nt, Human
gccuuggccucucaaagugcug

SEQ ID NO: 782550 - RNA, 24 nt, Human
gcgauucuucugccucagccuucc

SEQ ID NO: 782551 - RNA, 21 nt, Human
gcggcucccagguccucaucc

SEQ ID NO: 782552 - RNA, 20 nt, Human
gcucacugcaaccuucuccu

SEQ ID NO: 782553 - RNA, 22 nt, Human
gcucccguuccucccuagccuc

SEQ ID NO: 782554 - RNA, 23 nt, Human
gcugaucuugaacuccugaccuc

SEQ ID NO: 782555 - RNA, 19 nt, Human
gcuggagugcaguggcaug

SEQ ID NO: 782556 - RNA, 20 nt, Human
ggaagccacauccgucuaca

SEQ ID NO: 782557 - RNA, 24 nt, Human
ggcugaucuugaacuccugaccuc

SEQ ID NO: 782558 - RNA, 19 nt, Human
gggaacguguagggcagga

SEQ ID NO: 782559 - RNA, 18 nt, Human
gggcaagggcccagccuu

SEQ ID NO: 782560 - RNA, 18 nt, Human
gggcaggacaggcuccuc

SEQ ID NO: 782561 - RNA, 22 nt, Human
gggguuuugccauguuggccag

SEQ ID NO: 782562 - RNA, 23 nt, Human
gggguuuugccauguuggccagg

SEQ ID NO: 782563 - RNA, 22 nt, Human
ggguuuugccauguuggccagg

SEQ ID NO: 782564 - RNA, 23 nt, Human
guacagaugggguuuugccaugu

SEQ ID NO: 782565 - RNA, 18 nt, Human
guaguugggauuacaggc

SEQ ID NO: 782566 - RNA, 19 nt, Human
guauuuuuaguacagaugg

SEQ ID NO: 782567 - RNA, 24 nt, Human
guccaggcuggagugcaguggcau

SEQ ID NO: 782568 - RNA, 21 nt, Human
gugagcagugucguaaacuug

SEQ ID NO: 782569 - RNA, 26 nt, Human
gugauccaccugccugccuuggccuc

SEQ ID NO: 782570 - RNA, 18 nt, Human
guggcccugaggcuugcu

SEQ ID NO: 782571 - RNA, 18 nt, Human
guuguccaggcuggagug

SEQ ID NO: 782572 - RNA, 19 nt, Human
uaaacagaaaacccacaca

SEQ ID NO: 782573 - RNA, 24 nt, Human
uaaacagaaaacccacacauuuuu

SEQ ID NO: 782574 - RNA, 26 nt, Human
uaaguaaacaauauaaugcgaaauaa

SEQ ID NO: 782575 - RNA, 24 nt, Human
uaauccaaggagcuuguuagauac

SEQ ID NO: 782576 - RNA, 22 nt, Human
uacagaugggguuuugccaugu

SEQ ID NO: 782577 - RNA, 21 nt, Human
uagaacuuggaggggcgaggg

SEQ ID NO: 782578 - RNA, 18 nt, Human
uaggaggaaguuuucccu

SEQ ID NO: 782579 - RNA, 25 nt, Human
uagggcaagggcccagccuuucacu

SEQ ID NO: 782580 - RNA, 22 nt, Human
uagggcaggacaggcuccucuu

SEQ ID NO: 782581 - RNA, 24 nt, Human
uaguacagaugggguuuugccaug

SEQ ID NO: 782582 - RNA, 24 nt, Human
uagucugaggagcuugcuagauac

SEQ ID NO: 782583 - RNA, 23 nt, Human
uauuccugaacccccacacucaa

SEQ ID NO: 782584 - RNA, 22 nt, Human
uauuccugagcccacacacaaa

SEQ ID NO: 782585 - RNA, 24 nt, Human
ucaaagugcugggauuauaggcau

SEQ ID NO: 782586 - RNA, 18 nt, Human
ucacugcaaccuucuccu

SEQ ID NO: 782587 - RNA, 19 nt, Human
ucacugcaaccuucuccuc

SEQ ID NO: 782588 - RNA, 24 nt, Human
ucagccgcaaaagguccccccgcc

SEQ ID NO: 782589 - RNA, 23 nt, Human
ucagucccgcuccgaggagcacc

SEQ ID NO: 782590 - RNA, 26 nt, Human
uccacacccucccugcuucuggucca

SEQ ID NO: 782591 - RNA, 23 nt, Human
uccagguaguugggauuacaggc

SEQ ID NO: 782592 - RNA, 24 nt, Human
uccagguaguugggauuacaggca

SEQ ID NO: 782593 - RNA, 20 nt, Human
uccaucuuguuaccaucagc

SEQ ID NO: 782594 - RNA, 30 nt, Human
ucccagguccucauccagggaagagccccu

SEQ ID NO: 782595 - RNA, 20 nt, Human
uccccacuguccccgcugca

SEQ ID NO: 782596 - RNA, 20 nt, Human
uccccaguucaagcgauucu

SEQ ID NO: 782597 - RNA, 24 nt, Human
uccccaguucaagcgauucuucug

SEQ ID NO: 782598 - RNA, 23 nt, Human
uccccgcugcaggacagcucuua

SEQ ID NO: 782599 - RNA, 25 nt, Human
uccccgcugucccugcuguccccac

SEQ ID NO: 782600 - RNA, 23 nt, Human
ucccguuccucccuagccuccac

SEQ ID NO: 782601 - RNA, 20 nt, Human
ucccuaaagguugagaaccc

SEQ ID NO: 782602 - RNA, 25 nt, Human
ucccuaaagguugagaaccccugcc

SEQ ID NO: 782603 - RNA, 19 nt, Human
ucccugcuguccccacugu

SEQ ID NO: 782604 - RNA, 23 nt, Human
ucccugcuguccccacugucccc

SEQ ID NO: 782605 - RNA, 23 nt, Human
ucccuuucuggggcuguccuccc

SEQ ID NO: 782606 - RNA, 23 nt, Human
uccgcaccgugacaaccugggac

SEQ ID NO: 782607 - RNA, 23 nt, Human
uccgccuccuccccucacagucc

SEQ ID NO: 782608 - RNA, 19 nt, Human
ucuacagcucccguuccuc

SEQ ID NO: 782609 - RNA, 22 nt, Human
ucuaccauucugggagcaucuu

SEQ ID NO: 782610 - RNA, 24 nt, Human
ucucaaagugcugggauuauaggc

SEQ ID NO: 782611 - RNA, 18 nt, Human
ucuccuccccaguucaag

SEQ ID NO: 782612 - RNA, 24 nt, Human
ucuguuguccaggcuggagugcag

SEQ ID NO: 782613 - RNA, 23 nt, Human
ucuugaacuccugaccucaggug

SEQ ID NO: 782614 - RNA, 23 nt, Human
ucuugcucuguuguccaggcugg

SEQ ID NO: 782615 - RNA, 24 nt, Human
ucuugcucuguuguccaggcugga

SEQ ID NO: 782616 - RNA, 18 nt, Human
ugaagaccccuagaacag

SEQ ID NO: 782617 - RNA, 24 nt, Human
ugaccucaggugauccaccugccu

SEQ ID NO: 782618 - RNA, 18 nt, Human
ugagaugggaacgggguc

SEQ ID NO: 782619 - RNA, 20 nt, Human
ugagaugggaacggggucaa

SEQ ID NO: 782620 - RNA, 24 nt, Human
ugccauguuggccaggcugaucuu

SEQ ID NO: 782621 - RNA, 27 nt, Human
ugccauguuggccaggcugaucuugaa

SEQ ID NO: 782622 - RNA, 22 nt, Human
uggacaguuccauggcuucuuc

SEQ ID NO: 782623 - RNA, 19 nt, Human
uggagugcaguggcaugau

SEQ ID NO: 782624 - RNA, 24 nt, Human
uggagugcaguggcaugaucucgg

SEQ ID NO: 782625 - RNA, 19 nt, Human
uggcaucacugucccuucu

SEQ ID NO: 782626 - RNA, 24 nt, Human
uggccaggcugaucuugaacuccu

SEQ ID NO: 782627 - RNA, 19 nt, Human
uggccuucuccacacccuc

SEQ ID NO: 782628 - RNA, 24 nt, Human
ugggagcaucuuugagaauuugau

SEQ ID NO: 782629 - RNA, 21 nt, Human
ugggauuacaggcacgcacca

SEQ ID NO: 782630 - RNA, 26 nt, Human
ugggauuacaggcacgcaccacgaug

SEQ ID NO: 782631 - RNA, 18 nt, Human
ugggauuauaggcaugag

SEQ ID NO: 782632 - RNA, 19 nt, Human
ugggauuauaggcaugagc

SEQ ID NO: 782633 - RNA, 21 nt, Human
ugggauuauaggcaugagcca

SEQ ID NO: 782634 - RNA, 21 nt, Human
ugggauuauaggcaugagcca

SEQ ID NO: 782635 - RNA, 21 nt, Human
ugggauuauaggcaugagcca

SEQ ID NO: 782636 - RNA, 22 nt, Human
ugggauuauaggcaugagccau

SEQ ID NO: 782637 - RNA, 24 nt, Human
ugggauuauaggcaugagccauug

SEQ ID NO: 782638 - RNA, 31 nt, Human
ugggauuauaggcaugagccauugcgcccgg

SEQ ID NO: 782639 - RNA, 22 nt, Human
uggggcuguccucccaggcggc

SEQ ID NO: 782640 - RNA, 24 nt, Human
ugggguuuugccauguuggccagg

SEQ ID NO: 782641 - RNA, 20 nt, Human
uguccaggcuggagugcagu

SEQ ID NO: 782642 - RNA, 21 nt, Human
uguccaggcuggagugcagug

SEQ ID NO: 782643 - RNA, 22 nt, Human
uguccaggcuggagugcagugg

SEQ ID NO: 782644 - RNA, 24 nt, Human
uguccaggcuggagugcaguggca

SEQ ID NO: 782645 - RNA, 19 nt, Human
ugucccuucuggaagagca

SEQ ID NO: 782646 - RNA, 20 nt, Human
ugucugggaagccacauccg

SEQ ID NO: 782647 - RNA, 22 nt, Human
uguguuucugugagggucgcug

SEQ ID NO: 782648 - RNA, 23 nt, Human
uuagauacauauuccugaacccc

SEQ ID NO: 782649 - RNA, 18 nt, Human
uuaguacagaugggguuu

SEQ ID NO: 782650 - RNA, 22 nt, Human
uuaguacagaugggguuuugcc

SEQ ID NO: 782651 - RNA, 24 nt, Human
uuaguacagaugggguuuugccau

SEQ ID NO: 782652 - RNA, 21 nt, Human
uuauccucggaaggccccuug

SEQ ID NO: 782653 - RNA, 23 nt, Human
uucaagcgauucuucugccucag

SEQ ID NO: 782654 - RNA, 24 nt, Human
uucaagcgauucuucugccucagc

SEQ ID NO: 782655 - RNA, 24 nt, Human
uugcucuguuguccaggcuggagu

SEQ ID NO: 782656 - RNA, 23 nt, Human
uuguauuuuuaguacagaugggg

SEQ ID NO: 782657 - RNA, 24 nt, Human
uuguccaggcuggagugcaguggc

SEQ ID NO: 782658 - RNA, 19 nt, Human
uuucugugagggucgcugg

SEQ ID NO: 782659 - RNA, 18 nt, Human
uuugagaaggagucuugc

SEQ ID NO: 782660 - RNA, 23 nt, Human
uuuuccugccuccccgcuguccc

SEQ ID NO: 782661 - RNA, 21 nt, Human
uuuuuaguacagaugggguuu

SEQ ID NO: 782662 - RNA, 24 nt, Human
uuuuuaguacagaugggguuuugc

SEQ ID NO: 782663 - RNA, 25 nt, Human
aaaaaacccagccaggcaugguggc

SEQ ID NO: 782664 - RNA, 23 nt, Human
aaaaaaucaaaauaggcuaggca

SEQ ID NO: 782665 - RNA, 22 nt, Human
aaaaaggaauuggccaaaaaga

SEQ ID NO: 782666 - RNA, 22 nt, Human
aaaacaaaaaaaccccuuuggg

SEQ ID NO: 782667 - RNA, 24 nt, Human
aaaacaaaaaaaccccuuugggug

SEQ ID NO: 782668 - RNA, 25 nt, Human
aaaacaaaacaaaacaaaaaaaccc

SEQ ID NO: 782669 - RNA, 23 nt, Human
aaaacagcauaaaaacuguacau

SEQ ID NO: 782670 - RNA, 22 nt, Human
aaaagaaaaaaaaaaggcaaaa

SEQ ID NO: 782671 - RNA, 27 nt, Human
aaaagaaaaaaaaaaggcaaaacaugg

SEQ ID NO: 782672 - RNA, 18 nt, Human
aaaagcaucaggauuuca

SEQ ID NO: 782673 - RNA, 24 nt, Human
aaaaggcaaaacauggcaguggga

SEQ ID NO: 782674 - RNA, 19 nt, Human
aaacaaaacaaaacaaaaa

SEQ ID NO: 782675 - RNA, 23 nt, Human
aaacaccagcggcacuuggaacu

SEQ ID NO: 782676 - RNA, 31 nt, Human
aaacaccagcggcacuuggaacuccagagcc

SEQ ID NO: 782677 - RNA, 18 nt, Human
aaaggaaguucgucccca

SEQ ID NO: 782678 - RNA, 20 nt, Human
aaagguccaggaggaagagu

SEQ ID NO: 782679 - RNA, 18 nt, Human
aaauagacucggaugugg

SEQ ID NO: 782680 - RNA, 20 nt, Human
aacaaaaaaaccccuuuggg

SEQ ID NO: 782681 - RNA, 21 nt, Human
aacaaaacaaaaaaaccccuu

SEQ ID NO: 782682 - RNA, 22 nt, Human
aacaaaacaaaaaaaccccuuu

SEQ ID NO: 782683 - RNA, 23 nt, Human
aacaaaacaaaaaaaccccuuug

SEQ ID NO: 782684 - RNA, 22 nt, Human
aacaaggaaaaaccaagcccug

SEQ ID NO: 782685 - RNA, 20 nt, Human
aacagcuggggccuggagac

SEQ ID NO: 782686 - RNA, 20 nt, Human
aacaguacaaaugacacaau

SEQ ID NO: 782687 - RNA, 24 nt, Human
aacucacuucguuucugucuucca

SEQ ID NO: 782688 - RNA, 25 nt, Human
aagcaagacccugucucaaaaacaa

SEQ ID NO: 782689 - RNA, 19 nt, Human
aagcagaauccucuccgug

SEQ ID NO: 782690 - RNA, 20 nt, Human
aagcagguuauacaaggggg

SEQ ID NO: 782691 - RNA, 22 nt, Human
aagccgggccagcugcugcugg

SEQ ID NO: 782692 - RNA, 18 nt, Human
aagcguagaagcuggcuu

SEQ ID NO: 782693 - RNA, 24 nt, Human
aauggcucaugccuaucaucucag

SEQ ID NO: 782694 - RNA, 20 nt, Human
acaaaacaaaacaaaaaaac

SEQ ID NO: 782695 - RNA, 23 nt, Human
acaaaacaaaacaaaaaaacccc

SEQ ID NO: 782696 - RNA, 24 nt, Human
acaaagcaagacccugucucaaaa

SEQ ID NO: 782697 - RNA, 22 nt, Human
acaaucggcaaaggucaauggc

SEQ ID NO: 782698 - RNA, 23 nt, Human
acagaaggcuacuuauuucuaca

SEQ ID NO: 782699 - RNA, 19 nt, Human
acagacagccaccacaagc

SEQ ID NO: 782700 - RNA, 25 nt, Human
acagagcaagaccuugacucuaaga

SEQ ID NO: 782701 - RNA, 21 nt, Human
acaggcuggguguccuggggc

SEQ ID NO: 782702 - RNA, 20 nt, Human
acauagcaagagacaagaag

SEQ ID NO: 782703 - RNA, 21 nt, Human
acauagcaagagacaagaagu

SEQ ID NO: 782704 - RNA, 24 nt, Human
accacgucacugcacuccagccug

SEQ ID NO: 782705 - RNA, 18 nt, Human
acccgcggcugcuccccg

SEQ ID NO: 782706 - RNA, 25 nt, Human
acccguauguccuucccucccccaa

SEQ ID NO: 782707 - RNA, 22 nt, Human
acccugucucaaaaacaaaaca

SEQ ID NO: 782708 - RNA, 23 nt, Human
accuccuccuccguguacuccag

SEQ ID NO: 782709 - RNA, 24 nt, Human
acgucacugcacuccagccugggc

SEQ ID NO: 782710 - RNA, 22 nt, Human
acuccagcuuggcccgcuccuc

SEQ ID NO: 782711 - RNA, 18 nt, Human
acugcacuccagccuggg

SEQ ID NO: 782712 - RNA, 23 nt, Human
acugcacuccagccugggcaaca

SEQ ID NO: 782713 - RNA, 18 nt, Human
acuggggcguguccaggg

SEQ ID NO: 782714 - RNA, 27 nt, Human
acuguucucuuggauccucaaucuggg

SEQ ID NO: 782715 - RNA, 19 nt, Human
acuucaaauggaaaucugu

SEQ ID NO: 782716 - RNA, 25 nt, Human
acuugacaucuuccgaucaaucucu

SEQ ID NO: 782717 - RNA, 23 nt, Human
agaaauauuuuucaaacaguaca

SEQ ID NO: 782718 - RNA, 20 nt, Human
agaacuuugggaggcugagg

SEQ ID NO: 782719 - RNA, 24 nt, Human
agaauccucuccguggcgcccuuc

SEQ ID NO: 782720 - RNA, 27 nt, Human
agacaagaagugugaaaagcaucagga

SEQ ID NO: 782721 - RNA, 23 nt, Human
agagagaaaagagugacaaaaaa

SEQ ID NO: 782722 - RNA, 22 nt, Human
agagcuccucauucagcugccu

SEQ ID NO: 782723 - RNA, 22 nt, Human
agcaucucgccccagagagucg

SEQ ID NO: 782724 - RNA, 18 nt, Human
agccaggcaugguggcuc

SEQ ID NO: 782725 - RNA, 20 nt, Human
agccaggcaugguggcucgc

SEQ ID NO: 782726 - RNA, 24 nt, Human
agccugggcaacagagcaagaccu

SEQ ID NO: 782727 - RNA, 19 nt, Human
agcggguggcuucuuccag

SEQ ID NO: 782728 - RNA, 20 nt, Human
agcugccucccugaacagcc

SEQ ID NO: 782729 - RNA, 19 nt, Human
agcugugccgugguucugg

SEQ ID NO: 782730 - RNA, 22 nt, Human
aggaagggcguguccaggggcg

SEQ ID NO: 782731 - RNA, 18 nt, Human
aggaauagugggacgacc

SEQ ID NO: 782732 - RNA, 18 nt, Human
aggcaaaauauuuauauc

SEQ ID NO: 782733 - RNA, 21 nt, Human
aggcacaauggcucaugccua

SEQ ID NO: 782734 - RNA, 18 nt, Human
aggcaggagggucacuug

SEQ ID NO: 782735 - RNA, 23 nt, Human
aggcaggagggucacuugagccc

SEQ ID NO: 782736 - RNA, 24 nt, Human
aggcaggagggucacuugagccca

SEQ ID NO: 782737 - RNA, 21 nt, Human
aggcugaggcaggagggucac

SEQ ID NO: 782738 - RNA, 24 nt, Human
aggcugaggcaggagggucacuug

SEQ ID NO: 782739 - RNA, 18 nt, Human
agggcgggguggggggag

SEQ ID NO: 782740 - RNA, 18 nt, Human
aggguucgucuuuccaaa

SEQ ID NO: 782741 - RNA, 23 nt, Human
aggugucaaaaaccaaaccagcc

SEQ ID NO: 782742 - RNA, 24 nt, Human
agguugaggcugcagugagcuaug

SEQ ID NO: 782743 - RNA, 20 nt, Human
aguccagggaggugcgggcc

SEQ ID NO: 782744 - RNA, 20 nt, Human
agugacaaaaaacaaagaga

SEQ ID NO: 782745 - RNA, 19 nt, Human
auaaagucugcaaacauac

SEQ ID NO: 782746 - RNA, 18 nt, Human
auagccgaggcgugugcc

SEQ ID NO: 782747 - RNA, 22 nt, Human
auauacaugguaaaugcacaua

SEQ ID NO: 782748 - RNA, 19 nt, Human
auccgacagacaugcggag

SEQ ID NO: 782749 - RNA, 24 nt, Human
augaaaauaaaacagguggauaaa

SEQ ID NO: 782750 - RNA, 20 nt, Human
augacgguagucaaguuugg

SEQ ID NO: 782751 - RNA, 19 nt, Human
auggagauggugugugcag

SEQ ID NO: 782752 - RNA, 19 nt, Human
augguaaaugcacauauga

SEQ ID NO: 782753 - RNA, 21 nt, Human
caaaacaaaaaaaccccuuug

SEQ ID NO: 782754 - RNA, 23 nt, Human
caaaacaaaacaaaaaaaccccu

SEQ ID NO: 782755 - RNA, 23 nt, Human
caaacaccccacugucgcuggcu

SEQ ID NO: 782756 - RNA, 25 nt, Human
caaagcaagacccugucucaaaaac

SEQ ID NO: 782757 - RNA, 22 nt, Human
caacaaagcaagacccugucuc

SEQ ID NO: 782758 - RNA, 18 nt, Human
caacagagcaagaccuug

SEQ ID NO: 782759 - RNA, 19 nt, Human
caacgcgcuggaaugcacg

SEQ ID NO: 782760 - RNA, 23 nt, Human
caagacccugucucaaaaacaaa

SEQ ID NO: 782761 - RNA, 21 nt, Human
caaggaaaaaaaaguacuaua

SEQ ID NO: 782762 - RNA, 19 nt, Human
caaugcacuccaucagacg

SEQ ID NO: 782763 - RNA, 21 nt, Human
caauggcucaugccuaucauc

SEQ ID NO: 782764 - RNA, 22 nt, Human
caauuagagagaaaagagugac

SEQ ID NO: 782765 - RNA, 21 nt, Human
cacaacaaggaaaaaccaagc

SEQ ID NO: 782766 - RNA, 23 nt, Human
cacaagcaagcaggcugaagccc

SEQ ID NO: 782767 - RNA, 20 nt, Human
cacacaggcuuuuuaacugg

SEQ ID NO: 782768 - RNA, 21 nt, Human
cacacaggcuuuuuaacuggg

SEQ ID NO: 782769 - RNA, 18 nt, Human
cacacaugcuuccgaguc

SEQ ID NO: 782770 - RNA, 23 nt, Human
cacacccagccucccgcguccuu

SEQ ID NO: 782771 - RNA, 21 nt, Human
cacacguauaacugaagugac

SEQ ID NO: 782772 - RNA, 21 nt, Human
cacaggcuggguguccugggg

SEQ ID NO: 782773 - RNA, 25 nt, Human
caccacaagcaagcaggcugaagcc

SEQ ID NO: 782774 - RNA, 18 nt, Human
cacccagccucccgcguc

SEQ ID NO: 782775 - RNA, 22 nt, Human
caccgccagccccgccggguuc

SEQ ID NO: 782776 - RNA, 21 nt, Human
cacggcuggaggcuagggacc

SEQ ID NO: 782777 - RNA, 21 nt, Human
cacugaacacacguauaacug

SEQ ID NO: 782778 - RNA, 19 nt, Human
cacugcacuccagccuggg

SEQ ID NO: 782779 - RNA, 20 nt, Human
cacugcacuccagccugggc

SEQ ID NO: 782780 - RNA, 21 nt, Human
cacugcacuccagccugggca

SEQ ID NO: 782781 - RNA, 22 nt, Human
cacugcacuccagccugggcaa

SEQ ID NO: 782782 - RNA, 23 nt, Human
cacugcacuccagccugggcaac

SEQ ID NO: 782783 - RNA, 24 nt, Human
cacugcacuccagccugggcaaca

SEQ ID NO: 782784 - RNA, 26 nt, Human
cacugcacuccagccugggcaacaaa

SEQ ID NO: 782785 - RNA, 18 nt, Human
cacuuggaugggcucuuu

SEQ ID NO: 782786 - RNA, 25 nt, Human
cagaacugcugggguacaccagcau

SEQ ID NO: 782787 - RNA, 18 nt, Human
cagaacuuugggaggcug

SEQ ID NO: 782788 - RNA, 24 nt, Human
cagaacuuugggaggcugaggcag

SEQ ID NO: 782789 - RNA, 21 nt, Human
cagcagggccuccuucuccuu

SEQ ID NO: 782790 - RNA, 20 nt, Human
cagcaucgccaggcacgccu

SEQ ID NO: 782791 - RNA, 25 nt, Human
cagccucggccgugcuuggccagga

SEQ ID NO: 782792 - RNA, 19 nt, Human
cagcgaggacagcgaggag

SEQ ID NO: 782793 - RNA, 20 nt, Human
cagcucucguuuuaaucugg

SEQ ID NO: 782794 - RNA, 21 nt, Human
cagcugcggagucacugaaca

SEQ ID NO: 782795 - RNA, 19 nt, Human
cagcugcugguauuccucc

SEQ ID NO: 782796 - RNA, 21 nt, Human
cagcugguagaucuccuugga

SEQ ID NO: 782797 - RNA, 20 nt, Human
cagggucccgggcggagcuc

SEQ ID NO: 782798 - RNA, 26 nt, Human
cagucuuaaaauacaucuuaaaguca

SEQ ID NO: 782799 - RNA, 20 nt, Human
cagugaauuugccugaacuc

SEQ ID NO: 782800 - RNA, 20 nt, Human
cauagccgaggcgugugccc

SEQ ID NO: 782801 - RNA, 25 nt, Human
caucaaagacaaacuccccgaugau

SEQ ID NO: 782802 - RNA, 26 nt, Human
caucaaagacaaacuccccgaugaua

SEQ ID NO: 782803 - RNA, 22 nt, Human
cauccgucuugccggagaugga

SEQ ID NO: 782804 - RNA, 25 nt, Human
caucuucguuccuuuugguuagagg

SEQ ID NO: 782805 - RNA, 19 nt, Human
caugccuaucaucucagaa

SEQ ID NO: 782806 - RNA, 19 nt, Human
caugcgcucuugcucucgc

SEQ ID NO: 782807 - RNA, 22 nt, Human
ccaaaaagaaaaaaaaaaggca

SEQ ID NO: 782808 - RNA, 21 nt, Human
ccaaguccagggaggugcggg

SEQ ID NO: 782809 - RNA, 24 nt, Human
ccacaagcaagcaggcugaagccc

SEQ ID NO: 782810 - RNA, 21 nt, Human
ccacagacagccaccacaagc

SEQ ID NO: 782811 - RNA, 23 nt, Human
ccaccacaagcaagcaggcugaa

SEQ ID NO: 782812 - RNA, 18 nt, Human
ccacuccgaacaaaaggc

SEQ ID NO: 782813 - RNA, 20 nt, Human
ccagagccuuggagcaguaa

SEQ ID NO: 782814 - RNA, 21 nt, Human
cccaaacaagcacuuucaaag

SEQ ID NO: 782815 - RNA, 24 nt, Human
cccaaacaagcacuuucaaaggug

SEQ ID NO: 782816 - RNA, 22 nt, Human
cccacggcuggaggcuagggac

SEQ ID NO: 782817 - RNA, 28 nt, Human
cccauagccgaggcgugugccggggucc

SEQ ID NO: 782818 - RNA, 19 nt, Human
ccccacagacagccaccac

SEQ ID NO: 782819 - RNA, 24 nt, Human
ccccagagagucgaagggaaugag

SEQ ID NO: 782820 - RNA, 24 nt, Human
ccccauagccgaggcgugugcccg

SEQ ID NO: 782821 - RNA, 21 nt, Human
ccccggcuggaggccagagac

SEQ ID NO: 782822 - RNA, 19 nt, Human
ccccguguggcugaagggc

SEQ ID NO: 782823 - RNA, 22 nt, Human
cccgccggguucuucagcugca

SEQ ID NO: 782824 - RNA, 24 nt, Human
cccgcuccuccuccagccgggcca

SEQ ID NO: 782825 - RNA, 19 nt, Human
cccuccucuccaaccucuu

SEQ ID NO: 782826 - RNA, 18 nt, Human
ccgcagcaggccacggag

SEQ ID NO: 782827 - RNA, 19 nt, Human
ccgccggguucuucagcug

SEQ ID NO: 782828 - RNA, 22 nt, Human
ccgucuugccggagauggagau

SEQ ID NO: 782829 - RNA, 18 nt, Human
ccguguacuccagcuugg

SEQ ID NO: 782830 - RNA, 19 nt, Human
ccguguacuccagcuuggc

SEQ ID NO: 782831 - RNA, 23 nt, Human
ccguguggcugaagggccgccau

SEQ ID NO: 782832 - RNA, 28 nt, Human
ccucccccaaacaagcacuuucaaaggu

SEQ ID NO: 782833 - RNA, 23 nt, Human
ccucccgcagcaggccacggagc

SEQ ID NO: 782834 - RNA, 23 nt, Human
ccucccugaacagccuagggucc

SEQ ID NO: 782835 - RNA, 24 nt, Human
ccuccguguacuccagcuuggccc

SEQ ID NO: 782836 - RNA, 22 nt, Human
ccuccucccagccggcgggcag

SEQ ID NO: 782837 - RNA, 19 nt, Human
ccuccugacucaaaccuga

SEQ ID NO: 782838 - RNA, 22 nt, Human
ccuccugacucaaaccugaucc

SEQ ID NO: 782839 - RNA, 21 nt, Human
ccuccugggccagcucgaacc

SEQ ID NO: 782840 - RNA, 20 nt, Human
ccucggccaguucccucucc

SEQ ID NO: 782841 - RNA, 19 nt, Human
ccucuccaaccucuuggca

SEQ ID NO: 782842 - RNA, 22 nt, Human
ccucugcaacacacacaugcuu

SEQ ID NO: 782843 - RNA, 18 nt, Human
ccugggccagcucgaacc

SEQ ID NO: 782844 - RNA, 20 nt, Human
ccuguggcccaccccauuga

SEQ ID NO: 782845 - RNA, 21 nt, Human
ccuucaugacacaguggcgug

SEQ ID NO: 782846 - RNA, 21 nt, Human
cgaauaauccgacagacaugc

SEQ ID NO: 782847 - RNA, 19 nt, Human
cgacucgcuggguaguucu

SEQ ID NO: 782848 - RNA, 24 nt, Human
cgaggacagcgaggagcgggagga

SEQ ID NO: 782849 - RNA, 23 nt, Human
cgcuggguaguucuaguuacccg

SEQ ID NO: 782850 - RNA, 20 nt, Human
cggagaugcggcgugcccuc

SEQ ID NO: 782851 - RNA, 25 nt, Human
cggcaaaggucaauggcuuuguuau

SEQ ID NO: 782852 - RNA, 19 nt, Human
cggcccacgccagagacug

SEQ ID NO: 782853 - RNA, 24 nt, Human
cggccugcuccuccuugcgcucca

SEQ ID NO: 782854 - RNA, 23 nt, Human
cgggaggacagcgaugccaggga

SEQ ID NO: 782855 - RNA, 24 nt, Human
cgucacugcacuccagccugggca

SEQ ID NO: 782856 - RNA, 24 nt, Human
cguguccaggggcgagcuuggggg

SEQ ID NO: 782857 - RNA, 21 nt, Human
cuaggcacaauggcucaugcc

SEQ ID NO: 782858 - RNA, 20 nt, Human
cucaaaaacaaaacaaaaca

SEQ ID NO: 782859 - RNA, 26 nt, Human
cucauugucaagccgggccagcugcu

SEQ ID NO: 782860 - RNA, 21 nt, Human
cuccagccgggccacaucucc

SEQ ID NO: 782861 - RNA, 20 nt, Human
cucccgcagcaggccacgga

SEQ ID NO: 782862 - RNA, 21 nt, Human
cuccgccacccuccuggucug

SEQ ID NO: 782863 - RNA, 26 nt, Human
cucgcgccuccucccagccggcgggc

SEQ ID NO: 782864 - RNA, 20 nt, Human
cucucguuuuaaucuggaaa

SEQ ID NO: 782865 - RNA, 21 nt, Human
cugaacacuucguuaaacacc

SEQ ID NO: 782866 - RNA, 21 nt, Human
cugacacaguggguuucccca

SEQ ID NO: 782867 - RNA, 22 nt, Human
cugaccucugcaacacacacau

SEQ ID NO: 782868 - RNA, 21 nt, Human
cugagcagcaaauggguggcc

SEQ ID NO: 782869 - RNA, 18 nt, Human
cugcagcagggccuccuu

SEQ ID NO: 782870 - RNA, 20 nt, Human
cugccacugucgcgcaggag

SEQ ID NO: 782871 - RNA, 20 nt, Human
cugcuccuccuugcgcucca

SEQ ID NO: 782872 - RNA, 19 nt, Human
cugucgcgcaggaguccca

SEQ ID NO: 782873 - RNA, 22 nt, Human
cugucucaaaaacaaaacaaaa

SEQ ID NO: 782874 - RNA, 22 nt, Human
cuucagacucacgcugagcaca

SEQ ID NO: 782875 - RNA, 21 nt, Human
cuuccccguccccggggaccc

SEQ ID NO: 782876 - RNA, 23 nt, Human
cuugagcccaggagguugaggcu

SEQ ID NO: 782877 - RNA, 20 nt, Human
cuuguggggcacaggcuggg

SEQ ID NO: 782878 - RNA, 23 nt, Human
cuuucuggcuucuucauauugcc

SEQ ID NO: 782879 - RNA, 25 nt, Human
gaaaaaaaaaaggcaaaacauggca

SEQ ID NO: 782880 - RNA, 21 nt, Human
gaagagugcauuucaucuaca

SEQ ID NO: 782881 - RNA, 23 nt, Human
gacaagaagugugaaaagcauca

SEQ ID NO: 782882 - RNA, 21 nt, Human
gacacaguggcguggcaggag

SEQ ID NO: 782883 - RNA, 21 nt, Human
gacacaguggcguggcaggag

SEQ ID NO: 782884 - RNA, 20 nt, Human
gacagcgaggacagcgagga

SEQ ID NO: 782885 - RNA, 21 nt, Human
gaccacgucacugcacuccag

SEQ ID NO: 782886 - RNA, 21 nt, Human
gagacaagaagugugaaaagc

SEQ ID NO: 782887 - RNA, 18 nt, Human
gagcgcuggcuggugggg

SEQ ID NO: 782888 - RNA, 27 nt, Human
gagcugccucccugaacagccuagggu

SEQ ID NO: 782889 - RNA, 18 nt, Human
gagcuggcguacgagcgg

SEQ ID NO: 782890 - RNA, 23 nt, Human
gaggugcgggccaugagcucagc

SEQ ID NO: 782891 - RNA, 18 nt, Human
gcaaacauacuggcuucg

SEQ ID NO: 782892 - RNA, 22 nt, Human
gcaaggcuagaggcagaaauac

SEQ ID NO: 782893 - RNA, 21 nt, Human
gcacacaggcuuuuuaacugg

SEQ ID NO: 782894 - RNA, 21 nt, Human
gcaggagucccacguggaucu

SEQ ID NO: 782895 - RNA, 22 nt, Human
gcaggagucccacguggaucug

SEQ ID NO: 782896 - RNA, 19 nt, Human
gcaguucuuccugcagcug

SEQ ID NO: 782897 - RNA, 24 nt, Human
gcccagcaguucuuccugcagcug

SEQ ID NO: 782898 - RNA, 24 nt, Human
gcccaggagguugaggcugcagug

SEQ ID NO: 782899 - RNA, 25 nt, Human
gcccuccucuccaaccucuuggcac

SEQ ID NO: 782900 - RNA, 23 nt, Human
gccugagcagcaaauggguggcc

SEQ ID NO: 782901 - RNA, 21 nt, Human
gccuucuucagcaucuucuca

SEQ ID NO: 782902 - RNA, 21 nt, Human
gcgaaggguucgucuuuccaa

SEQ ID NO: 782903 - RNA, 19 nt, Human
gcgcuccaucuccaggacc

SEQ ID NO: 782904 - RNA, 21 nt, Human
gcuacaauuaaauauuccuuc

SEQ ID NO: 782905 - RNA, 18 nt, Human
gcucucguuuuaaucugg

SEQ ID NO: 782906 - RNA, 22 nt, Human
gcugcggagucacugaacacac

SEQ ID NO: 782907 - RNA, 19 nt, Human
gcugcuucuuccagaaaga

SEQ ID NO: 782908 - RNA, 22 nt, Human
gcuggaaugcacggggauucug

SEQ ID NO: 782909 - RNA, 19 nt, Human
ggaagaccugcaugacugc

SEQ ID NO: 782910 - RNA, 21 nt, Human
ggaagcccgaggggccugggg

SEQ ID NO: 782911 - RNA, 18 nt, Human
ggacagcgaggagcggga

SEQ ID NO: 782912 - RNA, 22 nt, Human
ggagcucucuccugcacacccu

SEQ ID NO: 782913 - RNA, 20 nt, Human
ggaggaagggcguguccagg

SEQ ID NO: 782914 - RNA, 21 nt, Human
ggcucaugccuaucaucucag

SEQ ID NO: 782915 - RNA, 21 nt, Human
ggcuccucggcaucuucguuc

SEQ ID NO: 782916 - RNA, 21 nt, Human
ggcuggaggccagagacccac

SEQ ID NO: 782917 - RNA, 21 nt, Human
gggaggaagggcguguccagg

SEQ ID NO: 782918 - RNA, 23 nt, Human
gggcagcguugaacugucgcugu

SEQ ID NO: 782919 - RNA, 21 nt, Human
gggcucuuuguggcucugccc

SEQ ID NO: 782920 - RNA, 21 nt, Human
ggggccgggguggaaaugagc

SEQ ID NO: 782921 - RNA, 25 nt, Human
gguccaggaggaagaguucugaguu

SEQ ID NO: 782922 - RNA, 19 nt, Human
ggucccgccucuccuucuc

SEQ ID NO: 782923 - RNA, 23 nt, Human
guacggagggcuggucugggugc

SEQ ID NO: 782924 - RNA, 24 nt, Human
gucacugcacuccagccugggcaa

SEQ ID NO: 782925 - RNA, 20 nt, Human
gucacuguuccacccacggg

SEQ ID NO: 782926 - RNA, 22 nt, Human
gucagucuggccacggagcugg

SEQ ID NO: 782927 - RNA, 23 nt, Human
guccagugggggcaaauagacuc

SEQ ID NO: 782928 - RNA, 21 nt, Human
gucgauacccaugcaacaggg

SEQ ID NO: 782929 - RNA, 18 nt, Human
uaaaaaacccagccaggc

SEQ ID NO: 782930 - RNA, 19 nt, Human
uaaaaaggaauuggccaaa

SEQ ID NO: 782931 - RNA, 23 nt, Human
uaaaaaggaauuggccaaaaaga

SEQ ID NO: 782932 - RNA, 24 nt, Human
uaaaacagguggauaaauacuuca

SEQ ID NO: 782933 - RNA, 23 nt, Human
uaaaagacgcgaccgucguaguc

SEQ ID NO: 782934 - RNA, 20 nt, Human
uaaaauaaccugucuucaga

SEQ ID NO: 782935 - RNA, 23 nt, Human
uaaaauaaccugucuucagagau

SEQ ID NO: 782936 - RNA, 23 nt, Human
uaaauaaauuacaauacagugaa

SEQ ID NO: 782937 - RNA, 22 nt, Human
uaaaugcacauaugauacggug

SEQ ID NO: 782938 - RNA, 26 nt, Human
uaaaugcacauaugauacggugacaa

SEQ ID NO: 782939 - RNA, 21 nt, Human
uaagaaaaaaaucaaaauagg

SEQ ID NO: 782940 - RNA, 22 nt, Human
uaagaaaaaaaucaaaauaggc

SEQ ID NO: 782941 - RNA, 18 nt, Human
uaagucuucgucccccau

SEQ ID NO: 782942 - RNA, 18 nt, Human
uacaaaauccacuuuuaa

SEQ ID NO: 782943 - RNA, 23 nt, Human
uacagugaauuugccugaacuca

SEQ ID NO: 782944 - RNA, 22 nt, Human
uacaugguaaaugcacauauga

SEQ ID NO: 782945 - RNA, 25 nt, Human
uacauuaaaaaauguuuuuccucac

SEQ ID NO: 782946 - RNA, 23 nt, Human
uacuaaagaacaaaauuucaguc

SEQ ID NO: 782947 - RNA, 23 nt, Human
uagcaagagacaagaagugugaa

SEQ ID NO: 782948 - RNA, 18 nt, Human
uaggcacaauggcucaug

SEQ ID NO: 782949 - RNA, 23 nt, Human
uaggcuaggcacaauggcucaug

SEQ ID NO: 782950 - RNA, 21 nt, Human
uagucagccagguuaaucuga

SEQ ID NO: 782951 - RNA, 18 nt, Human
uauacaaggggggaagcu

SEQ ID NO: 782952 - RNA, 19 nt, Human
uauauauguauagauauac

SEQ ID NO: 782953 - RNA, 18 nt, Human
uauccagagaaugagcug

SEQ ID NO: 782954 - RNA, 19 nt, Human
ucaaacaccccacugucgc

SEQ ID NO: 782955 - RNA, 18 nt, Human
ucaaaggugauggugugu

SEQ ID NO: 782956 - RNA, 21 nt, Human
ucaaaguuucaacagcugggg

SEQ ID NO: 782957 - RNA, 20 nt, Human
ucaacagcuggggccuggag

SEQ ID NO: 782958 - RNA, 19 nt, Human
ucacaacaaggaaaaacca

SEQ ID NO: 782959 - RNA, 22 nt, Human
ucacaagcugguucuaagauuu

SEQ ID NO: 782960 - RNA, 22 nt, Human
ucacacauuuugugcagcugcu

SEQ ID NO: 782961 - RNA, 20 nt, Human
ucacgaggcuggcugcuucu

SEQ ID NO: 782962 - RNA, 20 nt, Human
ucacugcacuccagccuggg

SEQ ID NO: 782963 - RNA, 21 nt, Human
ucacugcacuccagccugggc

SEQ ID NO: 782964 - RNA, 24 nt, Human
ucacugcacuccagccugggcaac

SEQ ID NO: 782965 - RNA, 20 nt, Human
ucagaacuuugggaggcuga

SEQ ID NO: 782966 - RNA, 19 nt, Human
ucagacucacgcugagcac

SEQ ID NO: 782967 - RNA, 19 nt, Human
ucagagcuggugaacaccu

SEQ ID NO: 782968 - RNA, 21 nt, Human
ucagccucggccgugcuuggc

SEQ ID NO: 782969 - RNA, 23 nt, Human
uccaaccgcugccgcagcucacg

SEQ ID NO: 782970 - RNA, 23 nt, Human
uccaagggaagggaagaaagguc

SEQ ID NO: 782971 - RNA, 20 nt, Human
uccaccgaguccgcuugcca

SEQ ID NO: 782972 - RNA, 19 nt, Human
uccaggggcgagcuugggg

SEQ ID NO: 782973 - RNA, 21 nt, Human
ucccacaacagaaggcuacuu

SEQ ID NO: 782974 - RNA, 19 nt, Human
ucccacguggaucugggga

SEQ ID NO: 782975 - RNA, 18 nt, Human
uccccgaggacaccguca

SEQ ID NO: 782976 - RNA, 21 nt, Human
ucccugaacagccuagggucc

SEQ ID NO: 782977 - RNA, 20 nt, Human
ucccuuucacuuuccuucau

SEQ ID NO: 782978 - RNA, 19 nt, Human
uccguguacuccagcuugg

SEQ ID NO: 782979 - RNA, 21 nt, Human
uccuaacugcuguauucaccc

SEQ ID NO: 782980 - RNA, 23 nt, Human
uccuacuuccucguucccuuuca

SEQ ID NO: 782981 - RNA, 18 nt, Human
uccugcacugacacagug

SEQ ID NO: 782982 - RNA, 21 nt, Human
uccugcagcugcggagucacu

SEQ ID NO: 782983 - RNA, 20 nt, Human
uccugggccagcucgaaccg

SEQ ID NO: 782984 - RNA, 20 nt, Human
uccuugaugagcugcagccg

SEQ ID NO: 782985 - RNA, 24 nt, Human
uccuugcgcuccaucuccaggacc

SEQ ID NO: 782986 - RNA, 20 nt, Human
ucgcuggguaguucuaguua

SEQ ID NO: 782987 - RNA, 18 nt, Human
ucggccaguucccucucc

SEQ ID NO: 782988 - RNA, 18 nt, Human
ucguagucucgcgccucc

SEQ ID NO: 782989 - RNA, 18 nt, Human
ucuaagaaaaaaaucaaa

SEQ ID NO: 782990 - RNA, 22 nt, Human
ucuccacccccuuuucuuugua

SEQ ID NO: 782991 - RNA, 18 nt, Human
ucuccccaccucuguugu

SEQ ID NO: 782992 - RNA, 23 nt, Human
ucucgaagagucacuguuccacc

SEQ ID NO: 782993 - RNA, 22 nt, Human
ucucgccccagagagucgaagg

SEQ ID NO: 782994 - RNA, 18 nt, Human
ugaaaaguacuaaagaac

SEQ ID NO: 782995 - RNA, 27 nt, Human
ugaaaugcuuuuacaaaauccacuuuu

SEQ ID NO: 782996 - RNA, 22 nt, Human
ugacaaaaaacaaagagaugaa

SEQ ID NO: 782997 - RNA, 22 nt, Human
ugagcccaggagguugaggcug

SEQ ID NO: 782998 - RNA, 20 nt, Human
ugaggcaggagggucacuug

SEQ ID NO: 782999 - RNA, 24 nt, Human
ugaggcaggagggucacuugagcc

SEQ ID NO: 783000 - RNA, 25 nt, Human
ugaggcaggagggucacuugagccc

SEQ ID NO: 783001 - RNA, 18 nt, Human
ugaggcagggaggaaggc

SEQ ID NO: 783002 - RNA, 22 nt, Human
ugcaacacacacaugcuuccga

SEQ ID NO: 783003 - RNA, 18 nt, Human
ugcaacagggcucugggu

SEQ ID NO: 783004 - RNA, 23 nt, Human
ugcacaaauauuuuaaagacaaa

SEQ ID NO: 783005 - RNA, 24 nt, Human
ugcacgaggagacacucgcugcca

SEQ ID NO: 783006 - RNA, 18 nt, Human
ugcaguuccugcuucauc

SEQ ID NO: 783007 - RNA, 18 nt, Human
ugcccuccucuccaaccu

SEQ ID NO: 783008 - RNA, 23 nt, Human
ugccgcagcucacggagggcgca

SEQ ID NO: 783009 - RNA, 19 nt, Human
ugccgugguucuggccagg

SEQ ID NO: 783010 - RNA, 19 nt, Human
ugccugagcagcaaauggg

SEQ ID NO: 783011 - RNA, 22 nt, Human
ugcuccgugucuccccaccucu

SEQ ID NO: 783012 - RNA, 20 nt, Human
uggaaaucugugcaggcugg

SEQ ID NO: 783013 - RNA, 19 nt, Human
uggaaaugagcugccuccc

SEQ ID NO: 783014 - RNA, 19 nt, Human
uggaagcccgaggggccug

SEQ ID NO: 783015 - RNA, 23 nt, Human
uggaagcccgaggggccuggggg

SEQ ID NO: 783016 - RNA, 18 nt, Human
uggaugggaaguacuuca

SEQ ID NO: 783017 - RNA, 18 nt, Human
uggcaaggcuagaggcag

SEQ ID NO: 783018 - RNA, 18 nt, Human
uggccaaaaagaaaaaaa

SEQ ID NO: 783019 - RNA, 19 nt, Human
uggcccaggauggagucga

SEQ ID NO: 783020 - RNA, 21 nt, Human
uggcccaggauggagucgauc

SEQ ID NO: 783021 - RNA, 24 nt, Human
uggcguggcaggaguuccuccgcc

SEQ ID NO: 783022 - RNA, 20 nt, Human
uggcugguggggguccucgc

SEQ ID NO: 783023 - RNA, 18 nt, Human
ugggaaggacccagggug

SEQ ID NO: 783024 - RNA, 23 nt, Human
ugggaaggacccagggugcuccg

SEQ ID NO: 783025 - RNA, 20 nt, Human
ugggaggcugaggcaggagg

SEQ ID NO: 783026 - RNA, 24 nt, Human
ugggaggcugaggcaggaggguca

SEQ ID NO: 783027 - RNA, 24 nt, Human
ugggccagcucgaaccgcugcugc

SEQ ID NO: 783028 - RNA, 21 nt, Human
ugggggcgacagcgaggacag

SEQ ID NO: 783029 - RNA, 21 nt, Human
ugggggcucugaaaagggagc

SEQ ID NO: 783030 - RNA, 23 nt, Human
uggguggcccaggauggagucga

SEQ ID NO: 783031 - RNA, 18 nt, Human
uggguguccuggggccgg

SEQ ID NO: 783032 - RNA, 22 nt, Human
ugguagaucuccuuggaggccu

SEQ ID NO: 783033 - RNA, 18 nt, Human
uggugugugcaggguccc

SEQ ID NO: 783034 - RNA, 25 nt, Human
uguauagauauacguguuuuuuuuu

SEQ ID NO: 783035 - RNA, 20 nt, Human
ugucaggguggaugggaagu

SEQ ID NO: 783036 - RNA, 22 nt, Human
uguccaggggcgagcuuggggg

SEQ ID NO: 783037 - RNA, 23 nt, Human
ugucucaaaaacaaaacaaaaca

SEQ ID NO: 783038 - RNA, 20 nt, Human
ugugaagaaugcuaucuucu

SEQ ID NO: 783039 - RNA, 23 nt, Human
uguggaagcccgaggggccuggg

SEQ ID NO: 783040 - RNA, 24 nt, Human
ugugggucauacuuuguauuuguu

SEQ ID NO: 783041 - RNA, 23 nt, Human
uguuguggucaauguaaaagacg

SEQ ID NO: 783042 - RNA, 23 nt, Human
uucaaaguuucaacagcuggggc

SEQ ID NO: 783043 - RNA, 24 nt, Human
uucaaaucgaggccucaucgagaa

SEQ ID NO: 783044 - RNA, 19 nt, Human
uucaaggaaaaaaaaguac

SEQ ID NO: 783045 - RNA, 23 nt, Human
uucacaacaaggaaaaaccaagc

SEQ ID NO: 783046 - RNA, 28 nt, Human
uucagucuuaaaauacaucuuaaaguca

SEQ ID NO: 783047 - RNA, 23 nt, Human
uucaugaaaauaaaacaggugga

SEQ ID NO: 783048 - RNA, 24 nt, Human
uuccucguucccuuucacuuuccu

SEQ ID NO: 783049 - RNA, 21 nt, Human
uuccuucaccgccagccccgc

SEQ ID NO: 783050 - RNA, 21 nt, Human
uucguuccuuuugguuagagg

SEQ ID NO: 783051 - RNA, 22 nt, Human
uugaaaacauuugucuagggcu

SEQ ID NO: 783052 - RNA, 23 nt, Human
uugcagggucuccacccccuuuu

SEQ ID NO: 783053 - RNA, 24 nt, Human
uuggccaaaaagaaaaaaaaaagg

SEQ ID NO: 783054 - RNA, 22 nt, Human
uugggaggcugaggcaggaggg

SEQ ID NO: 783055 - RNA, 25 nt, Human
uugggaggcugaggcaggaggguca

SEQ ID NO: 783056 - RNA, 25 nt, Human
uuuccuguggcccaccccauugauu

SEQ ID NO: 783057 - RNA, 25 nt, Human
uuucuuggcauugagagccuccuga

SEQ ID NO: 783058 - RNA, 20 nt, Human
uuuguauuuguugaauaucc

SEQ ID NO: 783059 - RNA, 20 nt, Human
aaaaaaaaaucuucuaaucu

SEQ ID NO: 783060 - RNA, 22 nt, Human
aaaaaacagagaguuuagagaa

SEQ ID NO: 783061 - RNA, 24 nt, Human
aaaaaaggaaagcauucaauauac

SEQ ID NO: 783062 - RNA, 19 nt, Human
aaaaugccuuucccacucc

SEQ ID NO: 783063 - RNA, 20 nt, Human
aaaaugccuuucccacucca

SEQ ID NO: 783064 - RNA, 23 nt, Human
aaaaugccuuucccacuccacuc

SEQ ID NO: 783065 - RNA, 24 nt, Human
aaacagaaguuuaauuacagcaac

SEQ ID NO: 783066 - RNA, 25 nt, Human
aaacagagaguuuagagaaaaaagu

SEQ ID NO: 783067 - RNA, 21 nt, Human
aaagguuuuuuuuuccucuua

SEQ ID NO: 783068 - RNA, 22 nt, Human
aaaguuuucccaacuucucauu

SEQ ID NO: 783069 - RNA, 22 nt, Human
aaaugaucaagaaggaagaaac

SEQ ID NO: 783070 - RNA, 21 nt, Human
aacaaucacagaugucucugg

SEQ ID NO: 783071 - RNA, 26 nt, Human
aacacuuuuuaacaugacaaauacau

SEQ ID NO: 783072 - RNA, 20 nt, Human
accccaugccuuccaaaagu

SEQ ID NO: 783073 - RNA, 21 nt, Human
acucgauaacauuauuccacc

SEQ ID NO: 783074 - RNA, 21 nt, Human
aggcagguauaaaaaaggaaa

SEQ ID NO: 783075 - RNA, 19 nt, Human
auauauguauauauacaga

SEQ ID NO: 783076 - RNA, 19 nt, Human
augaucccauguagcaaac

SEQ ID NO: 783077 - RNA, 24 nt, Human
auucaaguaauagaacaaucacag

SEQ ID NO: 783078 - RNA, 24 nt, Human
caaaaugccuuucccacuccacuc

SEQ ID NO: 783079 - RNA, 23 nt, Human
caaauaacacaucucagccagaa

SEQ ID NO: 783080 - RNA, 21 nt, Human
caaauagacaucuaaauugua

SEQ ID NO: 783081 - RNA, 25 nt, Human
caagauuaucaaaaaaugacaccuc

SEQ ID NO: 783082 - RNA, 19 nt, Human
caaguaaccaggcaauggc

SEQ ID NO: 783083 - RNA, 20 nt, Human
caauacacaaguacaaacag

SEQ ID NO: 783084 - RNA, 19 nt, Human
cacaaguacaaacagugac

SEQ ID NO: 783085 - RNA, 21 nt, Human
cacaaguacaaacagugacua

SEQ ID NO: 783086 - RNA, 21 nt, Human
cacaguuuuugugguacuggc

SEQ ID NO: 783087 - RNA, 20 nt, Human
caccaaagguuuuuuuuucc

SEQ ID NO: 783088 - RNA, 19 nt, Human
caccauggaacugaugucu

SEQ ID NO: 783089 - RNA, 23 nt, Human
cacuccacucggcaaacaagccu

SEQ ID NO: 783090 - RNA, 19 nt, Human
cacuguacagcuggaaaau

SEQ ID NO: 783091 - RNA, 20 nt, Human
cagaugcucauuauuucccc

SEQ ID NO: 783092 - RNA, 21 nt, Human
caguuagccuuucugaggggc

SEQ ID NO: 783093 - RNA, 22 nt, Human
cauaaaacaaguaaccaggcaa

SEQ ID NO: 783094 - RNA, 26 nt, Human
cauucaagauuaucaaaaaaugacac

SEQ ID NO: 783095 - RNA, 21 nt, Human
cauucaauauacauuuuacau

SEQ ID NO: 783096 - RNA, 26 nt, Human
ccaccaaauagacaucuaaauuguac

SEQ ID NO: 783097 - RNA, 20 nt, Human
ccaccuuuuccuuuuaaucc

SEQ ID NO: 783098 - RNA, 21 nt, Human
ccacuccacucggcaaacaag

SEQ ID NO: 783099 - RNA, 18 nt, Human
cccaccccccuuuuggca

SEQ ID NO: 783100 - RNA, 24 nt, Human
cccaccccccuuuuggcaaacgaa

SEQ ID NO: 783101 - RNA, 21 nt, Human
cccacuccacucggcaaacaa

SEQ ID NO: 783102 - RNA, 19 nt, Human
ccccacgaauguguccagg

SEQ ID NO: 783103 - RNA, 21 nt, Human
ccccacgaauguguccaggga

SEQ ID NO: 783104 - RNA, 20 nt, Human
ccgccuucaguuccagacuu

SEQ ID NO: 783105 - RNA, 20 nt, Human
ccucuucuuuuuccugcccc

SEQ ID NO: 783106 - RNA, 22 nt, Human
ccucuucuuuuuccugccccac

SEQ ID NO: 783107 - RNA, 24 nt, Human
ccuuccaaaaguacuuuuuccaca

SEQ ID NO: 783108 - RNA, 20 nt, Human
ccuuuuguggcuaacacuuu

SEQ ID NO: 783109 - RNA, 23 nt, Human
cgauaacauuauuccaccucccc

SEQ ID NO: 783110 - RNA, 24 nt, Human
cgauaacauuauuccaccucccca

SEQ ID NO: 783111 - RNA, 18 nt, Human
cggcaaacaagccugugc

SEQ ID NO: 783112 - RNA, 24 nt, Human
cguauauauauauaaaacagaagu

SEQ ID NO: 783113 - RNA, 19 nt, Human
cucaaagaaaaaaaaaauc

SEQ ID NO: 783114 - RNA, 24 nt, Human
cugguuacugauacaaaaaguaaa

SEQ ID NO: 783115 - RNA, 19 nt, Human
cuguauaaagcgcuucccc

SEQ ID NO: 783116 - RNA, 18 nt, Human
cugugugugcgagccugg

SEQ ID NO: 783117 - RNA, 21 nt, Human
gacccugugugugcgagccug

SEQ ID NO: 783118 - RNA, 23 nt, Human
gaggggcuuaugggaaauaugug

SEQ ID NO: 783119 - RNA, 22 nt, Human
gcagacccugugugugcgagcc

SEQ ID NO: 783120 - RNA, 27 nt, Human
gccuuuuguggcuaacacuuuuuuuuu

SEQ ID NO: 783121 - RNA, 22 nt, Human
guauacguauauauauauaaaa

SEQ ID NO: 783122 - RNA, 23 nt, Human
guccuuuucuccuuaaaaaaaau

SEQ ID NO: 783123 - RNA, 18 nt, Human
uaaaacaaguaaccaggc

SEQ ID NO: 783124 - RNA, 22 nt, Human
uaaacauuaaaaaaaaaaaaag

SEQ ID NO: 783125 - RNA, 18 nt, Human
uaacauuauuccaccucc

SEQ ID NO: 783126 - RNA, 20 nt, Human
uacaggaacauuuuacacug

SEQ ID NO: 783127 - RNA, 18 nt, Human
uauacguauauauauaua

SEQ ID NO: 783128 - RNA, 28 nt, Human
uauauacagauauguauacguauauaua

SEQ ID NO: 783129 - RNA, 18 nt, Human
uauauauauguauauaua

SEQ ID NO: 783130 - RNA, 18 nt, Human
uauauauguauauauaca

SEQ ID NO: 783131 - RNA, 21 nt, Human
uauauguauauauacagauau

SEQ ID NO: 783132 - RNA, 20 nt, Human
uauauuuauauauauauaua

SEQ ID NO: 783133 - RNA, 24 nt, Human
uauauuuauauauauauauaugua

SEQ ID NO: 783134 - RNA, 29 nt, Human
uauauuuauauuuauauauauauauaugu

SEQ ID NO: 783135 - RNA, 18 nt, Human
uaucaaaaaaugacaccu

SEQ ID NO: 783136 - RNA, 22 nt, Human
uauguauauauacagauaugua

SEQ ID NO: 783137 - RNA, 18 nt, Human
ucaagaaggaagaaacca

SEQ ID NO: 783138 - RNA, 18 nt, Human
ucacaguuagccuuucug

SEQ ID NO: 783139 - RNA, 22 nt, Human
ucacaguuagccuuucugaggg

SEQ ID NO: 783140 - RNA, 21 nt, Human
uccaccuuuuccuuuuaaucc

SEQ ID NO: 783141 - RNA, 20 nt, Human
ucccacuccacucggcaaac

SEQ ID NO: 783142 - RNA, 21 nt, Human
ucuagaauaaaaauccgauga

SEQ ID NO: 783143 - RNA, 20 nt, Human
ucucucaaagaaaaaaaaaa

SEQ ID NO: 783144 - RNA, 18 nt, Human
ugaagaugagcucucuag

SEQ ID NO: 783145 - RNA, 23 nt, Human
ugacaauguacauguccaaucuu

SEQ ID NO: 783146 - RNA, 21 nt, Human
ugagugguuugcgacguggca

SEQ ID NO: 783147 - RNA, 19 nt, Human
ugaucaguaaugaucccau

SEQ ID NO: 783148 - RNA, 18 nt, Human
uguauacguauauauaua

SEQ ID NO: 783149 - RNA, 20 nt, Human
uguauauauacagauaugua

SEQ ID NO: 783150 - RNA, 22 nt, Human
uguauauauacagauauguaua

SEQ ID NO: 783151 - RNA, 29 nt, Human
uguauauauacagauauguauacguuaca

SEQ ID NO: 783152 - RNA, 21 nt, Human
uguccagggauuuuacacccu

SEQ ID NO: 783153 - RNA, 20 nt, Human
uucagagucaccgugaucag

SEQ ID NO: 783154 - RNA, 22 nt, Human
uuccagacuucagagucaccgu

SEQ ID NO: 783155 - RNA, 20 nt, Human
uuccucuucuuuuuccugcc

SEQ ID NO: 783156 - RNA, 24 nt, Human
uuguaccaaagugucaucaucaca

SEQ ID NO: 783157 - RNA, 18 nt, Human
uuuaaaggaaaaggaaaa

SEQ ID NO: 783158 - RNA, 24 nt, Human
uuuacauuauauacaacacaguuu

SEQ ID NO: 783159 - RNA, 22 nt, Human
uuugugguacuggcaaccccau

SEQ ID NO: 783160 - RNA, 23 nt, Human
uuuuugugguacuggcaacccca

SEQ ID NO: 783161 - RNA, 19 nt, Human
uuuuuuuuccucuuaacaa

SEQ ID NO: 783162 - RNA, 20 nt, Human
aaacagagggagcugcaauc

SEQ ID NO: 783163 - RNA, 20 nt, Human
acacaggcuuguccgucugg

SEQ ID NO: 783164 - RNA, 19 nt, Human
aguaacguguauucuuguc

SEQ ID NO: 783165 - RNA, 24 nt, Human
auggucacgcugaugacuuccucc

SEQ ID NO: 783166 - RNA, 19 nt, Human
caaguaacccggggccuga

SEQ ID NO: 783167 - RNA, 21 nt, Human
cacgcccgcgcgaaaaacaga

SEQ ID NO: 783168 - RNA, 18 nt, Human
cagcagcaggagcaggag

SEQ ID NO: 783169 - RNA, 23 nt, Human
caggauggcucccuggcucugca

SEQ ID NO: 783170 - RNA, 21 nt, Human
ccacaggcacaagcugggugu

SEQ ID NO: 783171 - RNA, 23 nt, Human
ccagaguuuucugagauguuaac

SEQ ID NO: 783172 - RNA, 22 nt, Human
cccgcgccgacagcagcaggag

SEQ ID NO: 783173 - RNA, 21 nt, Human
ccgcgccgacagcagcaggag

SEQ ID NO: 783174 - RNA, 24 nt, Human
cgaaaaacagagggagcugcaauc

SEQ ID NO: 783175 - RNA, 27 nt, Human
cgacagcagcaggagcaggagcgggag

SEQ ID NO: 783176 - RNA, 22 nt, Human
cggcucacccugggccaccagc

SEQ ID NO: 783177 - RNA, 18 nt, Human
cguugacaggccucagau

SEQ ID NO: 783178 - RNA, 22 nt, Human
cugcaaucaaguaacccggggc

SEQ ID NO: 783179 - RNA, 21 nt, Human
cuucccuuggagaguuaaaga

SEQ ID NO: 783180 - RNA, 19 nt, Human
gaaagaggggccccuccuc

SEQ ID NO: 783181 - RNA, 21 nt, Human
gacagcagcaggagcaggagc

SEQ ID NO: 783182 - RNA, 19 nt, Human
gcaggagcaggagcgggag

SEQ ID NO: 783183 - RNA, 22 nt, Human
guacacaggcuuguccgucugg

SEQ ID NO: 783184 - RNA, 18 nt, Human
gucuggaugaauacagaa

SEQ ID NO: 783185 - RNA, 27 nt, Human
ucccuggcucugcaccaccggcucacc

SEQ ID NO: 783186 - RNA, 18 nt, Human
ugaaagaggggccccucc

SEQ ID NO: 783187 - RNA, 22 nt, Human
ugaauacagaagcgccccggcc

SEQ ID NO: 783188 - RNA, 20 nt, Human
ugaaugguccccaggaccaa

SEQ ID NO: 783189 - RNA, 18 nt, Human
ugaguaagaucaguaacg

SEQ ID NO: 783190 - RNA, 25 nt, Human
ugaguuugauugucccuuuauccag

SEQ ID NO: 783191 - RNA, 22 nt, Human
ugcaaucaaguaacccggggcc

SEQ ID NO: 783192 - RNA, 20 nt, Human
uggcucccuggcucugcacc

SEQ ID NO: 783193 - RNA, 23 nt, Human
uggggucuguacacaggcuuguc

SEQ ID NO: 783194 - RNA, 20 nt, Human
ugucaauauccuggagugau

SEQ ID NO: 783195 - RNA, 18 nt, Human
ugugaaagaggggccccu

SEQ ID NO: 783196 - RNA, 21 nt, Human
aauaaguuaacaaucccuucu

SEQ ID NO: 783197 - RNA, 23 nt, Human
aaucucgcagcuauagcuugcua

SEQ ID NO: 783198 - RNA, 20 nt, Human
acaauauuauguucaauauu

SEQ ID NO: 783199 - RNA, 23 nt, Human
auugaauaguaaaaagaagcuaa

SEQ ID NO: 783200 - RNA, 20 nt, Human
caugcacguguuucuacgca

SEQ ID NO: 783201 - RNA, 18 nt, Human
cgaguggaguaauucaaa

SEQ ID NO: 783202 - RNA, 20 nt, Human
uaaaaagaagcuaaacuuua

SEQ ID NO: 783203 - RNA, 22 nt, Human
uaaucugauauaaaaaacacuu

SEQ ID NO: 783204 - RNA, 25 nt, Human
uagcaauaaguuaacaaucccuucu

SEQ ID NO: 783205 - RNA, 21 nt, Human
ugaauaguaaaaagaagcuaa

SEQ ID NO: 783206 - RNA, 24 nt, Human
uuaacaaucccuucuuucacauuu

SEQ ID NO: 783207 - RNA, 24 nt, Human
aacucuguucuccuugcuugcaac

SEQ ID NO: 783208 - RNA, 22 nt, Human
auuggcuccgacagccuuccuc

SEQ ID NO: 783209 - RNA, 20 nt, Human
cagcccaggcgacgugcugg

SEQ ID NO: 783210 - RNA, 20 nt, Human
ccugggguccucgccugccc

SEQ ID NO: 783211 - RNA, 18 nt, Human
gguccucgccugcccagg

SEQ ID NO: 783212 - RNA, 22 nt, Human
ucucuacaacucuguucuccuu

SEQ ID NO: 783213 - RNA, 23 nt, Human
ucucuacaacucuguucuccuug

SEQ ID NO: 783214 - RNA, 21 nt, Human
ugcuggggucuggaggcggcu

SEQ ID NO: 783215 - RNA, 20 nt, Human
uguguguggguauaugaggg

SEQ ID NO: 783216 - RNA, 23 nt, Human
uguugugaucucuacaacucugu

SEQ ID NO: 783217 - RNA, 18 nt, Human
uuggcuccgacagccuuc

SEQ ID NO: 783218 - RNA, 30 nt, Human
aaaaaaaaaaaaaaaacacaagugaagagg

SEQ ID NO: 783219 - RNA, 24 nt, Human
aaaaaaaaaaaacacaagugaaga

SEQ ID NO: 783220 - RNA, 25 nt, Human
aaaaaaaaaacacaagugaagaggu

SEQ ID NO: 783221 - RNA, 24 nt, Human
aaaaaagggaauuacuuucuacau

SEQ ID NO: 783222 - RNA, 21 nt, Human
aaacagcuacaaacucauucu

SEQ ID NO: 783223 - RNA, 23 nt, Human
aaacagcuacaaacucauucuca

SEQ ID NO: 783224 - RNA, 22 nt, Human
aaacuacaccuucuuauuagcc

SEQ ID NO: 783225 - RNA, 19 nt, Human
aacaaaucugaugaaaaag

SEQ ID NO: 783226 - RNA, 18 nt, Human
aacacugcauuuucuuac

SEQ ID NO: 783227 - RNA, 20 nt, Human
aacaggggaagacuccaccu

SEQ ID NO: 783228 - RNA, 20 nt, Human
aagaggucuguuucaagugg

SEQ ID NO: 783229 - RNA, 20 nt, Human
aaguaucucuuuaaacauau

SEQ ID NO: 783230 - RNA, 24 nt, Human
aaucccuugaacccagguggcaga

SEQ ID NO: 783231 - RNA, 20 nt, Human
acacagcagguuaugaccag

SEQ ID NO: 783232 - RNA, 24 nt, Human
acaggggaagacuccaccucagga

SEQ ID NO: 783233 - RNA, 28 nt, Human
accucaggaaaaaaaaaaaaaaaacaca

SEQ ID NO: 783234 - RNA, 21 nt, Human
accugaauaugucugccuaau

SEQ ID NO: 783235 - RNA, 19 nt, Human
acucaggagguugaggcac

SEQ ID NO: 783236 - RNA, 24 nt, Human
acugcacuccagccugggcaacag

SEQ ID NO: 783237 - RNA, 24 nt, Human
acugcacuccagccugggcaacag

SEQ ID NO: 783238 - RNA, 20 nt, Human
agaaguugcagugagccaag

SEQ ID NO: 783239 - RNA, 20 nt, Human
agaggaaggguggcugcgag

SEQ ID NO: 783240 - RNA, 24 nt, Human
agcacuuugggaggccaagguggg

SEQ ID NO: 783241 - RNA, 24 nt, Human
agccugggcaacaggggaagacuc

SEQ ID NO: 783242 - RNA, 21 nt, Human
aggccaaggugggcagaucac

SEQ ID NO: 783243 - RNA, 22 nt, Human
aggccucaguuuaaaaaaaaaa

SEQ ID NO: 783244 - RNA, 24 nt, Human
aggugcgguggcucacaccuguaa

SEQ ID NO: 783245 - RNA, 24 nt, Human
agguggcagaaguugcagugagcc

SEQ ID NO: 783246 - RNA, 22 nt, Human
aggugggcagaucaccugaggg

SEQ ID NO: 783247 - RNA, 23 nt, Human
agucugggcaacauggcaaaccc

SEQ ID NO: 783248 - RNA, 23 nt, Human
aucaccugaggccaggaguucaa

SEQ ID NO: 783249 - RNA, 24 nt, Human
aucaucccacugcacuccagccug

SEQ ID NO: 783250 - RNA, 18 nt, Human
auccccagcgucugacuc

SEQ ID NO: 783251 - RNA, 22 nt, Human
aucuaauaaaaaguuauaaaua

SEQ ID NO: 783252 - RNA, 20 nt, Human
auuagaaaacauacuuuuaa

SEQ ID NO: 783253 - RNA, 23 nt, Human
caaaguagauccaaagaugugcc

SEQ ID NO: 783254 - RNA, 23 nt, Human
caagacaauauuuucuacacuuu

SEQ ID NO: 783255 - RNA, 22 nt, Human
caagaucaucccacugcacucc

SEQ ID NO: 783256 - RNA, 19 nt, Human
caaggugggcagaucaccu

SEQ ID NO: 783257 - RNA, 26 nt, Human
caaggugggcagaucaccugaggcca

SEQ ID NO: 783258 - RNA, 24 nt, Human
cacaccuguaaucccagcacuuug

SEQ ID NO: 783259 - RNA, 23 nt, Human
caccuguaaucccagcacuuugg

SEQ ID NO: 783260 - RNA, 24 nt, Human
caccuguaaucccagcacuuuggg

SEQ ID NO: 783261 - RNA, 19 nt, Human
cacugcacuccagccuggg

SEQ ID NO: 783262 - RNA, 21 nt, Human
cacugcacuccagccugggca

SEQ ID NO: 783263 - RNA, 22 nt, Human
cacugcacuccagccugggcaa

SEQ ID NO: 783264 - RNA, 23 nt, Human
cacugcacuccagccugggcaac

SEQ ID NO: 783265 - RNA, 24 nt, Human
cacugcacuccagccugggcaaca

SEQ ID NO: 783266 - RNA, 27 nt, Human
cacugcacuccagccugggcaacaggg

SEQ ID NO: 783267 - RNA, 18 nt, Human
cagagagaaaaaagggaa

SEQ ID NO: 783268 - RNA, 27 nt, Human
cagaucaccugaggccaggaguucaaa

SEQ ID NO: 783269 - RNA, 24 nt, Human
cagcacuuugggaggccaaggugg

SEQ ID NO: 783270 - RNA, 18 nt, Human
cagccugggcaacagggg

SEQ ID NO: 783271 - RNA, 24 nt, Human
caugaauauuaacauuuacuaaua

SEQ ID NO: 783272 - RNA, 22 nt, Human
cauggcaaacccccgucuuuac

SEQ ID NO: 783273 - RNA, 23 nt, Human
ccaagagcucuuuaauccagugg

SEQ ID NO: 783274 - RNA, 21 nt, Human
ccaaucagaaacaagcaagca

SEQ ID NO: 783275 - RNA, 20 nt, Human
ccacugcacuccagccuggg

SEQ ID NO: 783276 - RNA, 21 nt, Human
ccacugcacuccagccugggc

SEQ ID NO: 783277 - RNA, 23 nt, Human
ccacugcacuccagccugggcaa

SEQ ID NO: 783278 - RNA, 24 nt, Human
ccacugcacuccagccugggcaac

SEQ ID NO: 783279 - RNA, 23 nt, Human
ccccgucuuuacuaaaaauacaa

SEQ ID NO: 783280 - RNA, 18 nt, Human
cccuuuacccuuuuuucc

SEQ ID NO: 783281 - RNA, 19 nt, Human
cccuuuuuuccucucccau

SEQ ID NO: 783282 - RNA, 19 nt, Human
ccugcagucccagcuacuc

SEQ ID NO: 783283 - RNA, 21 nt, Human
ccugcagucccagcuacucag

SEQ ID NO: 783284 - RNA, 22 nt, Human
ccugcagucccagcuacucagg

SEQ ID NO: 783285 - RNA, 23 nt, Human
ccuuucccuuuacccuuuuuuuu

SEQ ID NO: 783286 - RNA, 22 nt, Human
cucacaccuguaaucccagcac

SEQ ID NO: 783287 - RNA, 24 nt, Human
cucacaccuguaaucccagcacuu

SEQ ID NO: 783288 - RNA, 18 nt, Human
cucauuuuuauaagaaau

SEQ ID NO: 783289 - RNA, 32 nt, Human
cugaacuccuagggcauaucuauucacacuac

SEQ ID NO: 783290 - RNA, 23 nt, Human
cuuuaaauccucaucuguauuuc

SEQ ID NO: 783291 - RNA, 18 nt, Human
gaaguugcagugagccaa

SEQ ID NO: 783292 - RNA, 18 nt, Human
gaucaccugaggccagga

SEQ ID NO: 783293 - RNA, 24 nt, Human
gaucaccugaggccaggaguucaa

SEQ ID NO: 783294 - RNA, 19 nt, Human
gaugacaaaccaagagcuc

SEQ ID NO: 783295 - RNA, 20 nt, Human
gcaacauggcaaacccccgu

SEQ ID NO: 783296 - RNA, 20 nt, Human
gcacgagaaucccuugaacc

SEQ ID NO: 783297 - RNA, 20 nt, Human
gcacuuugggaggccaaggu

SEQ ID NO: 783298 - RNA, 22 nt, Human
ggaguucaaaaccagucugggc

SEQ ID NO: 783299 - RNA, 23 nt, Human
ggcagaaguugcagugagccaag

SEQ ID NO: 783300 - RNA, 21 nt, Human
ggccaggugcgguggcucaca

SEQ ID NO: 783301 - RNA, 23 nt, Human
gguggcucacaccuguaauccca

SEQ ID NO: 783302 - RNA, 24 nt, Human
gguggcucacaccuguaaucccag

SEQ ID NO: 783303 - RNA, 25 nt, Human
guugaauugaauuguuuuagugauu

SEQ ID NO: 783304 - RNA, 26 nt, Human
guuucuguaaacacuuuuacaccagu

SEQ ID NO: 783305 - RNA, 20 nt, Human
uaaaacauaaaacuaaauga

SEQ ID NO: 783306 - RNA, 18 nt, Human
uaaaauaaacacuagggc

SEQ ID NO: 783307 - RNA, 24 nt, Human
uaaaugagaucucucagguucuuc

SEQ ID NO: 783308 - RNA, 25 nt, Human
uacaccaguaucuuaaaauuccaaa

SEQ ID NO: 783309 - RNA, 23 nt, Human
uacaugaauauuaacauuuacua

SEQ ID NO: 783310 - RNA, 21 nt, Human
uacccuuuuuuccucucccau

SEQ ID NO: 783311 - RNA, 18 nt, Human
uagauccaaagaugugcc

SEQ ID NO: 783312 - RNA, 19 nt, Human
uagauccaaagaugugcca

SEQ ID NO: 783313 - RNA, 27 nt, Human
uagauccaaagaugugccaaucagaaa

SEQ ID NO: 783314 - RNA, 21 nt, Human
uaucagcaaaguagauccaaa

SEQ ID NO: 783315 - RNA, 23 nt, Human
uauucuaucacaugugauacuau

SEQ ID NO: 783316 - RNA, 21 nt, Human
ucaaaaccagucugggcaaca

SEQ ID NO: 783317 - RNA, 25 nt, Human
ucaaaguaagauaugaauuauaauc

SEQ ID NO: 783318 - RNA, 19 nt, Human
ucaccugaggccaggaguu

SEQ ID NO: 783319 - RNA, 22 nt, Human
ucaggaaaaaaaaaaaaaaaaa

SEQ ID NO: 783320 - RNA, 26 nt, Human
ucaggaaaaaaaaaaaaaaaacacaa

SEQ ID NO: 783321 - RNA, 20 nt, Human
ucaguuuaaaaaaaaaagga

SEQ ID NO: 783322 - RNA, 22 nt, Human
uccaaauuauucaaguaucucu

SEQ ID NO: 783323 - RNA, 24 nt, Human
ucccacugcacuccagccugggca

SEQ ID NO: 783324 - RNA, 27 nt, Human
uccucagguucaaacacugcauuuucu

SEQ ID NO: 783325 - RNA, 19 nt, Human
ucuccuuucccuuuacccu

SEQ ID NO: 783326 - RNA, 18 nt, Human
ucuggccaggugcggugg

SEQ ID NO: 783327 - RNA, 19 nt, Human
ugaaaaagagcauauguga

SEQ ID NO: 783328 - RNA, 22 nt, Human
ugacaaauuuuauaaccuuaac

SEQ ID NO: 783329 - RNA, 18 nt, Human
ugagaggaaggguggcug

SEQ ID NO: 783330 - RNA, 27 nt, Human
ugagaggaaggguggcugcgagaggaa

SEQ ID NO: 783331 - RNA, 24 nt, Human
ugaggcacgagaaucccuugaacc

SEQ ID NO: 783332 - RNA, 23 nt, Human
ugaggccaggaguucaaaaccag

SEQ ID NO: 783333 - RNA, 20 nt, Human
ugaugacaaaccaagagcuc

SEQ ID NO: 783334 - RNA, 22 nt, Human
ugcaaaauccuucggcaagaca

SEQ ID NO: 783335 - RNA, 24 nt, Human
ugccugcagucccagcuacucagg

SEQ ID NO: 783336 - RNA, 19 nt, Human
uggcagaaguugcagugag

SEQ ID NO: 783337 - RNA, 21 nt, Human
uggcagaaguugcagugagcc

SEQ ID NO: 783338 - RNA, 24 nt, Human
uggccaggugcgguggcucacacc

SEQ ID NO: 783339 - RNA, 24 nt, Human
uggcgcgugccugcagucccagcu

SEQ ID NO: 783340 - RNA, 21 nt, Human
uggcucacaccuguaauccca

SEQ ID NO: 783341 - RNA, 22 nt, Human
uggcucacaccuguaaucccag

SEQ ID NO: 783342 - RNA, 24 nt, Human
uggcucacaccuguaaucccagca

SEQ ID NO: 783343 - RNA, 20 nt, Human
ugggaggccaaggugggcag

SEQ ID NO: 783344 - RNA, 24 nt, Human
ugggaggccaaggugggcagauca

SEQ ID NO: 783345 - RNA, 24 nt, Human
ugggcagaucaccugaggccagga

SEQ ID NO: 783346 - RNA, 24 nt, Human
uggggguggggaagugugugauug

SEQ ID NO: 783347 - RNA, 26 nt, Human
uuaaaagucuucucaauacucuuucu

SEQ ID NO: 783348 - RNA, 23 nt, Human
uuaaaauaaacacuagggcuacc

SEQ ID NO: 783349 - RNA, 22 nt, Human
uuaggguuuaccugaauauguc

SEQ ID NO: 783350 - RNA, 20 nt, Human
uuccucagguucaaacacug

SEQ ID NO: 783351 - RNA, 21 nt, Human
uuccuuaauucuccuuucccu

SEQ ID NO: 783352 - RNA, 24 nt, Human
uucuuacucaaagaucuucucaaa

SEQ ID NO: 783353 - RNA, 20 nt, Human
uucuucuuugaacaaagaug

SEQ ID NO: 783354 - RNA, 20 nt, Human
uugaauauugauccaggaau

SEQ ID NO: 783355 - RNA, 20 nt, Human
uugcagugagccaagaucau

SEQ ID NO: 783356 - RNA, 23 nt, Human
uuuccaauaaugaguuucuuaca

SEQ ID NO: 783357 - RNA, 19 nt, Human
uuucucaaaaacuacaccu

SEQ ID NO: 783358 - RNA, 20 nt, Human
aaaccgaggggccucugccg

SEQ ID NO: 783359 - RNA, 24 nt, Human
aaagacagcagcguggggcuuggg

SEQ ID NO: 783360 - RNA, 23 nt, Human
aaagcgagcaguuuccccagccc

SEQ ID NO: 783361 - RNA, 20 nt, Human
aagcaccccugccgaucucc

SEQ ID NO: 783362 - RNA, 18 nt, Human
aagccguccgaacagcgg

SEQ ID NO: 783363 - RNA, 18 nt, Human
aagcggccccccacaauc

SEQ ID NO: 783364 - RNA, 21 nt, Human
aagcggccccccacaauccga

SEQ ID NO: 783365 - RNA, 24 nt, Human
aagggggugagggcuugcugcugc

SEQ ID NO: 783366 - RNA, 24 nt, Human
aauaccggaaccugucacugagcc

SEQ ID NO: 783367 - RNA, 22 nt, Human
aauccgaggaggaugagagccc

SEQ ID NO: 783368 - RNA, 21 nt, Human
acagcagcguggggcuugggc

SEQ ID NO: 783369 - RNA, 21 nt, Human
acggaaccucacagucacgcc

SEQ ID NO: 783370 - RNA, 20 nt, Human
acugccaaaguccacaaucu

SEQ ID NO: 783371 - RNA, 25 nt, Human
agaauccgaggaggaugagagcccc

SEQ ID NO: 783372 - RNA, 19 nt, Human
agacagaggaaggcaacaa

SEQ ID NO: 783373 - RNA, 20 nt, Human
agacccccguccugccgcag

SEQ ID NO: 783374 - RNA, 18 nt, Human
agacuggggggaagucug

SEQ ID NO: 783375 - RNA, 19 nt, Human
agagaagccccagcggagc

SEQ ID NO: 783376 - RNA, 21 nt, Human
agcaccaucccacaccagcag

SEQ ID NO: 783377 - RNA, 23 nt, Human
agcacgugguggccguggaggua

SEQ ID NO: 783378 - RNA, 21 nt, Human
agcaggguggcugccuccccc

SEQ ID NO: 783379 - RNA, 21 nt, Human
agcagguugucuggcuugaug

SEQ ID NO: 783380 - RNA, 20 nt, Human
agcagugcaggcugcagcag

SEQ ID NO: 783381 - RNA, 24 nt, Human
agccagagaacucgggcugcagug

SEQ ID NO: 783382 - RNA, 18 nt, Human
agcccagggacucggcgg

SEQ ID NO: 783383 - RNA, 18 nt, Human
agccgggccucccgacgc

SEQ ID NO: 783384 - RNA, 20 nt, Human
agccuggccagcagccgggc

SEQ ID NO: 783385 - RNA, 21 nt, Human
agccuggccagcagccgggcc

SEQ ID NO: 783386 - RNA, 19 nt, Human
agcgcucaggccgucgcac

SEQ ID NO: 783387 - RNA, 24 nt, Human
agcggcgugcugcggcccgacgcg

SEQ ID NO: 783388 - RNA, 19 nt, Human
agcucggugacaaugacca

SEQ ID NO: 783389 - RNA, 18 nt, Human
aggagguguggggggaga

SEQ ID NO: 783390 - RNA, 21 nt, Human
aggcagagcaggguggcugcc

SEQ ID NO: 783391 - RNA, 21 nt, Human
aggcucaggagggggcucagg

SEQ ID NO: 783392 - RNA, 18 nt, Human
aggcucugcacagucacc

SEQ ID NO: 783393 - RNA, 21 nt, Human
agggggcucaggggcuggggg

SEQ ID NO: 783394 - RNA, 20 nt, Human
agguguagacgccuccaucc

SEQ ID NO: 783395 - RNA, 18 nt, Human
aguuuccccagcccccac

SEQ ID NO: 783396 - RNA, 26 nt, Human
auacuggcaguacuggggcucuccug

SEQ ID NO: 783397 - RNA, 21 nt, Human
auagcaggcagcuuugcccag

SEQ ID NO: 783398 - RNA, 21 nt, Human
aucaaagcggccccccacaau

SEQ ID NO: 783399 - RNA, 19 nt, Human
augcugcccaguacguugg

SEQ ID NO: 783400 - RNA, 22 nt, Human
caaagcggccccccacaauccg

SEQ ID NO: 783401 - RNA, 19 nt, Human
caacaacacccacaggcca

SEQ ID NO: 783402 - RNA, 21 nt, Human
caaggggccuaagggccuggg

SEQ ID NO: 783403 - RNA, 19 nt, Human
cacacagacuccccaucca

SEQ ID NO: 783404 - RNA, 20 nt, Human
cacaccagcagguucucagg

SEQ ID NO: 783405 - RNA, 18 nt, Human
cacagccacgguacagga

SEQ ID NO: 783406 - RNA, 20 nt, Human
caccaagcgauggacauccc

SEQ ID NO: 783407 - RNA, 20 nt, Human
caccagcgccguguccuggu

SEQ ID NO: 783408 - RNA, 22 nt, Human
caccagcuccagcggggucccc

SEQ ID NO: 783409 - RNA, 24 nt, Human
caccaggcacucaaacagcgccau

SEQ ID NO: 783410 - RNA, 21 nt, Human
cacccgggagccagagaacuc

SEQ ID NO: 783411 - RNA, 22 nt, Human
caccuccacaucuuccagcagc

SEQ ID NO: 783412 - RNA, 22 nt, Human
caccucugcgcccuuugccuga

SEQ ID NO: 783413 - RNA, 20 nt, Human
cacgugguggccguggaggu

SEQ ID NO: 783414 - RNA, 18 nt, Human
cacugagggcagcucuuc

SEQ ID NO: 783415 - RNA, 25 nt, Human
cacugagggcucugaccucaaggac

SEQ ID NO: 783416 - RNA, 18 nt, Human
cacuguguacgucaggga

SEQ ID NO: 783417 - RNA, 22 nt, Human
cagacacaaaggaagucaccac

SEQ ID NO: 783418 - RNA, 20 nt, Human
cagacuccuggggggguucc

SEQ ID NO: 783419 - RNA, 22 nt, Human
cagagcaggguggcugccuccc

SEQ ID NO: 783420 - RNA, 20 nt, Human
cagcaccaucccacaccagc

SEQ ID NO: 783421 - RNA, 21 nt, Human
cagcagcagguugucuggcuu

SEQ ID NO: 783422 - RNA, 21 nt, Human
cagcagcguggggcuugggcu

SEQ ID NO: 783423 - RNA, 22 nt, Human
cagcaggagcuagggguggggc

SEQ ID NO: 783424 - RNA, 23 nt, Human
cagcccccaccuccacguccucc

SEQ ID NO: 783425 - RNA, 21 nt, Human
cagccgcagccccagcgacag

SEQ ID NO: 783426 - RNA, 22 nt, Human
cagccgcagccccagcgacagg

SEQ ID NO: 783427 - RNA, 21 nt, Human
cagccgcuccagcucacccug

SEQ ID NO: 783428 - RNA, 22 nt, Human
cagccgguccugcaccaacacu

SEQ ID NO: 783429 - RNA, 23 nt, Human
cagcucacccugcucuggcuccu

SEQ ID NO: 783430 - RNA, 22 nt, Human
caggcggccacggcacagccaa

SEQ ID NO: 783431 - RNA, 18 nt, Human
caggcucuccgacagccc

SEQ ID NO: 783432 - RNA, 23 nt, Human
cagggcaggccgcuggcaggcag

SEQ ID NO: 783433 - RNA, 24 nt, Human
caggggccagcagcagguugucug

SEQ ID NO: 783434 - RNA, 22 nt, Human
caggggcugguggugcagacac

SEQ ID NO: 783435 - RNA, 19 nt, Human
cagggugaagcucagccgc

SEQ ID NO: 783436 - RNA, 23 nt, Human
cagugggccccgccaccaggcac

SEQ ID NO: 783437 - RNA, 23 nt, Human
cauccugggcccccgugcugagc

SEQ ID NO: 783438 - RNA, 20 nt, Human
cauuuguagcugaucuggga

SEQ ID NO: 783439 - RNA, 24 nt, Human
ccaacaccuccacaucuuccagca

SEQ ID NO: 783440 - RNA, 20 nt, Human
ccacaaucuugagggcauug

SEQ ID NO: 783441 - RNA, 21 nt, Human
ccacugggggguggccuucug

SEQ ID NO: 783442 - RNA, 20 nt, Human
ccagacgaccugggccucca

SEQ ID NO: 783443 - RNA, 20 nt, Human
ccaggcacucaaacagcgcc

SEQ ID NO: 783444 - RNA, 19 nt, Human
ccaguacguugguggccga

SEQ ID NO: 783445 - RNA, 18 nt, Human
ccaucccacaccagcagg

SEQ ID NO: 783446 - RNA, 20 nt, Human
ccaucgaaaugcaucuugca

SEQ ID NO: 783447 - RNA, 22 nt, Human
ccaucuccggagccaugaacuc

SEQ ID NO: 783448 - RNA, 23 nt, Human
cccacggcagggaacaccaagcg

SEQ ID NO: 783449 - RNA, 18 nt, Human
cccaggccggguggcgcu

SEQ ID NO: 783450 - RNA, 18 nt, Human
cccaggggagcugaccac

SEQ ID NO: 783451 - RNA, 24 nt, Human
cccaggggagcugaccaccuccuu

SEQ ID NO: 783452 - RNA, 21 nt, Human
ccccacggcagggaacaccaa

SEQ ID NO: 783453 - RNA, 21 nt, Human
ccccacugggggguggccuuc

SEQ ID NO: 783454 - RNA, 19 nt, Human
cccccacaauccgagccuc

SEQ ID NO: 783455 - RNA, 18 nt, Human
cccccacugggggguggc

SEQ ID NO: 783456 - RNA, 18 nt, Human
cccccaugucccggcggc

SEQ ID NO: 783457 - RNA, 22 nt, Human
cccccguccugccgcagccgca

SEQ ID NO: 783458 - RNA, 20 nt, Human
ccccgacccccucgaccucc

SEQ ID NO: 783459 - RNA, 22 nt, Human
ccccgccgcgggccucccaggc

SEQ ID NO: 783460 - RNA, 19 nt, Human
ccccgcgccgagcucccgc

SEQ ID NO: 783461 - RNA, 23 nt, Human
ccccgcgccgagcucccgcccuc

SEQ ID NO: 783462 - RNA, 24 nt, Human
ccccgcgccgagcucccgcccucc

SEQ ID NO: 783463 - RNA, 21 nt, Human
ccccggcgccucucgaaggcc

SEQ ID NO: 783464 - RNA, 24 nt, Human
ccccgggccucccugcucaggcuc

SEQ ID NO: 783465 - RNA, 25 nt, Human
ccccgugcugagcaccaccagggag

SEQ ID NO: 783466 - RNA, 18 nt, Human
ccccuggcuuucuccucc

SEQ ID NO: 783467 - RNA, 21 nt, Human
cccgcagcaccaucccacacc

SEQ ID NO: 783468 - RNA, 21 nt, Human
cccgccaccaggcacucaaac

SEQ ID NO: 783469 - RNA, 18 nt, Human
cccgcgccgagcucccgc

SEQ ID NO: 783470 - RNA, 18 nt, Human
cccguccugccgcagccg

SEQ ID NO: 783471 - RNA, 20 nt, Human
cccguccugccgcagccgca

SEQ ID NO: 783472 - RNA, 23 nt, Human
cccgugcugagcaccaccaggga

SEQ ID NO: 783473 - RNA, 22 nt, Human
cccucggcagcauagggcacga

SEQ ID NO: 783474 - RNA, 19 nt, Human
cccuugaggaguggaggcu

SEQ ID NO: 783475 - RNA, 21 nt, Human
ccgacgcgccccccgaguccu

SEQ ID NO: 783476 - RNA, 19 nt, Human
ccgagcccagcaccuggug

SEQ ID NO: 783477 - RNA, 19 nt, Human
ccgcgccgagcucccgccc

SEQ ID NO: 783478 - RNA, 22 nt, Human
ccggagcuacgcuccacuaugc

SEQ ID NO: 783479 - RNA, 21 nt, Human
ccguccccgccgcgggccucc

SEQ ID NO: 783480 - RNA, 24 nt, Human
ccucagaauaccggaaccugucac

SEQ ID NO: 783481 - RNA, 22 nt, Human
ccuccacaucuuccagcagccg

SEQ ID NO: 783482 - RNA, 22 nt, Human
ccuccacgucagugggccccgc

SEQ ID NO: 783483 - RNA, 21 nt, Human
ccuccagguccugcaguggcc

SEQ ID NO: 783484 - RNA, 23 nt, Human
ccuccauggggcagccaaaauga

SEQ ID NO: 783485 - RNA, 22 nt, Human
ccucccugcucaggcucaggaa

SEQ ID NO: 783486 - RNA, 24 nt, Human
ccucgaugguccucauccuccccg

SEQ ID NO: 783487 - RNA, 19 nt, Human
ccucggagcccagggacuc

SEQ ID NO: 783488 - RNA, 20 nt, Human
ccucgggaauggauggcauc

SEQ ID NO: 783489 - RNA, 23 nt, Human
ccugacaaagaccuucucagaag

SEQ ID NO: 783490 - RNA, 18 nt, Human
ccugcaggacccgccgcu

SEQ ID NO: 783491 - RNA, 19 nt, Human
ccugcaggacccgccgcuu

SEQ ID NO: 783492 - RNA, 19 nt, Human
ccuugaggaguggaggcug

SEQ ID NO: 783493 - RNA, 21 nt, Human
cgaggggcccugggcguggcc

SEQ ID NO: 783494 - RNA, 24 nt, Human
cgcaucgccagcaccggggagccc

SEQ ID NO: 783495 - RNA, 25 nt, Human
cgccaccaggcacucaaacagcgcc

SEQ ID NO: 783496 - RNA, 18 nt, Human
cgccccguggcauucucc

SEQ ID NO: 783497 - RNA, 22 nt, Human
cgcccuccgagcucucuccguc

SEQ ID NO: 783498 - RNA, 21 nt, Human
cgccgcuccagcguauacgug

SEQ ID NO: 783499 - RNA, 18 nt, Human
cgcugccaccuccgccgg

SEQ ID NO: 783500 - RNA, 23 nt, Human
cggaaccucacagucacgccagu

SEQ ID NO: 783501 - RNA, 19 nt, Human
cggcacagccaauccaccu

SEQ ID NO: 783502 - RNA, 19 nt, Human
cggccccuggcuuucuccu

SEQ ID NO: 783503 - RNA, 21 nt, Human
cggcgcggcagggcccugcga

SEQ ID NO: 783504 - RNA, 21 nt, Human
cgggggugugggggcagcagg

SEQ ID NO: 783505 - RNA, 22 nt, Human
cguggggcuugggcucugaagg

SEQ ID NO: 783506 - RNA, 23 nt, Human
cuacaaacucaggugugccauac

SEQ ID NO: 783507 - RNA, 18 nt, Human
cuacauacagcugggcug

SEQ ID NO: 783508 - RNA, 19 nt, Human
cucacccugcucuggcucc

SEQ ID NO: 783509 - RNA, 18 nt, Human
cucagacucacacacggu

SEQ ID NO: 783510 - RNA, 20 nt, Human
cucaggccgucgcaccagcu

SEQ ID NO: 783511 - RNA, 22 nt, Human
cuccaacaccuccacaucuucc

SEQ ID NO: 783512 - RNA, 22 nt, Human
cuccaggaagguguaggguuuc

SEQ ID NO: 783513 - RNA, 22 nt, Human
cuccauccugggcccccgugcu

SEQ ID NO: 783514 - RNA, 23 nt, Human
cucccuucaccaucuccggagcc

SEQ ID NO: 783515 - RNA, 22 nt, Human
cucgcacaacaccaaagcggcc

SEQ ID NO: 783516 - RNA, 19 nt, Human
cucguacacaccggcccgu

SEQ ID NO: 783517 - RNA, 21 nt, Human
cucguacacgaagcucacaug

SEQ ID NO: 783518 - RNA, 19 nt, Human
cugaaugcacagccaacuc

SEQ ID NO: 783519 - RNA, 20 nt, Human
cugacaaagaccuucucaga

SEQ ID NO: 783520 - RNA, 24 nt, Human
cugagcccacagaggaguucccgg

SEQ ID NO: 783521 - RNA, 22 nt, Human
cugagcucacagggugccacac

SEQ ID NO: 783522 - RNA, 23 nt, Human
cugcaggccccugugucuucgug

SEQ ID NO: 783523 - RNA, 19 nt, Human
cugcucuggaugcgguggc

SEQ ID NO: 783524 - RNA, 20 nt, Human
cuggagccuggccagcagcc

SEQ ID NO: 783525 - RNA, 19 nt, Human
cuggcaaagacagcagcgu

SEQ ID NO: 783526 - RNA, 21 nt, Human
cugucccuccaccacauacac

SEQ ID NO: 783527 - RNA, 27 nt, Human
cuguccggggcucuucuacauacagcu

SEQ ID NO: 783528 - RNA, 19 nt, Human
cuuccacagcaccagcgcc

SEQ ID NO: 783529 - RNA, 24 nt, Human
cuugaacuuggccucgaacacggc

SEQ ID NO: 783530 - RNA, 19 nt, Human
gaacacggccuccgacucc

SEQ ID NO: 783531 - RNA, 18 nt, Human
gaagaugugcuggacccc

SEQ ID NO: 783532 - RNA, 18 nt, Human
gacccgccgcuugcccuc

SEQ ID NO: 783533 - RNA, 18 nt, Human
gagaagccccagcggagc

SEQ ID NO: 783534 - RNA, 20 nt, Human
gagagccccccacugggggg

SEQ ID NO: 783535 - RNA, 18 nt, Human
gagaugugcggugcaggg

SEQ ID NO: 783536 - RNA, 20 nt, Human
gagcaguuuccccagccccc

SEQ ID NO: 783537 - RNA, 22 nt, Human
gagcgcgaacggcucagcagcc

SEQ ID NO: 783538 - RNA, 18 nt, Human
gagguguggggggagaug

SEQ ID NO: 783539 - RNA, 21 nt, Human
gaugagagccccccacugggg

SEQ ID NO: 783540 - RNA, 20 nt, Human
gauguucuagggucucuucu

SEQ ID NO: 783541 - RNA, 19 nt, Human
gcacacccgcuccccagau

SEQ ID NO: 783542 - RNA, 18 nt, Human
gcacagcugaagaaucuu

SEQ ID NO: 783543 - RNA, 25 nt, Human
gcacaggcucagaagggggggaacc

SEQ ID NO: 783544 - RNA, 25 nt, Human
gcagcguggggcuugggcucugaag

SEQ ID NO: 783545 - RNA, 20 nt, Human
gcagguguagacgccuccau

SEQ ID NO: 783546 - RNA, 19 nt, Human
gcagucgaaacgggcagcu

SEQ ID NO: 783547 - RNA, 23 nt, Human
gcaucgccagcaccggggagccc

SEQ ID NO: 783548 - RNA, 22 nt, Human
gccaauccaccuccacgucagu

SEQ ID NO: 783549 - RNA, 21 nt, Human
gccauggguguuaacagcacu

SEQ ID NO: 783550 - RNA, 23 nt, Human
gcccccaccuccacguccuccau

SEQ ID NO: 783551 - RNA, 22 nt, Human
gcccccaugucccggcggcuca

SEQ ID NO: 783552 - RNA, 20 nt, Human
gccccuggcuuucuccucca

SEQ ID NO: 783553 - RNA, 23 nt, Human
gcccgcagcagcucggggauggg

SEQ ID NO: 783554 - RNA, 18 nt, Human
gcccuggcuggccuugag

SEQ ID NO: 783555 - RNA, 22 nt, Human
gcccuggcuggccuugagguga

SEQ ID NO: 783556 - RNA, 25 nt, Human
gccgcuggcaggcagagcagggugg

SEQ ID NO: 783557 - RNA, 19 nt, Human
gccuccuuggccaguccca

SEQ ID NO: 783558 - RNA, 20 nt, Human
gccuggggguuguagggcug

SEQ ID NO: 783559 - RNA, 18 nt, Human
gcggccccccacaauccg

SEQ ID NO: 783560 - RNA, 19 nt, Human
gcggcgcggcagggcccug

SEQ ID NO: 783561 - RNA, 24 nt, Human
gcggcgugcugcggcccgacgcgc

SEQ ID NO: 783562 - RNA, 21 nt, Human
gcuacaaacucaggugugcca

SEQ ID NO: 783563 - RNA, 24 nt, Human
gcucagcucguacacaccggcccg

SEQ ID NO: 783564 - RNA, 23 nt, Human
gcucgcacaacaccaaagcggcc

SEQ ID NO: 783565 - RNA, 19 nt, Human
gcugagcaccaccagggag

SEQ ID NO: 783566 - RNA, 23 nt, Human
gcugcagugggcggggcacugag

SEQ ID NO: 783567 - RNA, 19 nt, Human
gcugcucucggucagcagc

SEQ ID NO: 783568 - RNA, 20 nt, Human
ggaaggcaacaacacccaca

SEQ ID NO: 783569 - RNA, 22 nt, Human
ggaaggcaacaacacccacagg

SEQ ID NO: 783570 - RNA, 21 nt, Human
ggaguucccgguugccacagc

SEQ ID NO: 783571 - RNA, 19 nt, Human
ggaugucauaaaagucgcu

SEQ ID NO: 783572 - RNA, 18 nt, Human
ggcagagagguuuggugg

SEQ ID NO: 783573 - RNA, 24 nt, Human
ggcaguacuggggcucuccuggag

SEQ ID NO: 783574 - RNA, 21 nt, Human
ggccgggcagccugcaggccc

SEQ ID NO: 783575 - RNA, 23 nt, Human
ggcgccggccugggcggccaacu

SEQ ID NO: 783576 - RNA, 18 nt, Human
ggcgcggcagggcccugc

SEQ ID NO: 783577 - RNA, 19 nt, Human
ggcggugcaggugagggcc

SEQ ID NO: 783578 - RNA, 21 nt, Human
ggcguggccugacagcuggag

SEQ ID NO: 783579 - RNA, 22 nt, Human
ggcucaggggcugggggcucag

SEQ ID NO: 783580 - RNA, 19 nt, Human
gggacagugacagcgagag

SEQ ID NO: 783581 - RNA, 20 nt, Human
gggagagcuucggggacugc

SEQ ID NO: 783582 - RNA, 21 nt, Human
gggagcacucauucuccucgu

SEQ ID NO: 783583 - RNA, 22 nt, Human
gggaguccgggucgauggccau

SEQ ID NO: 783584 - RNA, 24 nt, Human
gggaugccugagcucacagggugc

SEQ ID NO: 783585 - RNA, 18 nt, Human
gggcagcaggagcuaggg

SEQ ID NO: 783586 - RNA, 19 nt, Human
gggccucugccagcuccaa

SEQ ID NO: 783587 - RNA, 19 nt, Human
gggcugggggcucaggggc

SEQ ID NO: 783588 - RNA, 18 nt, Human
gggcuugggcucugaagg

SEQ ID NO: 783589 - RNA, 19 nt, Human
ggggagccccgcgccgagc

SEQ ID NO: 783590 - RNA, 22 nt, Human
ggggcccgcagcagcucgggga

SEQ ID NO: 783591 - RNA, 18 nt, Human
gggggcagcaggagcuag

SEQ ID NO: 783592 - RNA, 24 nt, Human
gggggcagcaggagcuaggggugg

SEQ ID NO: 783593 - RNA, 25 nt, Human
ggggguggccuucugggcaugguca

SEQ ID NO: 783594 - RNA, 20 nt, Human
gggggugugggggcagcagg

SEQ ID NO: 783595 - RNA, 23 nt, Human
ggggugccacugaucuugcaguc

SEQ ID NO: 783596 - RNA, 23 nt, Human
ggguagggugggcuccgcuggcc

SEQ ID NO: 783597 - RNA, 23 nt, Human
gggugauguaggccucgugcagg

SEQ ID NO: 783598 - RNA, 18 nt, Human
ggguugggccgugcucca

SEQ ID NO: 783599 - RNA, 19 nt, Human
gguccccgccgggcugggc

SEQ ID NO: 783600 - RNA, 18 nt, Human
ggugugggggcagcagga

SEQ ID NO: 783601 - RNA, 19 nt, Human
guacaggagcuggugaugc

SEQ ID NO: 783602 - RNA, 19 nt, Human
gugagggcccccauguccc

SEQ ID NO: 783603 - RNA, 24 nt, Human
gugcggugcagggcaggccgcugg

SEQ ID NO: 783604 - RNA, 21 nt, Human
gugcgguggccaaggggccua

SEQ ID NO: 783605 - RNA, 22 nt, Human
gugcuggacccccuuacgcagc

SEQ ID NO: 783606 - RNA, 20 nt, Human
guggagcacgugguggccgg

SEQ ID NO: 783607 - RNA, 20 nt, Human
guggggcuugggcucugaag

SEQ ID NO: 783608 - RNA, 30 nt, Human
guggugcagacacaaaggaagucaccgucc

SEQ ID NO: 783609 - RNA, 23 nt, Human
guguagacgccuccauccugggc

SEQ ID NO: 783610 - RNA, 18 nt, Human
gugugggggcagcaggag

SEQ ID NO: 783611 - RNA, 27 nt, Human
uaagugagcacacccgcuccccugaag

SEQ ID NO: 783612 - RNA, 21 nt, Human
uacgcagcccuguggcugccc

SEQ ID NO: 783613 - RNA, 23 nt, Human
uacuggugacccaacuccuccug

SEQ ID NO: 783614 - RNA, 22 nt, Human
uagcuucaggugauccgugcuc

SEQ ID NO: 783615 - RNA, 24 nt, Human
uaggagguguggggggagaugagg

SEQ ID NO: 783616 - RNA, 21 nt, Human
uaggcucaggagggggcucag

SEQ ID NO: 783617 - RNA, 20 nt, Human
uagggucucuucugcgguag

SEQ ID NO: 783618 - RNA, 20 nt, Human
ucacugagcccacagaggag

SEQ ID NO: 783619 - RNA, 18 nt, Human
ucagaagaguugcugaag

SEQ ID NO: 783620 - RNA, 21 nt, Human
ucagaauaccggaaccuguca

SEQ ID NO: 783621 - RNA, 18 nt, Human
ucagcagccgcagcccca

SEQ ID NO: 783622 - RNA, 22 nt, Human
ucaggugauccgugcucaccuc

SEQ ID NO: 783623 - RNA, 22 nt, Human
uccaccacauacacgaugucug

SEQ ID NO: 783624 - RNA, 22 nt, Human
uccaccacauacacgaugucug

SEQ ID NO: 783625 - RNA, 25 nt, Human
uccaccacauacacgaugucugguu

SEQ ID NO: 783626 - RNA, 22 nt, Human
uccagacgaccugggccuccac

SEQ ID NO: 783627 - RNA, 27 nt, Human
uccagcucuuccucuucaggggccgcc

SEQ ID NO: 783628 - RNA, 18 nt, Human
uccaggccggagcuacgc

SEQ ID NO: 783629 - RNA, 24 nt, Human
uccccgccgcgggccucccaggcc

SEQ ID NO: 783630 - RNA, 18 nt, Human
uccgcggccgagagaagc

SEQ ID NO: 783631 - RNA, 24 nt, Human
uccgcggccgagagaagccccagc

SEQ ID NO: 783632 - RNA, 22 nt, Human
uccuccccgacccccucgaccu

SEQ ID NO: 783633 - RNA, 19 nt, Human
uccucgcugcugccacugc

SEQ ID NO: 783634 - RNA, 19 nt, Human
ucggcagcauagggcacga

SEQ ID NO: 783635 - RNA, 23 nt, Human
ucgggcugcagugggcggggcaa

SEQ ID NO: 783636 - RNA, 21 nt, Human
ucuccagcuucgagcuggggc

SEQ ID NO: 783637 - RNA, 22 nt, Human
ucuccuccauggggcagccaaa

SEQ ID NO: 783638 - RNA, 26 nt, Human
ucucgcccucggacguggcccugcga

SEQ ID NO: 783639 - RNA, 19 nt, Human
ucugguuuguccagcaugg

SEQ ID NO: 783640 - RNA, 27 nt, Human
ucuuccagcagccgugugaacaggggu

SEQ ID NO: 783641 - RNA, 21 nt, Human
ugaagaaucuugaguaccccu

SEQ ID NO: 783642 - RNA, 18 nt, Human
ugaccgagcaggucugug

SEQ ID NO: 783643 - RNA, 21 nt, Human
ugagcacacccgcuccccaga

SEQ ID NO: 783644 - RNA, 23 nt, Human
ugagcagugcaggcugcagcagg

SEQ ID NO: 783645 - RNA, 18 nt, Human
ugagcauaauguaaguga

SEQ ID NO: 783646 - RNA, 18 nt, Human
ugagcauaauguaaguga

SEQ ID NO: 783647 - RNA, 18 nt, Human
ugagcugaaugcacagcc

SEQ ID NO: 783648 - RNA, 21 nt, Human
ugagggcuugcugcugcucuu

SEQ ID NO: 783649 - RNA, 26 nt, Human
ugaggugacaggggccucuugguggg

SEQ ID NO: 783650 - RNA, 25 nt, Human
ugaguccagguaacaacagggggcg

SEQ ID NO: 783651 - RNA, 23 nt, Human
ugcagugggcggggcacugaggg

SEQ ID NO: 783652 - RNA, 25 nt, Human
ugccaaaguccacaaucuugagggc

SEQ ID NO: 783653 - RNA, 23 nt, Human
ugccacugaucuugcagucgaaa

SEQ ID NO: 783654 - RNA, 19 nt, Human
ugcccgugcgguggccaag

SEQ ID NO: 783655 - RNA, 20 nt, Human
ugccugaguuuugaaccaag

SEQ ID NO: 783656 - RNA, 18 nt, Human
ugcgaggggcccugggcg

SEQ ID NO: 783657 - RNA, 21 nt, Human
ugcgccggucgucgcugcucu

SEQ ID NO: 783658 - RNA, 23 nt, Human
ugcugcuacugagacugcugccu

SEQ ID NO: 783659 - RNA, 21 nt, Human
ugcugcugcucuugacagugg

SEQ ID NO: 783660 - RNA, 20 nt, Human
uggaagacuggggggaaguc

SEQ ID NO: 783661 - RNA, 21 nt, Human
uggaagacuggggggaagucu

SEQ ID NO: 783662 - RNA, 20 nt, Human
uggacccccuuacgcagccc

SEQ ID NO: 783663 - RNA, 22 nt, Human
uggcaggcugucccuccaccac

SEQ ID NO: 783664 - RNA, 22 nt, Human
uggcaguacuggggcucuccug

SEQ ID NO: 783665 - RNA, 19 nt, Human
uggcauuuguagcugaucu

SEQ ID NO: 783666 - RNA, 20 nt, Human
uggccgggcugaggcucugc

SEQ ID NO: 783667 - RNA, 19 nt, Human
uggcucccgcaggccugug

SEQ ID NO: 783668 - RNA, 21 nt, Human
uggcugccucccccuccagca

SEQ ID NO: 783669 - RNA, 18 nt, Human
uggcuggggaugaacuug

SEQ ID NO: 783670 - RNA, 26 nt, Human
ugggagagcuucggggaccaggagcc

SEQ ID NO: 783671 - RNA, 22 nt, Human
ugggagagcuucggggacugcu

SEQ ID NO: 783672 - RNA, 20 nt, Human
ugggcauggucacccacacc

SEQ ID NO: 783673 - RNA, 21 nt, Human
ugggggcagcaggagcuaggg

SEQ ID NO: 783674 - RNA, 21 nt, Human
ugggggcucaggggcuggugg

SEQ ID NO: 783675 - RNA, 22 nt, Human
uggggggaagucugacucacug

SEQ ID NO: 783676 - RNA, 19 nt, Human
uggggguuguagggcuggg

SEQ ID NO: 783677 - RNA, 19 nt, Human
uggggugguggacccacag

SEQ ID NO: 783678 - RNA, 23 nt, Human
uggugcaggguccgcagcaccuc

SEQ ID NO: 783679 - RNA, 22 nt, Human
ugguugaaugugacggugacgc

SEQ ID NO: 783680 - RNA, 24 nt, Human
uguaagugagcacacccgcucccc

SEQ ID NO: 783681 - RNA, 20 nt, Human
uguaccacaugauguccggc

SEQ ID NO: 783682 - RNA, 23 nt, Human
uguagacaccggcgugcugaggc

SEQ ID NO: 783683 - RNA, 19 nt, Human
ugucccggcggcucacccg

SEQ ID NO: 783684 - RNA, 19 nt, Human
uguccggucauuuucccca

SEQ ID NO: 783685 - RNA, 22 nt, Human
ugucuagguggagcacguggug

SEQ ID NO: 783686 - RNA, 23 nt, Human
ugugggggcagcaggagcuaggg

SEQ ID NO: 783687 - RNA, 24 nt, Human
ugugggggcagcaggagcuagggg

SEQ ID NO: 783688 - RNA, 26 nt, Human
uuccugggggucuggcuccccggcgg

SEQ ID NO: 783689 - RNA, 22 nt, Human
uugucuuucauccaggagaugu

SEQ ID NO: 783690 - RNA, 18 nt, Human
uuuccccagcccccaccu

SEQ ID NO: 783691 - RNA, 19 nt, Human
uuuccccagcccccaccuu

SEQ ID NO: 783692 - RNA, 21 nt, Human
uuuccuggcgauucgcuccag

SEQ ID NO: 783693 - RNA, 22 nt, Human
uuugaugaggaagccccgggcc

SEQ ID NO: 783694 - RNA, 19 nt, Human
uuuuccccaacaaacgggg

SEQ ID NO: 783695 - RNA, 22 nt, Human
aaacacaaaguucauguucagc

SEQ ID NO: 783696 - RNA, 25 nt, Human
aaacaggaaagaaaggugagaaauc

SEQ ID NO: 783697 - RNA, 28 nt, Human
aaacaggaaagaaaggugagaaauccaa

SEQ ID NO: 783698 - RNA, 22 nt, Human
aaagggagaaaaaaagcaaaaa

SEQ ID NO: 783699 - RNA, 23 nt, Human
aacaccccugccucaggccaaga

SEQ ID NO: 783700 - RNA, 23 nt, Human
aaccugguucuauagugucuucc

SEQ ID NO: 783701 - RNA, 24 nt, Human
aacucagccuccaacccugacccc

SEQ ID NO: 783702 - RNA, 21 nt, Human
aagaacucagccuccaacccu

SEQ ID NO: 783703 - RNA, 25 nt, Human
aagaacucagccuccaacccugacc

SEQ ID NO: 783704 - RNA, 18 nt, Human
aagcaauuuuaaaaaacc

SEQ ID NO: 783705 - RNA, 21 nt, Human
aauauaucaugucaccaaaaa

SEQ ID NO: 783706 - RNA, 18 nt, Human
acaagaaaacugaaccca

SEQ ID NO: 783707 - RNA, 22 nt, Human
accacaucuucugaauccccag

SEQ ID NO: 783708 - RNA, 19 nt, Human
acccacucuccaucccacc

SEQ ID NO: 783709 - RNA, 24 nt, Human
accugguucuauagugucguguac

SEQ ID NO: 783710 - RNA, 21 nt, Human
acugcaguccccggcucugcu

SEQ ID NO: 783711 - RNA, 18 nt, Human
agacuucugucaacccag

SEQ ID NO: 783712 - RNA, 18 nt, Human
agagcaucaucgcucaac

SEQ ID NO: 783713 - RNA, 20 nt, Human
agccuccaacccugacccca

SEQ ID NO: 783714 - RNA, 26 nt, Human
aggcuaaaguacaagaaaacugaacc

SEQ ID NO: 783715 - RNA, 18 nt, Human
agggagaaaaaaagcaaa

SEQ ID NO: 783716 - RNA, 18 nt, Human
aguagagcugaaugcuag

SEQ ID NO: 783717 - RNA, 19 nt, Human
caaaaaauuuacccgagaa

SEQ ID NO: 783718 - RNA, 26 nt, Human
caacaagccacucaccuccucuggga

SEQ ID NO: 783719 - RNA, 21 nt, Human
caccaucuggcugccacucca

SEQ ID NO: 783720 - RNA, 21 nt, Human
caccccugccucaggccaaga

SEQ ID NO: 783721 - RNA, 18 nt, Human
cacucuccaucccacccc

SEQ ID NO: 783722 - RNA, 22 nt, Human
cacucuccaucccaccccaucc

SEQ ID NO: 783723 - RNA, 23 nt, Human
cacucuccaucccaccccauccu

SEQ ID NO: 783724 - RNA, 22 nt, Human
cacugcaguccccggcucugcu

SEQ ID NO: 783725 - RNA, 25 nt, Human
cagccaggcuaaaguacaagaaaac

SEQ ID NO: 783726 - RNA, 25 nt, Human
cagccugggccugcaucucagcagc

SEQ ID NO: 783727 - RNA, 23 nt, Human
caucuucugaauccccaguuccc

SEQ ID NO: 783728 - RNA, 21 nt, Human
ccaacaagccacucaccuccu

SEQ ID NO: 783729 - RNA, 25 nt, Human
ccaacccugaccccaaaucugucca

SEQ ID NO: 783730 - RNA, 19 nt, Human
ccagcccugcagacuucug

SEQ ID NO: 783731 - RNA, 18 nt, Human
ccaucccaccccauccua

SEQ ID NO: 783732 - RNA, 18 nt, Human
cccaccccuaccacuucc

SEQ ID NO: 783733 - RNA, 18 nt, Human
cccaucacacaguagagc

SEQ ID NO: 783734 - RNA, 18 nt, Human
ccccaaaucuguccaacc

SEQ ID NO: 783735 - RNA, 23 nt, Human
cccccaggauuugcgcuuggucu

SEQ ID NO: 783736 - RNA, 24 nt, Human
ccccugccucaggccaagacccaa

SEQ ID NO: 783737 - RNA, 21 nt, Human
cccuggaagguacuacacagg

SEQ ID NO: 783738 - RNA, 22 nt, Human
ccuccaacccugaccccaaauc

SEQ ID NO: 783739 - RNA, 24 nt, Human
ccuccaacccugaccccaaaucug

SEQ ID NO: 783740 - RNA, 21 nt, Human
ccucccaacaagccacucacc

SEQ ID NO: 783741 - RNA, 20 nt, Human
ccuccucucccuuccucaaa

SEQ ID NO: 783742 - RNA, 22 nt, Human
ccucuagacgggcugagagucc

SEQ ID NO: 783743 - RNA, 22 nt, Human
cgagaaauagaaguuuaaaagc

SEQ ID NO: 783744 - RNA, 22 nt, Human
cucaacaccccugccucaggcc

SEQ ID NO: 783745 - RNA, 25 nt, Human
cucagccuccaacccugaccccaaa

SEQ ID NO: 783746 - RNA, 23 nt, Human
cucaggacuccaccccucccaag

SEQ ID NO: 783747 - RNA, 19 nt, Human
cucaggccguuugcucugc

SEQ ID NO: 783748 - RNA, 20 nt, Human
cucccaagugcacugaggua

SEQ ID NO: 783749 - RNA, 22 nt, Human
cucuaaaacacaguaaaguaga

SEQ ID NO: 783750 - RNA, 25 nt, Human
cucugccacacuacagaaauagacc

SEQ ID NO: 783751 - RNA, 18 nt, Human
cuggcaguggaauuggcc

SEQ ID NO: 783752 - RNA, 26 nt, Human
cuuccucccaacaagccacucaccuc

SEQ ID NO: 783753 - RNA, 18 nt, Human
gaagcaccuugccaaagc

SEQ ID NO: 783754 - RNA, 18 nt, Human
gaauccccaguucccucc

SEQ ID NO: 783755 - RNA, 20 nt, Human
gagcucuagagugacagcuc

SEQ ID NO: 783756 - RNA, 20 nt, Human
gagcuuccucccaacaagcc

SEQ ID NO: 783757 - RNA, 23 nt, Human
gcauggcugucggcaaggaagag

SEQ ID NO: 783758 - RNA, 19 nt, Human
gccgcagagucccagaaac

SEQ ID NO: 783759 - RNA, 24 nt, Human
gccuccaacccugaccccaaaucu

SEQ ID NO: 783760 - RNA, 18 nt, Human
gccugcuucccuaccagc

SEQ ID NO: 783761 - RNA, 26 nt, Human
gcuaaaguacaagaaaacugaaccca

SEQ ID NO: 783762 - RNA, 19 nt, Human
gcucugcacuggugccagc

SEQ ID NO: 783763 - RNA, 21 nt, Human
ggaagguacuacacagggugg

SEQ ID NO: 783764 - RNA, 20 nt, Human
ggagaaaagauucugaaucg

SEQ ID NO: 783765 - RNA, 21 nt, Human
ggccaagacccaaaugucuuc

SEQ ID NO: 783766 - RNA, 23 nt, Human
gggccagggcagaaaucauggaa

SEQ ID NO: 783767 - RNA, 24 nt, Human
gggugucuacauggggcuuccucc

SEQ ID NO: 783768 - RNA, 18 nt, Human
gguaagagggaaaaaugc

SEQ ID NO: 783769 - RNA, 18 nt, Human
gguggguggauaguaugu

SEQ ID NO: 783770 - RNA, 22 nt, Human
guccucaaaagaacucagccuc

SEQ ID NO: 783771 - RNA, 20 nt, Human
uaaaaaaccuucaaucaaca

SEQ ID NO: 783772 - RNA, 23 nt, Human
uaaaaaaccuucaaucaacaaua

SEQ ID NO: 783773 - RNA, 26 nt, Human
uaaaagcaauuuuaaaaaaccuucaa

SEQ ID NO: 783774 - RNA, 18 nt, Human
uaccagccugcggaagca

SEQ ID NO: 783775 - RNA, 22 nt, Human
uagaaaaacacaucucugccac

SEQ ID NO: 783776 - RNA, 23 nt, Human
uagaaaaacacaucucugccaca

SEQ ID NO: 783777 - RNA, 18 nt, Human
uagcaucagcuuuuccug

SEQ ID NO: 783778 - RNA, 26 nt, Human
uagugucuuccaucugaccgagcucu

SEQ ID NO: 783779 - RNA, 18 nt, Human
uaucagagcaucaucgcu

SEQ ID NO: 783780 - RNA, 25 nt, Human
uaucaugucaccaaaaaauuuaccc

SEQ ID NO: 783781 - RNA, 18 nt, Human
ucaaaagaacucagccuc

SEQ ID NO: 783782 - RNA, 19 nt, Human
uccaacccugaccccaaau

SEQ ID NO: 783783 - RNA, 18 nt, Human
uccaccccucccaagugc

SEQ ID NO: 783784 - RNA, 18 nt, Human
uccaucuaccaaagauuu

SEQ ID NO: 783785 - RNA, 20 nt, Human
ucccaacaagccacucaccu

SEQ ID NO: 783786 - RNA, 24 nt, Human
ucccaacaagccacucaccuccuc

SEQ ID NO: 783787 - RNA, 23 nt, Human
uccccaauucccccaggauuugc

SEQ ID NO: 783788 - RNA, 20 nt, Human
uccccaguucccuccaucua

SEQ ID NO: 783789 - RNA, 22 nt, Human
uccccaguucccuccaucuacc

SEQ ID NO: 783790 - RNA, 20 nt, Human
uccccggcucugcuggcugu

SEQ ID NO: 783791 - RNA, 18 nt, Human
ucccuaggucaccaucuc

SEQ ID NO: 783792 - RNA, 20 nt, Human
ucccuaggucaccaucucua

SEQ ID NO: 783793 - RNA, 20 nt, Human
ucccuugggugucuacaugg

SEQ ID NO: 783794 - RNA, 26 nt, Human
ucucccaccccuaccacuuccaggua

SEQ ID NO: 783795 - RNA, 18 nt, Human
ucuggaacugagcuuccu

SEQ ID NO: 783796 - RNA, 18 nt, Human
ugaaaagagguaggagua

SEQ ID NO: 783797 - RNA, 21 nt, Human
ugaccgagcucuagagugaca

SEQ ID NO: 783798 - RNA, 24 nt, Human
ugacugggcuuugcuagcaucccu

SEQ ID NO: 783799 - RNA, 21 nt, Human
ugagguaagagggaaaaaugc

SEQ ID NO: 783800 - RNA, 22 nt, Human
ugagguaagagggaaaaaugcc

SEQ ID NO: 783801 - RNA, 19 nt, Human
ugagguaaguucuggaacu

SEQ ID NO: 783802 - RNA, 21 nt, Human
ugcaaaaacucaagagggaga

SEQ ID NO: 783803 - RNA, 18 nt, Human
ugcacuggugccagcugu

SEQ ID NO: 783804 - RNA, 19 nt, Human
ugccacuccaaccaguccu

SEQ ID NO: 783805 - RNA, 19 nt, Human
ugccgcagagucccagaaa

SEQ ID NO: 783806 - RNA, 22 nt, Human
ugccgcagagucccagaaacag

SEQ ID NO: 783807 - RNA, 24 nt, Human
ugccgcagagucccagaaacagga

SEQ ID NO: 783808 - RNA, 18 nt, Human
ugcggaagcaccuugcca

SEQ ID NO: 783809 - RNA, 19 nt, Human
ugcucaggacuccaccccu

SEQ ID NO: 783810 - RNA, 22 nt, Human
uggaagguacuacacagggugg

SEQ ID NO: 783811 - RNA, 26 nt, Human
uggaauuggccuggaauguuugccgu

SEQ ID NO: 783812 - RNA, 21 nt, Human
uggcaguggaauuggccugga

SEQ ID NO: 783813 - RNA, 20 nt, Human
uggcugugcccaguccuggu

SEQ ID NO: 783814 - RNA, 19 nt, Human
ugggaggaauaagcaugag

SEQ ID NO: 783815 - RNA, 21 nt, Human
ugggaguucauucaccuccuc

SEQ ID NO: 783816 - RNA, 24 nt, Human
ugggccaggagcucaggaccaaag

SEQ ID NO: 783817 - RNA, 18 nt, Human
ugucaccaaaaaauuuac

SEQ ID NO: 783818 - RNA, 22 nt, Human
ugugaccaaguacugacugggc

SEQ ID NO: 783819 - RNA, 24 nt, Human
uucaccuccucucccuuccucaaa

SEQ ID NO: 783820 - RNA, 21 nt, Human
uuugcuagcaucccugggcca

SEQ ID NO: 783821 - RNA, 20 nt, Human
uuugguauuuuuaacguccc

SEQ ID NO: 783822 - RNA, 23 nt, Human
aaaacaccuaugaaaacuaugca

SEQ ID NO: 783823 - RNA, 19 nt, Human
aaacagaacucacugugua

SEQ ID NO: 783824 - RNA, 28 nt, Human
aagaacauaaacauaaugaaccuacaag

SEQ ID NO: 783825 - RNA, 21 nt, Human
aagcaagaaaugaauauucug

SEQ ID NO: 783826 - RNA, 21 nt, Human
aagcauccucuugaaacuucc

SEQ ID NO: 783827 - RNA, 22 nt, Human
aaggaagcauccucuugaaacu

SEQ ID NO: 783828 - RNA, 25 nt, Human
acaaaacaccuaugaaaacuaugca

SEQ ID NO: 783829 - RNA, 24 nt, Human
acccaaauccuuccaagaggacuc

SEQ ID NO: 783830 - RNA, 22 nt, Human
agaucucaaagaaauguuuggg

SEQ ID NO: 783831 - RNA, 23 nt, Human
aggcacucauaagcaagaaauga

SEQ ID NO: 783832 - RNA, 26 nt, Human
agugcaggaguguaacauaaguggua

SEQ ID NO: 783833 - RNA, 23 nt, Human
augaaaacuaugcauaugaccuc

SEQ ID NO: 783834 - RNA, 25 nt, Human
augaaccuacaaaaaauaaacagaa

SEQ ID NO: 783835 - RNA, 20 nt, Human
augcauaucauacuaucaca

SEQ ID NO: 783836 - RNA, 20 nt, Human
auggaacaugaaaauggaau

SEQ ID NO: 783837 - RNA, 22 nt, Human
auggaacaugaaaauggaauga

SEQ ID NO: 783838 - RNA, 20 nt, Human
caaaauauuuggggaauuuu

SEQ ID NO: 783839 - RNA, 24 nt, Human
caacagcacauagcuuuauccuaa

SEQ ID NO: 783840 - RNA, 19 nt, Human
cacccaaauccuuccaaga

SEQ ID NO: 783841 - RNA, 23 nt, Human
cagcagaggauguucacggcaca

SEQ ID NO: 783842 - RNA, 23 nt, Human
caggccccaagcuccagcagagg

SEQ ID NO: 783843 - RNA, 19 nt, Human
cauaacaaauggaaaaagu

SEQ ID NO: 783844 - RNA, 22 nt, Human
cauaauuacacacauaccacuu

SEQ ID NO: 783845 - RNA, 20 nt, Human
cccaguaguaaacauagcuu

SEQ ID NO: 783846 - RNA, 26 nt, Human
ccuauggugcacaccaugcaggcacu

SEQ ID NO: 783847 - RNA, 24 nt, Human
cuauaacccuuuuucagaacauuu

SEQ ID NO: 783848 - RNA, 24 nt, Human
cucauaaaauuaagcagaaguaag

SEQ ID NO: 783849 - RNA, 21 nt, Human
cuccaggccccaagcuccagc

SEQ ID NO: 783850 - RNA, 18 nt, Human
cucugggauuggcugccu

SEQ ID NO: 783851 - RNA, 25 nt, Human
cugcagccccaguuugcuccaggcc

SEQ ID NO: 783852 - RNA, 20 nt, Human
cuggaaaacaacagcacaua

SEQ ID NO: 783853 - RNA, 21 nt, Human
cuucucugggauuggcugccu

SEQ ID NO: 783854 - RNA, 21 nt, Human
cuuuauccuaaaggaagcauc

SEQ ID NO: 783855 - RNA, 20 nt, Human
gaacauaaacauaaugaacc

SEQ ID NO: 783856 - RNA, 23 nt, Human
gaacauaaacauaaugaaccuac

SEQ ID NO: 783857 - RNA, 20 nt, Human
gaguuucaauuugugguguc

SEQ ID NO: 783858 - RNA, 19 nt, Human
gcagcuucugaaccugccu

SEQ ID NO: 783859 - RNA, 24 nt, Human
gccccaguuugcuccaggccccaa

SEQ ID NO: 783860 - RNA, 23 nt, Human
ggcacauucccaaccaaaaagga

SEQ ID NO: 783861 - RNA, 19 nt, Human
ggccccaagcuccagcaga

SEQ ID NO: 783862 - RNA, 24 nt, Human
guccucucccucaacugaugcuca

SEQ ID NO: 783863 - RNA, 31 nt, Human
gucuuuagccauaauuacacacauaccacuu

SEQ ID NO: 783864 - RNA, 20 nt, Human
gugucuucacugaugaggga

SEQ ID NO: 783865 - RNA, 21 nt, Human
uaacaaauggaaaaaguuugg

SEQ ID NO: 783866 - RNA, 20 nt, Human
uacaaaacaccuaugaaaac

SEQ ID NO: 783867 - RNA, 23 nt, Human
uacacacauaccacuugcauaua

SEQ ID NO: 783868 - RNA, 18 nt, Human
uacagcaugauagguagg

SEQ ID NO: 783869 - RNA, 22 nt, Human
uaccucauauugacuugguuuc

SEQ ID NO: 783870 - RNA, 22 nt, Human
uagugcaggaguguaacauaag

SEQ ID NO: 783871 - RNA, 24 nt, Human
uauccuaaaggaagcauccucuug

SEQ ID NO: 783872 - RNA, 25 nt, Human
uauuguaaugucccuucaccuuugg

SEQ ID NO: 783873 - RNA, 25 nt, Human
ucaagcucacccaaauccuuccaag

SEQ ID NO: 783874 - RNA, 23 nt, Human
ucacccaaauccuuccaagagga

SEQ ID NO: 783875 - RNA, 19 nt, Human
ucagaacauuucuucacac

SEQ ID NO: 783876 - RNA, 24 nt, Human
uccacagagaugggcauucagcuu

SEQ ID NO: 783877 - RNA, 25 nt, Human
ucccaguaguaaacauaggguaccc

SEQ ID NO: 783878 - RNA, 22 nt, Human
uccugagucccuaaaaauuacc

SEQ ID NO: 783879 - RNA, 20 nt, Human
ucuauaaaauguaagauugc

SEQ ID NO: 783880 - RNA, 24 nt, Human
ucugcagccccaguuugcuccagg

SEQ ID NO: 783881 - RNA, 19 nt, Human
ucugcagucucgcguccuc

SEQ ID NO: 783882 - RNA, 18 nt, Human
ucugcuucucugggauug

SEQ ID NO: 783883 - RNA, 22 nt, Human
ugauggaguugcuguuagucau

SEQ ID NO: 783884 - RNA, 19 nt, Human
ugcacaccaugcaggcacu

SEQ ID NO: 783885 - RNA, 24 nt, Human
ugcaguacgugccuuuagugcagg

SEQ ID NO: 783886 - RNA, 23 nt, Human
ugcauaucauacuaucacauaua

SEQ ID NO: 783887 - RNA, 21 nt, Human
ugccaacaucccauaauagga

SEQ ID NO: 783888 - RNA, 20 nt, Human
ugccauagaaaaacugucuc

SEQ ID NO: 783889 - RNA, 19 nt, Human
ugcccgaguaugcauggaa

SEQ ID NO: 783890 - RNA, 23 nt, Human
ugcuccaggccccaagcuccagc

SEQ ID NO: 783891 - RNA, 24 nt, Human
ugcuccaggccccaagcuccagcc

SEQ ID NO: 783892 - RNA, 20 nt, Human
uggaaaaaguuuggcaguca

SEQ ID NO: 783893 - RNA, 22 nt, Human
uggaguugcuguuagucauauu

SEQ ID NO: 783894 - RNA, 18 nt, Human
uggcugccuacaaagcuc

SEQ ID NO: 783895 - RNA, 22 nt, Human
uuacacacauaccacuugcaua

SEQ ID NO: 783896 - RNA, 20 nt, Human
uucaagauucuccugagucc

SEQ ID NO: 783897 - RNA, 22 nt, Human
uucaugaucaauaaguacaaag

SEQ ID NO: 783898 - RNA, 20 nt, Human
uuccauggcugcuuauaaau

SEQ ID NO: 783899 - RNA, 21 nt, Human
uuggagaugccauagaaaaac

SEQ ID NO: 783900 - RNA, 18 nt, Human
aaaauaccaucauugugg

SEQ ID NO: 783901 - RNA, 22 nt, Human
aaaauuucgaaacagacuagcc

SEQ ID NO: 783902 - RNA, 18 nt, Human
aaacagacuagccaccag

SEQ ID NO: 783903 - RNA, 23 nt, Human
aaagaacacuuuucaaaauacca

SEQ ID NO: 783904 - RNA, 24 nt, Human
aaagaacacuuuucaaaauaccau

SEQ ID NO: 783905 - RNA, 19 nt, Human
aaaggagcagcggaggggc

SEQ ID NO: 783906 - RNA, 19 nt, Human
aacuggaguccagagaccu

SEQ ID NO: 783907 - RNA, 22 nt, Human
aaggagccccguggauuaaggc

SEQ ID NO: 783908 - RNA, 21 nt, Human
aauaaauagauaaugagccuc

SEQ ID NO: 783909 - RNA, 22 nt, Human
acagaacaggagagggacagag

SEQ ID NO: 783910 - RNA, 24 nt, Human
acagaacaggagagggacagaggc

SEQ ID NO: 783911 - RNA, 26 nt, Human
acagaggcgccguggccgcgggggug

SEQ ID NO: 783912 - RNA, 23 nt, Human
acagguggugauuuugucucaaa

SEQ ID NO: 783913 - RNA, 24 nt, Human
acagguggugauuuugucucaaaa

SEQ ID NO: 783914 - RNA, 23 nt, Human
accugccuccccugugcaccgcc

SEQ ID NO: 783915 - RNA, 19 nt, Human
acuggaguccagagaccug

SEQ ID NO: 783916 - RNA, 20 nt, Human
agcgggggcggggggggguc

SEQ ID NO: 783917 - RNA, 25 nt, Human
aggcauggagaccacaggucgggcu

SEQ ID NO: 783918 - RNA, 22 nt, Human
agguggugggccuggcuggggc

SEQ ID NO: 783919 - RNA, 19 nt, Human
agugccucuugccuguaug

SEQ ID NO: 783920 - RNA, 19 nt, Human
augaagccaccuggcuccu

SEQ ID NO: 783921 - RNA, 28 nt, Human
caaaacaaacagaaacgcguguugggua

SEQ ID NO: 783922 - RNA, 23 nt, Human
cacacagcuccugucugcaccac

SEQ ID NO: 783923 - RNA, 20 nt, Human
caccagccacaccgcaggag

SEQ ID NO: 783924 - RNA, 21 nt, Human
cacccggagccguccgggacc

SEQ ID NO: 783925 - RNA, 24 nt, Human
caccuggaugcuggugcucagugg

SEQ ID NO: 783926 - RNA, 19 nt, Human
cacgacagcgaagacagac

SEQ ID NO: 783927 - RNA, 23 nt, Human
cacgacagcgaagacagacaaaa

SEQ ID NO: 783928 - RNA, 20 nt, Human
cagaagaugcucuuggccac

SEQ ID NO: 783929 - RNA, 22 nt, Human
cagcaaguccugucugaagagc

SEQ ID NO: 783930 - RNA, 23 nt, Human
cagcagcuaaggcagcagccaac

SEQ ID NO: 783931 - RNA, 21 nt, Human
cagcaggcggccguggccugg

SEQ ID NO: 783932 - RNA, 23 nt, Human
cagcgccugccucuccgccaggg

SEQ ID NO: 783933 - RNA, 26 nt, Human
cagcuaaggcagcagccaacguucac

SEQ ID NO: 783934 - RNA, 21 nt, Human
cagcucagcccccugagggcc

SEQ ID NO: 783935 - RNA, 23 nt, Human
cagcucagcccccugagggccag

SEQ ID NO: 783936 - RNA, 23 nt, Human
cagcucagucuccagcucagccc

SEQ ID NO: 783937 - RNA, 20 nt, Human
cagcugccccagggacccgu

SEQ ID NO: 783938 - RNA, 22 nt, Human
caggccaccagccacaccgcag

SEQ ID NO: 783939 - RNA, 19 nt, Human
cagggacccguaggagccc

SEQ ID NO: 783940 - RNA, 18 nt, Human
caucugcacaugcgugug

SEQ ID NO: 783941 - RNA, 24 nt, Human
cauggagaccacaggucgggcugc

SEQ ID NO: 783942 - RNA, 18 nt, Human
caugugugugcccccagg

SEQ ID NO: 783943 - RNA, 21 nt, Human
ccacagcggccccugcugaca

SEQ ID NO: 783944 - RNA, 25 nt, Human
ccacccagaagaugcucuuggccac

SEQ ID NO: 783945 - RNA, 22 nt, Human
ccacgccgccugcaugugugug

SEQ ID NO: 783946 - RNA, 21 nt, Human
ccagaagaugcucuuggccac

SEQ ID NO: 783947 - RNA, 21 nt, Human
ccagacacgacagcgaagaca

SEQ ID NO: 783948 - RNA, 23 nt, Human
ccagcgccugccucuccgccagg

SEQ ID NO: 783949 - RNA, 19 nt, Human
ccccagcgccugccucucc

SEQ ID NO: 783950 - RNA, 24 nt, Human
ccccagggacccguaggagcccca

SEQ ID NO: 783951 - RNA, 18 nt, Human
cccccugagggccaggug

SEQ ID NO: 783952 - RNA, 18 nt, Human
ccccugggcggcuuccuu

SEQ ID NO: 783953 - RNA, 19 nt, Human
cccgagcccuccccuuccc

SEQ ID NO: 783954 - RNA, 23 nt, Human
cccguggucaugggccucucacu

SEQ ID NO: 783955 - RNA, 21 nt, Human
ccgacgccccgugccccggcg

SEQ ID NO: 783956 - RNA, 18 nt, Human
ccggaaccuucuucuggu

SEQ ID NO: 783957 - RNA, 21 nt, Human
ccgggcugcuuucucggccca

SEQ ID NO: 783958 - RNA, 25 nt, Human
ccucgccaaggaccugccuccccug

SEQ ID NO: 783959 - RNA, 19 nt, Human
ccucucaauaauccugauu

SEQ ID NO: 783960 - RNA, 23 nt, Human
ccucucacugccagaaugaagcc

SEQ ID NO: 783961 - RNA, 21 nt, Human
ccugccgucaucagcagcuaa

SEQ ID NO: 783962 - RNA, 19 nt, Human
ccugccucuccgccagggc

SEQ ID NO: 783963 - RNA, 22 nt, Human
ccuggaggugcggggagggugg

SEQ ID NO: 783964 - RNA, 27 nt, Human
cgaaacagacuagccaccagcaagucc

SEQ ID NO: 783965 - RNA, 21 nt, Human
cgacagcgaagacagacaaaa

SEQ ID NO: 783966 - RNA, 22 nt, Human
cgcccugcggccccuccugggc

SEQ ID NO: 783967 - RNA, 21 nt, Human
cggaccccugggcggcuuccu

SEQ ID NO: 783968 - RNA, 19 nt, Human
cggccaaggacagcccgga

SEQ ID NO: 783969 - RNA, 20 nt, Human
cggcucaaggcuggagacgg

SEQ ID NO: 783970 - RNA, 21 nt, Human
cgggacccggcagugccucuu

SEQ ID NO: 783971 - RNA, 24 nt, Human
cguggugccaucugcacaugcgug

SEQ ID NO: 783972 - RNA, 19 nt, Human
cgugugcuacaccugugug

SEQ ID NO: 783973 - RNA, 18 nt, Human
cuagccaccagcaagucc

SEQ ID NO: 783974 - RNA, 23 nt, Human
cucacugccagaaugaagccacc

SEQ ID NO: 783975 - RNA, 24 nt, Human
cuccagcucagcccccugagggcc

SEQ ID NO: 783976 - RNA, 20 nt, Human
cuccugccgucaucagcagc

SEQ ID NO: 783977 - RNA, 22 nt, Human
cugcaccacaggcccagcuguc

SEQ ID NO: 783978 - RNA, 25 nt, Human
cugcaugugugugcccccaggugcc

SEQ ID NO: 783979 - RNA, 22 nt, Human
cugcggccccuccugggcggga

SEQ ID NO: 783980 - RNA, 19 nt, Human
cuguccugccuugucacgu

SEQ ID NO: 783981 - RNA, 20 nt, Human
cuucccugacauuccagaca

SEQ ID NO: 783982 - RNA, 21 nt, Human
cuuccucucucuugguuuccc

SEQ ID NO: 783983 - RNA, 18 nt, Human
gaaauaaagugagguguu

SEQ ID NO: 783984 - RNA, 22 nt, Human
gaccuggaggugcggggagggu

SEQ ID NO: 783985 - RNA, 22 nt, Human
gagaccacgccgccugcaugug

SEQ ID NO: 783986 - RNA, 19 nt, Human
gagcgggggcggggggggg

SEQ ID NO: 783987 - RNA, 23 nt, Human
gcaggccaccagccacaccgcag

SEQ ID NO: 783988 - RNA, 18 nt, Human
gcccggaccccugggcgg

SEQ ID NO: 783989 - RNA, 19 nt, Human
gcccugcggccccuccugg

SEQ ID NO: 783990 - RNA, 24 nt, Human
gccgcagcagccgacgccccgugc

SEQ ID NO: 783991 - RNA, 20 nt, Human
gccugccucuccgccagggc

SEQ ID NO: 783992 - RNA, 21 nt, Human
gcgggggcgggggggggucuu

SEQ ID NO: 783993 - RNA, 21 nt, Human
gcgugugcggguggagcuggg

SEQ ID NO: 783994 - RNA, 21 nt, Human
ggccacggcaggccaccagcc

SEQ ID NO: 783995 - RNA, 18 nt, Human
ggccucucacugccagaa

SEQ ID NO: 783996 - RNA, 18 nt, Human
gggcacaggcauggagac

SEQ ID NO: 783997 - RNA, 23 nt, Human
gggccaaaacuggaguccagaga

SEQ ID NO: 783998 - RNA, 21 nt, Human
gggccuggcuggggcagcgcc

SEQ ID NO: 783999 - RNA, 22 nt, Human
gggcuggugucacccggagccg

SEQ ID NO: 784000 - RNA, 24 nt, Human
gggggugcaccuggaugcuggugc

SEQ ID NO: 784001 - RNA, 19 nt, Human
ggugcggggagggugggcu

SEQ ID NO: 784002 - RNA, 19 nt, Human
ggugcucagugggaagcca

SEQ ID NO: 784003 - RNA, 20 nt, Human
gguggagcgggggcgggggg

SEQ ID NO: 784004 - RNA, 24 nt, Human
guccacacagcuccugucugcacc

SEQ ID NO: 784005 - RNA, 18 nt, Human
gugccggaaccuucuucu

SEQ ID NO: 784006 - RNA, 23 nt, Human
guggagcgggggcgggggggggu

SEQ ID NO: 784007 - RNA, 18 nt, Human
uaaaaaauuucgaaacag

SEQ ID NO: 784008 - RNA, 19 nt, Human
uagccaccagcaaguccug

SEQ ID NO: 784009 - RNA, 28 nt, Human
uaugugaggaacguguggggacagagca

SEQ ID NO: 784010 - RNA, 24 nt, Human
ucagaccugugaagacagcccacg

SEQ ID NO: 784011 - RNA, 22 nt, Human
ucagcagcuaaggcagcagcca

SEQ ID NO: 784012 - RNA, 28 nt, Human
ucagcccccugagggccaggugugucuc

SEQ ID NO: 784013 - RNA, 19 nt, Human
ucccccagcuggcuaggaa

SEQ ID NO: 784014 - RNA, 26 nt, Human
uccgccaauaaaaaauuucgaaacag

SEQ ID NO: 784015 - RNA, 18 nt, Human
uccuccugucguucaggc

SEQ ID NO: 784016 - RNA, 22 nt, Human
ucgcucuuggccugauggggac

SEQ ID NO: 784017 - RNA, 21 nt, Human
ucucaaaacaaacagaaacgc

SEQ ID NO: 784018 - RNA, 20 nt, Human
ucucagagaaacacagaaca

SEQ ID NO: 784019 - RNA, 18 nt, Human
ucuccuucuuccucucuc

SEQ ID NO: 784020 - RNA, 18 nt, Human
ugagagguggugggccug

SEQ ID NO: 784021 - RNA, 23 nt, Human
ugagagguggugggccuggcugg

SEQ ID NO: 784022 - RNA, 19 nt, Human
ugagcugagugaggccggg

SEQ ID NO: 784023 - RNA, 24 nt, Human
ugauggcugugaagauccaguuca

SEQ ID NO: 784024 - RNA, 20 nt, Human
ugauuacauggaaauaaagu

SEQ ID NO: 784025 - RNA, 22 nt, Human
ugccggccguggugccaucugc

SEQ ID NO: 784026 - RNA, 23 nt, Human
ugcggggagggugggcugugcgc

SEQ ID NO: 784027 - RNA, 22 nt, Human
ugcuuucucggcccagacgugg

SEQ ID NO: 784028 - RNA, 30 nt, Human
uggaaauaaagugagguguuuccccuuucc

SEQ ID NO: 784029 - RNA, 20 nt, Human
uggaagauucugguguugcc

SEQ ID NO: 784030 - RNA, 23 nt, Human
uggagccaccugccuuuugacag

SEQ ID NO: 784031 - RNA, 19 nt, Human
uggaugcuggugcucagug

SEQ ID NO: 784032 - RNA, 20 nt, Human
ugggccucucacugccagaa

SEQ ID NO: 784033 - RNA, 23 nt, Human
uggugggccuggcuggggcagcg

SEQ ID NO: 784034 - RNA, 22 nt, Human
uguccacacagcuccugucugc

SEQ ID NO: 784035 - RNA, 19 nt, Human
ugucucaaaacaaacagaa

SEQ ID NO: 784036 - RNA, 20 nt, Human
ugucugaagagcuuuuggaa

SEQ ID NO: 784037 - RNA, 19 nt, Human
ugucugugauggcugugaa

SEQ ID NO: 784038 - RNA, 22 nt, Human
ugugaagauccaguucaguuca

SEQ ID NO: 784039 - RNA, 21 nt, Human
ugugagggcacaggcauggag

SEQ ID NO: 784040 - RNA, 21 nt, Human
uguuuugucaaaguccgucuc

SEQ ID NO: 784041 - RNA, 22 nt, Human
uucuggaagauucugguguugc

SEQ ID NO: 784042 - RNA, 21 nt, Human
uugaaggacuggaugggaagc

SEQ ID NO: 784043 - RNA, 20 nt, Human
uuggaggggcgucuccuucu

SEQ ID NO: 784044 - RNA, 21 nt, Human
uuuacuguuggucacucucug

SEQ ID NO: 784045 - RNA, 20 nt, Human
uuuggaagagaucccggggg

SEQ ID NO: 784046 - RNA, 20 nt, Human
aaaaccacugggagugggga

SEQ ID NO: 784047 - RNA, 18 nt, Human
aaccuguugccagaaccc

SEQ ID NO: 784048 - RNA, 23 nt, Human
aacuugcugugugacuuugggug

SEQ ID NO: 784049 - RNA, 23 nt, Human
acagagagccccgguaggagguu

SEQ ID NO: 784050 - RNA, 20 nt, Human
acuccaccacugcccacccc

SEQ ID NO: 784051 - RNA, 23 nt, Human
acucugcaaugccaagcguucug

SEQ ID NO: 784052 - RNA, 19 nt, Human
agagagcaccugccaaaaa

SEQ ID NO: 784053 - RNA, 19 nt, Human
agagcaggcuugggugagg

SEQ ID NO: 784054 - RNA, 20 nt, Human
agcaggcuugggugagggag

SEQ ID NO: 784055 - RNA, 24 nt, Human
aggaaagagagcaccugccaaaaa

SEQ ID NO: 784056 - RNA, 19 nt, Human
aggaagagaaaggauggcg

SEQ ID NO: 784057 - RNA, 18 nt, Human
aggccagccagagugacg

SEQ ID NO: 784058 - RNA, 18 nt, Human
agggagggagagugaggc

SEQ ID NO: 784059 - RNA, 25 nt, Human
agggaugagaggccagaggugaggg

SEQ ID NO: 784060 - RNA, 21 nt, Human
agugacguggcacuggccuuc

SEQ ID NO: 784061 - RNA, 21 nt, Human
auccuuuggcaaacuccacca

SEQ ID NO: 784062 - RNA, 18 nt, Human
augaacuugcugugugac

SEQ ID NO: 784063 - RNA, 25 nt, Human
cacaggacucggggggugauacaga

SEQ ID NO: 784064 - RNA, 24 nt, Human
cacauccuuuggcaaacuccacca

SEQ ID NO: 784065 - RNA, 18 nt, Human
caccuggaaggaacucac

SEQ ID NO: 784066 - RNA, 19 nt, Human
cacugggaguggggacugg

SEQ ID NO: 784067 - RNA, 23 nt, Human
caggagaaggaucgcccccagac

SEQ ID NO: 784068 - RNA, 18 nt, Human
caggauacaguggaggua

SEQ ID NO: 784069 - RNA, 24 nt, Human
ccacugcccaccccccugggcacc

SEQ ID NO: 784070 - RNA, 21 nt, Human
ccacugggaguggggacuggc

SEQ ID NO: 784071 - RNA, 20 nt, Human
cccacacuuuccacuucuca

SEQ ID NO: 784072 - RNA, 22 nt, Human
ccgcaggccacggcugccaggu

SEQ ID NO: 784073 - RNA, 19 nt, Human
ccuccagaggggcaggagc

SEQ ID NO: 784074 - RNA, 25 nt, Human
ccugccaaaaaucccacacuuucca

SEQ ID NO: 784075 - RNA, 20 nt, Human
ccuggucucagcucagccau

SEQ ID NO: 784076 - RNA, 19 nt, Human
cgcauacagcaccagggag

SEQ ID NO: 784077 - RNA, 22 nt, Human
cgcccgcuccccgcacggcucg

SEQ ID NO: 784078 - RNA, 22 nt, Human
cggaagggaugagaggccagag

SEQ ID NO: 784079 - RNA, 24 nt, Human
cucacacucacugcaagggugauc

SEQ ID NO: 784080 - RNA, 22 nt, Human
cuccaccacugcccaccccccu

SEQ ID NO: 784081 - RNA, 19 nt, Human
cucccacaggaggcugaag

SEQ ID NO: 784082 - RNA, 22 nt, Human
cugcccaccccccugggcaccc

SEQ ID NO: 784083 - RNA, 19 nt, Human
cugcccaccccccugggcu

SEQ ID NO: 784084 - RNA, 18 nt, Human
cuggagcuugguccccuu

SEQ ID NO: 784085 - RNA, 18 nt, Human
cuggcaaccugggcuaga

SEQ ID NO: 784086 - RNA, 20 nt, Human
cuuugggaugggguugggag

SEQ ID NO: 784087 - RNA, 19 nt, Human
gaaccuguugccagaaccc

SEQ ID NO: 784088 - RNA, 20 nt, Human
gaagauccaguugcagugag

SEQ ID NO: 784089 - RNA, 22 nt, Human
gaagccccgagcccuccagagg

SEQ ID NO: 784090 - RNA, 20 nt, Human
gaagggaugagaggccagag

SEQ ID NO: 784091 - RNA, 24 nt, Human
gagcaggcuugggugagggagugg

SEQ ID NO: 784092 - RNA, 20 nt, Human
gaggggcaggagcucccaca

SEQ ID NO: 784093 - RNA, 19 nt, Human
gaguuggagagaauguggg

SEQ ID NO: 784094 - RNA, 24 nt, Human
gcacacaccuggaaggaacucaca

SEQ ID NO: 784095 - RNA, 18 nt, Human
gcacccugcuuggccagg

SEQ ID NO: 784096 - RNA, 25 nt, Human
gccaaaaaucccacacuuuccacuu

SEQ ID NO: 784097 - RNA, 18 nt, Human
gcgcccgcccucuggagc

SEQ ID NO: 784098 - RNA, 18 nt, Human
gcucgggcgcccgcccuc

SEQ ID NO: 784099 - RNA, 21 nt, Human
ggaaaaccacugggagugggg

SEQ ID NO: 784100 - RNA, 21 nt, Human
ggaagccccgagcccuccaga

SEQ ID NO: 784101 - RNA, 21 nt, Human
ggagaugaagaguuggagaga

SEQ ID NO: 784102 - RNA, 28 nt, Human
ggaggaagagaaaggauggcgcgggggg

SEQ ID NO: 784103 - RNA, 23 nt, Human
ggagguagaaggagcagaggacu

SEQ ID NO: 784104 - RNA, 23 nt, Human
ggaugggguugggagggguuggg

SEQ ID NO: 784105 - RNA, 19 nt, Human
ggcauggggacucacugua

SEQ ID NO: 784106 - RNA, 22 nt, Human
ggcgcggggggcggaggaaaga

SEQ ID NO: 784107 - RNA, 22 nt, Human
gggaguggggacuggccaaagc

SEQ ID NO: 784108 - RNA, 19 nt, Human
gggaugggguugggagggg

SEQ ID NO: 784109 - RNA, 24 nt, Human
ggguguagcauuuugaaggauucu

SEQ ID NO: 784110 - RNA, 23 nt, Human
uaagaaggccagccagagugacg

SEQ ID NO: 784111 - RNA, 19 nt, Human
uaaggggagcaggagaagg

SEQ ID NO: 784112 - RNA, 25 nt, Human
uacagcaccagggagggagagugag

SEQ ID NO: 784113 - RNA, 21 nt, Human
uagaaggagcagaggacugua

SEQ ID NO: 784114 - RNA, 23 nt, Human
uauugacaaaucaaaugaaaaaa

SEQ ID NO: 784115 - RNA, 20 nt, Human
ucagggagaugaagaguugg

SEQ ID NO: 784116 - RNA, 18 nt, Human
uccacuucucagcuauca

SEQ ID NO: 784117 - RNA, 24 nt, Human
ucccacaggaggcugaagauccag

SEQ ID NO: 784118 - RNA, 18 nt, Human
ucccucugugauccucuu

SEQ ID NO: 784119 - RNA, 21 nt, Human
ucugcaaugccaagcguucug

SEQ ID NO: 784120 - RNA, 22 nt, Human
ugaaaaaaauucacuuaaaaga

SEQ ID NO: 784121 - RNA, 21 nt, Human
ugacaaaucaaaugaaaaaaa

SEQ ID NO: 784122 - RNA, 24 nt, Human
ugaggcuggacauaccauuacaga

SEQ ID NO: 784123 - RNA, 24 nt, Human
ugagugaggaaaaccacugggagu

SEQ ID NO: 784124 - RNA, 19 nt, Human
ugccccgcccgcuccccgc

SEQ ID NO: 784125 - RNA, 21 nt, Human
ugcugugugacuuugggugaa

SEQ ID NO: 784126 - RNA, 22 nt, Human
uggaagaucagggagaugaaga

SEQ ID NO: 784127 - RNA, 23 nt, Human
uggacauaccauuacagagagga

SEQ ID NO: 784128 - RNA, 20 nt, Human
uggcaaccugggcuagacca

SEQ ID NO: 784129 - RNA, 21 nt, Human
uggcaaguucuccacuggcuc

SEQ ID NO: 784130 - RNA, 22 nt, Human
uggcagcggcagcaauucagag

SEQ ID NO: 784131 - RNA, 24 nt, Human
uggcugugagggagccuggguuuu

SEQ ID NO: 784132 - RNA, 19 nt, Human
ugggagggguugggaggua

SEQ ID NO: 784133 - RNA, 18 nt, Human
ugggaguggggacuggcc

SEQ ID NO: 784134 - RNA, 21 nt, Human
ugggaguggggacuggccaaa

SEQ ID NO: 784135 - RNA, 21 nt, Human
uguaggggcuggcacauccuu

SEQ ID NO: 784136 - RNA, 20 nt, Human
uuccucugcuguaaaacaau

SEQ ID NO: 784137 - RNA, 18 nt, Human
uugcagugagugaggaaa

SEQ ID NO: 784138 - RNA, 23 nt, Human
uugcagugagugaggaaaaccac

SEQ ID NO: 784139 - RNA, 19 nt, Human
uuugggugaaucauuuucc

SEQ ID NO: 784140 - RNA, 20 nt, Human
aaaaaagauaaaacauggaa

SEQ ID NO: 784141 - RNA, 23 nt, Human
aaacauucuaggccaaacaaaga

SEQ ID NO: 784142 - RNA, 20 nt, Human
aaauaaccuuaugaacugag

SEQ ID NO: 784143 - RNA, 23 nt, Human
aacaaaaaaagauaaaacaugga

SEQ ID NO: 784144 - RNA, 19 nt, Human
aagagcacaaauaacauca

SEQ ID NO: 784145 - RNA, 20 nt, Human
aauaacaucaauguugucuu

SEQ ID NO: 784146 - RNA, 21 nt, Human
aauaacaucaauguugucuuu

SEQ ID NO: 784147 - RNA, 27 nt, Human
acaaaaaaagauaaaacauggaaguug

SEQ ID NO: 784148 - RNA, 19 nt, Human
acuuugugcuaaauaaccu

SEQ ID NO: 784149 - RNA, 23 nt, Human
agcucaugcgaguuggcaaccuu

SEQ ID NO: 784150 - RNA, 19 nt, Human
aggcaccagcacccgcacc

SEQ ID NO: 784151 - RNA, 24 nt, Human
auaaacauucuaggccaaacaaag

SEQ ID NO: 784152 - RNA, 27 nt, Human
auacauuuccagaaugguuguguuacc

SEQ ID NO: 784153 - RNA, 24 nt, Human
auguguguauguguauguauguau

SEQ ID NO: 784154 - RNA, 20 nt, Human
auugcaaagauagaacuacg

SEQ ID NO: 784155 - RNA, 24 nt, Human
caaacaaagagcacaaauaacauc

SEQ ID NO: 784156 - RNA, 24 nt, Human
caaauaacaucaauguugucuuuu

SEQ ID NO: 784157 - RNA, 18 nt, Human
cacuuuaaaaacaccaaa

SEQ ID NO: 784158 - RNA, 21 nt, Human
cagaauacauauaauaugcaa

SEQ ID NO: 784159 - RNA, 22 nt, Human
ccagcacccgcaccuucgcacc

SEQ ID NO: 784160 - RNA, 19 nt, Human
cccgccgcuuguccgccgg

SEQ ID NO: 784161 - RNA, 24 nt, Human
cgagggccaaagagggagucgcgc

SEQ ID NO: 784162 - RNA, 20 nt, Human
cuccgagggccaaagaggga

SEQ ID NO: 784163 - RNA, 24 nt, Human
cucgccgcguccuggcgucccgcc

SEQ ID NO: 784164 - RNA, 21 nt, Human
cugccuccaagggacaauuuc

SEQ ID NO: 784165 - RNA, 18 nt, Human
cuuuuuuuuucauauguu

SEQ ID NO: 784166 - RNA, 27 nt, Human
gcaccagcacccgcaccuucgcacccu

SEQ ID NO: 784167 - RNA, 21 nt, Human
guauacacacuuuaaaaacac

SEQ ID NO: 784168 - RNA, 25 nt, Human
guguauguauguauacacacuuuaa

SEQ ID NO: 784169 - RNA, 25 nt, Human
guguuggucuuccucuuccacgaga

SEQ ID NO: 784170 - RNA, 18 nt, Human
uaacauauauacuacuua

SEQ ID NO: 784171 - RNA, 19 nt, Human
uacacacuuuaaaaacacc

SEQ ID NO: 784172 - RNA, 19 nt, Human
uacagcaucuuaguuguag

SEQ ID NO: 784173 - RNA, 19 nt, Human
uacagucaaagaugaaagg

SEQ ID NO: 784174 - RNA, 22 nt, Human
uaccuuacacccaauacacagc

SEQ ID NO: 784175 - RNA, 24 nt, Human
uaccuuacacccaauacacagcau

SEQ ID NO: 784176 - RNA, 21 nt, Human
uacugaagaaacauuuuauag

SEQ ID NO: 784177 - RNA, 24 nt, Human
uagugaauuuaagcuacuucuccu

SEQ ID NO: 784178 - RNA, 19 nt, Human
uaugugcauguguguaugu

SEQ ID NO: 784179 - RNA, 20 nt, Human
uaugugcauguguguaugug

SEQ ID NO: 784180 - RNA, 22 nt, Human
uccucuuccacgagagaucuug

SEQ ID NO: 784181 - RNA, 20 nt, Human
ucgcacccucugcucgcccc

SEQ ID NO: 784182 - RNA, 21 nt, Human
ucuccugugugucuaggaaac

SEQ ID NO: 784183 - RNA, 18 nt, Human
ucuuccucuuccacgaga

SEQ ID NO: 784184 - RNA, 24 nt, Human
ugaagccuagugagcacaguugua

SEQ ID NO: 784185 - RNA, 21 nt, Human
ugacauaugugcaugugugua

SEQ ID NO: 784186 - RNA, 20 nt, Human
ugagcaaaagcagcucucca

SEQ ID NO: 784187 - RNA, 22 nt, Human
ugagcaaaagcagcucuccagg

SEQ ID NO: 784188 - RNA, 19 nt, Human
ugcaaagauagaacuacag

SEQ ID NO: 784189 - RNA, 18 nt, Human
ugcaaguuaccucaacag

SEQ ID NO: 784190 - RNA, 19 nt, Human
ugcauguguguauguguau

SEQ ID NO: 784191 - RNA, 21 nt, Human
ugcauguguguauguguaugu

SEQ ID NO: 784192 - RNA, 19 nt, Human
ugcuuuuuggaagaauucu

SEQ ID NO: 784193 - RNA, 22 nt, Human
uguaugguucuacauauaugca

SEQ ID NO: 784194 - RNA, 21 nt, Human
uguguauguauguauacacac

SEQ ID NO: 784195 - RNA, 19 nt, Human
uguguauguguauguaugu

SEQ ID NO: 784196 - RNA, 20 nt, Human
uguguauguguauguaugua

SEQ ID NO: 784197 - RNA, 20 nt, Human
uguguauguguauguaugua

SEQ ID NO: 784198 - RNA, 19 nt, Human
uguguguauguguauguau

SEQ ID NO: 784199 - RNA, 21 nt, Human
uguguguauguguauguaugu

SEQ ID NO: 784200 - RNA, 19 nt, Human
uguuggucuuccucuucca

SEQ ID NO: 784201 - RNA, 24 nt, Human
uguugucuuuuuuccaauaucugu

SEQ ID NO: 784202 - RNA, 24 nt, Human
uuaaaaacaccaaacccuuguuua

SEQ ID NO: 784203 - RNA, 19 nt, Human
uuaagcuacuucuccugug

SEQ ID NO: 784204 - RNA, 27 nt, Human
uuggcaaccuuuuguguauuguuuccu

SEQ ID NO: 784205 - RNA, 23 nt, Human
uuuauaaacauucuaggccaaac

SEQ ID NO: 784206 - RNA, 23 nt, Human
aaaacaaacaaaaggccggaccc

SEQ ID NO: 784207 - RNA, 18 nt, Human
aaacaaaaacggcuacaa

SEQ ID NO: 784208 - RNA, 19 nt, Human
aaacaaaaggaaaaaccaa

SEQ ID NO: 784209 - RNA, 24 nt, Human
aaacaaaaggaaaaaccaaaauua

SEQ ID NO: 784210 - RNA, 20 nt, Human
aaacagguaaacgaccgagg

SEQ ID NO: 784211 - RNA, 24 nt, Human
aaacauugaaaagaaugaagacau

SEQ ID NO: 784212 - RNA, 21 nt, Human
aaagaauaccacuuaaauuca

SEQ ID NO: 784213 - RNA, 20 nt, Human
aaagcaaucaaaauccacag

SEQ ID NO: 784214 - RNA, 18 nt, Human
aaagugccagagaggugu

SEQ ID NO: 784215 - RNA, 23 nt, Human
aaauuagucauuguuuuccuccu

SEQ ID NO: 784216 - RNA, 23 nt, Human
aacauugaaaagaaugaagacau

SEQ ID NO: 784217 - RNA, 19 nt, Human
aacucaacucccaagauaa

SEQ ID NO: 784218 - RNA, 21 nt, Human
aagaaguaaagcagagaaaau

SEQ ID NO: 784219 - RNA, 18 nt, Human
aagaucaaauaucugcua

SEQ ID NO: 784220 - RNA, 20 nt, Human
aagcaaguaaaaauguagcu

SEQ ID NO: 784221 - RNA, 21 nt, Human
aagcccugaugagaggagguu

SEQ ID NO: 784222 - RNA, 20 nt, Human
aaucccaaaggcaaacaaaa

SEQ ID NO: 784223 - RNA, 23 nt, Human
aaucuacccuguggauuuacaug

SEQ ID NO: 784224 - RNA, 20 nt, Human
aaucuuuggaaaggauccuu

SEQ ID NO: 784225 - RNA, 18 nt, Human
acaacacaggaacacaga

SEQ ID NO: 784226 - RNA, 22 nt, Human
acaggugaagugaugcugaaaa

SEQ ID NO: 784227 - RNA, 20 nt, Human
acaguacuuccagugacaac

SEQ ID NO: 784228 - RNA, 21 nt, Human
accaggacuuagaagcuuuuc

SEQ ID NO: 784229 - RNA, 22 nt, Human
acgaacacuccuuuugcagugu

SEQ ID NO: 784230 - RNA, 23 nt, Human
acugaaaugcaugaggaaugcug

SEQ ID NO: 784231 - RNA, 22 nt, Human
acuuguaagaaagggaaaagga

SEQ ID NO: 784232 - RNA, 22 nt, Human
agaaacauugaaaagaaugaag

SEQ ID NO: 784233 - RNA, 22 nt, Human
agaaagaaaucuacccugugga

SEQ ID NO: 784234 - RNA, 19 nt, Human
agaaagcccagaagcagaa

SEQ ID NO: 784235 - RNA, 21 nt, Human
agaaagcccagaagcagaaag

SEQ ID NO: 784236 - RNA, 21 nt, Human
agacaaagagcaaagcaguaa

SEQ ID NO: 784237 - RNA, 19 nt, Human
agacagaacaucuuacaua

SEQ ID NO: 784238 - RNA, 24 nt, Human
agagaugccggcggggggcccggg

SEQ ID NO: 784239 - RNA, 22 nt, Human
agagcauguacucuuauaacuc

SEQ ID NO: 784240 - RNA, 25 nt, Human
agaucaguucauuuuugauaguggg

SEQ ID NO: 784241 - RNA, 21 nt, Human
agcaauuuauggcccuuguca

SEQ ID NO: 784242 - RNA, 20 nt, Human
aggaacacagaacuuaaugu

SEQ ID NO: 784243 - RNA, 23 nt, Human
aggaaugcugaaaauaaaacugg

SEQ ID NO: 784244 - RNA, 18 nt, Human
aggcaagaaaccauccag

SEQ ID NO: 784245 - RNA, 23 nt, Human
agggaaugaucucccaaagcuca

SEQ ID NO: 784246 - RNA, 19 nt, Human
auccacagccaaacugagu

SEQ ID NO: 784247 - RNA, 19 nt, Human
caaagcaguaaaauggagc

SEQ ID NO: 784248 - RNA, 19 nt, Human
caaagcccgaaucccaaag

SEQ ID NO: 784249 - RNA, 22 nt, Human
caaaucccaaacagguaaaggg

SEQ ID NO: 784250 - RNA, 23 nt, Human
caacuccauucaaaccuucagga

SEQ ID NO: 784251 - RNA, 18 nt, Human
caagaaaccauccaggga

SEQ ID NO: 784252 - RNA, 19 nt, Human
cacaaggaauguuugacca

SEQ ID NO: 784253 - RNA, 21 nt, Human
cagaaggcaaucuaaguuggg

SEQ ID NO: 784254 - RNA, 23 nt, Human
cagaggaacacugccacgaacac

SEQ ID NO: 784255 - RNA, 22 nt, Human
cagcagugcaggcaagaaacca

SEQ ID NO: 784256 - RNA, 25 nt, Human
cagccaaagcccgaaucccaaaggc

SEQ ID NO: 784257 - RNA, 21 nt, Human
cagccuuuuacuggccagguc

SEQ ID NO: 784258 - RNA, 22 nt, Human
cagcuccgagucacguccuccu

SEQ ID NO: 784259 - RNA, 22 nt, Human
caggguagagaaggcugagugu

SEQ ID NO: 784260 - RNA, 20 nt, Human
caguuaccuuguuggguugu

SEQ ID NO: 784261 - RNA, 19 nt, Human
cauaaaaaugacacagcua

SEQ ID NO: 784262 - RNA, 18 nt, Human
caucauaaaaaugacaca

SEQ ID NO: 784263 - RNA, 22 nt, Human
cauugggccagaucuuuuucua

SEQ ID NO: 784264 - RNA, 21 nt, Human
ccaaagcccgaaucccaaagg

SEQ ID NO: 784265 - RNA, 21 nt, Human
ccacaacaacacaggaacaca

SEQ ID NO: 784266 - RNA, 18 nt, Human
ccacagccaaacugaguc

SEQ ID NO: 784267 - RNA, 21 nt, Human
ccagcucuccucauccucucu

SEQ ID NO: 784268 - RNA, 22 nt, Human
ccaggggaaaagaaaaauggaa

SEQ ID NO: 784269 - RNA, 25 nt, Human
ccaggggaaaagaaaaauggaaaaa

SEQ ID NO: 784270 - RNA, 19 nt, Human
cccaaacagguaaacgacc

SEQ ID NO: 784271 - RNA, 23 nt, Human
cccaaacagguaaacgaccgagg

SEQ ID NO: 784272 - RNA, 23 nt, Human
cccaagaaaucaaaauguauaag

SEQ ID NO: 784273 - RNA, 25 nt, Human
cccaagauaaacuuucuuuuucacu

SEQ ID NO: 784274 - RNA, 18 nt, Human
cccaggggaaaagaaaaa

SEQ ID NO: 784275 - RNA, 20 nt, Human
cccauucauuguauccacuc

SEQ ID NO: 784276 - RNA, 18 nt, Human
cccccaaccccauaaaca

SEQ ID NO: 784277 - RNA, 23 nt, Human
ccugcuagggucccagguagcca

SEQ ID NO: 784278 - RNA, 18 nt, Human
ccugucuuccccuuuucc

SEQ ID NO: 784279 - RNA, 21 nt, Human
cggcaagggcaaacggacucc

SEQ ID NO: 784280 - RNA, 18 nt, Human
cggcggggggcccggggc

SEQ ID NO: 784281 - RNA, 21 nt, Human
cgugugcgucauguguauaua

SEQ ID NO: 784282 - RNA, 25 nt, Human
cgugugcgucauguguauauacauu

SEQ ID NO: 784283 - RNA, 20 nt, Human
cuaaaacaaacaaaaggccg

SEQ ID NO: 784284 - RNA, 24 nt, Human
cuagagcauguacucuuauaacuc

SEQ ID NO: 784285 - RNA, 23 nt, Human
cucuugacaacucaacucccaag

SEQ ID NO: 784286 - RNA, 22 nt, Human
cugaaaaaguaguuuaaacccu

SEQ ID NO: 784287 - RNA, 22 nt, Human
cugaaaauaaaacuggucuuuu

SEQ ID NO: 784288 - RNA, 20 nt, Human
cuggcacauauagauuugag

SEQ ID NO: 784289 - RNA, 25 nt, Human
cuuaaaggaauauggcuuggagaaa

SEQ ID NO: 784290 - RNA, 19 nt, Human
gaaaaagaaaucuuuggaa

SEQ ID NO: 784291 - RNA, 21 nt, Human
gaaaagaaaaauggaaaaaga

SEQ ID NO: 784292 - RNA, 18 nt, Human
gaaaugcaugaggaaugc

SEQ ID NO: 784293 - RNA, 18 nt, Human
gagaaagcggaggcagcc

SEQ ID NO: 784294 - RNA, 21 nt, Human
gagaggagguuggguugaaga

SEQ ID NO: 784295 - RNA, 24 nt, Human
gagagguggcccagaauaaaaaua

SEQ ID NO: 784296 - RNA, 20 nt, Human
gagcuucaguuaccuuguug

SEQ ID NO: 784297 - RNA, 22 nt, Human
gagucacagccuuauccuuugg

SEQ ID NO: 784298 - RNA, 23 nt, Human
gcgcagagaugccggcggggggc

SEQ ID NO: 784299 - RNA, 19 nt, Human
gcggaggcagcuccgaguc

SEQ ID NO: 784300 - RNA, 22 nt, Human
ggaaaagaaaaauggaaaaaga

SEQ ID NO: 784301 - RNA, 23 nt, Human
ggaaaagaaaaauggaaaaagaa

SEQ ID NO: 784302 - RNA, 18 nt, Human
ggacaaggaaacauuagc

SEQ ID NO: 784303 - RNA, 21 nt, Human
guacuuccagugacaacacaa

SEQ ID NO: 784304 - RNA, 19 nt, Human
guaguuuaaacccuggaug

SEQ ID NO: 784305 - RNA, 20 nt, Human
guggaauacaacuuucucua

SEQ ID NO: 784306 - RNA, 22 nt, Human
guucccccuuuuauuuuaauuc

SEQ ID NO: 784307 - RNA, 23 nt, Human
uaaagcagagaaaauauucaacc

SEQ ID NO: 784308 - RNA, 22 nt, Human
uaacucuggagcuucaguuacc

SEQ ID NO: 784309 - RNA, 20 nt, Human
uaacuucagggaaacaugcc

SEQ ID NO: 784310 - RNA, 23 nt, Human
uaagaucaaauaucugcuaauau

SEQ ID NO: 784311 - RNA, 23 nt, Human
uaauucaccaugcaugcauuuuc

SEQ ID NO: 784312 - RNA, 23 nt, Human
uaauuuccuguuuaaagaaugua

SEQ ID NO: 784313 - RNA, 21 nt, Human
uacaaaggauaacaucagugc

SEQ ID NO: 784314 - RNA, 19 nt, Human
uaccaugggaugagugcca

SEQ ID NO: 784315 - RNA, 18 nt, Human
uagcacaugggacgaagu

SEQ ID NO: 784316 - RNA, 21 nt, Human
uagcaugggcacagccaaagc

SEQ ID NO: 784317 - RNA, 19 nt, Human
uauacaagucaggauguaa

SEQ ID NO: 784318 - RNA, 20 nt, Human
uauguauguauguagguaca

SEQ ID NO: 784319 - RNA, 18 nt, Human
uauuuauguauguaugua

SEQ ID NO: 784320 - RNA, 23 nt, Human
ucaaauaucugcuaauauauuaa

SEQ ID NO: 784321 - RNA, 23 nt, Human
ucaagcucacaugcaaggcaggc

SEQ ID NO: 784322 - RNA, 20 nt, Human
ucacaauaccauaugaucua

SEQ ID NO: 784323 - RNA, 18 nt, Human
ucagaaagcccagaagca

SEQ ID NO: 784324 - RNA, 18 nt, Human
ucagaagcucauccaucu

SEQ ID NO: 784325 - RNA, 21 nt, Human
ucagagcagagaaaacucaug

SEQ ID NO: 784326 - RNA, 21 nt, Human
ucaggucugaaauuuaaggaa

SEQ ID NO: 784327 - RNA, 19 nt, Human
ucauuuagaaaucugaaac

SEQ ID NO: 784328 - RNA, 23 nt, Human
uccacaggugaagugaugcugaa

SEQ ID NO: 784329 - RNA, 21 nt, Human
ucccaaggccucucagcuacu

SEQ ID NO: 784330 - RNA, 24 nt, Human
ucccagaaggcaaucuaaguuggg

SEQ ID NO: 784331 - RNA, 23 nt, Human
ucccagguagccaccccaccugc

SEQ ID NO: 784332 - RNA, 19 nt, Human
uccccccaaccccauaaac

SEQ ID NO: 784333 - RNA, 18 nt, Human
ucccuuucuucugcugcu

SEQ ID NO: 784334 - RNA, 19 nt, Human
uccugucuuccccuuuucc

SEQ ID NO: 784335 - RNA, 19 nt, Human
ucucuugacaacucaacuc

SEQ ID NO: 784336 - RNA, 23 nt, Human
ucucuugacaacucaacucccaa

SEQ ID NO: 784337 - RNA, 21 nt, Human
ucuggagcuucaguuaccuug

SEQ ID NO: 784338 - RNA, 23 nt, Human
ucuugacaacucaacucccaaga

SEQ ID NO: 784339 - RNA, 22 nt, Human
ugaaaaaaauaauaauaaccau

SEQ ID NO: 784340 - RNA, 21 nt, Human
ugacaguacuuccagugacaa

SEQ ID NO: 784341 - RNA, 22 nt, Human
ugaccuccucuuaucccaguau

SEQ ID NO: 784342 - RNA, 18 nt, Human
ugagagaaaaaacccagu

SEQ ID NO: 784343 - RNA, 19 nt, Human
ugagaggagguuggguuga

SEQ ID NO: 784344 - RNA, 22 nt, Human
ugagaggagguuggguugaaga

SEQ ID NO: 784345 - RNA, 21 nt, Human
ugcagacaaagagcaaagcag

SEQ ID NO: 784346 - RNA, 27 nt, Human
ugccacgaacacuccuuuugcaguguu

SEQ ID NO: 784347 - RNA, 23 nt, Human
ugccaugugcuaucaagaaacau

SEQ ID NO: 784348 - RNA, 19 nt, Human
ugcgucauguguauauaca

SEQ ID NO: 784349 - RNA, 19 nt, Human
ugcugcugcuauuuugauu

SEQ ID NO: 784350 - RNA, 24 nt, Human
uggaaaaagaaaucuuuggaaagg

SEQ ID NO: 784351 - RNA, 23 nt, Human
uggagacccaguucuugugaaaa

SEQ ID NO: 784352 - RNA, 19 nt, Human
uggaugguagugagcugcu

SEQ ID NO: 784353 - RNA, 20 nt, Human
uggcggcggagcuggguggu

SEQ ID NO: 784354 - RNA, 22 nt, Human
uggcucucauuauauauaagau

SEQ ID NO: 784355 - RNA, 20 nt, Human
ugggaugagugccagucgag

SEQ ID NO: 784356 - RNA, 24 nt, Human
ugggcacagccaaagcccgaaucc

SEQ ID NO: 784357 - RNA, 23 nt, Human
uguauaagaguccacaggugaag

SEQ ID NO: 784358 - RNA, 20 nt, Human
uguauguauguagguacaua

SEQ ID NO: 784359 - RNA, 22 nt, Human
ugugauuccccauucauuguau

SEQ ID NO: 784360 - RNA, 21 nt, Human
ugugcucuuggaaaauaacua

SEQ ID NO: 784361 - RNA, 22 nt, Human
uguggaauacaacuuucucuaa

SEQ ID NO: 784362 - RNA, 22 nt, Human
uuaaacccuggaugguggaugg

SEQ ID NO: 784363 - RNA, 24 nt, Human
uuaaacugugggcaguaagaacuc

SEQ ID NO: 784364 - RNA, 24 nt, Human
uuaaggugaacuagguaaaguagg

SEQ ID NO: 784365 - RNA, 23 nt, Human
uucaaccaaagcuuccccagggg

SEQ ID NO: 784366 - RNA, 19 nt, Human
uucaacuucuugacccauu

SEQ ID NO: 784367 - RNA, 19 nt, Human
uucagaauuaaacaaaaag

SEQ ID NO: 784368 - RNA, 22 nt, Human
uuccccccaaccccauaaacaa

SEQ ID NO: 784369 - RNA, 21 nt, Human
uugaauauuuuaccaugggau

SEQ ID NO: 784370 - RNA, 22 nt, Human
uugaauauuuuaccaugggaug

SEQ ID NO: 784371 - RNA, 19 nt, Human
uuuuuugucagcauuucag

SEQ ID NO: 784372 - RNA, 22 nt, Human
aaacaacagaucaagaggucaa

SEQ ID NO: 784373 - RNA, 23 nt, Human
aaacaacagaucaagaggucaga

SEQ ID NO: 784374 - RNA, 20 nt, Human
aacagaucaagaggucagaa

SEQ ID NO: 784375 - RNA, 24 nt, Human
aagaaaauaaaaacuacccauaac

SEQ ID NO: 784376 - RNA, 20 nt, Human
aagaggucagaagcugacaa

SEQ ID NO: 784377 - RNA, 19 nt, Human
aagcugggcuugucacucg

SEQ ID NO: 784378 - RNA, 22 nt, Human
aaggucaaaucagccaagugag

SEQ ID NO: 784379 - RNA, 23 nt, Human
aauguauagagaaguagaaggaa

SEQ ID NO: 784380 - RNA, 18 nt, Human
acaaaggccauaaacaac

SEQ ID NO: 784381 - RNA, 22 nt, Human
acaacugagggggucacccaga

SEQ ID NO: 784382 - RNA, 19 nt, Human
accaccugaaggcaaacac

SEQ ID NO: 784383 - RNA, 21 nt, Human
accauacacucuuguaguccc

SEQ ID NO: 784384 - RNA, 24 nt, Human
acccagaggucagagcuagagaac

SEQ ID NO: 784385 - RNA, 21 nt, Human
accgcugagagggagcgaagc

SEQ ID NO: 784386 - RNA, 30 nt, Human
acuacccauaaccccaccaccugaaggcag

SEQ ID NO: 784387 - RNA, 25 nt, Human
agaaaauaaaaacuacccauaaccc

SEQ ID NO: 784388 - RNA, 19 nt, Human
aggaagaaaauaaaaacua

SEQ ID NO: 784389 - RNA, 23 nt, Human
auagaccaagacccucaucaaga

SEQ ID NO: 784390 - RNA, 20 nt, Human
auggugcuugucaagaguuu

SEQ ID NO: 784391 - RNA, 18 nt, Human
caacagccaaggggagug

SEQ ID NO: 784392 - RNA, 19 nt, Human
caagacaaaggccauaaac

SEQ ID NO: 784393 - RNA, 19 nt, Human
cacaagaacaaguuguguu

SEQ ID NO: 784394 - RNA, 20 nt, Human
cacaggagaagauuccaugg

SEQ ID NO: 784395 - RNA, 18 nt, Human
cacaugcuuacuguagag

SEQ ID NO: 784396 - RNA, 18 nt, Human
caccauacacucuuguag

SEQ ID NO: 784397 - RNA, 26 nt, Human
cauacaccauacacucuuguaguccc

SEQ ID NO: 784398 - RNA, 21 nt, Human
cccauaaccccaccaccugaa

SEQ ID NO: 784399 - RNA, 23 nt, Human
cccauaaccccaccaccugaagg

SEQ ID NO: 784400 - RNA, 27 nt, Human
ccucauacaccauacacucuuguaguc

SEQ ID NO: 784401 - RNA, 19 nt, Human
ccugccuagacuucucccu

SEQ ID NO: 784402 - RNA, 20 nt, Human
ccuggaccaagaacuaggac

SEQ ID NO: 784403 - RNA, 21 nt, Human
ccuggaccaagaacuaggacc

SEQ ID NO: 784404 - RNA, 21 nt, Human
cgaaugguucaggauggauac

SEQ ID NO: 784405 - RNA, 20 nt, Human
cucacauuauguucuagcua

SEQ ID NO: 784406 - RNA, 25 nt, Human
cucauacaccauacacucuuguagu

SEQ ID NO: 784407 - RNA, 22 nt, Human
cugagggggucacccagagguc

SEQ ID NO: 784408 - RNA, 19 nt, Human
gccuggagcgggaggcuga

SEQ ID NO: 784409 - RNA, 19 nt, Human
ggagcccaggaggcaagaa

SEQ ID NO: 784410 - RNA, 27 nt, Human
ggugaaauagaaccagggcuuccucaa

SEQ ID NO: 784411 - RNA, 23 nt, Human
gugaugggaguucagaaccucau

SEQ ID NO: 784412 - RNA, 22 nt, Human
uaaaaacuacccauaaccccac

SEQ ID NO: 784413 - RNA, 24 nt, Human
uaaaaacuacccauaaccccacca

SEQ ID NO: 784414 - RNA, 20 nt, Human
uacuguaagaauguagugag

SEQ ID NO: 784415 - RNA, 22 nt, Human
uagaaccagggcuuccucaagu

SEQ ID NO: 784416 - RNA, 23 nt, Human
uagaccaagacccucaucaagaa

SEQ ID NO: 784417 - RNA, 22 nt, Human
uagcuaucuaugccuguuuaua

SEQ ID NO: 784418 - RNA, 21 nt, Human
uccaggaaccaguccuccagu

SEQ ID NO: 784419 - RNA, 25 nt, Human
ucugacucagccagugcuccccagg

SEQ ID NO: 784420 - RNA, 23 nt, Human
ugaaauagaaccagggcuuccuc

SEQ ID NO: 784421 - RNA, 18 nt, Human
ugagagggagcgaagcug

SEQ ID NO: 784422 - RNA, 19 nt, Human
ugagagggagcgaagcugg

SEQ ID NO: 784423 - RNA, 24 nt, Human
ugagauggugcuugucaagaguuu

SEQ ID NO: 784424 - RNA, 21 nt, Human
ugaugggaguucagaaccuca

SEQ ID NO: 784425 - RNA, 24 nt, Human
ugccacagccacaggauagugugg

SEQ ID NO: 784426 - RNA, 23 nt, Human
uggaauggguccaggaaccaguc

SEQ ID NO: 784427 - RNA, 24 nt, Human
uggcaagauacgcuaaggguuuuu

SEQ ID NO: 784428 - RNA, 21 nt, Human
uguuuauagaccaagacccuc

SEQ ID NO: 784429 - RNA, 21 nt, Human
uugagguaagauaugauuuau

SEQ ID NO: 784430 - RNA, 23 nt, Human
uuuaggugcuaugaguuggggca

SEQ ID NO: 784431 - RNA, 25 nt, Human
aaaacccugagcaggaccaagaccc

SEQ ID NO: 784432 - RNA, 21 nt, Human
aaagcccugaaucagagccaa

SEQ ID NO: 784433 - RNA, 23 nt, Human
aagacaaaaauauaggaacugga

SEQ ID NO: 784434 - RNA, 22 nt, Human
aagcaccucagaaaaugaaggu

SEQ ID NO: 784435 - RNA, 20 nt, Human
aaggcucaguuggcuugaaa

SEQ ID NO: 784436 - RNA, 18 nt, Human
aagguaggaauggcaaag

SEQ ID NO: 784437 - RNA, 19 nt, Human
aagguaggaauggcaaaga

SEQ ID NO: 784438 - RNA, 20 nt, Human
aagguaggaauggcaaagag

SEQ ID NO: 784439 - RNA, 20 nt, Human
aauuucuaucccuuccuauc

SEQ ID NO: 784440 - RNA, 25 nt, Human
acccugagcaggaccaagacccccg

SEQ ID NO: 784441 - RNA, 22 nt, Human
accggcucccuauacaaccugc

SEQ ID NO: 784442 - RNA, 24 nt, Human
agagaagccccaaggaaggccaca

SEQ ID NO: 784443 - RNA, 21 nt, Human
agagcagagcagcacuugcug

SEQ ID NO: 784444 - RNA, 18 nt, Human
agaggagggagaggagga

SEQ ID NO: 784445 - RNA, 23 nt, Human
agaggagggagaggaggaaggau

SEQ ID NO: 784446 - RNA, 25 nt, Human
agcaagaagagcauccuuaucuccu

SEQ ID NO: 784447 - RNA, 20 nt, Human
agcagggaaggcugagggcc

SEQ ID NO: 784448 - RNA, 23 nt, Human
aggaagaagacaaaaauauagga

SEQ ID NO: 784449 - RNA, 19 nt, Human
aggaauggcaaagagggga

SEQ ID NO: 784450 - RNA, 20 nt, Human
aggggucauuggcagagaaa

SEQ ID NO: 784451 - RNA, 23 nt, Human
agguaggaauggcaaagagggga

SEQ ID NO: 784452 - RNA, 21 nt, Human
aggugcaaccaccuuauaacc

SEQ ID NO: 784453 - RNA, 22 nt, Human
aggugcaaccaccuuauaacca

SEQ ID NO: 784454 - RNA, 21 nt, Human
aucaucccccuuaccucuucc

SEQ ID NO: 784455 - RNA, 19 nt, Human
auuccccucacccugcucc

SEQ ID NO: 784456 - RNA, 22 nt, Human
auuugugaaaacagccuuccuc

SEQ ID NO: 784457 - RNA, 18 nt, Human
caaagcagcacgcgcagc

SEQ ID NO: 784458 - RNA, 19 nt, Human
cacuuuaucaugacccuac

SEQ ID NO: 784459 - RNA, 23 nt, Human
cagccuaaugcugaccauccuuc

SEQ ID NO: 784460 - RNA, 20 nt, Human
caggaccaagacccccgcca

SEQ ID NO: 784461 - RNA, 21 nt, Human
caguccccaucagccuaaugc

SEQ ID NO: 784462 - RNA, 20 nt, Human
cauaacauuccccucacccu

SEQ ID NO: 784463 - RNA, 23 nt, Human
caucccccuuaccucuucccuac

SEQ ID NO: 784464 - RNA, 20 nt, Human
caugacccuaccaaaguccc

SEQ ID NO: 784465 - RNA, 22 nt, Human
ccaugccugcaugucuguuacc

SEQ ID NO: 784466 - RNA, 20 nt, Human
ccccucguccucucggccga

SEQ ID NO: 784467 - RNA, 21 nt, Human
ccccuuaccucuucccuacca

SEQ ID NO: 784468 - RNA, 21 nt, Human
cccuaccaaagucccucuccc

SEQ ID NO: 784469 - RNA, 24 nt, Human
ccuaccagggcuugguucucccca

SEQ ID NO: 784470 - RNA, 22 nt, Human
ccucacccugcuccagagugga

SEQ ID NO: 784471 - RNA, 24 nt, Human
ccugucuuaggucugaauaauugg

SEQ ID NO: 784472 - RNA, 22 nt, Human
ccuuccuauccuucucaguccc

SEQ ID NO: 784473 - RNA, 19 nt, Human
ccuuggcuaaggcacugac

SEQ ID NO: 784474 - RNA, 19 nt, Human
cgggcucgggcucgggcaa

SEQ ID NO: 784475 - RNA, 21 nt, Human
cuaccaaagucccucucccag

SEQ ID NO: 784476 - RNA, 25 nt, Human
cuccugccaccggcucccuauacaa

SEQ ID NO: 784477 - RNA, 20 nt, Human
cucgagccugguuucugagu

SEQ ID NO: 784478 - RNA, 18 nt, Human
cugagcaggaccaagacc

SEQ ID NO: 784479 - RNA, 22 nt, Human
cuuccuauccuucucagucccc

SEQ ID NO: 784480 - RNA, 21 nt, Human
cuugaaacguccacuccuaca

SEQ ID NO: 784481 - RNA, 18 nt, Human
cuuggcuaaggcacugac

SEQ ID NO: 784482 - RNA, 24 nt, Human
gaacuggagggguauggggacuac

SEQ ID NO: 784483 - RNA, 26 nt, Human
gaaucagagccaagcaccucagaaaa

SEQ ID NO: 784484 - RNA, 26 nt, Human
gaggaaggaugaaaacccugagcagg

SEQ ID NO: 784485 - RNA, 22 nt, Human
gcaaagcccugaaucagagcca

SEQ ID NO: 784486 - RNA, 23 nt, Human
gcaaagcccugaaucagagccaa

SEQ ID NO: 784487 - RNA, 22 nt, Human
gcaagguaggaauggcaaagag

SEQ ID NO: 784488 - RNA, 19 nt, Human
gcccuggcuggggaaaagc

SEQ ID NO: 784489 - RNA, 23 nt, Human
gcucuggcccucccccucguccu

SEQ ID NO: 784490 - RNA, 19 nt, Human
gcugagggcccuggcuggg

SEQ ID NO: 784491 - RNA, 19 nt, Human
ggcccucccccucguccuc

SEQ ID NO: 784492 - RNA, 21 nt, Human
ggcccuggcuggggaaaagcu

SEQ ID NO: 784493 - RNA, 24 nt, Human
gggaaaggaagaagacaaaaauau

SEQ ID NO: 784494 - RNA, 20 nt, Human
gggcacauguggucagagaa

SEQ ID NO: 784495 - RNA, 22 nt, Human
uaaaaagcaagaagagcauccu

SEQ ID NO: 784496 - RNA, 20 nt, Human
uaagagagaugagggaggug

SEQ ID NO: 784497 - RNA, 20 nt, Human
uaagagagaugagggaggug

SEQ ID NO: 784498 - RNA, 20 nt, Human
uaccagggcuugguucuccc

SEQ ID NO: 784499 - RNA, 18 nt, Human
uaccucuucccuaccagg

SEQ ID NO: 784500 - RNA, 21 nt, Human
ucacagaggagggagaggagg

SEQ ID NO: 784501 - RNA, 19 nt, Human
ucacuggggcagcagggaa

SEQ ID NO: 784502 - RNA, 19 nt, Human
ucacuggggcagcagggaa

SEQ ID NO: 784503 - RNA, 19 nt, Human
ucagaaaaugaaggucccu

SEQ ID NO: 784504 - RNA, 24 nt, Human
uccacuauaagagagaugagggag

SEQ ID NO: 784505 - RNA, 20 nt, Human
uccuuccacuauaagagaga

SEQ ID NO: 784506 - RNA, 23 nt, Human
ugaaaacagccuuccuccugcca

SEQ ID NO: 784507 - RNA, 22 nt, Human
ugaaaacccugagcaggaccaa

SEQ ID NO: 784508 - RNA, 19 nt, Human
ugaaucagagccaagcacc

SEQ ID NO: 784509 - RNA, 23 nt, Human
ugagccuuaggguuaagggcuaa

SEQ ID NO: 784510 - RNA, 24 nt, Human
ugccaccggcucccuauacaaccu

SEQ ID NO: 784511 - RNA, 21 nt, Human
ugccuuggcuaaggcacugac

SEQ ID NO: 784512 - RNA, 19 nt, Human
ugcugggauaggccucgag

SEQ ID NO: 784513 - RNA, 18 nt, Human
ugcuuaggaaauauggag

SEQ ID NO: 784514 - RNA, 19 nt, Human
uggaauuugugcagccagu

SEQ ID NO: 784515 - RNA, 18 nt, Human
uggcaaagaggggaaagg

SEQ ID NO: 784516 - RNA, 19 nt, Human
uggcaaagaggggaaagga

SEQ ID NO: 784517 - RNA, 19 nt, Human
uggcaaagaggggaaagga

SEQ ID NO: 784518 - RNA, 19 nt, Human
uggcagagaaaccccaaca

SEQ ID NO: 784519 - RNA, 23 nt, Human
uggcuggggaaaagcuggucuuu

SEQ ID NO: 784520 - RNA, 19 nt, Human
uugcugggauaggccucga

SEQ ID NO: 784521 - RNA, 24 nt, Human
uugucagggcucccaggugcaacc

SEQ ID NO: 784522 - RNA, 27 nt, Human
uuuuuaaucacgacauuacaagucauu

SEQ ID NO: 784523 - RNA, 23 nt, Human
uuuuuuuuuaucaccaucacucu

SEQ ID NO: 784524 - RNA, 22 nt, Human
aaaaaaaaaaaaaaaacaaaca

SEQ ID NO: 784525 - RNA, 29 nt, Human
aaaaaaaaaaaaaacaaacaaacaaacaa

SEQ ID NO: 784526 - RNA, 25 nt, Human
aaaaaaaaaaaacaaaacacaacua

SEQ ID NO: 784527 - RNA, 24 nt, Human
aaaaaaaaaaaacaaacaaacaaa

SEQ ID NO: 784528 - RNA, 25 nt, Human
aaaaaaaaaaaacaaacaaacaaac

SEQ ID NO: 784529 - RNA, 25 nt, Human
aaaaaaaaaaaacaaacaaacaaac

SEQ ID NO: 784530 - RNA, 25 nt, Human
aaaaaaaaaacaaacaaacaaacaa

SEQ ID NO: 784531 - RNA, 25 nt, Human
aaaaaaaacaaacaaacaaacaaaa

SEQ ID NO: 784532 - RNA, 28 nt, Human
aaaaaaacaaacaaacaaacaaaaaaaa

SEQ ID NO: 784533 - RNA, 22 nt, Human
aaaaaacaaaacacaacuagac

SEQ ID NO: 784534 - RNA, 24 nt, Human
aaaaacacaacaaaaccaacaaaa

SEQ ID NO: 784535 - RNA, 21 nt, Human
aaaaacccaccaacauccaag

SEQ ID NO: 784536 - RNA, 18 nt, Human
aaaaagcagaaaaacaca

SEQ ID NO: 784537 - RNA, 18 nt, Human
aaaaccaccacuacuaca

SEQ ID NO: 784538 - RNA, 21 nt, Human
aaaauacugacuagcaggccg

SEQ ID NO: 784539 - RNA, 25 nt, Human
aaaaugcuaaaaaaaucauugcaau

SEQ ID NO: 784540 - RNA, 25 nt, Human
aaacaaaaaaaaaaaccugcuagga

SEQ ID NO: 784541 - RNA, 19 nt, Human
aaacaaaacacaacuagac

SEQ ID NO: 784542 - RNA, 21 nt, Human
aaacaaaacacaacuagacaa

SEQ ID NO: 784543 - RNA, 22 nt, Human
aaacaaaacacaacuagacaaa

SEQ ID NO: 784544 - RNA, 23 nt, Human
aaacacaacaaaaccaacaaaac

SEQ ID NO: 784545 - RNA, 20 nt, Human
aaacuacaggauuaaaaaaa

SEQ ID NO: 784546 - RNA, 21 nt, Human
aaacuauuuccuauuauuauu

SEQ ID NO: 784547 - RNA, 24 nt, Human
aaacugauuaaccacccaaaaauu

SEQ ID NO: 784548 - RNA, 23 nt, Human
aaagcaaauuuaagaagcaaaaa

SEQ ID NO: 784549 - RNA, 24 nt, Human
aaagcagaaaaacacaacaaaacc

SEQ ID NO: 784550 - RNA, 27 nt, Human
aaagcagaaaaacacaacaaaaccaac

SEQ ID NO: 784551 - RNA, 22 nt, Human
aaauaccuucacugccacuuuc

SEQ ID NO: 784552 - RNA, 18 nt, Human
aaauacugacagauaccu

SEQ ID NO: 784553 - RNA, 22 nt, Human
aacaaaaccaacaaaaccacca

SEQ ID NO: 784554 - RNA, 25 nt, Human
aaccaaaaagcagaaaaacacaaca

SEQ ID NO: 784555 - RNA, 20 nt, Human
aaccaccacuacuacaaucu

SEQ ID NO: 784556 - RNA, 21 nt, Human
aagaaauuacaaaauguggca

SEQ ID NO: 784557 - RNA, 20 nt, Human
aagagaaucaaaaccaacga

SEQ ID NO: 784558 - RNA, 23 nt, Human
aagcacccagcugccauaaauac

SEQ ID NO: 784559 - RNA, 22 nt, Human
aagcagaaaaacacaacaaaac

SEQ ID NO: 784560 - RNA, 23 nt, Human
aaggcuacagugagcugugauca

SEQ ID NO: 784561 - RNA, 24 nt, Human
aaugaugaaaagcaaauuuaagaa

SEQ ID NO: 784562 - RNA, 18 nt, Human
aauuagccagacauggug

SEQ ID NO: 784563 - RNA, 20 nt, Human
acaaaaccaacaaaaccacc

SEQ ID NO: 784564 - RNA, 23 nt, Human
acaaacaaaaaaaaaaaccugcu

SEQ ID NO: 784565 - RNA, 23 nt, Human
acacauuacuacuauauauaauc

SEQ ID NO: 784566 - RNA, 18 nt, Human
acaccacugcacuccagc

SEQ ID NO: 784567 - RNA, 20 nt, Human
acaccacugcacuccagccu

SEQ ID NO: 784568 - RNA, 22 nt, Human
acagaaacauaucuguaaacau

SEQ ID NO: 784569 - RNA, 24 nt, Human
acagauaccuucacugaaaauucu

SEQ ID NO: 784570 - RNA, 24 nt, Human
acagggcgagacuccaucucaaaa

SEQ ID NO: 784571 - RNA, 25 nt, Human
acauuuucccaaauuacuucugcca

SEQ ID NO: 784572 - RNA, 25 nt, Human
accaccacuacuacaaucaacaaaa

SEQ ID NO: 784573 - RNA, 19 nt, Human
accacugcacuccagccug

SEQ ID NO: 784574 - RNA, 24 nt, Human
acccaggaggcagagguugcagug

SEQ ID NO: 784575 - RNA, 20 nt, Human
acuacaaucaacaaaaaccu

SEQ ID NO: 784576 - RNA, 18 nt, Human
acuauacuccagccuggg

SEQ ID NO: 784577 - RNA, 24 nt, Human
acuccagccugggugaaagaguga

SEQ ID NO: 784578 - RNA, 18 nt, Human
acugcacuccagccuggg

SEQ ID NO: 784579 - RNA, 24 nt, Human
acugcacuccagccugggugacag

SEQ ID NO: 784580 - RNA, 21 nt, Human
agaaaaacacaacaaaaccaa

SEQ ID NO: 784581 - RNA, 21 nt, Human
agaaaaacacaacaaaaccaa

SEQ ID NO: 784582 - RNA, 22 nt, Human
agaaaacacccuuuuaacaaga

SEQ ID NO: 784583 - RNA, 20 nt, Human
agaaggcagugacuucuaca

SEQ ID NO: 784584 - RNA, 20 nt, Human
agagaauaagagaaucaaaa

SEQ ID NO: 784585 - RNA, 20 nt, Human
agagguugcagugagcuaag

SEQ ID NO: 784586 - RNA, 23 nt, Human
agagguugcagugagcuaagauc

SEQ ID NO: 784587 - RNA, 24 nt, Human
agagguugcagugagcuaagauca

SEQ ID NO: 784588 - RNA, 21 nt, Human
agauaaaaguaaugaaaagaa

SEQ ID NO: 784589 - RNA, 19 nt, Human
agauuuggagucccugaac

SEQ ID NO: 784590 - RNA, 24 nt, Human
agcacuuugggaggccgagguggg

SEQ ID NO: 784591 - RNA, 20 nt, Human
agccuggccaacauggugaa

SEQ ID NO: 784592 - RNA, 24 nt, Human
agccugggugacagggcgagacuc

SEQ ID NO: 784593 - RNA, 20 nt, Human
aggaaaaacuaaaucuaaca

SEQ ID NO: 784594 - RNA, 23 nt, Human
aggaaaaacuaaaucuaacaaaa

SEQ ID NO: 784595 - RNA, 23 nt, Human
aggaauucgagaucagccuggcc

SEQ ID NO: 784596 - RNA, 20 nt, Human
aggauuaaaaaaaaaaaaac

SEQ ID NO: 784597 - RNA, 19 nt, Human
aggcacauaucacuugaac

SEQ ID NO: 784598 - RNA, 24 nt, Human
aggcagagguugcagugagcuaag

SEQ ID NO: 784599 - RNA, 18 nt, Human
aggcaggacgaucacuug

SEQ ID NO: 784600 - RNA, 23 nt, Human
aggcaggacgaucacuugaaccc

SEQ ID NO: 784601 - RNA, 21 nt, Human
aggccgagguggguagaucac

SEQ ID NO: 784602 - RNA, 21 nt, Human
aggcugaggcaggacgaucac

SEQ ID NO: 784603 - RNA, 24 nt, Human
aggcugaggcaggacgaucacuug

SEQ ID NO: 784604 - RNA, 23 nt, Human
agguggguagaucacuugagguc

SEQ ID NO: 784605 - RNA, 23 nt, Human
aguguuuuuuuaaaacaagagau

SEQ ID NO: 784606 - RNA, 18 nt, Human
auaagagaaucaaaacca

SEQ ID NO: 784607 - RNA, 24 nt, Human
aucacaccacugcacuccagccug

SEQ ID NO: 784608 - RNA, 21 nt, Human
aucacuugaggucaggaauuc

SEQ ID NO: 784609 - RNA, 24 nt, Human
aucaugucacuauacuccagccug

SEQ ID NO: 784610 - RNA, 23 nt, Human
augaaaagcaaauuuaagaagca

SEQ ID NO: 784611 - RNA, 24 nt, Human
augaccucauauaauauaucagaa

SEQ ID NO: 784612 - RNA, 22 nt, Human
augucacuauacuccagccugg

SEQ ID NO: 784613 - RNA, 21 nt, Human
auuagcuauccuucugcaaau

SEQ ID NO: 784614 - RNA, 20 nt, Human
caaaaaaaacuaauaugaca

SEQ ID NO: 784615 - RNA, 19 nt, Human
caaaaacccaccaacaucc

SEQ ID NO: 784616 - RNA, 23 nt, Human
caaaaagcagaaaaacacaacaa

SEQ ID NO: 784617 - RNA, 24 nt, Human
caaaacauaaaacauuauuagcuu

SEQ ID NO: 784618 - RNA, 20 nt, Human
caaaaccaacaaaaccacca

SEQ ID NO: 784619 - RNA, 25 nt, Human
caaacaaacaaaaaaaaaaaccugc

SEQ ID NO: 784620 - RNA, 23 nt, Human
caacaaaaccaccacuacuacaa

SEQ ID NO: 784621 - RNA, 21 nt, Human
cacaccacugcacuccagccu

SEQ ID NO: 784622 - RNA, 19 nt, Human
cacaccuauaauuccagcu

SEQ ID NO: 784623 - RNA, 23 nt, Human
caccuauaauuccagcuacucgg

SEQ ID NO: 784624 - RNA, 24 nt, Human
caccuauaauuccagcuacucggg

SEQ ID NO: 784625 - RNA, 24 nt, Human
cacgccuguaaucccagcacuuug

SEQ ID NO: 784626 - RNA, 21 nt, Human
cacuacuacaaucaacaaaaa

SEQ ID NO: 784627 - RNA, 19 nt, Human
cacuauacuccagccuggg

SEQ ID NO: 784628 - RNA, 19 nt, Human
cacuauacuccagccuggg

SEQ ID NO: 784629 - RNA, 20 nt, Human
cacuauacuccagccugggu

SEQ ID NO: 784630 - RNA, 22 nt, Human
cacuauacuccagccuggguga

SEQ ID NO: 784631 - RNA, 24 nt, Human
cacuauacuccagccugggugaaa

SEQ ID NO: 784632 - RNA, 22 nt, Human
cacuccagccugggugacaggg

SEQ ID NO: 784633 - RNA, 23 nt, Human
cacuccagccugggugacagggc

SEQ ID NO: 784634 - RNA, 24 nt, Human
cacuccagccugggugacagggcg

SEQ ID NO: 784635 - RNA, 19 nt, Human
cacugcacuccagccuggg

SEQ ID NO: 784636 - RNA, 19 nt, Human
cacugcacuccagccuggg

SEQ ID NO: 784637 - RNA, 22 nt, Human
cacugcacuccagccuggguga

SEQ ID NO: 784638 - RNA, 23 nt, Human
cacugcacuccagccugggugac

SEQ ID NO: 784639 - RNA, 24 nt, Human
cacugcacuccagccugggugaca

SEQ ID NO: 784640 - RNA, 24 nt, Human
cacugcacuccagccugggugaca

SEQ ID NO: 784641 - RNA, 20 nt, Human
cacuugaggucaggaauucg

SEQ ID NO: 784642 - RNA, 19 nt, Human
cagaaaaacacaacaaaac

SEQ ID NO: 784643 - RNA, 21 nt, Human
cagcacuuugggaggccgagg

SEQ ID NO: 784644 - RNA, 24 nt, Human
cagcacuuugggaggccgaggugg

SEQ ID NO: 784645 - RNA, 24 nt, Human
cagcuacucgggaggcugaggcag

SEQ ID NO: 784646 - RNA, 19 nt, Human
caggcaugcacuuguaguc

SEQ ID NO: 784647 - RNA, 23 nt, Human
caggccggagaugguggcucacg

SEQ ID NO: 784648 - RNA, 22 nt, Human
cauauacuuacagacacaaucc

SEQ ID NO: 784649 - RNA, 20 nt, Human
cauauuuauguauauacaua

SEQ ID NO: 784650 - RNA, 18 nt, Human
cauguuccuacuuccugu

SEQ ID NO: 784651 - RNA, 18 nt, Human
ccaacaaaaccaccacua

SEQ ID NO: 784652 - RNA, 20 nt, Human
ccacugcacuccagccuggg

SEQ ID NO: 784653 - RNA, 20 nt, Human
ccacugcacuccagccuggg

SEQ ID NO: 784654 - RNA, 21 nt, Human
ccacugcacuccagccugggu

SEQ ID NO: 784655 - RNA, 21 nt, Human
ccacugcacuccagccugggu

SEQ ID NO: 784656 - RNA, 23 nt, Human
ccacugcacuccagccuggguga

SEQ ID NO: 784657 - RNA, 23 nt, Human
ccacugcacuccagccuggguga

SEQ ID NO: 784658 - RNA, 24 nt, Human
ccacugcacuccagccugggugac

SEQ ID NO: 784659 - RNA, 25 nt, Human
ccacugcacuccagccugggugaca

SEQ ID NO: 784660 - RNA, 24 nt, Human
ccaucucaaaaaaaaaaaaaaaaa

SEQ ID NO: 784661 - RNA, 21 nt, Human
ccaugugcuacagaaagacuc

SEQ ID NO: 784662 - RNA, 22 nt, Human
cccaaaaauucaaaaacccacc

SEQ ID NO: 784663 - RNA, 24 nt, Human
cccaaauaaagauuaauaguuuau

SEQ ID NO: 784664 - RNA, 22 nt, Human
cccaucucuacuaaaaauacaa

SEQ ID NO: 784665 - RNA, 21 nt, Human
ccuauaauuccagcuacucgg

SEQ ID NO: 784666 - RNA, 21 nt, Human
ccuggccaacauggugaauug

SEQ ID NO: 784667 - RNA, 30 nt, Human
ccuggccaacauggugaauugaaaucccaa

SEQ ID NO: 784668 - RNA, 22 nt, Human
ccugggugacagggcgagacuc

SEQ ID NO: 784669 - RNA, 22 nt, Human
ccuguaaucccagcacuuuggg

SEQ ID NO: 784670 - RNA, 21 nt, Human
ccuucacugccacuuucagcc

SEQ ID NO: 784671 - RNA, 20 nt, Human
ccuuccguuagcauuucuuc

SEQ ID NO: 784672 - RNA, 23 nt, Human
ccuucugcaaauaaauauaaaag

SEQ ID NO: 784673 - RNA, 21 nt, Human
ccuuuauaaauuggaagcauc

SEQ ID NO: 784674 - RNA, 23 nt, Human
cgagacuccaucucaaaaaaaaa

SEQ ID NO: 784675 - RNA, 24 nt, Human
cgagaucagccuggccaacauggu

SEQ ID NO: 784676 - RNA, 24 nt, Human
cgagguggguagaucacuugaggu

SEQ ID NO: 784677 - RNA, 26 nt, Human
cgagguggguagaucacuugagguca

SEQ ID NO: 784678 - RNA, 23 nt, Human
cgccuguaaucccagcacuuugg

SEQ ID NO: 784679 - RNA, 24 nt, Human
cgggaggcugaggcaggacgauca

SEQ ID NO: 784680 - RNA, 22 nt, Human
cuacaggauuaaaaaaaaaaaa

SEQ ID NO: 784681 - RNA, 19 nt, Human
cuaguucacucacucaacc

SEQ ID NO: 784682 - RNA, 18 nt, Human
cucaaaaaaaaaaaaaaa

SEQ ID NO: 784683 - RNA, 20 nt, Human
cucacagauaaaaguaauga

SEQ ID NO: 784684 - RNA, 22 nt, Human
cucacgccuguaaucccagcac

SEQ ID NO: 784685 - RNA, 24 nt, Human
cucacgccuguaaucccagcacuu

SEQ ID NO: 784686 - RNA, 26 nt, Human
cuccaaaaaaaaaaaaaaaacaaaca

SEQ ID NO: 784687 - RNA, 27 nt, Human
cuccaaaaaaaaaaaaaaaacaaacaa

SEQ ID NO: 784688 - RNA, 19 nt, Human
cuccaucucaaaaaaaaaa

SEQ ID NO: 784689 - RNA, 19 nt, Human
cugaggcaggacgaucacu

SEQ ID NO: 784690 - RNA, 21 nt, Human
cugaggcaggacgaucacuug

SEQ ID NO: 784691 - RNA, 21 nt, Human
cuuccauacucacaacgguug

SEQ ID NO: 784692 - RNA, 21 nt, Human
gaaaaacacaacaaaaccaac

SEQ ID NO: 784693 - RNA, 19 nt, Human
gaaaaacuaaaucuaacaa

SEQ ID NO: 784694 - RNA, 20 nt, Human
gaaaagcaaauuuaagaagc

SEQ ID NO: 784695 - RNA, 23 nt, Human
gaaccccuaaguauaaucacuca

SEQ ID NO: 784696 - RNA, 24 nt, Human
gaagggggaggauugcuugagucu

SEQ ID NO: 784697 - RNA, 22 nt, Human
gagaauaagagaaucaaaacca

SEQ ID NO: 784698 - RNA, 24 nt, Human
gaucacuugaacccaggaggcaga

SEQ ID NO: 784699 - RNA, 18 nt, Human
gaucacuugaggucagga

SEQ ID NO: 784700 - RNA, 24 nt, Human
gaucacuugaggucaggaauucga

SEQ ID NO: 784701 - RNA, 28 nt, Human
gauuaaaaaaaaaaaaacaaaacacaac

SEQ ID NO: 784702 - RNA, 24 nt, Human
gauuuuuucaguuaaaaaaugaga

SEQ ID NO: 784703 - RNA, 24 nt, Human
gcacuccagccugggugacagggc

SEQ ID NO: 784704 - RNA, 22 nt, Human
gcaggacgaucacuugaaccca

SEQ ID NO: 784705 - RNA, 25 nt, Human
gcaggccggagaugguggcucacgc

SEQ ID NO: 784706 - RNA, 22 nt, Human
gccaacauggugaauugaaauc

SEQ ID NO: 784707 - RNA, 20 nt, Human
gccaggaaauucuucccaau

SEQ ID NO: 784708 - RNA, 23 nt, Human
gccauggaaggagauuauacaac

SEQ ID NO: 784709 - RNA, 18 nt, Human
gccugggugacagggcga

SEQ ID NO: 784710 - RNA, 20 nt, Human
gcuaagaucacaccacugca

SEQ ID NO: 784711 - RNA, 21 nt, Human
ggaaaagagagaaacagaaaa

SEQ ID NO: 784712 - RNA, 24 nt, Human
ggagaugguggcucacgccuguaa

SEQ ID NO: 784713 - RNA, 22 nt, Human
ggaggcagagguugcagugagc

SEQ ID NO: 784714 - RNA, 21 nt, Human
ggcacacaccuauaauuccag

SEQ ID NO: 784715 - RNA, 21 nt, Human
gggaagauccuaaacauaaca

SEQ ID NO: 784716 - RNA, 18 nt, Human
gggcaagaagcacccagc

SEQ ID NO: 784717 - RNA, 21 nt, Human
gguagaucacuugaggucagg

SEQ ID NO: 784718 - RNA, 24 nt, Human
gguggcucacgccuguaaucccag

SEQ ID NO: 784719 - RNA, 24 nt, Human
gucacuauacuccagccuggguga

SEQ ID NO: 784720 - RNA, 23 nt, Human
guggcucacgccuguaaucccag

SEQ ID NO: 784721 - RNA, 22 nt, Human
guugcauuuaggcugcuuuuuu

SEQ ID NO: 784722 - RNA, 23 nt, Human
uaaaaaaugagaaucccuaaaga

SEQ ID NO: 784723 - RNA, 22 nt, Human
uaaaauauuaaaaugcuaaaaa

SEQ ID NO: 784724 - RNA, 26 nt, Human
uaaacauaacaaauccuuccguuagc

SEQ ID NO: 784725 - RNA, 22 nt, Human
uaaauaaagcauccgaaucuua

SEQ ID NO: 784726 - RNA, 23 nt, Human
uaaauaaagcauccgaaucuuaa

SEQ ID NO: 784727 - RNA, 19 nt, Human
uaaauacugacagauaccu

SEQ ID NO: 784728 - RNA, 23 nt, Human
uaaaucaccucaggccuucauuu

SEQ ID NO: 784729 - RNA, 21 nt, Human
uaacaaauaccuucacugcca

SEQ ID NO: 784730 - RNA, 26 nt, Human
uaacuuuuaaauaauuccuaaauuuc

SEQ ID NO: 784731 - RNA, 23 nt, Human
uaauaaaaaggaaaaacuaaauc

SEQ ID NO: 784732 - RNA, 23 nt, Human
uaauaaaauuauacaaaugcuac

SEQ ID NO: 784733 - RNA, 24 nt, Human
uaauauauacauauggaaaacugg

SEQ ID NO: 784734 - RNA, 23 nt, Human
uaauuuguauguauguauuccuu

SEQ ID NO: 784735 - RNA, 21 nt, Human
uacagaaugcuacaaacuaca

SEQ ID NO: 784736 - RNA, 25 nt, Human
uacagaaugcuacaaacuacaccau

SEQ ID NO: 784737 - RNA, 21 nt, Human
uaccuucacugccacuuucag

SEQ ID NO: 784738 - RNA, 22 nt, Human
uacuacaaucaacaaaaaccua

SEQ ID NO: 784739 - RNA, 22 nt, Human
uacuccagccugggugaaagag

SEQ ID NO: 784740 - RNA, 23 nt, Human
uacuccagccugggugaaagagu

SEQ ID NO: 784741 - RNA, 24 nt, Human
uacuccagccugggugaaagagug

SEQ ID NO: 784742 - RNA, 24 nt, Human
uagaucacuugaggucaggaauuc

SEQ ID NO: 784743 - RNA, 27 nt, Human
uagaucacuugaggucaggaauucgag

SEQ ID NO: 784744 - RNA, 22 nt, Human
uagcauuuuaaaaaauaaaauc

SEQ ID NO: 784745 - RNA, 21 nt, Human
uaguuuauaagugguacagug

SEQ ID NO: 784746 - RNA, 28 nt, Human
uauaaacagaaacauaucuguaaacauu

SEQ ID NO: 784747 - RNA, 21 nt, Human
uauaaucacucaacauuuucu

SEQ ID NO: 784748 - RNA, 19 nt, Human
uauaauuccagcuacucgg

SEQ ID NO: 784749 - RNA, 21 nt, Human
uauacauauacuuacagacac

SEQ ID NO: 784750 - RNA, 24 nt, Human
uauaucagaaauuaggagaaaaca

SEQ ID NO: 784751 - RNA, 26 nt, Human
uaucagaaauuaggagaaaacacccu

SEQ ID NO: 784752 - RNA, 18 nt, Human
uauggaaaacuggccacu

SEQ ID NO: 784753 - RNA, 26 nt, Human
uauuauaugguuauaaacagaaacau

SEQ ID NO: 784754 - RNA, 22 nt, Human
uauuaucuaucucuuuuacaua

SEQ ID NO: 784755 - RNA, 19 nt, Human
ucacaaacagagaaaacau

SEQ ID NO: 784756 - RNA, 23 nt, Human
ucacaccacugcacuccagccug

SEQ ID NO: 784757 - RNA, 21 nt, Human
ucacuauacuccagccugggu

SEQ ID NO: 784758 - RNA, 18 nt, Human
ucaguagucagaggaguu

SEQ ID NO: 784759 - RNA, 21 nt, Human
ucaguuagcauuuuaaaaaau

SEQ ID NO: 784760 - RNA, 29 nt, Human
uccaaaaaaaaaaaaaaaacaaacaaacu

SEQ ID NO: 784761 - RNA, 26 nt, Human
uccaaguaaagauuaacaccuuucua

SEQ ID NO: 784762 - RNA, 23 nt, Human
uccagccugggugaaagagugag

SEQ ID NO: 784763 - RNA, 24 nt, Human
uccagccugggugaaagagugaga

SEQ ID NO: 784764 - RNA, 23 nt, Human
uccagccugggugacagggcgag

SEQ ID NO: 784765 - RNA, 24 nt, Human
uccagccugggugacagggcgaga

SEQ ID NO: 784766 - RNA, 23 nt, Human
uccaucucaaaaaaaaaaaaaaa

SEQ ID NO: 784767 - RNA, 25 nt, Human
ucgggaggcugaggcaggacgauca

SEQ ID NO: 784768 - RNA, 23 nt, Human
ucuauuaaaaaaaaaaaagauga

SEQ ID NO: 784769 - RNA, 20 nt, Human
ucuccaaaaaaaaaaaaaaa

SEQ ID NO: 784770 - RNA, 24 nt, Human
ucuccaaaaaaaaaaaaaaaacaa

SEQ ID NO: 784771 - RNA, 22 nt, Human
ucucuacuaaaaauacaaaaaa

SEQ ID NO: 784772 - RNA, 24 nt, Human
ucucucaaacauuacuggcaaaca

SEQ ID NO: 784773 - RNA, 24 nt, Human
ucuuuuuucaauuaaaaaaugaga

SEQ ID NO: 784774 - RNA, 23 nt, Human
ugaaaagcaaauuuaagaagcaa

SEQ ID NO: 784775 - RNA, 18 nt, Human
ugaacugcuuaaagaagg

SEQ ID NO: 784776 - RNA, 24 nt, Human
ugaggcaggacgaucacuugaacc

SEQ ID NO: 784777 - RNA, 25 nt, Human
ugaggcaggacgaucacuugaaccc

SEQ ID NO: 784778 - RNA, 21 nt, Human
ugauuaaccacccaaaaauuc

SEQ ID NO: 784779 - RNA, 18 nt, Human
ugcaaaaaaaacuaauau

SEQ ID NO: 784780 - RNA, 19 nt, Human
ugcaaauaauucauacaau

SEQ ID NO: 784781 - RNA, 21 nt, Human
ugcauguuccuacuuccuguu

SEQ ID NO: 784782 - RNA, 18 nt, Human
ugccaggaaauucuuccc

SEQ ID NO: 784783 - RNA, 19 nt, Human
ugccuuaauacaaucuugg

SEQ ID NO: 784784 - RNA, 19 nt, Human
uggaugaccucauauaaua

SEQ ID NO: 784785 - RNA, 19 nt, Human
uggaugaccucauauaaua

SEQ ID NO: 784786 - RNA, 22 nt, Human
uggcacacaccuauaauuccag

SEQ ID NO: 784787 - RNA, 18 nt, Human
uggccaacauggugaauu

SEQ ID NO: 784788 - RNA, 24 nt, Human
uggcucacgccuguaaucccagca

SEQ ID NO: 784789 - RNA, 20 nt, Human
ugggaggccgagguggguag

SEQ ID NO: 784790 - RNA, 24 nt, Human
ugggaggccgagguggguagauca

SEQ ID NO: 784791 - RNA, 24 nt, Human
uggguagaucacuugaggucagga

SEQ ID NO: 784792 - RNA, 23 nt, Human
ugguggcacacaccuauaauucc

SEQ ID NO: 784793 - RNA, 24 nt, Human
ugguggcucacgccuguaauccca

SEQ ID NO: 784794 - RNA, 26 nt, Human
uguauauacauauacuuacagacaca

SEQ ID NO: 784795 - RNA, 22 nt, Human
uguaugcauguuccuacuuccu

SEQ ID NO: 784796 - RNA, 21 nt, Human
ugugcuacagaaagacucacc

SEQ ID NO: 784797 - RNA, 21 nt, Human
uguggcauauuuauguauaua

SEQ ID NO: 784798 - RNA, 25 nt, Human
uguggcauauuuauguauauacauu

SEQ ID NO: 784799 - RNA, 23 nt, Human
uuaaaaaaaaaaaaacaaaacac

SEQ ID NO: 784800 - RNA, 23 nt, Human
uuaaaaaauaaaaucuacuguga

SEQ ID NO: 784801 - RNA, 26 nt, Human
uuaaccacccaaaaauucaaaaaccc

SEQ ID NO: 784802 - RNA, 19 nt, Human
uuagaaaauguuugaacua

SEQ ID NO: 784803 - RNA, 21 nt, Human
uuagcauuuuaaaaaauaaaa

SEQ ID NO: 784804 - RNA, 19 nt, Human
uucaaggaaagaaauaauc

SEQ ID NO: 784805 - RNA, 25 nt, Human
uucacaaucuuucuucuuuuaauuu

SEQ ID NO: 784806 - RNA, 21 nt, Human
uugaacuugacauuuuaauga

SEQ ID NO: 784807 - RNA, 19 nt, Human
uugcagugagcuaagauca

SEQ ID NO: 784808 - RNA, 20 nt, Human
uugcagugagcuaagaucac

SEQ ID NO: 784809 - RNA, 24 nt, Human
uugcuugagucucggaagucaagg

SEQ ID NO: 784810 - RNA, 25 nt, Human
uugggaggccgagguggguagauca

SEQ ID NO: 784811 - RNA, 21 nt, Human
uuuauguauauacauauacuu

SEQ ID NO: 784812 - RNA, 22 nt, Human
aaaaacaaaaacuaacagaaga

SEQ ID NO: 784813 - RNA, 22 nt, Human
aaaaaccuuuggacagacagag

SEQ ID NO: 784814 - RNA, 18 nt, Human
aaaauaggaacaaggcag

SEQ ID NO: 784815 - RNA, 21 nt, Human
aaacccagaaaguuucuugug

SEQ ID NO: 784816 - RNA, 23 nt, Human
aaagaaaauuuccagaauuucac

SEQ ID NO: 784817 - RNA, 23 nt, Human
aaagauaauuuacagaaaggucu

SEQ ID NO: 784818 - RNA, 22 nt, Human
aaagcagaauauauuuuugcuc

SEQ ID NO: 784819 - RNA, 20 nt, Human
aagcauccuagcuuuuggca

SEQ ID NO: 784820 - RNA, 23 nt, Human
aaggaugccucugcuuucaauug

SEQ ID NO: 784821 - RNA, 21 nt, Human
aaguauuuccccaacacccca

SEQ ID NO: 784822 - RNA, 19 nt, Human
aauaaauggaaagaaauaa

SEQ ID NO: 784823 - RNA, 30 nt, Human
aauaaguuauuuuauauauauauauauauu

SEQ ID NO: 784824 - RNA, 23 nt, Human
aaugcccuccccuauccccgccc

SEQ ID NO: 784825 - RNA, 27 nt, Human
acaaggcaauugaacacacagcagaac

SEQ ID NO: 784826 - RNA, 24 nt, Human
acacaaaaacacagacuuuuuuca

SEQ ID NO: 784827 - RNA, 26 nt, Human
acagacauuccuaacuacauaccucu

SEQ ID NO: 784828 - RNA, 21 nt, Human
acuaaaugcagggcacaucug

SEQ ID NO: 784829 - RNA, 18 nt, Human
agacagggcuaaugcucu

SEQ ID NO: 784830 - RNA, 22 nt, Human
agauauaauuagaagcuaacaa

SEQ ID NO: 784831 - RNA, 18 nt, Human
agcagaacuuuaaaaccu

SEQ ID NO: 784832 - RNA, 23 nt, Human
agccaaaguaguuacuuucuccc

SEQ ID NO: 784833 - RNA, 20 nt, Human
aggagacucaacaaaaauca

SEQ ID NO: 784834 - RNA, 26 nt, Human
aggcaggagacucaacaaaaaucaaa

SEQ ID NO: 784835 - RNA, 20 nt, Human
aggcugcgggcugcugcacc

SEQ ID NO: 784836 - RNA, 23 nt, Human
aggggacuagagaggggaaucug

SEQ ID NO: 784837 - RNA, 21 nt, Human
aguaccggagauuaaauaacc

SEQ ID NO: 784838 - RNA, 23 nt, Human
auaacuauauauauauauaugua

SEQ ID NO: 784839 - RNA, 23 nt, Human
auauauguauauauauauauuug

SEQ ID NO: 784840 - RNA, 18 nt, Human
auccagacuaaaaagaua

SEQ ID NO: 784841 - RNA, 23 nt, Human
augaaaacacaccuucuacaguc

SEQ ID NO: 784842 - RNA, 24 nt, Human
augaacgauggcucuaaugcugca

SEQ ID NO: 784843 - RNA, 23 nt, Human
auucacacuuaaaaacaaaaacu

SEQ ID NO: 784844 - RNA, 22 nt, Human
auuuuauauauauauauauauu

SEQ ID NO: 784845 - RNA, 24 nt, Human
caaaacaagaaaacccauccauac

SEQ ID NO: 784846 - RNA, 22 nt, Human
caaacagcacaaagagauuugu

SEQ ID NO: 784847 - RNA, 19 nt, Human
caaauaaucaacaaaacaa

SEQ ID NO: 784848 - RNA, 18 nt, Human
caacaaaacaagaaaacc

SEQ ID NO: 784849 - RNA, 22 nt, Human
caacaccccagaggccgcuuaa

SEQ ID NO: 784850 - RNA, 22 nt, Human
caauauguaaccgaagccaagu

SEQ ID NO: 784851 - RNA, 22 nt, Human
cagcagaacuuuaaaaccugua

SEQ ID NO: 784852 - RNA, 21 nt, Human
ccacaaguuucugaaccugga

SEQ ID NO: 784853 - RNA, 24 nt, Human
ccaggcaagcaaaauggacauuua

SEQ ID NO: 784854 - RNA, 21 nt, Human
ccauccauacuacagucacuc

SEQ ID NO: 784855 - RNA, 20 nt, Human
cccaaaauacugacaguuaa

SEQ ID NO: 784856 - RNA, 19 nt, Human
ccccaacaccccagaggcc

SEQ ID NO: 784857 - RNA, 18 nt, Human
ccccagaggccgcuuaac

SEQ ID NO: 784858 - RNA, 20 nt, Human
ccccagaggccgcuuaacuc

SEQ ID NO: 784859 - RNA, 21 nt, Human
ccccagaggccgcuuaacucc

SEQ ID NO: 784860 - RNA, 20 nt, Human
ccgucaggaucugagacugc

SEQ ID NO: 784861 - RNA, 21 nt, Human
ccuauccccgccccacaaaaa

SEQ ID NO: 784862 - RNA, 21 nt, Human
ccucaaauaaucaacaaaaca

SEQ ID NO: 784863 - RNA, 18 nt, Human
cgaauaggcagucugguc

SEQ ID NO: 784864 - RNA, 27 nt, Human
cggagagcaagucuggagcaccuacaa

SEQ ID NO: 784865 - RNA, 19 nt, Human
cuccccuauccccgccccc

SEQ ID NO: 784866 - RNA, 19 nt, Human
cucccuggcugaggcugcg

SEQ ID NO: 784867 - RNA, 20 nt, Human
cuuaaaaacccaucuugcuc

SEQ ID NO: 784868 - RNA, 23 nt, Human
cuuucaguugccuuuuuuaaaua

SEQ ID NO: 784869 - RNA, 22 nt, Human
gaaaauuuccagaauuucacau

SEQ ID NO: 784870 - RNA, 19 nt, Human
gaaagcggcugggacuccc

SEQ ID NO: 784871 - RNA, 19 nt, Human
gcucaaggaugccucugcu

SEQ ID NO: 784872 - RNA, 24 nt, Human
gcugcagugcaacaggauggcaau

SEQ ID NO: 784873 - RNA, 21 nt, Human
ggaacuggccuaccacaaguu

SEQ ID NO: 784874 - RNA, 23 nt, Human
ggagcaccuacaguugaaaagca

SEQ ID NO: 784875 - RNA, 21 nt, Human
ggugaaaugaaacuaucugga

SEQ ID NO: 784876 - RNA, 19 nt, Human
guaaaacaaacuggagccu

SEQ ID NO: 784877 - RNA, 22 nt, Human
guauauauauauauuuguauau

SEQ ID NO: 784878 - RNA, 18 nt, Human
uaaaaaaacacaaaaaca

SEQ ID NO: 784879 - RNA, 20 nt, Human
uaaaaaaacacaaaaacaca

SEQ ID NO: 784880 - RNA, 20 nt, Human
uaaaaaaacacaaaaacaca

SEQ ID NO: 784881 - RNA, 19 nt, Human
uaaaaccuguaaaacaaac

SEQ ID NO: 784882 - RNA, 22 nt, Human
uaaaguaaaaccaaaaagauca

SEQ ID NO: 784883 - RNA, 25 nt, Human
uacacaaggcaauugaacacacagc

SEQ ID NO: 784884 - RNA, 22 nt, Human
uacagucaggguuuauuaucuu

SEQ ID NO: 784885 - RNA, 18 nt, Human
uagagaggggaaucuggc

SEQ ID NO: 784886 - RNA, 18 nt, Human
uauauauauauauauaua

SEQ ID NO: 784887 - RNA, 19 nt, Human
uauauauauauauauauau

SEQ ID NO: 784888 - RNA, 18 nt, Human
uauauauauauguauaua

SEQ ID NO: 784889 - RNA, 18 nt, Human
uauauauauguauauaua

SEQ ID NO: 784890 - RNA, 23 nt, Human
uauauauauguauauauauauau

SEQ ID NO: 784891 - RNA, 18 nt, Human
uauauauguauauauaua

SEQ ID NO: 784892 - RNA, 18 nt, Human
uauauguauauauauaua

SEQ ID NO: 784893 - RNA, 21 nt, Human
uauggaaggaaauuagaaaag

SEQ ID NO: 784894 - RNA, 22 nt, Human
uauguauauauauauauuugua

SEQ ID NO: 784895 - RNA, 28 nt, Human
ucaaauaaucaacaaaacaagaaaaccc

SEQ ID NO: 784896 - RNA, 21 nt, Human
ucaaugcccuccccuaucccc

SEQ ID NO: 784897 - RNA, 19 nt, Human
ucacuggcuaaaaacauga

SEQ ID NO: 784898 - RNA, 22 nt, Human
uccauacuacagucacucaaaa

SEQ ID NO: 784899 - RNA, 21 nt, Human
ucccaaaguccugcuuguacc

SEQ ID NO: 784900 - RNA, 23 nt, Human
uccccaaauaccccaggggaucc

SEQ ID NO: 784901 - RNA, 22 nt, Human
uccccuauccccgccccacaaa

SEQ ID NO: 784902 - RNA, 24 nt, Human
uccccuauccccgccccacaaaaa

SEQ ID NO: 784903 - RNA, 21 nt, Human
ucccuggcugaggcugcgggc

SEQ ID NO: 784904 - RNA, 21 nt, Human
ucuaaguuugucuuaaauguu

SEQ ID NO: 784905 - RNA, 22 nt, Human
ucuaauuacuuucaguugccuu

SEQ ID NO: 784906 - RNA, 21 nt, Human
ucuggagcaccuacaguugaa

SEQ ID NO: 784907 - RNA, 20 nt, Human
ucuggcccuaaggcgacaag

SEQ ID NO: 784908 - RNA, 21 nt, Human
ucuggcccuaaggcgacaagu

SEQ ID NO: 784909 - RNA, 26 nt, Human
ucugugugugugaugugaugcugugu

SEQ ID NO: 784910 - RNA, 20 nt, Human
ucuuucaugaacuacuuguu

SEQ ID NO: 784911 - RNA, 20 nt, Human
ugaaaaacaaggaaaacagc

SEQ ID NO: 784912 - RNA, 21 nt, Human
ugaacacacagcagaacuuua

SEQ ID NO: 784913 - RNA, 21 nt, Human
ugaagcauccuagcuuuuggc

SEQ ID NO: 784914 - RNA, 21 nt, Human
ugaguugugagacggaagaac

SEQ ID NO: 784915 - RNA, 21 nt, Human
ugcaacaaauagaguuaagug

SEQ ID NO: 784916 - RNA, 23 nt, Human
ugcaacaggauggcaauguaaug

SEQ ID NO: 784917 - RNA, 19 nt, Human
ugcuauacacaagcugcag

SEQ ID NO: 784918 - RNA, 24 nt, Human
uggaaagaaauaaaguauuucccc

SEQ ID NO: 784919 - RNA, 20 nt, Human
uggagcaccuacaguugaaa

SEQ ID NO: 784920 - RNA, 24 nt, Human
uggcaagacaugcaaaucauauuc

SEQ ID NO: 784921 - RNA, 22 nt, Human
uggcaagcaggcaggagacuca

SEQ ID NO: 784922 - RNA, 23 nt, Human
uggcuucucugaacacugaggcc

SEQ ID NO: 784923 - RNA, 23 nt, Human
uggggucuggguuuguuuuuugu

SEQ ID NO: 784924 - RNA, 24 nt, Human
uguauauauauauauuuguauaua

SEQ ID NO: 784925 - RNA, 20 nt, Human
uguaugucacaaacccagaa

SEQ ID NO: 784926 - RNA, 18 nt, Human
uguauucauuaaucacuu

SEQ ID NO: 784927 - RNA, 19 nt, Human
ugugugaggaccuaaggag

SEQ ID NO: 784928 - RNA, 21 nt, Human
ugugugugugaugugaugcug

SEQ ID NO: 784929 - RNA, 23 nt, Human
ugugugugugaugugaugcugug

SEQ ID NO: 784930 - RNA, 24 nt, Human
uguucaaugcuuuaaagcucaagg

SEQ ID NO: 784931 - RNA, 22 nt, Human
uuaaaaacaaaaacuaacagaa

SEQ ID NO: 784932 - RNA, 20 nt, Human
uuaaaaccuguaaaacaaac

SEQ ID NO: 784933 - RNA, 23 nt, Human
uuaauuucugcacacacacacaa

SEQ ID NO: 784934 - RNA, 18 nt, Human
uucaaugcccuccccuau

SEQ ID NO: 784935 - RNA, 21 nt, Human
uucaaugcccuccccuauccc

SEQ ID NO: 784936 - RNA, 19 nt, Human
uucacauuauuuuccuuaa

SEQ ID NO: 784937 - RNA, 21 nt, Human
uucgcuaaaaaaauacacccu

SEQ ID NO: 784938 - RNA, 18 nt, Human
uucuccccaaauacccca

SEQ ID NO: 784939 - RNA, 24 nt, Human
uuguacaugggccugaagcauccu

SEQ ID NO: 784940 - RNA, 22 nt, Human
uuguagaacuucaaugcccucc

SEQ ID NO: 784941 - RNA, 21 nt, Human
uugucccaaaguccugcuugu

SEQ ID NO: 784942 - RNA, 19 nt, Human
uuuauauauauauauauau

SEQ ID NO: 784943 - RNA, 20 nt, Human
uuucuuuaaaugacacgcau

SEQ ID NO: 784944 - RNA, 28 nt, Human
uuuuaaauaacuauauauauauauaugu

SEQ ID NO: 784945 - RNA, 22 nt, Human
aaacagcccucaacaucagaaa

SEQ ID NO: 784946 - RNA, 22 nt, Human
aaagcaucucaagucucccaaa

SEQ ID NO: 784947 - RNA, 20 nt, Human
aaaggagugggggugagcca

SEQ ID NO: 784948 - RNA, 20 nt, Human
aacgacccugggaaagucag

SEQ ID NO: 784949 - RNA, 18 nt, Human
aacugcuucaccaggaac

SEQ ID NO: 784950 - RNA, 19 nt, Human
aagcaauuaaaacaugaua

SEQ ID NO: 784951 - RNA, 22 nt, Human
aagcacacguucuaaagucaaa

SEQ ID NO: 784952 - RNA, 20 nt, Human
aaggcaacauggcccagagc

SEQ ID NO: 784953 - RNA, 23 nt, Human
aaggcaacauggcccagagcuca

SEQ ID NO: 784954 - RNA, 18 nt, Human
aaguggucuccacgaugc

SEQ ID NO: 784955 - RNA, 24 nt, Human
acaacagaggggccgcggcauggg

SEQ ID NO: 784956 - RNA, 22 nt, Human
acacgcagggcugggcgcugaa

SEQ ID NO: 784957 - RNA, 20 nt, Human
acagagccaaacagcccuca

SEQ ID NO: 784958 - RNA, 20 nt, Human
acucuguguucucuccgcuu

SEQ ID NO: 784959 - RNA, 18 nt, Human
acuggagcccacgugugc

SEQ ID NO: 784960 - RNA, 24 nt, Human
acuggccugcccuuuagacugcgc

SEQ ID NO: 784961 - RNA, 23 nt, Human
agacagagccaaacagcccucaa

SEQ ID NO: 784962 - RNA, 19 nt, Human
agacaggacgccuccuccg

SEQ ID NO: 784963 - RNA, 20 nt, Human
agaugcaguggcuggcugug

SEQ ID NO: 784964 - RNA, 24 nt, Human
agcaucucaagucucccaaauaac

SEQ ID NO: 784965 - RNA, 19 nt, Human
agccaaagcaucucaaguc

SEQ ID NO: 784966 - RNA, 21 nt, Human
agcccacgugugcaccugcag

SEQ ID NO: 784967 - RNA, 21 nt, Human
agccccuagcccaaggcuccu

SEQ ID NO: 784968 - RNA, 28 nt, Human
agcuauacagacagagccaaacagcccu

SEQ ID NO: 784969 - RNA, 25 nt, Human
agcucggcuuuccuuccccagcccc

SEQ ID NO: 784970 - RNA, 22 nt, Human
aggcaacauggcccagagcuca

SEQ ID NO: 784971 - RNA, 19 nt, Human
aggcagagaggagccacug

SEQ ID NO: 784972 - RNA, 22 nt, Human
aggcagccucuacacuugccaa

SEQ ID NO: 784973 - RNA, 21 nt, Human
aggcagcggguccgacccgca

SEQ ID NO: 784974 - RNA, 19 nt, Human
agugggggugagccacugc

SEQ ID NO: 784975 - RNA, 24 nt, Human
agugugcagaccucuggaggagca

SEQ ID NO: 784976 - RNA, 18 nt, Human
augaacaaaaauaaguac

SEQ ID NO: 784977 - RNA, 22 nt, Human
augguccaguaugagcaucuga

SEQ ID NO: 784978 - RNA, 22 nt, Human
caaaguccucacacaaaguucu

SEQ ID NO: 784979 - RNA, 19 nt, Human
caaggcacacauguacgca

SEQ ID NO: 784980 - RNA, 18 nt, Human
caaggggccaccuccccc

SEQ ID NO: 784981 - RNA, 24 nt, Human
cacaucaguggccauccucagaga

SEQ ID NO: 784982 - RNA, 22 nt, Human
cacaucucuuucucuacccuuu

SEQ ID NO: 784983 - RNA, 24 nt, Human
caccgggacccccccgugaagaca

SEQ ID NO: 784984 - RNA, 20 nt, Human
cacugcacgaggcccuuugc

SEQ ID NO: 784985 - RNA, 25 nt, Human
cagaagauccccaggggcaaucuga

SEQ ID NO: 784986 - RNA, 18 nt, Human
cagagcucaccugcaggc

SEQ ID NO: 784987 - RNA, 22 nt, Human
cagcauuuaaaggccgaggcag

SEQ ID NO: 784988 - RNA, 23 nt, Human
cagcauuuaaaggccgaggcaga

SEQ ID NO: 784989 - RNA, 22 nt, Human
cagcggaccgccacgugggccc

SEQ ID NO: 784990 - RNA, 22 nt, Human
cagcucggcuuuccuuccccag

SEQ ID NO: 784991 - RNA, 26 nt, Human
caggccucaggcggccccucccacag

SEQ ID NO: 784992 - RNA, 18 nt, Human
cagggcucaaaggcagag

SEQ ID NO: 784993 - RNA, 22 nt, Human
caucagaaaugagaucagccug

SEQ ID NO: 784994 - RNA, 22 nt, Human
cauguacgcaugacuaaccaag

SEQ ID NO: 784995 - RNA, 23 nt, Human
ccaaacagcccucaacaucagaa

SEQ ID NO: 784996 - RNA, 21 nt, Human
ccacgugugcaccugcagccu

SEQ ID NO: 784997 - RNA, 20 nt, Human
ccacuggagcccacgugugc

SEQ ID NO: 784998 - RNA, 18 nt, Human
ccagagcucaccugcagg

SEQ ID NO: 784999 - RNA, 21 nt, Human
ccagcucuggaaaaacuaucu

SEQ ID NO: 785000 - RNA, 21 nt, Human
cccacaggcccagcucagacc

SEQ ID NO: 785001 - RNA, 22 nt, Human
cccacaugugcuguucugggcu

SEQ ID NO: 785002 - RNA, 22 nt, Human
ccccagccccuagcccaaggcu

SEQ ID NO: 785003 - RNA, 19 nt, Human
ccccgggacccgugggccc

SEQ ID NO: 785004 - RNA, 20 nt, Human
ccccuagcccaaggcuccug

SEQ ID NO: 785005 - RNA, 24 nt, Human
cccgcagcccaggccccgcgggac

SEQ ID NO: 785006 - RNA, 23 nt, Human
cccgcaggugcgcgcgagcagcc

SEQ ID NO: 785007 - RNA, 28 nt, Human
cccgggacccgugggcccgcagcccagg

SEQ ID NO: 785008 - RNA, 18 nt, Human
cccgugggcccgcagccc

SEQ ID NO: 785009 - RNA, 21 nt, Human
cccuggccggggacucagaac

SEQ ID NO: 785010 - RNA, 18 nt, Human
cccuuugccgcgccaccu

SEQ ID NO: 785011 - RNA, 18 nt, Human
ccgcagcagcucauccuu

SEQ ID NO: 785012 - RNA, 20 nt, Human
ccgcagcagcucauccuucc

SEQ ID NO: 785013 - RNA, 24 nt, Human
ccucacucuacugugcaggcugga

SEQ ID NO: 785014 - RNA, 18 nt, Human
cggcaugugaaguggagu

SEQ ID NO: 785015 - RNA, 23 nt, Human
cggcgaacagcggcgcgcacccu

SEQ ID NO: 785016 - RNA, 22 nt, Human
cgggcacgcgguaggcagcggg

SEQ ID NO: 785017 - RNA, 19 nt, Human
cgugggcccgcagcccagg

SEQ ID NO: 785018 - RNA, 20 nt, Human
cucaacaucagaaaugagau

SEQ ID NO: 785019 - RNA, 24 nt, Human
cucacucuacugugcaggcuggac

SEQ ID NO: 785020 - RNA, 22 nt, Human
cucaugcauccuggcuaagacu

SEQ ID NO: 785021 - RNA, 21 nt, Human
cucuauugccacagggcuucc

SEQ ID NO: 785022 - RNA, 20 nt, Human
cugcgcagcugcaaaacggu

SEQ ID NO: 785023 - RNA, 19 nt, Human
cuggccucugaagaggacc

SEQ ID NO: 785024 - RNA, 19 nt, Human
cugggaaggagggcacggg

SEQ ID NO: 785025 - RNA, 21 nt, Human
cuuaaaccacacacagaggca

SEQ ID NO: 785026 - RNA, 20 nt, Human
cuuccagacacuggccugcc

SEQ ID NO: 785027 - RNA, 25 nt, Human
gaaaauauauacaucuuuaaggaac

SEQ ID NO: 785028 - RNA, 18 nt, Human
gaaacugcuucaccagga

SEQ ID NO: 785029 - RNA, 20 nt, Human
gaagacaggacgccuccucc

SEQ ID NO: 785030 - RNA, 20 nt, Human
gaggacaacagcgcacaggc

SEQ ID NO: 785031 - RNA, 22 nt, Human
gaggacccaggaaacuggcgag

SEQ ID NO: 785032 - RNA, 24 nt, Human
gaggggccgcggcauggggcucug

SEQ ID NO: 785033 - RNA, 20 nt, Human
gcagaaugcuccccaggacc

SEQ ID NO: 785034 - RNA, 22 nt, Human
gcagaaugcuccccaggaccag

SEQ ID NO: 785035 - RNA, 21 nt, Human
gcagcccgcggcgaacagcgg

SEQ ID NO: 785036 - RNA, 18 nt, Human
gcagcucauccuuccacu

SEQ ID NO: 785037 - RNA, 19 nt, Human
gcagggcugggcgcugaag

SEQ ID NO: 785038 - RNA, 21 nt, Human
gcaguggcuggcugugguccg

SEQ ID NO: 785039 - RNA, 18 nt, Human
gcccaaggcuccuguuac

SEQ ID NO: 785040 - RNA, 18 nt, Human
gccccucccacaggccca

SEQ ID NO: 785041 - RNA, 23 nt, Human
gccccucccacaggcccagcuca

SEQ ID NO: 785042 - RNA, 22 nt, Human
gcccgcagcccaggccccgcgg

SEQ ID NO: 785043 - RNA, 22 nt, Human
gccgcgccaccuucuguacgac

SEQ ID NO: 785044 - RNA, 19 nt, Human
gcgagaccucaugugaccc

SEQ ID NO: 785045 - RNA, 22 nt, Human
gcgcgacgaggacgccgggcac

SEQ ID NO: 785046 - RNA, 21 nt, Human
gcgcugaagacacagaagauc

SEQ ID NO: 785047 - RNA, 18 nt, Human
ggacccaggaaacuggcg

SEQ ID NO: 785048 - RNA, 19 nt, Human
ggacccaggaaacuggcga

SEQ ID NO: 785049 - RNA, 21 nt, Human
ggcccuuugccgcgccaccuu

SEQ ID NO: 785050 - RNA, 19 nt, Human
ggccgaggcagaaaguggu

SEQ ID NO: 785051 - RNA, 23 nt, Human
ggccguggagugcagagcacccc

SEQ ID NO: 785052 - RNA, 20 nt, Human
ggccucugaagaggacccag

SEQ ID NO: 785053 - RNA, 18 nt, Human
ggggugagccacugccca

SEQ ID NO: 785054 - RNA, 19 nt, Human
ggguccagcugugcagggc

SEQ ID NO: 785055 - RNA, 18 nt, Human
gucaaugucucauuucca

SEQ ID NO: 785056 - RNA, 19 nt, Human
guccaaggagaaacggagu

SEQ ID NO: 785057 - RNA, 20 nt, Human
gucuguucuucucggcugcc

SEQ ID NO: 785058 - RNA, 24 nt, Human
gugaagacaggacgccuccuccga

SEQ ID NO: 785059 - RNA, 22 nt, Human
gugcaccugcagccucuacaac

SEQ ID NO: 785060 - RNA, 19 nt, Human
guggagugcagagcacccc

SEQ ID NO: 785061 - RNA, 20 nt, Human
guggagugcagagcacccca

SEQ ID NO: 785062 - RNA, 21 nt, Human
uaaaggagugggggugagcca

SEQ ID NO: 785063 - RNA, 21 nt, Human
uaacaugaacaaaaauaagua

SEQ ID NO: 785064 - RNA, 24 nt, Human
uaacucaaucagcgaucccuuucu

SEQ ID NO: 785065 - RNA, 22 nt, Human
uaagauugggaagguguuccaa

SEQ ID NO: 785066 - RNA, 26 nt, Human
uacagacagagccaaacagcccucaa

SEQ ID NO: 785067 - RNA, 21 nt, Human
uacuaaauaaaauuaaagguu

SEQ ID NO: 785068 - RNA, 18 nt, Human
uacuuaaaccacacacag

SEQ ID NO: 785069 - RNA, 23 nt, Human
uacuuugauacacuuuacuaaau

SEQ ID NO: 785070 - RNA, 18 nt, Human
uagcgcggcuccgacgcc

SEQ ID NO: 785071 - RNA, 25 nt, Human
uagugcugggaaggagggcacgggg

SEQ ID NO: 785072 - RNA, 18 nt, Human
uaucaggaguuuucagca

SEQ ID NO: 785073 - RNA, 22 nt, Human
ucaaggcaacauggcccagagc

SEQ ID NO: 785074 - RNA, 18 nt, Human
ucagcaaacuauuuaaaa

SEQ ID NO: 785075 - RNA, 26 nt, Human
ucaguggccauccucagagagccccu

SEQ ID NO: 785076 - RNA, 26 nt, Human
uccacaaacacacaucaguggccauc

SEQ ID NO: 785077 - RNA, 22 nt, Human
uccccagccccuagcccaaggc

SEQ ID NO: 785078 - RNA, 19 nt, Human
uccccaggaccagccugcc

SEQ ID NO: 785079 - RNA, 24 nt, Human
uccccgggacccgugggcccgcag

SEQ ID NO: 785080 - RNA, 18 nt, Human
uccgacccgcaggugcgc

SEQ ID NO: 785081 - RNA, 22 nt, Human
uccgggaaacgugacacaugau

SEQ ID NO: 785082 - RNA, 19 nt, Human
uccuguucagaagcggaau

SEQ ID NO: 785083 - RNA, 20 nt, Human
ucucuacccuuuuacuuaca

SEQ ID NO: 785084 - RNA, 20 nt, Human
ucugaacuaagauugggaag

SEQ ID NO: 785085 - RNA, 18 nt, Human
ucuggaaaaacuaucuca

SEQ ID NO: 785086 - RNA, 21 nt, Human
ucugugccgagguguuaaggg

SEQ ID NO: 785087 - RNA, 19 nt, Human
ucuguucuucucggcugcc

SEQ ID NO: 785088 - RNA, 22 nt, Human
ugaaacugcuucaccaggaaca

SEQ ID NO: 785089 - RNA, 18 nt, Human
ugaagacaggacgccucc

SEQ ID NO: 785090 - RNA, 21 nt, Human
ugaagacaggacgccuccucc

SEQ ID NO: 785091 - RNA, 20 nt, Human
ugaagaggacccaggaaacu

SEQ ID NO: 785092 - RNA, 21 nt, Human
ugaagucuuagacugugagag

SEQ ID NO: 785093 - RNA, 18 nt, Human
ugacacaugauagugcug

SEQ ID NO: 785094 - RNA, 21 nt, Human
ugaccggguccgcagaaugcu

SEQ ID NO: 785095 - RNA, 18 nt, Human
ugagaagggccguggagu

SEQ ID NO: 785096 - RNA, 22 nt, Human
ugcagcagaugcaguggcuggc

SEQ ID NO: 785097 - RNA, 20 nt, Human
ugcgcagcugcaaaacgguu

SEQ ID NO: 785098 - RNA, 19 nt, Human
ugcuguucugggcugcugc

SEQ ID NO: 785099 - RNA, 23 nt, Human
ugggaaggagggcacggggcagc

SEQ ID NO: 785100 - RNA, 22 nt, Human
ugggaagguguuccacacuggc

SEQ ID NO: 785101 - RNA, 25 nt, Human
ugggaaguguggcugagaagggccg

SEQ ID NO: 785102 - RNA, 24 nt, Human
ugggagagggcccagccacacauc

SEQ ID NO: 785103 - RNA, 23 nt, Human
ugucaaggcaacauggcccagag

SEQ ID NO: 785104 - RNA, 19 nt, Human
uguuaucaggaguuuucag

SEQ ID NO: 785105 - RNA, 24 nt, Human
uguucugggcugcugcccuggccu

SEQ ID NO: 785106 - RNA, 18 nt, Human
uuaggauggguccagcug

SEQ ID NO: 785107 - RNA, 23 nt, Human
uucugggcugcugcccuggccuc

SEQ ID NO: 785108 - RNA, 18 nt, Human
uuuggauaaccaaagucc

SEQ ID NO: 785109 - RNA, 24 nt, Human
aaaaaagcaaccuguauuaaagcc

SEQ ID NO: 785110 - RNA, 18 nt, Human
aaaaagcuuaucaacagc

SEQ ID NO: 785111 - RNA, 22 nt, Human
aaaacaaaaacaaaaaacacaa

SEQ ID NO: 785112 - RNA, 22 nt, Human
aaacaaaaaacacaauuuccaa

SEQ ID NO: 785113 - RNA, 21 nt, Human
aaacaaaaacaaaaaacacaa

SEQ ID NO: 785114 - RNA, 26 nt, Human
aaacaagagaaaugcaaaggggaccc

SEQ ID NO: 785115 - RNA, 22 nt, Human
aaaccagccagcaaagcucccc

SEQ ID NO: 785116 - RNA, 21 nt, Human
aaagaaagagauaauggaaau

SEQ ID NO: 785117 - RNA, 20 nt, Human
aaaggaaauaauuaaacuuc

SEQ ID NO: 785118 - RNA, 20 nt, Human
aaccagacacaucuuaagca

SEQ ID NO: 785119 - RNA, 18 nt, Human
aagaucacccacuugaaa

SEQ ID NO: 785120 - RNA, 23 nt, Human
aagcagacauaaagacaguugac

SEQ ID NO: 785121 - RNA, 21 nt, Human
aaggagaaaaugguaggguga

SEQ ID NO: 785122 - RNA, 18 nt, Human
aaucuuauuaucucucac

SEQ ID NO: 785123 - RNA, 21 nt, Human
acaaacuuccaccuuuaaauc

SEQ ID NO: 785124 - RNA, 19 nt, Human
acaagcagacauaaagaca

SEQ ID NO: 785125 - RNA, 24 nt, Human
acacuuccaacaaggcacacauaa

SEQ ID NO: 785126 - RNA, 21 nt, Human
acagcaauaugaagugguguc

SEQ ID NO: 785127 - RNA, 24 nt, Human
acagguaagcagacauuucuauac

SEQ ID NO: 785128 - RNA, 23 nt, Human
acgugaacaaauaccauuagaac

SEQ ID NO: 785129 - RNA, 18 nt, Human
acugaaguaagaaaagcu

SEQ ID NO: 785130 - RNA, 22 nt, Human
acugcugcacaauaaauucuga

SEQ ID NO: 785131 - RNA, 18 nt, Human
acugggauuuccccuuag

SEQ ID NO: 785132 - RNA, 18 nt, Human
agaaaacaaaaaggggag

SEQ ID NO: 785133 - RNA, 19 nt, Human
agaaaagauuuuuucuugg

SEQ ID NO: 785134 - RNA, 23 nt, Human
agaauaaaggagaaaaugguagg

SEQ ID NO: 785135 - RNA, 21 nt, Human
agacacaucuuaagcagcaug

SEQ ID NO: 785136 - RNA, 18 nt, Human
agagaagaaaagauuuuu

SEQ ID NO: 785137 - RNA, 19 nt, Human
agauaauggaaauaaggcc

SEQ ID NO: 785138 - RNA, 22 nt, Human
agauuuaaaggagggaaaaaaa

SEQ ID NO: 785139 - RNA, 23 nt, Human
agcuggucaauuugcaauguuua

SEQ ID NO: 785140 - RNA, 18 nt, Human
aggaaaaaccugacaugc

SEQ ID NO: 785141 - RNA, 20 nt, Human
aggagaaaacaaaaagggga

SEQ ID NO: 785142 - RNA, 21 nt, Human
aggagacaauaagauuacaaa

SEQ ID NO: 785143 - RNA, 18 nt, Human
aguuaaacaauguuccuu

SEQ ID NO: 785144 - RNA, 23 nt, Human
aguugacacuuccaacaaggcac

SEQ ID NO: 785145 - RNA, 22 nt, Human
aucaaugccacaaacaguucca

SEQ ID NO: 785146 - RNA, 22 nt, Human
auccuccaugaccaugcugcaa

SEQ ID NO: 785147 - RNA, 22 nt, Human
auccucuuuuuuucucuacacu

SEQ ID NO: 785148 - RNA, 20 nt, Human
augaaggauaacugaucaca

SEQ ID NO: 785149 - RNA, 25 nt, Human
augaaguggugucugucggcgcuug

SEQ ID NO: 785150 - RNA, 22 nt, Human
auugaccaugucuuggauauug

SEQ ID NO: 785151 - RNA, 24 nt, Human
caaaaaauacuauaaagaaagaga

SEQ ID NO: 785152 - RNA, 20 nt, Human
caaagcuccccauugcuuuc

SEQ ID NO: 785153 - RNA, 21 nt, Human
caacaguguaaauguacuuca

SEQ ID NO: 785154 - RNA, 25 nt, Human
caacaugauagucugucugucucuu

SEQ ID NO: 785155 - RNA, 22 nt, Human
caacuuuaccuaaaguuggaag

SEQ ID NO: 785156 - RNA, 18 nt, Human
caaguuaaacaauguucc

SEQ ID NO: 785157 - RNA, 18 nt, Human
cacguuuugcuucaaaag

SEQ ID NO: 785158 - RNA, 21 nt, Human
cacguuuugcuucaaaaguaa

SEQ ID NO: 785159 - RNA, 20 nt, Human
cagcaaagcuccccauugcu

SEQ ID NO: 785160 - RNA, 20 nt, Human
cagcacuaccucgauguagu

SEQ ID NO: 785161 - RNA, 19 nt, Human
cagccagcaaagcucccca

SEQ ID NO: 785162 - RNA, 20 nt, Human
cagcccaauuauacucuagu

SEQ ID NO: 785163 - RNA, 20 nt, Human
caggcuaacaccauaaaaau

SEQ ID NO: 785164 - RNA, 22 nt, Human
caucaaugccacaaacaguucc

SEQ ID NO: 785165 - RNA, 20 nt, Human
cauggaauuguugagacuac

SEQ ID NO: 785166 - RNA, 19 nt, Human
cauguggguaacuuccugu

SEQ ID NO: 785167 - RNA, 20 nt, Human
cauucugcucaccuagcaca

SEQ ID NO: 785168 - RNA, 24 nt, Human
ccaaacacuacucaaugacaacuc

SEQ ID NO: 785169 - RNA, 23 nt, Human
ccaagauguuccacaaacuucca

SEQ ID NO: 785170 - RNA, 20 nt, Human
ccacaaacuuccaccuuuaa

SEQ ID NO: 785171 - RNA, 22 nt, Human
ccaccuuuaaaucacugucuga

SEQ ID NO: 785172 - RNA, 19 nt, Human
ccacuguccugauccuacu

SEQ ID NO: 785173 - RNA, 19 nt, Human
ccuccuucugcacccugag

SEQ ID NO: 785174 - RNA, 24 nt, Human
ccugauauaaucuagcagcaauga

SEQ ID NO: 785175 - RNA, 21 nt, Human
ccugcagaugccaccuuggaa

SEQ ID NO: 785176 - RNA, 24 nt, Human
cuaaagaauuuagguguuucuuga

SEQ ID NO: 785177 - RNA, 24 nt, Human
cuccaugaccaugcugcaaagacu

SEQ ID NO: 785178 - RNA, 25 nt, Human
cuccaugaccaugcugcaaagacug

SEQ ID NO: 785179 - RNA, 25 nt, Human
cucccuuggcauccuggacacauuu

SEQ ID NO: 785180 - RNA, 18 nt, Human
cucugauuggccaaacuc

SEQ ID NO: 785181 - RNA, 20 nt, Human
cugauccuacucuaccccau

SEQ ID NO: 785182 - RNA, 25 nt, Human
cugauccuacucuaccccaucucua

SEQ ID NO: 785183 - RNA, 19 nt, Human
cugcaacaugauagucugu

SEQ ID NO: 785184 - RNA, 19 nt, Human
cugcuaggauaucaucacg

SEQ ID NO: 785185 - RNA, 22 nt, Human
cuuuaugugaacaucaucaguc

SEQ ID NO: 785186 - RNA, 22 nt, Human
gaacaaauuucaaggugauaca

SEQ ID NO: 785187 - RNA, 20 nt, Human
gacauccacguuuugcuuca

SEQ ID NO: 785188 - RNA, 18 nt, Human
gagaacagcaggauugaa

SEQ ID NO: 785189 - RNA, 21 nt, Human
gagcauuaaauccauuauugu

SEQ ID NO: 785190 - RNA, 26 nt, Human
gaugccauuuuuccacuguuguguau

SEQ ID NO: 785191 - RNA, 20 nt, Human
gcgccuucaucuccaaaagc

SEQ ID NO: 785192 - RNA, 21 nt, Human
ggagaaaaugguagggugagg

SEQ ID NO: 785193 - RNA, 24 nt, Human
ggaucucuuccuuuuaacuacaga

SEQ ID NO: 785194 - RNA, 23 nt, Human
gggaagagauggguagcccaugg

SEQ ID NO: 785195 - RNA, 20 nt, Human
guagacacuauguaaacacc

SEQ ID NO: 785196 - RNA, 23 nt, Human
guuuugcuucaaaaguaacuuca

SEQ ID NO: 785197 - RNA, 23 nt, Human
uaaaaacacuggcugaacaaaau

SEQ ID NO: 785198 - RNA, 19 nt, Human
uaaaacaaaaacaaaaaac

SEQ ID NO: 785199 - RNA, 23 nt, Human
uaaaacaaaaacaaaaaacacaa

SEQ ID NO: 785200 - RNA, 19 nt, Human
uaaaaccuacucaauuuaa

SEQ ID NO: 785201 - RNA, 22 nt, Human
uaaaauacacaacugcugcaca

SEQ ID NO: 785202 - RNA, 21 nt, Human
uaacugauacagagaagaaaa

SEQ ID NO: 785203 - RNA, 18 nt, Human
uaagaauucagaaacaaa

SEQ ID NO: 785204 - RNA, 22 nt, Human
uaagaugccauuuuuccacugu

SEQ ID NO: 785205 - RNA, 19 nt, Human
uaagugcuuuuccuuuugg

SEQ ID NO: 785206 - RNA, 18 nt, Human
uacaaaaccagccagcaa

SEQ ID NO: 785207 - RNA, 20 nt, Human
uacaagcagacauaaagaca

SEQ ID NO: 785208 - RNA, 22 nt, Human
uacagaaaacccacaaguacua

SEQ ID NO: 785209 - RNA, 25 nt, Human
uacaucugcaaagcuaaauagaacc

SEQ ID NO: 785210 - RNA, 21 nt, Human
uaccaggucaccaaucugcaa

SEQ ID NO: 785211 - RNA, 25 nt, Human
uaccaugaccuuagaucuugcaaac

SEQ ID NO: 785212 - RNA, 18 nt, Human
uagaaaacaagagaaaug

SEQ ID NO: 785213 - RNA, 21 nt, Human
uagaaagaaccucccuuggca

SEQ ID NO: 785214 - RNA, 18 nt, Human
uagaagaauaaaggagaa

SEQ ID NO: 785215 - RNA, 19 nt, Human
uagcaacaucuccauuggc

SEQ ID NO: 785216 - RNA, 19 nt, Human
uaguauaagcaguaagaac

SEQ ID NO: 785217 - RNA, 25 nt, Human
uaguucaugaauuuaacuaauucuu

SEQ ID NO: 785218 - RNA, 23 nt, Human
uauaaaaacugaaguaagaaaag

SEQ ID NO: 785219 - RNA, 25 nt, Human
uauaacaaaaaauacuauaaagaaa

SEQ ID NO: 785220 - RNA, 21 nt, Human
uaucaccaucuuuauccucug

SEQ ID NO: 785221 - RNA, 23 nt, Human
uaucaggaccuuuggaucucuuc

SEQ ID NO: 785222 - RNA, 18 nt, Human
uaucccagaggacauaug

SEQ ID NO: 785223 - RNA, 19 nt, Human
uaucccagaggacauaugc

SEQ ID NO: 785224 - RNA, 18 nt, Human
uaugcugcgcuauguggg

SEQ ID NO: 785225 - RNA, 21 nt, Human
ucagcccauucuccauguccu

SEQ ID NO: 785226 - RNA, 20 nt, Human
ucaguccauccuccaugacc

SEQ ID NO: 785227 - RNA, 27 nt, Human
uccacaaacuuccaccuuuaaaucacc

SEQ ID NO: 785228 - RNA, 19 nt, Human
uccacugaggagaaaacaa

SEQ ID NO: 785229 - RNA, 19 nt, Human
uccaugaccaugcugcaaa

SEQ ID NO: 785230 - RNA, 21 nt, Human
uccaugaccaugcugcaaaga

SEQ ID NO: 785231 - RNA, 23 nt, Human
uccaugaccaugcugcaaagacu

SEQ ID NO: 785232 - RNA, 24 nt, Human
uccauuggcagcagccuuaacuaa

SEQ ID NO: 785233 - RNA, 23 nt, Human
uccuacucuaccccaucucuaau

SEQ ID NO: 785234 - RNA, 23 nt, Human
uccucugcuucgacauccacguu

SEQ ID NO: 785235 - RNA, 22 nt, Human
uccugcagaugccaccuuggaa

SEQ ID NO: 785236 - RNA, 22 nt, Human
uccuggagacugggaugacagc

SEQ ID NO: 785237 - RNA, 23 nt, Human
ucgaggucgagaucuauauuuac

SEQ ID NO: 785238 - RNA, 23 nt, Human
ucuagugggaagagauggguagc

SEQ ID NO: 785239 - RNA, 22 nt, Human
ucuauaacagcgccuucaucuc

SEQ ID NO: 785240 - RNA, 21 nt, Human
ucuauucauggaacaaauuuc

SEQ ID NO: 785241 - RNA, 19 nt, Human
ucuccauuggcagcagccu

SEQ ID NO: 785242 - RNA, 19 nt, Human
ucucugauuggccaaacuc

SEQ ID NO: 785243 - RNA, 20 nt, Human
ucuguagaaagaaccucccu

SEQ ID NO: 785244 - RNA, 23 nt, Human
ugaaaaaguucuggagaucugcu

SEQ ID NO: 785245 - RNA, 22 nt, Human
ugaaaugaaggauaacugauca

SEQ ID NO: 785246 - RNA, 22 nt, Human
ugaaccagacacaucuuaagca

SEQ ID NO: 785247 - RNA, 24 nt, Human
ugaaggauaacugaucacaaagaa

SEQ ID NO: 785248 - RNA, 18 nt, Human
ugaaugaaugcgugucag

SEQ ID NO: 785249 - RNA, 22 nt, Human
ugacacuuccaacaaggcacac

SEQ ID NO: 785250 - RNA, 21 nt, Human
ugacccagcaaguuuugauau

SEQ ID NO: 785251 - RNA, 20 nt, Human
ugagacuacaaaaccagcca

SEQ ID NO: 785252 - RNA, 20 nt, Human
ugaugcacuccaguccugga

SEQ ID NO: 785253 - RNA, 23 nt, Human
ugaugcagagcauuaaauccauu

SEQ ID NO: 785254 - RNA, 22 nt, Human
ugcaagaugaaaaaguucugga

SEQ ID NO: 785255 - RNA, 18 nt, Human
ugcacuccaguccuggau

SEQ ID NO: 785256 - RNA, 18 nt, Human
ugcaugagucagccaggu

SEQ ID NO: 785257 - RNA, 22 nt, Human
ugcucuaucaccaucuuuaucc

SEQ ID NO: 785258 - RNA, 18 nt, Human
uggaagaugcuauuaccu

SEQ ID NO: 785259 - RNA, 20 nt, Human
uggaagaugcuauuaccuuu

SEQ ID NO: 785260 - RNA, 22 nt, Human
uggaaggaaaggaaaaaccuga

SEQ ID NO: 785261 - RNA, 20 nt, Human
uggauauuguuggcaguuuu

SEQ ID NO: 785262 - RNA, 19 nt, Human
uggcauggaaggaaaggaa

SEQ ID NO: 785263 - RNA, 21 nt, Human
uggccaaacucugcaugaguc

SEQ ID NO: 785264 - RNA, 21 nt, Human
uggcucaaaaugaaauaacaa

SEQ ID NO: 785265 - RNA, 21 nt, Human
ugguauguuguauguguaugu

SEQ ID NO: 785266 - RNA, 22 nt, Human
ugguauguuguauguguauguu

SEQ ID NO: 785267 - RNA, 19 nt, Human
uguaaaaaugacccagcaa

SEQ ID NO: 785268 - RNA, 20 nt, Human
uguaaacaccugauauaauc

SEQ ID NO: 785269 - RNA, 19 nt, Human
uguaggguuuuuuguucug

SEQ ID NO: 785270 - RNA, 25 nt, Human
ugucuaauauauuccuacacuaaua

SEQ ID NO: 785271 - RNA, 23 nt, Human
uguguaaaaccacgaugaaauga

SEQ ID NO: 785272 - RNA, 19 nt, Human
uuaaaaugugccucucccc

SEQ ID NO: 785273 - RNA, 21 nt, Human
uuaaacagccagaaacagugu

SEQ ID NO: 785274 - RNA, 19 nt, Human
uuaccaggucaccaaucug

SEQ ID NO: 785275 - RNA, 21 nt, Human
uuauugcuuauuuuuccuuuu

SEQ ID NO: 785276 - RNA, 22 nt, Human
uucaguuuugcaagaugaaaaa

SEQ ID NO: 785277 - RNA, 24 nt, Human
uuccaccuuuaaaucacugucuga

SEQ ID NO: 785278 - RNA, 20 nt, Human
uuccaggucauaacaaacuu

SEQ ID NO: 785279 - RNA, 20 nt, Human
uuccuguugccauucugcuc

SEQ ID NO: 785280 - RNA, 22 nt, Human
uugaugcacuccaguccuggau

SEQ ID NO: 785281 - RNA, 30 nt, Human
uugcauagcuguguggccagcacauugccu

SEQ ID NO: 785282 - RNA, 19 nt, Human
uuggauuaaaaaaagcaac

SEQ ID NO: 785283 - RNA, 19 nt, Human
uuuaaaggagggaaaaaaa

SEQ ID NO: 785284 - RNA, 26 nt, Human
uuucaucacaaaaaauacaaaaaacu

SEQ ID NO: 785285 - RNA, 21 nt, Human
cugcggcugcugcuucugcug

SEQ ID NO: 785286 - RNA, 21 nt, Human
gagcggcaguagcggcucagg

SEQ ID NO: 785287 - RNA, 23 nt, Human
ugcuggcagaaggcggaaaaaaa

SEQ ID NO: 785288 - RNA, 28 nt, Human
uggcagaaggcggaaaaaaagggacccc

SEQ ID NO: 785289 - RNA, 19 nt, Human
aaaaaaaaaacccauacac

SEQ ID NO: 785290 - RNA, 22 nt, Human
aaaaaaaaacccauacacacug

SEQ ID NO: 785291 - RNA, 21 nt, Human
aaaacaagaauaugaacaaaa

SEQ ID NO: 785292 - RNA, 21 nt, Human
aaaacagagccacaacuguga

SEQ ID NO: 785293 - RNA, 24 nt, Human
aaaaucucaguaagaaaccaugua

SEQ ID NO: 785294 - RNA, 23 nt, Human
aaacaacauaaaauccugaaacu

SEQ ID NO: 785295 - RNA, 23 nt, Human
aaagagaagccuauggccaccaa

SEQ ID NO: 785296 - RNA, 18 nt, Human
aaagcuugcaccuaggga

SEQ ID NO: 785297 - RNA, 23 nt, Human
aacaagaaaaagcuugcaccuag

SEQ ID NO: 785298 - RNA, 21 nt, Human
aacagaggaauuacaucugga

SEQ ID NO: 785299 - RNA, 18 nt, Human
aacccauacacacugaau

SEQ ID NO: 785300 - RNA, 19 nt, Human
aacugugaacagaaaagca

SEQ ID NO: 785301 - RNA, 18 nt, Human
aacuuuaccugaaccaga

SEQ ID NO: 785302 - RNA, 19 nt, Human
aagccaguuucuauacuga

SEQ ID NO: 785303 - RNA, 19 nt, Human
aaucccaauuuugaauguu

SEQ ID NO: 785304 - RNA, 24 nt, Human
acagaugcaaguauaaucuaaaaa

SEQ ID NO: 785305 - RNA, 18 nt, Human
accaccuucuuugcuguc

SEQ ID NO: 785306 - RNA, 22 nt, Human
accuucaccaccuucuuugcug

SEQ ID NO: 785307 - RNA, 20 nt, Human
agaaaaagcuugcaccuagg

SEQ ID NO: 785308 - RNA, 18 nt, Human
agaacagcacagaagagg

SEQ ID NO: 785309 - RNA, 24 nt, Human
agagggauuucugcugcaggugac

SEQ ID NO: 785310 - RNA, 21 nt, Human
aggagggaccuaaucuugaau

SEQ ID NO: 785311 - RNA, 21 nt, Human
aggcacaacagucacugaacu

SEQ ID NO: 785312 - RNA, 21 nt, Human
agggguuugcauucaugaugu

SEQ ID NO: 785313 - RNA, 21 nt, Human
aguggcaucuccuugagcaac

SEQ ID NO: 785314 - RNA, 22 nt, Human
auaaaauccugaaacuggauag

SEQ ID NO: 785315 - RNA, 24 nt, Human
auauaaaaucucaguaagaaacca

SEQ ID NO: 785316 - RNA, 22 nt, Human
auauuaagauaguuacagagca

SEQ ID NO: 785317 - RNA, 22 nt, Human
auuacaucuggaucauacgauu

SEQ ID NO: 785318 - RNA, 24 nt, Human
caaaacaguucuuuugucaaacag

SEQ ID NO: 785319 - RNA, 25 nt, Human
cauucuuaaaaaacagagccacaac

SEQ ID NO: 785320 - RNA, 23 nt, Human
ccuauggccaccaaggccggggc

SEQ ID NO: 785321 - RNA, 19 nt, Human
cuggagggguuugcauuca

SEQ ID NO: 785322 - RNA, 25 nt, Human
gaauaugaacaaaacauuuuaaaau

SEQ ID NO: 785323 - RNA, 20 nt, Human
gacugcauagcauuuaaaac

SEQ ID NO: 785324 - RNA, 23 nt, Human
gagccacaacugugaacagaaaa

SEQ ID NO: 785325 - RNA, 18 nt, Human
ggagucuaaauuugugga

SEQ ID NO: 785326 - RNA, 20 nt, Human
ggaucauacgauucccucag

SEQ ID NO: 785327 - RNA, 23 nt, Human
guaaaauaaacagauauauagua

SEQ ID NO: 785328 - RNA, 22 nt, Human
gucacauugggaaaucccaauu

SEQ ID NO: 785329 - RNA, 18 nt, Human
uaaaacaagaauaugaac

SEQ ID NO: 785330 - RNA, 26 nt, Human
uaaaacaagaauaugaacaaaacauu

SEQ ID NO: 785331 - RNA, 25 nt, Human
uaaagucacagaugcaaguauaauc

SEQ ID NO: 785332 - RNA, 19 nt, Human
uacauucuuaaaaaacaga

SEQ ID NO: 785333 - RNA, 18 nt, Human
uaccaguaggcagccugg

SEQ ID NO: 785334 - RNA, 25 nt, Human
uacugaaauaacuguguauaaaaca

SEQ ID NO: 785335 - RNA, 21 nt, Human
uagaguaaaauacaaccuauu

SEQ ID NO: 785336 - RNA, 22 nt, Human
uauaaaacaagaauaugaacaa

SEQ ID NO: 785337 - RNA, 24 nt, Human
ucaaaauaaaaaaaaaaacccaua

SEQ ID NO: 785338 - RNA, 18 nt, Human
ucacagauaaguuuucuc

SEQ ID NO: 785339 - RNA, 18 nt, Human
ucagacuuugguuaggga

SEQ ID NO: 785340 - RNA, 22 nt, Human
ucccucagaggcacaacaguca

SEQ ID NO: 785341 - RNA, 22 nt, Human
uccgcaggggaggugcuggcug

SEQ ID NO: 785342 - RNA, 18 nt, Human
ucuuaaggacuucugauu

SEQ ID NO: 785343 - RNA, 18 nt, Human
ugaaaaagacaauaugga

SEQ ID NO: 785344 - RNA, 23 nt, Human
ugaaaaagacaauauggaaagag

SEQ ID NO: 785345 - RNA, 24 nt, Human
ugaagagggauuucugcugcaggu

SEQ ID NO: 785346 - RNA, 21 nt, Human
uggaaagaguauugguagaag

SEQ ID NO: 785347 - RNA, 21 nt, Human
uggaaugugucuuuugcuagu

SEQ ID NO: 785348 - RNA, 19 nt, Human
uggcaauaaagccaguuuc

SEQ ID NO: 785349 - RNA, 23 nt, Human
ugggcuggagggguuugcauuca

SEQ ID NO: 785350 - RNA, 18 nt, Human
ugugucaacguggcuggu

SEQ ID NO: 785351 - RNA, 22 nt, Human
uuaaaaaaaaaauaaaguaaaa

SEQ ID NO: 785352 - RNA, 18 nt, Human
uuaaaaaacagagccaca

SEQ ID NO: 785353 - RNA, 27 nt, Human
uuaagagucaaaauaaaaaaaaaaacc

SEQ ID NO: 785354 - RNA, 19 nt, Human
uuauaaaacaagaauauga

SEQ ID NO: 785355 - RNA, 24 nt, Human
uucugauucccuaacagucagacu

SEQ ID NO: 785356 - RNA, 27 nt, Human
uucuuugcugucacuugucuuaaggac

SEQ ID NO: 785357 - RNA, 20 nt, Human
uugaauguuaaaauauacaa

SEQ ID NO: 785358 - RNA, 18 nt, Human
uugcugguguaucuacug

SEQ ID NO: 785359 - RNA, 20 nt, Human
uugcugguguaucuacugug

SEQ ID NO: 785360 - RNA, 27 nt, Human
uuuaaaaaaacacuuggcaauaaagcc

SEQ ID NO: 785361 - RNA, 25 nt, Human
uuucugcugcaggugacugacgcaa

SEQ ID NO: 785362 - RNA, 20 nt, Human
aaaacucucucuucccacaa

SEQ ID NO: 785363 - RNA, 19 nt, Human
aaacuccacucuguggcug

SEQ ID NO: 785364 - RNA, 20 nt, Human
aaagcccaucucugcuuuuc

SEQ ID NO: 785365 - RNA, 27 nt, Human
aaaggcagauuccuuugugccagaucc

SEQ ID NO: 785366 - RNA, 21 nt, Human
aaaggcuuuuugauaugggau

SEQ ID NO: 785367 - RNA, 20 nt, Human
aacuaguuagucuugacuuu

SEQ ID NO: 785368 - RNA, 18 nt, Human
aagaaggcuggguggagg

SEQ ID NO: 785369 - RNA, 24 nt, Human
aauacagagaugggguuucaccgu

SEQ ID NO: 785370 - RNA, 19 nt, Human
acagagaugggguuucacc

SEQ ID NO: 785371 - RNA, 18 nt, Human
acagccuccaucucucuu

SEQ ID NO: 785372 - RNA, 18 nt, Human
acagguguaagccaccgc

SEQ ID NO: 785373 - RNA, 20 nt, Human
accaacaccaacaaaauguc

SEQ ID NO: 785374 - RNA, 24 nt, Human
acccaggcuggagugcagcggcau

SEQ ID NO: 785375 - RNA, 22 nt, Human
acguaacaggaugcuagugaga

SEQ ID NO: 785376 - RNA, 19 nt, Human
acuacaggugcgugccacc

SEQ ID NO: 785377 - RNA, 18 nt, Human
acuucguccagcucugcc

SEQ ID NO: 785378 - RNA, 19 nt, Human
agagaugggguuucaccgu

SEQ ID NO: 785379 - RNA, 22 nt, Human
agaggcuacuagggaccacugc

SEQ ID NO: 785380 - RNA, 24 nt, Human
agcacuuugggaggccgagguggg

SEQ ID NO: 785381 - RNA, 20 nt, Human
aggaaacacucuugaaauga

SEQ ID NO: 785382 - RNA, 19 nt, Human
aggagcacgugugaugggg

SEQ ID NO: 785383 - RNA, 24 nt, Human
aggagcacgugugauggggggugg

SEQ ID NO: 785384 - RNA, 21 nt, Human
aggccgaggugggcauaucac

SEQ ID NO: 785385 - RNA, 24 nt, Human
aggugcaguggcucacgucuguaa

SEQ ID NO: 785386 - RNA, 19 nt, Human
aggugggcauaucacgagg

SEQ ID NO: 785387 - RNA, 19 nt, Human
agucaugacacagggggca

SEQ ID NO: 785388 - RNA, 18 nt, Human
agugaaagaaggcugggu

SEQ ID NO: 785389 - RNA, 18 nt, Human
agugagacaaguccccgu

SEQ ID NO: 785390 - RNA, 24 nt, Human
agugauucuccugccucagccucc

SEQ ID NO: 785391 - RNA, 24 nt, Human
agugcagcggcaugaucuuggcuc

SEQ ID NO: 785392 - RNA, 24 nt, Human
aguggcucacgucuguaaucccag

SEQ ID NO: 785393 - RNA, 22 nt, Human
auacacaucugggaacacaccc

SEQ ID NO: 785394 - RNA, 19 nt, Human
auacagagaugggguuuca

SEQ ID NO: 785395 - RNA, 24 nt, Human
auacagagaugggguuucaccgug

SEQ ID NO: 785396 - RNA, 22 nt, Human
auaggcuuucucugggucaaaa

SEQ ID NO: 785397 - RNA, 20 nt, Human
auccucucacuccagaguuu

SEQ ID NO: 785398 - RNA, 18 nt, Human
augggguuucaccguguu

SEQ ID NO: 785399 - RNA, 19 nt, Human
augggguuucaccguguua

SEQ ID NO: 785400 - RNA, 20 nt, Human
augggguuucaccguguuag

SEQ ID NO: 785401 - RNA, 24 nt, Human
augggguuucaccguguuagccag

SEQ ID NO: 785402 - RNA, 23 nt, Human
caaagccugggauuacaggugua

SEQ ID NO: 785403 - RNA, 21 nt, Human
caaaucccaaccagucaaggg

SEQ ID NO: 785404 - RNA, 20 nt, Human
caagugauucuccugccuca

SEQ ID NO: 785405 - RNA, 22 nt, Human
caagugauucuccugccucagc

SEQ ID NO: 785406 - RNA, 18 nt, Human
cacaaccuaccuaccucc

SEQ ID NO: 785407 - RNA, 21 nt, Human
cacagaaagcuccacacucca

SEQ ID NO: 785408 - RNA, 22 nt, Human
caccaacaccaacaaaaugucc

SEQ ID NO: 785409 - RNA, 21 nt, Human
cacccuccagcccauugagcu

SEQ ID NO: 785410 - RNA, 18 nt, Human
caccguguuagccaggau

SEQ ID NO: 785411 - RNA, 24 nt, Human
caccguguuagccaggauggucuc

SEQ ID NO: 785412 - RNA, 24 nt, Human
cacgucuguaaucccagcacuuug

SEQ ID NO: 785413 - RNA, 21 nt, Human
cacugcaaccuccgccucccg

SEQ ID NO: 785414 - RNA, 23 nt, Human
cacugcaaccuccgccucccggg

SEQ ID NO: 785415 - RNA, 21 nt, Human
cacugcauaacuuccauaggc

SEQ ID NO: 785416 - RNA, 18 nt, Human
cacuuugguucucugcau

SEQ ID NO: 785417 - RNA, 24 nt, Human
cagcacuuugggaggccgaggugg

SEQ ID NO: 785418 - RNA, 20 nt, Human
cagccuccugaguagccggg

SEQ ID NO: 785419 - RNA, 23 nt, Human
caucaggccucuccucuccccug

SEQ ID NO: 785420 - RNA, 23 nt, Human
caucauccccauuagcuugagag

SEQ ID NO: 785421 - RNA, 24 nt, Human
caugauccggcugccucggccucc

SEQ ID NO: 785422 - RNA, 20 nt, Human
ccaaagccugggauuacagg

SEQ ID NO: 785423 - RNA, 23 nt, Human
ccaaagccugggauuacaggugu

SEQ ID NO: 785424 - RNA, 24 nt, Human
ccaacaccaacaaaauguccauua

SEQ ID NO: 785425 - RNA, 22 nt, Human
ccacagaaagcuccacacucca

SEQ ID NO: 785426 - RNA, 20 nt, Human
ccaccacgcucagguaauuu

SEQ ID NO: 785427 - RNA, 18 nt, Human
ccauaggcuuucucuggg

SEQ ID NO: 785428 - RNA, 24 nt, Human
cccaaagccugggauuacaggugu

SEQ ID NO: 785429 - RNA, 20 nt, Human
cccaucagcuuugcagcagc

SEQ ID NO: 785430 - RNA, 21 nt, Human
ccccaggacuaaucacucccu

SEQ ID NO: 785431 - RNA, 25 nt, Human
ccccaggacuaaucacucccugaug

SEQ ID NO: 785432 - RNA, 18 nt, Human
ccccaucaggccucuccu

SEQ ID NO: 785433 - RNA, 21 nt, Human
cccccaaaaagccuuuaguuu

SEQ ID NO: 785434 - RNA, 21 nt, Human
cccggguucaagugauucucc

SEQ ID NO: 785435 - RNA, 23 nt, Human
cccggguucaagugauucuccug

SEQ ID NO: 785436 - RNA, 24 nt, Human
ccucccggguucaagugauucucc

SEQ ID NO: 785437 - RNA, 24 nt, Human
ccugaguagccgggacuacaggug

SEQ ID NO: 785438 - RNA, 23 nt, Human
ccugccucagccuccugaguagc

SEQ ID NO: 785439 - RNA, 18 nt, Human
ccuggcuaacacggugaa

SEQ ID NO: 785440 - RNA, 22 nt, Human
ccuugcaccaacaccaacaaaa

SEQ ID NO: 785441 - RNA, 24 nt, Human
cgagaucauccuggcuaacacggu

SEQ ID NO: 785442 - RNA, 18 nt, Human
cgcugcaugcaggcugcc

SEQ ID NO: 785443 - RNA, 21 nt, Human
cgggacuacaggugcgugcca

SEQ ID NO: 785444 - RNA, 24 nt, Human
cgucuguaaucccagcacuuuggg

SEQ ID NO: 785445 - RNA, 23 nt, Human
cuaaaggcaaacaagcuucuuca

SEQ ID NO: 785446 - RNA, 19 nt, Human
cuaccucccgcuacuaucu

SEQ ID NO: 785447 - RNA, 23 nt, Human
cuacuccaaagaauaaaaaaccc

SEQ ID NO: 785448 - RNA, 24 nt, Human
cucacgucuguaaucccagcacuu

SEQ ID NO: 785449 - RNA, 24 nt, Human
cucacugcaaccuccgccucccgg

SEQ ID NO: 785450 - RNA, 20 nt, Human
cucccggguucaagugauuc

SEQ ID NO: 785451 - RNA, 24 nt, Human
cuccugaccucaugauccggcugc

SEQ ID NO: 785452 - RNA, 23 nt, Human
cucugucacccaggcuggagugc

SEQ ID NO: 785453 - RNA, 23 nt, Human
cugcaaccuccgccucccggguu

SEQ ID NO: 785454 - RNA, 24 nt, Human
cugcaaccuccgccucccggguuc

SEQ ID NO: 785455 - RNA, 23 nt, Human
cugccaggcugauggcuacuggu

SEQ ID NO: 785456 - RNA, 22 nt, Human
cugccucagccuccugaguagc

SEQ ID NO: 785457 - RNA, 21 nt, Human
cugccucggccucccaaagcc

SEQ ID NO: 785458 - RNA, 18 nt, Human
cugcugaaagcccaucuc

SEQ ID NO: 785459 - RNA, 24 nt, Human
cuggagugcagcggcaugaucuug

SEQ ID NO: 785460 - RNA, 18 nt, Human
cuggcuaacacggugaaa

SEQ ID NO: 785461 - RNA, 18 nt, Human
cugucacccaggcuggag

SEQ ID NO: 785462 - RNA, 19 nt, Human
cugucacccaggcuggagu

SEQ ID NO: 785463 - RNA, 20 nt, Human
cuuuaguuuagacucuguuu

SEQ ID NO: 785464 - RNA, 19 nt, Human
cuuugugccagauccuuuc

SEQ ID NO: 785465 - RNA, 21 nt, Human
gaaacccacaaauuuccuaag

SEQ ID NO: 785466 - RNA, 21 nt, Human
gacccccaaaaagccuuuagu

SEQ ID NO: 785467 - RNA, 22 nt, Human
gaccucaugauccggcugccuc

SEQ ID NO: 785468 - RNA, 21 nt, Human
gacuugagacggaggaaaggc

SEQ ID NO: 785469 - RNA, 24 nt, Human
gagaugggguuucaccguguuagc

SEQ ID NO: 785470 - RNA, 20 nt, Human
gagcaaaucccaaccaguca

SEQ ID NO: 785471 - RNA, 21 nt, Human
gaggaaaagggagggccagag

SEQ ID NO: 785472 - RNA, 23 nt, Human
gaggugggcauaucacgagguca

SEQ ID NO: 785473 - RNA, 18 nt, Human
gauuacagguguaagcca

SEQ ID NO: 785474 - RNA, 22 nt, Human
gauuacagguguaagccaccgc

SEQ ID NO: 785475 - RNA, 19 nt, Human
gcaccaacaccaacaaaau

SEQ ID NO: 785476 - RNA, 21 nt, Human
gcagcggcaugaucuuggcuc

SEQ ID NO: 785477 - RNA, 20 nt, Human
gccggaagcagggacaagug

SEQ ID NO: 785478 - RNA, 18 nt, Human
gcuaacacggugaaaccc

SEQ ID NO: 785479 - RNA, 19 nt, Human
gcucuuaguuugccaucca

SEQ ID NO: 785480 - RNA, 18 nt, Human
gcugaauaugcaaugguu

SEQ ID NO: 785481 - RNA, 19 nt, Human
gcuggagugcagcggcaug

SEQ ID NO: 785482 - RNA, 19 nt, Human
gcuuuauuuuuucuccaca

SEQ ID NO: 785483 - RNA, 19 nt, Human
ggaaugggugacugugggc

SEQ ID NO: 785484 - RNA, 24 nt, Human
ggacccaucucaagagcucugugg

SEQ ID NO: 785485 - RNA, 20 nt, Human
ggagaguuuugaacucuggc

SEQ ID NO: 785486 - RNA, 24 nt, Human
ggauggucucgaucuccugaccuc

SEQ ID NO: 785487 - RNA, 22 nt, Human
ggauuacagguguaagccaccg

SEQ ID NO: 785488 - RNA, 18 nt, Human
ggcauaucacgaggucag

SEQ ID NO: 785489 - RNA, 18 nt, Human
ggcauaucacgaggucag

SEQ ID NO: 785490 - RNA, 23 nt, Human
gggacuacaggugcgugccacca

SEQ ID NO: 785491 - RNA, 19 nt, Human
gggggguggggugaauaag

SEQ ID NO: 785492 - RNA, 22 nt, Human
gggguuucaccguguuagccag

SEQ ID NO: 785493 - RNA, 19 nt, Human
gggucaaaacgaggccagu

SEQ ID NO: 785494 - RNA, 22 nt, Human
ggguucaagugauucuccugcc

SEQ ID NO: 785495 - RNA, 22 nt, Human
ggguuucaccguguuagccagg

SEQ ID NO: 785496 - RNA, 18 nt, Human
gugauggggggugggggg

SEQ ID NO: 785497 - RNA, 24 nt, Human
gugauucuccugccucagccuccu

SEQ ID NO: 785498 - RNA, 20 nt, Human
gugugauggggggugggggg

SEQ ID NO: 785499 - RNA, 19 nt, Human
guucaaaggacaugcugug

SEQ ID NO: 785500 - RNA, 23 nt, Human
guuuugaacucuggcuaaaccag

SEQ ID NO: 785501 - RNA, 20 nt, Human
uaaaagauaccaucuuccau

SEQ ID NO: 785502 - RNA, 23 nt, Human
uaaaauucccaaguaauacacau

SEQ ID NO: 785503 - RNA, 18 nt, Human
uaauuuuuuguauuuuua

SEQ ID NO: 785504 - RNA, 19 nt, Human
uacaggugcgugccaccac

SEQ ID NO: 785505 - RNA, 22 nt, Human
uacagguguaagccaccgcgcc

SEQ ID NO: 785506 - RNA, 22 nt, Human
uaccaucuuccauuccuacccc

SEQ ID NO: 785507 - RNA, 21 nt, Human
uacuagggaccacugcaagcu

SEQ ID NO: 785508 - RNA, 21 nt, Human
uacuaucugccucuuuccugc

SEQ ID NO: 785509 - RNA, 19 nt, Human
uacugagacugacucacaa

SEQ ID NO: 785510 - RNA, 18 nt, Human
uagcagaaguuugagaag

SEQ ID NO: 785511 - RNA, 19 nt, Human
uagcauauaaaagauacca

SEQ ID NO: 785512 - RNA, 19 nt, Human
ucaagugauucuccugccu

SEQ ID NO: 785513 - RNA, 18 nt, Human
ucacccaggcuggagugc

SEQ ID NO: 785514 - RNA, 24 nt, Human
ucaccguguuagccaggauggucu

SEQ ID NO: 785515 - RNA, 24 nt, Human
ucacgaggucagaaaaucgagauc

SEQ ID NO: 785516 - RNA, 18 nt, Human
ucacuccagaguuuuaag

SEQ ID NO: 785517 - RNA, 23 nt, Human
ucacugcaaccuccgccucccgg

SEQ ID NO: 785518 - RNA, 24 nt, Human
ucacugcaaccuccgccucccggg

SEQ ID NO: 785519 - RNA, 25 nt, Human
ucacugcaaccuccgccucccgggu

SEQ ID NO: 785520 - RNA, 27 nt, Human
ucacugcaaccuccgccucccggguuc

SEQ ID NO: 785521 - RNA, 19 nt, Human
ucauaauuucuuuugaccu

SEQ ID NO: 785522 - RNA, 25 nt, Human
ucauucauauguauguauauauuuc

SEQ ID NO: 785523 - RNA, 20 nt, Human
uccaaagaauaaaaaacccc

SEQ ID NO: 785524 - RNA, 23 nt, Human
uccaaagaauaaaaaaccccaag

SEQ ID NO: 785525 - RNA, 22 nt, Human
ucccaaagccugggauuacagg

SEQ ID NO: 785526 - RNA, 24 nt, Human
ucccaaagccugggauuacaggug

SEQ ID NO: 785527 - RNA, 19 nt, Human
uccccaugacauuuggggg

SEQ ID NO: 785528 - RNA, 19 nt, Human
uccccgugaaaggagagac

SEQ ID NO: 785529 - RNA, 21 nt, Human
ucccggguucaagugauucuc

SEQ ID NO: 785530 - RNA, 24 nt, Human
ucccggguucaagugauucuccug

SEQ ID NO: 785531 - RNA, 25 nt, Human
ucccucucuccccaugacauuuggg

SEQ ID NO: 785532 - RNA, 24 nt, Human
uccugaguagccgggacuacaggu

SEQ ID NO: 785533 - RNA, 18 nt, Human
ucguggaggaaaagggag

SEQ ID NO: 785534 - RNA, 24 nt, Human
ucuccugccucagccuccugagua

SEQ ID NO: 785535 - RNA, 31 nt, Human
ucugccucuuuccugcuuuauuuuuucuccc

SEQ ID NO: 785536 - RNA, 19 nt, Human
ucugccuuucugaaacugc

SEQ ID NO: 785537 - RNA, 20 nt, Human
ucugccuuucugaaacugcu

SEQ ID NO: 785538 - RNA, 21 nt, Human
ucuguaaugauuuuccaacuu

SEQ ID NO: 785539 - RNA, 24 nt, Human
ucugucacccaggcuggagugcag

SEQ ID NO: 785540 - RNA, 22 nt, Human
ucuuacucccaguuuaguuggg

SEQ ID NO: 785541 - RNA, 23 nt, Human
ucuugcucugucacccaggcugg

SEQ ID NO: 785542 - RNA, 24 nt, Human
ucuugcucugucacccaggcugga

SEQ ID NO: 785543 - RNA, 22 nt, Human
ugaagaguagcucugagggagc

SEQ ID NO: 785544 - RNA, 23 nt, Human
ugaauuuccccaggacuaaucac

SEQ ID NO: 785545 - RNA, 22 nt, Human
ugacuaagucuuacucccaguu

SEQ ID NO: 785546 - RNA, 23 nt, Human
ugagaaagaugagagagucugcc

SEQ ID NO: 785547 - RNA, 18 nt, Human
ugagacggaggaaaggca

SEQ ID NO: 785548 - RNA, 21 nt, Human
ugaggcucuguaacaaccuuu

SEQ ID NO: 785549 - RNA, 19 nt, Human
ugaguuggaaggaguccgc

SEQ ID NO: 785550 - RNA, 21 nt, Human
ugauggggggugggggggugg

SEQ ID NO: 785551 - RNA, 20 nt, Human
ugauucuccugccucagccu

SEQ ID NO: 785552 - RNA, 20 nt, Human
ugcagcagcuugcaucacuc

SEQ ID NO: 785553 - RNA, 18 nt, Human
ugccauaccacagaaagc

SEQ ID NO: 785554 - RNA, 21 nt, Human
ugccauaccacagaaagcucc

SEQ ID NO: 785555 - RNA, 24 nt, Human
ugccucagccuccugaguagccgg

SEQ ID NO: 785556 - RNA, 19 nt, Human
ugccucggccucccaaagc

SEQ ID NO: 785557 - RNA, 23 nt, Human
ugccucggccucccaaagccugg

SEQ ID NO: 785558 - RNA, 24 nt, Human
ugccucggccucccaaagccuggg

SEQ ID NO: 785559 - RNA, 24 nt, Human
ugcucugucacccaggcuggagug

SEQ ID NO: 785560 - RNA, 22 nt, Human
ugcuuugggaagugucuagagg

SEQ ID NO: 785561 - RNA, 18 nt, Human
uggaaagguuuuucuugu

SEQ ID NO: 785562 - RNA, 18 nt, Human
uggaaugggugacugugg

SEQ ID NO: 785563 - RNA, 23 nt, Human
uggaggaaaagggagggccagag

SEQ ID NO: 785564 - RNA, 19 nt, Human
uggagucuugcucugucac

SEQ ID NO: 785565 - RNA, 19 nt, Human
uggagugcagcggcaugau

SEQ ID NO: 785566 - RNA, 24 nt, Human
uggagugcagcggcaugaucuugg

SEQ ID NO: 785567 - RNA, 25 nt, Human
uggauaaacacaaguuugccuccug

SEQ ID NO: 785568 - RNA, 21 nt, Human
uggcaaccuaacuuuaacuga

SEQ ID NO: 785569 - RNA, 18 nt, Human
uggcaggggcaccaacuc

SEQ ID NO: 785570 - RNA, 24 nt, Human
uggcucacgucuguaaucccagca

SEQ ID NO: 785571 - RNA, 23 nt, Human
uggcugggucucacccuccagcc

SEQ ID NO: 785572 - RNA, 18 nt, Human
ugggaagugucuagaggc

SEQ ID NO: 785573 - RNA, 24 nt, Human
ugggaggccgaggugggcauauca

SEQ ID NO: 785574 - RNA, 20 nt, Human
ugggauagucugcaacagcu

SEQ ID NO: 785575 - RNA, 23 nt, Human
ugggaugggcagcugccaggcuu

SEQ ID NO: 785576 - RNA, 18 nt, Human
ugggauuacagguguaag

SEQ ID NO: 785577 - RNA, 19 nt, Human
ugggauuacagguguaagc

SEQ ID NO: 785578 - RNA, 21 nt, Human
ugggauuacagguguaagcca

SEQ ID NO: 785579 - RNA, 22 nt, Human
ugggauuacagguguaagccac

SEQ ID NO: 785580 - RNA, 23 nt, Human
ugggauuacagguguaagccacc

SEQ ID NO: 785581 - RNA, 24 nt, Human
ugggauuacagguguaagccaccg

SEQ ID NO: 785582 - RNA, 21 nt, Human
ugggcagcugccaggcugaug

SEQ ID NO: 785583 - RNA, 26 nt, Human
uggggccacgagcagagcaccuguga

SEQ ID NO: 785584 - RNA, 25 nt, Human
uggggggguggggugaauaagcuga

SEQ ID NO: 785585 - RNA, 21 nt, Human
ugggggguggggggguggggu

SEQ ID NO: 785586 - RNA, 24 nt, Human
ugggguuucaccguguuagccagg

SEQ ID NO: 785587 - RNA, 21 nt, Human
ugggugacugugggcauggga

SEQ ID NO: 785588 - RNA, 18 nt, Human
uggguggaggugacagcg

SEQ ID NO: 785589 - RNA, 18 nt, Human
uguaguagugagagaaca

SEQ ID NO: 785590 - RNA, 22 nt, Human
ugugaggaaacccacaaauuuc

SEQ ID NO: 785591 - RNA, 20 nt, Human
ugugaugggggguggggggg

SEQ ID NO: 785592 - RNA, 25 nt, Human
uguucuguauaccucuuauaauuca

SEQ ID NO: 785593 - RNA, 21 nt, Human
uuaugucauaugucaugucau

SEQ ID NO: 785594 - RNA, 25 nt, Human
uucaagaaacugugauccugugcgg

SEQ ID NO: 785595 - RNA, 21 nt, Human
uucaagugauucuccugccuc

SEQ ID NO: 785596 - RNA, 23 nt, Human
uucaagugauucuccugccucag

SEQ ID NO: 785597 - RNA, 24 nt, Human
uucaagugauucuccugccucagc

SEQ ID NO: 785598 - RNA, 18 nt, Human
uucuuuggggccacgagc

SEQ ID NO: 785599 - RNA, 31 nt, Human
uugaacauaggccaggugcaguggcucacgg

SEQ ID NO: 785600 - RNA, 22 nt, Human
uugcagcagcuugcaucacucu

SEQ ID NO: 785601 - RNA, 19 nt, Human
uuggccauucauggagagg

SEQ ID NO: 785602 - RNA, 21 nt, Human
uugguugauauucugcugaaa

SEQ ID NO: 785603 - RNA, 22 nt, Human
uugguugauauucugcugaaag

SEQ ID NO: 785604 - RNA, 19 nt, Human
uuucaccguguuagccagg

SEQ ID NO: 785605 - RNA, 23 nt, Human
uuugcucauauucaaaauacacu

SEQ ID NO: 785606 - RNA, 18 nt, Human
aaaagaaacagaaaguca

SEQ ID NO: 785607 - RNA, 23 nt, Human
aaaaggcaguuuccaaguaccau

SEQ ID NO: 785608 - RNA, 23 nt, Human
aaacacaauguccuaacacaagg

SEQ ID NO: 785609 - RNA, 20 nt, Human
aaacccagaaugacaaggug

SEQ ID NO: 785610 - RNA, 19 nt, Human
aacacaaaacccgcucugc

SEQ ID NO: 785611 - RNA, 23 nt, Human
aacuuuccucagccauaaaaggc

SEQ ID NO: 785612 - RNA, 23 nt, Human
aagaagacaagugcaaaggaugg

SEQ ID NO: 785613 - RNA, 25 nt, Human
aagagaccauggauaaugcaaagug

SEQ ID NO: 785614 - RNA, 22 nt, Human
aagcaaacagucugguuccagg

SEQ ID NO: 785615 - RNA, 19 nt, Human
aagcaaggauuggcaacag

SEQ ID NO: 785616 - RNA, 18 nt, Human
aagcacuccaaagaccaa

SEQ ID NO: 785617 - RNA, 19 nt, Human
aagcagccuguaagugaau

SEQ ID NO: 785618 - RNA, 22 nt, Human
aaggaccccacaugaucgaaca

SEQ ID NO: 785619 - RNA, 26 nt, Human
aaggcagcccagccccuguuaaaacc

SEQ ID NO: 785620 - RNA, 24 nt, Human
aagggaacacaaagagcaguuucu

SEQ ID NO: 785621 - RNA, 22 nt, Human
aaggugaaagaaaggaaaggga

SEQ ID NO: 785622 - RNA, 18 nt, Human
aaggugaccagugaaguc

SEQ ID NO: 785623 - RNA, 23 nt, Human
acaaagagcaguuucuggaacac

SEQ ID NO: 785624 - RNA, 19 nt, Human
acacaagaagcacuccaaa

SEQ ID NO: 785625 - RNA, 22 nt, Human
acacauaccccuccccacaagc

SEQ ID NO: 785626 - RNA, 21 nt, Human
acacgcccacagugcccagga

SEQ ID NO: 785627 - RNA, 25 nt, Human
acacuguuaugugcccaaaaugagg

SEQ ID NO: 785628 - RNA, 20 nt, Human
acagcaauagcgguaacacc

SEQ ID NO: 785629 - RNA, 20 nt, Human
acagggggcucuucaguuuc

SEQ ID NO: 785630 - RNA, 18 nt, Human
acagguuuuaggacuuca

SEQ ID NO: 785631 - RNA, 20 nt, Human
accacuuuuaagggggaagg

SEQ ID NO: 785632 - RNA, 23 nt, Human
acccaagcccuauuugggugaca

SEQ ID NO: 785633 - RNA, 27 nt, Human
acuguguugaaucacuuucccauggua

SEQ ID NO: 785634 - RNA, 27 nt, Human
agaaaaaagguagaagaaaagggaccc

SEQ ID NO: 785635 - RNA, 23 nt, Human
agaaggaaacccagaaugacaag

SEQ ID NO: 785636 - RNA, 21 nt, Human
agacaaaauugguaucaugug

SEQ ID NO: 785637 - RNA, 21 nt, Human
agacacaaaauguuuucugag

SEQ ID NO: 785638 - RNA, 21 nt, Human
agacagacagaccaaccaggg

SEQ ID NO: 785639 - RNA, 22 nt, Human
agaccaaccaggaauaccacuu

SEQ ID NO: 785640 - RNA, 24 nt, Human
agaccacaucauaaaagcuaaugg

SEQ ID NO: 785641 - RNA, 21 nt, Human
agagucuaaaacccuccaccu

SEQ ID NO: 785642 - RNA, 18 nt, Human
aggacuaagggaaagacu

SEQ ID NO: 785643 - RNA, 21 nt, Human
aggggagcagagcaaguagag

SEQ ID NO: 785644 - RNA, 21 nt, Human
agggugagguuguggagucca

SEQ ID NO: 785645 - RNA, 22 nt, Human
agguggcuucaggaggccugag

SEQ ID NO: 785646 - RNA, 20 nt, Human
auaauaaaaagaggaguguc

SEQ ID NO: 785647 - RNA, 19 nt, Human
auaauauauauauauauau

SEQ ID NO: 785648 - RNA, 21 nt, Human
auagggaaaaaacaguaucuu

SEQ ID NO: 785649 - RNA, 20 nt, Human
augaucgaacagucuuugcc

SEQ ID NO: 785650 - RNA, 23 nt, Human
augccaggaucaccacaaggaca

SEQ ID NO: 785651 - RNA, 24 nt, Human
auguuuuuuggcaacuugccacca

SEQ ID NO: 785652 - RNA, 21 nt, Human
auugcuaaaaagucaucaggg

SEQ ID NO: 785653 - RNA, 25 nt, Human
caaacacaauguccuaacacaaggu

SEQ ID NO: 785654 - RNA, 27 nt, Human
caagaagcacuccaaagaccggggccc

SEQ ID NO: 785655 - RNA, 21 nt, Human
caaggacagacagacagacca

SEQ ID NO: 785656 - RNA, 22 nt, Human
cacaaaauguuuucugagacac

SEQ ID NO: 785657 - RNA, 27 nt, Human
cacaaggacaaggacagacagacagac

SEQ ID NO: 785658 - RNA, 21 nt, Human
cacaaugacccggcacacaaa

SEQ ID NO: 785659 - RNA, 23 nt, Human
cacagcaccagcuucgccagggc

SEQ ID NO: 785660 - RNA, 26 nt, Human
caccacaaggacaaggacagacagac

SEQ ID NO: 785661 - RNA, 22 nt, Human
caccaggcgugguuagauccuc

SEQ ID NO: 785662 - RNA, 21 nt, Human
caccuggcaucccugaguugu

SEQ ID NO: 785663 - RNA, 23 nt, Human
cacgugaagucccaccgcacagg

SEQ ID NO: 785664 - RNA, 21 nt, Human
cacuguguugaaucacuuucc

SEQ ID NO: 785665 - RNA, 20 nt, Human
cagaccaaccaggaauacca

SEQ ID NO: 785666 - RNA, 18 nt, Human
cagcuuccucaccaccag

SEQ ID NO: 785667 - RNA, 20 nt, Human
caggacccagggccagcugc

SEQ ID NO: 785668 - RNA, 23 nt, Human
caggaggccugaggagacaauca

SEQ ID NO: 785669 - RNA, 19 nt, Human
cauguucuaagggaagaaa

SEQ ID NO: 785670 - RNA, 20 nt, Human
cauguuguuuccucauugaa

SEQ ID NO: 785671 - RNA, 20 nt, Human
ccacagaaaaggaaaggggu

SEQ ID NO: 785672 - RNA, 22 nt, Human
ccagagccugagucgcgaaagg

SEQ ID NO: 785673 - RNA, 23 nt, Human
ccaggacccagggccagcugcag

SEQ ID NO: 785674 - RNA, 21 nt, Human
ccaggagcuaccaagaccaac

SEQ ID NO: 785675 - RNA, 22 nt, Human
ccaucaccugccaauagccagg

SEQ ID NO: 785676 - RNA, 22 nt, Human
ccaugcacaaacacaauguccu

SEQ ID NO: 785677 - RNA, 19 nt, Human
cccacagugcccaggagcu

SEQ ID NO: 785678 - RNA, 21 nt, Human
cccaguaugcccuaaaaugaa

SEQ ID NO: 785679 - RNA, 24 nt, Human
cccaugguacacgcccacagugcc

SEQ ID NO: 785680 - RNA, 24 nt, Human
ccccuguuaaaacacagcaacaac

SEQ ID NO: 785681 - RNA, 22 nt, Human
cccugguuggagggaggggagc

SEQ ID NO: 785682 - RNA, 19 nt, Human
ccgccgccgcagcugcugc

SEQ ID NO: 785683 - RNA, 19 nt, Human
ccgccgccgccgcagcugc

SEQ ID NO: 785684 - RNA, 18 nt, Human
ccuccuccuccucuuuuc

SEQ ID NO: 785685 - RNA, 18 nt, Human
ccuggaaauucagcuucc

SEQ ID NO: 785686 - RNA, 23 nt, Human
ccuggaaauucagcuuccucacc

SEQ ID NO: 785687 - RNA, 19 nt, Human
ccuggcaucccugaguugu

SEQ ID NO: 785688 - RNA, 22 nt, Human
ccuguuaaaacacagcaacaac

SEQ ID NO: 785689 - RNA, 24 nt, Human
cgaagaccacaucauaaaagcuaa

SEQ ID NO: 785690 - RNA, 26 nt, Human
cgcccggagccgccaucuuccuccac

SEQ ID NO: 785691 - RNA, 21 nt, Human
cgccgccgccgccgcagcugc

SEQ ID NO: 785692 - RNA, 23 nt, Human
cuccccacaagcuaggcuuggca

SEQ ID NO: 785693 - RNA, 20 nt, Human
cuccuccuccuccucuuuuc

SEQ ID NO: 785694 - RNA, 23 nt, Human
cuccuccuccuccucuuuucuuu

SEQ ID NO: 785695 - RNA, 19 nt, Human
cugcagcaggcuuugugcc

SEQ ID NO: 785696 - RNA, 22 nt, Human
cuggaacacauaccccucccca

SEQ ID NO: 785697 - RNA, 23 nt, Human
cuuccuccuccuccuccucuuuu

SEQ ID NO: 785698 - RNA, 26 nt, Human
gaaaaaggcagcccagccccuguuaa

SEQ ID NO: 785699 - RNA, 18 nt, Human
gaacacggugagagggag

SEQ ID NO: 785700 - RNA, 23 nt, Human
gaagaccacaucauaaaagcuaa

SEQ ID NO: 785701 - RNA, 20 nt, Human
gaagcccauagggaaaaaaa

SEQ ID NO: 785702 - RNA, 27 nt, Human
gaagggaacacaaagagcaguuucugg

SEQ ID NO: 785703 - RNA, 24 nt, Human
gaauuaaagaguuuuggcuucugg

SEQ ID NO: 785704 - RNA, 20 nt, Human
gaccaauggacacuacuagg

SEQ ID NO: 785705 - RNA, 23 nt, Human
gagccgccaucuuccuccacuca

SEQ ID NO: 785706 - RNA, 22 nt, Human
gagcugucacagguccucugug

SEQ ID NO: 785707 - RNA, 21 nt, Human
gcaacaacuuuaucugaacca

SEQ ID NO: 785708 - RNA, 21 nt, Human
gcuagccuucuggcccagcuu

SEQ ID NO: 785709 - RNA, 19 nt, Human
ggaacacauaccccucccc

SEQ ID NO: 785710 - RNA, 21 nt, Human
ggaacacauaccccuccccac

SEQ ID NO: 785711 - RNA, 21 nt, Human
ggaacacauaccccuccccac

SEQ ID NO: 785712 - RNA, 24 nt, Human
ggagaaaacacacuuaucaguaca

SEQ ID NO: 785713 - RNA, 19 nt, Human
ggagcauaucaccaugcca

SEQ ID NO: 785714 - RNA, 23 nt, Human
ggagccgccaucuuccuccacuc

SEQ ID NO: 785715 - RNA, 23 nt, Human
ggcgacgguaaugagggagcccc

SEQ ID NO: 785716 - RNA, 20 nt, Human
gguaaugagggagccaggga

SEQ ID NO: 785717 - RNA, 22 nt, Human
gucacagguccucugugguuuu

SEQ ID NO: 785718 - RNA, 23 nt, Human
gugaagcagaaggaaacccagaa

SEQ ID NO: 785719 - RNA, 20 nt, Human
guggagcauaucaccaugcc

SEQ ID NO: 785720 - RNA, 18 nt, Human
guuuucuuucuuccuccu

SEQ ID NO: 785721 - RNA, 30 nt, Human
uaaauacggauaaauauuugcuucaggugg

SEQ ID NO: 785722 - RNA, 23 nt, Human
uaacaaaaaaugaaauugacaga

SEQ ID NO: 785723 - RNA, 20 nt, Human
uaagacaauuguccauuuua

SEQ ID NO: 785724 - RNA, 20 nt, Human
uaagauggacaaggugaccc

SEQ ID NO: 785725 - RNA, 21 nt, Human
uaagguugagauucuguacca

SEQ ID NO: 785726 - RNA, 24 nt, Human
uaaguagacacauguuguuuccuc

SEQ ID NO: 785727 - RNA, 23 nt, Human
uacagggggcucuucaguuucuu

SEQ ID NO: 785728 - RNA, 20 nt, Human
uacauaugcccuuucauuuu

SEQ ID NO: 785729 - RNA, 23 nt, Human
uaccagcaagguagaaaaaggca

SEQ ID NO: 785730 - RNA, 24 nt, Human
uacuugggggaaguggaaggaaaa

SEQ ID NO: 785731 - RNA, 21 nt, Human
uagaauucccuacuggccccc

SEQ ID NO: 785732 - RNA, 22 nt, Human
uaggcugccagaugcuggcuga

SEQ ID NO: 785733 - RNA, 20 nt, Human
uauauaauauauauauauau

SEQ ID NO: 785734 - RNA, 21 nt, Human
uauauaauauauauauauaua

SEQ ID NO: 785735 - RNA, 22 nt, Human
uaucucaggguaagccaccugg

SEQ ID NO: 785736 - RNA, 22 nt, Human
uaucugaaccaggauggaaauc

SEQ ID NO: 785737 - RNA, 19 nt, Human
uaugcccuaaaaugaaauu

SEQ ID NO: 785738 - RNA, 19 nt, Human
ucaaaacaaaacaaaggca

SEQ ID NO: 785739 - RNA, 21 nt, Human
ucaaaucaauccacagacagc

SEQ ID NO: 785740 - RNA, 23 nt, Human
ucaauggaguucagaggaaccag

SEQ ID NO: 785741 - RNA, 19 nt, Human
ucagaaauuuccacaauca

SEQ ID NO: 785742 - RNA, 19 nt, Human
ucaggccgcgacagccgug

SEQ ID NO: 785743 - RNA, 24 nt, Human
uccaaagaccaauggacacuacua

SEQ ID NO: 785744 - RNA, 18 nt, Human
uccaaauuaaaagccaca

SEQ ID NO: 785745 - RNA, 19 nt, Human
ucccaaaguguaggguagg

SEQ ID NO: 785746 - RNA, 19 nt, Human
ucccuuuuuuugucaacag

SEQ ID NO: 785747 - RNA, 22 nt, Human
ucccuuuuuuugucaacagagu

SEQ ID NO: 785748 - RNA, 18 nt, Human
uccucuuuccacugauga

SEQ ID NO: 785749 - RNA, 18 nt, Human
ucgccagggcacaugggg

SEQ ID NO: 785750 - RNA, 23 nt, Human
ucuaaaacccuccaccuuugcaa

SEQ ID NO: 785751 - RNA, 19 nt, Human
ucuaagcagcuucugauuu

SEQ ID NO: 785752 - RNA, 18 nt, Human
ucucaggguaagccaccu

SEQ ID NO: 785753 - RNA, 27 nt, Human
ucucccuuuuuuugucaacagaguugg

SEQ ID NO: 785754 - RNA, 19 nt, Human
ucugcaguucauggagagg

SEQ ID NO: 785755 - RNA, 18 nt, Human
ucugcuguauaaccugug

SEQ ID NO: 785756 - RNA, 22 nt, Human
ucuuaaguugguuuucuuucuu

SEQ ID NO: 785757 - RNA, 24 nt, Human
ucuuccuccuccuccuccucuuuu

SEQ ID NO: 785758 - RNA, 18 nt, Human
ugaaaacacaaaacccgc

SEQ ID NO: 785759 - RNA, 19 nt, Human
ugaaaacacaaaacccgcu

SEQ ID NO: 785760 - RNA, 25 nt, Human
ugaaaacacaaaacccgcucugcug

SEQ ID NO: 785761 - RNA, 18 nt, Human
ugaaagaaaggaaaggga

SEQ ID NO: 785762 - RNA, 19 nt, Human
ugaacacggugagagggag

SEQ ID NO: 785763 - RNA, 20 nt, Human
ugaagucacuaggccauggg

SEQ ID NO: 785764 - RNA, 26 nt, Human
ugaagugaaaguaaaaacccaagccc

SEQ ID NO: 785765 - RNA, 18 nt, Human
ugacaaugaacacgguga

SEQ ID NO: 785766 - RNA, 19 nt, Human
ugacccggcacacaaaugu

SEQ ID NO: 785767 - RNA, 27 nt, Human
ugagacacacaagaagcacuccaaaga

SEQ ID NO: 785768 - RNA, 20 nt, Human
ugagagucuaaaacccucca

SEQ ID NO: 785769 - RNA, 20 nt, Human
ugaggagacaaucaccuuca

SEQ ID NO: 785770 - RNA, 21 nt, Human
ugcaacuuacauaugcccuuu

SEQ ID NO: 785771 - RNA, 18 nt, Human
ugcacaaacacaaugucc

SEQ ID NO: 785772 - RNA, 21 nt, Human
ugcccaggagcuaccaagaca

SEQ ID NO: 785773 - RNA, 23 nt, Human
ugcccaggagcuaccaagaccaa

SEQ ID NO: 785774 - RNA, 21 nt, Human
ugcgucaagaagucaaguaca

SEQ ID NO: 785775 - RNA, 25 nt, Human
uggaugccacauaaguagacacagu

SEQ ID NO: 785776 - RNA, 19 nt, Human
uggcaacagcaccagagga

SEQ ID NO: 785777 - RNA, 20 nt, Human
uggcccccuagugacaccag

SEQ ID NO: 785778 - RNA, 18 nt, Human
uggccugacugcagcauc

SEQ ID NO: 785779 - RNA, 18 nt, Human
ugggagcucucaaaaggc

SEQ ID NO: 785780 - RNA, 25 nt, Human
ugggaugagugugcucaaugugcuu

SEQ ID NO: 785781 - RNA, 19 nt, Human
ugggggaaguggaaggaau

SEQ ID NO: 785782 - RNA, 21 nt, Human
uggggugugcacugacaugaa

SEQ ID NO: 785783 - RNA, 19 nt, Human
uguacaauggagccaacac

SEQ ID NO: 785784 - RNA, 23 nt, Human
uguacaauggagccaacaccuaa

SEQ ID NO: 785785 - RNA, 20 nt, Human
uguggaaaugcucgccuugg

SEQ ID NO: 785786 - RNA, 22 nt, Human
uguggaaaugcucgccuuggcc

SEQ ID NO: 785787 - RNA, 19 nt, Human
ugugguuuuaagagaaggg

SEQ ID NO: 785788 - RNA, 21 nt, Human
uguucuaagggaagaaagagg

SEQ ID NO: 785789 - RNA, 19 nt, Human
uguuucaacaccaaauuug

SEQ ID NO: 785790 - RNA, 23 nt, Human
uguuuccucauugaagggaacac

SEQ ID NO: 785791 - RNA, 20 nt, Human
uucagcuuccucaccaccag

SEQ ID NO: 785792 - RNA, 21 nt, Human
uucauggagaggcuacauggg

SEQ ID NO: 785793 - RNA, 22 nt, Human
uucauuuuuuaacuccaagaag

SEQ ID NO: 785794 - RNA, 20 nt, Human
uuccuccuccuccuccucuu

SEQ ID NO: 785795 - RNA, 21 nt, Human
uucucaacuccaucaccugcc

SEQ ID NO: 785796 - RNA, 19 nt, Human
uuuccacaaucagacacaa

SEQ ID NO: 785797 - RNA, 22 nt, Human
uuucuguccuccaaagucaagg

SEQ ID NO: 785798 - RNA, 22 nt, Human
aaaaauaugaaaagccacaaag

SEQ ID NO: 785799 - RNA, 21 nt, Human
aaacaugguugauuuucauac

SEQ ID NO: 785800 - RNA, 21 nt, Human
aaccaaaaacaagauaaacaa

SEQ ID NO: 785801 - RNA, 22 nt, Human
aacuacaaaauggauauuucug

SEQ ID NO: 785802 - RNA, 19 nt, Human
aagacaaagguccccaaga

SEQ ID NO: 785803 - RNA, 24 nt, Human
aaguuuucugcacaaucauaugaa

SEQ ID NO: 785804 - RNA, 20 nt, Human
aauacaauaaagaagacauu

SEQ ID NO: 785805 - RNA, 20 nt, Human
acacacacacgcacacaaaa

SEQ ID NO: 785806 - RNA, 25 nt, Human
acacagaagacaaagguccccaaga

SEQ ID NO: 785807 - RNA, 21 nt, Human
accacagauagaaaggagcaa

SEQ ID NO: 785808 - RNA, 18 nt, Human
acucccaugcuuccccca

SEQ ID NO: 785809 - RNA, 21 nt, Human
agaaacaauucagauuguaaa

SEQ ID NO: 785810 - RNA, 21 nt, Human
agaacuaaagcaaaugaaagu

SEQ ID NO: 785811 - RNA, 23 nt, Human
agcaagagauaccaaauauucau

SEQ ID NO: 785812 - RNA, 23 nt, Human
agugacaauguuucaacagaagc

SEQ ID NO: 785813 - RNA, 22 nt, Human
auaaaaccaacuagauugacuc

SEQ ID NO: 785814 - RNA, 24 nt, Human
auaagugugccaucccuacaaccc

SEQ ID NO: 785815 - RNA, 18 nt, Human
auagagaaagcucauuuc

SEQ ID NO: 785816 - RNA, 21 nt, Human
auaucaagaaaaaaucacucc

SEQ ID NO: 785817 - RNA, 21 nt, Human
augaaaacagacgcauaucaa

SEQ ID NO: 785818 - RNA, 22 nt, Human
augaaaagccacaaagauacca

SEQ ID NO: 785819 - RNA, 21 nt, Human
caaaugaaagugcaaccaaca

SEQ ID NO: 785820 - RNA, 20 nt, Human
caaccaacaaaucacaguaa

SEQ ID NO: 785821 - RNA, 18 nt, Human
caacuuggcauuacucaa

SEQ ID NO: 785822 - RNA, 21 nt, Human
caagagauaccaaauauucau

SEQ ID NO: 785823 - RNA, 23 nt, Human
cacaccacuuugaaacauguaau

SEQ ID NO: 785824 - RNA, 26 nt, Human
cacacgcacacaaaauuagguccaca

SEQ ID NO: 785825 - RNA, 22 nt, Human
cagaagacaaagguccccaaga

SEQ ID NO: 785826 - RNA, 21 nt, Human
cagacgcauaucaagaaaaaa

SEQ ID NO: 785827 - RNA, 18 nt, Human
cagcagcuccggaaagcu

SEQ ID NO: 785828 - RNA, 22 nt, Human
caguaaggggcuagaggcauga

SEQ ID NO: 785829 - RNA, 19 nt, Human
cauauagccauguauauau

SEQ ID NO: 785830 - RNA, 21 nt, Human
caucccuacaacccugaacau

SEQ ID NO: 785831 - RNA, 23 nt, Human
caugaagcacuaaaaauaugaaa

SEQ ID NO: 785832 - RNA, 20 nt, Human
caugagacauauaaagccuu

SEQ ID NO: 785833 - RNA, 20 nt, Human
cauguaaccaaaaacaagau

SEQ ID NO: 785834 - RNA, 23 nt, Human
ccaacuagauugacucauaauau

SEQ ID NO: 785835 - RNA, 19 nt, Human
ccacagauagaaaggagca

SEQ ID NO: 785836 - RNA, 19 nt, Human
ccacucccaugcuuccccc

SEQ ID NO: 785837 - RNA, 21 nt, Human
cccacucccaugcuuccccca

SEQ ID NO: 785838 - RNA, 22 nt, Human
cccaugcuucccccacucccua

SEQ ID NO: 785839 - RNA, 21 nt, Human
ccccacucccuacucccuuca

SEQ ID NO: 785840 - RNA, 19 nt, Human
cccuaaaaacagaaagucc

SEQ ID NO: 785841 - RNA, 24 nt, Human
ccucaaagacuucuggucuucucu

SEQ ID NO: 785842 - RNA, 21 nt, Human
cgcacacaaaauuagguccac

SEQ ID NO: 785843 - RNA, 22 nt, Human
cggaaagcucccgucgcccugg

SEQ ID NO: 785844 - RNA, 20 nt, Human
cuaaaaauaugaaaagccac

SEQ ID NO: 785845 - RNA, 23 nt, Human
cuaaagcaaaugaaagugcaacc

SEQ ID NO: 785846 - RNA, 19 nt, Human
cugguauagaacaaaugag

SEQ ID NO: 785847 - RNA, 22 nt, Human
cuugccccugacacccuucuau

SEQ ID NO: 785848 - RNA, 19 nt, Human
gagagaaaacaugguugau

SEQ ID NO: 785849 - RNA, 20 nt, Human
gcacacaaaauuagguccac

SEQ ID NO: 785850 - RNA, 22 nt, Human
gcacuaaaaauaugaaaagcca

SEQ ID NO: 785851 - RNA, 21 nt, Human
gcccucgacaaguaacgguuc

SEQ ID NO: 785852 - RNA, 23 nt, Human
gcuauaacuacaaaauggauauu

SEQ ID NO: 785853 - RNA, 20 nt, Human
ggaaaauucuagggcucagg

SEQ ID NO: 785854 - RNA, 23 nt, Human
ggaaagaagagauacucaagcau

SEQ ID NO: 785855 - RNA, 18 nt, Human
gguaucauguaaccaaaa

SEQ ID NO: 785856 - RNA, 21 nt, Human
gguccaacuuagugacaaugu

SEQ ID NO: 785857 - RNA, 18 nt, Human
guaaccaaaaacaagaua

SEQ ID NO: 785858 - RNA, 18 nt, Human
gugaaguguacuugcccc

SEQ ID NO: 785859 - RNA, 25 nt, Human
uaaaaucuaagaucucagcucuugg

SEQ ID NO: 785860 - RNA, 23 nt, Human
uaaaaugccaucgccucacuucu

SEQ ID NO: 785861 - RNA, 23 nt, Human
uaaaaugccaucgccucacuucu

SEQ ID NO: 785862 - RNA, 22 nt, Human
uaaccaaaaacaagauaaacaa

SEQ ID NO: 785863 - RNA, 24 nt, Human
uaacuacaaaauggauauuucugu

SEQ ID NO: 785864 - RNA, 21 nt, Human
uaagaucucagcucuuggaau

SEQ ID NO: 785865 - RNA, 22 nt, Human
uaagugugccaucccuacaacc

SEQ ID NO: 785866 - RNA, 21 nt, Human
uaauaagugugccaucccuuc

SEQ ID NO: 785867 - RNA, 19 nt, Human
uacacagaagacaaagguc

SEQ ID NO: 785868 - RNA, 24 nt, Human
uacagcuuuaucagucaguuccau

SEQ ID NO: 785869 - RNA, 22 nt, Human
uaccaaauauucaugaagcacu

SEQ ID NO: 785870 - RNA, 22 nt, Human
uaccaaauauucaugauacacu

SEQ ID NO: 785871 - RNA, 22 nt, Human
uaccauuuacacagaagacaaa

SEQ ID NO: 785872 - RNA, 23 nt, Human
uacuugccccugacacccuucua

SEQ ID NO: 785873 - RNA, 21 nt, Human
uagaacaaaugagaaagcugg

SEQ ID NO: 785874 - RNA, 21 nt, Human
uagagcguguaugugugacca

SEQ ID NO: 785875 - RNA, 19 nt, Human
uagcaaaacaauuuauaau

SEQ ID NO: 785876 - RNA, 22 nt, Human
uagugacaauguuucaacagaa

SEQ ID NO: 785877 - RNA, 23 nt, Human
uaugcaacuucucaccagguaau

SEQ ID NO: 785878 - RNA, 23 nt, Human
ucaacuuugccccacucccaugc

SEQ ID NO: 785879 - RNA, 21 nt, Human
ucaauauacuaccuaauucug

SEQ ID NO: 785880 - RNA, 20 nt, Human
ucccaugcuucccccacucc

SEQ ID NO: 785881 - RNA, 24 nt, Human
ucccccacucccuacucccuucaa

SEQ ID NO: 785882 - RNA, 24 nt, Human
ucccuacaacccugaacauuucuc

SEQ ID NO: 785883 - RNA, 25 nt, Human
ucccuacaacccugaacauuucucu

SEQ ID NO: 785884 - RNA, 26 nt, Human
ucccucaacaauacuuguguaaauaa

SEQ ID NO: 785885 - RNA, 20 nt, Human
uccuaagcucaucuaggcuc

SEQ ID NO: 785886 - RNA, 21 nt, Human
uccuaagcucaucuaggcucu

SEQ ID NO: 785887 - RNA, 20 nt, Human
ucgaaugaauucucagcuga

SEQ ID NO: 785888 - RNA, 19 nt, Human
ucucagcugauuccugaga

SEQ ID NO: 785889 - RNA, 18 nt, Human
ucucuacaagacaaaaac

SEQ ID NO: 785890 - RNA, 24 nt, Human
ucucuacaagacaaaaacauauga

SEQ ID NO: 785891 - RNA, 24 nt, Human
ucucuauguauugccucuacuaua

SEQ ID NO: 785892 - RNA, 26 nt, Human
ugaagcacuaaaaauaugaaaagcca

SEQ ID NO: 785893 - RNA, 21 nt, Human
ugaauucaguuaccuugacac

SEQ ID NO: 785894 - RNA, 20 nt, Human
ugaccaaacuguccugcagg

SEQ ID NO: 785895 - RNA, 21 nt, Human
ugaccaaacuguccugcagga

SEQ ID NO: 785896 - RNA, 21 nt, Human
ugagaaaaaaauuuauuugga

SEQ ID NO: 785897 - RNA, 22 nt, Human
ugagaaaaaaauuuauuuggaa

SEQ ID NO: 785898 - RNA, 25 nt, Human
ugagaaaaaaauuuauuuggaauau

SEQ ID NO: 785899 - RNA, 18 nt, Human
ugagaaauaaacagagaa

SEQ ID NO: 785900 - RNA, 23 nt, Human
ugagaaauaaacagagaacauua

SEQ ID NO: 785901 - RNA, 21 nt, Human
ugagagguuguuuuuagagau

SEQ ID NO: 785902 - RNA, 22 nt, Human
ugagcccacucucuauccuaag

SEQ ID NO: 785903 - RNA, 22 nt, Human
ugcaaaaacaaaguugcguauc

SEQ ID NO: 785904 - RNA, 24 nt, Human
ugccauaaaaauuauuuuauuaac

SEQ ID NO: 785905 - RNA, 24 nt, Human
ugccccacucccaugcuuccccca

SEQ ID NO: 785906 - RNA, 18 nt, Human
ugcuuuucuuuguccccc

SEQ ID NO: 785907 - RNA, 19 nt, Human
ugggaauucaugagaaaua

SEQ ID NO: 785908 - RNA, 23 nt, Human
ugguauagaacaaaugagaaagc

SEQ ID NO: 785909 - RNA, 22 nt, Human
ugguaucauguaaccaaaaaca

SEQ ID NO: 785910 - RNA, 18 nt, Human
ugguuucuggauccaacu

SEQ ID NO: 785911 - RNA, 25 nt, Human
ugucgaauaaaaccaacuagauuga

SEQ ID NO: 785912 - RNA, 19 nt, Human
ugucuauauacauaugcgc

SEQ ID NO: 785913 - RNA, 22 nt, Human
ugugcaaaaauucaacuauaaa

SEQ ID NO: 785914 - RNA, 23 nt, Human
uuacaauuguuuaacuuccuugu

SEQ ID NO: 785915 - RNA, 20 nt, Human
uuacccacuggugacacuca

SEQ ID NO: 785916 - RNA, 22 nt, Human
uuagagauacugguuucuggau

SEQ ID NO: 785917 - RNA, 22 nt, Human
uucaagauuuuuuaaugaauuc

SEQ ID NO: 785918 - RNA, 20 nt, Human
uucaauguuuauuauuuucg

SEQ ID NO: 785919 - RNA, 24 nt, Human
uucacaguuguauugccauaaaaa

SEQ ID NO: 785920 - RNA, 21 nt, Human
uucaucugauugagucaucug

SEQ ID NO: 785921 - RNA, 18 nt, Human
uucaugaagcacuaaaaa

SEQ ID NO: 785922 - RNA, 23 nt, Human
uucuagggcucaggcagcacaga

SEQ ID NO: 785923 - RNA, 18 nt, Human
uucucagcugauuccuga

SEQ ID NO: 785924 - RNA, 18 nt, Human
uugcuuucuccuuguucc

SEQ ID NO: 785925 - RNA, 20 nt, Human
uuuacaguuauauacaguuu

SEQ ID NO: 785926 - RNA, 19 nt, Human
uuucucuuuccuugaugaa

SEQ ID NO: 785927 - RNA, 24 nt, Human
uuugucccccuagucaagggagag

SEQ ID NO: 785928 - RNA, 23 nt, Human
uuuucugcacaaucauaugaaag

SEQ ID NO: 785929 - RNA, 18 nt, Human
aagcagcuccuguccccc

SEQ ID NO: 785930 - RNA, 21 nt, Human
acagggcagccacuguguccu

SEQ ID NO: 785931 - RNA, 23 nt, Human
acccccuacaaaaauaaccugac

SEQ ID NO: 785932 - RNA, 18 nt, Human
agacaggggcuuagaucc

SEQ ID NO: 785933 - RNA, 24 nt, Human
agcacugaggcagugugagaggga

SEQ ID NO: 785934 - RNA, 22 nt, Human
agcccccagagagggccuuuga

SEQ ID NO: 785935 - RNA, 24 nt, Human
agccggguccuucugucuucucug

SEQ ID NO: 785936 - RNA, 18 nt, Human
aggcagcaugguccacac

SEQ ID NO: 785937 - RNA, 18 nt, Human
aggcagugugagagggag

SEQ ID NO: 785938 - RNA, 18 nt, Human
aggcggccggcauggcag

SEQ ID NO: 785939 - RNA, 23 nt, Human
agggccuuugaggggccccuuga

SEQ ID NO: 785940 - RNA, 19 nt, Human
aggggccaucccccaaaac

SEQ ID NO: 785941 - RNA, 22 nt, Human
agggggugagaggcccccaccc

SEQ ID NO: 785942 - RNA, 21 nt, Human
auggcgcucggaggcagcucu

SEQ ID NO: 785943 - RNA, 21 nt, Human
augggaggagggcuggucucu

SEQ ID NO: 785944 - RNA, 24 nt, Human
caccacgcugcgcagacucgucuc

SEQ ID NO: 785945 - RNA, 18 nt, Human
cacgcugcgcagacucgu

SEQ ID NO: 785946 - RNA, 20 nt, Human
cagagcccccagagagggcc

SEQ ID NO: 785947 - RNA, 24 nt, Human
cagcucuggcucugcuacugaucc

SEQ ID NO: 785948 - RNA, 19 nt, Human
caggccuggggacacagcu

SEQ ID NO: 785949 - RNA, 20 nt, Human
ccacccaugggaccaaaggu

SEQ ID NO: 785950 - RNA, 24 nt, Human
ccacgcugcgcagacucgucuccu

SEQ ID NO: 785951 - RNA, 18 nt, Human
ccccagagcccccagaga

SEQ ID NO: 785952 - RNA, 23 nt, Human
cccuacaaaaauaaccugacccc

SEQ ID NO: 785953 - RNA, 27 nt, Human
cgagcugggaagcagcuccuguccccc

SEQ ID NO: 785954 - RNA, 24 nt, Human
cgcccugggcccaggccuggggac

SEQ ID NO: 785955 - RNA, 21 nt, Human
cggaggcagcucuggcucugc

SEQ ID NO: 785956 - RNA, 21 nt, Human
cucccagcuccacaaggcagc

SEQ ID NO: 785957 - RNA, 23 nt, Human
cuccccacaggggccauccccca

SEQ ID NO: 785958 - RNA, 25 nt, Human
cucuucugccacugggcaaaaagcc

SEQ ID NO: 785959 - RNA, 25 nt, Human
cugacccccauggugaccgggcaug

SEQ ID NO: 785960 - RNA, 20 nt, Human
cuggcccgcagggcgcccug

SEQ ID NO: 785961 - RNA, 20 nt, Human
cuggcgccucaguuuucaca

SEQ ID NO: 785962 - RNA, 22 nt, Human
gacagggcagccacuguguccu

SEQ ID NO: 785963 - RNA, 22 nt, Human
gagaggcccccacccuggaucc

SEQ ID NO: 785964 - RNA, 19 nt, Human
gcacuggccgccguaaagc

SEQ ID NO: 785965 - RNA, 20 nt, Human
gcagcuccugucccccaccc

SEQ ID NO: 785966 - RNA, 22 nt, Human
gcauggcagcuccuccccacag

SEQ ID NO: 785967 - RNA, 20 nt, Human
gccacuguguccuggcgccu

SEQ ID NO: 785968 - RNA, 18 nt, Human
gcgcagagggucgggggg

SEQ ID NO: 785969 - RNA, 18 nt, Human
ggaaagacaggggcuuag

SEQ ID NO: 785970 - RNA, 18 nt, Human
ggccuuugaggggccccu

SEQ ID NO: 785971 - RNA, 20 nt, Human
gggcuaggcugagccgccgg

SEQ ID NO: 785972 - RNA, 24 nt, Human
ggggggcggcggccaccacgcugc

SEQ ID NO: 785973 - RNA, 18 nt, Human
guaggacaugcagaagcc

SEQ ID NO: 785974 - RNA, 22 nt, Human
uaaccugacccccauggugacc

SEQ ID NO: 785975 - RNA, 22 nt, Human
uacaaaaauaaccugaccccca

SEQ ID NO: 785976 - RNA, 23 nt, Human
uacaaaaauaaccugacccccau

SEQ ID NO: 785977 - RNA, 19 nt, Human
ucagagucaggugggaaag

SEQ ID NO: 785978 - RNA, 22 nt, Human
uccacaaggcagcaugguccac

SEQ ID NO: 785979 - RNA, 19 nt, Human
ucccccaaaacauccacuc

SEQ ID NO: 785980 - RNA, 24 nt, Human
ucgcagggggaagcuucucggagc

SEQ ID NO: 785981 - RNA, 23 nt, Human
ucggaggcagcucuggcucugcu

SEQ ID NO: 785982 - RNA, 22 nt, Human
ucucuggccaagaccaaaaggc

SEQ ID NO: 785983 - RNA, 20 nt, Human
ucugccgugagcaggcggcu

SEQ ID NO: 785984 - RNA, 22 nt, Human
ugaggaaagcugugcugagccc

SEQ ID NO: 785985 - RNA, 24 nt, Human
ugaggaaagcugugcugagcccca

SEQ ID NO: 785986 - RNA, 18 nt, Human
ugaggcuggggucagggg

SEQ ID NO: 785987 - RNA, 25 nt, Human
ugccacugggcaaaaagccgagugu

SEQ ID NO: 785988 - RNA, 21 nt, Human
ugugagagggagacccccuac

SEQ ID NO: 785989 - RNA, 21 nt, Human
uguggcugccaguagcccggc

SEQ ID NO: 785990 - RNA, 18 nt, Human
aaaaaaacuugaaccagg

SEQ ID NO: 785991 - RNA, 24 nt, Human
aaaaaaggcuggaaaaauagcuaa

SEQ ID NO: 785992 - RNA, 19 nt, Human
aaaaguaacucuuaaaggc

SEQ ID NO: 785993 - RNA, 24 nt, Human
aaacaaaauaucugaacacagaac

SEQ ID NO: 785994 - RNA, 25 nt, Human
aaacaaaauaucugaacacagaacc

SEQ ID NO: 785995 - RNA, 22 nt, Human
aaagcaaaacaugaauuacaaa

SEQ ID NO: 785996 - RNA, 18 nt, Human
aaauuacaggucacugga

SEQ ID NO: 785997 - RNA, 18 nt, Human
aaccuguagucacuccuc

SEQ ID NO: 785998 - RNA, 19 nt, Human
aagaaucuaauugucaaca

SEQ ID NO: 785999 - RNA, 24 nt, Human
aagcaaaacaugaauuacaaagcu

SEQ ID NO: 786000 - RNA, 26 nt, Human
aagcacuuuaccuaacuucagaaaua

SEQ ID NO: 786001 - RNA, 22 nt, Human
aauuagaaagcugccgacuuaa

SEQ ID NO: 786002 - RNA, 24 nt, Human
acaaagccuuuaaaaaguuaagcu

SEQ ID NO: 786003 - RNA, 23 nt, Human
acaaaguuuuuuuagccuuaaaa

SEQ ID NO: 786004 - RNA, 23 nt, Human
acacacacaaccucaaaccuggu

SEQ ID NO: 786005 - RNA, 21 nt, Human
acacacacacacacacacaca

SEQ ID NO: 786006 - RNA, 27 nt, Human
acacacacacacacacacacaccccca

SEQ ID NO: 786007 - RNA, 25 nt, Human
acacacacacacacccccacacaca

SEQ ID NO: 786008 - RNA, 27 nt, Human
acacacacacacacccccacacacaca

SEQ ID NO: 786009 - RNA, 18 nt, Human
acaguuuuuuuuuucccc

SEQ ID NO: 786010 - RNA, 19 nt, Human
acaguuuuuuuuuuccccu

SEQ ID NO: 786011 - RNA, 28 nt, Human
acauacacacacacacacacacacaccc

SEQ ID NO: 786012 - RNA, 21 nt, Human
accagaaaccauuccacuucu

SEQ ID NO: 786013 - RNA, 21 nt, Human
accagccgcaggcccggcgcg

SEQ ID NO: 786014 - RNA, 21 nt, Human
acugcagaaagauggaaucca

SEQ ID NO: 786015 - RNA, 20 nt, Human
acuugaaccagguuuuuuuc

SEQ ID NO: 786016 - RNA, 18 nt, Human
agacagagucuugcacug

SEQ ID NO: 786017 - RNA, 19 nt, Human
agcccagaauaaccaaaau

SEQ ID NO: 786018 - RNA, 21 nt, Human
agcuaaauuaaaacuacccuc

SEQ ID NO: 786019 - RNA, 19 nt, Human
aggaauguugaucuaugau

SEQ ID NO: 786020 - RNA, 19 nt, Human
aggcaaauagacccaauga

SEQ ID NO: 786021 - RNA, 24 nt, Human
agugcaauggcacaaucucggcuc

SEQ ID NO: 786022 - RNA, 19 nt, Human
auaagaaaaagaaaaccuc

SEQ ID NO: 786023 - RNA, 24 nt, Human
auaggacaaagccuuuaaaaaguu

SEQ ID NO: 786024 - RNA, 25 nt, Human
auaugcaaacauacacacacacaca

SEQ ID NO: 786025 - RNA, 19 nt, Human
auguaaugaaauuacaggu

SEQ ID NO: 786026 - RNA, 24 nt, Human
auuaacugguuggcuggaauauug

SEQ ID NO: 786027 - RNA, 23 nt, Human
caaaaguaacucuuaaaggcaaa

SEQ ID NO: 786028 - RNA, 22 nt, Human
caaaguuuuuuuagccuuaaaa

SEQ ID NO: 786029 - RNA, 21 nt, Human
caacaagagaaccgagcuaaa

SEQ ID NO: 786030 - RNA, 20 nt, Human
cacacacacaaccucaaacc

SEQ ID NO: 786031 - RNA, 18 nt, Human
cacacacacacacacaca

SEQ ID NO: 786032 - RNA, 20 nt, Human
cacacacacacacacacaca

SEQ ID NO: 786033 - RNA, 22 nt, Human
cacacacccccacacacacaca

SEQ ID NO: 786034 - RNA, 19 nt, Human
cacagaacccuaaacauac

SEQ ID NO: 786035 - RNA, 23 nt, Human
cacagaacccuaaacauacuaga

SEQ ID NO: 786036 - RNA, 24 nt, Human
cacauaaauaaaauaagagguuuu

SEQ ID NO: 786037 - RNA, 19 nt, Human
caccagccgcaggcccggc

SEQ ID NO: 786038 - RNA, 21 nt, Human
cacugauaagaaaaagaaaac

SEQ ID NO: 786039 - RNA, 22 nt, Human
cacuuaaggugcuaaugauaug

SEQ ID NO: 786040 - RNA, 24 nt, Human
cagaaagauggaauccagcucaca

SEQ ID NO: 786041 - RNA, 22 nt, Human
cagaaauaccaccagaaaccau

SEQ ID NO: 786042 - RNA, 19 nt, Human
cagcaacgaaaaguuaaca

SEQ ID NO: 786043 - RNA, 19 nt, Human
caggaagagaauuaacugg

SEQ ID NO: 786044 - RNA, 23 nt, Human
cauuaggcaaauagacccaauga

SEQ ID NO: 786045 - RNA, 20 nt, Human
ccaagaaucuaauugucaac

SEQ ID NO: 786046 - RNA, 18 nt, Human
ccacacagacacaaugaa

SEQ ID NO: 786047 - RNA, 20 nt, Human
cccacacacacacacaaccu

SEQ ID NO: 786048 - RNA, 27 nt, Human
cccacacacacacacaaccucaaaccu

SEQ ID NO: 786049 - RNA, 20 nt, Human
cccccacacacacacacaac

SEQ ID NO: 786050 - RNA, 21 nt, Human
cccccacacacacacacaacc

SEQ ID NO: 786051 - RNA, 25 nt, Human
cccccacacacacacacaaccucaa

SEQ ID NO: 786052 - RNA, 21 nt, Human
ccccgcagccucuccgcccgg

SEQ ID NO: 786053 - RNA, 22 nt, Human
ccccgcgcgggcccaggagccc

SEQ ID NO: 786054 - RNA, 20 nt, Human
cccgccgcccuuuuccccgc

SEQ ID NO: 786055 - RNA, 21 nt, Human
cccgcgcgggcccaggagcca

SEQ ID NO: 786056 - RNA, 21 nt, Human
cccucacuugguccaagaauc

SEQ ID NO: 786057 - RNA, 20 nt, Human
ccgacuuaaauaugacaaag

SEQ ID NO: 786058 - RNA, 22 nt, Human
ccuacuuuaacccuucuuuacc

SEQ ID NO: 786059 - RNA, 26 nt, Human
ccuguagucacuccucuaauaaacca

SEQ ID NO: 786060 - RNA, 24 nt, Human
cgcccggggcgcgccggcuccgcc

SEQ ID NO: 786061 - RNA, 23 nt, Human
cgcccuuuuccccgcgcgggccc

SEQ ID NO: 786062 - RNA, 22 nt, Human
cucacaguuuaacugaugccau

SEQ ID NO: 786063 - RNA, 31 nt, Human
cugccacauaaauaaaauaagagguuuuauu

SEQ ID NO: 786064 - RNA, 21 nt, Human
cuggcagcccagaauaaccaa

SEQ ID NO: 786065 - RNA, 25 nt, Human
cuuggaaugggacaccacauuuuaa

SEQ ID NO: 786066 - RNA, 19 nt, Human
gaaauuacaggucacugga

SEQ ID NO: 786067 - RNA, 23 nt, Human
gagcuaaauuaaaacuacccuca

SEQ ID NO: 786068 - RNA, 19 nt, Human
gcccaggcuggagugcaau

SEQ ID NO: 786069 - RNA, 23 nt, Human
gcccaggcuggagugcaauggca

SEQ ID NO: 786070 - RNA, 23 nt, Human
gcgcagcugcgggaggcggaggg

SEQ ID NO: 786071 - RNA, 19 nt, Human
gcuggagugcaauggcaca

SEQ ID NO: 786072 - RNA, 22 nt, Human
ggccaugguuguaaagaaaacc

SEQ ID NO: 786073 - RNA, 18 nt, Human
gggaggacugaacacugg

SEQ ID NO: 786074 - RNA, 18 nt, Human
ggggaggacugaacacug

SEQ ID NO: 786075 - RNA, 24 nt, Human
gugcaaacaaaauaucugaacaca

SEQ ID NO: 786076 - RNA, 21 nt, Human
uaaaauaagaacuaagucaaa

SEQ ID NO: 786077 - RNA, 23 nt, Human
uaaccaaaaucuuuuuagauguc

SEQ ID NO: 786078 - RNA, 24 nt, Human
uacaaugaauauaaauuaacauua

SEQ ID NO: 786079 - RNA, 26 nt, Human
uacacacacacacacacacacacccc

SEQ ID NO: 786080 - RNA, 23 nt, Human
uaguccacaaaagcaaaacauga

SEQ ID NO: 786081 - RNA, 31 nt, Human
uauaauaugcaaacauacacacacacacaca

SEQ ID NO: 786082 - RNA, 24 nt, Human
ucaacauuaggcaaauagacccaa

SEQ ID NO: 786083 - RNA, 18 nt, Human
ucacugcaaccuccgccu

SEQ ID NO: 786084 - RNA, 20 nt, Human
ucacugcaaccuccgccuga

SEQ ID NO: 786085 - RNA, 21 nt, Human
ucacugcaaccuccgccugaa

SEQ ID NO: 786086 - RNA, 23 nt, Human
ucacugcaaccuccgccugaagg

SEQ ID NO: 786087 - RNA, 24 nt, Human
ucacugcaaccuccgccugaaggg

SEQ ID NO: 786088 - RNA, 23 nt, Human
ucagaaauaccaccagaaaccau

SEQ ID NO: 786089 - RNA, 24 nt, Human
uccaagaaucuaauugucaacauu

SEQ ID NO: 786090 - RNA, 27 nt, Human
uccauuuuucuaaauaauauauccucu

SEQ ID NO: 786091 - RNA, 18 nt, Human
uccccucacuccagcaca

SEQ ID NO: 786092 - RNA, 18 nt, Human
ucgcccaggcuggagugc

SEQ ID NO: 786093 - RNA, 22 nt, Human
ucuaaauaauauauccucuuua

SEQ ID NO: 786094 - RNA, 18 nt, Human
ucuaugauuggcagaagc

SEQ ID NO: 786095 - RNA, 22 nt, Human
ucuugcacugucgcccaggcug

SEQ ID NO: 786096 - RNA, 23 nt, Human
ucuugcacugucgcccaggcugg

SEQ ID NO: 786097 - RNA, 24 nt, Human
ucuugcacugucgcccaggcugga

SEQ ID NO: 786098 - RNA, 18 nt, Human
ugaauguaaccaggaaga

SEQ ID NO: 786099 - RNA, 20 nt, Human
ugacaagauacaaagaucug

SEQ ID NO: 786100 - RNA, 21 nt, Human
ugaggcacaugcuaacugaaa

SEQ ID NO: 786101 - RNA, 20 nt, Human
ugaggcccgggaagcugcgg

SEQ ID NO: 786102 - RNA, 26 nt, Human
ugcaaaaaaggcuggaaaaauagcua

SEQ ID NO: 786103 - RNA, 21 nt, Human
ugcaaacaaaauaucugaaca

SEQ ID NO: 786104 - RNA, 31 nt, Human
ugcaaacauacacacacacacacacacacag

SEQ ID NO: 786105 - RNA, 24 nt, Human
ugcacugucgcccaggcuggagug

SEQ ID NO: 786106 - RNA, 23 nt, Human
uggagugcaauggcacaaucucg

SEQ ID NO: 786107 - RNA, 24 nt, Human
uggagugcaauggcacaaucucgg

SEQ ID NO: 786108 - RNA, 24 nt, Human
uggcacaaucucggcucacugcaa

SEQ ID NO: 786109 - RNA, 20 nt, Human
ugggacaccacauuuuaaaa

SEQ ID NO: 786110 - RNA, 27 nt, Human
uggugacaagauacaaagaucuguuuc

SEQ ID NO: 786111 - RNA, 24 nt, Human
ugguguuuucuucccuucccauuu

SEQ ID NO: 786112 - RNA, 22 nt, Human
uguaaagaaaaccuguagucac

SEQ ID NO: 786113 - RNA, 19 nt, Human
ugucaacauuaggcaaaua

SEQ ID NO: 786114 - RNA, 26 nt, Human
ugucacaaaaugcacagaucuguucc

SEQ ID NO: 786115 - RNA, 18 nt, Human
uguccuacaucugcacaa

SEQ ID NO: 786116 - RNA, 20 nt, Human
ugucgcccaggcuggagugc

SEQ ID NO: 786117 - RNA, 22 nt, Human
ugucgcccaggcuggagugcaa

SEQ ID NO: 786118 - RNA, 19 nt, Human
uuaaaauaagaacuaaguc

SEQ ID NO: 786119 - RNA, 21 nt, Human
uuaaauuagaaagcugccgac

SEQ ID NO: 786120 - RNA, 26 nt, Human
uuaacaccaucuaaaauaaauagauu

SEQ ID NO: 786121 - RNA, 22 nt, Human
uuaaggugcuaaugauauguca

SEQ ID NO: 786122 - RNA, 23 nt, Human
uuccccuacaggacuuucuuaaa

SEQ ID NO: 786123 - RNA, 18 nt, Human
uugaaugcaugaauucgc

SEQ ID NO: 786124 - RNA, 24 nt, Human
uugcacugucgcccaggcuggagu

SEQ ID NO: 786125 - RNA, 22 nt, Human
uuuaaaugcuguccuuaccuua

SEQ ID NO: 786126 - RNA, 26 nt, Human
uuuaccauuugucccaauuauugacc

SEQ ID NO: 786127 - RNA, 20 nt, Human
uuuuaaaaucaucuuuacca

SEQ ID NO: 786128 - RNA, 21 nt, Human
uuuuggggaggacugaacacu

SEQ ID NO: 786129 - RNA, 25 nt, Human
uuuuggggaggacugaacacuggua

SEQ ID NO: 786130 - RNA, 20 nt, Human
aaaaagaaaaauacaguaga

SEQ ID NO: 786131 - RNA, 24 nt, Human
aaauauaacugucagcugcaugaa

SEQ ID NO: 786132 - RNA, 20 nt, Human
aacacuuccaugcuguccuc

SEQ ID NO: 786133 - RNA, 23 nt, Human
aagaaaugcaguaaguauaaaau

SEQ ID NO: 786134 - RNA, 23 nt, Human
aagaagaggaaggggaggcagag

SEQ ID NO: 786135 - RNA, 23 nt, Human
aagaagaggaaggggaggcagag

SEQ ID NO: 786136 - RNA, 24 nt, Human
aagaagaggaaggggaggcagagg

SEQ ID NO: 786137 - RNA, 19 nt, Human
aagaggaaggggaggcaga

SEQ ID NO: 786138 - RNA, 22 nt, Human
aagcagcagggcuggaagacuu

SEQ ID NO: 786139 - RNA, 25 nt, Human
aagcagcagggcuggaagacuugca

SEQ ID NO: 786140 - RNA, 18 nt, Human
aaggaaaugcaaauacuu

SEQ ID NO: 786141 - RNA, 22 nt, Human
aaggggaggcagaggaucaaaa

SEQ ID NO: 786142 - RNA, 21 nt, Human
aaugcaaauacuuggccaccu

SEQ ID NO: 786143 - RNA, 23 nt, Human
acaaauauaacugucagcugcau

SEQ ID NO: 786144 - RNA, 26 nt, Human
acaaaugucucaaaaaaugcacagag

SEQ ID NO: 786145 - RNA, 22 nt, Human
acaagguuuucuucaauuauag

SEQ ID NO: 786146 - RNA, 24 nt, Human
acagguuacuuuuaacacaagguu

SEQ ID NO: 786147 - RNA, 20 nt, Human
accagugucaauauugcuuu

SEQ ID NO: 786148 - RNA, 21 nt, Human
acuagccggguagccuggaac

SEQ ID NO: 786149 - RNA, 23 nt, Human
agacuagccggguagccuggaac

SEQ ID NO: 786150 - RNA, 19 nt, Human
agaggaaggggaggcagag

SEQ ID NO: 786151 - RNA, 21 nt, Human
agaggaaggggaggcagagga

SEQ ID NO: 786152 - RNA, 21 nt, Human
agcauccuaacucuuuaucac

SEQ ID NO: 786153 - RNA, 18 nt, Human
aggaaauaaauuaagucu

SEQ ID NO: 786154 - RNA, 18 nt, Human
aggaaggggaggcagagg

SEQ ID NO: 786155 - RNA, 19 nt, Human
aggaaggggaggcagagga

SEQ ID NO: 786156 - RNA, 25 nt, Human
aguaaaugaauccaaguauuucugc

SEQ ID NO: 786157 - RNA, 19 nt, Human
aguccugcuucuaauuucu

SEQ ID NO: 786158 - RNA, 19 nt, Human
aguucacuuuugagcaucc

SEQ ID NO: 786159 - RNA, 21 nt, Human
auauccuuuuagguaguuucc

SEQ ID NO: 786160 - RNA, 22 nt, Human
augaggccguguggcucaggga

SEQ ID NO: 786161 - RNA, 20 nt, Human
auuuuggguauacuacuggg

SEQ ID NO: 786162 - RNA, 22 nt, Human
caaaaaaugcacagagcaaaaa

SEQ ID NO: 786163 - RNA, 24 nt, Human
caaacagaucagucuaacagcuaa

SEQ ID NO: 786164 - RNA, 20 nt, Human
caagguuuucuucaauuaua

SEQ ID NO: 786165 - RNA, 25 nt, Human
cacuaaaugucaauaacugcccuag

SEQ ID NO: 786166 - RNA, 19 nt, Human
cacuucucccucccagccu

SEQ ID NO: 786167 - RNA, 18 nt, Human
cagaagacggggccgugc

SEQ ID NO: 786168 - RNA, 18 nt, Human
cagacacuuuauuuaaaa

SEQ ID NO: 786169 - RNA, 23 nt, Human
cagagacgcuucagaugagggag

SEQ ID NO: 786170 - RNA, 20 nt, Human
cagcauauuugguugacagu

SEQ ID NO: 786171 - RNA, 20 nt, Human
ccacuggaguauucuuuaga

SEQ ID NO: 786172 - RNA, 20 nt, Human
ccauauuagaaauaaaagca

SEQ ID NO: 786173 - RNA, 21 nt, Human
cccacuggaguauucuuuaga

SEQ ID NO: 786174 - RNA, 21 nt, Human
ccccugagguugacaaacgcu

SEQ ID NO: 786175 - RNA, 24 nt, Human
ccccugagguugacaaacgcugau

SEQ ID NO: 786176 - RNA, 18 nt, Human
cccucaagauuccucucc

SEQ ID NO: 786177 - RNA, 21 nt, Human
ccugagguugacaaacgcuga

SEQ ID NO: 786178 - RNA, 20 nt, Human
cgggcggggaccugggccga

SEQ ID NO: 786179 - RNA, 19 nt, Human
cggggaccugggccguucc

SEQ ID NO: 786180 - RNA, 20 nt, Human
cuaaauagucccaauacuga

SEQ ID NO: 786181 - RNA, 19 nt, Human
cucaagauuccucucccca

SEQ ID NO: 786182 - RNA, 21 nt, Human
cucaagauuccucuccccacu

SEQ ID NO: 786183 - RNA, 21 nt, Human
cugcccgggaccugcgggcgg

SEQ ID NO: 786184 - RNA, 23 nt, Human
cuguccaaugcagguuauuuagc

SEQ ID NO: 786185 - RNA, 21 nt, Human
cuucuucagaauaaauuccag

SEQ ID NO: 786186 - RNA, 20 nt, Human
gaaaugcaaauacuuggcca

SEQ ID NO: 786187 - RNA, 25 nt, Human
gaaugcacuguggaguuaacuguga

SEQ ID NO: 786188 - RNA, 23 nt, Human
gaccugcgggcggggaccugggc

SEQ ID NO: 786189 - RNA, 21 nt, Human
gaccugggccguucccgaggc

SEQ ID NO: 786190 - RNA, 23 nt, Human
gagcagaaccaggaaauucugga

SEQ ID NO: 786191 - RNA, 19 nt, Human
gagcagguaaaauugugau

SEQ ID NO: 786192 - RNA, 26 nt, Human
gaguaaaugaauccaaguauuucugc

SEQ ID NO: 786193 - RNA, 22 nt, Human
gcacaucuguuucuuucauaca

SEQ ID NO: 786194 - RNA, 19 nt, Human
gcagaagacggggccgugc

SEQ ID NO: 786195 - RNA, 21 nt, Human
gcugcaugaaugcacugugga

SEQ ID NO: 786196 - RNA, 18 nt, Human
ggaucccuggccucuacu

SEQ ID NO: 786197 - RNA, 18 nt, Human
gguaguuuccugcuucac

SEQ ID NO: 786198 - RNA, 20 nt, Human
guagagcaccaaauagaaua

SEQ ID NO: 786199 - RNA, 18 nt, Human
guauacuacugggugaaa

SEQ ID NO: 786200 - RNA, 20 nt, Human
gugccaucacugaacaaaau

SEQ ID NO: 786201 - RNA, 18 nt, Human
gugucuggcaagcagcag

SEQ ID NO: 786202 - RNA, 20 nt, Human
gugugucuggcaagcagcag

SEQ ID NO: 786203 - RNA, 19 nt, Human
uaaaagcaaaugaaaauga

SEQ ID NO: 786204 - RNA, 23 nt, Human
uaaaccaauuacuucuauuccaa

SEQ ID NO: 786205 - RNA, 20 nt, Human
uaaagaacaagauaucaagu

SEQ ID NO: 786206 - RNA, 21 nt, Human
uaaauagucccaauacugaca

SEQ ID NO: 786207 - RNA, 21 nt, Human
uaacugggaagauuuuccaca

SEQ ID NO: 786208 - RNA, 18 nt, Human
uaagaaaugcaguaagua

SEQ ID NO: 786209 - RNA, 22 nt, Human
uaagaggagguuuuaagacuca

SEQ ID NO: 786210 - RNA, 24 nt, Human
uaagcuggaagaggagguuuccaa

SEQ ID NO: 786211 - RNA, 20 nt, Human
uacagugccaucacugaaca

SEQ ID NO: 786212 - RNA, 24 nt, Human
uacagugccaucacugaacaaaau

SEQ ID NO: 786213 - RNA, 24 nt, Human
uagaauauucucaacaaaugucuc

SEQ ID NO: 786214 - RNA, 19 nt, Human
uagcuagugggaugcucuc

SEQ ID NO: 786215 - RNA, 19 nt, Human
uagucugcaaacuugaaau

SEQ ID NO: 786216 - RNA, 22 nt, Human
ucagaguuucaaucgguucuuu

SEQ ID NO: 786217 - RNA, 23 nt, Human
ucauacuuagaaaaucauaagcu

SEQ ID NO: 786218 - RNA, 22 nt, Human
ucaugacaucaaaaaugucucc

SEQ ID NO: 786219 - RNA, 19 nt, Human
uccagugauaacauauccu

SEQ ID NO: 786220 - RNA, 19 nt, Human
ucccuggccucuacucacu

SEQ ID NO: 786221 - RNA, 21 nt, Human
ucuauguuaucugcccgggac

SEQ ID NO: 786222 - RNA, 18 nt, Human
ucugaaacccagacacuu

SEQ ID NO: 786223 - RNA, 19 nt, Human
ucugaagucugaaauaacu

SEQ ID NO: 786224 - RNA, 19 nt, Human
ucugcaaacuugaaaugau

SEQ ID NO: 786225 - RNA, 21 nt, Human
ucuguuuuuucacugcugugu

SEQ ID NO: 786226 - RNA, 23 nt, Human
ugagacaaacaacugcuacaaac

SEQ ID NO: 786227 - RNA, 23 nt, Human
ugauacgugagcagaaccaggaa

SEQ ID NO: 786228 - RNA, 18 nt, Human
ugcccgggaccugcgggc

SEQ ID NO: 786229 - RNA, 22 nt, Human
uggcaaggaacacuugaaauau

SEQ ID NO: 786230 - RNA, 22 nt, Human
ugguuggacuaaauagucccaa

SEQ ID NO: 786231 - RNA, 21 nt, Human
uguaaaauaucucauuaauaa

SEQ ID NO: 786232 - RNA, 24 nt, Human
ugucuaguacugaacuguccaaua

SEQ ID NO: 786233 - RNA, 23 nt, Human
ugucucaaaaaaugcacagagca

SEQ ID NO: 786234 - RNA, 18 nt, Human
uguuaucugcccgggacc

SEQ ID NO: 786235 - RNA, 19 nt, Human
uuaaucaggcaucacaugc

SEQ ID NO: 786236 - RNA, 19 nt, Human
uuagaaauaaaagcaaaug

SEQ ID NO: 786237 - RNA, 18 nt, Human
uucacucucauuguuccc

SEQ ID NO: 786238 - RNA, 19 nt, Human
uuccaugaggagauggcag

SEQ ID NO: 786239 - RNA, 19 nt, Human
uuggcacgacuaccauuuc

SEQ ID NO: 786240 - RNA, 20 nt, Human
uuugaacuaugucuugugca

SEQ ID NO: 786241 - RNA, 21 nt, Human
uuuuucacugcuguguucugu

SEQ ID NO: 786242 - RNA, 22 nt, Human
aaaauuuucucauauccuaagu

SEQ ID NO: 786243 - RNA, 19 nt, Human
acagcaguugguggcuuga

SEQ ID NO: 786244 - RNA, 19 nt, Human
agcaguugguggcuugaaa

SEQ ID NO: 786245 - RNA, 18 nt, Human
cccugcacgggaugcucc

SEQ ID NO: 786246 - RNA, 19 nt, Human
ggagaggugggggaggauc

SEQ ID NO: 786247 - RNA, 21 nt, Human
gggaacuccugcggagaggug

SEQ ID NO: 786248 - RNA, 18 nt, Human
ugcggagaggugggggag

SEQ ID NO: 786249 - RNA, 20 nt, Human
ugcggagaggugggggagga

SEQ ID NO: 786250 - RNA, 19 nt, Human
uggggacagcaguuggugg

SEQ ID NO: 786251 - RNA, 21 nt, Human
uuccuuggggacagcaguugg

SEQ ID NO: 786252 - RNA, 22 nt, Human
aaaaaacaggaaaccaaaccua

SEQ ID NO: 786253 - RNA, 18 nt, Human
aaaaacaggaaaccaaac

SEQ ID NO: 786254 - RNA, 20 nt, Human
aaaacaagucauuccaagca

SEQ ID NO: 786255 - RNA, 26 nt, Human
aaaauuucucacaagcauaaucacua

SEQ ID NO: 786256 - RNA, 20 nt, Human
aaagggguaagaugagaaaa

SEQ ID NO: 786257 - RNA, 27 nt, Human
aaauaucucuucauagucuacaagucc

SEQ ID NO: 786258 - RNA, 21 nt, Human
aaaugccacagcaacucauga

SEQ ID NO: 786259 - RNA, 19 nt, Human
aagcaugcuuacaguaggc

SEQ ID NO: 786260 - RNA, 25 nt, Human
aagcgucccaucugauaagucucac

SEQ ID NO: 786261 - RNA, 19 nt, Human
aagguuuggauagcuaguu

SEQ ID NO: 786262 - RNA, 20 nt, Human
acaaaaaacaggaaaccaaa

SEQ ID NO: 786263 - RNA, 19 nt, Human
acagugccacaacugcggc

SEQ ID NO: 786264 - RNA, 23 nt, Human
acagugcugggauuacaggcgua

SEQ ID NO: 786265 - RNA, 24 nt, Human
accaaaacaagucauuccaagcau

SEQ ID NO: 786266 - RNA, 24 nt, Human
acucuuguugcccaggcuggagug

SEQ ID NO: 786267 - RNA, 22 nt, Human
agacaaaaaacaggaaaccaaa

SEQ ID NO: 786268 - RNA, 27 nt, Human
agacaaaaaacaggaaaccaaaccuag

SEQ ID NO: 786269 - RNA, 21 nt, Human
agaggcauagauccuaucagc

SEQ ID NO: 786270 - RNA, 20 nt, Human
agcauagcagagguagaagg

SEQ ID NO: 786271 - RNA, 18 nt, Human
aggcauagacuaguuacc

SEQ ID NO: 786272 - RNA, 19 nt, Human
aggcguaaacuacugcacc

SEQ ID NO: 786273 - RNA, 20 nt, Human
agggguucagcauagcagag

SEQ ID NO: 786274 - RNA, 24 nt, Human
aggugauccauccgccucggccuc

SEQ ID NO: 786275 - RNA, 21 nt, Human
aguagcugggauuacaggcau

SEQ ID NO: 786276 - RNA, 24 nt, Human
agugauuuuccugccucagccucc

SEQ ID NO: 786277 - RNA, 23 nt, Human
agugcaauggugcgaucuuggcu

SEQ ID NO: 786278 - RNA, 24 nt, Human
agugcaauggugcgaucuuggcuc

SEQ ID NO: 786279 - RNA, 18 nt, Human
agugcugggauuacaggc

SEQ ID NO: 786280 - RNA, 18 nt, Human
agugcugggauuacaggc

SEQ ID NO: 786281 - RNA, 24 nt, Human
auagacaaaaaacaggaaaccaaa

SEQ ID NO: 786282 - RNA, 23 nt, Human
auaggaagcaggaacaugugaaa

SEQ ID NO: 786283 - RNA, 26 nt, Human
auccuaucagcugaaaaccaaaacaa

SEQ ID NO: 786284 - RNA, 21 nt, Human
augcaggaaaggucaggaguu

SEQ ID NO: 786285 - RNA, 24 nt, Human
auggaguuucuccauguuggucag

SEQ ID NO: 786286 - RNA, 19 nt, Human
auuacacuuuuauuuuugc

SEQ ID NO: 786287 - RNA, 22 nt, Human
auucaucuccaaaauggauccc

SEQ ID NO: 786288 - RNA, 22 nt, Human
caaaauggauccacauaacuga

SEQ ID NO: 786289 - RNA, 21 nt, Human
caaaggcucagcccaggagga

SEQ ID NO: 786290 - RNA, 24 nt, Human
caagcgucccaucugauaagucuc

SEQ ID NO: 786291 - RNA, 22 nt, Human
caagugauuuuccugccucagc

SEQ ID NO: 786292 - RNA, 21 nt, Human
cacaacuaccacaugcaauca

SEQ ID NO: 786293 - RNA, 22 nt, Human
cacagcaacucaugagaugaag

SEQ ID NO: 786294 - RNA, 24 nt, Human
cacagugcugggauuacaggcgua

SEQ ID NO: 786295 - RNA, 24 nt, Human
caccaccaaauuagaaguauccca

SEQ ID NO: 786296 - RNA, 21 nt, Human
caccgcaaccuccgccucccg

SEQ ID NO: 786297 - RNA, 19 nt, Human
cacuccucccuccugccca

SEQ ID NO: 786298 - RNA, 24 nt, Human
cacucuuguugcccaggcuggagu

SEQ ID NO: 786299 - RNA, 18 nt, Human
cacugaaaaauguacaaa

SEQ ID NO: 786300 - RNA, 25 nt, Human
cagaaagcuuaaaugcugugaauca

SEQ ID NO: 786301 - RNA, 20 nt, Human
cagcccacagaaaccauuac

SEQ ID NO: 786302 - RNA, 19 nt, Human
cagccgcccgcuccguccg

SEQ ID NO: 786303 - RNA, 19 nt, Human
caggaaaggucaggaguua

SEQ ID NO: 786304 - RNA, 18 nt, Human
caggugcagggugaauga

SEQ ID NO: 786305 - RNA, 24 nt, Human
cagugcugggauuacaggcguaaa

SEQ ID NO: 786306 - RNA, 23 nt, Human
ccacagcaacucaugagaugaaa

SEQ ID NO: 786307 - RNA, 22 nt, Human
ccacagugcugggauuacaggc

SEQ ID NO: 786308 - RNA, 24 nt, Human
ccacagugcugggauuacaggcgu

SEQ ID NO: 786309 - RNA, 22 nt, Human
ccaccaaauuagaaguauccca

SEQ ID NO: 786310 - RNA, 19 nt, Human
ccauguuggucaggcuggu

SEQ ID NO: 786311 - RNA, 23 nt, Human
ccauguuggucaggcuggucucg

SEQ ID NO: 786312 - RNA, 18 nt, Human
cccacagaaaccauuaca

SEQ ID NO: 786313 - RNA, 18 nt, Human
cccccaaaggcucagccc

SEQ ID NO: 786314 - RNA, 19 nt, Human
cccgaccucaggugaucca

SEQ ID NO: 786315 - RNA, 22 nt, Human
cccgaccucaggugauccaucc

SEQ ID NO: 786316 - RNA, 23 nt, Human
cccgaguagcugggauuacaggc

SEQ ID NO: 786317 - RNA, 24 nt, Human
cccgaguagcugggauuacaggca

SEQ ID NO: 786318 - RNA, 23 nt, Human
cccggguucaagugauuuuccuc

SEQ ID NO: 786319 - RNA, 23 nt, Human
cccggguucaagugauuuuccug

SEQ ID NO: 786320 - RNA, 26 nt, Human
cccuccugcccaccaccucucaggaa

SEQ ID NO: 786321 - RNA, 23 nt, Human
ccgaguagcugggauuacaggca

SEQ ID NO: 786322 - RNA, 24 nt, Human
ccgaguagcugggauuacaggcau

SEQ ID NO: 786323 - RNA, 18 nt, Human
ccgcaaccuccgccuccc

SEQ ID NO: 786324 - RNA, 23 nt, Human
ccgcaaccuccgccucccggguu

SEQ ID NO: 786325 - RNA, 24 nt, Human
ccgcaaccuccgccucccggguuc

SEQ ID NO: 786326 - RNA, 24 nt, Human
ccgccucccggguucaagugauuu

SEQ ID NO: 786327 - RNA, 18 nt, Human
ccuauacuaaauaugguc

SEQ ID NO: 786328 - RNA, 20 nt, Human
ccucccggguucaagugauu

SEQ ID NO: 786329 - RNA, 19 nt, Human
ccucccuccugcccaccac

SEQ ID NO: 786330 - RNA, 22 nt, Human
ccucccuccugcccaccaccuc

SEQ ID NO: 786331 - RNA, 20 nt, Human
ccuccugcccaccaccucuc

SEQ ID NO: 786332 - RNA, 23 nt, Human
ccugccucagccucccgaguagc

SEQ ID NO: 786333 - RNA, 19 nt, Human
cgaccucaggugauccauc

SEQ ID NO: 786334 - RNA, 24 nt, Human
cgaccucaggugauccauccgccu

SEQ ID NO: 786335 - RNA, 24 nt, Human
cgccucggccucccacagugcugg

SEQ ID NO: 786336 - RNA, 21 nt, Human
cgcuaaauuaaccuguccugu

SEQ ID NO: 786337 - RNA, 24 nt, Human
cggguucaagugauuuuccugccu

SEQ ID NO: 786338 - RNA, 25 nt, Human
cgucuaucaccacaacuaccacaug

SEQ ID NO: 786339 - RNA, 19 nt, Human
cuacacaagcccaagccaa

SEQ ID NO: 786340 - RNA, 24 nt, Human
cucaccgcaaccuccgccucccgg

SEQ ID NO: 786341 - RNA, 24 nt, Human
cucagccucccgaguagcugggau

SEQ ID NO: 786342 - RNA, 24 nt, Human
cuccauguuggucaggcuggucuc

SEQ ID NO: 786343 - RNA, 18 nt, Human
cucuuguugcccaggcug

SEQ ID NO: 786344 - RNA, 23 nt, Human
cugccucagccucccgaguagcu

SEQ ID NO: 786345 - RNA, 23 nt, Human
cugggacauagacaaaaaacagg

SEQ ID NO: 786346 - RNA, 24 nt, Human
cuuguugcccaggcuggagugcaa

SEQ ID NO: 786347 - RNA, 26 nt, Human
gaaaaccaaaacaagucauuccaagc

SEQ ID NO: 786348 - RNA, 18 nt, Human
gaccucaggugauccauc

SEQ ID NO: 786349 - RNA, 23 nt, Human
gaccucaggugauccauccgccu

SEQ ID NO: 786350 - RNA, 24 nt, Human
gaccucaggugauccauccgccuc

SEQ ID NO: 786351 - RNA, 22 nt, Human
gagaaaagggaucaacaaaugu

SEQ ID NO: 786352 - RNA, 22 nt, Human
gagacagaguuucacucuuguu

SEQ ID NO: 786353 - RNA, 20 nt, Human
gagauggaguuucuccaugu

SEQ ID NO: 786354 - RNA, 24 nt, Human
gagauggaguuucuccauguuggu

SEQ ID NO: 786355 - RNA, 24 nt, Human
gaguagcugggauuacaggcaugc

SEQ ID NO: 786356 - RNA, 23 nt, Human
gauuacaggcguaaacuacugca

SEQ ID NO: 786357 - RNA, 19 nt, Human
gauugugaauucaggagaa

SEQ ID NO: 786358 - RNA, 20 nt, Human
gcaccaccacaccuggcuaa

SEQ ID NO: 786359 - RNA, 19 nt, Human
gcccaggcuggagugcaau

SEQ ID NO: 786360 - RNA, 18 nt, Human
gccugcgcacagugccac

SEQ ID NO: 786361 - RNA, 21 nt, Human
gccugcgcacagugccacaac

SEQ ID NO: 786362 - RNA, 22 nt, Human
ggaguuucuccauguuggucag

SEQ ID NO: 786363 - RNA, 23 nt, Human
ggaguuucuccauguuggucagg

SEQ ID NO: 786364 - RNA, 24 nt, Human
ggauuauauuuguuuccauuuagg

SEQ ID NO: 786365 - RNA, 20 nt, Human
gggauuauauuuguuuccau

SEQ ID NO: 786366 - RNA, 22 nt, Human
ggguucaagugauuuuccugcc

SEQ ID NO: 786367 - RNA, 23 nt, Human
ggguucaagugauuuuccugccu

SEQ ID NO: 786368 - RNA, 20 nt, Human
guagcugggauuacaggcau

SEQ ID NO: 786369 - RNA, 24 nt, Human
gugauccauccgccucggccuccc

SEQ ID NO: 786370 - RNA, 24 nt, Human
gugauuuuccugccucagccuccc

SEQ ID NO: 786371 - RNA, 21 nt, Human
gugggauuauauuuguuucca

SEQ ID NO: 786372 - RNA, 20 nt, Human
uaaaagacaaacaaauaaaa

SEQ ID NO: 786373 - RNA, 22 nt, Human
uaaauacaaagagucuacagcc

SEQ ID NO: 786374 - RNA, 23 nt, Human
uaaauacaaagagucuacagccc

SEQ ID NO: 786375 - RNA, 22 nt, Human
uacaggcaugcaccaccacacc

SEQ ID NO: 786376 - RNA, 23 nt, Human
uaccuccuagcauggcucaaagu

SEQ ID NO: 786377 - RNA, 23 nt, Human
uagacaaaaaacaggaaaccaaa

SEQ ID NO: 786378 - RNA, 21 nt, Human
uagagggcacaaaaagcugca

SEQ ID NO: 786379 - RNA, 20 nt, Human
uagcauggcucaaaguuucu

SEQ ID NO: 786380 - RNA, 24 nt, Human
uaguagagauggaguuucuccaug

SEQ ID NO: 786381 - RNA, 26 nt, Human
uauaagacuuaaucagaacauacagg

SEQ ID NO: 786382 - RNA, 20 nt, Human
uaucaccacaacuaccacau

SEQ ID NO: 786383 - RNA, 21 nt, Human
uauuacaaaauuucucacaag

SEQ ID NO: 786384 - RNA, 19 nt, Human
ucaagugauuuuccugccu

SEQ ID NO: 786385 - RNA, 24 nt, Human
ucaccgcaaccuccgccucccggg

SEQ ID NO: 786386 - RNA, 25 nt, Human
ucaccgcaaccuccgccucccgggu

SEQ ID NO: 786387 - RNA, 27 nt, Human
ucaccgcaaccuccgccucccggguuc

SEQ ID NO: 786388 - RNA, 22 nt, Human
ucacucuuguugcccaggcugg

SEQ ID NO: 786389 - RNA, 23 nt, Human
ucacucuuguugcccaggcugga

SEQ ID NO: 786390 - RNA, 20 nt, Human
ucagccucccgaguagcugg

SEQ ID NO: 786391 - RNA, 19 nt, Human
ucaucuccaaaauggaucc

SEQ ID NO: 786392 - RNA, 23 nt, Human
uccacaauccgcuaaauuaaccu

SEQ ID NO: 786393 - RNA, 24 nt, Human
ucccacagugcugggauuacaggc

SEQ ID NO: 786394 - RNA, 24 nt, Human
ucccgaguagcugggauuacaggc

SEQ ID NO: 786395 - RNA, 18 nt, Human
ucccggguucaagugauu

SEQ ID NO: 786396 - RNA, 24 nt, Human
ucccggguucaagugauuuuccug

SEQ ID NO: 786397 - RNA, 22 nt, Human
uccucaccucacccaggcgguc

SEQ ID NO: 786398 - RNA, 18 nt, Human
uccugcccaccaccucuc

SEQ ID NO: 786399 - RNA, 23 nt, Human
ucucacuccucccuccugcccac

SEQ ID NO: 786400 - RNA, 21 nt, Human
ucugaaacuauaccagcaaau

SEQ ID NO: 786401 - RNA, 22 nt, Human
ucuuguugcccaggcuggagug

SEQ ID NO: 786402 - RNA, 19 nt, Human
ugaaaaauguacaaagaaa

SEQ ID NO: 786403 - RNA, 23 nt, Human
ugaaaucacugcuauuucacugu

SEQ ID NO: 786404 - RNA, 22 nt, Human
ugaaggcucaggcugacacagu

SEQ ID NO: 786405 - RNA, 23 nt, Human
ugacacaguuuaacaacaucuuu

SEQ ID NO: 786406 - RNA, 22 nt, Human
ugacuggggcuacacaagccca

SEQ ID NO: 786407 - RNA, 24 nt, Human
ugagaaaagggaucaacaaaugua

SEQ ID NO: 786408 - RNA, 23 nt, Human
ugcaauggugcgaucuuggcucc

SEQ ID NO: 786409 - RNA, 19 nt, Human
ugcaggaaaggucaggagu

SEQ ID NO: 786410 - RNA, 18 nt, Human
ugcaguuggcaggugcag

SEQ ID NO: 786411 - RNA, 18 nt, Human
ugcccaggcuggagugca

SEQ ID NO: 786412 - RNA, 21 nt, Human
ugcccaggcuggagugcaaug

SEQ ID NO: 786413 - RNA, 24 nt, Human
ugcccaggcuggagugcaauggug

SEQ ID NO: 786414 - RNA, 19 nt, Human
ugccccaacuccuauacua

SEQ ID NO: 786415 - RNA, 24 nt, Human
ugccucagccucccgaguagcugg

SEQ ID NO: 786416 - RNA, 27 nt, Human
ugcugggauuacaggcguaaacuacug

SEQ ID NO: 786417 - RNA, 18 nt, Human
ugcuuuguaaaccuagac

SEQ ID NO: 786418 - RNA, 23 nt, Human
uggagugcaauggugcgaucuug

SEQ ID NO: 786419 - RNA, 24 nt, Human
uggagugcaauggugcgaucuugg

SEQ ID NO: 786420 - RNA, 24 nt, Human
uggaguuucuccauguuggucagg

SEQ ID NO: 786421 - RNA, 24 nt, Human
uggcaggugcagggugaaugaggg

SEQ ID NO: 786422 - RNA, 29 nt, Human
uggcuaauuuuguauuuuuaguagagaug

SEQ ID NO: 786423 - RNA, 21 nt, Human
ugggauuacaggcaugcacca

SEQ ID NO: 786424 - RNA, 24 nt, Human
ugggauuacaggcaugcaccacca

SEQ ID NO: 786425 - RNA, 19 nt, Human
ugggauuacaggcguaaac

SEQ ID NO: 786426 - RNA, 19 nt, Human
ugggauuacaggcguaaac

SEQ ID NO: 786427 - RNA, 24 nt, Human
ugggauuacaggcguaaacuacug

SEQ ID NO: 786428 - RNA, 24 nt, Human
ugggauuacaggcguaaacuacug

SEQ ID NO: 786429 - RNA, 25 nt, Human
ugggauuacaggcguaaacuacugc

SEQ ID NO: 786430 - RNA, 23 nt, Human
uggucaggcuggucucgaauucc

SEQ ID NO: 786431 - RNA, 19 nt, Human
uggucucgaauucccgacc

SEQ ID NO: 786432 - RNA, 23 nt, Human
ugguuagaaacuguuguccuuaa

SEQ ID NO: 786433 - RNA, 19 nt, Human
uguacaaagaaacaccacc

SEQ ID NO: 786434 - RNA, 20 nt, Human
uguccuuaagccuuuguguu

SEQ ID NO: 786435 - RNA, 19 nt, Human
uguggcaagaccuaagaag

SEQ ID NO: 786436 - RNA, 20 nt, Human
uguugcccaggcuggagugc

SEQ ID NO: 786437 - RNA, 18 nt, Human
uuaguagagauggaguuu

SEQ ID NO: 786438 - RNA, 24 nt, Human
uuaguagagauggaguuucuccau

SEQ ID NO: 786439 - RNA, 21 nt, Human
uucaagugauuuuccugccuc

SEQ ID NO: 786440 - RNA, 23 nt, Human
uucaagugauuuuccugccucag

SEQ ID NO: 786441 - RNA, 24 nt, Human
uucaagugauuuuccugccucagc

SEQ ID NO: 786442 - RNA, 24 nt, Human
uucacucuuguugcccaggcugga

SEQ ID NO: 786443 - RNA, 20 nt, Human
uugcauagaaaaggguccug

SEQ ID NO: 786444 - RNA, 18 nt, Human
uugcccaggcuggagugc

SEQ ID NO: 786445 - RNA, 23 nt, Human
uuguauuuuuaguagagauggag

SEQ ID NO: 786446 - RNA, 24 nt, Human
uuucacucuuguugcccaggcugg

SEQ ID NO: 786447 - RNA, 22 nt, Human
uuucagaauaaaaggaucaagg

SEQ ID NO: 786448 - RNA, 23 nt, Human
uuucaguagguggcauaaagggg

SEQ ID NO: 786449 - RNA, 21 nt, Human
uuucuccauguuggucaggcu

SEQ ID NO: 786450 - RNA, 20 nt, Human
uuuucuccuuuccugcagcc

SEQ ID NO: 786451 - RNA, 19 nt, Human
uuuuguauuuuuaguagag

SEQ ID NO: 786452 - RNA, 20 nt, Human
uuuuguauuuuuaguagaga

SEQ ID NO: 786453 - RNA, 19 nt, Human
uuuuuaguagagauggagu

SEQ ID NO: 786454 - RNA, 22 nt, Human
aaaaacacagaaaagaaaguag

SEQ ID NO: 786455 - RNA, 21 nt, Human
aaaacaaaaaauugaugaacc

SEQ ID NO: 786456 - RNA, 18 nt, Human
aaaagcaauaaauacaug

SEQ ID NO: 786457 - RNA, 23 nt, Human
aaacacagaaaagaaaguaaaaa

SEQ ID NO: 786458 - RNA, 23 nt, Human
aaacagaaauaaccaucauuaau

SEQ ID NO: 786459 - RNA, 19 nt, Human
aaccacacacacacacaua

SEQ ID NO: 786460 - RNA, 20 nt, Human
aagaaaagacagauaaauga

SEQ ID NO: 786461 - RNA, 20 nt, Human
acaggauaaugaucaccuac

SEQ ID NO: 786462 - RNA, 20 nt, Human
acauggauaaugaauauaug

SEQ ID NO: 786463 - RNA, 18 nt, Human
accacacacacacacaua

SEQ ID NO: 786464 - RNA, 18 nt, Human
acuaaaacagaaauaacc

SEQ ID NO: 786465 - RNA, 27 nt, Human
agacagauaaaugaauagaagggaccc

SEQ ID NO: 786466 - RNA, 21 nt, Human
agcugggcacaguggcucaug

SEQ ID NO: 786467 - RNA, 24 nt, Human
aggaaaaaauuaacuuaaaaacac

SEQ ID NO: 786468 - RNA, 22 nt, Human
agggauuaaagacuuaagugua

SEQ ID NO: 786469 - RNA, 24 nt, Human
aguaaaaaacaaaaaauugaugaa

SEQ ID NO: 786470 - RNA, 24 nt, Human
aguggcucaugccuauaaucucag

SEQ ID NO: 786471 - RNA, 23 nt, Human
auaucaaaaauauauaaaaagca

SEQ ID NO: 786472 - RNA, 23 nt, Human
auccuuucaucucucucaaaagu

SEQ ID NO: 786473 - RNA, 22 nt, Human
aucucucucaaaaguucacaua

SEQ ID NO: 786474 - RNA, 19 nt, Human
augaaccacuaaaacagaa

SEQ ID NO: 786475 - RNA, 19 nt, Human
augccuauaaucucagcac

SEQ ID NO: 786476 - RNA, 23 nt, Human
augucacaauuuaucuaaccagu

SEQ ID NO: 786477 - RNA, 21 nt, Human
auucacuuuguuugcaguugg

SEQ ID NO: 786478 - RNA, 20 nt, Human
auuuguucauuauuuuccuc

SEQ ID NO: 786479 - RNA, 21 nt, Human
caaaaaagagaaaaaucaagu

SEQ ID NO: 786480 - RNA, 22 nt, Human
caaaaaauugaugaaccacuaa

SEQ ID NO: 786481 - RNA, 27 nt, Human
caaaaacuaaaguagcaaauucaauga

SEQ ID NO: 786482 - RNA, 23 nt, Human
caaaccccaauagcuagcaaaag

SEQ ID NO: 786483 - RNA, 23 nt, Human
caaggaaaaaauuaacuuaaaaa

SEQ ID NO: 786484 - RNA, 18 nt, Human
cacuaaaacagaaauaac

SEQ ID NO: 786485 - RNA, 21 nt, Human
cagcauuuacauuuuucuguu

SEQ ID NO: 786486 - RNA, 20 nt, Human
caugccuauaaucucagcac

SEQ ID NO: 786487 - RNA, 24 nt, Human
caugccuauaaucucagcacuuug

SEQ ID NO: 786488 - RNA, 22 nt, Human
ccacacacacacacauaaacac

SEQ ID NO: 786489 - RNA, 33 nt, Human
ccaugugcaucuaaccacacacacacacauagu

SEQ ID NO: 786490 - RNA, 22 nt, Human
cccucuacaaacaguacuucaa

SEQ ID NO: 786491 - RNA, 22 nt, Human
ccuauaaucucagcacuuuggg

SEQ ID NO: 786492 - RNA, 18 nt, Human
ccucuacaaacaguacuu

SEQ ID NO: 786493 - RNA, 24 nt, Human
cucaugccuauaaucucagcacuu

SEQ ID NO: 786494 - RNA, 19 nt, Human
cuccagguuuauaagaaaa

SEQ ID NO: 786495 - RNA, 19 nt, Human
cuuauaacuucuaagauuu

SEQ ID NO: 786496 - RNA, 18 nt, Human
cuuccauaccugucucca

SEQ ID NO: 786497 - RNA, 23 nt, Human
gaaguauguuacacaaccuuuaa

SEQ ID NO: 786498 - RNA, 19 nt, Human
gauauauuguauauauaca

SEQ ID NO: 786499 - RNA, 21 nt, Human
gcauucacuuuguuugcaguu

SEQ ID NO: 786500 - RNA, 21 nt, Human
ggacugcugguggaaguaugu

SEQ ID NO: 786501 - RNA, 19 nt, Human
gggaaguuucaucucacug

SEQ ID NO: 786502 - RNA, 18 nt, Human
gggcacaguggcucaugc

SEQ ID NO: 786503 - RNA, 24 nt, Human
gggcacaguggcucaugccuauaa

SEQ ID NO: 786504 - RNA, 23 nt, Human
gggcauucacuuuguuugcaguu

SEQ ID NO: 786505 - RNA, 23 nt, Human
guacaugguuucccaaaccccaa

SEQ ID NO: 786506 - RNA, 19 nt, Human
gucuggggcaaaaaagaga

SEQ ID NO: 786507 - RNA, 25 nt, Human
uaaaaacacagaaaagaaaguaaaa

SEQ ID NO: 786508 - RNA, 27 nt, Human
uaaaaagcaccuccagguuuauaagaa

SEQ ID NO: 786509 - RNA, 22 nt, Human
uaaaugaauagaaaaauaggca

SEQ ID NO: 786510 - RNA, 18 nt, Human
uaacaaaaaugauauauu

SEQ ID NO: 786511 - RNA, 21 nt, Human
uaagaaaaacaucugcuacau

SEQ ID NO: 786512 - RNA, 20 nt, Human
uaagggaggcugguuuagca

SEQ ID NO: 786513 - RNA, 24 nt, Human
uaauaguacaugguuucccaaacc

SEQ ID NO: 786514 - RNA, 19 nt, Human
uacaaacaguacuucaaca

SEQ ID NO: 786515 - RNA, 23 nt, Human
uacaaacaguacuucaacaaaca

SEQ ID NO: 786516 - RNA, 24 nt, Human
uacaaacaguacuucaacaaacau

SEQ ID NO: 786517 - RNA, 18 nt, Human
uagaaaaauaggcaaaua

SEQ ID NO: 786518 - RNA, 27 nt, Human
uagauuaagaaaaacaucugcuacaua

SEQ ID NO: 786519 - RNA, 20 nt, Human
uagcaaaaacuaaaguagca

SEQ ID NO: 786520 - RNA, 21 nt, Human
uagcaaaaacuaaaguagcaa

SEQ ID NO: 786521 - RNA, 24 nt, Human
uagcaaaaacuaaaguagcaaauu

SEQ ID NO: 786522 - RNA, 19 nt, Human
uaggauacuacguauaacc

SEQ ID NO: 786523 - RNA, 20 nt, Human
uagugagaagaagguagggu

SEQ ID NO: 786524 - RNA, 22 nt, Human
uauaagaaaagacagauaaaug

SEQ ID NO: 786525 - RNA, 21 nt, Human
uauaagauucaucuuguggag

SEQ ID NO: 786526 - RNA, 21 nt, Human
uaugaaaucuggaugaacacu

SEQ ID NO: 786527 - RNA, 18 nt, Human
ucacaggauaaugaucac

SEQ ID NO: 786528 - RNA, 22 nt, Human
ucacuuuguuugcaguuggggc

SEQ ID NO: 786529 - RNA, 23 nt, Human
ucagcugggcacaguggcucaug

SEQ ID NO: 786530 - RNA, 21 nt, Human
ucccugagugcuuuuuagguu

SEQ ID NO: 786531 - RNA, 23 nt, Human
ucuacaaacaguacuucaacaaa

SEQ ID NO: 786532 - RNA, 19 nt, Human
ucuuaugcauugaugcugc

SEQ ID NO: 786533 - RNA, 20 nt, Human
ugaagaaccauccaguccag

SEQ ID NO: 786534 - RNA, 21 nt, Human
ugaagaaccauccaguccaga

SEQ ID NO: 786535 - RNA, 21 nt, Human
ugagaguuuccuuauaacuuc

SEQ ID NO: 786536 - RNA, 26 nt, Human
ugcaaggaaaaaauuaacuuaaaaac

SEQ ID NO: 786537 - RNA, 23 nt, Human
ugccuauaaucucagcacuuugg

SEQ ID NO: 786538 - RNA, 21 nt, Human
uggcucaugccuauaaucuca

SEQ ID NO: 786539 - RNA, 24 nt, Human
uggcucaugccuauaaucucagca

SEQ ID NO: 786540 - RNA, 22 nt, Human
uguauauucuuccauaccuguc

SEQ ID NO: 786541 - RNA, 18 nt, Human
uuggagaccauccuuuca

SEQ ID NO: 786542 - RNA, 23 nt, Human
uuuaacaaaaaugauauauugua

SEQ ID NO: 786543 - RNA, 24 nt, Human
uuuagcaaaaacuaaaguagcaaa

SEQ ID NO: 786544 - RNA, 23 nt, Human
uuuuuccuuuuaauguaaauauu

SEQ ID NO: 786545 - RNA, 19 nt, Human
aaaacaaaugggugaagcc

SEQ ID NO: 786546 - RNA, 24 nt, Human
aaauggccucugagaaguaaaagu

SEQ ID NO: 786547 - RNA, 20 nt, Human
aagacaaaaauucuaggagc

SEQ ID NO: 786548 - RNA, 25 nt, Human
aauaaaaauuccuuuaauuuucaaa

SEQ ID NO: 786549 - RNA, 18 nt, Human
acacauacauauguauag

SEQ ID NO: 786550 - RNA, 20 nt, Human
acacauauacacauacauau

SEQ ID NO: 786551 - RNA, 24 nt, Human
acgagauaaauaaauacacuaaag

SEQ ID NO: 786552 - RNA, 25 nt, Human
agaaaaaaaguaacgagauaaauaa

SEQ ID NO: 786553 - RNA, 20 nt, Human
agacaaaaauucuaggagcu

SEQ ID NO: 786554 - RNA, 20 nt, Human
agauuuucaaauucagauaa

SEQ ID NO: 786555 - RNA, 18 nt, Human
agcaaaauuaaauuccau

SEQ ID NO: 786556 - RNA, 22 nt, Human
agcagcccaaaguaaaccaaac

SEQ ID NO: 786557 - RNA, 21 nt, Human
agcccaaaguaaaccaaacca

SEQ ID NO: 786558 - RNA, 23 nt, Human
agguaauauuacagcaaagaaaa

SEQ ID NO: 786559 - RNA, 23 nt, Human
agugaacauaaaacuauucuaaa

SEQ ID NO: 786560 - RNA, 22 nt, Human
caauucuuugacaaaaaaguac

SEQ ID NO: 786561 - RNA, 19 nt, Human
cagaagggcagcuugaacc

SEQ ID NO: 786562 - RNA, 25 nt, Human
cagcccaaaguaaaccaaaccaaaa

SEQ ID NO: 786563 - RNA, 19 nt, Human
ccacagcuacgacacacac

SEQ ID NO: 786564 - RNA, 18 nt, Human
cccaaaguaaaccaaacc

SEQ ID NO: 786565 - RNA, 21 nt, Human
cccaaaguaaaccaaaccaaa

SEQ ID NO: 786566 - RNA, 24 nt, Human
ccccaaaugcuaucaaauucauaa

SEQ ID NO: 786567 - RNA, 21 nt, Human
cuaggagcaaaauuaaauucc

SEQ ID NO: 786568 - RNA, 25 nt, Human
cuugaaccaagauuauuauguaaca

SEQ ID NO: 786569 - RNA, 18 nt, Human
gaagggcagcuugaacca

SEQ ID NO: 786570 - RNA, 20 nt, Human
gagauaaauaaauacacuaa

SEQ ID NO: 786571 - RNA, 18 nt, Human
gcagcccaaaguaaacca

SEQ ID NO: 786572 - RNA, 21 nt, Human
gcagcccaaaguaaaccaaac

SEQ ID NO: 786573 - RNA, 21 nt, Human
gcccaaaguaaaccaaaccaa

SEQ ID NO: 786574 - RNA, 24 nt, Human
gggaauuucuaaaauaucuaagau

SEQ ID NO: 786575 - RNA, 22 nt, Human
gguaauauuacagcaaagaaaa

SEQ ID NO: 786576 - RNA, 33 nt, Human
guguauacacauauacacauacauauguauagu

SEQ ID NO: 786577 - RNA, 24 nt, Human
uaaaauaucuaagauauugaucau

SEQ ID NO: 786578 - RNA, 19 nt, Human
uaacacaggucuaguccuu

SEQ ID NO: 786579 - RNA, 23 nt, Human
uaacaguauucacauuaaauuag

SEQ ID NO: 786580 - RNA, 21 nt, Human
uacacauauacacauacauau

SEQ ID NO: 786581 - RNA, 21 nt, Human
uaccauaauaauaaaaauucc

SEQ ID NO: 786582 - RNA, 28 nt, Human
uacugguuaguuuaauacuucccagucu

SEQ ID NO: 786583 - RNA, 19 nt, Human
uagaauaaaagggaaggau

SEQ ID NO: 786584 - RNA, 23 nt, Human
uagcagcccaaaguaaaccaaac

SEQ ID NO: 786585 - RNA, 19 nt, Human
uagcauuuaugaauaccua

SEQ ID NO: 786586 - RNA, 23 nt, Human
uauacacauacauauguauagug

SEQ ID NO: 786587 - RNA, 18 nt, Human
uauauauguguauacaca

SEQ ID NO: 786588 - RNA, 22 nt, Human
uauauguguauacacauauaca

SEQ ID NO: 786589 - RNA, 21 nt, Human
uaugagguuuauccauuuagc

SEQ ID NO: 786590 - RNA, 26 nt, Human
ucauauaaaauuagaaaaaaaguaac

SEQ ID NO: 786591 - RNA, 23 nt, Human
uccccaaaugcuaucaaauucau

SEQ ID NO: 786592 - RNA, 26 nt, Human
ucuaaaccacaauuaguuuaccagca

SEQ ID NO: 786593 - RNA, 22 nt, Human
ucucuauaugaaagguagaaau

SEQ ID NO: 786594 - RNA, 22 nt, Human
ugaaccaagauuauuauguaac

SEQ ID NO: 786595 - RNA, 24 nt, Human
ugaagacaaaaauucuaggagcaa

SEQ ID NO: 786596 - RNA, 24 nt, Human
ugacaaccuauaagcagguaauau

SEQ ID NO: 786597 - RNA, 20 nt, Human
ugcuccacagcuacgacaca

SEQ ID NO: 786598 - RNA, 19 nt, Human
uggcuacauuuacuaguuu

SEQ ID NO: 786599 - RNA, 23 nt, Human
uggguugacaaccuauaagcagg

SEQ ID NO: 786600 - RNA, 19 nt, Human
uguaacacaggucuagucc

SEQ ID NO: 786601 - RNA, 24 nt, Human
uguauacacauauacacauacaua

SEQ ID NO: 786602 - RNA, 22 nt, Human
uguguauacacauauacacaua

SEQ ID NO: 786603 - RNA, 23 nt, Human
uguuuuaacacgauuuacgcaau

SEQ ID NO: 786604 - RNA, 19 nt, Human
uuauaagcaauuauuuucu

SEQ ID NO: 786605 - RNA, 19 nt, Human
uucccaauaagagggugcc

SEQ ID NO: 786606 - RNA, 22 nt, Human
uucccagucuacuggccacaaa

SEQ ID NO: 786607 - RNA, 21 nt, Human
uuuauguaucacuagguuugg

SEQ ID NO: 786608 - RNA, 24 nt, Human
uuucucaguuaucaggagugaaca

SEQ ID NO: 786609 - RNA, 23 nt, Human
uuuguucaaaguagaauaaaagg

SEQ ID NO: 786610 - RNA, 20 nt, Human
aaaaggacaggaacaucuga

SEQ ID NO: 786611 - RNA, 23 nt, Human
aaacacagcuaccgauagcacac

SEQ ID NO: 786612 - RNA, 25 nt, Human
aaagaaacacagcuaccgauagcac

SEQ ID NO: 786613 - RNA, 23 nt, Human
aaagcaguucucugaaaccugaa

SEQ ID NO: 786614 - RNA, 20 nt, Human
aaaucacccuguagcaggac

SEQ ID NO: 786615 - RNA, 21 nt, Human
aacaaagcaacuccaacagau

SEQ ID NO: 786616 - RNA, 21 nt, Human
aagaaacuucaaauauucuga

SEQ ID NO: 786617 - RNA, 20 nt, Human
aaggagaaaguuguuccuga

SEQ ID NO: 786618 - RNA, 23 nt, Human
aauacacaagcagaaaacaguaa

SEQ ID NO: 786619 - RNA, 19 nt, Human
acaaagggcuguggaccuc

SEQ ID NO: 786620 - RNA, 20 nt, Human
acagacaugacaaaaacuac

SEQ ID NO: 786621 - RNA, 27 nt, Human
acaugacaaaaacuacgaaaagaggga

SEQ ID NO: 786622 - RNA, 22 nt, Human
acaugcugacaaucuuccaggg

SEQ ID NO: 786623 - RNA, 18 nt, Human
accccaaaucacaaaaua

SEQ ID NO: 786624 - RNA, 21 nt, Human
acccuguagcaggaccacaaa

SEQ ID NO: 786625 - RNA, 19 nt, Human
acuaaguugggaggcugaa

SEQ ID NO: 786626 - RNA, 21 nt, Human
acuguaagaagauacaacuga

SEQ ID NO: 786627 - RNA, 20 nt, Human
agagauaccaaauacuggcu

SEQ ID NO: 786628 - RNA, 21 nt, Human
agauaacagaagggcaaaagg

SEQ ID NO: 786629 - RNA, 19 nt, Human
agcaacuccaacagauaac

SEQ ID NO: 786630 - RNA, 18 nt, Human
agcacauuuuuccucacu

SEQ ID NO: 786631 - RNA, 19 nt, Human
agcaccagggcaagcaccc

SEQ ID NO: 786632 - RNA, 21 nt, Human
aggcagaucacacagcucagg

SEQ ID NO: 786633 - RNA, 24 nt, Human
aggcagucacugcggcaccccucg

SEQ ID NO: 786634 - RNA, 24 nt, Human
agggccgggaacacaggccugggc

SEQ ID NO: 786635 - RNA, 19 nt, Human
aucaguuaccuuuauaucu

SEQ ID NO: 786636 - RNA, 19 nt, Human
aucauaaacagcauuaaaa

SEQ ID NO: 786637 - RNA, 20 nt, Human
augugugcaugcauguaugg

SEQ ID NO: 786638 - RNA, 21 nt, Human
auugucaauaaggagaaaguu

SEQ ID NO: 786639 - RNA, 23 nt, Human
caaaagcaguucucugaaaccug

SEQ ID NO: 786640 - RNA, 25 nt, Human
caaagcaacuccaacagauaacaga

SEQ ID NO: 786641 - RNA, 21 nt, Human
cacacacacacaauguauaua

SEQ ID NO: 786642 - RNA, 24 nt, Human
caccccaaaucacaaaauaaucau

SEQ ID NO: 786643 - RNA, 19 nt, Human
cagaaaucauaaacagcau

SEQ ID NO: 786644 - RNA, 19 nt, Human
cagacaugacaaaaacuac

SEQ ID NO: 786645 - RNA, 22 nt, Human
cagcauuaaaaugaaucaacac

SEQ ID NO: 786646 - RNA, 23 nt, Human
caucacaaaaagacaucuaaacu

SEQ ID NO: 786647 - RNA, 18 nt, Human
cauccacugaaaaucacc

SEQ ID NO: 786648 - RNA, 20 nt, Human
caugacaaaaacuacgaaaa

SEQ ID NO: 786649 - RNA, 23 nt, Human
ccaaaaagguggaaaaaagaacc

SEQ ID NO: 786650 - RNA, 23 nt, Human
ccaacagauaacagaagggcaaa

SEQ ID NO: 786651 - RNA, 18 nt, Human
ccagggcaagcaccccaa

SEQ ID NO: 786652 - RNA, 18 nt, Human
ccauaguguuccagaggc

SEQ ID NO: 786653 - RNA, 19 nt, Human
cccaugacguacugcaaag

SEQ ID NO: 786654 - RNA, 20 nt, Human
ccuagccccaacaccgagcc

SEQ ID NO: 786655 - RNA, 18 nt, Human
ccuccucucucccucucu

SEQ ID NO: 786656 - RNA, 19 nt, Human
ccuccucucucccucucuu

SEQ ID NO: 786657 - RNA, 20 nt, Human
ccuguaacuccauuugcuga

SEQ ID NO: 786658 - RNA, 23 nt, Human
ccuguagcaggaccacaaagggc

SEQ ID NO: 786659 - RNA, 20 nt, Human
cgaacggcccgcugcgcccu

SEQ ID NO: 786660 - RNA, 19 nt, Human
cgcagcggccaccggccug

SEQ ID NO: 786661 - RNA, 24 nt, Human
cgcugccgcuccuucagcaguucc

SEQ ID NO: 786662 - RNA, 27 nt, Human
cugaccaaaaagguggaaaaaagaacc

SEQ ID NO: 786663 - RNA, 22 nt, Human
cugggccugggcuugggccuag

SEQ ID NO: 786664 - RNA, 20 nt, Human
cugucuuugagacauggcca

SEQ ID NO: 786665 - RNA, 26 nt, Human
cuuaaaacccuauagcuuuguucaga

SEQ ID NO: 786666 - RNA, 22 nt, Human
gaccaaaaagguggaaaaaaga

SEQ ID NO: 786667 - RNA, 18 nt, Human
gagacauggccaaaagca

SEQ ID NO: 786668 - RNA, 22 nt, Human
gagagauaccaaauacuggcuu

SEQ ID NO: 786669 - RNA, 21 nt, Human
gauaacagaagggcaaaagga

SEQ ID NO: 786670 - RNA, 18 nt, Human
gaugacuaaguugggagg

SEQ ID NO: 786671 - RNA, 19 nt, Human
gcacauggacuggaacagc

SEQ ID NO: 786672 - RNA, 18 nt, Human
gcauugaagaggcugagg

SEQ ID NO: 786673 - RNA, 19 nt, Human
gcugccgcuccuucagcag

SEQ ID NO: 786674 - RNA, 24 nt, Human
ggagguaacuaguauuaauacuug

SEQ ID NO: 786675 - RNA, 19 nt, Human
ggauaaagaaguuauaacc

SEQ ID NO: 786676 - RNA, 23 nt, Human
gguaacgagguguccagaaagaa

SEQ ID NO: 786677 - RNA, 24 nt, Human
uaaaaaacugaguaauuaaaaaaa

SEQ ID NO: 786678 - RNA, 21 nt, Human
uaaaacagcuauguuaaauac

SEQ ID NO: 786679 - RNA, 21 nt, Human
uaaaaugaaucaacacuugua

SEQ ID NO: 786680 - RNA, 27 nt, Human
uaaaaugaaucaacacuuguaugggca

SEQ ID NO: 786681 - RNA, 19 nt, Human
uaaacauacuaaaagccag

SEQ ID NO: 786682 - RNA, 18 nt, Human
uaacagaagggcaaaagg

SEQ ID NO: 786683 - RNA, 24 nt, Human
uacacaagcagaaaacaguaaugu

SEQ ID NO: 786684 - RNA, 22 nt, Human
uaccuuuggcauugaagaggcu

SEQ ID NO: 786685 - RNA, 20 nt, Human
uagaagccaauucauuuugc

SEQ ID NO: 786686 - RNA, 18 nt, Human
uaggaugcacuucuugcu

SEQ ID NO: 786687 - RNA, 23 nt, Human
uauaacuugauacgaaaaacaaa

SEQ ID NO: 786688 - RNA, 22 nt, Human
uaucaagggaaggcagucacug

SEQ ID NO: 786689 - RNA, 19 nt, Human
uauguauguaugugugcau

SEQ ID NO: 786690 - RNA, 19 nt, Human
uauguaugugugcaugcau

SEQ ID NO: 786691 - RNA, 18 nt, Human
uauguguguguauacaua

SEQ ID NO: 786692 - RNA, 19 nt, Human
uauguguguguauacauau

SEQ ID NO: 786693 - RNA, 22 nt, Human
uauuaugggauugucaauaagg

SEQ ID NO: 786694 - RNA, 28 nt, Human
ucaaauauucugaaugcaaccacacaau

SEQ ID NO: 786695 - RNA, 18 nt, Human
ucaagggaaggcagucac

SEQ ID NO: 786696 - RNA, 21 nt, Human
ucaccucguccggccugcgcu

SEQ ID NO: 786697 - RNA, 25 nt, Human
ucaucugaaguaacgguuuagucac

SEQ ID NO: 786698 - RNA, 19 nt, Human
uccaacagauaacagaagg

SEQ ID NO: 786699 - RNA, 21 nt, Human
uccagaaagaacagaaagcuc

SEQ ID NO: 786700 - RNA, 18 nt, Human
ucccauuaaaaauuacca

SEQ ID NO: 786701 - RNA, 18 nt, Human
uccgcuguaccuagagug

SEQ ID NO: 786702 - RNA, 19 nt, Human
uccuccucucucccucucu

SEQ ID NO: 786703 - RNA, 20 nt, Human
uccuccucucucccucucuu

SEQ ID NO: 786704 - RNA, 19 nt, Human
uccucucucccucucuugc

SEQ ID NO: 786705 - RNA, 20 nt, Human
uccuguaacuccauuugcug

SEQ ID NO: 786706 - RNA, 20 nt, Human
ucucugguacugaauuucca

SEQ ID NO: 786707 - RNA, 21 nt, Human
ucugaaguugguccugucuuu

SEQ ID NO: 786708 - RNA, 24 nt, Human
ucugaucaaagaaacacagcuacc

SEQ ID NO: 786709 - RNA, 19 nt, Human
ucuuugggaaucugaaguu

SEQ ID NO: 786710 - RNA, 26 nt, Human
ugacaaaaacuacgaaaagagggagg

SEQ ID NO: 786711 - RNA, 19 nt, Human
ugauaaaagucccauuaaa

SEQ ID NO: 786712 - RNA, 24 nt, Human
ugauucaucaccugaaggcgguua

SEQ ID NO: 786713 - RNA, 21 nt, Human
ugccuugguuccugaguuuua

SEQ ID NO: 786714 - RNA, 22 nt, Human
uggaacagcaccagggcaagca

SEQ ID NO: 786715 - RNA, 26 nt, Human
uggacauaauuacacauuuaccacag

SEQ ID NO: 786716 - RNA, 20 nt, Human
uggcauugaagaggcugagg

SEQ ID NO: 786717 - RNA, 19 nt, Human
ugggaggcugaacuuaaaa

SEQ ID NO: 786718 - RNA, 22 nt, Human
uguaugugugcaugcauguagu

SEQ ID NO: 786719 - RNA, 28 nt, Human
uguauuacacacacacacaauguauaua

SEQ ID NO: 786720 - RNA, 24 nt, Human
ugucaauaaggagaaaguuguucc

SEQ ID NO: 786721 - RNA, 20 nt, Human
uguguauacauauguaugua

SEQ ID NO: 786722 - RNA, 23 nt, Human
uguguauacauauguauguaugu

SEQ ID NO: 786723 - RNA, 23 nt, Human
uguguauacauauguauguaugu

SEQ ID NO: 786724 - RNA, 18 nt, Human
ugugugcaugcauguaug

SEQ ID NO: 786725 - RNA, 26 nt, Human
ugugugcaugcauguauguuuguauu

SEQ ID NO: 786726 - RNA, 19 nt, Human
uguguguauacauauguau

SEQ ID NO: 786727 - RNA, 21 nt, Human
uguguguauacauauguaugu

SEQ ID NO: 786728 - RNA, 21 nt, Human
uguguguauacauauguaugu

SEQ ID NO: 786729 - RNA, 24 nt, Human
uguguguauacauauguauguaug

SEQ ID NO: 786730 - RNA, 20 nt, Human
uguguguguauacauaugua

SEQ ID NO: 786731 - RNA, 22 nt, Human
uguguguguauacauauguaug

SEQ ID NO: 786732 - RNA, 19 nt, Human
uguguguguauuacacaca

SEQ ID NO: 786733 - RNA, 22 nt, Human
uguuccagaggcucuguagcug

SEQ ID NO: 786734 - RNA, 24 nt, Human
uuaggaugacuaaguugggaggcu

SEQ ID NO: 786735 - RNA, 24 nt, Human
uuccagaggcucuguagcuggcuu

SEQ ID NO: 786736 - RNA, 22 nt, Human
uuccaggaaaguaccucuucag

SEQ ID NO: 786737 - RNA, 19 nt, Human
uucucugaaaccugaacuu

SEQ ID NO: 786738 - RNA, 24 nt, Human
uucugucuacguaagaaacuucaa

SEQ ID NO: 786739 - RNA, 19 nt, Human
uugcucagaucauagccuc

SEQ ID NO: 786740 - RNA, 20 nt, Human
uugcugauaaaagucccauu

SEQ ID NO: 786741 - RNA, 26 nt, Human
uuucauuaaguuuuacugaccaaaaa

SEQ ID NO: 786742 - RNA, 25 nt, Human
aaaaaaaaaaaacuguuguaaaagg

SEQ ID NO: 786743 - RNA, 22 nt, Human
aaaaaaaaaaucuuccccggga

SEQ ID NO: 786744 - RNA, 19 nt, Human
aaaaggaaaagcuccaccc

SEQ ID NO: 786745 - RNA, 20 nt, Human
aaaaucugauuggagaagau

SEQ ID NO: 786746 - RNA, 21 nt, Human
aaagaagcaaagucuaccucc

SEQ ID NO: 786747 - RNA, 20 nt, Human
aaccaauuagucacuuagcc

SEQ ID NO: 786748 - RNA, 19 nt, Human
acacugcagggcuggcaac

SEQ ID NO: 786749 - RNA, 22 nt, Human
acagcacagaagcagagugggc

SEQ ID NO: 786750 - RNA, 19 nt, Human
accccggggcccacagcac

SEQ ID NO: 786751 - RNA, 22 nt, Human
acuccuuuccaacccuuccccu

SEQ ID NO: 786752 - RNA, 19 nt, Human
agcaaagucuaccuccccc

SEQ ID NO: 786753 - RNA, 22 nt, Human
agcauuuagcaaaaaaaaaaaa

SEQ ID NO: 786754 - RNA, 20 nt, Human
agucuaccucccccagaaaa

SEQ ID NO: 786755 - RNA, 24 nt, Human
aguguggaaaaugcacacauacag

SEQ ID NO: 786756 - RNA, 19 nt, Human
augcacacauacacaccca

SEQ ID NO: 786757 - RNA, 20 nt, Human
augcacacauacacacccag

SEQ ID NO: 786758 - RNA, 24 nt, Human
caaaaggauauccaaaaguuagca

SEQ ID NO: 786759 - RNA, 19 nt, Human
cacagcacagaagcagagu

SEQ ID NO: 786760 - RNA, 25 nt, Human
caccucagcagcacacgugugcaua

SEQ ID NO: 786761 - RNA, 25 nt, Human
cagcacagaagcagagugggcuccc

SEQ ID NO: 786762 - RNA, 23 nt, Human
cagcagcaggcaccagguuacag

SEQ ID NO: 786763 - RNA, 20 nt, Human
ccacagcacagaagcagagu

SEQ ID NO: 786764 - RNA, 19 nt, Human
ccacagggcaagugccagg

SEQ ID NO: 786765 - RNA, 18 nt, Human
ccaggcccuaccaauuuu

SEQ ID NO: 786766 - RNA, 22 nt, Human
cccagaaaaaaguaccugaacc

SEQ ID NO: 786767 - RNA, 33 nt, Human
cccagcauuuagcaaaaaaaaaaaaaaaaaaaa

SEQ ID NO: 786768 - RNA, 22 nt, Human
ccccagaaaaaaguaccugaac

SEQ ID NO: 786769 - RNA, 22 nt, Human
cccccagaaaaaaguaccugaa

SEQ ID NO: 786770 - RNA, 24 nt, Human
cccccagaaaaaaguaccugaacc

SEQ ID NO: 786771 - RNA, 21 nt, Human
ccccggggcccacagcacaga

SEQ ID NO: 786772 - RNA, 19 nt, Human
cgccuagaccagaggacuc

SEQ ID NO: 786773 - RNA, 23 nt, Human
cgugcucaccagaccugccucac

SEQ ID NO: 786774 - RNA, 19 nt, Human
cgugugcauauaucugugu

SEQ ID NO: 786775 - RNA, 19 nt, Human
cuagaccagaggacuccgu

SEQ ID NO: 786776 - RNA, 19 nt, Human
cucuauguccacaccauca

SEQ ID NO: 786777 - RNA, 27 nt, Human
cucuccgugcucaccagaccugccuca

SEQ ID NO: 786778 - RNA, 23 nt, Human
cucugguuaaaaaaaaaaaaaaa

SEQ ID NO: 786779 - RNA, 24 nt, Human
cugcauugcucgucuccccccgug

SEQ ID NO: 786780 - RNA, 24 nt, Human
cuucuacuuguucuuaagccacag

SEQ ID NO: 786781 - RNA, 21 nt, Human
cuugcuuucuucuauuucugu

SEQ ID NO: 786782 - RNA, 23 nt, Human
gcaaaaaaaaaaaaaaaaaaaaa

SEQ ID NO: 786783 - RNA, 24 nt, Human
gcaaagucuaccucccccagaaaa

SEQ ID NO: 786784 - RNA, 25 nt, Human
gcaaagucuaccucccccagaaaag

SEQ ID NO: 786785 - RNA, 18 nt, Human
gcauugcucgucuccccc

SEQ ID NO: 786786 - RNA, 22 nt, Human
gccaggugaguccuaaauaacc

SEQ ID NO: 786787 - RNA, 21 nt, Human
ggcaaccccggggcccacagc

SEQ ID NO: 786788 - RNA, 24 nt, Human
gucacuuagccccuucccagccuc

SEQ ID NO: 786789 - RNA, 22 nt, Human
gugcucaccagaccugccucac

SEQ ID NO: 786790 - RNA, 18 nt, Human
gugugcauauaucugugu

SEQ ID NO: 786791 - RNA, 22 nt, Human
uaaaaggaaaagcuccacccau

SEQ ID NO: 786792 - RNA, 23 nt, Human
uaaacaaauauaaaaaugcacaa

SEQ ID NO: 786793 - RNA, 31 nt, Human
uaaacucugguuaaaaaaaaaaaaaaaaaaa

SEQ ID NO: 786794 - RNA, 24 nt, Human
uaaccaaaaggauauccaaaaguu

SEQ ID NO: 786795 - RNA, 18 nt, Human
uacucuaguuuauuuaac

SEQ ID NO: 786796 - RNA, 23 nt, Human
uagauuuugauaaaucuuucuga

SEQ ID NO: 786797 - RNA, 22 nt, Human
uagucacuuagccccuucccag

SEQ ID NO: 786798 - RNA, 24 nt, Human
ucaaggaggaaauucauuaaaaaa

SEQ ID NO: 786799 - RNA, 22 nt, Human
ucacucacacugcagggcuggc

SEQ ID NO: 786800 - RNA, 22 nt, Human
ucacuuagccccuucccagccu

SEQ ID NO: 786801 - RNA, 24 nt, Human
uccacccauaguucuguagugcaa

SEQ ID NO: 786802 - RNA, 19 nt, Human
uccccgggaagcacuuuca

SEQ ID NO: 786803 - RNA, 23 nt, Human
uccccgggaagcacuuucagaag

SEQ ID NO: 786804 - RNA, 20 nt, Human
uccccucucucuauguccac

SEQ ID NO: 786805 - RNA, 20 nt, Human
uccuuuccaacccuuccccu

SEQ ID NO: 786806 - RNA, 23 nt, Human
ucucuauguccacaccaucacuu

SEQ ID NO: 786807 - RNA, 22 nt, Human
ucucugaaagcaauuaccgccu

SEQ ID NO: 786808 - RNA, 21 nt, Human
ucuguacauguuguuugugua

SEQ ID NO: 786809 - RNA, 24 nt, Human
ucuguacauguuguuuguguauau

SEQ ID NO: 786810 - RNA, 20 nt, Human
ugcaaaaaaaccuuuuuaau

SEQ ID NO: 786811 - RNA, 19 nt, Human
ugcauuaagaaccagcaac

SEQ ID NO: 786812 - RNA, 19 nt, Human
ugcauugcucgucuccccc

SEQ ID NO: 786813 - RNA, 19 nt, Human
uggggguaaugagauuauu

SEQ ID NO: 786814 - RNA, 18 nt, Human
ugguuaaaaaaaaaaaaa

SEQ ID NO: 786815 - RNA, 22 nt, Human
uguaaccaaaaggauauccaaa

SEQ ID NO: 786816 - RNA, 18 nt, Human
uguccacaccaucacuuc

SEQ ID NO: 786817 - RNA, 22 nt, Human
uguccacaccaucacuucaguu

SEQ ID NO: 786818 - RNA, 21 nt, Human
uguguguauguggcugcacag

SEQ ID NO: 786819 - RNA, 20 nt, Human
uuaaaaaaaaaaaaaaaaaa

SEQ ID NO: 786820 - RNA, 21 nt, Human
uuaagaaccagcaacucuacu

SEQ ID NO: 786821 - RNA, 23 nt, Human
uuaagccacagggcaagugccag

SEQ ID NO: 786822 - RNA, 18 nt, Human
uuagaaguaauuagcaac

SEQ ID NO: 786823 - RNA, 21 nt, Human
uucaaggaaaaaaaaauagcc

SEQ ID NO: 786824 - RNA, 22 nt, Human
uucaaggaaaaaaaaauagcca

SEQ ID NO: 786825 - RNA, 19 nt, Human
uuccaacccuuccccucuc

SEQ ID NO: 786826 - RNA, 20 nt, Human
uucccagccucuccgugcuc

SEQ ID NO: 786827 - RNA, 24 nt, Human
uuuagcaaaaaaaaaaaaaaaaaa

SEQ ID NO: 786828 - RNA, 24 nt, Human
uuucauaggcaggaaacaaauucc

SEQ ID NO: 786829 - RNA, 18 nt, Human
aagaagaaaaggggcaga

SEQ ID NO: 786830 - RNA, 23 nt, Human
aagaagaaaaggggcagagucag

SEQ ID NO: 786831 - RNA, 18 nt, Human
agaagaaaaggggcagag

SEQ ID NO: 786832 - RNA, 21 nt, Human
agaagaagaaaaggggcagag

SEQ ID NO: 786833 - RNA, 21 nt, Human
agaagaagaaaaggggcagag

SEQ ID NO: 786834 - RNA, 21 nt, Human
agagaccccacccucccagca

SEQ ID NO: 786835 - RNA, 22 nt, Human
agagcuccuagagaccccaccc

SEQ ID NO: 786836 - RNA, 18 nt, Human
agcagaagaagaaaaggg

SEQ ID NO: 786837 - RNA, 18 nt, Human
agcaguggugggcguggc

SEQ ID NO: 786838 - RNA, 21 nt, Human
agucagaccccagagagccca

SEQ ID NO: 786839 - RNA, 19 nt, Human
caccgcugcuccacagaac

SEQ ID NO: 786840 - RNA, 22 nt, Human
cagcagaagaagaaaaggggca

SEQ ID NO: 786841 - RNA, 19 nt, Human
ccccagagagcccauccua

SEQ ID NO: 786842 - RNA, 23 nt, Human
cggccaccgcugcuccacagaac

SEQ ID NO: 786843 - RNA, 19 nt, Human
cuagagaccccacccuccc

SEQ ID NO: 786844 - RNA, 25 nt, Human
cuccacagaacugcuggcugucucu

SEQ ID NO: 786845 - RNA, 20 nt, Human
cugcucugcgggugcugggg

SEQ ID NO: 786846 - RNA, 23 nt, Human
cuguugggggcuucaucgugguc

SEQ ID NO: 786847 - RNA, 18 nt, Human
gaaaaggggcagagucag

SEQ ID NO: 786848 - RNA, 20 nt, Human
gagcaguggugggcguggcu

SEQ ID NO: 786849 - RNA, 20 nt, Human
gcaguggugggcguggcugu

SEQ ID NO: 786850 - RNA, 22 nt, Human
gccucguccgagcagugguggg

SEQ ID NO: 786851 - RNA, 21 nt, Human
gugcuggggccugcagagcuc

SEQ ID NO: 786852 - RNA, 18 nt, Human
uagccggccaccgcugcu

SEQ ID NO: 786853 - RNA, 18 nt, Human
ugagguuguggucuuggc

SEQ ID NO: 786854 - RNA, 19 nt, Human
ugcuggggccugcagagcu

SEQ ID NO: 786855 - RNA, 21 nt, Human
uggugggcguggcuguugggg

SEQ ID NO: 786856 - RNA, 18 nt, Human
aaaaacaaacaaacccgg

SEQ ID NO: 786857 - RNA, 24 nt, Human
aaaaacaaacaaacccggcagcca

SEQ ID NO: 786858 - RNA, 18 nt, Human
aaaaaucaaugaaguccu

SEQ ID NO: 786859 - RNA, 26 nt, Human
aaaaauccccuaucuagccaauucuu

SEQ ID NO: 786860 - RNA, 23 nt, Human
aaaacaaacaaacccggcagcca

SEQ ID NO: 786861 - RNA, 21 nt, Human
aaacaaacaaacccggcagcc

SEQ ID NO: 786862 - RNA, 24 nt, Human
aaacaaacaaacccggcagccaag

SEQ ID NO: 786863 - RNA, 25 nt, Human
aaacacaaaacagaacgcuuuacaa

SEQ ID NO: 786864 - RNA, 24 nt, Human
aaacagaaaaucacauaagccaaa

SEQ ID NO: 786865 - RNA, 21 nt, Human
aaacgucaggacacguaagcu

SEQ ID NO: 786866 - RNA, 25 nt, Human
aaugcaauccucacacaacuuguga

SEQ ID NO: 786867 - RNA, 24 nt, Human
acaaaacagaacgcuuuacaaaaa

SEQ ID NO: 786868 - RNA, 22 nt, Human
acaaagaaggcacaauugaaug

SEQ ID NO: 786869 - RNA, 22 nt, Human
acgucaggacacguaagcuuca

SEQ ID NO: 786870 - RNA, 19 nt, Human
acuguuuggggucuugggc

SEQ ID NO: 786871 - RNA, 18 nt, Human
auaaaauauaccauaugc

SEQ ID NO: 786872 - RNA, 18 nt, Human
auaagcaacaaaacguca

SEQ ID NO: 786873 - RNA, 20 nt, Human
augaagauuagucagcagcu

SEQ ID NO: 786874 - RNA, 21 nt, Human
augaagauuagucagcagcug

SEQ ID NO: 786875 - RNA, 18 nt, Human
auguguguguauauauau

SEQ ID NO: 786876 - RNA, 21 nt, Human
auuucugcuuucuuuuuuuag

SEQ ID NO: 786877 - RNA, 24 nt, Human
caaaaacaaacaaacccggcagcc

SEQ ID NO: 786878 - RNA, 26 nt, Human
caaaaacaaacaaacccggcagccaa

SEQ ID NO: 786879 - RNA, 27 nt, Human
caaaaacaaacaaacccggcagccaag

SEQ ID NO: 786880 - RNA, 26 nt, Human
caaacaaaguaaaaguacuguuuggg

SEQ ID NO: 786881 - RNA, 21 nt, Human
caaacccggcagccaaguacu

SEQ ID NO: 786882 - RNA, 22 nt, Human
cacaaaacagaacgcuuuacaa

SEQ ID NO: 786883 - RNA, 24 nt, Human
cacaaaacagaacgcuuuacaaaa

SEQ ID NO: 786884 - RNA, 20 nt, Human
cacaguauaagcaacaaaac

SEQ ID NO: 786885 - RNA, 19 nt, Human
cacaugcauaauauaugug

SEQ ID NO: 786886 - RNA, 21 nt, Human
caccauaugaacuuucagggc

SEQ ID NO: 786887 - RNA, 21 nt, Human
cacucagcuuccacacuguag

SEQ ID NO: 786888 - RNA, 18 nt, Human
cacuguggcaacuaaaca

SEQ ID NO: 786889 - RNA, 22 nt, Human
cagccaaguacuaugacauccc

SEQ ID NO: 786890 - RNA, 20 nt, Human
caguauaagcaacaaaacgu

SEQ ID NO: 786891 - RNA, 21 nt, Human
cauuauagagcuuagcuagga

SEQ ID NO: 786892 - RNA, 18 nt, Human
ccccaaaaacaaacaaac

SEQ ID NO: 786893 - RNA, 19 nt, Human
ccuaguuccuuuucaguag

SEQ ID NO: 786894 - RNA, 27 nt, Human
ccucacucugcugcgggaaggucggac

SEQ ID NO: 786895 - RNA, 26 nt, Human
ccucacucugcugcgggaaggucggc

SEQ ID NO: 786896 - RNA, 25 nt, Human
ccucucacccuucuggucuucccca

SEQ ID NO: 786897 - RNA, 23 nt, Human
cuacucucugaaaaaaucaauga

SEQ ID NO: 786898 - RNA, 22 nt, Human
cucacccuucuggucuucccca

SEQ ID NO: 786899 - RNA, 21 nt, Human
cuuguaaacagaaaaucacau

SEQ ID NO: 786900 - RNA, 18 nt, Human
gcauaauauauguguaug

SEQ ID NO: 786901 - RNA, 20 nt, Human
ggcagacagcuccagcggaa

SEQ ID NO: 786902 - RNA, 21 nt, Human
gugaucuccuuaaguaccccc

SEQ ID NO: 786903 - RNA, 24 nt, Human
guggaagugguguuucccccacug

SEQ ID NO: 786904 - RNA, 21 nt, Human
guggugaugaagauuagucag

SEQ ID NO: 786905 - RNA, 22 nt, Human
guucauggauuucugcuuucuu

SEQ ID NO: 786906 - RNA, 22 nt, Human
uaaacacaaaacagaacgcuuu

SEQ ID NO: 786907 - RNA, 22 nt, Human
uaauauauguguaugugugugu

SEQ ID NO: 786908 - RNA, 22 nt, Human
uacaguggugaugaagauuagu

SEQ ID NO: 786909 - RNA, 23 nt, Human
uaccaguaauaacuuauuucaau

SEQ ID NO: 786910 - RNA, 25 nt, Human
uagcacugaggcuugagacuugugg

SEQ ID NO: 786911 - RNA, 20 nt, Human
uaggauacagacacccaaaa

SEQ ID NO: 786912 - RNA, 24 nt, Human
uauauauauguacacacauacaca

SEQ ID NO: 786913 - RNA, 21 nt, Human
uauauauguacacacauacgc

SEQ ID NO: 786914 - RNA, 19 nt, Human
uauauguacacacauacac

SEQ ID NO: 786915 - RNA, 20 nt, Human
uauauguguaugugugugua

SEQ ID NO: 786916 - RNA, 24 nt, Human
uauauguguauguguguguauaua

SEQ ID NO: 786917 - RNA, 19 nt, Human
uaugacgcauucaggaaaa

SEQ ID NO: 786918 - RNA, 22 nt, Human
uauguacacacauacacauuua

SEQ ID NO: 786919 - RNA, 25 nt, Human
uauguacacacauacacauuuauuu

SEQ ID NO: 786920 - RNA, 19 nt, Human
uauguguauguguguguau

SEQ ID NO: 786921 - RNA, 25 nt, Human
uauguguguguauauauauguacca

SEQ ID NO: 786922 - RNA, 22 nt, Human
uauuucaacauaugcugccugc

SEQ ID NO: 786923 - RNA, 22 nt, Human
ucagaaacuucuuaggauacag

SEQ ID NO: 786924 - RNA, 22 nt, Human
ucagggccccucucacccuucu

SEQ ID NO: 786925 - RNA, 22 nt, Human
ucauaauacaaagaaggcacaa

SEQ ID NO: 786926 - RNA, 23 nt, Human
uccacacuguaguacccaaguga

SEQ ID NO: 786927 - RNA, 23 nt, Human
uccacuuuucaaaauuuccccaa

SEQ ID NO: 786928 - RNA, 21 nt, Human
uccagcggaauugccacucuc

SEQ ID NO: 786929 - RNA, 20 nt, Human
ucuacuuguaaacagaaaau

SEQ ID NO: 786930 - RNA, 18 nt, Human
ucugaaaaaaucaaugaa

SEQ ID NO: 786931 - RNA, 25 nt, Human
ucugaaaaaaucaaugaaguccuuu

SEQ ID NO: 786932 - RNA, 23 nt, Human
ugaaaaaaucaaugaaguccuuu

SEQ ID NO: 786933 - RNA, 19 nt, Human
ugaauggacaaaaaucacu

SEQ ID NO: 786934 - RNA, 20 nt, Human
ugcaguguucagaaaaaucc

SEQ ID NO: 786935 - RNA, 21 nt, Human
ugcaguguucagaaaaauccc

SEQ ID NO: 786936 - RNA, 21 nt, Human
uggcaauuugcaaauauggca

SEQ ID NO: 786937 - RNA, 21 nt, Human
uguauauauauguacacacau

SEQ ID NO: 786938 - RNA, 26 nt, Human
uguauauauauguacacacauacaca

SEQ ID NO: 786939 - RNA, 21 nt, Human
uguauguguguguauauauau

SEQ ID NO: 786940 - RNA, 21 nt, Human
uguauguguguguauauauau

SEQ ID NO: 786941 - RNA, 20 nt, Human
uguggaagugguguuuccua

SEQ ID NO: 786942 - RNA, 18 nt, Human
uguguauauauauguaca

SEQ ID NO: 786943 - RNA, 23 nt, Human
uguguauauauauguacacacau

SEQ ID NO: 786944 - RNA, 20 nt, Human
uguguauguguguguauaua

SEQ ID NO: 786945 - RNA, 24 nt, Human
uguguauguguguguauauauaug

SEQ ID NO: 786946 - RNA, 26 nt, Human
uguguauguguguguauauauaugua

SEQ ID NO: 786947 - RNA, 18 nt, Human
uguguguauauauaugua

SEQ ID NO: 786948 - RNA, 22 nt, Human
uuccuaguuccuuuucaguagu

SEQ ID NO: 786949 - RNA, 19 nt, Human
uugaaggcucauagguuug

SEQ ID NO: 786950 - RNA, 22 nt, Human
uuuuuaguccaaaugaggcuga

SEQ ID NO: 786951 - RNA, 24 nt, Human
aaaaaaaaaaaaucaaucugcaga

SEQ ID NO: 786952 - RNA, 22 nt, Human
aaaaaaaaaaaucaaucugcag

SEQ ID NO: 786953 - RNA, 28 nt, Human
aaaaaaccaccacauaaggagaggccaa

SEQ ID NO: 786954 - RNA, 23 nt, Human
aaaaacacaacaaaaaccuaaug

SEQ ID NO: 786955 - RNA, 18 nt, Human
aaaauagauccaccaaga

SEQ ID NO: 786956 - RNA, 25 nt, Human
aaaccuagaugacuuuacuaggcgg

SEQ ID NO: 786957 - RNA, 20 nt, Human
aaagaacaaugaaacucaag

SEQ ID NO: 786958 - RNA, 24 nt, Human
aaagaccagaggguacuugguccc

SEQ ID NO: 786959 - RNA, 22 nt, Human
aaagcagguguaggaggucaag

SEQ ID NO: 786960 - RNA, 28 nt, Human
aaagcagguguaggaggucaagaggggc

SEQ ID NO: 786961 - RNA, 30 nt, Human
aaagcagguguaggaggucaagaggggcuc

SEQ ID NO: 786962 - RNA, 19 nt, Human
aaagccauauaagugaaaa

SEQ ID NO: 786963 - RNA, 21 nt, Human
aaauaccccaucuucccagga

SEQ ID NO: 786964 - RNA, 24 nt, Human
aaccaaaaacacaacaaaaaccua

SEQ ID NO: 786965 - RNA, 20 nt, Human
aaccauccauucacaaaaga

SEQ ID NO: 786966 - RNA, 24 nt, Human
aacuuguucuuuccagaaaaccuu

SEQ ID NO: 786967 - RNA, 23 nt, Human
aagcggagaugagcagugugugc

SEQ ID NO: 786968 - RNA, 21 nt, Human
acacacacaggcacacauaca

SEQ ID NO: 786969 - RNA, 21 nt, Human
acacaggcacacauacauacu

SEQ ID NO: 786970 - RNA, 18 nt, Human
acagugguugaccucuuu

SEQ ID NO: 786971 - RNA, 22 nt, Human
acccuaaaaagcggagaugagc

SEQ ID NO: 786972 - RNA, 25 nt, Human
acccuaaggcaguuuuuuaaaaaau

SEQ ID NO: 786973 - RNA, 19 nt, Human
acgguguccuugcaaagug

SEQ ID NO: 786974 - RNA, 28 nt, Human
acucuaugauccagagcuggaagaacug

SEQ ID NO: 786975 - RNA, 19 nt, Human
agaaacuuguucuuuccag

SEQ ID NO: 786976 - RNA, 22 nt, Human
agaauaagaacuaaaaucccau

SEQ ID NO: 786977 - RNA, 28 nt, Human
agacaaccucaaaauaagggggaacgcc

SEQ ID NO: 786978 - RNA, 21 nt, Human
agccaaucagaggcugcgucg

SEQ ID NO: 786979 - RNA, 24 nt, Human
agccacaguacuaaaaaaaaaaaa

SEQ ID NO: 786980 - RNA, 19 nt, Human
aggaaggcaggcagagauc

SEQ ID NO: 786981 - RNA, 18 nt, Human
aggguacuugguccccag

SEQ ID NO: 786982 - RNA, 24 nt, Human
agugguugaccucuuuuuuccuuu

SEQ ID NO: 786983 - RNA, 20 nt, Human
augcccccucuacggugucc

SEQ ID NO: 786984 - RNA, 21 nt, Human
auggaauagaaauuccauaac

SEQ ID NO: 786985 - RNA, 24 nt, Human
auggacaucuuucugaaaaaccuu

SEQ ID NO: 786986 - RNA, 18 nt, Human
auuuuauuuucuuuuucu

SEQ ID NO: 786987 - RNA, 24 nt, Human
caaaaaaaccaccacauaaggaga

SEQ ID NO: 786988 - RNA, 24 nt, Human
caaaauaagguccaaauauugguu

SEQ ID NO: 786989 - RNA, 21 nt, Human
caaagauguucccacuggcag

SEQ ID NO: 786990 - RNA, 25 nt, Human
cacaacaaaaaccuaaugauauaua

SEQ ID NO: 786991 - RNA, 23 nt, Human
cacaguacuaaaaaaaaaaaauc

SEQ ID NO: 786992 - RNA, 25 nt, Human
caccaagauaauuauauaauagucu

SEQ ID NO: 786993 - RNA, 23 nt, Human
caccaggugccaguguacgcccu

SEQ ID NO: 786994 - RNA, 23 nt, Human
cacgcauuuaauacugcucugaa

SEQ ID NO: 786995 - RNA, 21 nt, Human
cacuauacagcacuucaaggu

SEQ ID NO: 786996 - RNA, 21 nt, Human
cagaauaagaacuaaaauccc

SEQ ID NO: 786997 - RNA, 25 nt, Human
cagacaaccucaaaauaagguccaa

SEQ ID NO: 786998 - RNA, 23 nt, Human
cauaaccaaaaacacaacaaaaa

SEQ ID NO: 786999 - RNA, 24 nt, Human
cauacaauacaucaauaaguaugc

SEQ ID NO: 787000 - RNA, 22 nt, Human
cauucacaaaagaccagagggu

SEQ ID NO: 787001 - RNA, 19 nt, Human
ccaacuggacuuacagaua

SEQ ID NO: 787002 - RNA, 20 nt, Human
ccagaaaaccuuugccaaaa

SEQ ID NO: 787003 - RNA, 22 nt, Human
ccauauaagugaaaaaauugag

SEQ ID NO: 787004 - RNA, 18 nt, Human
cggagaugagcagugugu

SEQ ID NO: 787005 - RNA, 23 nt, Human
cggagaugagcagugugugcccc

SEQ ID NO: 787006 - RNA, 20 nt, Human
cgggaggaaguuggagcgcg

SEQ ID NO: 787007 - RNA, 19 nt, Human
cuaccaaaaaaaccaccac

SEQ ID NO: 787008 - RNA, 21 nt, Human
cuaccaaaaaaaccaccacau

SEQ ID NO: 787009 - RNA, 22 nt, Human
cucuaaaucuaaauaaguuugc

SEQ ID NO: 787010 - RNA, 21 nt, Human
cucuaugauccagagcuggaa

SEQ ID NO: 787011 - RNA, 20 nt, Human
cucuccgcagccccuaaaag

SEQ ID NO: 787012 - RNA, 18 nt, Human
cuuccagaccuggcugga

SEQ ID NO: 787013 - RNA, 21 nt, Human
cuuguauaugcauauaaacac

SEQ ID NO: 787014 - RNA, 19 nt, Human
gaaagacgaggcccagaga

SEQ ID NO: 787015 - RNA, 23 nt, Human
gaaccaaauuuacauguuuugca

SEQ ID NO: 787016 - RNA, 21 nt, Human
gacuucaguuauggaauagaa

SEQ ID NO: 787017 - RNA, 21 nt, Human
gcauaaaauagauccaccaag

SEQ ID NO: 787018 - RNA, 18 nt, Human
gccagucugacaagacag

SEQ ID NO: 787019 - RNA, 24 nt, Human
ggaaaaaaagaccuucgaugaugc

SEQ ID NO: 787020 - RNA, 19 nt, Human
ggaaagacgaggcccagag

SEQ ID NO: 787021 - RNA, 18 nt, Human
ggagaugggggaucuagg

SEQ ID NO: 787022 - RNA, 21 nt, Human
ggaggagaugggggaucuagg

SEQ ID NO: 787023 - RNA, 21 nt, Human
gggacagcauaaccaaaaaca

SEQ ID NO: 787024 - RNA, 23 nt, Human
uaaaaagaacguccuaaugaagg

SEQ ID NO: 787025 - RNA, 25 nt, Human
uaaaaagaacguccuaaugaaggca

SEQ ID NO: 787026 - RNA, 24 nt, Human
uaaaagaacaaugaaacucaagua

SEQ ID NO: 787027 - RNA, 21 nt, Human
uaaaaguagcauggaucgggg

SEQ ID NO: 787028 - RNA, 21 nt, Human
uaaaauaggaaaagaaagcca

SEQ ID NO: 787029 - RNA, 21 nt, Human
uaaaaugcuacuggcucauac

SEQ ID NO: 787030 - RNA, 22 nt, Human
uaaaccuagaugacuuuacuag

SEQ ID NO: 787031 - RNA, 23 nt, Human
uaaauucuucacaaaucaauaaa

SEQ ID NO: 787032 - RNA, 19 nt, Human
uaacaagaacagagagaag

SEQ ID NO: 787033 - RNA, 19 nt, Human
uaaccaaaaacacaacaaa

SEQ ID NO: 787034 - RNA, 21 nt, Human
uaaccaaaaacacaacaaaaa

SEQ ID NO: 787035 - RNA, 22 nt, Human
uaaccaaaaacacaacaaaaac

SEQ ID NO: 787036 - RNA, 23 nt, Human
uaaccaaaaacacaacaaaaacc

SEQ ID NO: 787037 - RNA, 24 nt, Human
uaaccaaaaacacaacaaaaaccu

SEQ ID NO: 787038 - RNA, 23 nt, Human
uaagaauacaaacuaaaagaaca

SEQ ID NO: 787039 - RNA, 21 nt, Human
uacucagcucugcugcugcuc

SEQ ID NO: 787040 - RNA, 21 nt, Human
uagauauccagugcaugcgac

SEQ ID NO: 787041 - RNA, 23 nt, Human
uagguaucaguauaguuggcuaa

SEQ ID NO: 787042 - RNA, 22 nt, Human
uagguuguuucauuugucuguu

SEQ ID NO: 787043 - RNA, 19 nt, Human
uaguauuauaugaggagga

SEQ ID NO: 787044 - RNA, 23 nt, Human
uaucacagaauaagaacuaaaau

SEQ ID NO: 787045 - RNA, 23 nt, Human
uaucagaaacagugguugaccuc

SEQ ID NO: 787046 - RNA, 25 nt, Human
uaucauaaagacuucaguuauggaa

SEQ ID NO: 787047 - RNA, 21 nt, Human
uaucauuuuuuucauaaaaua

SEQ ID NO: 787048 - RNA, 27 nt, Human
ucaaguacauuaucagaaacagugguu

SEQ ID NO: 787049 - RNA, 18 nt, Human
ucacaaaagaccagaggg

SEQ ID NO: 787050 - RNA, 24 nt, Human
uccagagcuggaagaacugcuucu

SEQ ID NO: 787051 - RNA, 19 nt, Human
ucccuuuucaucugagaga

SEQ ID NO: 787052 - RNA, 21 nt, Human
uccgcagccccuaaaaguagc

SEQ ID NO: 787053 - RNA, 21 nt, Human
ucgagacagacaaccucaaaa

SEQ ID NO: 787054 - RNA, 20 nt, Human
ucuaugauccagagcuggaa

SEQ ID NO: 787055 - RNA, 19 nt, Human
ugaccuaccaaaaaaacca

SEQ ID NO: 787056 - RNA, 23 nt, Human
ugaccugaaagugcacgcauuua

SEQ ID NO: 787057 - RNA, 22 nt, Human
ugaggaggauaguuaucacaga

SEQ ID NO: 787058 - RNA, 18 nt, Human
ugccaaaauucccauagg

SEQ ID NO: 787059 - RNA, 25 nt, Human
ugccaaaauucccauaggaaacaaa

SEQ ID NO: 787060 - RNA, 20 nt, Human
ugccaguguacgcccuucac

SEQ ID NO: 787061 - RNA, 19 nt, Human
ugcccccucuacggugucc

SEQ ID NO: 787062 - RNA, 19 nt, Human
ugcccccucuacggugucc

SEQ ID NO: 787063 - RNA, 19 nt, Human
uggaaggaggagauggggg

SEQ ID NO: 787064 - RNA, 20 nt, Human
uggaaggaggagauggggga

SEQ ID NO: 787065 - RNA, 19 nt, Human
uggagcgcggacaugcccc

SEQ ID NO: 787066 - RNA, 20 nt, Human
uggagcgcggacaugccccc

SEQ ID NO: 787067 - RNA, 26 nt, Human
uggagugucuuguugugucaaagaug

SEQ ID NO: 787068 - RNA, 21 nt, Human
uggcuggaaggaggagauggg

SEQ ID NO: 787069 - RNA, 20 nt, Human
ugggaaauaagcaaagucaa

SEQ ID NO: 787070 - RNA, 23 nt, Human
ugggaaauaagcaaagucaaagg

SEQ ID NO: 787071 - RNA, 24 nt, Human
ugggaaauaagcaaagucaaaggu

SEQ ID NO: 787072 - RNA, 21 nt, Human
uguacgcccuucacucagaac

SEQ ID NO: 787073 - RNA, 18 nt, Human
ugugugccuugccuaagc

SEQ ID NO: 787074 - RNA, 20 nt, Human
uguuauuucguugcuggaag

SEQ ID NO: 787075 - RNA, 21 nt, Human
uguugugucaaagauguuccc

SEQ ID NO: 787076 - RNA, 22 nt, Human
uuaaaggucacucuaugaucca

SEQ ID NO: 787077 - RNA, 23 nt, Human
uuauaaguggaagagaccucaag

SEQ ID NO: 787078 - RNA, 23 nt, Human
uucacaaaucaauaaaacauuaa

SEQ ID NO: 787079 - RNA, 19 nt, Human
uucacuauacagcacuuca

SEQ ID NO: 787080 - RNA, 20 nt, Human
uucacuauacagcacuucaa

SEQ ID NO: 787081 - RNA, 24 nt, Human
uucauaaaaucuaccuuccccuuc

SEQ ID NO: 787082 - RNA, 22 nt, Human
uuccagaaaaccuuugccaaaa

SEQ ID NO: 787083 - RNA, 25 nt, Human
uucuuuccagaaaaccuuugccaaa

SEQ ID NO: 787084 - RNA, 19 nt, Human
uugguacuuuaugucagaa

SEQ ID NO: 787085 - RNA, 22 nt, Human
uuuaggaaaaaaagaccuucga

SEQ ID NO: 787086 - RNA, 21 nt, Human
uuucuuauaagcccaggagcu

SEQ ID NO: 787087 - RNA, 23 nt, Human
uuuuaacaauuuugaacuaauau

SEQ ID NO: 787088 - RNA, 25 nt, Human
uuuuuuuuuuuaggaaaaaaagacc

SEQ ID NO: 787089 - RNA, 24 nt, Human
aaagugcugggauuacaggcauga

SEQ ID NO: 787090 - RNA, 24 nt, Human
aagaaaccgagacacacagaggug

SEQ ID NO: 787091 - RNA, 24 nt, Human
aagcaauucucaugccuuacccuc

SEQ ID NO: 787092 - RNA, 27 nt, Human
aagcaauucucaugccuuacccuccca

SEQ ID NO: 787093 - RNA, 21 nt, Human
aagcagcucggcccagcaaac

SEQ ID NO: 787094 - RNA, 21 nt, Human
aaggguuuauaaauguguuuu

SEQ ID NO: 787095 - RNA, 19 nt, Human
aaguagcugggauuacagg

SEQ ID NO: 787096 - RNA, 19 nt, Human
aagugcugggauuacaggc

SEQ ID NO: 787097 - RNA, 21 nt, Human
aagugcugggauuacaggcau

SEQ ID NO: 787098 - RNA, 26 nt, Human
aagugcugggauuacaggcaugagcc

SEQ ID NO: 787099 - RNA, 18 nt, Human
acacagcaucucucaccc

SEQ ID NO: 787100 - RNA, 23 nt, Human
acacaggcuggagugcaguggug

SEQ ID NO: 787101 - RNA, 18 nt, Human
acaggguuucauuauguu

SEQ ID NO: 787102 - RNA, 23 nt, Human
acaggguuucauuauguuggcca

SEQ ID NO: 787103 - RNA, 24 nt, Human
acaggguuucauuauguuggccag

SEQ ID NO: 787104 - RNA, 22 nt, Human
acccagagucccuccccgugug

SEQ ID NO: 787105 - RNA, 22 nt, Human
acggagucucaccaucucccag

SEQ ID NO: 787106 - RNA, 21 nt, Human
agagucccuccccgugugccc

SEQ ID NO: 787107 - RNA, 21 nt, Human
agcaucucucacccucacugc

SEQ ID NO: 787108 - RNA, 20 nt, Human
aggaauaaauacuuccugaa

SEQ ID NO: 787109 - RNA, 21 nt, Human
aggcugcccccggcaugcacg

SEQ ID NO: 787110 - RNA, 18 nt, Human
agggcugagguggcgggu

SEQ ID NO: 787111 - RNA, 23 nt, Human
aguaagaugaggcauguauugca

SEQ ID NO: 787112 - RNA, 23 nt, Human
aguagcugggauuacaggugugc

SEQ ID NO: 787113 - RNA, 24 nt, Human
agugaugugcccaccuuggccucc

SEQ ID NO: 787114 - RNA, 20 nt, Human
agugcaguggugcaguggca

SEQ ID NO: 787115 - RNA, 18 nt, Human
agugcugggauuacaggc

SEQ ID NO: 787116 - RNA, 21 nt, Human
aguggcaugaucucggcucgc

SEQ ID NO: 787117 - RNA, 25 nt, Human
aguggugcaguggcaugaucucggc

SEQ ID NO: 787118 - RNA, 19 nt, Human
aguguacuggugugaucuc

SEQ ID NO: 787119 - RNA, 22 nt, Human
augccuuacccucccaaguagc

SEQ ID NO: 787120 - RNA, 19 nt, Human
auguuggccaggcuggucu

SEQ ID NO: 787121 - RNA, 21 nt, Human
auuacagcucuggaacugccu

SEQ ID NO: 787122 - RNA, 24 nt, Human
auuauguuggccaggcuggucuug

SEQ ID NO: 787123 - RNA, 24 nt, Human
auuuuuguauuuuuaguagagaca

SEQ ID NO: 787124 - RNA, 24 nt, Human
caaagugcugggauuacaggcaug

SEQ ID NO: 787125 - RNA, 20 nt, Human
caaccuccgccucccagguu

SEQ ID NO: 787126 - RNA, 22 nt, Human
cacacagcaucucucacccuca

SEQ ID NO: 787127 - RNA, 24 nt, Human
cacacaggcuggagugcaguggug

SEQ ID NO: 787128 - RNA, 22 nt, Human
caccaccaugcccagcuaauuu

SEQ ID NO: 787129 - RNA, 21 nt, Human
caccaucucccaggcuggagu

SEQ ID NO: 787130 - RNA, 24 nt, Human
caccaugcccagcuaauuuuugua

SEQ ID NO: 787131 - RNA, 24 nt, Human
cacccagagucccuccccgugugc

SEQ ID NO: 787132 - RNA, 21 nt, Human
cacugcaaccuccgccuccca

SEQ ID NO: 787133 - RNA, 22 nt, Human
cagcugaaagcagcucggccca

SEQ ID NO: 787134 - RNA, 24 nt, Human
caggguuucauuauguuggccagg

SEQ ID NO: 787135 - RNA, 19 nt, Human
cauuauguuggccaggcug

SEQ ID NO: 787136 - RNA, 24 nt, Human
cauuauguuggccaggcuggucuu

SEQ ID NO: 787137 - RNA, 24 nt, Human
cauucugucacacaggcuggagug

SEQ ID NO: 787138 - RNA, 23 nt, Human
ccaaagugcugggauuacaggca

SEQ ID NO: 787139 - RNA, 24 nt, Human
ccaaagugcugggauuacaggcau

SEQ ID NO: 787140 - RNA, 21 nt, Human
ccaaguagcugggauuacagg

SEQ ID NO: 787141 - RNA, 24 nt, Human
ccaaguagcugggauuacaggugu

SEQ ID NO: 787142 - RNA, 22 nt, Human
ccacuugaggccucugccccuc

SEQ ID NO: 787143 - RNA, 24 nt, Human
cccaaagugcugggauuacaggca

SEQ ID NO: 787144 - RNA, 22 nt, Human
cccaaguagcugggauuacagg

SEQ ID NO: 787145 - RNA, 23 nt, Human
cccaaguagcugggauuacaggu

SEQ ID NO: 787146 - RNA, 24 nt, Human
cccaaguagcugggauuacaggug

SEQ ID NO: 787147 - RNA, 23 nt, Human
cccagguucaagcaauucucaug

SEQ ID NO: 787148 - RNA, 23 nt, Human
cccagguucaagugauucuccuc

SEQ ID NO: 787149 - RNA, 23 nt, Human
cccagguucaagugauucuccug

SEQ ID NO: 787150 - RNA, 22 nt, Human
ccccacugccucucacaauuua

SEQ ID NO: 787151 - RNA, 26 nt, Human
ccgccucccagguucaagcaauucuu

SEQ ID NO: 787152 - RNA, 24 nt, Human
ccgccucccagguucaagugauuc

SEQ ID NO: 787153 - RNA, 22 nt, Human
ccucccagguucaagcaauucu

SEQ ID NO: 787154 - RNA, 24 nt, Human
ccucccagguucaagugauucucc

SEQ ID NO: 787155 - RNA, 22 nt, Human
ccugaccuuaagugaugugccc

SEQ ID NO: 787156 - RNA, 23 nt, Human
ccuguguuucuguccugaagccc

SEQ ID NO: 787157 - RNA, 21 nt, Human
cgagacacacagaggugagga

SEQ ID NO: 787158 - RNA, 22 nt, Human
cgccucccagguucaagugauu

SEQ ID NO: 787159 - RNA, 18 nt, Human
cggcaugcacggaggagc

SEQ ID NO: 787160 - RNA, 20 nt, Human
cucacccucacugcaggguc

SEQ ID NO: 787161 - RNA, 24 nt, Human
cucauucugucacacaggcuggag

SEQ ID NO: 787162 - RNA, 23 nt, Human
cuccaaggccacuugaggccucu

SEQ ID NO: 787163 - RNA, 21 nt, Human
cucccaggcuggaguguacug

SEQ ID NO: 787164 - RNA, 18 nt, Human
cucccagguucaagugau

SEQ ID NO: 787165 - RNA, 23 nt, Human
cugcaaccuccgccucccagguu

SEQ ID NO: 787166 - RNA, 24 nt, Human
cugcaaccuccgccucccagguuc

SEQ ID NO: 787167 - RNA, 24 nt, Human
cugcaaccuccgccucccagguuc

SEQ ID NO: 787168 - RNA, 19 nt, Human
cugccauaaaugccagggg

SEQ ID NO: 787169 - RNA, 24 nt, Human
cugcucugcucuccuuauccccac

SEQ ID NO: 787170 - RNA, 24 nt, Human
cuggaguguacuggugugaucuca

SEQ ID NO: 787171 - RNA, 24 nt, Human
cuuacccucccaaguagcugggau

SEQ ID NO: 787172 - RNA, 18 nt, Human
cuuccugaaucucugaau

SEQ ID NO: 787173 - RNA, 22 nt, Human
cuugaggccucugccccucggg

SEQ ID NO: 787174 - RNA, 21 nt, Human
gaaaauggugcugacccacac

SEQ ID NO: 787175 - RNA, 22 nt, Human
gauggaggaguccucacugacu

SEQ ID NO: 787176 - RNA, 18 nt, Human
gauuacaggcaugagcca

SEQ ID NO: 787177 - RNA, 22 nt, Human
gauuacaggcaugagccacugc

SEQ ID NO: 787178 - RNA, 22 nt, Human
gauuacaggcaugagccacugc

SEQ ID NO: 787179 - RNA, 22 nt, Human
gauuacaggugugcaccaccau

SEQ ID NO: 787180 - RNA, 22 nt, Human
gauucuccugugugagccaccg

SEQ ID NO: 787181 - RNA, 23 nt, Human
gcacauccccaaaggugucaccc

SEQ ID NO: 787182 - RNA, 21 nt, Human
gcaggaaagacaggaggccuc

SEQ ID NO: 787183 - RNA, 22 nt, Human
gcccagcuaauuuuuguauuuu

SEQ ID NO: 787184 - RNA, 23 nt, Human
gcgggcagcaggaaagacaggag

SEQ ID NO: 787185 - RNA, 21 nt, Human
gcucuggauagggaagcagag

SEQ ID NO: 787186 - RNA, 21 nt, Human
ggacggacuaggccucccuca

SEQ ID NO: 787187 - RNA, 19 nt, Human
ggacugcgggcagcaggaa

SEQ ID NO: 787188 - RNA, 20 nt, Human
ggagaaaauggugcugaccc

SEQ ID NO: 787189 - RNA, 26 nt, Human
ggagaguggggccuccaugggugcuu

SEQ ID NO: 787190 - RNA, 19 nt, Human
ggaggccucccuucacuga

SEQ ID NO: 787191 - RNA, 22 nt, Human
ggauuacaggcaugagccacug

SEQ ID NO: 787192 - RNA, 24 nt, Human
ggauuacaggugugcaccaccaug

SEQ ID NO: 787193 - RNA, 23 nt, Human
ggcccagcaaacaccuucuggaa

SEQ ID NO: 787194 - RNA, 21 nt, Human
ggcccggugcacugguggcug

SEQ ID NO: 787195 - RNA, 18 nt, Human
ggcugaacacuuugaagc

SEQ ID NO: 787196 - RNA, 22 nt, Human
ggcuggaguguacuggugugau

SEQ ID NO: 787197 - RNA, 23 nt, Human
ggcuggucuugaacuccugaccu

SEQ ID NO: 787198 - RNA, 18 nt, Human
gggcacaguggggagagu

SEQ ID NO: 787199 - RNA, 21 nt, Human
gggcacaguggggagaguggg

SEQ ID NO: 787200 - RNA, 23 nt, Human
gggcacaguggggagaguggggc

SEQ ID NO: 787201 - RNA, 22 nt, Human
ggguuucauuauguuggccagg

SEQ ID NO: 787202 - RNA, 19 nt, Human
ggucuugaacuccugaccu

SEQ ID NO: 787203 - RNA, 18 nt, Human
ggugcagcugaaagcagc

SEQ ID NO: 787204 - RNA, 20 nt, Human
ggugcaguggcaugaucucg

SEQ ID NO: 787205 - RNA, 23 nt, Human
ggugcaguggcaugaucucggcu

SEQ ID NO: 787206 - RNA, 24 nt, Human
ggugcaguggcaugaucucggcuc

SEQ ID NO: 787207 - RNA, 18 nt, Human
gucucauucugucacaca

SEQ ID NO: 787208 - RNA, 21 nt, Human
gugcagcugaaagcagcucgg

SEQ ID NO: 787209 - RNA, 21 nt, Human
gugcaguggcaugaucucggg

SEQ ID NO: 787210 - RNA, 21 nt, Human
gugugagccaccgugccuggc

SEQ ID NO: 787211 - RNA, 21 nt, Human
gugugcaccaccaugcccagc

SEQ ID NO: 787212 - RNA, 21 nt, Human
uaagaugaggcauguauugca

SEQ ID NO: 787213 - RNA, 24 nt, Human
uaagugaugugcccaccccugaag

SEQ ID NO: 787214 - RNA, 24 nt, Human
uaauuuuuguauuuuuaguagaga

SEQ ID NO: 787215 - RNA, 24 nt, Human
uacaggcaugagccacugcgccca

SEQ ID NO: 787216 - RNA, 18 nt, Human
uacaguggagaaaauggu

SEQ ID NO: 787217 - RNA, 22 nt, Human
uagagacaggguuucauuaugu

SEQ ID NO: 787218 - RNA, 24 nt, Human
uaguagagacaggguuucauuaug

SEQ ID NO: 787219 - RNA, 24 nt, Human
uauguuggccaggcuggucuugaa

SEQ ID NO: 787220 - RNA, 20 nt, Human
ucaaggguuuauaaaugugu

SEQ ID NO: 787221 - RNA, 23 nt, Human
ucaaggguuuauaaauguguuuu

SEQ ID NO: 787222 - RNA, 19 nt, Human
ucacugcaaccuccgccuc

SEQ ID NO: 787223 - RNA, 24 nt, Human
ucacugcaaccuccgccucccagg

SEQ ID NO: 787224 - RNA, 25 nt, Human
ucacugcaaccuccgccucccaggu

SEQ ID NO: 787225 - RNA, 27 nt, Human
ucacugcaaccuccgccucccagguuc

SEQ ID NO: 787226 - RNA, 18 nt, Human
ucauggcuaaaucaaggu

SEQ ID NO: 787227 - RNA, 22 nt, Human
ucauuauguuggccaggcuggu

SEQ ID NO: 787228 - RNA, 21 nt, Human
uccaaggccacuugaggccuc

SEQ ID NO: 787229 - RNA, 24 nt, Human
ucccaaagugcugggauuacaggc

SEQ ID NO: 787230 - RNA, 23 nt, Human
ucccaaguagcugggauuacagg

SEQ ID NO: 787231 - RNA, 25 nt, Human
ucccaaugacagacuugggguaccc

SEQ ID NO: 787232 - RNA, 24 nt, Human
ucccaggcuggaguguacuggugu

SEQ ID NO: 787233 - RNA, 21 nt, Human
ucccagguucaagcaauucuc

SEQ ID NO: 787234 - RNA, 24 nt, Human
ucccagguucaagcaauucucaug

SEQ ID NO: 787235 - RNA, 21 nt, Human
ucccagguucaagugauucuc

SEQ ID NO: 787236 - RNA, 24 nt, Human
ucccagguucaagugauucuccug

SEQ ID NO: 787237 - RNA, 18 nt, Human
uccccgugugcccguccu

SEQ ID NO: 787238 - RNA, 24 nt, Human
uccccgugugcccguccuucccuc

SEQ ID NO: 787239 - RNA, 19 nt, Human
ucccucaagacggcccggu

SEQ ID NO: 787240 - RNA, 19 nt, Human
ucgcugcaaccuccgccuc

SEQ ID NO: 787241 - RNA, 24 nt, Human
ucgcugcaaccuccgccucccagg

SEQ ID NO: 787242 - RNA, 25 nt, Human
ucgcugcaaccuccgccucccaggu

SEQ ID NO: 787243 - RNA, 18 nt, Human
ucucaccaucucccaggc

SEQ ID NO: 787244 - RNA, 22 nt, Human
ucucaccaucucccaggcugga

SEQ ID NO: 787245 - RNA, 24 nt, Human
ucucaccaucucccaggcuggagu

SEQ ID NO: 787246 - RNA, 24 nt, Human
ucucauucugucacacaggcugga

SEQ ID NO: 787247 - RNA, 18 nt, Human
ucucccaggcuggagugu

SEQ ID NO: 787248 - RNA, 24 nt, Human
ucugucacacaggcuggagugcag

SEQ ID NO: 787249 - RNA, 21 nt, Human
ucuugaacuccugaccuuaag

SEQ ID NO: 787250 - RNA, 19 nt, Human
ugacagacuuggagcuggg

SEQ ID NO: 787251 - RNA, 22 nt, Human
ugagauggagucucauucuguc

SEQ ID NO: 787252 - RNA, 18 nt, Human
ugaggcagcccaagaaug

SEQ ID NO: 787253 - RNA, 19 nt, Human
ugaggcuaagaaccuaaaa

SEQ ID NO: 787254 - RNA, 20 nt, Human
ugauacuggaagcccugggg

SEQ ID NO: 787255 - RNA, 23 nt, Human
ugcagacaccaaggcagaggcug

SEQ ID NO: 787256 - RNA, 26 nt, Human
ugcaguggugcaguggcaugaucucg

SEQ ID NO: 787257 - RNA, 19 nt, Human
ugcauagaugcugacugau

SEQ ID NO: 787258 - RNA, 19 nt, Human
ugccagggguuagccuucc

SEQ ID NO: 787259 - RNA, 22 nt, Human
ugcccguccuucccucugcugg

SEQ ID NO: 787260 - RNA, 21 nt, Human
ugccugggggacggacuaggc

SEQ ID NO: 787261 - RNA, 21 nt, Human
ugccuuacccucccaaguagc

SEQ ID NO: 787262 - RNA, 21 nt, Human
ugcucugcucuccuuaucccc

SEQ ID NO: 787263 - RNA, 19 nt, Human
ugcugacccacacucagcc

SEQ ID NO: 787264 - RNA, 23 nt, Human
uggaccuuaaaaaaacugcucug

SEQ ID NO: 787265 - RNA, 20 nt, Human
uggagagagagagugggcuc

SEQ ID NO: 787266 - RNA, 28 nt, Human
uggagugcaguggugcaguggcaugauc

SEQ ID NO: 787267 - RNA, 18 nt, Human
uggaguguacugguguga

SEQ ID NO: 787268 - RNA, 24 nt, Human
uggaguguacuggugugaucucag

SEQ ID NO: 787269 - RNA, 21 nt, Human
uggcaugaucucggcucgcug

SEQ ID NO: 787270 - RNA, 24 nt, Human
uggccaggcuggucuugaacuccu

SEQ ID NO: 787271 - RNA, 18 nt, Human
ugggauuacaggcaugag

SEQ ID NO: 787272 - RNA, 19 nt, Human
ugggauuacaggcaugagc

SEQ ID NO: 787273 - RNA, 21 nt, Human
ugggauuacaggcaugagcca

SEQ ID NO: 787274 - RNA, 22 nt, Human
ugggauuacaggcaugagccac

SEQ ID NO: 787275 - RNA, 22 nt, Human
ugggauuacaggcaugagccac

SEQ ID NO: 787276 - RNA, 24 nt, Human
ugggauuacaggcaugagccacug

SEQ ID NO: 787277 - RNA, 26 nt, Human
ugggauuacaggcaugagccacugcg

SEQ ID NO: 787278 - RNA, 21 nt, Human
ugggauuacaggugugcacca

SEQ ID NO: 787279 - RNA, 22 nt, Human
ugggauuacaggugugcaccac

SEQ ID NO: 787280 - RNA, 24 nt, Human
ugggauuacaggugugcaccacca

SEQ ID NO: 787281 - RNA, 24 nt, Human
ugggauuacaggugugcaccacca

SEQ ID NO: 787282 - RNA, 25 nt, Human
ugggauuacaggugugcaccaccau

SEQ ID NO: 787283 - RNA, 24 nt, Human
uggggagaguggggccuccauggg

SEQ ID NO: 787284 - RNA, 18 nt, Human
uggggugcagggcagugg

SEQ ID NO: 787285 - RNA, 25 nt, Human
uggugcaguggcaugaucucggcuc

SEQ ID NO: 787286 - RNA, 22 nt, Human
uggugugaucucagaucacugc

SEQ ID NO: 787287 - RNA, 18 nt, Human
ugucauaccugccauaaa

SEQ ID NO: 787288 - RNA, 18 nt, Human
uguccugaagccccacag

SEQ ID NO: 787289 - RNA, 26 nt, Human
ugugagccaccgugccuggccuuuau

SEQ ID NO: 787290 - RNA, 20 nt, Human
uuaguagagacaggguuuca

SEQ ID NO: 787291 - RNA, 24 nt, Human
uuaguagagacaggguuucauuau

SEQ ID NO: 787292 - RNA, 24 nt, Human
uugaggccucugccccucggguuu

SEQ ID NO: 787293 - RNA, 18 nt, Human
uuggccucccaaagugcu

SEQ ID NO: 787294 - RNA, 21 nt, Human
uuucauguuuucugugcugcc

SEQ ID NO: 787295 - RNA, 24 nt, Human
uuucauuauguuggccaggcuggu

SEQ ID NO: 787296 - RNA, 24 nt, Human
uuuuuaguagagacaggguuucau

SEQ ID NO: 787297 - RNA, 20 nt, Human
uuuuuguauuuuuaguagag

SEQ ID NO: 787298 - RNA, 22 nt, Human
aaaacaaaaacaaaaacagaaa

SEQ ID NO: 787299 - RNA, 30 nt, Human
aaaacaaaaacagaaacaaaacugcaccaa

SEQ ID NO: 787300 - RNA, 19 nt, Human
aaacagaaacaaaacugca

SEQ ID NO: 787301 - RNA, 21 nt, Human
aaacagaaacaaaacugcacc

SEQ ID NO: 787302 - RNA, 22 nt, Human
aaauccauuuugagaagaaacu

SEQ ID NO: 787303 - RNA, 20 nt, Human
caaaaacaaaaacagaaaca

SEQ ID NO: 787304 - RNA, 25 nt, Human
caaaaacaaaaacagaaacaaaacu

SEQ ID NO: 787305 - RNA, 22 nt, Human
caaaaacagaaacaaaacugca

SEQ ID NO: 787306 - RNA, 21 nt, Human
caccaaugcacagccagaggc

SEQ ID NO: 787307 - RNA, 21 nt, Human
ccagcaauuggcaaaauuugu

SEQ ID NO: 787308 - RNA, 24 nt, Human
cuaauacauaaccacaugaacauc

SEQ ID NO: 787309 - RNA, 31 nt, Human
gauuaaaaacaaaaacaaaaacagaaacaaa

SEQ ID NO: 787310 - RNA, 22 nt, Human
guuucugauggagagcagaauu

SEQ ID NO: 787311 - RNA, 25 nt, Human
uaaaaacaaaaacaaaaacagaaac

SEQ ID NO: 787312 - RNA, 21 nt, Human
uacauaaccacaugaacaucu

SEQ ID NO: 787313 - RNA, 22 nt, Human
uggagagcagaauucauaaaga

SEQ ID NO: 787314 - RNA, 21 nt, Human
uuucugauggagagcagaauu

SEQ ID NO: 787315 - RNA, 22 nt, Human
aaaaugccucccuccccaaauu

SEQ ID NO: 787316 - RNA, 24 nt, Human
aaacagccauguuuuccagauuuu

SEQ ID NO: 787317 - RNA, 22 nt, Human
aaacauauguaagaaaacaaag

SEQ ID NO: 787318 - RNA, 20 nt, Human
aaaccaaacuuuuaugugaa

SEQ ID NO: 787319 - RNA, 25 nt, Human
aaaccagguauuuugaagauuaaag

SEQ ID NO: 787320 - RNA, 23 nt, Human
aacacuguuagcauucuaaacaa

SEQ ID NO: 787321 - RNA, 21 nt, Human
aacauacagagaauggaauaa

SEQ ID NO: 787322 - RNA, 25 nt, Human
aagaacaaaaaaggaaagacauaua

SEQ ID NO: 787323 - RNA, 26 nt, Human
aagauuuuuccaacaauggagggcca

SEQ ID NO: 787324 - RNA, 20 nt, Human
acaauuuauccaaaaggauu

SEQ ID NO: 787325 - RNA, 19 nt, Human
acauaccacaugaaaaaca

SEQ ID NO: 787326 - RNA, 22 nt, Human
acggcauguccagaguggucug

SEQ ID NO: 787327 - RNA, 20 nt, Human
agaagaacaaaaaaggaaag

SEQ ID NO: 787328 - RNA, 19 nt, Human
agaauucuagaccagacuu

SEQ ID NO: 787329 - RNA, 24 nt, Human
agauaaucagugacaaguugacaa

SEQ ID NO: 787330 - RNA, 25 nt, Human
agccauguuuuccagauuuucugaa

SEQ ID NO: 787331 - RNA, 18 nt, Human
aggaaagacauauaggaa

SEQ ID NO: 787332 - RNA, 20 nt, Human
agggaugggaaaugggagau

SEQ ID NO: 787333 - RNA, 19 nt, Human
agggcaucuagguucuuua

SEQ ID NO: 787334 - RNA, 19 nt, Human
agugaaagggguggugggg

SEQ ID NO: 787335 - RNA, 19 nt, Human
auguuuuccagauuuucug

SEQ ID NO: 787336 - RNA, 20 nt, Human
caacaaguauaauaaugcaa

SEQ ID NO: 787337 - RNA, 23 nt, Human
caaccuucucuuugcuucaauuu

SEQ ID NO: 787338 - RNA, 20 nt, Human
caagaccagugagcaaugac

SEQ ID NO: 787339 - RNA, 18 nt, Human
cacugcacaugguuuuag

SEQ ID NO: 787340 - RNA, 21 nt, Human
cagauuuucugaaauaaccau

SEQ ID NO: 787341 - RNA, 21 nt, Human
cauguaagauucuagcaggcc

SEQ ID NO: 787342 - RNA, 21 nt, Human
ccacauagaaaagcaccuaaa

SEQ ID NO: 787343 - RNA, 24 nt, Human
ccgacauaccacaugaaaaacaaa

SEQ ID NO: 787344 - RNA, 20 nt, Human
ccuggcaaaugaccaaccuu

SEQ ID NO: 787345 - RNA, 23 nt, Human
cggcaauucaacuaaacuucagu

SEQ ID NO: 787346 - RNA, 19 nt, Human
cuccacauagaaaagcacc

SEQ ID NO: 787347 - RNA, 18 nt, Human
cugcauggcuauguguau

SEQ ID NO: 787348 - RNA, 20 nt, Human
gaacuagaaagaaaaacuaa

SEQ ID NO: 787349 - RNA, 21 nt, Human
gaacuagaaagaaaaacuaag

SEQ ID NO: 787350 - RNA, 21 nt, Human
gacauaccacaugaaaaacaa

SEQ ID NO: 787351 - RNA, 21 nt, Human
gagauaauaaggagaggacag

SEQ ID NO: 787352 - RNA, 26 nt, Human
ggauagauacacaugacauuaucccc

SEQ ID NO: 787353 - RNA, 19 nt, Human
gggagaguauuuauugcac

SEQ ID NO: 787354 - RNA, 24 nt, Human
uaaaacuaaaauggguaagaauuu

SEQ ID NO: 787355 - RNA, 22 nt, Human
uaaauaagcaacuuguuagcca

SEQ ID NO: 787356 - RNA, 21 nt, Human
uaagcaacuuguuagccaaug

SEQ ID NO: 787357 - RNA, 22 nt, Human
uaaggcuuuugugccuucuaag

SEQ ID NO: 787358 - RNA, 20 nt, Human
uaaguuauuuuucucuuuug

SEQ ID NO: 787359 - RNA, 24 nt, Human
uaauauaccuuggauucacagaac

SEQ ID NO: 787360 - RNA, 19 nt, Human
uaaugacucuuaaugaagg

SEQ ID NO: 787361 - RNA, 18 nt, Human
uaaugcaauaugacauga

SEQ ID NO: 787362 - RNA, 23 nt, Human
uagaaaaauaagauuuuuccaac

SEQ ID NO: 787363 - RNA, 19 nt, Human
uagcauucuaaacaagggu

SEQ ID NO: 787364 - RNA, 18 nt, Human
uagccauaucccaacaag

SEQ ID NO: 787365 - RNA, 22 nt, Human
uagcuugaaagaacccaaacac

SEQ ID NO: 787366 - RNA, 20 nt, Human
uagggaugggaaaugggaga

SEQ ID NO: 787367 - RNA, 24 nt, Human
uauaauaaauauaugacucaggug

SEQ ID NO: 787368 - RNA, 21 nt, Human
uauagcagaagaacaaaaaag

SEQ ID NO: 787369 - RNA, 23 nt, Human
uauagcuaacugaaaucuccaca

SEQ ID NO: 787370 - RNA, 19 nt, Human
uaugacucaggugaaaugu

SEQ ID NO: 787371 - RNA, 19 nt, Human
uauguaagaaaacaaaguu

SEQ ID NO: 787372 - RNA, 24 nt, Human
ucaaauccuacuuuaaacauaugu

SEQ ID NO: 787373 - RNA, 22 nt, Human
ucaauuucuaaaucuucuacau

SEQ ID NO: 787374 - RNA, 19 nt, Human
ucaguuuaaaaaaaaaaaa

SEQ ID NO: 787375 - RNA, 26 nt, Human
ucaguuuaaaaaaaaaaaacacccua

SEQ ID NO: 787376 - RNA, 24 nt, Human
uccaagaggcaugccagcuacaga

SEQ ID NO: 787377 - RNA, 23 nt, Human
ucucaauauuccauuuuuuaaaa

SEQ ID NO: 787378 - RNA, 22 nt, Human
ucugaaauaaccaugcuuccaa

SEQ ID NO: 787379 - RNA, 18 nt, Human
ugaaaaauuucacuucag

SEQ ID NO: 787380 - RNA, 21 nt, Human
ugaaaagagcauaacaugugg

SEQ ID NO: 787381 - RNA, 21 nt, Human
ugaaacagccauguuuuccag

SEQ ID NO: 787382 - RNA, 24 nt, Human
ugaaagaacccaaacacugucuua

SEQ ID NO: 787383 - RNA, 18 nt, Human
ugagaugacguucaacuc

SEQ ID NO: 787384 - RNA, 20 nt, Human
ugccacugcacaugguuuua

SEQ ID NO: 787385 - RNA, 20 nt, Human
ugcuaacauauuuguuaaua

SEQ ID NO: 787386 - RNA, 18 nt, Human
ugcugcauggcuaugugu

SEQ ID NO: 787387 - RNA, 18 nt, Human
uggaauaaacauaaaagu

SEQ ID NO: 787388 - RNA, 27 nt, Human
uggagucaggaaaccuggcaaaugacc

SEQ ID NO: 787389 - RNA, 18 nt, Human
uggccaauuagaaacaaa

SEQ ID NO: 787390 - RNA, 23 nt, Human
ugggagauaauaaggagaggaca

SEQ ID NO: 787391 - RNA, 22 nt, Human
uguaagauucuagcaggccuug

SEQ ID NO: 787392 - RNA, 19 nt, Human
uguaagcaaaauauaauuu

SEQ ID NO: 787393 - RNA, 24 nt, Human
uguagaaccaggguaaguuauuuu

SEQ ID NO: 787394 - RNA, 19 nt, Human
ugugaagauauuguaauga

SEQ ID NO: 787395 - RNA, 21 nt, Human
uguggagucaggaaaccuggu

SEQ ID NO: 787396 - RNA, 23 nt, Human
uguuagcauucuaaacaaggguu

SEQ ID NO: 787397 - RNA, 25 nt, Human
uucaguggccaauuagaaacaaaua

SEQ ID NO: 787398 - RNA, 21 nt, Human
uucuccaaucauaaaccaaac

SEQ ID NO: 787399 - RNA, 24 nt, Human
uugaaacuauuauccacaucacua

SEQ ID NO: 787400 - RNA, 20 nt, Human
uuuggacauaaaaguaggau

SEQ ID NO: 787401 - RNA, 18 nt, Human
uuuguauagcagaagaac

SEQ ID NO: 787402 - RNA, 24 nt, Human
aaaauaguacuugaugucaaaaca

SEQ ID NO: 787403 - RNA, 24 nt, Human
aaacaaacaaacaggacagccaga

SEQ ID NO: 787404 - RNA, 21 nt, Human
aaaggccuccugcugugagaa

SEQ ID NO: 787405 - RNA, 21 nt, Human
aaccagacauggcugggaaau

SEQ ID NO: 787406 - RNA, 19 nt, Human
aagcuagccccccgccccc

SEQ ID NO: 787407 - RNA, 19 nt, Human
aagcuagccccccgccccc

SEQ ID NO: 787408 - RNA, 28 nt, Human
aagcuuuggcuccagcaaguccuugcug

SEQ ID NO: 787409 - RNA, 18 nt, Human
aaguccuugcugugugac

SEQ ID NO: 787410 - RNA, 19 nt, Human
accccaagucucgccccuc

SEQ ID NO: 787411 - RNA, 24 nt, Human
accccaagucucgccccuccacac

SEQ ID NO: 787412 - RNA, 22 nt, Human
accuggcuccuggagggaaggg

SEQ ID NO: 787413 - RNA, 19 nt, Human
agacacugaggcucccagc

SEQ ID NO: 787414 - RNA, 22 nt, Human
agcaccccaagucucgccccuc

SEQ ID NO: 787415 - RNA, 24 nt, Human
aggagacacugccccccccacccc

SEQ ID NO: 787416 - RNA, 24 nt, Human
agggcagccccggggucugugggc

SEQ ID NO: 787417 - RNA, 25 nt, Human
agugacacagggacaagggacaccc

SEQ ID NO: 787418 - RNA, 19 nt, Human
agugacagugacacaggga

SEQ ID NO: 787419 - RNA, 18 nt, Human
auaauaccucccucagag

SEQ ID NO: 787420 - RNA, 24 nt, Human
auggcugggaaaugcacaagccca

SEQ ID NO: 787421 - RNA, 18 nt, Human
caagaagggagccaggcc

SEQ ID NO: 787422 - RNA, 24 nt, Human
caagaagggagccaggcccucuca

SEQ ID NO: 787423 - RNA, 20 nt, Human
caagcccagcacagccaccu

SEQ ID NO: 787424 - RNA, 18 nt, Human
cacaacacagccugccug

SEQ ID NO: 787425 - RNA, 22 nt, Human
cacacagcugccaugcagucag

SEQ ID NO: 787426 - RNA, 23 nt, Human
cacacugggcugcaaugccagaa

SEQ ID NO: 787427 - RNA, 22 nt, Human
caccauugagcaggauauucca

SEQ ID NO: 787428 - RNA, 21 nt, Human
cacccaaaaugcuggggugag

SEQ ID NO: 787429 - RNA, 21 nt, Human
cacccccauaugagaaacaaa

SEQ ID NO: 787430 - RNA, 20 nt, Human
cacugccccccccaccccuu

SEQ ID NO: 787431 - RNA, 22 nt, Human
cagagcaagccacuuccccgcu

SEQ ID NO: 787432 - RNA, 18 nt, Human
cagcacagccaccugcca

SEQ ID NO: 787433 - RNA, 24 nt, Human
cagcacagccaccugccagacacu

SEQ ID NO: 787434 - RNA, 26 nt, Human
cagccagaggagacacugcccccccc

SEQ ID NO: 787435 - RNA, 21 nt, Human
cagcccaccaagaagggagcc

SEQ ID NO: 787436 - RNA, 23 nt, Human
cagcccaccaagaagggagccag

SEQ ID NO: 787437 - RNA, 28 nt, Human
cagccccucuggaccccacaacacagcc

SEQ ID NO: 787438 - RNA, 24 nt, Human
cagcuacaaaggccaacugcucag

SEQ ID NO: 787439 - RNA, 20 nt, Human
cagcugcuucugccuggaag

SEQ ID NO: 787440 - RNA, 24 nt, Human
caggcccuaccuggcuccuggagg

SEQ ID NO: 787441 - RNA, 20 nt, Human
caggcguggaggggcugugg

SEQ ID NO: 787442 - RNA, 25 nt, Human
caguaaaaucaggacucuaaccaca

SEQ ID NO: 787443 - RNA, 19 nt, Human
cauccuuccucuugguagg

SEQ ID NO: 787444 - RNA, 21 nt, Human
cauuggagcugaggucuagcc

SEQ ID NO: 787445 - RNA, 22 nt, Human
ccacacuucacaaggaacauga

SEQ ID NO: 787446 - RNA, 21 nt, Human
ccacaggcuuccuaagagccc

SEQ ID NO: 787447 - RNA, 19 nt, Human
ccagaagcuuuggcuccag

SEQ ID NO: 787448 - RNA, 25 nt, Human
cccacaacacagccugccugugcgg

SEQ ID NO: 787449 - RNA, 24 nt, Human
cccacaggcuuccuaagagcccac

SEQ ID NO: 787450 - RNA, 23 nt, Human
cccaccaagaagggagccaggcc

SEQ ID NO: 787451 - RNA, 23 nt, Human
ccccaaaaccaugcaguggcgcu

SEQ ID NO: 787452 - RNA, 24 nt, Human
cccccaaaaccaugcaguggcgcu

SEQ ID NO: 787453 - RNA, 25 nt, Human
cccccacccccauaugagaaacaaa

SEQ ID NO: 787454 - RNA, 24 nt, Human
ccccccacccccauaugagaaaca

SEQ ID NO: 787455 - RNA, 26 nt, Human
ccccccacccccauaugagaaacaaa

SEQ ID NO: 787456 - RNA, 22 nt, Human
ccccccccaccccuuugugcaa

SEQ ID NO: 787457 - RNA, 18 nt, Human
cccccccccccaaaacca

SEQ ID NO: 787458 - RNA, 20 nt, Human
ccccccgcccccccccccaa

SEQ ID NO: 787459 - RNA, 21 nt, Human
ccccccgcccccccccccaaa

SEQ ID NO: 787460 - RNA, 24 nt, Human
cccccgcccccccccccaaaaccc

SEQ ID NO: 787461 - RNA, 25 nt, Human
ccccgcucugggccucaguuucuuc

SEQ ID NO: 787462 - RNA, 22 nt, Human
ccccugggccagaagcuuuggc

SEQ ID NO: 787463 - RNA, 24 nt, Human
ccccugggccagaagcuuuggcuc

SEQ ID NO: 787464 - RNA, 19 nt, Human
cccucaggcccuaccuggc

SEQ ID NO: 787465 - RNA, 18 nt, Human
cccucucagcaccccaag

SEQ ID NO: 787466 - RNA, 20 nt, Human
cccugggccagaagcuuugg

SEQ ID NO: 787467 - RNA, 20 nt, Human
ccgcccccccccccaaaacc

SEQ ID NO: 787468 - RNA, 18 nt, Human
ccugaggcaggcguggag

SEQ ID NO: 787469 - RNA, 21 nt, Human
cucuggaccccacaacacagc

SEQ ID NO: 787470 - RNA, 19 nt, Human
cugggcugcaaugccagaa

SEQ ID NO: 787471 - RNA, 21 nt, Human
cuuuauaccguacagcagucg

SEQ ID NO: 787472 - RNA, 21 nt, Human
cuuugugcaaggcuuggaucc

SEQ ID NO: 787473 - RNA, 18 nt, Human
gaagcuuuggcuccagca

SEQ ID NO: 787474 - RNA, 18 nt, Human
gacacagggacaagggac

SEQ ID NO: 787475 - RNA, 22 nt, Human
gacacccaaaaugcugggguga

SEQ ID NO: 787476 - RNA, 20 nt, Human
gacacugccccccccacccc

SEQ ID NO: 787477 - RNA, 20 nt, Human
gacccgugugugcccaucuc

SEQ ID NO: 787478 - RNA, 22 nt, Human
gaggagacacugccccccccac

SEQ ID NO: 787479 - RNA, 19 nt, Human
gaggagcccacaggcuucc

SEQ ID NO: 787480 - RNA, 21 nt, Human
gagggaaggggucagguuggc

SEQ ID NO: 787481 - RNA, 21 nt, Human
gcagccccggggucugugggc

SEQ ID NO: 787482 - RNA, 23 nt, Human
gcagccccggggucugugggcug

SEQ ID NO: 787483 - RNA, 19 nt, Human
gccaugcagucagugcuga

SEQ ID NO: 787484 - RNA, 18 nt, Human
gccccccccaccccuuug

SEQ ID NO: 787485 - RNA, 24 nt, Human
gccccucuggaccccacaacacag

SEQ ID NO: 787486 - RNA, 18 nt, Human
gcuagccccccgcccccc

SEQ ID NO: 787487 - RNA, 20 nt, Human
gcucagaggagcccacaggc

SEQ ID NO: 787488 - RNA, 21 nt, Human
ggacuuaggucuuacuuccau

SEQ ID NO: 787489 - RNA, 18 nt, Human
ggcaggucucggucucug

SEQ ID NO: 787490 - RNA, 23 nt, Human
ggccagaagcuuuggcuccagca

SEQ ID NO: 787491 - RNA, 18 nt, Human
ggcccugaggcaggcgug

SEQ ID NO: 787492 - RNA, 22 nt, Human
ggcguggaggggcugugggggc

SEQ ID NO: 787493 - RNA, 21 nt, Human
ggugagggcagcccaggggcu

SEQ ID NO: 787494 - RNA, 19 nt, Human
gucaaaacauuggagcuga

SEQ ID NO: 787495 - RNA, 26 nt, Human
uacagcagucggaaggaaaauaguac

SEQ ID NO: 787496 - RNA, 21 nt, Human
uagaagggggcuacagcagug

SEQ ID NO: 787497 - RNA, 21 nt, Human
uagccccccgccccccccccc

SEQ ID NO: 787498 - RNA, 18 nt, Human
ucaggcccugaggcaggc

SEQ ID NO: 787499 - RNA, 19 nt, Human
ucagggcacuucacccaac

SEQ ID NO: 787500 - RNA, 22 nt, Human
ucccucaggcccuaccuggcuc

SEQ ID NO: 787501 - RNA, 22 nt, Human
uccguaauguccuggguuccca

SEQ ID NO: 787502 - RNA, 21 nt, Human
uccugcugugcuuuauaccgu

SEQ ID NO: 787503 - RNA, 22 nt, Human
uccuggguucccacauugacuc

SEQ ID NO: 787504 - RNA, 23 nt, Human
ugacccagagcaagccacuuccc

SEQ ID NO: 787505 - RNA, 22 nt, Human
ugagaaacaaacaaacaggaca

SEQ ID NO: 787506 - RNA, 24 nt, Human
ugagaagcuagccccccgcccccc

SEQ ID NO: 787507 - RNA, 21 nt, Human
ugagcacacagcugccaugca

SEQ ID NO: 787508 - RNA, 21 nt, Human
ugagcuguaccauccuuccuc

SEQ ID NO: 787509 - RNA, 21 nt, Human
ugaggaaaacagccuagacuc

SEQ ID NO: 787510 - RNA, 18 nt, Human
ugaggcaggcguggaggg

SEQ ID NO: 787511 - RNA, 18 nt, Human
ugcagguaccccccaccc

SEQ ID NO: 787512 - RNA, 19 nt, Human
ugcugugagaagcuagccc

SEQ ID NO: 787513 - RNA, 23 nt, Human
uggagggaaggggucagguuggc

SEQ ID NO: 787514 - RNA, 21 nt, Human
ugggccucaguuucuuccucu

SEQ ID NO: 787515 - RNA, 24 nt, Human
uggggugagggcagcccaggggcu

SEQ ID NO: 787516 - RNA, 18 nt, Human
uguaaaauggggauaaua

SEQ ID NO: 787517 - RNA, 21 nt, Human
ugucagggcacuucacccaac

SEQ ID NO: 787518 - RNA, 20 nt, Human
ugugugcccaucucggcugc

SEQ ID NO: 787519 - RNA, 19 nt, Human
uuccaucaacuuuacaugu

SEQ ID NO: 787520 - RNA, 20 nt, Human
uuccccgcucugggccucag

SEQ ID NO: 787521 - RNA, 20 nt, Human
uuccugaacaucaucaggac

SEQ ID NO: 787522 - RNA, 19 nt, Human
uugcagcuacaaaggccaa

SEQ ID NO: 787523 - RNA, 18 nt, Human
aaaauuagcugggcgugg

SEQ ID NO: 787524 - RNA, 22 nt, Human
aaaguaccaauuugaagugcaa

SEQ ID NO: 787525 - RNA, 19 nt, Human
aacaaaaacacacaagaca

SEQ ID NO: 787526 - RNA, 19 nt, Human
aacaggguaaaaccccauc

SEQ ID NO: 787527 - RNA, 20 nt, Human
aacaggguaaaaccccaucu

SEQ ID NO: 787528 - RNA, 21 nt, Human
aacaggguaaaaccccaucuc

SEQ ID NO: 787529 - RNA, 20 nt, Human
aacaguuugcuagaugauuc

SEQ ID NO: 787530 - RNA, 22 nt, Human
aacuuauuauuuuccucacuuu

SEQ ID NO: 787531 - RNA, 20 nt, Human
aagcugagaugggaggacag

SEQ ID NO: 787532 - RNA, 24 nt, Human
aaucgcuugaaccugggaggugga

SEQ ID NO: 787533 - RNA, 21 nt, Human
acagagugagacucugucuca

SEQ ID NO: 787534 - RNA, 19 nt, Human
acaugcuagaaauuacagu

SEQ ID NO: 787535 - RNA, 24 nt, Human
accccaucucuacuaaaaauacaa

SEQ ID NO: 787536 - RNA, 19 nt, Human
acccggcgacgaggcgucc

SEQ ID NO: 787537 - RNA, 24 nt, Human
acuagccaggcaugguggcucaug

SEQ ID NO: 787538 - RNA, 24 nt, Human
acuccagccugggcgacagaguga

SEQ ID NO: 787539 - RNA, 24 nt, Human
acugcacuccagccugggcgacag

SEQ ID NO: 787540 - RNA, 26 nt, Human
acugcacuccagccugggcgacagag

SEQ ID NO: 787541 - RNA, 24 nt, Human
acugugccacugcacuccagccug

SEQ ID NO: 787542 - RNA, 24 nt, Human
agcacuuugggaagcugagauggg

SEQ ID NO: 787543 - RNA, 23 nt, Human
agccaggcaugguggcucaugcc

SEQ ID NO: 787544 - RNA, 23 nt, Human
agccuggacaauauagugagacc

SEQ ID NO: 787545 - RNA, 24 nt, Human
agccuggacaauauagugagaccu

SEQ ID NO: 787546 - RNA, 24 nt, Human
agccugggcgacagagugagacuc

SEQ ID NO: 787547 - RNA, 23 nt, Human
agcugggcgugguggugcacgcc

SEQ ID NO: 787548 - RNA, 19 nt, Human
aggacagcuugaggccagg

SEQ ID NO: 787549 - RNA, 22 nt, Human
aggcaugagaaucgcuugaacc

SEQ ID NO: 787550 - RNA, 24 nt, Human
aggcaugagaaucgcuugaaccug

SEQ ID NO: 787551 - RNA, 24 nt, Human
aggcaugguggcucaugccuauaa

SEQ ID NO: 787552 - RNA, 24 nt, Human
aggcggguagaucaucagagguca

SEQ ID NO: 787553 - RNA, 26 nt, Human
aggcggguagaucaucagaggucagg

SEQ ID NO: 787554 - RNA, 24 nt, Human
aggcugaggcaugagaaucgcuug

SEQ ID NO: 787555 - RNA, 20 nt, Human
agguggagguugcagugagc

SEQ ID NO: 787556 - RNA, 24 nt, Human
agguggagguugcagugagcugag

SEQ ID NO: 787557 - RNA, 23 nt, Human
aguggcucaugucuguaauccca

SEQ ID NO: 787558 - RNA, 24 nt, Human
aguggcucaugucuguaaucccag

SEQ ID NO: 787559 - RNA, 24 nt, Human
auaguacuauagugaucucagcuc

SEQ ID NO: 787560 - RNA, 18 nt, Human
aucuguacaguauuacag

SEQ ID NO: 787561 - RNA, 19 nt, Human
augccuauaaucucagcac

SEQ ID NO: 787562 - RNA, 22 nt, Human
augcuagaaauuacaguaaaca

SEQ ID NO: 787563 - RNA, 21 nt, Human
auggcccagagucacaagcca

SEQ ID NO: 787564 - RNA, 19 nt, Human
augucuguaaucccagcac

SEQ ID NO: 787565 - RNA, 25 nt, Human
caagaaagaguuguuuucaucggga

SEQ ID NO: 787566 - RNA, 22 nt, Human
cacaaaacagaggcagggcaca

SEQ ID NO: 787567 - RNA, 19 nt, Human
cacaguacacaagccuuga

SEQ ID NO: 787568 - RNA, 18 nt, Human
cacccuggccaacagggu

SEQ ID NO: 787569 - RNA, 21 nt, Human
caccuaaacucccuuuugcuc

SEQ ID NO: 787570 - RNA, 18 nt, Human
cacgccuguaguccucgc

SEQ ID NO: 787571 - RNA, 22 nt, Human
cacuccagccugggcgacagag

SEQ ID NO: 787572 - RNA, 24 nt, Human
cacuccagccugggcgacagagug

SEQ ID NO: 787573 - RNA, 19 nt, Human
cacugcacuccagccuggg

SEQ ID NO: 787574 - RNA, 20 nt, Human
cacugcacuccagccugggc

SEQ ID NO: 787575 - RNA, 22 nt, Human
cacugcacuccagccugggcga

SEQ ID NO: 787576 - RNA, 23 nt, Human
cacugcacuccagccugggcgac

SEQ ID NO: 787577 - RNA, 24 nt, Human
cacugcacuccagccugggcgaca

SEQ ID NO: 787578 - RNA, 19 nt, Human
cagaaaaagcucgcaggug

SEQ ID NO: 787579 - RNA, 23 nt, Human
cagaaaaagcucgcagguggaag

SEQ ID NO: 787580 - RNA, 21 nt, Human
cagaggcagggcacaguggcu

SEQ ID NO: 787581 - RNA, 22 nt, Human
cagaggucaggaauucgagacc

SEQ ID NO: 787582 - RNA, 24 nt, Human
cagcacuuugagagguccaggcgg

SEQ ID NO: 787583 - RNA, 18 nt, Human
cagcacuuugggaagcug

SEQ ID NO: 787584 - RNA, 20 nt, Human
cagcacuuugggaagcugag

SEQ ID NO: 787585 - RNA, 19 nt, Human
cagcccgugugggacggcg

SEQ ID NO: 787586 - RNA, 22 nt, Human
cagggcacaguggcucaugucu

SEQ ID NO: 787587 - RNA, 22 nt, Human
caggguaccuggccucacaucc

SEQ ID NO: 787588 - RNA, 24 nt, Human
caguacacaagccuugaugcagcc

SEQ ID NO: 787589 - RNA, 24 nt, Human
caugccuauaaucucagcacuuug

SEQ ID NO: 787590 - RNA, 24 nt, Human
caugucuguaaucccagcacuuug

SEQ ID NO: 787591 - RNA, 18 nt, Human
cauucugcagaaaaagcu

SEQ ID NO: 787592 - RNA, 20 nt, Human
cauugcaucccaaacagagc

SEQ ID NO: 787593 - RNA, 23 nt, Human
ccaacauuuaauaaauugcauuc

SEQ ID NO: 787594 - RNA, 20 nt, Human
ccacugcacuccagccuggg

SEQ ID NO: 787595 - RNA, 21 nt, Human
ccacugcacuccagccugggc

SEQ ID NO: 787596 - RNA, 21 nt, Human
ccacugcacuccagccugggc

SEQ ID NO: 787597 - RNA, 23 nt, Human
ccacugcacuccagccugggcga

SEQ ID NO: 787598 - RNA, 24 nt, Human
ccacugcacuccagccugggcgac

SEQ ID NO: 787599 - RNA, 19 nt, Human
cccacgcgcaggccggccg

SEQ ID NO: 787600 - RNA, 25 nt, Human
ccccuccucuguggcggcggcggcg

SEQ ID NO: 787601 - RNA, 18 nt, Human
ccccugggugccgccucc

SEQ ID NO: 787602 - RNA, 20 nt, Human
cccugcacgucuucucccca

SEQ ID NO: 787603 - RNA, 23 nt, Human
cccugcugccgcugcugcaggaa

SEQ ID NO: 787604 - RNA, 24 nt, Human
ccgaaccugcagcaaccgucccug

SEQ ID NO: 787605 - RNA, 19 nt, Human
ccgaccccgaaccugcagc

SEQ ID NO: 787606 - RNA, 22 nt, Human
ccgccuccgccucugccucccc

SEQ ID NO: 787607 - RNA, 21 nt, Human
ccgccuccgccucugccuccg

SEQ ID NO: 787608 - RNA, 22 nt, Human
ccggccccugggugccgccucc

SEQ ID NO: 787609 - RNA, 18 nt, Human
ccgugcgucguucuccuc

SEQ ID NO: 787610 - RNA, 22 nt, Human
ccuauaaucucagcacuuuggg

SEQ ID NO: 787611 - RNA, 20 nt, Human
ccucggccgugccuccuccc

SEQ ID NO: 787612 - RNA, 18 nt, Human
ccugcggauggccuagag

SEQ ID NO: 787613 - RNA, 22 nt, Human
ccugcggauggccuagagcccu

SEQ ID NO: 787614 - RNA, 20 nt, Human
ccuggcaauucuuggauuac

SEQ ID NO: 787615 - RNA, 24 nt, Human
ccuggccaacaggguaaaacccca

SEQ ID NO: 787616 - RNA, 21 nt, Human
ccugggagguggagguugcag

SEQ ID NO: 787617 - RNA, 22 nt, Human
ccugggcgacagagugagacuc

SEQ ID NO: 787618 - RNA, 19 nt, Human
ccuguaguccucgcuacuc

SEQ ID NO: 787619 - RNA, 22 nt, Human
ccuguaguccucgcuacucggg

SEQ ID NO: 787620 - RNA, 21 nt, Human
ccuucuccauuccacuucuug

SEQ ID NO: 787621 - RNA, 23 nt, Human
cgaacagcguccucgcaagccca

SEQ ID NO: 787622 - RNA, 24 nt, Human
cgagaccacccuggccaacagggu

SEQ ID NO: 787623 - RNA, 24 nt, Human
cgccuguaguccucgcuacucggg

SEQ ID NO: 787624 - RNA, 23 nt, Human
cgcgcaggccggccgaccccgaa

SEQ ID NO: 787625 - RNA, 19 nt, Human
cggccccugggugccgccu

SEQ ID NO: 787626 - RNA, 24 nt, Human
cggguagaucaucagaggucagga

SEQ ID NO: 787627 - RNA, 21 nt, Human
cgucccugcugccgcugcugc

SEQ ID NO: 787628 - RNA, 20 nt, Human
cucaaucacuucauuagcaa

SEQ ID NO: 787629 - RNA, 24 nt, Human
cucaugccuauaaucucagcacuu

SEQ ID NO: 787630 - RNA, 23 nt, Human
cucaugucuguaaucccagcacu

SEQ ID NO: 787631 - RNA, 24 nt, Human
cucaugucuguaaucccagcacuu

SEQ ID NO: 787632 - RNA, 18 nt, Human
cuccccugccccggcccc

SEQ ID NO: 787633 - RNA, 20 nt, Human
cuccgugcgucguucuccuc

SEQ ID NO: 787634 - RNA, 19 nt, Human
cuccuccucgcugucggac

SEQ ID NO: 787635 - RNA, 22 nt, Human
cucgcaagcccacgcgcaggcc

SEQ ID NO: 787636 - RNA, 19 nt, Human
cugaauuuccaaaauaaac

SEQ ID NO: 787637 - RNA, 23 nt, Human
cugaccguuaaacugucacugga

SEQ ID NO: 787638 - RNA, 23 nt, Human
cuggccaacaggguaaaacccca

SEQ ID NO: 787639 - RNA, 19 nt, Human
cuugaaccugggaggugga

SEQ ID NO: 787640 - RNA, 22 nt, Human
gaaguaaauggcccagagucac

SEQ ID NO: 787641 - RNA, 22 nt, Human
gacagagugagacucugucuca

SEQ ID NO: 787642 - RNA, 24 nt, Human
gacagcuugaggccaggaguucaa

SEQ ID NO: 787643 - RNA, 20 nt, Human
gaccccgaaccugcagcaac

SEQ ID NO: 787644 - RNA, 23 nt, Human
gagacugugccacugcacuccag

SEQ ID NO: 787645 - RNA, 23 nt, Human
gagguugcagugagcugagacug

SEQ ID NO: 787646 - RNA, 18 nt, Human
gaucaucagaggucagga

SEQ ID NO: 787647 - RNA, 24 nt, Human
gaucaucagaggucaggaauucga

SEQ ID NO: 787648 - RNA, 24 nt, Human
gcacuccagccugggcgacagagu

SEQ ID NO: 787649 - RNA, 19 nt, Human
gcagggcacaguggcucau

SEQ ID NO: 787650 - RNA, 23 nt, Human
gcagggcacaguggcucaugucu

SEQ ID NO: 787651 - RNA, 22 nt, Human
gccacugcacuccagccugggc

SEQ ID NO: 787652 - RNA, 24 nt, Human
gccacugcacuccagccugggcga

SEQ ID NO: 787653 - RNA, 18 nt, Human
gccccacaauauuagagc

SEQ ID NO: 787654 - RNA, 20 nt, Human
gccuggacaauauagugaga

SEQ ID NO: 787655 - RNA, 24 nt, Human
gcgacagagugagacucugucuca

SEQ ID NO: 787656 - RNA, 23 nt, Human
gcugaucuguacaguauuacagu

SEQ ID NO: 787657 - RNA, 23 nt, Human
ggacagcuugaggccaggaguuc

SEQ ID NO: 787658 - RNA, 18 nt, Human
ggaggacagcuugaggcc

SEQ ID NO: 787659 - RNA, 22 nt, Human
ggagguugcagugagcugagac

SEQ ID NO: 787660 - RNA, 18 nt, Human
ggcagggcacaguggcuc

SEQ ID NO: 787661 - RNA, 19 nt, Human
ggccccugggugccgccuc

SEQ ID NO: 787662 - RNA, 18 nt, Human
ggccgaccccgaaccugc

SEQ ID NO: 787663 - RNA, 22 nt, Human
ggcgugguggugcacgccugua

SEQ ID NO: 787664 - RNA, 21 nt, Human
ggcucaugccuauaaucucag

SEQ ID NO: 787665 - RNA, 24 nt, Human
gggcacaguggcucaugucuguaa

SEQ ID NO: 787666 - RNA, 19 nt, Human
gguggagguugcagugagc

SEQ ID NO: 787667 - RNA, 24 nt, Human
gguggcucaugccuauaaucucag

SEQ ID NO: 787668 - RNA, 24 nt, Human
gguggugcacgccuguaguccucg

SEQ ID NO: 787669 - RNA, 22 nt, Human
gucccugcugccgcugcugcag

SEQ ID NO: 787670 - RNA, 20 nt, Human
guggagguugcagugagcug

SEQ ID NO: 787671 - RNA, 24 nt, Human
guucuaguuuuaaaauuuaagaag

SEQ ID NO: 787672 - RNA, 21 nt, Human
uaaauaaauaaauaacugauc

SEQ ID NO: 787673 - RNA, 21 nt, Human
uaaauaaauaacugaucucac

SEQ ID NO: 787674 - RNA, 28 nt, Human
uaacaaaaacacacaagacauagaggua

SEQ ID NO: 787675 - RNA, 20 nt, Human
uaccuggccucacauccaug

SEQ ID NO: 787676 - RNA, 24 nt, Human
uagaucaucagaggucaggaauuc

SEQ ID NO: 787677 - RNA, 22 nt, Human
ucaagaacauuuuucuauuugg

SEQ ID NO: 787678 - RNA, 26 nt, Human
ucaagccaaaugaaauuccacccacg

SEQ ID NO: 787679 - RNA, 22 nt, Human
ucaccaaagagucaagccaaau

SEQ ID NO: 787680 - RNA, 23 nt, Human
ucagaggucaggaauucgagacc

SEQ ID NO: 787681 - RNA, 23 nt, Human
ucaggaucccaaaaaugcuuccu

SEQ ID NO: 787682 - RNA, 18 nt, Human
ucaggguauauuucuggg

SEQ ID NO: 787683 - RNA, 22 nt, Human
ucaucagaggucaggaauucga

SEQ ID NO: 787684 - RNA, 23 nt, Human
uccagccugggcgacagagugag

SEQ ID NO: 787685 - RNA, 24 nt, Human
uccagccugggcgacagagugaga

SEQ ID NO: 787686 - RNA, 19 nt, Human
uccaugaguacuugagaaa

SEQ ID NO: 787687 - RNA, 19 nt, Human
ucccggccuccccugcccc

SEQ ID NO: 787688 - RNA, 19 nt, Human
ucccugcugccgcugcugc

SEQ ID NO: 787689 - RNA, 22 nt, Human
ucccugcugccgcugcugcagg

SEQ ID NO: 787690 - RNA, 24 nt, Human
ucgcuugaaccugggagguggagg

SEQ ID NO: 787691 - RNA, 24 nt, Human
ucgggaggcugaggcaugagaauc

SEQ ID NO: 787692 - RNA, 21 nt, Human
ucucuacuaaaaauacaaaaa

SEQ ID NO: 787693 - RNA, 21 nt, Human
ucuuaucugugaaaugaggau

SEQ ID NO: 787694 - RNA, 20 nt, Human
ucuuggauuaccuaaucacc

SEQ ID NO: 787695 - RNA, 22 nt, Human
ugaaacccugcacgucuucucc

SEQ ID NO: 787696 - RNA, 24 nt, Human
ugaaccugggagguggagguugca

SEQ ID NO: 787697 - RNA, 18 nt, Human
ugaagaaugaauggucua

SEQ ID NO: 787698 - RNA, 22 nt, Human
ugaaguaaauggcccagaguca

SEQ ID NO: 787699 - RNA, 22 nt, Human
ugacaaacacaacauugcaucc

SEQ ID NO: 787700 - RNA, 23 nt, Human
ugagagccugauuuuuuuuuuuu

SEQ ID NO: 787701 - RNA, 24 nt, Human
ugagagguccaggcggguagauca

SEQ ID NO: 787702 - RNA, 24 nt, Human
ugagaugggaggacagcuugaggc

SEQ ID NO: 787703 - RNA, 26 nt, Human
ugagaugggaggacagcuugaggcca

SEQ ID NO: 787704 - RNA, 22 nt, Human
ugagcugagacugugccacugc

SEQ ID NO: 787705 - RNA, 24 nt, Human
ugaggcaugagaaucgcuugaacc

SEQ ID NO: 787706 - RNA, 23 nt, Human
ugcagcggggugauaccggcacc

SEQ ID NO: 787707 - RNA, 19 nt, Human
ugccccggccccugggugc

SEQ ID NO: 787708 - RNA, 18 nt, Human
ugccuccgcccccuccuc

SEQ ID NO: 787709 - RNA, 19 nt, Human
ugccuccgcccccuccucu

SEQ ID NO: 787710 - RNA, 18 nt, Human
uggagguugcagugagcu

SEQ ID NO: 787711 - RNA, 24 nt, Human
uggcccagagucacaagccagcaa

SEQ ID NO: 787712 - RNA, 20 nt, Human
uggccuggcaaaaacaguuu

SEQ ID NO: 787713 - RNA, 21 nt, Human
uggcucaugccuauaaucuca

SEQ ID NO: 787714 - RNA, 24 nt, Human
uggcucaugccuauaaucucagca

SEQ ID NO: 787715 - RNA, 22 nt, Human
uggcucaugucuguaaucccag

SEQ ID NO: 787716 - RNA, 24 nt, Human
uggcucaugucuguaaucccagca

SEQ ID NO: 787717 - RNA, 24 nt, Human
ugggaagcugagaugggaggacag

SEQ ID NO: 787718 - RNA, 18 nt, Human
ugggagguggagguugca

SEQ ID NO: 787719 - RNA, 29 nt, Human
ugggagguggagguugcagugacaacggu

SEQ ID NO: 787720 - RNA, 24 nt, Human
ugggagguggagguugcagugagc

SEQ ID NO: 787721 - RNA, 21 nt, Human
ugggcgacagagugagacucu

SEQ ID NO: 787722 - RNA, 23 nt, Human
uggguccucucaaugucugguuu

SEQ ID NO: 787723 - RNA, 26 nt, Human
uggugacaaacacaacauugcauccc

SEQ ID NO: 787724 - RNA, 18 nt, Human
uggugcacgccuguaguc

SEQ ID NO: 787725 - RNA, 22 nt, Human
uggugcacgccuguaguccucg

SEQ ID NO: 787726 - RNA, 24 nt, Human
ugguggcucaugccuauaaucuca

SEQ ID NO: 787727 - RNA, 21 nt, Human
ugucacuggagucuggggaag

SEQ ID NO: 787728 - RNA, 18 nt, Human
ugucuguaaucccagcac

SEQ ID NO: 787729 - RNA, 23 nt, Human
ugucuguaaucccagcacuuuga

SEQ ID NO: 787730 - RNA, 18 nt, Human
ugugauacuaauacaacc

SEQ ID NO: 787731 - RNA, 18 nt, Human
uguggcggcggcggcggc

SEQ ID NO: 787732 - RNA, 24 nt, Human
uguggcggcggcggcggcuucccg

SEQ ID NO: 787733 - RNA, 22 nt, Human
uuaaucaggaucccaaaaaugc

SEQ ID NO: 787734 - RNA, 18 nt, Human
uuaccuaaucaccuucuc

SEQ ID NO: 787735 - RNA, 20 nt, Human
uuagcugggcgugguggugc

SEQ ID NO: 787736 - RNA, 22 nt, Human
uuagcugggcgugguggugcac

SEQ ID NO: 787737 - RNA, 24 nt, Human
uuagcugggcgugguggugcacgc

SEQ ID NO: 787738 - RNA, 18 nt, Human
uucauuagcaacccuugg

SEQ ID NO: 787739 - RNA, 19 nt, Human
uucugguuucacuuucacu

SEQ ID NO: 787740 - RNA, 24 nt, Human
uugaaccugggagguggagguugc

SEQ ID NO: 787741 - RNA, 21 nt, Human
uugaggccaggaguucaagau

SEQ ID NO: 787742 - RNA, 19 nt, Human
uugcagugagcugagacug

SEQ ID NO: 787743 - RNA, 22 nt, Human
uugcagugagcugagacugugc

SEQ ID NO: 787744 - RNA, 23 nt, Human
uugcagugagcugagacugugcc

SEQ ID NO: 787745 - RNA, 21 nt, Human
uugcaucccaaacagagccaa

SEQ ID NO: 787746 - RNA, 20 nt, Human
uuugccucggccgugccucc

SEQ ID NO: 787747 - RNA, 20 nt, Human
uuuuaaaauuuaagaagaau

SEQ ID NO: 787748 - RNA, 24 nt, Human
uuuucuuuagaaaggaaaggcaga

SEQ ID NO: 787749 - RNA, 25 nt, Human
aaaagaaaagaaacauguuaaaaag

SEQ ID NO: 787750 - RNA, 20 nt, Human
aaacaauaaccccacccccc

SEQ ID NO: 787751 - RNA, 20 nt, Human
aaacaauaaccccacccccc

SEQ ID NO: 787752 - RNA, 22 nt, Human
aaacaauaaccccaccccccau

SEQ ID NO: 787753 - RNA, 20 nt, Human
aaacacauacacaguacaaa

SEQ ID NO: 787754 - RNA, 18 nt, Human
aaacauguuaaaaagaaa

SEQ ID NO: 787755 - RNA, 24 nt, Human
aaagaaaagaaacauguuaaaaag

SEQ ID NO: 787756 - RNA, 24 nt, Human
aaagcuaaauaauauuccauugua

SEQ ID NO: 787757 - RNA, 20 nt, Human
aaccaaaacaugcuuacccu

SEQ ID NO: 787758 - RNA, 25 nt, Human
aagaaaagaaacauguuaaaaagaa

SEQ ID NO: 787759 - RNA, 28 nt, Human
aagaaaagaaacauguuaaaaagaaaag

SEQ ID NO: 787760 - RNA, 26 nt, Human
aauauacauaacaaaauuuaccauuu

SEQ ID NO: 787761 - RNA, 21 nt, Human
accacaugugcaaaaacgaca

SEQ ID NO: 787762 - RNA, 24 nt, Human
agaaaagaaacauguuaaaaagaa

SEQ ID NO: 787763 - RNA, 18 nt, Human
agaauauuccaauauucc

SEQ ID NO: 787764 - RNA, 18 nt, Human
agcacauuuguuuaucca

SEQ ID NO: 787765 - RNA, 26 nt, Human
aguggcauuaacauucaaaauguuga

SEQ ID NO: 787766 - RNA, 19 nt, Human
aucuggaucaagaacagaa

SEQ ID NO: 787767 - RNA, 20 nt, Human
augcaucuauacccacccua

SEQ ID NO: 787768 - RNA, 23 nt, Human
auuccaguaaugcugcuaugaac

SEQ ID NO: 787769 - RNA, 25 nt, Human
caagaacagaauauuccaauauucc

SEQ ID NO: 787770 - RNA, 18 nt, Human
cacagcaaguacuuauac

SEQ ID NO: 787771 - RNA, 24 nt, Human
cagaacguguuucaaaagauaaaa

SEQ ID NO: 787772 - RNA, 18 nt, Human
cauuguauguauuauagc

SEQ ID NO: 787773 - RNA, 18 nt, Human
ccagcaaucugagugcca

SEQ ID NO: 787774 - RNA, 21 nt, Human
ccauucaugauagacacuuga

SEQ ID NO: 787775 - RNA, 18 nt, Human
ccccauuuccuccucccu

SEQ ID NO: 787776 - RNA, 22 nt, Human
cccccauuuccuccucccugca

SEQ ID NO: 787777 - RNA, 24 nt, Human
ccggaaaagaaaagaaacauguua

SEQ ID NO: 787778 - RNA, 24 nt, Human
ccugcagucccuggcaaccacuau

SEQ ID NO: 787779 - RNA, 21 nt, Human
cuaaauacacagcaaguacuu

SEQ ID NO: 787780 - RNA, 19 nt, Human
cuccagcaaucugagugcc

SEQ ID NO: 787781 - RNA, 23 nt, Human
cuuuucguuaauguuacuugaaa

SEQ ID NO: 787782 - RNA, 20 nt, Human
gaaaauuuuuccacucccaa

SEQ ID NO: 787783 - RNA, 18 nt, Human
gacauguccauuuccaca

SEQ ID NO: 787784 - RNA, 24 nt, Human
ggaaaagaaaagaaacauguuaaa

SEQ ID NO: 787785 - RNA, 21 nt, Human
gggguuaagagagguaaucuc

SEQ ID NO: 787786 - RNA, 24 nt, Human
guguauauauauauauaucauaca

SEQ ID NO: 787787 - RNA, 20 nt, Human
guguguauauauauauauau

SEQ ID NO: 787788 - RNA, 21 nt, Human
uaaacaauaaccccacccccc

SEQ ID NO: 787789 - RNA, 22 nt, Human
uaaacaauaaccccacccccca

SEQ ID NO: 787790 - RNA, 18 nt, Human
uaaauagaguaaucaaac

SEQ ID NO: 787791 - RNA, 25 nt, Human
uaacauucaaaauguugagcaacca

SEQ ID NO: 787792 - RNA, 22 nt, Human
uaaucgacacuacacagguauc

SEQ ID NO: 787793 - RNA, 23 nt, Human
uacacagguaucucuuaaguaca

SEQ ID NO: 787794 - RNA, 20 nt, Human
uaggaaacacauacacagua

SEQ ID NO: 787795 - RNA, 26 nt, Human
uauauauauauaucauacauaauccc

SEQ ID NO: 787796 - RNA, 20 nt, Human
uaucuaugcaucuauaccca

SEQ ID NO: 787797 - RNA, 23 nt, Human
uauuuguuuuauuguuuaaaaga

SEQ ID NO: 787798 - RNA, 20 nt, Human
ucagaacguguuucaaaaga

SEQ ID NO: 787799 - RNA, 24 nt, Human
ucccauaucuaugcaucuauaccc

SEQ ID NO: 787800 - RNA, 24 nt, Human
ucccuggcaaccacuauucuccuu

SEQ ID NO: 787801 - RNA, 22 nt, Human
uccucauguauuuuuguucuau

SEQ ID NO: 787802 - RNA, 24 nt, Human
ugaaguaaugggcaaaaaacugac

SEQ ID NO: 787803 - RNA, 24 nt, Human
ugaggagaauccuucuugcccauu

SEQ ID NO: 787804 - RNA, 20 nt, Human
uggaggcauuuuacaauuua

SEQ ID NO: 787805 - RNA, 19 nt, Human
uggcaaccacuauucuccu

SEQ ID NO: 787806 - RNA, 21 nt, Human
uguauauauauauauaucaua

SEQ ID NO: 787807 - RNA, 22 nt, Human
uguauauauauauauaucauaa

SEQ ID NO: 787808 - RNA, 23 nt, Human
uguauauauauauauaucauaca

SEQ ID NO: 787809 - RNA, 22 nt, Human
ugugguaauaacuuugggauac

SEQ ID NO: 787810 - RNA, 18 nt, Human
uguguauauauauauaua

SEQ ID NO: 787811 - RNA, 19 nt, Human
uguguauauauauauauau

SEQ ID NO: 787812 - RNA, 23 nt, Human
uguguauauauauauauaucaua

SEQ ID NO: 787813 - RNA, 18 nt, Human
uguguguguauauauaua

SEQ ID NO: 787814 - RNA, 24 nt, Human
uguguguguauauauauauauaau

SEQ ID NO: 787815 - RNA, 23 nt, Human
uguguguguguauauauauauau

SEQ ID NO: 787816 - RNA, 23 nt, Human
uguguguguguguauauauauau

SEQ ID NO: 787817 - RNA, 18 nt, Human
uucaaaagauaaaauuuc

SEQ ID NO: 787818 - RNA, 20 nt, Human
uucaucuuucugcauguacu

SEQ ID NO: 787819 - RNA, 22 nt, Human
uucaugauagacacuugagcug

SEQ ID NO: 787820 - RNA, 20 nt, Human
uucuccuuucuguuucugug

SEQ ID NO: 787821 - RNA, 25 nt, Human
uucuccuuucuguuucugugaacuu

SEQ ID NO: 787822 - RNA, 22 nt, Human
uugaaaauuuuuccacucccaa

SEQ ID NO: 787823 - RNA, 21 nt, Human
uugaaauauaacaauauagga

SEQ ID NO: 787824 - RNA, 21 nt, Human
uuucaagguuuauccugaggu

SEQ ID NO: 787825 - RNA, 22 nt, Human
uuuggaggcauuuuacaauuua

SEQ ID NO: 787826 - RNA, 27 nt, Human
uuuucagaaauggguuuucgggucacc

SEQ ID NO: 787827 - RNA, 24 nt, Human
uuuugugucuggcuuauuucacuu

SEQ ID NO: 787828 - RNA, 19 nt, Human
aaaaaaaaaaaaaaaaaga

SEQ ID NO: 787829 - RNA, 20 nt, Human
aaaaaaagagaaauuacaaa

SEQ ID NO: 787830 - RNA, 24 nt, Human
aaaaagccaaccaaauaaacaaac

SEQ ID NO: 787831 - RNA, 18 nt, Human
aaaaaggaaaaaaagaga

SEQ ID NO: 787832 - RNA, 22 nt, Human
aaaaauccaaaagauuuaucgc

SEQ ID NO: 787833 - RNA, 23 nt, Human
aaaacacaaauagcauuccaaca

SEQ ID NO: 787834 - RNA, 25 nt, Human
aaaauacaacaacaacaacaacaac

SEQ ID NO: 787835 - RNA, 22 nt, Human
aaacaaacaaacgaaaaaaaca

SEQ ID NO: 787836 - RNA, 18 nt, Human
aaacacaaauagcauucc

SEQ ID NO: 787837 - RNA, 23 nt, Human
aaacagugcaacaaaacacaaau

SEQ ID NO: 787838 - RNA, 23 nt, Human
aaaugcuaucaugaaugcuggua

SEQ ID NO: 787839 - RNA, 20 nt, Human
aacaacaacaaaauaaguac

SEQ ID NO: 787840 - RNA, 20 nt, Human
aacaacaacaacaacaaaau

SEQ ID NO: 787841 - RNA, 24 nt, Human
aaccaaauaaacaaacaaacaaac

SEQ ID NO: 787842 - RNA, 19 nt, Human
aacuugauucaaccaagug

SEQ ID NO: 787843 - RNA, 19 nt, Human
aagaguaucaagagucugg

SEQ ID NO: 787844 - RNA, 23 nt, Human
aaggaaaaaaagagaaauuacaa

SEQ ID NO: 787845 - RNA, 24 nt, Human
aauggaaaacuuccauacuuucaa

SEQ ID NO: 787846 - RNA, 22 nt, Human
acaaaacagaaaaaaacaaaac

SEQ ID NO: 787847 - RNA, 23 nt, Human
acaaaacagaaaaaaacaaaaca

SEQ ID NO: 787848 - RNA, 20 nt, Human
acaaacgaaaaaaacagugc

SEQ ID NO: 787849 - RNA, 19 nt, Human
acaacaacaacaacaacaa

SEQ ID NO: 787850 - RNA, 19 nt, Human
acaacaacaacaacaacaa

SEQ ID NO: 787851 - RNA, 24 nt, Human
acaacaacaacaacaacaaaauaa

SEQ ID NO: 787852 - RNA, 22 nt, Human
acaacaacaacaacaacaacaa

SEQ ID NO: 787853 - RNA, 24 nt, Human
acaacaacaacaacaacaacaaaa

SEQ ID NO: 787854 - RNA, 23 nt, Human
accaaauaaaaaaggaaaaaaag

SEQ ID NO: 787855 - RNA, 21 nt, Human
accaaauaaacaaacaaacaa

SEQ ID NO: 787856 - RNA, 21 nt, Human
accaaaugcccuuuaugccaa

SEQ ID NO: 787857 - RNA, 23 nt, Human
accaaaugcccuuuaugccaaau

SEQ ID NO: 787858 - RNA, 25 nt, Human
accagcaaaagcgauuuccaacaua

SEQ ID NO: 787859 - RNA, 21 nt, Human
agaaaaaaaaaaaaaaaaaaa

SEQ ID NO: 787860 - RNA, 22 nt, Human
agaaaaacacaaaaauccaaaa

SEQ ID NO: 787861 - RNA, 20 nt, Human
agacagcaaagguacaaauu

SEQ ID NO: 787862 - RNA, 22 nt, Human
agagagaaaagggauuuucuga

SEQ ID NO: 787863 - RNA, 19 nt, Human
agagucuggcaaaaauaga

SEQ ID NO: 787864 - RNA, 23 nt, Human
agcuuccuccucuuaucucuuuu

SEQ ID NO: 787865 - RNA, 23 nt, Human
aggaaaaaaagagaaauuacaaa

SEQ ID NO: 787866 - RNA, 19 nt, Human
aggaagagcaauaggaaaa

SEQ ID NO: 787867 - RNA, 21 nt, Human
aggcagucaguaacaaaaugc

SEQ ID NO: 787868 - RNA, 21 nt, Human
aguaggcugcaaaacauacag

SEQ ID NO: 787869 - RNA, 20 nt, Human
aucucuuuuuuucccacauu

SEQ ID NO: 787870 - RNA, 19 nt, Human
augcauaucaacaauuguu

SEQ ID NO: 787871 - RNA, 20 nt, Human
augccaaauauuccauuagc

SEQ ID NO: 787872 - RNA, 21 nt, Human
caaaacauacagcaaaaagga

SEQ ID NO: 787873 - RNA, 23 nt, Human
caaacaaaaauaaaaccaccaaa

SEQ ID NO: 787874 - RNA, 19 nt, Human
caaagcuuuguuuuguucc

SEQ ID NO: 787875 - RNA, 21 nt, Human
caaauuguucuuuagguaaug

SEQ ID NO: 787876 - RNA, 22 nt, Human
caaauuucccucuccaaaaagc

SEQ ID NO: 787877 - RNA, 18 nt, Human
caacaacaacaacaacaa

SEQ ID NO: 787878 - RNA, 20 nt, Human
caacaacaacaacaacaaaa

SEQ ID NO: 787879 - RNA, 22 nt, Human
caccagcaaaagcgauuuccaa

SEQ ID NO: 787880 - RNA, 21 nt, Human
cacuuuucccuccuuucccca

SEQ ID NO: 787881 - RNA, 24 nt, Human
cagaaaauuaccuuuaauauaaac

SEQ ID NO: 787882 - RNA, 22 nt, Human
caggauagauguaacacccauu

SEQ ID NO: 787883 - RNA, 18 nt, Human
cagggcagcagaggcugc

SEQ ID NO: 787884 - RNA, 19 nt, Human
cagguaaaguccaggcuau

SEQ ID NO: 787885 - RNA, 21 nt, Human
caguauuuaaccaggucaagc

SEQ ID NO: 787886 - RNA, 22 nt, Human
cauuagaaaaacacaaaaaucc

SEQ ID NO: 787887 - RNA, 23 nt, Human
cauuuuacacguauguugcaaca

SEQ ID NO: 787888 - RNA, 31 nt, Human
ccaccaaaugcccuuuaugccaaauauuccu

SEQ ID NO: 787889 - RNA, 24 nt, Human
cccacauuaucuguugcguaucua

SEQ ID NO: 787890 - RNA, 19 nt, Human
ccccauuuccuuauuaucu

SEQ ID NO: 787891 - RNA, 18 nt, Human
ccuccucuuaucucuuuu

SEQ ID NO: 787892 - RNA, 21 nt, Human
ccucuuaucucuuuuuuuccc

SEQ ID NO: 787893 - RNA, 22 nt, Human
cuaauugaaaaaucaggaaucu

SEQ ID NO: 787894 - RNA, 22 nt, Human
cucaaacaaaaauaaaaccacc

SEQ ID NO: 787895 - RNA, 19 nt, Human
cucaacucuuugcuggugc

SEQ ID NO: 787896 - RNA, 23 nt, Human
cuccucuuaucucuuuuuuuccc

SEQ ID NO: 787897 - RNA, 24 nt, Human
cugcugcuccgcgcucccgcucgu

SEQ ID NO: 787898 - RNA, 20 nt, Human
gaaaaaaacagugcaacaaa

SEQ ID NO: 787899 - RNA, 21 nt, Human
gaaaaaaacagugcaacaaaa

SEQ ID NO: 787900 - RNA, 24 nt, Human
gaaaaaaacagugcaacaaaacac

SEQ ID NO: 787901 - RNA, 24 nt, Human
gaaaaaaacagugcaacaaaacac

SEQ ID NO: 787902 - RNA, 23 nt, Human
gaaaaugcugaaaugcuaucaug

SEQ ID NO: 787903 - RNA, 20 nt, Human
gagaaaagggauuuucugac

SEQ ID NO: 787904 - RNA, 21 nt, Human
gcaagacagcaaagguacaaa

SEQ ID NO: 787905 - RNA, 21 nt, Human
ggaauacaacugugaaccuca

SEQ ID NO: 787906 - RNA, 21 nt, Human
gguauauuuguuaugagccaa

SEQ ID NO: 787907 - RNA, 21 nt, Human
guauuaguuugcuacgggagc

SEQ ID NO: 787908 - RNA, 20 nt, Human
uaaaaaaggaaaaaaagaga

SEQ ID NO: 787909 - RNA, 18 nt, Human
uaaaacagagccuacaag

SEQ ID NO: 787910 - RNA, 18 nt, Human
uaaacuauaacuuacuga

SEQ ID NO: 787911 - RNA, 25 nt, Human
uaaauaaauccacaauuggauccaa

SEQ ID NO: 787912 - RNA, 29 nt, Human
uaaccaggucaagcaccaagccagagcua

SEQ ID NO: 787913 - RNA, 19 nt, Human
uaacuuacugaugugauug

SEQ ID NO: 787914 - RNA, 18 nt, Human
uaagacaaaaaagucaag

SEQ ID NO: 787915 - RNA, 25 nt, Human
uacaacaacaacaacaacaacaaaa

SEQ ID NO: 787916 - RNA, 27 nt, Human
uagcuuccuccucuuaucucuuuuuuu

SEQ ID NO: 787917 - RNA, 22 nt, Human
uaggcugcaaaacauacagcaa

SEQ ID NO: 787918 - RNA, 21 nt, Human
uaguucauugagauuucuuaa

SEQ ID NO: 787919 - RNA, 23 nt, Human
uaucuaguauuaguuugcuacgg

SEQ ID NO: 787920 - RNA, 26 nt, Human
uauguugcaacaucagagaugcuggu

SEQ ID NO: 787921 - RNA, 24 nt, Human
ucaaacaaaaauaaaaccaccaaa

SEQ ID NO: 787922 - RNA, 18 nt, Human
ucaacucuuugcuggugc

SEQ ID NO: 787923 - RNA, 18 nt, Human
ucaagcauguuggagcag

SEQ ID NO: 787924 - RNA, 22 nt, Human
uccaaauuucccucuccaaaaa

SEQ ID NO: 787925 - RNA, 27 nt, Human
uccacaauuggauccaagccggggucc

SEQ ID NO: 787926 - RNA, 24 nt, Human
ucccucuccaaaaagccaaccaaa

SEQ ID NO: 787927 - RNA, 29 nt, Human
uccuccucuuaucucuuuuuuucccacaa

SEQ ID NO: 787928 - RNA, 22 nt, Human
uccucugaaacgugucuccaag

SEQ ID NO: 787929 - RNA, 23 nt, Human
ucuaaagcaugaucacugguugu

SEQ ID NO: 787930 - RNA, 22 nt, Human
ucuccaagauacuucucugucc

SEQ ID NO: 787931 - RNA, 22 nt, Human
ucuuauuagcuuccuccucuua

SEQ ID NO: 787932 - RNA, 19 nt, Human
ugaaaaacaguauucucau

SEQ ID NO: 787933 - RNA, 25 nt, Human
ugaaaaacaguauucucauuagaag

SEQ ID NO: 787934 - RNA, 19 nt, Human
ugauaaaaagggaaugugg

SEQ ID NO: 787935 - RNA, 18 nt, Human
ugcaacaaaacacaaaua

SEQ ID NO: 787936 - RNA, 23 nt, Human
ugcaacaaaacacaaauagcauu

SEQ ID NO: 787937 - RNA, 18 nt, Human
ugccaauuaucagaauau

SEQ ID NO: 787938 - RNA, 18 nt, Human
ugcccuuuaugccaaaua

SEQ ID NO: 787939 - RNA, 24 nt, Human
ugcuccgcgcucccgcucgucuca

SEQ ID NO: 787940 - RNA, 20 nt, Human
ugcugaccacaaacaaguuu

SEQ ID NO: 787941 - RNA, 19 nt, Human
ugcugcuccgcgcucccgc

SEQ ID NO: 787942 - RNA, 20 nt, Human
ugcuugcaggccggaucagu

SEQ ID NO: 787943 - RNA, 20 nt, Human
uggaaaagccuauuuguuuu

SEQ ID NO: 787944 - RNA, 22 nt, Human
uggagguaauuaaguaacucug

SEQ ID NO: 787945 - RNA, 18 nt, Human
uguaagcauugagcaugu

SEQ ID NO: 787946 - RNA, 21 nt, Human
uguaagcauugagcaugugca

SEQ ID NO: 787947 - RNA, 20 nt, Human
ugugggguuaaauggcagga

SEQ ID NO: 787948 - RNA, 18 nt, Human
uguuucauguauucgcca

SEQ ID NO: 787949 - RNA, 19 nt, Human
uguuuuguuccuuguugug

SEQ ID NO: 787950 - RNA, 20 nt, Human
uuaaaagaaaccaagaaggu

SEQ ID NO: 787951 - RNA, 23 nt, Human
uucaaagcuuuguuuuguuccuu

SEQ ID NO: 787952 - RNA, 20 nt, Human
uucccacauuaucuguugcg

SEQ ID NO: 787953 - RNA, 21 nt, Human
uucccucuccaaaaagccaac

SEQ ID NO: 787954 - RNA, 24 nt, Human
uugacagucucuuauuagcuuccu

SEQ ID NO: 787955 - RNA, 22 nt, Human
uugguaccuuggaaaaugcuga

SEQ ID NO: 787956 - RNA, 21 nt, Human
uugugcugaccacaaacaagu

SEQ ID NO: 787957 - RNA, 18 nt, Human
uuucccuccuuuccccag

SEQ ID NO: 787958 - RNA, 21 nt, Human
uuugugauccagugccaauua

SEQ ID NO: 787959 - RNA, 20 nt, Human
uuuuacacugggcuuucuuc

SEQ ID NO: 787960 - RNA, 24 nt, Human
uuuucagccacuuuauuaacugug

SEQ ID NO: 787961 - RNA, 19 nt, Human
aaagugcugggauuacagg

SEQ ID NO: 787962 - RNA, 23 nt, Human
aaagugcugggauuacaggcaua

SEQ ID NO: 787963 - RNA, 26 nt, Human
aaguaauccucccgccucagcacccc

SEQ ID NO: 787964 - RNA, 19 nt, Human
aaguagcugggacuacagg

SEQ ID NO: 787965 - RNA, 20 nt, Human
aaguagcugggacuacaggu

SEQ ID NO: 787966 - RNA, 26 nt, Human
aaguagcugggacuacaggugcaugc

SEQ ID NO: 787967 - RNA, 19 nt, Human
aagugcugggauuacaggc

SEQ ID NO: 787968 - RNA, 20 nt, Human
aagugcugggauuacaggca

SEQ ID NO: 787969 - RNA, 21 nt, Human
aagugcugggauuacaggcau

SEQ ID NO: 787970 - RNA, 26 nt, Human
aagugcugggauuacaggcauaagcc

SEQ ID NO: 787971 - RNA, 24 nt, Human
aauaaagagguucaauaaacagaa

SEQ ID NO: 787972 - RNA, 24 nt, Human
aauaugccauacuucauaaacauc

SEQ ID NO: 787973 - RNA, 19 nt, Human
aauuguacagccauaggaa

SEQ ID NO: 787974 - RNA, 25 nt, Human
acacugucacccaggcuggugugca

SEQ ID NO: 787975 - RNA, 18 nt, Human
acagcucacugcagccuc

SEQ ID NO: 787976 - RNA, 22 nt, Human
accaagggccauuuugugggau

SEQ ID NO: 787977 - RNA, 19 nt, Human
acuacaggugcaugccacc

SEQ ID NO: 787978 - RNA, 21 nt, Human
agcggcgaccucgccgggcaa

SEQ ID NO: 787979 - RNA, 21 nt, Human
agcggcgauggcagcugaggc

SEQ ID NO: 787980 - RNA, 18 nt, Human
agugcugggauuacaggc

SEQ ID NO: 787981 - RNA, 18 nt, Human
aucuauaaauugcaaagg

SEQ ID NO: 787982 - RNA, 22 nt, Human
caaaaagguaaccuuugcucua

SEQ ID NO: 787983 - RNA, 19 nt, Human
caaagugccauguaugaaa

SEQ ID NO: 787984 - RNA, 23 nt, Human
caaagugccauguaugaaauaug

SEQ ID NO: 787985 - RNA, 18 nt, Human
caaagugcugggauuaca

SEQ ID NO: 787986 - RNA, 21 nt, Human
caaagugcugggauuacaggc

SEQ ID NO: 787987 - RNA, 22 nt, Human
caaagugcugggauuacaggca

SEQ ID NO: 787988 - RNA, 23 nt, Human
caaagugcugggauuacaggcau

SEQ ID NO: 787989 - RNA, 24 nt, Human
caaagugcugggauuacaggcaua

SEQ ID NO: 787990 - RNA, 22 nt, Human
caaccucccagguugaaguaau

SEQ ID NO: 787991 - RNA, 23 nt, Human
cacaaaaucugaguuaggacaaa

SEQ ID NO: 787992 - RNA, 24 nt, Human
caccaugccugguuaauuuuugua

SEQ ID NO: 787993 - RNA, 19 nt, Human
cacuccgucucucaggccc

SEQ ID NO: 787994 - RNA, 20 nt, Human
cacuccgucucucaggcccc

SEQ ID NO: 787995 - RNA, 22 nt, Human
cacugcagccucaaccucccag

SEQ ID NO: 787996 - RNA, 22 nt, Human
cacuucagcgccgccugucugc

SEQ ID NO: 787997 - RNA, 24 nt, Human
cagccucaaccucccagguugaag

SEQ ID NO: 787998 - RNA, 19 nt, Human
cauauauuucaacaugaaa

SEQ ID NO: 787999 - RNA, 25 nt, Human
ccagguugaaguaauccuccugggc

SEQ ID NO: 788000 - RNA, 20 nt, Human
ccauacaaaaagguaaccuu

SEQ ID NO: 788001 - RNA, 23 nt, Human
ccauguaugaaauaugaaauuug

SEQ ID NO: 788002 - RNA, 23 nt, Human
cccaaguagcugggacuacaggu

SEQ ID NO: 788003 - RNA, 24 nt, Human
cccaaguagcugggacuacaggug

SEQ ID NO: 788004 - RNA, 24 nt, Human
ccccaaguagcugggacuacaggu

SEQ ID NO: 788005 - RNA, 26 nt, Human
cccccagaaccucccucauggcagcu

SEQ ID NO: 788006 - RNA, 24 nt, Human
ccucccgccucagcaccccaagua

SEQ ID NO: 788007 - RNA, 20 nt, Human
ccuccugcucggccccuccc

SEQ ID NO: 788008 - RNA, 24 nt, Human
ccuccugggcucaaguaauccucc

SEQ ID NO: 788009 - RNA, 18 nt, Human
ccugggcucaaguaaucc

SEQ ID NO: 788010 - RNA, 21 nt, Human
ccugucugcucgcccccagaa

SEQ ID NO: 788011 - RNA, 22 nt, Human
cgaaacacagcucacugcagcc

SEQ ID NO: 788012 - RNA, 25 nt, Human
cgaaacacagcucacugcagccuca

SEQ ID NO: 788013 - RNA, 20 nt, Human
cgaacuccugagcucaagcc

SEQ ID NO: 788014 - RNA, 24 nt, Human
cgccucagcaccccaaguagcugg

SEQ ID NO: 788015 - RNA, 20 nt, Human
cggcagcaacccugcagccg

SEQ ID NO: 788016 - RNA, 18 nt, Human
cggccccucccuacacuc

SEQ ID NO: 788017 - RNA, 21 nt, Human
cgucacgggcgcggaaggguu

SEQ ID NO: 788018 - RNA, 25 nt, Human
cucaaguaauccucccgccucagca

SEQ ID NO: 788019 - RNA, 23 nt, Human
cucacaaaaucugaguuaggaca

SEQ ID NO: 788020 - RNA, 24 nt, Human
cucagaacucuguuaaacuucacu

SEQ ID NO: 788021 - RNA, 24 nt, Human
cucauggcagcuccggcuuccucc

SEQ ID NO: 788022 - RNA, 18 nt, Human
cuccuccuccugcucggc

SEQ ID NO: 788023 - RNA, 19 nt, Human
cuccuccugcucggccccc

SEQ ID NO: 788024 - RNA, 22 nt, Human
cugaggcagcggcgaccucgcc

SEQ ID NO: 788025 - RNA, 20 nt, Human
cugcaaagugcugggauuac

SEQ ID NO: 788026 - RNA, 23 nt, Human
cugcagccucaaccucccagguu

SEQ ID NO: 788027 - RNA, 18 nt, Human
cugccaccaagggccauu

SEQ ID NO: 788028 - RNA, 24 nt, Human
cugccaccaagggccauuuugugg

SEQ ID NO: 788029 - RNA, 22 nt, Human
cugucugcucgcccccagaacc

SEQ ID NO: 788030 - RNA, 21 nt, Human
gaaggccucccuucaccauac

SEQ ID NO: 788031 - RNA, 24 nt, Human
gacuacaggugcaugccaccaugc

SEQ ID NO: 788032 - RNA, 18 nt, Human
gauuacaggcauaagcca

SEQ ID NO: 788033 - RNA, 24 nt, Human
gcaaagugcugggauuacaggcau

SEQ ID NO: 788034 - RNA, 20 nt, Human
gccucagcaccccaaguagc

SEQ ID NO: 788035 - RNA, 25 nt, Human
gcgaaacacagcucacugcagccuc

SEQ ID NO: 788036 - RNA, 20 nt, Human
gcgauggcagcugaggcagc

SEQ ID NO: 788037 - RNA, 23 nt, Human
gcuccggcuuccuccuccuccug

SEQ ID NO: 788038 - RNA, 23 nt, Human
gcucggccccucccuacacuccc

SEQ ID NO: 788039 - RNA, 21 nt, Human
gcuuuguuaaaugucacugcu

SEQ ID NO: 788040 - RNA, 22 nt, Human
ggauuacaggcauaagccaacg

SEQ ID NO: 788041 - RNA, 22 nt, Human
ggcaauagcagauggggcggca

SEQ ID NO: 788042 - RNA, 22 nt, Human
guuguugcucacauguuuuccu

SEQ ID NO: 788043 - RNA, 24 nt, Human
uaauuuuuguauuuuuuguagaga

SEQ ID NO: 788044 - RNA, 18 nt, Human
uagcagauggggcggcag

SEQ ID NO: 788045 - RNA, 23 nt, Human
uaggacaaauguucauggggguu

SEQ ID NO: 788046 - RNA, 20 nt, Human
uaugccauacuucauaaaca

SEQ ID NO: 788047 - RNA, 22 nt, Human
ucacacugucacccaggcuggu

SEQ ID NO: 788048 - RNA, 23 nt, Human
ucacacugucacccaggcuggug

SEQ ID NO: 788049 - RNA, 23 nt, Human
ucacgaacuccugagcucaagcc

SEQ ID NO: 788050 - RNA, 19 nt, Human
ucacugcagccucaaccuc

SEQ ID NO: 788051 - RNA, 23 nt, Human
ucacugcagccucaaccucccag

SEQ ID NO: 788052 - RNA, 24 nt, Human
ucacugcagccucaaccucccagg

SEQ ID NO: 788053 - RNA, 18 nt, Human
ucccagguugaaguaauc

SEQ ID NO: 788054 - RNA, 24 nt, Human
ucccagguugaaguaauccuccug

SEQ ID NO: 788055 - RNA, 22 nt, Human
ucccgccucagcaccccaagua

SEQ ID NO: 788056 - RNA, 23 nt, Human
uccgucucucaggccccgcguca

SEQ ID NO: 788057 - RNA, 19 nt, Human
uccugcucggccccucccu

SEQ ID NO: 788058 - RNA, 23 nt, Human
uccugggcucaaguaauccuccc

SEQ ID NO: 788059 - RNA, 22 nt, Human
ucucacacugucacccaggcug

SEQ ID NO: 788060 - RNA, 23 nt, Human
ucucacacugucacccaggcugg

SEQ ID NO: 788061 - RNA, 24 nt, Human
ucucacacugucacccaggcuggu

SEQ ID NO: 788062 - RNA, 18 nt, Human
ucugcucgcccccagaac

SEQ ID NO: 788063 - RNA, 20 nt, Human
ucuuaucaguaaguuagagg

SEQ ID NO: 788064 - RNA, 18 nt, Human
ugaggcagcggcgaccuc

SEQ ID NO: 788065 - RNA, 18 nt, Human
ugcagccucaaccuccca

SEQ ID NO: 788066 - RNA, 24 nt, Human
ugcccaggcuggucacgaacuccu

SEQ ID NO: 788067 - RNA, 28 nt, Human
ugcccaggcuggucacgaacuccugagc

SEQ ID NO: 788068 - RNA, 24 nt, Human
ugcucgcccccagaaccucccuca

SEQ ID NO: 788069 - RNA, 24 nt, Human
ugcugggauuacaggcauaagcca

SEQ ID NO: 788070 - RNA, 22 nt, Human
uggcagcugaggcagcggcgac

SEQ ID NO: 788071 - RNA, 19 nt, Human
uggccucgacagcccuagc

SEQ ID NO: 788072 - RNA, 22 nt, Human
uggcgaaacacagcucacugca

SEQ ID NO: 788073 - RNA, 23 nt, Human
uggcgaaacacagcucacugcag

SEQ ID NO: 788074 - RNA, 21 nt, Human
ugggacuacaggugcaugcca

SEQ ID NO: 788075 - RNA, 22 nt, Human
ugggacuacaggugcaugccac

SEQ ID NO: 788076 - RNA, 24 nt, Human
ugggacuacaggugcaugccacca

SEQ ID NO: 788077 - RNA, 25 nt, Human
ugggacuacaggugcaugccaccau

SEQ ID NO: 788078 - RNA, 18 nt, Human
ugggauuacaggcauaag

SEQ ID NO: 788079 - RNA, 19 nt, Human
ugggauuacaggcauaagc

SEQ ID NO: 788080 - RNA, 21 nt, Human
ugggauuacaggcauaagcca

SEQ ID NO: 788081 - RNA, 21 nt, Human
ugggauuacaggcauaagcca

SEQ ID NO: 788082 - RNA, 24 nt, Human
ugggauuacaggcauaagccaacg

SEQ ID NO: 788083 - RNA, 27 nt, Human
ugggauuacaggcauaagccaacggcc

SEQ ID NO: 788084 - RNA, 24 nt, Human
ugggcucaaguaauccucccgccu

SEQ ID NO: 788085 - RNA, 23 nt, Human
uggugugcaguggcgaaacacag

SEQ ID NO: 788086 - RNA, 23 nt, Human
uguagcggcgauggcagcugagg

SEQ ID NO: 788087 - RNA, 24 nt, Human
uguagcggcgauggcagcugaggc

SEQ ID NO: 788088 - RNA, 22 nt, Human
ugugcaguggcgaaacacagcu

SEQ ID NO: 788089 - RNA, 19 nt, Human
uuaggacaaauguucaugg

SEQ ID NO: 788090 - RNA, 20 nt, Human
uugcucuacucacaagcuuc

SEQ ID NO: 788091 - RNA, 21 nt, Human
uuguagagacaggguugccca

SEQ ID NO: 788092 - RNA, 18 nt, Human
uuuguagagacaggguug

SEQ ID NO: 788093 - RNA, 20 nt, Human
uuuuuguauuuuuuguagag

SEQ ID NO: 788094 - RNA, 23 nt, Human
uuuuuguauuuuuuguagagaca

SEQ ID NO: 788095 - RNA, 20 nt, Human
uuuuuuguagagacaggguu

SEQ ID NO: 788096 - RNA, 19 nt, Human
aaaacaaauaugaucccau

SEQ ID NO: 788097 - RNA, 24 nt, Human
aaaaggugcagggcacuaugagag

SEQ ID NO: 788098 - RNA, 24 nt, Human
aaaauaaccauugaacaaacugaa

SEQ ID NO: 788099 - RNA, 20 nt, Human
aaacaaaaggugcagggcac

SEQ ID NO: 788100 - RNA, 22 nt, Human
aaacugaacuccuauaucagaa

SEQ ID NO: 788101 - RNA, 18 nt, Human
aaagagaagcggauucag

SEQ ID NO: 788102 - RNA, 22 nt, Human
aaccauugaacaaacugaaaug

SEQ ID NO: 788103 - RNA, 24 nt, Human
aaccauugaacaaacugaaaugac

SEQ ID NO: 788104 - RNA, 23 nt, Human
aaccuuucauaucucaaaacuuu

SEQ ID NO: 788105 - RNA, 24 nt, Human
aacugaacuccuauaucagaaacu

SEQ ID NO: 788106 - RNA, 24 nt, Human
aagaaacugaacuccuauaucaga

SEQ ID NO: 788107 - RNA, 18 nt, Human
aagucagcuuuagaauga

SEQ ID NO: 788108 - RNA, 23 nt, Human
aauaaucuguuauuccuauugcu

SEQ ID NO: 788109 - RNA, 19 nt, Human
accaaauaaaacguugguu

SEQ ID NO: 788110 - RNA, 22 nt, Human
accauugaacaaacugaaauga

SEQ ID NO: 788111 - RNA, 23 nt, Human
acucaacaaauguccuuucuacc

SEQ ID NO: 788112 - RNA, 19 nt, Human
acugaaaugacaagaaacu

SEQ ID NO: 788113 - RNA, 25 nt, Human
agaaaccuuucauaucucaaaacuu

SEQ ID NO: 788114 - RNA, 22 nt, Human
agaaaggaaauuagaaccucac

SEQ ID NO: 788115 - RNA, 24 nt, Human
agagacaauuuagaaagacacacu

SEQ ID NO: 788116 - RNA, 21 nt, Human
agccacuagccacagaaaccu

SEQ ID NO: 788117 - RNA, 23 nt, Human
agcuuuaaaauuuuuuucacuaa

SEQ ID NO: 788118 - RNA, 20 nt, Human
auaaggaauuauuucuuuga

SEQ ID NO: 788119 - RNA, 18 nt, Human
auuccuauugcuuagaau

SEQ ID NO: 788120 - RNA, 21 nt, Human
caaaacagaaauauuacaguc

SEQ ID NO: 788121 - RNA, 26 nt, Human
caaauaugaucccaucacacaacuga

SEQ ID NO: 788122 - RNA, 20 nt, Human
caucacacaacugaagccua

SEQ ID NO: 788123 - RNA, 24 nt, Human
cauccucuucucucuuuccucuga

SEQ ID NO: 788124 - RNA, 23 nt, Human
ccccaaaauguaacauccucuuc

SEQ ID NO: 788125 - RNA, 22 nt, Human
cuaaacccucccauuagguauu

SEQ ID NO: 788126 - RNA, 18 nt, Human
cucacuucauacauucaa

SEQ ID NO: 788127 - RNA, 19 nt, Human
cugcagccacaugccagga

SEQ ID NO: 788128 - RNA, 19 nt, Human
gaggcucucuguaaucugg

SEQ ID NO: 788129 - RNA, 21 nt, Human
gcuagauacaaaaaugcacug

SEQ ID NO: 788130 - RNA, 19 nt, Human
ggaagacuucuuaucuaca

SEQ ID NO: 788131 - RNA, 22 nt, Human
guccuuucuaccacucuguagc

SEQ ID NO: 788132 - RNA, 21 nt, Human
uaaaaagucuaaaaauuaaag

SEQ ID NO: 788133 - RNA, 21 nt, Human
uaaaacguugguuuauaagga

SEQ ID NO: 788134 - RNA, 20 nt, Human
uaaaagcaacuucaccuauu

SEQ ID NO: 788135 - RNA, 21 nt, Human
uaaaauauucaaaaugucaug

SEQ ID NO: 788136 - RNA, 24 nt, Human
uaaaguauaacacagcuagaagaa

SEQ ID NO: 788137 - RNA, 25 nt, Human
uaacaguacacauagguccuugaaa

SEQ ID NO: 788138 - RNA, 18 nt, Human
uaacucaaagagaagcgg

SEQ ID NO: 788139 - RNA, 26 nt, Human
uaagagagacaauuuagaaagacaca

SEQ ID NO: 788140 - RNA, 20 nt, Human
uagauacaaaaaugcacuga

SEQ ID NO: 788141 - RNA, 21 nt, Human
uagccacagaaaccuuucaua

SEQ ID NO: 788142 - RNA, 21 nt, Human
uauucacauaauucaugaacu

SEQ ID NO: 788143 - RNA, 21 nt, Human
uauugcacugcagccacaugc

SEQ ID NO: 788144 - RNA, 23 nt, Human
uauuucagagaacaccugaaggc

SEQ ID NO: 788145 - RNA, 24 nt, Human
ucaaagagaagcggauucagcuac

SEQ ID NO: 788146 - RNA, 23 nt, Human
ucauaaaaacaaaguuccauaca

SEQ ID NO: 788147 - RNA, 28 nt, Human
uccauacacuaaaaauaaccauugaaca

SEQ ID NO: 788148 - RNA, 24 nt, Human
ucccaucacacaacugaagccuag

SEQ ID NO: 788149 - RNA, 19 nt, Human
uccuauaucagaaacugua

SEQ ID NO: 788150 - RNA, 21 nt, Human
ucucuguaaucuggcauuuuc

SEQ ID NO: 788151 - RNA, 23 nt, Human
ucugcaucuaacacaguaagucu

SEQ ID NO: 788152 - RNA, 24 nt, Human
ucuguagcaugaguggaucauucu

SEQ ID NO: 788153 - RNA, 24 nt, Human
ugaacaaacugaaaugacaagaaa

SEQ ID NO: 788154 - RNA, 18 nt, Human
ugacuuacucucuaccaa

SEQ ID NO: 788155 - RNA, 23 nt, Human
ugaguggaucauucuauucaaga

SEQ ID NO: 788156 - RNA, 24 nt, Human
ugaucaauacuguagacuagacac

SEQ ID NO: 788157 - RNA, 19 nt, Human
ugcacugauguguaaaaca

SEQ ID NO: 788158 - RNA, 22 nt, Human
ugcuuaauucuaaacccuccca

SEQ ID NO: 788159 - RNA, 19 nt, Human
uggaguagaauuuguagaa

SEQ ID NO: 788160 - RNA, 19 nt, Human
uuaaacaucuaguuacaau

SEQ ID NO: 788161 - RNA, 24 nt, Human
uuaugauuaaacaauuuaaaaaga

SEQ ID NO: 788162 - RNA, 18 nt, Human
uucagagaacaccugaag

SEQ ID NO: 788163 - RNA, 23 nt, Human
uucauauugcuccccaaaaugua

SEQ ID NO: 788164 - RNA, 23 nt, Human
uuccaauaaggauuuucugcagg

SEQ ID NO: 788165 - RNA, 23 nt, Human
uuccauaguaaugacaaauugcu

SEQ ID NO: 788166 - RNA, 23 nt, Human
uucuagaaauaaguauucaugga

SEQ ID NO: 788167 - RNA, 25 nt, Human
uugcacugcagccacaugccaggaa

SEQ ID NO: 788168 - RNA, 21 nt, Human
uuguagaauguaauaggaagg

SEQ ID NO: 788169 - RNA, 20 nt, Human
uuuauugucucuuccauagg

SEQ ID NO: 788170 - RNA, 21 nt, Human
uuugaugauucugauauugcu

SEQ ID NO: 788171 - RNA, 18 nt, Human
aaaauaguauugacugaa

SEQ ID NO: 788172 - RNA, 24 nt, Human
aaacaacgaagauugcacuuuacu

SEQ ID NO: 788173 - RNA, 24 nt, Human
aaaccuccaugaacugaauaguga

SEQ ID NO: 788174 - RNA, 19 nt, Human
aagaagaagaaaaaaugua

SEQ ID NO: 788175 - RNA, 23 nt, Human
aagaagaagaaaaaauguacgug

SEQ ID NO: 788176 - RNA, 22 nt, Human
aauaaaaugcagaacaagucua

SEQ ID NO: 788177 - RNA, 21 nt, Human
acaccuucugguucccaacuc

SEQ ID NO: 788178 - RNA, 23 nt, Human
acggcaucggauuccaguauacc

SEQ ID NO: 788179 - RNA, 22 nt, Human
agaaacagugacaguugacaac

SEQ ID NO: 788180 - RNA, 20 nt, Human
agaagaagaaaaaauguacg

SEQ ID NO: 788181 - RNA, 20 nt, Human
agagaaagagagagggagag

SEQ ID NO: 788182 - RNA, 22 nt, Human
agagaagaagaagaaaaaaugu

SEQ ID NO: 788183 - RNA, 19 nt, Human
agagagaaagagagaggga

SEQ ID NO: 788184 - RNA, 23 nt, Human
agagagggagagagagagggagc

SEQ ID NO: 788185 - RNA, 18 nt, Human
agcaaagguucuuguaca

SEQ ID NO: 788186 - RNA, 20 nt, Human
agcacaaaccuccaugaacu

SEQ ID NO: 788187 - RNA, 24 nt, Human
aggauucaacaccaucucuggaug

SEQ ID NO: 788188 - RNA, 22 nt, Human
agggagaaaagagagaaagaga

SEQ ID NO: 788189 - RNA, 28 nt, Human
agggagaaaagagagaaagagagaggga

SEQ ID NO: 788190 - RNA, 20 nt, Human
agucaaggcucacuuaagcu

SEQ ID NO: 788191 - RNA, 23 nt, Human
aguggcaauuucuguaaugcagu

SEQ ID NO: 788192 - RNA, 23 nt, Human
aguugacaacaaaagguucugaa

SEQ ID NO: 788193 - RNA, 21 nt, Human
aguuguuguucaagcucugga

SEQ ID NO: 788194 - RNA, 25 nt, Human
auacugaucugaggucucucugggg

SEQ ID NO: 788195 - RNA, 25 nt, Human
auuaugcuaccaagaaacaacacau

SEQ ID NO: 788196 - RNA, 19 nt, Human
caagaaaauguaggagagg

SEQ ID NO: 788197 - RNA, 20 nt, Human
caagaacaggucucuuucuu

SEQ ID NO: 788198 - RNA, 18 nt, Human
cacaauacugaucugagg

SEQ ID NO: 788199 - RNA, 24 nt, Human
cacaucauuauccuugggccuggg

SEQ ID NO: 788200 - RNA, 21 nt, Human
caccuucugguucccaacucc

SEQ ID NO: 788201 - RNA, 21 nt, Human
cagaacaagucuaaggaaagc

SEQ ID NO: 788202 - RNA, 24 nt, Human
cagaaucucuaaaauaguauugac

SEQ ID NO: 788203 - RNA, 22 nt, Human
cagaguacuguaacuuuucuuu

SEQ ID NO: 788204 - RNA, 19 nt, Human
cagcaagaaaauguaggag

SEQ ID NO: 788205 - RNA, 20 nt, Human
cauauauuuauauauauaua

SEQ ID NO: 788206 - RNA, 19 nt, Human
caucagaaaccaagggugg

SEQ ID NO: 788207 - RNA, 21 nt, Human
caugcagguagacuacaaugc

SEQ ID NO: 788208 - RNA, 18 nt, Human
ccaagaaacaacacauca

SEQ ID NO: 788209 - RNA, 24 nt, Human
ccacagaguacuguaacuuuucuu

SEQ ID NO: 788210 - RNA, 18 nt, Human
ccccuuccaagcaagcuu

SEQ ID NO: 788211 - RNA, 23 nt, Human
cccugaauuccugaaaacaaucu

SEQ ID NO: 788212 - RNA, 21 nt, Human
cucacuuaagcuccccccaaa

SEQ ID NO: 788213 - RNA, 21 nt, Human
cuccaggcagucacucuuuac

SEQ ID NO: 788214 - RNA, 19 nt, Human
cuuuacaauuuauuuuguc

SEQ ID NO: 788215 - RNA, 19 nt, Human
gaaacgaaaaugccucucu

SEQ ID NO: 788216 - RNA, 18 nt, Human
gaaaugucaacauagauc

SEQ ID NO: 788217 - RNA, 19 nt, Human
gaaugacacauuuguugaa

SEQ ID NO: 788218 - RNA, 18 nt, Human
gaauuccucaugcuccuc

SEQ ID NO: 788219 - RNA, 19 nt, Human
gagaaaagagagaaagaga

SEQ ID NO: 788220 - RNA, 21 nt, Human
gagaagaagaagaaaaaaugu

SEQ ID NO: 788221 - RNA, 19 nt, Human
gagggagcagagcuuucug

SEQ ID NO: 788222 - RNA, 24 nt, Human
gauauacauauauuuauauauaua

SEQ ID NO: 788223 - RNA, 22 nt, Human
gcagagcuuucugcaagagaag

SEQ ID NO: 788224 - RNA, 19 nt, Human
gcuaccaagaaacaacaca

SEQ ID NO: 788225 - RNA, 23 nt, Human
gcuccugaauuccucaugcuccu

SEQ ID NO: 788226 - RNA, 18 nt, Human
gcuuuaaacccuccucca

SEQ ID NO: 788227 - RNA, 20 nt, Human
ggcaauuucuguaaugcagu

SEQ ID NO: 788228 - RNA, 19 nt, Human
ggcgagcugacucggugca

SEQ ID NO: 788229 - RNA, 20 nt, Human
guaaugcaguguauuuuggu

SEQ ID NO: 788230 - RNA, 20 nt, Human
uaaaaccagucugaaaugga

SEQ ID NO: 788231 - RNA, 21 nt, Human
uaaaucaucagaaaccaaggg

SEQ ID NO: 788232 - RNA, 23 nt, Human
uaagucaagugucuagaggcacc

SEQ ID NO: 788233 - RNA, 19 nt, Human
uaaguuaaaaccagucuga

SEQ ID NO: 788234 - RNA, 23 nt, Human
uacaugauuuucaauaacagugu

SEQ ID NO: 788235 - RNA, 20 nt, Human
uagaaacgaaaaugccucuc

SEQ ID NO: 788236 - RNA, 22 nt, Human
uagaaagcauuuauuacaagag

SEQ ID NO: 788237 - RNA, 25 nt, Human
uagcaacagcaagaaaauguaggag

SEQ ID NO: 788238 - RNA, 21 nt, Human
uaguaucuguucaagaacagg

SEQ ID NO: 788239 - RNA, 25 nt, Human
uauacauauauuuauauauauauau

SEQ ID NO: 788240 - RNA, 22 nt, Human
uaugaaaaagcacaaaccucca

SEQ ID NO: 788241 - RNA, 19 nt, Human
uauuuuguuuuaaucuuuc

SEQ ID NO: 788242 - RNA, 21 nt, Human
ucccugaauuccugaaaacaa

SEQ ID NO: 788243 - RNA, 23 nt, Human
ucccugaauuccugaaaacaauc

SEQ ID NO: 788244 - RNA, 18 nt, Human
uccuugggccuggggcuc

SEQ ID NO: 788245 - RNA, 23 nt, Human
ucugcaagagaagaagaagaaaa

SEQ ID NO: 788246 - RNA, 22 nt, Human
ucuguaaugcaguguauuuugg

SEQ ID NO: 788247 - RNA, 24 nt, Human
ucugucaggugcuauaauuggagu

SEQ ID NO: 788248 - RNA, 19 nt, Human
ucugugacuuauuuauuca

SEQ ID NO: 788249 - RNA, 18 nt, Human
ugaaaaagcacaaaccuc

SEQ ID NO: 788250 - RNA, 22 nt, Human
ugaauuccugaaaacaaucucc

SEQ ID NO: 788251 - RNA, 26 nt, Human
ugacacauuuguugaaggauucaaca

SEQ ID NO: 788252 - RNA, 18 nt, Human
ugacuuuuggaagaaaca

SEQ ID NO: 788253 - RNA, 19 nt, Human
ugaggaagaggagaaguau

SEQ ID NO: 788254 - RNA, 19 nt, Human
ugcaccuggcuuuaaaccc

SEQ ID NO: 788255 - RNA, 24 nt, Human
ugccaugaaagcuuaucacuaagg

SEQ ID NO: 788256 - RNA, 23 nt, Human
uggauauacauauauuuauauau

SEQ ID NO: 788257 - RNA, 25 nt, Human
uggugagaaauaaaaaauaaaaugc

SEQ ID NO: 788258 - RNA, 22 nt, Human
uguaggagagggagaaaagaga

SEQ ID NO: 788259 - RNA, 22 nt, Human
ugugauacuguucauuccagag

SEQ ID NO: 788260 - RNA, 20 nt, Human
uguguuuuagaaacagaaag

SEQ ID NO: 788261 - RNA, 18 nt, Human
uguuuuagaaacagaaag

SEQ ID NO: 788262 - RNA, 23 nt, Human
uuaaagguuugcugucuccuugg

SEQ ID NO: 788263 - RNA, 20 nt, Human
uuaugucucucugaaauaca

SEQ ID NO: 788264 - RNA, 21 nt, Human
uugaaugacacauuuguugaa

SEQ ID NO: 788265 - RNA, 22 nt, Human
uugaaugacacauuuguugaag

SEQ ID NO: 788266 - RNA, 22 nt, Human
uuuagaaacagaaagacaacug

SEQ ID NO: 788267 - RNA, 18 nt, Human
uuugaaugacacauuugu

SEQ ID NO: 788268 - RNA, 18 nt, Human
uuugucaauccugucuuu

SEQ ID NO: 788269 - RNA, 22 nt, Human
uuuuaggcuuuuauuuacuccu

SEQ ID NO: 788270 - RNA, 23 nt, Human
uuuuaggcuuuuauuuacuccua

SEQ ID NO: 788271 - RNA, 24 nt, Human
uuuuauuuaaaguuuuccccuucc

SEQ ID NO: 788272 - RNA, 21 nt, Human
aaaaagcagcuuucauaucac

SEQ ID NO: 788273 - RNA, 25 nt, Human
aaaacaacaacauggccagcaccau

SEQ ID NO: 788274 - RNA, 24 nt, Human
aaaauuguuucuagaucgacaccc

SEQ ID NO: 788275 - RNA, 21 nt, Human
aaacaacaacauggccagcac

SEQ ID NO: 788276 - RNA, 19 nt, Human
aaacaggggaaacugcuuu

SEQ ID NO: 788277 - RNA, 24 nt, Human
aaagacagaacuuuacuaacaaag

SEQ ID NO: 788278 - RNA, 28 nt, Human
aaauggacccguaacacauuacaagggu

SEQ ID NO: 788279 - RNA, 24 nt, Human
aacuacaaaaucuccaaaacaggg

SEQ ID NO: 788280 - RNA, 27 nt, Human
aacuuuacuaacaaaguagaaagugau

SEQ ID NO: 788281 - RNA, 19 nt, Human
aagaggcaacugauuaaaa

SEQ ID NO: 788282 - RNA, 21 nt, Human
aagcuacaugugcugcaugcu

SEQ ID NO: 788283 - RNA, 25 nt, Human
aaguagcuucuuggaucaaaauggc

SEQ ID NO: 788284 - RNA, 20 nt, Human
aauuaacuacaaaaucucca

SEQ ID NO: 788285 - RNA, 18 nt, Human
acaagagccacugaggcc

SEQ ID NO: 788286 - RNA, 23 nt, Human
acucucccgucucuuugcccccc

SEQ ID NO: 788287 - RNA, 21 nt, Human
agaaaacucaacaugugcuga

SEQ ID NO: 788288 - RNA, 21 nt, Human
agaaaagcuacaugugcugca

SEQ ID NO: 788289 - RNA, 27 nt, Human
aggcaguaguggcgguggcggcggcgg

SEQ ID NO: 788290 - RNA, 24 nt, Human
aguuuacaacugaaguucuguaaa

SEQ ID NO: 788291 - RNA, 21 nt, Human
auagaugagcaaacuaacauu

SEQ ID NO: 788292 - RNA, 21 nt, Human
auucuguucgaucuacuuuca

SEQ ID NO: 788293 - RNA, 21 nt, Human
auucuuggccuucguugucuc

SEQ ID NO: 788294 - RNA, 21 nt, Human
auuuacaguuaacuuguugcu

SEQ ID NO: 788295 - RNA, 22 nt, Human
caaaauggcuucuagauacuaa

SEQ ID NO: 788296 - RNA, 22 nt, Human
caaaccccuuaauuacuagcaa

SEQ ID NO: 788297 - RNA, 18 nt, Human
caacuaccuaaaaggcug

SEQ ID NO: 788298 - RNA, 18 nt, Human
caagagccacugaggccu

SEQ ID NO: 788299 - RNA, 18 nt, Human
caccccgaggagcaaccc

SEQ ID NO: 788300 - RNA, 18 nt, Human
cagccuaaaaggcaaacc

SEQ ID NO: 788301 - RNA, 24 nt, Human
cauacacccacucucccgucucuu

SEQ ID NO: 788302 - RNA, 20 nt, Human
cccccagggcucgcuugcuc

SEQ ID NO: 788303 - RNA, 24 nt, Human
ccccccagggcucgcuugcucucc

SEQ ID NO: 788304 - RNA, 24 nt, Human
ccccguuaccucucacuucacccg

SEQ ID NO: 788305 - RNA, 20 nt, Human
ccccuccccuaaaccguccc

SEQ ID NO: 788306 - RNA, 22 nt, Human
cccgcgcauacacccacucucc

SEQ ID NO: 788307 - RNA, 23 nt, Human
cccuuaauuacuagcaagcaauc

SEQ ID NO: 788308 - RNA, 20 nt, Human
ccgccgccuccucgcuuacc

SEQ ID NO: 788309 - RNA, 20 nt, Human
ccgcucuagccgccgccucc

SEQ ID NO: 788310 - RNA, 22 nt, Human
ccugaauuuuacaguuuagcau

SEQ ID NO: 788311 - RNA, 23 nt, Human
cgccgcgguaacuacuacagauc

SEQ ID NO: 788312 - RNA, 20 nt, Human
cgcgcauacacccacucucc

SEQ ID NO: 788313 - RNA, 22 nt, Human
gaaugugcuuuuacucuucuua

SEQ ID NO: 788314 - RNA, 22 nt, Human
gcaguaguggcgguggcggcuu

SEQ ID NO: 788315 - RNA, 20 nt, Human
gcccggagccccguuaccuc

SEQ ID NO: 788316 - RNA, 21 nt, Human
gcugagaagcugucucccagg

SEQ ID NO: 788317 - RNA, 24 nt, Human
ggcccgaauucaccauggcuccaa

SEQ ID NO: 788318 - RNA, 20 nt, Human
ggcgguggcggcggcggcgg

SEQ ID NO: 788319 - RNA, 22 nt, Human
gguggcggcggcggcggcuucg

SEQ ID NO: 788320 - RNA, 24 nt, Human
guaguggcgguggcggcggcggcg

SEQ ID NO: 788321 - RNA, 23 nt, Human
guggcggcggcggcggcuucgga

SEQ ID NO: 788322 - RNA, 22 nt, Human
guggcgguggcggcggcggcgg

SEQ ID NO: 788323 - RNA, 28 nt, Human
guggcgguggcggcggcggcggcuucuu

SEQ ID NO: 788324 - RNA, 25 nt, Human
guucaauugagaaagcuuucugauu

SEQ ID NO: 788325 - RNA, 24 nt, Human
uaaaacaacaacauggccagcacc

SEQ ID NO: 788326 - RNA, 21 nt, Human
uacacagacagcucaucuuuu

SEQ ID NO: 788327 - RNA, 19 nt, Human
uaggagacgguaaaggcag

SEQ ID NO: 788328 - RNA, 21 nt, Human
uaggcgguugacaacauuccc

SEQ ID NO: 788329 - RNA, 18 nt, Human
uaguggcgguggcggcgg

SEQ ID NO: 788330 - RNA, 23 nt, Human
uauggaaaaaacuauacuucaua

SEQ ID NO: 788331 - RNA, 21 nt, Human
ucagccgcgagaaggggugac

SEQ ID NO: 788332 - RNA, 18 nt, Human
uccaggaaaaauggaccc

SEQ ID NO: 788333 - RNA, 23 nt, Human
ucgcuugcucucccgccgccgcg

SEQ ID NO: 788334 - RNA, 24 nt, Human
ucuccaccgcucuagccgccgccu

SEQ ID NO: 788335 - RNA, 22 nt, Human
ucucccgucucuuugcccccca

SEQ ID NO: 788336 - RNA, 22 nt, Human
ucuuccacaaaagauuguacug

SEQ ID NO: 788337 - RNA, 19 nt, Human
ugacaagagccacugaggc

SEQ ID NO: 788338 - RNA, 23 nt, Human
ugacagccuaaaaggcaaacccc

SEQ ID NO: 788339 - RNA, 19 nt, Human
ugagaaagcuuucugauuc

SEQ ID NO: 788340 - RNA, 24 nt, Human
ugcauuauuauaucaaccuuuucc

SEQ ID NO: 788341 - RNA, 21 nt, Human
uggcggcggcggcggcuucgg

SEQ ID NO: 788342 - RNA, 18 nt, Human
uggcgguggcggcggcgg

SEQ ID NO: 788343 - RNA, 20 nt, Human
ugguaggcgguugacaacau

SEQ ID NO: 788344 - RNA, 18 nt, Human
uguagaaaacucaacaug

SEQ ID NO: 788345 - RNA, 19 nt, Human
uuaacuguuugccucaauu

SEQ ID NO: 788346 - RNA, 21 nt, Human
uuaacuguuugccucaauuua

SEQ ID NO: 788347 - RNA, 19 nt, Human
uucaacuaccuaaaaggcu

SEQ ID NO: 788348 - RNA, 20 nt, Human
uucagauuuucagcucacug

SEQ ID NO: 788349 - RNA, 19 nt, Human
uucagcacuauucuugguu

SEQ ID NO: 788350 - RNA, 24 nt, Human
uuccugggaagccugauuuuuauu

SEQ ID NO: 788351 - RNA, 19 nt, Human
uuccugguguagaaaacuc

SEQ ID NO: 788352 - RNA, 21 nt, Human
uuccugguguagaaaacuccu

SEQ ID NO: 788353 - RNA, 18 nt, Human
uuccuugcugagaagcug

SEQ ID NO: 788354 - RNA, 19 nt, Human
uugacagccuaaaaggcaa

SEQ ID NO: 788355 - RNA, 23 nt, Human
uuuccccuccccuaaaccguccc

SEQ ID NO: 788356 - RNA, 26 nt, Human
uuuuacaguuuagcauuaauaucacc

SEQ ID NO: 788357 - RNA, 20 nt, Human
aaagaauuagcaguugggac

SEQ ID NO: 788358 - RNA, 20 nt, Human
aaagguccuucugggcuucc

SEQ ID NO: 788359 - RNA, 18 nt, Human
aacccacuugcucuuucu

SEQ ID NO: 788360 - RNA, 20 nt, Human
aagauccaaaaugacaugaa

SEQ ID NO: 788361 - RNA, 18 nt, Human
aaggaccagccccucccu

SEQ ID NO: 788362 - RNA, 24 nt, Human
aaguagcuggauguuguccagaac

SEQ ID NO: 788363 - RNA, 25 nt, Human
acagaagaggggcuggucagacagc

SEQ ID NO: 788364 - RNA, 19 nt, Human
acagcccgagucaguaacc

SEQ ID NO: 788365 - RNA, 21 nt, Human
acaggaaggaacucagucaga

SEQ ID NO: 788366 - RNA, 22 nt, Human
accaggucccccacaggcuucc

SEQ ID NO: 788367 - RNA, 22 nt, Human
acccacccugcacaucuccccu

SEQ ID NO: 788368 - RNA, 21 nt, Human
acccucugcuucaugagccuc

SEQ ID NO: 788369 - RNA, 22 nt, Human
acccugcacaucuccccugcca

SEQ ID NO: 788370 - RNA, 23 nt, Human
acccuggccuagucuuggcucug

SEQ ID NO: 788371 - RNA, 26 nt, Human
accuagcccaccucuggggccccagc

SEQ ID NO: 788372 - RNA, 20 nt, Human
acucacccucugcccuccca

SEQ ID NO: 788373 - RNA, 18 nt, Human
acucuaagccuucucggg

SEQ ID NO: 788374 - RNA, 19 nt, Human
acugcacuacaaagguggg

SEQ ID NO: 788375 - RNA, 22 nt, Human
acuugcucuuucugcucccuau

SEQ ID NO: 788376 - RNA, 25 nt, Human
agagauggacaaggaccucagacaa

SEQ ID NO: 788377 - RNA, 21 nt, Human
agagggcaggggauagagcag

SEQ ID NO: 788378 - RNA, 24 nt, Human
agccagagaccuagggggacucua

SEQ ID NO: 788379 - RNA, 21 nt, Human
agcccaccucuggggccccag

SEQ ID NO: 788380 - RNA, 25 nt, Human
agcccaccucuggggccccagcccc

SEQ ID NO: 788381 - RNA, 19 nt, Human
agcuggguggggcccuugg

SEQ ID NO: 788382 - RNA, 21 nt, Human
aggaagaaggaaggagaagcc

SEQ ID NO: 788383 - RNA, 19 nt, Human
aggaaggagaagccuucac

SEQ ID NO: 788384 - RNA, 22 nt, Human
aggacacuuguuugcaucugcu

SEQ ID NO: 788385 - RNA, 18 nt, Human
aggagaggagcggcugcu

SEQ ID NO: 788386 - RNA, 20 nt, Human
aggcacagaagaggggcugg

SEQ ID NO: 788387 - RNA, 21 nt, Human
aggcagcagguugcuugagca

SEQ ID NO: 788388 - RNA, 18 nt, Human
aggcagcugugaggagcu

SEQ ID NO: 788389 - RNA, 23 nt, Human
agggagggguggggcuggaagag

SEQ ID NO: 788390 - RNA, 18 nt, Human
agggaggguacugggggg

SEQ ID NO: 788391 - RNA, 22 nt, Human
agggguggggcuggaagagggc

SEQ ID NO: 788392 - RNA, 18 nt, Human
aggguuuggagaguaaug

SEQ ID NO: 788393 - RNA, 19 nt, Human
aggucucagaacaccgagc

SEQ ID NO: 788394 - RNA, 20 nt, Human
agugauccguucacuuugug

SEQ ID NO: 788395 - RNA, 25 nt, Human
auccaaauccucacauuuuuauaua

SEQ ID NO: 788396 - RNA, 24 nt, Human
auguagggaggguacugggggggu

SEQ ID NO: 788397 - RNA, 22 nt, Human
caaacugcuuucagaaagcaaa

SEQ ID NO: 788398 - RNA, 18 nt, Human
caaagaaauguaagaguc

SEQ ID NO: 788399 - RNA, 19 nt, Human
caagaccagggaggggugg

SEQ ID NO: 788400 - RNA, 24 nt, Human
caagacccacccugcacaucuccc

SEQ ID NO: 788401 - RNA, 22 nt, Human
caaggcacagaagaggggcugg

SEQ ID NO: 788402 - RNA, 23 nt, Human
caauccagagagagaagcugccc

SEQ ID NO: 788403 - RNA, 18 nt, Human
cacagaagaggggcuggu

SEQ ID NO: 788404 - RNA, 19 nt, Human
cacagagauggacaaggac

SEQ ID NO: 788405 - RNA, 22 nt, Human
cacaggacagucuggccucuaa

SEQ ID NO: 788406 - RNA, 18 nt, Human
cacccucugcccucccag

SEQ ID NO: 788407 - RNA, 22 nt, Human
cacccucugcccucccaguccc

SEQ ID NO: 788408 - RNA, 22 nt, Human
cacccugcacaucuccccugcc

SEQ ID NO: 788409 - RNA, 21 nt, Human
caccuagcccaccucuggggc

SEQ ID NO: 788410 - RNA, 21 nt, Human
cacuauauauuaacaucaaaa

SEQ ID NO: 788411 - RNA, 21 nt, Human
cagaaagcaaaaugaaaggaa

SEQ ID NO: 788412 - RNA, 23 nt, Human
cagaacaucuuggcuguaccaga

SEQ ID NO: 788413 - RNA, 18 nt, Human
cagcaccgaggggaagga

SEQ ID NO: 788414 - RNA, 20 nt, Human
cagccccaagacccacccug

SEQ ID NO: 788415 - RNA, 18 nt, Human
cagggagggguggggcug

SEQ ID NO: 788416 - RNA, 20 nt, Human
caggucccccacaggcuucc

SEQ ID NO: 788417 - RNA, 20 nt, Human
caugggcagccagagaccua

SEQ ID NO: 788418 - RNA, 23 nt, Human
ccaauccagagagagaagcugcc

SEQ ID NO: 788419 - RNA, 18 nt, Human
ccaccaggucccccacag

SEQ ID NO: 788420 - RNA, 19 nt, Human
cccacugauuagucuucuu

SEQ ID NO: 788421 - RNA, 24 nt, Human
ccccaaggauggcacugucccuuu

SEQ ID NO: 788422 - RNA, 22 nt, Human
ccccacacggcaacugaugccu

SEQ ID NO: 788423 - RNA, 23 nt, Human
ccccacccuggccuagucuuggc

SEQ ID NO: 788424 - RNA, 19 nt, Human
ccccagccccaccaugagc

SEQ ID NO: 788425 - RNA, 22 nt, Human
ccccagccccaccaugagccuc

SEQ ID NO: 788426 - RNA, 19 nt, Human
cccccuucccccugggccc

SEQ ID NO: 788427 - RNA, 27 nt, Human
ccccuggcuagagcagacggagagggc

SEQ ID NO: 788428 - RNA, 19 nt, Human
ccccugggcccacuggucu

SEQ ID NO: 788429 - RNA, 22 nt, Human
ccccugggcccacuggucucca

SEQ ID NO: 788430 - RNA, 22 nt, Human
ccccugggcccacuggucucca

SEQ ID NO: 788431 - RNA, 24 nt, Human
ccccugggcccacuggucuccagg

SEQ ID NO: 788432 - RNA, 21 nt, Human
cccgcacugcccgcuggugcc

SEQ ID NO: 788433 - RNA, 25 nt, Human
cccucugcccucccaguccccaggc

SEQ ID NO: 788434 - RNA, 22 nt, Human
cccucugcuucaugagccucau

SEQ ID NO: 788435 - RNA, 20 nt, Human
ccgcacugcccgcuggugcc

SEQ ID NO: 788436 - RNA, 24 nt, Human
ccguagccacccagcgauguuggu

SEQ ID NO: 788437 - RNA, 22 nt, Human
ccuaggccugguccugcuuccu
